United States Patent 7,250,289 (METHODS OF GENETIC ANALYSIS OF MOUSE) - sequence listing, part 19

SEQ ID NO: 723116 - DNA, 25 bp, Mus musculus
gttacctctggtattcatacctttt

SEQ ID NO: 723117 - DNA, 25 bp, Mus musculus
gttacctctggttttcatacctttt

SEQ ID NO: 723118 - DNA, 25 bp, Mus musculus
gttacctcttgaagttacagatttt

SEQ ID NO: 723119 - DNA, 25 bp, Mus musculus
gttacctcttgatgttacagatttt

SEQ ID NO: 723120 - DNA, 25 bp, Mus musculus
gttacctgaaccagacttagaaatt

SEQ ID NO: 723121 - DNA, 25 bp, Mus musculus
gttacctgaacctgacttagaaatt

SEQ ID NO: 723122 - DNA, 25 bp, Mus musculus
gttacctgaagtatgctgtgtacca

SEQ ID NO: 723123 - DNA, 25 bp, Mus musculus
gttacctgaagtttgctgtgtacca

SEQ ID NO: 723124 - DNA, 25 bp, Mus musculus
gttacctgagtaccctaaacttggg

SEQ ID NO: 723125 - DNA, 25 bp, Mus musculus
gttacctgagtagcctaaacttggg

SEQ ID NO: 723126 - DNA, 25 bp, Mus musculus
gttacctgatacatttccagctaat

SEQ ID NO: 723127 - DNA, 25 bp, Mus musculus
gttacctgatacttttccagctaat

SEQ ID NO: 723128 - DNA, 25 bp, Mus musculus
gttacctgcacactttcacatagag

SEQ ID NO: 723129 - DNA, 25 bp, Mus musculus
gttacctgcacagtttcacatagag

SEQ ID NO: 723130 - DNA, 25 bp, Mus musculus
gttacctgcagcctaagcctgaaaa

SEQ ID NO: 723131 - DNA, 25 bp, Mus musculus
gttacctgcagcgtaagcctgaaaa

SEQ ID NO: 723132 - DNA, 25 bp, Mus musculus
gttacctgcattcttgtacacatac

SEQ ID NO: 723133 - DNA, 25 bp, Mus musculus
gttacctgcattgttgtacacatac

SEQ ID NO: 723134 - DNA, 25 bp, Mus musculus
gttacctgctgtagactgtcagcat

SEQ ID NO: 723135 - DNA, 25 bp, Mus musculus
gttacctgctgttgactgtcagcat

SEQ ID NO: 723136 - DNA, 25 bp, Mus musculus
gttacctgcttaataggcatttgtg

SEQ ID NO: 723137 - DNA, 25 bp, Mus musculus
gttacctgcttattaggcatttgtg

SEQ ID NO: 723138 - DNA, 25 bp, Mus musculus
gttacctgcttgaaaacactgctgt

SEQ ID NO: 723139 - DNA, 25 bp, Mus musculus
gttacctgcttgtaaacactgctgt

SEQ ID NO: 723140 - DNA, 25 bp, Mus musculus
gttacctggaaaacagccttagctg

SEQ ID NO: 723141 - DNA, 25 bp, Mus musculus
gttacctggaaatcagccttagctg

SEQ ID NO: 723142 - DNA, 25 bp, Mus musculus
gttacctggcatccatgattgctac

SEQ ID NO: 723143 - DNA, 25 bp, Mus musculus
gttacctggcatgcatgattgctac

SEQ ID NO: 723144 - DNA, 25 bp, Mus musculus
gttacctggtccacttagggcttgg

SEQ ID NO: 723145 - DNA, 25 bp, Mus musculus
gttacctggtcctcttagggcttgg

SEQ ID NO: 723146 - DNA, 25 bp, Mus musculus
gttacctgtcctcaagtactctggg

SEQ ID NO: 723147 - DNA, 25 bp, Mus musculus
gttacctgtcctgaagtactctggg

SEQ ID NO: 723148 - DNA, 25 bp, Mus musculus
gttacctgtcgcatccagaggaatc

SEQ ID NO: 723149 - DNA, 25 bp, Mus musculus
gttacctgtcgcttccagaggaatc

SEQ ID NO: 723150 - DNA, 25 bp, Mus musculus
gttacctgtggtagtcagatcacta

SEQ ID NO: 723151 - DNA, 25 bp, Mus musculus
gttacctgtggttgtcagatcacta

SEQ ID NO: 723152 - DNA, 25 bp, Mus musculus
gttacctgtgtccatcaagacctca

SEQ ID NO: 723153 - DNA, 25 bp, Mus musculus
gttacctgtgtcctgccagaaccaa

SEQ ID NO: 723154 - DNA, 25 bp, Mus musculus
gttacctgtgtcgatcaagacctca

SEQ ID NO: 723155 - DNA, 25 bp, Mus musculus
gttacctgtgtcgtgccagaaccaa

SEQ ID NO: 723156 - DNA, 25 bp, Mus musculus
gttacctgtgttatccaagttcttg

SEQ ID NO: 723157 - DNA, 25 bp, Mus musculus
gttacctgtgttttccaagttcttg

SEQ ID NO: 723158 - DNA, 25 bp, Mus musculus
gttacctgttatagcagagttccta

SEQ ID NO: 723159 - DNA, 25 bp, Mus musculus
gttacctgttattgcagagttccta

SEQ ID NO: 723160 - DNA, 25 bp, Mus musculus
gttaccttaccaactcagtatgctt

SEQ ID NO: 723161 - DNA, 25 bp, Mus musculus
gttaccttaccatctcagtatgctt

SEQ ID NO: 723162 - DNA, 25 bp, Mus musculus
gttaccttattacaacttcgcccag

SEQ ID NO: 723163 - DNA, 25 bp, Mus musculus
gttaccttattagaacttcgcccag

SEQ ID NO: 723164 - DNA, 25 bp, Mus musculus
gttaccttcacgatagcagaagcta

SEQ ID NO: 723165 - DNA, 25 bp, Mus musculus
gttaccttcacgttagcagaagcta

SEQ ID NO: 723166 - DNA, 25 bp, Mus musculus
gttaccttcagtactcaagttgagg

SEQ ID NO: 723167 - DNA, 25 bp, Mus musculus
gttaccttcagttctcaagttgagg

SEQ ID NO: 723168 - DNA, 25 bp, Mus musculus
gttaccttcctacacgtctgtgtaa

SEQ ID NO: 723169 - DNA, 25 bp, Mus musculus
gttaccttcctagacgtctgtgtaa

SEQ ID NO: 723170 - DNA, 25 bp, Mus musculus
gttaccttccttaagtagaccatgt

SEQ ID NO: 723171 - DNA, 25 bp, Mus musculus
gttaccttcctttagtagaccatgt

SEQ ID NO: 723172 - DNA, 25 bp, Mus musculus
gttaccttctagctgaaccctcaga

SEQ ID NO: 723173 - DNA, 25 bp, Mus musculus
gttaccttctaggtgaaccctcaga

SEQ ID NO: 723174 - DNA, 25 bp, Mus musculus
gttaccttctgaacatgagtccaat

SEQ ID NO: 723175 - DNA, 25 bp, Mus musculus
gttaccttctgatcatgagtccaat

SEQ ID NO: 723176 - DNA, 25 bp, Mus musculus
gttaccttgacgaatcagatcccag

SEQ ID NO: 723177 - DNA, 25 bp, Mus musculus
gttaccttgacgtatcagatcccag

SEQ ID NO: 723178 - DNA, 25 bp, Mus musculus
gttaccttgcttatgctttgcttta

SEQ ID NO: 723179 - DNA, 25 bp, Mus musculus
gttaccttgcttcttgcttaacctg

SEQ ID NO: 723180 - DNA, 25 bp, Mus musculus
gttaccttgcttgttgcttaacctg

SEQ ID NO: 723181 - DNA, 25 bp, Mus musculus
gttaccttgcttttgctttgcttta

SEQ ID NO: 723182 - DNA, 25 bp, Mus musculus
gttaccttggaacacttttgagttg

SEQ ID NO: 723183 - DNA, 25 bp, Mus musculus
gttaccttggaagacttttgagttg

SEQ ID NO: 723184 - DNA, 25 bp, Mus musculus
gttaccttggttatgctgcaacaga

SEQ ID NO: 723185 - DNA, 25 bp, Mus musculus
gttaccttggttttgctgcaacaga

SEQ ID NO: 723186 - DNA, 25 bp, Mus musculus
gttaccttgttacttcagcctagag

SEQ ID NO: 723187 - DNA, 25 bp, Mus musculus
gttaccttgttagttcagcctagag

SEQ ID NO: 723188 - DNA, 25 bp, Mus musculus
gttacctttaatatttcttctagag

SEQ ID NO: 723189 - DNA, 25 bp, Mus musculus
gttacctttaatttttcttctagag

SEQ ID NO: 723190 - DNA, 25 bp, Mus musculus
gttacctttcatacgcaatcatgga

SEQ ID NO: 723191 - DNA, 25 bp, Mus musculus
gttacctttcattcgcaatcatgga

SEQ ID NO: 723192 - DNA, 25 bp, Mus musculus
gttacctttgctcccgtagggagga

SEQ ID NO: 723193 - DNA, 25 bp, Mus musculus
gttacctttgctgccgtagggagga

SEQ ID NO: 723194 - DNA, 25 bp, Mus musculus
gttacctttgtccagtgagatggtc

SEQ ID NO: 723195 - DNA, 25 bp, Mus musculus
gttacctttgtcgagtgagatggtc

SEQ ID NO: 723196 - DNA, 25 bp, Mus musculus
gttaccttttggcagctgacatcac

SEQ ID NO: 723197 - DNA, 25 bp, Mus musculus
gttaccttttgggagctgacatcac

SEQ ID NO: 723198 - DNA, 25 bp, Mus musculus
gttacgaaaggactcatgggccaaa

SEQ ID NO: 723199 - DNA, 25 bp, Mus musculus
gttacgaaaggagtcatgggccaaa

SEQ ID NO: 723200 - DNA, 25 bp, Mus musculus
gttacgaaccacatcaactgtatat

SEQ ID NO: 723201 - DNA, 25 bp, Mus musculus
gttacgaaccacttcaactgtatat

SEQ ID NO: 723202 - DNA, 25 bp, Mus musculus
gttacgagcaaaaacttgttctttt

SEQ ID NO: 723203 - DNA, 25 bp, Mus musculus
gttacgagcaaaaatatcttcttag

SEQ ID NO: 723204 - DNA, 25 bp, Mus musculus
gttacgagcaaatacttgttctttt

SEQ ID NO: 723205 - DNA, 25 bp, Mus musculus
gttacgagcaaatatatcttcttag

SEQ ID NO: 723206 - DNA, 25 bp, Mus musculus
gttacgagggaacgctgtttcatca

SEQ ID NO: 723207 - DNA, 25 bp, Mus musculus
gttacgagggaaggctgtttcatca

SEQ ID NO: 723208 - DNA, 25 bp, Mus musculus
gttacgaggtcccagagcttcgcac

SEQ ID NO: 723209 - DNA, 25 bp, Mus musculus
gttacgaggtccgagagcttcgcac

SEQ ID NO: 723210 - DNA, 25 bp, Mus musculus
gttacgagtcctatcaaatgtgctt

SEQ ID NO: 723211 - DNA, 25 bp, Mus musculus
gttacgagtcctttcaaatgtgctt

SEQ ID NO: 723212 - DNA, 25 bp, Mus musculus
gttacgatacgacctggcatgaccc

SEQ ID NO: 723213 - DNA, 25 bp, Mus musculus
gttacgatacgagctggcatgaccc

SEQ ID NO: 723214 - DNA, 25 bp, Mus musculus
gttacgatagcaccacaagttatgt

SEQ ID NO: 723215 - DNA, 25 bp, Mus musculus
gttacgatagcagcacaagttatgt

SEQ ID NO: 723216 - DNA, 25 bp, Mus musculus
gttacgatcccaaacctgcaggaaa

SEQ ID NO: 723217 - DNA, 25 bp, Mus musculus
gttacgatcccatacctgcaggaaa

SEQ ID NO: 723218 - DNA, 25 bp, Mus musculus
gttacgcaaccgcaggctgggtcca

SEQ ID NO: 723219 - DNA, 25 bp, Mus musculus
gttacgcaaccggaggctgggtcca

SEQ ID NO: 723220 - DNA, 25 bp, Mus musculus
gttacgcaagctccacagataatta

SEQ ID NO: 723221 - DNA, 25 bp, Mus musculus
gttacgcaagctgcacagataatta

SEQ ID NO: 723222 - DNA, 25 bp, Mus musculus
gttacgcagaatcctatccagccac

SEQ ID NO: 723223 - DNA, 25 bp, Mus musculus
gttacgcagaatgctatccagccac

SEQ ID NO: 723224 - DNA, 25 bp, Mus musculus
gttacgcaggtaaataggccagtct

SEQ ID NO: 723225 - DNA, 25 bp, Mus musculus
gttacgcaggtatataggccagtct

SEQ ID NO: 723226 - DNA, 25 bp, Mus musculus
gttacgcatctcacacagttgtgat

SEQ ID NO: 723227 - DNA, 25 bp, Mus musculus
gttacgcatctctcacagttgtgat

SEQ ID NO: 723228 - DNA, 25 bp, Mus musculus
gttacgcttgccctgagtgaccaag

SEQ ID NO: 723229 - DNA, 25 bp, Mus musculus
gttacgcttgccgtgagtgaccaag

SEQ ID NO: 723230 - DNA, 25 bp, Mus musculus
gttacgcttgtaaatcctgcagatg

SEQ ID NO: 723231 - DNA, 25 bp, Mus musculus
gttacgcttgtatatcctgcagatg

SEQ ID NO: 723232 - DNA, 25 bp, Mus musculus
gttacggaaccccatatggttacag

SEQ ID NO: 723233 - DNA, 25 bp, Mus musculus
gttacggaacccgatatggttacag

SEQ ID NO: 723234 - DNA, 25 bp, Mus musculus
gttacggaccagacaagctctgtat

SEQ ID NO: 723235 - DNA, 25 bp, Mus musculus
gttacggaccagtcaagctctgtat

SEQ ID NO: 723236 - DNA, 25 bp, Mus musculus
gttacggcatctcaaacaatgggtt

SEQ ID NO: 723237 - DNA, 25 bp, Mus musculus
gttacggcatctgaaacaatgggtt

SEQ ID NO: 723238 - DNA, 25 bp, Mus musculus
gttacggcggcgacgcaaagcccga

SEQ ID NO: 723239 - DNA, 25 bp, Mus musculus
gttacggcggcgtcgcaaagcccga

SEQ ID NO: 723240 - DNA, 25 bp, Mus musculus
gttacgggagataagttgacagcca

SEQ ID NO: 723241 - DNA, 25 bp, Mus musculus
gttacgggagattagttgacagcca

SEQ ID NO: 723242 - DNA, 25 bp, Mus musculus
gttacgggcagtagaaaattgacat

SEQ ID NO: 723243 - DNA, 25 bp, Mus musculus
gttacgggcagttgaaaattgacat

SEQ ID NO: 723244 - DNA, 25 bp, Mus musculus
gttacggtaactcatcactctaaag

SEQ ID NO: 723245 - DNA, 25 bp, Mus musculus
gttacggtaactgatcactctaaag

SEQ ID NO: 723246 - DNA, 25 bp, Mus musculus
gttacgtactgtatctttctttgat

SEQ ID NO: 723247 - DNA, 25 bp, Mus musculus
gttacgtactgtttctttctttgat

SEQ ID NO: 723248 - DNA, 25 bp, Mus musculus
gttacgtcagccaccttgaggaaat

SEQ ID NO: 723249 - DNA, 25 bp, Mus musculus
gttacgtcagcctccttgaggaaat

SEQ ID NO: 723250 - DNA, 25 bp, Mus musculus
gttacgtccatcctagcaagctaaa

SEQ ID NO: 723251 - DNA, 25 bp, Mus musculus
gttacgtccatcgtagcaagctaaa

SEQ ID NO: 723252 - DNA, 25 bp, Mus musculus
gttacgtcgcacagtcagacagaca

SEQ ID NO: 723253 - DNA, 25 bp, Mus musculus
gttacgtcgcactgtcagacagaca

SEQ ID NO: 723254 - DNA, 25 bp, Mus musculus
gttacgtgccacagttagattaaag

SEQ ID NO: 723255 - DNA, 25 bp, Mus musculus
gttacgtgccactgttagattaaag

SEQ ID NO: 723256 - DNA, 25 bp, Mus musculus
gttacgtggaacacagctgctcaaa

SEQ ID NO: 723257 - DNA, 25 bp, Mus musculus
gttacgtggaactcagctgctcaaa

SEQ ID NO: 723258 - DNA, 25 bp, Mus musculus
gttacgtggtaacatgggacatccc

SEQ ID NO: 723259 - DNA, 25 bp, Mus musculus
gttacgtggtaagatgggacatccc

SEQ ID NO: 723260 - DNA, 25 bp, Mus musculus
gttacgtgtgggagtctgttctgta

SEQ ID NO: 723261 - DNA, 25 bp, Mus musculus
gttacgtgtgggtgtctgttctgta

SEQ ID NO: 723262 - DNA, 25 bp, Mus musculus
gttacgtgtgttaccttcctgtgac

SEQ ID NO: 723263 - DNA, 25 bp, Mus musculus
gttacgtgtgtttccttcctgtgac

SEQ ID NO: 723264 - DNA, 25 bp, Mus musculus
gttacgttaaagcatatctcctgat

SEQ ID NO: 723265 - DNA, 25 bp, Mus musculus
gttacgttaaaggatatctcctgat

SEQ ID NO: 723266 - DNA, 25 bp, Mus musculus
gttacgttcaatcaaatcttaatat

SEQ ID NO: 723267 - DNA, 25 bp, Mus musculus
gttacgttcaatgaaatcttaatat

SEQ ID NO: 723268 - DNA, 25 bp, Mus musculus
gttactaactaactcttcttctaga

SEQ ID NO: 723269 - DNA, 25 bp, Mus musculus
gttactaactaagtcttcttctaga

SEQ ID NO: 723270 - DNA, 25 bp, Mus musculus
gttactaactcacatcattaaaatg

SEQ ID NO: 723271 - DNA, 25 bp, Mus musculus
gttactaactcagatcattaaaatg

SEQ ID NO: 723272 - DNA, 25 bp, Mus musculus
gttactaactttaatgtgagaccat

SEQ ID NO: 723273 - DNA, 25 bp, Mus musculus
gttactaacttttatgtgagaccat

SEQ ID NO: 723274 - DNA, 25 bp, Mus musculus
gttactaagtaacgatgctcagcag

SEQ ID NO: 723275 - DNA, 25 bp, Mus musculus
gttactaagtaaggatgctcagcag

SEQ ID NO: 723276 - DNA, 25 bp, Mus musculus
gttactaatctaacgtgatttcttc

SEQ ID NO: 723277 - DNA, 25 bp, Mus musculus
gttactaatctatcgtgatttcttc

SEQ ID NO: 723278 - DNA, 25 bp, Mus musculus
gttactaatctgaaccttcatggaa

SEQ ID NO: 723279 - DNA, 25 bp, Mus musculus
gttactaatctgtaccttcatggaa

SEQ ID NO: 723280 - DNA, 25 bp, Mus musculus
gttactaatggactctgctgcagaa

SEQ ID NO: 723281 - DNA, 25 bp, Mus musculus
gttactaatggagtctgctgcagaa

SEQ ID NO: 723282 - DNA, 25 bp, Mus musculus
gttactaatgtaagcaactttaatt

SEQ ID NO: 723283 - DNA, 25 bp, Mus musculus
gttactaatgtatgcaactttaatt

SEQ ID NO: 723284 - DNA, 25 bp, Mus musculus
gttactacaagactgccctgctgaa

SEQ ID NO: 723285 - DNA, 25 bp, Mus musculus
gttactacaagagtgccctgctgaa

SEQ ID NO: 723286 - DNA, 25 bp, Mus musculus
gttactacatatacaagcacactca

SEQ ID NO: 723287 - DNA, 25 bp, Mus musculus
gttactacatattcaagcacactca

SEQ ID NO: 723288 - DNA, 25 bp, Mus musculus
gttactacatcaatctgcagctatc

SEQ ID NO: 723289 - DNA, 25 bp, Mus musculus
gttactacatcattctgcagctatc

SEQ ID NO: 723290 - DNA, 25 bp, Mus musculus
gttactaccagaagccttagtcatg

SEQ ID NO: 723291 - DNA, 25 bp, Mus musculus
gttactaccagatgccttagtcatg

SEQ ID NO: 723292 - DNA, 25 bp, Mus musculus
gttactacccaaagaagactgctgt

SEQ ID NO: 723293 - DNA, 25 bp, Mus musculus
gttactacccaatgaagactgctgt

SEQ ID NO: 723294 - DNA, 25 bp, Mus musculus
gttactacccatcatactgtttaaa

SEQ ID NO: 723295 - DNA, 25 bp, Mus musculus
gttactacccatgatactgtttaaa

SEQ ID NO: 723296 - DNA, 25 bp, Mus musculus
gttactacctcaaaaccttctagaa

SEQ ID NO: 723297 - DNA, 25 bp, Mus musculus
gttactacctcataaccttctagaa

SEQ ID NO: 723298 - DNA, 25 bp, Mus musculus
gttactactgtgaagctgtcctgat

SEQ ID NO: 723299 - DNA, 25 bp, Mus musculus
gttactactgtgtagctgtcctgat

SEQ ID NO: 723300 - DNA, 25 bp, Mus musculus
gttactacttaaatgacagtttctg

SEQ ID NO: 723301 - DNA, 25 bp, Mus musculus
gttactacttaattgacagtttctg

SEQ ID NO: 723302 - DNA, 25 bp, Mus musculus
gttactactttcatccatagcagag

SEQ ID NO: 723303 - DNA, 25 bp, Mus musculus
gttactactttcttccatagcagag

SEQ ID NO: 723304 - DNA, 25 bp, Mus musculus
gttactagaattacaaggacctgat

SEQ ID NO: 723305 - DNA, 25 bp, Mus musculus
gttactagaattaccagcttgattc

SEQ ID NO: 723306 - DNA, 25 bp, Mus musculus
gttactagaatttcaaggacctgat

SEQ ID NO: 723307 - DNA, 25 bp, Mus musculus
gttactagaatttccagcttgattc

SEQ ID NO: 723308 - DNA, 25 bp, Mus musculus
gttactagagaaaatcatcaggagg

SEQ ID NO: 723309 - DNA, 25 bp, Mus musculus
gttactagagaatatcatcaggagg

SEQ ID NO: 723310 - DNA, 25 bp, Mus musculus
gttactagagatcgcataccgagga

SEQ ID NO: 723311 - DNA, 25 bp, Mus musculus
gttactagagatggcataccgagga

SEQ ID NO: 723312 - DNA, 25 bp, Mus musculus
gttactagcataccccacccgtgta

SEQ ID NO: 723313 - DNA, 25 bp, Mus musculus
gttactagcatagcccacccgtgta

SEQ ID NO: 723314 - DNA, 25 bp, Mus musculus
gttactagctcactaccaagtcctg

SEQ ID NO: 723315 - DNA, 25 bp, Mus musculus
gttactagctcagtaccaagtcctg

SEQ ID NO: 723316 - DNA, 25 bp, Mus musculus
gttactagggttcaccaggtctatc

SEQ ID NO: 723317 - DNA, 25 bp, Mus musculus
gttactagggttgaccaggtctatc

SEQ ID NO: 723318 - DNA, 25 bp, Mus musculus
gttactagtattaatgtgcacggtg

SEQ ID NO: 723319 - DNA, 25 bp, Mus musculus
gttactagtatttatgtgcacggtg

SEQ ID NO: 723320 - DNA, 25 bp, Mus musculus
gttactagtctcaactgctgcaaga

SEQ ID NO: 723321 - DNA, 25 bp, Mus musculus
gttactagtctctactgctgcaaga

SEQ ID NO: 723322 - DNA, 25 bp, Mus musculus
gttactagtctgcagtggtccccaa

SEQ ID NO: 723323 - DNA, 25 bp, Mus musculus
gttactagtctggagtggtccccaa

SEQ ID NO: 723324 - DNA, 25 bp, Mus musculus
gttactataatgatacctccctatg

SEQ ID NO: 723325 - DNA, 25 bp, Mus musculus
gttactataatgttacctccctatg

SEQ ID NO: 723326 - DNA, 25 bp, Mus musculus
gttactatacaaatcactacatcat

SEQ ID NO: 723327 - DNA, 25 bp, Mus musculus
gttactatacaattcactacatcat

SEQ ID NO: 723328 - DNA, 25 bp, Mus musculus
gttactatagcaacgtgtcattcta

SEQ ID NO: 723329 - DNA, 25 bp, Mus musculus
gttactatagcatcgtgtcattcta

SEQ ID NO: 723330 - DNA, 25 bp, Mus musculus
gttactatagtgagagtccagccgc

SEQ ID NO: 723331 - DNA, 25 bp, Mus musculus
gttactatagtgtgagtccagccgc

SEQ ID NO: 723332 - DNA, 25 bp, Mus musculus
gttactatatgcactcagggaactt

SEQ ID NO: 723333 - DNA, 25 bp, Mus musculus
gttactatatgctctcagggaactt

SEQ ID NO: 723334 - DNA, 25 bp, Mus musculus
gttactatctgtccttttattgccg

SEQ ID NO: 723335 - DNA, 25 bp, Mus musculus
gttactatctgtgcttttattgccg

SEQ ID NO: 723336 - DNA, 25 bp, Mus musculus
gttactatggagacctggcagcccg

SEQ ID NO: 723337 - DNA, 25 bp, Mus musculus
gttactatggagtcctggcagcccg

SEQ ID NO: 723338 - DNA, 25 bp, Mus musculus
gttactatggcaacatcagccgatt

SEQ ID NO: 723339 - DNA, 25 bp, Mus musculus
gttactatggcatcatcagccgatt

SEQ ID NO: 723340 - DNA, 25 bp, Mus musculus
gttactatggtacgagagatccact

SEQ ID NO: 723341 - DNA, 25 bp, Mus musculus
gttactatggtaggagagatccact

SEQ ID NO: 723342 - DNA, 25 bp, Mus musculus
gttactatgtgacacccatacctga

SEQ ID NO: 723343 - DNA, 25 bp, Mus musculus
gttactatgtgagacccatacctga

SEQ ID NO: 723344 - DNA, 25 bp, Mus musculus
gttactattattcgcctttcgtcct

SEQ ID NO: 723345 - DNA, 25 bp, Mus musculus
gttactattattggcctttcgtcct

SEQ ID NO: 723346 - DNA, 25 bp, Mus musculus
gttactattgcactataaacctaga

SEQ ID NO: 723347 - DNA, 25 bp, Mus musculus
gttactattgcagtataaacctaga

SEQ ID NO: 723348 - DNA, 25 bp, Mus musculus
gttactatttaacgactcgtgtgtt

SEQ ID NO: 723349 - DNA, 25 bp, Mus musculus
gttactatttaaggactcgtgtgtt

SEQ ID NO: 723350 - DNA, 25 bp, Mus musculus
gttactcaaaatcttggcagttgca

SEQ ID NO: 723351 - DNA, 25 bp, Mus musculus
gttactcaaaatgttggcagttgca

SEQ ID NO: 723352 - DNA, 25 bp, Mus musculus
gttactcaacccctgaggatcatga

SEQ ID NO: 723353 - DNA, 25 bp, Mus musculus
gttactcaacccgtgaggatcatga

SEQ ID NO: 723354 - DNA, 25 bp, Mus musculus
gttactcaatgtaaactgtcagaat

SEQ ID NO: 723355 - DNA, 25 bp, Mus musculus
gttactcaatgttaactgtcagaat

SEQ ID NO: 723356 - DNA, 25 bp, Mus musculus
gttactcacacaactaaatcacaga

SEQ ID NO: 723357 - DNA, 25 bp, Mus musculus
gttactcacacatctaaatcacaga

SEQ ID NO: 723358 - DNA, 25 bp, Mus musculus
gttactcacagcaccatagcagttt

SEQ ID NO: 723359 - DNA, 25 bp, Mus musculus
gttactcacagctccatagcagttt

SEQ ID NO: 723360 - DNA, 25 bp, Mus musculus
gttactcacctcactggtagaaggg

SEQ ID NO: 723361 - DNA, 25 bp, Mus musculus
gttactcacctctctggtagaaggg

SEQ ID NO: 723362 - DNA, 25 bp, Mus musculus
gttactcagggcctgaacagctcac

SEQ ID NO: 723363 - DNA, 25 bp, Mus musculus
gttactcagggcgtgaacagctcac

SEQ ID NO: 723364 - DNA, 25 bp, Mus musculus
gttactcagtagctacagtgctgtg

SEQ ID NO: 723365 - DNA, 25 bp, Mus musculus
gttactcagtaggtacagtgctgtg

SEQ ID NO: 723366 - DNA, 25 bp, Mus musculus
gttactcagtgaaagcaaactacta

SEQ ID NO: 723367 - DNA, 25 bp, Mus musculus
gttactcagtgatagcaaactacta

SEQ ID NO: 723368 - DNA, 25 bp, Mus musculus
gttactcagttgaattgtaccttgt

SEQ ID NO: 723369 - DNA, 25 bp, Mus musculus
gttactcagttgtattgtaccttgt

SEQ ID NO: 723370 - DNA, 25 bp, Mus musculus
gttactcatacacaagtgtacgcaa

SEQ ID NO: 723371 - DNA, 25 bp, Mus musculus
gttactcatacagaagtgtacgcaa

SEQ ID NO: 723372 - DNA, 25 bp, Mus musculus
gttactcatccgagtgtccatacat

SEQ ID NO: 723373 - DNA, 25 bp, Mus musculus
gttactcatccgtgtgtccatacat

SEQ ID NO: 723374 - DNA, 25 bp, Mus musculus
gttactcatggcatgttcagcttgt

SEQ ID NO: 723375 - DNA, 25 bp, Mus musculus
gttactcatggcttgttcagcttgt

SEQ ID NO: 723376 - DNA, 25 bp, Mus musculus
gttactccaataagcagatgacctc

SEQ ID NO: 723377 - DNA, 25 bp, Mus musculus
gttactccaatatgcagatgacctc

SEQ ID NO: 723378 - DNA, 25 bp, Mus musculus
gttactccacaaacatcttcacata

SEQ ID NO: 723379 - DNA, 25 bp, Mus musculus
gttactccacaatcatcttcacata

SEQ ID NO: 723380 - DNA, 25 bp, Mus musculus
gttactccactaacagctacacaga

SEQ ID NO: 723381 - DNA, 25 bp, Mus musculus
gttactccactatcagctacacaga

SEQ ID NO: 723382 - DNA, 25 bp, Mus musculus
gttactccaggtctataaaattttg

SEQ ID NO: 723383 - DNA, 25 bp, Mus musculus
gttactccaggtgtataaaattttg

SEQ ID NO: 723384 - DNA, 25 bp, Mus musculus
gttactcccagacagatggactcat

SEQ ID NO: 723385 - DNA, 25 bp, Mus musculus
gttactcccagagagatggactcat

SEQ ID NO: 723386 - DNA, 25 bp, Mus musculus
gttactccctgacaaccagatgtag

SEQ ID NO: 723387 - DNA, 25 bp, Mus musculus
gttactccctgagaaccagatgtag

SEQ ID NO: 723388 - DNA, 25 bp, Mus musculus
gttactccctgtcgtatagatgtat

SEQ ID NO: 723389 - DNA, 25 bp, Mus musculus
gttactccctgtggtatagatgtat

SEQ ID NO: 723390 - DNA, 25 bp, Mus musculus
gttactcctagtactgcctttgcat

SEQ ID NO: 723391 - DNA, 25 bp, Mus musculus
gttactcctagttctgcctttgcat

SEQ ID NO: 723392 - DNA, 25 bp, Mus musculus
gttactcctcagacatacttatgca

SEQ ID NO: 723393 - DNA, 25 bp, Mus musculus
gttactcctcagtcatacttatgca

SEQ ID NO: 723394 - DNA, 25 bp, Mus musculus
gttactcctctgagtttaggatcat

SEQ ID NO: 723395 - DNA, 25 bp, Mus musculus
gttactcctctgtgtttaggatcat

SEQ ID NO: 723396 - DNA, 25 bp, Mus musculus
gttactcctgcaaagctggtgaata

SEQ ID NO: 723397 - DNA, 25 bp, Mus musculus
gttactcctgcatagctggtgaata

SEQ ID NO: 723398 - DNA, 25 bp, Mus musculus
gttactcgacaacgcttgacgagca

SEQ ID NO: 723399 - DNA, 25 bp, Mus musculus
gttactcgacaaggcttgacgagca

SEQ ID NO: 723400 - DNA, 25 bp, Mus musculus
gttactcgcgctcgagaacgcactg

SEQ ID NO: 723401 - DNA, 25 bp, Mus musculus
gttactcgcgctggagaacgcactg

SEQ ID NO: 723402 - DNA, 25 bp, Mus musculus
gttactcgcggtacatgaatacact

SEQ ID NO: 723403 - DNA, 25 bp, Mus musculus
gttactcgcggttcatgaatacact

SEQ ID NO: 723404 - DNA, 25 bp, Mus musculus
gttactcgctctatgcaaactgaga

SEQ ID NO: 723405 - DNA, 25 bp, Mus musculus
gttactcgctctttgcaaactgaga

SEQ ID NO: 723406 - DNA, 25 bp, Mus musculus
gttactcggactatcttgttgctct

SEQ ID NO: 723407 - DNA, 25 bp, Mus musculus
gttactcggactttcttgttgctct

SEQ ID NO: 723408 - DNA, 25 bp, Mus musculus
gttactcggattatagacaatctca

SEQ ID NO: 723409 - DNA, 25 bp, Mus musculus
gttactcggattttagacaatctca

SEQ ID NO: 723410 - DNA, 25 bp, Mus musculus
gttactcggtgtatttcattctatt

SEQ ID NO: 723411 - DNA, 25 bp, Mus musculus
gttactcggtgtttttcattctatt

SEQ ID NO: 723412 - DNA, 25 bp, Mus musculus
gttactcgtgttattccttcagcaa

SEQ ID NO: 723413 - DNA, 25 bp, Mus musculus
gttactcgtgtttttccttcagcaa

SEQ ID NO: 723414 - DNA, 25 bp, Mus musculus
gttactctattaccaaaccttttca

SEQ ID NO: 723415 - DNA, 25 bp, Mus musculus
gttactctattagcaaaccttttca

SEQ ID NO: 723416 - DNA, 25 bp, Mus musculus
gttactctcagcactgttgattgcg

SEQ ID NO: 723417 - DNA, 25 bp, Mus musculus
gttactctcagctctgttgattgcg

SEQ ID NO: 723418 - DNA, 25 bp, Mus musculus
gttactctccagatcagcagaaggc

SEQ ID NO: 723419 - DNA, 25 bp, Mus musculus
gttactctccagttcagcagaaggc

SEQ ID NO: 723420 - DNA, 25 bp, Mus musculus
gttactctccatcactaactgtgta

SEQ ID NO: 723421 - DNA, 25 bp, Mus musculus
gttactctccatgactaactgtgta

SEQ ID NO: 723422 - DNA, 25 bp, Mus musculus
gttactctctagcagaacatagcca

SEQ ID NO: 723423 - DNA, 25 bp, Mus musculus
gttactctctaggagaacatagcca

SEQ ID NO: 723424 - DNA, 25 bp, Mus musculus
gttactctgaaacttagtggtgctt

SEQ ID NO: 723425 - DNA, 25 bp, Mus musculus
gttactctgaaagttagtggtgctt

SEQ ID NO: 723426 - DNA, 25 bp, Mus musculus
gttactctgcacaacttatttttac

SEQ ID NO: 723427 - DNA, 25 bp, Mus musculus
gttactctgcactacttatttttac

SEQ ID NO: 723428 - DNA, 25 bp, Mus musculus
gttactctgcttcagatggtcggaa

SEQ ID NO: 723429 - DNA, 25 bp, Mus musculus
gttactctgcttgagatggtcggaa

SEQ ID NO: 723430 - DNA, 25 bp, Mus musculus
gttactctgtctagaattctctgtt

SEQ ID NO: 723431 - DNA, 25 bp, Mus musculus
gttactctgtctcttaagttgcact

SEQ ID NO: 723432 - DNA, 25 bp, Mus musculus
gttactctgtctgttaagttgcact

SEQ ID NO: 723433 - DNA, 25 bp, Mus musculus
gttactctgtcttgaattctctgtt

SEQ ID NO: 723434 - DNA, 25 bp, Mus musculus
gttactctgtttagctatgacacaa

SEQ ID NO: 723435 - DNA, 25 bp, Mus musculus
gttactctgttttgctatgacacaa

SEQ ID NO: 723436 - DNA, 25 bp, Mus musculus
gttactcttgagagtatttacagtt

SEQ ID NO: 723437 - DNA, 25 bp, Mus musculus
gttactcttgagtgtatttacagtt

SEQ ID NO: 723438 - DNA, 25 bp, Mus musculus
gttactcttgccctgtcctgttcta

SEQ ID NO: 723439 - DNA, 25 bp, Mus musculus
gttactcttgccgtgtcctgttcta

SEQ ID NO: 723440 - DNA, 25 bp, Mus musculus
gttactcttttcagtcagaaacatg

SEQ ID NO: 723441 - DNA, 25 bp, Mus musculus
gttactcttttctgtcagaaacatg

SEQ ID NO: 723442 - DNA, 25 bp, Mus musculus
gttactcttttgactcaccaatgat

SEQ ID NO: 723443 - DNA, 25 bp, Mus musculus
gttactcttttgtctcaccaatgat

SEQ ID NO: 723444 - DNA, 25 bp, Mus musculus
gttactctttttcatagtcccaatg

SEQ ID NO: 723445 - DNA, 25 bp, Mus musculus
gttactctttttgatagtcccaatg

SEQ ID NO: 723446 - DNA, 25 bp, Mus musculus
gttactgaaaccattagcttattga

SEQ ID NO: 723447 - DNA, 25 bp, Mus musculus
gttactgaaacctttagcttattga

SEQ ID NO: 723448 - DNA, 25 bp, Mus musculus
gttactgaagccaaggttcgacaag

SEQ ID NO: 723449 - DNA, 25 bp, Mus musculus
gttactgaagcctaggttcgacaag

SEQ ID NO: 723450 - DNA, 25 bp, Mus musculus
gttactgaagctatttcttatgtct

SEQ ID NO: 723451 - DNA, 25 bp, Mus musculus
gttactgaagctttttcttatgtct

SEQ ID NO: 723452 - DNA, 25 bp, Mus musculus
gttactgaatgaacagcccactcca

SEQ ID NO: 723453 - DNA, 25 bp, Mus musculus
gttactgaatgatcagcccactcca

SEQ ID NO: 723454 - DNA, 25 bp, Mus musculus
gttactgacagcacaaattccattg

SEQ ID NO: 723455 - DNA, 25 bp, Mus musculus
gttactgacagctcaaattccattg

SEQ ID NO: 723456 - DNA, 25 bp, Mus musculus
gttactgacatgagctttcttccta

SEQ ID NO: 723457 - DNA, 25 bp, Mus musculus
gttactgacatgtgctttcttccta

SEQ ID NO: 723458 - DNA, 25 bp, Mus musculus
gttactgaccagctactgcttcctt

SEQ ID NO: 723459 - DNA, 25 bp, Mus musculus
gttactgaccaggtactgcttcctt

SEQ ID NO: 723460 - DNA, 25 bp, Mus musculus
gttactgactaaagccaaccttgag

SEQ ID NO: 723461 - DNA, 25 bp, Mus musculus
gttactgactaatgccaaccttgag

SEQ ID NO: 723462 - DNA, 25 bp, Mus musculus
gttactgagaccattttcccagcat

SEQ ID NO: 723463 - DNA, 25 bp, Mus musculus
gttactgagacctttttcccagcat

SEQ ID NO: 723464 - DNA, 25 bp, Mus musculus
gttactgagatgacaccggcaagtt

SEQ ID NO: 723465 - DNA, 25 bp, Mus musculus
gttactgagatgtcaccggcaagtt

SEQ ID NO: 723466 - DNA, 25 bp, Mus musculus
gttactgagcatcgacatcacgaaa

SEQ ID NO: 723467 - DNA, 25 bp, Mus musculus
gttactgagcatggacatcacgaaa

SEQ ID NO: 723468 - DNA, 25 bp, Mus musculus
gttactgagggtctgtgctccccta

SEQ ID NO: 723469 - DNA, 25 bp, Mus musculus
gttactgagggtgtgtgctccccta

SEQ ID NO: 723470 - DNA, 25 bp, Mus musculus
gttactgatagtagagagccacccc

SEQ ID NO: 723471 - DNA, 25 bp, Mus musculus
gttactgatagttgagagccacccc

SEQ ID NO: 723472 - DNA, 25 bp, Mus musculus
gttactgatgggatgtggcttgcaa

SEQ ID NO: 723473 - DNA, 25 bp, Mus musculus
gttactgatgggttgtggcttgcaa

SEQ ID NO: 723474 - DNA, 25 bp, Mus musculus
gttactgatgttctttttacctaga

SEQ ID NO: 723475 - DNA, 25 bp, Mus musculus
gttactgatgttgtttttacctaga

SEQ ID NO: 723476 - DNA, 25 bp, Mus musculus
gttactgattaaaccccagcagaag

SEQ ID NO: 723477 - DNA, 25 bp, Mus musculus
gttactgattaatccccagcagaag

SEQ ID NO: 723478 - DNA, 25 bp, Mus musculus
gttactgatttactaagaagcctgg

SEQ ID NO: 723479 - DNA, 25 bp, Mus musculus
gttactgatttagtaagaagcctgg

SEQ ID NO: 723480 - DNA, 25 bp, Mus musculus
gttactgatttcatgtatcccagga

SEQ ID NO: 723481 - DNA, 25 bp, Mus musculus
gttactgatttcttgtatcccagga

SEQ ID NO: 723482 - DNA, 25 bp, Mus musculus
gttactgcaagaaacccacctggta

SEQ ID NO: 723483 - DNA, 25 bp, Mus musculus
gttactgcaagatacccacctggta

SEQ ID NO: 723484 - DNA, 25 bp, Mus musculus
gttactgcaaggaacacccactctg

SEQ ID NO: 723485 - DNA, 25 bp, Mus musculus
gttactgcaaggtacacccactctg

SEQ ID NO: 723486 - DNA, 25 bp, Mus musculus
gttactgcaattccacactttcatt

SEQ ID NO: 723487 - DNA, 25 bp, Mus musculus
gttactgcaattgcacactttcatt

SEQ ID NO: 723488 - DNA, 25 bp, Mus musculus
gttactgcacagagttcgtgtctca

SEQ ID NO: 723489 - DNA, 25 bp, Mus musculus
gttactgcacagtgttcgtgtctca

SEQ ID NO: 723490 - DNA, 25 bp, Mus musculus
gttactgcacttcatagggatgtgt

SEQ ID NO: 723491 - DNA, 25 bp, Mus musculus
gttactgcacttgatagggatgtgt

SEQ ID NO: 723492 - DNA, 25 bp, Mus musculus
gttactgcaggtaaatgtaagctga

SEQ ID NO: 723493 - DNA, 25 bp, Mus musculus
gttactgcaggttaatgtaagctga

SEQ ID NO: 723494 - DNA, 25 bp, Mus musculus
gttactgcagtgataccttcaggag

SEQ ID NO: 723495 - DNA, 25 bp, Mus musculus
gttactgcagtgttaccttcaggag

SEQ ID NO: 723496 - DNA, 25 bp, Mus musculus
gttactgccactctgttatatatag

SEQ ID NO: 723497 - DNA, 25 bp, Mus musculus
gttactgccactgtgttatatatag

SEQ ID NO: 723498 - DNA, 25 bp, Mus musculus
gttactgccagaaatgcaacctgca

SEQ ID NO: 723499 - DNA, 25 bp, Mus musculus
gttactgccagatatgcaacctgca

SEQ ID NO: 723500 - DNA, 25 bp, Mus musculus
gttactgccatcaatattgctacca

SEQ ID NO: 723501 - DNA, 25 bp, Mus musculus
gttactgccatctatattgctacca

SEQ ID NO: 723502 - DNA, 25 bp, Mus musculus
gttactgcccagcaagacgtggtca

SEQ ID NO: 723503 - DNA, 25 bp, Mus musculus
gttactgcccaggaagacgtggtca

SEQ ID NO: 723504 - DNA, 25 bp, Mus musculus
gttactgccgctactgtaacccgga

SEQ ID NO: 723505 - DNA, 25 bp, Mus musculus
gttactgccgcttctgtaacccgga

SEQ ID NO: 723506 - DNA, 25 bp, Mus musculus
gttactgcctaactagccttcataa

SEQ ID NO: 723507 - DNA, 25 bp, Mus musculus
gttactgcctaagtagccttcataa

SEQ ID NO: 723508 - DNA, 25 bp, Mus musculus
gttactgcctctcagattgcaaggg

SEQ ID NO: 723509 - DNA, 25 bp, Mus musculus
gttactgcctctgagattgcaaggg

SEQ ID NO: 723510 - DNA, 25 bp, Mus musculus
gttactgctatgaaagggtcctttg

SEQ ID NO: 723511 - DNA, 25 bp, Mus musculus
gttactgctatgtaagggtcctttg

SEQ ID NO: 723512 - DNA, 25 bp, Mus musculus
gttactgctcagcttagggtggctt

SEQ ID NO: 723513 - DNA, 25 bp, Mus musculus
gttactgctcagctttgccgtctga

SEQ ID NO: 723514 - DNA, 25 bp, Mus musculus
gttactgctcaggttagggtggctt

SEQ ID NO: 723515 - DNA, 25 bp, Mus musculus
gttactgctcaggtttgccgtctga

SEQ ID NO: 723516 - DNA, 25 bp, Mus musculus
gttactgctgccacagattaagaat

SEQ ID NO: 723517 - DNA, 25 bp, Mus musculus
gttactgctgcctcagattaagaat

SEQ ID NO: 723518 - DNA, 25 bp, Mus musculus
gttactgctgctcaaaaatcatcga

SEQ ID NO: 723519 - DNA, 25 bp, Mus musculus
gttactgctgctcttcatgaatgga

SEQ ID NO: 723520 - DNA, 25 bp, Mus musculus
gttactgctgctgaaaaatcatcga

SEQ ID NO: 723521 - DNA, 25 bp, Mus musculus
gttactgctgctgttcatgaatgga

SEQ ID NO: 723522 - DNA, 25 bp, Mus musculus
gttactgctgtaagaaccacactcg

SEQ ID NO: 723523 - DNA, 25 bp, Mus musculus
gttactgctgtatgaaccacactcg

SEQ ID NO: 723524 - DNA, 25 bp, Mus musculus
gttactggaattctgatgatggtca

SEQ ID NO: 723525 - DNA, 25 bp, Mus musculus
gttactggaattgtgatgatggtca

SEQ ID NO: 723526 - DNA, 25 bp, Mus musculus
gttactggagaaacttgtcttcaac

SEQ ID NO: 723527 - DNA, 25 bp, Mus musculus
gttactggagaatcttgtcttcaac

SEQ ID NO: 723528 - DNA, 25 bp, Mus musculus
gttactggatacaatgttcatgttc

SEQ ID NO: 723529 - DNA, 25 bp, Mus musculus
gttactggatactatgttcatgttc

SEQ ID NO: 723530 - DNA, 25 bp, Mus musculus
gttactggcacaagggcgcaaaaaa

SEQ ID NO: 723531 - DNA, 25 bp, Mus musculus
gttactggcacatgggcgcaaaaaa

SEQ ID NO: 723532 - DNA, 25 bp, Mus musculus
gttactggcactaagaaatcacttt

SEQ ID NO: 723533 - DNA, 25 bp, Mus musculus
gttactggcacttagaaatcacttt

SEQ ID NO: 723534 - DNA, 25 bp, Mus musculus
gttactggccacatttgtgtgctaa

SEQ ID NO: 723535 - DNA, 25 bp, Mus musculus
gttactggccacttttgtgtgctaa

SEQ ID NO: 723536 - DNA, 25 bp, Mus musculus
gttactgggtgcagcctccatccca

SEQ ID NO: 723537 - DNA, 25 bp, Mus musculus
gttactgggtgcatctcggttctac

SEQ ID NO: 723538 - DNA, 25 bp, Mus musculus
gttactgggtgctgcctccatccca

SEQ ID NO: 723539 - DNA, 25 bp, Mus musculus
gttactgggtgcttctcggttctac

SEQ ID NO: 723540 - DNA, 25 bp, Mus musculus
gttactggtactatcagctttagtt

SEQ ID NO: 723541 - DNA, 25 bp, Mus musculus
gttactggtactttcagctttagtt

SEQ ID NO: 723542 - DNA, 25 bp, Mus musculus
gttactggttcaatttctcagagta

SEQ ID NO: 723543 - DNA, 25 bp, Mus musculus
gttactggttcattttctcagagta

SEQ ID NO: 723544 - DNA, 25 bp, Mus musculus
gttactggtttaacacctacaaaca

SEQ ID NO: 723545 - DNA, 25 bp, Mus musculus
gttactggtttatcacctacaaaca

SEQ ID NO: 723546 - DNA, 25 bp, Mus musculus
gttactgtaaacaagcctctccaaa

SEQ ID NO: 723547 - DNA, 25 bp, Mus musculus
gttactgtaaactagcctctccaaa

SEQ ID NO: 723548 - DNA, 25 bp, Mus musculus
gttactgtacagaattgggctccat

SEQ ID NO: 723549 - DNA, 25 bp, Mus musculus
gttactgtacagtattgggctccat

SEQ ID NO: 723550 - DNA, 25 bp, Mus musculus
gttactgtacctcccactaaatgca

SEQ ID NO: 723551 - DNA, 25 bp, Mus musculus
gttactgtacctgccactaaatgca

SEQ ID NO: 723552 - DNA, 25 bp, Mus musculus
gttactgtagttatgatgtctctcc

SEQ ID NO: 723553 - DNA, 25 bp, Mus musculus
gttactgtagttttgatgtctctcc

SEQ ID NO: 723554 - DNA, 25 bp, Mus musculus
gttactgtatataaaggtgatcctc

SEQ ID NO: 723555 - DNA, 25 bp, Mus musculus
gttactgtatataacggcttcgttc

SEQ ID NO: 723556 - DNA, 25 bp, Mus musculus
gttactgtatattaaggtgatcctc

SEQ ID NO: 723557 - DNA, 25 bp, Mus musculus
gttactgtatattacggcttcgttc

SEQ ID NO: 723558 - DNA, 25 bp, Mus musculus
gttactgtatcacaaagtactttta

SEQ ID NO: 723559 - DNA, 25 bp, Mus musculus
gttactgtatcagaaagtactttta

SEQ ID NO: 723560 - DNA, 25 bp, Mus musculus
gttactgtcaacaaaattccatgga

SEQ ID NO: 723561 - DNA, 25 bp, Mus musculus
gttactgtcaactaaattccatgga

SEQ ID NO: 723562 - DNA, 25 bp, Mus musculus
gttactgtcaggattagatatctct

SEQ ID NO: 723563 - DNA, 25 bp, Mus musculus
gttactgtcaggtttagatatctct

SEQ ID NO: 723564 - DNA, 25 bp, Mus musculus
gttactgtctgaaattgaacacagc

SEQ ID NO: 723565 - DNA, 25 bp, Mus musculus
gttactgtctgatattgaacacagc

SEQ ID NO: 723566 - DNA, 25 bp, Mus musculus
gttactgtgcacaccattaatgaag

SEQ ID NO: 723567 - DNA, 25 bp, Mus musculus
gttactgtgcactccattaatgaag

SEQ ID NO: 723568 - DNA, 25 bp, Mus musculus
gttactgtggctacaaagaagctat

SEQ ID NO: 723569 - DNA, 25 bp, Mus musculus
gttactgtggcttcaaagaagctat

SEQ ID NO: 723570 - DNA, 25 bp, Mus musculus
gttactgtgtcaactccacatttag

SEQ ID NO: 723571 - DNA, 25 bp, Mus musculus
gttactgtgtcatctccacatttag

SEQ ID NO: 723572 - DNA, 25 bp, Mus musculus
gttactgtgtctaccattgatgaag

SEQ ID NO: 723573 - DNA, 25 bp, Mus musculus
gttactgtgtcttccattgatgaag

SEQ ID NO: 723574 - DNA, 25 bp, Mus musculus
gttactgtgtttacttgtacccctg

SEQ ID NO: 723575 - DNA, 25 bp, Mus musculus
gttactgtgttttcttgtacccctg

SEQ ID NO: 723576 - DNA, 25 bp, Mus musculus
gttactgttaacagatgcttcatgt

SEQ ID NO: 723577 - DNA, 25 bp, Mus musculus
gttactgttaactgatgcttcatgt

SEQ ID NO: 723578 - DNA, 25 bp, Mus musculus
gttactgttagtagtgactgtcgga

SEQ ID NO: 723579 - DNA, 25 bp, Mus musculus
gttactgttagttgtgactgtcgga

SEQ ID NO: 723580 - DNA, 25 bp, Mus musculus
gttactgttccaattctttgtgtca

SEQ ID NO: 723581 - DNA, 25 bp, Mus musculus
gttactgttccatttctttgtgtca

SEQ ID NO: 723582 - DNA, 25 bp, Mus musculus
gttactgttcctaattgactgtgtg

SEQ ID NO: 723583 - DNA, 25 bp, Mus musculus
gttactgttccttattgactgtgtg

SEQ ID NO: 723584 - DNA, 25 bp, Mus musculus
gttactgttgccagcaccagtccag

SEQ ID NO: 723585 - DNA, 25 bp, Mus musculus
gttactgttgcctgcaccagtccag

SEQ ID NO: 723586 - DNA, 25 bp, Mus musculus
gttactgttgctctgctttcatttt

SEQ ID NO: 723587 - DNA, 25 bp, Mus musculus
gttactgttgctgtgctttcatttt

SEQ ID NO: 723588 - DNA, 25 bp, Mus musculus
gttactgttgttacgatttctggtt

SEQ ID NO: 723589 - DNA, 25 bp, Mus musculus
gttactgttgtttcgatttctggtt

SEQ ID NO: 723590 - DNA, 25 bp, Mus musculus
gttactgtttagctctagtcttcct

SEQ ID NO: 723591 - DNA, 25 bp, Mus musculus
gttactgtttaggtctagtcttcct

SEQ ID NO: 723592 - DNA, 25 bp, Mus musculus
gttactgtttgcattttctacccac

SEQ ID NO: 723593 - DNA, 25 bp, Mus musculus
gttactgtttgctttttctacccac

SEQ ID NO: 723594 - DNA, 25 bp, Mus musculus
gttactgttttcagattactatgat

SEQ ID NO: 723595 - DNA, 25 bp, Mus musculus
gttactgttttctgattactatgat

SEQ ID NO: 723596 - DNA, 25 bp, Mus musculus
gttactgtttttccttctctgatta

SEQ ID NO: 723597 - DNA, 25 bp, Mus musculus
gttactgtttttgcttctctgatta

SEQ ID NO: 723598 - DNA, 25 bp, Mus musculus
gttacttaactactccacactacat

SEQ ID NO: 723599 - DNA, 25 bp, Mus musculus
gttacttaactagtccacactacat

SEQ ID NO: 723600 - DNA, 25 bp, Mus musculus
gttacttaatatagtactgttaaat

SEQ ID NO: 723601 - DNA, 25 bp, Mus musculus
gttacttaatatcacgtggcgtccg

SEQ ID NO: 723602 - DNA, 25 bp, Mus musculus
gttacttaatatgacgtggcgtccg

SEQ ID NO: 723603 - DNA, 25 bp, Mus musculus
gttacttaatattgtactgttaaat

SEQ ID NO: 723604 - DNA, 25 bp, Mus musculus
gttacttaattcatttcagctcttt

SEQ ID NO: 723605 - DNA, 25 bp, Mus musculus
gttacttaattcttttcagctcttt

SEQ ID NO: 723606 - DNA, 25 bp, Mus musculus
gttacttacgtcctaagaggcatcc

SEQ ID NO: 723607 - DNA, 25 bp, Mus musculus
gttacttacgtcgtaagaggcatcc

SEQ ID NO: 723608 - DNA, 25 bp, Mus musculus
gttacttactcaaatacaccaatca

SEQ ID NO: 723609 - DNA, 25 bp, Mus musculus
gttacttactcatatacaccaatca

SEQ ID NO: 723610 - DNA, 25 bp, Mus musculus
gttacttactgtactatcgctgtgg

SEQ ID NO: 723611 - DNA, 25 bp, Mus musculus
gttacttactgttctatcgctgtgg

SEQ ID NO: 723612 - DNA, 25 bp, Mus musculus
gttacttacttactgtccagtctgc

SEQ ID NO: 723613 - DNA, 25 bp, Mus musculus
gttacttacttagtgtccagtctgc

SEQ ID NO: 723614 - DNA, 25 bp, Mus musculus
gttacttagaagaatcctttggtct

SEQ ID NO: 723615 - DNA, 25 bp, Mus musculus
gttacttagaagtatcctttggtct

SEQ ID NO: 723616 - DNA, 25 bp, Mus musculus
gttacttagagtatgaacttccctg

SEQ ID NO: 723617 - DNA, 25 bp, Mus musculus
gttacttagagtttgaacttccctg

SEQ ID NO: 723618 - DNA, 25 bp, Mus musculus
gttacttagatactctcacactgcc

SEQ ID NO: 723619 - DNA, 25 bp, Mus musculus
gttacttagatagtctcacactgcc

SEQ ID NO: 723620 - DNA, 25 bp, Mus musculus
gttacttagcctatagaatacatcc

SEQ ID NO: 723621 - DNA, 25 bp, Mus musculus
gttacttagcctttagaatacatcc

SEQ ID NO: 723622 - DNA, 25 bp, Mus musculus
gttacttagcttatgccttttgtgg

SEQ ID NO: 723623 - DNA, 25 bp, Mus musculus
gttacttagcttttgccttttgtgg

SEQ ID NO: 723624 - DNA, 25 bp, Mus musculus
gttacttatgtaacattcatatttt

SEQ ID NO: 723625 - DNA, 25 bp, Mus musculus
gttacttatgtatcattcatatttt

SEQ ID NO: 723626 - DNA, 25 bp, Mus musculus
gttacttcaaaaactgtggtcacag

SEQ ID NO: 723627 - DNA, 25 bp, Mus musculus
gttacttcaaaatctgtggtcacag

SEQ ID NO: 723628 - DNA, 25 bp, Mus musculus
gttacttcactgctataatccttgg

SEQ ID NO: 723629 - DNA, 25 bp, Mus musculus
gttacttcactggtataatccttgg

SEQ ID NO: 723630 - DNA, 25 bp, Mus musculus
gttacttcagcgataacactgccta

SEQ ID NO: 723631 - DNA, 25 bp, Mus musculus
gttacttcagcgttaacactgccta

SEQ ID NO: 723632 - DNA, 25 bp, Mus musculus
gttacttctactacactgtggaact

SEQ ID NO: 723633 - DNA, 25 bp, Mus musculus
gttacttctacttcactgtggaact

SEQ ID NO: 723634 - DNA, 25 bp, Mus musculus
gttacttctctgatgttgagcaatg

SEQ ID NO: 723635 - DNA, 25 bp, Mus musculus
gttacttctctgttgttgagcaatg

SEQ ID NO: 723636 - DNA, 25 bp, Mus musculus
gttacttctgttagattagccgatg

SEQ ID NO: 723637 - DNA, 25 bp, Mus musculus
gttacttctgttcacaatttgaatt

SEQ ID NO: 723638 - DNA, 25 bp, Mus musculus
gttacttctgttgacaatttgaatt

SEQ ID NO: 723639 - DNA, 25 bp, Mus musculus
gttacttctgtttgattagccgatg

SEQ ID NO: 723640 - DNA, 25 bp, Mus musculus
gttacttcttctctgtggcccagaa

SEQ ID NO: 723641 - DNA, 25 bp, Mus musculus
gttacttcttctgtgtggcccagaa

SEQ ID NO: 723642 - DNA, 25 bp, Mus musculus
gttacttcttttagctcatctgaaa

SEQ ID NO: 723643 - DNA, 25 bp, Mus musculus
gttacttctttttgctcatctgaaa

SEQ ID NO: 723644 - DNA, 25 bp, Mus musculus
gttacttgaatcaatgtagtcttcc

SEQ ID NO: 723645 - DNA, 25 bp, Mus musculus
gttacttgaatcagtgcttcactct

SEQ ID NO: 723646 - DNA, 25 bp, Mus musculus
gttacttgaatctatgtagtcttcc

SEQ ID NO: 723647 - DNA, 25 bp, Mus musculus
gttacttgaatctgtgcttcactct

SEQ ID NO: 723648 - DNA, 25 bp, Mus musculus
gttacttgaatgactttcccctgtt

SEQ ID NO: 723649 - DNA, 25 bp, Mus musculus
gttacttgaatgtctttcccctgtt

SEQ ID NO: 723650 - DNA, 25 bp, Mus musculus
gttacttgacaaattgtaatcctat

SEQ ID NO: 723651 - DNA, 25 bp, Mus musculus
gttacttgacaatttgtaatcctat

SEQ ID NO: 723652 - DNA, 25 bp, Mus musculus
gttacttgacgacgttgaggccagc

SEQ ID NO: 723653 - DNA, 25 bp, Mus musculus
gttacttgacgaggttgaggccagc

SEQ ID NO: 723654 - DNA, 25 bp, Mus musculus
gttacttgagtcagttctcttcaga

SEQ ID NO: 723655 - DNA, 25 bp, Mus musculus
gttacttgagtctgttctcttcaga

SEQ ID NO: 723656 - DNA, 25 bp, Mus musculus
gttacttgagtgagagccaaatcca

SEQ ID NO: 723657 - DNA, 25 bp, Mus musculus
gttacttgagtgtgagccaaatcca

SEQ ID NO: 723658 - DNA, 25 bp, Mus musculus
gttacttgattcattgtgttacaca

SEQ ID NO: 723659 - DNA, 25 bp, Mus musculus
gttacttgattctttgtgttacaca

SEQ ID NO: 723660 - DNA, 25 bp, Mus musculus
gttacttgattgctataaaggatag

SEQ ID NO: 723661 - DNA, 25 bp, Mus musculus
gttacttgattggtataaaggatag

SEQ ID NO: 723662 - DNA, 25 bp, Mus musculus
gttacttgatttaggatacctgaga

SEQ ID NO: 723663 - DNA, 25 bp, Mus musculus
gttacttgattttggatacctgaga

SEQ ID NO: 723664 - DNA, 25 bp, Mus musculus
gttacttgccaaaatgaccttctct

SEQ ID NO: 723665 - DNA, 25 bp, Mus musculus
gttacttgccaatatgaccttctct

SEQ ID NO: 723666 - DNA, 25 bp, Mus musculus
gttacttgcctgatcaagaccagcc

SEQ ID NO: 723667 - DNA, 25 bp, Mus musculus
gttacttgcctgttcaagaccagcc

SEQ ID NO: 723668 - DNA, 25 bp, Mus musculus
gttacttgcttaaagaatttacata

SEQ ID NO: 723669 - DNA, 25 bp, Mus musculus
gttacttgcttatagaatttacata

SEQ ID NO: 723670 - DNA, 25 bp, Mus musculus
gttacttggcaacattatacacagc

SEQ ID NO: 723671 - DNA, 25 bp, Mus musculus
gttacttggcaagattatacacagc

SEQ ID NO: 723672 - DNA, 25 bp, Mus musculus
gttacttgtcagattgaggtccttc

SEQ ID NO: 723673 - DNA, 25 bp, Mus musculus
gttacttgtcagtttgaggtccttc

SEQ ID NO: 723674 - DNA, 25 bp, Mus musculus
gttacttgttagcatgagttactgg

SEQ ID NO: 723675 - DNA, 25 bp, Mus musculus
gttacttgttaggatgagttactgg

SEQ ID NO: 723676 - DNA, 25 bp, Mus musculus
gttacttgtttcaagttgactctac

SEQ ID NO: 723677 - DNA, 25 bp, Mus musculus
gttacttgtttctagttgactctac

SEQ ID NO: 723678 - DNA, 25 bp, Mus musculus
gttactttaaatactcattacatga

SEQ ID NO: 723679 - DNA, 25 bp, Mus musculus
gttactttaaatcccatctgcctat

SEQ ID NO: 723680 - DNA, 25 bp, Mus musculus
gttactttaaatctctgggaagcag

SEQ ID NO: 723681 - DNA, 25 bp, Mus musculus
gttactttaaatgccatctgcctat

SEQ ID NO: 723682 - DNA, 25 bp, Mus musculus
gttactttaaatgtctgggaagcag

SEQ ID NO: 723683 - DNA, 25 bp, Mus musculus
gttactttaaattctcattacatga

SEQ ID NO: 723684 - DNA, 25 bp, Mus musculus
gttactttaattagctgttcatctg

SEQ ID NO: 723685 - DNA, 25 bp, Mus musculus
gttactttaatttgctgttcatctg

SEQ ID NO: 723686 - DNA, 25 bp, Mus musculus
gttactttataaatctctggtcatg

SEQ ID NO: 723687 - DNA, 25 bp, Mus musculus
gttactttataattctctggtcatg

SEQ ID NO: 723688 - DNA, 25 bp, Mus musculus
gttactttcacaatgtcatcttctg

SEQ ID NO: 723689 - DNA, 25 bp, Mus musculus
gttactttcacattgtcatcttctg

SEQ ID NO: 723690 - DNA, 25 bp, Mus musculus
gttactttccacatctcaataaatg

SEQ ID NO: 723691 - DNA, 25 bp, Mus musculus
gttactttccacttctcaataaatg

SEQ ID NO: 723692 - DNA, 25 bp, Mus musculus
gttactttccgcagctaacagttgc

SEQ ID NO: 723693 - DNA, 25 bp, Mus musculus
gttactttccgctgctaacagttgc

SEQ ID NO: 723694 - DNA, 25 bp, Mus musculus
gttactttctacacagactgtctat

SEQ ID NO: 723695 - DNA, 25 bp, Mus musculus
gttactttctactcagactgtctat

SEQ ID NO: 723696 - DNA, 25 bp, Mus musculus
gttactttgaagatgctcaaggcat

SEQ ID NO: 723697 - DNA, 25 bp, Mus musculus
gttactttgaagttgctcaaggcat

SEQ ID NO: 723698 - DNA, 25 bp, Mus musculus
gttactttgctaccaccttgtgaag

SEQ ID NO: 723699 - DNA, 25 bp, Mus musculus
gttactttgctagcaccttgtgaag

SEQ ID NO: 723700 - DNA, 25 bp, Mus musculus
gttactttgctcataagcccatgag

SEQ ID NO: 723701 - DNA, 25 bp, Mus musculus
gttactttgctcttaagcccatgag

SEQ ID NO: 723702 - DNA, 25 bp, Mus musculus
gttactttgtggctgagtttgcatt

SEQ ID NO: 723703 - DNA, 25 bp, Mus musculus
gttactttgtgggtgagtttgcatt

SEQ ID NO: 723704 - DNA, 25 bp, Mus musculus
gttacttttcaaacatgttggacgt

SEQ ID NO: 723705 - DNA, 25 bp, Mus musculus
gttacttttcaaccttgtacttaag

SEQ ID NO: 723706 - DNA, 25 bp, Mus musculus
gttacttttcaagcttgtacttaag

SEQ ID NO: 723707 - DNA, 25 bp, Mus musculus
gttacttttcaatcatgttggacgt

SEQ ID NO: 723708 - DNA, 25 bp, Mus musculus
gttacttttcagaatacgtctacat

SEQ ID NO: 723709 - DNA, 25 bp, Mus musculus
gttacttttcagtatacgtctacat

SEQ ID NO: 723710 - DNA, 25 bp, Mus musculus
gttacttttgagagtcttctctgtg

SEQ ID NO: 723711 - DNA, 25 bp, Mus musculus
gttacttttgagatccactctgact

SEQ ID NO: 723712 - DNA, 25 bp, Mus musculus
gttacttttgagtgtcttctctgtg

SEQ ID NO: 723713 - DNA, 25 bp, Mus musculus
gttacttttgagttccactctgact

SEQ ID NO: 723714 - DNA, 25 bp, Mus musculus
gttagaaaacacagcaccattgaat

SEQ ID NO: 723715 - DNA, 25 bp, Mus musculus
gttagaaaacacagctaagtgtcat

SEQ ID NO: 723716 - DNA, 25 bp, Mus musculus
gttagaaaacactgcaccattgaat

SEQ ID NO: 723717 - DNA, 25 bp, Mus musculus
gttagaaaacactgctaagtgtcat

SEQ ID NO: 723718 - DNA, 25 bp, Mus musculus
gttagaaaactactgtacacttttg

SEQ ID NO: 723719 - DNA, 25 bp, Mus musculus
gttagaaaactagtgtacacttttg

SEQ ID NO: 723720 - DNA, 25 bp, Mus musculus
gttagaaaagcacatggcgacatcg

SEQ ID NO: 723721 - DNA, 25 bp, Mus musculus
gttagaaaagcagatggcgacatcg

SEQ ID NO: 723722 - DNA, 25 bp, Mus musculus
gttagaaaccgacctgcacagggat

SEQ ID NO: 723723 - DNA, 25 bp, Mus musculus
gttagaaaccgagctgcacagggat

SEQ ID NO: 723724 - DNA, 25 bp, Mus musculus
gttagaaacgccagtgcactttgat

SEQ ID NO: 723725 - DNA, 25 bp, Mus musculus
gttagaaacgcctgtgcactttgat

SEQ ID NO: 723726 - DNA, 25 bp, Mus musculus
gttagaaaggccacggacctccaag

SEQ ID NO: 723727 - DNA, 25 bp, Mus musculus
gttagaaaggcctcggacctccaag

SEQ ID NO: 723728 - DNA, 25 bp, Mus musculus
gttagaaatgaccaccagtcttaag

SEQ ID NO: 723729 - DNA, 25 bp, Mus musculus
gttagaaatgacgaccagtcttaag

SEQ ID NO: 723730 - DNA, 25 bp, Mus musculus
gttagaacaagaagcccggcaccat

SEQ ID NO: 723731 - DNA, 25 bp, Mus musculus
gttagaacaagatgcccggcaccat

SEQ ID NO: 723732 - DNA, 25 bp, Mus musculus
gttagaacagacagctctgacccac

SEQ ID NO: 723733 - DNA, 25 bp, Mus musculus
gttagaacagactgctctgacccac

SEQ ID NO: 723734 - DNA, 25 bp, Mus musculus
gttagaacatgacgaagagacaggc

SEQ ID NO: 723735 - DNA, 25 bp, Mus musculus
gttagaacatgaggaagagacaggc

SEQ ID NO: 723736 - DNA, 25 bp, Mus musculus
gttagaacccatagtcacgttgaag

SEQ ID NO: 723737 - DNA, 25 bp, Mus musculus
gttagaacccatcgaactggtcttt

SEQ ID NO: 723738 - DNA, 25 bp, Mus musculus
gttagaacccatggaactggtcttt

SEQ ID NO: 723739 - DNA, 25 bp, Mus musculus
gttagaacccattgtcacgttgaag

SEQ ID NO: 723740 - DNA, 25 bp, Mus musculus
gttagaacctagacagcagcatgac

SEQ ID NO: 723741 - DNA, 25 bp, Mus musculus
gttagaacctagtcagcagcatgac

SEQ ID NO: 723742 - DNA, 25 bp, Mus musculus
gttagaaccttgcatcgggccagtc

SEQ ID NO: 723743 - DNA, 25 bp, Mus musculus
gttagaaccttggatcgggccagtc

SEQ ID NO: 723744 - DNA, 25 bp, Mus musculus
gttagaacgacacattcacgaccac

SEQ ID NO: 723745 - DNA, 25 bp, Mus musculus
gttagaacgacagattcacgaccac

SEQ ID NO: 723746 - DNA, 25 bp, Mus musculus
gttagaacgagtccccaaggagagc

SEQ ID NO: 723747 - DNA, 25 bp, Mus musculus
gttagaacgagtgcccaaggagagc

SEQ ID NO: 723748 - DNA, 25 bp, Mus musculus
gttagaactacacgtccagagccca

SEQ ID NO: 723749 - DNA, 25 bp, Mus musculus
gttagaactacaggtccagagccca

SEQ ID NO: 723750 - DNA, 25 bp, Mus musculus
gttagaactcctatcatacacacaa

SEQ ID NO: 723751 - DNA, 25 bp, Mus musculus
gttagaactcctttcatacacacaa

SEQ ID NO: 723752 - DNA, 25 bp, Mus musculus
gttagaactgacacccgcccttgtg

SEQ ID NO: 723753 - DNA, 25 bp, Mus musculus
gttagaactgactcccgcccttgtg

SEQ ID NO: 723754 - DNA, 25 bp, Mus musculus
gttagaactgtcagcagccgaacgc

SEQ ID NO: 723755 - DNA, 25 bp, Mus musculus
gttagaactgtctgcagccgaacgc

SEQ ID NO: 723756 - DNA, 25 bp, Mus musculus
gttagaacttcaacctcgatgggaa

SEQ ID NO: 723757 - DNA, 25 bp, Mus musculus
gttagaacttcatcctcgatgggaa

SEQ ID NO: 723758 - DNA, 25 bp, Mus musculus
gttagaacttctctaccaactttga

SEQ ID NO: 723759 - DNA, 25 bp, Mus musculus
gttagaacttctgtaccaactttga

SEQ ID NO: 723760 - DNA, 25 bp, Mus musculus
gttagaagacaaactggcctgccag

SEQ ID NO: 723761 - DNA, 25 bp, Mus musculus
gttagaagacaatctggcctgccag

SEQ ID NO: 723762 - DNA, 25 bp, Mus musculus
gttagaagatccaacagcatccctt

SEQ ID NO: 723763 - DNA, 25 bp, Mus musculus
gttagaagatcctacagcatccctt

SEQ ID NO: 723764 - DNA, 25 bp, Mus musculus
gttagaagccatccagccagattat

SEQ ID NO: 723765 - DNA, 25 bp, Mus musculus
gttagaagccatgcagccagattat

SEQ ID NO: 723766 - DNA, 25 bp, Mus musculus
gttagaatccccaactcggagtcta

SEQ ID NO: 723767 - DNA, 25 bp, Mus musculus
gttagaatcccctactcggagtcta

SEQ ID NO: 723768 - DNA, 25 bp, Mus musculus
gttagaatcctacttttcttgaagt

SEQ ID NO: 723769 - DNA, 25 bp, Mus musculus
gttagaatcctagttttcttgaagt

SEQ ID NO: 723770 - DNA, 25 bp, Mus musculus
gttagaatggtcactgtgtctctta

SEQ ID NO: 723771 - DNA, 25 bp, Mus musculus
gttagaatggtctctgtgtctctta

SEQ ID NO: 723772 - DNA, 25 bp, Mus musculus
gttagaatgtgcactcttaggttgc

SEQ ID NO: 723773 - DNA, 25 bp, Mus musculus
gttagaatgtgctctcttaggttgc

SEQ ID NO: 723774 - DNA, 25 bp, Mus musculus
gttagaattccacgcattgcaggca

SEQ ID NO: 723775 - DNA, 25 bp, Mus musculus
gttagaattccaggcattgcaggca

SEQ ID NO: 723776 - DNA, 25 bp, Mus musculus
gttagaatttccacctgttaagtga

SEQ ID NO: 723777 - DNA, 25 bp, Mus musculus
gttagaatttcctcctgttaagtga

SEQ ID NO: 723778 - DNA, 25 bp, Mus musculus
gttagacaagacatggcttcccaga

SEQ ID NO: 723779 - DNA, 25 bp, Mus musculus
gttagacaagacttggcttcccaga

SEQ ID NO: 723780 - DNA, 25 bp, Mus musculus
gttagacacaacataaataccttca

SEQ ID NO: 723781 - DNA, 25 bp, Mus musculus
gttagacacaacttaaataccttca

SEQ ID NO: 723782 - DNA, 25 bp, Mus musculus
gttagacacacaaacttttaattca

SEQ ID NO: 723783 - DNA, 25 bp, Mus musculus
gttagacacacatacttttaattca

SEQ ID NO: 723784 - DNA, 25 bp, Mus musculus
gttagacacctgagaagtatcttga

SEQ ID NO: 723785 - DNA, 25 bp, Mus musculus
gttagacacctgtgaagtatcttga

SEQ ID NO: 723786 - DNA, 25 bp, Mus musculus
gttagacactctagcaggactactc

SEQ ID NO: 723787 - DNA, 25 bp, Mus musculus
gttagacactcttgcaggactactc

SEQ ID NO: 723788 - DNA, 25 bp, Mus musculus
gttagacactgtaccgcatgcaata

SEQ ID NO: 723789 - DNA, 25 bp, Mus musculus
gttagacactgtatgggcccatgga

SEQ ID NO: 723790 - DNA, 25 bp, Mus musculus
gttagacactgttccgcatgcaata

SEQ ID NO: 723791 - DNA, 25 bp, Mus musculus
gttagacactgtttgggcccatgga

SEQ ID NO: 723792 - DNA, 25 bp, Mus musculus
gttagacagcagagcgctttggccc

SEQ ID NO: 723793 - DNA, 25 bp, Mus musculus
gttagacagcagtgcgctttggccc

SEQ ID NO: 723794 - DNA, 25 bp, Mus musculus
gttagacagcgtatgtagcttttca

SEQ ID NO: 723795 - DNA, 25 bp, Mus musculus
gttagacagcgtttgtagcttttca

SEQ ID NO: 723796 - DNA, 25 bp, Mus musculus
gttagacatgatatttacaagtttg

SEQ ID NO: 723797 - DNA, 25 bp, Mus musculus
gttagacatgatttttacaagtttg

SEQ ID NO: 723798 - DNA, 25 bp, Mus musculus
gttagacatgccaaagcttgatttt

SEQ ID NO: 723799 - DNA, 25 bp, Mus musculus
gttagacatgcctaagcttgatttt

SEQ ID NO: 723800 - DNA, 25 bp, Mus musculus
gttagacattaaacaggagtcccaa

SEQ ID NO: 723801 - DNA, 25 bp, Mus musculus
gttagacattaatcaggagtcccaa

SEQ ID NO: 723802 - DNA, 25 bp, Mus musculus
gttagacattgcataatcctttttt

SEQ ID NO: 723803 - DNA, 25 bp, Mus musculus
gttagacattgcttaatcctttttt

SEQ ID NO: 723804 - DNA, 25 bp, Mus musculus
gttagaccataactaccatctgcgc

SEQ ID NO: 723805 - DNA, 25 bp, Mus musculus
gttagaccataagtaccatctgcgc

SEQ ID NO: 723806 - DNA, 25 bp, Mus musculus
gttagaccctataggtttgagccta

SEQ ID NO: 723807 - DNA, 25 bp, Mus musculus
gttagaccctattggtttgagccta

SEQ ID NO: 723808 - DNA, 25 bp, Mus musculus
gttagaccgcttctaggctactaag

SEQ ID NO: 723809 - DNA, 25 bp, Mus musculus
gttagaccgcttgtaggctactaag

SEQ ID NO: 723810 - DNA, 25 bp, Mus musculus
gttagacctgaacagttcctcctca

SEQ ID NO: 723811 - DNA, 25 bp, Mus musculus
gttagacctgaagagttcctcctca

SEQ ID NO: 723812 - DNA, 25 bp, Mus musculus
gttagacctttcaaccaagtggcac

SEQ ID NO: 723813 - DNA, 25 bp, Mus musculus
gttagacctttctaccaagtggcac

SEQ ID NO: 723814 - DNA, 25 bp, Mus musculus
gttagacgaatcatatggaagctgt

SEQ ID NO: 723815 - DNA, 25 bp, Mus musculus
gttagacgaatcttatggaagctgt

SEQ ID NO: 723816 - DNA, 25 bp, Mus musculus
gttagacgtccacatttagccagaa

SEQ ID NO: 723817 - DNA, 25 bp, Mus musculus
gttagacgtccagatttagccagaa

SEQ ID NO: 723818 - DNA, 25 bp, Mus musculus
gttagactcagaacttccctcggct

SEQ ID NO: 723819 - DNA, 25 bp, Mus musculus
gttagactcagatcttccctcggct

SEQ ID NO: 723820 - DNA, 25 bp, Mus musculus
gttagactccagaaattgttagcat

SEQ ID NO: 723821 - DNA, 25 bp, Mus musculus
gttagactccagacacttcatttca

SEQ ID NO: 723822 - DNA, 25 bp, Mus musculus
gttagactccagtaattgttagcat

SEQ ID NO: 723823 - DNA, 25 bp, Mus musculus
gttagactccagtcacttcatttca

SEQ ID NO: 723824 - DNA, 25 bp, Mus musculus
gttagactctaaaagttttgtctcc

SEQ ID NO: 723825 - DNA, 25 bp, Mus musculus
gttagactctaatagttttgtctcc

SEQ ID NO: 723826 - DNA, 25 bp, Mus musculus
gttagactctttacagtagctctgt

SEQ ID NO: 723827 - DNA, 25 bp, Mus musculus
gttagactcttttcagtagctctgt

SEQ ID NO: 723828 - DNA, 25 bp, Mus musculus
gttagactgctgattttcctctaaa

SEQ ID NO: 723829 - DNA, 25 bp, Mus musculus
gttagactgctgtttttcctctaaa

SEQ ID NO: 723830 - DNA, 25 bp, Mus musculus
gttagactgttaactccatgtgaga

SEQ ID NO: 723831 - DNA, 25 bp, Mus musculus
gttagactgttatctccatgtgaga

SEQ ID NO: 723832 - DNA, 25 bp, Mus musculus
gttagactgttgcagacactctctg

SEQ ID NO: 723833 - DNA, 25 bp, Mus musculus
gttagactgttggagacactctctg

SEQ ID NO: 723834 - DNA, 25 bp, Mus musculus
gttagacttcagcaccataatttag

SEQ ID NO: 723835 - DNA, 25 bp, Mus musculus
gttagacttcaggaccataatttag

SEQ ID NO: 723836 - DNA, 25 bp, Mus musculus
gttagacttggcagccagtgttctt

SEQ ID NO: 723837 - DNA, 25 bp, Mus musculus
gttagacttggctgccagtgttctt

SEQ ID NO: 723838 - DNA, 25 bp, Mus musculus
gttagactttcactgatctgtgtgc

SEQ ID NO: 723839 - DNA, 25 bp, Mus musculus
gttagactttcagtgatctgtgtgc

SEQ ID NO: 723840 - DNA, 25 bp, Mus musculus
gttagactttggatagacattatga

SEQ ID NO: 723841 - DNA, 25 bp, Mus musculus
gttagactttggttagacattatga

SEQ ID NO: 723842 - DNA, 25 bp, Mus musculus
gttagacttttcaagtatactccat

SEQ ID NO: 723843 - DNA, 25 bp, Mus musculus
gttagacttttctagtatactccat

SEQ ID NO: 723844 - DNA, 25 bp, Mus musculus
gttagagacccactttacacgagag

SEQ ID NO: 723845 - DNA, 25 bp, Mus musculus
gttagagacccagtttacacgagag

SEQ ID NO: 723846 - DNA, 25 bp, Mus musculus
gttagagactatcctggcctacata

SEQ ID NO: 723847 - DNA, 25 bp, Mus musculus
gttagagactatgctggcctacata

SEQ ID NO: 723848 - DNA, 25 bp, Mus musculus
gttagagactcgctaggtctgtccc

SEQ ID NO: 723849 - DNA, 25 bp, Mus musculus
gttagagactcggtaggtctgtccc

SEQ ID NO: 723850 - DNA, 25 bp, Mus musculus
gttagagagcacatgcaaacaaaaa

SEQ ID NO: 723851 - DNA, 25 bp, Mus musculus
gttagagagcacttgcaaacaaaaa

SEQ ID NO: 723852 - DNA, 25 bp, Mus musculus
gttagagagcttcttctgtgaaaaa

SEQ ID NO: 723853 - DNA, 25 bp, Mus musculus
gttagagagcttgttctgtgaaaaa

SEQ ID NO: 723854 - DNA, 25 bp, Mus musculus
gttagagattacatttgatcccaaa

SEQ ID NO: 723855 - DNA, 25 bp, Mus musculus
gttagagattacttttgatcccaaa

SEQ ID NO: 723856 - DNA, 25 bp, Mus musculus
gttagagatttaatgctgccttgtt

SEQ ID NO: 723857 - DNA, 25 bp, Mus musculus
gttagagatttattgctgccttgtt

SEQ ID NO: 723858 - DNA, 25 bp, Mus musculus
gttagagcactcaactactgtagag

SEQ ID NO: 723859 - DNA, 25 bp, Mus musculus
gttagagcactctactactgtagag

SEQ ID NO: 723860 - DNA, 25 bp, Mus musculus
gttagagcaggcatcttcgcatatt

SEQ ID NO: 723861 - DNA, 25 bp, Mus musculus
gttagagcaggcttcttcgcatatt

SEQ ID NO: 723862 - DNA, 25 bp, Mus musculus
gttagagccacaattaattcctatt

SEQ ID NO: 723863 - DNA, 25 bp, Mus musculus
gttagagccacatttaattcctatt

SEQ ID NO: 723864 - DNA, 25 bp, Mus musculus
gttagagccagtacacatgctggga

SEQ ID NO: 723865 - DNA, 25 bp, Mus musculus
gttagagccagttcacatgctggga

SEQ ID NO: 723866 - DNA, 25 bp, Mus musculus
gttagagccattaagtgcttcctaa

SEQ ID NO: 723867 - DNA, 25 bp, Mus musculus
gttagagccatttagtgcttcctaa

SEQ ID NO: 723868 - DNA, 25 bp, Mus musculus
gttagagcctaccttttgcagtttc

SEQ ID NO: 723869 - DNA, 25 bp, Mus musculus
gttagagcctacgttttgcagtttc

SEQ ID NO: 723870 - DNA, 25 bp, Mus musculus
gttagagctcctcggtcaggaccag

SEQ ID NO: 723871 - DNA, 25 bp, Mus musculus
gttagagctcctgggtcaggaccag

SEQ ID NO: 723872 - DNA, 25 bp, Mus musculus
gttagagctggaccgcataggccct

SEQ ID NO: 723873 - DNA, 25 bp, Mus musculus
gttagagctggagcgcataggccct

SEQ ID NO: 723874 - DNA, 25 bp, Mus musculus
gttagagcttctaactgagtttgta

SEQ ID NO: 723875 - DNA, 25 bp, Mus musculus
gttagagcttcttactgagtttgta

SEQ ID NO: 723876 - DNA, 25 bp, Mus musculus
gttagagctttcagcccttgatact

SEQ ID NO: 723877 - DNA, 25 bp, Mus musculus
gttagagctttctgcccttgatact

SEQ ID NO: 723878 - DNA, 25 bp, Mus musculus
gttagaggaaatacactccctccta

SEQ ID NO: 723879 - DNA, 25 bp, Mus musculus
gttagaggaaattcactccctccta

SEQ ID NO: 723880 - DNA, 25 bp, Mus musculus
gttagaggaagcctgtaagccatgc

SEQ ID NO: 723881 - DNA, 25 bp, Mus musculus
gttagaggaagcgtgtaagccatgc

SEQ ID NO: 723882 - DNA, 25 bp, Mus musculus
gttagaggacagctgccactacctg

SEQ ID NO: 723883 - DNA, 25 bp, Mus musculus
gttagaggacaggtgccactacctg

SEQ ID NO: 723884 - DNA, 25 bp, Mus musculus
gttagaggacgtctgtcaccacaga

SEQ ID NO: 723885 - DNA, 25 bp, Mus musculus
gttagaggacgtgtgtcaccacaga

SEQ ID NO: 723886 - DNA, 25 bp, Mus musculus
gttagaggaggtaccttcttcatct

SEQ ID NO: 723887 - DNA, 25 bp, Mus musculus
gttagaggaggttccttcttcatct

SEQ ID NO: 723888 - DNA, 25 bp, Mus musculus
gttagaggcattcctgactgctcaa

SEQ ID NO: 723889 - DNA, 25 bp, Mus musculus
gttagaggcattgctgactgctcaa

SEQ ID NO: 723890 - DNA, 25 bp, Mus musculus
gttagaggccatccaggtttacata

SEQ ID NO: 723891 - DNA, 25 bp, Mus musculus
gttagaggccatgcaggtttacata

SEQ ID NO: 723892 - DNA, 25 bp, Mus musculus
gttagaggctcacactttagcttga

SEQ ID NO: 723893 - DNA, 25 bp, Mus musculus
gttagaggctcagactttagcttga

SEQ ID NO: 723894 - DNA, 25 bp, Mus musculus
gttagaggcttgacgacgctcatct

SEQ ID NO: 723895 - DNA, 25 bp, Mus musculus
gttagaggcttgtcgacgctcatct

SEQ ID NO: 723896 - DNA, 25 bp, Mus musculus
gttagagggctaccagccagtcaaa

SEQ ID NO: 723897 - DNA, 25 bp, Mus musculus
gttagagggctagcagccagtcaaa

SEQ ID NO: 723898 - DNA, 25 bp, Mus musculus
gttagagggcttcctacacaaacat

SEQ ID NO: 723899 - DNA, 25 bp, Mus musculus
gttagagggcttgctacacaaacat

SEQ ID NO: 723900 - DNA, 25 bp, Mus musculus
gttagaggtattcatcactgtgcaa

SEQ ID NO: 723901 - DNA, 25 bp, Mus musculus
gttagaggtattgatcactgtgcaa

SEQ ID NO: 723902 - DNA, 25 bp, Mus musculus
gttagaggtgtgaacaactgtatca

SEQ ID NO: 723903 - DNA, 25 bp, Mus musculus
gttagaggtgtgtacaactgtatca

SEQ ID NO: 723904 - DNA, 25 bp, Mus musculus
gttagagtaacaaccccagtagagc

SEQ ID NO: 723905 - DNA, 25 bp, Mus musculus
gttagagtaacatccccagtagagc

SEQ ID NO: 723906 - DNA, 25 bp, Mus musculus
gttagagtccagcatcgcagaggct

SEQ ID NO: 723907 - DNA, 25 bp, Mus musculus
gttagagtccaggatcgcagaggct

SEQ ID NO: 723908 - DNA, 25 bp, Mus musculus
gttagagtccccagcatctgtgtaa

SEQ ID NO: 723909 - DNA, 25 bp, Mus musculus
gttagagtcccctgcatctgtgtaa

SEQ ID NO: 723910 - DNA, 25 bp, Mus musculus
gttagagtcctcagaactgggtcta

SEQ ID NO: 723911 - DNA, 25 bp, Mus musculus
gttagagtcctctgaactgggtcta

SEQ ID NO: 723912 - DNA, 25 bp, Mus musculus
gttagagtcgggactcaggctttac

SEQ ID NO: 723913 - DNA, 25 bp, Mus musculus
gttagagtcgggtctcaggctttac

SEQ ID NO: 723914 - DNA, 25 bp, Mus musculus
gttagagtctacagtctggtctcct

SEQ ID NO: 723915 - DNA, 25 bp, Mus musculus
gttagagtctactgtctggtctcct

SEQ ID NO: 723916 - DNA, 25 bp, Mus musculus
gttagagtgaccatggagctttcag

SEQ ID NO: 723917 - DNA, 25 bp, Mus musculus
gttagagtgaccttggagctttcag

SEQ ID NO: 723918 - DNA, 25 bp, Mus musculus
gttagagttatccacaagcctttat

SEQ ID NO: 723919 - DNA, 25 bp, Mus musculus
gttagagttatcgacaagcctttat

SEQ ID NO: 723920 - DNA, 25 bp, Mus musculus
gttagagttttaccggcagttgtgt

SEQ ID NO: 723921 - DNA, 25 bp, Mus musculus
gttagagttttagcggcagttgtgt

SEQ ID NO: 723922 - DNA, 25 bp, Mus musculus
gttagataacggactatgcactagt

SEQ ID NO: 723923 - DNA, 25 bp, Mus musculus
gttagataacggtctatgcactagt

SEQ ID NO: 723924 - DNA, 25 bp, Mus musculus
gttagataatgcagtgccctgtcat

SEQ ID NO: 723925 - DNA, 25 bp, Mus musculus
gttagataatgctgtgccctgtcat

SEQ ID NO: 723926 - DNA, 25 bp, Mus musculus
gttagatacttacttgcctcacaga

SEQ ID NO: 723927 - DNA, 25 bp, Mus musculus
gttagatacttagttgcctcacaga

SEQ ID NO: 723928 - DNA, 25 bp, Mus musculus
gttagataggctcgcccaaagggcc

SEQ ID NO: 723929 - DNA, 25 bp, Mus musculus
gttagataggctggcccaaagggcc

SEQ ID NO: 723930 - DNA, 25 bp, Mus musculus
gttagatatcataatcatgtttgca

SEQ ID NO: 723931 - DNA, 25 bp, Mus musculus
gttagatatcattatcatgtttgca

SEQ ID NO: 723932 - DNA, 25 bp, Mus musculus
gttagatcaactccaaatacacact

SEQ ID NO: 723933 - DNA, 25 bp, Mus musculus
gttagatcaactgcaaatacacact

SEQ ID NO: 723934 - DNA, 25 bp, Mus musculus
gttagatcatgccacttgtagtaaa

SEQ ID NO: 723935 - DNA, 25 bp, Mus musculus
gttagatcatgcgacttgtagtaaa

SEQ ID NO: 723936 - DNA, 25 bp, Mus musculus
gttagatccaatctcttgggcacga

SEQ ID NO: 723937 - DNA, 25 bp, Mus musculus
gttagatccaatgtcttgggcacga

SEQ ID NO: 723938 - DNA, 25 bp, Mus musculus
gttagatcctgaacgcttatgctcc

SEQ ID NO: 723939 - DNA, 25 bp, Mus musculus
gttagatcctgatcgcttatgctcc

SEQ ID NO: 723940 - DNA, 25 bp, Mus musculus
gttagatcctttcagtagtcattgt

SEQ ID NO: 723941 - DNA, 25 bp, Mus musculus
gttagatcctttgagtagtcattgt

SEQ ID NO: 723942 - DNA, 25 bp, Mus musculus
gttagatctatgaaccctcattagg

SEQ ID NO: 723943 - DNA, 25 bp, Mus musculus
gttagatctatgtaccctcattagg

SEQ ID NO: 723944 - DNA, 25 bp, Mus musculus
gttagatgatccattttgttaccaa

SEQ ID NO: 723945 - DNA, 25 bp, Mus musculus
gttagatgatcctttttgttaccaa

SEQ ID NO: 723946 - DNA, 25 bp, Mus musculus
gttagatggtagacctacgatccct

SEQ ID NO: 723947 - DNA, 25 bp, Mus musculus
gttagatggtagtcctacgatccct

SEQ ID NO: 723948 - DNA, 25 bp, Mus musculus
gttagatgtcagaataaagccctta

SEQ ID NO: 723949 - DNA, 25 bp, Mus musculus
gttagatgtcagtataaagccctta

SEQ ID NO: 723950 - DNA, 25 bp, Mus musculus
gttagattactcatctgtccaccaa

SEQ ID NO: 723951 - DNA, 25 bp, Mus musculus
gttagattactcttctgtccaccaa

SEQ ID NO: 723952 - DNA, 25 bp, Mus musculus
gttagatttcccacatcatagagca

SEQ ID NO: 723953 - DNA, 25 bp, Mus musculus
gttagatttccctcatcatagagca

SEQ ID NO: 723954 - DNA, 25 bp, Mus musculus
gttagattttctcggatcccctgaa

SEQ ID NO: 723955 - DNA, 25 bp, Mus musculus
gttagattttctgggatcccctgaa

SEQ ID NO: 723956 - DNA, 25 bp, Mus musculus
gttagcaaaactcttctcacatgga

SEQ ID NO: 723957 - DNA, 25 bp, Mus musculus
gttagcaaaactgttctcacatgga

SEQ ID NO: 723958 - DNA, 25 bp, Mus musculus
gttagcaaacagaagctatcactac

SEQ ID NO: 723959 - DNA, 25 bp, Mus musculus
gttagcaaacagtagctatcactac

SEQ ID NO: 723960 - DNA, 25 bp, Mus musculus
gttagcaaacatactttaccaccaa

SEQ ID NO: 723961 - DNA, 25 bp, Mus musculus
gttagcaaacattctttaccaccaa

SEQ ID NO: 723962 - DNA, 25 bp, Mus musculus
gttagcaaaggtatgctcccaggcc

SEQ ID NO: 723963 - DNA, 25 bp, Mus musculus
gttagcaaaggtttgctcccaggcc

SEQ ID NO: 723964 - DNA, 25 bp, Mus musculus
gttagcaacatactctgccaacttg

SEQ ID NO: 723965 - DNA, 25 bp, Mus musculus
gttagcaacatacttcgtttccctt

SEQ ID NO: 723966 - DNA, 25 bp, Mus musculus
gttagcaacatagtctgccaacttg

SEQ ID NO: 723967 - DNA, 25 bp, Mus musculus
gttagcaacatagttcgtttccctt

SEQ ID NO: 723968 - DNA, 25 bp, Mus musculus
gttagcaagcccctgtttaacatta

SEQ ID NO: 723969 - DNA, 25 bp, Mus musculus
gttagcaagcccgtgtttaacatta

SEQ ID NO: 723970 - DNA, 25 bp, Mus musculus
gttagcaagttccatttccctggag

SEQ ID NO: 723971 - DNA, 25 bp, Mus musculus
gttagcaagttcgatttccctggag

SEQ ID NO: 723972 - DNA, 25 bp, Mus musculus
gttagcaatgcccaagccaggactt

SEQ ID NO: 723973 - DNA, 25 bp, Mus musculus
gttagcaatgccgaagccaggactt

SEQ ID NO: 723974 - DNA, 25 bp, Mus musculus
gttagcaatgctcttctctgggaaa

SEQ ID NO: 723975 - DNA, 25 bp, Mus musculus
gttagcaatgctgttctctgggaaa

SEQ ID NO: 723976 - DNA, 25 bp, Mus musculus
gttagcacaatacctctgacggtca

SEQ ID NO: 723977 - DNA, 25 bp, Mus musculus
gttagcacaatagctctgacggtca

SEQ ID NO: 723978 - DNA, 25 bp, Mus musculus
gttagcacacaacactaggtatcgt

SEQ ID NO: 723979 - DNA, 25 bp, Mus musculus
gttagcacacaagactaggtatcgt

SEQ ID NO: 723980 - DNA, 25 bp, Mus musculus
gttagcacaggaacaccatactttg

SEQ ID NO: 723981 - DNA, 25 bp, Mus musculus
gttagcacaggatcaccatactttg

SEQ ID NO: 723982 - DNA, 25 bp, Mus musculus
gttagcacaggcactgtcagccagt

SEQ ID NO: 723983 - DNA, 25 bp, Mus musculus
gttagcacaggctctgtcagccagt

SEQ ID NO: 723984 - DNA, 25 bp, Mus musculus
gttagcacagttagtatgctcccta

SEQ ID NO: 723985 - DNA, 25 bp, Mus musculus
gttagcacagtttgtatgctcccta

SEQ ID NO: 723986 - DNA, 25 bp, Mus musculus
gttagcacatgaaactcccagagga

SEQ ID NO: 723987 - DNA, 25 bp, Mus musculus
gttagcacatgatactcccagagga

SEQ ID NO: 723988 - DNA, 25 bp, Mus musculus
gttagcacctccaatagattctttc

SEQ ID NO: 723989 - DNA, 25 bp, Mus musculus
gttagcacctcctatagattctttc

SEQ ID NO: 723990 - DNA, 25 bp, Mus musculus
gttagcactaggacatttcgatcat

SEQ ID NO: 723991 - DNA, 25 bp, Mus musculus
gttagcactaggtcatttcgatcat

SEQ ID NO: 723992 - DNA, 25 bp, Mus musculus
gttagcactcccaaagtatcggtag

SEQ ID NO: 723993 - DNA, 25 bp, Mus musculus
gttagcactccctaagtatcggtag

SEQ ID NO: 723994 - DNA, 25 bp, Mus musculus
gttagcactcctaactgcttcaacc

SEQ ID NO: 723995 - DNA, 25 bp, Mus musculus
gttagcactccttactgcttcaacc

SEQ ID NO: 723996 - DNA, 25 bp, Mus musculus
gttagcactgaaatcaacttgacct

SEQ ID NO: 723997 - DNA, 25 bp, Mus musculus
gttagcactgaattcaacttgacct

SEQ ID NO: 723998 - DNA, 25 bp, Mus musculus
gttagcactgcaatatcctcttatt

SEQ ID NO: 723999 - DNA, 25 bp, Mus musculus
gttagcactgcactggcatccagat

SEQ ID NO: 724000 - DNA, 25 bp, Mus musculus
gttagcactgcagtggcatccagat

SEQ ID NO: 724001 - DNA, 25 bp, Mus musculus
gttagcactgcattatcctcttatt

SEQ ID NO: 724002 - DNA, 25 bp, Mus musculus
gttagcactggcacagctttaactg

SEQ ID NO: 724003 - DNA, 25 bp, Mus musculus
gttagcactggctcagctttaactg

SEQ ID NO: 724004 - DNA, 25 bp, Mus musculus
gttagcacttgcaccatagcacatg

SEQ ID NO: 724005 - DNA, 25 bp, Mus musculus
gttagcacttgctccatagcacatg

SEQ ID NO: 724006 - DNA, 25 bp, Mus musculus
gttagcagatttacttcgttgtcaa

SEQ ID NO: 724007 - DNA, 25 bp, Mus musculus
gttagcagattttcttcgttgtcaa

SEQ ID NO: 724008 - DNA, 25 bp, Mus musculus
gttagcagcacaaaggctgatgcca

SEQ ID NO: 724009 - DNA, 25 bp, Mus musculus
gttagcagcacataggctgatgcca

SEQ ID NO: 724010 - DNA, 25 bp, Mus musculus
gttagcagccgcaaccatgacagga

SEQ ID NO: 724011 - DNA, 25 bp, Mus musculus
gttagcagccgctaccatgacagga

SEQ ID NO: 724012 - DNA, 25 bp, Mus musculus
gttagcagctatcgaaacctctttt

SEQ ID NO: 724013 - DNA, 25 bp, Mus musculus
gttagcagctatggaaacctctttt

SEQ ID NO: 724014 - DNA, 25 bp, Mus musculus
gttagcaggcagattcagaaataca

SEQ ID NO: 724015 - DNA, 25 bp, Mus musculus
gttagcaggcagtttcagaaataca

SEQ ID NO: 724016 - DNA, 25 bp, Mus musculus
gttagcagggtcctctcacctggcc

SEQ ID NO: 724017 - DNA, 25 bp, Mus musculus
gttagcagggtcgtctcacctggcc

SEQ ID NO: 724018 - DNA, 25 bp, Mus musculus
gttagcagtgccatacttgtgggtt

SEQ ID NO: 724019 - DNA, 25 bp, Mus musculus
gttagcagtgccttacttgtgggtt

SEQ ID NO: 724020 - DNA, 25 bp, Mus musculus
gttagcagttgcaggttgacccaag

SEQ ID NO: 724021 - DNA, 25 bp, Mus musculus
gttagcagttgctggttgacccaag

SEQ ID NO: 724022 - DNA, 25 bp, Mus musculus
gttagcagttttcatctttgacagt

SEQ ID NO: 724023 - DNA, 25 bp, Mus musculus
gttagcagttttgatctttgacagt

SEQ ID NO: 724024 - DNA, 25 bp, Mus musculus
gttagcatacaaatactgggactca

SEQ ID NO: 724025 - DNA, 25 bp, Mus musculus
gttagcatacaattactgggactca

SEQ ID NO: 724026 - DNA, 25 bp, Mus musculus
gttagcatagtgatgccgcaaccac

SEQ ID NO: 724027 - DNA, 25 bp, Mus musculus
gttagcatagtgttgccgcaaccac

SEQ ID NO: 724028 - DNA, 25 bp, Mus musculus
gttagcatctcacttacacagacgc

SEQ ID NO: 724029 - DNA, 25 bp, Mus musculus
gttagcatctcagttacacagacgc

SEQ ID NO: 724030 - DNA, 25 bp, Mus musculus
gttagcatgtacaattttcaaccag

SEQ ID NO: 724031 - DNA, 25 bp, Mus musculus
gttagcatgtactattttcaaccag

SEQ ID NO: 724032 - DNA, 25 bp, Mus musculus
gttagcattccaattgcatgtagta

SEQ ID NO: 724033 - DNA, 25 bp, Mus musculus
gttagcattccatttgcatgtagta

SEQ ID NO: 724034 - DNA, 25 bp, Mus musculus
gttagcattctgcacttgaactctg

SEQ ID NO: 724035 - DNA, 25 bp, Mus musculus
gttagcattctggacttgaactctg

SEQ ID NO: 724036 - DNA, 25 bp, Mus musculus
gttagcattgacactttgcaatttt

SEQ ID NO: 724037 - DNA, 25 bp, Mus musculus
gttagcattgactctttgcaatttt

SEQ ID NO: 724038 - DNA, 25 bp, Mus musculus
gttagcattggtccagctgaggcaa

SEQ ID NO: 724039 - DNA, 25 bp, Mus musculus
gttagcattggtgcagctgaggcaa

SEQ ID NO: 724040 - DNA, 25 bp, Mus musculus
gttagcatttagaagcatacaacct

SEQ ID NO: 724041 - DNA, 25 bp, Mus musculus
gttagcatttagtagcatacaacct

SEQ ID NO: 724042 - DNA, 25 bp, Mus musculus
gttagcatttccaaggtgacgcctg

SEQ ID NO: 724043 - DNA, 25 bp, Mus musculus
gttagcatttcctaggtgacgcctg

SEQ ID NO: 724044 - DNA, 25 bp, Mus musculus
gttagcatttctaccattctgcatt

SEQ ID NO: 724045 - DNA, 25 bp, Mus musculus
gttagcatttcttccattctgcatt

SEQ ID NO: 724046 - DNA, 25 bp, Mus musculus
gttagcattttaagttgcccctgca

SEQ ID NO: 724047 - DNA, 25 bp, Mus musculus
gttagcattttatgttgcccctgca

SEQ ID NO: 724048 - DNA, 25 bp, Mus musculus
gttagcattttccatgggcatgcgt

SEQ ID NO: 724049 - DNA, 25 bp, Mus musculus
gttagcattttcgatgggcatgcgt

SEQ ID NO: 724050 - DNA, 25 bp, Mus musculus
gttagccaaaggagggcgtctctgc

SEQ ID NO: 724051 - DNA, 25 bp, Mus musculus
gttagccaaaggtgggcgtctctgc

SEQ ID NO: 724052 - DNA, 25 bp, Mus musculus
gttagccaactaaaaggactagcct

SEQ ID NO: 724053 - DNA, 25 bp, Mus musculus
gttagccaactataaggactagcct

SEQ ID NO: 724054 - DNA, 25 bp, Mus musculus
gttagccaaggtccagggtacagct

SEQ ID NO: 724055 - DNA, 25 bp, Mus musculus
gttagccaaggtgcagggtacagct

SEQ ID NO: 724056 - DNA, 25 bp, Mus musculus
gttagccaagtgaaatagcagatca

SEQ ID NO: 724057 - DNA, 25 bp, Mus musculus
gttagccaagtgtaatagcagatca

SEQ ID NO: 724058 - DNA, 25 bp, Mus musculus
gttagccaagttcttcgctccaaaa

SEQ ID NO: 724059 - DNA, 25 bp, Mus musculus
gttagccaagttgttcgctccaaaa

SEQ ID NO: 724060 - DNA, 25 bp, Mus musculus
gttagccacaataacatttccttag

SEQ ID NO: 724061 - DNA, 25 bp, Mus musculus
gttagccacaattacatttccttag

SEQ ID NO: 724062 - DNA, 25 bp, Mus musculus
gttagccacctgatactcattcatt

SEQ ID NO: 724063 - DNA, 25 bp, Mus musculus
gttagccacctgttactcattcatt

SEQ ID NO: 724064 - DNA, 25 bp, Mus musculus
gttagccacgtcatcgtgtgggaca

SEQ ID NO: 724065 - DNA, 25 bp, Mus musculus
gttagccacgtcttcgtgtgggaca

SEQ ID NO: 724066 - DNA, 25 bp, Mus musculus
gttagccactgcagcctgggaggaa

SEQ ID NO: 724067 - DNA, 25 bp, Mus musculus
gttagccactgctgcctgggaggaa

SEQ ID NO: 724068 - DNA, 25 bp, Mus musculus
gttagccacttaccatgaaagcaat

SEQ ID NO: 724069 - DNA, 25 bp, Mus musculus
gttagccacttagcatgaaagcaat

SEQ ID NO: 724070 - DNA, 25 bp, Mus musculus
gttagccagagcacctgtttcagtg

SEQ ID NO: 724071 - DNA, 25 bp, Mus musculus
gttagccagagctcctgtttcagtg

SEQ ID NO: 724072 - DNA, 25 bp, Mus musculus
gttagccagcacaccagtagttaaa

SEQ ID NO: 724073 - DNA, 25 bp, Mus musculus
gttagccagcactccagtagttaaa

SEQ ID NO: 724074 - DNA, 25 bp, Mus musculus
gttagccagttacgatcttgaagac

SEQ ID NO: 724075 - DNA, 25 bp, Mus musculus
gttagccagttaggatcttgaagac

SEQ ID NO: 724076 - DNA, 25 bp, Mus musculus
gttagccagtttaccactgattctt

SEQ ID NO: 724077 - DNA, 25 bp, Mus musculus
gttagccagttttccactgattctt

SEQ ID NO: 724078 - DNA, 25 bp, Mus musculus
gttagccataccacctttagtgaga

SEQ ID NO: 724079 - DNA, 25 bp, Mus musculus
gttagccatacctcctttagtgaga

SEQ ID NO: 724080 - DNA, 25 bp, Mus musculus
gttagccatgacagtgcaggtctct

SEQ ID NO: 724081 - DNA, 25 bp, Mus musculus
gttagccatgactgtgcaggtctct

SEQ ID NO: 724082 - DNA, 25 bp, Mus musculus
gttagccatttacctagatgatctc

SEQ ID NO: 724083 - DNA, 25 bp, Mus musculus
gttagccatttagctagatgatctc

SEQ ID NO: 724084 - DNA, 25 bp, Mus musculus
gttagcccagaaagggatcttgccc

SEQ ID NO: 724085 - DNA, 25 bp, Mus musculus
gttagcccagaatgggatcttgccc

SEQ ID NO: 724086 - DNA, 25 bp, Mus musculus
gttagcccattaagttcattccaat

SEQ ID NO: 724087 - DNA, 25 bp, Mus musculus
gttagcccattatgttcattccaat

SEQ ID NO: 724088 - DNA, 25 bp, Mus musculus
gttagccccatgagtgttgttttat

SEQ ID NO: 724089 - DNA, 25 bp, Mus musculus
gttagccccatgtgtgttgttttat

SEQ ID NO: 724090 - DNA, 25 bp, Mus musculus
gttagcccctgtattttgtgtatga

SEQ ID NO: 724091 - DNA, 25 bp, Mus musculus
gttagcccctgttttttgtgtatga

SEQ ID NO: 724092 - DNA, 25 bp, Mus musculus
gttagccctagtagaagcacctgtg

SEQ ID NO: 724093 - DNA, 25 bp, Mus musculus
gttagccctagttgaagcacctgtg

SEQ ID NO: 724094 - DNA, 25 bp, Mus musculus
gttagccctcagagtcttatttctc

SEQ ID NO: 724095 - DNA, 25 bp, Mus musculus
gttagccctcagtgtcttatttctc

SEQ ID NO: 724096 - DNA, 25 bp, Mus musculus
gttagccctgaaataactcctttga

SEQ ID NO: 724097 - DNA, 25 bp, Mus musculus
gttagccctgaattaactcctttga

SEQ ID NO: 724098 - DNA, 25 bp, Mus musculus
gttagcccttctagctcttgaaaat

SEQ ID NO: 724099 - DNA, 25 bp, Mus musculus
gttagcccttcttgctcttgaaaat

SEQ ID NO: 724100 - DNA, 25 bp, Mus musculus
gttagcccttttccacacatggaaa

SEQ ID NO: 724101 - DNA, 25 bp, Mus musculus
gttagcccttttgcacacatggaaa

SEQ ID NO: 724102 - DNA, 25 bp, Mus musculus
gttagccgctacatctactgtaaga

SEQ ID NO: 724103 - DNA, 25 bp, Mus musculus
gttagccgctacttctactgtaaga

SEQ ID NO: 724104 - DNA, 25 bp, Mus musculus
gttagcctcacactttagttgcttg

SEQ ID NO: 724105 - DNA, 25 bp, Mus musculus
gttagcctcacagtttagttgcttg

SEQ ID NO: 724106 - DNA, 25 bp, Mus musculus
gttagcctcatcaacatagttcgga

SEQ ID NO: 724107 - DNA, 25 bp, Mus musculus
gttagcctcatctacatagttcgga

SEQ ID NO: 724108 - DNA, 25 bp, Mus musculus
gttagcctccaaataaagtctttat

SEQ ID NO: 724109 - DNA, 25 bp, Mus musculus
gttagcctccaattaaagtctttat

SEQ ID NO: 724110 - DNA, 25 bp, Mus musculus
gttagcctgcagcatcccttaagta

SEQ ID NO: 724111 - DNA, 25 bp, Mus musculus
gttagcctgcaggatcccttaagta

SEQ ID NO: 724112 - DNA, 25 bp, Mus musculus
gttagcctggaacgagttagctccc

SEQ ID NO: 724113 - DNA, 25 bp, Mus musculus
gttagcctggaaggagttagctccc

SEQ ID NO: 724114 - DNA, 25 bp, Mus musculus
gttagcctggttcaaagtggaattt

SEQ ID NO: 724115 - DNA, 25 bp, Mus musculus
gttagcctggttgaaagtggaattt

SEQ ID NO: 724116 - DNA, 25 bp, Mus musculus
gttagcctgtagagagagaccctat

SEQ ID NO: 724117 - DNA, 25 bp, Mus musculus
gttagcctgtagtgagagaccctat

SEQ ID NO: 724118 - DNA, 25 bp, Mus musculus
gttagccttaagacactgtgggaac

SEQ ID NO: 724119 - DNA, 25 bp, Mus musculus
gttagccttaagtcactgtgggaac

SEQ ID NO: 724120 - DNA, 25 bp, Mus musculus
gttagccttcgaacaggtactaggt

SEQ ID NO: 724121 - DNA, 25 bp, Mus musculus
gttagccttcgatcaggtactaggt

SEQ ID NO: 724122 - DNA, 25 bp, Mus musculus
gttagccttctgacagccttggcta

SEQ ID NO: 724123 - DNA, 25 bp, Mus musculus
gttagccttctgtcagccttggcta

SEQ ID NO: 724124 - DNA, 25 bp, Mus musculus
gttagccttggtcttagcattttaa

SEQ ID NO: 724125 - DNA, 25 bp, Mus musculus
gttagccttggtgttagcattttaa

SEQ ID NO: 724126 - DNA, 25 bp, Mus musculus
gttagccttgtacatatgtattgaa

SEQ ID NO: 724127 - DNA, 25 bp, Mus musculus
gttagccttgtagatatgtattgaa

SEQ ID NO: 724128 - DNA, 25 bp, Mus musculus
gttagcctttaacagcatcttctgc

SEQ ID NO: 724129 - DNA, 25 bp, Mus musculus
gttagcctttaagagcatcttctgc

SEQ ID NO: 724130 - DNA, 25 bp, Mus musculus
gttagcctttatagtcaacacatca

SEQ ID NO: 724131 - DNA, 25 bp, Mus musculus
gttagcctttattgtcaacacatca

SEQ ID NO: 724132 - DNA, 25 bp, Mus musculus
gttagcctttgcaacgaaccaagct

SEQ ID NO: 724133 - DNA, 25 bp, Mus musculus
gttagcctttgctacgaaccaagct

SEQ ID NO: 724134 - DNA, 25 bp, Mus musculus
gttagcgacagaccatttgaaaaat

SEQ ID NO: 724135 - DNA, 25 bp, Mus musculus
gttagcgacagagcatttgaaaaat

SEQ ID NO: 724136 - DNA, 25 bp, Mus musculus
gttagcgacgttcatggtttggttt

SEQ ID NO: 724137 - DNA, 25 bp, Mus musculus
gttagcgacgttgatggtttggttt

SEQ ID NO: 724138 - DNA, 25 bp, Mus musculus
gttagcgagagaccgcacttgtcag

SEQ ID NO: 724139 - DNA, 25 bp, Mus musculus
gttagcgagagagcgcacttgtcag

SEQ ID NO: 724140 - DNA, 25 bp, Mus musculus
gttagcgccagaactacctgtgatg

SEQ ID NO: 724141 - DNA, 25 bp, Mus musculus
gttagcgccagatctacctgtgatg

SEQ ID NO: 724142 - DNA, 25 bp, Mus musculus
gttagcgctaacactcacgctgtga

SEQ ID NO: 724143 - DNA, 25 bp, Mus musculus
gttagcgctaactctcacgctgtga

SEQ ID NO: 724144 - DNA, 25 bp, Mus musculus
gttagcggagtgcagctgtctcact

SEQ ID NO: 724145 - DNA, 25 bp, Mus musculus
gttagcggagtggagctgtctcact

SEQ ID NO: 724146 - DNA, 25 bp, Mus musculus
gttagcgggattacaactgatgctt

SEQ ID NO: 724147 - DNA, 25 bp, Mus musculus
gttagcgggatttcaactgatgctt

SEQ ID NO: 724148 - DNA, 25 bp, Mus musculus
gttagcgtattgacgacctgtgtct

SEQ ID NO: 724149 - DNA, 25 bp, Mus musculus
gttagcgtattgtcgacctgtgtct

SEQ ID NO: 724150 - DNA, 25 bp, Mus musculus
gttagcgttggaacaatggctccag

SEQ ID NO: 724151 - DNA, 25 bp, Mus musculus
gttagcgttggatcaatggctccag

SEQ ID NO: 724152 - DNA, 25 bp, Mus musculus
gttagctactcaaaaaggcattcca

SEQ ID NO: 724153 - DNA, 25 bp, Mus musculus
gttagctactcataaaggcattcca

SEQ ID NO: 724154 - DNA, 25 bp, Mus musculus
gttagctacttgatagtcccctgaa

SEQ ID NO: 724155 - DNA, 25 bp, Mus musculus
gttagctacttgttagtcccctgaa

SEQ ID NO: 724156 - DNA, 25 bp, Mus musculus
gttagctagaacagtaactgagcca

SEQ ID NO: 724157 - DNA, 25 bp, Mus musculus
gttagctagaactgtaactgagcca

SEQ ID NO: 724158 - DNA, 25 bp, Mus musculus
gttagctagactattgttacctgga

SEQ ID NO: 724159 - DNA, 25 bp, Mus musculus
gttagctagacttttgttacctgga

SEQ ID NO: 724160 - DNA, 25 bp, Mus musculus
gttagctagattacatcactactca

SEQ ID NO: 724161 - DNA, 25 bp, Mus musculus
gttagctagatttcatcactactca

SEQ ID NO: 724162 - DNA, 25 bp, Mus musculus
gttagctagcatctttggccttatc

SEQ ID NO: 724163 - DNA, 25 bp, Mus musculus
gttagctagcatgtttggccttatc

SEQ ID NO: 724164 - DNA, 25 bp, Mus musculus
gttagctatcaccagcattcagaga

SEQ ID NO: 724165 - DNA, 25 bp, Mus musculus
gttagctatcacgagcattcagaga

SEQ ID NO: 724166 - DNA, 25 bp, Mus musculus
gttagctatttaaagaaagcttcga

SEQ ID NO: 724167 - DNA, 25 bp, Mus musculus
gttagctatttatagaaagcttcga

SEQ ID NO: 724168 - DNA, 25 bp, Mus musculus
gttagctcaaggctcagctttctat

SEQ ID NO: 724169 - DNA, 25 bp, Mus musculus
gttagctcaagggtcagctttctat

SEQ ID NO: 724170 - DNA, 25 bp, Mus musculus
gttagctcactgagtggatcctaca

SEQ ID NO: 724171 - DNA, 25 bp, Mus musculus
gttagctcactgtgtggatcctaca

SEQ ID NO: 724172 - DNA, 25 bp, Mus musculus
gttagctcagcacggaatgtaggat

SEQ ID NO: 724173 - DNA, 25 bp, Mus musculus
gttagctcagcagggaatgtaggat

SEQ ID NO: 724174 - DNA, 25 bp, Mus musculus
gttagctccttaccgcagtaactca

SEQ ID NO: 724175 - DNA, 25 bp, Mus musculus
gttagctccttagcgcagtaactca

SEQ ID NO: 724176 - DNA, 25 bp, Mus musculus
gttagctcctttcgttagcatgcca

SEQ ID NO: 724177 - DNA, 25 bp, Mus musculus
gttagctcctttggttagcatgcca

SEQ ID NO: 724178 - DNA, 25 bp, Mus musculus
gttagctctcttacacactatttta

SEQ ID NO: 724179 - DNA, 25 bp, Mus musculus
gttagctctctttcacactatttta

SEQ ID NO: 724180 - DNA, 25 bp, Mus musculus
gttagctctggtcggcccagatgct

SEQ ID NO: 724181 - DNA, 25 bp, Mus musculus
gttagctctggtgggcccagatgct

SEQ ID NO: 724182 - DNA, 25 bp, Mus musculus
gttagctctgtgaaaacaacctggc

SEQ ID NO: 724183 - DNA, 25 bp, Mus musculus
gttagctctgtgtaaacaacctggc

SEQ ID NO: 724184 - DNA, 25 bp, Mus musculus
gttagctgaccaaatggtggcacga

SEQ ID NO: 724185 - DNA, 25 bp, Mus musculus
gttagctgaccatatggtggcacga

SEQ ID NO: 724186 - DNA, 25 bp, Mus musculus
gttagctgaggtataaccatgccat

SEQ ID NO: 724187 - DNA, 25 bp, Mus musculus
gttagctgaggtttaaccatgccat

SEQ ID NO: 724188 - DNA, 25 bp, Mus musculus
gttagctgatgaattccctcaaatg

SEQ ID NO: 724189 - DNA, 25 bp, Mus musculus
gttagctgatgatttccctcaaatg

SEQ ID NO: 724190 - DNA, 25 bp, Mus musculus
gttagctgcagccaacctgagtgtt

SEQ ID NO: 724191 - DNA, 25 bp, Mus musculus
gttagctgcagcgaacctgagtgtt

SEQ ID NO: 724192 - DNA, 25 bp, Mus musculus
gttagctgcatacaattctcgatta

SEQ ID NO: 724193 - DNA, 25 bp, Mus musculus
gttagctgcatagaattctcgatta

SEQ ID NO: 724194 - DNA, 25 bp, Mus musculus
gttagctgccagacaaagggttcga

SEQ ID NO: 724195 - DNA, 25 bp, Mus musculus
gttagctgccagtcaaagggttcga

SEQ ID NO: 724196 - DNA, 25 bp, Mus musculus
gttagctgccataactcagaacact

SEQ ID NO: 724197 - DNA, 25 bp, Mus musculus
gttagctgccattactcagaacact

SEQ ID NO: 724198 - DNA, 25 bp, Mus musculus
gttagctgccttagctgaagcttct

SEQ ID NO: 724199 - DNA, 25 bp, Mus musculus
gttagctgcctttgctgaagcttct

SEQ ID NO: 724200 - DNA, 25 bp, Mus musculus
gttagctggaacagacacccaaaat

SEQ ID NO: 724201 - DNA, 25 bp, Mus musculus
gttagctggaactgacacccaaaat

SEQ ID NO: 724202 - DNA, 25 bp, Mus musculus
gttagcttaacacttgtatagaaaa

SEQ ID NO: 724203 - DNA, 25 bp, Mus musculus
gttagcttaacagttgtatagaaaa

SEQ ID NO: 724204 - DNA, 25 bp, Mus musculus
gttagcttacagacccatggaatgt

SEQ ID NO: 724205 - DNA, 25 bp, Mus musculus
gttagcttacagtcccatggaatgt

SEQ ID NO: 724206 - DNA, 25 bp, Mus musculus
gttagcttagctcttttcctttata

SEQ ID NO: 724207 - DNA, 25 bp, Mus musculus
gttagcttagctgttttcctttata

SEQ ID NO: 724208 - DNA, 25 bp, Mus musculus
gttagcttataaacatcaccgtgtg

SEQ ID NO: 724209 - DNA, 25 bp, Mus musculus
gttagcttataatcatcaccgtgtg

SEQ ID NO: 724210 - DNA, 25 bp, Mus musculus
gttagcttatggcagcaacctcaca

SEQ ID NO: 724211 - DNA, 25 bp, Mus musculus
gttagcttatgggagcaacctcaca

SEQ ID NO: 724212 - DNA, 25 bp, Mus musculus
gttagcttcatgaccccaaggttaa

SEQ ID NO: 724213 - DNA, 25 bp, Mus musculus
gttagcttcatgtccccaaggttaa

SEQ ID NO: 724214 - DNA, 25 bp, Mus musculus
gttagcttctaacctgtctggagta

SEQ ID NO: 724215 - DNA, 25 bp, Mus musculus
gttagcttctaagctgtctggagta

SEQ ID NO: 724216 - DNA, 25 bp, Mus musculus
gttagcttctgacatcaggcccatt

SEQ ID NO: 724217 - DNA, 25 bp, Mus musculus
gttagcttctgagatcaggcccatt

SEQ ID NO: 724218 - DNA, 25 bp, Mus musculus
gttagcttctggaactaccttattc

SEQ ID NO: 724219 - DNA, 25 bp, Mus musculus
gttagcttctggtactaccttattc

SEQ ID NO: 724220 - DNA, 25 bp, Mus musculus
gttagcttcttcacgcccaggaagg

SEQ ID NO: 724221 - DNA, 25 bp, Mus musculus
gttagcttcttctcgcccaggaagg

SEQ ID NO: 724222 - DNA, 25 bp, Mus musculus
gttagcttgagtagatgttgagaat

SEQ ID NO: 724223 - DNA, 25 bp, Mus musculus
gttagcttgagttgatgttgagaat

SEQ ID NO: 724224 - DNA, 25 bp, Mus musculus
gttagcttggaacctggtcagctct

SEQ ID NO: 724225 - DNA, 25 bp, Mus musculus
gttagcttggaagctggtcagctct

SEQ ID NO: 724226 - DNA, 25 bp, Mus musculus
gttagcttggttactgacattgttc

SEQ ID NO: 724227 - DNA, 25 bp, Mus musculus
gttagcttggtttctgacattgttc

SEQ ID NO: 724228 - DNA, 25 bp, Mus musculus
gttagcttgtttagcccagatttca

SEQ ID NO: 724229 - DNA, 25 bp, Mus musculus
gttagcttgttttgcccagatttca

SEQ ID NO: 724230 - DNA, 25 bp, Mus musculus
gttagctttaagacatctctacatg

SEQ ID NO: 724231 - DNA, 25 bp, Mus musculus
gttagctttaagtcatctctacatg

SEQ ID NO: 724232 - DNA, 25 bp, Mus musculus
gttagctttacaatggtggtgccat

SEQ ID NO: 724233 - DNA, 25 bp, Mus musculus
gttagctttacattggtggtgccat

SEQ ID NO: 724234 - DNA, 25 bp, Mus musculus
gttagctttccactttgtattcatt

SEQ ID NO: 724235 - DNA, 25 bp, Mus musculus
gttagctttccagtttgtattcatt

SEQ ID NO: 724236 - DNA, 25 bp, Mus musculus
gttagctttctacttcatgtctcaa

SEQ ID NO: 724237 - DNA, 25 bp, Mus musculus
gttagctttctagttcatgtctcaa

SEQ ID NO: 724238 - DNA, 25 bp, Mus musculus
gttagctttgtactgtcagtccagg

SEQ ID NO: 724239 - DNA, 25 bp, Mus musculus
gttagctttgtagtgtcagtccagg

SEQ ID NO: 724240 - DNA, 25 bp, Mus musculus
gttagctttgtcattcgtagtggca

SEQ ID NO: 724241 - DNA, 25 bp, Mus musculus
gttagctttgtctttcgtagtggca

SEQ ID NO: 724242 - DNA, 25 bp, Mus musculus
gttagctttttaccattcagtgcaa

SEQ ID NO: 724243 - DNA, 25 bp, Mus musculus
gttagctttttagcattcagtgcaa

SEQ ID NO: 724244 - DNA, 25 bp, Mus musculus
gttagctttttcactagaggaccac

SEQ ID NO: 724245 - DNA, 25 bp, Mus musculus
gttagctttttctctagaggaccac

SEQ ID NO: 724246 - DNA, 25 bp, Mus musculus
gttaggaaatcacttggctctcaga

SEQ ID NO: 724247 - DNA, 25 bp, Mus musculus
gttaggaaatcagttggctctcaga

SEQ ID NO: 724248 - DNA, 25 bp, Mus musculus
gttaggaactccataagggatctag

SEQ ID NO: 724249 - DNA, 25 bp, Mus musculus
gttaggaactccttaagggatctag

SEQ ID NO: 724250 - DNA, 25 bp, Mus musculus
gttaggaatctcatcactcagaatc

SEQ ID NO: 724251 - DNA, 25 bp, Mus musculus
gttaggaatctcttcactcagaatc

SEQ ID NO: 724252 - DNA, 25 bp, Mus musculus
gttaggaatgaactatggccttcga

SEQ ID NO: 724253 - DNA, 25 bp, Mus musculus
gttaggaatgaagtatggccttcga

SEQ ID NO: 724254 - DNA, 25 bp, Mus musculus
gttaggaattgcatggacactgact

SEQ ID NO: 724255 - DNA, 25 bp, Mus musculus
gttaggaattgcttggacactgact

SEQ ID NO: 724256 - DNA, 25 bp, Mus musculus
gttaggacaattaatcacccacaga

SEQ ID NO: 724257 - DNA, 25 bp, Mus musculus
gttaggacaatttatcacccacaga

SEQ ID NO: 724258 - DNA, 25 bp, Mus musculus
gttaggaccaacagcaagttaatgt

SEQ ID NO: 724259 - DNA, 25 bp, Mus musculus
gttaggaccaactgcaagttaatgt

SEQ ID NO: 724260 - DNA, 25 bp, Mus musculus
gttaggaccattaaggaccttgcct

SEQ ID NO: 724261 - DNA, 25 bp, Mus musculus
gttaggaccattactgccagaggag

SEQ ID NO: 724262 - DNA, 25 bp, Mus musculus
gttaggaccatttaggaccttgcct

SEQ ID NO: 724263 - DNA, 25 bp, Mus musculus
gttaggaccatttctgccagaggag

SEQ ID NO: 724264 - DNA, 25 bp, Mus musculus
gttaggactcagcaatttcacattt

SEQ ID NO: 724265 - DNA, 25 bp, Mus musculus
gttaggactcaggaatttcacattt

SEQ ID NO: 724266 - DNA, 25 bp, Mus musculus
gttaggactcttacattgggtcagt

SEQ ID NO: 724267 - DNA, 25 bp, Mus musculus
gttaggactctttcattgggtcagt

SEQ ID NO: 724268 - DNA, 25 bp, Mus musculus
gttaggagacgcagcaagccgttaa

SEQ ID NO: 724269 - DNA, 25 bp, Mus musculus
gttaggagacgctgcaagccgttaa

SEQ ID NO: 724270 - DNA, 25 bp, Mus musculus
gttaggagatccacacgaccatggt

SEQ ID NO: 724271 - DNA, 25 bp, Mus musculus
gttaggagatcctcacgaccatggt

SEQ ID NO: 724272 - DNA, 25 bp, Mus musculus
gttaggagatgccactgagaccagt

SEQ ID NO: 724273 - DNA, 25 bp, Mus musculus
gttaggagatgcgactgagaccagt

SEQ ID NO: 724274 - DNA, 25 bp, Mus musculus
gttaggagcacgactactcttccag

SEQ ID NO: 724275 - DNA, 25 bp, Mus musculus
gttaggagcacgtctactcttccag

SEQ ID NO: 724276 - DNA, 25 bp, Mus musculus
gttaggagctaaattctaggccagt

SEQ ID NO: 724277 - DNA, 25 bp, Mus musculus
gttaggagctaatttctaggccagt

SEQ ID NO: 724278 - DNA, 25 bp, Mus musculus
gttaggaggaccagagcctgtctca

SEQ ID NO: 724279 - DNA, 25 bp, Mus musculus
gttaggaggacctgagcctgtctca

SEQ ID NO: 724280 - DNA, 25 bp, Mus musculus
gttaggaggccacagcagtcagtca

SEQ ID NO: 724281 - DNA, 25 bp, Mus musculus
gttaggaggccagagcagtcagtca

SEQ ID NO: 724282 - DNA, 25 bp, Mus musculus
gttaggataacaagtgactctgatt

SEQ ID NO: 724283 - DNA, 25 bp, Mus musculus
gttaggataacatgtgactctgatt

SEQ ID NO: 724284 - DNA, 25 bp, Mus musculus
gttaggatatttctgctttacccag

SEQ ID NO: 724285 - DNA, 25 bp, Mus musculus
gttaggatatttgtgctttacccag

SEQ ID NO: 724286 - DNA, 25 bp, Mus musculus
gttaggatgtaaaactcagccccat

SEQ ID NO: 724287 - DNA, 25 bp, Mus musculus
gttaggatgtaatactcagccccat

SEQ ID NO: 724288 - DNA, 25 bp, Mus musculus
gttaggatgtatccactctgtggtt

SEQ ID NO: 724289 - DNA, 25 bp, Mus musculus
gttaggatgtatgcactctgtggtt

SEQ ID NO: 724290 - DNA, 25 bp, Mus musculus
gttaggcaacttcattgtacgtcag

SEQ ID NO: 724291 - DNA, 25 bp, Mus musculus
gttaggcaacttgattgtacgtcag

SEQ ID NO: 724292 - DNA, 25 bp, Mus musculus
gttaggcaatcaatcagtctatcac

SEQ ID NO: 724293 - DNA, 25 bp, Mus musculus
gttaggcaatcattcagtctatcac

SEQ ID NO: 724294 - DNA, 25 bp, Mus musculus
gttaggcacagaatccttgaggctg

SEQ ID NO: 724295 - DNA, 25 bp, Mus musculus
gttaggcacagattccttgaggctg

SEQ ID NO: 724296 - DNA, 25 bp, Mus musculus
gttaggcagacactacagtgacaaa

SEQ ID NO: 724297 - DNA, 25 bp, Mus musculus
gttaggcagacagtacagtgacaaa

SEQ ID NO: 724298 - DNA, 25 bp, Mus musculus
gttaggcaggcacttgggcctaatt

SEQ ID NO: 724299 - DNA, 25 bp, Mus musculus
gttaggcaggcagttgggcctaatt

SEQ ID NO: 724300 - DNA, 25 bp, Mus musculus
gttaggcaggccctctcccgttgag

SEQ ID NO: 724301 - DNA, 25 bp, Mus musculus
gttaggcaggccgtctcccgttgag

SEQ ID NO: 724302 - DNA, 25 bp, Mus musculus
gttaggcatgtgcaacaccaaacag

SEQ ID NO: 724303 - DNA, 25 bp, Mus musculus
gttaggcatgtggaacaccaaacag

SEQ ID NO: 724304 - DNA, 25 bp, Mus musculus
gttaggcattccaatcatccaagat

SEQ ID NO: 724305 - DNA, 25 bp, Mus musculus
gttaggcattcctatcatccaagat

SEQ ID NO: 724306 - DNA, 25 bp, Mus musculus
gttaggccacacagcatggtaagtc

SEQ ID NO: 724307 - DNA, 25 bp, Mus musculus
gttaggccacactgcatggtaagtc

SEQ ID NO: 724308 - DNA, 25 bp, Mus musculus
gttaggccacagatgatactgctat

SEQ ID NO: 724309 - DNA, 25 bp, Mus musculus
gttaggccacagttgatactgctat

SEQ ID NO: 724310 - DNA, 25 bp, Mus musculus
gttaggccacccacaagaatgaagt

SEQ ID NO: 724311 - DNA, 25 bp, Mus musculus
gttaggccaccctcaagaatgaagt

SEQ ID NO: 724312 - DNA, 25 bp, Mus musculus
gttaggccctccaccagtaaatcat

SEQ ID NO: 724313 - DNA, 25 bp, Mus musculus
gttaggccctcctccagtaaatcat

SEQ ID NO: 724314 - DNA, 25 bp, Mus musculus
gttaggctaatcattcggcacactc

SEQ ID NO: 724315 - DNA, 25 bp, Mus musculus
gttaggctaatctttcggcacactc

SEQ ID NO: 724316 - DNA, 25 bp, Mus musculus
gttaggctagtcaccaacctagttg

SEQ ID NO: 724317 - DNA, 25 bp, Mus musculus
gttaggctagtctccaacctagttg

SEQ ID NO: 724318 - DNA, 25 bp, Mus musculus
gttaggctcattctgttcatgtggc

SEQ ID NO: 724319 - DNA, 25 bp, Mus musculus
gttaggctcattgtgttcatgtggc

SEQ ID NO: 724320 - DNA, 25 bp, Mus musculus
gttaggctccagattaagttcagaa

SEQ ID NO: 724321 - DNA, 25 bp, Mus musculus
gttaggctccagtttaagttcagaa

SEQ ID NO: 724322 - DNA, 25 bp, Mus musculus
gttaggctctagatagaccccttgg

SEQ ID NO: 724323 - DNA, 25 bp, Mus musculus
gttaggctctagttagaccccttgg

SEQ ID NO: 724324 - DNA, 25 bp, Mus musculus
gttaggctggtaaccaacaagcttg

SEQ ID NO: 724325 - DNA, 25 bp, Mus musculus
gttaggctggtatccaacaagcttg

SEQ ID NO: 724326 - DNA, 25 bp, Mus musculus
gttaggcttcagcagggagggaggt

SEQ ID NO: 724327 - DNA, 25 bp, Mus musculus
gttaggcttcaggagggagggaggt

SEQ ID NO: 724328 - DNA, 25 bp, Mus musculus
gttaggcttggaagagcaatctgtt

SEQ ID NO: 724329 - DNA, 25 bp, Mus musculus
gttaggcttggatgagcaatctgtt

SEQ ID NO: 724330 - DNA, 25 bp, Mus musculus
gttaggcttgtgacaactgtttgga

SEQ ID NO: 724331 - DNA, 25 bp, Mus musculus
gttaggcttgtgtcaactgtttgga

SEQ ID NO: 724332 - DNA, 25 bp, Mus musculus
gttagggaacttctctgagtaccac

SEQ ID NO: 724333 - DNA, 25 bp, Mus musculus
gttagggaacttgtctgagtaccac

SEQ ID NO: 724334 - DNA, 25 bp, Mus musculus
gttagggaatccctctggacagacg

SEQ ID NO: 724335 - DNA, 25 bp, Mus musculus
gttagggaatccgtctggacagacg

SEQ ID NO: 724336 - DNA, 25 bp, Mus musculus
gttagggaccacctcagaggctcaa

SEQ ID NO: 724337 - DNA, 25 bp, Mus musculus
gttagggaccacgtcagaggctcaa

SEQ ID NO: 724338 - DNA, 25 bp, Mus musculus
gttagggacctaagaagatctctca

SEQ ID NO: 724339 - DNA, 25 bp, Mus musculus
gttagggacctatgaagatctctca

SEQ ID NO: 724340 - DNA, 25 bp, Mus musculus
gttagggactcaactgtgcttgtaa

SEQ ID NO: 724341 - DNA, 25 bp, Mus musculus
gttagggactcatctgtgcttgtaa

SEQ ID NO: 724342 - DNA, 25 bp, Mus musculus
gttagggacttccttgattatgcaa

SEQ ID NO: 724343 - DNA, 25 bp, Mus musculus
gttagggacttcgttgattatgcaa

SEQ ID NO: 724344 - DNA, 25 bp, Mus musculus
gttagggataggcttgccatccttg

SEQ ID NO: 724345 - DNA, 25 bp, Mus musculus
gttagggatagggttgccatccttg

SEQ ID NO: 724346 - DNA, 25 bp, Mus musculus
gttagggatctgctatatttctcaa

SEQ ID NO: 724347 - DNA, 25 bp, Mus musculus
gttagggatctggtatatttctcaa

SEQ ID NO: 724348 - DNA, 25 bp, Mus musculus
gttagggatgctactctagtcccac

SEQ ID NO: 724349 - DNA, 25 bp, Mus musculus
gttagggatgcttctctagtcccac

SEQ ID NO: 724350 - DNA, 25 bp, Mus musculus
gttagggcaaggaacctgccattca

SEQ ID NO: 724351 - DNA, 25 bp, Mus musculus
gttagggcaaggtacctgccattca

SEQ ID NO: 724352 - DNA, 25 bp, Mus musculus
gttagggcacctatgtagtcctgga

SEQ ID NO: 724353 - DNA, 25 bp, Mus musculus
gttagggcacctttgtagtcctgga

SEQ ID NO: 724354 - DNA, 25 bp, Mus musculus
gttagggcactaacttgcctttcaa

SEQ ID NO: 724355 - DNA, 25 bp, Mus musculus
gttagggcactatcttgcctttcaa

SEQ ID NO: 724356 - DNA, 25 bp, Mus musculus
gttagggccacacaaccattgtagt

SEQ ID NO: 724357 - DNA, 25 bp, Mus musculus
gttagggccacagaaccattgtagt

SEQ ID NO: 724358 - DNA, 25 bp, Mus musculus
gttagggtagcaccgatgttagtaa

SEQ ID NO: 724359 - DNA, 25 bp, Mus musculus
gttagggtagcagcgatgttagtaa

SEQ ID NO: 724360 - DNA, 25 bp, Mus musculus
gttagggtcactaccagagtcagca

SEQ ID NO: 724361 - DNA, 25 bp, Mus musculus
gttagggtcacttccagagtcagca

SEQ ID NO: 724362 - DNA, 25 bp, Mus musculus
gttagggtcctaccacacatgtctg

SEQ ID NO: 724363 - DNA, 25 bp, Mus musculus
gttagggtcctagcacacatgtctg

SEQ ID NO: 724364 - DNA, 25 bp, Mus musculus
gttagggtcttaaggtcaggcctca

SEQ ID NO: 724365 - DNA, 25 bp, Mus musculus
gttagggtcttatggtcaggcctca

SEQ ID NO: 724366 - DNA, 25 bp, Mus musculus
gttagggtgctcagttaacagaaac

SEQ ID NO: 724367 - DNA, 25 bp, Mus musculus
gttagggtgctctgttaacagaaac

SEQ ID NO: 724368 - DNA, 25 bp, Mus musculus
gttagggtgggcacatccactctgc

SEQ ID NO: 724369 - DNA, 25 bp, Mus musculus
gttagggtgggctcatccactctgc

SEQ ID NO: 724370 - DNA, 25 bp, Mus musculus
gttagggtttctcttactgtagtga

SEQ ID NO: 724371 - DNA, 25 bp, Mus musculus
gttagggtttctgttactgtagtga

SEQ ID NO: 724372 - DNA, 25 bp, Mus musculus
gttaggtaatatccttcccatcaca

SEQ ID NO: 724373 - DNA, 25 bp, Mus musculus
gttaggtaatatgcttcccatcaca

SEQ ID NO: 724374 - DNA, 25 bp, Mus musculus
gttaggtactggatagactacttca

SEQ ID NO: 724375 - DNA, 25 bp, Mus musculus
gttaggtactggttagactacttca

SEQ ID NO: 724376 - DNA, 25 bp, Mus musculus
gttaggtagctcaaaatcgcatgaa

SEQ ID NO: 724377 - DNA, 25 bp, Mus musculus
gttaggtagctctaaatcgcatgaa

SEQ ID NO: 724378 - DNA, 25 bp, Mus musculus
gttaggtaggctccttgccactcaa

SEQ ID NO: 724379 - DNA, 25 bp, Mus musculus
gttaggtaggctgcttgccactcaa

SEQ ID NO: 724380 - DNA, 25 bp, Mus musculus
gttaggtcactcagggtaacccata

SEQ ID NO: 724381 - DNA, 25 bp, Mus musculus
gttaggtcactctgggtaacccata

SEQ ID NO: 724382 - DNA, 25 bp, Mus musculus
gttaggtccaaccatgtgttttagg

SEQ ID NO: 724383 - DNA, 25 bp, Mus musculus
gttaggtccaacgatgtgttttagg

SEQ ID NO: 724384 - DNA, 25 bp, Mus musculus
gttaggtctcaaaccaagagcttag

SEQ ID NO: 724385 - DNA, 25 bp, Mus musculus
gttaggtctcaatccaagagcttag

SEQ ID NO: 724386 - DNA, 25 bp, Mus musculus
gttaggtctgaccaagtttgaggcc

SEQ ID NO: 724387 - DNA, 25 bp, Mus musculus
gttaggtctgacctaacttctccac

SEQ ID NO: 724388 - DNA, 25 bp, Mus musculus
gttaggtctgacgaagtttgaggcc

SEQ ID NO: 724389 - DNA, 25 bp, Mus musculus
gttaggtctgacgtaacttctccac

SEQ ID NO: 724390 - DNA, 25 bp, Mus musculus
gttaggtctgttatcttgagcttac

SEQ ID NO: 724391 - DNA, 25 bp, Mus musculus
gttaggtctgttttcttgagcttac

SEQ ID NO: 724392 - DNA, 25 bp, Mus musculus
gttaggtgatgcagtccggtgactc

SEQ ID NO: 724393 - DNA, 25 bp, Mus musculus
gttaggtgatgctgtccggtgactc

SEQ ID NO: 724394 - DNA, 25 bp, Mus musculus
gttaggtgcttcaccactatcagga

SEQ ID NO: 724395 - DNA, 25 bp, Mus musculus
gttaggtgcttctccactatcagga

SEQ ID NO: 724396 - DNA, 25 bp, Mus musculus
gttaggtgctttagctctctgatca

SEQ ID NO: 724397 - DNA, 25 bp, Mus musculus
gttaggtgcttttgctctctgatca

SEQ ID NO: 724398 - DNA, 25 bp, Mus musculus
gttaggtggagtcagatccttctct

SEQ ID NO: 724399 - DNA, 25 bp, Mus musculus
gttaggtggagtgagatccttctct

SEQ ID NO: 724400 - DNA, 25 bp, Mus musculus
gttaggtgtatgacttatggcatct

SEQ ID NO: 724401 - DNA, 25 bp, Mus musculus
gttaggtgtatgtcttatggcatct

SEQ ID NO: 724402 - DNA, 25 bp, Mus musculus
gttaggtgtctcaaggaatgcagct

SEQ ID NO: 724403 - DNA, 25 bp, Mus musculus
gttaggtgtctctaggaatgcagct

SEQ ID NO: 724404 - DNA, 25 bp, Mus musculus
gttaggtgtgatcgcgtcttaccca

SEQ ID NO: 724405 - DNA, 25 bp, Mus musculus
gttaggtgtgatggcgtcttaccca

SEQ ID NO: 724406 - DNA, 25 bp, Mus musculus
gttaggtgtgggattcttgctttcg

SEQ ID NO: 724407 - DNA, 25 bp, Mus musculus
gttaggtgtgggtttcttgctttcg

SEQ ID NO: 724408 - DNA, 25 bp, Mus musculus
gttaggtgttagagtcatccccttc

SEQ ID NO: 724409 - DNA, 25 bp, Mus musculus
gttaggtgttagtgtcatccccttc

SEQ ID NO: 724410 - DNA, 25 bp, Mus musculus
gttaggtgtttaaaaatctcatcgt

SEQ ID NO: 724411 - DNA, 25 bp, Mus musculus
gttaggtgtttataaatctcatcgt

SEQ ID NO: 724412 - DNA, 25 bp, Mus musculus
gttaggttaactagtcgccagactt

SEQ ID NO: 724413 - DNA, 25 bp, Mus musculus
gttaggttaacttgtcgccagactt

SEQ ID NO: 724414 - DNA, 25 bp, Mus musculus
gttaggttaggactgactacccaat

SEQ ID NO: 724415 - DNA, 25 bp, Mus musculus
gttaggttaggagtgactacccaat

SEQ ID NO: 724416 - DNA, 25 bp, Mus musculus
gttaggttcaccagtccccaacgat

SEQ ID NO: 724417 - DNA, 25 bp, Mus musculus
gttaggttcacctgtccccaacgat

SEQ ID NO: 724418 - DNA, 25 bp, Mus musculus
gttaggttcggtcccttacagcaaa

SEQ ID NO: 724419 - DNA, 25 bp, Mus musculus
gttaggttcggtgccttacagcaaa

SEQ ID NO: 724420 - DNA, 25 bp, Mus musculus
gttaggttctgtcaactgccaccaa

SEQ ID NO: 724421 - DNA, 25 bp, Mus musculus
gttaggttctgtgaactgccaccaa

SEQ ID NO: 724422 - DNA, 25 bp, Mus musculus
gttaggttgaacatgatactgaata

SEQ ID NO: 724423 - DNA, 25 bp, Mus musculus
gttaggttgaacttgatactgaata

SEQ ID NO: 724424 - DNA, 25 bp, Mus musculus
gttaggttggacacagggcagttta

SEQ ID NO: 724425 - DNA, 25 bp, Mus musculus
gttaggttggactcagggcagttta

SEQ ID NO: 724426 - DNA, 25 bp, Mus musculus
gttaggttgttcagtagactggcaa

SEQ ID NO: 724427 - DNA, 25 bp, Mus musculus
gttaggttgttctgtagactggcaa

SEQ ID NO: 724428 - DNA, 25 bp, Mus musculus
gttagtaaaagtctttgttctccat

SEQ ID NO: 724429 - DNA, 25 bp, Mus musculus
gttagtaaaagtgtttgttctccat

SEQ ID NO: 724430 - DNA, 25 bp, Mus musculus
gttagtaacacgcatctttgaggag

SEQ ID NO: 724431 - DNA, 25 bp, Mus musculus
gttagtaacacggatctttgaggag

SEQ ID NO: 724432 - DNA, 25 bp, Mus musculus
gttagtaaccctacacatctaattg

SEQ ID NO: 724433 - DNA, 25 bp, Mus musculus
gttagtaacccttcacatctaattg

SEQ ID NO: 724434 - DNA, 25 bp, Mus musculus
gttagtaagtttcaaccctgaatgc

SEQ ID NO: 724435 - DNA, 25 bp, Mus musculus
gttagtaagtttgaaccctgaatgc

SEQ ID NO: 724436 - DNA, 25 bp, Mus musculus
gttagtaatgaaacctcacattcct

SEQ ID NO: 724437 - DNA, 25 bp, Mus musculus
gttagtaatgaatcctcacattcct

SEQ ID NO: 724438 - DNA, 25 bp, Mus musculus
gttagtaatgctctaggtacctgct

SEQ ID NO: 724439 - DNA, 25 bp, Mus musculus
gttagtaatgctgtaggtacctgct

SEQ ID NO: 724440 - DNA, 25 bp, Mus musculus
gttagtacaatgacttcctaattcc

SEQ ID NO: 724441 - DNA, 25 bp, Mus musculus
gttagtacaatgtcttcctaattcc

SEQ ID NO: 724442 - DNA, 25 bp, Mus musculus
gttagtacgtggctcaacttgttag

SEQ ID NO: 724443 - DNA, 25 bp, Mus musculus
gttagtacgtgggtcaacttgttag

SEQ ID NO: 724444 - DNA, 25 bp, Mus musculus
gttagtactgcaaggccgaaactcc

SEQ ID NO: 724445 - DNA, 25 bp, Mus musculus
gttagtactgcatggccgaaactcc

SEQ ID NO: 724446 - DNA, 25 bp, Mus musculus
gttagtagcctcattggtcctgaac

SEQ ID NO: 724447 - DNA, 25 bp, Mus musculus
gttagtagcctctttggtcctgaac

SEQ ID NO: 724448 - DNA, 25 bp, Mus musculus
gttagtagggttacacagtgcaatc

SEQ ID NO: 724449 - DNA, 25 bp, Mus musculus
gttagtagggtttcacagtgcaatc

SEQ ID NO: 724450 - DNA, 25 bp, Mus musculus
gttagtatagttcaagccaggctca

SEQ ID NO: 724451 - DNA, 25 bp, Mus musculus
gttagtatagttgaagccaggctca

SEQ ID NO: 724452 - DNA, 25 bp, Mus musculus
gttagtatccatctcaagttgctca

SEQ ID NO: 724453 - DNA, 25 bp, Mus musculus
gttagtatccatgtcaagttgctca

SEQ ID NO: 724454 - DNA, 25 bp, Mus musculus
gttagtatgtaacgatctctggaca

SEQ ID NO: 724455 - DNA, 25 bp, Mus musculus
gttagtatgtaaggatctctggaca

SEQ ID NO: 724456 - DNA, 25 bp, Mus musculus
gttagtatgtacctctctgaatgaa

SEQ ID NO: 724457 - DNA, 25 bp, Mus musculus
gttagtatgtacgtctctgaatgaa

SEQ ID NO: 724458 - DNA, 25 bp, Mus musculus
gttagtatgttactgtgcacaccat

SEQ ID NO: 724459 - DNA, 25 bp, Mus musculus
gttagtatgttagtgtgcacaccat

SEQ ID NO: 724460 - DNA, 25 bp, Mus musculus
gttagtatttatatcagcgcctgtc

SEQ ID NO: 724461 - DNA, 25 bp, Mus musculus
gttagtatttatttcagcgcctgtc

SEQ ID NO: 724462 - DNA, 25 bp, Mus musculus
gttagtatttctaaatcttcagttt

SEQ ID NO: 724463 - DNA, 25 bp, Mus musculus
gttagtatttcttaatcttcagttt

SEQ ID NO: 724464 - DNA, 25 bp, Mus musculus
gttagtatttggcacacatttcttg

SEQ ID NO: 724465 - DNA, 25 bp, Mus musculus
gttagtatttgggacacatttcttg

SEQ ID NO: 724466 - DNA, 25 bp, Mus musculus
gttagtcaaacacccagccggactg

SEQ ID NO: 724467 - DNA, 25 bp, Mus musculus
gttagtcaaacagccagccggactg

SEQ ID NO: 724468 - DNA, 25 bp, Mus musculus
gttagtcacaagagggctttaccct

SEQ ID NO: 724469 - DNA, 25 bp, Mus musculus
gttagtcacaagtgggctttaccct

SEQ ID NO: 724470 - DNA, 25 bp, Mus musculus
gttagtcacacacactgatcctgga

SEQ ID NO: 724471 - DNA, 25 bp, Mus musculus
gttagtcacacagactgatcctgga

SEQ ID NO: 724472 - DNA, 25 bp, Mus musculus
gttagtcactctctgtaatcccgga

SEQ ID NO: 724473 - DNA, 25 bp, Mus musculus
gttagtcactctgtgtaatcccgga

SEQ ID NO: 724474 - DNA, 25 bp, Mus musculus
gttagtcagcagaagcctggcacca

SEQ ID NO: 724475 - DNA, 25 bp, Mus musculus
gttagtcagcagtagcctggcacca

SEQ ID NO: 724476 - DNA, 25 bp, Mus musculus
gttagtcagtgacgcctggaacact

SEQ ID NO: 724477 - DNA, 25 bp, Mus musculus
gttagtcagtgaggcctggaacact

SEQ ID NO: 724478 - DNA, 25 bp, Mus musculus
gttagtcatagccaatgctctcatt

SEQ ID NO: 724479 - DNA, 25 bp, Mus musculus
gttagtcatagcgaatgctctcatt

SEQ ID NO: 724480 - DNA, 25 bp, Mus musculus
gttagtcatatcagtccattggttg

SEQ ID NO: 724481 - DNA, 25 bp, Mus musculus
gttagtcatatctgtccattggttg

SEQ ID NO: 724482 - DNA, 25 bp, Mus musculus
gttagtcattacaaggcaattagga

SEQ ID NO: 724483 - DNA, 25 bp, Mus musculus
gttagtcattactaggcaattagga

SEQ ID NO: 724484 - DNA, 25 bp, Mus musculus
gttagtcattctacattgtgttcat

SEQ ID NO: 724485 - DNA, 25 bp, Mus musculus
gttagtcattcttcattgtgttcat

SEQ ID NO: 724486 - DNA, 25 bp, Mus musculus
gttagtccatccacagctaggtaga

SEQ ID NO: 724487 - DNA, 25 bp, Mus musculus
gttagtccatcctcagctaggtaga

SEQ ID NO: 724488 - DNA, 25 bp, Mus musculus
gttagtccctaaattatacaggtca

SEQ ID NO: 724489 - DNA, 25 bp, Mus musculus
gttagtccctaatttatacaggtca

SEQ ID NO: 724490 - DNA, 25 bp, Mus musculus
gttagtcctcacctggaacctgcgc

SEQ ID NO: 724491 - DNA, 25 bp, Mus musculus
gttagtcctcacgtggaacctgcgc

SEQ ID NO: 724492 - DNA, 25 bp, Mus musculus
gttagtcctgagacagaggccagtg

SEQ ID NO: 724493 - DNA, 25 bp, Mus musculus
gttagtcctgagtcagaggccagtg

SEQ ID NO: 724494 - DNA, 25 bp, Mus musculus
gttagtccttagaaatttcttgatt

SEQ ID NO: 724495 - DNA, 25 bp, Mus musculus
gttagtccttagtaatttcttgatt

SEQ ID NO: 724496 - DNA, 25 bp, Mus musculus
gttagtcgacgcctgagttttaagt

SEQ ID NO: 724497 - DNA, 25 bp, Mus musculus
gttagtcgacgcgtgagttttaagt

SEQ ID NO: 724498 - DNA, 25 bp, Mus musculus
gttagtctcaaaacatagaaccttt

SEQ ID NO: 724499 - DNA, 25 bp, Mus musculus
gttagtctcaaatcatagaaccttt

SEQ ID NO: 724500 - DNA, 25 bp, Mus musculus
gttagtctctaaatactgcagcgta

SEQ ID NO: 724501 - DNA, 25 bp, Mus musculus
gttagtctctaattactgcagcgta

SEQ ID NO: 724502 - DNA, 25 bp, Mus musculus
gttagtctctttctcacgcgtgaga

SEQ ID NO: 724503 - DNA, 25 bp, Mus musculus
gttagtctctttgtcacgcgtgaga

SEQ ID NO: 724504 - DNA, 25 bp, Mus musculus
gttagtctgaatcacagtgccttgg

SEQ ID NO: 724505 - DNA, 25 bp, Mus musculus
gttagtctgaatgacagtgccttgg

SEQ ID NO: 724506 - DNA, 25 bp, Mus musculus
gttagtctgtcaccaacctttagat

SEQ ID NO: 724507 - DNA, 25 bp, Mus musculus
gttagtctgtcagcaacctttagat

SEQ ID NO: 724508 - DNA, 25 bp, Mus musculus
gttagtcttaggcacattcctttac

SEQ ID NO: 724509 - DNA, 25 bp, Mus musculus
gttagtcttagggacattcctttac

SEQ ID NO: 724510 - DNA, 25 bp, Mus musculus
gttagtcttcctctagaaatcctat

SEQ ID NO: 724511 - DNA, 25 bp, Mus musculus
gttagtcttcctgtagaaatcctat

SEQ ID NO: 724512 - DNA, 25 bp, Mus musculus
gttagtcttgttacagcatttgaag

SEQ ID NO: 724513 - DNA, 25 bp, Mus musculus
gttagtcttgtttcagcatttgaag

SEQ ID NO: 724514 - DNA, 25 bp, Mus musculus
gttagtgaaccaaaggaacatacct

SEQ ID NO: 724515 - DNA, 25 bp, Mus musculus
gttagtgaaccataggaacatacct

SEQ ID NO: 724516 - DNA, 25 bp, Mus musculus
gttagtgaacccactcaaatgtttg

SEQ ID NO: 724517 - DNA, 25 bp, Mus musculus
gttagtgaaccctctcaaatgtttg

SEQ ID NO: 724518 - DNA, 25 bp, Mus musculus
gttagtgaactaccttacttggttt

SEQ ID NO: 724519 - DNA, 25 bp, Mus musculus
gttagtgaactagcttacttggttt

SEQ ID NO: 724520 - DNA, 25 bp, Mus musculus
gttagtgacacaacggtgacaggta

SEQ ID NO: 724521 - DNA, 25 bp, Mus musculus
gttagtgacacatcggtgacaggta

SEQ ID NO: 724522 - DNA, 25 bp, Mus musculus
gttagtgacattatgcaagtctcta

SEQ ID NO: 724523 - DNA, 25 bp, Mus musculus
gttagtgacattttgcaagtctcta

SEQ ID NO: 724524 - DNA, 25 bp, Mus musculus
gttagtgactttacttactgttgtg

SEQ ID NO: 724525 - DNA, 25 bp, Mus musculus
gttagtgacttttcttactgttgtg

SEQ ID NO: 724526 - DNA, 25 bp, Mus musculus
gttagtgcaacacaccaagtatttt

SEQ ID NO: 724527 - DNA, 25 bp, Mus musculus
gttagtgcaacagaccaagtatttt

SEQ ID NO: 724528 - DNA, 25 bp, Mus musculus
gttagtgcaactatctccatttgaa

SEQ ID NO: 724529 - DNA, 25 bp, Mus musculus
gttagtgcaactttctccatttgaa

SEQ ID NO: 724530 - DNA, 25 bp, Mus musculus
gttagtgcaatgacttcactgtgcc

SEQ ID NO: 724531 - DNA, 25 bp, Mus musculus
gttagtgcaatgagtcttgatgtcc

SEQ ID NO: 724532 - DNA, 25 bp, Mus musculus
gttagtgcaatgtcttcactgtgcc

SEQ ID NO: 724533 - DNA, 25 bp, Mus musculus
gttagtgcaatgtgtcttgatgtcc

SEQ ID NO: 724534 - DNA, 25 bp, Mus musculus
gttagtgcactaagattgacctcca

SEQ ID NO: 724535 - DNA, 25 bp, Mus musculus
gttagtgcactatgattgacctcca

SEQ ID NO: 724536 - DNA, 25 bp, Mus musculus
gttagtgccactcacccataatctt

SEQ ID NO: 724537 - DNA, 25 bp, Mus musculus
gttagtgccactgacccataatctt

SEQ ID NO: 724538 - DNA, 25 bp, Mus musculus
gttagtgcctaacctaatggccact

SEQ ID NO: 724539 - DNA, 25 bp, Mus musculus
gttagtgcctaagctaatggccact

SEQ ID NO: 724540 - DNA, 25 bp, Mus musculus
gttagtgcgggcattgctacccctt

SEQ ID NO: 724541 - DNA, 25 bp, Mus musculus
gttagtgcgggctttgctacccctt

SEQ ID NO: 724542 - DNA, 25 bp, Mus musculus
gttagtgctcaaatggatcggacca

SEQ ID NO: 724543 - DNA, 25 bp, Mus musculus
gttagtgctcaattggatcggacca

SEQ ID NO: 724544 - DNA, 25 bp, Mus musculus
gttagtgctcatctggagcagactg

SEQ ID NO: 724545 - DNA, 25 bp, Mus musculus
gttagtgctcatgtggagcagactg

SEQ ID NO: 724546 - DNA, 25 bp, Mus musculus
gttagtgctcttcctatgactagaa

SEQ ID NO: 724547 - DNA, 25 bp, Mus musculus
gttagtgctcttgctatgactagaa

SEQ ID NO: 724548 - DNA, 25 bp, Mus musculus
gttagtgctgcacggtctatcaaaa

SEQ ID NO: 724549 - DNA, 25 bp, Mus musculus
gttagtgctgcagggtctatcaaaa

SEQ ID NO: 724550 - DNA, 25 bp, Mus musculus
gttagtgctggaccaccaggaaagt

SEQ ID NO: 724551 - DNA, 25 bp, Mus musculus
gttagtgctggagcaccaggaaagt

SEQ ID NO: 724552 - DNA, 25 bp, Mus musculus
gttagtggccacattgccctgtgat

SEQ ID NO: 724553 - DNA, 25 bp, Mus musculus
gttagtggccactttgccctgtgat

SEQ ID NO: 724554 - DNA, 25 bp, Mus musculus
gttagtggctcaaacagtgctggtt

SEQ ID NO: 724555 - DNA, 25 bp, Mus musculus
gttagtggctcatacagtgctggtt

SEQ ID NO: 724556 - DNA, 25 bp, Mus musculus
gttagtgggatcaggagctgcatca

SEQ ID NO: 724557 - DNA, 25 bp, Mus musculus
gttagtgggatctggagctgcatca

SEQ ID NO: 724558 - DNA, 25 bp, Mus musculus
gttagtgggcagacaggctcccatt

SEQ ID NO: 724559 - DNA, 25 bp, Mus musculus
gttagtgggcagtcaggctcccatt

SEQ ID NO: 724560 - DNA, 25 bp, Mus musculus
gttagtggtggcactcagaaggact

SEQ ID NO: 724561 - DNA, 25 bp, Mus musculus
gttagtggtggctctcagaaggact

SEQ ID NO: 724562 - DNA, 25 bp, Mus musculus
gttagtggttctcgtatcttgtccc

SEQ ID NO: 724563 - DNA, 25 bp, Mus musculus
gttagtggttctggtatcttgtccc

SEQ ID NO: 724564 - DNA, 25 bp, Mus musculus
gttagtggttgtccctgactatcaa

SEQ ID NO: 724565 - DNA, 25 bp, Mus musculus
gttagtggttgtgcctgactatcaa

SEQ ID NO: 724566 - DNA, 25 bp, Mus musculus
gttagtgtatctatgaggtaccatc

SEQ ID NO: 724567 - DNA, 25 bp, Mus musculus
gttagtgtatctttgaggtaccatc

SEQ ID NO: 724568 - DNA, 25 bp, Mus musculus
gttagtgtattcacttcactgcaga

SEQ ID NO: 724569 - DNA, 25 bp, Mus musculus
gttagtgtattctcttcactgcaga

SEQ ID NO: 724570 - DNA, 25 bp, Mus musculus
gttagtgtcaatccctgatactgta

SEQ ID NO: 724571 - DNA, 25 bp, Mus musculus
gttagtgtcaatgcctgatactgta

SEQ ID NO: 724572 - DNA, 25 bp, Mus musculus
gttagtgtgatacatctctcatgca

SEQ ID NO: 724573 - DNA, 25 bp, Mus musculus
gttagtgtgatagatctctcatgca

SEQ ID NO: 724574 - DNA, 25 bp, Mus musculus
gttagtgtgattaaaccacctgcca

SEQ ID NO: 724575 - DNA, 25 bp, Mus musculus
gttagtgtgatttaaccacctgcca

SEQ ID NO: 724576 - DNA, 25 bp, Mus musculus
gttagtgtgtgaaaggattcctgtc

SEQ ID NO: 724577 - DNA, 25 bp, Mus musculus
gttagtgtgtgataggattcctgtc

SEQ ID NO: 724578 - DNA, 25 bp, Mus musculus
gttagtgttaacactgcctgcactg

SEQ ID NO: 724579 - DNA, 25 bp, Mus musculus
gttagtgttaacaggcgcggtgaca

SEQ ID NO: 724580 - DNA, 25 bp, Mus musculus
gttagtgttaactctgcctgcactg

SEQ ID NO: 724581 - DNA, 25 bp, Mus musculus
gttagtgttaactggcgcggtgaca

SEQ ID NO: 724582 - DNA, 25 bp, Mus musculus
gttagttaatatcccattgcttgtg

SEQ ID NO: 724583 - DNA, 25 bp, Mus musculus
gttagttaatatgccattgcttgtg

SEQ ID NO: 724584 - DNA, 25 bp, Mus musculus
gttagttacaccatttcacaatctt

SEQ ID NO: 724585 - DNA, 25 bp, Mus musculus
gttagttacaccttttcacaatctt

SEQ ID NO: 724586 - DNA, 25 bp, Mus musculus
gttagttaccatcctacttaattag

SEQ ID NO: 724587 - DNA, 25 bp, Mus musculus
gttagttaccatgctacttaattag

SEQ ID NO: 724588 - DNA, 25 bp, Mus musculus
gttagttatgccatattcataccag

SEQ ID NO: 724589 - DNA, 25 bp, Mus musculus
gttagttatgccatcttgcgctttc

SEQ ID NO: 724590 - DNA, 25 bp, Mus musculus
gttagttatgccttattcataccag

SEQ ID NO: 724591 - DNA, 25 bp, Mus musculus
gttagttatgccttcttgcgctttc

SEQ ID NO: 724592 - DNA, 25 bp, Mus musculus
gttagttcaaggacggtctacacaa

SEQ ID NO: 724593 - DNA, 25 bp, Mus musculus
gttagttcaaggtcggtctacacaa

SEQ ID NO: 724594 - DNA, 25 bp, Mus musculus
gttagttcagtaccttatctcactt

SEQ ID NO: 724595 - DNA, 25 bp, Mus musculus
gttagttcagtagcttatctcactt

SEQ ID NO: 724596 - DNA, 25 bp, Mus musculus
gttagttcccacatattactagtgc

SEQ ID NO: 724597 - DNA, 25 bp, Mus musculus
gttagttcccacttattactagtgc

SEQ ID NO: 724598 - DNA, 25 bp, Mus musculus
gttagttctaagcacagttgccctg

SEQ ID NO: 724599 - DNA, 25 bp, Mus musculus
gttagttctaaggacagttgccctg

SEQ ID NO: 724600 - DNA, 25 bp, Mus musculus
gttagttctcaacgacttagctgct

SEQ ID NO: 724601 - DNA, 25 bp, Mus musculus
gttagttctcaaggacttagctgct

SEQ ID NO: 724602 - DNA, 25 bp, Mus musculus
gttagttctccaaggagatgctcag

SEQ ID NO: 724603 - DNA, 25 bp, Mus musculus
gttagttctccatggagatgctcag

SEQ ID NO: 724604 - DNA, 25 bp, Mus musculus
gttagttctcttactaatcttgtct

SEQ ID NO: 724605 - DNA, 25 bp, Mus musculus
gttagttctctttctaatcttgtct

SEQ ID NO: 724606 - DNA, 25 bp, Mus musculus
gttagttctgttctgagccatagcc

SEQ ID NO: 724607 - DNA, 25 bp, Mus musculus
gttagttctgttgtgagccatagcc

SEQ ID NO: 724608 - DNA, 25 bp, Mus musculus
gttagttgacttatgagcctttctc

SEQ ID NO: 724609 - DNA, 25 bp, Mus musculus
gttagttgacttttgagcctttctc

SEQ ID NO: 724610 - DNA, 25 bp, Mus musculus
gttagttgatccatacttgagagtt

SEQ ID NO: 724611 - DNA, 25 bp, Mus musculus
gttagttgatccttacttgagagtt

SEQ ID NO: 724612 - DNA, 25 bp, Mus musculus
gttagttgatctacaagaccacaga

SEQ ID NO: 724613 - DNA, 25 bp, Mus musculus
gttagttgatcttcaagaccacaga

SEQ ID NO: 724614 - DNA, 25 bp, Mus musculus
gttagttgatgtataggtagagccc

SEQ ID NO: 724615 - DNA, 25 bp, Mus musculus
gttagttgatgtttaggtagagccc

SEQ ID NO: 724616 - DNA, 25 bp, Mus musculus
gttagttgcatccacaaattctccc

SEQ ID NO: 724617 - DNA, 25 bp, Mus musculus
gttagttgcatcgacaaattctccc

SEQ ID NO: 724618 - DNA, 25 bp, Mus musculus
gttagttggacgctttatccattgg

SEQ ID NO: 724619 - DNA, 25 bp, Mus musculus
gttagttggacggtttatccattgg

SEQ ID NO: 724620 - DNA, 25 bp, Mus musculus
gttagttggactatgttgctgatta

SEQ ID NO: 724621 - DNA, 25 bp, Mus musculus
gttagttggactttgttgctgatta

SEQ ID NO: 724622 - DNA, 25 bp, Mus musculus
gttagtttacaaattgttgcagaca

SEQ ID NO: 724623 - DNA, 25 bp, Mus musculus
gttagtttacaatttgttgcagaca

SEQ ID NO: 724624 - DNA, 25 bp, Mus musculus
gttagtttaccaattgagacagggt

SEQ ID NO: 724625 - DNA, 25 bp, Mus musculus
gttagtttaccatttgagacagggt

SEQ ID NO: 724626 - DNA, 25 bp, Mus musculus
gttagtttagaacagctctcaagtc

SEQ ID NO: 724627 - DNA, 25 bp, Mus musculus
gttagtttagaagagctctcaagtc

SEQ ID NO: 724628 - DNA, 25 bp, Mus musculus
gttagtttagttctgcagttcttgt

SEQ ID NO: 724629 - DNA, 25 bp, Mus musculus
gttagtttagttgtgcagttcttgt

SEQ ID NO: 724630 - DNA, 25 bp, Mus musculus
gttagtttcactcatgcaatagctt

SEQ ID NO: 724631 - DNA, 25 bp, Mus musculus
gttagtttcactgatgcaatagctt

SEQ ID NO: 724632 - DNA, 25 bp, Mus musculus
gttagtttcctcattggtagtgtga

SEQ ID NO: 724633 - DNA, 25 bp, Mus musculus
gttagtttcctctttggtagtgtga

SEQ ID NO: 724634 - DNA, 25 bp, Mus musculus
gttagtttctgacccaagtttcttg

SEQ ID NO: 724635 - DNA, 25 bp, Mus musculus
gttagtttctgagccaagtttcttg

SEQ ID NO: 724636 - DNA, 25 bp, Mus musculus
gttagtttgcaaaagccaccttatg

SEQ ID NO: 724637 - DNA, 25 bp, Mus musculus
gttagtttgcaatagccaccttatg

SEQ ID NO: 724638 - DNA, 25 bp, Mus musculus
gttagtttgcataggctttccagta

SEQ ID NO: 724639 - DNA, 25 bp, Mus musculus
gttagtttgcattggctttccagta

SEQ ID NO: 724640 - DNA, 25 bp, Mus musculus
gttagtttggtaaacctctcctgct

SEQ ID NO: 724641 - DNA, 25 bp, Mus musculus
gttagtttggtatacctctcctgct

SEQ ID NO: 724642 - DNA, 25 bp, Mus musculus
gttagttttcgtcacaatcctctga

SEQ ID NO: 724643 - DNA, 25 bp, Mus musculus
gttagttttcgtgacaatcctctga

SEQ ID NO: 724644 - DNA, 25 bp, Mus musculus
gttagttttgaacatatgtatcttt

SEQ ID NO: 724645 - DNA, 25 bp, Mus musculus
gttagttttgaagatatgtatcttt

SEQ ID NO: 724646 - DNA, 25 bp, Mus musculus
gttagttttggaacgccattcggct

SEQ ID NO: 724647 - DNA, 25 bp, Mus musculus
gttagttttggatcgccattcggct

SEQ ID NO: 724648 - DNA, 25 bp, Mus musculus
gttagtttttctaatctgctgtcca

SEQ ID NO: 724649 - DNA, 25 bp, Mus musculus
gttagtttttcttatctgctgtcca

SEQ ID NO: 724650 - DNA, 25 bp, Mus musculus
gttataaaaatccttcgactggcgc

SEQ ID NO: 724651 - DNA, 25 bp, Mus musculus
gttataaaaatcgttcgactggcgc

SEQ ID NO: 724652 - DNA, 25 bp, Mus musculus
gttataaaactaaggaacctcctct

SEQ ID NO: 724653 - DNA, 25 bp, Mus musculus
gttataaaactatggaacctcctct

SEQ ID NO: 724654 - DNA, 25 bp, Mus musculus
gttataaagtggcagctagcgtcga

SEQ ID NO: 724655 - DNA, 25 bp, Mus musculus
gttataaagtgggagctagcgtcga

SEQ ID NO: 724656 - DNA, 25 bp, Mus musculus
gttataaatacacttagctgggaaa

SEQ ID NO: 724657 - DNA, 25 bp, Mus musculus
gttataaatacagttagctgggaaa

SEQ ID NO: 724658 - DNA, 25 bp, Mus musculus
gttataacacatccgtgtatttaaa

SEQ ID NO: 724659 - DNA, 25 bp, Mus musculus
gttataacacatgcgtgtatttaaa

SEQ ID NO: 724660 - DNA, 25 bp, Mus musculus
gttataacacttaggattgtccaca

SEQ ID NO: 724661 - DNA, 25 bp, Mus musculus
gttataacactttggattgtccaca

SEQ ID NO: 724662 - DNA, 25 bp, Mus musculus
gttataacagcaagaacagcaaata

SEQ ID NO: 724663 - DNA, 25 bp, Mus musculus
gttataacagcatgaacagcaaata

SEQ ID NO: 724664 - DNA, 25 bp, Mus musculus
gttataaccattcaagaccttcgtg

SEQ ID NO: 724665 - DNA, 25 bp, Mus musculus
gttataaccattgaagaccttcgtg

SEQ ID NO: 724666 - DNA, 25 bp, Mus musculus
gttataaccctacttgcaagggctt

SEQ ID NO: 724667 - DNA, 25 bp, Mus musculus
gttataaccctagttgcaagggctt

SEQ ID NO: 724668 - DNA, 25 bp, Mus musculus
gttataaccgcacggactcactcaa

SEQ ID NO: 724669 - DNA, 25 bp, Mus musculus
gttataaccgcagggactcactcaa

SEQ ID NO: 724670 - DNA, 25 bp, Mus musculus
gttataacctgtagtgaccttgcaa

SEQ ID NO: 724671 - DNA, 25 bp, Mus musculus
gttataacctgttgtgaccttgcaa

SEQ ID NO: 724672 - DNA, 25 bp, Mus musculus
gttataacgccccacagaaagaatg

SEQ ID NO: 724673 - DNA, 25 bp, Mus musculus
gttataacgcccgacagaaagaatg

SEQ ID NO: 724674 - DNA, 25 bp, Mus musculus
gttataactaagacttctgccgtgt

SEQ ID NO: 724675 - DNA, 25 bp, Mus musculus
gttataactaagtcttctgccgtgt

SEQ ID NO: 724676 - DNA, 25 bp, Mus musculus
gttataagccttaggagcctaccct

SEQ ID NO: 724677 - DNA, 25 bp, Mus musculus
gttataagcctttggagcctaccct

SEQ ID NO: 724678 - DNA, 25 bp, Mus musculus
gttataataatcaggcaatgcatag

SEQ ID NO: 724679 - DNA, 25 bp, Mus musculus
gttataataatctggcaatgcatag

SEQ ID NO: 724680 - DNA, 25 bp, Mus musculus
gttataatcactatacgtctagctt

SEQ ID NO: 724681 - DNA, 25 bp, Mus musculus
gttataatcactttacgtctagctt

SEQ ID NO: 724682 - DNA, 25 bp, Mus musculus
gttataatctcaaacattcgtacag

SEQ ID NO: 724683 - DNA, 25 bp, Mus musculus
gttataatctcatacattcgtacag

SEQ ID NO: 724684 - DNA, 25 bp, Mus musculus
gttataatctctcccaatctttctt

SEQ ID NO: 724685 - DNA, 25 bp, Mus musculus
gttataatctctgccaatctttctt

SEQ ID NO: 724686 - DNA, 25 bp, Mus musculus
gttataatctttatgctgcctgcaa

SEQ ID NO: 724687 - DNA, 25 bp, Mus musculus
gttataatctttttgctgcctgcaa

SEQ ID NO: 724688 - DNA, 25 bp, Mus musculus
gttataatttcacctgtacatgcgc

SEQ ID NO: 724689 - DNA, 25 bp, Mus musculus
gttataatttcagctgtacatgcgc

SEQ ID NO: 724690 - DNA, 25 bp, Mus musculus
gttatacaaccacgctcaacaaaac

SEQ ID NO: 724691 - DNA, 25 bp, Mus musculus
gttatacaaccaggctcaacaaaac

SEQ ID NO: 724692 - DNA, 25 bp, Mus musculus
gttatacacacaatggaagctgtcc

SEQ ID NO: 724693 - DNA, 25 bp, Mus musculus
gttatacacacattggaagctgtcc

SEQ ID NO: 724694 - DNA, 25 bp, Mus musculus
gttatacagcctagatacgcatcag

SEQ ID NO: 724695 - DNA, 25 bp, Mus musculus
gttatacagccttgatacgcatcag

SEQ ID NO: 724696 - DNA, 25 bp, Mus musculus
gttatacatttaatccacagggcat

SEQ ID NO: 724697 - DNA, 25 bp, Mus musculus
gttatacatttattccacagggcat

SEQ ID NO: 724698 - DNA, 25 bp, Mus musculus
gttataccagatattccactgatgt

SEQ ID NO: 724699 - DNA, 25 bp, Mus musculus
gttataccagattttccactgatgt

SEQ ID NO: 724700 - DNA, 25 bp, Mus musculus
gttataccagcactctgggtcagca

SEQ ID NO: 724701 - DNA, 25 bp, Mus musculus
gttataccagcagtctgggtcagca

SEQ ID NO: 724702 - DNA, 25 bp, Mus musculus
gttataccatttatctgttcagctc

SEQ ID NO: 724703 - DNA, 25 bp, Mus musculus
gttataccatttttctgttcagctc

SEQ ID NO: 724704 - DNA, 25 bp, Mus musculus
gttatacccaacagactgaaccgtt

SEQ ID NO: 724705 - DNA, 25 bp, Mus musculus
gttatacccaactgactgaaccgtt

SEQ ID NO: 724706 - DNA, 25 bp, Mus musculus
gttatacgagaacccatcatccatg

SEQ ID NO: 724707 - DNA, 25 bp, Mus musculus
gttatacgagaagccatcatccatg

SEQ ID NO: 724708 - DNA, 25 bp, Mus musculus
gttatactatacaactccacccttt

SEQ ID NO: 724709 - DNA, 25 bp, Mus musculus
gttatactatactactccacccttt

SEQ ID NO: 724710 - DNA, 25 bp, Mus musculus
gttatactctgtatactacgtcata

SEQ ID NO: 724711 - DNA, 25 bp, Mus musculus
gttatactctgtttactacgtcata

SEQ ID NO: 724712 - DNA, 25 bp, Mus musculus
gttatactcttgatcattggctctt

SEQ ID NO: 724713 - DNA, 25 bp, Mus musculus
gttatactcttgttcattggctctt

SEQ ID NO: 724714 - DNA, 25 bp, Mus musculus
gttatacttggtaatatgtctctga

SEQ ID NO: 724715 - DNA, 25 bp, Mus musculus
gttatacttggttatatgtctctga

SEQ ID NO: 724716 - DNA, 25 bp, Mus musculus
gttatactttccctattgctatggc

SEQ ID NO: 724717 - DNA, 25 bp, Mus musculus
gttatactttccgtattgctatggc

SEQ ID NO: 724718 - DNA, 25 bp, Mus musculus
gttatagaactcacacgttgccgtg

SEQ ID NO: 724719 - DNA, 25 bp, Mus musculus
gttatagaactctcacgttgccgtg

SEQ ID NO: 724720 - DNA, 25 bp, Mus musculus
gttatagacaaaataagactggtaa

SEQ ID NO: 724721 - DNA, 25 bp, Mus musculus
gttatagacaaattaagactggtaa

SEQ ID NO: 724722 - DNA, 25 bp, Mus musculus
gttatagagtctagctactcagccc

SEQ ID NO: 724723 - DNA, 25 bp, Mus musculus
gttatagagtcttgctactcagccc

SEQ ID NO: 724724 - DNA, 25 bp, Mus musculus
gttatagatgacctgctctctaatt

SEQ ID NO: 724725 - DNA, 25 bp, Mus musculus
gttatagatgacctggactacaaga

SEQ ID NO: 724726 - DNA, 25 bp, Mus musculus
gttatagatgacgtgctctctaatt

SEQ ID NO: 724727 - DNA, 25 bp, Mus musculus
gttatagatgacgtggactacaaga

SEQ ID NO: 724728 - DNA, 25 bp, Mus musculus
gttatagatgataaacctctgttca

SEQ ID NO: 724729 - DNA, 25 bp, Mus musculus
gttatagatgattaacctctgttca

SEQ ID NO: 724730 - DNA, 25 bp, Mus musculus
gttatagatgttccggccaggccca

SEQ ID NO: 724731 - DNA, 25 bp, Mus musculus
gttatagatgttgcggccaggccca

SEQ ID NO: 724732 - DNA, 25 bp, Mus musculus
gttatagcatccataactgaggctg

SEQ ID NO: 724733 - DNA, 25 bp, Mus musculus
gttatagcatccttaactgaggctg

SEQ ID NO: 724734 - DNA, 25 bp, Mus musculus
gttatagcctgtaagtgccatgttt

SEQ ID NO: 724735 - DNA, 25 bp, Mus musculus
gttatagcctgtcggtaatgcctta

SEQ ID NO: 724736 - DNA, 25 bp, Mus musculus
gttatagcctgtgggtaatgcctta

SEQ ID NO: 724737 - DNA, 25 bp, Mus musculus
gttatagcctgttagtgccatgttt

SEQ ID NO: 724738 - DNA, 25 bp, Mus musculus
gttatagctacaacaatgagacact

SEQ ID NO: 724739 - DNA, 25 bp, Mus musculus
gttatagctacatcaatgagacact

SEQ ID NO: 724740 - DNA, 25 bp, Mus musculus
gttatagctcagaaccatgcggtga

SEQ ID NO: 724741 - DNA, 25 bp, Mus musculus
gttatagctcagtaccatgcggtga

SEQ ID NO: 724742 - DNA, 25 bp, Mus musculus
gttatagctctacgcacattctgct

SEQ ID NO: 724743 - DNA, 25 bp, Mus musculus
gttatagctctaggcacattctgct

SEQ ID NO: 724744 - DNA, 25 bp, Mus musculus
gttatagctgctctcatagcttgtc

SEQ ID NO: 724745 - DNA, 25 bp, Mus musculus
gttatagctgctgtcatagcttgtc

SEQ ID NO: 724746 - DNA, 25 bp, Mus musculus
gttatagcttgtaactcagtttctt

SEQ ID NO: 724747 - DNA, 25 bp, Mus musculus
gttatagcttgttactcagtttctt

SEQ ID NO: 724748 - DNA, 25 bp, Mus musculus
gttataggcaagcaagagtaatttt

SEQ ID NO: 724749 - DNA, 25 bp, Mus musculus
gttataggcaaggaagagtaatttt

SEQ ID NO: 724750 - DNA, 25 bp, Mus musculus
gttatagggagtatctttgattcac

SEQ ID NO: 724751 - DNA, 25 bp, Mus musculus
gttatagggagtttctttgattcac

SEQ ID NO: 724752 - DNA, 25 bp, Mus musculus
gttatagggcatatttatctagaga

SEQ ID NO: 724753 - DNA, 25 bp, Mus musculus
gttatagggcatttttatctagaga

SEQ ID NO: 724754 - DNA, 25 bp, Mus musculus
gttataggtttgcaccatgacaccc

SEQ ID NO: 724755 - DNA, 25 bp, Mus musculus
gttataggtttggaccatgacaccc

SEQ ID NO: 724756 - DNA, 25 bp, Mus musculus
gttatagtagatactccttcccttg

SEQ ID NO: 724757 - DNA, 25 bp, Mus musculus
gttatagtagattctccttcccttg

SEQ ID NO: 724758 - DNA, 25 bp, Mus musculus
gttatagtcaagcttcttctccacg

SEQ ID NO: 724759 - DNA, 25 bp, Mus musculus
gttatagtcaaggttcttctccacg

SEQ ID NO: 724760 - DNA, 25 bp, Mus musculus
gttatagtcccactgatgaacccac

SEQ ID NO: 724761 - DNA, 25 bp, Mus musculus
gttatagtcccagtgatgaacccac

SEQ ID NO: 724762 - DNA, 25 bp, Mus musculus
gttatagtctaccacccatggtctt

SEQ ID NO: 724763 - DNA, 25 bp, Mus musculus
gttatagtctacgacccatggtctt

SEQ ID NO: 724764 - DNA, 25 bp, Mus musculus
gttatagtctataaagctttggttt

SEQ ID NO: 724765 - DNA, 25 bp, Mus musculus
gttatagtctattaagctttggttt

SEQ ID NO: 724766 - DNA, 25 bp, Mus musculus
gttatagtgactaccatgacttcca

SEQ ID NO: 724767 - DNA, 25 bp, Mus musculus
gttatagtgacttccatgacttcca

SEQ ID NO: 724768 - DNA, 25 bp, Mus musculus
gttatagtggccctaattcccaggg

SEQ ID NO: 724769 - DNA, 25 bp, Mus musculus
gttatagtggccgtaattcccaggg

SEQ ID NO: 724770 - DNA, 25 bp, Mus musculus
gttatagttataccctagctctgca

SEQ ID NO: 724771 - DNA, 25 bp, Mus musculus
gttatagttatagcctagctctgca

SEQ ID NO: 724772 - DNA, 25 bp, Mus musculus
gttatataggcacaccctgtcataa

SEQ ID NO: 724773 - DNA, 25 bp, Mus musculus
gttatataggcagaccctgtcataa

SEQ ID NO: 724774 - DNA, 25 bp, Mus musculus
gttatatagttaccaaccatctctt

SEQ ID NO: 724775 - DNA, 25 bp, Mus musculus
gttatatagttagcaaccatctctt

SEQ ID NO: 724776 - DNA, 25 bp, Mus musculus
gttatatatacaacccagctctgcc

SEQ ID NO: 724777 - DNA, 25 bp, Mus musculus
gttatatatacatcccagctctgcc

SEQ ID NO: 724778 - DNA, 25 bp, Mus musculus
gttatatatagtacctgtctggtcc

SEQ ID NO: 724779 - DNA, 25 bp, Mus musculus
gttatatatagttcctgtctggtcc

SEQ ID NO: 724780 - DNA, 25 bp, Mus musculus
gttatatatgtgagtcccttgctat

SEQ ID NO: 724781 - DNA, 25 bp, Mus musculus
gttatatatgtgtgtcccttgctat

SEQ ID NO: 724782 - DNA, 25 bp, Mus musculus
gttatatcagcacacactccagttt

SEQ ID NO: 724783 - DNA, 25 bp, Mus musculus
gttatatcagcagacactccagttt

SEQ ID NO: 724784 - DNA, 25 bp, Mus musculus
gttatatcagttatatgcacaagag

SEQ ID NO: 724785 - DNA, 25 bp, Mus musculus
gttatatcagttttatgcacaagag

SEQ ID NO: 724786 - DNA, 25 bp, Mus musculus
gttatatcgtatatagactcatcct

SEQ ID NO: 724787 - DNA, 25 bp, Mus musculus
gttatatcgtatttagactcatcct

SEQ ID NO: 724788 - DNA, 25 bp, Mus musculus
gttatatctcagcaaccatctgtcc

SEQ ID NO: 724789 - DNA, 25 bp, Mus musculus
gttatatctcaggaaccatctgtcc

SEQ ID NO: 724790 - DNA, 25 bp, Mus musculus
gttatatcttaaccgaacctgtatg

SEQ ID NO: 724791 - DNA, 25 bp, Mus musculus
gttatatcttaagcgaacctgtatg

SEQ ID NO: 724792 - DNA, 25 bp, Mus musculus
gttatatcttagatccctgacagtt

SEQ ID NO: 724793 - DNA, 25 bp, Mus musculus
gttatatcttagttccctgacagtt

SEQ ID NO: 724794 - DNA, 25 bp, Mus musculus
gttatatgactgaattctctgttct

SEQ ID NO: 724795 - DNA, 25 bp, Mus musculus
gttatatgactgtattctctgttct

SEQ ID NO: 724796 - DNA, 25 bp, Mus musculus
gttatatgattacctatgccctctc

SEQ ID NO: 724797 - DNA, 25 bp, Mus musculus
gttatatgattagctatgccctctc

SEQ ID NO: 724798 - DNA, 25 bp, Mus musculus
gttatatgcctgaactgtcacatca

SEQ ID NO: 724799 - DNA, 25 bp, Mus musculus
gttatatgcctgtactgtcacatca

SEQ ID NO: 724800 - DNA, 25 bp, Mus musculus
gttatatgtaaaccttgtgtgggta

SEQ ID NO: 724801 - DNA, 25 bp, Mus musculus
gttatatgtaaagcttgtgtgggta

SEQ ID NO: 724802 - DNA, 25 bp, Mus musculus
gttatatgtcccaaccaatgtcatt

SEQ ID NO: 724803 - DNA, 25 bp, Mus musculus
gttatatgtccctaccaatgtcatt

SEQ ID NO: 724804 - DNA, 25 bp, Mus musculus
gttatatgtctgacctactgttctt

SEQ ID NO: 724805 - DNA, 25 bp, Mus musculus
gttatatgtctgtcctactgttctt

SEQ ID NO: 724806 - DNA, 25 bp, Mus musculus
gttatattaccacggaacacccaat

SEQ ID NO: 724807 - DNA, 25 bp, Mus musculus
gttatattaccagggaacacccaat

SEQ ID NO: 724808 - DNA, 25 bp, Mus musculus
gttatattgtatctgggccttgttc

SEQ ID NO: 724809 - DNA, 25 bp, Mus musculus
gttatattgtatgtgggccttgttc

SEQ ID NO: 724810 - DNA, 25 bp, Mus musculus
gttatatttaagattgggagcccag

SEQ ID NO: 724811 - DNA, 25 bp, Mus musculus
gttatatttaagtttgggagcccag

SEQ ID NO: 724812 - DNA, 25 bp, Mus musculus
gttatatttaccacccatcttacaa

SEQ ID NO: 724813 - DNA, 25 bp, Mus musculus
gttatatttacctcccatcttacaa

SEQ ID NO: 724814 - DNA, 25 bp, Mus musculus
gttatatttatgcttctaggccctc

SEQ ID NO: 724815 - DNA, 25 bp, Mus musculus
gttatatttatggttctaggccctc

SEQ ID NO: 724816 - DNA, 25 bp, Mus musculus
gttatatttgggatggcagtcgagt

SEQ ID NO: 724817 - DNA, 25 bp, Mus musculus
gttatatttgggttggcagtcgagt

SEQ ID NO: 724818 - DNA, 25 bp, Mus musculus
gttatatttgtacgcgctaacccaa

SEQ ID NO: 724819 - DNA, 25 bp, Mus musculus
gttatatttgtaggcgctaacccaa

SEQ ID NO: 724820 - DNA, 25 bp, Mus musculus
gttatattttaacaccactggagaa

SEQ ID NO: 724821 - DNA, 25 bp, Mus musculus
gttatattttaagaccactggagaa

SEQ ID NO: 724822 - DNA, 25 bp, Mus musculus
gttatattttcccatagtcacctat

SEQ ID NO: 724823 - DNA, 25 bp, Mus musculus
gttatattttccgatagtcacctat

SEQ ID NO: 724824 - DNA, 25 bp, Mus musculus
gttatcaaacgtcatagagtttcca

SEQ ID NO: 724825 - DNA, 25 bp, Mus musculus
gttatcaaacgtgatagagtttcca

SEQ ID NO: 724826 - DNA, 25 bp, Mus musculus
gttatcaaatctatgacccactttt

SEQ ID NO: 724827 - DNA, 25 bp, Mus musculus
gttatcaaatctttgacccactttt

SEQ ID NO: 724828 - DNA, 25 bp, Mus musculus
gttatcaaccacatcatctctgtag

SEQ ID NO: 724829 - DNA, 25 bp, Mus musculus
gttatcaaccacttcatctctgtag

SEQ ID NO: 724830 - DNA, 25 bp, Mus musculus
gttatcaaccttcctttcccactgg

SEQ ID NO: 724831 - DNA, 25 bp, Mus musculus
gttatcaaccttgctttcccactgg

SEQ ID NO: 724832 - DNA, 25 bp, Mus musculus
gttatcaactctcatcagaaaccag

SEQ ID NO: 724833 - DNA, 25 bp, Mus musculus
gttatcaactctgatcagaaaccag

SEQ ID NO: 724834 - DNA, 25 bp, Mus musculus
gttatcaacttgctaggccttttgt

SEQ ID NO: 724835 - DNA, 25 bp, Mus musculus
gttatcaacttggtaggccttttgt

SEQ ID NO: 724836 - DNA, 25 bp, Mus musculus
gttatcaagatactcagaggaacct

SEQ ID NO: 724837 - DNA, 25 bp, Mus musculus
gttatcaagatagtcagaggaacct

SEQ ID NO: 724838 - DNA, 25 bp, Mus musculus
gttatcaataaaatttatcccaggt

SEQ ID NO: 724839 - DNA, 25 bp, Mus musculus
gttatcaataaattttatcccaggt

SEQ ID NO: 724840 - DNA, 25 bp, Mus musculus
gttatcaatgctccctacaaccaag

SEQ ID NO: 724841 - DNA, 25 bp, Mus musculus
gttatcaatgctgcctacaaccaag

SEQ ID NO: 724842 - DNA, 25 bp, Mus musculus
gttatcacacatattttcccctttc

SEQ ID NO: 724843 - DNA, 25 bp, Mus musculus
gttatcacacattttttcccctttc

SEQ ID NO: 724844 - DNA, 25 bp, Mus musculus
gttatcacaccaacagttgcttgta

SEQ ID NO: 724845 - DNA, 25 bp, Mus musculus
gttatcacaccatcagttgcttgta

SEQ ID NO: 724846 - DNA, 25 bp, Mus musculus
gttatcacatttactccgcagctac

SEQ ID NO: 724847 - DNA, 25 bp, Mus musculus
gttatcacattttctccgcagctac

SEQ ID NO: 724848 - DNA, 25 bp, Mus musculus
gttatcaccaaaattgagctgacca

SEQ ID NO: 724849 - DNA, 25 bp, Mus musculus
gttatcaccaaatttgagctgacca

SEQ ID NO: 724850 - DNA, 25 bp, Mus musculus
gttatcaccattcttagtgtcatca

SEQ ID NO: 724851 - DNA, 25 bp, Mus musculus
gttatcaccattgttagtgtcatca

SEQ ID NO: 724852 - DNA, 25 bp, Mus musculus
gttatcaccgcgcttgtgacctttt

SEQ ID NO: 724853 - DNA, 25 bp, Mus musculus
gttatcaccgcggttgtgacctttt

SEQ ID NO: 724854 - DNA, 25 bp, Mus musculus
gttatcacctagctgaatgtttttc

SEQ ID NO: 724855 - DNA, 25 bp, Mus musculus
gttatcacctaggtgaatgtttttc

SEQ ID NO: 724856 - DNA, 25 bp, Mus musculus
gttatcacgcttcgagaaccgattt

SEQ ID NO: 724857 - DNA, 25 bp, Mus musculus
gttatcacgcttggagaaccgattt

SEQ ID NO: 724858 - DNA, 25 bp, Mus musculus
gttatcactatacctctgcttcctt

SEQ ID NO: 724859 - DNA, 25 bp, Mus musculus
gttatcactatagctctgcttcctt

SEQ ID NO: 724860 - DNA, 25 bp, Mus musculus
gttatcactcacatgtcatagctgg

SEQ ID NO: 724861 - DNA, 25 bp, Mus musculus
gttatcactcacttgtcatagctgg

SEQ ID NO: 724862 - DNA, 25 bp, Mus musculus
gttatcactgtcagacttcatcttt

SEQ ID NO: 724863 - DNA, 25 bp, Mus musculus
gttatcactgtcagtacaatttctg

SEQ ID NO: 724864 - DNA, 25 bp, Mus musculus
gttatcactgtctgacttcatcttt

SEQ ID NO: 724865 - DNA, 25 bp, Mus musculus
gttatcactgtctgtacaatttctg

SEQ ID NO: 724866 - DNA, 25 bp, Mus musculus
gttatcagaggactcctgtttctcg

SEQ ID NO: 724867 - DNA, 25 bp, Mus musculus
gttatcagaggagtcctgtttctcg

SEQ ID NO: 724868 - DNA, 25 bp, Mus musculus
gttatcagccacctaaaccagggac

SEQ ID NO: 724869 - DNA, 25 bp, Mus musculus
gttatcagccacgtaaaccagggac

SEQ ID NO: 724870 - DNA, 25 bp, Mus musculus
gttatcagctgtatcatttagccag

SEQ ID NO: 724871 - DNA, 25 bp, Mus musculus
gttatcagctgtttcatttagccag

SEQ ID NO: 724872 - DNA, 25 bp, Mus musculus
gttatcagggacagaaccccattta

SEQ ID NO: 724873 - DNA, 25 bp, Mus musculus
gttatcagggactgaaccccattta

SEQ ID NO: 724874 - DNA, 25 bp, Mus musculus
gttatcagggccatccagggaggtt

SEQ ID NO: 724875 - DNA, 25 bp, Mus musculus
gttatcagggccttccagggaggtt

SEQ ID NO: 724876 - DNA, 25 bp, Mus musculus
gttatcagggttagcaagtgccagc

SEQ ID NO: 724877 - DNA, 25 bp, Mus musculus
gttatcagggtttgcaagtgccagc

SEQ ID NO: 724878 - DNA, 25 bp, Mus musculus
gttatcagtgacaacacccttgtgg

SEQ ID NO: 724879 - DNA, 25 bp, Mus musculus
gttatcagtgactacacccttgtgg

SEQ ID NO: 724880 - DNA, 25 bp, Mus musculus
gttatcagtgtaatccagtcttcag

SEQ ID NO: 724881 - DNA, 25 bp, Mus musculus
gttatcagtgtattccagtcttcag

SEQ ID NO: 724882 - DNA, 25 bp, Mus musculus
gttatcagttttaagttcactttct

SEQ ID NO: 724883 - DNA, 25 bp, Mus musculus
gttatcagtttttagttcactttct

SEQ ID NO: 724884 - DNA, 25 bp, Mus musculus
gttatcataatacccacctttcgtc

SEQ ID NO: 724885 - DNA, 25 bp, Mus musculus
gttatcataatagccacctttcgtc

SEQ ID NO: 724886 - DNA, 25 bp, Mus musculus
gttatcatggccacaaaccgaatag

SEQ ID NO: 724887 - DNA, 25 bp, Mus musculus
gttatcatggcctcaaaccgaatag

SEQ ID NO: 724888 - DNA, 25 bp, Mus musculus
gttatcatggctcaaaacatccctg

SEQ ID NO: 724889 - DNA, 25 bp, Mus musculus
gttatcatggctgaaaacatccctg

SEQ ID NO: 724890 - DNA, 25 bp, Mus musculus
gttatcattaacatcatcaggcagg

SEQ ID NO: 724891 - DNA, 25 bp, Mus musculus
gttatcattaacttcatcaggcagg

SEQ ID NO: 724892 - DNA, 25 bp, Mus musculus
gttatcattcaaagctgaactgtct

SEQ ID NO: 724893 - DNA, 25 bp, Mus musculus
gttatcattcaatgctgaactgtct

SEQ ID NO: 724894 - DNA, 25 bp, Mus musculus
gttatcattctgatagttgcgtcag

SEQ ID NO: 724895 - DNA, 25 bp, Mus musculus
gttatcattctgttagttgcgtcag

SEQ ID NO: 724896 - DNA, 25 bp, Mus musculus
gttatcattcttacaatttagaagg

SEQ ID NO: 724897 - DNA, 25 bp, Mus musculus
gttatcattctttcaatttagaagg

SEQ ID NO: 724898 - DNA, 25 bp, Mus musculus
gttatcattgctcgattttgcagaa

SEQ ID NO: 724899 - DNA, 25 bp, Mus musculus
gttatcattgctggattttgcagaa

SEQ ID NO: 724900 - DNA, 25 bp, Mus musculus
gttatcattttcatcacgtctcttg

SEQ ID NO: 724901 - DNA, 25 bp, Mus musculus
gttatcattttcttcacgtctcttg

SEQ ID NO: 724902 - DNA, 25 bp, Mus musculus
gttatccaaaacctgggcggccagc

SEQ ID NO: 724903 - DNA, 25 bp, Mus musculus
gttatccaaaacgtgggcggccagc

SEQ ID NO: 724904 - DNA, 25 bp, Mus musculus
gttatccaacatagctacatgccat

SEQ ID NO: 724905 - DNA, 25 bp, Mus musculus
gttatccaacattgctacatgccat

SEQ ID NO: 724906 - DNA, 25 bp, Mus musculus
gttatccaaccacaaggcattcttg

SEQ ID NO: 724907 - DNA, 25 bp, Mus musculus
gttatccaaccagaaggcattcttg

SEQ ID NO: 724908 - DNA, 25 bp, Mus musculus
gttatccaacctacaattctagtat

SEQ ID NO: 724909 - DNA, 25 bp, Mus musculus
gttatccaaccttcaattctagtat

SEQ ID NO: 724910 - DNA, 25 bp, Mus musculus
gttatccaagttactcaagtcacca

SEQ ID NO: 724911 - DNA, 25 bp, Mus musculus
gttatccaagtttctcaagtcacca

SEQ ID NO: 724912 - DNA, 25 bp, Mus musculus
gttatccacctcatgaatcactggc

SEQ ID NO: 724913 - DNA, 25 bp, Mus musculus
gttatccacctcttgaatcactggc

SEQ ID NO: 724914 - DNA, 25 bp, Mus musculus
gttatccaggaccatacctgagctg

SEQ ID NO: 724915 - DNA, 25 bp, Mus musculus
gttatccaggacgatacctgagctg

SEQ ID NO: 724916 - DNA, 25 bp, Mus musculus
gttatccagtatccagtctgtcttc

SEQ ID NO: 724917 - DNA, 25 bp, Mus musculus
gttatccagtatgcagtctgtcttc

SEQ ID NO: 724918 - DNA, 25 bp, Mus musculus
gttatccatggtcgcctgtatgtgt

SEQ ID NO: 724919 - DNA, 25 bp, Mus musculus
gttatccatggtggcctgtatgtgt

SEQ ID NO: 724920 - DNA, 25 bp, Mus musculus
gttatccatgttaggccagagcgat

SEQ ID NO: 724921 - DNA, 25 bp, Mus musculus
gttatccatgttctctgaaatacga

SEQ ID NO: 724922 - DNA, 25 bp, Mus musculus
gttatccatgttgtctgaaatacga

SEQ ID NO: 724923 - DNA, 25 bp, Mus musculus
gttatccatgtttggccagagcgat

SEQ ID NO: 724924 - DNA, 25 bp, Mus musculus
gttatccattctctatgcagagcca

SEQ ID NO: 724925 - DNA, 25 bp, Mus musculus
gttatccattctgtatgcagagcca

SEQ ID NO: 724926 - DNA, 25 bp, Mus musculus
gttatcccaagcacttgtgaggcat

SEQ ID NO: 724927 - DNA, 25 bp, Mus musculus
gttatcccaagctcttgtgaggcat

SEQ ID NO: 724928 - DNA, 25 bp, Mus musculus
gttatcccacctccgtggatgcaga

SEQ ID NO: 724929 - DNA, 25 bp, Mus musculus
gttatcccacctgcgtggatgcaga

SEQ ID NO: 724930 - DNA, 25 bp, Mus musculus
gttatcccatcacttttgttaccag

SEQ ID NO: 724931 - DNA, 25 bp, Mus musculus
gttatcccatcagttttgttaccag

SEQ ID NO: 724932 - DNA, 25 bp, Mus musculus
gttatccccacacaaggtcattttg

SEQ ID NO: 724933 - DNA, 25 bp, Mus musculus
gttatccccacagaaggtcattttg

SEQ ID NO: 724934 - DNA, 25 bp, Mus musculus
gttatccccagcaactgaatgacaa

SEQ ID NO: 724935 - DNA, 25 bp, Mus musculus
gttatccccagctactgaatgacaa

SEQ ID NO: 724936 - DNA, 25 bp, Mus musculus
gttatccctatgatgaacccattca

SEQ ID NO: 724937 - DNA, 25 bp, Mus musculus
gttatccctatgttgaacccattca

SEQ ID NO: 724938 - DNA, 25 bp, Mus musculus
gttatccctggactacttggatctt

SEQ ID NO: 724939 - DNA, 25 bp, Mus musculus
gttatccctggagtacttggatctt

SEQ ID NO: 724940 - DNA, 25 bp, Mus musculus
gttatccgaaccatacaatttcttg

SEQ ID NO: 724941 - DNA, 25 bp, Mus musculus
gttatccgaaccttacaatttcttg

SEQ ID NO: 724942 - DNA, 25 bp, Mus musculus
gttatccggcccctagtagaggaga

SEQ ID NO: 724943 - DNA, 25 bp, Mus musculus
gttatccggcccgtagtagaggaga

SEQ ID NO: 724944 - DNA, 25 bp, Mus musculus
gttatccgtaacattctatccatgt

SEQ ID NO: 724945 - DNA, 25 bp, Mus musculus
gttatccgtaactttctatccatgt

SEQ ID NO: 724946 - DNA, 25 bp, Mus musculus
gttatccgtgttagatcaactatga

SEQ ID NO: 724947 - DNA, 25 bp, Mus musculus
gttatccgtgtttgatcaactatga

SEQ ID NO: 724948 - DNA, 25 bp, Mus musculus
gttatcctaattcttgtaactgatt

SEQ ID NO: 724949 - DNA, 25 bp, Mus musculus
gttatcctaattgttgtaactgatt

SEQ ID NO: 724950 - DNA, 25 bp, Mus musculus
gttatcctacacctaagatgtttta

SEQ ID NO: 724951 - DNA, 25 bp, Mus musculus
gttatcctacacgtaagatgtttta

SEQ ID NO: 724952 - DNA, 25 bp, Mus musculus
gttatcctaggcctctagactgcaa

SEQ ID NO: 724953 - DNA, 25 bp, Mus musculus
gttatcctaggcgtctagactgcaa

SEQ ID NO: 724954 - DNA, 25 bp, Mus musculus
gttatcctcaaacggtgacaacctc

SEQ ID NO: 724955 - DNA, 25 bp, Mus musculus
gttatcctcaaagggtgacaacctc

SEQ ID NO: 724956 - DNA, 25 bp, Mus musculus
gttatcctcacactatctctatcta

SEQ ID NO: 724957 - DNA, 25 bp, Mus musculus
gttatcctcacagtatctctatcta

SEQ ID NO: 724958 - DNA, 25 bp, Mus musculus
gttatcctcctgcagcgacgtggca

SEQ ID NO: 724959 - DNA, 25 bp, Mus musculus
gttatcctcctggagcgacgtggca

SEQ ID NO: 724960 - DNA, 25 bp, Mus musculus
gttatcctctgaaatcagataccag

SEQ ID NO: 724961 - DNA, 25 bp, Mus musculus
gttatcctctgatatcagataccag

SEQ ID NO: 724962 - DNA, 25 bp, Mus musculus
gttatcctggaacggccctatggca

SEQ ID NO: 724963 - DNA, 25 bp, Mus musculus
gttatcctggaagggccctatggca

SEQ ID NO: 724964 - DNA, 25 bp, Mus musculus
gttatcctggacatgagagatctct

SEQ ID NO: 724965 - DNA, 25 bp, Mus musculus
gttatcctggacttgagagatctct

SEQ ID NO: 724966 - DNA, 25 bp, Mus musculus
gttatcctgggaaacctcggaacag

SEQ ID NO: 724967 - DNA, 25 bp, Mus musculus
gttatcctgggaccaacttgggaga

SEQ ID NO: 724968 - DNA, 25 bp, Mus musculus
gttatcctgggagcaacttgggaga

SEQ ID NO: 724969 - DNA, 25 bp, Mus musculus
gttatcctgggatacctcggaacag

SEQ ID NO: 724970 - DNA, 25 bp, Mus musculus
gttatcctgggtcatactttgttcc

SEQ ID NO: 724971 - DNA, 25 bp, Mus musculus
gttatcctgggtgatactttgttcc

SEQ ID NO: 724972 - DNA, 25 bp, Mus musculus
gttatccttcacaaggcctgggaca

SEQ ID NO: 724973 - DNA, 25 bp, Mus musculus
gttatccttcactaggcctgggaca

SEQ ID NO: 724974 - DNA, 25 bp, Mus musculus
gttatccttcccaagaaactggtca

SEQ ID NO: 724975 - DNA, 25 bp, Mus musculus
gttatccttccctagaaactggtca

SEQ ID NO: 724976 - DNA, 25 bp, Mus musculus
gttatccttcctacttaaattgtca

SEQ ID NO: 724977 - DNA, 25 bp, Mus musculus
gttatccttcctcccagaattccta

SEQ ID NO: 724978 - DNA, 25 bp, Mus musculus
gttatccttcctgccagaattccta

SEQ ID NO: 724979 - DNA, 25 bp, Mus musculus
gttatccttccttcttaaattgtca

SEQ ID NO: 724980 - DNA, 25 bp, Mus musculus
gttatccttgaaatgtctgaccacg

SEQ ID NO: 724981 - DNA, 25 bp, Mus musculus
gttatccttgaattgtctgaccacg

SEQ ID NO: 724982 - DNA, 25 bp, Mus musculus
gttatccttgcacacaactcaggag

SEQ ID NO: 724983 - DNA, 25 bp, Mus musculus
gttatccttgcagacaactcaggag

SEQ ID NO: 724984 - DNA, 25 bp, Mus musculus
gttatccttgccatatcacagttgt

SEQ ID NO: 724985 - DNA, 25 bp, Mus musculus
gttatccttgccttatcacagttgt

SEQ ID NO: 724986 - DNA, 25 bp, Mus musculus
gttatccttgctacacttaagttgc

SEQ ID NO: 724987 - DNA, 25 bp, Mus musculus
gttatccttgcttcacttaagttgc

SEQ ID NO: 724988 - DNA, 25 bp, Mus musculus
gttatccttgggaactgttcattta

SEQ ID NO: 724989 - DNA, 25 bp, Mus musculus
gttatccttgggtactgttcattta

SEQ ID NO: 724990 - DNA, 25 bp, Mus musculus
gttatcgagattattagcaccattt

SEQ ID NO: 724991 - DNA, 25 bp, Mus musculus
gttatcgagatttttagcaccattt

SEQ ID NO: 724992 - DNA, 25 bp, Mus musculus
gttatcgcatgtatcaggacgtcat

SEQ ID NO: 724993 - DNA, 25 bp, Mus musculus
gttatcgcatgtttcaggacgtcat

SEQ ID NO: 724994 - DNA, 25 bp, Mus musculus
gttatcgcccttctgttgtaaacat

SEQ ID NO: 724995 - DNA, 25 bp, Mus musculus
gttatcgcccttgtgttgtaaacat

SEQ ID NO: 724996 - DNA, 25 bp, Mus musculus
gttatcggcaggagctgtgcaaact

SEQ ID NO: 724997 - DNA, 25 bp, Mus musculus
gttatcggcaggtgctgtgcaaact

SEQ ID NO: 724998 - DNA, 25 bp, Mus musculus
gttatcggctgcaatacagtaaaca

SEQ ID NO: 724999 - DNA, 25 bp, Mus musculus
gttatcggctgctatacagtaaaca

SEQ ID NO: 725000 - DNA, 25 bp, Mus musculus
gttatcgtcaccaccaagagcatgt

SEQ ID NO: 725001 - DNA, 25 bp, Mus musculus
gttatcgtcacctccaagagcatgt

SEQ ID NO: 725002 - DNA, 25 bp, Mus musculus
gttatcgtcattctgctggctatca

SEQ ID NO: 725003 - DNA, 25 bp, Mus musculus
gttatcgtcattgtgctggctatca

SEQ ID NO: 725004 - DNA, 25 bp, Mus musculus
gttatcgtgcacatacaggacctga

SEQ ID NO: 725005 - DNA, 25 bp, Mus musculus
gttatcgtgcacttacaggacctga

SEQ ID NO: 725006 - DNA, 25 bp, Mus musculus
gttatcgtgtacagctgtttcctca

SEQ ID NO: 725007 - DNA, 25 bp, Mus musculus
gttatcgtgtactgctgtttcctca

SEQ ID NO: 725008 - DNA, 25 bp, Mus musculus
gttatctaaaggaaccattcaactt

SEQ ID NO: 725009 - DNA, 25 bp, Mus musculus
gttatctaaaggtaccattcaactt

SEQ ID NO: 725010 - DNA, 25 bp, Mus musculus
gttatctaaatacacacacttgggt

SEQ ID NO: 725011 - DNA, 25 bp, Mus musculus
gttatctaaatagacacacttgggt

SEQ ID NO: 725012 - DNA, 25 bp, Mus musculus
gttatctaagagatttgtacaattc

SEQ ID NO: 725013 - DNA, 25 bp, Mus musculus
gttatctaagagttttgtacaattc

SEQ ID NO: 725014 - DNA, 25 bp, Mus musculus
gttatctacactcaccaggctggac

SEQ ID NO: 725015 - DNA, 25 bp, Mus musculus
gttatctacactgaccaggctggac

SEQ ID NO: 725016 - DNA, 25 bp, Mus musculus
gttatctacatacgccagaagaggg

SEQ ID NO: 725017 - DNA, 25 bp, Mus musculus
gttatctacataggccagaagaggg

SEQ ID NO: 725018 - DNA, 25 bp, Mus musculus
gttatctacatcaatacatgcagag

SEQ ID NO: 725019 - DNA, 25 bp, Mus musculus
gttatctacatctatacatgcagag

SEQ ID NO: 725020 - DNA, 25 bp, Mus musculus
gttatctagtgaaaccttgtctcta

SEQ ID NO: 725021 - DNA, 25 bp, Mus musculus
gttatctagtgataccttgtctcta

SEQ ID NO: 725022 - DNA, 25 bp, Mus musculus
gttatctatcttaagtgacaagtta

SEQ ID NO: 725023 - DNA, 25 bp, Mus musculus
gttatctatctttagtgacaagtta

SEQ ID NO: 725024 - DNA, 25 bp, Mus musculus
gttatctatgcaacgttaaggccag

SEQ ID NO: 725025 - DNA, 25 bp, Mus musculus
gttatctatgcatcgttaaggccag

SEQ ID NO: 725026 - DNA, 25 bp, Mus musculus
gttatctatgtcacactgcacaggc

SEQ ID NO: 725027 - DNA, 25 bp, Mus musculus
gttatctatgtctcactgcacaggc

SEQ ID NO: 725028 - DNA, 25 bp, Mus musculus
gttatctcagagaagcccatttcat

SEQ ID NO: 725029 - DNA, 25 bp, Mus musculus
gttatctcagagtagcccatttcat

SEQ ID NO: 725030 - DNA, 25 bp, Mus musculus
gttatctcagtcacttactcatgcc

SEQ ID NO: 725031 - DNA, 25 bp, Mus musculus
gttatctcagtctcttactcatgcc

SEQ ID NO: 725032 - DNA, 25 bp, Mus musculus
gttatctccaggcaaagaagatcta

SEQ ID NO: 725033 - DNA, 25 bp, Mus musculus
gttatctccagggaaagaagatcta

SEQ ID NO: 725034 - DNA, 25 bp, Mus musculus
gttatctccagtcacaattttctct

SEQ ID NO: 725035 - DNA, 25 bp, Mus musculus
gttatctccagtgacaattttctct

SEQ ID NO: 725036 - DNA, 25 bp, Mus musculus
gttatctctaaaagcttcgccacaa

SEQ ID NO: 725037 - DNA, 25 bp, Mus musculus
gttatctctaaatgcttcgccacaa

SEQ ID NO: 725038 - DNA, 25 bp, Mus musculus
gttatctctagcagctggtgcctcc

SEQ ID NO: 725039 - DNA, 25 bp, Mus musculus
gttatctctagccatgatctcactg

SEQ ID NO: 725040 - DNA, 25 bp, Mus musculus
gttatctctagcgatgatctcactg

SEQ ID NO: 725041 - DNA, 25 bp, Mus musculus
gttatctctagctgctggtgcctcc

SEQ ID NO: 725042 - DNA, 25 bp, Mus musculus
gttatctctgacaacattaaaggaa

SEQ ID NO: 725043 - DNA, 25 bp, Mus musculus
gttatctctgactacattaaaggaa

SEQ ID NO: 725044 - DNA, 25 bp, Mus musculus
gttatctctgatcgcaactcctatg

SEQ ID NO: 725045 - DNA, 25 bp, Mus musculus
gttatctctgatggcaactcctatg

SEQ ID NO: 725046 - DNA, 25 bp, Mus musculus
gttatctgaacaagagaggctgtaa

SEQ ID NO: 725047 - DNA, 25 bp, Mus musculus
gttatctgaacatgagaggctgtaa

SEQ ID NO: 725048 - DNA, 25 bp, Mus musculus
gttatctgacccaggctacagattg

SEQ ID NO: 725049 - DNA, 25 bp, Mus musculus
gttatctgaccctggctacagattg

SEQ ID NO: 725050 - DNA, 25 bp, Mus musculus
gttatctgacttaccagggtctgta

SEQ ID NO: 725051 - DNA, 25 bp, Mus musculus
gttatctgactttccagggtctgta

SEQ ID NO: 725052 - DNA, 25 bp, Mus musculus
gttatctgatacattggaaatagct

SEQ ID NO: 725053 - DNA, 25 bp, Mus musculus
gttatctgatactttggaaatagct

SEQ ID NO: 725054 - DNA, 25 bp, Mus musculus
gttatctgcaataggcttggaccca

SEQ ID NO: 725055 - DNA, 25 bp, Mus musculus
gttatctgcaattggcttggaccca

SEQ ID NO: 725056 - DNA, 25 bp, Mus musculus
gttatctgcactagccttgtatgga

SEQ ID NO: 725057 - DNA, 25 bp, Mus musculus
gttatctgcacttgccttgtatgga

SEQ ID NO: 725058 - DNA, 25 bp, Mus musculus
gttatctgcagcatttccaccagga

SEQ ID NO: 725059 - DNA, 25 bp, Mus musculus
gttatctgcagcttttccaccagga

SEQ ID NO: 725060 - DNA, 25 bp, Mus musculus
gttatctgcatacctgcacagctgt

SEQ ID NO: 725061 - DNA, 25 bp, Mus musculus
gttatctgcatagctgcacagctgt

SEQ ID NO: 725062 - DNA, 25 bp, Mus musculus
gttatctgccaaaaaggttactctg

SEQ ID NO: 725063 - DNA, 25 bp, Mus musculus
gttatctgccaataaggttactctg

SEQ ID NO: 725064 - DNA, 25 bp, Mus musculus
gttatctgccgaaacgggatttcag

SEQ ID NO: 725065 - DNA, 25 bp, Mus musculus
gttatctgccgatacgggatttcag

SEQ ID NO: 725066 - DNA, 25 bp, Mus musculus
gttatctgcttcattttacttctcc

SEQ ID NO: 725067 - DNA, 25 bp, Mus musculus
gttatctgcttctttttacttctcc

SEQ ID NO: 725068 - DNA, 25 bp, Mus musculus
gttatctggattatctaattctata

SEQ ID NO: 725069 - DNA, 25 bp, Mus musculus
gttatctggattttctaattctata

SEQ ID NO: 725070 - DNA, 25 bp, Mus musculus
gttatctggtgtatcttgactttac

SEQ ID NO: 725071 - DNA, 25 bp, Mus musculus
gttatctggtgtttcttgactttac

SEQ ID NO: 725072 - DNA, 25 bp, Mus musculus
gttatctgtgagatctgagccactg

SEQ ID NO: 725073 - DNA, 25 bp, Mus musculus
gttatctgtgagttctgagccactg

SEQ ID NO: 725074 - DNA, 25 bp, Mus musculus
gttatcttaagtccctcagtgttag

SEQ ID NO: 725075 - DNA, 25 bp, Mus musculus
gttatcttaagtgcctcagtgttag

SEQ ID NO: 725076 - DNA, 25 bp, Mus musculus
gttatcttacacaatgagcactcag

SEQ ID NO: 725077 - DNA, 25 bp, Mus musculus
gttatcttacactatgagcactcag

SEQ ID NO: 725078 - DNA, 25 bp, Mus musculus
gttatcttagaaacccacactatgg

SEQ ID NO: 725079 - DNA, 25 bp, Mus musculus
gttatcttagaatcccacactatgg

SEQ ID NO: 725080 - DNA, 25 bp, Mus musculus
gttatcttagatactctcttaccgg

SEQ ID NO: 725081 - DNA, 25 bp, Mus musculus
gttatcttagattctctcttaccgg

SEQ ID NO: 725082 - DNA, 25 bp, Mus musculus
gttatcttctgtccacaactgacag

SEQ ID NO: 725083 - DNA, 25 bp, Mus musculus
gttatcttctgtgcacaactgacag

SEQ ID NO: 725084 - DNA, 25 bp, Mus musculus
gttatcttgaccctcaaaagtgccc

SEQ ID NO: 725085 - DNA, 25 bp, Mus musculus
gttatcttgaccgtcaaaagtgccc

SEQ ID NO: 725086 - DNA, 25 bp, Mus musculus
gttatcttgattctgagcgttcttg

SEQ ID NO: 725087 - DNA, 25 bp, Mus musculus
gttatcttgattgtgagcgttcttg

SEQ ID NO: 725088 - DNA, 25 bp, Mus musculus
gttatctttccacaaacttgttgca

SEQ ID NO: 725089 - DNA, 25 bp, Mus musculus
gttatctttccagaaacttgttgca

SEQ ID NO: 725090 - DNA, 25 bp, Mus musculus
gttatctttcctccgtcaaaagctt

SEQ ID NO: 725091 - DNA, 25 bp, Mus musculus
gttatctttcctgcgtcaaaagctt

SEQ ID NO: 725092 - DNA, 25 bp, Mus musculus
gttatctttttaatcctcaacttgt

SEQ ID NO: 725093 - DNA, 25 bp, Mus musculus
gttatctttttattcctcaacttgt

SEQ ID NO: 725094 - DNA, 25 bp, Mus musculus
gttatgaaaccactcatcttatata

SEQ ID NO: 725095 - DNA, 25 bp, Mus musculus
gttatgaaaccagtcatcttatata

SEQ ID NO: 725096 - DNA, 25 bp, Mus musculus
gttatgaaacgcagatccggtcagc

SEQ ID NO: 725097 - DNA, 25 bp, Mus musculus
gttatgaaacgctgatccggtcagc

SEQ ID NO: 725098 - DNA, 25 bp, Mus musculus
gttatgaaaggcctgacttccacaa

SEQ ID NO: 725099 - DNA, 25 bp, Mus musculus
gttatgaaaggcgtgacttccacaa

SEQ ID NO: 725100 - DNA, 25 bp, Mus musculus
gttatgaacaagatgccactttgaa

SEQ ID NO: 725101 - DNA, 25 bp, Mus musculus
gttatgaacaagttgccactttgaa

SEQ ID NO: 725102 - DNA, 25 bp, Mus musculus
gttatgaaccagataatttccttgt

SEQ ID NO: 725103 - DNA, 25 bp, Mus musculus
gttatgaaccagttaatttccttgt

SEQ ID NO: 725104 - DNA, 25 bp, Mus musculus
gttatgaacgatcctctacacaagt

SEQ ID NO: 725105 - DNA, 25 bp, Mus musculus
gttatgaacgatgctctacacaagt

SEQ ID NO: 725106 - DNA, 25 bp, Mus musculus
gttatgaactatcttttaaacactc

SEQ ID NO: 725107 - DNA, 25 bp, Mus musculus
gttatgaactatgttttaaacactc

SEQ ID NO: 725108 - DNA, 25 bp, Mus musculus
gttatgaactgtctatcaactttag

SEQ ID NO: 725109 - DNA, 25 bp, Mus musculus
gttatgaactgtgtatcaactttag

SEQ ID NO: 725110 - DNA, 25 bp, Mus musculus
gttatgaagattacgttgagggtct

SEQ ID NO: 725111 - DNA, 25 bp, Mus musculus
gttatgaagatttcgttgagggtct

SEQ ID NO: 725112 - DNA, 25 bp, Mus musculus
gttatgaaggcgatctttgcaccgt

SEQ ID NO: 725113 - DNA, 25 bp, Mus musculus
gttatgaaggcgttctttgcaccgt

SEQ ID NO: 725114 - DNA, 25 bp, Mus musculus
gttatgaatcaccattaagtatctg

SEQ ID NO: 725115 - DNA, 25 bp, Mus musculus
gttatgaatcacgattaagtatctg

SEQ ID NO: 725116 - DNA, 25 bp, Mus musculus
gttatgaattcacaaagagggtttc

SEQ ID NO: 725117 - DNA, 25 bp, Mus musculus
gttatgaattcagaaagagggtttc

SEQ ID NO: 725118 - DNA, 25 bp, Mus musculus
gttatgacaatcctgtctcagctca

SEQ ID NO: 725119 - DNA, 25 bp, Mus musculus
gttatgacaatcgtgtctcagctca

SEQ ID NO: 725120 - DNA, 25 bp, Mus musculus
gttatgacacatccttccatccaga

SEQ ID NO: 725121 - DNA, 25 bp, Mus musculus
gttatgacacatgcttccatccaga

SEQ ID NO: 725122 - DNA, 25 bp, Mus musculus
gttatgacacctaaatcctggtttc

SEQ ID NO: 725123 - DNA, 25 bp, Mus musculus
gttatgacaccttaatcctggtttc

SEQ ID NO: 725124 - DNA, 25 bp, Mus musculus
gttatgacagcaagcccagttcaga

SEQ ID NO: 725125 - DNA, 25 bp, Mus musculus
gttatgacagcatgcccagttcaga

SEQ ID NO: 725126 - DNA, 25 bp, Mus musculus
gttatgacatctctttcttcctggg

SEQ ID NO: 725127 - DNA, 25 bp, Mus musculus
gttatgacatctgtttcttcctggg

SEQ ID NO: 725128 - DNA, 25 bp, Mus musculus
gttatgacctacagacaacgttttt

SEQ ID NO: 725129 - DNA, 25 bp, Mus musculus
gttatgacctactgacaacgttttt

SEQ ID NO: 725130 - DNA, 25 bp, Mus musculus
gttatgactcacaaagcctaatact

SEQ ID NO: 725131 - DNA, 25 bp, Mus musculus
gttatgactcactaagcctaatact

SEQ ID NO: 725132 - DNA, 25 bp, Mus musculus
gttatgactcatatgctatatttag

SEQ ID NO: 725133 - DNA, 25 bp, Mus musculus
gttatgactcatttgctatatttag

SEQ ID NO: 725134 - DNA, 25 bp, Mus musculus
gttatgactgtgaacctgggtgttc

SEQ ID NO: 725135 - DNA, 25 bp, Mus musculus
gttatgactgtgtacctgggtgttc

SEQ ID NO: 725136 - DNA, 25 bp, Mus musculus
gttatgacttatattctcccagggt

SEQ ID NO: 725137 - DNA, 25 bp, Mus musculus
gttatgacttattttctcccagggt

SEQ ID NO: 725138 - DNA, 25 bp, Mus musculus
gttatgagacctcagctgcagactg

SEQ ID NO: 725139 - DNA, 25 bp, Mus musculus
gttatgagacctgagctgcagactg

SEQ ID NO: 725140 - DNA, 25 bp, Mus musculus
gttatgagcaacaatttcggaatat

SEQ ID NO: 725141 - DNA, 25 bp, Mus musculus
gttatgagcaactatttcggaatat

SEQ ID NO: 725142 - DNA, 25 bp, Mus musculus
gttatgagccataatgtgattgttg

SEQ ID NO: 725143 - DNA, 25 bp, Mus musculus
gttatgagccattatgtgattgttg

SEQ ID NO: 725144 - DNA, 25 bp, Mus musculus
gttatgagccctcccatgatggaga

SEQ ID NO: 725145 - DNA, 25 bp, Mus musculus
gttatgagccctgccatgatggaga

SEQ ID NO: 725146 - DNA, 25 bp, Mus musculus
gttatgagccggaagggcccagccc

SEQ ID NO: 725147 - DNA, 25 bp, Mus musculus
gttatgagccggtagggcccagccc

SEQ ID NO: 725148 - DNA, 25 bp, Mus musculus
gttatgaggaaccagaccgttatgt

SEQ ID NO: 725149 - DNA, 25 bp, Mus musculus
gttatgaggaacgagaccgttatgt

SEQ ID NO: 725150 - DNA, 25 bp, Mus musculus
gttatgagggttcttcttttgcgat

SEQ ID NO: 725151 - DNA, 25 bp, Mus musculus
gttatgagggttgttcttttgcgat

SEQ ID NO: 725152 - DNA, 25 bp, Mus musculus
gttatgagtttgattccacgggaat

SEQ ID NO: 725153 - DNA, 25 bp, Mus musculus
gttatgagtttgtttccacgggaat

SEQ ID NO: 725154 - DNA, 25 bp, Mus musculus
gttatgataacaaccccagaaggtt

SEQ ID NO: 725155 - DNA, 25 bp, Mus musculus
gttatgataacatccccagaaggtt

SEQ ID NO: 725156 - DNA, 25 bp, Mus musculus
gttatgatacagatcccttccacat

SEQ ID NO: 725157 - DNA, 25 bp, Mus musculus
gttatgatacagttcccttccacat

SEQ ID NO: 725158 - DNA, 25 bp, Mus musculus
gttatgatacttaggactgtcagca

SEQ ID NO: 725159 - DNA, 25 bp, Mus musculus
gttatgatactttggactgtcagca

SEQ ID NO: 725160 - DNA, 25 bp, Mus musculus
gttatgatatttatccgagttttga

SEQ ID NO: 725161 - DNA, 25 bp, Mus musculus
gttatgatatttttccgagttttga

SEQ ID NO: 725162 - DNA, 25 bp, Mus musculus
gttatgatcagcagtggcctgcgat

SEQ ID NO: 725163 - DNA, 25 bp, Mus musculus
gttatgatcagctgtggcctgcgat

SEQ ID NO: 725164 - DNA, 25 bp, Mus musculus
gttatgatctctagatggccatggt

SEQ ID NO: 725165 - DNA, 25 bp, Mus musculus
gttatgatctcttgatggccatggt

SEQ ID NO: 725166 - DNA, 25 bp, Mus musculus
gttatgatgcctcgcctttctgtac

SEQ ID NO: 725167 - DNA, 25 bp, Mus musculus
gttatgatgcctggcctttctgtac

SEQ ID NO: 725168 - DNA, 25 bp, Mus musculus
gttatgatgctacatgttctttaca

SEQ ID NO: 725169 - DNA, 25 bp, Mus musculus
gttatgatgctagatgttctttaca

SEQ ID NO: 725170 - DNA, 25 bp, Mus musculus
gttatgatgcttatcaggctacttc

SEQ ID NO: 725171 - DNA, 25 bp, Mus musculus
gttatgatgcttttcaggctacttc

SEQ ID NO: 725172 - DNA, 25 bp, Mus musculus
gttatgattgtcattcttcccactg

SEQ ID NO: 725173 - DNA, 25 bp, Mus musculus
gttatgattgtctttcttcccactg

SEQ ID NO: 725174 - DNA, 25 bp, Mus musculus
gttatgatttccatggaatccagca

SEQ ID NO: 725175 - DNA, 25 bp, Mus musculus
gttatgatttccttggaatccagca

SEQ ID NO: 725176 - DNA, 25 bp, Mus musculus
gttatgatttctacagggattttta

SEQ ID NO: 725177 - DNA, 25 bp, Mus musculus
gttatgatttctctttagctacctg

SEQ ID NO: 725178 - DNA, 25 bp, Mus musculus
gttatgatttctgtttagctacctg

SEQ ID NO: 725179 - DNA, 25 bp, Mus musculus
gttatgatttcttcagggattttta

SEQ ID NO: 725180 - DNA, 25 bp, Mus musculus
gttatgattttgaacattgacttga

SEQ ID NO: 725181 - DNA, 25 bp, Mus musculus
gttatgattttgtacattgacttga

SEQ ID NO: 725182 - DNA, 25 bp, Mus musculus
gttatgcaaagaaaggttactcaat

SEQ ID NO: 725183 - DNA, 25 bp, Mus musculus
gttatgcaaagataggttactcaat

SEQ ID NO: 725184 - DNA, 25 bp, Mus musculus
gttatgcaatctactctagtcttcg

SEQ ID NO: 725185 - DNA, 25 bp, Mus musculus
gttatgcaatcttctctagtcttcg

SEQ ID NO: 725186 - DNA, 25 bp, Mus musculus
gttatgcagcgcactttgtgtgtgg

SEQ ID NO: 725187 - DNA, 25 bp, Mus musculus
gttatgcagcgctctttgtgtgtgg

SEQ ID NO: 725188 - DNA, 25 bp, Mus musculus
gttatgcagggaccgactgagcccc

SEQ ID NO: 725189 - DNA, 25 bp, Mus musculus
gttatgcagggagcgactgagcccc

SEQ ID NO: 725190 - DNA, 25 bp, Mus musculus
gttatgcatagcacttcaacatggc

SEQ ID NO: 725191 - DNA, 25 bp, Mus musculus
gttatgcatagctcttcaacatggc

SEQ ID NO: 725192 - DNA, 25 bp, Mus musculus
gttatgcatatgataggaagcctgt

SEQ ID NO: 725193 - DNA, 25 bp, Mus musculus
gttatgcatatgttaggaagcctgt

SEQ ID NO: 725194 - DNA, 25 bp, Mus musculus
gttatgcatgaccttggagggccca

SEQ ID NO: 725195 - DNA, 25 bp, Mus musculus
gttatgcatgacgttggagggccca

SEQ ID NO: 725196 - DNA, 25 bp, Mus musculus
gttatgcatttacacctcaggtcct

SEQ ID NO: 725197 - DNA, 25 bp, Mus musculus
gttatgcatttagacctcaggtcct

SEQ ID NO: 725198 - DNA, 25 bp, Mus musculus
gttatgccaaaccagaacttaccac

SEQ ID NO: 725199 - DNA, 25 bp, Mus musculus
gttatgccaaacgagaacttaccac

SEQ ID NO: 725200 - DNA, 25 bp, Mus musculus
gttatgccacttaacgagcacagca

SEQ ID NO: 725201 - DNA, 25 bp, Mus musculus
gttatgccactttacgagcacagca

SEQ ID NO: 725202 - DNA, 25 bp, Mus musculus
gttatgccagaaacccttcactgaa

SEQ ID NO: 725203 - DNA, 25 bp, Mus musculus
gttatgccagaatcccttcactgaa

SEQ ID NO: 725204 - DNA, 25 bp, Mus musculus
gttatgccatatctcacatgaccac

SEQ ID NO: 725205 - DNA, 25 bp, Mus musculus
gttatgccatatgtcacatgaccac

SEQ ID NO: 725206 - DNA, 25 bp, Mus musculus
gttatgccatgaatgttccagattt

SEQ ID NO: 725207 - DNA, 25 bp, Mus musculus
gttatgccatgattgttccagattt

SEQ ID NO: 725208 - DNA, 25 bp, Mus musculus
gttatgcccaatacgtcttattacc

SEQ ID NO: 725209 - DNA, 25 bp, Mus musculus
gttatgcccaattcgtcttattacc

SEQ ID NO: 725210 - DNA, 25 bp, Mus musculus
gttatgcccagtatgtccaccgcct

SEQ ID NO: 725211 - DNA, 25 bp, Mus musculus
gttatgcccagtttgtccaccgcct

SEQ ID NO: 725212 - DNA, 25 bp, Mus musculus
gttatgccttttcgactcggaacaa

SEQ ID NO: 725213 - DNA, 25 bp, Mus musculus
gttatgccttttggactcggaacaa

SEQ ID NO: 725214 - DNA, 25 bp, Mus musculus
gttatgcgccacaaaagagccaagc

SEQ ID NO: 725215 - DNA, 25 bp, Mus musculus
gttatgcgccactaaagagccaagc

SEQ ID NO: 725216 - DNA, 25 bp, Mus musculus
gttatgcgctgaccccggcctgaca

SEQ ID NO: 725217 - DNA, 25 bp, Mus musculus
gttatgcgctgagcccggcctgaca

SEQ ID NO: 725218 - DNA, 25 bp, Mus musculus
gttatgctaaccatagagatccaag

SEQ ID NO: 725219 - DNA, 25 bp, Mus musculus
gttatgctaaccttagagatccaag

SEQ ID NO: 725220 - DNA, 25 bp, Mus musculus
gttatgctaacgctgtaagccccca

SEQ ID NO: 725221 - DNA, 25 bp, Mus musculus
gttatgctaacggtgtaagccccca

SEQ ID NO: 725222 - DNA, 25 bp, Mus musculus
gttatgctattgcttatctgttgga

SEQ ID NO: 725223 - DNA, 25 bp, Mus musculus
gttatgctattggttatctgttgga

SEQ ID NO: 725224 - DNA, 25 bp, Mus musculus
gttatgctcaggaacctcttgtata

SEQ ID NO: 725225 - DNA, 25 bp, Mus musculus
gttatgctcaggtacctcttgtata

SEQ ID NO: 725226 - DNA, 25 bp, Mus musculus
gttatgctcccacttacaatcagtt

SEQ ID NO: 725227 - DNA, 25 bp, Mus musculus
gttatgctcccagttacaatcagtt

SEQ ID NO: 725228 - DNA, 25 bp, Mus musculus
gttatgctctacacagacatgccat

SEQ ID NO: 725229 - DNA, 25 bp, Mus musculus
gttatgctctactcagacatgccat

SEQ ID NO: 725230 - DNA, 25 bp, Mus musculus
gttatgctgttaaaggaaagagtct

SEQ ID NO: 725231 - DNA, 25 bp, Mus musculus
gttatgctgttataggaaagagtct

SEQ ID NO: 725232 - DNA, 25 bp, Mus musculus
gttatgcttacaccacccatgtgct

SEQ ID NO: 725233 - DNA, 25 bp, Mus musculus
gttatgcttacagcacccatgtgct

SEQ ID NO: 725234 - DNA, 25 bp, Mus musculus
gttatgcttttgaatgaccttgtta

SEQ ID NO: 725235 - DNA, 25 bp, Mus musculus
gttatgcttttgtatgaccttgtta

SEQ ID NO: 725236 - DNA, 25 bp, Mus musculus
gttatggaatgccttcttcgttttc

SEQ ID NO: 725237 - DNA, 25 bp, Mus musculus
gttatggaatgcgttcttcgttttc

SEQ ID NO: 725238 - DNA, 25 bp, Mus musculus
gttatggaattcagtcttgctgtat

SEQ ID NO: 725239 - DNA, 25 bp, Mus musculus
gttatggaattctgtcttgctgtat

SEQ ID NO: 725240 - DNA, 25 bp, Mus musculus
gttatggacaacacaaggacaggta

SEQ ID NO: 725241 - DNA, 25 bp, Mus musculus
gttatggacaactcaaggacaggta

SEQ ID NO: 725242 - DNA, 25 bp, Mus musculus
gttatggatccgatctatgtagctt

SEQ ID NO: 725243 - DNA, 25 bp, Mus musculus
gttatggatccgttctatgtagctt

SEQ ID NO: 725244 - DNA, 25 bp, Mus musculus
gttatggcaccaacatctgttacca

SEQ ID NO: 725245 - DNA, 25 bp, Mus musculus
gttatggcaccatcatctgttacca

SEQ ID NO: 725246 - DNA, 25 bp, Mus musculus
gttatggcatagatgctgctccgca

SEQ ID NO: 725247 - DNA, 25 bp, Mus musculus
gttatggcatagttgctgctccgca

SEQ ID NO: 725248 - DNA, 25 bp, Mus musculus
gttatggccagaaacttaccagaaa

SEQ ID NO: 725249 - DNA, 25 bp, Mus musculus
gttatggccagatacttaccagaaa

SEQ ID NO: 725250 - DNA, 25 bp, Mus musculus
gttatggccggaccctgagatacgc

SEQ ID NO: 725251 - DNA, 25 bp, Mus musculus
gttatggccggagcctgagatacgc

SEQ ID NO: 725252 - DNA, 25 bp, Mus musculus
gttatggccgttaatactgtagctg

SEQ ID NO: 725253 - DNA, 25 bp, Mus musculus
gttatggccgtttatactgtagctg

SEQ ID NO: 725254 - DNA, 25 bp, Mus musculus
gttatggctccaaaagcacttccac

SEQ ID NO: 725255 - DNA, 25 bp, Mus musculus
gttatggctccataagcacttccac

SEQ ID NO: 725256 - DNA, 25 bp, Mus musculus
gttatggctcggcttaattagacat

SEQ ID NO: 725257 - DNA, 25 bp, Mus musculus
gttatggctcgggttaattagacat

SEQ ID NO: 725258 - DNA, 25 bp, Mus musculus
gttatggctctcagcctgtaatgta

SEQ ID NO: 725259 - DNA, 25 bp, Mus musculus
gttatggctctctgcctgtaatgta

SEQ ID NO: 725260 - DNA, 25 bp, Mus musculus
gttatgggaaagaaaactctacaag

SEQ ID NO: 725261 - DNA, 25 bp, Mus musculus
gttatgggaaagtaaactctacaag

SEQ ID NO: 725262 - DNA, 25 bp, Mus musculus
gttatgggaagtcattctgcacccc

SEQ ID NO: 725263 - DNA, 25 bp, Mus musculus
gttatgggaagtgattctgcacccc

SEQ ID NO: 725264 - DNA, 25 bp, Mus musculus
gttatgggctacagtctaaaacaca

SEQ ID NO: 725265 - DNA, 25 bp, Mus musculus
gttatgggctactgtctaaaacaca

SEQ ID NO: 725266 - DNA, 25 bp, Mus musculus
gttatgggtccaattttcctggaat

SEQ ID NO: 725267 - DNA, 25 bp, Mus musculus
gttatgggtccatttttcctggaat

SEQ ID NO: 725268 - DNA, 25 bp, Mus musculus
gttatgggtggtctgtaccctatcc

SEQ ID NO: 725269 - DNA, 25 bp, Mus musculus
gttatgggtggtgtgtaccctatcc

SEQ ID NO: 725270 - DNA, 25 bp, Mus musculus
gttatggtaatgatctctctgctga

SEQ ID NO: 725271 - DNA, 25 bp, Mus musculus
gttatggtaatgttctctctgctga

SEQ ID NO: 725272 - DNA, 25 bp, Mus musculus
gttatggtaccgaactcatcttttg

SEQ ID NO: 725273 - DNA, 25 bp, Mus musculus
gttatggtaccgtactcatcttttg

SEQ ID NO: 725274 - DNA, 25 bp, Mus musculus
gttatggtacgtcttctttcctgaa

SEQ ID NO: 725275 - DNA, 25 bp, Mus musculus
gttatggtacgtgttctttcctgaa

SEQ ID NO: 725276 - DNA, 25 bp, Mus musculus
gttatggtcaatatatgtcgccaca

SEQ ID NO: 725277 - DNA, 25 bp, Mus musculus
gttatggtcaatttatgtcgccaca

SEQ ID NO: 725278 - DNA, 25 bp, Mus musculus
gttatggtgcatacttggctcagcc

SEQ ID NO: 725279 - DNA, 25 bp, Mus musculus
gttatggtgcattcttggctcagcc

SEQ ID NO: 725280 - DNA, 25 bp, Mus musculus
gttatggttatgatcccatttcaca

SEQ ID NO: 725281 - DNA, 25 bp, Mus musculus
gttatggttatgttcccatttcaca

SEQ ID NO: 725282 - DNA, 25 bp, Mus musculus
gttatggttctccttcttattgaaa

SEQ ID NO: 725283 - DNA, 25 bp, Mus musculus
gttatggttctcgttcttattgaaa

SEQ ID NO: 725284 - DNA, 25 bp, Mus musculus
gttatggttggaaagcttgatgttc

SEQ ID NO: 725285 - DNA, 25 bp, Mus musculus
gttatggttggatagcttgatgttc

SEQ ID NO: 725286 - DNA, 25 bp, Mus musculus
gttatgtaacaacctgacgtgatgg

SEQ ID NO: 725287 - DNA, 25 bp, Mus musculus
gttatgtaacaagctgacgtgatgg

SEQ ID NO: 725288 - DNA, 25 bp, Mus musculus
gttatgtaagcgatcctgacaggaa

SEQ ID NO: 725289 - DNA, 25 bp, Mus musculus
gttatgtaagcgttcctgacaggaa

SEQ ID NO: 725290 - DNA, 25 bp, Mus musculus
gttatgtaccacagcatgatttcag

SEQ ID NO: 725291 - DNA, 25 bp, Mus musculus
gttatgtaccactgcatgatttcag

SEQ ID NO: 725292 - DNA, 25 bp, Mus musculus
gttatgtagtcacacgctagctgct

SEQ ID NO: 725293 - DNA, 25 bp, Mus musculus
gttatgtagtcagacgctagctgct

SEQ ID NO: 725294 - DNA, 25 bp, Mus musculus
gttatgtatagcctgctacctccag

SEQ ID NO: 725295 - DNA, 25 bp, Mus musculus
gttatgtatagcgtgctacctccag

SEQ ID NO: 725296 - DNA, 25 bp, Mus musculus
gttatgtcatctaaagacactgcca

SEQ ID NO: 725297 - DNA, 25 bp, Mus musculus
gttatgtcatcttaagacactgcca

SEQ ID NO: 725298 - DNA, 25 bp, Mus musculus
gttatgtcccctaggctggaagctg

SEQ ID NO: 725299 - DNA, 25 bp, Mus musculus
gttatgtccccttggctggaagctg

SEQ ID NO: 725300 - DNA, 25 bp, Mus musculus
gttatgtcctcacctatgtcaagtt

SEQ ID NO: 725301 - DNA, 25 bp, Mus musculus
gttatgtcctcagctatgtcaagtt

SEQ ID NO: 725302 - DNA, 25 bp, Mus musculus
gttatgtctcctaagtgacacccat

SEQ ID NO: 725303 - DNA, 25 bp, Mus musculus
gttatgtctccttagtgacacccat

SEQ ID NO: 725304 - DNA, 25 bp, Mus musculus
gttatgtctctaattaccttcctgg

SEQ ID NO: 725305 - DNA, 25 bp, Mus musculus
gttatgtctctatttaccttcctgg

SEQ ID NO: 725306 - DNA, 25 bp, Mus musculus
gttatgtctgacagcttaccagctc

SEQ ID NO: 725307 - DNA, 25 bp, Mus musculus
gttatgtctgactgcttaccagctc

SEQ ID NO: 725308 - DNA, 25 bp, Mus musculus
gttatgtcttccagaaggcctacct

SEQ ID NO: 725309 - DNA, 25 bp, Mus musculus
gttatgtcttcctgaaggcctacct

SEQ ID NO: 725310 - DNA, 25 bp, Mus musculus
gttatgtgaaccacctgaagtatta

SEQ ID NO: 725311 - DNA, 25 bp, Mus musculus
gttatgtgaacctcctgaagtatta

SEQ ID NO: 725312 - DNA, 25 bp, Mus musculus
gttatgtgaatcatagcctaggagc

SEQ ID NO: 725313 - DNA, 25 bp, Mus musculus
gttatgtgaatcttagcctaggagc

SEQ ID NO: 725314 - DNA, 25 bp, Mus musculus
gttatgtgcagaacccgctgagaga

SEQ ID NO: 725315 - DNA, 25 bp, Mus musculus
gttatgtgcagatcccgctgagaga

SEQ ID NO: 725316 - DNA, 25 bp, Mus musculus
gttatgtgcgaaattttcaccccgt

SEQ ID NO: 725317 - DNA, 25 bp, Mus musculus
gttatgtgcgaatttttcaccccgt

SEQ ID NO: 725318 - DNA, 25 bp, Mus musculus
gttatgtgctgcattctggagcata

SEQ ID NO: 725319 - DNA, 25 bp, Mus musculus
gttatgtgctgctttctggagcata

SEQ ID NO: 725320 - DNA, 25 bp, Mus musculus
gttatgtgtataacctttctgccgg

SEQ ID NO: 725321 - DNA, 25 bp, Mus musculus
gttatgtgtatatcctttctgccgg

SEQ ID NO: 725322 - DNA, 25 bp, Mus musculus
gttatgtgtcatacttgttgtcaaa

SEQ ID NO: 725323 - DNA, 25 bp, Mus musculus
gttatgtgtcattcttgttgtcaaa

SEQ ID NO: 725324 - DNA, 25 bp, Mus musculus
gttatgtgttaccttgtgagtgcta

SEQ ID NO: 725325 - DNA, 25 bp, Mus musculus
gttatgtgttacgttgtgagtgcta

SEQ ID NO: 725326 - DNA, 25 bp, Mus musculus
gttatgttaaaaccttcctacaggg

SEQ ID NO: 725327 - DNA, 25 bp, Mus musculus
gttatgttaaaagcttcctacaggg

SEQ ID NO: 725328 - DNA, 25 bp, Mus musculus
gttatgttaattcgtcttctctaga

SEQ ID NO: 725329 - DNA, 25 bp, Mus musculus
gttatgttaattggtcttctctaga

SEQ ID NO: 725330 - DNA, 25 bp, Mus musculus
gttatgttacttcatttgtcattac

SEQ ID NO: 725331 - DNA, 25 bp, Mus musculus
gttatgttacttgatttgtcattac

SEQ ID NO: 725332 - DNA, 25 bp, Mus musculus
gttatgttatgaactccttcttccc

SEQ ID NO: 725333 - DNA, 25 bp, Mus musculus
gttatgttatgatctccttcttccc

SEQ ID NO: 725334 - DNA, 25 bp, Mus musculus
gttatgttcagcattccccttactt

SEQ ID NO: 725335 - DNA, 25 bp, Mus musculus
gttatgttcagctttccccttactt

SEQ ID NO: 725336 - DNA, 25 bp, Mus musculus
gttatgttccagacagcacagcact

SEQ ID NO: 725337 - DNA, 25 bp, Mus musculus
gttatgttccagtcagcacagcact

SEQ ID NO: 725338 - DNA, 25 bp, Mus musculus
gttatgttctcgctaatctctccaa

SEQ ID NO: 725339 - DNA, 25 bp, Mus musculus
gttatgttctcggtaatctctccaa

SEQ ID NO: 725340 - DNA, 25 bp, Mus musculus
gttatgttcttccatctgttttgta

SEQ ID NO: 725341 - DNA, 25 bp, Mus musculus
gttatgttcttcgatctgttttgta

SEQ ID NO: 725342 - DNA, 25 bp, Mus musculus
gttatgttgacactagctgaaccat

SEQ ID NO: 725343 - DNA, 25 bp, Mus musculus
gttatgttgacagtagctgaaccat

SEQ ID NO: 725344 - DNA, 25 bp, Mus musculus
gttatgttggatacttagctacttc

SEQ ID NO: 725345 - DNA, 25 bp, Mus musculus
gttatgttggattcttagctacttc

SEQ ID NO: 725346 - DNA, 25 bp, Mus musculus
gttatgttgtcacaccacatctcag

SEQ ID NO: 725347 - DNA, 25 bp, Mus musculus
gttatgttgtcagaccacatctcag

SEQ ID NO: 725348 - DNA, 25 bp, Mus musculus
gttatgtttctcacttttattccag

SEQ ID NO: 725349 - DNA, 25 bp, Mus musculus
gttatgtttctccaatattacctca

SEQ ID NO: 725350 - DNA, 25 bp, Mus musculus
gttatgtttctcgaatattacctca

SEQ ID NO: 725351 - DNA, 25 bp, Mus musculus
gttatgtttctctcttttattccag

SEQ ID NO: 725352 - DNA, 25 bp, Mus musculus
gttatgtttttcactcaagttctta

SEQ ID NO: 725353 - DNA, 25 bp, Mus musculus
gttatgtttttctctcaagttctta

SEQ ID NO: 725354 - DNA, 25 bp, Mus musculus
gttattaaactgacctagcttttgg

SEQ ID NO: 725355 - DNA, 25 bp, Mus musculus
gttattaaactgtcctagcttttgg

SEQ ID NO: 725356 - DNA, 25 bp, Mus musculus
gttattaaagcgctcactgtctcag

SEQ ID NO: 725357 - DNA, 25 bp, Mus musculus
gttattaaagcggtcactgtctcag

SEQ ID NO: 725358 - DNA, 25 bp, Mus musculus
gttattaactcaaggatgtatgcac

SEQ ID NO: 725359 - DNA, 25 bp, Mus musculus
gttattaactcatggatgtatgcac

SEQ ID NO: 725360 - DNA, 25 bp, Mus musculus
gttattaatgtcaaaagtctgtact

SEQ ID NO: 725361 - DNA, 25 bp, Mus musculus
gttattaatgtctaaagtctgtact

SEQ ID NO: 725362 - DNA, 25 bp, Mus musculus
gttattacaagaccctaacgccggc

SEQ ID NO: 725363 - DNA, 25 bp, Mus musculus
gttattacaagagcctaacgccggc

SEQ ID NO: 725364 - DNA, 25 bp, Mus musculus
gttattacagatatgttacatttgg

SEQ ID NO: 725365 - DNA, 25 bp, Mus musculus
gttattacagatttgttacatttgg

SEQ ID NO: 725366 - DNA, 25 bp, Mus musculus
gttattaccatcctgaggggagtgg

SEQ ID NO: 725367 - DNA, 25 bp, Mus musculus
gttattaccatcgtgaggggagtgg

SEQ ID NO: 725368 - DNA, 25 bp, Mus musculus
gttattactcacagaagggccacat

SEQ ID NO: 725369 - DNA, 25 bp, Mus musculus
gttattactcactgaagggccacat

SEQ ID NO: 725370 - DNA, 25 bp, Mus musculus
gttattactctcagaacacagccag

SEQ ID NO: 725371 - DNA, 25 bp, Mus musculus
gttattactctctgaacacagccag

SEQ ID NO: 725372 - DNA, 25 bp, Mus musculus
gttattagaacaatcgcttctacct

SEQ ID NO: 725373 - DNA, 25 bp, Mus musculus
gttattagaacattcgcttctacct

SEQ ID NO: 725374 - DNA, 25 bp, Mus musculus
gttattagcaccagactgcaaaggg

SEQ ID NO: 725375 - DNA, 25 bp, Mus musculus
gttattagcacctgactgcaaaggg

SEQ ID NO: 725376 - DNA, 25 bp, Mus musculus
gttattagccagatgtaaccccgct

SEQ ID NO: 725377 - DNA, 25 bp, Mus musculus
gttattagccagttgtaaccccgct

SEQ ID NO: 725378 - DNA, 25 bp, Mus musculus
gttattagctagatatcccagtttt

SEQ ID NO: 725379 - DNA, 25 bp, Mus musculus
gttattagctagttatcccagtttt

SEQ ID NO: 725380 - DNA, 25 bp, Mus musculus
gttattagcttacaacactatacaa

SEQ ID NO: 725381 - DNA, 25 bp, Mus musculus
gttattagcttagaacactatacaa

SEQ ID NO: 725382 - DNA, 25 bp, Mus musculus
gttattaggactcttgtttcatgtg

SEQ ID NO: 725383 - DNA, 25 bp, Mus musculus
gttattaggactgttgtttcatgtg

SEQ ID NO: 725384 - DNA, 25 bp, Mus musculus
gttattagtaacatgcaagattgca

SEQ ID NO: 725385 - DNA, 25 bp, Mus musculus
gttattagtaacttgcaagattgca

SEQ ID NO: 725386 - DNA, 25 bp, Mus musculus
gttattagtggaagtactcctgcca

SEQ ID NO: 725387 - DNA, 25 bp, Mus musculus
gttattagtggatgtactcctgcca

SEQ ID NO: 725388 - DNA, 25 bp, Mus musculus
gttattagttcaacctcgaggctac

SEQ ID NO: 725389 - DNA, 25 bp, Mus musculus
gttattagttcatcctcgaggctac

SEQ ID NO: 725390 - DNA, 25 bp, Mus musculus
gttattataaatcgttttcctactg

SEQ ID NO: 725391 - DNA, 25 bp, Mus musculus
gttattataaatggttttcctactg

SEQ ID NO: 725392 - DNA, 25 bp, Mus musculus
gttattataccccagggcttcagaa

SEQ ID NO: 725393 - DNA, 25 bp, Mus musculus
gttattatacccgagggcttcagaa

SEQ ID NO: 725394 - DNA, 25 bp, Mus musculus
gttattatccttctatttccagcca

SEQ ID NO: 725395 - DNA, 25 bp, Mus musculus
gttattatccttgtatttccagcca

SEQ ID NO: 725396 - DNA, 25 bp, Mus musculus
gttattattattctcaccaccatga

SEQ ID NO: 725397 - DNA, 25 bp, Mus musculus
gttattattattgtcaccaccatga

SEQ ID NO: 725398 - DNA, 25 bp, Mus musculus
gttattattctgactgttggcttga

SEQ ID NO: 725399 - DNA, 25 bp, Mus musculus
gttattattctgtctgttggcttga

SEQ ID NO: 725400 - DNA, 25 bp, Mus musculus
gttattcaaaagcaagacctgggca

SEQ ID NO: 725401 - DNA, 25 bp, Mus musculus
gttattcaaaaggaagacctgggca

SEQ ID NO: 725402 - DNA, 25 bp, Mus musculus
gttattcaacacagtactggctggt

SEQ ID NO: 725403 - DNA, 25 bp, Mus musculus
gttattcaacactgtactggctggt

SEQ ID NO: 725404 - DNA, 25 bp, Mus musculus
gttattcaaggtctgtcttccgagt

SEQ ID NO: 725405 - DNA, 25 bp, Mus musculus
gttattcaaggtgtgtcttccgagt

SEQ ID NO: 725406 - DNA, 25 bp, Mus musculus
gttattcacaaaagccttggcctgg

SEQ ID NO: 725407 - DNA, 25 bp, Mus musculus
gttattcacaaatgccttggcctgg

SEQ ID NO: 725408 - DNA, 25 bp, Mus musculus
gttattcaccagcaaagatccttag

SEQ ID NO: 725409 - DNA, 25 bp, Mus musculus
gttattcaccaggaaagatccttag

SEQ ID NO: 725410 - DNA, 25 bp, Mus musculus
gttattcactcaaaggtctcagtat

SEQ ID NO: 725411 - DNA, 25 bp, Mus musculus
gttattcactcataggtctcagtat

SEQ ID NO: 725412 - DNA, 25 bp, Mus musculus
gttattcacttgacctggatttctt

SEQ ID NO: 725413 - DNA, 25 bp, Mus musculus
gttattcacttgctgtgtacttgaa

SEQ ID NO: 725414 - DNA, 25 bp, Mus musculus
gttattcacttggtgtgtacttgaa

SEQ ID NO: 725415 - DNA, 25 bp, Mus musculus
gttattcacttgtcctggatttctt

SEQ ID NO: 725416 - DNA, 25 bp, Mus musculus
gttattcagaccatcaagctgcaag

SEQ ID NO: 725417 - DNA, 25 bp, Mus musculus
gttattcagaccttcaagctgcaag

SEQ ID NO: 725418 - DNA, 25 bp, Mus musculus
gttattcagttaactacccagccag

SEQ ID NO: 725419 - DNA, 25 bp, Mus musculus
gttattcagttatctacccagccag

SEQ ID NO: 725420 - DNA, 25 bp, Mus musculus
gttattcagttcaacccaagcaagt

SEQ ID NO: 725421 - DNA, 25 bp, Mus musculus
gttattcagttctacccaagcaagt

SEQ ID NO: 725422 - DNA, 25 bp, Mus musculus
gttattcatcagagatcccacactg

SEQ ID NO: 725423 - DNA, 25 bp, Mus musculus
gttattcatcagtgatcccacactg

SEQ ID NO: 725424 - DNA, 25 bp, Mus musculus
gttattcatgatatcttactccaaa

SEQ ID NO: 725425 - DNA, 25 bp, Mus musculus
gttattcatgatttcttactccaaa

SEQ ID NO: 725426 - DNA, 25 bp, Mus musculus
gttattcattatattgattggctag

SEQ ID NO: 725427 - DNA, 25 bp, Mus musculus
gttattcattattttgattggctag

SEQ ID NO: 725428 - DNA, 25 bp, Mus musculus
gttattcattgtctacttctcactg

SEQ ID NO: 725429 - DNA, 25 bp, Mus musculus
gttattcattgtgtacttctcactg

SEQ ID NO: 725430 - DNA, 25 bp, Mus musculus
gttattccacatccaatcaagttga

SEQ ID NO: 725431 - DNA, 25 bp, Mus musculus
gttattccacatgcaatcaagttga

SEQ ID NO: 725432 - DNA, 25 bp, Mus musculus
gttattccagagaccagtagcagtg

SEQ ID NO: 725433 - DNA, 25 bp, Mus musculus
gttattccagagtccagtagcagtg

SEQ ID NO: 725434 - DNA, 25 bp, Mus musculus
gttattccatgtactctgaaatgtt

SEQ ID NO: 725435 - DNA, 25 bp, Mus musculus
gttattccatgttctctgaaatgtt

SEQ ID NO: 725436 - DNA, 25 bp, Mus musculus
gttattccccatccttgattttgag

SEQ ID NO: 725437 - DNA, 25 bp, Mus musculus
gttattccccatgcttgattttgag

SEQ ID NO: 725438 - DNA, 25 bp, Mus musculus
gttattcccttgatactttactgag

SEQ ID NO: 725439 - DNA, 25 bp, Mus musculus
gttattcccttgttactttactgag

SEQ ID NO: 725440 - DNA, 25 bp, Mus musculus
gttattcctcagaaatactgcactg

SEQ ID NO: 725441 - DNA, 25 bp, Mus musculus
gttattcctcagtaatactgcactg

SEQ ID NO: 725442 - DNA, 25 bp, Mus musculus
gttattccttatatcctgtatgttg

SEQ ID NO: 725443 - DNA, 25 bp, Mus musculus
gttattccttatttcctgtatgttg

SEQ ID NO: 725444 - DNA, 25 bp, Mus musculus
gttattcgagacactacagtccctg

SEQ ID NO: 725445 - DNA, 25 bp, Mus musculus
gttattcgagactctacagtccctg

SEQ ID NO: 725446 - DNA, 25 bp, Mus musculus
gttattcgagcacagtaggtccttg

SEQ ID NO: 725447 - DNA, 25 bp, Mus musculus
gttattcgagcagagtaggtccttg

SEQ ID NO: 725448 - DNA, 25 bp, Mus musculus
gttattctaaacctcactggccagg

SEQ ID NO: 725449 - DNA, 25 bp, Mus musculus
gttattctaaacgtcactggccagg

SEQ ID NO: 725450 - DNA, 25 bp, Mus musculus
gttattctaaatatgccagctctga

SEQ ID NO: 725451 - DNA, 25 bp, Mus musculus
gttattctaaatttgccagctctga

SEQ ID NO: 725452 - DNA, 25 bp, Mus musculus
gttattctagtaattgcccaggttg

SEQ ID NO: 725453 - DNA, 25 bp, Mus musculus
gttattctagtatttgcccaggttg

SEQ ID NO: 725454 - DNA, 25 bp, Mus musculus
gttattctgatgaatatctcacgtg

SEQ ID NO: 725455 - DNA, 25 bp, Mus musculus
gttattctgatgtatatctcacgtg

SEQ ID NO: 725456 - DNA, 25 bp, Mus musculus
gttattctgcagctctgggtgatct

SEQ ID NO: 725457 - DNA, 25 bp, Mus musculus
gttattctgcaggtctgggtgatct

SEQ ID NO: 725458 - DNA, 25 bp, Mus musculus
gttattctgcatctaagtctgtgac

SEQ ID NO: 725459 - DNA, 25 bp, Mus musculus
gttattctgcatgtaagtctgtgac

SEQ ID NO: 725460 - DNA, 25 bp, Mus musculus
gttattctggaactgtgttacaagc

SEQ ID NO: 725461 - DNA, 25 bp, Mus musculus
gttattctggaagtgtgttacaagc

SEQ ID NO: 725462 - DNA, 25 bp, Mus musculus
gttattctgtgaagcaggcggtgca

SEQ ID NO: 725463 - DNA, 25 bp, Mus musculus
gttattctgtgatgcaggcggtgca

SEQ ID NO: 725464 - DNA, 25 bp, Mus musculus
gttattcttcatacaacaccctcta

SEQ ID NO: 725465 - DNA, 25 bp, Mus musculus
gttattcttcattcaacaccctcta

SEQ ID NO: 725466 - DNA, 25 bp, Mus musculus
gttattcttggaccacacatcatgt

SEQ ID NO: 725467 - DNA, 25 bp, Mus musculus
gttattcttggagcacacatcatgt

SEQ ID NO: 725468 - DNA, 25 bp, Mus musculus
gttattgaaatgcttgctgggcttc

SEQ ID NO: 725469 - DNA, 25 bp, Mus musculus
gttattgaaatggttgctgggcttc

SEQ ID NO: 725470 - DNA, 25 bp, Mus musculus
gttattgaacacattaggctagaaa

SEQ ID NO: 725471 - DNA, 25 bp, Mus musculus
gttattgaacactttaggctagaaa

SEQ ID NO: 725472 - DNA, 25 bp, Mus musculus
gttattgaacgaatgacccgggtgg

SEQ ID NO: 725473 - DNA, 25 bp, Mus musculus
gttattgaacgattgacccgggtgg

SEQ ID NO: 725474 - DNA, 25 bp, Mus musculus
gttattgactccagattgatcattg

SEQ ID NO: 725475 - DNA, 25 bp, Mus musculus
gttattgactcctgattgatcattg

SEQ ID NO: 725476 - DNA, 25 bp, Mus musculus
gttattgagacacgctctcgctgtt

SEQ ID NO: 725477 - DNA, 25 bp, Mus musculus
gttattgagacaggctctcgctgtt

SEQ ID NO: 725478 - DNA, 25 bp, Mus musculus
gttattgatgcgcagccttgaactt

SEQ ID NO: 725479 - DNA, 25 bp, Mus musculus
gttattgatgcggagccttgaactt

SEQ ID NO: 725480 - DNA, 25 bp, Mus musculus
gttattgatgtgacgatgtgggcag

SEQ ID NO: 725481 - DNA, 25 bp, Mus musculus
gttattgatgtgtcgatgtgggcag

SEQ ID NO: 725482 - DNA, 25 bp, Mus musculus
gttattgcaactctgtctggattct

SEQ ID NO: 725483 - DNA, 25 bp, Mus musculus
gttattgcaactgtgtctggattct

SEQ ID NO: 725484 - DNA, 25 bp, Mus musculus
gttattgcagtcaaagccagctttg

SEQ ID NO: 725485 - DNA, 25 bp, Mus musculus
gttattgcagtctaagccagctttg

SEQ ID NO: 725486 - DNA, 25 bp, Mus musculus
gttattgccacacacttaaccataa

SEQ ID NO: 725487 - DNA, 25 bp, Mus musculus
gttattgccacagacttaaccataa

SEQ ID NO: 725488 - DNA, 25 bp, Mus musculus
gttattgcctctaacggccttggaa

SEQ ID NO: 725489 - DNA, 25 bp, Mus musculus
gttattgcctcttacggccttggaa

SEQ ID NO: 725490 - DNA, 25 bp, Mus musculus
gttattgcctgcctgagtcaattat

SEQ ID NO: 725491 - DNA, 25 bp, Mus musculus
gttattgcctgcgtgagtcaattat

SEQ ID NO: 725492 - DNA, 25 bp, Mus musculus
gttattgcgttgaattctttccctc

SEQ ID NO: 725493 - DNA, 25 bp, Mus musculus
gttattgcgttgtattctttccctc

SEQ ID NO: 725494 - DNA, 25 bp, Mus musculus
gttattgctaagatcatacattgta

SEQ ID NO: 725495 - DNA, 25 bp, Mus musculus
gttattgctaagttcatacattgta

SEQ ID NO: 725496 - DNA, 25 bp, Mus musculus
gttattgctctcaaccgaagaacag

SEQ ID NO: 725497 - DNA, 25 bp, Mus musculus
gttattgctctctaccgaagaacag

SEQ ID NO: 725498 - DNA, 25 bp, Mus musculus
gttattgcttgccataaactggaga

SEQ ID NO: 725499 - DNA, 25 bp, Mus musculus
gttattgcttgcgataaactggaga

SEQ ID NO: 725500 - DNA, 25 bp, Mus musculus
gttattggatggcgttccgtcctat

SEQ ID NO: 725501 - DNA, 25 bp, Mus musculus
gttattggatggggttccgtcctat

SEQ ID NO: 725502 - DNA, 25 bp, Mus musculus
gttattggcaacagacgggttctga

SEQ ID NO: 725503 - DNA, 25 bp, Mus musculus
gttattggcaactgacgggttctga

SEQ ID NO: 725504 - DNA, 25 bp, Mus musculus
gttattggccagatcatctatagca

SEQ ID NO: 725505 - DNA, 25 bp, Mus musculus
gttattggccagttcatctatagca

SEQ ID NO: 725506 - DNA, 25 bp, Mus musculus
gttattggtgatcacagccacttca

SEQ ID NO: 725507 - DNA, 25 bp, Mus musculus
gttattggtgatgacagccacttca

SEQ ID NO: 725508 - DNA, 25 bp, Mus musculus
gttattggtggcagcctcaggatct

SEQ ID NO: 725509 - DNA, 25 bp, Mus musculus
gttattggtggcattcgtaaggcca

SEQ ID NO: 725510 - DNA, 25 bp, Mus musculus
gttattggtggctgcctcaggatct

SEQ ID NO: 725511 - DNA, 25 bp, Mus musculus
gttattggtggctttcgtaaggcca

SEQ ID NO: 725512 - DNA, 25 bp, Mus musculus
gttattggtttcaggatgctctcta

SEQ ID NO: 725513 - DNA, 25 bp, Mus musculus
gttattggtttctggatgctctcta

SEQ ID NO: 725514 - DNA, 25 bp, Mus musculus
gttattgtaataatccctgagggca

SEQ ID NO: 725515 - DNA, 25 bp, Mus musculus
gttattgtaatattccctgagggca

SEQ ID NO: 725516 - DNA, 25 bp, Mus musculus
gttattgtaatcatctggcctggag

SEQ ID NO: 725517 - DNA, 25 bp, Mus musculus
gttattgtaatcttctggcctggag

SEQ ID NO: 725518 - DNA, 25 bp, Mus musculus
gttattgtagagacttgctctcatt

SEQ ID NO: 725519 - DNA, 25 bp, Mus musculus
gttattgtagagtcttgctctcatt

SEQ ID NO: 725520 - DNA, 25 bp, Mus musculus
gttattgtatccaattgccagcagt

SEQ ID NO: 725521 - DNA, 25 bp, Mus musculus
gttattgtatcctattgccagcagt

SEQ ID NO: 725522 - DNA, 25 bp, Mus musculus
gttattgtcacactggaacacgggt

SEQ ID NO: 725523 - DNA, 25 bp, Mus musculus
gttattgtcacagtggaacacgggt

SEQ ID NO: 725524 - DNA, 25 bp, Mus musculus
gttattgtccagagactactgaata

SEQ ID NO: 725525 - DNA, 25 bp, Mus musculus
gttattgtccagtgactactgaata

SEQ ID NO: 725526 - DNA, 25 bp, Mus musculus
gttattgtctgacttacacttgcca

SEQ ID NO: 725527 - DNA, 25 bp, Mus musculus
gttattgtctgagttacacttgcca

SEQ ID NO: 725528 - DNA, 25 bp, Mus musculus
gttattgtggtgattgttctccttg

SEQ ID NO: 725529 - DNA, 25 bp, Mus musculus
gttattgtggtgtttgttctccttg

SEQ ID NO: 725530 - DNA, 25 bp, Mus musculus
gttattgtgtgtctcatgagccctg

SEQ ID NO: 725531 - DNA, 25 bp, Mus musculus
gttattgtgtgtgtcatgagccctg

SEQ ID NO: 725532 - DNA, 25 bp, Mus musculus
gttattgttctgaaatcacttcctg

SEQ ID NO: 725533 - DNA, 25 bp, Mus musculus
gttattgttctgtaatcacttcctg

SEQ ID NO: 725534 - DNA, 25 bp, Mus musculus
gttattgttgagaggcagccagata

SEQ ID NO: 725535 - DNA, 25 bp, Mus musculus
gttattgttgagtggcagccagata

SEQ ID NO: 725536 - DNA, 25 bp, Mus musculus
gttattgttgctaggaacccttcaa

SEQ ID NO: 725537 - DNA, 25 bp, Mus musculus
gttattgttgcttggaacccttcaa

SEQ ID NO: 725538 - DNA, 25 bp, Mus musculus
gttattgttggaaggcatctcccat

SEQ ID NO: 725539 - DNA, 25 bp, Mus musculus
gttattgttggatggcatctcccat

SEQ ID NO: 725540 - DNA, 25 bp, Mus musculus
gttatttaagccacatgctgtacat

SEQ ID NO: 725541 - DNA, 25 bp, Mus musculus
gttatttaagcctcatgctgtacat

SEQ ID NO: 725542 - DNA, 25 bp, Mus musculus
gttatttacagcaggtggctccctt

SEQ ID NO: 725543 - DNA, 25 bp, Mus musculus
gttatttacagccttctgacatagt

SEQ ID NO: 725544 - DNA, 25 bp, Mus musculus
gttatttacagcgttctgacatagt

SEQ ID NO: 725545 - DNA, 25 bp, Mus musculus
gttatttacagctggtggctccctt

SEQ ID NO: 725546 - DNA, 25 bp, Mus musculus
gttatttaccatcgccaggcactga

SEQ ID NO: 725547 - DNA, 25 bp, Mus musculus
gttatttaccatggccaggcactga

SEQ ID NO: 725548 - DNA, 25 bp, Mus musculus
gttatttaccttcaggtctatatga

SEQ ID NO: 725549 - DNA, 25 bp, Mus musculus
gttatttaccttgaggtctatatga

SEQ ID NO: 725550 - DNA, 25 bp, Mus musculus
gttatttacttcactaactatgaca

SEQ ID NO: 725551 - DNA, 25 bp, Mus musculus
gttatttacttctctaactatgaca

SEQ ID NO: 725552 - DNA, 25 bp, Mus musculus
gttatttagaacagctcatttcgag

SEQ ID NO: 725553 - DNA, 25 bp, Mus musculus
gttatttagaactgctcatttcgag

SEQ ID NO: 725554 - DNA, 25 bp, Mus musculus
gttatttagatgaccgattctcgat

SEQ ID NO: 725555 - DNA, 25 bp, Mus musculus
gttatttagatgtccgattctcgat

SEQ ID NO: 725556 - DNA, 25 bp, Mus musculus
gttatttataatcactccaaccctg

SEQ ID NO: 725557 - DNA, 25 bp, Mus musculus
gttatttataatgactccaaccctg

SEQ ID NO: 725558 - DNA, 25 bp, Mus musculus
gttatttatatcacctcagttctgg

SEQ ID NO: 725559 - DNA, 25 bp, Mus musculus
gttatttatatctcctcagttctgg

SEQ ID NO: 725560 - DNA, 25 bp, Mus musculus
gttatttatcctcactattctccct

SEQ ID NO: 725561 - DNA, 25 bp, Mus musculus
gttatttatcctgactattctccct

SEQ ID NO: 725562 - DNA, 25 bp, Mus musculus
gttatttatgagagactttcagtgc

SEQ ID NO: 725563 - DNA, 25 bp, Mus musculus
gttatttatgagtgactttcagtgc

SEQ ID NO: 725564 - DNA, 25 bp, Mus musculus
gttatttattgcaatccctttcctg

SEQ ID NO: 725565 - DNA, 25 bp, Mus musculus
gttatttattgctatccctttcctg

SEQ ID NO: 725566 - DNA, 25 bp, Mus musculus
gttatttcaacaaccattaaactct

SEQ ID NO: 725567 - DNA, 25 bp, Mus musculus
gttatttcaacaatatactacaagg

SEQ ID NO: 725568 - DNA, 25 bp, Mus musculus
gttatttcaacatccattaaactct

SEQ ID NO: 725569 - DNA, 25 bp, Mus musculus
gttatttcaacattatactacaagg

SEQ ID NO: 725570 - DNA, 25 bp, Mus musculus
gttatttcaagtatctttccctcag

SEQ ID NO: 725571 - DNA, 25 bp, Mus musculus
gttatttcaagtttctttccctcag

SEQ ID NO: 725572 - DNA, 25 bp, Mus musculus
gttatttcacttaatttgctagctt

SEQ ID NO: 725573 - DNA, 25 bp, Mus musculus
gttatttcactttatttgctagctt

SEQ ID NO: 725574 - DNA, 25 bp, Mus musculus
gttatttccaacattctgctgctct

SEQ ID NO: 725575 - DNA, 25 bp, Mus musculus
gttatttccaactttctgctgctct

SEQ ID NO: 725576 - DNA, 25 bp, Mus musculus
gttatttcccataatatcaactggt

SEQ ID NO: 725577 - DNA, 25 bp, Mus musculus
gttatttcccattatatcaactggt

SEQ ID NO: 725578 - DNA, 25 bp, Mus musculus
gttatttccccacgcttaagaacag

SEQ ID NO: 725579 - DNA, 25 bp, Mus musculus
gttatttccccaggcttaagaacag

SEQ ID NO: 725580 - DNA, 25 bp, Mus musculus
gttatttcctatctcaggagatcag

SEQ ID NO: 725581 - DNA, 25 bp, Mus musculus
gttatttcctatgtcaggagatcag

SEQ ID NO: 725582 - DNA, 25 bp, Mus musculus
gttatttcctctcctggatgtggaa

SEQ ID NO: 725583 - DNA, 25 bp, Mus musculus
gttatttcctctgctggatgtggaa

SEQ ID NO: 725584 - DNA, 25 bp, Mus musculus
gttatttcgggtcccctgggactga

SEQ ID NO: 725585 - DNA, 25 bp, Mus musculus
gttatttcgggtgccctgggactga

SEQ ID NO: 725586 - DNA, 25 bp, Mus musculus
gttatttctaatacttatgcattgg

SEQ ID NO: 725587 - DNA, 25 bp, Mus musculus
gttatttctaattcttatgcattgg

SEQ ID NO: 725588 - DNA, 25 bp, Mus musculus
gttatttctactctcaccctgagag

SEQ ID NO: 725589 - DNA, 25 bp, Mus musculus
gttatttctactgtcaccctgagag

SEQ ID NO: 725590 - DNA, 25 bp, Mus musculus
gttatttctataagccttgtattgt

SEQ ID NO: 725591 - DNA, 25 bp, Mus musculus
gttatttctatactgattgcctggt

SEQ ID NO: 725592 - DNA, 25 bp, Mus musculus
gttatttctatagtgattgcctggt

SEQ ID NO: 725593 - DNA, 25 bp, Mus musculus
gttatttctatatgccttgtattgt

SEQ ID NO: 725594 - DNA, 25 bp, Mus musculus
gttatttctcacagggaggacgcat

SEQ ID NO: 725595 - DNA, 25 bp, Mus musculus
gttatttctcactgggaggacgcat

SEQ ID NO: 725596 - DNA, 25 bp, Mus musculus
gttatttctctcaccctatggatac

SEQ ID NO: 725597 - DNA, 25 bp, Mus musculus
gttatttctctctccctatggatac

SEQ ID NO: 725598 - DNA, 25 bp, Mus musculus
gttatttctgatcttccaaggttag

SEQ ID NO: 725599 - DNA, 25 bp, Mus musculus
gttatttctgatgttccaaggttag

SEQ ID NO: 725600 - DNA, 25 bp, Mus musculus
gttatttgaacacagcaggactggc

SEQ ID NO: 725601 - DNA, 25 bp, Mus musculus
gttatttgaacagagcaggactggc

SEQ ID NO: 725602 - DNA, 25 bp, Mus musculus
gttatttgcataattcaccctgact

SEQ ID NO: 725603 - DNA, 25 bp, Mus musculus
gttatttgcatatttcaccctgact

SEQ ID NO: 725604 - DNA, 25 bp, Mus musculus
gttatttgcgacaaccaactagaga

SEQ ID NO: 725605 - DNA, 25 bp, Mus musculus
gttatttgcgactaccaactagaga

SEQ ID NO: 725606 - DNA, 25 bp, Mus musculus
gttatttgtcctctgctatagtagt

SEQ ID NO: 725607 - DNA, 25 bp, Mus musculus
gttatttgtcctgtgctatagtagt

SEQ ID NO: 725608 - DNA, 25 bp, Mus musculus
gttatttgtgaaagcatggtctgac

SEQ ID NO: 725609 - DNA, 25 bp, Mus musculus
gttatttgtgaatgcatggtctgac

SEQ ID NO: 725610 - DNA, 25 bp, Mus musculus
gttatttgtgctcggcagtgttgtc

SEQ ID NO: 725611 - DNA, 25 bp, Mus musculus
gttatttgtgctgggcagtgttgtc

SEQ ID NO: 725612 - DNA, 25 bp, Mus musculus
gttattttacataacctggcctaga

SEQ ID NO: 725613 - DNA, 25 bp, Mus musculus
gttattttacatagtcctgaagagc

SEQ ID NO: 725614 - DNA, 25 bp, Mus musculus
gttattttacattacctggcctaga

SEQ ID NO: 725615 - DNA, 25 bp, Mus musculus
gttattttacattgtcctgaagagc

SEQ ID NO: 725616 - DNA, 25 bp, Mus musculus
gttattttaccaagtgttactgaaa

SEQ ID NO: 725617 - DNA, 25 bp, Mus musculus
gttattttaccacgtgtgcagcagg

SEQ ID NO: 725618 - DNA, 25 bp, Mus musculus
gttattttaccaggtgtgcagcagg

SEQ ID NO: 725619 - DNA, 25 bp, Mus musculus
gttattttaccatgtgttactgaaa

SEQ ID NO: 725620 - DNA, 25 bp, Mus musculus
gttattttactgactgttactctaa

SEQ ID NO: 725621 - DNA, 25 bp, Mus musculus
gttattttactgtctgttactctaa

SEQ ID NO: 725622 - DNA, 25 bp, Mus musculus
gttattttagttactgttctgtgga

SEQ ID NO: 725623 - DNA, 25 bp, Mus musculus
gttattttagtttctgttctgtgga

SEQ ID NO: 725624 - DNA, 25 bp, Mus musculus
gttattttatgcctgtttgcccgcg

SEQ ID NO: 725625 - DNA, 25 bp, Mus musculus
gttattttatgcgtgtttgcccgcg

SEQ ID NO: 725626 - DNA, 25 bp, Mus musculus
gttattttcaagctgttctgcctct

SEQ ID NO: 725627 - DNA, 25 bp, Mus musculus
gttattttcaaggtgttctgcctct

SEQ ID NO: 725628 - DNA, 25 bp, Mus musculus
gttattttcacaataggcatccctt

SEQ ID NO: 725629 - DNA, 25 bp, Mus musculus
gttattttcacattaggcatccctt

SEQ ID NO: 725630 - DNA, 25 bp, Mus musculus
gttattttcctaaatctcacagtat

SEQ ID NO: 725631 - DNA, 25 bp, Mus musculus
gttattttcctatatctcacagtat

SEQ ID NO: 725632 - DNA, 25 bp, Mus musculus
gttattttctgcaattcttcctatc

SEQ ID NO: 725633 - DNA, 25 bp, Mus musculus
gttattttctgctattcttcctatc

SEQ ID NO: 725634 - DNA, 25 bp, Mus musculus
gttattttgacaccgaagcatgcaa

SEQ ID NO: 725635 - DNA, 25 bp, Mus musculus
gttattttgacagcgaagcatgcaa

SEQ ID NO: 725636 - DNA, 25 bp, Mus musculus
gttattttgcacagacccaccctag

SEQ ID NO: 725637 - DNA, 25 bp, Mus musculus
gttattttgcactgacccaccctag

SEQ ID NO: 725638 - DNA, 25 bp, Mus musculus
gttattttgtacattctctactctt

SEQ ID NO: 725639 - DNA, 25 bp, Mus musculus
gttattttgtactttctctactctt

SEQ ID NO: 725640 - DNA, 25 bp, Mus musculus
gttattttgttcatccaacctcact

SEQ ID NO: 725641 - DNA, 25 bp, Mus musculus
gttattttgttcttccaacctcact

SEQ ID NO: 725642 - DNA, 25 bp, Mus musculus
gttatttttaccaagctatatccag

SEQ ID NO: 725643 - DNA, 25 bp, Mus musculus
gttatttttaccacactgcgaggct

SEQ ID NO: 725644 - DNA, 25 bp, Mus musculus
gttatttttacctagctatatccag

SEQ ID NO: 725645 - DNA, 25 bp, Mus musculus
gttatttttacctcactgcgaggct

SEQ ID NO: 725646 - DNA, 25 bp, Mus musculus
gttatttttactcttggttgcatat

SEQ ID NO: 725647 - DNA, 25 bp, Mus musculus
gttatttttactgttggttgcatat

SEQ ID NO: 725648 - DNA, 25 bp, Mus musculus
gttatttttagcctagatctaacca

SEQ ID NO: 725649 - DNA, 25 bp, Mus musculus
gttatttttagcgtagatctaacca

SEQ ID NO: 725650 - DNA, 25 bp, Mus musculus
gttatttttgacaaccatgcatgtg

SEQ ID NO: 725651 - DNA, 25 bp, Mus musculus
gttatttttgactaccatgcatgtg

SEQ ID NO: 725652 - DNA, 25 bp, Mus musculus
gttatttttgtaaactatatcactt

SEQ ID NO: 725653 - DNA, 25 bp, Mus musculus
gttatttttgtatactatatcactt

SEQ ID NO: 725654 - DNA, 25 bp, Mus musculus
gttcaaaaacaaccgcatcctcatg

SEQ ID NO: 725655 - DNA, 25 bp, Mus musculus
gttcaaaaacaagcgcatcctcatg

SEQ ID NO: 725656 - DNA, 25 bp, Mus musculus
gttcaaaagttgacagatagtggtg

SEQ ID NO: 725657 - DNA, 25 bp, Mus musculus
gttcaaaagttgtcagatagtggtg

SEQ ID NO: 725658 - DNA, 25 bp, Mus musculus
gttcaaaatattacattcagccatt

SEQ ID NO: 725659 - DNA, 25 bp, Mus musculus
gttcaaaatatttcattcagccatt

SEQ ID NO: 725660 - DNA, 25 bp, Mus musculus
gttcaaaatcacagcctcaagagaa

SEQ ID NO: 725661 - DNA, 25 bp, Mus musculus
gttcaaaatcactgcctcaagagaa

SEQ ID NO: 725662 - DNA, 25 bp, Mus musculus
gttcaaaatcagattgttgttcaga

SEQ ID NO: 725663 - DNA, 25 bp, Mus musculus
gttcaaaatcagtttgttgttcaga

SEQ ID NO: 725664 - DNA, 25 bp, Mus musculus
gttcaaaatcgaagttcttagcaat

SEQ ID NO: 725665 - DNA, 25 bp, Mus musculus
gttcaaaatcgatgttcttagcaat

SEQ ID NO: 725666 - DNA, 25 bp, Mus musculus
gttcaaaatgcaatactgtgtctcc

SEQ ID NO: 725667 - DNA, 25 bp, Mus musculus
gttcaaaatgcattactgtgtctcc

SEQ ID NO: 725668 - DNA, 25 bp, Mus musculus
gttcaaaatggcagcctgtgtggca

SEQ ID NO: 725669 - DNA, 25 bp, Mus musculus
gttcaaaatggctgcctgtgtggca

SEQ ID NO: 725670 - DNA, 25 bp, Mus musculus
gttcaaaattgtcttgccattccct

SEQ ID NO: 725671 - DNA, 25 bp, Mus musculus
gttcaaaattgtgttgccattccct

SEQ ID NO: 725672 - DNA, 25 bp, Mus musculus
gttcaaacagatccatactctccag

SEQ ID NO: 725673 - DNA, 25 bp, Mus musculus
gttcaaacagatgcatactctccag

SEQ ID NO: 725674 - DNA, 25 bp, Mus musculus
gttcaaaccagacaccagccgagga

SEQ ID NO: 725675 - DNA, 25 bp, Mus musculus
gttcaaaccagagaccagccgagga

SEQ ID NO: 725676 - DNA, 25 bp, Mus musculus
gttcaaacccataacctgatcagtg

SEQ ID NO: 725677 - DNA, 25 bp, Mus musculus
gttcaaacccattacctgatcagtg

SEQ ID NO: 725678 - DNA, 25 bp, Mus musculus
gttcaaacctgtagttgctgcacaa

SEQ ID NO: 725679 - DNA, 25 bp, Mus musculus
gttcaaacctgttgttgctgcacaa

SEQ ID NO: 725680 - DNA, 25 bp, Mus musculus
gttcaaactcacaggtattcttctc

SEQ ID NO: 725681 - DNA, 25 bp, Mus musculus
gttcaaactcactggtattcttctc

SEQ ID NO: 725682 - DNA, 25 bp, Mus musculus
gttcaaactctaactaccagttcag

SEQ ID NO: 725683 - DNA, 25 bp, Mus musculus
gttcaaactctatctaccagttcag

SEQ ID NO: 725684 - DNA, 25 bp, Mus musculus
gttcaaactgagcacattttgcctt

SEQ ID NO: 725685 - DNA, 25 bp, Mus musculus
gttcaaactgaggacattttgcctt

SEQ ID NO: 725686 - DNA, 25 bp, Mus musculus
gttcaaactgtcattccatagaggt

SEQ ID NO: 725687 - DNA, 25 bp, Mus musculus
gttcaaactgtctttccatagaggt

SEQ ID NO: 725688 - DNA, 25 bp, Mus musculus
gttcaaacttcgacaagctgtagac

SEQ ID NO: 725689 - DNA, 25 bp, Mus musculus
gttcaaacttcgtcaagctgtagac

SEQ ID NO: 725690 - DNA, 25 bp, Mus musculus
gttcaaagcaagaggcaaactttca

SEQ ID NO: 725691 - DNA, 25 bp, Mus musculus
gttcaaagcaagtggcaaactttca

SEQ ID NO: 725692 - DNA, 25 bp, Mus musculus
gttcaaagcacacgcaatctactcc

SEQ ID NO: 725693 - DNA, 25 bp, Mus musculus
gttcaaagcacaggcaatctactcc

SEQ ID NO: 725694 - DNA, 25 bp, Mus musculus
gttcaaagccatccttagctctata

SEQ ID NO: 725695 - DNA, 25 bp, Mus musculus
gttcaaagccatgcttagctctata

SEQ ID NO: 725696 - DNA, 25 bp, Mus musculus
gttcaaagcccaaccagcttagact

SEQ ID NO: 725697 - DNA, 25 bp, Mus musculus
gttcaaagcccatccagcttagact

SEQ ID NO: 725698 - DNA, 25 bp, Mus musculus
gttcaaagcgatcgccactgtggaa

SEQ ID NO: 725699 - DNA, 25 bp, Mus musculus
gttcaaagcgatggccactgtggaa

SEQ ID NO: 725700 - DNA, 25 bp, Mus musculus
gttcaaagcgccattcccaagagaa

SEQ ID NO: 725701 - DNA, 25 bp, Mus musculus
gttcaaagcgcctttcccaagagaa

SEQ ID NO: 725702 - DNA, 25 bp, Mus musculus
gttcaaagctggacagcctttgcct

SEQ ID NO: 725703 - DNA, 25 bp, Mus musculus
gttcaaagctggtcagcctttgcct

SEQ ID NO: 725704 - DNA, 25 bp, Mus musculus
gttcaaagcttactatccagcagtg

SEQ ID NO: 725705 - DNA, 25 bp, Mus musculus
gttcaaagcttagtatccagcagtg

SEQ ID NO: 725706 - DNA, 25 bp, Mus musculus
gttcaaagctttagcatgcttaagg

SEQ ID NO: 725707 - DNA, 25 bp, Mus musculus
gttcaaagcttttgcatgcttaagg

SEQ ID NO: 725708 - DNA, 25 bp, Mus musculus
gttcaaaggaggaggtaagactact

SEQ ID NO: 725709 - DNA, 25 bp, Mus musculus
gttcaaaggaggtggtaagactact

SEQ ID NO: 725710 - DNA, 25 bp, Mus musculus
gttcaaagtcacagcacgagcctag

SEQ ID NO: 725711 - DNA, 25 bp, Mus musculus
gttcaaagtcactgcacgagcctag

SEQ ID NO: 725712 - DNA, 25 bp, Mus musculus
gttcaaagtgagatagcgccttcaa

SEQ ID NO: 725713 - DNA, 25 bp, Mus musculus
gttcaaagtgagttagcgccttcaa

SEQ ID NO: 725714 - DNA, 25 bp, Mus musculus
gttcaaagtggaatttgaggtcatc

SEQ ID NO: 725715 - DNA, 25 bp, Mus musculus
gttcaaagtggattttgaggtcatc

SEQ ID NO: 725716 - DNA, 25 bp, Mus musculus
gttcaaagttgcatttgggattcta

SEQ ID NO: 725717 - DNA, 25 bp, Mus musculus
gttcaaagttgcttttgggattcta

SEQ ID NO: 725718 - DNA, 25 bp, Mus musculus
gttcaaataacacatcttttaagtg

SEQ ID NO: 725719 - DNA, 25 bp, Mus musculus
gttcaaataacagatcttttaagtg

SEQ ID NO: 725720 - DNA, 25 bp, Mus musculus
gttcaaataccccaatctatggaga

SEQ ID NO: 725721 - DNA, 25 bp, Mus musculus
gttcaaatacccgaatctatggaga

SEQ ID NO: 725722 - DNA, 25 bp, Mus musculus
gttcaaatagttcttgttcaggcaa

SEQ ID NO: 725723 - DNA, 25 bp, Mus musculus
gttcaaatagttcttttctgtgggc

SEQ ID NO: 725724 - DNA, 25 bp, Mus musculus
gttcaaatagttgttgttcaggcaa

SEQ ID NO: 725725 - DNA, 25 bp, Mus musculus
gttcaaatagttgttttctgtgggc

SEQ ID NO: 725726 - DNA, 25 bp, Mus musculus
gttcaaatatccagatgatctccag

SEQ ID NO: 725727 - DNA, 25 bp, Mus musculus
gttcaaatatcctgatgatctccag

SEQ ID NO: 725728 - DNA, 25 bp, Mus musculus
gttcaaatcaagcactggatgtttt

SEQ ID NO: 725729 - DNA, 25 bp, Mus musculus
gttcaaatcaaggactggatgtttt

SEQ ID NO: 725730 - DNA, 25 bp, Mus musculus
gttcaaatccccacaacagatgttc

SEQ ID NO: 725731 - DNA, 25 bp, Mus musculus
gttcaaatcccctcaacagatgttc

SEQ ID NO: 725732 - DNA, 25 bp, Mus musculus
gttcaaatccctatgatgctgtaaa

SEQ ID NO: 725733 - DNA, 25 bp, Mus musculus
gttcaaatccctttgatgctgtaaa

SEQ ID NO: 725734 - DNA, 25 bp, Mus musculus
gttcaaatccttcagtgttggttca

SEQ ID NO: 725735 - DNA, 25 bp, Mus musculus
gttcaaatccttgagtgttggttca

SEQ ID NO: 725736 - DNA, 25 bp, Mus musculus
gttcaaatgaagcttcctccaggct

SEQ ID NO: 725737 - DNA, 25 bp, Mus musculus
gttcaaatgaaggttcctccaggct

SEQ ID NO: 725738 - DNA, 25 bp, Mus musculus
gttcaaatgactagggagcacaatc

SEQ ID NO: 725739 - DNA, 25 bp, Mus musculus
gttcaaatgacttgggagcacaatc

SEQ ID NO: 725740 - DNA, 25 bp, Mus musculus
gttcaaatgctcacacttgggcaag

SEQ ID NO: 725741 - DNA, 25 bp, Mus musculus
gttcaaatgctctcacttgggcaag

SEQ ID NO: 725742 - DNA, 25 bp, Mus musculus
gttcaaatggttaccacttggccct

SEQ ID NO: 725743 - DNA, 25 bp, Mus musculus
gttcaaatggtttccacttggccct

SEQ ID NO: 725744 - DNA, 25 bp, Mus musculus
gttcaaattaccatcctgatgctat

SEQ ID NO: 725745 - DNA, 25 bp, Mus musculus
gttcaaattaccttcctgatgctat

SEQ ID NO: 725746 - DNA, 25 bp, Mus musculus
gttcaaattcacactacaaagtgag

SEQ ID NO: 725747 - DNA, 25 bp, Mus musculus
gttcaaattcactctacaaagtgag

SEQ ID NO: 725748 - DNA, 25 bp, Mus musculus
gttcaaattgccaatggtgcccatt

SEQ ID NO: 725749 - DNA, 25 bp, Mus musculus
gttcaaattgcctatggtgcccatt

SEQ ID NO: 725750 - DNA, 25 bp, Mus musculus
gttcaacaagcaccctcatgggact

SEQ ID NO: 725751 - DNA, 25 bp, Mus musculus
gttcaacaagcagcctcatgggact

SEQ ID NO: 725752 - DNA, 25 bp, Mus musculus
gttcaacaagctcggctcagcctct

SEQ ID NO: 725753 - DNA, 25 bp, Mus musculus
gttcaacaagctgggctcagcctct

SEQ ID NO: 725754 - DNA, 25 bp, Mus musculus
gttcaacaatccctggctgctcatt

SEQ ID NO: 725755 - DNA, 25 bp, Mus musculus
gttcaacaatccgtggctgctcatt

SEQ ID NO: 725756 - DNA, 25 bp, Mus musculus
gttcaacacagaattaacctccaaa

SEQ ID NO: 725757 - DNA, 25 bp, Mus musculus
gttcaacacagatttaacctccaaa

SEQ ID NO: 725758 - DNA, 25 bp, Mus musculus
gttcaacactttatatatgcatatt

SEQ ID NO: 725759 - DNA, 25 bp, Mus musculus
gttcaacactttttatatgcatatt

SEQ ID NO: 725760 - DNA, 25 bp, Mus musculus
gttcaacagtacagggagcagctgg

SEQ ID NO: 725761 - DNA, 25 bp, Mus musculus
gttcaacagtactgggagcagctgg

SEQ ID NO: 725762 - DNA, 25 bp, Mus musculus
gttcaacatacaatccagggcctta

SEQ ID NO: 725763 - DNA, 25 bp, Mus musculus
gttcaacatacattccagggcctta

SEQ ID NO: 725764 - DNA, 25 bp, Mus musculus
gttcaacatcacaatcaataggcag

SEQ ID NO: 725765 - DNA, 25 bp, Mus musculus
gttcaacatcactatcaataggcag

SEQ ID NO: 725766 - DNA, 25 bp, Mus musculus
gttcaacatccaaacttcatctgtg

SEQ ID NO: 725767 - DNA, 25 bp, Mus musculus
gttcaacatccatacttcatctgtg

SEQ ID NO: 725768 - DNA, 25 bp, Mus musculus
gttcaacatcctcttcgttacaagt

SEQ ID NO: 725769 - DNA, 25 bp, Mus musculus
gttcaacatcctgttcgttacaagt

SEQ ID NO: 725770 - DNA, 25 bp, Mus musculus
gttcaacatgacagcttcctttttt

SEQ ID NO: 725771 - DNA, 25 bp, Mus musculus
gttcaacatgactgcttcctttttt

SEQ ID NO: 725772 - DNA, 25 bp, Mus musculus
gttcaacattttacaggcattagct

SEQ ID NO: 725773 - DNA, 25 bp, Mus musculus
gttcaacatttttcaggcattagct

SEQ ID NO: 725774 - DNA, 25 bp, Mus musculus
gttcaaccaaagcacagtcgagcct

SEQ ID NO: 725775 - DNA, 25 bp, Mus musculus
gttcaaccaaaggacagtcgagcct

SEQ ID NO: 725776 - DNA, 25 bp, Mus musculus
gttcaaccattcagtcctcatcaat

SEQ ID NO: 725777 - DNA, 25 bp, Mus musculus
gttcaaccattctgtcctcatcaat

SEQ ID NO: 725778 - DNA, 25 bp, Mus musculus
gttcaaccctgacaacttcgaaaat

SEQ ID NO: 725779 - DNA, 25 bp, Mus musculus
gttcaaccctgagaacttcgaaaat

SEQ ID NO: 725780 - DNA, 25 bp, Mus musculus
gttcaacgctttcttgtacagactg

SEQ ID NO: 725781 - DNA, 25 bp, Mus musculus
gttcaacgctttgttgtacagactg

SEQ ID NO: 725782 - DNA, 25 bp, Mus musculus
gttcaactaaacactacttcctatg

SEQ ID NO: 725783 - DNA, 25 bp, Mus musculus
gttcaactaaactctacttcctatg

SEQ ID NO: 725784 - DNA, 25 bp, Mus musculus
gttcaactacgtacatagcggcttt

SEQ ID NO: 725785 - DNA, 25 bp, Mus musculus
gttcaactacgttcatagcggcttt

SEQ ID NO: 725786 - DNA, 25 bp, Mus musculus
gttcaactatagactgggcaaccta

SEQ ID NO: 725787 - DNA, 25 bp, Mus musculus
gttcaactatagtctgggcaaccta

SEQ ID NO: 725788 - DNA, 25 bp, Mus musculus
gttcaactatctcacaaagtccctt

SEQ ID NO: 725789 - DNA, 25 bp, Mus musculus
gttcaactatctgacaaagtccctt

SEQ ID NO: 725790 - DNA, 25 bp, Mus musculus
gttcaactattccttgtcccatggg

SEQ ID NO: 725791 - DNA, 25 bp, Mus musculus
gttcaactattcgttgtcccatggg

SEQ ID NO: 725792 - DNA, 25 bp, Mus musculus
gttcaactcatgataccttcgatct

SEQ ID NO: 725793 - DNA, 25 bp, Mus musculus
gttcaactcatgttaccttcgatct

SEQ ID NO: 725794 - DNA, 25 bp, Mus musculus
gttcaactctccactggtaacaaga

SEQ ID NO: 725795 - DNA, 25 bp, Mus musculus
gttcaactctcctctggtaacaaga

SEQ ID NO: 725796 - DNA, 25 bp, Mus musculus
gttcaactgaacacatttgccttgt

SEQ ID NO: 725797 - DNA, 25 bp, Mus musculus
gttcaactgaactcatttgccttgt

SEQ ID NO: 725798 - DNA, 25 bp, Mus musculus
gttcaactgaggctgtaacaactcc

SEQ ID NO: 725799 - DNA, 25 bp, Mus musculus
gttcaactgagggtgtaacaactcc

SEQ ID NO: 725800 - DNA, 25 bp, Mus musculus
gttcaactgcagctcgggcgacttc

SEQ ID NO: 725801 - DNA, 25 bp, Mus musculus
gttcaactgcaggtcgggcgacttc

SEQ ID NO: 725802 - DNA, 25 bp, Mus musculus
gttcaactggccaacgtggaacaga

SEQ ID NO: 725803 - DNA, 25 bp, Mus musculus
gttcaactggcctacgtggaacaga

SEQ ID NO: 725804 - DNA, 25 bp, Mus musculus
gttcaactggtaacactttgtggcc

SEQ ID NO: 725805 - DNA, 25 bp, Mus musculus
gttcaactggtatcactttgtggcc

SEQ ID NO: 725806 - DNA, 25 bp, Mus musculus
gttcaacttcaactactgtcacgtt

SEQ ID NO: 725807 - DNA, 25 bp, Mus musculus
gttcaacttcaagtactgtcacgtt

SEQ ID NO: 725808 - DNA, 25 bp, Mus musculus
gttcaacttggaccctgagtccgct

SEQ ID NO: 725809 - DNA, 25 bp, Mus musculus
gttcaacttggagcctgagtccgct

SEQ ID NO: 725810 - DNA, 25 bp, Mus musculus
gttcaagacagcatcagtctctcta

SEQ ID NO: 725811 - DNA, 25 bp, Mus musculus
gttcaagacagcttcagtctctcta

SEQ ID NO: 725812 - DNA, 25 bp, Mus musculus
gttcaagaccaccttgtctctaaaa

SEQ ID NO: 725813 - DNA, 25 bp, Mus musculus
gttcaagaccacgttgtctctaaaa

SEQ ID NO: 725814 - DNA, 25 bp, Mus musculus
gttcaagaccagcatcaccaactgc

SEQ ID NO: 725815 - DNA, 25 bp, Mus musculus
gttcaagaccagccggagcttcatg

SEQ ID NO: 725816 - DNA, 25 bp, Mus musculus
gttcaagaccaggatcaccaactgc

SEQ ID NO: 725817 - DNA, 25 bp, Mus musculus
gttcaagaccaggcggagcttcatg

SEQ ID NO: 725818 - DNA, 25 bp, Mus musculus
gttcaagaccatactgggccatacg

SEQ ID NO: 725819 - DNA, 25 bp, Mus musculus
gttcaagaccattctgggccatacg

SEQ ID NO: 725820 - DNA, 25 bp, Mus musculus
gttcaagaccgcctatggcatgaag

SEQ ID NO: 725821 - DNA, 25 bp, Mus musculus
gttcaagaccgcgtatggcatgaag

SEQ ID NO: 725822 - DNA, 25 bp, Mus musculus
gttcaagactgcatgtatcctaact

SEQ ID NO: 725823 - DNA, 25 bp, Mus musculus
gttcaagactgcttgtatcctaact

SEQ ID NO: 725824 - DNA, 25 bp, Mus musculus
gttcaagacttacattagggaccaa

SEQ ID NO: 725825 - DNA, 25 bp, Mus musculus
gttcaagacttagattagggaccaa

SEQ ID NO: 725826 - DNA, 25 bp, Mus musculus
gttcaagactttcgcgccttttctg

SEQ ID NO: 725827 - DNA, 25 bp, Mus musculus
gttcaagactttggcgccttttctg

SEQ ID NO: 725828 - DNA, 25 bp, Mus musculus
gttcaagagcctcacgacatctgtg

SEQ ID NO: 725829 - DNA, 25 bp, Mus musculus
gttcaagagcctgacgacatctgtg

SEQ ID NO: 725830 - DNA, 25 bp, Mus musculus
gttcaagatatgatgcatgttgctt

SEQ ID NO: 725831 - DNA, 25 bp, Mus musculus
gttcaagatatgttgcatgttgctt

SEQ ID NO: 725832 - DNA, 25 bp, Mus musculus
gttcaagcacacagtattcatggtt

SEQ ID NO: 725833 - DNA, 25 bp, Mus musculus
gttcaagcacactgtattcatggtt

SEQ ID NO: 725834 - DNA, 25 bp, Mus musculus
gttcaagcacccagttgaccactgg

SEQ ID NO: 725835 - DNA, 25 bp, Mus musculus
gttcaagcaccctgttgaccactgg

SEQ ID NO: 725836 - DNA, 25 bp, Mus musculus
gttcaagcacctcgtacacaagcca

SEQ ID NO: 725837 - DNA, 25 bp, Mus musculus
gttcaagcacctggtacacaagcca

SEQ ID NO: 725838 - DNA, 25 bp, Mus musculus
gttcaagcactgcaggccttgatga

SEQ ID NO: 725839 - DNA, 25 bp, Mus musculus
gttcaagcactggaggccttgatga

SEQ ID NO: 725840 - DNA, 25 bp, Mus musculus
gttcaagcagcaaatcaccaggttt

SEQ ID NO: 725841 - DNA, 25 bp, Mus musculus
gttcaagcagcaccatcactagtgt

SEQ ID NO: 725842 - DNA, 25 bp, Mus musculus
gttcaagcagcagcatcactagtgt

SEQ ID NO: 725843 - DNA, 25 bp, Mus musculus
gttcaagcagcatatcaccaggttt

SEQ ID NO: 725844 - DNA, 25 bp, Mus musculus
gttcaagcagccagtaaacagccaa

SEQ ID NO: 725845 - DNA, 25 bp, Mus musculus
gttcaagcagcctgtaaacagccaa

SEQ ID NO: 725846 - DNA, 25 bp, Mus musculus
gttcaagcatagagggcaatcccat

SEQ ID NO: 725847 - DNA, 25 bp, Mus musculus
gttcaagcatagtgggcaatcccat

SEQ ID NO: 725848 - DNA, 25 bp, Mus musculus
gttcaagcccagattaggctaacta

SEQ ID NO: 725849 - DNA, 25 bp, Mus musculus
gttcaagcccagtttaggctaacta

SEQ ID NO: 725850 - DNA, 25 bp, Mus musculus
gttcaagccgctcatgtcggtgctg

SEQ ID NO: 725851 - DNA, 25 bp, Mus musculus
gttcaagccgctgatgtcggtgctg

SEQ ID NO: 725852 - DNA, 25 bp, Mus musculus
gttcaagcctaaatcttatgtcatg

SEQ ID NO: 725853 - DNA, 25 bp, Mus musculus
gttcaagcctaattcttatgtcatg

SEQ ID NO: 725854 - DNA, 25 bp, Mus musculus
gttcaagccttcattattacaccaa

SEQ ID NO: 725855 - DNA, 25 bp, Mus musculus
gttcaagccttctttattacaccaa

SEQ ID NO: 725856 - DNA, 25 bp, Mus musculus
gttcaagctccaagtcttgttttaa

SEQ ID NO: 725857 - DNA, 25 bp, Mus musculus
gttcaagctccatgtcttgttttaa

SEQ ID NO: 725858 - DNA, 25 bp, Mus musculus
gttcaagctcctcagtggatccaga

SEQ ID NO: 725859 - DNA, 25 bp, Mus musculus
gttcaagctcctgagtggatccaga

SEQ ID NO: 725860 - DNA, 25 bp, Mus musculus
gttcaagctctaagcctctcttgga

SEQ ID NO: 725861 - DNA, 25 bp, Mus musculus
gttcaagctctatgcctctcttgga

SEQ ID NO: 725862 - DNA, 25 bp, Mus musculus
gttcaagctgaaacgtggactacct

SEQ ID NO: 725863 - DNA, 25 bp, Mus musculus
gttcaagctgaatcgtggactacct

SEQ ID NO: 725864 - DNA, 25 bp, Mus musculus
gttcaagctgatatgctgacctgga

SEQ ID NO: 725865 - DNA, 25 bp, Mus musculus
gttcaagctgatttgctgacctgga

SEQ ID NO: 725866 - DNA, 25 bp, Mus musculus
gttcaagctgtcattccaacaatag

SEQ ID NO: 725867 - DNA, 25 bp, Mus musculus
gttcaagctgtctttccaacaatag

SEQ ID NO: 725868 - DNA, 25 bp, Mus musculus
gttcaagcttggacccattcattaa

SEQ ID NO: 725869 - DNA, 25 bp, Mus musculus
gttcaagcttggtcccattcattaa

SEQ ID NO: 725870 - DNA, 25 bp, Mus musculus
gttcaagcttgtatcagcagccgaa

SEQ ID NO: 725871 - DNA, 25 bp, Mus musculus
gttcaagcttgtttcagcagccgaa

SEQ ID NO: 725872 - DNA, 25 bp, Mus musculus
gttcaaggaaacagtctagctctct

SEQ ID NO: 725873 - DNA, 25 bp, Mus musculus
gttcaaggaaactgtctagctctct

SEQ ID NO: 725874 - DNA, 25 bp, Mus musculus
gttcaaggacacattcaccgaggaa

SEQ ID NO: 725875 - DNA, 25 bp, Mus musculus
gttcaaggacactttcaccgaggaa

SEQ ID NO: 725876 - DNA, 25 bp, Mus musculus
gttcaaggaggccttcactgtaatt

SEQ ID NO: 725877 - DNA, 25 bp, Mus musculus
gttcaaggaggcgttcactgtaatt

SEQ ID NO: 725878 - DNA, 25 bp, Mus musculus
gttcaaggcaaaatcctgggagctt

SEQ ID NO: 725879 - DNA, 25 bp, Mus musculus
gttcaaggcaaattcctgggagctt

SEQ ID NO: 725880 - DNA, 25 bp, Mus musculus
gttcaaggcataacactattggcat

SEQ ID NO: 725881 - DNA, 25 bp, Mus musculus
gttcaaggcatatcactattggcat

SEQ ID NO: 725882 - DNA, 25 bp, Mus musculus
gttcaaggcatcactaccaagcata

SEQ ID NO: 725883 - DNA, 25 bp, Mus musculus
gttcaaggcatctctaccaagcata

SEQ ID NO: 725884 - DNA, 25 bp, Mus musculus
gttcaaggccagacttgtctcgagg

SEQ ID NO: 725885 - DNA, 25 bp, Mus musculus
gttcaaggccagatttcttctcaaa

SEQ ID NO: 725886 - DNA, 25 bp, Mus musculus
gttcaaggccagtcttgtctcgagg

SEQ ID NO: 725887 - DNA, 25 bp, Mus musculus
gttcaaggccagttttcttctcaaa

SEQ ID NO: 725888 - DNA, 25 bp, Mus musculus
gttcaaggccttaccaaaatatcta

SEQ ID NO: 725889 - DNA, 25 bp, Mus musculus
gttcaaggcctttccaaaatatcta

SEQ ID NO: 725890 - DNA, 25 bp, Mus musculus
gttcaaggctaacccttaactcctg

SEQ ID NO: 725891 - DNA, 25 bp, Mus musculus
gttcaaggctaagccttaactcctg

SEQ ID NO: 725892 - DNA, 25 bp, Mus musculus
gttcaaggctagaagcattggctac

SEQ ID NO: 725893 - DNA, 25 bp, Mus musculus
gttcaaggctagtagcattggctac

SEQ ID NO: 725894 - DNA, 25 bp, Mus musculus
gttcaaggctggatcatgacaagaa

SEQ ID NO: 725895 - DNA, 25 bp, Mus musculus
gttcaaggctggttcatgacaagaa

SEQ ID NO: 725896 - DNA, 25 bp, Mus musculus
gttcaaggctttccttcggaagaat

SEQ ID NO: 725897 - DNA, 25 bp, Mus musculus
gttcaaggctttcgtcgctattggg

SEQ ID NO: 725898 - DNA, 25 bp, Mus musculus
gttcaaggctttgcttcggaagaat

SEQ ID NO: 725899 - DNA, 25 bp, Mus musculus
gttcaaggctttggtcgctattggg

SEQ ID NO: 725900 - DNA, 25 bp, Mus musculus
gttcaagggcaacgctgcaggcata

SEQ ID NO: 725901 - DNA, 25 bp, Mus musculus
gttcaagggcaaggctgcaggcata

SEQ ID NO: 725902 - DNA, 25 bp, Mus musculus
gttcaaggtcgcatactagtgtaat

SEQ ID NO: 725903 - DNA, 25 bp, Mus musculus
gttcaaggtcgcttactagtgtaat

SEQ ID NO: 725904 - DNA, 25 bp, Mus musculus
gttcaaggtttcatttggcacagat

SEQ ID NO: 725905 - DNA, 25 bp, Mus musculus
gttcaaggtttcttttggcacagat

SEQ ID NO: 725906 - DNA, 25 bp, Mus musculus
gttcaaggttttcaggtttcaacag

SEQ ID NO: 725907 - DNA, 25 bp, Mus musculus
gttcaaggttttgaggtttcaacag

SEQ ID NO: 725908 - DNA, 25 bp, Mus musculus
gttcaagtacttataacctgcgagt

SEQ ID NO: 725909 - DNA, 25 bp, Mus musculus
gttcaagtacttttaacctgcgagt

SEQ ID NO: 725910 - DNA, 25 bp, Mus musculus
gttcaagtcaatactaacacagggc

SEQ ID NO: 725911 - DNA, 25 bp, Mus musculus
gttcaagtcaattctaacacagggc

SEQ ID NO: 725912 - DNA, 25 bp, Mus musculus
gttcaagtcataccagtcaatcagt

SEQ ID NO: 725913 - DNA, 25 bp, Mus musculus
gttcaagtcatagcagtcaatcagt

SEQ ID NO: 725914 - DNA, 25 bp, Mus musculus
gttcaagtccaaaccacatggggct

SEQ ID NO: 725915 - DNA, 25 bp, Mus musculus
gttcaagtccaatccacatggggct

SEQ ID NO: 725916 - DNA, 25 bp, Mus musculus
gttcaagtcctgcaactcctggagt

SEQ ID NO: 725917 - DNA, 25 bp, Mus musculus
gttcaagtcctgcttaccacttggt

SEQ ID NO: 725918 - DNA, 25 bp, Mus musculus
gttcaagtcctggaactcctggagt

SEQ ID NO: 725919 - DNA, 25 bp, Mus musculus
gttcaagtcctggttaccacttggt

SEQ ID NO: 725920 - DNA, 25 bp, Mus musculus
gttcaagtcgtccaaggactaaatt

SEQ ID NO: 725921 - DNA, 25 bp, Mus musculus
gttcaagtcgtcgaaggactaaatt

SEQ ID NO: 725922 - DNA, 25 bp, Mus musculus
gttcaagtctcacaagcctccaaat

SEQ ID NO: 725923 - DNA, 25 bp, Mus musculus
gttcaagtctcagaagcctccaaat

SEQ ID NO: 725924 - DNA, 25 bp, Mus musculus
gttcaagtggccacagaaacttcct

SEQ ID NO: 725925 - DNA, 25 bp, Mus musculus
gttcaagtggcctcagaaacttcct

SEQ ID NO: 725926 - DNA, 25 bp, Mus musculus
gttcaagtgtgactttatagctctg

SEQ ID NO: 725927 - DNA, 25 bp, Mus musculus
gttcaagtgtgagtttatagctctg

SEQ ID NO: 725928 - DNA, 25 bp, Mus musculus
gttcaagttagcatcagtccttcag

SEQ ID NO: 725929 - DNA, 25 bp, Mus musculus
gttcaagttagcttcagtccttcag

SEQ ID NO: 725930 - DNA, 25 bp, Mus musculus
gttcaagttaggaccatggttttca

SEQ ID NO: 725931 - DNA, 25 bp, Mus musculus
gttcaagttaggtccatggttttca

SEQ ID NO: 725932 - DNA, 25 bp, Mus musculus
gttcaagttcaacctgggataccta

SEQ ID NO: 725933 - DNA, 25 bp, Mus musculus
gttcaagttcaagctgggataccta

SEQ ID NO: 725934 - DNA, 25 bp, Mus musculus
gttcaagttcgcagggacgtcacgt

SEQ ID NO: 725935 - DNA, 25 bp, Mus musculus
gttcaagttcgctgggacgtcacgt

SEQ ID NO: 725936 - DNA, 25 bp, Mus musculus
gttcaagttgagattccctcttgtt

SEQ ID NO: 725937 - DNA, 25 bp, Mus musculus
gttcaagttgagtttccctcttgtt

SEQ ID NO: 725938 - DNA, 25 bp, Mus musculus
gttcaagttttaatttcctcataga

SEQ ID NO: 725939 - DNA, 25 bp, Mus musculus
gttcaagttttattttcctcataga

SEQ ID NO: 725940 - DNA, 25 bp, Mus musculus
gttcaataactacctactgactgcc

SEQ ID NO: 725941 - DNA, 25 bp, Mus musculus
gttcaataactagctactgactgcc

SEQ ID NO: 725942 - DNA, 25 bp, Mus musculus
gttcaataacttccgcctgcgtgtg

SEQ ID NO: 725943 - DNA, 25 bp, Mus musculus
gttcaataacttgcgcctgcgtgtg

SEQ ID NO: 725944 - DNA, 25 bp, Mus musculus
gttcaataagtgctcgtgtccttcc

SEQ ID NO: 725945 - DNA, 25 bp, Mus musculus
gttcaataagtggtcgtgtccttcc

SEQ ID NO: 725946 - DNA, 25 bp, Mus musculus
gttcaatacaacagctcttttcaca

SEQ ID NO: 725947 - DNA, 25 bp, Mus musculus
gttcaatacaactgctcttttcaca

SEQ ID NO: 725948 - DNA, 25 bp, Mus musculus
gttcaatagaatactgattaaccag

SEQ ID NO: 725949 - DNA, 25 bp, Mus musculus
gttcaatagaattctgattaaccag

SEQ ID NO: 725950 - DNA, 25 bp, Mus musculus
gttcaatatgtcctagtacttgcct

SEQ ID NO: 725951 - DNA, 25 bp, Mus musculus
gttcaatatgtcgtagtacttgcct

SEQ ID NO: 725952 - DNA, 25 bp, Mus musculus
gttcaatattataacgggtccgtct

SEQ ID NO: 725953 - DNA, 25 bp, Mus musculus
gttcaatattattacgggtccgtct

SEQ ID NO: 725954 - DNA, 25 bp, Mus musculus
gttcaatcaactatttcttagacca

SEQ ID NO: 725955 - DNA, 25 bp, Mus musculus
gttcaatcaactttttcttagacca

SEQ ID NO: 725956 - DNA, 25 bp, Mus musculus
gttcaatcaccaacaggagagtcag

SEQ ID NO: 725957 - DNA, 25 bp, Mus musculus
gttcaatcaccatcaggagagtcag

SEQ ID NO: 725958 - DNA, 25 bp, Mus musculus
gttcaatcagtcatgctttgcgtgc

SEQ ID NO: 725959 - DNA, 25 bp, Mus musculus
gttcaatcagtcttgctttgcgtgc

SEQ ID NO: 725960 - DNA, 25 bp, Mus musculus
gttcaatcatccctgagccttaaaa

SEQ ID NO: 725961 - DNA, 25 bp, Mus musculus
gttcaatcatccgtgagccttaaaa

SEQ ID NO: 725962 - DNA, 25 bp, Mus musculus
gttcaatcatgtacttatctcctcc

SEQ ID NO: 725963 - DNA, 25 bp, Mus musculus
gttcaatcatgttcttatctcctcc

SEQ ID NO: 725964 - DNA, 25 bp, Mus musculus
gttcaatccaggatgctccttctga

SEQ ID NO: 725965 - DNA, 25 bp, Mus musculus
gttcaatccaggttgctccttctga

SEQ ID NO: 725966 - DNA, 25 bp, Mus musculus
gttcaatccagtcactacaccggaa

SEQ ID NO: 725967 - DNA, 25 bp, Mus musculus
gttcaatccagtgactacaccggaa

SEQ ID NO: 725968 - DNA, 25 bp, Mus musculus
gttcaatccattccaaacatctatg

SEQ ID NO: 725969 - DNA, 25 bp, Mus musculus
gttcaatccattgcaaacatctatg

SEQ ID NO: 725970 - DNA, 25 bp, Mus musculus
gttcaatccccaacaaatgcttagt

SEQ ID NO: 725971 - DNA, 25 bp, Mus musculus
gttcaatccccactaacacacaaat

SEQ ID NO: 725972 - DNA, 25 bp, Mus musculus
gttcaatccccagtaacacacaaat

SEQ ID NO: 725973 - DNA, 25 bp, Mus musculus
gttcaatccccatcaaatgcttagt

SEQ ID NO: 725974 - DNA, 25 bp, Mus musculus
gttcaatctcaactgtggctcagca

SEQ ID NO: 725975 - DNA, 25 bp, Mus musculus
gttcaatctcaagtgtggctcagca

SEQ ID NO: 725976 - DNA, 25 bp, Mus musculus
gttcaatctgttctgtattcccatt

SEQ ID NO: 725977 - DNA, 25 bp, Mus musculus
gttcaatctgttgtgtattcccatt

SEQ ID NO: 725978 - DNA, 25 bp, Mus musculus
gttcaatgacctctgaaagcctgaa

SEQ ID NO: 725979 - DNA, 25 bp, Mus musculus
gttcaatgacctgtgaaagcctgaa

SEQ ID NO: 725980 - DNA, 25 bp, Mus musculus
gttcaatgagctcacggtgcccatc

SEQ ID NO: 725981 - DNA, 25 bp, Mus musculus
gttcaatgagctgacggtgcccatc

SEQ ID NO: 725982 - DNA, 25 bp, Mus musculus
gttcaatgcaccagatactattttg

SEQ ID NO: 725983 - DNA, 25 bp, Mus musculus
gttcaatgcacctgatactattttg

SEQ ID NO: 725984 - DNA, 25 bp, Mus musculus
gttcaatgccctcactttctaaagg

SEQ ID NO: 725985 - DNA, 25 bp, Mus musculus
gttcaatgccctgactttctaaagg

SEQ ID NO: 725986 - DNA, 25 bp, Mus musculus
gttcaatgctcaagcagccactgac

SEQ ID NO: 725987 - DNA, 25 bp, Mus musculus
gttcaatgctcatgcagccactgac

SEQ ID NO: 725988 - DNA, 25 bp, Mus musculus
gttcaatggactacacaacccagat

SEQ ID NO: 725989 - DNA, 25 bp, Mus musculus
gttcaatggacttcacaacccagat

SEQ ID NO: 725990 - DNA, 25 bp, Mus musculus
gttcaatgtcctagaccagaatggt

SEQ ID NO: 725991 - DNA, 25 bp, Mus musculus
gttcaatgtccttgaccagaatggt

SEQ ID NO: 725992 - DNA, 25 bp, Mus musculus
gttcaatgttcaagtttcccatttt

SEQ ID NO: 725993 - DNA, 25 bp, Mus musculus
gttcaatgttcatgtttcccatttt

SEQ ID NO: 725994 - DNA, 25 bp, Mus musculus
gttcaatgttgtatctatattccac

SEQ ID NO: 725995 - DNA, 25 bp, Mus musculus
gttcaatgttgtttctatattccac

SEQ ID NO: 725996 - DNA, 25 bp, Mus musculus
gttcaattaccacgagtcaacagct

SEQ ID NO: 725997 - DNA, 25 bp, Mus musculus
gttcaattaccaggagtcaacagct

SEQ ID NO: 725998 - DNA, 25 bp, Mus musculus
gttcaattcaagactccagggtgtt

SEQ ID NO: 725999 - DNA, 25 bp, Mus musculus
gttcaattcaagtctccagggtgtt

SEQ ID NO: 726000 - DNA, 25 bp, Mus musculus
gttcaattcatgagtgttcgtgtct

SEQ ID NO: 726001 - DNA, 25 bp, Mus musculus
gttcaattcatgtgtgttcgtgtct

SEQ ID NO: 726002 - DNA, 25 bp, Mus musculus
gttcaattctgacttctttaaggca

SEQ ID NO: 726003 - DNA, 25 bp, Mus musculus
gttcaattctgagttctttaaggca

SEQ ID NO: 726004 - DNA, 25 bp, Mus musculus
gttcaatttctgacacgttctctaa

SEQ ID NO: 726005 - DNA, 25 bp, Mus musculus
gttcaatttctgtcacgttctctaa

SEQ ID NO: 726006 - DNA, 25 bp, Mus musculus
gttcaatttgacactgcaccacata

SEQ ID NO: 726007 - DNA, 25 bp, Mus musculus
gttcaatttgactctgcaccacata

SEQ ID NO: 726008 - DNA, 25 bp, Mus musculus
gttcaatttgctaagttaccactta

SEQ ID NO: 726009 - DNA, 25 bp, Mus musculus
gttcaatttgcttagttaccactta

SEQ ID NO: 726010 - DNA, 25 bp, Mus musculus
gttcaatttggaacgggctaatgtt

SEQ ID NO: 726011 - DNA, 25 bp, Mus musculus
gttcaatttggatcgggctaatgtt

SEQ ID NO: 726012 - DNA, 25 bp, Mus musculus
gttcacaaaacacttctcgaattta

SEQ ID NO: 726013 - DNA, 25 bp, Mus musculus
gttcacaaaacagttctcgaattta

SEQ ID NO: 726014 - DNA, 25 bp, Mus musculus
gttcacaaactacctctggacggtt

SEQ ID NO: 726015 - DNA, 25 bp, Mus musculus
gttcacaaactagctctggacggtt

SEQ ID NO: 726016 - DNA, 25 bp, Mus musculus
gttcacaaagccagggagctgccct

SEQ ID NO: 726017 - DNA, 25 bp, Mus musculus
gttcacaaagcctgggagctgccct

SEQ ID NO: 726018 - DNA, 25 bp, Mus musculus
gttcacaagaataacacccacacgc

SEQ ID NO: 726019 - DNA, 25 bp, Mus musculus
gttcacaagaattacacccacacgc

SEQ ID NO: 726020 - DNA, 25 bp, Mus musculus
gttcacaaggatcgtttccctttct

SEQ ID NO: 726021 - DNA, 25 bp, Mus musculus
gttcacaaggatggtttccctttct

SEQ ID NO: 726022 - DNA, 25 bp, Mus musculus
gttcacaatctgagtgccgacctga

SEQ ID NO: 726023 - DNA, 25 bp, Mus musculus
gttcacaatctgtgtgccgacctga

SEQ ID NO: 726024 - DNA, 25 bp, Mus musculus
gttcacaatgcgcagtttgtcctga

SEQ ID NO: 726025 - DNA, 25 bp, Mus musculus
gttcacaatgcggagtttgtcctga

SEQ ID NO: 726026 - DNA, 25 bp, Mus musculus
gttcacaattataacatgttagcca

SEQ ID NO: 726027 - DNA, 25 bp, Mus musculus
gttcacaattattacatgttagcca

SEQ ID NO: 726028 - DNA, 25 bp, Mus musculus
gttcacaattctatttatactgctg

SEQ ID NO: 726029 - DNA, 25 bp, Mus musculus
gttcacaattctttttatactgctg

SEQ ID NO: 726030 - DNA, 25 bp, Mus musculus
gttcacaattgcaaaggtttcctaa

SEQ ID NO: 726031 - DNA, 25 bp, Mus musculus
gttcacaattgctaaggtttcctaa

SEQ ID NO: 726032 - DNA, 25 bp, Mus musculus
gttcacaattgtcttcatcataggt

SEQ ID NO: 726033 - DNA, 25 bp, Mus musculus
gttcacaattgtgttcatcataggt

SEQ ID NO: 726034 - DNA, 25 bp, Mus musculus
gttcacaatttacatctcagctgga

SEQ ID NO: 726035 - DNA, 25 bp, Mus musculus
gttcacaatttagatctcagctgga

SEQ ID NO: 726036 - DNA, 25 bp, Mus musculus
gttcacacaataatttccttcggga

SEQ ID NO: 726037 - DNA, 25 bp, Mus musculus
gttcacacaatattttccttcggga

SEQ ID NO: 726038 - DNA, 25 bp, Mus musculus
gttcacacacaaaatccatggctta

SEQ ID NO: 726039 - DNA, 25 bp, Mus musculus
gttcacacacaatatccatggctta

SEQ ID NO: 726040 - DNA, 25 bp, Mus musculus
gttcacacaccaagcctttggaagc

SEQ ID NO: 726041 - DNA, 25 bp, Mus musculus
gttcacacaccatgcctttggaagc

SEQ ID NO: 726042 - DNA, 25 bp, Mus musculus
gttcacacagacaccagggcagata

SEQ ID NO: 726043 - DNA, 25 bp, Mus musculus
gttcacacagactccagggcagata

SEQ ID NO: 726044 - DNA, 25 bp, Mus musculus
gttcacacataaatcttgccatcta

SEQ ID NO: 726045 - DNA, 25 bp, Mus musculus
gttcacacataattcttgccatcta

SEQ ID NO: 726046 - DNA, 25 bp, Mus musculus
gttcacaccccacggttgatgtgat

SEQ ID NO: 726047 - DNA, 25 bp, Mus musculus
gttcacaccccagggttgatgtgat

SEQ ID NO: 726048 - DNA, 25 bp, Mus musculus
gttcacacccgcagttaacaggcat

SEQ ID NO: 726049 - DNA, 25 bp, Mus musculus
gttcacacccgctgttaacaggcat

SEQ ID NO: 726050 - DNA, 25 bp, Mus musculus
gttcacaccggtagataatgctaag

SEQ ID NO: 726051 - DNA, 25 bp, Mus musculus
gttcacaccggttgataatgctaag

SEQ ID NO: 726052 - DNA, 25 bp, Mus musculus
gttcacaccgtgcagtctccaaggg

SEQ ID NO: 726053 - DNA, 25 bp, Mus musculus
gttcacaccgtggagtctccaaggg

SEQ ID NO: 726054 - DNA, 25 bp, Mus musculus
gttcacacctcacaaagtcagtatt

SEQ ID NO: 726055 - DNA, 25 bp, Mus musculus
gttcacacctcagaaagtcagtatt

SEQ ID NO: 726056 - DNA, 25 bp, Mus musculus
gttcacacctccagcaggcgtgtgc

SEQ ID NO: 726057 - DNA, 25 bp, Mus musculus
gttcacacctcctgcaggcgtgtgc

SEQ ID NO: 726058 - DNA, 25 bp, Mus musculus
gttcacacgggacgcagcacaggac

SEQ ID NO: 726059 - DNA, 25 bp, Mus musculus
gttcacacgggaggcagcacaggac

SEQ ID NO: 726060 - DNA, 25 bp, Mus musculus
gttcacacgtctcttctctgggaaa

SEQ ID NO: 726061 - DNA, 25 bp, Mus musculus
gttcacacgtctgttctctgggaaa

SEQ ID NO: 726062 - DNA, 25 bp, Mus musculus
gttcacactgaacaggttgccctgt

SEQ ID NO: 726063 - DNA, 25 bp, Mus musculus
gttcacactgaagaggttgccctgt

SEQ ID NO: 726064 - DNA, 25 bp, Mus musculus
gttcacactgatcagtccaaaagga

SEQ ID NO: 726065 - DNA, 25 bp, Mus musculus
gttcacactgatgagtccaaaagga

SEQ ID NO: 726066 - DNA, 25 bp, Mus musculus
gttcacactggactcacgatgtctt

SEQ ID NO: 726067 - DNA, 25 bp, Mus musculus
gttcacactggagtcacgatgtctt

SEQ ID NO: 726068 - DNA, 25 bp, Mus musculus
gttcacactgtgatggccaagacac

SEQ ID NO: 726069 - DNA, 25 bp, Mus musculus
gttcacactgtgcagcatagcgttc

SEQ ID NO: 726070 - DNA, 25 bp, Mus musculus
gttcacactgtggagcatagcgttc

SEQ ID NO: 726071 - DNA, 25 bp, Mus musculus
gttcacactgtgttggccaagacac

SEQ ID NO: 726072 - DNA, 25 bp, Mus musculus
gttcacacttgtcgaaaccttgtat

SEQ ID NO: 726073 - DNA, 25 bp, Mus musculus
gttcacacttgtggaaaccttgtat

SEQ ID NO: 726074 - DNA, 25 bp, Mus musculus
gttcacacttttcagatttctcgtg

SEQ ID NO: 726075 - DNA, 25 bp, Mus musculus
gttcacacttttgagatttctcgtg

SEQ ID NO: 726076 - DNA, 25 bp, Mus musculus
gttcacagactgagctgcagcagat

SEQ ID NO: 726077 - DNA, 25 bp, Mus musculus
gttcacagactgtgctgcagcagat

SEQ ID NO: 726078 - DNA, 25 bp, Mus musculus
gttcacagatctcctgttgctggga

SEQ ID NO: 726079 - DNA, 25 bp, Mus musculus
gttcacagatctgctgttgctggga

SEQ ID NO: 726080 - DNA, 25 bp, Mus musculus
gttcacagcgtgacaactttcattt

SEQ ID NO: 726081 - DNA, 25 bp, Mus musculus
gttcacagcgtgtcaactttcattt

SEQ ID NO: 726082 - DNA, 25 bp, Mus musculus
gttcacagctcacatgatcaccatc

SEQ ID NO: 726083 - DNA, 25 bp, Mus musculus
gttcacagctcagatgatcaccatc

SEQ ID NO: 726084 - DNA, 25 bp, Mus musculus
gttcacaggtgaccacagaagcact

SEQ ID NO: 726085 - DNA, 25 bp, Mus musculus
gttcacaggtgagcacagaagcact

SEQ ID NO: 726086 - DNA, 25 bp, Mus musculus
gttcacagtaaactcatgtagtgct

SEQ ID NO: 726087 - DNA, 25 bp, Mus musculus
gttcacagtaaagtcatgtagtgct

SEQ ID NO: 726088 - DNA, 25 bp, Mus musculus
gttcacagtaccactgtagcgtttc

SEQ ID NO: 726089 - DNA, 25 bp, Mus musculus
gttcacagtacctctgtagcgtttc

SEQ ID NO: 726090 - DNA, 25 bp, Mus musculus
gttcacagtcgcctctgccagtggg

SEQ ID NO: 726091 - DNA, 25 bp, Mus musculus
gttcacagtcgcgtctgccagtggg

SEQ ID NO: 726092 - DNA, 25 bp, Mus musculus
gttcacagtgccctaagagctccaa

SEQ ID NO: 726093 - DNA, 25 bp, Mus musculus
gttcacagtgccgtaagagctccaa

SEQ ID NO: 726094 - DNA, 25 bp, Mus musculus
gttcacagtgtcatgtttcctagca

SEQ ID NO: 726095 - DNA, 25 bp, Mus musculus
gttcacagtgtcttgtttcctagca

SEQ ID NO: 726096 - DNA, 25 bp, Mus musculus
gttcacagtttcattgtctttaggt

SEQ ID NO: 726097 - DNA, 25 bp, Mus musculus
gttcacagtttctttgtctttaggt

SEQ ID NO: 726098 - DNA, 25 bp, Mus musculus
gttcacataaacagttaaccactgt

SEQ ID NO: 726099 - DNA, 25 bp, Mus musculus
gttcacataaactgttaaccactgt

SEQ ID NO: 726100 - DNA, 25 bp, Mus musculus
gttcacataagaaagggagcccctc

SEQ ID NO: 726101 - DNA, 25 bp, Mus musculus
gttcacataagatagggagcccctc

SEQ ID NO: 726102 - DNA, 25 bp, Mus musculus
gttcacatacccaaccctgtagaag

SEQ ID NO: 726103 - DNA, 25 bp, Mus musculus
gttcacataccctaccctgtagaag

SEQ ID NO: 726104 - DNA, 25 bp, Mus musculus
gttcacatatgtctgcacgtgtatg

SEQ ID NO: 726105 - DNA, 25 bp, Mus musculus
gttcacatatgtgtgcacgtgtatg

SEQ ID NO: 726106 - DNA, 25 bp, Mus musculus
gttcacatattaattagctctactt

SEQ ID NO: 726107 - DNA, 25 bp, Mus musculus
gttcacatattatttagctctactt

SEQ ID NO: 726108 - DNA, 25 bp, Mus musculus
gttcacatcagacgtagaccctaag

SEQ ID NO: 726109 - DNA, 25 bp, Mus musculus
gttcacatcagaggtagaccctaag

SEQ ID NO: 726110 - DNA, 25 bp, Mus musculus
gttcacatcccaagagactctgttt

SEQ ID NO: 726111 - DNA, 25 bp, Mus musculus
gttcacatcccatgagactctgttt

SEQ ID NO: 726112 - DNA, 25 bp, Mus musculus
gttcacatctgtaacagctctttgg

SEQ ID NO: 726113 - DNA, 25 bp, Mus musculus
gttcacatctgtagctgggtctgga

SEQ ID NO: 726114 - DNA, 25 bp, Mus musculus
gttcacatctgttacagctctttgg

SEQ ID NO: 726115 - DNA, 25 bp, Mus musculus
gttcacatctgttgctgggtctgga

SEQ ID NO: 726116 - DNA, 25 bp, Mus musculus
gttcacatgacaccgtggcatctaa

SEQ ID NO: 726117 - DNA, 25 bp, Mus musculus
gttcacatgacagcgtggcatctaa

SEQ ID NO: 726118 - DNA, 25 bp, Mus musculus
gttcacatgactcgttgctggtaga

SEQ ID NO: 726119 - DNA, 25 bp, Mus musculus
gttcacatgactggttgctggtaga

SEQ ID NO: 726120 - DNA, 25 bp, Mus musculus
gttcacatggagcttcagagctgtt

SEQ ID NO: 726121 - DNA, 25 bp, Mus musculus
gttcacatggaggttcagagctgtt

SEQ ID NO: 726122 - DNA, 25 bp, Mus musculus
gttcacatgggtattgtaacaccct

SEQ ID NO: 726123 - DNA, 25 bp, Mus musculus
gttcacatgggttttgtaacaccct

SEQ ID NO: 726124 - DNA, 25 bp, Mus musculus
gttcacatgtatacatcttccggtc

SEQ ID NO: 726125 - DNA, 25 bp, Mus musculus
gttcacatgtattcatcttccggtc

SEQ ID NO: 726126 - DNA, 25 bp, Mus musculus
gttcacatgtgacttcacccagcag

SEQ ID NO: 726127 - DNA, 25 bp, Mus musculus
gttcacatgtgagttcacccagcag

SEQ ID NO: 726128 - DNA, 25 bp, Mus musculus
gttcacattaccacagttgctgtca

SEQ ID NO: 726129 - DNA, 25 bp, Mus musculus
gttcacattacctcagttgctgtca

SEQ ID NO: 726130 - DNA, 25 bp, Mus musculus
gttcacattcttcggccatctgtcc

SEQ ID NO: 726131 - DNA, 25 bp, Mus musculus
gttcacattcttgggccatctgtcc

SEQ ID NO: 726132 - DNA, 25 bp, Mus musculus
gttcacattgtcatcctttctggaa

SEQ ID NO: 726133 - DNA, 25 bp, Mus musculus
gttcacattgtcttcctttctggaa

SEQ ID NO: 726134 - DNA, 25 bp, Mus musculus
gttcaccaaaggcaagtccttccgg

SEQ ID NO: 726135 - DNA, 25 bp, Mus musculus
gttcaccaaagggaagtccttccgg

SEQ ID NO: 726136 - DNA, 25 bp, Mus musculus
gttcaccaaagtaatcatgaggatt

SEQ ID NO: 726137 - DNA, 25 bp, Mus musculus
gttcaccaaagttatcatgaggatt

SEQ ID NO: 726138 - DNA, 25 bp, Mus musculus
gttcaccaacgcaacatgataccct

SEQ ID NO: 726139 - DNA, 25 bp, Mus musculus
gttcaccaacgctacatgataccct

SEQ ID NO: 726140 - DNA, 25 bp, Mus musculus
gttcaccaacttactttctttgaga

SEQ ID NO: 726141 - DNA, 25 bp, Mus musculus
gttcaccaactttctttctttgaga

SEQ ID NO: 726142 - DNA, 25 bp, Mus musculus
gttcaccacaaaagtatctgctgct

SEQ ID NO: 726143 - DNA, 25 bp, Mus musculus
gttcaccacaaatgtatctgctgct

SEQ ID NO: 726144 - DNA, 25 bp, Mus musculus
gttcaccacacacctagtattctag

SEQ ID NO: 726145 - DNA, 25 bp, Mus musculus
gttcaccacacagctagtattctag

SEQ ID NO: 726146 - DNA, 25 bp, Mus musculus
gttcaccacggtagctgagccagag

SEQ ID NO: 726147 - DNA, 25 bp, Mus musculus
gttcaccacggttgctgagccagag

SEQ ID NO: 726148 - DNA, 25 bp, Mus musculus
gttcaccagaatcagatcttgcggg

SEQ ID NO: 726149 - DNA, 25 bp, Mus musculus
gttcaccagaatgagatcttgcggg

SEQ ID NO: 726150 - DNA, 25 bp, Mus musculus
gttcaccagtgcaaaaggcttaatg

SEQ ID NO: 726151 - DNA, 25 bp, Mus musculus
gttcaccagtgctaaaggcttaatg

SEQ ID NO: 726152 - DNA, 25 bp, Mus musculus
gttcaccataatctggctctcatgt

SEQ ID NO: 726153 - DNA, 25 bp, Mus musculus
gttcaccataatgtggctctcatgt

SEQ ID NO: 726154 - DNA, 25 bp, Mus musculus
gttcaccatacaatcatttactctt

SEQ ID NO: 726155 - DNA, 25 bp, Mus musculus
gttcaccatacattcatttactctt

SEQ ID NO: 726156 - DNA, 25 bp, Mus musculus
gttcaccatcaacgttttgttgcag

SEQ ID NO: 726157 - DNA, 25 bp, Mus musculus
gttcaccatcaaggttttgttgcag

SEQ ID NO: 726158 - DNA, 25 bp, Mus musculus
gttcaccatctcagtcgatgacatc

SEQ ID NO: 726159 - DNA, 25 bp, Mus musculus
gttcaccatctctgtcgatgacatc

SEQ ID NO: 726160 - DNA, 25 bp, Mus musculus
gttcaccatgatctttgtcacgctg

SEQ ID NO: 726161 - DNA, 25 bp, Mus musculus
gttcaccatgatgtttgtcacgctg

SEQ ID NO: 726162 - DNA, 25 bp, Mus musculus
gttcaccatgttatcttgtcttgta

SEQ ID NO: 726163 - DNA, 25 bp, Mus musculus
gttcaccatgttttcttgtcttgta

SEQ ID NO: 726164 - DNA, 25 bp, Mus musculus
gttcaccattcccaaaggcacagtg

SEQ ID NO: 726165 - DNA, 25 bp, Mus musculus
gttcaccattccgaaaggcacagtg

SEQ ID NO: 726166 - DNA, 25 bp, Mus musculus
gttcacccaccaacagcaatttgaa

SEQ ID NO: 726167 - DNA, 25 bp, Mus musculus
gttcacccaccatcagcaatttgaa

SEQ ID NO: 726168 - DNA, 25 bp, Mus musculus
gttcacccagttatgatccagcaca

SEQ ID NO: 726169 - DNA, 25 bp, Mus musculus
gttcacccagttttgatccagcaca

SEQ ID NO: 726170 - DNA, 25 bp, Mus musculus
gttcacccatagatcacatttttgt

SEQ ID NO: 726171 - DNA, 25 bp, Mus musculus
gttcacccatagttcacatttttgt

SEQ ID NO: 726172 - DNA, 25 bp, Mus musculus
gttcacccatctcaacacaactggg

SEQ ID NO: 726173 - DNA, 25 bp, Mus musculus
gttcacccatctgaacacaactggg

SEQ ID NO: 726174 - DNA, 25 bp, Mus musculus
gttcacccatggctgttcttgacac

SEQ ID NO: 726175 - DNA, 25 bp, Mus musculus
gttcacccatgggtgttcttgacac

SEQ ID NO: 726176 - DNA, 25 bp, Mus musculus
gttcaccccgttatgttcatagtat

SEQ ID NO: 726177 - DNA, 25 bp, Mus musculus
gttcaccccgttttgttcatagtat

SEQ ID NO: 726178 - DNA, 25 bp, Mus musculus
gttcacccctgcagtcaaaggatct

SEQ ID NO: 726179 - DNA, 25 bp, Mus musculus
gttcacccctgctgtcaaaggatct

SEQ ID NO: 726180 - DNA, 25 bp, Mus musculus
gttcacccctgtacaaaggtggcag

SEQ ID NO: 726181 - DNA, 25 bp, Mus musculus
gttcacccctgtaggatgatactta

SEQ ID NO: 726182 - DNA, 25 bp, Mus musculus
gttcacccctgttcaaaggtggcag

SEQ ID NO: 726183 - DNA, 25 bp, Mus musculus
gttcacccctgttggatgatactta

SEQ ID NO: 726184 - DNA, 25 bp, Mus musculus
gttcacccgtcaaactacattggta

SEQ ID NO: 726185 - DNA, 25 bp, Mus musculus
gttcacccgtcatactacattggta

SEQ ID NO: 726186 - DNA, 25 bp, Mus musculus
gttcacccgtgaaatctctattaca

SEQ ID NO: 726187 - DNA, 25 bp, Mus musculus
gttcacccgtgatatctctattaca

SEQ ID NO: 726188 - DNA, 25 bp, Mus musculus
gttcaccctatacaatcacatacat

SEQ ID NO: 726189 - DNA, 25 bp, Mus musculus
gttcaccctatagaatcacatacat

SEQ ID NO: 726190 - DNA, 25 bp, Mus musculus
gttcaccctgtcaactatcaagaca

SEQ ID NO: 726191 - DNA, 25 bp, Mus musculus
gttcaccctgtctactatcaagaca

SEQ ID NO: 726192 - DNA, 25 bp, Mus musculus
gttcaccgagagagtctatgtcctt

SEQ ID NO: 726193 - DNA, 25 bp, Mus musculus
gttcaccgagagtgtctatgtcctt

SEQ ID NO: 726194 - DNA, 25 bp, Mus musculus
gttcacctaagacatgcaacatgaa

SEQ ID NO: 726195 - DNA, 25 bp, Mus musculus
gttcacctaagagatgcaacatgaa

SEQ ID NO: 726196 - DNA, 25 bp, Mus musculus
gttcacctaccccaaaggagctgga

SEQ ID NO: 726197 - DNA, 25 bp, Mus musculus
gttcacctacccgaaaggagctgga

SEQ ID NO: 726198 - DNA, 25 bp, Mus musculus
gttcacctattgcacttccagtgaa

SEQ ID NO: 726199 - DNA, 25 bp, Mus musculus
gttcacctattggacttccagtgaa

SEQ ID NO: 726200 - DNA, 25 bp, Mus musculus
gttcacctcaccattgtatgttctg

SEQ ID NO: 726201 - DNA, 25 bp, Mus musculus
gttcacctcacctttgtatgttctg

SEQ ID NO: 726202 - DNA, 25 bp, Mus musculus
gttcacctcactcgcagcttggtat

SEQ ID NO: 726203 - DNA, 25 bp, Mus musculus
gttcacctcactggcagcttggtat

SEQ ID NO: 726204 - DNA, 25 bp, Mus musculus
gttcacctcccaagatgcctggcgt

SEQ ID NO: 726205 - DNA, 25 bp, Mus musculus
gttcacctcccatgatgcctggcgt

SEQ ID NO: 726206 - DNA, 25 bp, Mus musculus
gttcacctcgcaaattatagtgctt

SEQ ID NO: 726207 - DNA, 25 bp, Mus musculus
gttcacctcgcatattatagtgctt

SEQ ID NO: 726208 - DNA, 25 bp, Mus musculus
gttcaccttaccaaagactctatcc

SEQ ID NO: 726209 - DNA, 25 bp, Mus musculus
gttcaccttacctaagactctatcc

SEQ ID NO: 726210 - DNA, 25 bp, Mus musculus
gttcaccttctgattcttgtgggaa

SEQ ID NO: 726211 - DNA, 25 bp, Mus musculus
gttcaccttctgtttcttgtgggaa

SEQ ID NO: 726212 - DNA, 25 bp, Mus musculus
gttcaccttgatactcattgatttg

SEQ ID NO: 726213 - DNA, 25 bp, Mus musculus
gttcaccttgattctcattgatttg

SEQ ID NO: 726214 - DNA, 25 bp, Mus musculus
gttcaccttgcgcttgtgttagaat

SEQ ID NO: 726215 - DNA, 25 bp, Mus musculus
gttcaccttgcggttgtgttagaat

SEQ ID NO: 726216 - DNA, 25 bp, Mus musculus
gttcaccttgtgcaatgggctgact

SEQ ID NO: 726217 - DNA, 25 bp, Mus musculus
gttcaccttgtggaatgggctgact

SEQ ID NO: 726218 - DNA, 25 bp, Mus musculus
gttcacctttagaaatgtccagaca

SEQ ID NO: 726219 - DNA, 25 bp, Mus musculus
gttcacctttagtaatgtccagaca

SEQ ID NO: 726220 - DNA, 25 bp, Mus musculus
gttcacctttgtataagtgtgccgc

SEQ ID NO: 726221 - DNA, 25 bp, Mus musculus
gttcacctttgtttaagtgtgccgc

SEQ ID NO: 726222 - DNA, 25 bp, Mus musculus
gttcaccttttcacattgcatagac

SEQ ID NO: 726223 - DNA, 25 bp, Mus musculus
gttcaccttttctcattgcatagac

SEQ ID NO: 726224 - DNA, 25 bp, Mus musculus
gttcacgaacccagacctggaggat

SEQ ID NO: 726225 - DNA, 25 bp, Mus musculus
gttcacgaaccctgacctggaggat

SEQ ID NO: 726226 - DNA, 25 bp, Mus musculus
gttcacgaagtaaccattgtctctt

SEQ ID NO: 726227 - DNA, 25 bp, Mus musculus
gttcacgaagtatccattgtctctt

SEQ ID NO: 726228 - DNA, 25 bp, Mus musculus
gttcacgagatgctcaggagcccct

SEQ ID NO: 726229 - DNA, 25 bp, Mus musculus
gttcacgagatggtcaggagcccct

SEQ ID NO: 726230 - DNA, 25 bp, Mus musculus
gttcacgagcacaatagctcccatg

SEQ ID NO: 726231 - DNA, 25 bp, Mus musculus
gttcacgagcactatagctcccatg

SEQ ID NO: 726232 - DNA, 25 bp, Mus musculus
gttcacgatgacaggataggctgca

SEQ ID NO: 726233 - DNA, 25 bp, Mus musculus
gttcacgatgactggataggctgca

SEQ ID NO: 726234 - DNA, 25 bp, Mus musculus
gttcacgcagacattcagcattaaa

SEQ ID NO: 726235 - DNA, 25 bp, Mus musculus
gttcacgcagactttcagcattaaa

SEQ ID NO: 726236 - DNA, 25 bp, Mus musculus
gttcacgcggtgcaaacagcagcag

SEQ ID NO: 726237 - DNA, 25 bp, Mus musculus
gttcacgcggtggaaacagcagcag

SEQ ID NO: 726238 - DNA, 25 bp, Mus musculus
gttcacgcttcaagggacatgtctc

SEQ ID NO: 726239 - DNA, 25 bp, Mus musculus
gttcacgcttcatgggacatgtctc

SEQ ID NO: 726240 - DNA, 25 bp, Mus musculus
gttcacggaactactcaaccaatca

SEQ ID NO: 726241 - DNA, 25 bp, Mus musculus
gttcacggaacttctcaaccaatca

SEQ ID NO: 726242 - DNA, 25 bp, Mus musculus
gttcacggactacggcaactatgaa

SEQ ID NO: 726243 - DNA, 25 bp, Mus musculus
gttcacggactagggcaactatgaa

SEQ ID NO: 726244 - DNA, 25 bp, Mus musculus
gttcacggagaactgctacaattat

SEQ ID NO: 726245 - DNA, 25 bp, Mus musculus
gttcacggagaagtgctacaattat

SEQ ID NO: 726246 - DNA, 25 bp, Mus musculus
gttcacggccccacgtatgaaagac

SEQ ID NO: 726247 - DNA, 25 bp, Mus musculus
gttcacggcccctcgtatgaaagac

SEQ ID NO: 726248 - DNA, 25 bp, Mus musculus
gttcacgggtgtcacattctctaac

SEQ ID NO: 726249 - DNA, 25 bp, Mus musculus
gttcacgggtgtgacattctctaac

SEQ ID NO: 726250 - DNA, 25 bp, Mus musculus
gttcacggtttacatcccaacactt

SEQ ID NO: 726251 - DNA, 25 bp, Mus musculus
gttcacggtttagatcccaacactt

SEQ ID NO: 726252 - DNA, 25 bp, Mus musculus
gttcacgtcagtatgtttcatatct

SEQ ID NO: 726253 - DNA, 25 bp, Mus musculus
gttcacgtcagtttgtttcatatct

SEQ ID NO: 726254 - DNA, 25 bp, Mus musculus
gttcactactacacacagtccaaaa

SEQ ID NO: 726255 - DNA, 25 bp, Mus musculus
gttcactactactcacagtccaaaa

SEQ ID NO: 726256 - DNA, 25 bp, Mus musculus
gttcactaggagagatgctgttcac

SEQ ID NO: 726257 - DNA, 25 bp, Mus musculus
gttcactaggagtgatgctgttcac

SEQ ID NO: 726258 - DNA, 25 bp, Mus musculus
gttcactatagtagggcttaccctg

SEQ ID NO: 726259 - DNA, 25 bp, Mus musculus
gttcactatagttgggcttaccctg

SEQ ID NO: 726260 - DNA, 25 bp, Mus musculus
gttcactatgatacgttttgttaag

SEQ ID NO: 726261 - DNA, 25 bp, Mus musculus
gttcactatgattcgttttgttaag

SEQ ID NO: 726262 - DNA, 25 bp, Mus musculus
gttcactatggactcttgccagatt

SEQ ID NO: 726263 - DNA, 25 bp, Mus musculus
gttcactatggagtcttgccagatt

SEQ ID NO: 726264 - DNA, 25 bp, Mus musculus
gttcactcacccatgattgtactgc

SEQ ID NO: 726265 - DNA, 25 bp, Mus musculus
gttcactcacccttgattgtactgc

SEQ ID NO: 726266 - DNA, 25 bp, Mus musculus
gttcactcaggcattaaagcaaata

SEQ ID NO: 726267 - DNA, 25 bp, Mus musculus
gttcactcaggctttaaagcaaata

SEQ ID NO: 726268 - DNA, 25 bp, Mus musculus
gttcactccatcatgttgcacagta

SEQ ID NO: 726269 - DNA, 25 bp, Mus musculus
gttcactccatcttgttgcacagta

SEQ ID NO: 726270 - DNA, 25 bp, Mus musculus
gttcactccgtaaccattcttatat

SEQ ID NO: 726271 - DNA, 25 bp, Mus musculus
gttcactccgtatccattcttatat

SEQ ID NO: 726272 - DNA, 25 bp, Mus musculus
gttcactcctgacaaacctgcaagt

SEQ ID NO: 726273 - DNA, 25 bp, Mus musculus
gttcactcctgagaaacctgcaagt

SEQ ID NO: 726274 - DNA, 25 bp, Mus musculus
gttcactcctgcacttagcagggat

SEQ ID NO: 726275 - DNA, 25 bp, Mus musculus
gttcactcctgctcttagcagggat

SEQ ID NO: 726276 - DNA, 25 bp, Mus musculus
gttcactcggtccaagagagttctt

SEQ ID NO: 726277 - DNA, 25 bp, Mus musculus
gttcactcggtcgaagagagttctt

SEQ ID NO: 726278 - DNA, 25 bp, Mus musculus
gttcactctcacaaacttacatcaa

SEQ ID NO: 726279 - DNA, 25 bp, Mus musculus
gttcactctcactaacttacatcaa

SEQ ID NO: 726280 - DNA, 25 bp, Mus musculus
gttcactctggtcgtagaatccccg

SEQ ID NO: 726281 - DNA, 25 bp, Mus musculus
gttcactctggtggtagaatccccg

SEQ ID NO: 726282 - DNA, 25 bp, Mus musculus
gttcactctgtgactttgacaagcc

SEQ ID NO: 726283 - DNA, 25 bp, Mus musculus
gttcactctgtgtctttgacaagcc

SEQ ID NO: 726284 - DNA, 25 bp, Mus musculus
gttcactgaccaaagtccacaattt

SEQ ID NO: 726285 - DNA, 25 bp, Mus musculus
gttcactgaccatagtccacaattt

SEQ ID NO: 726286 - DNA, 25 bp, Mus musculus
gttcactgagagaaccacctctgat

SEQ ID NO: 726287 - DNA, 25 bp, Mus musculus
gttcactgagagtaccacctctgat

SEQ ID NO: 726288 - DNA, 25 bp, Mus musculus
gttcactgagatctgccatgctgga

SEQ ID NO: 726289 - DNA, 25 bp, Mus musculus
gttcactgagatgtgccatgctgga

SEQ ID NO: 726290 - DNA, 25 bp, Mus musculus
gttcactgaggtatacaaaccttag

SEQ ID NO: 726291 - DNA, 25 bp, Mus musculus
gttcactgaggtttacaaaccttag

SEQ ID NO: 726292 - DNA, 25 bp, Mus musculus
gttcactgatataactacatttgca

SEQ ID NO: 726293 - DNA, 25 bp, Mus musculus
gttcactgatattactacatttgca

SEQ ID NO: 726294 - DNA, 25 bp, Mus musculus
gttcactgcacccaaaggcaacgga

SEQ ID NO: 726295 - DNA, 25 bp, Mus musculus
gttcactgcaccgaaaggcaacgga

SEQ ID NO: 726296 - DNA, 25 bp, Mus musculus
gttcactgccagagtgagaggatta

SEQ ID NO: 726297 - DNA, 25 bp, Mus musculus
gttcactgccagtgtgagaggatta

SEQ ID NO: 726298 - DNA, 25 bp, Mus musculus
gttcactgcgcccaagaggaagaga

SEQ ID NO: 726299 - DNA, 25 bp, Mus musculus
gttcactgcgccgaagaggaagaga

SEQ ID NO: 726300 - DNA, 25 bp, Mus musculus
gttcactgctaaaggacatctcctt

SEQ ID NO: 726301 - DNA, 25 bp, Mus musculus
gttcactgctaatggacatctcctt

SEQ ID NO: 726302 - DNA, 25 bp, Mus musculus
gttcactgctcaagacacatttgat

SEQ ID NO: 726303 - DNA, 25 bp, Mus musculus
gttcactgctcatgacacatttgat

SEQ ID NO: 726304 - DNA, 25 bp, Mus musculus
gttcactggaaaacaatgacaactg

SEQ ID NO: 726305 - DNA, 25 bp, Mus musculus
gttcactggaaatcaatgacaactg

SEQ ID NO: 726306 - DNA, 25 bp, Mus musculus
gttcactggagtatctgtttgcaca

SEQ ID NO: 726307 - DNA, 25 bp, Mus musculus
gttcactggagtttctgtttgcaca

SEQ ID NO: 726308 - DNA, 25 bp, Mus musculus
gttcactgggtacgagtgcctgctc

SEQ ID NO: 726309 - DNA, 25 bp, Mus musculus
gttcactgggtaggagtgcctgctc

SEQ ID NO: 726310 - DNA, 25 bp, Mus musculus
gttcactggtgacgcagctaggcat

SEQ ID NO: 726311 - DNA, 25 bp, Mus musculus
gttcactggtgaggcagctaggcat

SEQ ID NO: 726312 - DNA, 25 bp, Mus musculus
gttcactgtaagactccatggtggt

SEQ ID NO: 726313 - DNA, 25 bp, Mus musculus
gttcactgtaagtctccatggtggt

SEQ ID NO: 726314 - DNA, 25 bp, Mus musculus
gttcactgtagaaccagttcttcca

SEQ ID NO: 726315 - DNA, 25 bp, Mus musculus
gttcactgtagatccagttcttcca

SEQ ID NO: 726316 - DNA, 25 bp, Mus musculus
gttcactgtattagatcattgtctt

SEQ ID NO: 726317 - DNA, 25 bp, Mus musculus
gttcactgtatttgatcattgtctt

SEQ ID NO: 726318 - DNA, 25 bp, Mus musculus
gttcactgtgccataatactgcttg

SEQ ID NO: 726319 - DNA, 25 bp, Mus musculus
gttcactgtgccttaatactgcttg

SEQ ID NO: 726320 - DNA, 25 bp, Mus musculus
gttcacttaaatagctcagcaacgt

SEQ ID NO: 726321 - DNA, 25 bp, Mus musculus
gttcacttaaattgctcagcaacgt

SEQ ID NO: 726322 - DNA, 25 bp, Mus musculus
gttcacttaattcttctcacgggat

SEQ ID NO: 726323 - DNA, 25 bp, Mus musculus
gttcacttaattgttctcacgggat

SEQ ID NO: 726324 - DNA, 25 bp, Mus musculus
gttcacttacacaggacagcgcttg

SEQ ID NO: 726325 - DNA, 25 bp, Mus musculus
gttcacttacactggacagcgcttg

SEQ ID NO: 726326 - DNA, 25 bp, Mus musculus
gttcacttcaggaaaacaagcttta

SEQ ID NO: 726327 - DNA, 25 bp, Mus musculus
gttcacttcaggtaaacaagcttta

SEQ ID NO: 726328 - DNA, 25 bp, Mus musculus
gttcacttcatcctctttttgcaag

SEQ ID NO: 726329 - DNA, 25 bp, Mus musculus
gttcacttcatcgtctttttgcaag

SEQ ID NO: 726330 - DNA, 25 bp, Mus musculus
gttcacttcccaacagggtgactga

SEQ ID NO: 726331 - DNA, 25 bp, Mus musculus
gttcacttcccacttctggaaggaa

SEQ ID NO: 726332 - DNA, 25 bp, Mus musculus
gttcacttcccagttctggaaggaa

SEQ ID NO: 726333 - DNA, 25 bp, Mus musculus
gttcacttcccatcagggtgactga

SEQ ID NO: 726334 - DNA, 25 bp, Mus musculus
gttcacttccgacattttcattcac

SEQ ID NO: 726335 - DNA, 25 bp, Mus musculus
gttcacttccgagattttcattcac

SEQ ID NO: 726336 - DNA, 25 bp, Mus musculus
gttcacttccggatcatttctctac

SEQ ID NO: 726337 - DNA, 25 bp, Mus musculus
gttcacttccggttcatttctctac

SEQ ID NO: 726338 - DNA, 25 bp, Mus musculus
gttcacttcctaaggcaactagtat

SEQ ID NO: 726339 - DNA, 25 bp, Mus musculus
gttcacttcctatggcaactagtat

SEQ ID NO: 726340 - DNA, 25 bp, Mus musculus
gttcacttcgatatctaatctgctt

SEQ ID NO: 726341 - DNA, 25 bp, Mus musculus
gttcacttcgatttctaatctgctt

SEQ ID NO: 726342 - DNA, 25 bp, Mus musculus
gttcacttctaacgacttcacagcc

SEQ ID NO: 726343 - DNA, 25 bp, Mus musculus
gttcacttctaaggacttcacagcc

SEQ ID NO: 726344 - DNA, 25 bp, Mus musculus
gttcacttgagtagtcatgagcata

SEQ ID NO: 726345 - DNA, 25 bp, Mus musculus
gttcacttgagttgtcatgagcata

SEQ ID NO: 726346 - DNA, 25 bp, Mus musculus
gttcacttgctgagagtgtgacctt

SEQ ID NO: 726347 - DNA, 25 bp, Mus musculus
gttcacttgctgtgagtgtgacctt

SEQ ID NO: 726348 - DNA, 25 bp, Mus musculus
gttcacttggagcttatgtactgtc

SEQ ID NO: 726349 - DNA, 25 bp, Mus musculus
gttcacttggaggttatgtactgtc

SEQ ID NO: 726350 - DNA, 25 bp, Mus musculus
gttcacttggctagctggcgatggc

SEQ ID NO: 726351 - DNA, 25 bp, Mus musculus
gttcacttggctatatgcacatgtt

SEQ ID NO: 726352 - DNA, 25 bp, Mus musculus
gttcacttggcttgctggcgatggc

SEQ ID NO: 726353 - DNA, 25 bp, Mus musculus
gttcacttggctttatgcacatgtt

SEQ ID NO: 726354 - DNA, 25 bp, Mus musculus
gttcacttgggccacagtaaccata

SEQ ID NO: 726355 - DNA, 25 bp, Mus musculus
gttcacttgggcgacagtaaccata

SEQ ID NO: 726356 - DNA, 25 bp, Mus musculus
gttcacttgtgtctcctccattgga

SEQ ID NO: 726357 - DNA, 25 bp, Mus musculus
gttcacttgtgtgtcctccattgga

SEQ ID NO: 726358 - DNA, 25 bp, Mus musculus
gttcactttaacatttgcatacaaa

SEQ ID NO: 726359 - DNA, 25 bp, Mus musculus
gttcactttaacttttgcatacaaa

SEQ ID NO: 726360 - DNA, 25 bp, Mus musculus
gttcactttagacatgtggtgtatc

SEQ ID NO: 726361 - DNA, 25 bp, Mus musculus
gttcactttagagatgtggtgtatc

SEQ ID NO: 726362 - DNA, 25 bp, Mus musculus
gttcactttccaaaatcgtttctca

SEQ ID NO: 726363 - DNA, 25 bp, Mus musculus
gttcactttccataatcgtttctca

SEQ ID NO: 726364 - DNA, 25 bp, Mus musculus
gttcactttggaaccctcgcaaggt

SEQ ID NO: 726365 - DNA, 25 bp, Mus musculus
gttcactttggatccctcgcaaggt

SEQ ID NO: 726366 - DNA, 25 bp, Mus musculus
gttcactttgtgacaatacattcag

SEQ ID NO: 726367 - DNA, 25 bp, Mus musculus
gttcactttgtgtcaatacattcag

SEQ ID NO: 726368 - DNA, 25 bp, Mus musculus
gttcacttttctagggaacttggag

SEQ ID NO: 726369 - DNA, 25 bp, Mus musculus
gttcacttttcttgggaacttggag

SEQ ID NO: 726370 - DNA, 25 bp, Mus musculus
gttcagaaacttctcgtggctggag

SEQ ID NO: 726371 - DNA, 25 bp, Mus musculus
gttcagaaacttgtcgtggctggag

SEQ ID NO: 726372 - DNA, 25 bp, Mus musculus
gttcagaaagaacccgatgttcgtt

SEQ ID NO: 726373 - DNA, 25 bp, Mus musculus
gttcagaaagaagccgatgttcgtt

SEQ ID NO: 726374 - DNA, 25 bp, Mus musculus
gttcagaacattccttacagaaata

SEQ ID NO: 726375 - DNA, 25 bp, Mus musculus
gttcagaacattgcttacagaaata

SEQ ID NO: 726376 - DNA, 25 bp, Mus musculus
gttcagaacgacaggtgataatttt

SEQ ID NO: 726377 - DNA, 25 bp, Mus musculus
gttcagaacgactggtgataatttt

SEQ ID NO: 726378 - DNA, 25 bp, Mus musculus
gttcagaagcatcaattatcccatc

SEQ ID NO: 726379 - DNA, 25 bp, Mus musculus
gttcagaagcatgaattatcccatc

SEQ ID NO: 726380 - DNA, 25 bp, Mus musculus
gttcagaagtaaacctcagctggca

SEQ ID NO: 726381 - DNA, 25 bp, Mus musculus
gttcagaagtaatcctcagctggca

SEQ ID NO: 726382 - DNA, 25 bp, Mus musculus
gttcagaatcacctgaagacctggc

SEQ ID NO: 726383 - DNA, 25 bp, Mus musculus
gttcagaatcacgtgaagacctggc

SEQ ID NO: 726384 - DNA, 25 bp, Mus musculus
gttcagaatctcctatttgctttgt

SEQ ID NO: 726385 - DNA, 25 bp, Mus musculus
gttcagaatctcgtatttgctttgt

SEQ ID NO: 726386 - DNA, 25 bp, Mus musculus
gttcagaatgaacccacacacacac

SEQ ID NO: 726387 - DNA, 25 bp, Mus musculus
gttcagaatgaagccacacacacac

SEQ ID NO: 726388 - DNA, 25 bp, Mus musculus
gttcagaatggaattgttcattgct

SEQ ID NO: 726389 - DNA, 25 bp, Mus musculus
gttcagaatggatttgttcattgct

SEQ ID NO: 726390 - DNA, 25 bp, Mus musculus
gttcagaatggcagcaaccgtttcc

SEQ ID NO: 726391 - DNA, 25 bp, Mus musculus
gttcagaatggctgcaaccgtttcc

SEQ ID NO: 726392 - DNA, 25 bp, Mus musculus
gttcagaatttactgtctccatgat

SEQ ID NO: 726393 - DNA, 25 bp, Mus musculus
gttcagaatttagtgtctccatgat

SEQ ID NO: 726394 - DNA, 25 bp, Mus musculus
gttcagaatttgactaaggccgtga

SEQ ID NO: 726395 - DNA, 25 bp, Mus musculus
gttcagaatttgtctaaggccgtga

SEQ ID NO: 726396 - DNA, 25 bp, Mus musculus
gttcagacaaatactctacctgaga

SEQ ID NO: 726397 - DNA, 25 bp, Mus musculus
gttcagacaaattctctacctgaga

SEQ ID NO: 726398 - DNA, 25 bp, Mus musculus
gttcagacactcaacacaccaaagt

SEQ ID NO: 726399 - DNA, 25 bp, Mus musculus
gttcagacactctacacaccaaagt

SEQ ID NO: 726400 - DNA, 25 bp, Mus musculus
gttcagacactgaaggcctgcacct

SEQ ID NO: 726401 - DNA, 25 bp, Mus musculus
gttcagacactgtaggcctgcacct

SEQ ID NO: 726402 - DNA, 25 bp, Mus musculus
gttcagacagaaccagtaactgcga

SEQ ID NO: 726403 - DNA, 25 bp, Mus musculus
gttcagacagaagcagtaactgcga

SEQ ID NO: 726404 - DNA, 25 bp, Mus musculus
gttcagacagcaatggcccagatgt

SEQ ID NO: 726405 - DNA, 25 bp, Mus musculus
gttcagacagcattggcccagatgt

SEQ ID NO: 726406 - DNA, 25 bp, Mus musculus
gttcagacaggaaagtgcttgttac

SEQ ID NO: 726407 - DNA, 25 bp, Mus musculus
gttcagacaggatagtgcttgttac

SEQ ID NO: 726408 - DNA, 25 bp, Mus musculus
gttcagacatgtagttattgcctgt

SEQ ID NO: 726409 - DNA, 25 bp, Mus musculus
gttcagacatgttgttattgcctgt

SEQ ID NO: 726410 - DNA, 25 bp, Mus musculus
gttcagacatttagtccattaccat

SEQ ID NO: 726411 - DNA, 25 bp, Mus musculus
gttcagacattttgtccattaccat

SEQ ID NO: 726412 - DNA, 25 bp, Mus musculus
gttcagaccacacctgaactggtac

SEQ ID NO: 726413 - DNA, 25 bp, Mus musculus
gttcagaccacagctgaactggtac

SEQ ID NO: 726414 - DNA, 25 bp, Mus musculus
gttcagacctgtccctgtccaaatt

SEQ ID NO: 726415 - DNA, 25 bp, Mus musculus
gttcagacctgtgcctgtccaaatt

SEQ ID NO: 726416 - DNA, 25 bp, Mus musculus
gttcagacgctcatactgtcaaggt

SEQ ID NO: 726417 - DNA, 25 bp, Mus musculus
gttcagacgctcttactgtcaaggt

SEQ ID NO: 726418 - DNA, 25 bp, Mus musculus
gttcagacgggcagaggaccagcat

SEQ ID NO: 726419 - DNA, 25 bp, Mus musculus
gttcagacgggctgaggaccagcat

SEQ ID NO: 726420 - DNA, 25 bp, Mus musculus
gttcagactattctgtccagtccag

SEQ ID NO: 726421 - DNA, 25 bp, Mus musculus
gttcagactattgtgtccagtccag

SEQ ID NO: 726422 - DNA, 25 bp, Mus musculus
gttcagactggcagatcttctcttt

SEQ ID NO: 726423 - DNA, 25 bp, Mus musculus
gttcagactggctgatcttctcttt

SEQ ID NO: 726424 - DNA, 25 bp, Mus musculus
gttcagacttctacatacatgtgca

SEQ ID NO: 726425 - DNA, 25 bp, Mus musculus
gttcagacttcttcatacatgtgca

SEQ ID NO: 726426 - DNA, 25 bp, Mus musculus
gttcagacttggatgcatgcataca

SEQ ID NO: 726427 - DNA, 25 bp, Mus musculus
gttcagacttggttgcatgcataca

SEQ ID NO: 726428 - DNA, 25 bp, Mus musculus
gttcagagagagctgcacaaatact

SEQ ID NO: 726429 - DNA, 25 bp, Mus musculus
gttcagagagaggtgcacaaatact

SEQ ID NO: 726430 - DNA, 25 bp, Mus musculus
gttcagagagctagttcatgagagc

SEQ ID NO: 726431 - DNA, 25 bp, Mus musculus
gttcagagagcttgttcatgagagc

SEQ ID NO: 726432 - DNA, 25 bp, Mus musculus
gttcagagatgactgccaactgccc

SEQ ID NO: 726433 - DNA, 25 bp, Mus musculus
gttcagagatgagtgccaactgccc

SEQ ID NO: 726434 - DNA, 25 bp, Mus musculus
gttcagagcagacactcagcttcct

SEQ ID NO: 726435 - DNA, 25 bp, Mus musculus
gttcagagcagagactcagcttcct

SEQ ID NO: 726436 - DNA, 25 bp, Mus musculus
gttcagagcccaaattcttacttca

SEQ ID NO: 726437 - DNA, 25 bp, Mus musculus
gttcagagcccatattcttacttca

SEQ ID NO: 726438 - DNA, 25 bp, Mus musculus
gttcagagcctaccatatcatacag

SEQ ID NO: 726439 - DNA, 25 bp, Mus musculus
gttcagagcctagcatatcatacag

SEQ ID NO: 726440 - DNA, 25 bp, Mus musculus
gttcagagccttctaccaaggtaca

SEQ ID NO: 726441 - DNA, 25 bp, Mus musculus
gttcagagccttgtaccaaggtaca

SEQ ID NO: 726442 - DNA, 25 bp, Mus musculus
gttcagagctatcatagttcccagc

SEQ ID NO: 726443 - DNA, 25 bp, Mus musculus
gttcagagctatgatagttcccagc

SEQ ID NO: 726444 - DNA, 25 bp, Mus musculus
gttcagaggaacattcacccacgac

SEQ ID NO: 726445 - DNA, 25 bp, Mus musculus
gttcagaggaactttcacccacgac

SEQ ID NO: 726446 - DNA, 25 bp, Mus musculus
gttcagaggagtatactcccttcct

SEQ ID NO: 726447 - DNA, 25 bp, Mus musculus
gttcagaggagtttactcccttcct

SEQ ID NO: 726448 - DNA, 25 bp, Mus musculus
gttcagaggcagaggataactttaa

SEQ ID NO: 726449 - DNA, 25 bp, Mus musculus
gttcagaggcagtggataactttaa

SEQ ID NO: 726450 - DNA, 25 bp, Mus musculus
gttcagaggcttcgcttcctgaagc

SEQ ID NO: 726451 - DNA, 25 bp, Mus musculus
gttcagaggcttggcttcctgaagc

SEQ ID NO: 726452 - DNA, 25 bp, Mus musculus
gttcagagtctgaggtgtaagcaaa

SEQ ID NO: 726453 - DNA, 25 bp, Mus musculus
gttcagagtctgtggtgtaagcaaa

SEQ ID NO: 726454 - DNA, 25 bp, Mus musculus
gttcagagtcttctcgaagttcaaa

SEQ ID NO: 726455 - DNA, 25 bp, Mus musculus
gttcagagtcttgtcgaagttcaaa

SEQ ID NO: 726456 - DNA, 25 bp, Mus musculus
gttcagataaatagtcagcagccag

SEQ ID NO: 726457 - DNA, 25 bp, Mus musculus
gttcagataaattgtcagcagccag

SEQ ID NO: 726458 - DNA, 25 bp, Mus musculus
gttcagatacagattccaattccta

SEQ ID NO: 726459 - DNA, 25 bp, Mus musculus
gttcagatacagtttccaattccta

SEQ ID NO: 726460 - DNA, 25 bp, Mus musculus
gttcagatacatacttctggcttcc

SEQ ID NO: 726461 - DNA, 25 bp, Mus musculus
gttcagatacattcttctggcttcc

SEQ ID NO: 726462 - DNA, 25 bp, Mus musculus
gttcagatagacatcgtcaacctag

SEQ ID NO: 726463 - DNA, 25 bp, Mus musculus
gttcagatagacttcgtcaacctag

SEQ ID NO: 726464 - DNA, 25 bp, Mus musculus
gttcagatatacctacgcacatgtg

SEQ ID NO: 726465 - DNA, 25 bp, Mus musculus
gttcagatatacgtacgcacatgtg

SEQ ID NO: 726466 - DNA, 25 bp, Mus musculus
gttcagatcagcactggcaggtact

SEQ ID NO: 726467 - DNA, 25 bp, Mus musculus
gttcagatcagctctggcaggtact

SEQ ID NO: 726468 - DNA, 25 bp, Mus musculus
gttcagatcaggatagcttattgct

SEQ ID NO: 726469 - DNA, 25 bp, Mus musculus
gttcagatcaggttagcttattgct

SEQ ID NO: 726470 - DNA, 25 bp, Mus musculus
gttcagatccatcgccataacaggg

SEQ ID NO: 726471 - DNA, 25 bp, Mus musculus
gttcagatccatggccataacaggg

SEQ ID NO: 726472 - DNA, 25 bp, Mus musculus
gttcagatctctcccaatgcatgag

SEQ ID NO: 726473 - DNA, 25 bp, Mus musculus
gttcagatctctgccaatgcatgag

SEQ ID NO: 726474 - DNA, 25 bp, Mus musculus
gttcagatgctcatctaagcagaga

SEQ ID NO: 726475 - DNA, 25 bp, Mus musculus
gttcagatgctcttctaagcagaga

SEQ ID NO: 726476 - DNA, 25 bp, Mus musculus
gttcagatgggacaagcagacagat

SEQ ID NO: 726477 - DNA, 25 bp, Mus musculus
gttcagatgggagaagcagacagat

SEQ ID NO: 726478 - DNA, 25 bp, Mus musculus
gttcagatgtgaatgccaccactgc

SEQ ID NO: 726479 - DNA, 25 bp, Mus musculus
gttcagatgtgattgccaccactgc

SEQ ID NO: 726480 - DNA, 25 bp, Mus musculus
gttcagatgtttcaatgcctcatga

SEQ ID NO: 726481 - DNA, 25 bp, Mus musculus
gttcagatgtttgaatgcctcatga

SEQ ID NO: 726482 - DNA, 25 bp, Mus musculus
gttcagattaatccagctagtgcta

SEQ ID NO: 726483 - DNA, 25 bp, Mus musculus
gttcagattaatgcagctagtgcta

SEQ ID NO: 726484 - DNA, 25 bp, Mus musculus
gttcagattcagaccggagcccacg

SEQ ID NO: 726485 - DNA, 25 bp, Mus musculus
gttcagattcagtccggagcccacg

SEQ ID NO: 726486 - DNA, 25 bp, Mus musculus
gttcagcaaaggattccagaatcca

SEQ ID NO: 726487 - DNA, 25 bp, Mus musculus
gttcagcaaaggtttccagaatcca

SEQ ID NO: 726488 - DNA, 25 bp, Mus musculus
gttcagcaagacaccaccttaaaaa

SEQ ID NO: 726489 - DNA, 25 bp, Mus musculus
gttcagcaagactccaccttaaaaa

SEQ ID NO: 726490 - DNA, 25 bp, Mus musculus
gttcagcaccaacttaactttccta

SEQ ID NO: 726491 - DNA, 25 bp, Mus musculus
gttcagcaccaagttaactttccta

SEQ ID NO: 726492 - DNA, 25 bp, Mus musculus
gttcagcacctgctcaagagggaca

SEQ ID NO: 726493 - DNA, 25 bp, Mus musculus
gttcagcacctggtcaagagggaca

SEQ ID NO: 726494 - DNA, 25 bp, Mus musculus
gttcagcacgtgaccggctggaagc

SEQ ID NO: 726495 - DNA, 25 bp, Mus musculus
gttcagcacgtgtccggctggaagc

SEQ ID NO: 726496 - DNA, 25 bp, Mus musculus
gttcagcactctcagtctaggcctc

SEQ ID NO: 726497 - DNA, 25 bp, Mus musculus
gttcagcactctgagtctaggcctc

SEQ ID NO: 726498 - DNA, 25 bp, Mus musculus
gttcagcacttgactcatttaatgt

SEQ ID NO: 726499 - DNA, 25 bp, Mus musculus
gttcagcacttgtctcatttaatgt

SEQ ID NO: 726500 - DNA, 25 bp, Mus musculus
gttcagcagcaacatgagcccagaa

SEQ ID NO: 726501 - DNA, 25 bp, Mus musculus
gttcagcagcaagatgagcccagaa

SEQ ID NO: 726502 - DNA, 25 bp, Mus musculus
gttcagcagcagacctagtcacaga

SEQ ID NO: 726503 - DNA, 25 bp, Mus musculus
gttcagcagcagtcctagtcacaga

SEQ ID NO: 726504 - DNA, 25 bp, Mus musculus
gttcagcagccaacttatcaacctt

SEQ ID NO: 726505 - DNA, 25 bp, Mus musculus
gttcagcagccatcttatcaacctt

SEQ ID NO: 726506 - DNA, 25 bp, Mus musculus
gttcagcagctgaaggcgtcagtga

SEQ ID NO: 726507 - DNA, 25 bp, Mus musculus
gttcagcagctgtaggcgtcagtga

SEQ ID NO: 726508 - DNA, 25 bp, Mus musculus
gttcagcagtagaggccttggcata

SEQ ID NO: 726509 - DNA, 25 bp, Mus musculus
gttcagcagtagtggccttggcata

SEQ ID NO: 726510 - DNA, 25 bp, Mus musculus
gttcagcataaacacagcagcgatg

SEQ ID NO: 726511 - DNA, 25 bp, Mus musculus
gttcagcataaagacagcagcgatg

SEQ ID NO: 726512 - DNA, 25 bp, Mus musculus
gttcagcatagaaactgtgtacagt

SEQ ID NO: 726513 - DNA, 25 bp, Mus musculus
gttcagcatagatactgtgtacagt

SEQ ID NO: 726514 - DNA, 25 bp, Mus musculus
gttcagcatgcaaaagacccacggt

SEQ ID NO: 726515 - DNA, 25 bp, Mus musculus
gttcagcatgcataagacccacggt

SEQ ID NO: 726516 - DNA, 25 bp, Mus musculus
gttcagcatgctaaaagagcactga

SEQ ID NO: 726517 - DNA, 25 bp, Mus musculus
gttcagcatgcttaaagagcactga

SEQ ID NO: 726518 - DNA, 25 bp, Mus musculus
gttcagccaaccaggactgtatgag

SEQ ID NO: 726519 - DNA, 25 bp, Mus musculus
gttcagccaacctggactgtatgag

SEQ ID NO: 726520 - DNA, 25 bp, Mus musculus
gttcagccaactcacatgggtacag

SEQ ID NO: 726521 - DNA, 25 bp, Mus musculus
gttcagccaactgacatgggtacag

SEQ ID NO: 726522 - DNA, 25 bp, Mus musculus
gttcagccaattatcagcaaactct

SEQ ID NO: 726523 - DNA, 25 bp, Mus musculus
gttcagccaattttcagcaaactct

SEQ ID NO: 726524 - DNA, 25 bp, Mus musculus
gttcagccaccccagattgagcaat

SEQ ID NO: 726525 - DNA, 25 bp, Mus musculus
gttcagccacccgagattgagcaat

SEQ ID NO: 726526 - DNA, 25 bp, Mus musculus
gttcagccagctctaggcagtgcca

SEQ ID NO: 726527 - DNA, 25 bp, Mus musculus
gttcagccagctgtaggcagtgcca

SEQ ID NO: 726528 - DNA, 25 bp, Mus musculus
gttcagccagtcaagacagtccata

SEQ ID NO: 726529 - DNA, 25 bp, Mus musculus
gttcagccagtctagacagtccata

SEQ ID NO: 726530 - DNA, 25 bp, Mus musculus
gttcagccatcaccatgcatcatat

SEQ ID NO: 726531 - DNA, 25 bp, Mus musculus
gttcagccatcagcatgcatcatat

SEQ ID NO: 726532 - DNA, 25 bp, Mus musculus
gttcagccatgtcttacattttggt

SEQ ID NO: 726533 - DNA, 25 bp, Mus musculus
gttcagccatgtgttacattttggt

SEQ ID NO: 726534 - DNA, 25 bp, Mus musculus
gttcagccctaacgaacctttgaca

SEQ ID NO: 726535 - DNA, 25 bp, Mus musculus
gttcagccctaaggaacctttgaca

SEQ ID NO: 726536 - DNA, 25 bp, Mus musculus
gttcagcccttgactacacatagat

SEQ ID NO: 726537 - DNA, 25 bp, Mus musculus
gttcagcccttgtctacacatagat

SEQ ID NO: 726538 - DNA, 25 bp, Mus musculus
gttcagccctttccctaactgtaaa

SEQ ID NO: 726539 - DNA, 25 bp, Mus musculus
gttcagccctttgcctaactgtaaa

SEQ ID NO: 726540 - DNA, 25 bp, Mus musculus
gttcagccgttaatgctgggatcca

SEQ ID NO: 726541 - DNA, 25 bp, Mus musculus
gttcagccgttattgctgggatcca

SEQ ID NO: 726542 - DNA, 25 bp, Mus musculus
gttcagcctcagaagcaggtgctca

SEQ ID NO: 726543 - DNA, 25 bp, Mus musculus
gttcagcctcagtagcaggtgctca

SEQ ID NO: 726544 - DNA, 25 bp, Mus musculus
gttcagcgagctccaaatgcctttt

SEQ ID NO: 726545 - DNA, 25 bp, Mus musculus
gttcagcgagctgcaaatgcctttt

SEQ ID NO: 726546 - DNA, 25 bp, Mus musculus
gttcagcgctgtctgatcatccaga

SEQ ID NO: 726547 - DNA, 25 bp, Mus musculus
gttcagcgctgtgtgatcatccaga

SEQ ID NO: 726548 - DNA, 25 bp, Mus musculus
gttcagcggaaactgatctgcatcc

SEQ ID NO: 726549 - DNA, 25 bp, Mus musculus
gttcagcggaaagtgatctgcatcc

SEQ ID NO: 726550 - DNA, 25 bp, Mus musculus
gttcagcggctgatccagtattatt

SEQ ID NO: 726551 - DNA, 25 bp, Mus musculus
gttcagcggctgttccagtattatt

SEQ ID NO: 726552 - DNA, 25 bp, Mus musculus
gttcagcgggtaaggatcactcact

SEQ ID NO: 726553 - DNA, 25 bp, Mus musculus
gttcagcgggtatggatcactcact

SEQ ID NO: 726554 - DNA, 25 bp, Mus musculus
gttcagcgtactcttctgctaacaa

SEQ ID NO: 726555 - DNA, 25 bp, Mus musculus
gttcagcgtactgttctgctaacaa

SEQ ID NO: 726556 - DNA, 25 bp, Mus musculus
gttcagcgtctcctcatatttttaa

SEQ ID NO: 726557 - DNA, 25 bp, Mus musculus
gttcagcgtctcgtcatatttttaa

SEQ ID NO: 726558 - DNA, 25 bp, Mus musculus
gttcagcgttcactgtcatgggcca

SEQ ID NO: 726559 - DNA, 25 bp, Mus musculus
gttcagcgttcagtgtcatgggcca

SEQ ID NO: 726560 - DNA, 25 bp, Mus musculus
gttcagctatacctggaggacctgt

SEQ ID NO: 726561 - DNA, 25 bp, Mus musculus
gttcagctatacgtggaggacctgt

SEQ ID NO: 726562 - DNA, 25 bp, Mus musculus
gttcagctcacaatctttgactgcc

SEQ ID NO: 726563 - DNA, 25 bp, Mus musculus
gttcagctcacattctttgactgcc

SEQ ID NO: 726564 - DNA, 25 bp, Mus musculus
gttcagctcatcaccagtttagtta

SEQ ID NO: 726565 - DNA, 25 bp, Mus musculus
gttcagctcatctccagtttagtta

SEQ ID NO: 726566 - DNA, 25 bp, Mus musculus
gttcagctcatgactgctatctgag

SEQ ID NO: 726567 - DNA, 25 bp, Mus musculus
gttcagctcatgtctgctatctgag

SEQ ID NO: 726568 - DNA, 25 bp, Mus musculus
gttcagctcggaagtggaaggccct

SEQ ID NO: 726569 - DNA, 25 bp, Mus musculus
gttcagctcggatgtggaaggccct

SEQ ID NO: 726570 - DNA, 25 bp, Mus musculus
gttcagctgaagactccaacagtgc

SEQ ID NO: 726571 - DNA, 25 bp, Mus musculus
gttcagctgaagtctccaacagtgc

SEQ ID NO: 726572 - DNA, 25 bp, Mus musculus
gttcagctgctacaatgtgtgtata

SEQ ID NO: 726573 - DNA, 25 bp, Mus musculus
gttcagctgctagaatgtgtgtata

SEQ ID NO: 726574 - DNA, 25 bp, Mus musculus
gttcagctgggtctcaacaatcaca

SEQ ID NO: 726575 - DNA, 25 bp, Mus musculus
gttcagctgggtgtcaacaatcaca

SEQ ID NO: 726576 - DNA, 25 bp, Mus musculus
gttcagctggtaatgctcatcatgg

SEQ ID NO: 726577 - DNA, 25 bp, Mus musculus
gttcagctggtattgctcatcatgg

SEQ ID NO: 726578 - DNA, 25 bp, Mus musculus
gttcagctgtgccatagctcccaag

SEQ ID NO: 726579 - DNA, 25 bp, Mus musculus
gttcagctgtgcgatagctcccaag

SEQ ID NO: 726580 - DNA, 25 bp, Mus musculus
gttcagctgttgctcttttcagtta

SEQ ID NO: 726581 - DNA, 25 bp, Mus musculus
gttcagctgttggtcttttcagtta

SEQ ID NO: 726582 - DNA, 25 bp, Mus musculus
gttcagcttcatagcatgtaatgta

SEQ ID NO: 726583 - DNA, 25 bp, Mus musculus
gttcagcttcattgcatgtaatgta

SEQ ID NO: 726584 - DNA, 25 bp, Mus musculus
gttcagcttctgaccatatgtagac

SEQ ID NO: 726585 - DNA, 25 bp, Mus musculus
gttcagcttctgtccatatgtagac

SEQ ID NO: 726586 - DNA, 25 bp, Mus musculus
gttcagcttcttacttaggttagga

SEQ ID NO: 726587 - DNA, 25 bp, Mus musculus
gttcagcttctttcttaggttagga

SEQ ID NO: 726588 - DNA, 25 bp, Mus musculus
gttcagcttgctcagttctttctac

SEQ ID NO: 726589 - DNA, 25 bp, Mus musculus
gttcagcttgctgagttctttctac

SEQ ID NO: 726590 - DNA, 25 bp, Mus musculus
gttcaggaaatgaactgctacattt

SEQ ID NO: 726591 - DNA, 25 bp, Mus musculus
gttcaggaaatgtactgctacattt

SEQ ID NO: 726592 - DNA, 25 bp, Mus musculus
gttcaggaactgacttcatccaaca

SEQ ID NO: 726593 - DNA, 25 bp, Mus musculus
gttcaggaactgtcttcatccaaca

SEQ ID NO: 726594 - DNA, 25 bp, Mus musculus
gttcaggaaggccagtcacagctgc

SEQ ID NO: 726595 - DNA, 25 bp, Mus musculus
gttcaggaaggcgagtcacagctgc

SEQ ID NO: 726596 - DNA, 25 bp, Mus musculus
gttcaggaatacaaatcatagtttt

SEQ ID NO: 726597 - DNA, 25 bp, Mus musculus
gttcaggaatactaatcatagtttt

SEQ ID NO: 726598 - DNA, 25 bp, Mus musculus
gttcaggacatcagtttcagccatg

SEQ ID NO: 726599 - DNA, 25 bp, Mus musculus
gttcaggacatctgtttcagccatg

SEQ ID NO: 726600 - DNA, 25 bp, Mus musculus
gttcaggacatgctcacactgatgc

SEQ ID NO: 726601 - DNA, 25 bp, Mus musculus
gttcaggacatggtcacactgatgc

SEQ ID NO: 726602 - DNA, 25 bp, Mus musculus
gttcaggaccttcctagactctata

SEQ ID NO: 726603 - DNA, 25 bp, Mus musculus
gttcaggaccttctgcatactaagc

SEQ ID NO: 726604 - DNA, 25 bp, Mus musculus
gttcaggaccttgctagactctata

SEQ ID NO: 726605 - DNA, 25 bp, Mus musculus
gttcaggaccttgtgcatactaagc

SEQ ID NO: 726606 - DNA, 25 bp, Mus musculus
gttcaggactatcccgataatatca

SEQ ID NO: 726607 - DNA, 25 bp, Mus musculus
gttcaggactatgccgataatatca

SEQ ID NO: 726608 - DNA, 25 bp, Mus musculus
gttcaggactgtaactatattactt

SEQ ID NO: 726609 - DNA, 25 bp, Mus musculus
gttcaggactgttactatattactt

SEQ ID NO: 726610 - DNA, 25 bp, Mus musculus
gttcaggagatcatggaagccaact

SEQ ID NO: 726611 - DNA, 25 bp, Mus musculus
gttcaggagatcttggaagccaact

SEQ ID NO: 726612 - DNA, 25 bp, Mus musculus
gttcaggaggcaaggtggactccat

SEQ ID NO: 726613 - DNA, 25 bp, Mus musculus
gttcaggaggcatggtggactccat

SEQ ID NO: 726614 - DNA, 25 bp, Mus musculus
gttcaggaggtgattctcagccgat

SEQ ID NO: 726615 - DNA, 25 bp, Mus musculus
gttcaggaggtgtttctcagccgat

SEQ ID NO: 726616 - DNA, 25 bp, Mus musculus
gttcaggatgccagaaccaggccac

SEQ ID NO: 726617 - DNA, 25 bp, Mus musculus
gttcaggatgcctgaaccaggccac

SEQ ID NO: 726618 - DNA, 25 bp, Mus musculus
gttcaggattcacgagcataagcta

SEQ ID NO: 726619 - DNA, 25 bp, Mus musculus
gttcaggattcaggagcataagcta

SEQ ID NO: 726620 - DNA, 25 bp, Mus musculus
gttcaggatttgaacattcagttgt

SEQ ID NO: 726621 - DNA, 25 bp, Mus musculus
gttcaggatttgtacattcagttgt

SEQ ID NO: 726622 - DNA, 25 bp, Mus musculus
gttcaggcaagcaggcggtgttcca

SEQ ID NO: 726623 - DNA, 25 bp, Mus musculus
gttcaggcaagctggcggtgttcca

SEQ ID NO: 726624 - DNA, 25 bp, Mus musculus
gttcaggcagacatggaagctcttc

SEQ ID NO: 726625 - DNA, 25 bp, Mus musculus
gttcaggcagacttggaagctcttc

SEQ ID NO: 726626 - DNA, 25 bp, Mus musculus
gttcaggcagccatacagttggtgc

SEQ ID NO: 726627 - DNA, 25 bp, Mus musculus
gttcaggcagccttacagttggtgc

SEQ ID NO: 726628 - DNA, 25 bp, Mus musculus
gttcaggccagtagagttctgcaaa

SEQ ID NO: 726629 - DNA, 25 bp, Mus musculus
gttcaggccagttgagttctgcaaa

SEQ ID NO: 726630 - DNA, 25 bp, Mus musculus
gttcaggccccacttgtcattgttg

SEQ ID NO: 726631 - DNA, 25 bp, Mus musculus
gttcaggccccagttgtcattgttg

SEQ ID NO: 726632 - DNA, 25 bp, Mus musculus
gttcaggcctcacctagggtataga

SEQ ID NO: 726633 - DNA, 25 bp, Mus musculus
gttcaggcctcagctagggtataga

SEQ ID NO: 726634 - DNA, 25 bp, Mus musculus
gttcaggctctaagcagttattcag

SEQ ID NO: 726635 - DNA, 25 bp, Mus musculus
gttcaggctctatgcagttattcag

SEQ ID NO: 726636 - DNA, 25 bp, Mus musculus
gttcaggctgggatgcacattgccc

SEQ ID NO: 726637 - DNA, 25 bp, Mus musculus
gttcaggctgggttgcacattgccc

SEQ ID NO: 726638 - DNA, 25 bp, Mus musculus
gttcaggctgtccttcgagcatcag

SEQ ID NO: 726639 - DNA, 25 bp, Mus musculus
gttcaggctgtcgttcgagcatcag

SEQ ID NO: 726640 - DNA, 25 bp, Mus musculus
gttcagggaaagcacctgcaagcct

SEQ ID NO: 726641 - DNA, 25 bp, Mus musculus
gttcagggaaaggacctgcaagcct

SEQ ID NO: 726642 - DNA, 25 bp, Mus musculus
gttcagggaactatgcactttgtaa

SEQ ID NO: 726643 - DNA, 25 bp, Mus musculus
gttcagggaactttgcactttgtaa

SEQ ID NO: 726644 - DNA, 25 bp, Mus musculus
gttcagggaatacagccaccttcat

SEQ ID NO: 726645 - DNA, 25 bp, Mus musculus
gttcagggaatagagccaccttcat

SEQ ID NO: 726646 - DNA, 25 bp, Mus musculus
gttcagggaccacatgtcctgagct

SEQ ID NO: 726647 - DNA, 25 bp, Mus musculus
gttcagggaccagatgtcctgagct

SEQ ID NO: 726648 - DNA, 25 bp, Mus musculus
gttcagggatagatcatgacataat

SEQ ID NO: 726649 - DNA, 25 bp, Mus musculus
gttcagggatagttcatgacataat

SEQ ID NO: 726650 - DNA, 25 bp, Mus musculus
gttcagggatctcacattctggaag

SEQ ID NO: 726651 - DNA, 25 bp, Mus musculus
gttcagggatctgacattctggaag

SEQ ID NO: 726652 - DNA, 25 bp, Mus musculus
gttcagggattgcagattttcacta

SEQ ID NO: 726653 - DNA, 25 bp, Mus musculus
gttcagggattggagattttcacta

SEQ ID NO: 726654 - DNA, 25 bp, Mus musculus
gttcagggcaacaatcttcaaaaag

SEQ ID NO: 726655 - DNA, 25 bp, Mus musculus
gttcagggcaactatcttcaaaaag

SEQ ID NO: 726656 - DNA, 25 bp, Mus musculus
gttcagggcatgaccttcatgacct

SEQ ID NO: 726657 - DNA, 25 bp, Mus musculus
gttcagggcatgtccttcatgacct

SEQ ID NO: 726658 - DNA, 25 bp, Mus musculus
gttcagggtactagggacacagcag

SEQ ID NO: 726659 - DNA, 25 bp, Mus musculus
gttcagggtacttgggacacagcag

SEQ ID NO: 726660 - DNA, 25 bp, Mus musculus
gttcagggtctcagacacagccaga

SEQ ID NO: 726661 - DNA, 25 bp, Mus musculus
gttcagggtctctgacacagccaga

SEQ ID NO: 726662 - DNA, 25 bp, Mus musculus
gttcagggtggaacttctcacttca

SEQ ID NO: 726663 - DNA, 25 bp, Mus musculus
gttcagggtggatcttctcacttca

SEQ ID NO: 726664 - DNA, 25 bp, Mus musculus
gttcagggtgtcagcaaggctccat

SEQ ID NO: 726665 - DNA, 25 bp, Mus musculus
gttcagggtgtctgcaaggctccat

SEQ ID NO: 726666 - DNA, 25 bp, Mus musculus
gttcagggttcccagagctctctgt

SEQ ID NO: 726667 - DNA, 25 bp, Mus musculus
gttcagggttccgagagctctctgt

SEQ ID NO: 726668 - DNA, 25 bp, Mus musculus
gttcaggtaccaccactcataataa

SEQ ID NO: 726669 - DNA, 25 bp, Mus musculus
gttcaggtaccagcactcataataa

SEQ ID NO: 726670 - DNA, 25 bp, Mus musculus
gttcaggtccacagcctttattttc

SEQ ID NO: 726671 - DNA, 25 bp, Mus musculus
gttcaggtccactgcctttattttc

SEQ ID NO: 726672 - DNA, 25 bp, Mus musculus
gttcaggtccagagaaccgtagcag

SEQ ID NO: 726673 - DNA, 25 bp, Mus musculus
gttcaggtccagtgaaccgtagcag

SEQ ID NO: 726674 - DNA, 25 bp, Mus musculus
gttcaggtcccgctgagagtctctc

SEQ ID NO: 726675 - DNA, 25 bp, Mus musculus
gttcaggtcccggtgagagtctctc

SEQ ID NO: 726676 - DNA, 25 bp, Mus musculus
gttcaggtccctcggttcatttctc

SEQ ID NO: 726677 - DNA, 25 bp, Mus musculus
gttcaggtccctgggttcatttctc

SEQ ID NO: 726678 - DNA, 25 bp, Mus musculus
gttcaggtgataacaatgtcccttt

SEQ ID NO: 726679 - DNA, 25 bp, Mus musculus
gttcaggtgatatcaatgtcccttt

SEQ ID NO: 726680 - DNA, 25 bp, Mus musculus
gttcaggtgattaggcttggccata

SEQ ID NO: 726681 - DNA, 25 bp, Mus musculus
gttcaggtgatttggcttggccata

SEQ ID NO: 726682 - DNA, 25 bp, Mus musculus
gttcaggtgcgactcacagcaacct

SEQ ID NO: 726683 - DNA, 25 bp, Mus musculus
gttcaggtgcgagtcacagcaacct

SEQ ID NO: 726684 - DNA, 25 bp, Mus musculus
gttcaggtggaccataaccaattct

SEQ ID NO: 726685 - DNA, 25 bp, Mus musculus
gttcaggtggacgataaccaattct

SEQ ID NO: 726686 - DNA, 25 bp, Mus musculus
gttcaggttacaatcccaggtttga

SEQ ID NO: 726687 - DNA, 25 bp, Mus musculus
gttcaggttacattcccaggtttga

SEQ ID NO: 726688 - DNA, 25 bp, Mus musculus
gttcaggttcaactcaaaagctcta

SEQ ID NO: 726689 - DNA, 25 bp, Mus musculus
gttcaggttcaagtcaaaagctcta

SEQ ID NO: 726690 - DNA, 25 bp, Mus musculus
gttcaggttccgctcatactggcta

SEQ ID NO: 726691 - DNA, 25 bp, Mus musculus
gttcaggttccggtcatactggcta

SEQ ID NO: 726692 - DNA, 25 bp, Mus musculus
gttcaggttgtcagctgttggcatc

SEQ ID NO: 726693 - DNA, 25 bp, Mus musculus
gttcaggttgtctgctgttggcatc

SEQ ID NO: 726694 - DNA, 25 bp, Mus musculus
gttcaggtttaacagcaagctccaa

SEQ ID NO: 726695 - DNA, 25 bp, Mus musculus
gttcaggtttaagagcaagctccaa

SEQ ID NO: 726696 - DNA, 25 bp, Mus musculus
gttcaggtttatatgtggaaatgca

SEQ ID NO: 726697 - DNA, 25 bp, Mus musculus
gttcaggtttatttgtggaaatgca

SEQ ID NO: 726698 - DNA, 25 bp, Mus musculus
gttcagtaaataacgtggtccagtt

SEQ ID NO: 726699 - DNA, 25 bp, Mus musculus
gttcagtaaatatcgtggtccagtt

SEQ ID NO: 726700 - DNA, 25 bp, Mus musculus
gttcagtaaatcataccatctcaaa

SEQ ID NO: 726701 - DNA, 25 bp, Mus musculus
gttcagtaaatcttaccatctcaaa

SEQ ID NO: 726702 - DNA, 25 bp, Mus musculus
gttcagtaacacatcttaccgagga

SEQ ID NO: 726703 - DNA, 25 bp, Mus musculus
gttcagtaacacttcttaccgagga

SEQ ID NO: 726704 - DNA, 25 bp, Mus musculus
gttcagtaatttcgatgccttcatt

SEQ ID NO: 726705 - DNA, 25 bp, Mus musculus
gttcagtaatttggatgccttcatt

SEQ ID NO: 726706 - DNA, 25 bp, Mus musculus
gttcagtacaatatacctttcattt

SEQ ID NO: 726707 - DNA, 25 bp, Mus musculus
gttcagtacaatttacctttcattt

SEQ ID NO: 726708 - DNA, 25 bp, Mus musculus
gttcagtacaggaatcatttttcag

SEQ ID NO: 726709 - DNA, 25 bp, Mus musculus
gttcagtacaggtatcatttttcag

SEQ ID NO: 726710 - DNA, 25 bp, Mus musculus
gttcagtacagtaatcaagatagac

SEQ ID NO: 726711 - DNA, 25 bp, Mus musculus
gttcagtacagttatcaagatagac

SEQ ID NO: 726712 - DNA, 25 bp, Mus musculus
gttcagtagaacaaaatcccctcca

SEQ ID NO: 726713 - DNA, 25 bp, Mus musculus
gttcagtagaactaaatcccctcca

SEQ ID NO: 726714 - DNA, 25 bp, Mus musculus
gttcagtagacaatttgcatccaga

SEQ ID NO: 726715 - DNA, 25 bp, Mus musculus
gttcagtagacattttgcatccaga

SEQ ID NO: 726716 - DNA, 25 bp, Mus musculus
gttcagtagagtctgcattgtgctt

SEQ ID NO: 726717 - DNA, 25 bp, Mus musculus
gttcagtagagtgtgcattgtgctt

SEQ ID NO: 726718 - DNA, 25 bp, Mus musculus
gttcagtatcccagatagctggtgt

SEQ ID NO: 726719 - DNA, 25 bp, Mus musculus
gttcagtatccctgatagctggtgt

SEQ ID NO: 726720 - DNA, 25 bp, Mus musculus
gttcagtatgaaccacctcaggagg

SEQ ID NO: 726721 - DNA, 25 bp, Mus musculus
gttcagtatgaagcacctcaggagg

SEQ ID NO: 726722 - DNA, 25 bp, Mus musculus
gttcagtatggcctggccccagata

SEQ ID NO: 726723 - DNA, 25 bp, Mus musculus
gttcagtatggcgtggccccagata

SEQ ID NO: 726724 - DNA, 25 bp, Mus musculus
gttcagtattcacatatccctagga

SEQ ID NO: 726725 - DNA, 25 bp, Mus musculus
gttcagtattcagatatccctagga

SEQ ID NO: 726726 - DNA, 25 bp, Mus musculus
gttcagtcacatcacatctgggttt

SEQ ID NO: 726727 - DNA, 25 bp, Mus musculus
gttcagtcacatgacatctgggttt

SEQ ID NO: 726728 - DNA, 25 bp, Mus musculus
gttcagtcagaacatcagatacgtc

SEQ ID NO: 726729 - DNA, 25 bp, Mus musculus
gttcagtcagaagatcagatacgtc

SEQ ID NO: 726730 - DNA, 25 bp, Mus musculus
gttcagtcagacacccatagggtaa

SEQ ID NO: 726731 - DNA, 25 bp, Mus musculus
gttcagtcagactcccatagggtaa

SEQ ID NO: 726732 - DNA, 25 bp, Mus musculus
gttcagtcagccctctaaattgttg

SEQ ID NO: 726733 - DNA, 25 bp, Mus musculus
gttcagtcagccgtctaaattgttg

SEQ ID NO: 726734 - DNA, 25 bp, Mus musculus
gttcagtcattaatagcattgcccc

SEQ ID NO: 726735 - DNA, 25 bp, Mus musculus
gttcagtcattattagcattgcccc

SEQ ID NO: 726736 - DNA, 25 bp, Mus musculus
gttcagtcattcacagaggtgctaa

SEQ ID NO: 726737 - DNA, 25 bp, Mus musculus
gttcagtcattctcagaggtgctaa

SEQ ID NO: 726738 - DNA, 25 bp, Mus musculus
gttcagtccaatcctgtgccacttt

SEQ ID NO: 726739 - DNA, 25 bp, Mus musculus
gttcagtccaatgctgtgccacttt

SEQ ID NO: 726740 - DNA, 25 bp, Mus musculus
gttcagtccagtctgagatcagcct

SEQ ID NO: 726741 - DNA, 25 bp, Mus musculus
gttcagtccagtgtgagatcagcct

SEQ ID NO: 726742 - DNA, 25 bp, Mus musculus
gttcagtcccaaccttcagattaga

SEQ ID NO: 726743 - DNA, 25 bp, Mus musculus
gttcagtcccaagcttcagattaga

SEQ ID NO: 726744 - DNA, 25 bp, Mus musculus
gttcagtcctaaacctaaattgttg

SEQ ID NO: 726745 - DNA, 25 bp, Mus musculus
gttcagtcctaatcctaaattgttg

SEQ ID NO: 726746 - DNA, 25 bp, Mus musculus
gttcagtcgatgcttagacttgttt

SEQ ID NO: 726747 - DNA, 25 bp, Mus musculus
gttcagtcgatggttagacttgttt

SEQ ID NO: 726748 - DNA, 25 bp, Mus musculus
gttcagtctatgattttgcttcatc

SEQ ID NO: 726749 - DNA, 25 bp, Mus musculus
gttcagtctatgtttttgcttcatc

SEQ ID NO: 726750 - DNA, 25 bp, Mus musculus
gttcagtctccacgatggcataaaa

SEQ ID NO: 726751 - DNA, 25 bp, Mus musculus
gttcagtctccaggatggcataaaa

SEQ ID NO: 726752 - DNA, 25 bp, Mus musculus
gttcagtctgacactgcaaaggtct

SEQ ID NO: 726753 - DNA, 25 bp, Mus musculus
gttcagtctgactctgcaaaggtct

SEQ ID NO: 726754 - DNA, 25 bp, Mus musculus
gttcagtcttatatgatggtcctca

SEQ ID NO: 726755 - DNA, 25 bp, Mus musculus
gttcagtcttatttgatggtcctca

SEQ ID NO: 726756 - DNA, 25 bp, Mus musculus
gttcagtcttgaagaggtgaccaca

SEQ ID NO: 726757 - DNA, 25 bp, Mus musculus
gttcagtcttgatgaggtgaccaca

SEQ ID NO: 726758 - DNA, 25 bp, Mus musculus
gttcagtgaaagcttttgtctccaa

SEQ ID NO: 726759 - DNA, 25 bp, Mus musculus
gttcagtgaaaggttttgtctccaa

SEQ ID NO: 726760 - DNA, 25 bp, Mus musculus
gttcagtgacacagtggttactcca

SEQ ID NO: 726761 - DNA, 25 bp, Mus musculus
gttcagtgacactgtggttactcca

SEQ ID NO: 726762 - DNA, 25 bp, Mus musculus
gttcagtgacatcaggatcctccag

SEQ ID NO: 726763 - DNA, 25 bp, Mus musculus
gttcagtgacatgaggatcctccag

SEQ ID NO: 726764 - DNA, 25 bp, Mus musculus
gttcagtgagaactagagcttcagt

SEQ ID NO: 726765 - DNA, 25 bp, Mus musculus
gttcagtgagaagtagagcttcagt

SEQ ID NO: 726766 - DNA, 25 bp, Mus musculus
gttcagtgagatattattcaatcat

SEQ ID NO: 726767 - DNA, 25 bp, Mus musculus
gttcagtgagatcctatttcttatt

SEQ ID NO: 726768 - DNA, 25 bp, Mus musculus
gttcagtgagatgctatttcttatt

SEQ ID NO: 726769 - DNA, 25 bp, Mus musculus
gttcagtgagattttattcaatcat

SEQ ID NO: 726770 - DNA, 25 bp, Mus musculus
gttcagtgatctaacatcccagctt

SEQ ID NO: 726771 - DNA, 25 bp, Mus musculus
gttcagtgatcttacatcccagctt

SEQ ID NO: 726772 - DNA, 25 bp, Mus musculus
gttcagtgattgatgctagccatct

SEQ ID NO: 726773 - DNA, 25 bp, Mus musculus
gttcagtgattgttgctagccatct

SEQ ID NO: 726774 - DNA, 25 bp, Mus musculus
gttcagtgcgttcctagtcagacga

SEQ ID NO: 726775 - DNA, 25 bp, Mus musculus
gttcagtgcgttgctagtcagacga

SEQ ID NO: 726776 - DNA, 25 bp, Mus musculus
gttcagtgctcaacccggagaccta

SEQ ID NO: 726777 - DNA, 25 bp, Mus musculus
gttcagtgctcatcccggagaccta

SEQ ID NO: 726778 - DNA, 25 bp, Mus musculus
gttcagtgctggaatgattatttac

SEQ ID NO: 726779 - DNA, 25 bp, Mus musculus
gttcagtgctggtatgattatttac

SEQ ID NO: 726780 - DNA, 25 bp, Mus musculus
gttcagtggaatctcaccaagtgtg

SEQ ID NO: 726781 - DNA, 25 bp, Mus musculus
gttcagtggaatgtcaccaagtgtg

SEQ ID NO: 726782 - DNA, 25 bp, Mus musculus
gttcagtggaccagttttagccaag

SEQ ID NO: 726783 - DNA, 25 bp, Mus musculus
gttcagtggacctgttttagccaag

SEQ ID NO: 726784 - DNA, 25 bp, Mus musculus
gttcagtggtcacacagcaccagga

SEQ ID NO: 726785 - DNA, 25 bp, Mus musculus
gttcagtggtcacagattgatgttt

SEQ ID NO: 726786 - DNA, 25 bp, Mus musculus
gttcagtggtcagacagcaccagga

SEQ ID NO: 726787 - DNA, 25 bp, Mus musculus
gttcagtggtcagagattgatgttt

SEQ ID NO: 726788 - DNA, 25 bp, Mus musculus
gttcagtggtgaagcatcctctatt

SEQ ID NO: 726789 - DNA, 25 bp, Mus musculus
gttcagtggtgatgcatcctctatt

SEQ ID NO: 726790 - DNA, 25 bp, Mus musculus
gttcagtggtggcaatttccctgtc

SEQ ID NO: 726791 - DNA, 25 bp, Mus musculus
gttcagtggtgggaatttccctgtc

SEQ ID NO: 726792 - DNA, 25 bp, Mus musculus
gttcagtggttacacagacctcttt

SEQ ID NO: 726793 - DNA, 25 bp, Mus musculus
gttcagtggttagacagacctcttt

SEQ ID NO: 726794 - DNA, 25 bp, Mus musculus
gttcagtgtccgcagtacagcttac

SEQ ID NO: 726795 - DNA, 25 bp, Mus musculus
gttcagtgtccggagtacagcttac

SEQ ID NO: 726796 - DNA, 25 bp, Mus musculus
gttcagtgtcctcacagtgacagtg

SEQ ID NO: 726797 - DNA, 25 bp, Mus musculus
gttcagtgtcctgacagtgacagtg

SEQ ID NO: 726798 - DNA, 25 bp, Mus musculus
gttcagtgtcgtccccagaactcat

SEQ ID NO: 726799 - DNA, 25 bp, Mus musculus
gttcagtgtcgtgcccagaactcat

SEQ ID NO: 726800 - DNA, 25 bp, Mus musculus
gttcagtgttcaaatctcatgtcag

SEQ ID NO: 726801 - DNA, 25 bp, Mus musculus
gttcagtgttcatatctcatgtcag

SEQ ID NO: 726802 - DNA, 25 bp, Mus musculus
gttcagttaaaaagccacgtcagat

SEQ ID NO: 726803 - DNA, 25 bp, Mus musculus
gttcagttaaaatgccacgtcagat

SEQ ID NO: 726804 - DNA, 25 bp, Mus musculus
gttcagttaacacagccagtaccca

SEQ ID NO: 726805 - DNA, 25 bp, Mus musculus
gttcagttaacagagccagtaccca

SEQ ID NO: 726806 - DNA, 25 bp, Mus musculus
gttcagttactgattaaaacccagg

SEQ ID NO: 726807 - DNA, 25 bp, Mus musculus
gttcagttactgtttaaaacccagg

SEQ ID NO: 726808 - DNA, 25 bp, Mus musculus
gttcagttagatcttcaccagcggt

SEQ ID NO: 726809 - DNA, 25 bp, Mus musculus
gttcagttagatgttcaccagcggt

SEQ ID NO: 726810 - DNA, 25 bp, Mus musculus
gttcagttccaacgagtctcagcgt

SEQ ID NO: 726811 - DNA, 25 bp, Mus musculus
gttcagttccaaggagtctcagcgt

SEQ ID NO: 726812 - DNA, 25 bp, Mus musculus
gttcagttcctaccagagaagtgct

SEQ ID NO: 726813 - DNA, 25 bp, Mus musculus
gttcagttcctagcagagaagtgct

SEQ ID NO: 726814 - DNA, 25 bp, Mus musculus
gttcagttcgtgattaagcagtcat

SEQ ID NO: 726815 - DNA, 25 bp, Mus musculus
gttcagttcgtgtttaagcagtcat

SEQ ID NO: 726816 - DNA, 25 bp, Mus musculus
gttcagttctcactttagttggtaa

SEQ ID NO: 726817 - DNA, 25 bp, Mus musculus
gttcagttctcagtttagttggtaa

SEQ ID NO: 726818 - DNA, 25 bp, Mus musculus
gttcagttctgaccatttacatcaa

SEQ ID NO: 726819 - DNA, 25 bp, Mus musculus
gttcagttctgagcatttacatcaa

SEQ ID NO: 726820 - DNA, 25 bp, Mus musculus
gttcagttctggaagagctcctagc

SEQ ID NO: 726821 - DNA, 25 bp, Mus musculus
gttcagttctggtagagctcctagc

SEQ ID NO: 726822 - DNA, 25 bp, Mus musculus
gttcagttcttaatctcatgccaaa

SEQ ID NO: 726823 - DNA, 25 bp, Mus musculus
gttcagttcttacctaagccagcag

SEQ ID NO: 726824 - DNA, 25 bp, Mus musculus
gttcagttcttagctaagccagcag

SEQ ID NO: 726825 - DNA, 25 bp, Mus musculus
gttcagttcttattctcatgccaaa

SEQ ID NO: 726826 - DNA, 25 bp, Mus musculus
gttcagttgcgacaggaagcctcaa

SEQ ID NO: 726827 - DNA, 25 bp, Mus musculus
gttcagttgcgagaggaagcctcaa

SEQ ID NO: 726828 - DNA, 25 bp, Mus musculus
gttcagttgggaaacctgagcctta

SEQ ID NO: 726829 - DNA, 25 bp, Mus musculus
gttcagttgggatacctgagcctta

SEQ ID NO: 726830 - DNA, 25 bp, Mus musculus
gttcagttgtttagccccagatggg

SEQ ID NO: 726831 - DNA, 25 bp, Mus musculus
gttcagttgttttgccccagatggg

SEQ ID NO: 726832 - DNA, 25 bp, Mus musculus
gttcagtttcacaacagcatgtcct

SEQ ID NO: 726833 - DNA, 25 bp, Mus musculus
gttcagtttcactacagcatgtcct

SEQ ID NO: 726834 - DNA, 25 bp, Mus musculus
gttcagtttctactaacacacaaaa

SEQ ID NO: 726835 - DNA, 25 bp, Mus musculus
gttcagtttctagtaacacacaaaa

SEQ ID NO: 726836 - DNA, 25 bp, Mus musculus
gttcagtttctgcaggcataacctg

SEQ ID NO: 726837 - DNA, 25 bp, Mus musculus
gttcagtttctggaggcataacctg

SEQ ID NO: 726838 - DNA, 25 bp, Mus musculus
gttcagtttggacttcggaaagcac

SEQ ID NO: 726839 - DNA, 25 bp, Mus musculus
gttcagtttggagttcggaaagcac

SEQ ID NO: 726840 - DNA, 25 bp, Mus musculus
gttcagttttaacatagtttggctc

SEQ ID NO: 726841 - DNA, 25 bp, Mus musculus
gttcagttttaagatagtttggctc

SEQ ID NO: 726842 - DNA, 25 bp, Mus musculus
gttcataaaaacattgaccagtgtt

SEQ ID NO: 726843 - DNA, 25 bp, Mus musculus
gttcataaaaactttgaccagtgtt

SEQ ID NO: 726844 - DNA, 25 bp, Mus musculus
gttcataaacctcagcatttggcag

SEQ ID NO: 726845 - DNA, 25 bp, Mus musculus
gttcataaacctgagcatttggcag

SEQ ID NO: 726846 - DNA, 25 bp, Mus musculus
gttcataaattcagattactgccat

SEQ ID NO: 726847 - DNA, 25 bp, Mus musculus
gttcataaattctgattactgccat

SEQ ID NO: 726848 - DNA, 25 bp, Mus musculus
gttcataagactcctaatacctacc

SEQ ID NO: 726849 - DNA, 25 bp, Mus musculus
gttcataagactgctaatacctacc

SEQ ID NO: 726850 - DNA, 25 bp, Mus musculus
gttcataatactatggctccttcag

SEQ ID NO: 726851 - DNA, 25 bp, Mus musculus
gttcataatactcgtcatttttcct

SEQ ID NO: 726852 - DNA, 25 bp, Mus musculus
gttcataatactggtcatttttcct

SEQ ID NO: 726853 - DNA, 25 bp, Mus musculus
gttcataatactttggctccttcag

SEQ ID NO: 726854 - DNA, 25 bp, Mus musculus
gttcataatggcagtcctattttat

SEQ ID NO: 726855 - DNA, 25 bp, Mus musculus
gttcataatggctgtcctattttat

SEQ ID NO: 726856 - DNA, 25 bp, Mus musculus
gttcataatgtgcttacagtcatat

SEQ ID NO: 726857 - DNA, 25 bp, Mus musculus
gttcataatgtggttacagtcatat

SEQ ID NO: 726858 - DNA, 25 bp, Mus musculus
gttcataattttatagttcttttca

SEQ ID NO: 726859 - DNA, 25 bp, Mus musculus
gttcataattttttagttcttttca

SEQ ID NO: 726860 - DNA, 25 bp, Mus musculus
gttcatacacagaaaccagtgggtt

SEQ ID NO: 726861 - DNA, 25 bp, Mus musculus
gttcatacacagtaaccagtgggtt

SEQ ID NO: 726862 - DNA, 25 bp, Mus musculus
gttcatacagttatattttacgtct

SEQ ID NO: 726863 - DNA, 25 bp, Mus musculus
gttcatacagttttattttacgtct

SEQ ID NO: 726864 - DNA, 25 bp, Mus musculus
gttcatacatgtcaatctacctcgt

SEQ ID NO: 726865 - DNA, 25 bp, Mus musculus
gttcatacatgtgaatctacctcgt

SEQ ID NO: 726866 - DNA, 25 bp, Mus musculus
gttcataccactcctccaagagaaa

SEQ ID NO: 726867 - DNA, 25 bp, Mus musculus
gttcataccactgctccaagagaaa

SEQ ID NO: 726868 - DNA, 25 bp, Mus musculus
gttcataccgcaagtttattttgga

SEQ ID NO: 726869 - DNA, 25 bp, Mus musculus
gttcataccgcatgtttattttgga

SEQ ID NO: 726870 - DNA, 25 bp, Mus musculus
gttcatacgattctttttatggatt

SEQ ID NO: 726871 - DNA, 25 bp, Mus musculus
gttcatacgattgtttttatggatt

SEQ ID NO: 726872 - DNA, 25 bp, Mus musculus
gttcatacgtccacagactgttctg

SEQ ID NO: 726873 - DNA, 25 bp, Mus musculus
gttcatacgtcctcagactgttctg

SEQ ID NO: 726874 - DNA, 25 bp, Mus musculus
gttcatactgaaaagaggccttaca

SEQ ID NO: 726875 - DNA, 25 bp, Mus musculus
gttcatactgaatagaggccttaca

SEQ ID NO: 726876 - DNA, 25 bp, Mus musculus
gttcatactgacatttctacttttt

SEQ ID NO: 726877 - DNA, 25 bp, Mus musculus
gttcatactgacttttctacttttt

SEQ ID NO: 726878 - DNA, 25 bp, Mus musculus
gttcatactgatattcttgcaagga

SEQ ID NO: 726879 - DNA, 25 bp, Mus musculus
gttcatactgattttcttgcaagga

SEQ ID NO: 726880 - DNA, 25 bp, Mus musculus
gttcatactgtccataacgtgttgt

SEQ ID NO: 726881 - DNA, 25 bp, Mus musculus
gttcatactgtcgataacgtgttgt

SEQ ID NO: 726882 - DNA, 25 bp, Mus musculus
gttcatacttctcataaaccatgta

SEQ ID NO: 726883 - DNA, 25 bp, Mus musculus
gttcatacttctgataaaccatgta

SEQ ID NO: 726884 - DNA, 25 bp, Mus musculus
gttcatacttgtctaattgttagtt

SEQ ID NO: 726885 - DNA, 25 bp, Mus musculus
gttcatacttgtgtaattgttagtt

SEQ ID NO: 726886 - DNA, 25 bp, Mus musculus
gttcatagaattactgccagcaata

SEQ ID NO: 726887 - DNA, 25 bp, Mus musculus
gttcatagaatttctgccagcaata

SEQ ID NO: 726888 - DNA, 25 bp, Mus musculus
gttcatagcagtctgtgaattccca

SEQ ID NO: 726889 - DNA, 25 bp, Mus musculus
gttcatagcagtgtgtgaattccca

SEQ ID NO: 726890 - DNA, 25 bp, Mus musculus
gttcatagcctgcttcagtagctga

SEQ ID NO: 726891 - DNA, 25 bp, Mus musculus
gttcatagcctggttcagtagctga

SEQ ID NO: 726892 - DNA, 25 bp, Mus musculus
gttcatagttcgagacttccagtat

SEQ ID NO: 726893 - DNA, 25 bp, Mus musculus
gttcatagttcgtgacttccagtat

SEQ ID NO: 726894 - DNA, 25 bp, Mus musculus
gttcatatatatcccttgtccttcc

SEQ ID NO: 726895 - DNA, 25 bp, Mus musculus
gttcatatatatgccttgtccttcc

SEQ ID NO: 726896 - DNA, 25 bp, Mus musculus
gttcatatcaggagttggtccttcc

SEQ ID NO: 726897 - DNA, 25 bp, Mus musculus
gttcatatcaggtgttggtccttcc

SEQ ID NO: 726898 - DNA, 25 bp, Mus musculus
gttcatatcatcattgtcttttagt

SEQ ID NO: 726899 - DNA, 25 bp, Mus musculus
gttcatatcatctttgtcttttagt

SEQ ID NO: 726900 - DNA, 25 bp, Mus musculus
gttcatatcggacagtgcacagcac

SEQ ID NO: 726901 - DNA, 25 bp, Mus musculus
gttcatatcggagagtgcacagcac

SEQ ID NO: 726902 - DNA, 25 bp, Mus musculus
gttcatatctgtcttttcatctgca

SEQ ID NO: 726903 - DNA, 25 bp, Mus musculus
gttcatatctgtgttttcatctgca

SEQ ID NO: 726904 - DNA, 25 bp, Mus musculus
gttcatatgatgaaggctctcgctg

SEQ ID NO: 726905 - DNA, 25 bp, Mus musculus
gttcatatgatgtaggctctcgctg

SEQ ID NO: 726906 - DNA, 25 bp, Mus musculus
gttcatatgtgtacggtggttcttc

SEQ ID NO: 726907 - DNA, 25 bp, Mus musculus
gttcatatgtgttcggtggttcttc

SEQ ID NO: 726908 - DNA, 25 bp, Mus musculus
gttcatatttcactacccagcttta

SEQ ID NO: 726909 - DNA, 25 bp, Mus musculus
gttcatatttcagtacccagcttta

SEQ ID NO: 726910 - DNA, 25 bp, Mus musculus
gttcatattttcctcccacgggtgg

SEQ ID NO: 726911 - DNA, 25 bp, Mus musculus
gttcatattttcctcgggccattgc

SEQ ID NO: 726912 - DNA, 25 bp, Mus musculus
gttcatattttcgtcccacgggtgg

SEQ ID NO: 726913 - DNA, 25 bp, Mus musculus
gttcatattttcgtcgggccattgc

SEQ ID NO: 726914 - DNA, 25 bp, Mus musculus
gttcatcaaactcctcagtgatccc

SEQ ID NO: 726915 - DNA, 25 bp, Mus musculus
gttcatcaaactgctcagtgatccc

SEQ ID NO: 726916 - DNA, 25 bp, Mus musculus
gttcatcaacctagtgattttgttt

SEQ ID NO: 726917 - DNA, 25 bp, Mus musculus
gttcatcaaccttgtgattttgttt

SEQ ID NO: 726918 - DNA, 25 bp, Mus musculus
gttcatcaagttagtcctgatccca

SEQ ID NO: 726919 - DNA, 25 bp, Mus musculus
gttcatcaagtttgtcctgatccca

SEQ ID NO: 726920 - DNA, 25 bp, Mus musculus
gttcatcaatgaaccctgtcctgac

SEQ ID NO: 726921 - DNA, 25 bp, Mus musculus
gttcatcaatgatccctgtcctgac

SEQ ID NO: 726922 - DNA, 25 bp, Mus musculus
gttcatcaatggacgcaatcttgga

SEQ ID NO: 726923 - DNA, 25 bp, Mus musculus
gttcatcaatggtcgcaatcttgga

SEQ ID NO: 726924 - DNA, 25 bp, Mus musculus
gttcatcacaccaattattccttat

SEQ ID NO: 726925 - DNA, 25 bp, Mus musculus
gttcatcacacccatgctaagaggg

SEQ ID NO: 726926 - DNA, 25 bp, Mus musculus
gttcatcacaccgatgctaagaggg

SEQ ID NO: 726927 - DNA, 25 bp, Mus musculus
gttcatcacacctattattccttat

SEQ ID NO: 726928 - DNA, 25 bp, Mus musculus
gttcatcacctgctagctagttgct

SEQ ID NO: 726929 - DNA, 25 bp, Mus musculus
gttcatcacctggtagctagttgct

SEQ ID NO: 726930 - DNA, 25 bp, Mus musculus
gttcatcactgactaatgctctccc

SEQ ID NO: 726931 - DNA, 25 bp, Mus musculus
gttcatcactgagtaatgctctccc

SEQ ID NO: 726932 - DNA, 25 bp, Mus musculus
gttcatcagagtcttcgtcttcatc

SEQ ID NO: 726933 - DNA, 25 bp, Mus musculus
gttcatcagagtgttcgtcttcatc

SEQ ID NO: 726934 - DNA, 25 bp, Mus musculus
gttcatcagcaaactgcagggactg

SEQ ID NO: 726935 - DNA, 25 bp, Mus musculus
gttcatcagcaatctgcagggactg

SEQ ID NO: 726936 - DNA, 25 bp, Mus musculus
gttcatcaggcaccagtcagaccga

SEQ ID NO: 726937 - DNA, 25 bp, Mus musculus
gttcatcaggcagcagtcagaccga

SEQ ID NO: 726938 - DNA, 25 bp, Mus musculus
gttcatcaggctccgggtcttcctg

SEQ ID NO: 726939 - DNA, 25 bp, Mus musculus
gttcatcaggctgcgggtcttcctg

SEQ ID NO: 726940 - DNA, 25 bp, Mus musculus
gttcatcagttcaaactcgtcattg

SEQ ID NO: 726941 - DNA, 25 bp, Mus musculus
gttcatcagttctaactcgtcattg

SEQ ID NO: 726942 - DNA, 25 bp, Mus musculus
gttcatcatactccagaccatgtat

SEQ ID NO: 726943 - DNA, 25 bp, Mus musculus
gttcatcatactgcagaccatgtat

SEQ ID NO: 726944 - DNA, 25 bp, Mus musculus
gttcatcatgaacttaccatccaag

SEQ ID NO: 726945 - DNA, 25 bp, Mus musculus
gttcatcatgaagttaccatccaag

SEQ ID NO: 726946 - DNA, 25 bp, Mus musculus
gttcatcatggacgcaatcccagca

SEQ ID NO: 726947 - DNA, 25 bp, Mus musculus
gttcatcatggaggcaatcccagca

SEQ ID NO: 726948 - DNA, 25 bp, Mus musculus
gttcatccaccaaagtacataccca

SEQ ID NO: 726949 - DNA, 25 bp, Mus musculus
gttcatccaccatagtacataccca

SEQ ID NO: 726950 - DNA, 25 bp, Mus musculus
gttcatccatctattatgccgagtt

SEQ ID NO: 726951 - DNA, 25 bp, Mus musculus
gttcatccatcttttatgccgagtt

SEQ ID NO: 726952 - DNA, 25 bp, Mus musculus
gttcatccatgacatttatccagaa

SEQ ID NO: 726953 - DNA, 25 bp, Mus musculus
gttcatccatgagatttatccagaa

SEQ ID NO: 726954 - DNA, 25 bp, Mus musculus
gttcatcccaccacaaaagttacca

SEQ ID NO: 726955 - DNA, 25 bp, Mus musculus
gttcatcccacctcaaaagttacca

SEQ ID NO: 726956 - DNA, 25 bp, Mus musculus
gttcatcccagacaatagcaactaa

SEQ ID NO: 726957 - DNA, 25 bp, Mus musculus
gttcatcccagagaatagcaactaa

SEQ ID NO: 726958 - DNA, 25 bp, Mus musculus
gttcatccctgacgcgtggactgga

SEQ ID NO: 726959 - DNA, 25 bp, Mus musculus
gttcatccctgaggcgtggactgga

SEQ ID NO: 726960 - DNA, 25 bp, Mus musculus
gttcatcctacaatctctactttga

SEQ ID NO: 726961 - DNA, 25 bp, Mus musculus
gttcatcctacattctctactttga

SEQ ID NO: 726962 - DNA, 25 bp, Mus musculus
gttcatcctcccagcagaactacgg

SEQ ID NO: 726963 - DNA, 25 bp, Mus musculus
gttcatcctccctgcagaactacgg

SEQ ID NO: 726964 - DNA, 25 bp, Mus musculus
gttcatcctctactactgagtggtt

SEQ ID NO: 726965 - DNA, 25 bp, Mus musculus
gttcatcctctagtactgagtggtt

SEQ ID NO: 726966 - DNA, 25 bp, Mus musculus
gttcatccttagatctagctttggg

SEQ ID NO: 726967 - DNA, 25 bp, Mus musculus
gttcatccttagttctagctttggg

SEQ ID NO: 726968 - DNA, 25 bp, Mus musculus
gttcatccttataactgctttgtct

SEQ ID NO: 726969 - DNA, 25 bp, Mus musculus
gttcatccttattactgctttgtct

SEQ ID NO: 726970 - DNA, 25 bp, Mus musculus
gttcatcgaccaagctgtgttgctg

SEQ ID NO: 726971 - DNA, 25 bp, Mus musculus
gttcatcgaccatgctgtgttgctg

SEQ ID NO: 726972 - DNA, 25 bp, Mus musculus
gttcatcgacgaccagcagattctg

SEQ ID NO: 726973 - DNA, 25 bp, Mus musculus
gttcatcgacgagcagcagattctg

SEQ ID NO: 726974 - DNA, 25 bp, Mus musculus
gttcatcgagaaaacctgcccaggt

SEQ ID NO: 726975 - DNA, 25 bp, Mus musculus
gttcatcgagaatacctgcccaggt

SEQ ID NO: 726976 - DNA, 25 bp, Mus musculus
gttcatcgatttaaaaacagccctt

SEQ ID NO: 726977 - DNA, 25 bp, Mus musculus
gttcatcgattttaaaacagccctt

SEQ ID NO: 726978 - DNA, 25 bp, Mus musculus
gttcatctaaatcttgtgttctgta

SEQ ID NO: 726979 - DNA, 25 bp, Mus musculus
gttcatctaaatgttgtgttctgta

SEQ ID NO: 726980 - DNA, 25 bp, Mus musculus
gttcatctacgtcgcaaacgctgaa

SEQ ID NO: 726981 - DNA, 25 bp, Mus musculus
gttcatctacgtggcaaacgctgaa

SEQ ID NO: 726982 - DNA, 25 bp, Mus musculus
gttcatctactcatcttctcttgag

SEQ ID NO: 726983 - DNA, 25 bp, Mus musculus
gttcatctactcttcttctcttgag

SEQ ID NO: 726984 - DNA, 25 bp, Mus musculus
gttcatctatagcaagccttcatat

SEQ ID NO: 726985 - DNA, 25 bp, Mus musculus
gttcatctataggaagccttcatat

SEQ ID NO: 726986 - DNA, 25 bp, Mus musculus
gttcatctatggagccttgctgtag

SEQ ID NO: 726987 - DNA, 25 bp, Mus musculus
gttcatctatggtgccttgctgtag

SEQ ID NO: 726988 - DNA, 25 bp, Mus musculus
gttcatctcacacaagttcaccaaa

SEQ ID NO: 726989 - DNA, 25 bp, Mus musculus
gttcatctcacagaagttcaccaaa

SEQ ID NO: 726990 - DNA, 25 bp, Mus musculus
gttcatctcattaagcatgtgacag

SEQ ID NO: 726991 - DNA, 25 bp, Mus musculus
gttcatctcatttagcatgtgacag

SEQ ID NO: 726992 - DNA, 25 bp, Mus musculus
gttcatctccgcctggttaatgaca

SEQ ID NO: 726993 - DNA, 25 bp, Mus musculus
gttcatctccgcgtggttaatgaca

SEQ ID NO: 726994 - DNA, 25 bp, Mus musculus
gttcatctgactaacggtatggttt

SEQ ID NO: 726995 - DNA, 25 bp, Mus musculus
gttcatctgacttacggtatggttt

SEQ ID NO: 726996 - DNA, 25 bp, Mus musculus
gttcatctgcaaatgttccctctgt

SEQ ID NO: 726997 - DNA, 25 bp, Mus musculus
gttcatctgcaattgttccctctgt

SEQ ID NO: 726998 - DNA, 25 bp, Mus musculus
gttcatctgcagatagtaccaggtg

SEQ ID NO: 726999 - DNA, 25 bp, Mus musculus
gttcatctgcagttagtaccaggtg

SEQ ID NO: 727000 - DNA, 25 bp, Mus musculus
gttcatctgtgcagggtttgtgaca

SEQ ID NO: 727001 - DNA, 25 bp, Mus musculus
gttcatctgtgctgggtttgtgaca

SEQ ID NO: 727002 - DNA, 25 bp, Mus musculus
gttcatcttaatagtatatgcctta

SEQ ID NO: 727003 - DNA, 25 bp, Mus musculus
gttcatcttaattgtatatgcctta

SEQ ID NO: 727004 - DNA, 25 bp, Mus musculus
gttcatcttattattctagcagtta

SEQ ID NO: 727005 - DNA, 25 bp, Mus musculus
gttcatcttatttttctagcagtta

SEQ ID NO: 727006 - DNA, 25 bp, Mus musculus
gttcatcttcacaagaggctcacaa

SEQ ID NO: 727007 - DNA, 25 bp, Mus musculus
gttcatcttcactagaggctcacaa

SEQ ID NO: 727008 - DNA, 25 bp, Mus musculus
gttcatcttcagagtcatcaaaggt

SEQ ID NO: 727009 - DNA, 25 bp, Mus musculus
gttcatcttcagattcattccacaa

SEQ ID NO: 727010 - DNA, 25 bp, Mus musculus
gttcatcttcagtgtcatcaaaggt

SEQ ID NO: 727011 - DNA, 25 bp, Mus musculus
gttcatcttcagtttcattccacaa

SEQ ID NO: 727012 - DNA, 25 bp, Mus musculus
gttcatcttctaaacacaggacagg

SEQ ID NO: 727013 - DNA, 25 bp, Mus musculus
gttcatcttctatacacaggacagg

SEQ ID NO: 727014 - DNA, 25 bp, Mus musculus
gttcatcttctgaggtcaactaaag

SEQ ID NO: 727015 - DNA, 25 bp, Mus musculus
gttcatcttctgtggtcaactaaag

SEQ ID NO: 727016 - DNA, 25 bp, Mus musculus
gttcatcttgctattggaggttgtt

SEQ ID NO: 727017 - DNA, 25 bp, Mus musculus
gttcatcttgcttttggaggttgtt

SEQ ID NO: 727018 - DNA, 25 bp, Mus musculus
gttcatcttgtcattttctcagatc

SEQ ID NO: 727019 - DNA, 25 bp, Mus musculus
gttcatcttgtctttttctcagatc

SEQ ID NO: 727020 - DNA, 25 bp, Mus musculus
gttcatcttgttctagcactttcta

SEQ ID NO: 727021 - DNA, 25 bp, Mus musculus
gttcatcttgttgtagcactttcta

SEQ ID NO: 727022 - DNA, 25 bp, Mus musculus
gttcatctttaaattccctgtaata

SEQ ID NO: 727023 - DNA, 25 bp, Mus musculus
gttcatctttaatttccctgtaata

SEQ ID NO: 727024 - DNA, 25 bp, Mus musculus
gttcatctttgtcagtcagcttttc

SEQ ID NO: 727025 - DNA, 25 bp, Mus musculus
gttcatctttgtgagtcagcttttc

SEQ ID NO: 727026 - DNA, 25 bp, Mus musculus
gttcatcttttcatgtcactagtcc

SEQ ID NO: 727027 - DNA, 25 bp, Mus musculus
gttcatcttttcttgtcactagtcc

SEQ ID NO: 727028 - DNA, 25 bp, Mus musculus
gttcatgaaaccacactacccaaat

SEQ ID NO: 727029 - DNA, 25 bp, Mus musculus
gttcatgaaacctcactacccaaat

SEQ ID NO: 727030 - DNA, 25 bp, Mus musculus
gttcatgaaactagggaggacccaa

SEQ ID NO: 727031 - DNA, 25 bp, Mus musculus
gttcatgaaacttgggaggacccaa

SEQ ID NO: 727032 - DNA, 25 bp, Mus musculus
gttcatgaacaactggctgccctgt

SEQ ID NO: 727033 - DNA, 25 bp, Mus musculus
gttcatgaacaagtggctgccctgt

SEQ ID NO: 727034 - DNA, 25 bp, Mus musculus
gttcatgaagaacctaagaggcccc

SEQ ID NO: 727035 - DNA, 25 bp, Mus musculus
gttcatgaagaagctaagaggcccc

SEQ ID NO: 727036 - DNA, 25 bp, Mus musculus
gttcatgaatgaacctatcccagcc

SEQ ID NO: 727037 - DNA, 25 bp, Mus musculus
gttcatgaatgatcctatcccagcc

SEQ ID NO: 727038 - DNA, 25 bp, Mus musculus
gttcatgaattcaagcccatcctga

SEQ ID NO: 727039 - DNA, 25 bp, Mus musculus
gttcatgaattctagcccatcctga

SEQ ID NO: 727040 - DNA, 25 bp, Mus musculus
gttcatgacacaaacataaccttgt

SEQ ID NO: 727041 - DNA, 25 bp, Mus musculus
gttcatgacacatacataaccttgt

SEQ ID NO: 727042 - DNA, 25 bp, Mus musculus
gttcatgacattccagcttgacctg

SEQ ID NO: 727043 - DNA, 25 bp, Mus musculus
gttcatgacattgcagcttgacctg

SEQ ID NO: 727044 - DNA, 25 bp, Mus musculus
gttcatgaccctcattctctagcgt

SEQ ID NO: 727045 - DNA, 25 bp, Mus musculus
gttcatgaccctgattctctagcgt

SEQ ID NO: 727046 - DNA, 25 bp, Mus musculus
gttcatgacgatcggacgccaacgt

SEQ ID NO: 727047 - DNA, 25 bp, Mus musculus
gttcatgacgatgggacgccaacgt

SEQ ID NO: 727048 - DNA, 25 bp, Mus musculus
gttcatgacgtcatatgccattcat

SEQ ID NO: 727049 - DNA, 25 bp, Mus musculus
gttcatgacgtcttatgccattcat

SEQ ID NO: 727050 - DNA, 25 bp, Mus musculus
gttcatgagaatctatcaccatcgt

SEQ ID NO: 727051 - DNA, 25 bp, Mus musculus
gttcatgagaatgtatcaccatcgt

SEQ ID NO: 727052 - DNA, 25 bp, Mus musculus
gttcatgatcaaaacccgtcgtagg

SEQ ID NO: 727053 - DNA, 25 bp, Mus musculus
gttcatgatcaatacccgtcgtagg

SEQ ID NO: 727054 - DNA, 25 bp, Mus musculus
gttcatgatgccacattttcacagc

SEQ ID NO: 727055 - DNA, 25 bp, Mus musculus
gttcatgatgcctcattttcacagc

SEQ ID NO: 727056 - DNA, 25 bp, Mus musculus
gttcatgcaacaactgataacctga

SEQ ID NO: 727057 - DNA, 25 bp, Mus musculus
gttcatgcaacatctgataacctga

SEQ ID NO: 727058 - DNA, 25 bp, Mus musculus
gttcatgcatatatccccgtttaaa

SEQ ID NO: 727059 - DNA, 25 bp, Mus musculus
gttcatgcatatttccccgtttaaa

SEQ ID NO: 727060 - DNA, 25 bp, Mus musculus
gttcatgcccagagagctaacttta

SEQ ID NO: 727061 - DNA, 25 bp, Mus musculus
gttcatgcccagtgagctaacttta

SEQ ID NO: 727062 - DNA, 25 bp, Mus musculus
gttcatgccgacagtggagcctgac

SEQ ID NO: 727063 - DNA, 25 bp, Mus musculus
gttcatgccgactgtggagcctgac

SEQ ID NO: 727064 - DNA, 25 bp, Mus musculus
gttcatgcctgaaaagtactaatgg

SEQ ID NO: 727065 - DNA, 25 bp, Mus musculus
gttcatgcctgaaatcacatatgga

SEQ ID NO: 727066 - DNA, 25 bp, Mus musculus
gttcatgcctgataagtactaatgg

SEQ ID NO: 727067 - DNA, 25 bp, Mus musculus
gttcatgcctgatatcacatatgga

SEQ ID NO: 727068 - DNA, 25 bp, Mus musculus
gttcatgcctttcatccagtaatgg

SEQ ID NO: 727069 - DNA, 25 bp, Mus musculus
gttcatgcctttgatccagtaatgg

SEQ ID NO: 727070 - DNA, 25 bp, Mus musculus
gttcatgcttctagtgtgacacttc

SEQ ID NO: 727071 - DNA, 25 bp, Mus musculus
gttcatgcttcttgtgtgacacttc

SEQ ID NO: 727072 - DNA, 25 bp, Mus musculus
gttcatgcttgtaatgccagccctg

SEQ ID NO: 727073 - DNA, 25 bp, Mus musculus
gttcatgcttgttatgccagccctg

SEQ ID NO: 727074 - DNA, 25 bp, Mus musculus
gttcatggaacaacagacacctcta

SEQ ID NO: 727075 - DNA, 25 bp, Mus musculus
gttcatggaacatcagacacctcta

SEQ ID NO: 727076 - DNA, 25 bp, Mus musculus
gttcatggaatgacaaatcgcctat

SEQ ID NO: 727077 - DNA, 25 bp, Mus musculus
gttcatggaatgtcaaatcgcctat

SEQ ID NO: 727078 - DNA, 25 bp, Mus musculus
gttcatggagaacggctgcctgctt

SEQ ID NO: 727079 - DNA, 25 bp, Mus musculus
gttcatggagaagggctgcctgctt

SEQ ID NO: 727080 - DNA, 25 bp, Mus musculus
gttcatggatataacctgtgtgctc

SEQ ID NO: 727081 - DNA, 25 bp, Mus musculus
gttcatggatattacctgtgtgctc

SEQ ID NO: 727082 - DNA, 25 bp, Mus musculus
gttcatggccatactcaattacttt

SEQ ID NO: 727083 - DNA, 25 bp, Mus musculus
gttcatggccattctcaattacttt

SEQ ID NO: 727084 - DNA, 25 bp, Mus musculus
gttcatgggagtcactagcctccta

SEQ ID NO: 727085 - DNA, 25 bp, Mus musculus
gttcatgggagtgactagcctccta

SEQ ID NO: 727086 - DNA, 25 bp, Mus musculus
gttcatgggtcaataacagcaaagt

SEQ ID NO: 727087 - DNA, 25 bp, Mus musculus
gttcatgggtcattaacagcaaagt

SEQ ID NO: 727088 - DNA, 25 bp, Mus musculus
gttcatggtcagatactgtgactat

SEQ ID NO: 727089 - DNA, 25 bp, Mus musculus
gttcatggtcagttactgtgactat

SEQ ID NO: 727090 - DNA, 25 bp, Mus musculus
gttcatggtgttatcaactccataa

SEQ ID NO: 727091 - DNA, 25 bp, Mus musculus
gttcatggtgttttcaactccataa

SEQ ID NO: 727092 - DNA, 25 bp, Mus musculus
gttcatggttatactacatttctag

SEQ ID NO: 727093 - DNA, 25 bp, Mus musculus
gttcatggttattctacatttctag

SEQ ID NO: 727094 - DNA, 25 bp, Mus musculus
gttcatggttttctttatggtggtt

SEQ ID NO: 727095 - DNA, 25 bp, Mus musculus
gttcatggttttgtttatggtggtt

SEQ ID NO: 727096 - DNA, 25 bp, Mus musculus
gttcatgtacttagagttccctcag

SEQ ID NO: 727097 - DNA, 25 bp, Mus musculus
gttcatgtacttcgactgtggatta

SEQ ID NO: 727098 - DNA, 25 bp, Mus musculus
gttcatgtacttggactgtggatta

SEQ ID NO: 727099 - DNA, 25 bp, Mus musculus
gttcatgtactttgagttccctcag

SEQ ID NO: 727100 - DNA, 25 bp, Mus musculus
gttcatgtatggaagccctaacccc

SEQ ID NO: 727101 - DNA, 25 bp, Mus musculus
gttcatgtatggtagccctaacccc

SEQ ID NO: 727102 - DNA, 25 bp, Mus musculus
gttcatgtccatatagccaccatta

SEQ ID NO: 727103 - DNA, 25 bp, Mus musculus
gttcatgtccatttagccaccatta

SEQ ID NO: 727104 - DNA, 25 bp, Mus musculus
gttcatgtcctgctcagtgcatcaa

SEQ ID NO: 727105 - DNA, 25 bp, Mus musculus
gttcatgtcctggtcagtgcatcaa

SEQ ID NO: 727106 - DNA, 25 bp, Mus musculus
gttcatgtcttcaccaaacttggga

SEQ ID NO: 727107 - DNA, 25 bp, Mus musculus
gttcatgtcttctccaaacttggga

SEQ ID NO: 727108 - DNA, 25 bp, Mus musculus
gttcatgtgaaacttctctgcttca

SEQ ID NO: 727109 - DNA, 25 bp, Mus musculus
gttcatgtgaaagttctctgcttca

SEQ ID NO: 727110 - DNA, 25 bp, Mus musculus
gttcatgtgaacagttaacgggttt

SEQ ID NO: 727111 - DNA, 25 bp, Mus musculus
gttcatgtgaactgttaacgggttt

SEQ ID NO: 727112 - DNA, 25 bp, Mus musculus
gttcatgtgcacatacttacaggtt

SEQ ID NO: 727113 - DNA, 25 bp, Mus musculus
gttcatgtgcacttacttacaggtt

SEQ ID NO: 727114 - DNA, 25 bp, Mus musculus
gttcatgtgcatacagattgtcaag

SEQ ID NO: 727115 - DNA, 25 bp, Mus musculus
gttcatgtgcattcagattgtcaag

SEQ ID NO: 727116 - DNA, 25 bp, Mus musculus
gttcatgtggctaagcaaggttttc

SEQ ID NO: 727117 - DNA, 25 bp, Mus musculus
gttcatgtggcttagcaaggttttc

SEQ ID NO: 727118 - DNA, 25 bp, Mus musculus
gttcatgtgtacagcacgtatgcga

SEQ ID NO: 727119 - DNA, 25 bp, Mus musculus
gttcatgtgtactgcacgtatgcga

SEQ ID NO: 727120 - DNA, 25 bp, Mus musculus
gttcatgtgtccattgaaacaccac

SEQ ID NO: 727121 - DNA, 25 bp, Mus musculus
gttcatgtgtcctttgaaacaccac

SEQ ID NO: 727122 - DNA, 25 bp, Mus musculus
gttcatgtgtctatgccccaaaatc

SEQ ID NO: 727123 - DNA, 25 bp, Mus musculus
gttcatgtgtctttgccccaaaatc

SEQ ID NO: 727124 - DNA, 25 bp, Mus musculus
gttcatgtgtgaaatatggccactc

SEQ ID NO: 727125 - DNA, 25 bp, Mus musculus
gttcatgtgtgatatatggccactc

SEQ ID NO: 727126 - DNA, 25 bp, Mus musculus
gttcatgttactctcctgtttgagt

SEQ ID NO: 727127 - DNA, 25 bp, Mus musculus
gttcatgttactgtcctgtttgagt

SEQ ID NO: 727128 - DNA, 25 bp, Mus musculus
gttcatgttcacctttctcttaaaa

SEQ ID NO: 727129 - DNA, 25 bp, Mus musculus
gttcatgttcacgtttctcttaaaa

SEQ ID NO: 727130 - DNA, 25 bp, Mus musculus
gttcatgttctaaataccccatcag

SEQ ID NO: 727131 - DNA, 25 bp, Mus musculus
gttcatgttctatataccccatcag

SEQ ID NO: 727132 - DNA, 25 bp, Mus musculus
gttcatgttgctattctgaatctag

SEQ ID NO: 727133 - DNA, 25 bp, Mus musculus
gttcatgttgcttttctgaatctag

SEQ ID NO: 727134 - DNA, 25 bp, Mus musculus
gttcatgtttacaaatttgtcctgc

SEQ ID NO: 727135 - DNA, 25 bp, Mus musculus
gttcatgtttactaatttgtcctgc

SEQ ID NO: 727136 - DNA, 25 bp, Mus musculus
gttcatgtttgtctgcatacatcaa

SEQ ID NO: 727137 - DNA, 25 bp, Mus musculus
gttcatgtttgtgtgcatacatcaa

SEQ ID NO: 727138 - DNA, 25 bp, Mus musculus
gttcattacagcagacaagggtctt

SEQ ID NO: 727139 - DNA, 25 bp, Mus musculus
gttcattacagctgacaagggtctt

SEQ ID NO: 727140 - DNA, 25 bp, Mus musculus
gttcattaccaccttggaggaggat

SEQ ID NO: 727141 - DNA, 25 bp, Mus musculus
gttcattaccacgttggaggaggat

SEQ ID NO: 727142 - DNA, 25 bp, Mus musculus
gttcattagaaaagcaggtctcaat

SEQ ID NO: 727143 - DNA, 25 bp, Mus musculus
gttcattagaaactccatctcaaag

SEQ ID NO: 727144 - DNA, 25 bp, Mus musculus
gttcattagaaagtccatctcaaag

SEQ ID NO: 727145 - DNA, 25 bp, Mus musculus
gttcattagaaatgcaggtctcaat

SEQ ID NO: 727146 - DNA, 25 bp, Mus musculus
gttcattagaacactttgttttcaa

SEQ ID NO: 727147 - DNA, 25 bp, Mus musculus
gttcattagaactctttgttttcaa

SEQ ID NO: 727148 - DNA, 25 bp, Mus musculus
gttcattagttgctttcctgtgact

SEQ ID NO: 727149 - DNA, 25 bp, Mus musculus
gttcattagttggtttcctgtgact

SEQ ID NO: 727150 - DNA, 25 bp, Mus musculus
gttcattatcatcctttctttgttt

SEQ ID NO: 727151 - DNA, 25 bp, Mus musculus
gttcattatcatgctttctttgttt

SEQ ID NO: 727152 - DNA, 25 bp, Mus musculus
gttcattatcgaatatctctgtata

SEQ ID NO: 727153 - DNA, 25 bp, Mus musculus
gttcattatcgattatctctgtata

SEQ ID NO: 727154 - DNA, 25 bp, Mus musculus
gttcattatgcaaagatgtcaccaa

SEQ ID NO: 727155 - DNA, 25 bp, Mus musculus
gttcattatgcatagatgtcaccaa

SEQ ID NO: 727156 - DNA, 25 bp, Mus musculus
gttcattatgttatggttattgaca

SEQ ID NO: 727157 - DNA, 25 bp, Mus musculus
gttcattatgttttggttattgaca

SEQ ID NO: 727158 - DNA, 25 bp, Mus musculus
gttcattattacatgcaggcagcca

SEQ ID NO: 727159 - DNA, 25 bp, Mus musculus
gttcattattacttgcaggcagcca

SEQ ID NO: 727160 - DNA, 25 bp, Mus musculus
gttcattattttcagctcagccacc

SEQ ID NO: 727161 - DNA, 25 bp, Mus musculus
gttcattattttctctgttctgtag

SEQ ID NO: 727162 - DNA, 25 bp, Mus musculus
gttcattattttgagctcagccacc

SEQ ID NO: 727163 - DNA, 25 bp, Mus musculus
gttcattattttgtctgttctgtag

SEQ ID NO: 727164 - DNA, 25 bp, Mus musculus
gttcattcaacaaactaacagggtt

SEQ ID NO: 727165 - DNA, 25 bp, Mus musculus
gttcattcaacatactaacagggtt

SEQ ID NO: 727166 - DNA, 25 bp, Mus musculus
gttcattcaagacttcagcacttgc

SEQ ID NO: 727167 - DNA, 25 bp, Mus musculus
gttcattcaagagttcagcacttgc

SEQ ID NO: 727168 - DNA, 25 bp, Mus musculus
gttcattcacacaggtatcatagcc

SEQ ID NO: 727169 - DNA, 25 bp, Mus musculus
gttcattcacactggtatcatagcc

SEQ ID NO: 727170 - DNA, 25 bp, Mus musculus
gttcattcacgaccgtcatgtccca

SEQ ID NO: 727171 - DNA, 25 bp, Mus musculus
gttcattcacgagcgtcatgtccca

SEQ ID NO: 727172 - DNA, 25 bp, Mus musculus
gttcattcagctctgggatccaggt

SEQ ID NO: 727173 - DNA, 25 bp, Mus musculus
gttcattcagctgtgggatccaggt

SEQ ID NO: 727174 - DNA, 25 bp, Mus musculus
gttcattcatgactgctatgtcctg

SEQ ID NO: 727175 - DNA, 25 bp, Mus musculus
gttcattcatgagtgctatgtcctg

SEQ ID NO: 727176 - DNA, 25 bp, Mus musculus
gttcattcattgacaggtcattagc

SEQ ID NO: 727177 - DNA, 25 bp, Mus musculus
gttcattcattgctttgactggtat

SEQ ID NO: 727178 - DNA, 25 bp, Mus musculus
gttcattcattggtttgactggtat

SEQ ID NO: 727179 - DNA, 25 bp, Mus musculus
gttcattcattgtcaggtcattagc

SEQ ID NO: 727180 - DNA, 25 bp, Mus musculus
gttcattccaagatataccatacca

SEQ ID NO: 727181 - DNA, 25 bp, Mus musculus
gttcattccaagttataccatacca

SEQ ID NO: 727182 - DNA, 25 bp, Mus musculus
gttcattccctcaattttcactgaa

SEQ ID NO: 727183 - DNA, 25 bp, Mus musculus
gttcattccctctattttcactgaa

SEQ ID NO: 727184 - DNA, 25 bp, Mus musculus
gttcattccgttattcagcagcaaa

SEQ ID NO: 727185 - DNA, 25 bp, Mus musculus
gttcattccgtttttcagcagcaaa

SEQ ID NO: 727186 - DNA, 25 bp, Mus musculus
gttcattcctgtatatggttgcacc

SEQ ID NO: 727187 - DNA, 25 bp, Mus musculus
gttcattcctgtttatggttgcacc

SEQ ID NO: 727188 - DNA, 25 bp, Mus musculus
gttcattcgttcactttaacaattt

SEQ ID NO: 727189 - DNA, 25 bp, Mus musculus
gttcattcgttctctttaacaattt

SEQ ID NO: 727190 - DNA, 25 bp, Mus musculus
gttcattctaaaacccatttctggg

SEQ ID NO: 727191 - DNA, 25 bp, Mus musculus
gttcattctaaatcccatttctggg

SEQ ID NO: 727192 - DNA, 25 bp, Mus musculus
gttcattctatcattccaagtactt

SEQ ID NO: 727193 - DNA, 25 bp, Mus musculus
gttcattctatccataattgccatg

SEQ ID NO: 727194 - DNA, 25 bp, Mus musculus
gttcattctatcgataattgccatg

SEQ ID NO: 727195 - DNA, 25 bp, Mus musculus
gttcattctatctttccaagtactt

SEQ ID NO: 727196 - DNA, 25 bp, Mus musculus
gttcattctattaaacaagcagagc

SEQ ID NO: 727197 - DNA, 25 bp, Mus musculus
gttcattctatttaacaagcagagc

SEQ ID NO: 727198 - DNA, 25 bp, Mus musculus
gttcattctcatcctatacccaaat

SEQ ID NO: 727199 - DNA, 25 bp, Mus musculus
gttcattctcatgctatacccaaat

SEQ ID NO: 727200 - DNA, 25 bp, Mus musculus
gttcattctccacttaataagtata

SEQ ID NO: 727201 - DNA, 25 bp, Mus musculus
gttcattctccagttaataagtata

SEQ ID NO: 727202 - DNA, 25 bp, Mus musculus
gttcattctgatctggttttagcct

SEQ ID NO: 727203 - DNA, 25 bp, Mus musculus
gttcattctgatgtggttttagcct

SEQ ID NO: 727204 - DNA, 25 bp, Mus musculus
gttcattcttagatgcttcatggcc

SEQ ID NO: 727205 - DNA, 25 bp, Mus musculus
gttcattcttagttgcttcatggcc

SEQ ID NO: 727206 - DNA, 25 bp, Mus musculus
gttcattcttctctcagacaatgtc

SEQ ID NO: 727207 - DNA, 25 bp, Mus musculus
gttcattcttctgtcagacaatgtc

SEQ ID NO: 727208 - DNA, 25 bp, Mus musculus
gttcattctttaattactcccacaa

SEQ ID NO: 727209 - DNA, 25 bp, Mus musculus
gttcattctttatttactcccacaa

SEQ ID NO: 727210 - DNA, 25 bp, Mus musculus
gttcattcttttccaaggtcagctg

SEQ ID NO: 727211 - DNA, 25 bp, Mus musculus
gttcattcttttgcaaggtcagctg

SEQ ID NO: 727212 - DNA, 25 bp, Mus musculus
gttcattgagaaaccctgactttaa

SEQ ID NO: 727213 - DNA, 25 bp, Mus musculus
gttcattgagaatccctgactttaa

SEQ ID NO: 727214 - DNA, 25 bp, Mus musculus
gttcattgcaaaagggtgctgagcc

SEQ ID NO: 727215 - DNA, 25 bp, Mus musculus
gttcattgcaaatgggtgctgagcc

SEQ ID NO: 727216 - DNA, 25 bp, Mus musculus
gttcattgccctaaactgtgctgat

SEQ ID NO: 727217 - DNA, 25 bp, Mus musculus
gttcattgcccttaactgtgctgat

SEQ ID NO: 727218 - DNA, 25 bp, Mus musculus
gttcattgcctgatcggctttgaga

SEQ ID NO: 727219 - DNA, 25 bp, Mus musculus
gttcattgcctgttcggctttgaga

SEQ ID NO: 727220 - DNA, 25 bp, Mus musculus
gttcattgctgaccagttgtgttta

SEQ ID NO: 727221 - DNA, 25 bp, Mus musculus
gttcattgctgagcagttgtgttta

SEQ ID NO: 727222 - DNA, 25 bp, Mus musculus
gttcattgcttcattatgttcatat

SEQ ID NO: 727223 - DNA, 25 bp, Mus musculus
gttcattgcttctttatgttcatat

SEQ ID NO: 727224 - DNA, 25 bp, Mus musculus
gttcattgtactaggcacagtgatg

SEQ ID NO: 727225 - DNA, 25 bp, Mus musculus
gttcattgtacttggcacagtgatg

SEQ ID NO: 727226 - DNA, 25 bp, Mus musculus
gttcattgtcatagacctcagcagc

SEQ ID NO: 727227 - DNA, 25 bp, Mus musculus
gttcattgtcattgacctcagcagc

SEQ ID NO: 727228 - DNA, 25 bp, Mus musculus
gttcattgtcttatgcgtatcctct

SEQ ID NO: 727229 - DNA, 25 bp, Mus musculus
gttcattgtcttttgcgtatcctct

SEQ ID NO: 727230 - DNA, 25 bp, Mus musculus
gttcattgtggaagtcaaggccaat

SEQ ID NO: 727231 - DNA, 25 bp, Mus musculus
gttcattgtggatgtcaaggccaat

SEQ ID NO: 727232 - DNA, 25 bp, Mus musculus
gttcattgttacataagtctactgt

SEQ ID NO: 727233 - DNA, 25 bp, Mus musculus
gttcattgttacttaagtctactgt

SEQ ID NO: 727234 - DNA, 25 bp, Mus musculus
gttcattgtttcacagtattactgc

SEQ ID NO: 727235 - DNA, 25 bp, Mus musculus
gttcattgtttctcagtattactgc

SEQ ID NO: 727236 - DNA, 25 bp, Mus musculus
gttcatttaacaagatcctccactg

SEQ ID NO: 727237 - DNA, 25 bp, Mus musculus
gttcatttaacatgatcctccactg

SEQ ID NO: 727238 - DNA, 25 bp, Mus musculus
gttcatttaagaaccacagcccagt

SEQ ID NO: 727239 - DNA, 25 bp, Mus musculus
gttcatttaagatccacagcccagt

SEQ ID NO: 727240 - DNA, 25 bp, Mus musculus
gttcatttacatatcacgtgtagca

SEQ ID NO: 727241 - DNA, 25 bp, Mus musculus
gttcatttacatttcacgtgtagca

SEQ ID NO: 727242 - DNA, 25 bp, Mus musculus
gttcatttactacccctgatttctg

SEQ ID NO: 727243 - DNA, 25 bp, Mus musculus
gttcatttactagccctgatttctg

SEQ ID NO: 727244 - DNA, 25 bp, Mus musculus
gttcatttagtaatgcttcccggga

SEQ ID NO: 727245 - DNA, 25 bp, Mus musculus
gttcatttagtattgcttcccggga

SEQ ID NO: 727246 - DNA, 25 bp, Mus musculus
gttcatttatggcacttgcaagaca

SEQ ID NO: 727247 - DNA, 25 bp, Mus musculus
gttcatttatgggacttgcaagaca

SEQ ID NO: 727248 - DNA, 25 bp, Mus musculus
gttcatttcaacactaggtgacaat

SEQ ID NO: 727249 - DNA, 25 bp, Mus musculus
gttcatttcaactctaggtgacaat

SEQ ID NO: 727250 - DNA, 25 bp, Mus musculus
gttcatttcagaaaccctgttctct

SEQ ID NO: 727251 - DNA, 25 bp, Mus musculus
gttcatttcagataccctgttctct

SEQ ID NO: 727252 - DNA, 25 bp, Mus musculus
gttcatttcagtctggcgctggcaa

SEQ ID NO: 727253 - DNA, 25 bp, Mus musculus
gttcatttcagtgtggcgctggcaa

SEQ ID NO: 727254 - DNA, 25 bp, Mus musculus
gttcatttcatgacccggatgtact

SEQ ID NO: 727255 - DNA, 25 bp, Mus musculus
gttcatttcatgtcccggatgtact

SEQ ID NO: 727256 - DNA, 25 bp, Mus musculus
gttcatttccaacatggctgcttcc

SEQ ID NO: 727257 - DNA, 25 bp, Mus musculus
gttcatttccaagatggctgcttcc

SEQ ID NO: 727258 - DNA, 25 bp, Mus musculus
gttcatttccacaccaaacttcaac

SEQ ID NO: 727259 - DNA, 25 bp, Mus musculus
gttcatttccactccaaacttcaac

SEQ ID NO: 727260 - DNA, 25 bp, Mus musculus
gttcatttccctatccctaatattt

SEQ ID NO: 727261 - DNA, 25 bp, Mus musculus
gttcatttccctttccctaatattt

SEQ ID NO: 727262 - DNA, 25 bp, Mus musculus
gttcatttctataggcatgggtcag

SEQ ID NO: 727263 - DNA, 25 bp, Mus musculus
gttcatttctattggcatgggtcag

SEQ ID NO: 727264 - DNA, 25 bp, Mus musculus
gttcatttctctagtatctagagct

SEQ ID NO: 727265 - DNA, 25 bp, Mus musculus
gttcatttctcttgtatctagagct

SEQ ID NO: 727266 - DNA, 25 bp, Mus musculus
gttcatttctgtatttcggacctag

SEQ ID NO: 727267 - DNA, 25 bp, Mus musculus
gttcatttctgtttttcggacctag

SEQ ID NO: 727268 - DNA, 25 bp, Mus musculus
gttcatttcttccagtataaccaca

SEQ ID NO: 727269 - DNA, 25 bp, Mus musculus
gttcatttcttcgagtataaccaca

SEQ ID NO: 727270 - DNA, 25 bp, Mus musculus
gttcatttgaaaacaacacatttac

SEQ ID NO: 727271 - DNA, 25 bp, Mus musculus
gttcatttgaaatcaacacatttac

SEQ ID NO: 727272 - DNA, 25 bp, Mus musculus
gttcatttgagaccgacagtgcaga

SEQ ID NO: 727273 - DNA, 25 bp, Mus musculus
gttcatttgagagcgacagtgcaga

SEQ ID NO: 727274 - DNA, 25 bp, Mus musculus
gttcatttgaggctatccatctttg

SEQ ID NO: 727275 - DNA, 25 bp, Mus musculus
gttcatttgagggtatccatctttg

SEQ ID NO: 727276 - DNA, 25 bp, Mus musculus
gttcatttgccaagtctgagtctta

SEQ ID NO: 727277 - DNA, 25 bp, Mus musculus
gttcatttgccatgtctgagtctta

SEQ ID NO: 727278 - DNA, 25 bp, Mus musculus
gttcatttgctgatgtactgctgtg

SEQ ID NO: 727279 - DNA, 25 bp, Mus musculus
gttcatttgctgttgtactgctgtg

SEQ ID NO: 727280 - DNA, 25 bp, Mus musculus
gttcatttggacaactgccatcatt

SEQ ID NO: 727281 - DNA, 25 bp, Mus musculus
gttcatttggactactgccatcatt

SEQ ID NO: 727282 - DNA, 25 bp, Mus musculus
gttcatttgtatctctgcttcttgc

SEQ ID NO: 727283 - DNA, 25 bp, Mus musculus
gttcatttgtatgtctgcttcttgc

SEQ ID NO: 727284 - DNA, 25 bp, Mus musculus
gttcatttgtcacttttgtttggcc

SEQ ID NO: 727285 - DNA, 25 bp, Mus musculus
gttcatttgtcagttttgtttggcc

SEQ ID NO: 727286 - DNA, 25 bp, Mus musculus
gttcatttgtgcagtctgatcacta

SEQ ID NO: 727287 - DNA, 25 bp, Mus musculus
gttcatttgtgcatgcaactcttct

SEQ ID NO: 727288 - DNA, 25 bp, Mus musculus
gttcatttgtgctgtctgatcacta

SEQ ID NO: 727289 - DNA, 25 bp, Mus musculus
gttcatttgtgcttgcaactcttct

SEQ ID NO: 727290 - DNA, 25 bp, Mus musculus
gttcattttaagagacttgatttcc

SEQ ID NO: 727291 - DNA, 25 bp, Mus musculus
gttcattttaagtgacttgatttcc

SEQ ID NO: 727292 - DNA, 25 bp, Mus musculus
gttcattttaatactagctccccaa

SEQ ID NO: 727293 - DNA, 25 bp, Mus musculus
gttcattttaattctagctccccaa

SEQ ID NO: 727294 - DNA, 25 bp, Mus musculus
gttcattttcatcttcttgtacagt

SEQ ID NO: 727295 - DNA, 25 bp, Mus musculus
gttcattttcatgttcttgtacagt

SEQ ID NO: 727296 - DNA, 25 bp, Mus musculus
gttcattttcgccacatacccaaaa

SEQ ID NO: 727297 - DNA, 25 bp, Mus musculus
gttcattttcgcgacatacccaaaa

SEQ ID NO: 727298 - DNA, 25 bp, Mus musculus
gttcattttctaagactcaaggatg

SEQ ID NO: 727299 - DNA, 25 bp, Mus musculus
gttcattttctatgactcaaggatg

SEQ ID NO: 727300 - DNA, 25 bp, Mus musculus
gttcattttcttcacaaccattctc

SEQ ID NO: 727301 - DNA, 25 bp, Mus musculus
gttcattttcttgacaaccattctc

SEQ ID NO: 727302 - DNA, 25 bp, Mus musculus
gttcattttgatatgctcctggaag

SEQ ID NO: 727303 - DNA, 25 bp, Mus musculus
gttcattttgatttgctcctggaag

SEQ ID NO: 727304 - DNA, 25 bp, Mus musculus
gttcattttgctatgcgacagcctt

SEQ ID NO: 727305 - DNA, 25 bp, Mus musculus
gttcattttgctttgcgacagcctt

SEQ ID NO: 727306 - DNA, 25 bp, Mus musculus
gttcattttgtcatcatgcttacag

SEQ ID NO: 727307 - DNA, 25 bp, Mus musculus
gttcattttgtcattggtgagcact

SEQ ID NO: 727308 - DNA, 25 bp, Mus musculus
gttcattttgtcttcatgcttacag

SEQ ID NO: 727309 - DNA, 25 bp, Mus musculus
gttcattttgtctttggtgagcact

SEQ ID NO: 727310 - DNA, 25 bp, Mus musculus
gttcatttttaactcgcggagccta

SEQ ID NO: 727311 - DNA, 25 bp, Mus musculus
gttcatttttaagtcgcggagccta

SEQ ID NO: 727312 - DNA, 25 bp, Mus musculus
gttccaaaaggaagcgcccgacact

SEQ ID NO: 727313 - DNA, 25 bp, Mus musculus
gttccaaaaggatgcgcccgacact

SEQ ID NO: 727314 - DNA, 25 bp, Mus musculus
gttccaaaaggtaagaggccataat

SEQ ID NO: 727315 - DNA, 25 bp, Mus musculus
gttccaaaaggttagaggccataat

SEQ ID NO: 727316 - DNA, 25 bp, Mus musculus
gttccaaaatggctccagatgattt

SEQ ID NO: 727317 - DNA, 25 bp, Mus musculus
gttccaaaatgggtccagatgattt

SEQ ID NO: 727318 - DNA, 25 bp, Mus musculus
gttccaaagcggctggtgcataaaa

SEQ ID NO: 727319 - DNA, 25 bp, Mus musculus
gttccaaagcgggtggtgcataaaa

SEQ ID NO: 727320 - DNA, 25 bp, Mus musculus
gttccaaagcttaagtgatgtaaga

SEQ ID NO: 727321 - DNA, 25 bp, Mus musculus
gttccaaagctttagtgatgtaaga

SEQ ID NO: 727322 - DNA, 25 bp, Mus musculus
gttccaaagttccatatcccaactt

SEQ ID NO: 727323 - DNA, 25 bp, Mus musculus
gttccaaagttcgatatcccaactt

SEQ ID NO: 727324 - DNA, 25 bp, Mus musculus
gttccaaatcatatttctgtctttc

SEQ ID NO: 727325 - DNA, 25 bp, Mus musculus
gttccaaatcatttttctgtctttc

SEQ ID NO: 727326 - DNA, 25 bp, Mus musculus
gttccaaatggtcctaactcctgtt

SEQ ID NO: 727327 - DNA, 25 bp, Mus musculus
gttccaaatggtcttgatgtcgatg

SEQ ID NO: 727328 - DNA, 25 bp, Mus musculus
gttccaaatggtgctaactcctgtt

SEQ ID NO: 727329 - DNA, 25 bp, Mus musculus
gttccaaatggtgttgatgtcgatg

SEQ ID NO: 727330 - DNA, 25 bp, Mus musculus
gttccaacaaatacccttgctatat

SEQ ID NO: 727331 - DNA, 25 bp, Mus musculus
gttccaacaaattcccttgctatat

SEQ ID NO: 727332 - DNA, 25 bp, Mus musculus
gttccaacatcacagacagatcgct

SEQ ID NO: 727333 - DNA, 25 bp, Mus musculus
gttccaacatcagagacagatcgct

SEQ ID NO: 727334 - DNA, 25 bp, Mus musculus
gttccaacatctatgacaggcagct

SEQ ID NO: 727335 - DNA, 25 bp, Mus musculus
gttccaacatctttgacaggcagct

SEQ ID NO: 727336 - DNA, 25 bp, Mus musculus
gttccaactgtaaatgctgtaaggc

SEQ ID NO: 727337 - DNA, 25 bp, Mus musculus
gttccaactgtatatgctgtaaggc

SEQ ID NO: 727338 - DNA, 25 bp, Mus musculus
gttccaacttaacctcagtaatgta

SEQ ID NO: 727339 - DNA, 25 bp, Mus musculus
gttccaacttaagctcagtaatgta

SEQ ID NO: 727340 - DNA, 25 bp, Mus musculus
gttccaactttgcactgtggagccg

SEQ ID NO: 727341 - DNA, 25 bp, Mus musculus
gttccaactttggactgtggagccg

SEQ ID NO: 727342 - DNA, 25 bp, Mus musculus
gttccaagagctcgcagtacaggca

SEQ ID NO: 727343 - DNA, 25 bp, Mus musculus
gttccaagagctggcagtacaggca

SEQ ID NO: 727344 - DNA, 25 bp, Mus musculus
gttccaagataactctgggcacaca

SEQ ID NO: 727345 - DNA, 25 bp, Mus musculus
gttccaagataagtctgggcacaca

SEQ ID NO: 727346 - DNA, 25 bp, Mus musculus
gttccaagatggctctgcaaagcac

SEQ ID NO: 727347 - DNA, 25 bp, Mus musculus
gttccaagatgggtctgcaaagcac

SEQ ID NO: 727348 - DNA, 25 bp, Mus musculus
gttccaagctccctgacaaaatgtc

SEQ ID NO: 727349 - DNA, 25 bp, Mus musculus
gttccaagctccgtgacaaaatgtc

SEQ ID NO: 727350 - DNA, 25 bp, Mus musculus
gttccaaggagcaggctttgaacct

SEQ ID NO: 727351 - DNA, 25 bp, Mus musculus
gttccaaggagctggctttgaacct

SEQ ID NO: 727352 - DNA, 25 bp, Mus musculus
gttccaaggagtcaactctgtaaac

SEQ ID NO: 727353 - DNA, 25 bp, Mus musculus
gttccaaggagtgaactctgtaaac

SEQ ID NO: 727354 - DNA, 25 bp, Mus musculus
gttccaagggatactggcttccaag

SEQ ID NO: 727355 - DNA, 25 bp, Mus musculus
gttccaagggatcctgtagtctctt

SEQ ID NO: 727356 - DNA, 25 bp, Mus musculus
gttccaagggatgctgtagtctctt

SEQ ID NO: 727357 - DNA, 25 bp, Mus musculus
gttccaagggattctggcttccaag

SEQ ID NO: 727358 - DNA, 25 bp, Mus musculus
gttccaaggtctctactttataaag

SEQ ID NO: 727359 - DNA, 25 bp, Mus musculus
gttccaaggtctgtactttataaag

SEQ ID NO: 727360 - DNA, 25 bp, Mus musculus
gttccaagtctcacttgtagcgctt

SEQ ID NO: 727361 - DNA, 25 bp, Mus musculus
gttccaagtctctcttgtagcgctt

SEQ ID NO: 727362 - DNA, 25 bp, Mus musculus
gttccaagttaacattttcaagctg

SEQ ID NO: 727363 - DNA, 25 bp, Mus musculus
gttccaagttaagattttcaagctg

SEQ ID NO: 727364 - DNA, 25 bp, Mus musculus
gttccaagtttgaatcattcctttg

SEQ ID NO: 727365 - DNA, 25 bp, Mus musculus
gttccaagtttgtatcattcctttg

SEQ ID NO: 727366 - DNA, 25 bp, Mus musculus
gttccaataacacgatctctttaag

SEQ ID NO: 727367 - DNA, 25 bp, Mus musculus
gttccaataacaggatctctttaag

SEQ ID NO: 727368 - DNA, 25 bp, Mus musculus
gttccaatacggaccagcaggcgag

SEQ ID NO: 727369 - DNA, 25 bp, Mus musculus
gttccaatacggtccagcaggcgag

SEQ ID NO: 727370 - DNA, 25 bp, Mus musculus
gttccaatagagcagctccgagagc

SEQ ID NO: 727371 - DNA, 25 bp, Mus musculus
gttccaatagaggagctccgagagc

SEQ ID NO: 727372 - DNA, 25 bp, Mus musculus
gttccaatcttaacttttgctattt

SEQ ID NO: 727373 - DNA, 25 bp, Mus musculus
gttccaatcttatcttttgctattt

SEQ ID NO: 727374 - DNA, 25 bp, Mus musculus
gttccaatcttcaatcttgtaggca

SEQ ID NO: 727375 - DNA, 25 bp, Mus musculus
gttccaatcttctatcttgtaggca

SEQ ID NO: 727376 - DNA, 25 bp, Mus musculus
gttccaatgaccagactgtgcgtgt

SEQ ID NO: 727377 - DNA, 25 bp, Mus musculus
gttccaatgacctgactgtgcgtgt

SEQ ID NO: 727378 - DNA, 25 bp, Mus musculus
gttccaatggaactcacctttctct

SEQ ID NO: 727379 - DNA, 25 bp, Mus musculus
gttccaatggaagtcacctttctct

SEQ ID NO: 727380 - DNA, 25 bp, Mus musculus
gttccaatgtcgaggcttcaggtgc

SEQ ID NO: 727381 - DNA, 25 bp, Mus musculus
gttccaatgtcgtggcttcaggtgc

SEQ ID NO: 727382 - DNA, 25 bp, Mus musculus
gttccaattttcaatgcatctccat

SEQ ID NO: 727383 - DNA, 25 bp, Mus musculus
gttccaattttctatgcatctccat

SEQ ID NO: 727384 - DNA, 25 bp, Mus musculus
gttccacaaacacaccacgttataa

SEQ ID NO: 727385 - DNA, 25 bp, Mus musculus
gttccacaaacagaccacgttataa

SEQ ID NO: 727386 - DNA, 25 bp, Mus musculus
gttccacaaattcccacaatggctg

SEQ ID NO: 727387 - DNA, 25 bp, Mus musculus
gttccacaaattgccacaatggctg

SEQ ID NO: 727388 - DNA, 25 bp, Mus musculus
gttccacaacagacagggttacata

SEQ ID NO: 727389 - DNA, 25 bp, Mus musculus
gttccacaacagtcagggttacata

SEQ ID NO: 727390 - DNA, 25 bp, Mus musculus
gttccacaagagaccattgctgaga

SEQ ID NO: 727391 - DNA, 25 bp, Mus musculus
gttccacaagagtccattgctgaga

SEQ ID NO: 727392 - DNA, 25 bp, Mus musculus
gttccacaagccatctcaggttgat

SEQ ID NO: 727393 - DNA, 25 bp, Mus musculus
gttccacaagccttctcaggttgat

SEQ ID NO: 727394 - DNA, 25 bp, Mus musculus
gttccacaagtcagagtactggact

SEQ ID NO: 727395 - DNA, 25 bp, Mus musculus
gttccacaagtctgagtactggact

SEQ ID NO: 727396 - DNA, 25 bp, Mus musculus
gttccacaatccagtgtgtcagacc

SEQ ID NO: 727397 - DNA, 25 bp, Mus musculus
gttccacaatcctgtgtgtcagacc

SEQ ID NO: 727398 - DNA, 25 bp, Mus musculus
gttccacacacgcttcaagcaagag

SEQ ID NO: 727399 - DNA, 25 bp, Mus musculus
gttccacacacggttcaagcaagag

SEQ ID NO: 727400 - DNA, 25 bp, Mus musculus
gttccacacatacaagtagtactgc

SEQ ID NO: 727401 - DNA, 25 bp, Mus musculus
gttccacacatagaagtagtactgc

SEQ ID NO: 727402 - DNA, 25 bp, Mus musculus
gttccacaccaacgctgtggcactg

SEQ ID NO: 727403 - DNA, 25 bp, Mus musculus
gttccacaccaaggctgtggcactg

SEQ ID NO: 727404 - DNA, 25 bp, Mus musculus
gttccacaccttcaggattcagaga

SEQ ID NO: 727405 - DNA, 25 bp, Mus musculus
gttccacaccttgaggattcagaga

SEQ ID NO: 727406 - DNA, 25 bp, Mus musculus
gttccacactaacaaggcaaaaaca

SEQ ID NO: 727407 - DNA, 25 bp, Mus musculus
gttccacactaagaaggcaaaaaca

SEQ ID NO: 727408 - DNA, 25 bp, Mus musculus
gttccacacttgagacacctggcaa

SEQ ID NO: 727409 - DNA, 25 bp, Mus musculus
gttccacacttgtgacacctggcaa

SEQ ID NO: 727410 - DNA, 25 bp, Mus musculus
gttccacagccgctaagcataagaa

SEQ ID NO: 727411 - DNA, 25 bp, Mus musculus
gttccacagccggtaagcataagaa

SEQ ID NO: 727412 - DNA, 25 bp, Mus musculus
gttccacaggagatcagatctcgaa

SEQ ID NO: 727413 - DNA, 25 bp, Mus musculus
gttccacaggagttcagatctcgaa

SEQ ID NO: 727414 - DNA, 25 bp, Mus musculus
gttccacagtagcaaagcctggagt

SEQ ID NO: 727415 - DNA, 25 bp, Mus musculus
gttccacagtaggaaagcctggagt

SEQ ID NO: 727416 - DNA, 25 bp, Mus musculus
gttccacagtgcctgctagagtatg

SEQ ID NO: 727417 - DNA, 25 bp, Mus musculus
gttccacagtgcgtgctagagtatg

SEQ ID NO: 727418 - DNA, 25 bp, Mus musculus
gttccacatcaacattgtatgactg

SEQ ID NO: 727419 - DNA, 25 bp, Mus musculus
gttccacatcaagattgtatgactg

SEQ ID NO: 727420 - DNA, 25 bp, Mus musculus
gttccacattctatatgatgggact

SEQ ID NO: 727421 - DNA, 25 bp, Mus musculus
gttccacattctttatgatgggact

SEQ ID NO: 727422 - DNA, 25 bp, Mus musculus
gttccaccaattcacagcagtgcct

SEQ ID NO: 727423 - DNA, 25 bp, Mus musculus
gttccaccaattgacagcagtgcct

SEQ ID NO: 727424 - DNA, 25 bp, Mus musculus
gttccaccacaacagaggctgctag

SEQ ID NO: 727425 - DNA, 25 bp, Mus musculus
gttccaccacaagagaggctgctag

SEQ ID NO: 727426 - DNA, 25 bp, Mus musculus
gttccaccagcaacatgtcaatttt

SEQ ID NO: 727427 - DNA, 25 bp, Mus musculus
gttccaccagcatcatgtcaatttt

SEQ ID NO: 727428 - DNA, 25 bp, Mus musculus
gttccaccaggcatcttgtataggg

SEQ ID NO: 727429 - DNA, 25 bp, Mus musculus
gttccaccaggcttcttgtataggg

SEQ ID NO: 727430 - DNA, 25 bp, Mus musculus
gttccaccaggtcaaggaagagctg

SEQ ID NO: 727431 - DNA, 25 bp, Mus musculus
gttccaccaggtgaaggaagagctg

SEQ ID NO: 727432 - DNA, 25 bp, Mus musculus
gttccaccatcaaacatgcagttgt

SEQ ID NO: 727433 - DNA, 25 bp, Mus musculus
gttccaccatcatacatgcagttgt

SEQ ID NO: 727434 - DNA, 25 bp, Mus musculus
gttccaccatgcattgacagtgacc

SEQ ID NO: 727435 - DNA, 25 bp, Mus musculus
gttccaccatgctttgacagtgacc

SEQ ID NO: 727436 - DNA, 25 bp, Mus musculus
gttccacccagcacggaaagtcaga

SEQ ID NO: 727437 - DNA, 25 bp, Mus musculus
gttccacccagctcggaaagtcaga

SEQ ID NO: 727438 - DNA, 25 bp, Mus musculus
gttccaccctacaatggagttctga

SEQ ID NO: 727439 - DNA, 25 bp, Mus musculus
gttccaccctactatggagttctga

SEQ ID NO: 727440 - DNA, 25 bp, Mus musculus
gttccaccgtgaccaccagcaagag

SEQ ID NO: 727441 - DNA, 25 bp, Mus musculus
gttccaccgtgagcaccagcaagag

SEQ ID NO: 727442 - DNA, 25 bp, Mus musculus
gttccaccgtttactgcatatgttg

SEQ ID NO: 727443 - DNA, 25 bp, Mus musculus
gttccaccgttttctgcatatgttg

SEQ ID NO: 727444 - DNA, 25 bp, Mus musculus
gttccacctctaattgtgcaggatt

SEQ ID NO: 727445 - DNA, 25 bp, Mus musculus
gttccacctctatttgtgcaggatt

SEQ ID NO: 727446 - DNA, 25 bp, Mus musculus
gttccacctcttcttgagagtgtca

SEQ ID NO: 727447 - DNA, 25 bp, Mus musculus
gttccacctcttgttgagagtgtca

SEQ ID NO: 727448 - DNA, 25 bp, Mus musculus
gttccacctggtattcactaagaga

SEQ ID NO: 727449 - DNA, 25 bp, Mus musculus
gttccacctggttttcactaagaga

SEQ ID NO: 727450 - DNA, 25 bp, Mus musculus
gttccacctgtgcacattttccaac

SEQ ID NO: 727451 - DNA, 25 bp, Mus musculus
gttccacctgtggacattttccaac

SEQ ID NO: 727452 - DNA, 25 bp, Mus musculus
gttccacctttgacaccttacaagt

SEQ ID NO: 727453 - DNA, 25 bp, Mus musculus
gttccacctttgtcaccttacaagt

SEQ ID NO: 727454 - DNA, 25 bp, Mus musculus
gttccacgatgccttccagtacgtc

SEQ ID NO: 727455 - DNA, 25 bp, Mus musculus
gttccacgatgcgttccagtacgtc

SEQ ID NO: 727456 - DNA, 25 bp, Mus musculus
gttccacggaatccaagcctgctgt

SEQ ID NO: 727457 - DNA, 25 bp, Mus musculus
gttccacggaatgcaagcctgctgt

SEQ ID NO: 727458 - DNA, 25 bp, Mus musculus
gttccactattactgagacccttgt

SEQ ID NO: 727459 - DNA, 25 bp, Mus musculus
gttccactattagtgagacccttgt

SEQ ID NO: 727460 - DNA, 25 bp, Mus musculus
gttccactatttactggcctccaaa

SEQ ID NO: 727461 - DNA, 25 bp, Mus musculus
gttccactattttctggcctccaaa

SEQ ID NO: 727462 - DNA, 25 bp, Mus musculus
gttccactccaaactgcaggatttt

SEQ ID NO: 727463 - DNA, 25 bp, Mus musculus
gttccactccaatctgcaggatttt

SEQ ID NO: 727464 - DNA, 25 bp, Mus musculus
gttccactctcgctcatttgtattt

SEQ ID NO: 727465 - DNA, 25 bp, Mus musculus
gttccactctcggtcatttgtattt

SEQ ID NO: 727466 - DNA, 25 bp, Mus musculus
gttccactctgcaaatttttaaggt

SEQ ID NO: 727467 - DNA, 25 bp, Mus musculus
gttccactctgctaatttttaaggt

SEQ ID NO: 727468 - DNA, 25 bp, Mus musculus
gttccactgaaaccatagccccagg

SEQ ID NO: 727469 - DNA, 25 bp, Mus musculus
gttccactgaaagcatagccccagg

SEQ ID NO: 727470 - DNA, 25 bp, Mus musculus
gttccactgaggatggcaggacctg

SEQ ID NO: 727471 - DNA, 25 bp, Mus musculus
gttccactgaggttggcaggacctg

SEQ ID NO: 727472 - DNA, 25 bp, Mus musculus
gttccactgattcaaattttcttct

SEQ ID NO: 727473 - DNA, 25 bp, Mus musculus
gttccactgattgaaattttcttct

SEQ ID NO: 727474 - DNA, 25 bp, Mus musculus
gttccactgggaattttccatgcaa

SEQ ID NO: 727475 - DNA, 25 bp, Mus musculus
gttccactgggatttttccatgcaa

SEQ ID NO: 727476 - DNA, 25 bp, Mus musculus
gttccactggtgacattgtgctgac

SEQ ID NO: 727477 - DNA, 25 bp, Mus musculus
gttccactggtgtcattgtgctgac

SEQ ID NO: 727478 - DNA, 25 bp, Mus musculus
gttccactgtagctataatttcgct

SEQ ID NO: 727479 - DNA, 25 bp, Mus musculus
gttccactgtaggtataatttcgct

SEQ ID NO: 727480 - DNA, 25 bp, Mus musculus
gttccactgtgtacattaaggcatg

SEQ ID NO: 727481 - DNA, 25 bp, Mus musculus
gttccactgtgttcattaaggcatg

SEQ ID NO: 727482 - DNA, 25 bp, Mus musculus
gttccacttccacattgaggacttt

SEQ ID NO: 727483 - DNA, 25 bp, Mus musculus
gttccacttccagattgaggacttt

SEQ ID NO: 727484 - DNA, 25 bp, Mus musculus
gttccacttctaaaaaggcagcagt

SEQ ID NO: 727485 - DNA, 25 bp, Mus musculus
gttccacttctataaaggcagcagt

SEQ ID NO: 727486 - DNA, 25 bp, Mus musculus
gttccacttgatcaagctacacctt

SEQ ID NO: 727487 - DNA, 25 bp, Mus musculus
gttccacttgatgaagctacacctt

SEQ ID NO: 727488 - DNA, 25 bp, Mus musculus
gttccagaaatgacaagcacctcct

SEQ ID NO: 727489 - DNA, 25 bp, Mus musculus
gttccagaaatgtcaagcacctcct

SEQ ID NO: 727490 - DNA, 25 bp, Mus musculus
gttccagaaccaccgagccaagatg

SEQ ID NO: 727491 - DNA, 25 bp, Mus musculus
gttccagaaccagcgagccaagatg

SEQ ID NO: 727492 - DNA, 25 bp, Mus musculus
gttccagaacccaacaaagcgtttg

SEQ ID NO: 727493 - DNA, 25 bp, Mus musculus
gttccagaaccctacaaagcgtttg

SEQ ID NO: 727494 - DNA, 25 bp, Mus musculus
gttccagaactcctctgtcattctc

SEQ ID NO: 727495 - DNA, 25 bp, Mus musculus
gttccagaactcgtctgtcattctc

SEQ ID NO: 727496 - DNA, 25 bp, Mus musculus
gttccagaagcaattcctgcagttt

SEQ ID NO: 727497 - DNA, 25 bp, Mus musculus
gttccagaagcatttcctgcagttt

SEQ ID NO: 727498 - DNA, 25 bp, Mus musculus
gttccagaatatcgctacctccaac

SEQ ID NO: 727499 - DNA, 25 bp, Mus musculus
gttccagaatatggctacctccaac

SEQ ID NO: 727500 - DNA, 25 bp, Mus musculus
gttccagaatgcagcagggtaactt

SEQ ID NO: 727501 - DNA, 25 bp, Mus musculus
gttccagaatgctgcagggtaactt

SEQ ID NO: 727502 - DNA, 25 bp, Mus musculus
gttccagaccagcttgaattacata

SEQ ID NO: 727503 - DNA, 25 bp, Mus musculus
gttccagaccaggttgaattacata

SEQ ID NO: 727504 - DNA, 25 bp, Mus musculus
gttccagaccatcttgggttacata

SEQ ID NO: 727505 - DNA, 25 bp, Mus musculus
gttccagaccatgttgggttacata

SEQ ID NO: 727506 - DNA, 25 bp, Mus musculus
gttccagacctccacactcaagaag

SEQ ID NO: 727507 - DNA, 25 bp, Mus musculus
gttccagacctcgacactcaagaag

SEQ ID NO: 727508 - DNA, 25 bp, Mus musculus
gttccagacgcgagctgatcttcag

SEQ ID NO: 727509 - DNA, 25 bp, Mus musculus
gttccagacgcgtgctgatcttcag

SEQ ID NO: 727510 - DNA, 25 bp, Mus musculus
gttccagactggaggtggaccttgt

SEQ ID NO: 727511 - DNA, 25 bp, Mus musculus
gttccagactggtggtggaccttgt

SEQ ID NO: 727512 - DNA, 25 bp, Mus musculus
gttccagaggagactccaagtccta

SEQ ID NO: 727513 - DNA, 25 bp, Mus musculus
gttccagaggagtctccaagtccta

SEQ ID NO: 727514 - DNA, 25 bp, Mus musculus
gttccagaggttctatccagggcaa

SEQ ID NO: 727515 - DNA, 25 bp, Mus musculus
gttccagaggttgtatccagggcaa

SEQ ID NO: 727516 - DNA, 25 bp, Mus musculus
gttccagagtatataatgacctttt

SEQ ID NO: 727517 - DNA, 25 bp, Mus musculus
gttccagagtatttaatgacctttt

SEQ ID NO: 727518 - DNA, 25 bp, Mus musculus
gttccagataccattgatgatgcct

SEQ ID NO: 727519 - DNA, 25 bp, Mus musculus
gttccagatacctttgatgatgcct

SEQ ID NO: 727520 - DNA, 25 bp, Mus musculus
gttccagatcacaatagaggcgaca

SEQ ID NO: 727521 - DNA, 25 bp, Mus musculus
gttccagatcactatagaggcgaca

SEQ ID NO: 727522 - DNA, 25 bp, Mus musculus
gttccagatcatatccatgatggtc

SEQ ID NO: 727523 - DNA, 25 bp, Mus musculus
gttccagatcatttccatgatggtc

SEQ ID NO: 727524 - DNA, 25 bp, Mus musculus
gttccagatcctaggaaacagttcc

SEQ ID NO: 727525 - DNA, 25 bp, Mus musculus
gttccagatccttggaaacagttcc

SEQ ID NO: 727526 - DNA, 25 bp, Mus musculus
gttccagatctgaccatttttctac

SEQ ID NO: 727527 - DNA, 25 bp, Mus musculus
gttccagatctgtccatttttctac

SEQ ID NO: 727528 - DNA, 25 bp, Mus musculus
gttccagatgctactgaccaagctt

SEQ ID NO: 727529 - DNA, 25 bp, Mus musculus
gttccagatgcttctgaccaagctt

SEQ ID NO: 727530 - DNA, 25 bp, Mus musculus
gttccagatgttagaatcctcagct

SEQ ID NO: 727531 - DNA, 25 bp, Mus musculus
gttccagatgtttgaatcctcagct

SEQ ID NO: 727532 - DNA, 25 bp, Mus musculus
gttccagattagcaaggactacgta

SEQ ID NO: 727533 - DNA, 25 bp, Mus musculus
gttccagattaggaaggactacgta

SEQ ID NO: 727534 - DNA, 25 bp, Mus musculus
gttccagcaacaaccttggtccagt

SEQ ID NO: 727535 - DNA, 25 bp, Mus musculus
gttccagcaacatccttggtccagt

SEQ ID NO: 727536 - DNA, 25 bp, Mus musculus
gttccagcacagatgatctagttgt

SEQ ID NO: 727537 - DNA, 25 bp, Mus musculus
gttccagcacagttgatctagttgt

SEQ ID NO: 727538 - DNA, 25 bp, Mus musculus
gttccagcacgaccagggctattta

SEQ ID NO: 727539 - DNA, 25 bp, Mus musculus
gttccagcacgagcagggctattta

SEQ ID NO: 727540 - DNA, 25 bp, Mus musculus
gttccagcagataaagcgtgagcct

SEQ ID NO: 727541 - DNA, 25 bp, Mus musculus
gttccagcagattaagcgtgagcct

SEQ ID NO: 727542 - DNA, 25 bp, Mus musculus
gttccagcagtgataaacttgcaat

SEQ ID NO: 727543 - DNA, 25 bp, Mus musculus
gttccagcagtgttaaacttgcaat

SEQ ID NO: 727544 - DNA, 25 bp, Mus musculus
gttccagcatgacccagtgacattt

SEQ ID NO: 727545 - DNA, 25 bp, Mus musculus
gttccagcatgagccagtgacattt

SEQ ID NO: 727546 - DNA, 25 bp, Mus musculus
gttccagcatgtagtgaagcagaca

SEQ ID NO: 727547 - DNA, 25 bp, Mus musculus
gttccagcatgttgtgaagcagaca

SEQ ID NO: 727548 - DNA, 25 bp, Mus musculus
gttccagcccatcaaggagatctgc

SEQ ID NO: 727549 - DNA, 25 bp, Mus musculus
gttccagcccatgaaggagatctgc

SEQ ID NO: 727550 - DNA, 25 bp, Mus musculus
gttccagcctaaccatgaatgagga

SEQ ID NO: 727551 - DNA, 25 bp, Mus musculus
gttccagcctaagcatgaatgagga

SEQ ID NO: 727552 - DNA, 25 bp, Mus musculus
gttccagcctgaaagcattgcttgt

SEQ ID NO: 727553 - DNA, 25 bp, Mus musculus
gttccagcctgatagcattgcttgt

SEQ ID NO: 727554 - DNA, 25 bp, Mus musculus
gttccagctcttctatcatttcatt

SEQ ID NO: 727555 - DNA, 25 bp, Mus musculus
gttccagctcttgtatcatttcatt

SEQ ID NO: 727556 - DNA, 25 bp, Mus musculus
gttccagctgaacgacagggacctg

SEQ ID NO: 727557 - DNA, 25 bp, Mus musculus
gttccagctgaaggacagggacctg

SEQ ID NO: 727558 - DNA, 25 bp, Mus musculus
gttccagctggaaccttggtgagga

SEQ ID NO: 727559 - DNA, 25 bp, Mus musculus
gttccagctggatccttggtgagga

SEQ ID NO: 727560 - DNA, 25 bp, Mus musculus
gttccagctgtgcaagatctgcgca

SEQ ID NO: 727561 - DNA, 25 bp, Mus musculus
gttccagctgtggaagatctgcgca

SEQ ID NO: 727562 - DNA, 25 bp, Mus musculus
gttccagcttcgccctgcacagaac

SEQ ID NO: 727563 - DNA, 25 bp, Mus musculus
gttccagcttcggcctgcacagaac

SEQ ID NO: 727564 - DNA, 25 bp, Mus musculus
gttccaggaaacaaccatgtctttg

SEQ ID NO: 727565 - DNA, 25 bp, Mus musculus
gttccaggaaactaccatgtctttg

SEQ ID NO: 727566 - DNA, 25 bp, Mus musculus
gttccaggaaatattcttcacattt

SEQ ID NO: 727567 - DNA, 25 bp, Mus musculus
gttccaggaaattttcttcacattt

SEQ ID NO: 727568 - DNA, 25 bp, Mus musculus
gttccaggaagacaaaccacagatg

SEQ ID NO: 727569 - DNA, 25 bp, Mus musculus
gttccaggaagactaacaaccatct

SEQ ID NO: 727570 - DNA, 25 bp, Mus musculus
gttccaggaagagaaaccacagatg

SEQ ID NO: 727571 - DNA, 25 bp, Mus musculus
gttccaggaagagtaacaaccatct

SEQ ID NO: 727572 - DNA, 25 bp, Mus musculus
gttccaggaaggctccaaggctgat

SEQ ID NO: 727573 - DNA, 25 bp, Mus musculus
gttccaggaagggtccaaggctgat

SEQ ID NO: 727574 - DNA, 25 bp, Mus musculus
gttccaggacatccaggactgccca

SEQ ID NO: 727575 - DNA, 25 bp, Mus musculus
gttccaggacatgcaggactgccca

SEQ ID NO: 727576 - DNA, 25 bp, Mus musculus
gttccaggaccactatggcgagttc

SEQ ID NO: 727577 - DNA, 25 bp, Mus musculus
gttccaggaccagtatggcgagttc

SEQ ID NO: 727578 - DNA, 25 bp, Mus musculus
gttccaggacctatacacagacaga

SEQ ID NO: 727579 - DNA, 25 bp, Mus musculus
gttccaggacctttacacagacaga

SEQ ID NO: 727580 - DNA, 25 bp, Mus musculus
gttccaggagaactgactcagtcac

SEQ ID NO: 727581 - DNA, 25 bp, Mus musculus
gttccaggagaagtgactcagtcac

SEQ ID NO: 727582 - DNA, 25 bp, Mus musculus
gttccaggagtgctcaaggtgactt

SEQ ID NO: 727583 - DNA, 25 bp, Mus musculus
gttccaggagtggtcaaggtgactt

SEQ ID NO: 727584 - DNA, 25 bp, Mus musculus
gttccaggatgacctatacccagac

SEQ ID NO: 727585 - DNA, 25 bp, Mus musculus
gttccaggatgagctatacccagac

SEQ ID NO: 727586 - DNA, 25 bp, Mus musculus
gttccaggatttaaccattatacta

SEQ ID NO: 727587 - DNA, 25 bp, Mus musculus
gttccaggattttaccattatacta

SEQ ID NO: 727588 - DNA, 25 bp, Mus musculus
gttccaggcagcactggatggatat

SEQ ID NO: 727589 - DNA, 25 bp, Mus musculus
gttccaggcagctctggatggatat

SEQ ID NO: 727590 - DNA, 25 bp, Mus musculus
gttccaggcaggatggtttctgtaa

SEQ ID NO: 727591 - DNA, 25 bp, Mus musculus
gttccaggcaggttggtttctgtaa

SEQ ID NO: 727592 - DNA, 25 bp, Mus musculus
gttccaggcatcatcacagtcatag

SEQ ID NO: 727593 - DNA, 25 bp, Mus musculus
gttccaggcatcttcacagtcatag

SEQ ID NO: 727594 - DNA, 25 bp, Mus musculus
gttccaggcattccttaactactac

SEQ ID NO: 727595 - DNA, 25 bp, Mus musculus
gttccaggcattgcttaactactac

SEQ ID NO: 727596 - DNA, 25 bp, Mus musculus
gttccaggccggattggtctacaga

SEQ ID NO: 727597 - DNA, 25 bp, Mus musculus
gttccaggccggtttggtctacaga

SEQ ID NO: 727598 - DNA, 25 bp, Mus musculus
gttccaggcctgaatcatgtgttat

SEQ ID NO: 727599 - DNA, 25 bp, Mus musculus
gttccaggcctgtatcatgtgttat

SEQ ID NO: 727600 - DNA, 25 bp, Mus musculus
gttccaggcgctacgaagagcaaga

SEQ ID NO: 727601 - DNA, 25 bp, Mus musculus
gttccaggcgcttcgaagagcaaga

SEQ ID NO: 727602 - DNA, 25 bp, Mus musculus
gttccaggctgccacgccgatctaa

SEQ ID NO: 727603 - DNA, 25 bp, Mus musculus
gttccaggctgcgacgccgatctaa

SEQ ID NO: 727604 - DNA, 25 bp, Mus musculus
gttccaggctgtcatgatcagtcat

SEQ ID NO: 727605 - DNA, 25 bp, Mus musculus
gttccaggctgtgatgatcagtcat

SEQ ID NO: 727606 - DNA, 25 bp, Mus musculus
gttccagggctaaatagacaggcac

SEQ ID NO: 727607 - DNA, 25 bp, Mus musculus
gttccagggctatatagacaggcac

SEQ ID NO: 727608 - DNA, 25 bp, Mus musculus
gttccaggtacaccgcagtgcgtta

SEQ ID NO: 727609 - DNA, 25 bp, Mus musculus
gttccaggtacagcgcagtgcgtta

SEQ ID NO: 727610 - DNA, 25 bp, Mus musculus
gttccaggtagacggacagcctcca

SEQ ID NO: 727611 - DNA, 25 bp, Mus musculus
gttccaggtagagggacagcctcca

SEQ ID NO: 727612 - DNA, 25 bp, Mus musculus
gttccaggtgcacgatagtctttcc

SEQ ID NO: 727613 - DNA, 25 bp, Mus musculus
gttccaggtgcaggatagtctttcc

SEQ ID NO: 727614 - DNA, 25 bp, Mus musculus
gttccaggtgctagtcatcctgacc

SEQ ID NO: 727615 - DNA, 25 bp, Mus musculus
gttccaggtgcttgtcatcctgacc

SEQ ID NO: 727616 - DNA, 25 bp, Mus musculus
gttccaggttccaccaggattgagg

SEQ ID NO: 727617 - DNA, 25 bp, Mus musculus
gttccaggttccactggtgacattg

SEQ ID NO: 727618 - DNA, 25 bp, Mus musculus
gttccaggttcctccaggattgagg

SEQ ID NO: 727619 - DNA, 25 bp, Mus musculus
gttccaggttcctctggtgacattg

SEQ ID NO: 727620 - DNA, 25 bp, Mus musculus
gttccaggtttaagtgtgagcctaa

SEQ ID NO: 727621 - DNA, 25 bp, Mus musculus
gttccaggtttatgtgtgagcctaa

SEQ ID NO: 727622 - DNA, 25 bp, Mus musculus
gttccagtacgtcttgattgcagct

SEQ ID NO: 727623 - DNA, 25 bp, Mus musculus
gttccagtacgtgttgattgcagct

SEQ ID NO: 727624 - DNA, 25 bp, Mus musculus
gttccagtactgctctgctgtgaaa

SEQ ID NO: 727625 - DNA, 25 bp, Mus musculus
gttccagtactggtctgctgtgaaa

SEQ ID NO: 727626 - DNA, 25 bp, Mus musculus
gttccagtatctccagtttacccag

SEQ ID NO: 727627 - DNA, 25 bp, Mus musculus
gttccagtatctgcagtttacccag

SEQ ID NO: 727628 - DNA, 25 bp, Mus musculus
gttccagtcaagatgtggttttaga

SEQ ID NO: 727629 - DNA, 25 bp, Mus musculus
gttccagtcaagttgtggttttaga

SEQ ID NO: 727630 - DNA, 25 bp, Mus musculus
gttccagtcacaaatgtggagccag

SEQ ID NO: 727631 - DNA, 25 bp, Mus musculus
gttccagtcacatatgtggagccag

SEQ ID NO: 727632 - DNA, 25 bp, Mus musculus
gttccagtcagacccaacactttta

SEQ ID NO: 727633 - DNA, 25 bp, Mus musculus
gttccagtcagagccaacactttta

SEQ ID NO: 727634 - DNA, 25 bp, Mus musculus
gttccagtcccgagacatgtgaaca

SEQ ID NO: 727635 - DNA, 25 bp, Mus musculus
gttccagtcccgtgacatgtgaaca

SEQ ID NO: 727636 - DNA, 25 bp, Mus musculus
gttccagtctgaagctagagtccgt

SEQ ID NO: 727637 - DNA, 25 bp, Mus musculus
gttccagtctgactttgaagtccat

SEQ ID NO: 727638 - DNA, 25 bp, Mus musculus
gttccagtctgagtttgaagtccat

SEQ ID NO: 727639 - DNA, 25 bp, Mus musculus
gttccagtctgatgctagagtccgt

SEQ ID NO: 727640 - DNA, 25 bp, Mus musculus
gttccagtgatcagtatgtgatgag

SEQ ID NO: 727641 - DNA, 25 bp, Mus musculus
gttccagtgatctgtatgtgatgag

SEQ ID NO: 727642 - DNA, 25 bp, Mus musculus
gttccagtgcatacttctgacattt

SEQ ID NO: 727643 - DNA, 25 bp, Mus musculus
gttccagtgcattcttctgacattt

SEQ ID NO: 727644 - DNA, 25 bp, Mus musculus
gttccagtgcgtaagtcaaactact

SEQ ID NO: 727645 - DNA, 25 bp, Mus musculus
gttccagtgcgttagtcaaactact

SEQ ID NO: 727646 - DNA, 25 bp, Mus musculus
gttccagtgtctacacaatgtagtg

SEQ ID NO: 727647 - DNA, 25 bp, Mus musculus
gttccagtgtcttcacaatgtagtg

SEQ ID NO: 727648 - DNA, 25 bp, Mus musculus
gttccagttacgatgtcttccagtt

SEQ ID NO: 727649 - DNA, 25 bp, Mus musculus
gttccagttacgttgtcttccagtt

SEQ ID NO: 727650 - DNA, 25 bp, Mus musculus
gttccagttcacctggagagaggca

SEQ ID NO: 727651 - DNA, 25 bp, Mus musculus
gttccagttcacgtggagagaggca

SEQ ID NO: 727652 - DNA, 25 bp, Mus musculus
gttccagttccacctcaagtcctag

SEQ ID NO: 727653 - DNA, 25 bp, Mus musculus
gttccagttccagctcaagtcctag

SEQ ID NO: 727654 - DNA, 25 bp, Mus musculus
gttccagttctacttccagcagaag

SEQ ID NO: 727655 - DNA, 25 bp, Mus musculus
gttccagttctagttccagcagaag

SEQ ID NO: 727656 - DNA, 25 bp, Mus musculus
gttccagttgtcaggcctgaacagc

SEQ ID NO: 727657 - DNA, 25 bp, Mus musculus
gttccagttgtctggcctgaacagc

SEQ ID NO: 727658 - DNA, 25 bp, Mus musculus
gttccataagaactgcatctccagt

SEQ ID NO: 727659 - DNA, 25 bp, Mus musculus
gttccataagaagtgcatctccagt

SEQ ID NO: 727660 - DNA, 25 bp, Mus musculus
gttccataagccacagatacctgac

SEQ ID NO: 727661 - DNA, 25 bp, Mus musculus
gttccataagcctcagatacctgac

SEQ ID NO: 727662 - DNA, 25 bp, Mus musculus
gttccataatgacttcccagccaga

SEQ ID NO: 727663 - DNA, 25 bp, Mus musculus
gttccataatgagttcccagccaga

SEQ ID NO: 727664 - DNA, 25 bp, Mus musculus
gttccatacacaatgactgtcatgt

SEQ ID NO: 727665 - DNA, 25 bp, Mus musculus
gttccatacacattgactgtcatgt

SEQ ID NO: 727666 - DNA, 25 bp, Mus musculus
gttccataccacagggccgttgtcc

SEQ ID NO: 727667 - DNA, 25 bp, Mus musculus
gttccataccactgggccgttgtcc

SEQ ID NO: 727668 - DNA, 25 bp, Mus musculus
gttccataggaaccatgcctacctg

SEQ ID NO: 727669 - DNA, 25 bp, Mus musculus
gttccataggaagcatgcctacctg

SEQ ID NO: 727670 - DNA, 25 bp, Mus musculus
gttccatagggaagcggcactatta

SEQ ID NO: 727671 - DNA, 25 bp, Mus musculus
gttccatagggatgcggcactatta

SEQ ID NO: 727672 - DNA, 25 bp, Mus musculus
gttccatatacaaggtcgtgccttg

SEQ ID NO: 727673 - DNA, 25 bp, Mus musculus
gttccatatacatggtcgtgccttg

SEQ ID NO: 727674 - DNA, 25 bp, Mus musculus
gttccatatcacatgacctcagtag

SEQ ID NO: 727675 - DNA, 25 bp, Mus musculus
gttccatatcacttgacctcagtag

SEQ ID NO: 727676 - DNA, 25 bp, Mus musculus
gttccatatcatccagtgaattaca

SEQ ID NO: 727677 - DNA, 25 bp, Mus musculus
gttccatatcatgcagtgaattaca

SEQ ID NO: 727678 - DNA, 25 bp, Mus musculus
gttccatatcgcatccgagtacgct

SEQ ID NO: 727679 - DNA, 25 bp, Mus musculus
gttccatatcgcatttagacgtctt

SEQ ID NO: 727680 - DNA, 25 bp, Mus musculus
gttccatatcgcttccgagtacgct

SEQ ID NO: 727681 - DNA, 25 bp, Mus musculus
gttccatatcgcttttagacgtctt

SEQ ID NO: 727682 - DNA, 25 bp, Mus musculus
gttccatatgcaactctattgacca

SEQ ID NO: 727683 - DNA, 25 bp, Mus musculus
gttccatatgcatctctattgacca

SEQ ID NO: 727684 - DNA, 25 bp, Mus musculus
gttccatatgggagttgaccgtcct

SEQ ID NO: 727685 - DNA, 25 bp, Mus musculus
gttccatatgggtgttgaccgtcct

SEQ ID NO: 727686 - DNA, 25 bp, Mus musculus
gttccatattttctcgtggcatcat

SEQ ID NO: 727687 - DNA, 25 bp, Mus musculus
gttccatattttgtcgtggcatcat

SEQ ID NO: 727688 - DNA, 25 bp, Mus musculus
gttccatcaaaccttgtgagctttg

SEQ ID NO: 727689 - DNA, 25 bp, Mus musculus
gttccatcaaacgttgtgagctttg

SEQ ID NO: 727690 - DNA, 25 bp, Mus musculus
gttccatcaatgagacttgcttcaa

SEQ ID NO: 727691 - DNA, 25 bp, Mus musculus
gttccatcaatgtgacttgcttcaa

SEQ ID NO: 727692 - DNA, 25 bp, Mus musculus
gttccatcacctacacagtatttat

SEQ ID NO: 727693 - DNA, 25 bp, Mus musculus
gttccatcaccttcacagtatttat

SEQ ID NO: 727694 - DNA, 25 bp, Mus musculus
gttccatcacggactgacagtctta

SEQ ID NO: 727695 - DNA, 25 bp, Mus musculus
gttccatcacggtctgacagtctta

SEQ ID NO: 727696 - DNA, 25 bp, Mus musculus
gttccatcactcaaatagaaagaag

SEQ ID NO: 727697 - DNA, 25 bp, Mus musculus
gttccatcactcaaggctctgaaga

SEQ ID NO: 727698 - DNA, 25 bp, Mus musculus
gttccatcactctaatagaaagaag

SEQ ID NO: 727699 - DNA, 25 bp, Mus musculus
gttccatcactctaggctctgaaga

SEQ ID NO: 727700 - DNA, 25 bp, Mus musculus
gttccatcagaactccagctcaggg

SEQ ID NO: 727701 - DNA, 25 bp, Mus musculus
gttccatcagaagtccagctcaggg

SEQ ID NO: 727702 - DNA, 25 bp, Mus musculus
gttccatcagccctaccgggcgatg

SEQ ID NO: 727703 - DNA, 25 bp, Mus musculus
gttccatcagccgtaccgggcgatg

SEQ ID NO: 727704 - DNA, 25 bp, Mus musculus
gttccatcaggtctgtagcatgcat

SEQ ID NO: 727705 - DNA, 25 bp, Mus musculus
gttccatcaggtgtgtagcatgcat

SEQ ID NO: 727706 - DNA, 25 bp, Mus musculus
gttccatcatcaaaatatttttcct

SEQ ID NO: 727707 - DNA, 25 bp, Mus musculus
gttccatcatcataatatttttcct

SEQ ID NO: 727708 - DNA, 25 bp, Mus musculus
gttccatcatccacagaccatgtaa

SEQ ID NO: 727709 - DNA, 25 bp, Mus musculus
gttccatcatcctcagaccatgtaa

SEQ ID NO: 727710 - DNA, 25 bp, Mus musculus
gttccatcatggcatagtctctgaa

SEQ ID NO: 727711 - DNA, 25 bp, Mus musculus
gttccatcatgggatagtctctgaa

SEQ ID NO: 727712 - DNA, 25 bp, Mus musculus
gttccatccaagcactcaacagagg

SEQ ID NO: 727713 - DNA, 25 bp, Mus musculus
gttccatccaaggactcaacagagg

SEQ ID NO: 727714 - DNA, 25 bp, Mus musculus
gttccatccctcataggaagagtaa

SEQ ID NO: 727715 - DNA, 25 bp, Mus musculus
gttccatccctcttaggaagagtaa

SEQ ID NO: 727716 - DNA, 25 bp, Mus musculus
gttccatcctaacgtctatgcagat

SEQ ID NO: 727717 - DNA, 25 bp, Mus musculus
gttccatcctaaggtctatgcagat

SEQ ID NO: 727718 - DNA, 25 bp, Mus musculus
gttccatcctttagtaatgcctttg

SEQ ID NO: 727719 - DNA, 25 bp, Mus musculus
gttccatccttttgtaatgcctttg

SEQ ID NO: 727720 - DNA, 25 bp, Mus musculus
gttccatctcatacgggatgtcaag

SEQ ID NO: 727721 - DNA, 25 bp, Mus musculus
gttccatctcattcgggatgtcaag

SEQ ID NO: 727722 - DNA, 25 bp, Mus musculus
gttccatctgcacattatagggttt

SEQ ID NO: 727723 - DNA, 25 bp, Mus musculus
gttccatctgcagattatagggttt

SEQ ID NO: 727724 - DNA, 25 bp, Mus musculus
gttccatctgggacaatccgagaga

SEQ ID NO: 727725 - DNA, 25 bp, Mus musculus
gttccatctgggtcaatccgagaga

SEQ ID NO: 727726 - DNA, 25 bp, Mus musculus
gttccatcttctcaggccagcaaag

SEQ ID NO: 727727 - DNA, 25 bp, Mus musculus
gttccatcttctgaggccagcaaag

SEQ ID NO: 727728 - DNA, 25 bp, Mus musculus
gttccatgaaaccttcgcagagatg

SEQ ID NO: 727729 - DNA, 25 bp, Mus musculus
gttccatgaaacgttcgcagagatg

SEQ ID NO: 727730 - DNA, 25 bp, Mus musculus
gttccatgaactcaagagcatcaca

SEQ ID NO: 727731 - DNA, 25 bp, Mus musculus
gttccatgaactgaagagcatcaca

SEQ ID NO: 727732 - DNA, 25 bp, Mus musculus
gttccatgaattcgcggatgtggtt

SEQ ID NO: 727733 - DNA, 25 bp, Mus musculus
gttccatgaattggcggatgtggtt

SEQ ID NO: 727734 - DNA, 25 bp, Mus musculus
gttccatgactcaagagggcagcct

SEQ ID NO: 727735 - DNA, 25 bp, Mus musculus
gttccatgactctagagggcagcct

SEQ ID NO: 727736 - DNA, 25 bp, Mus musculus
gttccatgatgtaacctataccgag

SEQ ID NO: 727737 - DNA, 25 bp, Mus musculus
gttccatgatgttacctataccgag

SEQ ID NO: 727738 - DNA, 25 bp, Mus musculus
gttccatgcctgcaaactatttcat

SEQ ID NO: 727739 - DNA, 25 bp, Mus musculus
gttccatgcctggaaactatttcat

SEQ ID NO: 727740 - DNA, 25 bp, Mus musculus
gttccatgctgactcgccagtggca

SEQ ID NO: 727741 - DNA, 25 bp, Mus musculus
gttccatgctgagtcgccagtggca

SEQ ID NO: 727742 - DNA, 25 bp, Mus musculus
gttccatgctggatgatgtgtttta

SEQ ID NO: 727743 - DNA, 25 bp, Mus musculus
gttccatgctggttgatgtgtttta

SEQ ID NO: 727744 - DNA, 25 bp, Mus musculus
gttccatgcttgaatttctttgtag

SEQ ID NO: 727745 - DNA, 25 bp, Mus musculus
gttccatgcttgtatttctttgtag

SEQ ID NO: 727746 - DNA, 25 bp, Mus musculus
gttccatggagtcatcaggctggca

SEQ ID NO: 727747 - DNA, 25 bp, Mus musculus
gttccatggagtgatcaggctggca

SEQ ID NO: 727748 - DNA, 25 bp, Mus musculus
gttccatggcctaaagaaccaccag

SEQ ID NO: 727749 - DNA, 25 bp, Mus musculus
gttccatggccttaagaaccaccag

SEQ ID NO: 727750 - DNA, 25 bp, Mus musculus
gttccatgtaaacctgctatgcggt

SEQ ID NO: 727751 - DNA, 25 bp, Mus musculus
gttccatgtaaagctgctatgcggt

SEQ ID NO: 727752 - DNA, 25 bp, Mus musculus
gttccatgtaacagattttttccca

SEQ ID NO: 727753 - DNA, 25 bp, Mus musculus
gttccatgtaactgattttttccca

SEQ ID NO: 727754 - DNA, 25 bp, Mus musculus
gttccatgtgacagggagtaaggaa

SEQ ID NO: 727755 - DNA, 25 bp, Mus musculus
gttccatgtgactgggagtaaggaa

SEQ ID NO: 727756 - DNA, 25 bp, Mus musculus
gttccatgttacagaccagtgtcta

SEQ ID NO: 727757 - DNA, 25 bp, Mus musculus
gttccatgttactgaccagtgtcta

SEQ ID NO: 727758 - DNA, 25 bp, Mus musculus
gttccatgttcaatcttagataccc

SEQ ID NO: 727759 - DNA, 25 bp, Mus musculus
gttccatgttcattcttagataccc

SEQ ID NO: 727760 - DNA, 25 bp, Mus musculus
gttccattaatcatgacctatgctg

SEQ ID NO: 727761 - DNA, 25 bp, Mus musculus
gttccattaatcttgacctatgctg

SEQ ID NO: 727762 - DNA, 25 bp, Mus musculus
gttccattactcctacctaaattgg

SEQ ID NO: 727763 - DNA, 25 bp, Mus musculus
gttccattactcgtacctaaattgg

SEQ ID NO: 727764 - DNA, 25 bp, Mus musculus
gttccattcaacagatgcctgtggt

SEQ ID NO: 727765 - DNA, 25 bp, Mus musculus
gttccattcaactgatgcctgtggt

SEQ ID NO: 727766 - DNA, 25 bp, Mus musculus
gttccattccaactgctctggaaaa

SEQ ID NO: 727767 - DNA, 25 bp, Mus musculus
gttccattccaagtgctctggaaaa

SEQ ID NO: 727768 - DNA, 25 bp, Mus musculus
gttccattcccacatatgaaagtat

SEQ ID NO: 727769 - DNA, 25 bp, Mus musculus
gttccattcccagatatgaaagtat

SEQ ID NO: 727770 - DNA, 25 bp, Mus musculus
gttccattcgatccagcctatacaa

SEQ ID NO: 727771 - DNA, 25 bp, Mus musculus
gttccattcgatgcagcctatacaa

SEQ ID NO: 727772 - DNA, 25 bp, Mus musculus
gttccattgcatcagaccttttagt

SEQ ID NO: 727773 - DNA, 25 bp, Mus musculus
gttccattgcatgagaccttttagt

SEQ ID NO: 727774 - DNA, 25 bp, Mus musculus
gttccattgttcagtatgacatttt

SEQ ID NO: 727775 - DNA, 25 bp, Mus musculus
gttccattgttctgtatgacatttt

SEQ ID NO: 727776 - DNA, 25 bp, Mus musculus
gttccatttaacactagctggtttg

SEQ ID NO: 727777 - DNA, 25 bp, Mus musculus
gttccatttaactctagctggtttg

SEQ ID NO: 727778 - DNA, 25 bp, Mus musculus
gttcccaaaaccaagttgttgctat

SEQ ID NO: 727779 - DNA, 25 bp, Mus musculus
gttcccaaaacctagttgttgctat

SEQ ID NO: 727780 - DNA, 25 bp, Mus musculus
gttcccaaaaggcttgagtcatgac

SEQ ID NO: 727781 - DNA, 25 bp, Mus musculus
gttcccaaaagggttgagtcatgac

SEQ ID NO: 727782 - DNA, 25 bp, Mus musculus
gttcccaaaccacggccaaggagtg

SEQ ID NO: 727783 - DNA, 25 bp, Mus musculus
gttcccaaaccagggccaaggagtg

SEQ ID NO: 727784 - DNA, 25 bp, Mus musculus
gttcccaaactaatgagccatcctt

SEQ ID NO: 727785 - DNA, 25 bp, Mus musculus
gttcccaaactattgagccatcctt

SEQ ID NO: 727786 - DNA, 25 bp, Mus musculus
gttcccaaagagacccaaatagtgc

SEQ ID NO: 727787 - DNA, 25 bp, Mus musculus
gttcccaaagagtcccaaatagtgc

SEQ ID NO: 727788 - DNA, 25 bp, Mus musculus
gttcccaaagctcgcatgtttctat

SEQ ID NO: 727789 - DNA, 25 bp, Mus musculus
gttcccaaagctggcatgtttctat

SEQ ID NO: 727790 - DNA, 25 bp, Mus musculus
gttcccaaagttatccatggcttca

SEQ ID NO: 727791 - DNA, 25 bp, Mus musculus
gttcccaaagttttccatggcttca

SEQ ID NO: 727792 - DNA, 25 bp, Mus musculus
gttcccaaataaactcagtgaggct

SEQ ID NO: 727793 - DNA, 25 bp, Mus musculus
gttcccaaataatctcagtgaggct

SEQ ID NO: 727794 - DNA, 25 bp, Mus musculus
gttcccaaatatatataggcagctt

SEQ ID NO: 727795 - DNA, 25 bp, Mus musculus
gttcccaaatatccgaggataactt

SEQ ID NO: 727796 - DNA, 25 bp, Mus musculus
gttcccaaatatgcgaggataactt

SEQ ID NO: 727797 - DNA, 25 bp, Mus musculus
gttcccaaatatttataggcagctt

SEQ ID NO: 727798 - DNA, 25 bp, Mus musculus
gttcccaaatcccagcccaagaaat

SEQ ID NO: 727799 - DNA, 25 bp, Mus musculus
gttcccaaatccgagcccaagaaat

SEQ ID NO: 727800 - DNA, 25 bp, Mus musculus
gttcccaaattcaaggctttccttg

SEQ ID NO: 727801 - DNA, 25 bp, Mus musculus
gttcccaaattctaggctttccttg

SEQ ID NO: 727802 - DNA, 25 bp, Mus musculus
gttcccaacactagctttaagtctt

SEQ ID NO: 727803 - DNA, 25 bp, Mus musculus
gttcccaacacttgctttaagtctt

SEQ ID NO: 727804 - DNA, 25 bp, Mus musculus
gttcccaacccaccttctaagtaat

SEQ ID NO: 727805 - DNA, 25 bp, Mus musculus
gttcccaacccagcttctaagtaat

SEQ ID NO: 727806 - DNA, 25 bp, Mus musculus
gttcccaactctacttcaaagtgtt

SEQ ID NO: 727807 - DNA, 25 bp, Mus musculus
gttcccaactcttcttcaaagtgtt

SEQ ID NO: 727808 - DNA, 25 bp, Mus musculus
gttcccaataatccctgtggctaag

SEQ ID NO: 727809 - DNA, 25 bp, Mus musculus
gttcccaataatgcctgtggctaag

SEQ ID NO: 727810 - DNA, 25 bp, Mus musculus
gttcccaatgtgaagacggacttat

SEQ ID NO: 727811 - DNA, 25 bp, Mus musculus
gttcccaatgtgtagacggacttat

SEQ ID NO: 727812 - DNA, 25 bp, Mus musculus
gttcccacaacacagactgttgaga

SEQ ID NO: 727813 - DNA, 25 bp, Mus musculus
gttcccacaacagagactgttgaga

SEQ ID NO: 727814 - DNA, 25 bp, Mus musculus
gttcccacacagatgcagcacaagt

SEQ ID NO: 727815 - DNA, 25 bp, Mus musculus
gttcccacacagttgcagcacaagt

SEQ ID NO: 727816 - DNA, 25 bp, Mus musculus
gttcccacagcacagagccggtgtg

SEQ ID NO: 727817 - DNA, 25 bp, Mus musculus
gttcccacagcagagagccggtgtg

SEQ ID NO: 727818 - DNA, 25 bp, Mus musculus
gttcccacaggaaacagtcagactc

SEQ ID NO: 727819 - DNA, 25 bp, Mus musculus
gttcccacaggatacagtcagactc

SEQ ID NO: 727820 - DNA, 25 bp, Mus musculus
gttcccacagttacagaaacagaag

SEQ ID NO: 727821 - DNA, 25 bp, Mus musculus
gttcccacagtttcagaaacagaag

SEQ ID NO: 727822 - DNA, 25 bp, Mus musculus
gttcccacatgtatcctgaatgtcc

SEQ ID NO: 727823 - DNA, 25 bp, Mus musculus
gttcccacatgtttcctgaatgtcc

SEQ ID NO: 727824 - DNA, 25 bp, Mus musculus
gttcccaccagcagggactgggaga

SEQ ID NO: 727825 - DNA, 25 bp, Mus musculus
gttcccaccagctgggactgggaga

SEQ ID NO: 727826 - DNA, 25 bp, Mus musculus
gttcccaccctgcacagttaagaga

SEQ ID NO: 727827 - DNA, 25 bp, Mus musculus
gttcccaccctggacagttaagaga

SEQ ID NO: 727828 - DNA, 25 bp, Mus musculus
gttcccaccttacctgaaggcatta

SEQ ID NO: 727829 - DNA, 25 bp, Mus musculus
gttcccaccttagctgaaggcatta

SEQ ID NO: 727830 - DNA, 25 bp, Mus musculus
gttcccactcctcctgtgttaataa

SEQ ID NO: 727831 - DNA, 25 bp, Mus musculus
gttcccactcctgctgtgttaataa

SEQ ID NO: 727832 - DNA, 25 bp, Mus musculus
gttcccactgccaggtaatgagcta

SEQ ID NO: 727833 - DNA, 25 bp, Mus musculus
gttcccactgcctggtaatgagcta

SEQ ID NO: 727834 - DNA, 25 bp, Mus musculus
gttcccactgtcagcgagaagaggc

SEQ ID NO: 727835 - DNA, 25 bp, Mus musculus
gttcccactgtctgcgagaagaggc

SEQ ID NO: 727836 - DNA, 25 bp, Mus musculus
gttcccacttgtccaaagcaactgc

SEQ ID NO: 727837 - DNA, 25 bp, Mus musculus
gttcccacttgtgcaaagcaactgc

SEQ ID NO: 727838 - DNA, 25 bp, Mus musculus
gttcccagaaacctttacaggagat

SEQ ID NO: 727839 - DNA, 25 bp, Mus musculus
gttcccagaaacgtttacaggagat

SEQ ID NO: 727840 - DNA, 25 bp, Mus musculus
gttcccagaacactcctgaactctt

SEQ ID NO: 727841 - DNA, 25 bp, Mus musculus
gttcccagaacagtcctgaactctt

SEQ ID NO: 727842 - DNA, 25 bp, Mus musculus
gttcccagaactcgactggtttcag

SEQ ID NO: 727843 - DNA, 25 bp, Mus musculus
gttcccagaactctatgtctatgag

SEQ ID NO: 727844 - DNA, 25 bp, Mus musculus
gttcccagaactggactggtttcag

SEQ ID NO: 727845 - DNA, 25 bp, Mus musculus
gttcccagaactgtatgtctatgag

SEQ ID NO: 727846 - DNA, 25 bp, Mus musculus
gttcccagaatccaaatatcacaca

SEQ ID NO: 727847 - DNA, 25 bp, Mus musculus
gttcccagaatcgaaatatcacaca

SEQ ID NO: 727848 - DNA, 25 bp, Mus musculus
gttcccagacggaccagttttgagg

SEQ ID NO: 727849 - DNA, 25 bp, Mus musculus
gttcccagacggtccagttttgagg

SEQ ID NO: 727850 - DNA, 25 bp, Mus musculus
gttcccagagaaagtacttttgctt

SEQ ID NO: 727851 - DNA, 25 bp, Mus musculus
gttcccagagaatgtacttttgctt

SEQ ID NO: 727852 - DNA, 25 bp, Mus musculus
gttcccagagccactgacttggaga

SEQ ID NO: 727853 - DNA, 25 bp, Mus musculus
gttcccagagcctctgacttggaga

SEQ ID NO: 727854 - DNA, 25 bp, Mus musculus
gttcccagagctcatagccaagtgt

SEQ ID NO: 727855 - DNA, 25 bp, Mus musculus
gttcccagagctgatagccaagtgt

SEQ ID NO: 727856 - DNA, 25 bp, Mus musculus
gttcccagaggacctagaggctcga

SEQ ID NO: 727857 - DNA, 25 bp, Mus musculus
gttcccagaggagctagaggctcga

SEQ ID NO: 727858 - DNA, 25 bp, Mus musculus
gttcccagattgagaaacttcccat

SEQ ID NO: 727859 - DNA, 25 bp, Mus musculus
gttcccagattgataagagttcacc

SEQ ID NO: 727860 - DNA, 25 bp, Mus musculus
gttcccagattgtgaaacttcccat

SEQ ID NO: 727861 - DNA, 25 bp, Mus musculus
gttcccagattgttaagagttcacc

SEQ ID NO: 727862 - DNA, 25 bp, Mus musculus
gttcccagcaaactacttgatctct

SEQ ID NO: 727863 - DNA, 25 bp, Mus musculus
gttcccagcaaagtacttgatctct

SEQ ID NO: 727864 - DNA, 25 bp, Mus musculus
gttcccagcaatcatcgtagtactt

SEQ ID NO: 727865 - DNA, 25 bp, Mus musculus
gttcccagcaatgatcgtagtactt

SEQ ID NO: 727866 - DNA, 25 bp, Mus musculus
gttcccagcacccttctgggatagc

SEQ ID NO: 727867 - DNA, 25 bp, Mus musculus
gttcccagcaccgttctgggatagc

SEQ ID NO: 727868 - DNA, 25 bp, Mus musculus
gttcccagcttgatctgagtagcat

SEQ ID NO: 727869 - DNA, 25 bp, Mus musculus
gttcccagcttgttctgagtagcat

SEQ ID NO: 727870 - DNA, 25 bp, Mus musculus
gttcccaggactcatcagtaagatg

SEQ ID NO: 727871 - DNA, 25 bp, Mus musculus
gttcccaggactgatcagtaagatg

SEQ ID NO: 727872 - DNA, 25 bp, Mus musculus
gttcccaggtacaacaaacgctcat

SEQ ID NO: 727873 - DNA, 25 bp, Mus musculus
gttcccaggtactacaaacgctcat

SEQ ID NO: 727874 - DNA, 25 bp, Mus musculus
gttcccaggtgtcacttcacttcta

SEQ ID NO: 727875 - DNA, 25 bp, Mus musculus
gttcccaggtgtgacttcacttcta

SEQ ID NO: 727876 - DNA, 25 bp, Mus musculus
gttcccagtaccaacgtcagatagc

SEQ ID NO: 727877 - DNA, 25 bp, Mus musculus
gttcccagtacctacgtcagatagc

SEQ ID NO: 727878 - DNA, 25 bp, Mus musculus
gttcccagtactccttagaagtgct

SEQ ID NO: 727879 - DNA, 25 bp, Mus musculus
gttcccagtactgcttagaagtgct

SEQ ID NO: 727880 - DNA, 25 bp, Mus musculus
gttcccagtcaaagctacaaactac

SEQ ID NO: 727881 - DNA, 25 bp, Mus musculus
gttcccagtcaatgctacaaactac

SEQ ID NO: 727882 - DNA, 25 bp, Mus musculus
gttcccagtcatctgtatcatggag

SEQ ID NO: 727883 - DNA, 25 bp, Mus musculus
gttcccagtcatgtgtatcatggag

SEQ ID NO: 727884 - DNA, 25 bp, Mus musculus
gttcccagtggtcgtatctcccaag

SEQ ID NO: 727885 - DNA, 25 bp, Mus musculus
gttcccagtggtggtatctcccaag

SEQ ID NO: 727886 - DNA, 25 bp, Mus musculus
gttcccagtttcagttacttcagat

SEQ ID NO: 727887 - DNA, 25 bp, Mus musculus
gttcccagtttctgttacttcagat

SEQ ID NO: 727888 - DNA, 25 bp, Mus musculus
gttcccataatgactttgtacttac

SEQ ID NO: 727889 - DNA, 25 bp, Mus musculus
gttcccataatgtctttgtacttac

SEQ ID NO: 727890 - DNA, 25 bp, Mus musculus
gttcccatactcaggctgtctgttg

SEQ ID NO: 727891 - DNA, 25 bp, Mus musculus
gttcccatactctggctgtctgttg

SEQ ID NO: 727892 - DNA, 25 bp, Mus musculus
gttcccatatctaaaggccagttcc

SEQ ID NO: 727893 - DNA, 25 bp, Mus musculus
gttcccatatcttaaggccagttcc

SEQ ID NO: 727894 - DNA, 25 bp, Mus musculus
gttcccatatggaataccgttggat

SEQ ID NO: 727895 - DNA, 25 bp, Mus musculus
gttcccatatggtataccgttggat

SEQ ID NO: 727896 - DNA, 25 bp, Mus musculus
gttcccatcaggatgtggttagcta

SEQ ID NO: 727897 - DNA, 25 bp, Mus musculus
gttcccatcaggttgtggttagcta

SEQ ID NO: 727898 - DNA, 25 bp, Mus musculus
gttcccatctgcaatggtggtcaca

SEQ ID NO: 727899 - DNA, 25 bp, Mus musculus
gttcccatctgctatggtggtcaca

SEQ ID NO: 727900 - DNA, 25 bp, Mus musculus
gttcccatgaatagatttgagactg

SEQ ID NO: 727901 - DNA, 25 bp, Mus musculus
gttcccatgaattgatttgagactg

SEQ ID NO: 727902 - DNA, 25 bp, Mus musculus
gttcccatgacacttcagtagctga

SEQ ID NO: 727903 - DNA, 25 bp, Mus musculus
gttcccatgacagttcagtagctga

SEQ ID NO: 727904 - DNA, 25 bp, Mus musculus
gttcccatggctcctgctagagtaa

SEQ ID NO: 727905 - DNA, 25 bp, Mus musculus
gttcccatggctgctgctagagtaa

SEQ ID NO: 727906 - DNA, 25 bp, Mus musculus
gttcccatgtaactcatacgactca

SEQ ID NO: 727907 - DNA, 25 bp, Mus musculus
gttcccatgtaagtcatacgactca

SEQ ID NO: 727908 - DNA, 25 bp, Mus musculus
gttcccattcgcaaaccagtgtgga

SEQ ID NO: 727909 - DNA, 25 bp, Mus musculus
gttcccattcgctaaccagtgtgga

SEQ ID NO: 727910 - DNA, 25 bp, Mus musculus
gttcccattctaattattcactgag

SEQ ID NO: 727911 - DNA, 25 bp, Mus musculus
gttcccattctatttattcactgag

SEQ ID NO: 727912 - DNA, 25 bp, Mus musculus
gttcccattgctatatacattttca

SEQ ID NO: 727913 - DNA, 25 bp, Mus musculus
gttcccattgctttatacattttca

SEQ ID NO: 727914 - DNA, 25 bp, Mus musculus
gttcccatttcacataccaaggtgt

SEQ ID NO: 727915 - DNA, 25 bp, Mus musculus
gttcccatttcagataccaaggtgt

SEQ ID NO: 727916 - DNA, 25 bp, Mus musculus
gttccccaaatcaaaacattacacg

SEQ ID NO: 727917 - DNA, 25 bp, Mus musculus
gttccccaaatctaaacattacacg

SEQ ID NO: 727918 - DNA, 25 bp, Mus musculus
gttccccaaggcaattcagacagag

SEQ ID NO: 727919 - DNA, 25 bp, Mus musculus
gttccccaaggctattcagacagag

SEQ ID NO: 727920 - DNA, 25 bp, Mus musculus
gttccccaaggtactgctcaagaaa

SEQ ID NO: 727921 - DNA, 25 bp, Mus musculus
gttccccaaggttctgctcaagaaa

SEQ ID NO: 727922 - DNA, 25 bp, Mus musculus
gttccccactaactctttactggag

SEQ ID NO: 727923 - DNA, 25 bp, Mus musculus
gttccccactaagtctttactggag

SEQ ID NO: 727924 - DNA, 25 bp, Mus musculus
gttccccactcgactaagaggagag

SEQ ID NO: 727925 - DNA, 25 bp, Mus musculus
gttccccactcgtctaagaggagag

SEQ ID NO: 727926 - DNA, 25 bp, Mus musculus
gttccccagaagatattgagcctcc

SEQ ID NO: 727927 - DNA, 25 bp, Mus musculus
gttccccagaagttattgagcctcc

SEQ ID NO: 727928 - DNA, 25 bp, Mus musculus
gttccccagcgaccccaagaaagtt

SEQ ID NO: 727929 - DNA, 25 bp, Mus musculus
gttccccagcgagcccaagaaagtt

SEQ ID NO: 727930 - DNA, 25 bp, Mus musculus
gttccccagctgatcttagattgag

SEQ ID NO: 727931 - DNA, 25 bp, Mus musculus
gttccccagctgttcttagattgag

SEQ ID NO: 727932 - DNA, 25 bp, Mus musculus
gttccccagttgcaggcgtatacag

SEQ ID NO: 727933 - DNA, 25 bp, Mus musculus
gttccccagttggaggcgtatacag

SEQ ID NO: 727934 - DNA, 25 bp, Mus musculus
gttccccatattcctgtgcatgtaa

SEQ ID NO: 727935 - DNA, 25 bp, Mus musculus
gttccccatattgctgtgcatgtaa

SEQ ID NO: 727936 - DNA, 25 bp, Mus musculus
gttccccatgaaccagagacacctt

SEQ ID NO: 727937 - DNA, 25 bp, Mus musculus
gttccccatgaagcagagacacctt

SEQ ID NO: 727938 - DNA, 25 bp, Mus musculus
gttccccccttcaaagatggataga

SEQ ID NO: 727939 - DNA, 25 bp, Mus musculus
gttccccccttctaagatggataga

SEQ ID NO: 727940 - DNA, 25 bp, Mus musculus
gttccccgaaaacaacctgcagatg

SEQ ID NO: 727941 - DNA, 25 bp, Mus musculus
gttccccgaaaagaacctgcagatg

SEQ ID NO: 727942 - DNA, 25 bp, Mus musculus
gttccccgaggcagtaaaaatccag

SEQ ID NO: 727943 - DNA, 25 bp, Mus musculus
gttccccgaggctgtaaaaatccag

SEQ ID NO: 727944 - DNA, 25 bp, Mus musculus
gttccccgatggcacatttgtgaca

SEQ ID NO: 727945 - DNA, 25 bp, Mus musculus
gttccccgatgggacatttgtgaca

SEQ ID NO: 727946 - DNA, 25 bp, Mus musculus
gttccccgctgactgtgtgcacaga

SEQ ID NO: 727947 - DNA, 25 bp, Mus musculus
gttccccgctgagtgtgtgcacaga

SEQ ID NO: 727948 - DNA, 25 bp, Mus musculus
gttccccgctttctgtggacaccct

SEQ ID NO: 727949 - DNA, 25 bp, Mus musculus
gttccccgctttgtgtggacaccct

SEQ ID NO: 727950 - DNA, 25 bp, Mus musculus
gttccccggatgaccagactgattt

SEQ ID NO: 727951 - DNA, 25 bp, Mus musculus
gttccccggatgtccagactgattt

SEQ ID NO: 727952 - DNA, 25 bp, Mus musculus
gttccccgggttacactgtggtgtg

SEQ ID NO: 727953 - DNA, 25 bp, Mus musculus
gttccccgggtttcactgtggtgtg

SEQ ID NO: 727954 - DNA, 25 bp, Mus musculus
gttccccggtatctcccagaagagc

SEQ ID NO: 727955 - DNA, 25 bp, Mus musculus
gttccccggtatgtcccagaagagc

SEQ ID NO: 727956 - DNA, 25 bp, Mus musculus
gttcccctacccagaatagccaaag

SEQ ID NO: 727957 - DNA, 25 bp, Mus musculus
gttcccctaccctgaatagccaaag

SEQ ID NO: 727958 - DNA, 25 bp, Mus musculus
gttcccctagccacagaaataactt

SEQ ID NO: 727959 - DNA, 25 bp, Mus musculus
gttcccctagcctcagaaataactt

SEQ ID NO: 727960 - DNA, 25 bp, Mus musculus
gttcccctatatatagcagtcaaat

SEQ ID NO: 727961 - DNA, 25 bp, Mus musculus
gttcccctatatttagcagtcaaat

SEQ ID NO: 727962 - DNA, 25 bp, Mus musculus
gttcccctatccagtgggtttcaga

SEQ ID NO: 727963 - DNA, 25 bp, Mus musculus
gttcccctatcctgtgggtttcaga

SEQ ID NO: 727964 - DNA, 25 bp, Mus musculus
gttcccctcaataattttttcactg

SEQ ID NO: 727965 - DNA, 25 bp, Mus musculus
gttcccctcaattattttttcactg

SEQ ID NO: 727966 - DNA, 25 bp, Mus musculus
gttcccctgacaatttatctatagt

SEQ ID NO: 727967 - DNA, 25 bp, Mus musculus
gttcccctgacattttatctatagt

SEQ ID NO: 727968 - DNA, 25 bp, Mus musculus
gttcccctgctcagttagattaggt

SEQ ID NO: 727969 - DNA, 25 bp, Mus musculus
gttcccctgctctgttagattaggt

SEQ ID NO: 727970 - DNA, 25 bp, Mus musculus
gttccccttgaactcaatgctagta

SEQ ID NO: 727971 - DNA, 25 bp, Mus musculus
gttccccttgaagtcaatgctagta

SEQ ID NO: 727972 - DNA, 25 bp, Mus musculus
gttccccttgtgaagctcactaaat

SEQ ID NO: 727973 - DNA, 25 bp, Mus musculus
gttccccttgtgtagctcactaaat

SEQ ID NO: 727974 - DNA, 25 bp, Mus musculus
gttccccttttgagtcaatgtacta

SEQ ID NO: 727975 - DNA, 25 bp, Mus musculus
gttccccttttgtgtcaatgtacta

SEQ ID NO: 727976 - DNA, 25 bp, Mus musculus
gttcccgacacacacggagatccag

SEQ ID NO: 727977 - DNA, 25 bp, Mus musculus
gttcccgacacagacggagatccag

SEQ ID NO: 727978 - DNA, 25 bp, Mus musculus
gttcccgacttcatttattgccaga

SEQ ID NO: 727979 - DNA, 25 bp, Mus musculus
gttcccgacttcttttattgccaga

SEQ ID NO: 727980 - DNA, 25 bp, Mus musculus
gttcccgagaagaatggagctccct

SEQ ID NO: 727981 - DNA, 25 bp, Mus musculus
gttcccgagaagtatggagctccct

SEQ ID NO: 727982 - DNA, 25 bp, Mus musculus
gttcccgagagaccacctaagtaag

SEQ ID NO: 727983 - DNA, 25 bp, Mus musculus
gttcccgagagagcacctaagtaag

SEQ ID NO: 727984 - DNA, 25 bp, Mus musculus
gttcccgaggacagtgacacgtaga

SEQ ID NO: 727985 - DNA, 25 bp, Mus musculus
gttcccgaggactgtgacacgtaga

SEQ ID NO: 727986 - DNA, 25 bp, Mus musculus
gttcccgaggccaggtgtgacatca

SEQ ID NO: 727987 - DNA, 25 bp, Mus musculus
gttcccgaggcctggtgtgacatca

SEQ ID NO: 727988 - DNA, 25 bp, Mus musculus
gttcccgatttgagattggcagact

SEQ ID NO: 727989 - DNA, 25 bp, Mus musculus
gttcccgatttgtgattggcagact

SEQ ID NO: 727990 - DNA, 25 bp, Mus musculus
gttcccgcagccatattgtattttg

SEQ ID NO: 727991 - DNA, 25 bp, Mus musculus
gttcccgcagccttattgtattttg

SEQ ID NO: 727992 - DNA, 25 bp, Mus musculus
gttcccgcgtgaagccaaaatgcta

SEQ ID NO: 727993 - DNA, 25 bp, Mus musculus
gttcccgcgtgatgccaaaatgcta

SEQ ID NO: 727994 - DNA, 25 bp, Mus musculus
gttcccgcttatccaaacaatgcat

SEQ ID NO: 727995 - DNA, 25 bp, Mus musculus
gttcccgcttatgcaaacaatgcat

SEQ ID NO: 727996 - DNA, 25 bp, Mus musculus
gttcccgggatgatatgactttgac

SEQ ID NO: 727997 - DNA, 25 bp, Mus musculus
gttcccgggatgttatgactttgac

SEQ ID NO: 727998 - DNA, 25 bp, Mus musculus
gttcccggtgctacctgaaagatga

SEQ ID NO: 727999 - DNA, 25 bp, Mus musculus
gttcccggtgcttcctgaaagatga

SEQ ID NO: 728000 - DNA, 25 bp, Mus musculus
gttcccggtggcaacattaattcca

SEQ ID NO: 728001 - DNA, 25 bp, Mus musculus
gttcccggtggctacattaattcca

SEQ ID NO: 728002 - DNA, 25 bp, Mus musculus
gttcccgtagcactcactacaaagg

SEQ ID NO: 728003 - DNA, 25 bp, Mus musculus
gttcccgtagcagtcactacaaagg

SEQ ID NO: 728004 - DNA, 25 bp, Mus musculus
gttcccgtcagaaacggacgtcaag

SEQ ID NO: 728005 - DNA, 25 bp, Mus musculus
gttcccgtcagatacggacgtcaag

SEQ ID NO: 728006 - DNA, 25 bp, Mus musculus
gttcccgtgacgagtacttaattga

SEQ ID NO: 728007 - DNA, 25 bp, Mus musculus
gttcccgtgacgtgtacttaattga

SEQ ID NO: 728008 - DNA, 25 bp, Mus musculus
gttcccgtgcgtagagatttgattt

SEQ ID NO: 728009 - DNA, 25 bp, Mus musculus
gttcccgtgcgttgagatttgattt

SEQ ID NO: 728010 - DNA, 25 bp, Mus musculus
gttcccgttagccagctccagagtg

SEQ ID NO: 728011 - DNA, 25 bp, Mus musculus
gttcccgttagcgagctccagagtg

SEQ ID NO: 728012 - DNA, 25 bp, Mus musculus
gttcccgtttgaattgtcagccttt

SEQ ID NO: 728013 - DNA, 25 bp, Mus musculus
gttcccgtttgatttgtcagccttt

SEQ ID NO: 728014 - DNA, 25 bp, Mus musculus
gttcccgtttgtaataaagcttctg

SEQ ID NO: 728015 - DNA, 25 bp, Mus musculus
gttcccgtttgttataaagcttctg

SEQ ID NO: 728016 - DNA, 25 bp, Mus musculus
gttccctaaatgctctctcatagag

SEQ ID NO: 728017 - DNA, 25 bp, Mus musculus
gttccctaaatggtctctcatagag

SEQ ID NO: 728018 - DNA, 25 bp, Mus musculus
gttccctaaccaataaagcgcacaa

SEQ ID NO: 728019 - DNA, 25 bp, Mus musculus
gttccctaaccattaaagcgcacaa

SEQ ID NO: 728020 - DNA, 25 bp, Mus musculus
gttccctaagaacgttgtcaccctg

SEQ ID NO: 728021 - DNA, 25 bp, Mus musculus
gttccctaagaaggttgtcaccctg

SEQ ID NO: 728022 - DNA, 25 bp, Mus musculus
gttccctaagtaacaggtcctgagt

SEQ ID NO: 728023 - DNA, 25 bp, Mus musculus
gttccctaagtatcaggtcctgagt

SEQ ID NO: 728024 - DNA, 25 bp, Mus musculus
gttccctaagtcagcaaattgcttt

SEQ ID NO: 728025 - DNA, 25 bp, Mus musculus
gttccctaagtctgcaaattgcttt

SEQ ID NO: 728026 - DNA, 25 bp, Mus musculus
gttccctacatcaccttggtagtaa

SEQ ID NO: 728027 - DNA, 25 bp, Mus musculus
gttccctacatctccttggtagtaa

SEQ ID NO: 728028 - DNA, 25 bp, Mus musculus
gttccctaccaactaatgcgcagaa

SEQ ID NO: 728029 - DNA, 25 bp, Mus musculus
gttccctaccaagtaatgcgcagaa

SEQ ID NO: 728030 - DNA, 25 bp, Mus musculus
gttccctagaccattctagaattct

SEQ ID NO: 728031 - DNA, 25 bp, Mus musculus
gttccctagacctttctagaattct

SEQ ID NO: 728032 - DNA, 25 bp, Mus musculus
gttccctagctcagttctctggaca

SEQ ID NO: 728033 - DNA, 25 bp, Mus musculus
gttccctagctctgttctctggaca

SEQ ID NO: 728034 - DNA, 25 bp, Mus musculus
gttccctagtgacccaagattcctt

SEQ ID NO: 728035 - DNA, 25 bp, Mus musculus
gttccctagtgagccaagattcctt

SEQ ID NO: 728036 - DNA, 25 bp, Mus musculus
gttccctagtgtatggctttctgat

SEQ ID NO: 728037 - DNA, 25 bp, Mus musculus
gttccctagtgtttggctttctgat

SEQ ID NO: 728038 - DNA, 25 bp, Mus musculus
gttccctcaatgatatcagttcaat

SEQ ID NO: 728039 - DNA, 25 bp, Mus musculus
gttccctcaatgttatcagttcaat

SEQ ID NO: 728040 - DNA, 25 bp, Mus musculus
gttccctcagtgcttttgtatgttg

SEQ ID NO: 728041 - DNA, 25 bp, Mus musculus
gttccctcagtggttttgtatgttg

SEQ ID NO: 728042 - DNA, 25 bp, Mus musculus
gttccctcataaaggatgagtccct

SEQ ID NO: 728043 - DNA, 25 bp, Mus musculus
gttccctcataatggatgagtccct

SEQ ID NO: 728044 - DNA, 25 bp, Mus musculus
gttccctcatctatacggatcatta

SEQ ID NO: 728045 - DNA, 25 bp, Mus musculus
gttccctcatctttacggatcatta

SEQ ID NO: 728046 - DNA, 25 bp, Mus musculus
gttccctcatgacaaggagctgcct

SEQ ID NO: 728047 - DNA, 25 bp, Mus musculus
gttccctcatgagaaggagctgcct

SEQ ID NO: 728048 - DNA, 25 bp, Mus musculus
gttccctccaggactgacaaagact

SEQ ID NO: 728049 - DNA, 25 bp, Mus musculus
gttccctccaggtctgacaaagact

SEQ ID NO: 728050 - DNA, 25 bp, Mus musculus
gttccctccctaaaagtgacagcga

SEQ ID NO: 728051 - DNA, 25 bp, Mus musculus
gttccctccctataagtgacagcga

SEQ ID NO: 728052 - DNA, 25 bp, Mus musculus
gttccctcctgaatcagagcgttaa

SEQ ID NO: 728053 - DNA, 25 bp, Mus musculus
gttccctcctgacttagactttgca

SEQ ID NO: 728054 - DNA, 25 bp, Mus musculus
gttccctcctgagttagactttgca

SEQ ID NO: 728055 - DNA, 25 bp, Mus musculus
gttccctcctgattcagagcgttaa

SEQ ID NO: 728056 - DNA, 25 bp, Mus musculus
gttccctccttcaactgtgtaggta

SEQ ID NO: 728057 - DNA, 25 bp, Mus musculus
gttccctccttcatacacaagggtg

SEQ ID NO: 728058 - DNA, 25 bp, Mus musculus
gttccctccttctactgtgtaggta

SEQ ID NO: 728059 - DNA, 25 bp, Mus musculus
gttccctccttcttacacaagggtg

SEQ ID NO: 728060 - DNA, 25 bp, Mus musculus
gttccctcgcagaatgccaaggagt

SEQ ID NO: 728061 - DNA, 25 bp, Mus musculus
gttccctcgcagtatgccaaggagt

SEQ ID NO: 728062 - DNA, 25 bp, Mus musculus
gttccctctcaaattttaagtcact

SEQ ID NO: 728063 - DNA, 25 bp, Mus musculus
gttccctctcaacgtggataagctt

SEQ ID NO: 728064 - DNA, 25 bp, Mus musculus
gttccctctcaaggtggataagctt

SEQ ID NO: 728065 - DNA, 25 bp, Mus musculus
gttccctctcaatttttaagtcact

SEQ ID NO: 728066 - DNA, 25 bp, Mus musculus
gttccctctgaaatttagtctctgc

SEQ ID NO: 728067 - DNA, 25 bp, Mus musculus
gttccctctgaattttagtctctgc

SEQ ID NO: 728068 - DNA, 25 bp, Mus musculus
gttccctctgagataagcttctatt

SEQ ID NO: 728069 - DNA, 25 bp, Mus musculus
gttccctctgagttaagcttctatt

SEQ ID NO: 728070 - DNA, 25 bp, Mus musculus
gttccctctggaagacgtgtttgac

SEQ ID NO: 728071 - DNA, 25 bp, Mus musculus
gttccctctggatgacgtgtttgac

SEQ ID NO: 728072 - DNA, 25 bp, Mus musculus
gttccctgaagacccatgtggtgta

SEQ ID NO: 728073 - DNA, 25 bp, Mus musculus
gttccctgaagagccatgtggtgta

SEQ ID NO: 728074 - DNA, 25 bp, Mus musculus
gttccctgagcccaccaatagcggg

SEQ ID NO: 728075 - DNA, 25 bp, Mus musculus
gttccctgagccgaccaatagcggg

SEQ ID NO: 728076 - DNA, 25 bp, Mus musculus
gttccctgagggataaccagaagct

SEQ ID NO: 728077 - DNA, 25 bp, Mus musculus
gttccctgagggttaaccagaagct

SEQ ID NO: 728078 - DNA, 25 bp, Mus musculus
gttccctgccagagacatttgcata

SEQ ID NO: 728079 - DNA, 25 bp, Mus musculus
gttccctgccagtgacatttgcata

SEQ ID NO: 728080 - DNA, 25 bp, Mus musculus
gttccctgcggacaaaagcacataa

SEQ ID NO: 728081 - DNA, 25 bp, Mus musculus
gttccctgcggagaaaagcacataa

SEQ ID NO: 728082 - DNA, 25 bp, Mus musculus
gttccctgctggattgtacacaaca

SEQ ID NO: 728083 - DNA, 25 bp, Mus musculus
gttccctgctggtttgtacacaaca

SEQ ID NO: 728084 - DNA, 25 bp, Mus musculus
gttccctggaagaactgtcactcct

SEQ ID NO: 728085 - DNA, 25 bp, Mus musculus
gttccctggaagtactgtcactcct

SEQ ID NO: 728086 - DNA, 25 bp, Mus musculus
gttccctggaatagcacaagagctt

SEQ ID NO: 728087 - DNA, 25 bp, Mus musculus
gttccctggaattgcacaagagctt

SEQ ID NO: 728088 - DNA, 25 bp, Mus musculus
gttccctggcttcaagtctgagatc

SEQ ID NO: 728089 - DNA, 25 bp, Mus musculus
gttccctggcttgaagtctgagatc

SEQ ID NO: 728090 - DNA, 25 bp, Mus musculus
gttccctgggtgaggagcgcaacta

SEQ ID NO: 728091 - DNA, 25 bp, Mus musculus
gttccctgggtgtggagcgcaacta

SEQ ID NO: 728092 - DNA, 25 bp, Mus musculus
gttccctggtatctaccaaatttgt

SEQ ID NO: 728093 - DNA, 25 bp, Mus musculus
gttccctggtatgtaccaaatttgt

SEQ ID NO: 728094 - DNA, 25 bp, Mus musculus
gttccctgtactataggcctgtgta

SEQ ID NO: 728095 - DNA, 25 bp, Mus musculus
gttccctgtactttaggcctgtgta

SEQ ID NO: 728096 - DNA, 25 bp, Mus musculus
gttccctgtagaaaaattactggtc

SEQ ID NO: 728097 - DNA, 25 bp, Mus musculus
gttccctgtagataaattactggtc

SEQ ID NO: 728098 - DNA, 25 bp, Mus musculus
gttccctgtattaagtcaccataag

SEQ ID NO: 728099 - DNA, 25 bp, Mus musculus
gttccctgtatttagtcaccataag

SEQ ID NO: 728100 - DNA, 25 bp, Mus musculus
gttccctgtcttccatgggagggag

SEQ ID NO: 728101 - DNA, 25 bp, Mus musculus
gttccctgtcttgcatgggagggag

SEQ ID NO: 728102 - DNA, 25 bp, Mus musculus
gttccctgtgagaggacatgacatc

SEQ ID NO: 728103 - DNA, 25 bp, Mus musculus
gttccctgtgagtggacatgacatc

SEQ ID NO: 728104 - DNA, 25 bp, Mus musculus
gttccctgtgcccaataaactgttt

SEQ ID NO: 728105 - DNA, 25 bp, Mus musculus
gttccctgtgccgaataaactgttt

SEQ ID NO: 728106 - DNA, 25 bp, Mus musculus
gttccctgttgtacatggctgatac

SEQ ID NO: 728107 - DNA, 25 bp, Mus musculus
gttccctgttgttcatggctgatac

SEQ ID NO: 728108 - DNA, 25 bp, Mus musculus
gttcccttactgaactctgcaactc

SEQ ID NO: 728109 - DNA, 25 bp, Mus musculus
gttcccttactgtactctgcaactc

SEQ ID NO: 728110 - DNA, 25 bp, Mus musculus
gttcccttagaccattaaatgaaga

SEQ ID NO: 728111 - DNA, 25 bp, Mus musculus
gttcccttagacgattaaatgaaga

SEQ ID NO: 728112 - DNA, 25 bp, Mus musculus
gttcccttatacctccttgattgaa

SEQ ID NO: 728113 - DNA, 25 bp, Mus musculus
gttcccttatacgtccttgattgaa

SEQ ID NO: 728114 - DNA, 25 bp, Mus musculus
gttcccttatggcactagctcatgg

SEQ ID NO: 728115 - DNA, 25 bp, Mus musculus
gttcccttatgggactagctcatgg

SEQ ID NO: 728116 - DNA, 25 bp, Mus musculus
gttcccttattaactcattctcagt

SEQ ID NO: 728117 - DNA, 25 bp, Mus musculus
gttcccttattatctcattctcagt

SEQ ID NO: 728118 - DNA, 25 bp, Mus musculus
gttcccttatttcgagctgtgataa

SEQ ID NO: 728119 - DNA, 25 bp, Mus musculus
gttcccttatttggagctgtgataa

SEQ ID NO: 728120 - DNA, 25 bp, Mus musculus
gttcccttcctaccagcctgtgggt

SEQ ID NO: 728121 - DNA, 25 bp, Mus musculus
gttcccttcctagcagcctgtgggt

SEQ ID NO: 728122 - DNA, 25 bp, Mus musculus
gttcccttctagctgccatgctagg

SEQ ID NO: 728123 - DNA, 25 bp, Mus musculus
gttcccttctaggtgccatgctagg

SEQ ID NO: 728124 - DNA, 25 bp, Mus musculus
gttcccttctgtacgaagactcaag

SEQ ID NO: 728125 - DNA, 25 bp, Mus musculus
gttcccttctgttcgaagactcaag

SEQ ID NO: 728126 - DNA, 25 bp, Mus musculus
gttcccttgatcatccagtatttca

SEQ ID NO: 728127 - DNA, 25 bp, Mus musculus
gttcccttgatccatgaagccacaa

SEQ ID NO: 728128 - DNA, 25 bp, Mus musculus
gttcccttgatcgatgaagccacaa

SEQ ID NO: 728129 - DNA, 25 bp, Mus musculus
gttcccttgatcttccagtatttca

SEQ ID NO: 728130 - DNA, 25 bp, Mus musculus
gttcccttgggcaattcaacactgg

SEQ ID NO: 728131 - DNA, 25 bp, Mus musculus
gttcccttgggctattcaacactgg

SEQ ID NO: 728132 - DNA, 25 bp, Mus musculus
gttcccttggtgcttagacttctga

SEQ ID NO: 728133 - DNA, 25 bp, Mus musculus
gttcccttggtggttagacttctga

SEQ ID NO: 728134 - DNA, 25 bp, Mus musculus
gttcccttgtaaaatgctaggctgg

SEQ ID NO: 728135 - DNA, 25 bp, Mus musculus
gttcccttgtaatatgctaggctgg

SEQ ID NO: 728136 - DNA, 25 bp, Mus musculus
gttccctttaagagctgagtcacct

SEQ ID NO: 728137 - DNA, 25 bp, Mus musculus
gttccctttaagtgctgagtcacct

SEQ ID NO: 728138 - DNA, 25 bp, Mus musculus
gttccctttctactatcaacaccta

SEQ ID NO: 728139 - DNA, 25 bp, Mus musculus
gttccctttctagtatcaacaccta

SEQ ID NO: 728140 - DNA, 25 bp, Mus musculus
gttccctttgcgcagtggcatctag

SEQ ID NO: 728141 - DNA, 25 bp, Mus musculus
gttccctttgcggagtggcatctag

SEQ ID NO: 728142 - DNA, 25 bp, Mus musculus
gttcccttttataatcccattgtgc

SEQ ID NO: 728143 - DNA, 25 bp, Mus musculus
gttcccttttattatcccattgtgc

SEQ ID NO: 728144 - DNA, 25 bp, Mus musculus
gttccgaaccaaaccctgtagatag

SEQ ID NO: 728145 - DNA, 25 bp, Mus musculus
gttccgaaccaatccctgtagatag

SEQ ID NO: 728146 - DNA, 25 bp, Mus musculus
gttccgaagcctcttcataccccag

SEQ ID NO: 728147 - DNA, 25 bp, Mus musculus
gttccgaagcctgttcataccccag

SEQ ID NO: 728148 - DNA, 25 bp, Mus musculus
gttccgaatatccacagactctagt

SEQ ID NO: 728149 - DNA, 25 bp, Mus musculus
gttccgaatatcgacagactctagt

SEQ ID NO: 728150 - DNA, 25 bp, Mus musculus
gttccgaccataaacgatgccgact

SEQ ID NO: 728151 - DNA, 25 bp, Mus musculus
gttccgaccatatacgatgccgact

SEQ ID NO: 728152 - DNA, 25 bp, Mus musculus
gttccgaccattattatccagatca

SEQ ID NO: 728153 - DNA, 25 bp, Mus musculus
gttccgaccatttttatccagatca

SEQ ID NO: 728154 - DNA, 25 bp, Mus musculus
gttccgagacgccacacggcagata

SEQ ID NO: 728155 - DNA, 25 bp, Mus musculus
gttccgagacgcgacacggcagata

SEQ ID NO: 728156 - DNA, 25 bp, Mus musculus
gttccgagcatcacttgtccaagaa

SEQ ID NO: 728157 - DNA, 25 bp, Mus musculus
gttccgagcatctcttgtccaagaa

SEQ ID NO: 728158 - DNA, 25 bp, Mus musculus
gttccgagccatactgtttcagagg

SEQ ID NO: 728159 - DNA, 25 bp, Mus musculus
gttccgagccattctgtttcagagg

SEQ ID NO: 728160 - DNA, 25 bp, Mus musculus
gttccgagctttcctggagtatcta

SEQ ID NO: 728161 - DNA, 25 bp, Mus musculus
gttccgagctttgctggagtatcta

SEQ ID NO: 728162 - DNA, 25 bp, Mus musculus
gttccgaggttcacagacagcagca

SEQ ID NO: 728163 - DNA, 25 bp, Mus musculus
gttccgaggttctcagacagcagca

SEQ ID NO: 728164 - DNA, 25 bp, Mus musculus
gttccgagtcgcaactacctatcga

SEQ ID NO: 728165 - DNA, 25 bp, Mus musculus
gttccgagtcgctactacctatcga

SEQ ID NO: 728166 - DNA, 25 bp, Mus musculus
gttccgatatcacctgagtgcaggg

SEQ ID NO: 728167 - DNA, 25 bp, Mus musculus
gttccgatatcagctgagtgcaggg

SEQ ID NO: 728168 - DNA, 25 bp, Mus musculus
gttccgatctttctggagagtgctg

SEQ ID NO: 728169 - DNA, 25 bp, Mus musculus
gttccgatctttgtggagagtgctg

SEQ ID NO: 728170 - DNA, 25 bp, Mus musculus
gttccgatgcacacattaaacgacg

SEQ ID NO: 728171 - DNA, 25 bp, Mus musculus
gttccgatgcactcattaaacgacg

SEQ ID NO: 728172 - DNA, 25 bp, Mus musculus
gttccgatgctgattgtgtaaccaa

SEQ ID NO: 728173 - DNA, 25 bp, Mus musculus
gttccgatgctgtttgtgtaaccaa

SEQ ID NO: 728174 - DNA, 25 bp, Mus musculus
gttccgattgttcaagtgactgtag

SEQ ID NO: 728175 - DNA, 25 bp, Mus musculus
gttccgattgttgaagtgactgtag

SEQ ID NO: 728176 - DNA, 25 bp, Mus musculus
gttccgatttgacgcctgaccacag

SEQ ID NO: 728177 - DNA, 25 bp, Mus musculus
gttccgatttgaggcctgaccacag

SEQ ID NO: 728178 - DNA, 25 bp, Mus musculus
gttccgcctttaactgctgatgtag

SEQ ID NO: 728179 - DNA, 25 bp, Mus musculus
gttccgcctttatctgctgatgtag

SEQ ID NO: 728180 - DNA, 25 bp, Mus musculus
gttccgcctttgccgggtcaaaatg

SEQ ID NO: 728181 - DNA, 25 bp, Mus musculus
gttccgcctttggcgggtcaaaatg

SEQ ID NO: 728182 - DNA, 25 bp, Mus musculus
gttccgctccggcaaggtggccttt

SEQ ID NO: 728183 - DNA, 25 bp, Mus musculus
gttccgctccgggaaggtggccttt

SEQ ID NO: 728184 - DNA, 25 bp, Mus musculus
gttccgctgcttcttgaaaaacctc

SEQ ID NO: 728185 - DNA, 25 bp, Mus musculus
gttccgctgcttgttgaaaaacctc

SEQ ID NO: 728186 - DNA, 25 bp, Mus musculus
gttccgctgggtcgtctttgtgtac

SEQ ID NO: 728187 - DNA, 25 bp, Mus musculus
gttccgctgggtggtctttgtgtac

SEQ ID NO: 728188 - DNA, 25 bp, Mus musculus
gttccggaaaccagtggctcacaga

SEQ ID NO: 728189 - DNA, 25 bp, Mus musculus
gttccggaaacctgtggctcacaga

SEQ ID NO: 728190 - DNA, 25 bp, Mus musculus
gttccggaccctcaagaagtgcttg

SEQ ID NO: 728191 - DNA, 25 bp, Mus musculus
gttccggaccctgaagaagtgcttg

SEQ ID NO: 728192 - DNA, 25 bp, Mus musculus
gttccggagaatctaccaccctcaa

SEQ ID NO: 728193 - DNA, 25 bp, Mus musculus
gttccggagaatgtaccaccctcaa

SEQ ID NO: 728194 - DNA, 25 bp, Mus musculus
gttccggatactagcaaagccactg

SEQ ID NO: 728195 - DNA, 25 bp, Mus musculus
gttccggatacttgcaaagccactg

SEQ ID NO: 728196 - DNA, 25 bp, Mus musculus
gttccggcagcaacagaaagaccta

SEQ ID NO: 728197 - DNA, 25 bp, Mus musculus
gttccggcagcatcagaaagaccta

SEQ ID NO: 728198 - DNA, 25 bp, Mus musculus
gttccggctaccagtgtgaaatgga

SEQ ID NO: 728199 - DNA, 25 bp, Mus musculus
gttccggctacctgtgtgaaatgga

SEQ ID NO: 728200 - DNA, 25 bp, Mus musculus
gttccggcttgtctggaaaatcttc

SEQ ID NO: 728201 - DNA, 25 bp, Mus musculus
gttccggcttgtgtggaaaatcttc

SEQ ID NO: 728202 - DNA, 25 bp, Mus musculus
gttccgggagtaagcaaccgccgca

SEQ ID NO: 728203 - DNA, 25 bp, Mus musculus
gttccgggagtatgcaaccgccgca

SEQ ID NO: 728204 - DNA, 25 bp, Mus musculus
gttccgggagttacattggatccac

SEQ ID NO: 728205 - DNA, 25 bp, Mus musculus
gttccgggagtttcattggatccac

SEQ ID NO: 728206 - DNA, 25 bp, Mus musculus
gttccgggattaaatcaactcacag

SEQ ID NO: 728207 - DNA, 25 bp, Mus musculus
gttccgggattatatcaactcacag

SEQ ID NO: 728208 - DNA, 25 bp, Mus musculus
gttccgggtctcagacagctgaaca

SEQ ID NO: 728209 - DNA, 25 bp, Mus musculus
gttccgggtctctgacagctgaaca

SEQ ID NO: 728210 - DNA, 25 bp, Mus musculus
gttccgggtggaacttagagcccta

SEQ ID NO: 728211 - DNA, 25 bp, Mus musculus
gttccgggtggatcttagagcccta

SEQ ID NO: 728212 - DNA, 25 bp, Mus musculus
gttccggtccaacgtcaaagggcat

SEQ ID NO: 728213 - DNA, 25 bp, Mus musculus
gttccggtccaaggtcaaagggcat

SEQ ID NO: 728214 - DNA, 25 bp, Mus musculus
gttccggtggaaaacacaagcctct

SEQ ID NO: 728215 - DNA, 25 bp, Mus musculus
gttccggtggaatacacaagcctct

SEQ ID NO: 728216 - DNA, 25 bp, Mus musculus
gttccggtgtaacctggatccattt

SEQ ID NO: 728217 - DNA, 25 bp, Mus musculus
gttccggtgtaagctggatccattt

SEQ ID NO: 728218 - DNA, 25 bp, Mus musculus
gttccggttggtaatagctagtact

SEQ ID NO: 728219 - DNA, 25 bp, Mus musculus
gttccggttggttatagctagtact

SEQ ID NO: 728220 - DNA, 25 bp, Mus musculus
gttccggtttgtacagtccaaactg

SEQ ID NO: 728221 - DNA, 25 bp, Mus musculus
gttccggtttgttcagtccaaactg

SEQ ID NO: 728222 - DNA, 25 bp, Mus musculus
gttccgtacagcaggcggcgataat

SEQ ID NO: 728223 - DNA, 25 bp, Mus musculus
gttccgtacagctggcggcgataat

SEQ ID NO: 728224 - DNA, 25 bp, Mus musculus
gttccgtatgctcttctttgaaaat

SEQ ID NO: 728225 - DNA, 25 bp, Mus musculus
gttccgtatgctgttctttgaaaat

SEQ ID NO: 728226 - DNA, 25 bp, Mus musculus
gttccgtccagtcacgcgaagagga

SEQ ID NO: 728227 - DNA, 25 bp, Mus musculus
gttccgtccagtgacgcgaagagga

SEQ ID NO: 728228 - DNA, 25 bp, Mus musculus
gttccgtgaacgatgcagggctgta

SEQ ID NO: 728229 - DNA, 25 bp, Mus musculus
gttccgtgaacgttgcagggctgta

SEQ ID NO: 728230 - DNA, 25 bp, Mus musculus
gttccgtgacctcaaatggacctgt

SEQ ID NO: 728231 - DNA, 25 bp, Mus musculus
gttccgtgacctgaaatggacctgt

SEQ ID NO: 728232 - DNA, 25 bp, Mus musculus
gttccgtgcaccaatttatattttt

SEQ ID NO: 728233 - DNA, 25 bp, Mus musculus
gttccgtgcacctatttatattttt

SEQ ID NO: 728234 - DNA, 25 bp, Mus musculus
gttccgtgcagtagcagaacctggt

SEQ ID NO: 728235 - DNA, 25 bp, Mus musculus
gttccgtgcagttgcagaacctggt

SEQ ID NO: 728236 - DNA, 25 bp, Mus musculus
gttccgtgcttcaagcttgaatcta

SEQ ID NO: 728237 - DNA, 25 bp, Mus musculus
gttccgtgcttctagcttgaatcta

SEQ ID NO: 728238 - DNA, 25 bp, Mus musculus
gttccgtgtagaagaaacccatgtc

SEQ ID NO: 728239 - DNA, 25 bp, Mus musculus
gttccgtgtagatgaaacccatgtc

SEQ ID NO: 728240 - DNA, 25 bp, Mus musculus
gttccgtgtcacattgtcacattta

SEQ ID NO: 728241 - DNA, 25 bp, Mus musculus
gttccgtgtcactttgtcacattta

SEQ ID NO: 728242 - DNA, 25 bp, Mus musculus
gttccgtgtgtcacttgcagctcac

SEQ ID NO: 728243 - DNA, 25 bp, Mus musculus
gttccgtgtgtctcttgcagctcac

SEQ ID NO: 728244 - DNA, 25 bp, Mus musculus
gttccgttataaatttcacttggct

SEQ ID NO: 728245 - DNA, 25 bp, Mus musculus
gttccgttataattttcacttggct

SEQ ID NO: 728246 - DNA, 25 bp, Mus musculus
gttccgttccatattccagcacata

SEQ ID NO: 728247 - DNA, 25 bp, Mus musculus
gttccgttccattttccagcacata

SEQ ID NO: 728248 - DNA, 25 bp, Mus musculus
gttccgttgcttatgttgtaagaca

SEQ ID NO: 728249 - DNA, 25 bp, Mus musculus
gttccgttgcttttgttgtaagaca

SEQ ID NO: 728250 - DNA, 25 bp, Mus musculus
gttcctaaaagcattgtggtcctgg

SEQ ID NO: 728251 - DNA, 25 bp, Mus musculus
gttcctaaaagctttgtggtcctgg

SEQ ID NO: 728252 - DNA, 25 bp, Mus musculus
gttcctaaaagtcaggtgggctaga

SEQ ID NO: 728253 - DNA, 25 bp, Mus musculus
gttcctaaaagtgaggtgggctaga

SEQ ID NO: 728254 - DNA, 25 bp, Mus musculus
gttcctaaagtgctgtatttactga

SEQ ID NO: 728255 - DNA, 25 bp, Mus musculus
gttcctaaagtggtgtatttactga

SEQ ID NO: 728256 - DNA, 25 bp, Mus musculus
gttcctaaatgaaaaccaggacaga

SEQ ID NO: 728257 - DNA, 25 bp, Mus musculus
gttcctaaatgataaccaggacaga

SEQ ID NO: 728258 - DNA, 25 bp, Mus musculus
gttcctaacactcttcagtagtaca

SEQ ID NO: 728259 - DNA, 25 bp, Mus musculus
gttcctaacactgttcagtagtaca

SEQ ID NO: 728260 - DNA, 25 bp, Mus musculus
gttcctaacattacattttactagc

SEQ ID NO: 728261 - DNA, 25 bp, Mus musculus
gttcctaacatttcattttactagc

SEQ ID NO: 728262 - DNA, 25 bp, Mus musculus
gttcctaaccaccagctgtctcaag

SEQ ID NO: 728263 - DNA, 25 bp, Mus musculus
gttcctaaccacgagctgtctcaag

SEQ ID NO: 728264 - DNA, 25 bp, Mus musculus
gttcctaacgtacaacgtgagctag

SEQ ID NO: 728265 - DNA, 25 bp, Mus musculus
gttcctaacgtagaacgtgagctag

SEQ ID NO: 728266 - DNA, 25 bp, Mus musculus
gttcctaacttcagtgtctcatcaa

SEQ ID NO: 728267 - DNA, 25 bp, Mus musculus
gttcctaacttctgtgtctcatcaa

SEQ ID NO: 728268 - DNA, 25 bp, Mus musculus
gttcctaagctgatccttactacat

SEQ ID NO: 728269 - DNA, 25 bp, Mus musculus
gttcctaagctgttccttactacat

SEQ ID NO: 728270 - DNA, 25 bp, Mus musculus
gttcctaatagtctccggttcctag

SEQ ID NO: 728271 - DNA, 25 bp, Mus musculus
gttcctaatagtgtccggttcctag

SEQ ID NO: 728272 - DNA, 25 bp, Mus musculus
gttcctaattctcacattgtatgtg

SEQ ID NO: 728273 - DNA, 25 bp, Mus musculus
gttcctaattctgacattgtatgtg

SEQ ID NO: 728274 - DNA, 25 bp, Mus musculus
gttcctacaaaccagtgctgtgaag

SEQ ID NO: 728275 - DNA, 25 bp, Mus musculus
gttcctacaaacgagtgctgtgaag

SEQ ID NO: 728276 - DNA, 25 bp, Mus musculus
gttcctacacggcagacagaggttt

SEQ ID NO: 728277 - DNA, 25 bp, Mus musculus
gttcctacacgggagacagaggttt

SEQ ID NO: 728278 - DNA, 25 bp, Mus musculus
gttcctacagccatagggctggagg

SEQ ID NO: 728279 - DNA, 25 bp, Mus musculus
gttcctacagccttagggctggagg

SEQ ID NO: 728280 - DNA, 25 bp, Mus musculus
gttcctaccacaagagcaagcgttt

SEQ ID NO: 728281 - DNA, 25 bp, Mus musculus
gttcctaccacatgagcaagcgttt

SEQ ID NO: 728282 - DNA, 25 bp, Mus musculus
gttcctactaggacgctcttgatac

SEQ ID NO: 728283 - DNA, 25 bp, Mus musculus
gttcctactaggtcgctcttgatac

SEQ ID NO: 728284 - DNA, 25 bp, Mus musculus
gttcctactccaaaggtctgtgaca

SEQ ID NO: 728285 - DNA, 25 bp, Mus musculus
gttcctactccataggtctgtgaca

SEQ ID NO: 728286 - DNA, 25 bp, Mus musculus
gttcctactgtacatttcacatgct

SEQ ID NO: 728287 - DNA, 25 bp, Mus musculus
gttcctactgtagatttcacatgct

SEQ ID NO: 728288 - DNA, 25 bp, Mus musculus
gttcctagaagtcgtaattcatact

SEQ ID NO: 728289 - DNA, 25 bp, Mus musculus
gttcctagaagtggtaattcatact

SEQ ID NO: 728290 - DNA, 25 bp, Mus musculus
gttcctagacatctgggaattttcc

SEQ ID NO: 728291 - DNA, 25 bp, Mus musculus
gttcctagacatgtgggaattttcc

SEQ ID NO: 728292 - DNA, 25 bp, Mus musculus
gttcctagagggacacagtgccttt

SEQ ID NO: 728293 - DNA, 25 bp, Mus musculus
gttcctagagggtcacagtgccttt

SEQ ID NO: 728294 - DNA, 25 bp, Mus musculus
gttcctagatggatatattagtact

SEQ ID NO: 728295 - DNA, 25 bp, Mus musculus
gttcctagatggttatattagtact

SEQ ID NO: 728296 - DNA, 25 bp, Mus musculus
gttcctagattgacagcttccagag

SEQ ID NO: 728297 - DNA, 25 bp, Mus musculus
gttcctagattgtcagcttccagag

SEQ ID NO: 728298 - DNA, 25 bp, Mus musculus
gttcctagatttatggctgtcttct

SEQ ID NO: 728299 - DNA, 25 bp, Mus musculus
gttcctagatttttggctgtcttct

SEQ ID NO: 728300 - DNA, 25 bp, Mus musculus
gttcctagcagcacttgtaagtcaa

SEQ ID NO: 728301 - DNA, 25 bp, Mus musculus
gttcctagcagctcttgtaagtcaa

SEQ ID NO: 728302 - DNA, 25 bp, Mus musculus
gttcctagccccacaatgaaattct

SEQ ID NO: 728303 - DNA, 25 bp, Mus musculus
gttcctagcccctcaatgaaattct

SEQ ID NO: 728304 - DNA, 25 bp, Mus musculus
gttcctagcctgagagccgaaagca

SEQ ID NO: 728305 - DNA, 25 bp, Mus musculus
gttcctagcctgtgagccgaaagca

SEQ ID NO: 728306 - DNA, 25 bp, Mus musculus
gttcctagccttccttagggcatta

SEQ ID NO: 728307 - DNA, 25 bp, Mus musculus
gttcctagccttgcttagggcatta

SEQ ID NO: 728308 - DNA, 25 bp, Mus musculus
gttcctagctttcattatgaagtct

SEQ ID NO: 728309 - DNA, 25 bp, Mus musculus
gttcctagctttgattatgaagtct

SEQ ID NO: 728310 - DNA, 25 bp, Mus musculus
gttcctagtatcatcatagcagctc

SEQ ID NO: 728311 - DNA, 25 bp, Mus musculus
gttcctagtatcttcatagcagctc

SEQ ID NO: 728312 - DNA, 25 bp, Mus musculus
gttcctagttgactctgcaattcat

SEQ ID NO: 728313 - DNA, 25 bp, Mus musculus
gttcctagttgagtctgcaattcat

SEQ ID NO: 728314 - DNA, 25 bp, Mus musculus
gttcctatacctcactttgttgttt

SEQ ID NO: 728315 - DNA, 25 bp, Mus musculus
gttcctatacctgactttgttgttt

SEQ ID NO: 728316 - DNA, 25 bp, Mus musculus
gttcctatacttaacaacttataat

SEQ ID NO: 728317 - DNA, 25 bp, Mus musculus
gttcctatactttacaacttataat

SEQ ID NO: 728318 - DNA, 25 bp, Mus musculus
gttcctatagctaattgtccatcca

SEQ ID NO: 728319 - DNA, 25 bp, Mus musculus
gttcctatagcttattgtccatcca

SEQ ID NO: 728320 - DNA, 25 bp, Mus musculus
gttcctatataaatctaatccctca

SEQ ID NO: 728321 - DNA, 25 bp, Mus musculus
gttcctatataattctaatccctca

SEQ ID NO: 728322 - DNA, 25 bp, Mus musculus
gttcctatcagcaatggacattgac

SEQ ID NO: 728323 - DNA, 25 bp, Mus musculus
gttcctatcagctatggacattgac

SEQ ID NO: 728324 - DNA, 25 bp, Mus musculus
gttcctatccagatggtgatcaaga

SEQ ID NO: 728325 - DNA, 25 bp, Mus musculus
gttcctatccagttggtgatcaaga

SEQ ID NO: 728326 - DNA, 25 bp, Mus musculus
gttcctatccggcttcatttgcaat

SEQ ID NO: 728327 - DNA, 25 bp, Mus musculus
gttcctatccgggttcatttgcaat

SEQ ID NO: 728328 - DNA, 25 bp, Mus musculus
gttcctatccttctccattgtcttt

SEQ ID NO: 728329 - DNA, 25 bp, Mus musculus
gttcctatccttgtccattgtcttt

SEQ ID NO: 728330 - DNA, 25 bp, Mus musculus
gttcctatctctcaagcattctgat

SEQ ID NO: 728331 - DNA, 25 bp, Mus musculus
gttcctatctctgaagcattctgat

SEQ ID NO: 728332 - DNA, 25 bp, Mus musculus
gttcctatcttcaaaattgcttctt

SEQ ID NO: 728333 - DNA, 25 bp, Mus musculus
gttcctatcttctaaattgcttctt

SEQ ID NO: 728334 - DNA, 25 bp, Mus musculus
gttcctatgatgacatattttcaaa

SEQ ID NO: 728335 - DNA, 25 bp, Mus musculus
gttcctatgatgtcatattttcaaa

SEQ ID NO: 728336 - DNA, 25 bp, Mus musculus
gttcctatgcatctgcagaaacaga

SEQ ID NO: 728337 - DNA, 25 bp, Mus musculus
gttcctatgcatgtgcagaaacaga

SEQ ID NO: 728338 - DNA, 25 bp, Mus musculus
gttcctatggaaacactgtactgta

SEQ ID NO: 728339 - DNA, 25 bp, Mus musculus
gttcctatggaaactttgaatattt

SEQ ID NO: 728340 - DNA, 25 bp, Mus musculus
gttcctatggaatcactgtactgta

SEQ ID NO: 728341 - DNA, 25 bp, Mus musculus
gttcctatggaatctttgaatattt

SEQ ID NO: 728342 - DNA, 25 bp, Mus musculus
gttcctatggtaccttctacatgtg

SEQ ID NO: 728343 - DNA, 25 bp, Mus musculus
gttcctatggtagcttctacatgtg

SEQ ID NO: 728344 - DNA, 25 bp, Mus musculus
gttcctatggttaacttgaagatac

SEQ ID NO: 728345 - DNA, 25 bp, Mus musculus
gttcctatggtttacttgaagatac

SEQ ID NO: 728346 - DNA, 25 bp, Mus musculus
gttcctatgtgtaagctctaccttt

SEQ ID NO: 728347 - DNA, 25 bp, Mus musculus
gttcctatgtgttagctctaccttt

SEQ ID NO: 728348 - DNA, 25 bp, Mus musculus
gttcctattataagtttttcctgtt

SEQ ID NO: 728349 - DNA, 25 bp, Mus musculus
gttcctattatatgtttttcctgtt

SEQ ID NO: 728350 - DNA, 25 bp, Mus musculus
gttcctattcaacaatttactccac

SEQ ID NO: 728351 - DNA, 25 bp, Mus musculus
gttcctattcaagaatttactccac

SEQ ID NO: 728352 - DNA, 25 bp, Mus musculus
gttcctattgcccatgggtttgaga

SEQ ID NO: 728353 - DNA, 25 bp, Mus musculus
gttcctattgccgatgggtttgaga

SEQ ID NO: 728354 - DNA, 25 bp, Mus musculus
gttcctattgctcttttgtcaccag

SEQ ID NO: 728355 - DNA, 25 bp, Mus musculus
gttcctattgctgttttgtcaccag

SEQ ID NO: 728356 - DNA, 25 bp, Mus musculus
gttcctattgttagccttttctttg

SEQ ID NO: 728357 - DNA, 25 bp, Mus musculus
gttcctattgttatctttgcttact

SEQ ID NO: 728358 - DNA, 25 bp, Mus musculus
gttcctattgtttgccttttctttg

SEQ ID NO: 728359 - DNA, 25 bp, Mus musculus
gttcctattgttttctttgcttact

SEQ ID NO: 728360 - DNA, 25 bp, Mus musculus
gttcctattttaccatttcaccata

SEQ ID NO: 728361 - DNA, 25 bp, Mus musculus
gttcctattttactctattgtatgt

SEQ ID NO: 728362 - DNA, 25 bp, Mus musculus
gttcctattttagcatttcaccata

SEQ ID NO: 728363 - DNA, 25 bp, Mus musculus
gttcctattttagtctattgtatgt

SEQ ID NO: 728364 - DNA, 25 bp, Mus musculus
gttcctatttttctatgttctactc

SEQ ID NO: 728365 - DNA, 25 bp, Mus musculus
gttcctatttttgtatgttctactc

SEQ ID NO: 728366 - DNA, 25 bp, Mus musculus
gttcctcaacaacacagcaagaaat

SEQ ID NO: 728367 - DNA, 25 bp, Mus musculus
gttcctcaacaagacagcaagaaat

SEQ ID NO: 728368 - DNA, 25 bp, Mus musculus
gttcctcaactcaaatatagattta

SEQ ID NO: 728369 - DNA, 25 bp, Mus musculus
gttcctcaactctaatatagattta

SEQ ID NO: 728370 - DNA, 25 bp, Mus musculus
gttcctcaagacatgccatgagatt

SEQ ID NO: 728371 - DNA, 25 bp, Mus musculus
gttcctcaagacttgccatgagatt

SEQ ID NO: 728372 - DNA, 25 bp, Mus musculus
gttcctcacccacatgaacttggat

SEQ ID NO: 728373 - DNA, 25 bp, Mus musculus
gttcctcacccagatgaacttggat

SEQ ID NO: 728374 - DNA, 25 bp, Mus musculus
gttcctcaccttcaagttgcataag

SEQ ID NO: 728375 - DNA, 25 bp, Mus musculus
gttcctcaccttgaagttgcataag

SEQ ID NO: 728376 - DNA, 25 bp, Mus musculus
gttcctcactagaagaaaatgctgt

SEQ ID NO: 728377 - DNA, 25 bp, Mus musculus
gttcctcactagtagaaaatgctgt

SEQ ID NO: 728378 - DNA, 25 bp, Mus musculus
gttcctcacttcaaactcctgaaat

SEQ ID NO: 728379 - DNA, 25 bp, Mus musculus
gttcctcacttctaactcctgaaat

SEQ ID NO: 728380 - DNA, 25 bp, Mus musculus
gttcctcagaacagtcagatggcct

SEQ ID NO: 728381 - DNA, 25 bp, Mus musculus
gttcctcagaacctatgtattgact

SEQ ID NO: 728382 - DNA, 25 bp, Mus musculus
gttcctcagaacgtatgtattgact

SEQ ID NO: 728383 - DNA, 25 bp, Mus musculus
gttcctcagaactgtcagatggcct

SEQ ID NO: 728384 - DNA, 25 bp, Mus musculus
gttcctcagactctaattctatgct

SEQ ID NO: 728385 - DNA, 25 bp, Mus musculus
gttcctcagactgtaattctatgct

SEQ ID NO: 728386 - DNA, 25 bp, Mus musculus
gttcctcagagaatttcctggttcg

SEQ ID NO: 728387 - DNA, 25 bp, Mus musculus
gttcctcagagattttcctggttcg

SEQ ID NO: 728388 - DNA, 25 bp, Mus musculus
gttcctcagaggagttgttccagta

SEQ ID NO: 728389 - DNA, 25 bp, Mus musculus
gttcctcagaggtgttgttccagta

SEQ ID NO: 728390 - DNA, 25 bp, Mus musculus
gttcctcagagtacagaagtgcact

SEQ ID NO: 728391 - DNA, 25 bp, Mus musculus
gttcctcagagttcagaagtgcact

SEQ ID NO: 728392 - DNA, 25 bp, Mus musculus
gttcctcagatgcagggtccacagt

SEQ ID NO: 728393 - DNA, 25 bp, Mus musculus
gttcctcagatggagggtccacagt

SEQ ID NO: 728394 - DNA, 25 bp, Mus musculus
gttcctcagcaaaggacgacgatct

SEQ ID NO: 728395 - DNA, 25 bp, Mus musculus
gttcctcagcaatggacgacgatct

SEQ ID NO: 728396 - DNA, 25 bp, Mus musculus
gttcctcagcatactgcaacatcag

SEQ ID NO: 728397 - DNA, 25 bp, Mus musculus
gttcctcagcattctgcaacatcag

SEQ ID NO: 728398 - DNA, 25 bp, Mus musculus
gttcctcagccaccttggaggagaa

SEQ ID NO: 728399 - DNA, 25 bp, Mus musculus
gttcctcagccagcttggaggagaa

SEQ ID NO: 728400 - DNA, 25 bp, Mus musculus
gttcctcagctccagatggacagcc

SEQ ID NO: 728401 - DNA, 25 bp, Mus musculus
gttcctcagctcgagatggacagcc

SEQ ID NO: 728402 - DNA, 25 bp, Mus musculus
gttcctcagcttaaatctttccaga

SEQ ID NO: 728403 - DNA, 25 bp, Mus musculus
gttcctcagctttaatctttccaga

SEQ ID NO: 728404 - DNA, 25 bp, Mus musculus
gttcctcaggttataagtgtactct

SEQ ID NO: 728405 - DNA, 25 bp, Mus musculus
gttcctcaggttttaagtgtactct

SEQ ID NO: 728406 - DNA, 25 bp, Mus musculus
gttcctcagtatcttgtccaggatg

SEQ ID NO: 728407 - DNA, 25 bp, Mus musculus
gttcctcagtatgttgtccaggatg

SEQ ID NO: 728408 - DNA, 25 bp, Mus musculus
gttcctcagtgaaaaactcccagtg

SEQ ID NO: 728409 - DNA, 25 bp, Mus musculus
gttcctcagtgataaactcccagtg

SEQ ID NO: 728410 - DNA, 25 bp, Mus musculus
gttcctcatgagaagctaggaccag

SEQ ID NO: 728411 - DNA, 25 bp, Mus musculus
gttcctcatgagtagctaggaccag

SEQ ID NO: 728412 - DNA, 25 bp, Mus musculus
gttcctcattcacgaggatctctgt

SEQ ID NO: 728413 - DNA, 25 bp, Mus musculus
gttcctcattcaggaggatctctgt

SEQ ID NO: 728414 - DNA, 25 bp, Mus musculus
gttcctccaaacacatggatcaatg

SEQ ID NO: 728415 - DNA, 25 bp, Mus musculus
gttcctccaaacctgtctaattcag

SEQ ID NO: 728416 - DNA, 25 bp, Mus musculus
gttcctccaaacgtgtctaattcag

SEQ ID NO: 728417 - DNA, 25 bp, Mus musculus
gttcctccaaactcatggatcaatg

SEQ ID NO: 728418 - DNA, 25 bp, Mus musculus
gttcctccaagacagtcactgcatg

SEQ ID NO: 728419 - DNA, 25 bp, Mus musculus
gttcctccaagagagtcactgcatg

SEQ ID NO: 728420 - DNA, 25 bp, Mus musculus
gttcctccacacatgctaaataaaa

SEQ ID NO: 728421 - DNA, 25 bp, Mus musculus
gttcctccacacttgctaaataaaa

SEQ ID NO: 728422 - DNA, 25 bp, Mus musculus
gttcctccaccaagtaacttagaca

SEQ ID NO: 728423 - DNA, 25 bp, Mus musculus
gttcctccaccatgtaacttagaca

SEQ ID NO: 728424 - DNA, 25 bp, Mus musculus
gttcctccagagctgattgcaagct

SEQ ID NO: 728425 - DNA, 25 bp, Mus musculus
gttcctccagaggtgattgcaagct

SEQ ID NO: 728426 - DNA, 25 bp, Mus musculus
gttcctccagttccaggacaagtga

SEQ ID NO: 728427 - DNA, 25 bp, Mus musculus
gttcctccagttgcaggacaagtga

SEQ ID NO: 728428 - DNA, 25 bp, Mus musculus
gttcctccatgtctagtccttggtt

SEQ ID NO: 728429 - DNA, 25 bp, Mus musculus
gttcctccatgtgtagtccttggtt

SEQ ID NO: 728430 - DNA, 25 bp, Mus musculus
gttcctccgtggcactaagggtatg

SEQ ID NO: 728431 - DNA, 25 bp, Mus musculus
gttcctccgtgggactaagggtatg

SEQ ID NO: 728432 - DNA, 25 bp, Mus musculus
gttcctcctagcattcaatcactaa

SEQ ID NO: 728433 - DNA, 25 bp, Mus musculus
gttcctcctagctttcaatcactaa

SEQ ID NO: 728434 - DNA, 25 bp, Mus musculus
gttcctcctaggctaacaagggcag

SEQ ID NO: 728435 - DNA, 25 bp, Mus musculus
gttcctcctagggtaacaagggcag

SEQ ID NO: 728436 - DNA, 25 bp, Mus musculus
gttcctcctcccaagctattgaaaa

SEQ ID NO: 728437 - DNA, 25 bp, Mus musculus
gttcctcctccctagctattgaaaa

SEQ ID NO: 728438 - DNA, 25 bp, Mus musculus
gttcctcctcctctgcaaggctaga

SEQ ID NO: 728439 - DNA, 25 bp, Mus musculus
gttcctcctcctgtgcaaggctaga

SEQ ID NO: 728440 - DNA, 25 bp, Mus musculus
gttcctcctgggaaatatcctacca

SEQ ID NO: 728441 - DNA, 25 bp, Mus musculus
gttcctcctgggtaatatcctacca

SEQ ID NO: 728442 - DNA, 25 bp, Mus musculus
gttcctcctgttatgtaaattccac

SEQ ID NO: 728443 - DNA, 25 bp, Mus musculus
gttcctcctgttttgtaaattccac

SEQ ID NO: 728444 - DNA, 25 bp, Mus musculus
gttcctccttttaaaatggcaatgt

SEQ ID NO: 728445 - DNA, 25 bp, Mus musculus
gttcctcctttttaaatggcaatgt

SEQ ID NO: 728446 - DNA, 25 bp, Mus musculus
gttcctcgaattccagctgaagcta

SEQ ID NO: 728447 - DNA, 25 bp, Mus musculus
gttcctcgaattgcagctgaagcta

SEQ ID NO: 728448 - DNA, 25 bp, Mus musculus
gttcctcgagtaccgtcgccaggtt

SEQ ID NO: 728449 - DNA, 25 bp, Mus musculus
gttcctcgagtagcgtcgccaggtt

SEQ ID NO: 728450 - DNA, 25 bp, Mus musculus
gttcctcgccatctcggagacaatt

SEQ ID NO: 728451 - DNA, 25 bp, Mus musculus
gttcctcgccatgtcggagacaatt

SEQ ID NO: 728452 - DNA, 25 bp, Mus musculus
gttcctcgcggaagaacgcatgggc

SEQ ID NO: 728453 - DNA, 25 bp, Mus musculus
gttcctcgcggatgaacgcatgggc

SEQ ID NO: 728454 - DNA, 25 bp, Mus musculus
gttcctcggctgagatagtatcccc

SEQ ID NO: 728455 - DNA, 25 bp, Mus musculus
gttcctcggctgtgatagtatcccc

SEQ ID NO: 728456 - DNA, 25 bp, Mus musculus
gttcctcggtgcatgacggtcagat

SEQ ID NO: 728457 - DNA, 25 bp, Mus musculus
gttcctcggtgcttgacggtcagat

SEQ ID NO: 728458 - DNA, 25 bp, Mus musculus
gttcctcgtcctataccagtgtcaa

SEQ ID NO: 728459 - DNA, 25 bp, Mus musculus
gttcctcgtcctttaccagtgtcaa

SEQ ID NO: 728460 - DNA, 25 bp, Mus musculus
gttcctcgtggaccccgacaaggag

SEQ ID NO: 728461 - DNA, 25 bp, Mus musculus
gttcctcgtggagcccgacaaggag

SEQ ID NO: 728462 - DNA, 25 bp, Mus musculus
gttcctctagctagcttactaatgc

SEQ ID NO: 728463 - DNA, 25 bp, Mus musculus
gttcctctagcttgcttactaatgc

SEQ ID NO: 728464 - DNA, 25 bp, Mus musculus
gttcctctatacatgtaaagacaca

SEQ ID NO: 728465 - DNA, 25 bp, Mus musculus
gttcctctatacttgtaaagacaca

SEQ ID NO: 728466 - DNA, 25 bp, Mus musculus
gttcctctatgcatttcctaggttt

SEQ ID NO: 728467 - DNA, 25 bp, Mus musculus
gttcctctatgcttttcctaggttt

SEQ ID NO: 728468 - DNA, 25 bp, Mus musculus
gttcctctcagcctttgggtttggg

SEQ ID NO: 728469 - DNA, 25 bp, Mus musculus
gttcctctcagcgtttgggtttggg

SEQ ID NO: 728470 - DNA, 25 bp, Mus musculus
gttcctctcaggcatatctccagga

SEQ ID NO: 728471 - DNA, 25 bp, Mus musculus
gttcctctcagggatatctccagga

SEQ ID NO: 728472 - DNA, 25 bp, Mus musculus
gttcctctcagtcccaagatttaca

SEQ ID NO: 728473 - DNA, 25 bp, Mus musculus
gttcctctcagtgccaagatttaca

SEQ ID NO: 728474 - DNA, 25 bp, Mus musculus
gttcctctcatgatcttctctaatt

SEQ ID NO: 728475 - DNA, 25 bp, Mus musculus
gttcctctcatgttcttctctaatt

SEQ ID NO: 728476 - DNA, 25 bp, Mus musculus
gttcctctcggaaactttgctgtaa

SEQ ID NO: 728477 - DNA, 25 bp, Mus musculus
gttcctctcggatactttgctgtaa

SEQ ID NO: 728478 - DNA, 25 bp, Mus musculus
gttcctctctcacggacttcttgaa

SEQ ID NO: 728479 - DNA, 25 bp, Mus musculus
gttcctctctcagggacttcttgaa

SEQ ID NO: 728480 - DNA, 25 bp, Mus musculus
gttcctctgaagcagccactctgtc

SEQ ID NO: 728481 - DNA, 25 bp, Mus musculus
gttcctctgaaggagccactctgtc

SEQ ID NO: 728482 - DNA, 25 bp, Mus musculus
gttcctctgagtagtattgataatt

SEQ ID NO: 728483 - DNA, 25 bp, Mus musculus
gttcctctgagtcatttggtttcat

SEQ ID NO: 728484 - DNA, 25 bp, Mus musculus
gttcctctgagtgatttggtttcat

SEQ ID NO: 728485 - DNA, 25 bp, Mus musculus
gttcctctgagttgtattgataatt

SEQ ID NO: 728486 - DNA, 25 bp, Mus musculus
gttcctctggctctaacaatctcta

SEQ ID NO: 728487 - DNA, 25 bp, Mus musculus
gttcctctggctgtaacaatctcta

SEQ ID NO: 728488 - DNA, 25 bp, Mus musculus
gttcctcttacaagccttttaagta

SEQ ID NO: 728489 - DNA, 25 bp, Mus musculus
gttcctcttacatgccttttaagta

SEQ ID NO: 728490 - DNA, 25 bp, Mus musculus
gttcctcttcacacaggtctgcaaa

SEQ ID NO: 728491 - DNA, 25 bp, Mus musculus
gttcctcttcactcaggtctgcaaa

SEQ ID NO: 728492 - DNA, 25 bp, Mus musculus
gttcctcttctgcttatatttttcc

SEQ ID NO: 728493 - DNA, 25 bp, Mus musculus
gttcctcttctggttatatttttcc

SEQ ID NO: 728494 - DNA, 25 bp, Mus musculus
gttcctcttggtcaaattgctataa

SEQ ID NO: 728495 - DNA, 25 bp, Mus musculus
gttcctcttggtgaaattgctataa

SEQ ID NO: 728496 - DNA, 25 bp, Mus musculus
gttcctgaaaatctgaagactccat

SEQ ID NO: 728497 - DNA, 25 bp, Mus musculus
gttcctgaaaatgtgaagactccat

SEQ ID NO: 728498 - DNA, 25 bp, Mus musculus
gttcctgaaacgcaccaaccagcaa

SEQ ID NO: 728499 - DNA, 25 bp, Mus musculus
gttcctgaaacggaccaaccagcaa

SEQ ID NO: 728500 - DNA, 25 bp, Mus musculus
gttcctgaacaaagggtgaattcct

SEQ ID NO: 728501 - DNA, 25 bp, Mus musculus
gttcctgaacaatgggtgaattcct

SEQ ID NO: 728502 - DNA, 25 bp, Mus musculus
gttcctgaagaacggtgccgactgt

SEQ ID NO: 728503 - DNA, 25 bp, Mus musculus
gttcctgaagaagggtgccgactgt

SEQ ID NO: 728504 - DNA, 25 bp, Mus musculus
gttcctgaagcacaggtttacagta

SEQ ID NO: 728505 - DNA, 25 bp, Mus musculus
gttcctgaagcagaggtttacagta

SEQ ID NO: 728506 - DNA, 25 bp, Mus musculus
gttcctgaagccaaggagcctttat

SEQ ID NO: 728507 - DNA, 25 bp, Mus musculus
gttcctgaagccaggattctatcct

SEQ ID NO: 728508 - DNA, 25 bp, Mus musculus
gttcctgaagcctaggagcctttat

SEQ ID NO: 728509 - DNA, 25 bp, Mus musculus
gttcctgaagcctggattctatcct

SEQ ID NO: 728510 - DNA, 25 bp, Mus musculus
gttcctgaaggtcagctgtgacgct

SEQ ID NO: 728511 - DNA, 25 bp, Mus musculus
gttcctgaaggtgagctgtgacgct

SEQ ID NO: 728512 - DNA, 25 bp, Mus musculus
gttcctgaatcaaaaagccagtctc

SEQ ID NO: 728513 - DNA, 25 bp, Mus musculus
gttcctgaatcataaagccagtctc

SEQ ID NO: 728514 - DNA, 25 bp, Mus musculus
gttcctgaatgcaccataattgctg

SEQ ID NO: 728515 - DNA, 25 bp, Mus musculus
gttcctgaatgctccataattgctg

SEQ ID NO: 728516 - DNA, 25 bp, Mus musculus
gttcctgactcacttgtcctaacag

SEQ ID NO: 728517 - DNA, 25 bp, Mus musculus
gttcctgactcagttgtcctaacag

SEQ ID NO: 728518 - DNA, 25 bp, Mus musculus
gttcctgactccctgtgagacacat

SEQ ID NO: 728519 - DNA, 25 bp, Mus musculus
gttcctgactccgtgtgagacacat

SEQ ID NO: 728520 - DNA, 25 bp, Mus musculus
gttcctgagagaagatgaggacagt

SEQ ID NO: 728521 - DNA, 25 bp, Mus musculus
gttcctgagagatgatgaggacagt

SEQ ID NO: 728522 - DNA, 25 bp, Mus musculus
gttcctgagatgagaaacaccttct

SEQ ID NO: 728523 - DNA, 25 bp, Mus musculus
gttcctgagatgtgaaacaccttct

SEQ ID NO: 728524 - DNA, 25 bp, Mus musculus
gttcctgagccacctcaaggaggag

SEQ ID NO: 728525 - DNA, 25 bp, Mus musculus
gttcctgagccagctcaaggaggag

SEQ ID NO: 728526 - DNA, 25 bp, Mus musculus
gttcctgagcgaaggctacgcagca

SEQ ID NO: 728527 - DNA, 25 bp, Mus musculus
gttcctgagcgatggctacgcagca

SEQ ID NO: 728528 - DNA, 25 bp, Mus musculus
gttcctgaggagattaccactgggt

SEQ ID NO: 728529 - DNA, 25 bp, Mus musculus
gttcctgaggagtttaccactgggt

SEQ ID NO: 728530 - DNA, 25 bp, Mus musculus
gttcctgaggatccaactcagttag

SEQ ID NO: 728531 - DNA, 25 bp, Mus musculus
gttcctgaggatgcaactcagttag

SEQ ID NO: 728532 - DNA, 25 bp, Mus musculus
gttcctgagtatcccagagccagca

SEQ ID NO: 728533 - DNA, 25 bp, Mus musculus
gttcctgagtatgccagagccagca

SEQ ID NO: 728534 - DNA, 25 bp, Mus musculus
gttcctgagtctagaataattcact

SEQ ID NO: 728535 - DNA, 25 bp, Mus musculus
gttcctgagtcttgaataattcact

SEQ ID NO: 728536 - DNA, 25 bp, Mus musculus
gttcctgatacccatgtaaagctgg

SEQ ID NO: 728537 - DNA, 25 bp, Mus musculus
gttcctgataccgatgtaaagctgg

SEQ ID NO: 728538 - DNA, 25 bp, Mus musculus
gttcctgatagacattgggctggct

SEQ ID NO: 728539 - DNA, 25 bp, Mus musculus
gttcctgatagagattgggctggct

SEQ ID NO: 728540 - DNA, 25 bp, Mus musculus
gttcctgatcttctggtgatcccag

SEQ ID NO: 728541 - DNA, 25 bp, Mus musculus
gttcctgatcttgtggtgatcccag

SEQ ID NO: 728542 - DNA, 25 bp, Mus musculus
gttcctgatgacattgagaccatgc

SEQ ID NO: 728543 - DNA, 25 bp, Mus musculus
gttcctgatgactttgagaccatgc

SEQ ID NO: 728544 - DNA, 25 bp, Mus musculus
gttcctgatgctctggataaactga

SEQ ID NO: 728545 - DNA, 25 bp, Mus musculus
gttcctgatgctgtggataaactga

SEQ ID NO: 728546 - DNA, 25 bp, Mus musculus
gttcctgatgtcaacagtgcctgta

SEQ ID NO: 728547 - DNA, 25 bp, Mus musculus
gttcctgatgtctacagtgcctgta

SEQ ID NO: 728548 - DNA, 25 bp, Mus musculus
gttcctgatgtgactccagactaca

SEQ ID NO: 728549 - DNA, 25 bp, Mus musculus
gttcctgatgtgagtttgtaaagtg

SEQ ID NO: 728550 - DNA, 25 bp, Mus musculus
gttcctgatgtgtctccagactaca

SEQ ID NO: 728551 - DNA, 25 bp, Mus musculus
gttcctgatgtgtgtttgtaaagtg

SEQ ID NO: 728552 - DNA, 25 bp, Mus musculus
gttcctgcaatccaacttcttaggt

SEQ ID NO: 728553 - DNA, 25 bp, Mus musculus
gttcctgcaatcgaacttcttaggt

SEQ ID NO: 728554 - DNA, 25 bp, Mus musculus
gttcctgcaccgaaacctgtggcat

SEQ ID NO: 728555 - DNA, 25 bp, Mus musculus
gttcctgcaccgtaacctgtggcat

SEQ ID NO: 728556 - DNA, 25 bp, Mus musculus
gttcctgcacggcagcttttattat

SEQ ID NO: 728557 - DNA, 25 bp, Mus musculus
gttcctgcacgggagcttttattat

SEQ ID NO: 728558 - DNA, 25 bp, Mus musculus
gttcctgcacttccaggctagtgca

SEQ ID NO: 728559 - DNA, 25 bp, Mus musculus
gttcctgcacttgcaggctagtgca

SEQ ID NO: 728560 - DNA, 25 bp, Mus musculus
gttcctgcagctagatttaaataga

SEQ ID NO: 728561 - DNA, 25 bp, Mus musculus
gttcctgcagcttgatttaaataga

SEQ ID NO: 728562 - DNA, 25 bp, Mus musculus
gttcctgcatagatctgagctgtcc

SEQ ID NO: 728563 - DNA, 25 bp, Mus musculus
gttcctgcatagttctgagctgtcc

SEQ ID NO: 728564 - DNA, 25 bp, Mus musculus
gttcctgcatccagtacataatgtt

SEQ ID NO: 728565 - DNA, 25 bp, Mus musculus
gttcctgcatcctgtacataatgtt

SEQ ID NO: 728566 - DNA, 25 bp, Mus musculus
gttcctgcattactagctacagtgg

SEQ ID NO: 728567 - DNA, 25 bp, Mus musculus
gttcctgcattagtagctacagtgg

SEQ ID NO: 728568 - DNA, 25 bp, Mus musculus
gttcctgcattgcaagtgccaggat

SEQ ID NO: 728569 - DNA, 25 bp, Mus musculus
gttcctgcattggaagtgccaggat

SEQ ID NO: 728570 - DNA, 25 bp, Mus musculus
gttcctgccactcctgaaattttta

SEQ ID NO: 728571 - DNA, 25 bp, Mus musculus
gttcctgccactgctgaaattttta

SEQ ID NO: 728572 - DNA, 25 bp, Mus musculus
gttcctgcccatattgggagagatg

SEQ ID NO: 728573 - DNA, 25 bp, Mus musculus
gttcctgcccatcgatgtctgtgtg

SEQ ID NO: 728574 - DNA, 25 bp, Mus musculus
gttcctgcccatggatgtctgtgtg

SEQ ID NO: 728575 - DNA, 25 bp, Mus musculus
gttcctgcccattttgggagagatg

SEQ ID NO: 728576 - DNA, 25 bp, Mus musculus
gttcctgccctgaattatatgtgag

SEQ ID NO: 728577 - DNA, 25 bp, Mus musculus
gttcctgccctgagagttagcagct

SEQ ID NO: 728578 - DNA, 25 bp, Mus musculus
gttcctgccctgtattatatgtgag

SEQ ID NO: 728579 - DNA, 25 bp, Mus musculus
gttcctgccctgtgagttagcagct

SEQ ID NO: 728580 - DNA, 25 bp, Mus musculus
gttcctgcctcacatgaaccaatgc

SEQ ID NO: 728581 - DNA, 25 bp, Mus musculus
gttcctgcctcagatgaaccaatgc

SEQ ID NO: 728582 - DNA, 25 bp, Mus musculus
gttcctgcctgcctgcagggtaaga

SEQ ID NO: 728583 - DNA, 25 bp, Mus musculus
gttcctgcctgcgtgcagggtaaga

SEQ ID NO: 728584 - DNA, 25 bp, Mus musculus
gttcctgcgcaaagggatcagtggc

SEQ ID NO: 728585 - DNA, 25 bp, Mus musculus
gttcctgcgcaatgggatcagtggc

SEQ ID NO: 728586 - DNA, 25 bp, Mus musculus
gttcctgcgtacatgaaatcccgtt

SEQ ID NO: 728587 - DNA, 25 bp, Mus musculus
gttcctgcgtacttgaaatcccgtt

SEQ ID NO: 728588 - DNA, 25 bp, Mus musculus
gttcctgctaaaatttgtacactca

SEQ ID NO: 728589 - DNA, 25 bp, Mus musculus
gttcctgctaaattttgtacactca

SEQ ID NO: 728590 - DNA, 25 bp, Mus musculus
gttcctgctaggatttatattctag

SEQ ID NO: 728591 - DNA, 25 bp, Mus musculus
gttcctgctaggttttatattctag

SEQ ID NO: 728592 - DNA, 25 bp, Mus musculus
gttcctgctcatctggctgacaacg

SEQ ID NO: 728593 - DNA, 25 bp, Mus musculus
gttcctgctcatgtggctgacaacg

SEQ ID NO: 728594 - DNA, 25 bp, Mus musculus
gttcctgctccccaagaggacacag

SEQ ID NO: 728595 - DNA, 25 bp, Mus musculus
gttcctgctcccgaagaggacacag

SEQ ID NO: 728596 - DNA, 25 bp, Mus musculus
gttcctgctgaaatagacaaggcta

SEQ ID NO: 728597 - DNA, 25 bp, Mus musculus
gttcctgctgaattagacaaggcta

SEQ ID NO: 728598 - DNA, 25 bp, Mus musculus
gttcctgctgaccttttgagatagt

SEQ ID NO: 728599 - DNA, 25 bp, Mus musculus
gttcctgctgacgttttgagatagt

SEQ ID NO: 728600 - DNA, 25 bp, Mus musculus
gttcctgctgcacaagtcagattcc

SEQ ID NO: 728601 - DNA, 25 bp, Mus musculus
gttcctgctgcagaagtcagattcc

SEQ ID NO: 728602 - DNA, 25 bp, Mus musculus
gttcctgctggaagtgtatagctgg

SEQ ID NO: 728603 - DNA, 25 bp, Mus musculus
gttcctgctggatgtgtatagctgg

SEQ ID NO: 728604 - DNA, 25 bp, Mus musculus
gttcctgctggcatggaccaacgaa

SEQ ID NO: 728605 - DNA, 25 bp, Mus musculus
gttcctgctggcttggaccaacgaa

SEQ ID NO: 728606 - DNA, 25 bp, Mus musculus
gttcctgcttatctgggaggcatgt

SEQ ID NO: 728607 - DNA, 25 bp, Mus musculus
gttcctgcttatgtgggaggcatgt

SEQ ID NO: 728608 - DNA, 25 bp, Mus musculus
gttcctgcttgccaacacttgttca

SEQ ID NO: 728609 - DNA, 25 bp, Mus musculus
gttcctgcttgcgaacacttgttca

SEQ ID NO: 728610 - DNA, 25 bp, Mus musculus
gttcctgcttgtccttgaggcctaa

SEQ ID NO: 728611 - DNA, 25 bp, Mus musculus
gttcctgcttgtgcttgaggcctaa

SEQ ID NO: 728612 - DNA, 25 bp, Mus musculus
gttcctgcttttatctcaaaagacg

SEQ ID NO: 728613 - DNA, 25 bp, Mus musculus
gttcctgcttttttctcaaaagacg

SEQ ID NO: 728614 - DNA, 25 bp, Mus musculus
gttcctggaaagaggcctttgcttt

SEQ ID NO: 728615 - DNA, 25 bp, Mus musculus
gttcctggaaagtggcctttgcttt

SEQ ID NO: 728616 - DNA, 25 bp, Mus musculus
gttcctggaacccacacagtggaag

SEQ ID NO: 728617 - DNA, 25 bp, Mus musculus
gttcctggaaccgacacagtggaag

SEQ ID NO: 728618 - DNA, 25 bp, Mus musculus
gttcctggaatgctgctatccacaa

SEQ ID NO: 728619 - DNA, 25 bp, Mus musculus
gttcctggaatggtgctatccacaa

SEQ ID NO: 728620 - DNA, 25 bp, Mus musculus
gttcctggacacaaagactgttgtt

SEQ ID NO: 728621 - DNA, 25 bp, Mus musculus
gttcctggacactaagactgttgtt

SEQ ID NO: 728622 - DNA, 25 bp, Mus musculus
gttcctggagaactgctacaacccg

SEQ ID NO: 728623 - DNA, 25 bp, Mus musculus
gttcctggagaagtgctacaacccg

SEQ ID NO: 728624 - DNA, 25 bp, Mus musculus
gttcctggagagagcttcagtactt

SEQ ID NO: 728625 - DNA, 25 bp, Mus musculus
gttcctggagagtgcttcagtactt

SEQ ID NO: 728626 - DNA, 25 bp, Mus musculus
gttcctggaggaatgtgagtcccac

SEQ ID NO: 728627 - DNA, 25 bp, Mus musculus
gttcctggaggactctgtatcaatg

SEQ ID NO: 728628 - DNA, 25 bp, Mus musculus
gttcctggaggagtctgtatcaatg

SEQ ID NO: 728629 - DNA, 25 bp, Mus musculus
gttcctggaggattgtgagtcccac

SEQ ID NO: 728630 - DNA, 25 bp, Mus musculus
gttcctggaggcaactttgtatcca

SEQ ID NO: 728631 - DNA, 25 bp, Mus musculus
gttcctggaggctactttgtatcca

SEQ ID NO: 728632 - DNA, 25 bp, Mus musculus
gttcctggaggtctgccaagtgccc

SEQ ID NO: 728633 - DNA, 25 bp, Mus musculus
gttcctggaggtgtgccaagtgccc

SEQ ID NO: 728634 - DNA, 25 bp, Mus musculus
gttcctggatcccagcctatgctga

SEQ ID NO: 728635 - DNA, 25 bp, Mus musculus
gttcctggatccgagcctatgctga

SEQ ID NO: 728636 - DNA, 25 bp, Mus musculus
gttcctggcaatagcgtgttccaat

SEQ ID NO: 728637 - DNA, 25 bp, Mus musculus
gttcctggcaattgcgtgttccaat

SEQ ID NO: 728638 - DNA, 25 bp, Mus musculus
gttcctggcagtcttccagaagtga

SEQ ID NO: 728639 - DNA, 25 bp, Mus musculus
gttcctggcagtgttccagaagtga

SEQ ID NO: 728640 - DNA, 25 bp, Mus musculus
gttcctggcatcatgggtagctgca

SEQ ID NO: 728641 - DNA, 25 bp, Mus musculus
gttcctggcatcttgggtagctgca

SEQ ID NO: 728642 - DNA, 25 bp, Mus musculus
gttcctggcccactgacaagcatgg

SEQ ID NO: 728643 - DNA, 25 bp, Mus musculus
gttcctggcccagtgacaagcatgg

SEQ ID NO: 728644 - DNA, 25 bp, Mus musculus
gttcctggccttcagtttgtgagat

SEQ ID NO: 728645 - DNA, 25 bp, Mus musculus
gttcctggccttgagtttgtgagat

SEQ ID NO: 728646 - DNA, 25 bp, Mus musculus
gttcctggcggcctacattaaagca

SEQ ID NO: 728647 - DNA, 25 bp, Mus musculus
gttcctggcggcgtacattaaagca

SEQ ID NO: 728648 - DNA, 25 bp, Mus musculus
gttcctggcggtcgtcatatggact

SEQ ID NO: 728649 - DNA, 25 bp, Mus musculus
gttcctggcggtggtcatatggact

SEQ ID NO: 728650 - DNA, 25 bp, Mus musculus
gttcctggcgtcacagttggagatc

SEQ ID NO: 728651 - DNA, 25 bp, Mus musculus
gttcctggcgtctcagttggagatc

SEQ ID NO: 728652 - DNA, 25 bp, Mus musculus
gttcctggctccaacagctgataag

SEQ ID NO: 728653 - DNA, 25 bp, Mus musculus
gttcctggctcctacagctgataag

SEQ ID NO: 728654 - DNA, 25 bp, Mus musculus
gttcctggctgtagtatgcattttc

SEQ ID NO: 728655 - DNA, 25 bp, Mus musculus
gttcctggctgttgtatgcattttc

SEQ ID NO: 728656 - DNA, 25 bp, Mus musculus
gttcctgggagaaacctaatgatga

SEQ ID NO: 728657 - DNA, 25 bp, Mus musculus
gttcctgggagatacctaatgatga

SEQ ID NO: 728658 - DNA, 25 bp, Mus musculus
gttcctgggagcagcctttaaattt

SEQ ID NO: 728659 - DNA, 25 bp, Mus musculus
gttcctgggagctgcctttaaattt

SEQ ID NO: 728660 - DNA, 25 bp, Mus musculus
gttcctgggcggatgggatacacac

SEQ ID NO: 728661 - DNA, 25 bp, Mus musculus
gttcctgggcggttgggatacacac

SEQ ID NO: 728662 - DNA, 25 bp, Mus musculus
gttcctgggctgctttgctggcttc

SEQ ID NO: 728663 - DNA, 25 bp, Mus musculus
gttcctgggctggtttgctggcttc

SEQ ID NO: 728664 - DNA, 25 bp, Mus musculus
gttcctggtcaaagatctataacat

SEQ ID NO: 728665 - DNA, 25 bp, Mus musculus
gttcctggtcaatgatctataacat

SEQ ID NO: 728666 - DNA, 25 bp, Mus musculus
gttcctggtggtagcctatgtttca

SEQ ID NO: 728667 - DNA, 25 bp, Mus musculus
gttcctggtggttgcctatgtttca

SEQ ID NO: 728668 - DNA, 25 bp, Mus musculus
gttcctggtgttccagacgctcctg

SEQ ID NO: 728669 - DNA, 25 bp, Mus musculus
gttcctggtgttgcagacgctcctg

SEQ ID NO: 728670 - DNA, 25 bp, Mus musculus
gttcctgtacccctctggtattggt

SEQ ID NO: 728671 - DNA, 25 bp, Mus musculus
gttcctgtacccgtctggtattggt

SEQ ID NO: 728672 - DNA, 25 bp, Mus musculus
gttcctgtactacttgagttcctaa

SEQ ID NO: 728673 - DNA, 25 bp, Mus musculus
gttcctgtactagttgagttcctaa

SEQ ID NO: 728674 - DNA, 25 bp, Mus musculus
gttcctgtagaaatctctggattcc

SEQ ID NO: 728675 - DNA, 25 bp, Mus musculus
gttcctgtagaattctctggattcc

SEQ ID NO: 728676 - DNA, 25 bp, Mus musculus
gttcctgtatctatcagtcctgttg

SEQ ID NO: 728677 - DNA, 25 bp, Mus musculus
gttcctgtatctttcagtcctgttg

SEQ ID NO: 728678 - DNA, 25 bp, Mus musculus
gttcctgtcacgaaggttatgctaa

SEQ ID NO: 728679 - DNA, 25 bp, Mus musculus
gttcctgtcacgtaggttatgctaa

SEQ ID NO: 728680 - DNA, 25 bp, Mus musculus
gttcctgtcattcctgcagtgagga

SEQ ID NO: 728681 - DNA, 25 bp, Mus musculus
gttcctgtcattgctgcagtgagga

SEQ ID NO: 728682 - DNA, 25 bp, Mus musculus
gttcctgtccagactgcaggatgga

SEQ ID NO: 728683 - DNA, 25 bp, Mus musculus
gttcctgtccagtctgcaggatgga

SEQ ID NO: 728684 - DNA, 25 bp, Mus musculus
gttcctgtcgaacaacaacgtcggc

SEQ ID NO: 728685 - DNA, 25 bp, Mus musculus
gttcctgtcgaagaacaacgtcggc

SEQ ID NO: 728686 - DNA, 25 bp, Mus musculus
gttcctgtctgactgtcactggaga

SEQ ID NO: 728687 - DNA, 25 bp, Mus musculus
gttcctgtctgagtgtcactggaga

SEQ ID NO: 728688 - DNA, 25 bp, Mus musculus
gttcctgtcttcctggtatggcaca

SEQ ID NO: 728689 - DNA, 25 bp, Mus musculus
gttcctgtcttcgtggtatggcaca

SEQ ID NO: 728690 - DNA, 25 bp, Mus musculus
gttcctgtcttgatttgaagcacat

SEQ ID NO: 728691 - DNA, 25 bp, Mus musculus
gttcctgtcttgttttgaagcacat

SEQ ID NO: 728692 - DNA, 25 bp, Mus musculus
gttcctgtgaaaagttgatctctgt

SEQ ID NO: 728693 - DNA, 25 bp, Mus musculus
gttcctgtgaaatgttgatctctgt

SEQ ID NO: 728694 - DNA, 25 bp, Mus musculus
gttcctgtgaataatgtgtaccgta

SEQ ID NO: 728695 - DNA, 25 bp, Mus musculus
gttcctgtgaattatgtgtaccgta

SEQ ID NO: 728696 - DNA, 25 bp, Mus musculus
gttcctgtgaccaagtagtaaatta

SEQ ID NO: 728697 - DNA, 25 bp, Mus musculus
gttcctgtgacctagtagtaaatta

SEQ ID NO: 728698 - DNA, 25 bp, Mus musculus
gttcctgtgatcctgtgtgtatgtg

SEQ ID NO: 728699 - DNA, 25 bp, Mus musculus
gttcctgtgatcgtgtgtgtatgtg

SEQ ID NO: 728700 - DNA, 25 bp, Mus musculus
gttcctgtgcagataagaccaagtc

SEQ ID NO: 728701 - DNA, 25 bp, Mus musculus
gttcctgtgcagttaagaccaagtc

SEQ ID NO: 728702 - DNA, 25 bp, Mus musculus
gttcctgtggagctgtgaactgcat

SEQ ID NO: 728703 - DNA, 25 bp, Mus musculus
gttcctgtggaggtgtgaactgcat

SEQ ID NO: 728704 - DNA, 25 bp, Mus musculus
gttcctgtggccaacaagcgggaca

SEQ ID NO: 728705 - DNA, 25 bp, Mus musculus
gttcctgtggccagaacatgagcgc

SEQ ID NO: 728706 - DNA, 25 bp, Mus musculus
gttcctgtggcctacaagcgggaca

SEQ ID NO: 728707 - DNA, 25 bp, Mus musculus
gttcctgtggcctgaacatgagcgc

SEQ ID NO: 728708 - DNA, 25 bp, Mus musculus
gttcctgtgggactgcacttacaga

SEQ ID NO: 728709 - DNA, 25 bp, Mus musculus
gttcctgtgggagtgcacttacaga

SEQ ID NO: 728710 - DNA, 25 bp, Mus musculus
gttcctgtggtacacttttcagaga

SEQ ID NO: 728711 - DNA, 25 bp, Mus musculus
gttcctgtggtagacttttcagaga

SEQ ID NO: 728712 - DNA, 25 bp, Mus musculus
gttcctgtggtgagatgtttgtcaa

SEQ ID NO: 728713 - DNA, 25 bp, Mus musculus
gttcctgtggtgtgatgtttgtcaa

SEQ ID NO: 728714 - DNA, 25 bp, Mus musculus
gttcctgtgtcacaacttctgttgt

SEQ ID NO: 728715 - DNA, 25 bp, Mus musculus
gttcctgtgtcagaacttctgttgt

SEQ ID NO: 728716 - DNA, 25 bp, Mus musculus
gttcctgtgtgacatagtgctggca

SEQ ID NO: 728717 - DNA, 25 bp, Mus musculus
gttcctgtgtgagatagtgctggca

SEQ ID NO: 728718 - DNA, 25 bp, Mus musculus
gttcctgtgtgtacctgaactttaa

SEQ ID NO: 728719 - DNA, 25 bp, Mus musculus
gttcctgtgtgttcctgaactttaa

SEQ ID NO: 728720 - DNA, 25 bp, Mus musculus
gttcctgtgttcagtagcatggtta

SEQ ID NO: 728721 - DNA, 25 bp, Mus musculus
gttcctgtgttctgtagcatggtta

SEQ ID NO: 728722 - DNA, 25 bp, Mus musculus
gttcctgttcaccttatgtattgtt

SEQ ID NO: 728723 - DNA, 25 bp, Mus musculus
gttcctgttcacgttatgtattgtt

SEQ ID NO: 728724 - DNA, 25 bp, Mus musculus
gttcctgttctacataaccaagccc

SEQ ID NO: 728725 - DNA, 25 bp, Mus musculus
gttcctgttctagataaccaagccc

SEQ ID NO: 728726 - DNA, 25 bp, Mus musculus
gttcctgttctcaagcacatagcag

SEQ ID NO: 728727 - DNA, 25 bp, Mus musculus
gttcctgttctctagcacatagcag

SEQ ID NO: 728728 - DNA, 25 bp, Mus musculus
gttcctgttcttaagtgtcactcac

SEQ ID NO: 728729 - DNA, 25 bp, Mus musculus
gttcctgttctttagtgtcactcac

SEQ ID NO: 728730 - DNA, 25 bp, Mus musculus
gttcctgttgagagttcgattccct

SEQ ID NO: 728731 - DNA, 25 bp, Mus musculus
gttcctgttgagtgttcgattccct

SEQ ID NO: 728732 - DNA, 25 bp, Mus musculus
gttcctgttgctacaaggaaggttc

SEQ ID NO: 728733 - DNA, 25 bp, Mus musculus
gttcctgttgcttcaaggaaggttc

SEQ ID NO: 728734 - DNA, 25 bp, Mus musculus
gttcctgttgtaatcgtcactaaca

SEQ ID NO: 728735 - DNA, 25 bp, Mus musculus
gttcctgttgtacgtttcgcataaa

SEQ ID NO: 728736 - DNA, 25 bp, Mus musculus
gttcctgttgtaggtttcgcataaa

SEQ ID NO: 728737 - DNA, 25 bp, Mus musculus
gttcctgttgtattcgtcactaaca

SEQ ID NO: 728738 - DNA, 25 bp, Mus musculus
gttcctgtttctcagttctgattta

SEQ ID NO: 728739 - DNA, 25 bp, Mus musculus
gttcctgtttctgagttctgattta

SEQ ID NO: 728740 - DNA, 25 bp, Mus musculus
gttcctgtttgtcacttttccaggg

SEQ ID NO: 728741 - DNA, 25 bp, Mus musculus
gttcctgtttgtgacttttccaggg

SEQ ID NO: 728742 - DNA, 25 bp, Mus musculus
gttcctgttttgaagtcttgtggat

SEQ ID NO: 728743 - DNA, 25 bp, Mus musculus
gttcctgttttgtagtcttgtggat

SEQ ID NO: 728744 - DNA, 25 bp, Mus musculus
gttccttaaaagagtcaccatgaac

SEQ ID NO: 728745 - DNA, 25 bp, Mus musculus
gttccttaaaagtgtcaccatgaac

SEQ ID NO: 728746 - DNA, 25 bp, Mus musculus
gttccttaatagagtcctcggttat

SEQ ID NO: 728747 - DNA, 25 bp, Mus musculus
gttccttaatagtgtcctcggttat

SEQ ID NO: 728748 - DNA, 25 bp, Mus musculus
gttccttaatcacagactcagttgt

SEQ ID NO: 728749 - DNA, 25 bp, Mus musculus
gttccttaatcagagactcagttgt

SEQ ID NO: 728750 - DNA, 25 bp, Mus musculus
gttccttaccataacctgctgggaa

SEQ ID NO: 728751 - DNA, 25 bp, Mus musculus
gttccttaccattacctgctgggaa

SEQ ID NO: 728752 - DNA, 25 bp, Mus musculus
gttccttactacacagcattcatac

SEQ ID NO: 728753 - DNA, 25 bp, Mus musculus
gttccttactactcagcattcatac

SEQ ID NO: 728754 - DNA, 25 bp, Mus musculus
gttccttagcatcacgcgaagagtt

SEQ ID NO: 728755 - DNA, 25 bp, Mus musculus
gttccttagcatgacgcgaagagtt

SEQ ID NO: 728756 - DNA, 25 bp, Mus musculus
gttccttaggcaatcattctatctt

SEQ ID NO: 728757 - DNA, 25 bp, Mus musculus
gttccttaggcattcattctatctt

SEQ ID NO: 728758 - DNA, 25 bp, Mus musculus
gttccttagttcctgtatcttgatg

SEQ ID NO: 728759 - DNA, 25 bp, Mus musculus
gttccttagttcgtgtatcttgatg

SEQ ID NO: 728760 - DNA, 25 bp, Mus musculus
gttccttatcacacactagactcaa

SEQ ID NO: 728761 - DNA, 25 bp, Mus musculus
gttccttatcactcactagactcaa

SEQ ID NO: 728762 - DNA, 25 bp, Mus musculus
gttccttatcagacctactatactc

SEQ ID NO: 728763 - DNA, 25 bp, Mus musculus
gttccttatcagtcctactatactc

SEQ ID NO: 728764 - DNA, 25 bp, Mus musculus
gttccttatcgtacatatcatcaca

SEQ ID NO: 728765 - DNA, 25 bp, Mus musculus
gttccttatcgtattcgtcacagca

SEQ ID NO: 728766 - DNA, 25 bp, Mus musculus
gttccttatcgttcatatcatcaca

SEQ ID NO: 728767 - DNA, 25 bp, Mus musculus
gttccttatcgttttcgtcacagca

SEQ ID NO: 728768 - DNA, 25 bp, Mus musculus
gttccttatctcatcttactaaaag

SEQ ID NO: 728769 - DNA, 25 bp, Mus musculus
gttccttatctcttcttactaaaag

SEQ ID NO: 728770 - DNA, 25 bp, Mus musculus
gttccttatctgctgatgtttccag

SEQ ID NO: 728771 - DNA, 25 bp, Mus musculus
gttccttatctggtgatgtttccag

SEQ ID NO: 728772 - DNA, 25 bp, Mus musculus
gttccttattccaccactagaaaga

SEQ ID NO: 728773 - DNA, 25 bp, Mus musculus
gttccttattcctccactagaaaga

SEQ ID NO: 728774 - DNA, 25 bp, Mus musculus
gttccttattggattcagcatgccc

SEQ ID NO: 728775 - DNA, 25 bp, Mus musculus
gttccttattggtttcagcatgccc

SEQ ID NO: 728776 - DNA, 25 bp, Mus musculus
gttccttcaataatccggttgtagt

SEQ ID NO: 728777 - DNA, 25 bp, Mus musculus
gttccttcaatattccggttgtagt

SEQ ID NO: 728778 - DNA, 25 bp, Mus musculus
gttccttcacacaaagttttccagg

SEQ ID NO: 728779 - DNA, 25 bp, Mus musculus
gttccttcacactaagttttccagg

SEQ ID NO: 728780 - DNA, 25 bp, Mus musculus
gttccttcacatatctctaatctgg

SEQ ID NO: 728781 - DNA, 25 bp, Mus musculus
gttccttcacatatgaaacgcactg

SEQ ID NO: 728782 - DNA, 25 bp, Mus musculus
gttccttcacatttctctaatctgg

SEQ ID NO: 728783 - DNA, 25 bp, Mus musculus
gttccttcacatttgaaacgcactg

SEQ ID NO: 728784 - DNA, 25 bp, Mus musculus
gttccttcagatatgggccaaccca

SEQ ID NO: 728785 - DNA, 25 bp, Mus musculus
gttccttcagatcagcagtagacac

SEQ ID NO: 728786 - DNA, 25 bp, Mus musculus
gttccttcagatgagcagtagacac

SEQ ID NO: 728787 - DNA, 25 bp, Mus musculus
gttccttcagatttgggccaaccca

SEQ ID NO: 728788 - DNA, 25 bp, Mus musculus
gttccttcaggcctggtattttatc

SEQ ID NO: 728789 - DNA, 25 bp, Mus musculus
gttccttcaggcgtggtattttatc

SEQ ID NO: 728790 - DNA, 25 bp, Mus musculus
gttccttcagtaacttgtgtgattt

SEQ ID NO: 728791 - DNA, 25 bp, Mus musculus
gttccttcagtatcttgtgtgattt

SEQ ID NO: 728792 - DNA, 25 bp, Mus musculus
gttccttcagttctggagacacatg

SEQ ID NO: 728793 - DNA, 25 bp, Mus musculus
gttccttcagttgtggagacacatg

SEQ ID NO: 728794 - DNA, 25 bp, Mus musculus
gttccttccagcagggagtgttact

SEQ ID NO: 728795 - DNA, 25 bp, Mus musculus
gttccttccagctgggagtgttact

SEQ ID NO: 728796 - DNA, 25 bp, Mus musculus
gttccttccataataaacatacctg

SEQ ID NO: 728797 - DNA, 25 bp, Mus musculus
gttccttccatattaaacatacctg

SEQ ID NO: 728798 - DNA, 25 bp, Mus musculus
gttccttcccagacatacttatgga

SEQ ID NO: 728799 - DNA, 25 bp, Mus musculus
gttccttcccagctgagtccagtag

SEQ ID NO: 728800 - DNA, 25 bp, Mus musculus
gttccttcccaggtgagtccagtag

SEQ ID NO: 728801 - DNA, 25 bp, Mus musculus
gttccttcccagtcatacttatgga

SEQ ID NO: 728802 - DNA, 25 bp, Mus musculus
gttccttccctcagagagaagcgaa

SEQ ID NO: 728803 - DNA, 25 bp, Mus musculus
gttccttccctctgagagaagcgaa

SEQ ID NO: 728804 - DNA, 25 bp, Mus musculus
gttccttcccttcaactgaaatgtg

SEQ ID NO: 728805 - DNA, 25 bp, Mus musculus
gttccttcccttgaactgaaatgtg

SEQ ID NO: 728806 - DNA, 25 bp, Mus musculus
gttccttcctacaaaatagagtctt

SEQ ID NO: 728807 - DNA, 25 bp, Mus musculus
gttccttcctactaaatagagtctt

SEQ ID NO: 728808 - DNA, 25 bp, Mus musculus
gttccttcctggcagctatttagct

SEQ ID NO: 728809 - DNA, 25 bp, Mus musculus
gttccttcctgggagctatttagct

SEQ ID NO: 728810 - DNA, 25 bp, Mus musculus
gttccttcctttctgcttggtatca

SEQ ID NO: 728811 - DNA, 25 bp, Mus musculus
gttccttcctttgtgcttggtatca

SEQ ID NO: 728812 - DNA, 25 bp, Mus musculus
gttccttctattctagaaaccttca

SEQ ID NO: 728813 - DNA, 25 bp, Mus musculus
gttccttctattgtagaaaccttca

SEQ ID NO: 728814 - DNA, 25 bp, Mus musculus
gttccttctcacataccagtctgga

SEQ ID NO: 728815 - DNA, 25 bp, Mus musculus
gttccttctcacttaccagtctgga

SEQ ID NO: 728816 - DNA, 25 bp, Mus musculus
gttccttctccaatctctggaagca

SEQ ID NO: 728817 - DNA, 25 bp, Mus musculus
gttccttctccattctctggaagca

SEQ ID NO: 728818 - DNA, 25 bp, Mus musculus
gttccttctctcagttagttattcg

SEQ ID NO: 728819 - DNA, 25 bp, Mus musculus
gttccttctctctgttagttattcg

SEQ ID NO: 728820 - DNA, 25 bp, Mus musculus
gttccttctgagatggagactggat

SEQ ID NO: 728821 - DNA, 25 bp, Mus musculus
gttccttctgagttggagactggat

SEQ ID NO: 728822 - DNA, 25 bp, Mus musculus
gttccttctgtgactaaagccttga

SEQ ID NO: 728823 - DNA, 25 bp, Mus musculus
gttccttctgtgtctaaagccttga

SEQ ID NO: 728824 - DNA, 25 bp, Mus musculus
gttccttcttatcaagtgctctctc

SEQ ID NO: 728825 - DNA, 25 bp, Mus musculus
gttccttcttatgaagtgctctctc

SEQ ID NO: 728826 - DNA, 25 bp, Mus musculus
gttccttcttgaccgcctaactgca

SEQ ID NO: 728827 - DNA, 25 bp, Mus musculus
gttccttcttgagcgcctaactgca

SEQ ID NO: 728828 - DNA, 25 bp, Mus musculus
gttccttgaaagcacatcatgttta

SEQ ID NO: 728829 - DNA, 25 bp, Mus musculus
gttccttgaaaggacatcatgttta

SEQ ID NO: 728830 - DNA, 25 bp, Mus musculus
gttccttgaacaccattctcaggaa

SEQ ID NO: 728831 - DNA, 25 bp, Mus musculus
gttccttgaacactgtggattcccc

SEQ ID NO: 728832 - DNA, 25 bp, Mus musculus
gttccttgaacagcattctcaggaa

SEQ ID NO: 728833 - DNA, 25 bp, Mus musculus
gttccttgaacagtgtggattcccc

SEQ ID NO: 728834 - DNA, 25 bp, Mus musculus
gttccttgactaaagtggtgtacct

SEQ ID NO: 728835 - DNA, 25 bp, Mus musculus
gttccttgactatagtggtgtacct

SEQ ID NO: 728836 - DNA, 25 bp, Mus musculus
gttccttgacttatcatagagtgac

SEQ ID NO: 728837 - DNA, 25 bp, Mus musculus
gttccttgacttttcatagagtgac

SEQ ID NO: 728838 - DNA, 25 bp, Mus musculus
gttccttgagaaataggtactgtac

SEQ ID NO: 728839 - DNA, 25 bp, Mus musculus
gttccttgagaattaggtactgtac

SEQ ID NO: 728840 - DNA, 25 bp, Mus musculus
gttccttgagtgattgactgcctta

SEQ ID NO: 728841 - DNA, 25 bp, Mus musculus
gttccttgagtgtttgactgcctta

SEQ ID NO: 728842 - DNA, 25 bp, Mus musculus
gttccttgatacacctcagtacagg

SEQ ID NO: 728843 - DNA, 25 bp, Mus musculus
gttccttgatactcctcagtacagg

SEQ ID NO: 728844 - DNA, 25 bp, Mus musculus
gttccttgatgtactactttctttg

SEQ ID NO: 728845 - DNA, 25 bp, Mus musculus
gttccttgatgttctactttctttg

SEQ ID NO: 728846 - DNA, 25 bp, Mus musculus
gttccttgcacaacttacagttacc

SEQ ID NO: 728847 - DNA, 25 bp, Mus musculus
gttccttgcacatcttacagttacc

SEQ ID NO: 728848 - DNA, 25 bp, Mus musculus
gttccttgccaacttcgagattgcc

SEQ ID NO: 728849 - DNA, 25 bp, Mus musculus
gttccttgccaagttcgagattgcc

SEQ ID NO: 728850 - DNA, 25 bp, Mus musculus
gttccttgctccctgagagatacaa

SEQ ID NO: 728851 - DNA, 25 bp, Mus musculus
gttccttgctccgtgagagatacaa

SEQ ID NO: 728852 - DNA, 25 bp, Mus musculus
gttccttgctggacagcctagaatg

SEQ ID NO: 728853 - DNA, 25 bp, Mus musculus
gttccttgctggtcagcctagaatg

SEQ ID NO: 728854 - DNA, 25 bp, Mus musculus
gttccttggaataagtcatcctcag

SEQ ID NO: 728855 - DNA, 25 bp, Mus musculus
gttccttggaattagtcatcctcag

SEQ ID NO: 728856 - DNA, 25 bp, Mus musculus
gttccttggcagatgctttagcaaa

SEQ ID NO: 728857 - DNA, 25 bp, Mus musculus
gttccttggcagttgctttagcaaa

SEQ ID NO: 728858 - DNA, 25 bp, Mus musculus
gttccttggtctctctattttagat

SEQ ID NO: 728859 - DNA, 25 bp, Mus musculus
gttccttggtctgtctattttagat

SEQ ID NO: 728860 - DNA, 25 bp, Mus musculus
gttccttggtgtccgtagtgccaga

SEQ ID NO: 728861 - DNA, 25 bp, Mus musculus
gttccttggtgtgcgtagtgccaga

SEQ ID NO: 728862 - DNA, 25 bp, Mus musculus
gttccttgtcagatatataacttaa

SEQ ID NO: 728863 - DNA, 25 bp, Mus musculus
gttccttgtcagttatataacttaa

SEQ ID NO: 728864 - DNA, 25 bp, Mus musculus
gttccttgttcgacagttgtaatgc

SEQ ID NO: 728865 - DNA, 25 bp, Mus musculus
gttccttgttcgtcagttgtaatgc

SEQ ID NO: 728866 - DNA, 25 bp, Mus musculus
gttccttgttgtaatcaggaaacac

SEQ ID NO: 728867 - DNA, 25 bp, Mus musculus
gttccttgttgttatcaggaaacac

SEQ ID NO: 728868 - DNA, 25 bp, Mus musculus
gttccttgttttaactgttcatgct

SEQ ID NO: 728869 - DNA, 25 bp, Mus musculus
gttccttgtttttactgttcatgct

SEQ ID NO: 728870 - DNA, 25 bp, Mus musculus
gttcctttaacacgctcacacacag

SEQ ID NO: 728871 - DNA, 25 bp, Mus musculus
gttcctttaacaggctcacacacag

SEQ ID NO: 728872 - DNA, 25 bp, Mus musculus
gttcctttagggactcaacacttga

SEQ ID NO: 728873 - DNA, 25 bp, Mus musculus
gttcctttagggtctcaacacttga

SEQ ID NO: 728874 - DNA, 25 bp, Mus musculus
gttcctttatccctcagttgaaatg

SEQ ID NO: 728875 - DNA, 25 bp, Mus musculus
gttcctttatccgtcagttgaaatg

SEQ ID NO: 728876 - DNA, 25 bp, Mus musculus
gttcctttcagacccattaattcaa

SEQ ID NO: 728877 - DNA, 25 bp, Mus musculus
gttcctttcagagccattaattcaa

SEQ ID NO: 728878 - DNA, 25 bp, Mus musculus
gttcctttcataccgctctatagaa

SEQ ID NO: 728879 - DNA, 25 bp, Mus musculus
gttcctttcatagcgctctatagaa

SEQ ID NO: 728880 - DNA, 25 bp, Mus musculus
gttcctttcatcaacttgtttttca

SEQ ID NO: 728881 - DNA, 25 bp, Mus musculus
gttcctttcatcactactaggcaag

SEQ ID NO: 728882 - DNA, 25 bp, Mus musculus
gttcctttcatctacttgtttttca

SEQ ID NO: 728883 - DNA, 25 bp, Mus musculus
gttcctttcatctctactaggcaag

SEQ ID NO: 728884 - DNA, 25 bp, Mus musculus
gttcctttccttaatctctgtgtgc

SEQ ID NO: 728885 - DNA, 25 bp, Mus musculus
gttcctttcctttatctctgtgtgc

SEQ ID NO: 728886 - DNA, 25 bp, Mus musculus
gttcctttcgccagtacacatgaag

SEQ ID NO: 728887 - DNA, 25 bp, Mus musculus
gttcctttcgcctgtacacatgaag

SEQ ID NO: 728888 - DNA, 25 bp, Mus musculus
gttcctttcggtctgattctctctg

SEQ ID NO: 728889 - DNA, 25 bp, Mus musculus
gttcctttcggtgtgattctctctg

SEQ ID NO: 728890 - DNA, 25 bp, Mus musculus
gttcctttgatactgaaatcatcta

SEQ ID NO: 728891 - DNA, 25 bp, Mus musculus
gttcctttgatagtgaaatcatcta

SEQ ID NO: 728892 - DNA, 25 bp, Mus musculus
gttcctttggcgatgagagaagtaa

SEQ ID NO: 728893 - DNA, 25 bp, Mus musculus
gttcctttggcgttgagagaagtaa

SEQ ID NO: 728894 - DNA, 25 bp, Mus musculus
gttcctttgggcagacagactggtc

SEQ ID NO: 728895 - DNA, 25 bp, Mus musculus
gttcctttgggctgacagactggtc

SEQ ID NO: 728896 - DNA, 25 bp, Mus musculus
gttcctttgtatcttgagtactggc

SEQ ID NO: 728897 - DNA, 25 bp, Mus musculus
gttcctttgtatgttgagtactggc

SEQ ID NO: 728898 - DNA, 25 bp, Mus musculus
gttccttttgatccagtattcaagt

SEQ ID NO: 728899 - DNA, 25 bp, Mus musculus
gttccttttgatgcagtattcaagt

SEQ ID NO: 728900 - DNA, 25 bp, Mus musculus
gttccttttgctatcacacggaatt

SEQ ID NO: 728901 - DNA, 25 bp, Mus musculus
gttccttttgctttcacacggaatt

SEQ ID NO: 728902 - DNA, 25 bp, Mus musculus
gttccttttgtcaggccaataacag

SEQ ID NO: 728903 - DNA, 25 bp, Mus musculus
gttccttttgtctggccaataacag

SEQ ID NO: 728904 - DNA, 25 bp, Mus musculus
gttcgaaacaagctacccatatcat

SEQ ID NO: 728905 - DNA, 25 bp, Mus musculus
gttcgaaacaaggtacccatatcat

SEQ ID NO: 728906 - DNA, 25 bp, Mus musculus
gttcgaaacatcatcctaggcaagt

SEQ ID NO: 728907 - DNA, 25 bp, Mus musculus
gttcgaaacatcttcctaggcaagt

SEQ ID NO: 728908 - DNA, 25 bp, Mus musculus
gttcgaaagctgcaggtttgttatg

SEQ ID NO: 728909 - DNA, 25 bp, Mus musculus
gttcgaaagctggaggtttgttatg

SEQ ID NO: 728910 - DNA, 25 bp, Mus musculus
gttcgaaagtctaactggtggacat

SEQ ID NO: 728911 - DNA, 25 bp, Mus musculus
gttcgaaagtcttactggtggacat

SEQ ID NO: 728912 - DNA, 25 bp, Mus musculus
gttcgaaattctaaaccccgcagag

SEQ ID NO: 728913 - DNA, 25 bp, Mus musculus
gttcgaaattcttaaccccgcagag

SEQ ID NO: 728914 - DNA, 25 bp, Mus musculus
gttcgaacacttcagtggacttcta

SEQ ID NO: 728915 - DNA, 25 bp, Mus musculus
gttcgaacacttgagtggacttcta

SEQ ID NO: 728916 - DNA, 25 bp, Mus musculus
gttcgaaccgtgacgtagaggccaa

SEQ ID NO: 728917 - DNA, 25 bp, Mus musculus
gttcgaaccgtgtcgtagaggccaa

SEQ ID NO: 728918 - DNA, 25 bp, Mus musculus
gttcgaacctcacatatgggtggtt

SEQ ID NO: 728919 - DNA, 25 bp, Mus musculus
gttcgaacctcagatatgggtggtt

SEQ ID NO: 728920 - DNA, 25 bp, Mus musculus
gttcgaagcttgcatgaggccatta

SEQ ID NO: 728921 - DNA, 25 bp, Mus musculus
gttcgaagcttggatgaggccatta

SEQ ID NO: 728922 - DNA, 25 bp, Mus musculus
gttcgaagtccacttgcacaatcac

SEQ ID NO: 728923 - DNA, 25 bp, Mus musculus
gttcgaagtccagttgcacaatcac

SEQ ID NO: 728924 - DNA, 25 bp, Mus musculus
gttcgaatcaacacttgctagcttt

SEQ ID NO: 728925 - DNA, 25 bp, Mus musculus
gttcgaatcaactcttgctagcttt

SEQ ID NO: 728926 - DNA, 25 bp, Mus musculus
gttcgaatccccaggttctcaggaa

SEQ ID NO: 728927 - DNA, 25 bp, Mus musculus
gttcgaatcccctggttctcaggaa

SEQ ID NO: 728928 - DNA, 25 bp, Mus musculus
gttcgaatccgtctttttccactcg

SEQ ID NO: 728929 - DNA, 25 bp, Mus musculus
gttcgaatccgtgtttttccactcg

SEQ ID NO: 728930 - DNA, 25 bp, Mus musculus
gttcgacaaagtactctattagcaa

SEQ ID NO: 728931 - DNA, 25 bp, Mus musculus
gttcgacaaagttctctattagcaa

SEQ ID NO: 728932 - DNA, 25 bp, Mus musculus
gttcgacaggaacacaaagcgggat

SEQ ID NO: 728933 - DNA, 25 bp, Mus musculus
gttcgacaggaagacaaagcgggat

SEQ ID NO: 728934 - DNA, 25 bp, Mus musculus
gttcgacaggagagcttattgacat

SEQ ID NO: 728935 - DNA, 25 bp, Mus musculus
gttcgacaggagtgcttattgacat

SEQ ID NO: 728936 - DNA, 25 bp, Mus musculus
gttcgacattctattcttcttggga

SEQ ID NO: 728937 - DNA, 25 bp, Mus musculus
gttcgacattcttttcttcttggga

SEQ ID NO: 728938 - DNA, 25 bp, Mus musculus
gttcgacctgcacgaaaagttcaag

SEQ ID NO: 728939 - DNA, 25 bp, Mus musculus
gttcgacctgcaggaaaagttcaag

SEQ ID NO: 728940 - DNA, 25 bp, Mus musculus
gttcgactatctcgctagctgtgaa

SEQ ID NO: 728941 - DNA, 25 bp, Mus musculus
gttcgactatctggctagctgtgaa

SEQ ID NO: 728942 - DNA, 25 bp, Mus musculus
gttcgactatttccaggtgccagat

SEQ ID NO: 728943 - DNA, 25 bp, Mus musculus
gttcgactatttgcaggtgccagat

SEQ ID NO: 728944 - DNA, 25 bp, Mus musculus
gttcgactcaatatacgtggcttgt

SEQ ID NO: 728945 - DNA, 25 bp, Mus musculus
gttcgactcaatttacgtggcttgt

SEQ ID NO: 728946 - DNA, 25 bp, Mus musculus
gttcgagacaagctgcacaggttac

SEQ ID NO: 728947 - DNA, 25 bp, Mus musculus
gttcgagacaaggtgcacaggttac

SEQ ID NO: 728948 - DNA, 25 bp, Mus musculus
gttcgagcagcgagtggatgatgat

SEQ ID NO: 728949 - DNA, 25 bp, Mus musculus
gttcgagcagcgtgtggatgatgat

SEQ ID NO: 728950 - DNA, 25 bp, Mus musculus
gttcgagccctaaatttccatggac

SEQ ID NO: 728951 - DNA, 25 bp, Mus musculus
gttcgagccctatatttccatggac

SEQ ID NO: 728952 - DNA, 25 bp, Mus musculus
gttcgagcctctatcactgaagatt

SEQ ID NO: 728953 - DNA, 25 bp, Mus musculus
gttcgagcctctttcactgaagatt

SEQ ID NO: 728954 - DNA, 25 bp, Mus musculus
gttcgagccttacctgttgccggaa

SEQ ID NO: 728955 - DNA, 25 bp, Mus musculus
gttcgagccttagctgttgccggaa

SEQ ID NO: 728956 - DNA, 25 bp, Mus musculus
gttcgaggaacacctaggtctgcat

SEQ ID NO: 728957 - DNA, 25 bp, Mus musculus
gttcgaggaacagctaggtctgcat

SEQ ID NO: 728958 - DNA, 25 bp, Mus musculus
gttcgaggaagcatgtcaccaaaat

SEQ ID NO: 728959 - DNA, 25 bp, Mus musculus
gttcgaggaagcttgtcaccaaaat

SEQ ID NO: 728960 - DNA, 25 bp, Mus musculus
gttcgaggaggacactcacctgtga

SEQ ID NO: 728961 - DNA, 25 bp, Mus musculus
gttcgaggaggagactcacctgtga

SEQ ID NO: 728962 - DNA, 25 bp, Mus musculus
gttcgaggatacaccatgagcatct

SEQ ID NO: 728963 - DNA, 25 bp, Mus musculus
gttcgaggatactccatgagcatct

SEQ ID NO: 728964 - DNA, 25 bp, Mus musculus
gttcgaggcatgactagtgttgcta

SEQ ID NO: 728965 - DNA, 25 bp, Mus musculus
gttcgaggcatgtctagtgttgcta

SEQ ID NO: 728966 - DNA, 25 bp, Mus musculus
gttcgagggaaacccactgctccag

SEQ ID NO: 728967 - DNA, 25 bp, Mus musculus
gttcgagggaaagccactgctccag

SEQ ID NO: 728968 - DNA, 25 bp, Mus musculus
gttcgaggtctcatttgtatttctt

SEQ ID NO: 728969 - DNA, 25 bp, Mus musculus
gttcgaggtctcttttgtatttctt

SEQ ID NO: 728970 - DNA, 25 bp, Mus musculus
gttcgaggttagagtagtctacagc

SEQ ID NO: 728971 - DNA, 25 bp, Mus musculus
gttcgaggttagtgtagtctacagc

SEQ ID NO: 728972 - DNA, 25 bp, Mus musculus
gttcgagtcaaacctgtcattccag

SEQ ID NO: 728973 - DNA, 25 bp, Mus musculus
gttcgagtcaaagctgtcattccag

SEQ ID NO: 728974 - DNA, 25 bp, Mus musculus
gttcgagtccaacttgggcttgtga

SEQ ID NO: 728975 - DNA, 25 bp, Mus musculus
gttcgagtccaagttgggcttgtga

SEQ ID NO: 728976 - DNA, 25 bp, Mus musculus
gttcgagtgtgcacacctaatgaaa

SEQ ID NO: 728977 - DNA, 25 bp, Mus musculus
gttcgagtgtgctcacctaatgaaa

SEQ ID NO: 728978 - DNA, 25 bp, Mus musculus
gttcgataaggcacagagcgcagtt

SEQ ID NO: 728979 - DNA, 25 bp, Mus musculus
gttcgataaggctcagagcgcagtt

SEQ ID NO: 728980 - DNA, 25 bp, Mus musculus
gttcgatatcctctctacttacttt

SEQ ID NO: 728981 - DNA, 25 bp, Mus musculus
gttcgatatcctgtctacttacttt

SEQ ID NO: 728982 - DNA, 25 bp, Mus musculus
gttcgatgaaataccctacaactcc

SEQ ID NO: 728983 - DNA, 25 bp, Mus musculus
gttcgatgaaattccctacaactcc

SEQ ID NO: 728984 - DNA, 25 bp, Mus musculus
gttcgatgaagccatcctcaacaca

SEQ ID NO: 728985 - DNA, 25 bp, Mus musculus
gttcgatgaagcgatcctcaacaca

SEQ ID NO: 728986 - DNA, 25 bp, Mus musculus
gttcgatgggctaaaatgtcacttt

SEQ ID NO: 728987 - DNA, 25 bp, Mus musculus
gttcgatgggcttaaatgtcacttt

SEQ ID NO: 728988 - DNA, 25 bp, Mus musculus
gttcgatgggtcactgggcttctca

SEQ ID NO: 728989 - DNA, 25 bp, Mus musculus
gttcgatgggtctctgggcttctca

SEQ ID NO: 728990 - DNA, 25 bp, Mus musculus
gttcgattgccactacctacagtac

SEQ ID NO: 728991 - DNA, 25 bp, Mus musculus
gttcgattgccagtacctacagtac

SEQ ID NO: 728992 - DNA, 25 bp, Mus musculus
gttcgcaagaagaaaaccaccatta

SEQ ID NO: 728993 - DNA, 25 bp, Mus musculus
gttcgcaagaagtaaaccaccatta

SEQ ID NO: 728994 - DNA, 25 bp, Mus musculus
gttcgcaaggctcagtactggtcta

SEQ ID NO: 728995 - DNA, 25 bp, Mus musculus
gttcgcaaggctgagtactggtcta

SEQ ID NO: 728996 - DNA, 25 bp, Mus musculus
gttcgcaatgcacagtgtcattctc

SEQ ID NO: 728997 - DNA, 25 bp, Mus musculus
gttcgcaatgcagagtgtcattctc

SEQ ID NO: 728998 - DNA, 25 bp, Mus musculus
gttcgcacactgctgatccagggag

SEQ ID NO: 728999 - DNA, 25 bp, Mus musculus
gttcgcacactggtgatccagggag

SEQ ID NO: 729000 - DNA, 25 bp, Mus musculus
gttcgcacatccattcagatcatga

SEQ ID NO: 729001 - DNA, 25 bp, Mus musculus
gttcgcacatcctttcagatcatga

SEQ ID NO: 729002 - DNA, 25 bp, Mus musculus
gttcgcacatttacaaatcaggcta

SEQ ID NO: 729003 - DNA, 25 bp, Mus musculus
gttcgcacattttcaaatcaggcta

SEQ ID NO: 729004 - DNA, 25 bp, Mus musculus
gttcgcaccagacatgcagtgtctt

SEQ ID NO: 729005 - DNA, 25 bp, Mus musculus
gttcgcaccagagatgcagtgtctt

SEQ ID NO: 729006 - DNA, 25 bp, Mus musculus
gttcgcagacaaacactaaacgtta

SEQ ID NO: 729007 - DNA, 25 bp, Mus musculus
gttcgcagacaatcactaaacgtta

SEQ ID NO: 729008 - DNA, 25 bp, Mus musculus
gttcgcagcaccaatatcatcacaa

SEQ ID NO: 729009 - DNA, 25 bp, Mus musculus
gttcgcagcacctatatcatcacaa

SEQ ID NO: 729010 - DNA, 25 bp, Mus musculus
gttcgcagcctaccagagtccagag

SEQ ID NO: 729011 - DNA, 25 bp, Mus musculus
gttcgcagcctagcagagtccagag

SEQ ID NO: 729012 - DNA, 25 bp, Mus musculus
gttcgcagggttagctctgctcttt

SEQ ID NO: 729013 - DNA, 25 bp, Mus musculus
gttcgcagggtttgctctgctcttt

SEQ ID NO: 729014 - DNA, 25 bp, Mus musculus
gttcgcatatacatctataagagcg

SEQ ID NO: 729015 - DNA, 25 bp, Mus musculus
gttcgcatatacttctataagagcg

SEQ ID NO: 729016 - DNA, 25 bp, Mus musculus
gttcgcatccggcataaagatgggt

SEQ ID NO: 729017 - DNA, 25 bp, Mus musculus
gttcgcatccgggataaagatgggt

SEQ ID NO: 729018 - DNA, 25 bp, Mus musculus
gttcgcatttctcctggtgttgctg

SEQ ID NO: 729019 - DNA, 25 bp, Mus musculus
gttcgcatttctgctggtgttgctg

SEQ ID NO: 729020 - DNA, 25 bp, Mus musculus
gttcgccatcagagtttccttatat

SEQ ID NO: 729021 - DNA, 25 bp, Mus musculus
gttcgccatcagtgtttccttatat

SEQ ID NO: 729022 - DNA, 25 bp, Mus musculus
gttcgccatctacgagcaggactca

SEQ ID NO: 729023 - DNA, 25 bp, Mus musculus
gttcgccatctaggagcaggactca

SEQ ID NO: 729024 - DNA, 25 bp, Mus musculus
gttcgccccgtaactagctgtctaa

SEQ ID NO: 729025 - DNA, 25 bp, Mus musculus
gttcgccccgtatctagctgtctaa

SEQ ID NO: 729026 - DNA, 25 bp, Mus musculus
gttcgccctgccacaatagagcaat

SEQ ID NO: 729027 - DNA, 25 bp, Mus musculus
gttcgccctgcctcaatagagcaat

SEQ ID NO: 729028 - DNA, 25 bp, Mus musculus
gttcgccctggcagccgggagactt

SEQ ID NO: 729029 - DNA, 25 bp, Mus musculus
gttcgccctggctgccgggagactt

SEQ ID NO: 729030 - DNA, 25 bp, Mus musculus
gttcgccgatcgaagcaggcattgt

SEQ ID NO: 729031 - DNA, 25 bp, Mus musculus
gttcgccgatcgtagcaggcattgt

SEQ ID NO: 729032 - DNA, 25 bp, Mus musculus
gttcgcctaggaacacatcctgact

SEQ ID NO: 729033 - DNA, 25 bp, Mus musculus
gttcgcctaggatcacatcctgact

SEQ ID NO: 729034 - DNA, 25 bp, Mus musculus
gttcgcctggataagtgtaaccctt

SEQ ID NO: 729035 - DNA, 25 bp, Mus musculus
gttcgcctggattagtgtaaccctt

SEQ ID NO: 729036 - DNA, 25 bp, Mus musculus
gttcgccttccaaggctactaacag

SEQ ID NO: 729037 - DNA, 25 bp, Mus musculus
gttcgccttccatggctactaacag

SEQ ID NO: 729038 - DNA, 25 bp, Mus musculus
gttcgccttgtaaccatttacttct

SEQ ID NO: 729039 - DNA, 25 bp, Mus musculus
gttcgccttgtatccatttacttct

SEQ ID NO: 729040 - DNA, 25 bp, Mus musculus
gttcgcgacatccaagcactcaagg

SEQ ID NO: 729041 - DNA, 25 bp, Mus musculus
gttcgcgacatcgaagcactcaagg

SEQ ID NO: 729042 - DNA, 25 bp, Mus musculus
gttcgcgaccctaaacgagcaatag

SEQ ID NO: 729043 - DNA, 25 bp, Mus musculus
gttcgcgacccttaacgagcaatag

SEQ ID NO: 729044 - DNA, 25 bp, Mus musculus
gttcgcgcacggcttccacgagctg

SEQ ID NO: 729045 - DNA, 25 bp, Mus musculus
gttcgcgcacgggttccacgagctg

SEQ ID NO: 729046 - DNA, 25 bp, Mus musculus
gttcgcgtccacacacatacagctt

SEQ ID NO: 729047 - DNA, 25 bp, Mus musculus
gttcgcgtccactcacatacagctt

SEQ ID NO: 729048 - DNA, 25 bp, Mus musculus
gttcgctacattctgcctttgctgc

SEQ ID NO: 729049 - DNA, 25 bp, Mus musculus
gttcgctacattgtgcctttgctgc

SEQ ID NO: 729050 - DNA, 25 bp, Mus musculus
gttcgctactaccatagcatctgtg

SEQ ID NO: 729051 - DNA, 25 bp, Mus musculus
gttcgctactacgatagcatctgtg

SEQ ID NO: 729052 - DNA, 25 bp, Mus musculus
gttcgctagagaaccaaactcaggt

SEQ ID NO: 729053 - DNA, 25 bp, Mus musculus
gttcgctagagatccaaactcaggt

SEQ ID NO: 729054 - DNA, 25 bp, Mus musculus
gttcgctagggtacctcaaacacgt

SEQ ID NO: 729055 - DNA, 25 bp, Mus musculus
gttcgctagggttcctcaaacacgt

SEQ ID NO: 729056 - DNA, 25 bp, Mus musculus
gttcgctccgccagtgttagacaga

SEQ ID NO: 729057 - DNA, 25 bp, Mus musculus
gttcgctccgcctgtgttagacaga

SEQ ID NO: 729058 - DNA, 25 bp, Mus musculus
gttcgctgagacaatttgcagagca

SEQ ID NO: 729059 - DNA, 25 bp, Mus musculus
gttcgctgagactatttgcagagca

SEQ ID NO: 729060 - DNA, 25 bp, Mus musculus
gttcgctgcttaaggtgcagccgga

SEQ ID NO: 729061 - DNA, 25 bp, Mus musculus
gttcgctgcttatggtgcagccgga

SEQ ID NO: 729062 - DNA, 25 bp, Mus musculus
gttcgcttagcaaccttagagcact

SEQ ID NO: 729063 - DNA, 25 bp, Mus musculus
gttcgcttagcatccttagagcact

SEQ ID NO: 729064 - DNA, 25 bp, Mus musculus
gttcgcttccggatctccaactcaa

SEQ ID NO: 729065 - DNA, 25 bp, Mus musculus
gttcgcttccggttctccaactcaa

SEQ ID NO: 729066 - DNA, 25 bp, Mus musculus
gttcgcttccttatggacagaggtg

SEQ ID NO: 729067 - DNA, 25 bp, Mus musculus
gttcgcttccttttggacagaggtg

SEQ ID NO: 729068 - DNA, 25 bp, Mus musculus
gttcgcttctatcatgactggaatg

SEQ ID NO: 729069 - DNA, 25 bp, Mus musculus
gttcgcttctatgatgactggaatg

SEQ ID NO: 729070 - DNA, 25 bp, Mus musculus
gttcgcttgactctgtgtagcttca

SEQ ID NO: 729071 - DNA, 25 bp, Mus musculus
gttcgcttgactgtgtgtagcttca

SEQ ID NO: 729072 - DNA, 25 bp, Mus musculus
gttcgcttgataacactcagcctgt

SEQ ID NO: 729073 - DNA, 25 bp, Mus musculus
gttcgcttgatatcactcagcctgt

SEQ ID NO: 729074 - DNA, 25 bp, Mus musculus
gttcgcttgtttactactgtcactt

SEQ ID NO: 729075 - DNA, 25 bp, Mus musculus
gttcgcttgttttctactgtcactt

SEQ ID NO: 729076 - DNA, 25 bp, Mus musculus
gttcgcttttcaaacccactaatca

SEQ ID NO: 729077 - DNA, 25 bp, Mus musculus
gttcgcttttcatacccactaatca

SEQ ID NO: 729078 - DNA, 25 bp, Mus musculus
gttcggaacagaaccaatatttagc

SEQ ID NO: 729079 - DNA, 25 bp, Mus musculus
gttcggaacagatccaatatttagc

SEQ ID NO: 729080 - DNA, 25 bp, Mus musculus
gttcggaacccgagcgataatcaat

SEQ ID NO: 729081 - DNA, 25 bp, Mus musculus
gttcggaacccgtgcgataatcaat

SEQ ID NO: 729082 - DNA, 25 bp, Mus musculus
gttcggaatgctatccagatctcca

SEQ ID NO: 729083 - DNA, 25 bp, Mus musculus
gttcggaatgctttccagatctcca

SEQ ID NO: 729084 - DNA, 25 bp, Mus musculus
gttcggacctacagatgctatttta

SEQ ID NO: 729085 - DNA, 25 bp, Mus musculus
gttcggacctactgatgctatttta

SEQ ID NO: 729086 - DNA, 25 bp, Mus musculus
gttcggagaatacaaatggagactg

SEQ ID NO: 729087 - DNA, 25 bp, Mus musculus
gttcggagaatagaaatggagactg

SEQ ID NO: 729088 - DNA, 25 bp, Mus musculus
gttcggatagttcatctgcctacag

SEQ ID NO: 729089 - DNA, 25 bp, Mus musculus
gttcggatagttgatctgcctacag

SEQ ID NO: 729090 - DNA, 25 bp, Mus musculus
gttcggatcatcaaccctcagatga

SEQ ID NO: 729091 - DNA, 25 bp, Mus musculus
gttcggatcatctaccctcagatga

SEQ ID NO: 729092 - DNA, 25 bp, Mus musculus
gttcggatcccactgtgacttagga

SEQ ID NO: 729093 - DNA, 25 bp, Mus musculus
gttcggatcccagtgtgacttagga

SEQ ID NO: 729094 - DNA, 25 bp, Mus musculus
gttcggatgcaaatgggcccagaga

SEQ ID NO: 729095 - DNA, 25 bp, Mus musculus
gttcggatgcaattgggcccagaga

SEQ ID NO: 729096 - DNA, 25 bp, Mus musculus
gttcggcacaggactccttttaaag

SEQ ID NO: 729097 - DNA, 25 bp, Mus musculus
gttcggcacaggtctccttttaaag

SEQ ID NO: 729098 - DNA, 25 bp, Mus musculus
gttcggcagtcaacacttgtatttt

SEQ ID NO: 729099 - DNA, 25 bp, Mus musculus
gttcggcagtcatcacttgtatttt

SEQ ID NO: 729100 - DNA, 25 bp, Mus musculus
gttcggcatcaaatccagataccca

SEQ ID NO: 729101 - DNA, 25 bp, Mus musculus
gttcggcatcaattccagataccca

SEQ ID NO: 729102 - DNA, 25 bp, Mus musculus
gttcggcatgtaaccagaaaggatt

SEQ ID NO: 729103 - DNA, 25 bp, Mus musculus
gttcggcatgtatccagaaaggatt

SEQ ID NO: 729104 - DNA, 25 bp, Mus musculus
gttcggccagagcattactcactgt

SEQ ID NO: 729105 - DNA, 25 bp, Mus musculus
gttcggccagaggattactcactgt

SEQ ID NO: 729106 - DNA, 25 bp, Mus musculus
gttcggcgactacactgaaaacttt

SEQ ID NO: 729107 - DNA, 25 bp, Mus musculus
gttcggcgactagactgaaaacttt

SEQ ID NO: 729108 - DNA, 25 bp, Mus musculus
gttcggctactgcacaaattgtata

SEQ ID NO: 729109 - DNA, 25 bp, Mus musculus
gttcggctactggacaaattgtata

SEQ ID NO: 729110 - DNA, 25 bp, Mus musculus
gttcggctccacacttgtcaggtgt

SEQ ID NO: 729111 - DNA, 25 bp, Mus musculus
gttcggctccactcttgtcaggtgt

SEQ ID NO: 729112 - DNA, 25 bp, Mus musculus
gttcggctctttcactggtggcatc

SEQ ID NO: 729113 - DNA, 25 bp, Mus musculus
gttcggctctttgactggtggcatc

SEQ ID NO: 729114 - DNA, 25 bp, Mus musculus
gttcgggaaaatcctactctcactg

SEQ ID NO: 729115 - DNA, 25 bp, Mus musculus
gttcgggaaaatgctactctcactg

SEQ ID NO: 729116 - DNA, 25 bp, Mus musculus
gttcgggacaagctcaataacttag

SEQ ID NO: 729117 - DNA, 25 bp, Mus musculus
gttcgggacaaggtcaataacttag

SEQ ID NO: 729118 - DNA, 25 bp, Mus musculus
gttcgggagcctaaaggaagactga

SEQ ID NO: 729119 - DNA, 25 bp, Mus musculus
gttcgggagccttaaggaagactga

SEQ ID NO: 729120 - DNA, 25 bp, Mus musculus
gttcgggccaaccagatactctgga

SEQ ID NO: 729121 - DNA, 25 bp, Mus musculus
gttcgggccaacgagatactctgga

SEQ ID NO: 729122 - DNA, 25 bp, Mus musculus
gttcgggccctaaactgaggaagtt

SEQ ID NO: 729123 - DNA, 25 bp, Mus musculus
gttcgggccctatactgaggaagtt

SEQ ID NO: 729124 - DNA, 25 bp, Mus musculus
gttcgggcccttactatggatagca

SEQ ID NO: 729125 - DNA, 25 bp, Mus musculus
gttcgggccctttctatggatagca

SEQ ID NO: 729126 - DNA, 25 bp, Mus musculus
gttcgggttattatctggccaggat

SEQ ID NO: 729127 - DNA, 25 bp, Mus musculus
gttcgggttattttctggccaggat

SEQ ID NO: 729128 - DNA, 25 bp, Mus musculus
gttcggtaggccacgatgagaccct

SEQ ID NO: 729129 - DNA, 25 bp, Mus musculus
gttcggtaggcctcgatgagaccct

SEQ ID NO: 729130 - DNA, 25 bp, Mus musculus
gttcggtattttatgccatccatga

SEQ ID NO: 729131 - DNA, 25 bp, Mus musculus
gttcggtattttttgccatccatga

SEQ ID NO: 729132 - DNA, 25 bp, Mus musculus
gttcggtcacctccgaggatggaca

SEQ ID NO: 729133 - DNA, 25 bp, Mus musculus
gttcggtcacctgcgaggatggaca

SEQ ID NO: 729134 - DNA, 25 bp, Mus musculus
gttcggtctgaaatagctggccaag

SEQ ID NO: 729135 - DNA, 25 bp, Mus musculus
gttcggtctgaattagctggccaag

SEQ ID NO: 729136 - DNA, 25 bp, Mus musculus
gttcggtgccttctgcccggacatc

SEQ ID NO: 729137 - DNA, 25 bp, Mus musculus
gttcggtgccttgtgcccggacatc

SEQ ID NO: 729138 - DNA, 25 bp, Mus musculus
gttcggtggacactgctggttactc

SEQ ID NO: 729139 - DNA, 25 bp, Mus musculus
gttcggtggacagtgctggttactc

SEQ ID NO: 729140 - DNA, 25 bp, Mus musculus
gttcggtggaggaaccaaactgact

SEQ ID NO: 729141 - DNA, 25 bp, Mus musculus
gttcggtggaggtaccaaactgact

SEQ ID NO: 729142 - DNA, 25 bp, Mus musculus
gttcggtgggtgacagtgtgagcca

SEQ ID NO: 729143 - DNA, 25 bp, Mus musculus
gttcggtgggtgtcagtgtgagcca

SEQ ID NO: 729144 - DNA, 25 bp, Mus musculus
gttcggtggtatattatatttgcgc

SEQ ID NO: 729145 - DNA, 25 bp, Mus musculus
gttcggtggtattttatatttgcgc

SEQ ID NO: 729146 - DNA, 25 bp, Mus musculus
gttcggtttattcctaggccccatg

SEQ ID NO: 729147 - DNA, 25 bp, Mus musculus
gttcggtttattgctaggccccatg

SEQ ID NO: 729148 - DNA, 25 bp, Mus musculus
gttcgtaaagcacacctcatcataa

SEQ ID NO: 729149 - DNA, 25 bp, Mus musculus
gttcgtaaagcagacctcatcataa

SEQ ID NO: 729150 - DNA, 25 bp, Mus musculus
gttcgtacctgtaggaagcagctct

SEQ ID NO: 729151 - DNA, 25 bp, Mus musculus
gttcgtacctgttggaagcagctct

SEQ ID NO: 729152 - DNA, 25 bp, Mus musculus
gttcgtagctaaataactatggtgt

SEQ ID NO: 729153 - DNA, 25 bp, Mus musculus
gttcgtagctaattaactatggtgt

SEQ ID NO: 729154 - DNA, 25 bp, Mus musculus
gttcgtatcatcatgttgtttgtgc

SEQ ID NO: 729155 - DNA, 25 bp, Mus musculus
gttcgtatcatcttgttgtttgtgc

SEQ ID NO: 729156 - DNA, 25 bp, Mus musculus
gttcgtcaaactcttcggcatggtc

SEQ ID NO: 729157 - DNA, 25 bp, Mus musculus
gttcgtcaaactgttcggcatggtc

SEQ ID NO: 729158 - DNA, 25 bp, Mus musculus
gttcgtcagacaaaaggtaccagtg

SEQ ID NO: 729159 - DNA, 25 bp, Mus musculus
gttcgtcagacataaggtaccagtg

SEQ ID NO: 729160 - DNA, 25 bp, Mus musculus
gttcgtcagcttcaagtggccggaa

SEQ ID NO: 729161 - DNA, 25 bp, Mus musculus
gttcgtcagcttgaagtggccggaa

SEQ ID NO: 729162 - DNA, 25 bp, Mus musculus
gttcgtccagaacttttgattgtac

SEQ ID NO: 729163 - DNA, 25 bp, Mus musculus
gttcgtccagaagttttgattgtac

SEQ ID NO: 729164 - DNA, 25 bp, Mus musculus
gttcgtccagagctctgtcccagga

SEQ ID NO: 729165 - DNA, 25 bp, Mus musculus
gttcgtccagaggtctgtcccagga

SEQ ID NO: 729166 - DNA, 25 bp, Mus musculus
gttcgtccagtaatttattcctccg

SEQ ID NO: 729167 - DNA, 25 bp, Mus musculus
gttcgtccagtattttattcctccg

SEQ ID NO: 729168 - DNA, 25 bp, Mus musculus
gttcgtcctaggctcacaacgcgaa

SEQ ID NO: 729169 - DNA, 25 bp, Mus musculus
gttcgtcctagggtcacaacgcgaa

SEQ ID NO: 729170 - DNA, 25 bp, Mus musculus
gttcgtctcctacaagcaaactact

SEQ ID NO: 729171 - DNA, 25 bp, Mus musculus
gttcgtctcctagaagcaaactact

SEQ ID NO: 729172 - DNA, 25 bp, Mus musculus
gttcgtgagggaacatggcctttac

SEQ ID NO: 729173 - DNA, 25 bp, Mus musculus
gttcgtgagggatcatggcctttac

SEQ ID NO: 729174 - DNA, 25 bp, Mus musculus
gttcgtgatgctcaagacgctttac

SEQ ID NO: 729175 - DNA, 25 bp, Mus musculus
gttcgtgatgctgaagacgctttac

SEQ ID NO: 729176 - DNA, 25 bp, Mus musculus
gttcgtgatgtaagcaacctgtggt

SEQ ID NO: 729177 - DNA, 25 bp, Mus musculus
gttcgtgatgtatgcaacctgtggt

SEQ ID NO: 729178 - DNA, 25 bp, Mus musculus
gttcgtgattgtctgtattctgggc

SEQ ID NO: 729179 - DNA, 25 bp, Mus musculus
gttcgtgattgtgtgtattctgggc

SEQ ID NO: 729180 - DNA, 25 bp, Mus musculus
gttcgtgcaagaatagtcactgatc

SEQ ID NO: 729181 - DNA, 25 bp, Mus musculus
gttcgtgcaagattagtcactgatc

SEQ ID NO: 729182 - DNA, 25 bp, Mus musculus
gttcgtgcagttcaagcaacagctg

SEQ ID NO: 729183 - DNA, 25 bp, Mus musculus
gttcgtgcagttgaagcaacagctg

SEQ ID NO: 729184 - DNA, 25 bp, Mus musculus
gttcgtgccaagcaacatcctgacc

SEQ ID NO: 729185 - DNA, 25 bp, Mus musculus
gttcgtgccaaggaacatcctgacc

SEQ ID NO: 729186 - DNA, 25 bp, Mus musculus
gttcgtgccaccaaatattcatttt

SEQ ID NO: 729187 - DNA, 25 bp, Mus musculus
gttcgtgccacctaatattcatttt

SEQ ID NO: 729188 - DNA, 25 bp, Mus musculus
gttcgtgcctttatgaggatcttca

SEQ ID NO: 729189 - DNA, 25 bp, Mus musculus
gttcgtgcctttttgaggatcttca

SEQ ID NO: 729190 - DNA, 25 bp, Mus musculus
gttcgtgctgcaagtgatctgtaat

SEQ ID NO: 729191 - DNA, 25 bp, Mus musculus
gttcgtgctgcatgtgatctgtaat

SEQ ID NO: 729192 - DNA, 25 bp, Mus musculus
gttcgtggaccaccaaagggcaaga

SEQ ID NO: 729193 - DNA, 25 bp, Mus musculus
gttcgtggaccagcaaagggcaaga

SEQ ID NO: 729194 - DNA, 25 bp, Mus musculus
gttcgtggacctcgatttacatttc

SEQ ID NO: 729195 - DNA, 25 bp, Mus musculus
gttcgtggacctggatttacatttc

SEQ ID NO: 729196 - DNA, 25 bp, Mus musculus
gttcgtggtggtcttagccatcttc

SEQ ID NO: 729197 - DNA, 25 bp, Mus musculus
gttcgtggtggtgttagccatcttc

SEQ ID NO: 729198 - DNA, 25 bp, Mus musculus
gttcgtgtatttaaaggctttcaag

SEQ ID NO: 729199 - DNA, 25 bp, Mus musculus
gttcgtgtattttaaggctttcaag

SEQ ID NO: 729200 - DNA, 25 bp, Mus musculus
gttcgtgtctagacgtctgaatgtc

SEQ ID NO: 729201 - DNA, 25 bp, Mus musculus
gttcgtgtctagtcgtctgaatgtc

SEQ ID NO: 729202 - DNA, 25 bp, Mus musculus
gttcgtgtctcaacatctgtagctt

SEQ ID NO: 729203 - DNA, 25 bp, Mus musculus
gttcgtgtctcacaaattgcaattg

SEQ ID NO: 729204 - DNA, 25 bp, Mus musculus
gttcgtgtctcagaaattgcaattg

SEQ ID NO: 729205 - DNA, 25 bp, Mus musculus
gttcgtgtctcatcatctgtagctt

SEQ ID NO: 729206 - DNA, 25 bp, Mus musculus
gttcgttaattgatacacttgcctg

SEQ ID NO: 729207 - DNA, 25 bp, Mus musculus
gttcgttaattgttacacttgcctg

SEQ ID NO: 729208 - DNA, 25 bp, Mus musculus
gttcgttagaacacatttgagaaat

SEQ ID NO: 729209 - DNA, 25 bp, Mus musculus
gttcgttagaactcatttgagaaat

SEQ ID NO: 729210 - DNA, 25 bp, Mus musculus
gttcgttcagaactctgtctgtgat

SEQ ID NO: 729211 - DNA, 25 bp, Mus musculus
gttcgttcagaagtctgtctgtgat

SEQ ID NO: 729212 - DNA, 25 bp, Mus musculus
gttcgttcattcagcagttgccata

SEQ ID NO: 729213 - DNA, 25 bp, Mus musculus
gttcgttcattctgcagttgccata

SEQ ID NO: 729214 - DNA, 25 bp, Mus musculus
gttcgttcctcaagtagcaatttcc

SEQ ID NO: 729215 - DNA, 25 bp, Mus musculus
gttcgttcctcatgtagcaatttcc

SEQ ID NO: 729216 - DNA, 25 bp, Mus musculus
gttcgttctaagatacactgttcag

SEQ ID NO: 729217 - DNA, 25 bp, Mus musculus
gttcgttctaagttacactgttcag

SEQ ID NO: 729218 - DNA, 25 bp, Mus musculus
gttcgttctgtaccgatgagccaat

SEQ ID NO: 729219 - DNA, 25 bp, Mus musculus
gttcgttctgtagcgatgagccaat

SEQ ID NO: 729220 - DNA, 25 bp, Mus musculus
gttcgttgatctaattctgctcatc

SEQ ID NO: 729221 - DNA, 25 bp, Mus musculus
gttcgttgatcttattctgctcatc

SEQ ID NO: 729222 - DNA, 25 bp, Mus musculus
gttcgttggcaacagttcccggagt

SEQ ID NO: 729223 - DNA, 25 bp, Mus musculus
gttcgttggcaagagttcccggagt

SEQ ID NO: 729224 - DNA, 25 bp, Mus musculus
gttcgttggtgcattttggacgtaa

SEQ ID NO: 729225 - DNA, 25 bp, Mus musculus
gttcgttggtgctttttggacgtaa

SEQ ID NO: 729226 - DNA, 25 bp, Mus musculus
gttcgttgttgtatattcacggata

SEQ ID NO: 729227 - DNA, 25 bp, Mus musculus
gttcgttgttgtttattcacggata

SEQ ID NO: 729228 - DNA, 25 bp, Mus musculus
gttcgtttaactcttcagcttcctg

SEQ ID NO: 729229 - DNA, 25 bp, Mus musculus
gttcgtttaactgttcagcttcctg

SEQ ID NO: 729230 - DNA, 25 bp, Mus musculus
gttcgtttactacctaagacacagc

SEQ ID NO: 729231 - DNA, 25 bp, Mus musculus
gttcgtttactagctaagacacagc

SEQ ID NO: 729232 - DNA, 25 bp, Mus musculus
gttcgtttagaacaactaatagtga

SEQ ID NO: 729233 - DNA, 25 bp, Mus musculus
gttcgtttagaagaactaatagtga

SEQ ID NO: 729234 - DNA, 25 bp, Mus musculus
gttcgtttctttcctttcgaatgca

SEQ ID NO: 729235 - DNA, 25 bp, Mus musculus
gttcgtttctttgctttcgaatgca

SEQ ID NO: 729236 - DNA, 25 bp, Mus musculus
gttcgttttattctccaagttacat

SEQ ID NO: 729237 - DNA, 25 bp, Mus musculus
gttcgttttattgtccaagttacat

SEQ ID NO: 729238 - DNA, 25 bp, Mus musculus
gttctaaaactgacccaatgaccta

SEQ ID NO: 729239 - DNA, 25 bp, Mus musculus
gttctaaaactgtcccaatgaccta

SEQ ID NO: 729240 - DNA, 25 bp, Mus musculus
gttctaaaacttactttcagcaggt

SEQ ID NO: 729241 - DNA, 25 bp, Mus musculus
gttctaaaactttctttcagcaggt

SEQ ID NO: 729242 - DNA, 25 bp, Mus musculus
gttctaaacattcctaccagcatgg

SEQ ID NO: 729243 - DNA, 25 bp, Mus musculus
gttctaaacattgctaccagcatgg

SEQ ID NO: 729244 - DNA, 25 bp, Mus musculus
gttctaaacgctccaagggtcaact

SEQ ID NO: 729245 - DNA, 25 bp, Mus musculus
gttctaaacgctgcaagggtcaact

SEQ ID NO: 729246 - DNA, 25 bp, Mus musculus
gttctaaagaagacggcacggccga

SEQ ID NO: 729247 - DNA, 25 bp, Mus musculus
gttctaaagaagtcggcacggccga

SEQ ID NO: 729248 - DNA, 25 bp, Mus musculus
gttctaaaggtcatttctctggtaa

SEQ ID NO: 729249 - DNA, 25 bp, Mus musculus
gttctaaaggtcttttctctggtaa

SEQ ID NO: 729250 - DNA, 25 bp, Mus musculus
gttctaaagtcaacgttcggttctt

SEQ ID NO: 729251 - DNA, 25 bp, Mus musculus
gttctaaagtcatcgttcggttctt

SEQ ID NO: 729252 - DNA, 25 bp, Mus musculus
gttctaaatggacagctctcaggca

SEQ ID NO: 729253 - DNA, 25 bp, Mus musculus
gttctaaatggagagctctcaggca

SEQ ID NO: 729254 - DNA, 25 bp, Mus musculus
gttctaacagacactgaaccctgaa

SEQ ID NO: 729255 - DNA, 25 bp, Mus musculus
gttctaacagactctgaaccctgaa

SEQ ID NO: 729256 - DNA, 25 bp, Mus musculus
gttctaacattcacagctgtctaca

SEQ ID NO: 729257 - DNA, 25 bp, Mus musculus
gttctaacattctcagctgtctaca

SEQ ID NO: 729258 - DNA, 25 bp, Mus musculus
gttctaacgagcaatgtatacatcc

SEQ ID NO: 729259 - DNA, 25 bp, Mus musculus
gttctaacgagctatgtatacatcc

SEQ ID NO: 729260 - DNA, 25 bp, Mus musculus
gttctaacgaggaccatttgtgttt

SEQ ID NO: 729261 - DNA, 25 bp, Mus musculus
gttctaacgaggtccatttgtgttt

SEQ ID NO: 729262 - DNA, 25 bp, Mus musculus
gttctaactcaactcaaatccacta

SEQ ID NO: 729263 - DNA, 25 bp, Mus musculus
gttctaactcaagtcaaatccacta

SEQ ID NO: 729264 - DNA, 25 bp, Mus musculus
gttctaactggtctactctggtgta

SEQ ID NO: 729265 - DNA, 25 bp, Mus musculus
gttctaactggtgtactctggtgta

SEQ ID NO: 729266 - DNA, 25 bp, Mus musculus
gttctaagaactacaacatccctcc

SEQ ID NO: 729267 - DNA, 25 bp, Mus musculus
gttctaagaacttcaacatccctcc

SEQ ID NO: 729268 - DNA, 25 bp, Mus musculus
gttctaagcagaagcaacctctctc

SEQ ID NO: 729269 - DNA, 25 bp, Mus musculus
gttctaagcagatgcaacctctctc

SEQ ID NO: 729270 - DNA, 25 bp, Mus musculus
gttctaagggccacacagcacacag

SEQ ID NO: 729271 - DNA, 25 bp, Mus musculus
gttctaagggcctcacagcacacag

SEQ ID NO: 729272 - DNA, 25 bp, Mus musculus
gttctaagtgttacttctgatttaa

SEQ ID NO: 729273 - DNA, 25 bp, Mus musculus
gttctaagtgtttcttctgatttaa

SEQ ID NO: 729274 - DNA, 25 bp, Mus musculus
gttctaataagtagccagattccta

SEQ ID NO: 729275 - DNA, 25 bp, Mus musculus
gttctaataagttgccagattccta

SEQ ID NO: 729276 - DNA, 25 bp, Mus musculus
gttctaatacacaacgggtggttct

SEQ ID NO: 729277 - DNA, 25 bp, Mus musculus
gttctaatacactacgggtggttct

SEQ ID NO: 729278 - DNA, 25 bp, Mus musculus
gttctaatacagatgttttgtttat

SEQ ID NO: 729279 - DNA, 25 bp, Mus musculus
gttctaatacagttgttttgtttat

SEQ ID NO: 729280 - DNA, 25 bp, Mus musculus
gttctaataccccatttgcttcttt

SEQ ID NO: 729281 - DNA, 25 bp, Mus musculus
gttctaatacccgatttgcttcttt

SEQ ID NO: 729282 - DNA, 25 bp, Mus musculus
gttctaatagacaagaccaggccat

SEQ ID NO: 729283 - DNA, 25 bp, Mus musculus
gttctaatagactagaccaggccat

SEQ ID NO: 729284 - DNA, 25 bp, Mus musculus
gttctaatagctctcttatggttac

SEQ ID NO: 729285 - DNA, 25 bp, Mus musculus
gttctaatagctgtcttatggttac

SEQ ID NO: 729286 - DNA, 25 bp, Mus musculus
gttctaatagtacctgtgcctcatc

SEQ ID NO: 729287 - DNA, 25 bp, Mus musculus
gttctaatagtagctgtgcctcatc

SEQ ID NO: 729288 - DNA, 25 bp, Mus musculus
gttctaatagtcaggagcctcagga

SEQ ID NO: 729289 - DNA, 25 bp, Mus musculus
gttctaatagtctggagcctcagga

SEQ ID NO: 729290 - DNA, 25 bp, Mus musculus
gttctaatccatcaagatatacgtg

SEQ ID NO: 729291 - DNA, 25 bp, Mus musculus
gttctaatccatgaagatatacgtg

SEQ ID NO: 729292 - DNA, 25 bp, Mus musculus
gttctaatcgccagcatctgggctg

SEQ ID NO: 729293 - DNA, 25 bp, Mus musculus
gttctaatcgcctgcatctgggctg

SEQ ID NO: 729294 - DNA, 25 bp, Mus musculus
gttctaatgacacacacaacttcgg

SEQ ID NO: 729295 - DNA, 25 bp, Mus musculus
gttctaatgacagacacaacttcgg

SEQ ID NO: 729296 - DNA, 25 bp, Mus musculus
gttctaatgactcatcccttactga

SEQ ID NO: 729297 - DNA, 25 bp, Mus musculus
gttctaatgactgatcccttactga

SEQ ID NO: 729298 - DNA, 25 bp, Mus musculus
gttctaatgccgctaaattgtgatc

SEQ ID NO: 729299 - DNA, 25 bp, Mus musculus
gttctaatgccggtaaattgtgatc

SEQ ID NO: 729300 - DNA, 25 bp, Mus musculus
gttctaatgctcctgctctctctct

SEQ ID NO: 729301 - DNA, 25 bp, Mus musculus
gttctaatgctcctgttttcttgct

SEQ ID NO: 729302 - DNA, 25 bp, Mus musculus
gttctaatgctcgtgctctctctct

SEQ ID NO: 729303 - DNA, 25 bp, Mus musculus
gttctaatgctcgtgttttcttgct

SEQ ID NO: 729304 - DNA, 25 bp, Mus musculus
gttctaattacaactttctctggca

SEQ ID NO: 729305 - DNA, 25 bp, Mus musculus
gttctaattacatctttctctggca

SEQ ID NO: 729306 - DNA, 25 bp, Mus musculus
gttctaattacgatcatgtgtgaca

SEQ ID NO: 729307 - DNA, 25 bp, Mus musculus
gttctaattacgttcatgtgtgaca

SEQ ID NO: 729308 - DNA, 25 bp, Mus musculus
gttctaattcacaacagcattctct

SEQ ID NO: 729309 - DNA, 25 bp, Mus musculus
gttctaattcactacagcattctct

SEQ ID NO: 729310 - DNA, 25 bp, Mus musculus
gttctaattctgaggcactttgttt

SEQ ID NO: 729311 - DNA, 25 bp, Mus musculus
gttctaattctgtggcactttgttt

SEQ ID NO: 729312 - DNA, 25 bp, Mus musculus
gttctaattgtaatcgtgttcctga

SEQ ID NO: 729313 - DNA, 25 bp, Mus musculus
gttctaattgtattcgtgttcctga

SEQ ID NO: 729314 - DNA, 25 bp, Mus musculus
gttctacaaacactagcctggcttg

SEQ ID NO: 729315 - DNA, 25 bp, Mus musculus
gttctacaaacagtagcctggcttg

SEQ ID NO: 729316 - DNA, 25 bp, Mus musculus
gttctacaacatctggtcaacctgt

SEQ ID NO: 729317 - DNA, 25 bp, Mus musculus
gttctacaacatgtggtcaacctgt

SEQ ID NO: 729318 - DNA, 25 bp, Mus musculus
gttctacaagatcgccaagcagatt

SEQ ID NO: 729319 - DNA, 25 bp, Mus musculus
gttctacaagatggccaagcagatt

SEQ ID NO: 729320 - DNA, 25 bp, Mus musculus
gttctacaaggactggaggccgacc

SEQ ID NO: 729321 - DNA, 25 bp, Mus musculus
gttctacaaggagtggaggccgacc

SEQ ID NO: 729322 - DNA, 25 bp, Mus musculus
gttctacaagttctgcagggttacc

SEQ ID NO: 729323 - DNA, 25 bp, Mus musculus
gttctacaagttgtgcagggttacc

SEQ ID NO: 729324 - DNA, 25 bp, Mus musculus
gttctacaccttacagctgttgtta

SEQ ID NO: 729325 - DNA, 25 bp, Mus musculus
gttctacaccttctttggtcggagt

SEQ ID NO: 729326 - DNA, 25 bp, Mus musculus
gttctacaccttgtttggtcggagt

SEQ ID NO: 729327 - DNA, 25 bp, Mus musculus
gttctacacctttcagctgttgtta

SEQ ID NO: 729328 - DNA, 25 bp, Mus musculus
gttctacagaagcaacgagtgtcct

SEQ ID NO: 729329 - DNA, 25 bp, Mus musculus
gttctacagaagcacatttgtctcc

SEQ ID NO: 729330 - DNA, 25 bp, Mus musculus
gttctacagaaggaacgagtgtcct

SEQ ID NO: 729331 - DNA, 25 bp, Mus musculus
gttctacagaaggacatttgtctcc

SEQ ID NO: 729332 - DNA, 25 bp, Mus musculus
gttctacagagtccttccgtttcta

SEQ ID NO: 729333 - DNA, 25 bp, Mus musculus
gttctacagagtgcttccgtttcta

SEQ ID NO: 729334 - DNA, 25 bp, Mus musculus
gttctacagccaaacattcggaaag

SEQ ID NO: 729335 - DNA, 25 bp, Mus musculus
gttctacagccatacattcggaaag

SEQ ID NO: 729336 - DNA, 25 bp, Mus musculus
gttctacaggatcgtgtaccaagat

SEQ ID NO: 729337 - DNA, 25 bp, Mus musculus
gttctacaggatggtgtaccaagat

SEQ ID NO: 729338 - DNA, 25 bp, Mus musculus
gttctacaggtgattgcagctcata

SEQ ID NO: 729339 - DNA, 25 bp, Mus musculus
gttctacaggtgtttgcagctcata

SEQ ID NO: 729340 - DNA, 25 bp, Mus musculus
gttctacatccaaccgttctggaag

SEQ ID NO: 729341 - DNA, 25 bp, Mus musculus
gttctacatccatccgttctggaag

SEQ ID NO: 729342 - DNA, 25 bp, Mus musculus
gttctacatctcactgatcaagtct

SEQ ID NO: 729343 - DNA, 25 bp, Mus musculus
gttctacatctctctgatcaagtct

SEQ ID NO: 729344 - DNA, 25 bp, Mus musculus
gttctacatctgcatatcctggctg

SEQ ID NO: 729345 - DNA, 25 bp, Mus musculus
gttctacatctggatatcctggctg

SEQ ID NO: 729346 - DNA, 25 bp, Mus musculus
gttctacatttcatcacgcaacatg

SEQ ID NO: 729347 - DNA, 25 bp, Mus musculus
gttctacatttcttcacgcaacatg

SEQ ID NO: 729348 - DNA, 25 bp, Mus musculus
gttctaccacagatgtttttcactc

SEQ ID NO: 729349 - DNA, 25 bp, Mus musculus
gttctaccacagttgtttttcactc

SEQ ID NO: 729350 - DNA, 25 bp, Mus musculus
gttctaccagcaaaggaccaagcgc

SEQ ID NO: 729351 - DNA, 25 bp, Mus musculus
gttctaccagcataggaccaagcgc

SEQ ID NO: 729352 - DNA, 25 bp, Mus musculus
gttctaccaggcaacaaacactaca

SEQ ID NO: 729353 - DNA, 25 bp, Mus musculus
gttctaccaggctacaaacactaca

SEQ ID NO: 729354 - DNA, 25 bp, Mus musculus
gttctaccatccacaatgtcacctt

SEQ ID NO: 729355 - DNA, 25 bp, Mus musculus
gttctaccatcctcaatgtcacctt

SEQ ID NO: 729356 - DNA, 25 bp, Mus musculus
gttctaccatgacaagacccagtct

SEQ ID NO: 729357 - DNA, 25 bp, Mus musculus
gttctaccatgagaagacccagtct

SEQ ID NO: 729358 - DNA, 25 bp, Mus musculus
gttctacccaaaaggcactggcaga

SEQ ID NO: 729359 - DNA, 25 bp, Mus musculus
gttctacccaaatggcactggcaga

SEQ ID NO: 729360 - DNA, 25 bp, Mus musculus
gttctacccggcatatcgttgaggt

SEQ ID NO: 729361 - DNA, 25 bp, Mus musculus
gttctacccggcttatcgttgaggt

SEQ ID NO: 729362 - DNA, 25 bp, Mus musculus
gttctaccgactagtctcataacgt

SEQ ID NO: 729363 - DNA, 25 bp, Mus musculus
gttctaccgacttgtctcataacgt

SEQ ID NO: 729364 - DNA, 25 bp, Mus musculus
gttctacctccgcactactaggaag

SEQ ID NO: 729365 - DNA, 25 bp, Mus musculus
gttctacctccggactactaggaag

SEQ ID NO: 729366 - DNA, 25 bp, Mus musculus
gttctacctgcacttgagttctgtg

SEQ ID NO: 729367 - DNA, 25 bp, Mus musculus
gttctacctgcagttgagttctgtg

SEQ ID NO: 729368 - DNA, 25 bp, Mus musculus
gttctacctggacacacagcagcag

SEQ ID NO: 729369 - DNA, 25 bp, Mus musculus
gttctacctggagacacagcagcag

SEQ ID NO: 729370 - DNA, 25 bp, Mus musculus
gttctacctgtacccagcactgaaa

SEQ ID NO: 729371 - DNA, 25 bp, Mus musculus
gttctacctgtagccagcactgaaa

SEQ ID NO: 729372 - DNA, 25 bp, Mus musculus
gttctacctgtcataacaatatgtt

SEQ ID NO: 729373 - DNA, 25 bp, Mus musculus
gttctacctgtcttaacaatatgtt

SEQ ID NO: 729374 - DNA, 25 bp, Mus musculus
gttctaccttgcattatggtcggac

SEQ ID NO: 729375 - DNA, 25 bp, Mus musculus
gttctaccttgccagtgctacacgg

SEQ ID NO: 729376 - DNA, 25 bp, Mus musculus
gttctaccttgcgagtgctacacgg

SEQ ID NO: 729377 - DNA, 25 bp, Mus musculus
gttctaccttgctttatggtcggac

SEQ ID NO: 729378 - DNA, 25 bp, Mus musculus
gttctacgacatcgaaaatctgggt

SEQ ID NO: 729379 - DNA, 25 bp, Mus musculus
gttctacgacatggaaaatctgggt

SEQ ID NO: 729380 - DNA, 25 bp, Mus musculus
gttctacgcttgacccttgtgctct

SEQ ID NO: 729381 - DNA, 25 bp, Mus musculus
gttctacgcttgtcccttgtgctct

SEQ ID NO: 729382 - DNA, 25 bp, Mus musculus
gttctacggaatctgaagctctctc

SEQ ID NO: 729383 - DNA, 25 bp, Mus musculus
gttctacggaatgtgaagctctctc

SEQ ID NO: 729384 - DNA, 25 bp, Mus musculus
gttctactaacaaccttcataaagc

SEQ ID NO: 729385 - DNA, 25 bp, Mus musculus
gttctactaacatccttcataaagc

SEQ ID NO: 729386 - DNA, 25 bp, Mus musculus
gttctactcaagcagccaacgttag

SEQ ID NO: 729387 - DNA, 25 bp, Mus musculus
gttctactcaaggagccaacgttag

SEQ ID NO: 729388 - DNA, 25 bp, Mus musculus
gttctactcagtcaccatggcacat

SEQ ID NO: 729389 - DNA, 25 bp, Mus musculus
gttctactcagtgaccatggcacat

SEQ ID NO: 729390 - DNA, 25 bp, Mus musculus
gttctactgaaccatacaagctagg

SEQ ID NO: 729391 - DNA, 25 bp, Mus musculus
gttctactgaacgatacaagctagg

SEQ ID NO: 729392 - DNA, 25 bp, Mus musculus
gttctactgccaactactgggacaa

SEQ ID NO: 729393 - DNA, 25 bp, Mus musculus
gttctactgccatctactgggacaa

SEQ ID NO: 729394 - DNA, 25 bp, Mus musculus
gttctactgtcaagcaagtgccctt

SEQ ID NO: 729395 - DNA, 25 bp, Mus musculus
gttctactgtcatgcaagtgccctt

SEQ ID NO: 729396 - DNA, 25 bp, Mus musculus
gttctacttcctccaaattacatac

SEQ ID NO: 729397 - DNA, 25 bp, Mus musculus
gttctacttcctgcaaattacatac

SEQ ID NO: 729398 - DNA, 25 bp, Mus musculus
gttctactttaaagcctggaatgct

SEQ ID NO: 729399 - DNA, 25 bp, Mus musculus
gttctactttaatgcctggaatgct

SEQ ID NO: 729400 - DNA, 25 bp, Mus musculus
gttctactttatcggcctcgaagag

SEQ ID NO: 729401 - DNA, 25 bp, Mus musculus
gttctactttatgggcctcgaagag

SEQ ID NO: 729402 - DNA, 25 bp, Mus musculus
gttctactttgaagtgggctctaat

SEQ ID NO: 729403 - DNA, 25 bp, Mus musculus
gttctactttgatgtgggctctaat

SEQ ID NO: 729404 - DNA, 25 bp, Mus musculus
gttctactttgccacaaacggatat

SEQ ID NO: 729405 - DNA, 25 bp, Mus musculus
gttctactttgcgacaaacggatat

SEQ ID NO: 729406 - DNA, 25 bp, Mus musculus
gttctacttttaaggcagtcggcta

SEQ ID NO: 729407 - DNA, 25 bp, Mus musculus
gttctacttttatggcagtcggcta

SEQ ID NO: 729408 - DNA, 25 bp, Mus musculus
gttctagaacttcctcaggaccagt

SEQ ID NO: 729409 - DNA, 25 bp, Mus musculus
gttctagaacttgctcaggaccagt

SEQ ID NO: 729410 - DNA, 25 bp, Mus musculus
gttctagaagccagattgtccgcca

SEQ ID NO: 729411 - DNA, 25 bp, Mus musculus
gttctagaagcctgattgtccgcca

SEQ ID NO: 729412 - DNA, 25 bp, Mus musculus
gttctagactccaattttgtccaat

SEQ ID NO: 729413 - DNA, 25 bp, Mus musculus
gttctagactcctattttgtccaat

SEQ ID NO: 729414 - DNA, 25 bp, Mus musculus
gttctagagaacagcactgctctga

SEQ ID NO: 729415 - DNA, 25 bp, Mus musculus
gttctagagaactgcactgctctga

SEQ ID NO: 729416 - DNA, 25 bp, Mus musculus
gttctagatccactccttagctgag

SEQ ID NO: 729417 - DNA, 25 bp, Mus musculus
gttctagatccagtccttagctgag

SEQ ID NO: 729418 - DNA, 25 bp, Mus musculus
gttctagatctaccaaggcctacct

SEQ ID NO: 729419 - DNA, 25 bp, Mus musculus
gttctagatctagcaaggcctacct

SEQ ID NO: 729420 - DNA, 25 bp, Mus musculus
gttctagatgcgctgagtgccaaaa

SEQ ID NO: 729421 - DNA, 25 bp, Mus musculus
gttctagatgcggtgagtgccaaaa

SEQ ID NO: 729422 - DNA, 25 bp, Mus musculus
gttctagatttccagatactttccc

SEQ ID NO: 729423 - DNA, 25 bp, Mus musculus
gttctagatttcgagatactttccc

SEQ ID NO: 729424 - DNA, 25 bp, Mus musculus
gttctagcacctatgagcatttact

SEQ ID NO: 729425 - DNA, 25 bp, Mus musculus
gttctagcacctttgagcatttact

SEQ ID NO: 729426 - DNA, 25 bp, Mus musculus
gttctagcataccatgtagttccta

SEQ ID NO: 729427 - DNA, 25 bp, Mus musculus
gttctagcatacgatgtagttccta

SEQ ID NO: 729428 - DNA, 25 bp, Mus musculus
gttctagccagaaacatgacttgat

SEQ ID NO: 729429 - DNA, 25 bp, Mus musculus
gttctagccagatacatgacttgat

SEQ ID NO: 729430 - DNA, 25 bp, Mus musculus
gttctagccgaactactatgcaata

SEQ ID NO: 729431 - DNA, 25 bp, Mus musculus
gttctagccgaagtactatgcaata

SEQ ID NO: 729432 - DNA, 25 bp, Mus musculus
gttctagccgctaggctgaaacttg

SEQ ID NO: 729433 - DNA, 25 bp, Mus musculus
gttctagccgcttggctgaaacttg

SEQ ID NO: 729434 - DNA, 25 bp, Mus musculus
gttctagcctaaacctactcaatca

SEQ ID NO: 729435 - DNA, 25 bp, Mus musculus
gttctagcctaaagtcaatggttta

SEQ ID NO: 729436 - DNA, 25 bp, Mus musculus
gttctagcctaatcctactcaatca

SEQ ID NO: 729437 - DNA, 25 bp, Mus musculus
gttctagcctaatgtcaatggttta

SEQ ID NO: 729438 - DNA, 25 bp, Mus musculus
gttctagcctgtacagctctgaaga

SEQ ID NO: 729439 - DNA, 25 bp, Mus musculus
gttctagcctgttcagctctgaaga

SEQ ID NO: 729440 - DNA, 25 bp, Mus musculus
gttctagcgtagagcctgttgttaa

SEQ ID NO: 729441 - DNA, 25 bp, Mus musculus
gttctagcgtagtgcctgttgttaa

SEQ ID NO: 729442 - DNA, 25 bp, Mus musculus
gttctagcgtttaaaagtccagtct

SEQ ID NO: 729443 - DNA, 25 bp, Mus musculus
gttctagcgttttaaagtccagtct

SEQ ID NO: 729444 - DNA, 25 bp, Mus musculus
gttctagctagacctggcctgcagg

SEQ ID NO: 729445 - DNA, 25 bp, Mus musculus
gttctagctagagctggcctgcagg

SEQ ID NO: 729446 - DNA, 25 bp, Mus musculus
gttctagctagtactgctgctttag

SEQ ID NO: 729447 - DNA, 25 bp, Mus musculus
gttctagctagttctgctgctttag

SEQ ID NO: 729448 - DNA, 25 bp, Mus musculus
gttctagctcacattgttgctatgt

SEQ ID NO: 729449 - DNA, 25 bp, Mus musculus
gttctagctcactttgttgctatgt

SEQ ID NO: 729450 - DNA, 25 bp, Mus musculus
gttctagctcatactgtaatccaag

SEQ ID NO: 729451 - DNA, 25 bp, Mus musculus
gttctagctcattctgtaatccaag

SEQ ID NO: 729452 - DNA, 25 bp, Mus musculus
gttctagctctaacaaaaatggctt

SEQ ID NO: 729453 - DNA, 25 bp, Mus musculus
gttctagctctactaggctctacag

SEQ ID NO: 729454 - DNA, 25 bp, Mus musculus
gttctagctctagtaggctctacag

SEQ ID NO: 729455 - DNA, 25 bp, Mus musculus
gttctagctctatcaaaaatggctt

SEQ ID NO: 729456 - DNA, 25 bp, Mus musculus
gttctaggaagactctgcaagccga

SEQ ID NO: 729457 - DNA, 25 bp, Mus musculus
gttctaggaagagtctgcaagccga

SEQ ID NO: 729458 - DNA, 25 bp, Mus musculus
gttctaggacttatacatcgttggt

SEQ ID NO: 729459 - DNA, 25 bp, Mus musculus
gttctaggacttttacatcgttggt

SEQ ID NO: 729460 - DNA, 25 bp, Mus musculus
gttctaggagatcttcccttgcacc

SEQ ID NO: 729461 - DNA, 25 bp, Mus musculus
gttctaggagatgttcccttgcacc

SEQ ID NO: 729462 - DNA, 25 bp, Mus musculus
gttctaggcagcaagagcttccaga

SEQ ID NO: 729463 - DNA, 25 bp, Mus musculus
gttctaggcagctagagcttccaga

SEQ ID NO: 729464 - DNA, 25 bp, Mus musculus
gttctaggccagaagaggctctgtt

SEQ ID NO: 729465 - DNA, 25 bp, Mus musculus
gttctaggccagcaaaggttacaca

SEQ ID NO: 729466 - DNA, 25 bp, Mus musculus
gttctaggccaggaaaggttacaca

SEQ ID NO: 729467 - DNA, 25 bp, Mus musculus
gttctaggccagtagaggctctgtt

SEQ ID NO: 729468 - DNA, 25 bp, Mus musculus
gttctaggccgtaaggatggtaaat

SEQ ID NO: 729469 - DNA, 25 bp, Mus musculus
gttctaggccgtctaacttgtacta

SEQ ID NO: 729470 - DNA, 25 bp, Mus musculus
gttctaggccgtgtaacttgtacta

SEQ ID NO: 729471 - DNA, 25 bp, Mus musculus
gttctaggccgttaggatggtaaat

SEQ ID NO: 729472 - DNA, 25 bp, Mus musculus
gttctaggcctaatagcatgtcggt

SEQ ID NO: 729473 - DNA, 25 bp, Mus musculus
gttctaggcctattagcatgtcggt

SEQ ID NO: 729474 - DNA, 25 bp, Mus musculus
gttctaggcgtgctggtcttttcct

SEQ ID NO: 729475 - DNA, 25 bp, Mus musculus
gttctaggcgtggtggtcttttcct

SEQ ID NO: 729476 - DNA, 25 bp, Mus musculus
gttctaggctccacctgacttttgt

SEQ ID NO: 729477 - DNA, 25 bp, Mus musculus
gttctaggctcctcctgacttttgt

SEQ ID NO: 729478 - DNA, 25 bp, Mus musculus
gttctaggctggagtggaatgctat

SEQ ID NO: 729479 - DNA, 25 bp, Mus musculus
gttctaggctggtgtggaatgctat

SEQ ID NO: 729480 - DNA, 25 bp, Mus musculus
gttctagggcagatagggcttcaca

SEQ ID NO: 729481 - DNA, 25 bp, Mus musculus
gttctagggcagttagggcttcaca

SEQ ID NO: 729482 - DNA, 25 bp, Mus musculus
gttctaggtccaatggttctgctca

SEQ ID NO: 729483 - DNA, 25 bp, Mus musculus
gttctaggtccattggttctgctca

SEQ ID NO: 729484 - DNA, 25 bp, Mus musculus
gttctaggtcttaggagcaccactc

SEQ ID NO: 729485 - DNA, 25 bp, Mus musculus
gttctaggtctttggagcaccactc

SEQ ID NO: 729486 - DNA, 25 bp, Mus musculus
gttctagtacaacagatcagtttat

SEQ ID NO: 729487 - DNA, 25 bp, Mus musculus
gttctagtacaaccaaagctaccca

SEQ ID NO: 729488 - DNA, 25 bp, Mus musculus
gttctagtacaagagatcagtttat

SEQ ID NO: 729489 - DNA, 25 bp, Mus musculus
gttctagtacaagcaaagctaccca

SEQ ID NO: 729490 - DNA, 25 bp, Mus musculus
gttctagtaccacagtattgagact

SEQ ID NO: 729491 - DNA, 25 bp, Mus musculus
gttctagtaccagagtattgagact

SEQ ID NO: 729492 - DNA, 25 bp, Mus musculus
gttctagtattgagaagccctcctg

SEQ ID NO: 729493 - DNA, 25 bp, Mus musculus
gttctagtattgtgaagccctcctg

SEQ ID NO: 729494 - DNA, 25 bp, Mus musculus
gttctagtccaaccgaatatctcaa

SEQ ID NO: 729495 - DNA, 25 bp, Mus musculus
gttctagtccaagcgaatatctcaa

SEQ ID NO: 729496 - DNA, 25 bp, Mus musculus
gttctagtcctcagaggtaacaggc

SEQ ID NO: 729497 - DNA, 25 bp, Mus musculus
gttctagtcctctgaggtaacaggc

SEQ ID NO: 729498 - DNA, 25 bp, Mus musculus
gttctagtccttatttgcactactt

SEQ ID NO: 729499 - DNA, 25 bp, Mus musculus
gttctagtccttttttgcactactt

SEQ ID NO: 729500 - DNA, 25 bp, Mus musculus
gttctagtggacagtttcatgaccc

SEQ ID NO: 729501 - DNA, 25 bp, Mus musculus
gttctagtggactgtttcatgaccc

SEQ ID NO: 729502 - DNA, 25 bp, Mus musculus
gttctagttacaccaagcactcttt

SEQ ID NO: 729503 - DNA, 25 bp, Mus musculus
gttctagttacagcaagcactcttt

SEQ ID NO: 729504 - DNA, 25 bp, Mus musculus
gttctagttcttcttttgttctggc

SEQ ID NO: 729505 - DNA, 25 bp, Mus musculus
gttctagttcttgttttgttctggc

SEQ ID NO: 729506 - DNA, 25 bp, Mus musculus
gttctagttgtaattttccagctgt

SEQ ID NO: 729507 - DNA, 25 bp, Mus musculus
gttctagttgtatttttccagctgt

SEQ ID NO: 729508 - DNA, 25 bp, Mus musculus
gttctagtttgaaggtcggccttgt

SEQ ID NO: 729509 - DNA, 25 bp, Mus musculus
gttctagtttgatggtcggccttgt

SEQ ID NO: 729510 - DNA, 25 bp, Mus musculus
gttctataaattaccttctcttcct

SEQ ID NO: 729511 - DNA, 25 bp, Mus musculus
gttctataaatttccttctcttcct

SEQ ID NO: 729512 - DNA, 25 bp, Mus musculus
gttctataacatacatggctggctg

SEQ ID NO: 729513 - DNA, 25 bp, Mus musculus
gttctataacattcatggctggctg

SEQ ID NO: 729514 - DNA, 25 bp, Mus musculus
gttctataataaccctagccaaagg

SEQ ID NO: 729515 - DNA, 25 bp, Mus musculus
gttctataataagcctagccaaagg

SEQ ID NO: 729516 - DNA, 25 bp, Mus musculus
gttctatacagactttgatcggcat

SEQ ID NO: 729517 - DNA, 25 bp, Mus musculus
gttctatacagagtttgatcggcat

SEQ ID NO: 729518 - DNA, 25 bp, Mus musculus
gttctatacccacgacccaaatgga

SEQ ID NO: 729519 - DNA, 25 bp, Mus musculus
gttctatacccaggacccaaatgga

SEQ ID NO: 729520 - DNA, 25 bp, Mus musculus
gttctatagaacacctgcataccat

SEQ ID NO: 729521 - DNA, 25 bp, Mus musculus
gttctatagaactcctgcataccat

SEQ ID NO: 729522 - DNA, 25 bp, Mus musculus
gttctatagggcaccgaattgcttt

SEQ ID NO: 729523 - DNA, 25 bp, Mus musculus
gttctatagggctccgaattgcttt

SEQ ID NO: 729524 - DNA, 25 bp, Mus musculus
gttctatataacagttcttcaccaa

SEQ ID NO: 729525 - DNA, 25 bp, Mus musculus
gttctatataactgttcttcaccaa

SEQ ID NO: 729526 - DNA, 25 bp, Mus musculus
gttctatatagcagtggatatggca

SEQ ID NO: 729527 - DNA, 25 bp, Mus musculus
gttctatatagctgtggatatggca

SEQ ID NO: 729528 - DNA, 25 bp, Mus musculus
gttctatattatcctggtggcagct

SEQ ID NO: 729529 - DNA, 25 bp, Mus musculus
gttctatattatgctggtggcagct

SEQ ID NO: 729530 - DNA, 25 bp, Mus musculus
gttctatattctctttaactggcag

SEQ ID NO: 729531 - DNA, 25 bp, Mus musculus
gttctatattctgtttaactggcag

SEQ ID NO: 729532 - DNA, 25 bp, Mus musculus
gttctatcacacaccaggttctgtt

SEQ ID NO: 729533 - DNA, 25 bp, Mus musculus
gttctatcacactccaggttctgtt

SEQ ID NO: 729534 - DNA, 25 bp, Mus musculus
gttctatcacctataaagggaagtg

SEQ ID NO: 729535 - DNA, 25 bp, Mus musculus
gttctatcacctttaaagggaagtg

SEQ ID NO: 729536 - DNA, 25 bp, Mus musculus
gttctatcagtgagagcagtgcgga

SEQ ID NO: 729537 - DNA, 25 bp, Mus musculus
gttctatcagtgtgagcagtgcgga

SEQ ID NO: 729538 - DNA, 25 bp, Mus musculus
gttctatccctacactctgagctgg

SEQ ID NO: 729539 - DNA, 25 bp, Mus musculus
gttctatccctagactctgagctgg

SEQ ID NO: 729540 - DNA, 25 bp, Mus musculus
gttctatccctgcaacttattgtta

SEQ ID NO: 729541 - DNA, 25 bp, Mus musculus
gttctatccctggaacttattgtta

SEQ ID NO: 729542 - DNA, 25 bp, Mus musculus
gttctatcccttagacactacacag

SEQ ID NO: 729543 - DNA, 25 bp, Mus musculus
gttctatccctttgacactacacag

SEQ ID NO: 729544 - DNA, 25 bp, Mus musculus
gttctatccgtgattgcgtcaatga

SEQ ID NO: 729545 - DNA, 25 bp, Mus musculus
gttctatccgtgtttgcgtcaatga

SEQ ID NO: 729546 - DNA, 25 bp, Mus musculus
gttctatcctgaatgtgctatgcac

SEQ ID NO: 729547 - DNA, 25 bp, Mus musculus
gttctatcctgattgtgctatgcac

SEQ ID NO: 729548 - DNA, 25 bp, Mus musculus
gttctatcgagcatttctatttcta

SEQ ID NO: 729549 - DNA, 25 bp, Mus musculus
gttctatcgagcttttctatttcta

SEQ ID NO: 729550 - DNA, 25 bp, Mus musculus
gttctatctaggactaaatgtttca

SEQ ID NO: 729551 - DNA, 25 bp, Mus musculus
gttctatctaggtctaaatgtttca

SEQ ID NO: 729552 - DNA, 25 bp, Mus musculus
gttctatctcccaaggctacttttg

SEQ ID NO: 729553 - DNA, 25 bp, Mus musculus
gttctatctccctaggctacttttg

SEQ ID NO: 729554 - DNA, 25 bp, Mus musculus
gttctatctgccacaaattaataag

SEQ ID NO: 729555 - DNA, 25 bp, Mus musculus
gttctatctgcctcaaattaataag

SEQ ID NO: 729556 - DNA, 25 bp, Mus musculus
gttctatctgtgctgggcctttgaa

SEQ ID NO: 729557 - DNA, 25 bp, Mus musculus
gttctatctgtggtgggcctttgaa

SEQ ID NO: 729558 - DNA, 25 bp, Mus musculus
gttctatgaacgagtgtgtgctgta

SEQ ID NO: 729559 - DNA, 25 bp, Mus musculus
gttctatgaacgtgtgtgtgctgta

SEQ ID NO: 729560 - DNA, 25 bp, Mus musculus
gttctatgaagtatgactatacgtg

SEQ ID NO: 729561 - DNA, 25 bp, Mus musculus
gttctatgaagtttgactatacgtg

SEQ ID NO: 729562 - DNA, 25 bp, Mus musculus
gttctatgaatcacacttcataaat

SEQ ID NO: 729563 - DNA, 25 bp, Mus musculus
gttctatgaatctcacttcataaat

SEQ ID NO: 729564 - DNA, 25 bp, Mus musculus
gttctatgattcacagtcatccata

SEQ ID NO: 729565 - DNA, 25 bp, Mus musculus
gttctatgattctcagtcatccata

SEQ ID NO: 729566 - DNA, 25 bp, Mus musculus
gttctatgcaggctgtctcgggact

SEQ ID NO: 729567 - DNA, 25 bp, Mus musculus
gttctatgcagggtgtctcgggact

SEQ ID NO: 729568 - DNA, 25 bp, Mus musculus
gttctatgccacaagagaccattac

SEQ ID NO: 729569 - DNA, 25 bp, Mus musculus
gttctatgccactagagaccattac

SEQ ID NO: 729570 - DNA, 25 bp, Mus musculus
gttctatggagtctttacattacac

SEQ ID NO: 729571 - DNA, 25 bp, Mus musculus
gttctatggagtgtttacattacac

SEQ ID NO: 729572 - DNA, 25 bp, Mus musculus
gttctatggcaccactaggaagcat

SEQ ID NO: 729573 - DNA, 25 bp, Mus musculus
gttctatggcacgactaggaagcat

SEQ ID NO: 729574 - DNA, 25 bp, Mus musculus
gttctatggcctattatatctgtca

SEQ ID NO: 729575 - DNA, 25 bp, Mus musculus
gttctatggccttttatatctgtca

SEQ ID NO: 729576 - DNA, 25 bp, Mus musculus
gttctatggctgagcaacatcccta

SEQ ID NO: 729577 - DNA, 25 bp, Mus musculus
gttctatggctgtgcaacatcccta

SEQ ID NO: 729578 - DNA, 25 bp, Mus musculus
gttctatgtcacagtttgctagcct

SEQ ID NO: 729579 - DNA, 25 bp, Mus musculus
gttctatgtcactgtttgctagcct

SEQ ID NO: 729580 - DNA, 25 bp, Mus musculus
gttctatgtcatagccttcagtatc

SEQ ID NO: 729581 - DNA, 25 bp, Mus musculus
gttctatgtcattgccttcagtatc

SEQ ID NO: 729582 - DNA, 25 bp, Mus musculus
gttctatgtcctcatattttaccct

SEQ ID NO: 729583 - DNA, 25 bp, Mus musculus
gttctatgtcctgatattttaccct

SEQ ID NO: 729584 - DNA, 25 bp, Mus musculus
gttctatgtcggctcttatgtgcac

SEQ ID NO: 729585 - DNA, 25 bp, Mus musculus
gttctatgtcgggtcttatgtgcac

SEQ ID NO: 729586 - DNA, 25 bp, Mus musculus
gttctatgtggcagagggacttgtc

SEQ ID NO: 729587 - DNA, 25 bp, Mus musculus
gttctatgtggctgagggacttgtc

SEQ ID NO: 729588 - DNA, 25 bp, Mus musculus
gttctattaaataccctgaggttct

SEQ ID NO: 729589 - DNA, 25 bp, Mus musculus
gttctattaaattccctgaggttct

SEQ ID NO: 729590 - DNA, 25 bp, Mus musculus
gttctattagttccagatgctgcta

SEQ ID NO: 729591 - DNA, 25 bp, Mus musculus
gttctattagttgcagatgctgcta

SEQ ID NO: 729592 - DNA, 25 bp, Mus musculus
gttctattattacgcagagggcaaa

SEQ ID NO: 729593 - DNA, 25 bp, Mus musculus
gttctattattaggcagagggcaaa

SEQ ID NO: 729594 - DNA, 25 bp, Mus musculus
gttctattcatacgtttcagggatc

SEQ ID NO: 729595 - DNA, 25 bp, Mus musculus
gttctattcataggtttcagggatc

SEQ ID NO: 729596 - DNA, 25 bp, Mus musculus
gttctattctgtatgctcttgtgac

SEQ ID NO: 729597 - DNA, 25 bp, Mus musculus
gttctattctgtttgctcttgtgac

SEQ ID NO: 729598 - DNA, 25 bp, Mus musculus
gttctattcttgacaacaattgagg

SEQ ID NO: 729599 - DNA, 25 bp, Mus musculus
gttctattcttgtcaacaattgagg

SEQ ID NO: 729600 - DNA, 25 bp, Mus musculus
gttctattgcgaacaaccctctttt

SEQ ID NO: 729601 - DNA, 25 bp, Mus musculus
gttctattgcgatcaaccctctttt

SEQ ID NO: 729602 - DNA, 25 bp, Mus musculus
gttctattgcttcacttcagtgctg

SEQ ID NO: 729603 - DNA, 25 bp, Mus musculus
gttctattgcttgacttcagtgctg

SEQ ID NO: 729604 - DNA, 25 bp, Mus musculus
gttctattttgtctgcacgactccc

SEQ ID NO: 729605 - DNA, 25 bp, Mus musculus
gttctattttgtgtgcacgactccc

SEQ ID NO: 729606 - DNA, 25 bp, Mus musculus
gttctatttttgaccaccttcaaat

SEQ ID NO: 729607 - DNA, 25 bp, Mus musculus
gttctatttttgtccaccttcaaat

SEQ ID NO: 729608 - DNA, 25 bp, Mus musculus
gttctcaaaagaccactggttcctt

SEQ ID NO: 729609 - DNA, 25 bp, Mus musculus
gttctcaaaagagcactggttcctt

SEQ ID NO: 729610 - DNA, 25 bp, Mus musculus
gttctcaaaatccacctttctagga

SEQ ID NO: 729611 - DNA, 25 bp, Mus musculus
gttctcaaaatcgacctttctagga

SEQ ID NO: 729612 - DNA, 25 bp, Mus musculus
gttctcaaaatgaccagttgctcaa

SEQ ID NO: 729613 - DNA, 25 bp, Mus musculus
gttctcaaaatgtccagttgctcaa

SEQ ID NO: 729614 - DNA, 25 bp, Mus musculus
gttctcaaatacacatatatggaaa

SEQ ID NO: 729615 - DNA, 25 bp, Mus musculus
gttctcaaatactcatatatggaaa

SEQ ID NO: 729616 - DNA, 25 bp, Mus musculus
gttctcaaatagaaatagccctgaa

SEQ ID NO: 729617 - DNA, 25 bp, Mus musculus
gttctcaaatagtaatagccctgaa

SEQ ID NO: 729618 - DNA, 25 bp, Mus musculus
gttctcaaattacgttgcggcgcta

SEQ ID NO: 729619 - DNA, 25 bp, Mus musculus
gttctcaaattaggttgcggcgcta

SEQ ID NO: 729620 - DNA, 25 bp, Mus musculus
gttctcaacatacctcaaacttctg

SEQ ID NO: 729621 - DNA, 25 bp, Mus musculus
gttctcaacatagctcaaacttctg

SEQ ID NO: 729622 - DNA, 25 bp, Mus musculus
gttctcaaccagcatgatgaccagt

SEQ ID NO: 729623 - DNA, 25 bp, Mus musculus
gttctcaaccaggatgatgaccagt

SEQ ID NO: 729624 - DNA, 25 bp, Mus musculus
gttctcaaccatcgccaaatacagt

SEQ ID NO: 729625 - DNA, 25 bp, Mus musculus
gttctcaaccatggccaaatacagt

SEQ ID NO: 729626 - DNA, 25 bp, Mus musculus
gttctcaaccttctgcagactatga

SEQ ID NO: 729627 - DNA, 25 bp, Mus musculus
gttctcaaccttgtgcagactatga

SEQ ID NO: 729628 - DNA, 25 bp, Mus musculus
gttctcaactccctcttgaggttga

SEQ ID NO: 729629 - DNA, 25 bp, Mus musculus
gttctcaactccgtcttgaggttga

SEQ ID NO: 729630 - DNA, 25 bp, Mus musculus
gttctcaactggacaatctgtcggt

SEQ ID NO: 729631 - DNA, 25 bp, Mus musculus
gttctcaactggtcaatctgtcggt

SEQ ID NO: 729632 - DNA, 25 bp, Mus musculus
gttctcaagcagaggcagtctattg

SEQ ID NO: 729633 - DNA, 25 bp, Mus musculus
gttctcaagcagtggcagtctattg

SEQ ID NO: 729634 - DNA, 25 bp, Mus musculus
gttctcaagccgaaggtcatgcaag

SEQ ID NO: 729635 - DNA, 25 bp, Mus musculus
gttctcaagccgtaggtcatgcaag

SEQ ID NO: 729636 - DNA, 25 bp, Mus musculus
gttctcaagcctatgggtttcctca

SEQ ID NO: 729637 - DNA, 25 bp, Mus musculus
gttctcaagcctttgggtttcctca

SEQ ID NO: 729638 - DNA, 25 bp, Mus musculus
gttctcaaggacatagctgctataa

SEQ ID NO: 729639 - DNA, 25 bp, Mus musculus
gttctcaaggacttagctgctataa

SEQ ID NO: 729640 - DNA, 25 bp, Mus musculus
gttctcaagtacagcagattggcca

SEQ ID NO: 729641 - DNA, 25 bp, Mus musculus
gttctcaagtactgcagattggcca

SEQ ID NO: 729642 - DNA, 25 bp, Mus musculus
gttctcaatgtgaaggatgctgcca

SEQ ID NO: 729643 - DNA, 25 bp, Mus musculus
gttctcaatgtgtaggatgctgcca

SEQ ID NO: 729644 - DNA, 25 bp, Mus musculus
gttctcacacttatatgctgtcttg

SEQ ID NO: 729645 - DNA, 25 bp, Mus musculus
gttctcacacttttatgctgtcttg

SEQ ID NO: 729646 - DNA, 25 bp, Mus musculus
gttctcacagctctttttataagac

SEQ ID NO: 729647 - DNA, 25 bp, Mus musculus
gttctcacagctgtttttataagac

SEQ ID NO: 729648 - DNA, 25 bp, Mus musculus
gttctcaccccgcagactaacagga

SEQ ID NO: 729649 - DNA, 25 bp, Mus musculus
gttctcaccccggagactaacagga

SEQ ID NO: 729650 - DNA, 25 bp, Mus musculus
gttctcaccgggaagacttgttcta

SEQ ID NO: 729651 - DNA, 25 bp, Mus musculus
gttctcaccgggtagacttgttcta

SEQ ID NO: 729652 - DNA, 25 bp, Mus musculus
gttctcacctccattattactgtta

SEQ ID NO: 729653 - DNA, 25 bp, Mus musculus
gttctcacctcctttattactgtta

SEQ ID NO: 729654 - DNA, 25 bp, Mus musculus
gttctcacctttatgaatgtagtcg

SEQ ID NO: 729655 - DNA, 25 bp, Mus musculus
gttctcacctttttgaatgtagtcg

SEQ ID NO: 729656 - DNA, 25 bp, Mus musculus
gttctcacgagacacataaagcttc

SEQ ID NO: 729657 - DNA, 25 bp, Mus musculus
gttctcacgagagacataaagcttc

SEQ ID NO: 729658 - DNA, 25 bp, Mus musculus
gttctcacgcagagagtgggtctcc

SEQ ID NO: 729659 - DNA, 25 bp, Mus musculus
gttctcacgcagtgagtgggtctcc

SEQ ID NO: 729660 - DNA, 25 bp, Mus musculus
gttctcactcatactgtacatcact

SEQ ID NO: 729661 - DNA, 25 bp, Mus musculus
gttctcactcattctgtacatcact

SEQ ID NO: 729662 - DNA, 25 bp, Mus musculus
gttctcactgaactgtgctagagta

SEQ ID NO: 729663 - DNA, 25 bp, Mus musculus
gttctcactgaagtgtgctagagta

SEQ ID NO: 729664 - DNA, 25 bp, Mus musculus
gttctcacttagatatagactcttt

SEQ ID NO: 729665 - DNA, 25 bp, Mus musculus
gttctcacttagttatagactcttt

SEQ ID NO: 729666 - DNA, 25 bp, Mus musculus
gttctcactttcatttcctagcaga

SEQ ID NO: 729667 - DNA, 25 bp, Mus musculus
gttctcactttcttttcctagcaga

SEQ ID NO: 729668 - DNA, 25 bp, Mus musculus
gttctcagaacccatgtcaactggc

SEQ ID NO: 729669 - DNA, 25 bp, Mus musculus
gttctcagaaccgatgtcaactggc

SEQ ID NO: 729670 - DNA, 25 bp, Mus musculus
gttctcagaccactataaacacgtg

SEQ ID NO: 729671 - DNA, 25 bp, Mus musculus
gttctcagaccagtataaacacgtg

SEQ ID NO: 729672 - DNA, 25 bp, Mus musculus
gttctcagagtcaccctttgtgaat

SEQ ID NO: 729673 - DNA, 25 bp, Mus musculus
gttctcagagtctccctttgtgaat

SEQ ID NO: 729674 - DNA, 25 bp, Mus musculus
gttctcagataccactggatacttt

SEQ ID NO: 729675 - DNA, 25 bp, Mus musculus
gttctcagatacgactggatacttt

SEQ ID NO: 729676 - DNA, 25 bp, Mus musculus
gttctcagatatccatgttcttcta

SEQ ID NO: 729677 - DNA, 25 bp, Mus musculus
gttctcagatatgcatgttcttcta

SEQ ID NO: 729678 - DNA, 25 bp, Mus musculus
gttctcagcaacaggatccatatct

SEQ ID NO: 729679 - DNA, 25 bp, Mus musculus
gttctcagcaacatcttcttggcta

SEQ ID NO: 729680 - DNA, 25 bp, Mus musculus
gttctcagcaactggatccatatct

SEQ ID NO: 729681 - DNA, 25 bp, Mus musculus
gttctcagcaacttcttcttggcta

SEQ ID NO: 729682 - DNA, 25 bp, Mus musculus
gttctcagcataatcacaaaagcat

SEQ ID NO: 729683 - DNA, 25 bp, Mus musculus
gttctcagcatattcacaaaagcat

SEQ ID NO: 729684 - DNA, 25 bp, Mus musculus
gttctcagccatacgtaacttcatt

SEQ ID NO: 729685 - DNA, 25 bp, Mus musculus
gttctcagccattcgtaacttcatt

SEQ ID NO: 729686 - DNA, 25 bp, Mus musculus
gttctcagcgccattgcgggagcag

SEQ ID NO: 729687 - DNA, 25 bp, Mus musculus
gttctcagcgcctttgcgggagcag

SEQ ID NO: 729688 - DNA, 25 bp, Mus musculus
gttctcagctaaaatgtcagagcca

SEQ ID NO: 729689 - DNA, 25 bp, Mus musculus
gttctcagctaatatgtcagagcca

SEQ ID NO: 729690 - DNA, 25 bp, Mus musculus
gttctcagctcccttgtgttcaaca

SEQ ID NO: 729691 - DNA, 25 bp, Mus musculus
gttctcagctccgttgtgttcaaca

SEQ ID NO: 729692 - DNA, 25 bp, Mus musculus
gttctcagcttcaatagagtcctcc

SEQ ID NO: 729693 - DNA, 25 bp, Mus musculus
gttctcagcttctatagagtcctcc

SEQ ID NO: 729694 - DNA, 25 bp, Mus musculus
gttctcaggagaaacacgttgcagg

SEQ ID NO: 729695 - DNA, 25 bp, Mus musculus
gttctcaggagatacacgttgcagg

SEQ ID NO: 729696 - DNA, 25 bp, Mus musculus
gttctcaggccccacaagaatggtg

SEQ ID NO: 729697 - DNA, 25 bp, Mus musculus
gttctcaggcccgacaagaatggtg

SEQ ID NO: 729698 - DNA, 25 bp, Mus musculus
gttctcagggctccttgtgcagaaa

SEQ ID NO: 729699 - DNA, 25 bp, Mus musculus
gttctcagggctgcttgtgcagaaa

SEQ ID NO: 729700 - DNA, 25 bp, Mus musculus
gttctcagtaagacctgtctacctc

SEQ ID NO: 729701 - DNA, 25 bp, Mus musculus
gttctcagtaagtcctgtctacctc

SEQ ID NO: 729702 - DNA, 25 bp, Mus musculus
gttctcagtaccagccaatttgggc

SEQ ID NO: 729703 - DNA, 25 bp, Mus musculus
gttctcagtacccatggcaagcaac

SEQ ID NO: 729704 - DNA, 25 bp, Mus musculus
gttctcagtaccgatggcaagcaac

SEQ ID NO: 729705 - DNA, 25 bp, Mus musculus
gttctcagtacctgccaatttgggc

SEQ ID NO: 729706 - DNA, 25 bp, Mus musculus
gttctcagtataagcaaacacattg

SEQ ID NO: 729707 - DNA, 25 bp, Mus musculus
gttctcagtatatgcaaacacattg

SEQ ID NO: 729708 - DNA, 25 bp, Mus musculus
gttctcagtattatcactctattga

SEQ ID NO: 729709 - DNA, 25 bp, Mus musculus
gttctcagtattttcactctattga

SEQ ID NO: 729710 - DNA, 25 bp, Mus musculus
gttctcagtcgacacaataacgtta

SEQ ID NO: 729711 - DNA, 25 bp, Mus musculus
gttctcagtcgagacaataacgtta

SEQ ID NO: 729712 - DNA, 25 bp, Mus musculus
gttctcagtcggaaagtctctgtaa

SEQ ID NO: 729713 - DNA, 25 bp, Mus musculus
gttctcagtcggtaagtctctgtaa

SEQ ID NO: 729714 - DNA, 25 bp, Mus musculus
gttctcagtcgtaagttctctcaaa

SEQ ID NO: 729715 - DNA, 25 bp, Mus musculus
gttctcagtcgttagttctctcaaa

SEQ ID NO: 729716 - DNA, 25 bp, Mus musculus
gttctcagtctaaaggtcatcagtt

SEQ ID NO: 729717 - DNA, 25 bp, Mus musculus
gttctcagtctataggtcatcagtt

SEQ ID NO: 729718 - DNA, 25 bp, Mus musculus
gttctcagttctcccagttccttta

SEQ ID NO: 729719 - DNA, 25 bp, Mus musculus
gttctcagttctgccagttccttta

SEQ ID NO: 729720 - DNA, 25 bp, Mus musculus
gttctcataactccttttcctaaag

SEQ ID NO: 729721 - DNA, 25 bp, Mus musculus
gttctcataactgcttttcctaaag

SEQ ID NO: 729722 - DNA, 25 bp, Mus musculus
gttctcataagacatctccacaggg

SEQ ID NO: 729723 - DNA, 25 bp, Mus musculus
gttctcataagagatctccacaggg

SEQ ID NO: 729724 - DNA, 25 bp, Mus musculus
gttctcataggcaaaggctaggaaa

SEQ ID NO: 729725 - DNA, 25 bp, Mus musculus
gttctcataggctaaggctaggaaa

SEQ ID NO: 729726 - DNA, 25 bp, Mus musculus
gttctcatagtgagcaaactcctca

SEQ ID NO: 729727 - DNA, 25 bp, Mus musculus
gttctcatagtgtgcaaactcctca

SEQ ID NO: 729728 - DNA, 25 bp, Mus musculus
gttctcatcatcacctttattacag

SEQ ID NO: 729729 - DNA, 25 bp, Mus musculus
gttctcatcatcctccatggaaatc

SEQ ID NO: 729730 - DNA, 25 bp, Mus musculus
gttctcatcatcgtccatggaaatc

SEQ ID NO: 729731 - DNA, 25 bp, Mus musculus
gttctcatcatctcctttattacag

SEQ ID NO: 729732 - DNA, 25 bp, Mus musculus
gttctcatcccactagacacagatt

SEQ ID NO: 729733 - DNA, 25 bp, Mus musculus
gttctcatcccagtagacacagatt

SEQ ID NO: 729734 - DNA, 25 bp, Mus musculus
gttctcatcgcacacacttctactg

SEQ ID NO: 729735 - DNA, 25 bp, Mus musculus
gttctcatcgcagacacttctactg

SEQ ID NO: 729736 - DNA, 25 bp, Mus musculus
gttctcatctttccccttgaaatag

SEQ ID NO: 729737 - DNA, 25 bp, Mus musculus
gttctcatctttgcccttgaaatag

SEQ ID NO: 729738 - DNA, 25 bp, Mus musculus
gttctcatgaacaagccattgcaca

SEQ ID NO: 729739 - DNA, 25 bp, Mus musculus
gttctcatgaactagccattgcaca

SEQ ID NO: 729740 - DNA, 25 bp, Mus musculus
gttctcatgactatggattatggaa

SEQ ID NO: 729741 - DNA, 25 bp, Mus musculus
gttctcatgactttggattatggaa

SEQ ID NO: 729742 - DNA, 25 bp, Mus musculus
gttctcatgatcagaccaactgtta

SEQ ID NO: 729743 - DNA, 25 bp, Mus musculus
gttctcatgatctgaccaactgtta

SEQ ID NO: 729744 - DNA, 25 bp, Mus musculus
gttctcatgcagaccataccaagga

SEQ ID NO: 729745 - DNA, 25 bp, Mus musculus
gttctcatgcagtccataccaagga

SEQ ID NO: 729746 - DNA, 25 bp, Mus musculus
gttctcatttcacagagttgtacaa

SEQ ID NO: 729747 - DNA, 25 bp, Mus musculus
gttctcatttcagagagttgtacaa

SEQ ID NO: 729748 - DNA, 25 bp, Mus musculus
gttctcatttccctgggatgtggca

SEQ ID NO: 729749 - DNA, 25 bp, Mus musculus
gttctcatttccgtgggatgtggca

SEQ ID NO: 729750 - DNA, 25 bp, Mus musculus
gttctcattttgatactgcacattt

SEQ ID NO: 729751 - DNA, 25 bp, Mus musculus
gttctcattttgttactgcacattt

SEQ ID NO: 729752 - DNA, 25 bp, Mus musculus
gttctccaaagcaccaaggcatgtt

SEQ ID NO: 729753 - DNA, 25 bp, Mus musculus
gttctccaaagctccaaggcatgtt

SEQ ID NO: 729754 - DNA, 25 bp, Mus musculus
gttctccaacaccaatattaaccta

SEQ ID NO: 729755 - DNA, 25 bp, Mus musculus
gttctccaacacgaatattaaccta

SEQ ID NO: 729756 - DNA, 25 bp, Mus musculus
gttctccaacctcggcgagatggaa

SEQ ID NO: 729757 - DNA, 25 bp, Mus musculus
gttctccaacctgggcgagatggaa

SEQ ID NO: 729758 - DNA, 25 bp, Mus musculus
gttctccaagtgaggcgtgatggcc

SEQ ID NO: 729759 - DNA, 25 bp, Mus musculus
gttctccaagtgtggcgtgatggcc

SEQ ID NO: 729760 - DNA, 25 bp, Mus musculus
gttctccaatgtagggttcctctgg

SEQ ID NO: 729761 - DNA, 25 bp, Mus musculus
gttctccaatgtatcagttgaggtt

SEQ ID NO: 729762 - DNA, 25 bp, Mus musculus
gttctccaatgttgggttcctctgg

SEQ ID NO: 729763 - DNA, 25 bp, Mus musculus
gttctccaatgtttcagttgaggtt

SEQ ID NO: 729764 - DNA, 25 bp, Mus musculus
gttctccacacccagtattggtgat

SEQ ID NO: 729765 - DNA, 25 bp, Mus musculus
gttctccacaccgagtattggtgat

SEQ ID NO: 729766 - DNA, 25 bp, Mus musculus
gttctccaccacagtgtactttatt

SEQ ID NO: 729767 - DNA, 25 bp, Mus musculus
gttctccaccactgtgtactttatt

SEQ ID NO: 729768 - DNA, 25 bp, Mus musculus
gttctccactgtaatagaatcccat

SEQ ID NO: 729769 - DNA, 25 bp, Mus musculus
gttctccactgttatagaatcccat

SEQ ID NO: 729770 - DNA, 25 bp, Mus musculus
gttctccacttcactgacatagcct

SEQ ID NO: 729771 - DNA, 25 bp, Mus musculus
gttctccacttctctgacatagcct

SEQ ID NO: 729772 - DNA, 25 bp, Mus musculus
gttctccagagccatgaatgagctg

SEQ ID NO: 729773 - DNA, 25 bp, Mus musculus
gttctccagagcgatgaatgagctg

SEQ ID NO: 729774 - DNA, 25 bp, Mus musculus
gttctccagcttcagcattccaccc

SEQ ID NO: 729775 - DNA, 25 bp, Mus musculus
gttctccagcttgagcattccaccc

SEQ ID NO: 729776 - DNA, 25 bp, Mus musculus
gttctccagtacactattctactta

SEQ ID NO: 729777 - DNA, 25 bp, Mus musculus
gttctccagtactctattctactta

SEQ ID NO: 729778 - DNA, 25 bp, Mus musculus
gttctccagtggatagtgtgctata

SEQ ID NO: 729779 - DNA, 25 bp, Mus musculus
gttctccagtggttagtgtgctata

SEQ ID NO: 729780 - DNA, 25 bp, Mus musculus
gttctccagtttagtgtcttactca

SEQ ID NO: 729781 - DNA, 25 bp, Mus musculus
gttctccagttttgtgtcttactca

SEQ ID NO: 729782 - DNA, 25 bp, Mus musculus
gttctccatctcatctcagtagagt

SEQ ID NO: 729783 - DNA, 25 bp, Mus musculus
gttctccatctcttctcagtagagt

SEQ ID NO: 729784 - DNA, 25 bp, Mus musculus
gttctccattccatgtttgcaacag

SEQ ID NO: 729785 - DNA, 25 bp, Mus musculus
gttctccattccttgtttgcaacag

SEQ ID NO: 729786 - DNA, 25 bp, Mus musculus
gttctcccaaagacgctgtcagaga

SEQ ID NO: 729787 - DNA, 25 bp, Mus musculus
gttctcccaaagtcgctgtcagaga

SEQ ID NO: 729788 - DNA, 25 bp, Mus musculus
gttctcccaggacatagcagcagac

SEQ ID NO: 729789 - DNA, 25 bp, Mus musculus
gttctcccaggagatagcagcagac

SEQ ID NO: 729790 - DNA, 25 bp, Mus musculus
gttctccccgtcaactgtacgagtg

SEQ ID NO: 729791 - DNA, 25 bp, Mus musculus
gttctccccgtctactgtacgagtg

SEQ ID NO: 729792 - DNA, 25 bp, Mus musculus
gttctcccctccatgggtgtgaata

SEQ ID NO: 729793 - DNA, 25 bp, Mus musculus
gttctcccctccttgggtgtgaata

SEQ ID NO: 729794 - DNA, 25 bp, Mus musculus
gttctccctagaaactcagttttat

SEQ ID NO: 729795 - DNA, 25 bp, Mus musculus
gttctccctagatactcagttttat

SEQ ID NO: 729796 - DNA, 25 bp, Mus musculus
gttctccctcataactgggtgattt

SEQ ID NO: 729797 - DNA, 25 bp, Mus musculus
gttctccctcattactgggtgattt

SEQ ID NO: 729798 - DNA, 25 bp, Mus musculus
gttctccctccgcttcatgtgaaaa

SEQ ID NO: 729799 - DNA, 25 bp, Mus musculus
gttctccctccggttcatgtgaaaa

SEQ ID NO: 729800 - DNA, 25 bp, Mus musculus
gttctccctgctcaataacaatcat

SEQ ID NO: 729801 - DNA, 25 bp, Mus musculus
gttctccctgctgaataacaatcat

SEQ ID NO: 729802 - DNA, 25 bp, Mus musculus
gttctccctggacatctccgaattg

SEQ ID NO: 729803 - DNA, 25 bp, Mus musculus
gttctccctggagatctccgaattg

SEQ ID NO: 729804 - DNA, 25 bp, Mus musculus
gttctccctggcattcagagacgag

SEQ ID NO: 729805 - DNA, 25 bp, Mus musculus
gttctccctggctttcagagacgag

SEQ ID NO: 729806 - DNA, 25 bp, Mus musculus
gttctccctttcagatacctggaga

SEQ ID NO: 729807 - DNA, 25 bp, Mus musculus
gttctccctttctgatacctggaga

SEQ ID NO: 729808 - DNA, 25 bp, Mus musculus
gttctcccttttactgacagtgtgg

SEQ ID NO: 729809 - DNA, 25 bp, Mus musculus
gttctccctttttctgacagtgtgg

SEQ ID NO: 729810 - DNA, 25 bp, Mus musculus
gttctccgaaacagtatcctagggt

SEQ ID NO: 729811 - DNA, 25 bp, Mus musculus
gttctccgaaactgtatcctagggt

SEQ ID NO: 729812 - DNA, 25 bp, Mus musculus
gttctccgagctagtagctggagag

SEQ ID NO: 729813 - DNA, 25 bp, Mus musculus
gttctccgagcttgtagctggagag

SEQ ID NO: 729814 - DNA, 25 bp, Mus musculus
gttctccgaggaactgttaaaagat

SEQ ID NO: 729815 - DNA, 25 bp, Mus musculus
gttctccgaggatctgttaaaagat

SEQ ID NO: 729816 - DNA, 25 bp, Mus musculus
gttctccgcacaagtgagaccttca

SEQ ID NO: 729817 - DNA, 25 bp, Mus musculus
gttctccgcacatgtgagaccttca

SEQ ID NO: 729818 - DNA, 25 bp, Mus musculus
gttctccgcttgcatctgatctcaa

SEQ ID NO: 729819 - DNA, 25 bp, Mus musculus
gttctccgcttggatctgatctcaa

SEQ ID NO: 729820 - DNA, 25 bp, Mus musculus
gttctccggatcacgtagcgaaagc

SEQ ID NO: 729821 - DNA, 25 bp, Mus musculus
gttctccggatctcgtagcgaaagc

SEQ ID NO: 729822 - DNA, 25 bp, Mus musculus
gttctccggtagctttgccaaagtg

SEQ ID NO: 729823 - DNA, 25 bp, Mus musculus
gttctccggtaggtttgccaaagtg

SEQ ID NO: 729824 - DNA, 25 bp, Mus musculus
gttctccgtactcttggcactgcga

SEQ ID NO: 729825 - DNA, 25 bp, Mus musculus
gttctccgtactgttggcactgcga

SEQ ID NO: 729826 - DNA, 25 bp, Mus musculus
gttctccgtgaactctgtagactgt

SEQ ID NO: 729827 - DNA, 25 bp, Mus musculus
gttctccgtgaagtctgtagactgt

SEQ ID NO: 729828 - DNA, 25 bp, Mus musculus
gttctccgttcaccagtagtacagt

SEQ ID NO: 729829 - DNA, 25 bp, Mus musculus
gttctccgttcagcagtagtacagt

SEQ ID NO: 729830 - DNA, 25 bp, Mus musculus
gttctcctacatccgtgaacaatct

SEQ ID NO: 729831 - DNA, 25 bp, Mus musculus
gttctcctacatgcgtgaacaatct

SEQ ID NO: 729832 - DNA, 25 bp, Mus musculus
gttctcctactgagacttgtgattt

SEQ ID NO: 729833 - DNA, 25 bp, Mus musculus
gttctcctactgtgacttgtgattt

SEQ ID NO: 729834 - DNA, 25 bp, Mus musculus
gttctcctagttagcattgacactt

SEQ ID NO: 729835 - DNA, 25 bp, Mus musculus
gttctcctagtttgcattgacactt

SEQ ID NO: 729836 - DNA, 25 bp, Mus musculus
gttctcctatgtcccttatgatata

SEQ ID NO: 729837 - DNA, 25 bp, Mus musculus
gttctcctatgtgccttatgatata

SEQ ID NO: 729838 - DNA, 25 bp, Mus musculus
gttctcctcaacctggtctatgaaa

SEQ ID NO: 729839 - DNA, 25 bp, Mus musculus
gttctcctcaacgtggtctatgaaa

SEQ ID NO: 729840 - DNA, 25 bp, Mus musculus
gttctcctcaatcatgagtcctgtg

SEQ ID NO: 729841 - DNA, 25 bp, Mus musculus
gttctcctcaatgatgagtcctgtg

SEQ ID NO: 729842 - DNA, 25 bp, Mus musculus
gttctcctcatacgtggaaaggttt

SEQ ID NO: 729843 - DNA, 25 bp, Mus musculus
gttctcctcataggtggaaaggttt

SEQ ID NO: 729844 - DNA, 25 bp, Mus musculus
gttctcctctccatagcacagagcg

SEQ ID NO: 729845 - DNA, 25 bp, Mus musculus
gttctcctctccttagcacagagcg

SEQ ID NO: 729846 - DNA, 25 bp, Mus musculus
gttctcctctctagcataagacttt

SEQ ID NO: 729847 - DNA, 25 bp, Mus musculus
gttctcctctcttgcataagacttt

SEQ ID NO: 729848 - DNA, 25 bp, Mus musculus
gttctcctctgaacagtttggattt

SEQ ID NO: 729849 - DNA, 25 bp, Mus musculus
gttctcctctgatcagtttggattt

SEQ ID NO: 729850 - DNA, 25 bp, Mus musculus
gttctcctgacgcatctggtggtgt

SEQ ID NO: 729851 - DNA, 25 bp, Mus musculus
gttctcctgacggatctggtggtgt

SEQ ID NO: 729852 - DNA, 25 bp, Mus musculus
gttctcctgactccttccgtgcatt

SEQ ID NO: 729853 - DNA, 25 bp, Mus musculus
gttctcctgactgcttccgtgcatt

SEQ ID NO: 729854 - DNA, 25 bp, Mus musculus
gttctcctggctcttcaagtattta

SEQ ID NO: 729855 - DNA, 25 bp, Mus musculus
gttctcctggctgttcaagtattta

SEQ ID NO: 729856 - DNA, 25 bp, Mus musculus
gttctcctgggcaggtattgtaggc

SEQ ID NO: 729857 - DNA, 25 bp, Mus musculus
gttctcctgggctggtattgtaggc

SEQ ID NO: 729858 - DNA, 25 bp, Mus musculus
gttctcctggtaatagtcactatgt

SEQ ID NO: 729859 - DNA, 25 bp, Mus musculus
gttctcctggtaatggttaattgca

SEQ ID NO: 729860 - DNA, 25 bp, Mus musculus
gttctcctggtattagtcactatgt

SEQ ID NO: 729861 - DNA, 25 bp, Mus musculus
gttctcctggtattggttaattgca

SEQ ID NO: 729862 - DNA, 25 bp, Mus musculus
gttctcctgtaacatcatggcctca

SEQ ID NO: 729863 - DNA, 25 bp, Mus musculus
gttctcctgtaagatcatggcctca

SEQ ID NO: 729864 - DNA, 25 bp, Mus musculus
gttctccttgagacttcttgcatct

SEQ ID NO: 729865 - DNA, 25 bp, Mus musculus
gttctccttgagtcttcttgcatct

SEQ ID NO: 729866 - DNA, 25 bp, Mus musculus
gttctccttgatcgttgatgcaaac

SEQ ID NO: 729867 - DNA, 25 bp, Mus musculus
gttctccttgatggttgatgcaaac

SEQ ID NO: 729868 - DNA, 25 bp, Mus musculus
gttctccttgtaaagctaaattcac

SEQ ID NO: 729869 - DNA, 25 bp, Mus musculus
gttctccttgtatagctaaattcac

SEQ ID NO: 729870 - DNA, 25 bp, Mus musculus
gttctcctttgtaagcctctgatta

SEQ ID NO: 729871 - DNA, 25 bp, Mus musculus
gttctcctttgttagcctctgatta

SEQ ID NO: 729872 - DNA, 25 bp, Mus musculus
gttctcgaaccaaatctacacagta

SEQ ID NO: 729873 - DNA, 25 bp, Mus musculus
gttctcgaaccatatctacacagta

SEQ ID NO: 729874 - DNA, 25 bp, Mus musculus
gttctcgactacagacaaatgtttg

SEQ ID NO: 729875 - DNA, 25 bp, Mus musculus
gttctcgactactgacaaatgtttg

SEQ ID NO: 729876 - DNA, 25 bp, Mus musculus
gttctcgactgactttgcagatctc

SEQ ID NO: 729877 - DNA, 25 bp, Mus musculus
gttctcgactgagtttgcagatctc

SEQ ID NO: 729878 - DNA, 25 bp, Mus musculus
gttctcgcaagtattccagtagggt

SEQ ID NO: 729879 - DNA, 25 bp, Mus musculus
gttctcgcaagttttccagtagggt

SEQ ID NO: 729880 - DNA, 25 bp, Mus musculus
gttctcgcaggaattccctagatgg

SEQ ID NO: 729881 - DNA, 25 bp, Mus musculus
gttctcgcaggatttccctagatgg

SEQ ID NO: 729882 - DNA, 25 bp, Mus musculus
gttctcgcccatcaagatgaccata

SEQ ID NO: 729883 - DNA, 25 bp, Mus musculus
gttctcgcccatgaagatgaccata

SEQ ID NO: 729884 - DNA, 25 bp, Mus musculus
gttctcggaaagattcaaggctctt

SEQ ID NO: 729885 - DNA, 25 bp, Mus musculus
gttctcggaaagtttcaaggctctt

SEQ ID NO: 729886 - DNA, 25 bp, Mus musculus
gttctcggccccagagaatgccgtg

SEQ ID NO: 729887 - DNA, 25 bp, Mus musculus
gttctcggcccctgagaatgccgtg

SEQ ID NO: 729888 - DNA, 25 bp, Mus musculus
gttctcggcctcaacaaattccagt

SEQ ID NO: 729889 - DNA, 25 bp, Mus musculus
gttctcggcctctacaaattccagt

SEQ ID NO: 729890 - DNA, 25 bp, Mus musculus
gttctcgggaccaagatctggatct

SEQ ID NO: 729891 - DNA, 25 bp, Mus musculus
gttctcgggacctagatctggatct

SEQ ID NO: 729892 - DNA, 25 bp, Mus musculus
gttctcgggaggaatactttgtctt

SEQ ID NO: 729893 - DNA, 25 bp, Mus musculus
gttctcgggaggtatactttgtctt

SEQ ID NO: 729894 - DNA, 25 bp, Mus musculus
gttctcgggtttctttttgacatat

SEQ ID NO: 729895 - DNA, 25 bp, Mus musculus
gttctcgggtttgtttttgacatat

SEQ ID NO: 729896 - DNA, 25 bp, Mus musculus
gttctcggttttcgatacatcttca

SEQ ID NO: 729897 - DNA, 25 bp, Mus musculus
gttctcggttttggatacatcttca

SEQ ID NO: 729898 - DNA, 25 bp, Mus musculus
gttctcgtttccacttttgaatagt

SEQ ID NO: 729899 - DNA, 25 bp, Mus musculus
gttctcgtttcctcttttgaatagt

SEQ ID NO: 729900 - DNA, 25 bp, Mus musculus
gttctctaaccacgattgtaacaaa

SEQ ID NO: 729901 - DNA, 25 bp, Mus musculus
gttctctaaccaggattgtaacaaa

SEQ ID NO: 729902 - DNA, 25 bp, Mus musculus
gttctctaagagcattggcaaccaa

SEQ ID NO: 729903 - DNA, 25 bp, Mus musculus
gttctctaagaggattggcaaccaa

SEQ ID NO: 729904 - DNA, 25 bp, Mus musculus
gttctctaagtcacaatatccacat

SEQ ID NO: 729905 - DNA, 25 bp, Mus musculus
gttctctaagtctcaatatccacat

SEQ ID NO: 729906 - DNA, 25 bp, Mus musculus
gttctctacaccaattgattcccca

SEQ ID NO: 729907 - DNA, 25 bp, Mus musculus
gttctctacaccaattttagacttg

SEQ ID NO: 729908 - DNA, 25 bp, Mus musculus
gttctctacacctattgattcccca

SEQ ID NO: 729909 - DNA, 25 bp, Mus musculus
gttctctacacctattttagacttg

SEQ ID NO: 729910 - DNA, 25 bp, Mus musculus
gttctctacggcacgctggtcaaat

SEQ ID NO: 729911 - DNA, 25 bp, Mus musculus
gttctctacggctcgctggtcaaat

SEQ ID NO: 729912 - DNA, 25 bp, Mus musculus
gttctctagaagaactacctgtctt

SEQ ID NO: 729913 - DNA, 25 bp, Mus musculus
gttctctagaagtactacctgtctt

SEQ ID NO: 729914 - DNA, 25 bp, Mus musculus
gttctctagaataaatccagggcag

SEQ ID NO: 729915 - DNA, 25 bp, Mus musculus
gttctctagaattaatccagggcag

SEQ ID NO: 729916 - DNA, 25 bp, Mus musculus
gttctctagcacattgagttgacat

SEQ ID NO: 729917 - DNA, 25 bp, Mus musculus
gttctctagcactttgagttgacat

SEQ ID NO: 729918 - DNA, 25 bp, Mus musculus
gttctctagcgtcatttttcttcca

SEQ ID NO: 729919 - DNA, 25 bp, Mus musculus
gttctctagcgtgatttttcttcca

SEQ ID NO: 729920 - DNA, 25 bp, Mus musculus
gttctctaggtcagggatcccgtga

SEQ ID NO: 729921 - DNA, 25 bp, Mus musculus
gttctctaggtctgggatcccgtga

SEQ ID NO: 729922 - DNA, 25 bp, Mus musculus
gttctctatagtcagcaactatctg

SEQ ID NO: 729923 - DNA, 25 bp, Mus musculus
gttctctatagtgagcaactatctg

SEQ ID NO: 729924 - DNA, 25 bp, Mus musculus
gttctctatatgaagccatggcctg

SEQ ID NO: 729925 - DNA, 25 bp, Mus musculus
gttctctatatgtagccatggcctg

SEQ ID NO: 729926 - DNA, 25 bp, Mus musculus
gttctctatgcgatacgagggctga

SEQ ID NO: 729927 - DNA, 25 bp, Mus musculus
gttctctatgcgttacgagggctga

SEQ ID NO: 729928 - DNA, 25 bp, Mus musculus
gttctctattatcctggtaatattg

SEQ ID NO: 729929 - DNA, 25 bp, Mus musculus
gttctctattatgctggtaatattg

SEQ ID NO: 729930 - DNA, 25 bp, Mus musculus
gttctctattttaatgctattggac

SEQ ID NO: 729931 - DNA, 25 bp, Mus musculus
gttctctatttttatgctattggac

SEQ ID NO: 729932 - DNA, 25 bp, Mus musculus
gttctctcaagtcgaaaatctctgg

SEQ ID NO: 729933 - DNA, 25 bp, Mus musculus
gttctctcaagtggaaaatctctgg

SEQ ID NO: 729934 - DNA, 25 bp, Mus musculus
gttctctcaataacgtttctttgtg

SEQ ID NO: 729935 - DNA, 25 bp, Mus musculus
gttctctcaatatcgtttctttgtg

SEQ ID NO: 729936 - DNA, 25 bp, Mus musculus
gttctctcacagatgacagcctgga

SEQ ID NO: 729937 - DNA, 25 bp, Mus musculus
gttctctcacagttgacagcctgga

SEQ ID NO: 729938 - DNA, 25 bp, Mus musculus
gttctctcagttacatgtctcttac

SEQ ID NO: 729939 - DNA, 25 bp, Mus musculus
gttctctcagtttcatgtctcttac

SEQ ID NO: 729940 - DNA, 25 bp, Mus musculus
gttctctcatagcatcctatcattg

SEQ ID NO: 729941 - DNA, 25 bp, Mus musculus
gttctctcataggatcctatcattg

SEQ ID NO: 729942 - DNA, 25 bp, Mus musculus
gttctctcattaccatggcacggag

SEQ ID NO: 729943 - DNA, 25 bp, Mus musculus
gttctctcattagcatggcacggag

SEQ ID NO: 729944 - DNA, 25 bp, Mus musculus
gttctctcattgataggttgccagc

SEQ ID NO: 729945 - DNA, 25 bp, Mus musculus
gttctctcattgttaggttgccagc

SEQ ID NO: 729946 - DNA, 25 bp, Mus musculus
gttctctcatttcatagccttttcc

SEQ ID NO: 729947 - DNA, 25 bp, Mus musculus
gttctctcatttctaaagcacaggg

SEQ ID NO: 729948 - DNA, 25 bp, Mus musculus
gttctctcatttgatagccttttcc

SEQ ID NO: 729949 - DNA, 25 bp, Mus musculus
gttctctcatttgtaaagcacaggg

SEQ ID NO: 729950 - DNA, 25 bp, Mus musculus
gttctctccctaaaacctgtttatt

SEQ ID NO: 729951 - DNA, 25 bp, Mus musculus
gttctctccctataacctgtttatt

SEQ ID NO: 729952 - DNA, 25 bp, Mus musculus
gttctctcccttagatatacgttgt

SEQ ID NO: 729953 - DNA, 25 bp, Mus musculus
gttctctccctttgatatacgttgt

SEQ ID NO: 729954 - DNA, 25 bp, Mus musculus
gttctctcctatactgatttgtttg

SEQ ID NO: 729955 - DNA, 25 bp, Mus musculus
gttctctcctattctgatttgtttg

SEQ ID NO: 729956 - DNA, 25 bp, Mus musculus
gttctctcggtccaaccaaagacag

SEQ ID NO: 729957 - DNA, 25 bp, Mus musculus
gttctctcggtcgaaccaaagacag

SEQ ID NO: 729958 - DNA, 25 bp, Mus musculus
gttctctctatacacaagattcctg

SEQ ID NO: 729959 - DNA, 25 bp, Mus musculus
gttctctctatagacaagattcctg

SEQ ID NO: 729960 - DNA, 25 bp, Mus musculus
gttctctctggtaataggtgttctg

SEQ ID NO: 729961 - DNA, 25 bp, Mus musculus
gttctctctggttataggtgttctg

SEQ ID NO: 729962 - DNA, 25 bp, Mus musculus
gttctctctgtaagccacagttctg

SEQ ID NO: 729963 - DNA, 25 bp, Mus musculus
gttctctctgtatgccacagttctg

SEQ ID NO: 729964 - DNA, 25 bp, Mus musculus
gttctctctgtgctgtttatggtga

SEQ ID NO: 729965 - DNA, 25 bp, Mus musculus
gttctctctgtggtgtttatggtga

SEQ ID NO: 729966 - DNA, 25 bp, Mus musculus
gttctctcttggaatgggtgccatt

SEQ ID NO: 729967 - DNA, 25 bp, Mus musculus
gttctctcttggtatgggtgccatt

SEQ ID NO: 729968 - DNA, 25 bp, Mus musculus
gttctctcttttatctgcacaggta

SEQ ID NO: 729969 - DNA, 25 bp, Mus musculus
gttctctcttttttctgcacaggta

SEQ ID NO: 729970 - DNA, 25 bp, Mus musculus
gttctctgaaacatcagtgttaacc

SEQ ID NO: 729971 - DNA, 25 bp, Mus musculus
gttctctgaaacctttaggcaactc

SEQ ID NO: 729972 - DNA, 25 bp, Mus musculus
gttctctgaaacgtttaggcaactc

SEQ ID NO: 729973 - DNA, 25 bp, Mus musculus
gttctctgaaacttcagtgttaacc

SEQ ID NO: 729974 - DNA, 25 bp, Mus musculus
gttctctgaatacactgcatttctt

SEQ ID NO: 729975 - DNA, 25 bp, Mus musculus
gttctctgaatagactgcatttctt

SEQ ID NO: 729976 - DNA, 25 bp, Mus musculus
gttctctgacagataccttactgcc

SEQ ID NO: 729977 - DNA, 25 bp, Mus musculus
gttctctgacagttaccttactgcc

SEQ ID NO: 729978 - DNA, 25 bp, Mus musculus
gttctctgagagacttatatagcaa

SEQ ID NO: 729979 - DNA, 25 bp, Mus musculus
gttctctgagagtcttatatagcaa

SEQ ID NO: 729980 - DNA, 25 bp, Mus musculus
gttctctgcacacctgactgggata

SEQ ID NO: 729981 - DNA, 25 bp, Mus musculus
gttctctgcacagctgactgggata

SEQ ID NO: 729982 - DNA, 25 bp, Mus musculus
gttctctgcaccagagaaccccatt

SEQ ID NO: 729983 - DNA, 25 bp, Mus musculus
gttctctgcacctgagaaccccatt

SEQ ID NO: 729984 - DNA, 25 bp, Mus musculus
gttctctgcattaagaagtatacac

SEQ ID NO: 729985 - DNA, 25 bp, Mus musculus
gttctctgcatttagaagtatacac

SEQ ID NO: 729986 - DNA, 25 bp, Mus musculus
gttctctgccgtcagaatatccaag

SEQ ID NO: 729987 - DNA, 25 bp, Mus musculus
gttctctgccgtgagaatatccaag

SEQ ID NO: 729988 - DNA, 25 bp, Mus musculus
gttctctgccttaatgtggatcatc

SEQ ID NO: 729989 - DNA, 25 bp, Mus musculus
gttctctgcctttatgtggatcatc

SEQ ID NO: 729990 - DNA, 25 bp, Mus musculus
gttctctgcgcaatgtttcctataa

SEQ ID NO: 729991 - DNA, 25 bp, Mus musculus
gttctctgcgcattgtttcctataa

SEQ ID NO: 729992 - DNA, 25 bp, Mus musculus
gttctctgctggattaaacactcac

SEQ ID NO: 729993 - DNA, 25 bp, Mus musculus
gttctctgctggtttaaacactcac

SEQ ID NO: 729994 - DNA, 25 bp, Mus musculus
gttctctggaagctatagtgagcct

SEQ ID NO: 729995 - DNA, 25 bp, Mus musculus
gttctctggaaggtatagtgagcct

SEQ ID NO: 729996 - DNA, 25 bp, Mus musculus
gttctctggatacagcgacggctca

SEQ ID NO: 729997 - DNA, 25 bp, Mus musculus
gttctctggatagagcgacggctca

SEQ ID NO: 729998 - DNA, 25 bp, Mus musculus
gttctctgggctacctgatacagaa

SEQ ID NO: 729999 - DNA, 25 bp, Mus musculus
gttctctgggcttcctgatacagaa

SEQ ID NO: 730000 - DNA, 25 bp, Mus musculus
gttctctggtagctcaatcactcat

SEQ ID NO: 730001 - DNA, 25 bp, Mus musculus
gttctctggtaggtcaatcactcat

SEQ ID NO: 730002 - DNA, 25 bp, Mus musculus
gttctctggtatctattttgacaga

SEQ ID NO: 730003 - DNA, 25 bp, Mus musculus
gttctctggtatgtattttgacaga

SEQ ID NO: 730004 - DNA, 25 bp, Mus musculus
gttctctgtaataacatgtcaccac

SEQ ID NO: 730005 - DNA, 25 bp, Mus musculus
gttctctgtaattacatgtcaccac

SEQ ID NO: 730006 - DNA, 25 bp, Mus musculus
gttctctgtactcttggtggtatgt

SEQ ID NO: 730007 - DNA, 25 bp, Mus musculus
gttctctgtactgttggtggtatgt

SEQ ID NO: 730008 - DNA, 25 bp, Mus musculus
gttctctgtctgctcatggagttat

SEQ ID NO: 730009 - DNA, 25 bp, Mus musculus
gttctctgtctggtcatggagttat

SEQ ID NO: 730010 - DNA, 25 bp, Mus musculus
gttctctgtggaagacttgccatct

SEQ ID NO: 730011 - DNA, 25 bp, Mus musculus
gttctctgtggatgacttgccatct

SEQ ID NO: 730012 - DNA, 25 bp, Mus musculus
gttctctgtggtaagtggactatag

SEQ ID NO: 730013 - DNA, 25 bp, Mus musculus
gttctctgtggttagtggactatag

SEQ ID NO: 730014 - DNA, 25 bp, Mus musculus
gttctctgtgtcattggtataccta

SEQ ID NO: 730015 - DNA, 25 bp, Mus musculus
gttctctgtgtctttggtataccta

SEQ ID NO: 730016 - DNA, 25 bp, Mus musculus
gttctctgtgtgatagccaacgtta

SEQ ID NO: 730017 - DNA, 25 bp, Mus musculus
gttctctgtgtgatgtcatattgga

SEQ ID NO: 730018 - DNA, 25 bp, Mus musculus
gttctctgtgtgttagccaacgtta

SEQ ID NO: 730019 - DNA, 25 bp, Mus musculus
gttctctgtgtgttgtcatattgga

SEQ ID NO: 730020 - DNA, 25 bp, Mus musculus
gttctctgtgttaaatagcctgatc

SEQ ID NO: 730021 - DNA, 25 bp, Mus musculus
gttctctgtgttctctcctgagcaa

SEQ ID NO: 730022 - DNA, 25 bp, Mus musculus
gttctctgtgttgtctcctgagcaa

SEQ ID NO: 730023 - DNA, 25 bp, Mus musculus
gttctctgtgtttaatagcctgatc

SEQ ID NO: 730024 - DNA, 25 bp, Mus musculus
gttctctgttctaagaaatattatc

SEQ ID NO: 730025 - DNA, 25 bp, Mus musculus
gttctctgttcttagaaatattatc

SEQ ID NO: 730026 - DNA, 25 bp, Mus musculus
gttctctgttttcatcactcatgtt

SEQ ID NO: 730027 - DNA, 25 bp, Mus musculus
gttctctgttttgatcactcatgtt

SEQ ID NO: 730028 - DNA, 25 bp, Mus musculus
gttctcttaacaccttgcacttttc

SEQ ID NO: 730029 - DNA, 25 bp, Mus musculus
gttctcttaacagcttgcacttttc

SEQ ID NO: 730030 - DNA, 25 bp, Mus musculus
gttctcttactaactctagcttggc

SEQ ID NO: 730031 - DNA, 25 bp, Mus musculus
gttctcttactatctctagcttggc

SEQ ID NO: 730032 - DNA, 25 bp, Mus musculus
gttctcttacttcctgagtcttgaa

SEQ ID NO: 730033 - DNA, 25 bp, Mus musculus
gttctcttacttgctgagtcttgaa

SEQ ID NO: 730034 - DNA, 25 bp, Mus musculus
gttctcttagagaacctatccttat

SEQ ID NO: 730035 - DNA, 25 bp, Mus musculus
gttctcttagagcactgcagtttgg

SEQ ID NO: 730036 - DNA, 25 bp, Mus musculus
gttctcttagaggactgcagtttgg

SEQ ID NO: 730037 - DNA, 25 bp, Mus musculus
gttctcttagagtacctatccttat

SEQ ID NO: 730038 - DNA, 25 bp, Mus musculus
gttctcttagggaacacttgtccat

SEQ ID NO: 730039 - DNA, 25 bp, Mus musculus
gttctcttagggtacacttgtccat

SEQ ID NO: 730040 - DNA, 25 bp, Mus musculus
gttctcttagttatactggattctc

SEQ ID NO: 730041 - DNA, 25 bp, Mus musculus
gttctcttagttttactggattctc

SEQ ID NO: 730042 - DNA, 25 bp, Mus musculus
gttctcttcatgaaacactcactaa

SEQ ID NO: 730043 - DNA, 25 bp, Mus musculus
gttctcttcatgtaacactcactaa

SEQ ID NO: 730044 - DNA, 25 bp, Mus musculus
gttctcttcattaaccatctaggtg

SEQ ID NO: 730045 - DNA, 25 bp, Mus musculus
gttctcttcatttaccatctaggtg

SEQ ID NO: 730046 - DNA, 25 bp, Mus musculus
gttctcttccacaggagtgttcctt

SEQ ID NO: 730047 - DNA, 25 bp, Mus musculus
gttctcttccactggagtgttcctt

SEQ ID NO: 730048 - DNA, 25 bp, Mus musculus
gttctcttcctacagcacagaaggt

SEQ ID NO: 730049 - DNA, 25 bp, Mus musculus
gttctcttcctagagcacagaaggt

SEQ ID NO: 730050 - DNA, 25 bp, Mus musculus
gttctcttctgaagcatactgtttg

SEQ ID NO: 730051 - DNA, 25 bp, Mus musculus
gttctcttctgatgcatactgtttg

SEQ ID NO: 730052 - DNA, 25 bp, Mus musculus
gttctcttcttcagcaaaatgaatg

SEQ ID NO: 730053 - DNA, 25 bp, Mus musculus
gttctcttcttctgcaaaatgaatg

SEQ ID NO: 730054 - DNA, 25 bp, Mus musculus
gttctcttcttgacagttttgtcag

SEQ ID NO: 730055 - DNA, 25 bp, Mus musculus
gttctcttcttgtcagttttgtcag

SEQ ID NO: 730056 - DNA, 25 bp, Mus musculus
gttctcttgctccatgacccagatc

SEQ ID NO: 730057 - DNA, 25 bp, Mus musculus
gttctcttgctcgatgacccagatc

SEQ ID NO: 730058 - DNA, 25 bp, Mus musculus
gttctctttacacaacgttgtctga

SEQ ID NO: 730059 - DNA, 25 bp, Mus musculus
gttctctttacagaacgttgtctga

SEQ ID NO: 730060 - DNA, 25 bp, Mus musculus
gttctctttcatagacactaattag

SEQ ID NO: 730061 - DNA, 25 bp, Mus musculus
gttctctttcattgacactaattag

SEQ ID NO: 730062 - DNA, 25 bp, Mus musculus
gttctctttgaccatacagtcgggc

SEQ ID NO: 730063 - DNA, 25 bp, Mus musculus
gttctctttgacgatacagtcgggc

SEQ ID NO: 730064 - DNA, 25 bp, Mus musculus
gttctctttgccacttggctatgga

SEQ ID NO: 730065 - DNA, 25 bp, Mus musculus
gttctctttgcctcttggctatgga

SEQ ID NO: 730066 - DNA, 25 bp, Mus musculus
gttctctttgttctccagcgaggag

SEQ ID NO: 730067 - DNA, 25 bp, Mus musculus
gttctctttgttgtccagcgaggag

SEQ ID NO: 730068 - DNA, 25 bp, Mus musculus
gttctcttttcgcatgtttttcaag

SEQ ID NO: 730069 - DNA, 25 bp, Mus musculus
gttctcttttcggatgtttttcaag

SEQ ID NO: 730070 - DNA, 25 bp, Mus musculus
gttctgaaacctcaaataccctata

SEQ ID NO: 730071 - DNA, 25 bp, Mus musculus
gttctgaaacctgaaataccctata

SEQ ID NO: 730072 - DNA, 25 bp, Mus musculus
gttctgaaactaactatcccaggat

SEQ ID NO: 730073 - DNA, 25 bp, Mus musculus
gttctgaaactatctatcccaggat

SEQ ID NO: 730074 - DNA, 25 bp, Mus musculus
gttctgaaagatcctgacaaaatgt

SEQ ID NO: 730075 - DNA, 25 bp, Mus musculus
gttctgaaagatgctgacaaaatgt

SEQ ID NO: 730076 - DNA, 25 bp, Mus musculus
gttctgaaatagactctagatcaat

SEQ ID NO: 730077 - DNA, 25 bp, Mus musculus
gttctgaaatagtctctagatcaat

SEQ ID NO: 730078 - DNA, 25 bp, Mus musculus
gttctgaaccatcctgcggtgtagc

SEQ ID NO: 730079 - DNA, 25 bp, Mus musculus
gttctgaaccatgctgcggtgtagc

SEQ ID NO: 730080 - DNA, 25 bp, Mus musculus
gttctgaaccctcgaatacaccttt

SEQ ID NO: 730081 - DNA, 25 bp, Mus musculus
gttctgaaccctggaatacaccttt

SEQ ID NO: 730082 - DNA, 25 bp, Mus musculus
gttctgaaccttcctgaacagcata

SEQ ID NO: 730083 - DNA, 25 bp, Mus musculus
gttctgaaccttgctgaacagcata

SEQ ID NO: 730084 - DNA, 25 bp, Mus musculus
gttctgaagcaaagagcaaccgatg

SEQ ID NO: 730085 - DNA, 25 bp, Mus musculus
gttctgaagcaatgagcaaccgatg

SEQ ID NO: 730086 - DNA, 25 bp, Mus musculus
gttctgaagcccagttttggaatct

SEQ ID NO: 730087 - DNA, 25 bp, Mus musculus
gttctgaagccctgttttggaatct

SEQ ID NO: 730088 - DNA, 25 bp, Mus musculus
gttctgaagtcaataatacccattt

SEQ ID NO: 730089 - DNA, 25 bp, Mus musculus
gttctgaagtcattaatacccattt

SEQ ID NO: 730090 - DNA, 25 bp, Mus musculus
gttctgaagtgtctctttgttccat

SEQ ID NO: 730091 - DNA, 25 bp, Mus musculus
gttctgaagtgtgtctttgttccat

SEQ ID NO: 730092 - DNA, 25 bp, Mus musculus
gttctgaagttccatctctgtgaca

SEQ ID NO: 730093 - DNA, 25 bp, Mus musculus
gttctgaagttcgatctctgtgaca

SEQ ID NO: 730094 - DNA, 25 bp, Mus musculus
gttctgaattctcatgccatttctg

SEQ ID NO: 730095 - DNA, 25 bp, Mus musculus
gttctgaattctgatgccatttctg

SEQ ID NO: 730096 - DNA, 25 bp, Mus musculus
gttctgaattgtcggtcctgtgttg

SEQ ID NO: 730097 - DNA, 25 bp, Mus musculus
gttctgaattgtgggtcctgtgttg

SEQ ID NO: 730098 - DNA, 25 bp, Mus musculus
gttctgacaaatcctaccgtaaagt

SEQ ID NO: 730099 - DNA, 25 bp, Mus musculus
gttctgacaaatgctaccgtaaagt

SEQ ID NO: 730100 - DNA, 25 bp, Mus musculus
gttctgacacggaaaacactgcaat

SEQ ID NO: 730101 - DNA, 25 bp, Mus musculus
gttctgacacggtaaacactgcaat

SEQ ID NO: 730102 - DNA, 25 bp, Mus musculus
gttctgacactcactcatagtatca

SEQ ID NO: 730103 - DNA, 25 bp, Mus musculus
gttctgacactctctcatagtatca

SEQ ID NO: 730104 - DNA, 25 bp, Mus musculus
gttctgacactgaggacgtgaccaa

SEQ ID NO: 730105 - DNA, 25 bp, Mus musculus
gttctgacactgtggacgtgaccaa

SEQ ID NO: 730106 - DNA, 25 bp, Mus musculus
gttctgacagaaaatgttcctctta

SEQ ID NO: 730107 - DNA, 25 bp, Mus musculus
gttctgacagaatatgttcctctta

SEQ ID NO: 730108 - DNA, 25 bp, Mus musculus
gttctgacagtgcattccttcccag

SEQ ID NO: 730109 - DNA, 25 bp, Mus musculus
gttctgacagtggattccttcccag

SEQ ID NO: 730110 - DNA, 25 bp, Mus musculus
gttctgacataccaaccaagcactt

SEQ ID NO: 730111 - DNA, 25 bp, Mus musculus
gttctgacataccagtgttttaaat

SEQ ID NO: 730112 - DNA, 25 bp, Mus musculus
gttctgacatacgaaccaagcactt

SEQ ID NO: 730113 - DNA, 25 bp, Mus musculus
gttctgacatacgagtgttttaaat

SEQ ID NO: 730114 - DNA, 25 bp, Mus musculus
gttctgaccacacttatgcggacat

SEQ ID NO: 730115 - DNA, 25 bp, Mus musculus
gttctgaccacagttatgcggacat

SEQ ID NO: 730116 - DNA, 25 bp, Mus musculus
gttctgaccctaattatctttctct

SEQ ID NO: 730117 - DNA, 25 bp, Mus musculus
gttctgaccctatttatctttctct

SEQ ID NO: 730118 - DNA, 25 bp, Mus musculus
gttctgaccttgctatggtttcaca

SEQ ID NO: 730119 - DNA, 25 bp, Mus musculus
gttctgaccttggtatggtttcaca

SEQ ID NO: 730120 - DNA, 25 bp, Mus musculus
gttctgactagtctctagcattcta

SEQ ID NO: 730121 - DNA, 25 bp, Mus musculus
gttctgactagtgtctagcattcta

SEQ ID NO: 730122 - DNA, 25 bp, Mus musculus
gttctgactcgcaaacttaatgatg

SEQ ID NO: 730123 - DNA, 25 bp, Mus musculus
gttctgactcgctaacttaatgatg

SEQ ID NO: 730124 - DNA, 25 bp, Mus musculus
gttctgactgagactgtttgtcgct

SEQ ID NO: 730125 - DNA, 25 bp, Mus musculus
gttctgactgagtctgtttgtcgct

SEQ ID NO: 730126 - DNA, 25 bp, Mus musculus
gttctgactgatatggactggccct

SEQ ID NO: 730127 - DNA, 25 bp, Mus musculus
gttctgactgatttggactggccct

SEQ ID NO: 730128 - DNA, 25 bp, Mus musculus
gttctgactgccctaaataattttt

SEQ ID NO: 730129 - DNA, 25 bp, Mus musculus
gttctgactgccgtaaataattttt

SEQ ID NO: 730130 - DNA, 25 bp, Mus musculus
gttctgactgtgcttaactaaagta

SEQ ID NO: 730131 - DNA, 25 bp, Mus musculus
gttctgactgtggttaactaaagta

SEQ ID NO: 730132 - DNA, 25 bp, Mus musculus
gttctgacttcccttagaatgtgat

SEQ ID NO: 730133 - DNA, 25 bp, Mus musculus
gttctgacttccgttagaatgtgat

SEQ ID NO: 730134 - DNA, 25 bp, Mus musculus
gttctgagaccaattccactgatgt

SEQ ID NO: 730135 - DNA, 25 bp, Mus musculus
gttctgagaccatttccactgatgt

SEQ ID NO: 730136 - DNA, 25 bp, Mus musculus
gttctgagaccgcactctcttgaag

SEQ ID NO: 730137 - DNA, 25 bp, Mus musculus
gttctgagaccggactctcttgaag

SEQ ID NO: 730138 - DNA, 25 bp, Mus musculus
gttctgagactccttcagtctggaa

SEQ ID NO: 730139 - DNA, 25 bp, Mus musculus
gttctgagactcgttcagtctggaa

SEQ ID NO: 730140 - DNA, 25 bp, Mus musculus
gttctgagagacaacatcaagccag

SEQ ID NO: 730141 - DNA, 25 bp, Mus musculus
gttctgagagactacatcaagccag

SEQ ID NO: 730142 - DNA, 25 bp, Mus musculus
gttctgagagccaaggtgaacgtga

SEQ ID NO: 730143 - DNA, 25 bp, Mus musculus
gttctgagagcctaggtgaacgtga

SEQ ID NO: 730144 - DNA, 25 bp, Mus musculus
gttctgagatgcagctgtgacttgt

SEQ ID NO: 730145 - DNA, 25 bp, Mus musculus
gttctgagatgctgctgtgacttgt

SEQ ID NO: 730146 - DNA, 25 bp, Mus musculus
gttctgagattaaaggacatactta

SEQ ID NO: 730147 - DNA, 25 bp, Mus musculus
gttctgagattataggacatactta

SEQ ID NO: 730148 - DNA, 25 bp, Mus musculus
gttctgagcactactgttacttcca

SEQ ID NO: 730149 - DNA, 25 bp, Mus musculus
gttctgagcacttctgttacttcca

SEQ ID NO: 730150 - DNA, 25 bp, Mus musculus
gttctgagcattactagccagtgtt

SEQ ID NO: 730151 - DNA, 25 bp, Mus musculus
gttctgagcatttctagccagtgtt

SEQ ID NO: 730152 - DNA, 25 bp, Mus musculus
gttctgagcccaaggtaggagtttc

SEQ ID NO: 730153 - DNA, 25 bp, Mus musculus
gttctgagcccatggtaggagtttc

SEQ ID NO: 730154 - DNA, 25 bp, Mus musculus
gttctgagcctgatggtccttctag

SEQ ID NO: 730155 - DNA, 25 bp, Mus musculus
gttctgagcctgttggtccttctag

SEQ ID NO: 730156 - DNA, 25 bp, Mus musculus
gttctgagccttaacttttgcataa

SEQ ID NO: 730157 - DNA, 25 bp, Mus musculus
gttctgagcctttacttttgcataa

SEQ ID NO: 730158 - DNA, 25 bp, Mus musculus
gttctgagctgtcagattccactgt

SEQ ID NO: 730159 - DNA, 25 bp, Mus musculus
gttctgagctgtgagattccactgt

SEQ ID NO: 730160 - DNA, 25 bp, Mus musculus
gttctgagcttgcaatgctgcccag

SEQ ID NO: 730161 - DNA, 25 bp, Mus musculus
gttctgagcttggaatgctgcccag

SEQ ID NO: 730162 - DNA, 25 bp, Mus musculus
gttctgaggacaccagaggccacaa

SEQ ID NO: 730163 - DNA, 25 bp, Mus musculus
gttctgaggacagcagaggccacaa

SEQ ID NO: 730164 - DNA, 25 bp, Mus musculus
gttctgaggagtcatttgcaacgca

SEQ ID NO: 730165 - DNA, 25 bp, Mus musculus
gttctgaggagtgatttgcaacgca

SEQ ID NO: 730166 - DNA, 25 bp, Mus musculus
gttctgaggcccaaacctgtgtcaa

SEQ ID NO: 730167 - DNA, 25 bp, Mus musculus
gttctgaggccctaacctgtgtcaa

SEQ ID NO: 730168 - DNA, 25 bp, Mus musculus
gttctgagggatactttctcactga

SEQ ID NO: 730169 - DNA, 25 bp, Mus musculus
gttctgagggattctttctcactga

SEQ ID NO: 730170 - DNA, 25 bp, Mus musculus
gttctgagtgagctgacacctgtaa

SEQ ID NO: 730171 - DNA, 25 bp, Mus musculus
gttctgagtgaggtgacacctgtaa

SEQ ID NO: 730172 - DNA, 25 bp, Mus musculus
gttctgagtggtatcaaatgccagt

SEQ ID NO: 730173 - DNA, 25 bp, Mus musculus
gttctgagtggtttcaaatgccagt

SEQ ID NO: 730174 - DNA, 25 bp, Mus musculus
gttctgagttaaaaagcaagcacca

SEQ ID NO: 730175 - DNA, 25 bp, Mus musculus
gttctgagttaataagcaagcacca

SEQ ID NO: 730176 - DNA, 25 bp, Mus musculus
gttctgataaagctagaggcccaag

SEQ ID NO: 730177 - DNA, 25 bp, Mus musculus
gttctgataaaggtagaggcccaag

SEQ ID NO: 730178 - DNA, 25 bp, Mus musculus
gttctgataacaactcactgagtgg

SEQ ID NO: 730179 - DNA, 25 bp, Mus musculus
gttctgataacatctcactgagtgg

SEQ ID NO: 730180 - DNA, 25 bp, Mus musculus
gttctgatacctagccaggtctgga

SEQ ID NO: 730181 - DNA, 25 bp, Mus musculus
gttctgatacctagctggagaagat

SEQ ID NO: 730182 - DNA, 25 bp, Mus musculus
gttctgataccttgccaggtctgga

SEQ ID NO: 730183 - DNA, 25 bp, Mus musculus
gttctgataccttgctggagaagat

SEQ ID NO: 730184 - DNA, 25 bp, Mus musculus
gttctgatacgacagtaatccgtgt

SEQ ID NO: 730185 - DNA, 25 bp, Mus musculus
gttctgatacgagagtaatccgtgt

SEQ ID NO: 730186 - DNA, 25 bp, Mus musculus
gttctgatactgattttgaggtaga

SEQ ID NO: 730187 - DNA, 25 bp, Mus musculus
gttctgatactgtttttgaggtaga

SEQ ID NO: 730188 - DNA, 25 bp, Mus musculus
gttctgatacttcatattcctattg

SEQ ID NO: 730189 - DNA, 25 bp, Mus musculus
gttctgatacttgatattcctattg

SEQ ID NO: 730190 - DNA, 25 bp, Mus musculus
gttctgatattgctgcctgttgcac

SEQ ID NO: 730191 - DNA, 25 bp, Mus musculus
gttctgatattggtgcctgttgcac

SEQ ID NO: 730192 - DNA, 25 bp, Mus musculus
gttctgatcaacacaattttacttt

SEQ ID NO: 730193 - DNA, 25 bp, Mus musculus
gttctgatcaactcaattttacttt

SEQ ID NO: 730194 - DNA, 25 bp, Mus musculus
gttctgatccgaagtgttctgacat

SEQ ID NO: 730195 - DNA, 25 bp, Mus musculus
gttctgatccgatgtgttctgacat

SEQ ID NO: 730196 - DNA, 25 bp, Mus musculus
gttctgatctagctgacacttcctc

SEQ ID NO: 730197 - DNA, 25 bp, Mus musculus
gttctgatctaggtgacacttcctc

SEQ ID NO: 730198 - DNA, 25 bp, Mus musculus
gttctgatctgaatccactgtggct

SEQ ID NO: 730199 - DNA, 25 bp, Mus musculus
gttctgatctgattccactgtggct

SEQ ID NO: 730200 - DNA, 25 bp, Mus musculus
gttctgatgacgaaaccagttgacc

SEQ ID NO: 730201 - DNA, 25 bp, Mus musculus
gttctgatgacgtaaccagttgacc

SEQ ID NO: 730202 - DNA, 25 bp, Mus musculus
gttctgatgcacatactttagatgg

SEQ ID NO: 730203 - DNA, 25 bp, Mus musculus
gttctgatgcacttactttagatgg

SEQ ID NO: 730204 - DNA, 25 bp, Mus musculus
gttctgatgcttctttcaccattta

SEQ ID NO: 730205 - DNA, 25 bp, Mus musculus
gttctgatgcttgtttcaccattta

SEQ ID NO: 730206 - DNA, 25 bp, Mus musculus
gttctgatggagacattctgttgtt

SEQ ID NO: 730207 - DNA, 25 bp, Mus musculus
gttctgatggagtcattctgttgtt

SEQ ID NO: 730208 - DNA, 25 bp, Mus musculus
gttctgatgggtacagccctggaga

SEQ ID NO: 730209 - DNA, 25 bp, Mus musculus
gttctgatgggttcagccctggaga

SEQ ID NO: 730210 - DNA, 25 bp, Mus musculus
gttctgatgtcaactatccagccag

SEQ ID NO: 730211 - DNA, 25 bp, Mus musculus
gttctgatgtcatctatccagccag

SEQ ID NO: 730212 - DNA, 25 bp, Mus musculus
gttctgatgtgtccccatgtcaaat

SEQ ID NO: 730213 - DNA, 25 bp, Mus musculus
gttctgatgtgtgcccatgtcaaat

SEQ ID NO: 730214 - DNA, 25 bp, Mus musculus
gttctgattaataattccctccctc

SEQ ID NO: 730215 - DNA, 25 bp, Mus musculus
gttctgattaattattccctccctc

SEQ ID NO: 730216 - DNA, 25 bp, Mus musculus
gttctgattatcacttgatttttct

SEQ ID NO: 730217 - DNA, 25 bp, Mus musculus
gttctgattatctcttgatttttct

SEQ ID NO: 730218 - DNA, 25 bp, Mus musculus
gttctgattggcagtcttgggccta

SEQ ID NO: 730219 - DNA, 25 bp, Mus musculus
gttctgattggctgtcttgggccta

SEQ ID NO: 730220 - DNA, 25 bp, Mus musculus
gttctgattggtacaagctcatgtc

SEQ ID NO: 730221 - DNA, 25 bp, Mus musculus
gttctgattggttcaagctcatgtc

SEQ ID NO: 730222 - DNA, 25 bp, Mus musculus
gttctgatttgtctcctcatactca

SEQ ID NO: 730223 - DNA, 25 bp, Mus musculus
gttctgatttgtgtcctcatactca

SEQ ID NO: 730224 - DNA, 25 bp, Mus musculus
gttctgcaacagcagggtggcaccc

SEQ ID NO: 730225 - DNA, 25 bp, Mus musculus
gttctgcaacaggagggtggcaccc

SEQ ID NO: 730226 - DNA, 25 bp, Mus musculus
gttctgcaacctactatggcttgta

SEQ ID NO: 730227 - DNA, 25 bp, Mus musculus
gttctgcaaccttctatggcttgta

SEQ ID NO: 730228 - DNA, 25 bp, Mus musculus
gttctgcaagccctacacattttaa

SEQ ID NO: 730229 - DNA, 25 bp, Mus musculus
gttctgcaagccgtacacattttaa

SEQ ID NO: 730230 - DNA, 25 bp, Mus musculus
gttctgcaagttcctgtttgctaag

SEQ ID NO: 730231 - DNA, 25 bp, Mus musculus
gttctgcaagttgctgtttgctaag

SEQ ID NO: 730232 - DNA, 25 bp, Mus musculus
gttctgcacagaattattggttcct

SEQ ID NO: 730233 - DNA, 25 bp, Mus musculus
gttctgcacagatttattggttcct

SEQ ID NO: 730234 - DNA, 25 bp, Mus musculus
gttctgcacctgagctagacaagga

SEQ ID NO: 730235 - DNA, 25 bp, Mus musculus
gttctgcacctgtgctagacaagga

SEQ ID NO: 730236 - DNA, 25 bp, Mus musculus
gttctgcactgacgcattacattag

SEQ ID NO: 730237 - DNA, 25 bp, Mus musculus
gttctgcactgaggcattacattag

SEQ ID NO: 730238 - DNA, 25 bp, Mus musculus
gttctgcagaggatcttcaggctct

SEQ ID NO: 730239 - DNA, 25 bp, Mus musculus
gttctgcagaggttcttcaggctct

SEQ ID NO: 730240 - DNA, 25 bp, Mus musculus
gttctgcagcagatggttcaagtca

SEQ ID NO: 730241 - DNA, 25 bp, Mus musculus
gttctgcagcagttggttcaagtca

SEQ ID NO: 730242 - DNA, 25 bp, Mus musculus
gttctgcagcatccatgggtacaag

SEQ ID NO: 730243 - DNA, 25 bp, Mus musculus
gttctgcagcatgcatgggtacaag

SEQ ID NO: 730244 - DNA, 25 bp, Mus musculus
gttctgcagccaccttttggaaata

SEQ ID NO: 730245 - DNA, 25 bp, Mus musculus
gttctgcagccagcttttggaaata

SEQ ID NO: 730246 - DNA, 25 bp, Mus musculus
gttctgcaggcccagtagagaagaa

SEQ ID NO: 730247 - DNA, 25 bp, Mus musculus
gttctgcaggccgagtagagaagaa

SEQ ID NO: 730248 - DNA, 25 bp, Mus musculus
gttctgcagtgcataacttaggacc

SEQ ID NO: 730249 - DNA, 25 bp, Mus musculus
gttctgcagtgcttaacttaggacc

SEQ ID NO: 730250 - DNA, 25 bp, Mus musculus
gttctgcagttaaggtataccaaca

SEQ ID NO: 730251 - DNA, 25 bp, Mus musculus
gttctgcagttatggtataccaaca

SEQ ID NO: 730252 - DNA, 25 bp, Mus musculus
gttctgcatagaccttttcacccaa

SEQ ID NO: 730253 - DNA, 25 bp, Mus musculus
gttctgcatagagcttttcacccaa

SEQ ID NO: 730254 - DNA, 25 bp, Mus musculus
gttctgcatgcacttactgtcttct

SEQ ID NO: 730255 - DNA, 25 bp, Mus musculus
gttctgcatgcagttactgtcttct

SEQ ID NO: 730256 - DNA, 25 bp, Mus musculus
gttctgccaagaactctgggtccat

SEQ ID NO: 730257 - DNA, 25 bp, Mus musculus
gttctgccaagatctctgggtccat

SEQ ID NO: 730258 - DNA, 25 bp, Mus musculus
gttctgccagaaagtagtccagcca

SEQ ID NO: 730259 - DNA, 25 bp, Mus musculus
gttctgccagaatgtagtccagcca

SEQ ID NO: 730260 - DNA, 25 bp, Mus musculus
gttctgccagccagtgggtatgaga

SEQ ID NO: 730261 - DNA, 25 bp, Mus musculus
gttctgccagcctgtgggtatgaga

SEQ ID NO: 730262 - DNA, 25 bp, Mus musculus
gttctgccatctagagagtctgttt

SEQ ID NO: 730263 - DNA, 25 bp, Mus musculus
gttctgccatcttgagagtctgttt

SEQ ID NO: 730264 - DNA, 25 bp, Mus musculus
gttctgccatgtagttggttacctc

SEQ ID NO: 730265 - DNA, 25 bp, Mus musculus
gttctgccatgttgttggttacctc

SEQ ID NO: 730266 - DNA, 25 bp, Mus musculus
gttctgcccacaaagtttctatagg

SEQ ID NO: 730267 - DNA, 25 bp, Mus musculus
gttctgcccacatagtttctatagg

SEQ ID NO: 730268 - DNA, 25 bp, Mus musculus
gttctgcccagtcataagttcctgc

SEQ ID NO: 730269 - DNA, 25 bp, Mus musculus
gttctgcccagtgataagttcctgc

SEQ ID NO: 730270 - DNA, 25 bp, Mus musculus
gttctgcccattaaaatgtgaccta

SEQ ID NO: 730271 - DNA, 25 bp, Mus musculus
gttctgcccatttaaatgtgaccta

SEQ ID NO: 730272 - DNA, 25 bp, Mus musculus
gttctgccccagaatcgttctagaa

SEQ ID NO: 730273 - DNA, 25 bp, Mus musculus
gttctgccccagtatcgttctagaa

SEQ ID NO: 730274 - DNA, 25 bp, Mus musculus
gttctgccctagatcattgaccaaa

SEQ ID NO: 730275 - DNA, 25 bp, Mus musculus
gttctgccctagttcattgaccaaa

SEQ ID NO: 730276 - DNA, 25 bp, Mus musculus
gttctgccctctcatttgctgaaat

SEQ ID NO: 730277 - DNA, 25 bp, Mus musculus
gttctgccctctgatttgctgaaat

SEQ ID NO: 730278 - DNA, 25 bp, Mus musculus
gttctgccctggattatctgcaagg

SEQ ID NO: 730279 - DNA, 25 bp, Mus musculus
gttctgccctggtttatctgcaagg

SEQ ID NO: 730280 - DNA, 25 bp, Mus musculus
gttctgcctactctgacaaacttca

SEQ ID NO: 730281 - DNA, 25 bp, Mus musculus
gttctgcctactgtgacaaacttca

SEQ ID NO: 730282 - DNA, 25 bp, Mus musculus
gttctgcctcaactgcatcgaagcg

SEQ ID NO: 730283 - DNA, 25 bp, Mus musculus
gttctgcctcaagtgcatcgaagcg

SEQ ID NO: 730284 - DNA, 25 bp, Mus musculus
gttctgcctcatagggtctctaagc

SEQ ID NO: 730285 - DNA, 25 bp, Mus musculus
gttctgcctcattgggtctctaagc

SEQ ID NO: 730286 - DNA, 25 bp, Mus musculus
gttctgcctctcagagttgaatctc

SEQ ID NO: 730287 - DNA, 25 bp, Mus musculus
gttctgcctctctgagttgaatctc

SEQ ID NO: 730288 - DNA, 25 bp, Mus musculus
gttctgcctctgatgtactttgtga

SEQ ID NO: 730289 - DNA, 25 bp, Mus musculus
gttctgcctctgttgtactttgtga

SEQ ID NO: 730290 - DNA, 25 bp, Mus musculus
gttctgcctgcgaagtaaagatctc

SEQ ID NO: 730291 - DNA, 25 bp, Mus musculus
gttctgcctgcgtagtaaagatctc

SEQ ID NO: 730292 - DNA, 25 bp, Mus musculus
gttctgcctggtaatatatgtacca

SEQ ID NO: 730293 - DNA, 25 bp, Mus musculus
gttctgcctggttatatatgtacca

SEQ ID NO: 730294 - DNA, 25 bp, Mus musculus
gttctgcctgtcactatgctggaat

SEQ ID NO: 730295 - DNA, 25 bp, Mus musculus
gttctgcctgtctctatgctggaat

SEQ ID NO: 730296 - DNA, 25 bp, Mus musculus
gttctgcctttgagaattgcccgag

SEQ ID NO: 730297 - DNA, 25 bp, Mus musculus
gttctgcctttgctgtcatgtcata

SEQ ID NO: 730298 - DNA, 25 bp, Mus musculus
gttctgcctttggtgtcatgtcata

SEQ ID NO: 730299 - DNA, 25 bp, Mus musculus
gttctgcctttgtgaattgcccgag

SEQ ID NO: 730300 - DNA, 25 bp, Mus musculus
gttctgcgatcaccttaccaagact

SEQ ID NO: 730301 - DNA, 25 bp, Mus musculus
gttctgcgatcagcttaccaagact

SEQ ID NO: 730302 - DNA, 25 bp, Mus musculus
gttctgcggtgtagctatgagcccc

SEQ ID NO: 730303 - DNA, 25 bp, Mus musculus
gttctgcggtgttgctatgagcccc

SEQ ID NO: 730304 - DNA, 25 bp, Mus musculus
gttctgcgtattaatcctggcttat

SEQ ID NO: 730305 - DNA, 25 bp, Mus musculus
gttctgcgtatttatcctggcttat

SEQ ID NO: 730306 - DNA, 25 bp, Mus musculus
gttctgcgtgatctgaaattctcca

SEQ ID NO: 730307 - DNA, 25 bp, Mus musculus
gttctgcgtgatgtgaaattctcca

SEQ ID NO: 730308 - DNA, 25 bp, Mus musculus
gttctgcgtggaatcagtatgccca

SEQ ID NO: 730309 - DNA, 25 bp, Mus musculus
gttctgcgtggattcagtatgccca

SEQ ID NO: 730310 - DNA, 25 bp, Mus musculus
gttctgctactgagaatgctgccat

SEQ ID NO: 730311 - DNA, 25 bp, Mus musculus
gttctgctactgtgaatgctgccat

SEQ ID NO: 730312 - DNA, 25 bp, Mus musculus
gttctgctagatacttgggattttt

SEQ ID NO: 730313 - DNA, 25 bp, Mus musculus
gttctgctagattcttgggattttt

SEQ ID NO: 730314 - DNA, 25 bp, Mus musculus
gttctgctataaaggctcgttctgc

SEQ ID NO: 730315 - DNA, 25 bp, Mus musculus
gttctgctataatggctcgttctgc

SEQ ID NO: 730316 - DNA, 25 bp, Mus musculus
gttctgctcacacgcccagtaaaga

SEQ ID NO: 730317 - DNA, 25 bp, Mus musculus
gttctgctcacaggcccagtaaaga

SEQ ID NO: 730318 - DNA, 25 bp, Mus musculus
gttctgctgagaaggctttgctgat

SEQ ID NO: 730319 - DNA, 25 bp, Mus musculus
gttctgctgagatggctttgctgat

SEQ ID NO: 730320 - DNA, 25 bp, Mus musculus
gttctgctgtccatcagatctcttt

SEQ ID NO: 730321 - DNA, 25 bp, Mus musculus
gttctgctgtccttcagatctcttt

SEQ ID NO: 730322 - DNA, 25 bp, Mus musculus
gttctgcttagtatatttccacaat

SEQ ID NO: 730323 - DNA, 25 bp, Mus musculus
gttctgcttagtttatttccacaat

SEQ ID NO: 730324 - DNA, 25 bp, Mus musculus
gttctgcttcacagggtgacagggt

SEQ ID NO: 730325 - DNA, 25 bp, Mus musculus
gttctgcttcactgggtgacagggt

SEQ ID NO: 730326 - DNA, 25 bp, Mus musculus
gttctgcttgacatttctaagttct

SEQ ID NO: 730327 - DNA, 25 bp, Mus musculus
gttctgcttgacttttctaagttct

SEQ ID NO: 730328 - DNA, 25 bp, Mus musculus
gttctgcttgcaagtgaacttccag

SEQ ID NO: 730329 - DNA, 25 bp, Mus musculus
gttctgcttgcatgtgaacttccag

SEQ ID NO: 730330 - DNA, 25 bp, Mus musculus
gttctgcttgctactttagcaaaat

SEQ ID NO: 730331 - DNA, 25 bp, Mus musculus
gttctgcttgcttctttagcaaaat

SEQ ID NO: 730332 - DNA, 25 bp, Mus musculus
gttctgcttgttcggtactagtcac

SEQ ID NO: 730333 - DNA, 25 bp, Mus musculus
gttctgcttgttgggtactagtcac

SEQ ID NO: 730334 - DNA, 25 bp, Mus musculus
gttctgctttctaaagtcttcaaat

SEQ ID NO: 730335 - DNA, 25 bp, Mus musculus
gttctgctttctaacagccattccc

SEQ ID NO: 730336 - DNA, 25 bp, Mus musculus
gttctgctttcttaagtcttcaaat

SEQ ID NO: 730337 - DNA, 25 bp, Mus musculus
gttctgctttcttacagccattccc

SEQ ID NO: 730338 - DNA, 25 bp, Mus musculus
gttctgctttgaagggtttcttttt

SEQ ID NO: 730339 - DNA, 25 bp, Mus musculus
gttctgctttgaagtaatttgtttc

SEQ ID NO: 730340 - DNA, 25 bp, Mus musculus
gttctgctttgatgggtttcttttt

SEQ ID NO: 730341 - DNA, 25 bp, Mus musculus
gttctgctttgatgtaatttgtttc

SEQ ID NO: 730342 - DNA, 25 bp, Mus musculus
gttctgctttgcagctgccctcaag

SEQ ID NO: 730343 - DNA, 25 bp, Mus musculus
gttctgctttgcattaatttgctgg

SEQ ID NO: 730344 - DNA, 25 bp, Mus musculus
gttctgctttgctgctgccctcaag

SEQ ID NO: 730345 - DNA, 25 bp, Mus musculus
gttctgctttgctttaatttgctgg

SEQ ID NO: 730346 - DNA, 25 bp, Mus musculus
gttctgctttgtatccagtgtgtaa

SEQ ID NO: 730347 - DNA, 25 bp, Mus musculus
gttctgctttgtttccagtgtgtaa

SEQ ID NO: 730348 - DNA, 25 bp, Mus musculus
gttctggaacttcttgagagaacag

SEQ ID NO: 730349 - DNA, 25 bp, Mus musculus
gttctggaacttgttgagagaacag

SEQ ID NO: 730350 - DNA, 25 bp, Mus musculus
gttctggaagcgcaaacccttgaat

SEQ ID NO: 730351 - DNA, 25 bp, Mus musculus
gttctggaagcggaaacccttgaat

SEQ ID NO: 730352 - DNA, 25 bp, Mus musculus
gttctggaatgaactgtgtcggcta

SEQ ID NO: 730353 - DNA, 25 bp, Mus musculus
gttctggaatgatctgtgtcggcta

SEQ ID NO: 730354 - DNA, 25 bp, Mus musculus
gttctggacaccaaataactcacaa

SEQ ID NO: 730355 - DNA, 25 bp, Mus musculus
gttctggacacctaataactcacaa

SEQ ID NO: 730356 - DNA, 25 bp, Mus musculus
gttctggacagcattacagcacaat

SEQ ID NO: 730357 - DNA, 25 bp, Mus musculus
gttctggacagctttacagcacaat

SEQ ID NO: 730358 - DNA, 25 bp, Mus musculus
gttctggaccagaatacctcaaacg

SEQ ID NO: 730359 - DNA, 25 bp, Mus musculus
gttctggaccagtatacctcaaacg

SEQ ID NO: 730360 - DNA, 25 bp, Mus musculus
gttctggaccatcacggtggacgtc

SEQ ID NO: 730361 - DNA, 25 bp, Mus musculus
gttctggaccatgacggtggacgtc

SEQ ID NO: 730362 - DNA, 25 bp, Mus musculus
gttctggacgttacttgcctgcaca

SEQ ID NO: 730363 - DNA, 25 bp, Mus musculus
gttctggacgtttcttgcctgcaca

SEQ ID NO: 730364 - DNA, 25 bp, Mus musculus
gttctggagatcagcttgagtgtca

SEQ ID NO: 730365 - DNA, 25 bp, Mus musculus
gttctggagatctgcttgagtgtca

SEQ ID NO: 730366 - DNA, 25 bp, Mus musculus
gttctggagcacaacagggctgtac

SEQ ID NO: 730367 - DNA, 25 bp, Mus musculus
gttctggagcactacagggctgtac

SEQ ID NO: 730368 - DNA, 25 bp, Mus musculus
gttctggagtacacagctggcactt

SEQ ID NO: 730369 - DNA, 25 bp, Mus musculus
gttctggagtactcagctggcactt

SEQ ID NO: 730370 - DNA, 25 bp, Mus musculus
gttctggagttaaaccacccagctg

SEQ ID NO: 730371 - DNA, 25 bp, Mus musculus
gttctggagttataccacccagctg

SEQ ID NO: 730372 - DNA, 25 bp, Mus musculus
gttctggagtttaagcacctttagt

SEQ ID NO: 730373 - DNA, 25 bp, Mus musculus
gttctggagttttagcacctttagt

SEQ ID NO: 730374 - DNA, 25 bp, Mus musculus
gttctggatatactttttaccttca

SEQ ID NO: 730375 - DNA, 25 bp, Mus musculus
gttctggatatagtttttaccttca

SEQ ID NO: 730376 - DNA, 25 bp, Mus musculus
gttctggatgttcccaagtctcagt

SEQ ID NO: 730377 - DNA, 25 bp, Mus musculus
gttctggatgttgccaagtctcagt

SEQ ID NO: 730378 - DNA, 25 bp, Mus musculus
gttctggcaataaacttgcagacct

SEQ ID NO: 730379 - DNA, 25 bp, Mus musculus
gttctggcaatatacttgcagacct

SEQ ID NO: 730380 - DNA, 25 bp, Mus musculus
gttctggcagacagtgagcggtaca

SEQ ID NO: 730381 - DNA, 25 bp, Mus musculus
gttctggcagactgtgagcggtaca

SEQ ID NO: 730382 - DNA, 25 bp, Mus musculus
gttctggcagctcacttagtgttgg

SEQ ID NO: 730383 - DNA, 25 bp, Mus musculus
gttctggcagctctctatagtccca

SEQ ID NO: 730384 - DNA, 25 bp, Mus musculus
gttctggcagctgacttagtgttgg

SEQ ID NO: 730385 - DNA, 25 bp, Mus musculus
gttctggcagctgtctatagtccca

SEQ ID NO: 730386 - DNA, 25 bp, Mus musculus
gttctggcatccacataattcttgt

SEQ ID NO: 730387 - DNA, 25 bp, Mus musculus
gttctggcatcctcataattcttgt

SEQ ID NO: 730388 - DNA, 25 bp, Mus musculus
gttctggcattcatggagaaacctc

SEQ ID NO: 730389 - DNA, 25 bp, Mus musculus
gttctggcattcttggagaaacctc

SEQ ID NO: 730390 - DNA, 25 bp, Mus musculus
gttctggcatttatgacccttgtga

SEQ ID NO: 730391 - DNA, 25 bp, Mus musculus
gttctggcatttttgacccttgtga

SEQ ID NO: 730392 - DNA, 25 bp, Mus musculus
gttctggccagcacagtgtggactt

SEQ ID NO: 730393 - DNA, 25 bp, Mus musculus
gttctggccagctcagtgtggactt

SEQ ID NO: 730394 - DNA, 25 bp, Mus musculus
gttctggccattatgcatctttacc

SEQ ID NO: 730395 - DNA, 25 bp, Mus musculus
gttctggccattttgcatctttacc

SEQ ID NO: 730396 - DNA, 25 bp, Mus musculus
gttctggcggctactaatttcccat

SEQ ID NO: 730397 - DNA, 25 bp, Mus musculus
gttctggcggcttctaatttcccat

SEQ ID NO: 730398 - DNA, 25 bp, Mus musculus
gttctggctccaccactatgtagag

SEQ ID NO: 730399 - DNA, 25 bp, Mus musculus
gttctggctccagcactatgtagag

SEQ ID NO: 730400 - DNA, 25 bp, Mus musculus
gttctggctctgattctgacacata

SEQ ID NO: 730401 - DNA, 25 bp, Mus musculus
gttctggctctgtttctgacacata

SEQ ID NO: 730402 - DNA, 25 bp, Mus musculus
gttctggctgaactgtgtgactttt

SEQ ID NO: 730403 - DNA, 25 bp, Mus musculus
gttctggctgaagtgtgtgactttt

SEQ ID NO: 730404 - DNA, 25 bp, Mus musculus
gttctggctgctccaaacgtggtga

SEQ ID NO: 730405 - DNA, 25 bp, Mus musculus
gttctggctgctgcaaacgtggtga

SEQ ID NO: 730406 - DNA, 25 bp, Mus musculus
gttctggcttgtctaaatgctgctg

SEQ ID NO: 730407 - DNA, 25 bp, Mus musculus
gttctggcttgtgtaaatgctgctg

SEQ ID NO: 730408 - DNA, 25 bp, Mus musculus
gttctgggactacaagtgtgtacca

SEQ ID NO: 730409 - DNA, 25 bp, Mus musculus
gttctgggactagaagtgtgtacca

SEQ ID NO: 730410 - DNA, 25 bp, Mus musculus
gttctgggacttagtagaccaatct

SEQ ID NO: 730411 - DNA, 25 bp, Mus musculus
gttctgggactttgtagaccaatct

SEQ ID NO: 730412 - DNA, 25 bp, Mus musculus
gttctgggagaacaagaatccttat

SEQ ID NO: 730413 - DNA, 25 bp, Mus musculus
gttctgggagaagaagaatccttat

SEQ ID NO: 730414 - DNA, 25 bp, Mus musculus
gttctgggagctcggaatgtcttct

SEQ ID NO: 730415 - DNA, 25 bp, Mus musculus
gttctgggagctgggaatgtcttct

SEQ ID NO: 730416 - DNA, 25 bp, Mus musculus
gttctgggcacactgcatcccgcag

SEQ ID NO: 730417 - DNA, 25 bp, Mus musculus
gttctgggcacagtgcatcccgcag

SEQ ID NO: 730418 - DNA, 25 bp, Mus musculus
gttctgggcagaaattttatctaat

SEQ ID NO: 730419 - DNA, 25 bp, Mus musculus
gttctgggcagatattttatctaat

SEQ ID NO: 730420 - DNA, 25 bp, Mus musculus
gttctgggcctgaatattgacatcc

SEQ ID NO: 730421 - DNA, 25 bp, Mus musculus
gttctgggcctgtatattgacatcc

SEQ ID NO: 730422 - DNA, 25 bp, Mus musculus
gttctgggtcctctgataatttggg

SEQ ID NO: 730423 - DNA, 25 bp, Mus musculus
gttctgggtcctgtgataatttggg

SEQ ID NO: 730424 - DNA, 25 bp, Mus musculus
gttctgggtcgcagcttacaagaga

SEQ ID NO: 730425 - DNA, 25 bp, Mus musculus
gttctgggtcgctgcttacaagaga

SEQ ID NO: 730426 - DNA, 25 bp, Mus musculus
gttctgggtgctcatgacaaagttt

SEQ ID NO: 730427 - DNA, 25 bp, Mus musculus
gttctgggtgctgatgacaaagttt

SEQ ID NO: 730428 - DNA, 25 bp, Mus musculus
gttctgggtgtgaggtctctgacca

SEQ ID NO: 730429 - DNA, 25 bp, Mus musculus
gttctgggtgtgtggtctctgacca

SEQ ID NO: 730430 - DNA, 25 bp, Mus musculus
gttctggtaactatcactggtacca

SEQ ID NO: 730431 - DNA, 25 bp, Mus musculus
gttctggtaactttcactggtacca

SEQ ID NO: 730432 - DNA, 25 bp, Mus musculus
gttctggtagatccttgcttctgag

SEQ ID NO: 730433 - DNA, 25 bp, Mus musculus
gttctggtagatgcttgcttctgag

SEQ ID NO: 730434 - DNA, 25 bp, Mus musculus
gttctggtatccactaggagtggct

SEQ ID NO: 730435 - DNA, 25 bp, Mus musculus
gttctggtatcctctaggagtggct

SEQ ID NO: 730436 - DNA, 25 bp, Mus musculus
gttctggtatgcctacctggcgtct

SEQ ID NO: 730437 - DNA, 25 bp, Mus musculus
gttctggtatgcgtacctggcgtct

SEQ ID NO: 730438 - DNA, 25 bp, Mus musculus
gttctggtattaccaaaccacacat

SEQ ID NO: 730439 - DNA, 25 bp, Mus musculus
gttctggtattagcaaaccacacat

SEQ ID NO: 730440 - DNA, 25 bp, Mus musculus
gttctggtgttacatgtcaaggcat

SEQ ID NO: 730441 - DNA, 25 bp, Mus musculus
gttctggtgttagatgtcaaggcat

SEQ ID NO: 730442 - DNA, 25 bp, Mus musculus
gttctggtgttgaatgtcccgggat

SEQ ID NO: 730443 - DNA, 25 bp, Mus musculus
gttctggtgttgtatgtcccgggat

SEQ ID NO: 730444 - DNA, 25 bp, Mus musculus
gttctgtaacccaacacaaagccac

SEQ ID NO: 730445 - DNA, 25 bp, Mus musculus
gttctgtaaccctacacaaagccac

SEQ ID NO: 730446 - DNA, 25 bp, Mus musculus
gttctgtaacttatcatccatgttt

SEQ ID NO: 730447 - DNA, 25 bp, Mus musculus
gttctgtaacttccttgttttagct

SEQ ID NO: 730448 - DNA, 25 bp, Mus musculus
gttctgtaacttgcttgttttagct

SEQ ID NO: 730449 - DNA, 25 bp, Mus musculus
gttctgtaacttttcatccatgttt

SEQ ID NO: 730450 - DNA, 25 bp, Mus musculus
gttctgtaagagagctcccagtcag

SEQ ID NO: 730451 - DNA, 25 bp, Mus musculus
gttctgtaagagtgctcccagtcag

SEQ ID NO: 730452 - DNA, 25 bp, Mus musculus
gttctgtaatgcaggctcacttaat

SEQ ID NO: 730453 - DNA, 25 bp, Mus musculus
gttctgtaatgctggctcacttaat

SEQ ID NO: 730454 - DNA, 25 bp, Mus musculus
gttctgtaccgaagagccaatgaca

SEQ ID NO: 730455 - DNA, 25 bp, Mus musculus
gttctgtaccgatgagccaatgaca

SEQ ID NO: 730456 - DNA, 25 bp, Mus musculus
gttctgtacgtactaccaggttcca

SEQ ID NO: 730457 - DNA, 25 bp, Mus musculus
gttctgtacgtagtaccaggttcca

SEQ ID NO: 730458 - DNA, 25 bp, Mus musculus
gttctgtactaaattccatggccgg

SEQ ID NO: 730459 - DNA, 25 bp, Mus musculus
gttctgtactaatttccatggccgg

SEQ ID NO: 730460 - DNA, 25 bp, Mus musculus
gttctgtactgtccaaatcagctcc

SEQ ID NO: 730461 - DNA, 25 bp, Mus musculus
gttctgtactgtgcaaatcagctcc

SEQ ID NO: 730462 - DNA, 25 bp, Mus musculus
gttctgtagaatactctgacttgct

SEQ ID NO: 730463 - DNA, 25 bp, Mus musculus
gttctgtagaattctctgacttgct

SEQ ID NO: 730464 - DNA, 25 bp, Mus musculus
gttctgtagaccagtttctatgtga

SEQ ID NO: 730465 - DNA, 25 bp, Mus musculus
gttctgtagacctgtttctatgtga

SEQ ID NO: 730466 - DNA, 25 bp, Mus musculus
gttctgtaggacattccaatttgga

SEQ ID NO: 730467 - DNA, 25 bp, Mus musculus
gttctgtaggactttccaatttgga

SEQ ID NO: 730468 - DNA, 25 bp, Mus musculus
gttctgtatatacaactctcaactt

SEQ ID NO: 730469 - DNA, 25 bp, Mus musculus
gttctgtatatagaactctcaactt

SEQ ID NO: 730470 - DNA, 25 bp, Mus musculus
gttctgtatatgacctcgtttcttg

SEQ ID NO: 730471 - DNA, 25 bp, Mus musculus
gttctgtatatgtcctcgtttcttg

SEQ ID NO: 730472 - DNA, 25 bp, Mus musculus
gttctgtatccacatggttggctat

SEQ ID NO: 730473 - DNA, 25 bp, Mus musculus
gttctgtatccagatggttggctat

SEQ ID NO: 730474 - DNA, 25 bp, Mus musculus
gttctgtatcttcttctttgtatgg

SEQ ID NO: 730475 - DNA, 25 bp, Mus musculus
gttctgtatcttgttctttgtatgg

SEQ ID NO: 730476 - DNA, 25 bp, Mus musculus
gttctgtattcaagcccatcgtatg

SEQ ID NO: 730477 - DNA, 25 bp, Mus musculus
gttctgtattcatgcccatcgtatg

SEQ ID NO: 730478 - DNA, 25 bp, Mus musculus
gttctgtattgcatgttttcttatt

SEQ ID NO: 730479 - DNA, 25 bp, Mus musculus
gttctgtattgcttgttttcttatt

SEQ ID NO: 730480 - DNA, 25 bp, Mus musculus
gttctgtcaaaaacatcgcagcgct

SEQ ID NO: 730481 - DNA, 25 bp, Mus musculus
gttctgtcaaaatcatcgcagcgct

SEQ ID NO: 730482 - DNA, 25 bp, Mus musculus
gttctgtcaagaatgctttctgttg

SEQ ID NO: 730483 - DNA, 25 bp, Mus musculus
gttctgtcaagattgctttctgttg

SEQ ID NO: 730484 - DNA, 25 bp, Mus musculus
gttctgtcaatgaattcaggtcctt

SEQ ID NO: 730485 - DNA, 25 bp, Mus musculus
gttctgtcaatgtattcaggtcctt

SEQ ID NO: 730486 - DNA, 25 bp, Mus musculus
gttctgtcactaaaatatttgtcct

SEQ ID NO: 730487 - DNA, 25 bp, Mus musculus
gttctgtcactataatatttgtcct

SEQ ID NO: 730488 - DNA, 25 bp, Mus musculus
gttctgtcatttactgcatttgcca

SEQ ID NO: 730489 - DNA, 25 bp, Mus musculus
gttctgtcattttctgcatttgcca

SEQ ID NO: 730490 - DNA, 25 bp, Mus musculus
gttctgtccaacatgggagctcatt

SEQ ID NO: 730491 - DNA, 25 bp, Mus musculus
gttctgtccaacttgggagctcatt

SEQ ID NO: 730492 - DNA, 25 bp, Mus musculus
gttctgtccagcactgtatttgggc

SEQ ID NO: 730493 - DNA, 25 bp, Mus musculus
gttctgtccagctctgtatttgggc

SEQ ID NO: 730494 - DNA, 25 bp, Mus musculus
gttctgtccattcagctgttcatca

SEQ ID NO: 730495 - DNA, 25 bp, Mus musculus
gttctgtccattgagctgttcatca

SEQ ID NO: 730496 - DNA, 25 bp, Mus musculus
gttctgtcccagaatagcagtctgt

SEQ ID NO: 730497 - DNA, 25 bp, Mus musculus
gttctgtcccagtatagcagtctgt

SEQ ID NO: 730498 - DNA, 25 bp, Mus musculus
gttctgtccctacctggttaagaca

SEQ ID NO: 730499 - DNA, 25 bp, Mus musculus
gttctgtccctagctggttaagaca

SEQ ID NO: 730500 - DNA, 25 bp, Mus musculus
gttctgtctccgagcagtcaagtag

SEQ ID NO: 730501 - DNA, 25 bp, Mus musculus
gttctgtctccgtgcagtcaagtag

SEQ ID NO: 730502 - DNA, 25 bp, Mus musculus
gttctgtctgacaaagtctgatcaa

SEQ ID NO: 730503 - DNA, 25 bp, Mus musculus
gttctgtctgactaagtctgatcaa

SEQ ID NO: 730504 - DNA, 25 bp, Mus musculus
gttctgtctgagagtagttcgccaa

SEQ ID NO: 730505 - DNA, 25 bp, Mus musculus
gttctgtctgagtgtagttcgccaa

SEQ ID NO: 730506 - DNA, 25 bp, Mus musculus
gttctgtctgctcatgtcagttctt

SEQ ID NO: 730507 - DNA, 25 bp, Mus musculus
gttctgtctgctgatgtcagttctt

SEQ ID NO: 730508 - DNA, 25 bp, Mus musculus
gttctgtctgggagatcacactcag

SEQ ID NO: 730509 - DNA, 25 bp, Mus musculus
gttctgtctgggtgatcacactcag

SEQ ID NO: 730510 - DNA, 25 bp, Mus musculus
gttctgtcttaacgtgatgttctgc

SEQ ID NO: 730511 - DNA, 25 bp, Mus musculus
gttctgtcttaaggtgatgttctgc

SEQ ID NO: 730512 - DNA, 25 bp, Mus musculus
gttctgtgaagtactctctctgtct

SEQ ID NO: 730513 - DNA, 25 bp, Mus musculus
gttctgtgaagttctctctctgtct

SEQ ID NO: 730514 - DNA, 25 bp, Mus musculus
gttctgtgaatcagccattgttaaa

SEQ ID NO: 730515 - DNA, 25 bp, Mus musculus
gttctgtgaatctgccattgttaaa

SEQ ID NO: 730516 - DNA, 25 bp, Mus musculus
gttctgtgacttatccaaagaataa

SEQ ID NO: 730517 - DNA, 25 bp, Mus musculus
gttctgtgacttttccaaagaataa

SEQ ID NO: 730518 - DNA, 25 bp, Mus musculus
gttctgtgagctagcttgtgtgtgt

SEQ ID NO: 730519 - DNA, 25 bp, Mus musculus
gttctgtgagcttgcttgtgtgtgt

SEQ ID NO: 730520 - DNA, 25 bp, Mus musculus
gttctgtgagtacccaaggccaagc

SEQ ID NO: 730521 - DNA, 25 bp, Mus musculus
gttctgtgagtagccaaggccaagc

SEQ ID NO: 730522 - DNA, 25 bp, Mus musculus
gttctgtgatagcacattgggcata

SEQ ID NO: 730523 - DNA, 25 bp, Mus musculus
gttctgtgataggacattgggcata

SEQ ID NO: 730524 - DNA, 25 bp, Mus musculus
gttctgtgcgaacgcgttgactttt

SEQ ID NO: 730525 - DNA, 25 bp, Mus musculus
gttctgtgcgaaggcgttgactttt

SEQ ID NO: 730526 - DNA, 25 bp, Mus musculus
gttctgtgctgcatcttggcacata

SEQ ID NO: 730527 - DNA, 25 bp, Mus musculus
gttctgtgctgcttcttggcacata

SEQ ID NO: 730528 - DNA, 25 bp, Mus musculus
gttctgtgctgtaggattatgtgac

SEQ ID NO: 730529 - DNA, 25 bp, Mus musculus
gttctgtgctgttggattatgtgac

SEQ ID NO: 730530 - DNA, 25 bp, Mus musculus
gttctgtgcttcctcaattgctttc

SEQ ID NO: 730531 - DNA, 25 bp, Mus musculus
gttctgtgcttcgtcaattgctttc

SEQ ID NO: 730532 - DNA, 25 bp, Mus musculus
gttctgtggactcgctcacaactac

SEQ ID NO: 730533 - DNA, 25 bp, Mus musculus
gttctgtggactggctcacaactac

SEQ ID NO: 730534 - DNA, 25 bp, Mus musculus
gttctgtggagaatgctacctggca

SEQ ID NO: 730535 - DNA, 25 bp, Mus musculus
gttctgtggagattgctacctggca

SEQ ID NO: 730536 - DNA, 25 bp, Mus musculus
gttctgtggataccaatggtcattt

SEQ ID NO: 730537 - DNA, 25 bp, Mus musculus
gttctgtggatagcaatggtcattt

SEQ ID NO: 730538 - DNA, 25 bp, Mus musculus
gttctgtggatcaaccattgctggc

SEQ ID NO: 730539 - DNA, 25 bp, Mus musculus
gttctgtggatctaccattgctggc

SEQ ID NO: 730540 - DNA, 25 bp, Mus musculus
gttctgtggcgaacacgctggctcc

SEQ ID NO: 730541 - DNA, 25 bp, Mus musculus
gttctgtggcgatcacgctggctcc

SEQ ID NO: 730542 - DNA, 25 bp, Mus musculus
gttctgtgggtcactggaagccaag

SEQ ID NO: 730543 - DNA, 25 bp, Mus musculus
gttctgtgggtctctggaagccaag

SEQ ID NO: 730544 - DNA, 25 bp, Mus musculus
gttctgtgtaaaagcaactcatcca

SEQ ID NO: 730545 - DNA, 25 bp, Mus musculus
gttctgtgtaaatgcaactcatcca

SEQ ID NO: 730546 - DNA, 25 bp, Mus musculus
gttctgtgtatcatcaatgtgctta

SEQ ID NO: 730547 - DNA, 25 bp, Mus musculus
gttctgtgtatcttcaatgtgctta

SEQ ID NO: 730548 - DNA, 25 bp, Mus musculus
gttctgtgtcatataccttagtggc

SEQ ID NO: 730549 - DNA, 25 bp, Mus musculus
gttctgtgtcatttaccttagtggc

SEQ ID NO: 730550 - DNA, 25 bp, Mus musculus
gttctgtgtcgaaagagatttcatt

SEQ ID NO: 730551 - DNA, 25 bp, Mus musculus
gttctgtgtcgatagagatttcatt

SEQ ID NO: 730552 - DNA, 25 bp, Mus musculus
gttctgtgtcttattcagcaaggct

SEQ ID NO: 730553 - DNA, 25 bp, Mus musculus
gttctgtgtctttttcagcaaggct

SEQ ID NO: 730554 - DNA, 25 bp, Mus musculus
gttctgtgtgaaatgaccactgtgt

SEQ ID NO: 730555 - DNA, 25 bp, Mus musculus
gttctgtgtgaattgaccactgtgt

SEQ ID NO: 730556 - DNA, 25 bp, Mus musculus
gttctgtgtgtgctctatgtgtaca

SEQ ID NO: 730557 - DNA, 25 bp, Mus musculus
gttctgtgtgtggtctatgtgtaca

SEQ ID NO: 730558 - DNA, 25 bp, Mus musculus
gttctgtgttggaatttgtgctagc

SEQ ID NO: 730559 - DNA, 25 bp, Mus musculus
gttctgtgttggtatttgtgctagc

SEQ ID NO: 730560 - DNA, 25 bp, Mus musculus
gttctgtgttttctcaaaggccctg

SEQ ID NO: 730561 - DNA, 25 bp, Mus musculus
gttctgtgttttgtcaaaggccctg

SEQ ID NO: 730562 - DNA, 25 bp, Mus musculus
gttctgttaaacaagttaggccctg

SEQ ID NO: 730563 - DNA, 25 bp, Mus musculus
gttctgttaaactagttaggccctg

SEQ ID NO: 730564 - DNA, 25 bp, Mus musculus
gttctgttaagccaatattctctag

SEQ ID NO: 730565 - DNA, 25 bp, Mus musculus
gttctgttaagcgaatattctctag

SEQ ID NO: 730566 - DNA, 25 bp, Mus musculus
gttctgttacaaatccatgtgtcct

SEQ ID NO: 730567 - DNA, 25 bp, Mus musculus
gttctgttacaattccatgtgtcct

SEQ ID NO: 730568 - DNA, 25 bp, Mus musculus
gttctgttacctctacacaattcta

SEQ ID NO: 730569 - DNA, 25 bp, Mus musculus
gttctgttacctgtacacaattcta

SEQ ID NO: 730570 - DNA, 25 bp, Mus musculus
gttctgttataacaacaaccacttg

SEQ ID NO: 730571 - DNA, 25 bp, Mus musculus
gttctgttataagaacaaccacttg

SEQ ID NO: 730572 - DNA, 25 bp, Mus musculus
gttctgttatcaccaccaggcataa

SEQ ID NO: 730573 - DNA, 25 bp, Mus musculus
gttctgttatcagcaccaggcataa

SEQ ID NO: 730574 - DNA, 25 bp, Mus musculus
gttctgttcacacgcatagcagcat

SEQ ID NO: 730575 - DNA, 25 bp, Mus musculus
gttctgttcacaggcatagcagcat

SEQ ID NO: 730576 - DNA, 25 bp, Mus musculus
gttctgttcagcagtaaattctctc

SEQ ID NO: 730577 - DNA, 25 bp, Mus musculus
gttctgttcagctgtaaattctctc

SEQ ID NO: 730578 - DNA, 25 bp, Mus musculus
gttctgttcccgcttcacttttcat

SEQ ID NO: 730579 - DNA, 25 bp, Mus musculus
gttctgttcccggttcacttttcat

SEQ ID NO: 730580 - DNA, 25 bp, Mus musculus
gttctgttctcgaaacgggagcttg

SEQ ID NO: 730581 - DNA, 25 bp, Mus musculus
gttctgttctcgtaacgggagcttg

SEQ ID NO: 730582 - DNA, 25 bp, Mus musculus
gttctgttgacacatagcaggtctt

SEQ ID NO: 730583 - DNA, 25 bp, Mus musculus
gttctgttgacagatagcaggtctt

SEQ ID NO: 730584 - DNA, 25 bp, Mus musculus
gttctgttgaccctacagacctaca

SEQ ID NO: 730585 - DNA, 25 bp, Mus musculus
gttctgttgaccgtacagacctaca

SEQ ID NO: 730586 - DNA, 25 bp, Mus musculus
gttctgttggttaaacttgccggag

SEQ ID NO: 730587 - DNA, 25 bp, Mus musculus
gttctgttggtttaacttgccggag

SEQ ID NO: 730588 - DNA, 25 bp, Mus musculus
gttctgttgtgaacaaccctctttt

SEQ ID NO: 730589 - DNA, 25 bp, Mus musculus
gttctgttgtgaaccactgaacaca

SEQ ID NO: 730590 - DNA, 25 bp, Mus musculus
gttctgttgtgaatacttctcggga

SEQ ID NO: 730591 - DNA, 25 bp, Mus musculus
gttctgttgtgatcaaccctctttt

SEQ ID NO: 730592 - DNA, 25 bp, Mus musculus
gttctgttgtgatccactgaacaca

SEQ ID NO: 730593 - DNA, 25 bp, Mus musculus
gttctgttgtgattacttctcggga

SEQ ID NO: 730594 - DNA, 25 bp, Mus musculus
gttctgttgtttatatactgcctat

SEQ ID NO: 730595 - DNA, 25 bp, Mus musculus
gttctgttgtttttatactgcctat

SEQ ID NO: 730596 - DNA, 25 bp, Mus musculus
gttctgtttactcagccgaatgtgg

SEQ ID NO: 730597 - DNA, 25 bp, Mus musculus
gttctgtttactgagccgaatgtgg

SEQ ID NO: 730598 - DNA, 25 bp, Mus musculus
gttctgtttagtccttgcccaaaag

SEQ ID NO: 730599 - DNA, 25 bp, Mus musculus
gttctgtttagtctctgttcgcagt

SEQ ID NO: 730600 - DNA, 25 bp, Mus musculus
gttctgtttagtgcttgcccaaaag

SEQ ID NO: 730601 - DNA, 25 bp, Mus musculus
gttctgtttagtgtctgttcgcagt

SEQ ID NO: 730602 - DNA, 25 bp, Mus musculus
gttctgtttatgataactagctgac

SEQ ID NO: 730603 - DNA, 25 bp, Mus musculus
gttctgtttatgttaactagctgac

SEQ ID NO: 730604 - DNA, 25 bp, Mus musculus
gttctgtttccactgttaattcata

SEQ ID NO: 730605 - DNA, 25 bp, Mus musculus
gttctgtttccagtgttaattcata

SEQ ID NO: 730606 - DNA, 25 bp, Mus musculus
gttctgtttgatcagcaacacgtgc

SEQ ID NO: 730607 - DNA, 25 bp, Mus musculus
gttctgtttgatgagcaacacgtgc

SEQ ID NO: 730608 - DNA, 25 bp, Mus musculus
gttctgtttgctaagtagacaaaaa

SEQ ID NO: 730609 - DNA, 25 bp, Mus musculus
gttctgtttgcttagtagacaaaaa

SEQ ID NO: 730610 - DNA, 25 bp, Mus musculus
gttctgtttggacagtcaccttcga

SEQ ID NO: 730611 - DNA, 25 bp, Mus musculus
gttctgtttggagagtcaccttcga

SEQ ID NO: 730612 - DNA, 25 bp, Mus musculus
gttctgtttgggaaaccatacatac

SEQ ID NO: 730613 - DNA, 25 bp, Mus musculus
gttctgtttgggtaaccatacatac

SEQ ID NO: 730614 - DNA, 25 bp, Mus musculus
gttctgtttgtgcttgtttcactgt

SEQ ID NO: 730615 - DNA, 25 bp, Mus musculus
gttctgtttgtggttgtttcactgt

SEQ ID NO: 730616 - DNA, 25 bp, Mus musculus
gttctgttttctaacctgcaggtca

SEQ ID NO: 730617 - DNA, 25 bp, Mus musculus
gttctgttttctaccttgtcgtatc

SEQ ID NO: 730618 - DNA, 25 bp, Mus musculus
gttctgttttcttacctgcaggtca

SEQ ID NO: 730619 - DNA, 25 bp, Mus musculus
gttctgttttcttccttgtcgtatc

SEQ ID NO: 730620 - DNA, 25 bp, Mus musculus
gttctgttttgcaaaaggctccatt

SEQ ID NO: 730621 - DNA, 25 bp, Mus musculus
gttctgttttgctaaaggctccatt

SEQ ID NO: 730622 - DNA, 25 bp, Mus musculus
gttcttaaaaggatagcaggcagtt

SEQ ID NO: 730623 - DNA, 25 bp, Mus musculus
gttcttaaaaggttagcaggcagtt

SEQ ID NO: 730624 - DNA, 25 bp, Mus musculus
gttcttaacctacgtttctgcttgg

SEQ ID NO: 730625 - DNA, 25 bp, Mus musculus
gttcttaacctaggtttctgcttgg

SEQ ID NO: 730626 - DNA, 25 bp, Mus musculus
gttcttaacgctcaaaaccttcaca

SEQ ID NO: 730627 - DNA, 25 bp, Mus musculus
gttcttaacgctgaaaaccttcaca

SEQ ID NO: 730628 - DNA, 25 bp, Mus musculus
gttcttaacttgctttggatgtcct

SEQ ID NO: 730629 - DNA, 25 bp, Mus musculus
gttcttaacttggtttggatgtcct

SEQ ID NO: 730630 - DNA, 25 bp, Mus musculus
gttcttaagcttcagatcgcctctt

SEQ ID NO: 730631 - DNA, 25 bp, Mus musculus
gttcttaagcttgagatcgcctctt

SEQ ID NO: 730632 - DNA, 25 bp, Mus musculus
gttcttaatacccactgtcaggcat

SEQ ID NO: 730633 - DNA, 25 bp, Mus musculus
gttcttaataccgactgtcaggcat

SEQ ID NO: 730634 - DNA, 25 bp, Mus musculus
gttcttaatataacacgttacaagg

SEQ ID NO: 730635 - DNA, 25 bp, Mus musculus
gttcttaatatatcacgttacaagg

SEQ ID NO: 730636 - DNA, 25 bp, Mus musculus
gttcttaatctcatgccaaaatcaa

SEQ ID NO: 730637 - DNA, 25 bp, Mus musculus
gttcttaatctcttgccaaaatcaa

SEQ ID NO: 730638 - DNA, 25 bp, Mus musculus
gttcttaatgtcctgcttcaaatcc

SEQ ID NO: 730639 - DNA, 25 bp, Mus musculus
gttcttaatgtcgtgcttcaaatcc

SEQ ID NO: 730640 - DNA, 25 bp, Mus musculus
gttcttaattatctacctgcctccg

SEQ ID NO: 730641 - DNA, 25 bp, Mus musculus
gttcttaattatgtacctgcctccg

SEQ ID NO: 730642 - DNA, 25 bp, Mus musculus
gttcttacaaagcactcaagttcga

SEQ ID NO: 730643 - DNA, 25 bp, Mus musculus
gttcttacaaaggactcaagttcga

SEQ ID NO: 730644 - DNA, 25 bp, Mus musculus
gttcttacagtactatacatggcca

SEQ ID NO: 730645 - DNA, 25 bp, Mus musculus
gttcttacagtagtatacatggcca

SEQ ID NO: 730646 - DNA, 25 bp, Mus musculus
gttcttacatatcagtggacacacc

SEQ ID NO: 730647 - DNA, 25 bp, Mus musculus
gttcttacatatgagtggacacacc

SEQ ID NO: 730648 - DNA, 25 bp, Mus musculus
gttcttacattcatttgtgggacat

SEQ ID NO: 730649 - DNA, 25 bp, Mus musculus
gttcttacattcttttgtgggacat

SEQ ID NO: 730650 - DNA, 25 bp, Mus musculus
gttcttaccaatctctaacctcaag

SEQ ID NO: 730651 - DNA, 25 bp, Mus musculus
gttcttaccaatgtctaacctcaag

SEQ ID NO: 730652 - DNA, 25 bp, Mus musculus
gttcttaccccaagtatatcgacat

SEQ ID NO: 730653 - DNA, 25 bp, Mus musculus
gttcttaccccatgtatatcgacat

SEQ ID NO: 730654 - DNA, 25 bp, Mus musculus
gttcttaccgttcatcacagggagt

SEQ ID NO: 730655 - DNA, 25 bp, Mus musculus
gttcttaccgttgatcacagggagt

SEQ ID NO: 730656 - DNA, 25 bp, Mus musculus
gttcttactaaaccactaatcattt

SEQ ID NO: 730657 - DNA, 25 bp, Mus musculus
gttcttactaaagcactaatcattt

SEQ ID NO: 730658 - DNA, 25 bp, Mus musculus
gttcttactgaactcattgttctct

SEQ ID NO: 730659 - DNA, 25 bp, Mus musculus
gttcttactgaagtcattgttctct

SEQ ID NO: 730660 - DNA, 25 bp, Mus musculus
gttcttactgacagaatagtactca

SEQ ID NO: 730661 - DNA, 25 bp, Mus musculus
gttcttactgactgaatagtactca

SEQ ID NO: 730662 - DNA, 25 bp, Mus musculus
gttcttactgatatttctgcccttt

SEQ ID NO: 730663 - DNA, 25 bp, Mus musculus
gttcttactgatttttctgcccttt

SEQ ID NO: 730664 - DNA, 25 bp, Mus musculus
gttcttacttcaatagcgttgctta

SEQ ID NO: 730665 - DNA, 25 bp, Mus musculus
gttcttacttcattagcgttgctta

SEQ ID NO: 730666 - DNA, 25 bp, Mus musculus
gttcttagaacaaccacctgagcaa

SEQ ID NO: 730667 - DNA, 25 bp, Mus musculus
gttcttagaacatccacctgagcaa

SEQ ID NO: 730668 - DNA, 25 bp, Mus musculus
gttcttagacaaaggctcactgtat

SEQ ID NO: 730669 - DNA, 25 bp, Mus musculus
gttcttagacaatggctcactgtat

SEQ ID NO: 730670 - DNA, 25 bp, Mus musculus
gttcttagagagaaccaatccatag

SEQ ID NO: 730671 - DNA, 25 bp, Mus musculus
gttcttagagagtaccaatccatag

SEQ ID NO: 730672 - DNA, 25 bp, Mus musculus
gttcttagatcacagcgtccattcc

SEQ ID NO: 730673 - DNA, 25 bp, Mus musculus
gttcttagatcagagcgtccattcc

SEQ ID NO: 730674 - DNA, 25 bp, Mus musculus
gttcttagatggatattacttgtga

SEQ ID NO: 730675 - DNA, 25 bp, Mus musculus
gttcttagatggttattacttgtga

SEQ ID NO: 730676 - DNA, 25 bp, Mus musculus
gttcttagatttaaactgcatccca

SEQ ID NO: 730677 - DNA, 25 bp, Mus musculus
gttcttagattttaactgcatccca

SEQ ID NO: 730678 - DNA, 25 bp, Mus musculus
gttcttagcagacgtactttttcgg

SEQ ID NO: 730679 - DNA, 25 bp, Mus musculus
gttcttagcagaggtactttttcgg

SEQ ID NO: 730680 - DNA, 25 bp, Mus musculus
gttcttagcatgaaaaccctacaga

SEQ ID NO: 730681 - DNA, 25 bp, Mus musculus
gttcttagcatgactgtactttttc

SEQ ID NO: 730682 - DNA, 25 bp, Mus musculus
gttcttagcatgtaaaccctacaga

SEQ ID NO: 730683 - DNA, 25 bp, Mus musculus
gttcttagcatgtctgtactttttc

SEQ ID NO: 730684 - DNA, 25 bp, Mus musculus
gttcttagcgtacagtctgtgcctc

SEQ ID NO: 730685 - DNA, 25 bp, Mus musculus
gttcttagcgtagagtctgtgcctc

SEQ ID NO: 730686 - DNA, 25 bp, Mus musculus
gttcttagctcccttgttggatatg

SEQ ID NO: 730687 - DNA, 25 bp, Mus musculus
gttcttagctccgttgttggatatg

SEQ ID NO: 730688 - DNA, 25 bp, Mus musculus
gttcttagcttgcatgtgtgattaa

SEQ ID NO: 730689 - DNA, 25 bp, Mus musculus
gttcttagcttggatgtgtgattaa

SEQ ID NO: 730690 - DNA, 25 bp, Mus musculus
gttcttaggtttactcactttgaca

SEQ ID NO: 730691 - DNA, 25 bp, Mus musculus
gttcttaggtttacttgtagcttag

SEQ ID NO: 730692 - DNA, 25 bp, Mus musculus
gttcttaggttttctcactttgaca

SEQ ID NO: 730693 - DNA, 25 bp, Mus musculus
gttcttaggttttcttgtagcttag

SEQ ID NO: 730694 - DNA, 25 bp, Mus musculus
gttcttagtgacatagagactgcat

SEQ ID NO: 730695 - DNA, 25 bp, Mus musculus
gttcttagtgacttagagactgcat

SEQ ID NO: 730696 - DNA, 25 bp, Mus musculus
gttcttagtgtcagtcattccaatt

SEQ ID NO: 730697 - DNA, 25 bp, Mus musculus
gttcttagtgtctgtcattccaatt

SEQ ID NO: 730698 - DNA, 25 bp, Mus musculus
gttcttagttaacggtgactctcta

SEQ ID NO: 730699 - DNA, 25 bp, Mus musculus
gttcttagttaagggtgactctcta

SEQ ID NO: 730700 - DNA, 25 bp, Mus musculus
gttcttagttctaagcaggttggtg

SEQ ID NO: 730701 - DNA, 25 bp, Mus musculus
gttcttagttcttagcaggttggtg

SEQ ID NO: 730702 - DNA, 25 bp, Mus musculus
gttcttagttgcatgcttctacaat

SEQ ID NO: 730703 - DNA, 25 bp, Mus musculus
gttcttagttgcttgcttctacaat

SEQ ID NO: 730704 - DNA, 25 bp, Mus musculus
gttcttataatgattcttgcctgtt

SEQ ID NO: 730705 - DNA, 25 bp, Mus musculus
gttcttataatgtttcttgcctgtt

SEQ ID NO: 730706 - DNA, 25 bp, Mus musculus
gttcttatacgcagttggtggctca

SEQ ID NO: 730707 - DNA, 25 bp, Mus musculus
gttcttatacgctgttggtggctca

SEQ ID NO: 730708 - DNA, 25 bp, Mus musculus
gttcttatatctcatctttctcttg

SEQ ID NO: 730709 - DNA, 25 bp, Mus musculus
gttcttatatctgatctttctcttg

SEQ ID NO: 730710 - DNA, 25 bp, Mus musculus
gttcttatatgaaacttacactttg

SEQ ID NO: 730711 - DNA, 25 bp, Mus musculus
gttcttatatgatacttacactttg

SEQ ID NO: 730712 - DNA, 25 bp, Mus musculus
gttcttatcaccatgcttcagatgt

SEQ ID NO: 730713 - DNA, 25 bp, Mus musculus
gttcttatcaccttgcttcagatgt

SEQ ID NO: 730714 - DNA, 25 bp, Mus musculus
gttcttatccctcctgtaactgtga

SEQ ID NO: 730715 - DNA, 25 bp, Mus musculus
gttcttatccctcggaaagtagttg

SEQ ID NO: 730716 - DNA, 25 bp, Mus musculus
gttcttatccctgctgtaactgtga

SEQ ID NO: 730717 - DNA, 25 bp, Mus musculus
gttcttatccctgggaaagtagttg

SEQ ID NO: 730718 - DNA, 25 bp, Mus musculus
gttcttatcctacttagagagtcag

SEQ ID NO: 730719 - DNA, 25 bp, Mus musculus
gttcttatcctagttagagagtcag

SEQ ID NO: 730720 - DNA, 25 bp, Mus musculus
gttcttatgaacagatcaccttact

SEQ ID NO: 730721 - DNA, 25 bp, Mus musculus
gttcttatgaactgatcaccttact

SEQ ID NO: 730722 - DNA, 25 bp, Mus musculus
gttcttatgcatagtcatatatgta

SEQ ID NO: 730723 - DNA, 25 bp, Mus musculus
gttcttatgcattgtcatatatgta

SEQ ID NO: 730724 - DNA, 25 bp, Mus musculus
gttcttattaatacagcatggctcc

SEQ ID NO: 730725 - DNA, 25 bp, Mus musculus
gttcttattaattcagcatggctcc

SEQ ID NO: 730726 - DNA, 25 bp, Mus musculus
gttcttattagtcatttccaacctg

SEQ ID NO: 730727 - DNA, 25 bp, Mus musculus
gttcttattagtgatttccaacctg

SEQ ID NO: 730728 - DNA, 25 bp, Mus musculus
gttcttattgaccttgaactctaca

SEQ ID NO: 730729 - DNA, 25 bp, Mus musculus
gttcttattgacgttgaactctaca

SEQ ID NO: 730730 - DNA, 25 bp, Mus musculus
gttcttattggccttgccttgctgc

SEQ ID NO: 730731 - DNA, 25 bp, Mus musculus
gttcttattggcgttgccttgctgc

SEQ ID NO: 730732 - DNA, 25 bp, Mus musculus
gttcttatttgcaacatggaggtga

SEQ ID NO: 730733 - DNA, 25 bp, Mus musculus
gttcttatttgctacatggaggtga

SEQ ID NO: 730734 - DNA, 25 bp, Mus musculus
gttcttatttgtaacttcatgaata

SEQ ID NO: 730735 - DNA, 25 bp, Mus musculus
gttcttatttgttacttcatgaata

SEQ ID NO: 730736 - DNA, 25 bp, Mus musculus
gttcttcaaacgcatctaggtgtaa

SEQ ID NO: 730737 - DNA, 25 bp, Mus musculus
gttcttcaaacggatctaggtgtaa

SEQ ID NO: 730738 - DNA, 25 bp, Mus musculus
gttcttcaaaggcaatatcaaccta

SEQ ID NO: 730739 - DNA, 25 bp, Mus musculus
gttcttcaaagggaatatcaaccta

SEQ ID NO: 730740 - DNA, 25 bp, Mus musculus
gttcttcaaagtctggttctctgat

SEQ ID NO: 730741 - DNA, 25 bp, Mus musculus
gttcttcaaagtgtggttctctgat

SEQ ID NO: 730742 - DNA, 25 bp, Mus musculus
gttcttcaaatcctccatcaactga

SEQ ID NO: 730743 - DNA, 25 bp, Mus musculus
gttcttcaaatcgtccatcaactga

SEQ ID NO: 730744 - DNA, 25 bp, Mus musculus
gttcttcaatacctctactagtctg

SEQ ID NO: 730745 - DNA, 25 bp, Mus musculus
gttcttcaatacgtctactagtctg

SEQ ID NO: 730746 - DNA, 25 bp, Mus musculus
gttcttcacaagagggttccctcaa

SEQ ID NO: 730747 - DNA, 25 bp, Mus musculus
gttcttcacaagtgggttccctcaa

SEQ ID NO: 730748 - DNA, 25 bp, Mus musculus
gttcttcacagcagatgaggactta

SEQ ID NO: 730749 - DNA, 25 bp, Mus musculus
gttcttcacagctgatgaggactta

SEQ ID NO: 730750 - DNA, 25 bp, Mus musculus
gttcttcacatccaatcatttccaa

SEQ ID NO: 730751 - DNA, 25 bp, Mus musculus
gttcttcacatcgaatcatttccaa

SEQ ID NO: 730752 - DNA, 25 bp, Mus musculus
gttcttcaccctcctttaagatgaa

SEQ ID NO: 730753 - DNA, 25 bp, Mus musculus
gttcttcaccctgctttaagatgaa

SEQ ID NO: 730754 - DNA, 25 bp, Mus musculus
gttcttcacggcaatgtatttttct

SEQ ID NO: 730755 - DNA, 25 bp, Mus musculus
gttcttcacggctatgtatttttct

SEQ ID NO: 730756 - DNA, 25 bp, Mus musculus
gttcttcacttgaactaatcaaata

SEQ ID NO: 730757 - DNA, 25 bp, Mus musculus
gttcttcacttgtactaatcaaata

SEQ ID NO: 730758 - DNA, 25 bp, Mus musculus
gttcttcagatgagttcactcctgt

SEQ ID NO: 730759 - DNA, 25 bp, Mus musculus
gttcttcagatgtgttcactcctgt

SEQ ID NO: 730760 - DNA, 25 bp, Mus musculus
gttcttcagattctatgtccacgtt

SEQ ID NO: 730761 - DNA, 25 bp, Mus musculus
gttcttcagattgtatgtccacgtt

SEQ ID NO: 730762 - DNA, 25 bp, Mus musculus
gttcttcagcacctacgacagggac

SEQ ID NO: 730763 - DNA, 25 bp, Mus musculus
gttcttcagcacgtacgacagggac

SEQ ID NO: 730764 - DNA, 25 bp, Mus musculus
gttcttcagcctactaagatatggg

SEQ ID NO: 730765 - DNA, 25 bp, Mus musculus
gttcttcagcctataaaccctggat

SEQ ID NO: 730766 - DNA, 25 bp, Mus musculus
gttcttcagccttctaagatatggg

SEQ ID NO: 730767 - DNA, 25 bp, Mus musculus
gttcttcagcctttaaaccctggat

SEQ ID NO: 730768 - DNA, 25 bp, Mus musculus
gttcttcaggcgaaacctaacatgg

SEQ ID NO: 730769 - DNA, 25 bp, Mus musculus
gttcttcaggcgtaacctaacatgg

SEQ ID NO: 730770 - DNA, 25 bp, Mus musculus
gttcttcagggacatagtgcatcta

SEQ ID NO: 730771 - DNA, 25 bp, Mus musculus
gttcttcagggagatagtgcatcta

SEQ ID NO: 730772 - DNA, 25 bp, Mus musculus
gttcttcagggcctctttctagcca

SEQ ID NO: 730773 - DNA, 25 bp, Mus musculus
gttcttcagggcgtctttctagcca

SEQ ID NO: 730774 - DNA, 25 bp, Mus musculus
gttcttcagggtaaatgtcacgcta

SEQ ID NO: 730775 - DNA, 25 bp, Mus musculus
gttcttcagggttaatgtcacgcta

SEQ ID NO: 730776 - DNA, 25 bp, Mus musculus
gttcttcagtgtacttcctcatcat

SEQ ID NO: 730777 - DNA, 25 bp, Mus musculus
gttcttcagtgttcttcctcatcat

SEQ ID NO: 730778 - DNA, 25 bp, Mus musculus
gttcttcatatacgaggaccctgtg

SEQ ID NO: 730779 - DNA, 25 bp, Mus musculus
gttcttcatataggaggaccctgtg

SEQ ID NO: 730780 - DNA, 25 bp, Mus musculus
gttcttcatctcctccaagtctttc

SEQ ID NO: 730781 - DNA, 25 bp, Mus musculus
gttcttcatctcgtccaagtctttc

SEQ ID NO: 730782 - DNA, 25 bp, Mus musculus
gttcttcatcttatattacattatc

SEQ ID NO: 730783 - DNA, 25 bp, Mus musculus
gttcttcatcttttattacattatc

SEQ ID NO: 730784 - DNA, 25 bp, Mus musculus
gttcttcatgcactggttctcgtaa

SEQ ID NO: 730785 - DNA, 25 bp, Mus musculus
gttcttcatgcagtggttctcgtaa

SEQ ID NO: 730786 - DNA, 25 bp, Mus musculus
gttcttcatgctatgcagctgtaag

SEQ ID NO: 730787 - DNA, 25 bp, Mus musculus
gttcttcatgctttgcagctgtaag

SEQ ID NO: 730788 - DNA, 25 bp, Mus musculus
gttcttcatgggaaagtctttacaa

SEQ ID NO: 730789 - DNA, 25 bp, Mus musculus
gttcttcatgggtaagtctttacaa

SEQ ID NO: 730790 - DNA, 25 bp, Mus musculus
gttcttcatgtaccagacttgcccc

SEQ ID NO: 730791 - DNA, 25 bp, Mus musculus
gttcttcatgtagcagacttgcccc

SEQ ID NO: 730792 - DNA, 25 bp, Mus musculus
gttcttcatgttatgagcactttat

SEQ ID NO: 730793 - DNA, 25 bp, Mus musculus
gttcttcatgttttgagcactttat

SEQ ID NO: 730794 - DNA, 25 bp, Mus musculus
gttcttcatttaactgcctgaaccc

SEQ ID NO: 730795 - DNA, 25 bp, Mus musculus
gttcttcatttatctgcctgaaccc

SEQ ID NO: 730796 - DNA, 25 bp, Mus musculus
gttcttcatttccatgccctgattt

SEQ ID NO: 730797 - DNA, 25 bp, Mus musculus
gttcttcatttcgatgccctgattt

SEQ ID NO: 730798 - DNA, 25 bp, Mus musculus
gttcttccacagatgacacagcttc

SEQ ID NO: 730799 - DNA, 25 bp, Mus musculus
gttcttccacagttgacacagcttc

SEQ ID NO: 730800 - DNA, 25 bp, Mus musculus
gttcttccacgtacaggacctagaa

SEQ ID NO: 730801 - DNA, 25 bp, Mus musculus
gttcttccacgttcaggacctagaa

SEQ ID NO: 730802 - DNA, 25 bp, Mus musculus
gttcttccagaacggtcgcaagcac

SEQ ID NO: 730803 - DNA, 25 bp, Mus musculus
gttcttccagaagggtcgcaagcac

SEQ ID NO: 730804 - DNA, 25 bp, Mus musculus
gttcttccagatccatgctacatag

SEQ ID NO: 730805 - DNA, 25 bp, Mus musculus
gttcttccagatgcatgctacatag

SEQ ID NO: 730806 - DNA, 25 bp, Mus musculus
gttcttcccgtgctagagtggcaga

SEQ ID NO: 730807 - DNA, 25 bp, Mus musculus
gttcttcccgtggtagagtggcaga

SEQ ID NO: 730808 - DNA, 25 bp, Mus musculus
gttcttccctaacttaaagccatgt

SEQ ID NO: 730809 - DNA, 25 bp, Mus musculus
gttcttccctaagttaaagccatgt

SEQ ID NO: 730810 - DNA, 25 bp, Mus musculus
gttcttccggaaagcattttcctgt

SEQ ID NO: 730811 - DNA, 25 bp, Mus musculus
gttcttccggaatgcattttcctgt

SEQ ID NO: 730812 - DNA, 25 bp, Mus musculus
gttcttccgtacagctgtttcatct

SEQ ID NO: 730813 - DNA, 25 bp, Mus musculus
gttcttccgtactgctgtttcatct

SEQ ID NO: 730814 - DNA, 25 bp, Mus musculus
gttcttcctaacatctatcaatacc

SEQ ID NO: 730815 - DNA, 25 bp, Mus musculus
gttcttcctaacttctatcaatacc

SEQ ID NO: 730816 - DNA, 25 bp, Mus musculus
gttcttcctacaatatcactctaat

SEQ ID NO: 730817 - DNA, 25 bp, Mus musculus
gttcttcctacattatcactctaat

SEQ ID NO: 730818 - DNA, 25 bp, Mus musculus
gttcttcctccaacattacaatagc

SEQ ID NO: 730819 - DNA, 25 bp, Mus musculus
gttcttcctccatcattacaatagc

SEQ ID NO: 730820 - DNA, 25 bp, Mus musculus
gttcttcctctactgttttgtgtga

SEQ ID NO: 730821 - DNA, 25 bp, Mus musculus
gttcttcctctagtgttttgtgtga

SEQ ID NO: 730822 - DNA, 25 bp, Mus musculus
gttcttcctgaaaatagttacatgt

SEQ ID NO: 730823 - DNA, 25 bp, Mus musculus
gttcttcctgaatatagttacatgt

SEQ ID NO: 730824 - DNA, 25 bp, Mus musculus
gttcttcctggcacttaaatgtctt

SEQ ID NO: 730825 - DNA, 25 bp, Mus musculus
gttcttcctggctcttaaatgtctt

SEQ ID NO: 730826 - DNA, 25 bp, Mus musculus
gttcttcgacacagagcgctactgg

SEQ ID NO: 730827 - DNA, 25 bp, Mus musculus
gttcttcgacactgagcgctactgg

SEQ ID NO: 730828 - DNA, 25 bp, Mus musculus
gttcttcgacgaacctatgttgctg

SEQ ID NO: 730829 - DNA, 25 bp, Mus musculus
gttcttcgacgaccctgaggtagat

SEQ ID NO: 730830 - DNA, 25 bp, Mus musculus
gttcttcgacgagcctgaggtagat

SEQ ID NO: 730831 - DNA, 25 bp, Mus musculus
gttcttcgacgatcctatgttgctg

SEQ ID NO: 730832 - DNA, 25 bp, Mus musculus
gttcttcggagtcttatttcactgt

SEQ ID NO: 730833 - DNA, 25 bp, Mus musculus
gttcttcggagtgttatttcactgt

SEQ ID NO: 730834 - DNA, 25 bp, Mus musculus
gttcttcggcaacatcctggacaga

SEQ ID NO: 730835 - DNA, 25 bp, Mus musculus
gttcttcggcaagatcctggacaga

SEQ ID NO: 730836 - DNA, 25 bp, Mus musculus
gttcttcggctgacaaatctcttga

SEQ ID NO: 730837 - DNA, 25 bp, Mus musculus
gttcttcggctgtcaaatctcttga

SEQ ID NO: 730838 - DNA, 25 bp, Mus musculus
gttcttcgggaacgatcatctatag

SEQ ID NO: 730839 - DNA, 25 bp, Mus musculus
gttcttcgggaaggatcatctatag

SEQ ID NO: 730840 - DNA, 25 bp, Mus musculus
gttcttcgggtgctacttcgtgcag

SEQ ID NO: 730841 - DNA, 25 bp, Mus musculus
gttcttcgggtggtacttcgtgcag

SEQ ID NO: 730842 - DNA, 25 bp, Mus musculus
gttcttcgtagccagaactaccatt

SEQ ID NO: 730843 - DNA, 25 bp, Mus musculus
gttcttcgtagcgagaactaccatt

SEQ ID NO: 730844 - DNA, 25 bp, Mus musculus
gttcttcgttcaattatctcagcaa

SEQ ID NO: 730845 - DNA, 25 bp, Mus musculus
gttcttcgttcatttatctcagcaa

SEQ ID NO: 730846 - DNA, 25 bp, Mus musculus
gttcttctacttctatctttcttca

SEQ ID NO: 730847 - DNA, 25 bp, Mus musculus
gttcttctacttgtatctttcttca

SEQ ID NO: 730848 - DNA, 25 bp, Mus musculus
gttcttctagatactcatctgccat

SEQ ID NO: 730849 - DNA, 25 bp, Mus musculus
gttcttctagattctcatctgccat

SEQ ID NO: 730850 - DNA, 25 bp, Mus musculus
gttcttctataaagtgcgcctggct

SEQ ID NO: 730851 - DNA, 25 bp, Mus musculus
gttcttctataatgtgcgcctggct

SEQ ID NO: 730852 - DNA, 25 bp, Mus musculus
gttcttctcaggagtctctgaggag

SEQ ID NO: 730853 - DNA, 25 bp, Mus musculus
gttcttctcaggtgtctctgaggag

SEQ ID NO: 730854 - DNA, 25 bp, Mus musculus
gttcttctccaaacatagctgcctt

SEQ ID NO: 730855 - DNA, 25 bp, Mus musculus
gttcttctccaatcatagctgcctt

SEQ ID NO: 730856 - DNA, 25 bp, Mus musculus
gttcttctcgttccttgttccaatc

SEQ ID NO: 730857 - DNA, 25 bp, Mus musculus
gttcttctcgttgcttgttccaatc

SEQ ID NO: 730858 - DNA, 25 bp, Mus musculus
gttcttctctggaaaaattccaggt

SEQ ID NO: 730859 - DNA, 25 bp, Mus musculus
gttcttctctggaattctttgttct

SEQ ID NO: 730860 - DNA, 25 bp, Mus musculus
gttcttctctggtaaaattccaggt

SEQ ID NO: 730861 - DNA, 25 bp, Mus musculus
gttcttctctggtattctttgttct

SEQ ID NO: 730862 - DNA, 25 bp, Mus musculus
gttcttctctttagactgtttgctt

SEQ ID NO: 730863 - DNA, 25 bp, Mus musculus
gttcttctcttttgactgtttgctt

SEQ ID NO: 730864 - DNA, 25 bp, Mus musculus
gttcttctgagtccggctgaagcag

SEQ ID NO: 730865 - DNA, 25 bp, Mus musculus
gttcttctgagtgcggctgaagcag

SEQ ID NO: 730866 - DNA, 25 bp, Mus musculus
gttcttctgcaacagtagtacatgt

SEQ ID NO: 730867 - DNA, 25 bp, Mus musculus
gttcttctgcaagagtagtacatgt

SEQ ID NO: 730868 - DNA, 25 bp, Mus musculus
gttcttctgcgcaacctaggaagag

SEQ ID NO: 730869 - DNA, 25 bp, Mus musculus
gttcttctgcgctacctaggaagag

SEQ ID NO: 730870 - DNA, 25 bp, Mus musculus
gttcttctggtcctacaatgtcact

SEQ ID NO: 730871 - DNA, 25 bp, Mus musculus
gttcttctggtcgtacaatgtcact

SEQ ID NO: 730872 - DNA, 25 bp, Mus musculus
gttcttctgtaaaggcctggttcac

SEQ ID NO: 730873 - DNA, 25 bp, Mus musculus
gttcttctgtaatggcctggttcac

SEQ ID NO: 730874 - DNA, 25 bp, Mus musculus
gttcttcttaagctattatttcaca

SEQ ID NO: 730875 - DNA, 25 bp, Mus musculus
gttcttcttaaggtattatttcaca

SEQ ID NO: 730876 - DNA, 25 bp, Mus musculus
gttcttcttcacatcgagttataca

SEQ ID NO: 730877 - DNA, 25 bp, Mus musculus
gttcttcttcacttcgagttataca

SEQ ID NO: 730878 - DNA, 25 bp, Mus musculus
gttcttcttctcaggcatatgttca

SEQ ID NO: 730879 - DNA, 25 bp, Mus musculus
gttcttcttctctggcatatgttca

SEQ ID NO: 730880 - DNA, 25 bp, Mus musculus
gttcttcttgagcatcatcaactcc

SEQ ID NO: 730881 - DNA, 25 bp, Mus musculus
gttcttcttgaggatcatcaactcc

SEQ ID NO: 730882 - DNA, 25 bp, Mus musculus
gttcttcttgctctaattgaatgtg

SEQ ID NO: 730883 - DNA, 25 bp, Mus musculus
gttcttcttgctgtaattgaatgtg

SEQ ID NO: 730884 - DNA, 25 bp, Mus musculus
gttcttcttgggacccattcataat

SEQ ID NO: 730885 - DNA, 25 bp, Mus musculus
gttcttcttgggtcccattcataat

SEQ ID NO: 730886 - DNA, 25 bp, Mus musculus
gttcttctttgaatatgtctttcct

SEQ ID NO: 730887 - DNA, 25 bp, Mus musculus
gttcttctttgaatttgttgctggt

SEQ ID NO: 730888 - DNA, 25 bp, Mus musculus
gttcttctttgattatgtctttcct

SEQ ID NO: 730889 - DNA, 25 bp, Mus musculus
gttcttctttgattttgttgctggt

SEQ ID NO: 730890 - DNA, 25 bp, Mus musculus
gttcttctttggctgtcgtgactgt

SEQ ID NO: 730891 - DNA, 25 bp, Mus musculus
gttcttctttgggtgtcgtgactgt

SEQ ID NO: 730892 - DNA, 25 bp, Mus musculus
gttcttctttttcttgagcagccta

SEQ ID NO: 730893 - DNA, 25 bp, Mus musculus
gttcttctttttgttgagcagccta

SEQ ID NO: 730894 - DNA, 25 bp, Mus musculus
gttcttgaaaacacttcgccttgct

SEQ ID NO: 730895 - DNA, 25 bp, Mus musculus
gttcttgaaaactcttcgccttgct

SEQ ID NO: 730896 - DNA, 25 bp, Mus musculus
gttcttgaaaatagtcgatgctatg

SEQ ID NO: 730897 - DNA, 25 bp, Mus musculus
gttcttgaaaatcggtggctgtcta

SEQ ID NO: 730898 - DNA, 25 bp, Mus musculus
gttcttgaaaatgggtggctgtcta

SEQ ID NO: 730899 - DNA, 25 bp, Mus musculus
gttcttgaaaattgtcgatgctatg

SEQ ID NO: 730900 - DNA, 25 bp, Mus musculus
gttcttgaaactaacaggccttact

SEQ ID NO: 730901 - DNA, 25 bp, Mus musculus
gttcttgaaacttacaggccttact

SEQ ID NO: 730902 - DNA, 25 bp, Mus musculus
gttcttgaaatcagggtccccaact

SEQ ID NO: 730903 - DNA, 25 bp, Mus musculus
gttcttgaaatctgggtccccaact

SEQ ID NO: 730904 - DNA, 25 bp, Mus musculus
gttcttgaacaacaccactaacagg

SEQ ID NO: 730905 - DNA, 25 bp, Mus musculus
gttcttgaacaagaccactaacagg

SEQ ID NO: 730906 - DNA, 25 bp, Mus musculus
gttcttgaagctaccagaacctcca

SEQ ID NO: 730907 - DNA, 25 bp, Mus musculus
gttcttgaagcttccagaacctcca

SEQ ID NO: 730908 - DNA, 25 bp, Mus musculus
gttcttgaagttcgagatgtctggc

SEQ ID NO: 730909 - DNA, 25 bp, Mus musculus
gttcttgaagttggagatgtctggc

SEQ ID NO: 730910 - DNA, 25 bp, Mus musculus
gttcttgaatgcagtgagcgcctca

SEQ ID NO: 730911 - DNA, 25 bp, Mus musculus
gttcttgaatgctgtgagcgcctca

SEQ ID NO: 730912 - DNA, 25 bp, Mus musculus
gttcttgaattaatttctgacctgg

SEQ ID NO: 730913 - DNA, 25 bp, Mus musculus
gttcttgaattattttctgacctgg

SEQ ID NO: 730914 - DNA, 25 bp, Mus musculus
gttcttgacaagatttcatgttcgt

SEQ ID NO: 730915 - DNA, 25 bp, Mus musculus
gttcttgacaagttttcatgttcgt

SEQ ID NO: 730916 - DNA, 25 bp, Mus musculus
gttcttgacactaagcaagttctgc

SEQ ID NO: 730917 - DNA, 25 bp, Mus musculus
gttcttgacacttagcaagttctgc

SEQ ID NO: 730918 - DNA, 25 bp, Mus musculus
gttcttgaccatcatggccagaaag

SEQ ID NO: 730919 - DNA, 25 bp, Mus musculus
gttcttgaccatgatggccagaaag

SEQ ID NO: 730920 - DNA, 25 bp, Mus musculus
gttcttgactataaggccctgcagg

SEQ ID NO: 730921 - DNA, 25 bp, Mus musculus
gttcttgactattaggccctgcagg

SEQ ID NO: 730922 - DNA, 25 bp, Mus musculus
gttcttgactctcctttgcagagaa

SEQ ID NO: 730923 - DNA, 25 bp, Mus musculus
gttcttgactctgctttgcagagaa

SEQ ID NO: 730924 - DNA, 25 bp, Mus musculus
gttcttgagactacctgagaggcca

SEQ ID NO: 730925 - DNA, 25 bp, Mus musculus
gttcttgagacttcctgagaggcca

SEQ ID NO: 730926 - DNA, 25 bp, Mus musculus
gttcttgagagacagacagtgtgct

SEQ ID NO: 730927 - DNA, 25 bp, Mus musculus
gttcttgagagagagacagtgtgct

SEQ ID NO: 730928 - DNA, 25 bp, Mus musculus
gttcttgagtcaattttgctgcata

SEQ ID NO: 730929 - DNA, 25 bp, Mus musculus
gttcttgagtcatttttgctgcata

SEQ ID NO: 730930 - DNA, 25 bp, Mus musculus
gttcttgatggaacccttgagttgg

SEQ ID NO: 730931 - DNA, 25 bp, Mus musculus
gttcttgatggatcccttgagttgg

SEQ ID NO: 730932 - DNA, 25 bp, Mus musculus
gttcttgattcaactgactgccaat

SEQ ID NO: 730933 - DNA, 25 bp, Mus musculus
gttcttgattcatctgactgccaat

SEQ ID NO: 730934 - DNA, 25 bp, Mus musculus
gttcttgattggacatgattgcaca

SEQ ID NO: 730935 - DNA, 25 bp, Mus musculus
gttcttgattggtcatgattgcaca

SEQ ID NO: 730936 - DNA, 25 bp, Mus musculus
gttcttgcacgcagtttcttagaga

SEQ ID NO: 730937 - DNA, 25 bp, Mus musculus
gttcttgcacgctgtttcttagaga

SEQ ID NO: 730938 - DNA, 25 bp, Mus musculus
gttcttgcagttatatcactagcca

SEQ ID NO: 730939 - DNA, 25 bp, Mus musculus
gttcttgcagttttatcactagcca

SEQ ID NO: 730940 - DNA, 25 bp, Mus musculus
gttcttgccaagatcatcccaagtt

SEQ ID NO: 730941 - DNA, 25 bp, Mus musculus
gttcttgccaagttcatcccaagtt

SEQ ID NO: 730942 - DNA, 25 bp, Mus musculus
gttcttgccaccaggagcactcaaa

SEQ ID NO: 730943 - DNA, 25 bp, Mus musculus
gttcttgccacctggagcactcaaa

SEQ ID NO: 730944 - DNA, 25 bp, Mus musculus
gttcttgcccagagcctttaatata

SEQ ID NO: 730945 - DNA, 25 bp, Mus musculus
gttcttgcccagtgcctttaatata

SEQ ID NO: 730946 - DNA, 25 bp, Mus musculus
gttcttgcctgtcctagtagggagt

SEQ ID NO: 730947 - DNA, 25 bp, Mus musculus
gttcttgcctgtgctagtagggagt

SEQ ID NO: 730948 - DNA, 25 bp, Mus musculus
gttcttgcgcgtctatcgcaggagt

SEQ ID NO: 730949 - DNA, 25 bp, Mus musculus
gttcttgcgcgtgtatcgcaggagt

SEQ ID NO: 730950 - DNA, 25 bp, Mus musculus
gttcttgcggtgagccacgtggaaa

SEQ ID NO: 730951 - DNA, 25 bp, Mus musculus
gttcttgcggtgtgccacgtggaaa

SEQ ID NO: 730952 - DNA, 25 bp, Mus musculus
gttcttgctcacagtggttcaatcc

SEQ ID NO: 730953 - DNA, 25 bp, Mus musculus
gttcttgctcactgtggttcaatcc

SEQ ID NO: 730954 - DNA, 25 bp, Mus musculus
gttcttgctgatagttcacgtgccg

SEQ ID NO: 730955 - DNA, 25 bp, Mus musculus
gttcttgctgatctcttattttttg

SEQ ID NO: 730956 - DNA, 25 bp, Mus musculus
gttcttgctgatgtcttattttttg

SEQ ID NO: 730957 - DNA, 25 bp, Mus musculus
gttcttgctgattgttcacgtgccg

SEQ ID NO: 730958 - DNA, 25 bp, Mus musculus
gttcttgctggaccagcccagacat

SEQ ID NO: 730959 - DNA, 25 bp, Mus musculus
gttcttgctggagcagcccagacat

SEQ ID NO: 730960 - DNA, 25 bp, Mus musculus
gttcttgctgttatccaacttgaag

SEQ ID NO: 730961 - DNA, 25 bp, Mus musculus
gttcttgctgttttccaacttgaag

SEQ ID NO: 730962 - DNA, 25 bp, Mus musculus
gttcttggacccaggcaccaacatt

SEQ ID NO: 730963 - DNA, 25 bp, Mus musculus
gttcttggaccctggcaccaacatt

SEQ ID NO: 730964 - DNA, 25 bp, Mus musculus
gttcttggacttcgccacgtcagat

SEQ ID NO: 730965 - DNA, 25 bp, Mus musculus
gttcttggacttggccacgtcagat

SEQ ID NO: 730966 - DNA, 25 bp, Mus musculus
gttcttggatagacaaaggtcctta

SEQ ID NO: 730967 - DNA, 25 bp, Mus musculus
gttcttggatagtcaaaggtcctta

SEQ ID NO: 730968 - DNA, 25 bp, Mus musculus
gttcttggatgaatcaacatgttat

SEQ ID NO: 730969 - DNA, 25 bp, Mus musculus
gttcttggatgattcaacatgttat

SEQ ID NO: 730970 - DNA, 25 bp, Mus musculus
gttcttggatggacatggactgcat

SEQ ID NO: 730971 - DNA, 25 bp, Mus musculus
gttcttggatggtcatggactgcat

SEQ ID NO: 730972 - DNA, 25 bp, Mus musculus
gttcttggcattagtcctttacgga

SEQ ID NO: 730973 - DNA, 25 bp, Mus musculus
gttcttggcatttgtcctttacgga

SEQ ID NO: 730974 - DNA, 25 bp, Mus musculus
gttcttggccaaaacgtcaactgta

SEQ ID NO: 730975 - DNA, 25 bp, Mus musculus
gttcttggccaatacgtcaactgta

SEQ ID NO: 730976 - DNA, 25 bp, Mus musculus
gttcttggcttaatggatctcttac

SEQ ID NO: 730977 - DNA, 25 bp, Mus musculus
gttcttggcttattggatctcttac

SEQ ID NO: 730978 - DNA, 25 bp, Mus musculus
gttcttggcttcactatttgtgaca

SEQ ID NO: 730979 - DNA, 25 bp, Mus musculus
gttcttggcttctctatttgtgaca

SEQ ID NO: 730980 - DNA, 25 bp, Mus musculus
gttcttgggaagatcctgcctctgt

SEQ ID NO: 730981 - DNA, 25 bp, Mus musculus
gttcttgggaagcacctgcatgtat

SEQ ID NO: 730982 - DNA, 25 bp, Mus musculus
gttcttgggaaggacctgcatgtat

SEQ ID NO: 730983 - DNA, 25 bp, Mus musculus
gttcttgggaagttcctgcctctgt

SEQ ID NO: 730984 - DNA, 25 bp, Mus musculus
gttcttgggagccagagcaacctca

SEQ ID NO: 730985 - DNA, 25 bp, Mus musculus
gttcttgggagcgagagcaacctca

SEQ ID NO: 730986 - DNA, 25 bp, Mus musculus
gttcttgggccaaagtcctgaggaa

SEQ ID NO: 730987 - DNA, 25 bp, Mus musculus
gttcttgggccaatatataaggtaa

SEQ ID NO: 730988 - DNA, 25 bp, Mus musculus
gttcttgggccatagtcctgaggaa

SEQ ID NO: 730989 - DNA, 25 bp, Mus musculus
gttcttgggccattatataaggtaa

SEQ ID NO: 730990 - DNA, 25 bp, Mus musculus
gttcttgggcctacagggaatccag

SEQ ID NO: 730991 - DNA, 25 bp, Mus musculus
gttcttgggccttcagggaatccag

SEQ ID NO: 730992 - DNA, 25 bp, Mus musculus
gttcttgggcttagtagagcttttt

SEQ ID NO: 730993 - DNA, 25 bp, Mus musculus
gttcttgggctttgtagagcttttt

SEQ ID NO: 730994 - DNA, 25 bp, Mus musculus
gttcttgggttcactagagctgtga

SEQ ID NO: 730995 - DNA, 25 bp, Mus musculus
gttcttgggttctctagagctgtga

SEQ ID NO: 730996 - DNA, 25 bp, Mus musculus
gttcttggtgcgatgtgttatgtta

SEQ ID NO: 730997 - DNA, 25 bp, Mus musculus
gttcttggtgcgttgtgttatgtta

SEQ ID NO: 730998 - DNA, 25 bp, Mus musculus
gttcttggtggcctactgacataaa

SEQ ID NO: 730999 - DNA, 25 bp, Mus musculus
gttcttggtggcgtactgacataaa

SEQ ID NO: 731000 - DNA, 25 bp, Mus musculus
gttcttggtgtccacgcctcagata

SEQ ID NO: 731001 - DNA, 25 bp, Mus musculus
gttcttggtgtcgacgcctcagata

SEQ ID NO: 731002 - DNA, 25 bp, Mus musculus
gttcttgtaaagctttctattcagc

SEQ ID NO: 731003 - DNA, 25 bp, Mus musculus
gttcttgtaaaggtttctattcagc

SEQ ID NO: 731004 - DNA, 25 bp, Mus musculus
gttcttgtaactcagcacgtgagcg

SEQ ID NO: 731005 - DNA, 25 bp, Mus musculus
gttcttgtaactgagcacgtgagcg

SEQ ID NO: 731006 - DNA, 25 bp, Mus musculus
gttcttgtaaggactgcctatttct

SEQ ID NO: 731007 - DNA, 25 bp, Mus musculus
gttcttgtaaggtctgcctatttct

SEQ ID NO: 731008 - DNA, 25 bp, Mus musculus
gttcttgtaattacacgcgcttttg

SEQ ID NO: 731009 - DNA, 25 bp, Mus musculus
gttcttgtaatttcacgcgcttttg

SEQ ID NO: 731010 - DNA, 25 bp, Mus musculus
gttcttgtagtcattttcaccatta

SEQ ID NO: 731011 - DNA, 25 bp, Mus musculus
gttcttgtagtctttttcaccatta

SEQ ID NO: 731012 - DNA, 25 bp, Mus musculus
gttcttgtatggatttaatcactgc

SEQ ID NO: 731013 - DNA, 25 bp, Mus musculus
gttcttgtatggttttaatcactgc

SEQ ID NO: 731014 - DNA, 25 bp, Mus musculus
gttcttgtcaacatgagtcacccaa

SEQ ID NO: 731015 - DNA, 25 bp, Mus musculus
gttcttgtcaacttgagtcacccaa

SEQ ID NO: 731016 - DNA, 25 bp, Mus musculus
gttcttgtcacaccagtagcttcct

SEQ ID NO: 731017 - DNA, 25 bp, Mus musculus
gttcttgtcacagcagtagcttcct

SEQ ID NO: 731018 - DNA, 25 bp, Mus musculus
gttcttgtcagtatttcatcctttc

SEQ ID NO: 731019 - DNA, 25 bp, Mus musculus
gttcttgtcagtttttcatcctttc

SEQ ID NO: 731020 - DNA, 25 bp, Mus musculus
gttcttgtcattccagcatcatcta

SEQ ID NO: 731021 - DNA, 25 bp, Mus musculus
gttcttgtcattgcagcatcatcta

SEQ ID NO: 731022 - DNA, 25 bp, Mus musculus
gttcttgtcccacacgtgaaaatga

SEQ ID NO: 731023 - DNA, 25 bp, Mus musculus
gttcttgtcccagacgtgaaaatga

SEQ ID NO: 731024 - DNA, 25 bp, Mus musculus
gttcttgtcggtatttaagcccatg

SEQ ID NO: 731025 - DNA, 25 bp, Mus musculus
gttcttgtcggtttttaagcccatg

SEQ ID NO: 731026 - DNA, 25 bp, Mus musculus
gttcttgtctcaatcatcagttttg

SEQ ID NO: 731027 - DNA, 25 bp, Mus musculus
gttcttgtctcattcatcagttttg

SEQ ID NO: 731028 - DNA, 25 bp, Mus musculus
gttcttgtgaaccagtgtatacata

SEQ ID NO: 731029 - DNA, 25 bp, Mus musculus
gttcttgtgaacgagtgtatacata

SEQ ID NO: 731030 - DNA, 25 bp, Mus musculus
gttcttgtgactcagtgtgctggca

SEQ ID NO: 731031 - DNA, 25 bp, Mus musculus
gttcttgtgactgagtgtgctggca

SEQ ID NO: 731032 - DNA, 25 bp, Mus musculus
gttcttgtgatgattgttatgcttg

SEQ ID NO: 731033 - DNA, 25 bp, Mus musculus
gttcttgtgatgtttgttatgcttg

SEQ ID NO: 731034 - DNA, 25 bp, Mus musculus
gttcttgtggcactgcattctgaga

SEQ ID NO: 731035 - DNA, 25 bp, Mus musculus
gttcttgtggcagtgcattctgaga

SEQ ID NO: 731036 - DNA, 25 bp, Mus musculus
gttcttgtgggtactgctagacatc

SEQ ID NO: 731037 - DNA, 25 bp, Mus musculus
gttcttgtgggttctgctagacatc

SEQ ID NO: 731038 - DNA, 25 bp, Mus musculus
gttcttgtgtatattttctaccgag

SEQ ID NO: 731039 - DNA, 25 bp, Mus musculus
gttcttgtgtatcctttctaatccc

SEQ ID NO: 731040 - DNA, 25 bp, Mus musculus
gttcttgtgtatgctttctaatccc

SEQ ID NO: 731041 - DNA, 25 bp, Mus musculus
gttcttgtgtattttttctaccgag

SEQ ID NO: 731042 - DNA, 25 bp, Mus musculus
gttcttgttaaaatgttcctatgat

SEQ ID NO: 731043 - DNA, 25 bp, Mus musculus
gttcttgttaaattgttcctatgat

SEQ ID NO: 731044 - DNA, 25 bp, Mus musculus
gttcttgttcaacgaaacacactcg

SEQ ID NO: 731045 - DNA, 25 bp, Mus musculus
gttcttgttcaaggaaacacactcg

SEQ ID NO: 731046 - DNA, 25 bp, Mus musculus
gttcttgttccaaaccttgctggga

SEQ ID NO: 731047 - DNA, 25 bp, Mus musculus
gttcttgttccataccttgctggga

SEQ ID NO: 731048 - DNA, 25 bp, Mus musculus
gttcttgttcttccctggaccgccg

SEQ ID NO: 731049 - DNA, 25 bp, Mus musculus
gttcttgttcttgcctggaccgccg

SEQ ID NO: 731050 - DNA, 25 bp, Mus musculus
gttcttgttgatagtttgtacaccc

SEQ ID NO: 731051 - DNA, 25 bp, Mus musculus
gttcttgttgattgtttgtacaccc

SEQ ID NO: 731052 - DNA, 25 bp, Mus musculus
gttcttgttggacagattgtccccg

SEQ ID NO: 731053 - DNA, 25 bp, Mus musculus
gttcttgttggagagattgtccccg

SEQ ID NO: 731054 - DNA, 25 bp, Mus musculus
gttcttgtttgcatgttactctctc

SEQ ID NO: 731055 - DNA, 25 bp, Mus musculus
gttcttgtttgcttgttactctctc

SEQ ID NO: 731056 - DNA, 25 bp, Mus musculus
gttcttgttttaagacaaggtctca

SEQ ID NO: 731057 - DNA, 25 bp, Mus musculus
gttcttgttttatgacaaggtctca

SEQ ID NO: 731058 - DNA, 25 bp, Mus musculus
gttctttaaagtactgtctcgccta

SEQ ID NO: 731059 - DNA, 25 bp, Mus musculus
gttctttaaagttctgtctcgccta

SEQ ID NO: 731060 - DNA, 25 bp, Mus musculus
gttctttaaataccaactcgcccct

SEQ ID NO: 731061 - DNA, 25 bp, Mus musculus
gttctttaaatagcaactcgcccct

SEQ ID NO: 731062 - DNA, 25 bp, Mus musculus
gttctttaaccaagtgtagctagta

SEQ ID NO: 731063 - DNA, 25 bp, Mus musculus
gttctttaaccatgtgtagctagta

SEQ ID NO: 731064 - DNA, 25 bp, Mus musculus
gttctttaagttcctacctgtatct

SEQ ID NO: 731065 - DNA, 25 bp, Mus musculus
gttctttaagttgctacctgtatct

SEQ ID NO: 731066 - DNA, 25 bp, Mus musculus
gttctttaatgtcacgacgctccag

SEQ ID NO: 731067 - DNA, 25 bp, Mus musculus
gttctttaatgtgacgacgctccag

SEQ ID NO: 731068 - DNA, 25 bp, Mus musculus
gttctttacaccagagcatagcttc

SEQ ID NO: 731069 - DNA, 25 bp, Mus musculus
gttctttacacctgagcatagcttc

SEQ ID NO: 731070 - DNA, 25 bp, Mus musculus
gttctttacagaattgcttcaaaat

SEQ ID NO: 731071 - DNA, 25 bp, Mus musculus
gttctttacagatttgcttcaaaat

SEQ ID NO: 731072 - DNA, 25 bp, Mus musculus
gttctttacattagaagttccttca

SEQ ID NO: 731073 - DNA, 25 bp, Mus musculus
gttctttacatttgaagttccttca

SEQ ID NO: 731074 - DNA, 25 bp, Mus musculus
gttctttaccagcagcatctgagca

SEQ ID NO: 731075 - DNA, 25 bp, Mus musculus
gttctttaccaggagcatctgagca

SEQ ID NO: 731076 - DNA, 25 bp, Mus musculus
gttctttaccctcagtggcaaacgt

SEQ ID NO: 731077 - DNA, 25 bp, Mus musculus
gttctttaccctgagtggcaaacgt

SEQ ID NO: 731078 - DNA, 25 bp, Mus musculus
gttctttaccgtctctggctaataa

SEQ ID NO: 731079 - DNA, 25 bp, Mus musculus
gttctttaccgtgtctggctaataa

SEQ ID NO: 731080 - DNA, 25 bp, Mus musculus
gttctttagcagatggcctttgtgt

SEQ ID NO: 731081 - DNA, 25 bp, Mus musculus
gttctttagcagttggcctttgtgt

SEQ ID NO: 731082 - DNA, 25 bp, Mus musculus
gttctttatacaataggagccacta

SEQ ID NO: 731083 - DNA, 25 bp, Mus musculus
gttctttatacattaggagccacta

SEQ ID NO: 731084 - DNA, 25 bp, Mus musculus
gttctttatgctatgataagtccca

SEQ ID NO: 731085 - DNA, 25 bp, Mus musculus
gttctttatgctttgataagtccca

SEQ ID NO: 731086 - DNA, 25 bp, Mus musculus
gttctttcaagcatttgggcctttc

SEQ ID NO: 731087 - DNA, 25 bp, Mus musculus
gttctttcaagcttttgggcctttc

SEQ ID NO: 731088 - DNA, 25 bp, Mus musculus
gttctttcacgtctgccaggattga

SEQ ID NO: 731089 - DNA, 25 bp, Mus musculus
gttctttcacgtgtgccaggattga

SEQ ID NO: 731090 - DNA, 25 bp, Mus musculus
gttctttcagagcatgctctcttct

SEQ ID NO: 731091 - DNA, 25 bp, Mus musculus
gttctttcagaggatgctctcttct

SEQ ID NO: 731092 - DNA, 25 bp, Mus musculus
gttctttccagaccactgcaaaaag

SEQ ID NO: 731093 - DNA, 25 bp, Mus musculus
gttctttccagagcactgcaaaaag

SEQ ID NO: 731094 - DNA, 25 bp, Mus musculus
gttctttccagcagtattacctact

SEQ ID NO: 731095 - DNA, 25 bp, Mus musculus
gttctttccagctgtattacctact

SEQ ID NO: 731096 - DNA, 25 bp, Mus musculus
gttctttcccagatgaagtctagtg

SEQ ID NO: 731097 - DNA, 25 bp, Mus musculus
gttctttcccagcagaagaaaggga

SEQ ID NO: 731098 - DNA, 25 bp, Mus musculus
gttctttcccaggagaagaaaggga

SEQ ID NO: 731099 - DNA, 25 bp, Mus musculus
gttctttcccagttgaagtctagtg

SEQ ID NO: 731100 - DNA, 25 bp, Mus musculus
gttctttccctcagagacagtcatt

SEQ ID NO: 731101 - DNA, 25 bp, Mus musculus
gttctttccctctgagacagtcatt

SEQ ID NO: 731102 - DNA, 25 bp, Mus musculus
gttctttcctagacagcactagtgg

SEQ ID NO: 731103 - DNA, 25 bp, Mus musculus
gttctttcctagtcagcactagtgg

SEQ ID NO: 731104 - DNA, 25 bp, Mus musculus
gttctttcctgccacagacatgtgg

SEQ ID NO: 731105 - DNA, 25 bp, Mus musculus
gttctttcctgcgacagacatgtgg

SEQ ID NO: 731106 - DNA, 25 bp, Mus musculus
gttctttctacaaactttacatcaa

SEQ ID NO: 731107 - DNA, 25 bp, Mus musculus
gttctttctacatactttacatcaa

SEQ ID NO: 731108 - DNA, 25 bp, Mus musculus
gttctttctagaattgctgtcttca

SEQ ID NO: 731109 - DNA, 25 bp, Mus musculus
gttctttctagatttgctgtcttca

SEQ ID NO: 731110 - DNA, 25 bp, Mus musculus
gttctttctcaaatccatactcatt

SEQ ID NO: 731111 - DNA, 25 bp, Mus musculus
gttctttctcaattccatactcatt

SEQ ID NO: 731112 - DNA, 25 bp, Mus musculus
gttctttctcacatgagtagagaga

SEQ ID NO: 731113 - DNA, 25 bp, Mus musculus
gttctttctcacttgagtagagaga

SEQ ID NO: 731114 - DNA, 25 bp, Mus musculus
gttctttctcatccttgtgtgtatc

SEQ ID NO: 731115 - DNA, 25 bp, Mus musculus
gttctttctcatgcttgtgtgtatc

SEQ ID NO: 731116 - DNA, 25 bp, Mus musculus
gttctttctcccatcttgtaatgta

SEQ ID NO: 731117 - DNA, 25 bp, Mus musculus
gttctttctcccttcttgtaatgta

SEQ ID NO: 731118 - DNA, 25 bp, Mus musculus
gttctttctcgactatttatttttg

SEQ ID NO: 731119 - DNA, 25 bp, Mus musculus
gttctttctcgagtatttatttttg

SEQ ID NO: 731120 - DNA, 25 bp, Mus musculus
gttctttctctcaaatttgatttca

SEQ ID NO: 731121 - DNA, 25 bp, Mus musculus
gttctttctctctaatttgatttca

SEQ ID NO: 731122 - DNA, 25 bp, Mus musculus
gttctttctgaacaccatcaacagt

SEQ ID NO: 731123 - DNA, 25 bp, Mus musculus
gttctttctgaagaccatcaacagt

SEQ ID NO: 731124 - DNA, 25 bp, Mus musculus
gttctttctttgctacacgtggaat

SEQ ID NO: 731125 - DNA, 25 bp, Mus musculus
gttctttctttggtacacgtggaat

SEQ ID NO: 731126 - DNA, 25 bp, Mus musculus
gttctttcttttctaggttgtgaca

SEQ ID NO: 731127 - DNA, 25 bp, Mus musculus
gttctttcttttgtaggttgtgaca

SEQ ID NO: 731128 - DNA, 25 bp, Mus musculus
gttctttgaaccatgcctgcagaaa

SEQ ID NO: 731129 - DNA, 25 bp, Mus musculus
gttctttgaaccttgcctgcagaaa

SEQ ID NO: 731130 - DNA, 25 bp, Mus musculus
gttctttgaagaatactacggacag

SEQ ID NO: 731131 - DNA, 25 bp, Mus musculus
gttctttgaagattactacggacag

SEQ ID NO: 731132 - DNA, 25 bp, Mus musculus
gttctttgagaaatgaaggacggtg

SEQ ID NO: 731133 - DNA, 25 bp, Mus musculus
gttctttgagaattgaaggacggtg

SEQ ID NO: 731134 - DNA, 25 bp, Mus musculus
gttctttgatacattgagaggcgct

SEQ ID NO: 731135 - DNA, 25 bp, Mus musculus
gttctttgatactttgagaggcgct

SEQ ID NO: 731136 - DNA, 25 bp, Mus musculus
gttctttgatctatctcagtgactt

SEQ ID NO: 731137 - DNA, 25 bp, Mus musculus
gttctttgatctttctcagtgactt

SEQ ID NO: 731138 - DNA, 25 bp, Mus musculus
gttctttgattacttgtctgtctgg

SEQ ID NO: 731139 - DNA, 25 bp, Mus musculus
gttctttgattagttgtctgtctgg

SEQ ID NO: 731140 - DNA, 25 bp, Mus musculus
gttctttgcaccctgtgtgtgtaaa

SEQ ID NO: 731141 - DNA, 25 bp, Mus musculus
gttctttgcaccgtgtgtgtgtaaa

SEQ ID NO: 731142 - DNA, 25 bp, Mus musculus
gttctttgcacgctgggctgtagcc

SEQ ID NO: 731143 - DNA, 25 bp, Mus musculus
gttctttgcacggtgggctgtagcc

SEQ ID NO: 731144 - DNA, 25 bp, Mus musculus
gttctttgcatgagggttccttata

SEQ ID NO: 731145 - DNA, 25 bp, Mus musculus
gttctttgcatgtgggttccttata

SEQ ID NO: 731146 - DNA, 25 bp, Mus musculus
gttctttgcattaaatctaagtagg

SEQ ID NO: 731147 - DNA, 25 bp, Mus musculus
gttctttgcatttaatctaagtagg

SEQ ID NO: 731148 - DNA, 25 bp, Mus musculus
gttctttgccatatgtttgtcttat

SEQ ID NO: 731149 - DNA, 25 bp, Mus musculus
gttctttgccatttgtttgtcttat

SEQ ID NO: 731150 - DNA, 25 bp, Mus musculus
gttctttgcctcacattgtcatgta

SEQ ID NO: 731151 - DNA, 25 bp, Mus musculus
gttctttgcctctcattgtcatgta

SEQ ID NO: 731152 - DNA, 25 bp, Mus musculus
gttctttgcttaagactcaagccaa

SEQ ID NO: 731153 - DNA, 25 bp, Mus musculus
gttctttgcttatgactcaagccaa

SEQ ID NO: 731154 - DNA, 25 bp, Mus musculus
gttctttgcttcatacatatggatg

SEQ ID NO: 731155 - DNA, 25 bp, Mus musculus
gttctttgcttcttacatatggatg

SEQ ID NO: 731156 - DNA, 25 bp, Mus musculus
gttctttggaaactctctgtgccta

SEQ ID NO: 731157 - DNA, 25 bp, Mus musculus
gttctttggaaagtctctgtgccta

SEQ ID NO: 731158 - DNA, 25 bp, Mus musculus
gttctttggaagcagctgcaacatg

SEQ ID NO: 731159 - DNA, 25 bp, Mus musculus
gttctttggaaggagctgcaacatg

SEQ ID NO: 731160 - DNA, 25 bp, Mus musculus
gttctttggaatcctcccatttact

SEQ ID NO: 731161 - DNA, 25 bp, Mus musculus
gttctttggaatgctcccatttact

SEQ ID NO: 731162 - DNA, 25 bp, Mus musculus
gttctttggagactcggttctgttg

SEQ ID NO: 731163 - DNA, 25 bp, Mus musculus
gttctttggagagtcggttctgttg

SEQ ID NO: 731164 - DNA, 25 bp, Mus musculus
gttctttggcccactctgagtgtaa

SEQ ID NO: 731165 - DNA, 25 bp, Mus musculus
gttctttggccctctctgagtgtaa

SEQ ID NO: 731166 - DNA, 25 bp, Mus musculus
gttctttggtaacagatccttgcaa

SEQ ID NO: 731167 - DNA, 25 bp, Mus musculus
gttctttggtaagagatccttgcaa

SEQ ID NO: 731168 - DNA, 25 bp, Mus musculus
gttctttgtactatgtcagttccac

SEQ ID NO: 731169 - DNA, 25 bp, Mus musculus
gttctttgtactttgtcagttccac

SEQ ID NO: 731170 - DNA, 25 bp, Mus musculus
gttctttgtcccctgcattacaaaa

SEQ ID NO: 731171 - DNA, 25 bp, Mus musculus
gttctttgtcccgtgcattacaaaa

SEQ ID NO: 731172 - DNA, 25 bp, Mus musculus
gttctttgtctcattgaaatcccct

SEQ ID NO: 731173 - DNA, 25 bp, Mus musculus
gttctttgtctctttgaaatcccct

SEQ ID NO: 731174 - DNA, 25 bp, Mus musculus
gttctttgtgaacctacctgaatgt

SEQ ID NO: 731175 - DNA, 25 bp, Mus musculus
gttctttgtgaacgatccggaaatc

SEQ ID NO: 731176 - DNA, 25 bp, Mus musculus
gttctttgtgaagctacctgaatgt

SEQ ID NO: 731177 - DNA, 25 bp, Mus musculus
gttctttgtgaaggatccggaaatc

SEQ ID NO: 731178 - DNA, 25 bp, Mus musculus
gttctttgtggtcttcgaatggaaa

SEQ ID NO: 731179 - DNA, 25 bp, Mus musculus
gttctttgtggtgttcgaatggaaa

SEQ ID NO: 731180 - DNA, 25 bp, Mus musculus
gttctttgtgtcctagtgacttaaa

SEQ ID NO: 731181 - DNA, 25 bp, Mus musculus
gttctttgtgtcgtagtgacttaaa

SEQ ID NO: 731182 - DNA, 25 bp, Mus musculus
gttctttgttagatttgggcacagc

SEQ ID NO: 731183 - DNA, 25 bp, Mus musculus
gttctttgttagttttgggcacagc

SEQ ID NO: 731184 - DNA, 25 bp, Mus musculus
gttctttgttgtactgtagtagcct

SEQ ID NO: 731185 - DNA, 25 bp, Mus musculus
gttctttgttgttctgtagtagcct

SEQ ID NO: 731186 - DNA, 25 bp, Mus musculus
gttcttttaaccaatgaccccatgt

SEQ ID NO: 731187 - DNA, 25 bp, Mus musculus
gttcttttaacctatgaccccatgt

SEQ ID NO: 731188 - DNA, 25 bp, Mus musculus
gttcttttacacaaaatctgggcgt

SEQ ID NO: 731189 - DNA, 25 bp, Mus musculus
gttcttttacactaaatctgggcgt

SEQ ID NO: 731190 - DNA, 25 bp, Mus musculus
gttcttttacccacatcttttcaat

SEQ ID NO: 731191 - DNA, 25 bp, Mus musculus
gttcttttaccctcatcttttcaat

SEQ ID NO: 731192 - DNA, 25 bp, Mus musculus
gttcttttactaagcttaatttcca

SEQ ID NO: 731193 - DNA, 25 bp, Mus musculus
gttcttttactatgcttaatttcca

SEQ ID NO: 731194 - DNA, 25 bp, Mus musculus
gttcttttagtgaacgatcctgatt

SEQ ID NO: 731195 - DNA, 25 bp, Mus musculus
gttcttttagtgtacgatcctgatt

SEQ ID NO: 731196 - DNA, 25 bp, Mus musculus
gttcttttagttctaccagcttctg

SEQ ID NO: 731197 - DNA, 25 bp, Mus musculus
gttcttttagttgtaccagcttctg

SEQ ID NO: 731198 - DNA, 25 bp, Mus musculus
gttcttttattaagacaccatagaa

SEQ ID NO: 731199 - DNA, 25 bp, Mus musculus
gttcttttattatgacaccatagaa

SEQ ID NO: 731200 - DNA, 25 bp, Mus musculus
gttcttttccctaaatacaagcact

SEQ ID NO: 731201 - DNA, 25 bp, Mus musculus
gttcttttcccttaatacaagcact

SEQ ID NO: 731202 - DNA, 25 bp, Mus musculus
gttcttttctgaacttgtgactttt

SEQ ID NO: 731203 - DNA, 25 bp, Mus musculus
gttcttttctgatcttgtgactttt

SEQ ID NO: 731204 - DNA, 25 bp, Mus musculus
gttcttttctggataccctacagct

SEQ ID NO: 731205 - DNA, 25 bp, Mus musculus
gttcttttctggttaccctacagct

SEQ ID NO: 731206 - DNA, 25 bp, Mus musculus
gttcttttgacaacagagcaggcat

SEQ ID NO: 731207 - DNA, 25 bp, Mus musculus
gttcttttgacatcagagcaggcat

SEQ ID NO: 731208 - DNA, 25 bp, Mus musculus
gttcttttgcacatacagatgttct

SEQ ID NO: 731209 - DNA, 25 bp, Mus musculus
gttcttttgcacttacagatgttct

SEQ ID NO: 731210 - DNA, 25 bp, Mus musculus
gttcttttgggcataatagtacaac

SEQ ID NO: 731211 - DNA, 25 bp, Mus musculus
gttcttttgggcttaatagtacaac

SEQ ID NO: 731212 - DNA, 25 bp, Mus musculus
gttcttttggttaggactctgagca

SEQ ID NO: 731213 - DNA, 25 bp, Mus musculus
gttcttttggttcttcagtttcact

SEQ ID NO: 731214 - DNA, 25 bp, Mus musculus
gttcttttggttgttcagtttcact

SEQ ID NO: 731215 - DNA, 25 bp, Mus musculus
gttcttttggtttggactctgagca

SEQ ID NO: 731216 - DNA, 25 bp, Mus musculus
gttcttttgtatattacgctgtagt

SEQ ID NO: 731217 - DNA, 25 bp, Mus musculus
gttcttttgtattttacgctgtagt

SEQ ID NO: 731218 - DNA, 25 bp, Mus musculus
gttctttttaaacttcgagcatcca

SEQ ID NO: 731219 - DNA, 25 bp, Mus musculus
gttctttttaaagttcgagcatcca

SEQ ID NO: 731220 - DNA, 25 bp, Mus musculus
gttctttttacaatgggtctgtgga

SEQ ID NO: 731221 - DNA, 25 bp, Mus musculus
gttctttttacattgggtctgtgga

SEQ ID NO: 731222 - DNA, 25 bp, Mus musculus
gttctttttagtcctctgtttatat

SEQ ID NO: 731223 - DNA, 25 bp, Mus musculus
gttctttttagtgctctgtttatat

SEQ ID NO: 731224 - DNA, 25 bp, Mus musculus
gttctttttcacattgagcctgaga

SEQ ID NO: 731225 - DNA, 25 bp, Mus musculus
gttctttttcactttgagcctgaga

SEQ ID NO: 731226 - DNA, 25 bp, Mus musculus
gttctttttgagcatttgttcttct

SEQ ID NO: 731227 - DNA, 25 bp, Mus musculus
gttctttttgaggatttgttcttct

SEQ ID NO: 731228 - DNA, 25 bp, Mus musculus
gttctttttgatctttccaagcaca

SEQ ID NO: 731229 - DNA, 25 bp, Mus musculus
gttctttttgatgtttccaagcaca

SEQ ID NO: 731230 - DNA, 25 bp, Mus musculus
gttctttttgcacggttagagtaag

SEQ ID NO: 731231 - DNA, 25 bp, Mus musculus
gttctttttgcacgtccagacacta

SEQ ID NO: 731232 - DNA, 25 bp, Mus musculus
gttctttttgcagggttagagtaag

SEQ ID NO: 731233 - DNA, 25 bp, Mus musculus
gttctttttgcaggtccagacacta

SEQ ID NO: 731234 - DNA, 25 bp, Mus musculus
gttctttttgtaaccactcatgtgt

SEQ ID NO: 731235 - DNA, 25 bp, Mus musculus
gttctttttgtatccactcatgtgt

SEQ ID NO: 731236 - DNA, 25 bp, Mus musculus
gttcttttttgacagccagcgcatc

SEQ ID NO: 731237 - DNA, 25 bp, Mus musculus
gttcttttttgagagccagcgcatc

SEQ ID NO: 731238 - DNA, 25 bp, Mus musculus
gttcttttttgtaacagctatgcac

SEQ ID NO: 731239 - DNA, 25 bp, Mus musculus
gttcttttttgttacagctatgcac

SEQ ID NO: 731240 - DNA, 25 bp, Mus musculus
gttgaaaacacacaccagcccttga

SEQ ID NO: 731241 - DNA, 25 bp, Mus musculus
gttgaaaacacagaccagcccttga

SEQ ID NO: 731242 - DNA, 25 bp, Mus musculus
gttgaaaaccgacttgagctatgtg

SEQ ID NO: 731243 - DNA, 25 bp, Mus musculus
gttgaaaaccgagttgagctatgtg

SEQ ID NO: 731244 - DNA, 25 bp, Mus musculus
gttgaaaacctcaggactgaagggt

SEQ ID NO: 731245 - DNA, 25 bp, Mus musculus
gttgaaaacctctggactgaagggt

SEQ ID NO: 731246 - DNA, 25 bp, Mus musculus
gttgaaaagatgctctctgttcgtg

SEQ ID NO: 731247 - DNA, 25 bp, Mus musculus
gttgaaaagatggtctctgttcgtg

SEQ ID NO: 731248 - DNA, 25 bp, Mus musculus
gttgaaaagtacatcttgcctccaa

SEQ ID NO: 731249 - DNA, 25 bp, Mus musculus
gttgaaaagtacttcttgcctccaa

SEQ ID NO: 731250 - DNA, 25 bp, Mus musculus
gttgaaaatcatcccaactggctct

SEQ ID NO: 731251 - DNA, 25 bp, Mus musculus
gttgaaaatcatgccaactggctct

SEQ ID NO: 731252 - DNA, 25 bp, Mus musculus
gttgaaaatgaactctagccgtaat

SEQ ID NO: 731253 - DNA, 25 bp, Mus musculus
gttgaaaatgaagtctagccgtaat

SEQ ID NO: 731254 - DNA, 25 bp, Mus musculus
gttgaaaatgggacctcctgaacat

SEQ ID NO: 731255 - DNA, 25 bp, Mus musculus
gttgaaaatgggtcctcctgaacat

SEQ ID NO: 731256 - DNA, 25 bp, Mus musculus
gttgaaaatgtcatccttgatctgg

SEQ ID NO: 731257 - DNA, 25 bp, Mus musculus
gttgaaaatgtcttccttgatctgg

SEQ ID NO: 731258 - DNA, 25 bp, Mus musculus
gttgaaacagccaccgccggtaaca

SEQ ID NO: 731259 - DNA, 25 bp, Mus musculus
gttgaaacagcctccgccggtaaca

SEQ ID NO: 731260 - DNA, 25 bp, Mus musculus
gttgaaacattcatccattgggctt

SEQ ID NO: 731261 - DNA, 25 bp, Mus musculus
gttgaaacattcttccattgggctt

SEQ ID NO: 731262 - DNA, 25 bp, Mus musculus
gttgaaaccataccagagactgctg

SEQ ID NO: 731263 - DNA, 25 bp, Mus musculus
gttgaaaccatagcagagactgctg

SEQ ID NO: 731264 - DNA, 25 bp, Mus musculus
gttgaaacccaacgcaagctcgtgt

SEQ ID NO: 731265 - DNA, 25 bp, Mus musculus
gttgaaacccaaggcaagctcgtgt

SEQ ID NO: 731266 - DNA, 25 bp, Mus musculus
gttgaaacggatcagacaccacaca

SEQ ID NO: 731267 - DNA, 25 bp, Mus musculus
gttgaaacggatgagacaccacaca

SEQ ID NO: 731268 - DNA, 25 bp, Mus musculus
gttgaaactcagcttgggcttcgcc

SEQ ID NO: 731269 - DNA, 25 bp, Mus musculus
gttgaaactcaggttgggcttcgcc

SEQ ID NO: 731270 - DNA, 25 bp, Mus musculus
gttgaaactgacaagcttctcctga

SEQ ID NO: 731271 - DNA, 25 bp, Mus musculus
gttgaaactgactagcttctcctga

SEQ ID NO: 731272 - DNA, 25 bp, Mus musculus
gttgaaagactaccagcgcggcctg

SEQ ID NO: 731273 - DNA, 25 bp, Mus musculus
gttgaaagactagcagcgcggcctg

SEQ ID NO: 731274 - DNA, 25 bp, Mus musculus
gttgaaagcacccattacctagtag

SEQ ID NO: 731275 - DNA, 25 bp, Mus musculus
gttgaaagcaccgattacctagtag

SEQ ID NO: 731276 - DNA, 25 bp, Mus musculus
gttgaaagccacagctctagagcca

SEQ ID NO: 731277 - DNA, 25 bp, Mus musculus
gttgaaagccactgctctagagcca

SEQ ID NO: 731278 - DNA, 25 bp, Mus musculus
gttgaaagccttctggcaagaatct

SEQ ID NO: 731279 - DNA, 25 bp, Mus musculus
gttgaaagccttgtggcaagaatct

SEQ ID NO: 731280 - DNA, 25 bp, Mus musculus
gttgaaagctctcctaagttactga

SEQ ID NO: 731281 - DNA, 25 bp, Mus musculus
gttgaaagctctgctaagttactga

SEQ ID NO: 731282 - DNA, 25 bp, Mus musculus
gttgaaagcttccattttaattcat

SEQ ID NO: 731283 - DNA, 25 bp, Mus musculus
gttgaaagcttcgattttaattcat

SEQ ID NO: 731284 - DNA, 25 bp, Mus musculus
gttgaaaggcccaaggcaagcctgc

SEQ ID NO: 731285 - DNA, 25 bp, Mus musculus
gttgaaaggccctaggcaagcctgc

SEQ ID NO: 731286 - DNA, 25 bp, Mus musculus
gttgaaagtgtaagcttctaataaa

SEQ ID NO: 731287 - DNA, 25 bp, Mus musculus
gttgaaagtgtatgcttctaataaa

SEQ ID NO: 731288 - DNA, 25 bp, Mus musculus
gttgaaataacacctctcctacata

SEQ ID NO: 731289 - DNA, 25 bp, Mus musculus
gttgaaataacagctctcctacata

SEQ ID NO: 731290 - DNA, 25 bp, Mus musculus
gttgaaataccacctctactaaaag

SEQ ID NO: 731291 - DNA, 25 bp, Mus musculus
gttgaaataccagctctactaaaag

SEQ ID NO: 731292 - DNA, 25 bp, Mus musculus
gttgaaatattaaccctcgctcttt

SEQ ID NO: 731293 - DNA, 25 bp, Mus musculus
gttgaaatattatccctcgctcttt

SEQ ID NO: 731294 - DNA, 25 bp, Mus musculus
gttgaaatcccacttttgtgaggac

SEQ ID NO: 731295 - DNA, 25 bp, Mus musculus
gttgaaatcccagttttgtgaggac

SEQ ID NO: 731296 - DNA, 25 bp, Mus musculus
gttgaaatccttagaccagcatatt

SEQ ID NO: 731297 - DNA, 25 bp, Mus musculus
gttgaaatcctttgaccagcatatt

SEQ ID NO: 731298 - DNA, 25 bp, Mus musculus
gttgaaatctgtcgtcccaggtgga

SEQ ID NO: 731299 - DNA, 25 bp, Mus musculus
gttgaaatctgtggtcccaggtgga

SEQ ID NO: 731300 - DNA, 25 bp, Mus musculus
gttgaaatggttccatcctccatcg

SEQ ID NO: 731301 - DNA, 25 bp, Mus musculus
gttgaaatggttgcatcctccatcg

SEQ ID NO: 731302 - DNA, 25 bp, Mus musculus
gttgaaatgtgcagttgtgtggttt

SEQ ID NO: 731303 - DNA, 25 bp, Mus musculus
gttgaaatgtgctgttgtgtggttt

SEQ ID NO: 731304 - DNA, 25 bp, Mus musculus
gttgaaattcctatgtggacgccga

SEQ ID NO: 731305 - DNA, 25 bp, Mus musculus
gttgaaattcctttgtggacgccga

SEQ ID NO: 731306 - DNA, 25 bp, Mus musculus
gttgaaattgctcgtccttacatgt

SEQ ID NO: 731307 - DNA, 25 bp, Mus musculus
gttgaaattgctggtccttacatgt

SEQ ID NO: 731308 - DNA, 25 bp, Mus musculus
gttgaaatttctaccacatgcaatg

SEQ ID NO: 731309 - DNA, 25 bp, Mus musculus
gttgaaatttcttccacatgcaatg

SEQ ID NO: 731310 - DNA, 25 bp, Mus musculus
gttgaacaaacgcatttcctttctt

SEQ ID NO: 731311 - DNA, 25 bp, Mus musculus
gttgaacaaacggatttcctttctt

SEQ ID NO: 731312 - DNA, 25 bp, Mus musculus
gttgaacaagatagactcttagatg

SEQ ID NO: 731313 - DNA, 25 bp, Mus musculus
gttgaacaagattgactcttagatg

SEQ ID NO: 731314 - DNA, 25 bp, Mus musculus
gttgaacaagctattctgtgattta

SEQ ID NO: 731315 - DNA, 25 bp, Mus musculus
gttgaacaagcttttctgtgattta

SEQ ID NO: 731316 - DNA, 25 bp, Mus musculus
gttgaacacaaacctgtcaggctga

SEQ ID NO: 731317 - DNA, 25 bp, Mus musculus
gttgaacacaaagctgtcaggctga

SEQ ID NO: 731318 - DNA, 25 bp, Mus musculus
gttgaacacatgatgcagacctaga

SEQ ID NO: 731319 - DNA, 25 bp, Mus musculus
gttgaacacatgttgcagacctaga

SEQ ID NO: 731320 - DNA, 25 bp, Mus musculus
gttgaacaccacagatctggcttct

SEQ ID NO: 731321 - DNA, 25 bp, Mus musculus
gttgaacaccactgatctggcttct

SEQ ID NO: 731322 - DNA, 25 bp, Mus musculus
gttgaacactcaagatttttgcttt

SEQ ID NO: 731323 - DNA, 25 bp, Mus musculus
gttgaacactcatgatttttgcttt

SEQ ID NO: 731324 - DNA, 25 bp, Mus musculus
gttgaacactctacatcttgggcct

SEQ ID NO: 731325 - DNA, 25 bp, Mus musculus
gttgaacactcttcatcttgggcct

SEQ ID NO: 731326 - DNA, 25 bp, Mus musculus
gttgaacagatacagagcttccata

SEQ ID NO: 731327 - DNA, 25 bp, Mus musculus
gttgaacagatagagagcttccata

SEQ ID NO: 731328 - DNA, 25 bp, Mus musculus
gttgaacagcaaattaccctatggc

SEQ ID NO: 731329 - DNA, 25 bp, Mus musculus
gttgaacagcaatttaccctatggc

SEQ ID NO: 731330 - DNA, 25 bp, Mus musculus
gttgaacagcacaatgtatctcggg

SEQ ID NO: 731331 - DNA, 25 bp, Mus musculus
gttgaacagcacactttagccaagt

SEQ ID NO: 731332 - DNA, 25 bp, Mus musculus
gttgaacagcactatgtatctcggg

SEQ ID NO: 731333 - DNA, 25 bp, Mus musculus
gttgaacagcactctttagccaagt

SEQ ID NO: 731334 - DNA, 25 bp, Mus musculus
gttgaacatcaactacccttcaggg

SEQ ID NO: 731335 - DNA, 25 bp, Mus musculus
gttgaacatcaagtacccttcaggg

SEQ ID NO: 731336 - DNA, 25 bp, Mus musculus
gttgaaccaaaacttgtatgcatct

SEQ ID NO: 731337 - DNA, 25 bp, Mus musculus
gttgaaccaaaagttgtatgcatct

SEQ ID NO: 731338 - DNA, 25 bp, Mus musculus
gttgaaccaagcagagtaacctgca

SEQ ID NO: 731339 - DNA, 25 bp, Mus musculus
gttgaaccaagctgagtaacctgca

SEQ ID NO: 731340 - DNA, 25 bp, Mus musculus
gttgaaccacggaccagtagtagca

SEQ ID NO: 731341 - DNA, 25 bp, Mus musculus
gttgaaccacggtccagtagtagca

SEQ ID NO: 731342 - DNA, 25 bp, Mus musculus
gttgaaccggttcctgggagactat

SEQ ID NO: 731343 - DNA, 25 bp, Mus musculus
gttgaaccggttgctgggagactat

SEQ ID NO: 731344 - DNA, 25 bp, Mus musculus
gttgaacctcaccaaaagctttctc

SEQ ID NO: 731345 - DNA, 25 bp, Mus musculus
gttgaacctcacgaaaagctttctc

SEQ ID NO: 731346 - DNA, 25 bp, Mus musculus
gttgaacctcccatcaggtgtgact

SEQ ID NO: 731347 - DNA, 25 bp, Mus musculus
gttgaacctcccttcaggtgtgact

SEQ ID NO: 731348 - DNA, 25 bp, Mus musculus
gttgaacctggtatgaggtgctttt

SEQ ID NO: 731349 - DNA, 25 bp, Mus musculus
gttgaacctggtttgaggtgctttt

SEQ ID NO: 731350 - DNA, 25 bp, Mus musculus
gttgaaccttaaacctttcctgatg

SEQ ID NO: 731351 - DNA, 25 bp, Mus musculus
gttgaaccttaatcctttcctgatg

SEQ ID NO: 731352 - DNA, 25 bp, Mus musculus
gttgaactacctcgaccacaatttg

SEQ ID NO: 731353 - DNA, 25 bp, Mus musculus
gttgaactacctggaccacaatttg

SEQ ID NO: 731354 - DNA, 25 bp, Mus musculus
gttgaactaggcactgtccgtgaaa

SEQ ID NO: 731355 - DNA, 25 bp, Mus musculus
gttgaactaggctctgtccgtgaaa

SEQ ID NO: 731356 - DNA, 25 bp, Mus musculus
gttgaactatatattgagaatctat

SEQ ID NO: 731357 - DNA, 25 bp, Mus musculus
gttgaactatattttgagaatctat

SEQ ID NO: 731358 - DNA, 25 bp, Mus musculus
gttgaactatgaattgtattctatt

SEQ ID NO: 731359 - DNA, 25 bp, Mus musculus
gttgaactatgatttgtattctatt

SEQ ID NO: 731360 - DNA, 25 bp, Mus musculus
gttgaactatgcagaagagggaaag

SEQ ID NO: 731361 - DNA, 25 bp, Mus musculus
gttgaactatgctgaagagggaaag

SEQ ID NO: 731362 - DNA, 25 bp, Mus musculus
gttgaactcgcaagcagcagaggct

SEQ ID NO: 731363 - DNA, 25 bp, Mus musculus
gttgaactcgcatgcagcagaggct

SEQ ID NO: 731364 - DNA, 25 bp, Mus musculus
gttgaactctggactacacatacat

SEQ ID NO: 731365 - DNA, 25 bp, Mus musculus
gttgaactctggtctacacatacat

SEQ ID NO: 731366 - DNA, 25 bp, Mus musculus
gttgaactgattatccaagtctctc

SEQ ID NO: 731367 - DNA, 25 bp, Mus musculus
gttgaactgattatgcctctttgct

SEQ ID NO: 731368 - DNA, 25 bp, Mus musculus
gttgaactgattttccaagtctctc

SEQ ID NO: 731369 - DNA, 25 bp, Mus musculus
gttgaactgattttgcctctttgct

SEQ ID NO: 731370 - DNA, 25 bp, Mus musculus
gttgaactgcttcacacaatcctat

SEQ ID NO: 731371 - DNA, 25 bp, Mus musculus
gttgaactgcttgacacaatcctat

SEQ ID NO: 731372 - DNA, 25 bp, Mus musculus
gttgaactgtagctagtgaaactat

SEQ ID NO: 731373 - DNA, 25 bp, Mus musculus
gttgaactgtaggtagtgaaactat

SEQ ID NO: 731374 - DNA, 25 bp, Mus musculus
gttgaactgtatatagatctccata

SEQ ID NO: 731375 - DNA, 25 bp, Mus musculus
gttgaactgtatttagatctccata

SEQ ID NO: 731376 - DNA, 25 bp, Mus musculus
gttgaactgtgaacaggaggcccag

SEQ ID NO: 731377 - DNA, 25 bp, Mus musculus
gttgaactgtgatcaggaggcccag

SEQ ID NO: 731378 - DNA, 25 bp, Mus musculus
gttgaacttacactgctcacctgag

SEQ ID NO: 731379 - DNA, 25 bp, Mus musculus
gttgaacttacagtgctcacctgag

SEQ ID NO: 731380 - DNA, 25 bp, Mus musculus
gttgaacttcgaacaagtaactggg

SEQ ID NO: 731381 - DNA, 25 bp, Mus musculus
gttgaacttcgatcaagtaactggg

SEQ ID NO: 731382 - DNA, 25 bp, Mus musculus
gttgaacttgttcttagggtgacta

SEQ ID NO: 731383 - DNA, 25 bp, Mus musculus
gttgaacttgttgttagggtgacta

SEQ ID NO: 731384 - DNA, 25 bp, Mus musculus
gttgaactttatatgttctgccctc

SEQ ID NO: 731385 - DNA, 25 bp, Mus musculus
gttgaactttatttgttctgccctc

SEQ ID NO: 731386 - DNA, 25 bp, Mus musculus
gttgaagaacctctagactgctgtt

SEQ ID NO: 731387 - DNA, 25 bp, Mus musculus
gttgaagaacctgtagactgctgtt

SEQ ID NO: 731388 - DNA, 25 bp, Mus musculus
gttgaagaattcaccactctggtgg

SEQ ID NO: 731389 - DNA, 25 bp, Mus musculus
gttgaagaattctccactctggtgg

SEQ ID NO: 731390 - DNA, 25 bp, Mus musculus
gttgaagacctcagcttcacgctaa

SEQ ID NO: 731391 - DNA, 25 bp, Mus musculus
gttgaagacctctgcttcacgctaa

SEQ ID NO: 731392 - DNA, 25 bp, Mus musculus
gttgaagatgttctgcatcatgcag

SEQ ID NO: 731393 - DNA, 25 bp, Mus musculus
gttgaagatgttgtgcatcatgcag

SEQ ID NO: 731394 - DNA, 25 bp, Mus musculus
gttgaagcaagaactctcctagctg

SEQ ID NO: 731395 - DNA, 25 bp, Mus musculus
gttgaagcaagatctctcctagctg

SEQ ID NO: 731396 - DNA, 25 bp, Mus musculus
gttgaagcaaggcatctcactgagc

SEQ ID NO: 731397 - DNA, 25 bp, Mus musculus
gttgaagcaagggatctcactgagc

SEQ ID NO: 731398 - DNA, 25 bp, Mus musculus
gttgaagcagatacgggaccccgag

SEQ ID NO: 731399 - DNA, 25 bp, Mus musculus
gttgaagcagatataccgaagttta

SEQ ID NO: 731400 - DNA, 25 bp, Mus musculus
gttgaagcagattcgggaccccgag

SEQ ID NO: 731401 - DNA, 25 bp, Mus musculus
gttgaagcagatttaccgaagttta

SEQ ID NO: 731402 - DNA, 25 bp, Mus musculus
gttgaagcatccagcactgactcta

SEQ ID NO: 731403 - DNA, 25 bp, Mus musculus
gttgaagcatcctgcactgactcta

SEQ ID NO: 731404 - DNA, 25 bp, Mus musculus
gttgaagcattcctggccaattgaa

SEQ ID NO: 731405 - DNA, 25 bp, Mus musculus
gttgaagcattcgtggccaattgaa

SEQ ID NO: 731406 - DNA, 25 bp, Mus musculus
gttgaagcatttcaggttatctctt

SEQ ID NO: 731407 - DNA, 25 bp, Mus musculus
gttgaagcatttgaggttatctctt

SEQ ID NO: 731408 - DNA, 25 bp, Mus musculus
gttgaagccctgagcagacacactc

SEQ ID NO: 731409 - DNA, 25 bp, Mus musculus
gttgaagccctgtgcagacacactc

SEQ ID NO: 731410 - DNA, 25 bp, Mus musculus
gttgaagcgccaactccacaggtgt

SEQ ID NO: 731411 - DNA, 25 bp, Mus musculus
gttgaagcgccatctccacaggtgt

SEQ ID NO: 731412 - DNA, 25 bp, Mus musculus
gttgaagcgtctattctgaagcatt

SEQ ID NO: 731413 - DNA, 25 bp, Mus musculus
gttgaagcgtcttttctgaagcatt

SEQ ID NO: 731414 - DNA, 25 bp, Mus musculus
gttgaagctacacggctaacaccat

SEQ ID NO: 731415 - DNA, 25 bp, Mus musculus
gttgaagctacagggctaacaccat

SEQ ID NO: 731416 - DNA, 25 bp, Mus musculus
gttgaagctcatattaagactcgtt

SEQ ID NO: 731417 - DNA, 25 bp, Mus musculus
gttgaagctcattttaagactcgtt

SEQ ID NO: 731418 - DNA, 25 bp, Mus musculus
gttgaagctcgccatggaccttaaa

SEQ ID NO: 731419 - DNA, 25 bp, Mus musculus
gttgaagctcgcgatggaccttaaa

SEQ ID NO: 731420 - DNA, 25 bp, Mus musculus
gttgaagctgctcttgacagacaag

SEQ ID NO: 731421 - DNA, 25 bp, Mus musculus
gttgaagctgctgttgacagacaag

SEQ ID NO: 731422 - DNA, 25 bp, Mus musculus
gttgaaggaattctcttacccaggg

SEQ ID NO: 731423 - DNA, 25 bp, Mus musculus
gttgaaggaattgtcttacccaggg

SEQ ID NO: 731424 - DNA, 25 bp, Mus musculus
gttgaaggacacattcctggtgccc

SEQ ID NO: 731425 - DNA, 25 bp, Mus musculus
gttgaaggacactttcctggtgccc

SEQ ID NO: 731426 - DNA, 25 bp, Mus musculus
gttgaaggacttcgccacacagcga

SEQ ID NO: 731427 - DNA, 25 bp, Mus musculus
gttgaaggacttggccacacagcga

SEQ ID NO: 731428 - DNA, 25 bp, Mus musculus
gttgaaggcacaccctgaagaccct

SEQ ID NO: 731429 - DNA, 25 bp, Mus musculus
gttgaaggcacagcctgaagaccct

SEQ ID NO: 731430 - DNA, 25 bp, Mus musculus
gttgaaggcagaatagctgcttatt

SEQ ID NO: 731431 - DNA, 25 bp, Mus musculus
gttgaaggcagattagctgcttatt

SEQ ID NO: 731432 - DNA, 25 bp, Mus musculus
gttgaaggctagctaccccaactct

SEQ ID NO: 731433 - DNA, 25 bp, Mus musculus
gttgaaggctaggtaccccaactct

SEQ ID NO: 731434 - DNA, 25 bp, Mus musculus
gttgaaggctgaaattttactgaaa

SEQ ID NO: 731435 - DNA, 25 bp, Mus musculus
gttgaaggctgatattttactgaaa

SEQ ID NO: 731436 - DNA, 25 bp, Mus musculus
gttgaagggacactcagcatctgaa

SEQ ID NO: 731437 - DNA, 25 bp, Mus musculus
gttgaagggacagtcagcatctgaa

SEQ ID NO: 731438 - DNA, 25 bp, Mus musculus
gttgaagggctaaacttatctctaa

SEQ ID NO: 731439 - DNA, 25 bp, Mus musculus
gttgaagggctatacttatctctaa

SEQ ID NO: 731440 - DNA, 25 bp, Mus musculus
gttgaaggtcacagttgcagagtat

SEQ ID NO: 731441 - DNA, 25 bp, Mus musculus
gttgaaggtcactgttgcagagtat

SEQ ID NO: 731442 - DNA, 25 bp, Mus musculus
gttgaaggtgtacccatccctgggc

SEQ ID NO: 731443 - DNA, 25 bp, Mus musculus
gttgaaggtgtagccatccctgggc

SEQ ID NO: 731444 - DNA, 25 bp, Mus musculus
gttgaaggttgcattccacactggc

SEQ ID NO: 731445 - DNA, 25 bp, Mus musculus
gttgaaggttgctttccacactggc

SEQ ID NO: 731446 - DNA, 25 bp, Mus musculus
gttgaagtcactatatcgcagctta

SEQ ID NO: 731447 - DNA, 25 bp, Mus musculus
gttgaagtcactttatcgcagctta

SEQ ID NO: 731448 - DNA, 25 bp, Mus musculus
gttgaagtcccactgttggcagttt

SEQ ID NO: 731449 - DNA, 25 bp, Mus musculus
gttgaagtcccagtgttggcagttt

SEQ ID NO: 731450 - DNA, 25 bp, Mus musculus
gttgaagtctatacttaattttgtt

SEQ ID NO: 731451 - DNA, 25 bp, Mus musculus
gttgaagtctattcttaattttgtt

SEQ ID NO: 731452 - DNA, 25 bp, Mus musculus
gttgaagtgattattggtagccatg

SEQ ID NO: 731453 - DNA, 25 bp, Mus musculus
gttgaagtgatttttggtagccatg

SEQ ID NO: 731454 - DNA, 25 bp, Mus musculus
gttgaagtggtgcagtttcctaaca

SEQ ID NO: 731455 - DNA, 25 bp, Mus musculus
gttgaagtggtggagtttcctaaca

SEQ ID NO: 731456 - DNA, 25 bp, Mus musculus
gttgaagtgtttatccccaataagt

SEQ ID NO: 731457 - DNA, 25 bp, Mus musculus
gttgaagtgtttttccccaataagt

SEQ ID NO: 731458 - DNA, 25 bp, Mus musculus
gttgaagttaagatttacagcaccg

SEQ ID NO: 731459 - DNA, 25 bp, Mus musculus
gttgaagttaagttttacagcaccg

SEQ ID NO: 731460 - DNA, 25 bp, Mus musculus
gttgaagtttacaaccctcattcag

SEQ ID NO: 731461 - DNA, 25 bp, Mus musculus
gttgaagtttactaccctcattcag

SEQ ID NO: 731462 - DNA, 25 bp, Mus musculus
gttgaagttttaatctccattcaca

SEQ ID NO: 731463 - DNA, 25 bp, Mus musculus
gttgaagttttattctccattcaca

SEQ ID NO: 731464 - DNA, 25 bp, Mus musculus
gttgaatatatgaccatcccaggcc

SEQ ID NO: 731465 - DNA, 25 bp, Mus musculus
gttgaatatatgtccatcccaggcc

SEQ ID NO: 731466 - DNA, 25 bp, Mus musculus
gttgaatatgcaattttgtttaaag

SEQ ID NO: 731467 - DNA, 25 bp, Mus musculus
gttgaatatgcatttttgtttaaag

SEQ ID NO: 731468 - DNA, 25 bp, Mus musculus
gttgaatatggccagtcctccagat

SEQ ID NO: 731469 - DNA, 25 bp, Mus musculus
gttgaatatggcgagtcctccagat

SEQ ID NO: 731470 - DNA, 25 bp, Mus musculus
gttgaatattttcttcaggcatcag

SEQ ID NO: 731471 - DNA, 25 bp, Mus musculus
gttgaatattttgttcaggcatcag

SEQ ID NO: 731472 - DNA, 25 bp, Mus musculus
gttgaatccactcatttatactctg

SEQ ID NO: 731473 - DNA, 25 bp, Mus musculus
gttgaatccactgatttatactctg

SEQ ID NO: 731474 - DNA, 25 bp, Mus musculus
gttgaatcctctcatttacactttg

SEQ ID NO: 731475 - DNA, 25 bp, Mus musculus
gttgaatcctctgatttacactttg

SEQ ID NO: 731476 - DNA, 25 bp, Mus musculus
gttgaatctaacaggcactcttcca

SEQ ID NO: 731477 - DNA, 25 bp, Mus musculus
gttgaatctaactggcactcttcca

SEQ ID NO: 731478 - DNA, 25 bp, Mus musculus
gttgaatctggtattctaactgcca

SEQ ID NO: 731479 - DNA, 25 bp, Mus musculus
gttgaatctggttttctaactgcca

SEQ ID NO: 731480 - DNA, 25 bp, Mus musculus
gttgaatcttgaacatcttcctctc

SEQ ID NO: 731481 - DNA, 25 bp, Mus musculus
gttgaatcttgatcatcttcctctc

SEQ ID NO: 731482 - DNA, 25 bp, Mus musculus
gttgaatgacaacaagaccctagag

SEQ ID NO: 731483 - DNA, 25 bp, Mus musculus
gttgaatgacaagaagaccctagag

SEQ ID NO: 731484 - DNA, 25 bp, Mus musculus
gttgaatgcttaaccattgtaaaca

SEQ ID NO: 731485 - DNA, 25 bp, Mus musculus
gttgaatgcttatccattgtaaaca

SEQ ID NO: 731486 - DNA, 25 bp, Mus musculus
gttgaatggattatgtacttgttta

SEQ ID NO: 731487 - DNA, 25 bp, Mus musculus
gttgaatggattttgtacttgttta

SEQ ID NO: 731488 - DNA, 25 bp, Mus musculus
gttgaatggctcattagtccctctt

SEQ ID NO: 731489 - DNA, 25 bp, Mus musculus
gttgaatggctctttagtccctctt

SEQ ID NO: 731490 - DNA, 25 bp, Mus musculus
gttgaatgtacacattacctttctg

SEQ ID NO: 731491 - DNA, 25 bp, Mus musculus
gttgaatgtacagattacctttctg

SEQ ID NO: 731492 - DNA, 25 bp, Mus musculus
gttgaatgtccacagccatagagta

SEQ ID NO: 731493 - DNA, 25 bp, Mus musculus
gttgaatgtccagagccatagagta

SEQ ID NO: 731494 - DNA, 25 bp, Mus musculus
gttgaatgtcttctatgtggcatat

SEQ ID NO: 731495 - DNA, 25 bp, Mus musculus
gttgaatgtcttgtatgtggcatat

SEQ ID NO: 731496 - DNA, 25 bp, Mus musculus
gttgaattagccctgggtccagtct

SEQ ID NO: 731497 - DNA, 25 bp, Mus musculus
gttgaattagccgtgggtccagtct

SEQ ID NO: 731498 - DNA, 25 bp, Mus musculus
gttgaattcactaactgcatatggt

SEQ ID NO: 731499 - DNA, 25 bp, Mus musculus
gttgaattcacttactgcatatggt

SEQ ID NO: 731500 - DNA, 25 bp, Mus musculus
gttgaattccctagaactgtgtttc

SEQ ID NO: 731501 - DNA, 25 bp, Mus musculus
gttgaattcccttgaactgtgtttc

SEQ ID NO: 731502 - DNA, 25 bp, Mus musculus
gttgaattcttactctcttgtgctg

SEQ ID NO: 731503 - DNA, 25 bp, Mus musculus
gttgaattcttagtctcttgtgctg

SEQ ID NO: 731504 - DNA, 25 bp, Mus musculus
gttgacaaaaccaagagctgtattt

SEQ ID NO: 731505 - DNA, 25 bp, Mus musculus
gttgacaaaacccatggcatttctg

SEQ ID NO: 731506 - DNA, 25 bp, Mus musculus
gttgacaaaaccgatggcatttctg

SEQ ID NO: 731507 - DNA, 25 bp, Mus musculus
gttgacaaaacctagagctgtattt

SEQ ID NO: 731508 - DNA, 25 bp, Mus musculus
gttgacaaacgtctgtccacgttct

SEQ ID NO: 731509 - DNA, 25 bp, Mus musculus
gttgacaaacgtgtgtccacgttct

SEQ ID NO: 731510 - DNA, 25 bp, Mus musculus
gttgacaactgaaattgccctccca

SEQ ID NO: 731511 - DNA, 25 bp, Mus musculus
gttgacaactgatattgccctccca

SEQ ID NO: 731512 - DNA, 25 bp, Mus musculus
gttgacaagttgagaggattccttc

SEQ ID NO: 731513 - DNA, 25 bp, Mus musculus
gttgacaagttgctggcctctgtac

SEQ ID NO: 731514 - DNA, 25 bp, Mus musculus
gttgacaagttggtggcctctgtac

SEQ ID NO: 731515 - DNA, 25 bp, Mus musculus
gttgacaagttgtgaggattccttc

SEQ ID NO: 731516 - DNA, 25 bp, Mus musculus
gttgacaataccactttccctaatg

SEQ ID NO: 731517 - DNA, 25 bp, Mus musculus
gttgacaatacctctttccctaatg

SEQ ID NO: 731518 - DNA, 25 bp, Mus musculus
gttgacaatcaaataggccatccta

SEQ ID NO: 731519 - DNA, 25 bp, Mus musculus
gttgacaatcaattaggccatccta

SEQ ID NO: 731520 - DNA, 25 bp, Mus musculus
gttgacaatgaacagctgatgtttt

SEQ ID NO: 731521 - DNA, 25 bp, Mus musculus
gttgacaatgaagagctgatgtttt

SEQ ID NO: 731522 - DNA, 25 bp, Mus musculus
gttgacacagagcaggtccttcctg

SEQ ID NO: 731523 - DNA, 25 bp, Mus musculus
gttgacacagaggaggtccttcctg

SEQ ID NO: 731524 - DNA, 25 bp, Mus musculus
gttgacacagatctgacccgtggat

SEQ ID NO: 731525 - DNA, 25 bp, Mus musculus
gttgacacagatgtgacccgtggat

SEQ ID NO: 731526 - DNA, 25 bp, Mus musculus
gttgacacatttacagttgaccatt

SEQ ID NO: 731527 - DNA, 25 bp, Mus musculus
gttgacacattttcagttgaccatt

SEQ ID NO: 731528 - DNA, 25 bp, Mus musculus
gttgacacccaactgtacccagagt

SEQ ID NO: 731529 - DNA, 25 bp, Mus musculus
gttgacacccaagtgtacccagagt

SEQ ID NO: 731530 - DNA, 25 bp, Mus musculus
gttgacacccacatatggaatcaat

SEQ ID NO: 731531 - DNA, 25 bp, Mus musculus
gttgacacccacttatggaatcaat

SEQ ID NO: 731532 - DNA, 25 bp, Mus musculus
gttgacacctaactattatctagca

SEQ ID NO: 731533 - DNA, 25 bp, Mus musculus
gttgacacctaagtattatctagca

SEQ ID NO: 731534 - DNA, 25 bp, Mus musculus
gttgacacctgcagggattggcttg

SEQ ID NO: 731535 - DNA, 25 bp, Mus musculus
gttgacacctgctgggattggcttg

SEQ ID NO: 731536 - DNA, 25 bp, Mus musculus
gttgacactacactggctggatttc

SEQ ID NO: 731537 - DNA, 25 bp, Mus musculus
gttgacactacagtggctggatttc

SEQ ID NO: 731538 - DNA, 25 bp, Mus musculus
gttgacactgggatgcagtcctttt

SEQ ID NO: 731539 - DNA, 25 bp, Mus musculus
gttgacactgggttgcagtcctttt

SEQ ID NO: 731540 - DNA, 25 bp, Mus musculus
gttgacactgtacctcatactggaa

SEQ ID NO: 731541 - DNA, 25 bp, Mus musculus
gttgacactgtagctcatactggaa

SEQ ID NO: 731542 - DNA, 25 bp, Mus musculus
gttgacagaagacgttgttccctcc

SEQ ID NO: 731543 - DNA, 25 bp, Mus musculus
gttgacagaagaggttgttccctcc

SEQ ID NO: 731544 - DNA, 25 bp, Mus musculus
gttgacagaagcagtttccacatga

SEQ ID NO: 731545 - DNA, 25 bp, Mus musculus
gttgacagaagctgtttccacatga

SEQ ID NO: 731546 - DNA, 25 bp, Mus musculus
gttgacagatagaggtggcacacat

SEQ ID NO: 731547 - DNA, 25 bp, Mus musculus
gttgacagatagtggtggcacacat

SEQ ID NO: 731548 - DNA, 25 bp, Mus musculus
gttgacagcaggactgggcttccag

SEQ ID NO: 731549 - DNA, 25 bp, Mus musculus
gttgacagcaggtctgggcttccag

SEQ ID NO: 731550 - DNA, 25 bp, Mus musculus
gttgacagctgactccgagcaggct

SEQ ID NO: 731551 - DNA, 25 bp, Mus musculus
gttgacagctgagtccgagcaggct

SEQ ID NO: 731552 - DNA, 25 bp, Mus musculus
gttgacagggatcagactggctcct

SEQ ID NO: 731553 - DNA, 25 bp, Mus musculus
gttgacagggatgagactggctcct

SEQ ID NO: 731554 - DNA, 25 bp, Mus musculus
gttgacagtcaacagttaccataaa

SEQ ID NO: 731555 - DNA, 25 bp, Mus musculus
gttgacagtcaagagttaccataaa

SEQ ID NO: 731556 - DNA, 25 bp, Mus musculus
gttgacagtcataattacccaccat

SEQ ID NO: 731557 - DNA, 25 bp, Mus musculus
gttgacagtcataggctggacagca

SEQ ID NO: 731558 - DNA, 25 bp, Mus musculus
gttgacagtcattattacccaccat

SEQ ID NO: 731559 - DNA, 25 bp, Mus musculus
gttgacagtcattggctggacagca

SEQ ID NO: 731560 - DNA, 25 bp, Mus musculus
gttgacatacacaagtcctccaagg

SEQ ID NO: 731561 - DNA, 25 bp, Mus musculus
gttgacatacactagtcctccaagg

SEQ ID NO: 731562 - DNA, 25 bp, Mus musculus
gttgacatagagctgcttctgtgta

SEQ ID NO: 731563 - DNA, 25 bp, Mus musculus
gttgacatagaggtgcttctgtgta

SEQ ID NO: 731564 - DNA, 25 bp, Mus musculus
gttgacatatatacaggcctcctct

SEQ ID NO: 731565 - DNA, 25 bp, Mus musculus
gttgacatatattcaggcctcctct

SEQ ID NO: 731566 - DNA, 25 bp, Mus musculus
gttgacatccaacaatggccatcat

SEQ ID NO: 731567 - DNA, 25 bp, Mus musculus
gttgacatccaagaatggccatcat

SEQ ID NO: 731568 - DNA, 25 bp, Mus musculus
gttgacatccataccccatatagaa

SEQ ID NO: 731569 - DNA, 25 bp, Mus musculus
gttgacatccattccccatatagaa

SEQ ID NO: 731570 - DNA, 25 bp, Mus musculus
gttgacatctcaaaaacgtctggtt

SEQ ID NO: 731571 - DNA, 25 bp, Mus musculus
gttgacatctcaactaaacatgcaa

SEQ ID NO: 731572 - DNA, 25 bp, Mus musculus
gttgacatctcataaacgtctggtt

SEQ ID NO: 731573 - DNA, 25 bp, Mus musculus
gttgacatctcatctaaacatgcaa

SEQ ID NO: 731574 - DNA, 25 bp, Mus musculus
gttgacatctggcttcagccttgat

SEQ ID NO: 731575 - DNA, 25 bp, Mus musculus
gttgacatctgggttcagccttgat

SEQ ID NO: 731576 - DNA, 25 bp, Mus musculus
gttgacatgtacctcaagctgctac

SEQ ID NO: 731577 - DNA, 25 bp, Mus musculus
gttgacatgtacgtcaagctgctac

SEQ ID NO: 731578 - DNA, 25 bp, Mus musculus
gttgacatgtctattctcctatgca

SEQ ID NO: 731579 - DNA, 25 bp, Mus musculus
gttgacatgtcttttctcctatgca

SEQ ID NO: 731580 - DNA, 25 bp, Mus musculus
gttgacattcacaatcttactggta

SEQ ID NO: 731581 - DNA, 25 bp, Mus musculus
gttgacattcactatcttactggta

SEQ ID NO: 731582 - DNA, 25 bp, Mus musculus
gttgacattcctattagaagttgtg

SEQ ID NO: 731583 - DNA, 25 bp, Mus musculus
gttgacattccttttagaagttgtg

SEQ ID NO: 731584 - DNA, 25 bp, Mus musculus
gttgacattgagaagagacacagca

SEQ ID NO: 731585 - DNA, 25 bp, Mus musculus
gttgacattgagtagagacacagca

SEQ ID NO: 731586 - DNA, 25 bp, Mus musculus
gttgacattgtcatgaaccatcact

SEQ ID NO: 731587 - DNA, 25 bp, Mus musculus
gttgacattgtcttgaaccatcact

SEQ ID NO: 731588 - DNA, 25 bp, Mus musculus
gttgacatttgcaactgtgtgcttt

SEQ ID NO: 731589 - DNA, 25 bp, Mus musculus
gttgacatttgctactgtgtgcttt

SEQ ID NO: 731590 - DNA, 25 bp, Mus musculus
gttgacatttgtatggttatagtgc

SEQ ID NO: 731591 - DNA, 25 bp, Mus musculus
gttgacatttgtttggttatagtgc

SEQ ID NO: 731592 - DNA, 25 bp, Mus musculus
gttgacattttcagaccctgtgtct

SEQ ID NO: 731593 - DNA, 25 bp, Mus musculus
gttgacattttctgaccctgtgtct

SEQ ID NO: 731594 - DNA, 25 bp, Mus musculus
gttgacatttttagaaagctggttt

SEQ ID NO: 731595 - DNA, 25 bp, Mus musculus
gttgacatttttctgaacacacata

SEQ ID NO: 731596 - DNA, 25 bp, Mus musculus
gttgacatttttgtgaacacacata

SEQ ID NO: 731597 - DNA, 25 bp, Mus musculus
gttgacattttttgaaagctggttt

SEQ ID NO: 731598 - DNA, 25 bp, Mus musculus
gttgaccaactaaccatgccaggag

SEQ ID NO: 731599 - DNA, 25 bp, Mus musculus
gttgaccaactatccatgccaggag

SEQ ID NO: 731600 - DNA, 25 bp, Mus musculus
gttgaccaaggcagacacgaactga

SEQ ID NO: 731601 - DNA, 25 bp, Mus musculus
gttgaccaaggctgacacgaactga

SEQ ID NO: 731602 - DNA, 25 bp, Mus musculus
gttgaccaatgcacgtgagtttcct

SEQ ID NO: 731603 - DNA, 25 bp, Mus musculus
gttgaccaatgctcgtgagtttcct

SEQ ID NO: 731604 - DNA, 25 bp, Mus musculus
gttgaccacatacagcaggcagctt

SEQ ID NO: 731605 - DNA, 25 bp, Mus musculus
gttgaccacatagagcaggcagctt

SEQ ID NO: 731606 - DNA, 25 bp, Mus musculus
gttgaccacatcacactgctggagg

SEQ ID NO: 731607 - DNA, 25 bp, Mus musculus
gttgaccacatctcactgctggagg

SEQ ID NO: 731608 - DNA, 25 bp, Mus musculus
gttgaccactctcatataattggaa

SEQ ID NO: 731609 - DNA, 25 bp, Mus musculus
gttgaccactctgatataattggaa

SEQ ID NO: 731610 - DNA, 25 bp, Mus musculus
gttgaccagaaacctcccgaataca

SEQ ID NO: 731611 - DNA, 25 bp, Mus musculus
gttgaccagaaagctcccgaataca

SEQ ID NO: 731612 - DNA, 25 bp, Mus musculus
gttgaccagagtcggaccaagtcca

SEQ ID NO: 731613 - DNA, 25 bp, Mus musculus
gttgaccagagtgggaccaagtcca

SEQ ID NO: 731614 - DNA, 25 bp, Mus musculus
gttgaccaggagatcatgaacatca

SEQ ID NO: 731615 - DNA, 25 bp, Mus musculus
gttgaccaggagttcatgaacatca

SEQ ID NO: 731616 - DNA, 25 bp, Mus musculus
gttgaccagggcagcgaccattaag

SEQ ID NO: 731617 - DNA, 25 bp, Mus musculus
gttgaccagggctgcgaccattaag

SEQ ID NO: 731618 - DNA, 25 bp, Mus musculus
gttgaccagttgaccaagaatgctt

SEQ ID NO: 731619 - DNA, 25 bp, Mus musculus
gttgaccagttgtccaagaatgctt

SEQ ID NO: 731620 - DNA, 25 bp, Mus musculus
gttgaccattgacattaaccatccc

SEQ ID NO: 731621 - DNA, 25 bp, Mus musculus
gttgaccattgagattaaccatccc

SEQ ID NO: 731622 - DNA, 25 bp, Mus musculus
gttgacccatacagttacccataaa

SEQ ID NO: 731623 - DNA, 25 bp, Mus musculus
gttgacccatactgttacccataaa

SEQ ID NO: 731624 - DNA, 25 bp, Mus musculus
gttgaccctgctaagcattcagaat

SEQ ID NO: 731625 - DNA, 25 bp, Mus musculus
gttgaccctgcttagcattcagaat

SEQ ID NO: 731626 - DNA, 25 bp, Mus musculus
gttgaccctggtatatggctgagca

SEQ ID NO: 731627 - DNA, 25 bp, Mus musculus
gttgaccctggtttatggctgagca

SEQ ID NO: 731628 - DNA, 25 bp, Mus musculus
gttgacccttcacacagagtgccct

SEQ ID NO: 731629 - DNA, 25 bp, Mus musculus
gttgacccttcagacagagtgccct

SEQ ID NO: 731630 - DNA, 25 bp, Mus musculus
gttgacctacctcctgaatttattc

SEQ ID NO: 731631 - DNA, 25 bp, Mus musculus
gttgacctacctgctgaatttattc

SEQ ID NO: 731632 - DNA, 25 bp, Mus musculus
gttgacctagggaatcctgtaccac

SEQ ID NO: 731633 - DNA, 25 bp, Mus musculus
gttgacctagggtatcctgtaccac

SEQ ID NO: 731634 - DNA, 25 bp, Mus musculus
gttgacctagtgaataccctaaaat

SEQ ID NO: 731635 - DNA, 25 bp, Mus musculus
gttgacctagtgtataccctaaaat

SEQ ID NO: 731636 - DNA, 25 bp, Mus musculus
gttgacctcaaacccattgtgtaag

SEQ ID NO: 731637 - DNA, 25 bp, Mus musculus
gttgacctcaaagccattgtgtaag

SEQ ID NO: 731638 - DNA, 25 bp, Mus musculus
gttgacctcattatattgccagaag

SEQ ID NO: 731639 - DNA, 25 bp, Mus musculus
gttgacctcattttattgccagaag

SEQ ID NO: 731640 - DNA, 25 bp, Mus musculus
gttgacctccagagtattgtgctca

SEQ ID NO: 731641 - DNA, 25 bp, Mus musculus
gttgacctccagtgtattgtgctca

SEQ ID NO: 731642 - DNA, 25 bp, Mus musculus
gttgacctcctcctctgaaaaagct

SEQ ID NO: 731643 - DNA, 25 bp, Mus musculus
gttgacctcctcgtctgaaaaagct

SEQ ID NO: 731644 - DNA, 25 bp, Mus musculus
gttgacctgggtactgctgaactca

SEQ ID NO: 731645 - DNA, 25 bp, Mus musculus
gttgacctgggttctgctgaactca

SEQ ID NO: 731646 - DNA, 25 bp, Mus musculus
gttgaccttaagctgggaagactgc

SEQ ID NO: 731647 - DNA, 25 bp, Mus musculus
gttgaccttaaggtgggaagactgc

SEQ ID NO: 731648 - DNA, 25 bp, Mus musculus
gttgaccttacaatgaaaaattgga

SEQ ID NO: 731649 - DNA, 25 bp, Mus musculus
gttgaccttacattgaaaaattgga

SEQ ID NO: 731650 - DNA, 25 bp, Mus musculus
gttgaccttcctaaactggacggcg

SEQ ID NO: 731651 - DNA, 25 bp, Mus musculus
gttgaccttccttaactggacggcg

SEQ ID NO: 731652 - DNA, 25 bp, Mus musculus
gttgaccttctaagaaaacttattt

SEQ ID NO: 731653 - DNA, 25 bp, Mus musculus
gttgaccttctatgaaaacttattt

SEQ ID NO: 731654 - DNA, 25 bp, Mus musculus
gttgaccttgaaattgttggactta

SEQ ID NO: 731655 - DNA, 25 bp, Mus musculus
gttgaccttgaatttgttggactta

SEQ ID NO: 731656 - DNA, 25 bp, Mus musculus
gttgaccttgagctagtggcaattc

SEQ ID NO: 731657 - DNA, 25 bp, Mus musculus
gttgaccttgagctatgctaacctt

SEQ ID NO: 731658 - DNA, 25 bp, Mus musculus
gttgaccttgaggtagtggcaattc

SEQ ID NO: 731659 - DNA, 25 bp, Mus musculus
gttgaccttgaggtatgctaacctt

SEQ ID NO: 731660 - DNA, 25 bp, Mus musculus
gttgacctttgcatgagggacaggt

SEQ ID NO: 731661 - DNA, 25 bp, Mus musculus
gttgacctttgcattgctgatacaa

SEQ ID NO: 731662 - DNA, 25 bp, Mus musculus
gttgacctttgcttgagggacaggt

SEQ ID NO: 731663 - DNA, 25 bp, Mus musculus
gttgacctttgctttgctgatacaa

SEQ ID NO: 731664 - DNA, 25 bp, Mus musculus
gttgacgaggaacacctgcagacac

SEQ ID NO: 731665 - DNA, 25 bp, Mus musculus
gttgacgaggaagacctgcagacac

SEQ ID NO: 731666 - DNA, 25 bp, Mus musculus
gttgacgaggcacaccatggctgaa

SEQ ID NO: 731667 - DNA, 25 bp, Mus musculus
gttgacgaggcagaccatggctgaa

SEQ ID NO: 731668 - DNA, 25 bp, Mus musculus
gttgacgatttgctcctaccaagag

SEQ ID NO: 731669 - DNA, 25 bp, Mus musculus
gttgacgatttggtcctaccaagag

SEQ ID NO: 731670 - DNA, 25 bp, Mus musculus
gttgacgcacagctagcacaggctc

SEQ ID NO: 731671 - DNA, 25 bp, Mus musculus
gttgacgcacaggtagcacaggctc

SEQ ID NO: 731672 - DNA, 25 bp, Mus musculus
gttgacgcagcacaaattaccagct

SEQ ID NO: 731673 - DNA, 25 bp, Mus musculus
gttgacgcagcagaaattaccagct

SEQ ID NO: 731674 - DNA, 25 bp, Mus musculus
gttgacgcagtcagaactcagcagc

SEQ ID NO: 731675 - DNA, 25 bp, Mus musculus
gttgacgcagtctgaactcagcagc

SEQ ID NO: 731676 - DNA, 25 bp, Mus musculus
gttgacgccctaatactacactata

SEQ ID NO: 731677 - DNA, 25 bp, Mus musculus
gttgacgccctattactacactata

SEQ ID NO: 731678 - DNA, 25 bp, Mus musculus
gttgacgctgctcgcgatttatgta

SEQ ID NO: 731679 - DNA, 25 bp, Mus musculus
gttgacgctgctggcgatttatgta

SEQ ID NO: 731680 - DNA, 25 bp, Mus musculus
gttgacgcttcccttggacattttg

SEQ ID NO: 731681 - DNA, 25 bp, Mus musculus
gttgacgcttccgttggacattttg

SEQ ID NO: 731682 - DNA, 25 bp, Mus musculus
gttgacggcatgaggtggcacactc

SEQ ID NO: 731683 - DNA, 25 bp, Mus musculus
gttgacggcatgtggtggcacactc

SEQ ID NO: 731684 - DNA, 25 bp, Mus musculus
gttgacgggaatactgcactgcaaa

SEQ ID NO: 731685 - DNA, 25 bp, Mus musculus
gttgacgggaattctgcactgcaaa

SEQ ID NO: 731686 - DNA, 25 bp, Mus musculus
gttgacgtttacatcatcagatgac

SEQ ID NO: 731687 - DNA, 25 bp, Mus musculus
gttgacgtttacttcatcagatgac

SEQ ID NO: 731688 - DNA, 25 bp, Mus musculus
gttgacgttttcatactgtatcagt

SEQ ID NO: 731689 - DNA, 25 bp, Mus musculus
gttgacgttttcttactgtatcagt

SEQ ID NO: 731690 - DNA, 25 bp, Mus musculus
gttgactaaatgaaggtgccgtctt

SEQ ID NO: 731691 - DNA, 25 bp, Mus musculus
gttgactaaatgtaggtgccgtctt

SEQ ID NO: 731692 - DNA, 25 bp, Mus musculus
gttgactaacacagaatggatgcca

SEQ ID NO: 731693 - DNA, 25 bp, Mus musculus
gttgactaacactgaatggatgcca

SEQ ID NO: 731694 - DNA, 25 bp, Mus musculus
gttgactaacctcgatccttgtggc

SEQ ID NO: 731695 - DNA, 25 bp, Mus musculus
gttgactaacctggatccttgtggc

SEQ ID NO: 731696 - DNA, 25 bp, Mus musculus
gttgactaattaattgagaccttct

SEQ ID NO: 731697 - DNA, 25 bp, Mus musculus
gttgactaattatttgagaccttct

SEQ ID NO: 731698 - DNA, 25 bp, Mus musculus
gttgactacaacagcttccatgaga

SEQ ID NO: 731699 - DNA, 25 bp, Mus musculus
gttgactacaactgcttccatgaga

SEQ ID NO: 731700 - DNA, 25 bp, Mus musculus
gttgactacgtacgaagccaccatc

SEQ ID NO: 731701 - DNA, 25 bp, Mus musculus
gttgactacgtaggaagccaccatc

SEQ ID NO: 731702 - DNA, 25 bp, Mus musculus
gttgactactgtaagaccaagctct

SEQ ID NO: 731703 - DNA, 25 bp, Mus musculus
gttgactactgttagaccaagctct

SEQ ID NO: 731704 - DNA, 25 bp, Mus musculus
gttgactagcttaagaccattgcag

SEQ ID NO: 731705 - DNA, 25 bp, Mus musculus
gttgactagctttagaccattgcag

SEQ ID NO: 731706 - DNA, 25 bp, Mus musculus
gttgactatagaagccacaagcctc

SEQ ID NO: 731707 - DNA, 25 bp, Mus musculus
gttgactatagatgccacaagcctc

SEQ ID NO: 731708 - DNA, 25 bp, Mus musculus
gttgactatcagaaccttgagcact

SEQ ID NO: 731709 - DNA, 25 bp, Mus musculus
gttgactatcagtaccttgagcact

SEQ ID NO: 731710 - DNA, 25 bp, Mus musculus
gttgactatgctaatttactttatg

SEQ ID NO: 731711 - DNA, 25 bp, Mus musculus
gttgactatgcttatttactttatg

SEQ ID NO: 731712 - DNA, 25 bp, Mus musculus
gttgactatgtcatctgcatggatg

SEQ ID NO: 731713 - DNA, 25 bp, Mus musculus
gttgactatgtcttctgcatggatg

SEQ ID NO: 731714 - DNA, 25 bp, Mus musculus
gttgactattatcccagatgtaaac

SEQ ID NO: 731715 - DNA, 25 bp, Mus musculus
gttgactattatgccagatgtaaac

SEQ ID NO: 731716 - DNA, 25 bp, Mus musculus
gttgactcagccattgacacgcaag

SEQ ID NO: 731717 - DNA, 25 bp, Mus musculus
gttgactcagcctttgacacgcaag

SEQ ID NO: 731718 - DNA, 25 bp, Mus musculus
gttgactcagtgattcctgtttgag

SEQ ID NO: 731719 - DNA, 25 bp, Mus musculus
gttgactcagtgtttcctgtttgag

SEQ ID NO: 731720 - DNA, 25 bp, Mus musculus
gttgactccagacacacaaatacca

SEQ ID NO: 731721 - DNA, 25 bp, Mus musculus
gttgactccagagacacaaatacca

SEQ ID NO: 731722 - DNA, 25 bp, Mus musculus
gttgactctagtactgtgaatccag

SEQ ID NO: 731723 - DNA, 25 bp, Mus musculus
gttgactctagttctgtgaatccag

SEQ ID NO: 731724 - DNA, 25 bp, Mus musculus
gttgactctcccagtatgttaaacc

SEQ ID NO: 731725 - DNA, 25 bp, Mus musculus
gttgactctccctgtatgttaaacc

SEQ ID NO: 731726 - DNA, 25 bp, Mus musculus
gttgactctggacctttccaagtat

SEQ ID NO: 731727 - DNA, 25 bp, Mus musculus
gttgactctggagctttccaagtat

SEQ ID NO: 731728 - DNA, 25 bp, Mus musculus
gttgactcttttatgctttgaccaa

SEQ ID NO: 731729 - DNA, 25 bp, Mus musculus
gttgactcttttttgctttgaccaa

SEQ ID NO: 731730 - DNA, 25 bp, Mus musculus
gttgactgacgtatatgcctggtga

SEQ ID NO: 731731 - DNA, 25 bp, Mus musculus
gttgactgacgtttatgcctggtga

SEQ ID NO: 731732 - DNA, 25 bp, Mus musculus
gttgactgagacaccaatgtcccaa

SEQ ID NO: 731733 - DNA, 25 bp, Mus musculus
gttgactgagactccaatgtcccaa

SEQ ID NO: 731734 - DNA, 25 bp, Mus musculus
gttgactgagttattcatccttaca

SEQ ID NO: 731735 - DNA, 25 bp, Mus musculus
gttgactgagtttttcatccttaca

SEQ ID NO: 731736 - DNA, 25 bp, Mus musculus
gttgactgctagaactgtgtatctc

SEQ ID NO: 731737 - DNA, 25 bp, Mus musculus
gttgactgctagtactgtgtatctc

SEQ ID NO: 731738 - DNA, 25 bp, Mus musculus
gttgactgctctcagaagtacctgc

SEQ ID NO: 731739 - DNA, 25 bp, Mus musculus
gttgactgctctgagaagtacctgc

SEQ ID NO: 731740 - DNA, 25 bp, Mus musculus
gttgactggcagattttattccctt

SEQ ID NO: 731741 - DNA, 25 bp, Mus musculus
gttgactggcagtttttattccctt

SEQ ID NO: 731742 - DNA, 25 bp, Mus musculus
gttgactggcttcatttatactgac

SEQ ID NO: 731743 - DNA, 25 bp, Mus musculus
gttgactggcttgatttatactgac

SEQ ID NO: 731744 - DNA, 25 bp, Mus musculus
gttgactggtcaactcagggtttca

SEQ ID NO: 731745 - DNA, 25 bp, Mus musculus
gttgactggtcatctcagggtttca

SEQ ID NO: 731746 - DNA, 25 bp, Mus musculus
gttgactgtactaatgactcccata

SEQ ID NO: 731747 - DNA, 25 bp, Mus musculus
gttgactgtacttatgactcccata

SEQ ID NO: 731748 - DNA, 25 bp, Mus musculus
gttgactgttcaatatctcagctag

SEQ ID NO: 731749 - DNA, 25 bp, Mus musculus
gttgactgttcattatctcagctag

SEQ ID NO: 731750 - DNA, 25 bp, Mus musculus
gttgacttaccactgcataccagag

SEQ ID NO: 731751 - DNA, 25 bp, Mus musculus
gttgacttaccagtgcataccagag

SEQ ID NO: 731752 - DNA, 25 bp, Mus musculus
gttgacttagtcacgtgaaagccta

SEQ ID NO: 731753 - DNA, 25 bp, Mus musculus
gttgacttagtctcgtgaaagccta

SEQ ID NO: 731754 - DNA, 25 bp, Mus musculus
gttgacttcactaagctgtagctta

SEQ ID NO: 731755 - DNA, 25 bp, Mus musculus
gttgacttcacttagctgtagctta

SEQ ID NO: 731756 - DNA, 25 bp, Mus musculus
gttgacttcattattcccatggtat

SEQ ID NO: 731757 - DNA, 25 bp, Mus musculus
gttgacttcatttttcccatggtat

SEQ ID NO: 731758 - DNA, 25 bp, Mus musculus
gttgacttccatacatgtagtttga

SEQ ID NO: 731759 - DNA, 25 bp, Mus musculus
gttgacttccattcatgtagtttga

SEQ ID NO: 731760 - DNA, 25 bp, Mus musculus
gttgacttcctgagtcatgacctca

SEQ ID NO: 731761 - DNA, 25 bp, Mus musculus
gttgacttcctgtgtcatgacctca

SEQ ID NO: 731762 - DNA, 25 bp, Mus musculus
gttgacttctagattgactcttcag

SEQ ID NO: 731763 - DNA, 25 bp, Mus musculus
gttgacttctagtttgactcttcag

SEQ ID NO: 731764 - DNA, 25 bp, Mus musculus
gttgacttctggcttgctacagaaa

SEQ ID NO: 731765 - DNA, 25 bp, Mus musculus
gttgacttctgggttgctacagaaa

SEQ ID NO: 731766 - DNA, 25 bp, Mus musculus
gttgacttctgtcattgtggcccaa

SEQ ID NO: 731767 - DNA, 25 bp, Mus musculus
gttgacttctgtgattgtggcccaa

SEQ ID NO: 731768 - DNA, 25 bp, Mus musculus
gttgacttcttaaggactccatgac

SEQ ID NO: 731769 - DNA, 25 bp, Mus musculus
gttgacttcttatggactccatgac

SEQ ID NO: 731770 - DNA, 25 bp, Mus musculus
gttgacttgatcatgtctgcagaga

SEQ ID NO: 731771 - DNA, 25 bp, Mus musculus
gttgacttgatcttgtctgcagaga

SEQ ID NO: 731772 - DNA, 25 bp, Mus musculus
gttgacttgccacagcagcataaca

SEQ ID NO: 731773 - DNA, 25 bp, Mus musculus
gttgacttgccagagcagcataaca

SEQ ID NO: 731774 - DNA, 25 bp, Mus musculus
gttgacttgtaacacaaagttgctt

SEQ ID NO: 731775 - DNA, 25 bp, Mus musculus
gttgacttgtaagacaaagttgctt

SEQ ID NO: 731776 - DNA, 25 bp, Mus musculus
gttgactttaatactctaagtgtca

SEQ ID NO: 731777 - DNA, 25 bp, Mus musculus
gttgactttaattctctaagtgtca

SEQ ID NO: 731778 - DNA, 25 bp, Mus musculus
gttgactttattaagcccagacact

SEQ ID NO: 731779 - DNA, 25 bp, Mus musculus
gttgactttattcttctactccaag

SEQ ID NO: 731780 - DNA, 25 bp, Mus musculus
gttgactttattgttctactccaag

SEQ ID NO: 731781 - DNA, 25 bp, Mus musculus
gttgactttatttagcccagacact

SEQ ID NO: 731782 - DNA, 25 bp, Mus musculus
gttgactttctacacataccaggat

SEQ ID NO: 731783 - DNA, 25 bp, Mus musculus
gttgactttctagacataccaggat

SEQ ID NO: 731784 - DNA, 25 bp, Mus musculus
gttgactttgaacgttacaccacct

SEQ ID NO: 731785 - DNA, 25 bp, Mus musculus
gttgactttgaaggttacaccacct

SEQ ID NO: 731786 - DNA, 25 bp, Mus musculus
gttgactttgctaatcttggatcca

SEQ ID NO: 731787 - DNA, 25 bp, Mus musculus
gttgactttgcttatcttggatcca

SEQ ID NO: 731788 - DNA, 25 bp, Mus musculus
gttgactttgttatgctcattcagt

SEQ ID NO: 731789 - DNA, 25 bp, Mus musculus
gttgactttgttttgctcattcagt

SEQ ID NO: 731790 - DNA, 25 bp, Mus musculus
gttgactttttgacatagcaaggcc

SEQ ID NO: 731791 - DNA, 25 bp, Mus musculus
gttgactttttgtcatagcaaggcc

SEQ ID NO: 731792 - DNA, 25 bp, Mus musculus
gttgagaaaactctagactatgggt

SEQ ID NO: 731793 - DNA, 25 bp, Mus musculus
gttgagaaaactgtagactatgggt

SEQ ID NO: 731794 - DNA, 25 bp, Mus musculus
gttgagaaaagcatgaccgggtcat

SEQ ID NO: 731795 - DNA, 25 bp, Mus musculus
gttgagaaaagcttgaccgggtcat

SEQ ID NO: 731796 - DNA, 25 bp, Mus musculus
gttgagaaactaaagccctgcacat

SEQ ID NO: 731797 - DNA, 25 bp, Mus musculus
gttgagaaactatagccctgcacat

SEQ ID NO: 731798 - DNA, 25 bp, Mus musculus
gttgagaaatataccatctattcct

SEQ ID NO: 731799 - DNA, 25 bp, Mus musculus
gttgagaaatattccatctattcct

SEQ ID NO: 731800 - DNA, 25 bp, Mus musculus
gttgagaaccacaaagccagagcct

SEQ ID NO: 731801 - DNA, 25 bp, Mus musculus
gttgagaaccactaagccagagcct

SEQ ID NO: 731802 - DNA, 25 bp, Mus musculus
gttgagaacgttagcttcagagtaa

SEQ ID NO: 731803 - DNA, 25 bp, Mus musculus
gttgagaacgtttgcttcagagtaa

SEQ ID NO: 731804 - DNA, 25 bp, Mus musculus
gttgagaagatacacccaccacatt

SEQ ID NO: 731805 - DNA, 25 bp, Mus musculus
gttgagaagatagacccaccacatt

SEQ ID NO: 731806 - DNA, 25 bp, Mus musculus
gttgagaagcctcgtggacacatac

SEQ ID NO: 731807 - DNA, 25 bp, Mus musculus
gttgagaagcctggtggacacatac

SEQ ID NO: 731808 - DNA, 25 bp, Mus musculus
gttgagaatggtcctcgctggtcac

SEQ ID NO: 731809 - DNA, 25 bp, Mus musculus
gttgagaatggtgctcgctggtcac

SEQ ID NO: 731810 - DNA, 25 bp, Mus musculus
gttgagaattagatcccacatcata

SEQ ID NO: 731811 - DNA, 25 bp, Mus musculus
gttgagaattagttcccacatcata

SEQ ID NO: 731812 - DNA, 25 bp, Mus musculus
gttgagaattgtagcttacactttc

SEQ ID NO: 731813 - DNA, 25 bp, Mus musculus
gttgagaattgttgcttacactttc

SEQ ID NO: 731814 - DNA, 25 bp, Mus musculus
gttgagacccatcccttgcatacta

SEQ ID NO: 731815 - DNA, 25 bp, Mus musculus
gttgagacccatgccttgcatacta

SEQ ID NO: 731816 - DNA, 25 bp, Mus musculus
gttgagacctagagcaatttccctg

SEQ ID NO: 731817 - DNA, 25 bp, Mus musculus
gttgagacctagtgcaatttccctg

SEQ ID NO: 731818 - DNA, 25 bp, Mus musculus
gttgagactgacatcctgagagccc

SEQ ID NO: 731819 - DNA, 25 bp, Mus musculus
gttgagactgacttcctgagagccc

SEQ ID NO: 731820 - DNA, 25 bp, Mus musculus
gttgagactgagatcctgtgggaca

SEQ ID NO: 731821 - DNA, 25 bp, Mus musculus
gttgagactgagttcctgtgggaca

SEQ ID NO: 731822 - DNA, 25 bp, Mus musculus
gttgagactgcaaggctccagcaat

SEQ ID NO: 731823 - DNA, 25 bp, Mus musculus
gttgagactgcatggctccagcaat

SEQ ID NO: 731824 - DNA, 25 bp, Mus musculus
gttgagactggtctagcttctgata

SEQ ID NO: 731825 - DNA, 25 bp, Mus musculus
gttgagactggtgtagcttctgata

SEQ ID NO: 731826 - DNA, 25 bp, Mus musculus
gttgagacttccactttggaagata

SEQ ID NO: 731827 - DNA, 25 bp, Mus musculus
gttgagacttcctctttggaagata

SEQ ID NO: 731828 - DNA, 25 bp, Mus musculus
gttgagagaggactccagcgatcca

SEQ ID NO: 731829 - DNA, 25 bp, Mus musculus
gttgagagaggagtccagcgatcca

SEQ ID NO: 731830 - DNA, 25 bp, Mus musculus
gttgagagagggagttctgacttcc

SEQ ID NO: 731831 - DNA, 25 bp, Mus musculus
gttgagagagggtgttctgacttcc

SEQ ID NO: 731832 - DNA, 25 bp, Mus musculus
gttgagagcacaagttcatatagca

SEQ ID NO: 731833 - DNA, 25 bp, Mus musculus
gttgagagcacatgttcatatagca

SEQ ID NO: 731834 - DNA, 25 bp, Mus musculus
gttgagagcactatgaaccctctgt

SEQ ID NO: 731835 - DNA, 25 bp, Mus musculus
gttgagagcactttgaaccctctgt

SEQ ID NO: 731836 - DNA, 25 bp, Mus musculus
gttgagagcatcatggaacagaact

SEQ ID NO: 731837 - DNA, 25 bp, Mus musculus
gttgagagcatcttggaacagaact

SEQ ID NO: 731838 - DNA, 25 bp, Mus musculus
gttgagagctctagatcctagtcat

SEQ ID NO: 731839 - DNA, 25 bp, Mus musculus
gttgagagctcttgatcctagtcat

SEQ ID NO: 731840 - DNA, 25 bp, Mus musculus
gttgagaggcctagactctgctact

SEQ ID NO: 731841 - DNA, 25 bp, Mus musculus
gttgagaggccttgactctgctact

SEQ ID NO: 731842 - DNA, 25 bp, Mus musculus
gttgagagtggcagagcacagacac

SEQ ID NO: 731843 - DNA, 25 bp, Mus musculus
gttgagagtggctgagcacagacac

SEQ ID NO: 731844 - DNA, 25 bp, Mus musculus
gttgagagtgtacaggagcacacca

SEQ ID NO: 731845 - DNA, 25 bp, Mus musculus
gttgagagtgtagaggagcacacca

SEQ ID NO: 731846 - DNA, 25 bp, Mus musculus
gttgagatctctccattttataaat

SEQ ID NO: 731847 - DNA, 25 bp, Mus musculus
gttgagatctctgcattttataaat

SEQ ID NO: 731848 - DNA, 25 bp, Mus musculus
gttgagattataacctacttgtaga

SEQ ID NO: 731849 - DNA, 25 bp, Mus musculus
gttgagattatatcctacttgtaga

SEQ ID NO: 731850 - DNA, 25 bp, Mus musculus
gttgagattatcatgtggttttgcc

SEQ ID NO: 731851 - DNA, 25 bp, Mus musculus
gttgagattatcttgtggttttgcc

SEQ ID NO: 731852 - DNA, 25 bp, Mus musculus
gttgagattattccacatgtggcta

SEQ ID NO: 731853 - DNA, 25 bp, Mus musculus
gttgagattattgcacatgtggcta

SEQ ID NO: 731854 - DNA, 25 bp, Mus musculus
gttgagattcacaccttaatgctgg

SEQ ID NO: 731855 - DNA, 25 bp, Mus musculus
gttgagattcactccttaatgctgg

SEQ ID NO: 731856 - DNA, 25 bp, Mus musculus
gttgagattcgcaggccagggcact

SEQ ID NO: 731857 - DNA, 25 bp, Mus musculus
gttgagattcgctggccagggcact

SEQ ID NO: 731858 - DNA, 25 bp, Mus musculus
gttgagattttacccattcctccag

SEQ ID NO: 731859 - DNA, 25 bp, Mus musculus
gttgagattttagccattcctccag

SEQ ID NO: 731860 - DNA, 25 bp, Mus musculus
gttgagcaacatcagtcttcttgga

SEQ ID NO: 731861 - DNA, 25 bp, Mus musculus
gttgagcaacatgagtcttcttgga

SEQ ID NO: 731862 - DNA, 25 bp, Mus musculus
gttgagcaactgattccatatgtgg

SEQ ID NO: 731863 - DNA, 25 bp, Mus musculus
gttgagcaactgtttccatatgtgg

SEQ ID NO: 731864 - DNA, 25 bp, Mus musculus
gttgagcacaccataaatgccaaag

SEQ ID NO: 731865 - DNA, 25 bp, Mus musculus
gttgagcacaccttaaatgccaaag

SEQ ID NO: 731866 - DNA, 25 bp, Mus musculus
gttgagcagctaatgaacgcttcca

SEQ ID NO: 731867 - DNA, 25 bp, Mus musculus
gttgagcagctattgaacgcttcca

SEQ ID NO: 731868 - DNA, 25 bp, Mus musculus
gttgagcagcttctccgacaggaaa

SEQ ID NO: 731869 - DNA, 25 bp, Mus musculus
gttgagcagcttctgttgtgattct

SEQ ID NO: 731870 - DNA, 25 bp, Mus musculus
gttgagcagcttgtccgacaggaaa

SEQ ID NO: 731871 - DNA, 25 bp, Mus musculus
gttgagcagcttgtgttgtgattct

SEQ ID NO: 731872 - DNA, 25 bp, Mus musculus
gttgagcagtcacagtcacctgaca

SEQ ID NO: 731873 - DNA, 25 bp, Mus musculus
gttgagcagtcagagtcacctgaca

SEQ ID NO: 731874 - DNA, 25 bp, Mus musculus
gttgagcagttactcacacagtgta

SEQ ID NO: 731875 - DNA, 25 bp, Mus musculus
gttgagcagttagtcacacagtgta

SEQ ID NO: 731876 - DNA, 25 bp, Mus musculus
gttgagcatagcagtcacctaggat

SEQ ID NO: 731877 - DNA, 25 bp, Mus musculus
gttgagcatagctgtcacctaggat

SEQ ID NO: 731878 - DNA, 25 bp, Mus musculus
gttgagcatcaaagttgggccttta

SEQ ID NO: 731879 - DNA, 25 bp, Mus musculus
gttgagcatcaatgttgggccttta

SEQ ID NO: 731880 - DNA, 25 bp, Mus musculus
gttgagcatcacaatcagcaggcta

SEQ ID NO: 731881 - DNA, 25 bp, Mus musculus
gttgagcatcactatcagcaggcta

SEQ ID NO: 731882 - DNA, 25 bp, Mus musculus
gttgagcatctgctgacattcccat

SEQ ID NO: 731883 - DNA, 25 bp, Mus musculus
gttgagcatctggtgacattcccat

SEQ ID NO: 731884 - DNA, 25 bp, Mus musculus
gttgagcatgagagctgccagcttc

SEQ ID NO: 731885 - DNA, 25 bp, Mus musculus
gttgagcatgagtgctgccagcttc

SEQ ID NO: 731886 - DNA, 25 bp, Mus musculus
gttgagcccattctaagtatcattg

SEQ ID NO: 731887 - DNA, 25 bp, Mus musculus
gttgagcccattgtaagtatcattg

SEQ ID NO: 731888 - DNA, 25 bp, Mus musculus
gttgagccctacaaggaagatcttt

SEQ ID NO: 731889 - DNA, 25 bp, Mus musculus
gttgagccctactaggaagatcttt

SEQ ID NO: 731890 - DNA, 25 bp, Mus musculus
gttgagccgagtcgaagcctccttt

SEQ ID NO: 731891 - DNA, 25 bp, Mus musculus
gttgagccgagtggaagcctccttt

SEQ ID NO: 731892 - DNA, 25 bp, Mus musculus
gttgagcctctgatacatatactat

SEQ ID NO: 731893 - DNA, 25 bp, Mus musculus
gttgagcctctgttacatatactat

SEQ ID NO: 731894 - DNA, 25 bp, Mus musculus
gttgagcgacctaacagtatttccc

SEQ ID NO: 731895 - DNA, 25 bp, Mus musculus
gttgagcgaccttacagtatttccc

SEQ ID NO: 731896 - DNA, 25 bp, Mus musculus
gttgagcggtctatagcagcagtca

SEQ ID NO: 731897 - DNA, 25 bp, Mus musculus
gttgagcggtctttagcagcagtca

SEQ ID NO: 731898 - DNA, 25 bp, Mus musculus
gttgagcgtgcacacagctacgaca

SEQ ID NO: 731899 - DNA, 25 bp, Mus musculus
gttgagcgtgcagacagctacgaca

SEQ ID NO: 731900 - DNA, 25 bp, Mus musculus
gttgagcgtgttatgctgtctttaa

SEQ ID NO: 731901 - DNA, 25 bp, Mus musculus
gttgagcgtgttttgctgtctttaa

SEQ ID NO: 731902 - DNA, 25 bp, Mus musculus
gttgagctacatacttcattgcttt

SEQ ID NO: 731903 - DNA, 25 bp, Mus musculus
gttgagctacattcttcattgcttt

SEQ ID NO: 731904 - DNA, 25 bp, Mus musculus
gttgagctactcaggtcaaggcttt

SEQ ID NO: 731905 - DNA, 25 bp, Mus musculus
gttgagctactctggtcaaggcttt

SEQ ID NO: 731906 - DNA, 25 bp, Mus musculus
gttgagctactgctaggaacctgag

SEQ ID NO: 731907 - DNA, 25 bp, Mus musculus
gttgagctactggtaggaacctgag

SEQ ID NO: 731908 - DNA, 25 bp, Mus musculus
gttgagctcatacttctctagagaa

SEQ ID NO: 731909 - DNA, 25 bp, Mus musculus
gttgagctcatagttctctagagaa

SEQ ID NO: 731910 - DNA, 25 bp, Mus musculus
gttgagctcatgaaaatgcctatgg

SEQ ID NO: 731911 - DNA, 25 bp, Mus musculus
gttgagctcatgtaaatgcctatgg

SEQ ID NO: 731912 - DNA, 25 bp, Mus musculus
gttgagctcccaacaagttttagta

SEQ ID NO: 731913 - DNA, 25 bp, Mus musculus
gttgagctcccatcaagttttagta

SEQ ID NO: 731914 - DNA, 25 bp, Mus musculus
gttgagctcgtcctgcaaggtcgca

SEQ ID NO: 731915 - DNA, 25 bp, Mus musculus
gttgagctcgtcgtgcaaggtcgca

SEQ ID NO: 731916 - DNA, 25 bp, Mus musculus
gttgagctctaccttgattgcaaga

SEQ ID NO: 731917 - DNA, 25 bp, Mus musculus
gttgagctctacgttgattgcaaga

SEQ ID NO: 731918 - DNA, 25 bp, Mus musculus
gttgagctctggagattatctgcta

SEQ ID NO: 731919 - DNA, 25 bp, Mus musculus
gttgagctctggtgattatctgcta

SEQ ID NO: 731920 - DNA, 25 bp, Mus musculus
gttgagctggacacacctcagaaga

SEQ ID NO: 731921 - DNA, 25 bp, Mus musculus
gttgagctggactcacctcagaaga

SEQ ID NO: 731922 - DNA, 25 bp, Mus musculus
gttgagctggttagagttgtttgcc

SEQ ID NO: 731923 - DNA, 25 bp, Mus musculus
gttgagctggtttgagttgtttgcc

SEQ ID NO: 731924 - DNA, 25 bp, Mus musculus
gttgagctgtacctacttcaaagat

SEQ ID NO: 731925 - DNA, 25 bp, Mus musculus
gttgagctgtacgtacttcaaagat

SEQ ID NO: 731926 - DNA, 25 bp, Mus musculus
gttgagcttcaaatctgatcacaga

SEQ ID NO: 731927 - DNA, 25 bp, Mus musculus
gttgagcttcaattctgatcacaga

SEQ ID NO: 731928 - DNA, 25 bp, Mus musculus
gttgagcttttcagacgctgtgtca

SEQ ID NO: 731929 - DNA, 25 bp, Mus musculus
gttgagcttttctgacgctgtgtca

SEQ ID NO: 731930 - DNA, 25 bp, Mus musculus
gttgagctttttctgaaccctctca

SEQ ID NO: 731931 - DNA, 25 bp, Mus musculus
gttgagctttttgtgaaccctctca

SEQ ID NO: 731932 - DNA, 25 bp, Mus musculus
gttgaggaatcactggcgacatatt

SEQ ID NO: 731933 - DNA, 25 bp, Mus musculus
gttgaggaatcagtggcgacatatt

SEQ ID NO: 731934 - DNA, 25 bp, Mus musculus
gttgaggacattagcaaggtagctt

SEQ ID NO: 731935 - DNA, 25 bp, Mus musculus
gttgaggacatttgcaaggtagctt

SEQ ID NO: 731936 - DNA, 25 bp, Mus musculus
gttgaggacggcaagaggttcatct

SEQ ID NO: 731937 - DNA, 25 bp, Mus musculus
gttgaggacggctagaggttcatct

SEQ ID NO: 731938 - DNA, 25 bp, Mus musculus
gttgaggatcaacagtgcccattat

SEQ ID NO: 731939 - DNA, 25 bp, Mus musculus
gttgaggatcaacgtttcccttcct

SEQ ID NO: 731940 - DNA, 25 bp, Mus musculus
gttgaggatcaagagtgcccattat

SEQ ID NO: 731941 - DNA, 25 bp, Mus musculus
gttgaggatcaaggtttcccttcct

SEQ ID NO: 731942 - DNA, 25 bp, Mus musculus
gttgaggatgttagttctttctgtg

SEQ ID NO: 731943 - DNA, 25 bp, Mus musculus
gttgaggatgtttgttctttctgtg

SEQ ID NO: 731944 - DNA, 25 bp, Mus musculus
gttgaggcaggacgcttagcatcca

SEQ ID NO: 731945 - DNA, 25 bp, Mus musculus
gttgaggcaggaggcttagcatcca

SEQ ID NO: 731946 - DNA, 25 bp, Mus musculus
gttgaggcagtactactaggactat

SEQ ID NO: 731947 - DNA, 25 bp, Mus musculus
gttgaggcagtagtactaggactat

SEQ ID NO: 731948 - DNA, 25 bp, Mus musculus
gttgaggccaacctaatctctacga

SEQ ID NO: 731949 - DNA, 25 bp, Mus musculus
gttgaggccaacgtaatctctacga

SEQ ID NO: 731950 - DNA, 25 bp, Mus musculus
gttgaggccacaataaataaccatg

SEQ ID NO: 731951 - DNA, 25 bp, Mus musculus
gttgaggccacattaaataaccatg

SEQ ID NO: 731952 - DNA, 25 bp, Mus musculus
gttgaggccattacctatactttgt

SEQ ID NO: 731953 - DNA, 25 bp, Mus musculus
gttgaggccatttcctatactttgt

SEQ ID NO: 731954 - DNA, 25 bp, Mus musculus
gttgaggcccagaaatcccaggtat

SEQ ID NO: 731955 - DNA, 25 bp, Mus musculus
gttgaggcccagtaatcccaggtat

SEQ ID NO: 731956 - DNA, 25 bp, Mus musculus
gttgaggcctctctaagttcttgaa

SEQ ID NO: 731957 - DNA, 25 bp, Mus musculus
gttgaggcctctgtaagttcttgaa

SEQ ID NO: 731958 - DNA, 25 bp, Mus musculus
gttgaggcgcttcaaaattctcctg

SEQ ID NO: 731959 - DNA, 25 bp, Mus musculus
gttgaggcgcttgaaaattctcctg

SEQ ID NO: 731960 - DNA, 25 bp, Mus musculus
gttgagggacatcctcggctacata

SEQ ID NO: 731961 - DNA, 25 bp, Mus musculus
gttgagggacatgctcggctacata

SEQ ID NO: 731962 - DNA, 25 bp, Mus musculus
gttgagggattcacccaggtggcta

SEQ ID NO: 731963 - DNA, 25 bp, Mus musculus
gttgagggattctcccaggtggcta

SEQ ID NO: 731964 - DNA, 25 bp, Mus musculus
gttgagggcctcattgaccacaaat

SEQ ID NO: 731965 - DNA, 25 bp, Mus musculus
gttgagggcctctttgaccacaaat

SEQ ID NO: 731966 - DNA, 25 bp, Mus musculus
gttgagggtcctaaactcttctgaa

SEQ ID NO: 731967 - DNA, 25 bp, Mus musculus
gttgagggtccttaactcttctgaa

SEQ ID NO: 731968 - DNA, 25 bp, Mus musculus
gttgaggtcaaaaactacctgttag

SEQ ID NO: 731969 - DNA, 25 bp, Mus musculus
gttgaggtcaaatactacctgttag

SEQ ID NO: 731970 - DNA, 25 bp, Mus musculus
gttgaggtcacacgtagctttcctt

SEQ ID NO: 731971 - DNA, 25 bp, Mus musculus
gttgaggtcacaggtagctttcctt

SEQ ID NO: 731972 - DNA, 25 bp, Mus musculus
gttgaggtgttaccaaaccacttga

SEQ ID NO: 731973 - DNA, 25 bp, Mus musculus
gttgaggtgttagcaaaccacttga

SEQ ID NO: 731974 - DNA, 25 bp, Mus musculus
gttgaggttactccagacacgttct

SEQ ID NO: 731975 - DNA, 25 bp, Mus musculus
gttgaggttactgcagacacgttct

SEQ ID NO: 731976 - DNA, 25 bp, Mus musculus
gttgaggttctcagccagcagagca

SEQ ID NO: 731977 - DNA, 25 bp, Mus musculus
gttgaggttctctgccagcagagca

SEQ ID NO: 731978 - DNA, 25 bp, Mus musculus
gttgaggtttgcatttcgtatctat

SEQ ID NO: 731979 - DNA, 25 bp, Mus musculus
gttgaggtttgcttttcgtatctat

SEQ ID NO: 731980 - DNA, 25 bp, Mus musculus
gttgagtaaaatagcattcccattg

SEQ ID NO: 731981 - DNA, 25 bp, Mus musculus
gttgagtaaaattgcattcccattg

SEQ ID NO: 731982 - DNA, 25 bp, Mus musculus
gttgagtagcttataactgcccata

SEQ ID NO: 731983 - DNA, 25 bp, Mus musculus
gttgagtagcttttaactgcccata

SEQ ID NO: 731984 - DNA, 25 bp, Mus musculus
gttgagtagttgattttcccctcta

SEQ ID NO: 731985 - DNA, 25 bp, Mus musculus
gttgagtagttgtttttcccctcta

SEQ ID NO: 731986 - DNA, 25 bp, Mus musculus
gttgagtcaaaactacagacttcca

SEQ ID NO: 731987 - DNA, 25 bp, Mus musculus
gttgagtcaaaagtacagacttcca

SEQ ID NO: 731988 - DNA, 25 bp, Mus musculus
gttgagtcacaacgtacacggtttt

SEQ ID NO: 731989 - DNA, 25 bp, Mus musculus
gttgagtcacaaggtacacggtttt

SEQ ID NO: 731990 - DNA, 25 bp, Mus musculus
gttgagtcatctcatttgttctaga

SEQ ID NO: 731991 - DNA, 25 bp, Mus musculus
gttgagtcatctgatttgttctaga

SEQ ID NO: 731992 - DNA, 25 bp, Mus musculus
gttgagtcccaaatgccaaagccat

SEQ ID NO: 731993 - DNA, 25 bp, Mus musculus
gttgagtcccaattgccaaagccat

SEQ ID NO: 731994 - DNA, 25 bp, Mus musculus
gttgagtccccaaggatacttagca

SEQ ID NO: 731995 - DNA, 25 bp, Mus musculus
gttgagtccccatggatacttagca

SEQ ID NO: 731996 - DNA, 25 bp, Mus musculus
gttgagtctaacacaggctgaggac

SEQ ID NO: 731997 - DNA, 25 bp, Mus musculus
gttgagtctaactcaggctgaggac

SEQ ID NO: 731998 - DNA, 25 bp, Mus musculus
gttgagtctatgacatgacaggata

SEQ ID NO: 731999 - DNA, 25 bp, Mus musculus
gttgagtctatgtcatgacaggata

SEQ ID NO: 732000 - DNA, 25 bp, Mus musculus
gttgagtctgttctgttgtgtttga

SEQ ID NO: 732001 - DNA, 25 bp, Mus musculus
gttgagtctgttgtgttgtgtttga

SEQ ID NO: 732002 - DNA, 25 bp, Mus musculus
gttgagtgaattagcgagcgcacaa

SEQ ID NO: 732003 - DNA, 25 bp, Mus musculus
gttgagtgaatttgcgagcgcacaa

SEQ ID NO: 732004 - DNA, 25 bp, Mus musculus
gttgagtgacgtcttcagggctcct

SEQ ID NO: 732005 - DNA, 25 bp, Mus musculus
gttgagtgacgtgttcagggctcct

SEQ ID NO: 732006 - DNA, 25 bp, Mus musculus
gttgagtggtctcaattaggaacat

SEQ ID NO: 732007 - DNA, 25 bp, Mus musculus
gttgagtggtctgaattaggaacat

SEQ ID NO: 732008 - DNA, 25 bp, Mus musculus
gttgagtgttctattgttcagtcca

SEQ ID NO: 732009 - DNA, 25 bp, Mus musculus
gttgagtgttcttttgttcagtcca

SEQ ID NO: 732010 - DNA, 25 bp, Mus musculus
gttgagttaccccaggaggattcca

SEQ ID NO: 732011 - DNA, 25 bp, Mus musculus
gttgagttacccgaggaggattcca

SEQ ID NO: 732012 - DNA, 25 bp, Mus musculus
gttgagttagtgacctggctggcca

SEQ ID NO: 732013 - DNA, 25 bp, Mus musculus
gttgagttagtgtcctggctggcca

SEQ ID NO: 732014 - DNA, 25 bp, Mus musculus
gttgagttcactatctcagcactca

SEQ ID NO: 732015 - DNA, 25 bp, Mus musculus
gttgagttcactttctcagcactca

SEQ ID NO: 732016 - DNA, 25 bp, Mus musculus
gttgagttcattcgcttacattaat

SEQ ID NO: 732017 - DNA, 25 bp, Mus musculus
gttgagttcattggcttacattaat

SEQ ID NO: 732018 - DNA, 25 bp, Mus musculus
gttgagttcgtcattcgtttccctg

SEQ ID NO: 732019 - DNA, 25 bp, Mus musculus
gttgagttcgtctttcgtttccctg

SEQ ID NO: 732020 - DNA, 25 bp, Mus musculus
gttgagttctagatgtctaccccaa

SEQ ID NO: 732021 - DNA, 25 bp, Mus musculus
gttgagttctagttgtctaccccaa

SEQ ID NO: 732022 - DNA, 25 bp, Mus musculus
gttgagttctgaacttgttgggaaa

SEQ ID NO: 732023 - DNA, 25 bp, Mus musculus
gttgagttctgatcttgttgggaaa

SEQ ID NO: 732024 - DNA, 25 bp, Mus musculus
gttgagttgactattcattacctaa

SEQ ID NO: 732025 - DNA, 25 bp, Mus musculus
gttgagttgacttttcattacctaa

SEQ ID NO: 732026 - DNA, 25 bp, Mus musculus
gttgagttttatcctatctattggg

SEQ ID NO: 732027 - DNA, 25 bp, Mus musculus
gttgagttttatgctatctattggg

SEQ ID NO: 732028 - DNA, 25 bp, Mus musculus
gttgagtttttacgccaaagactga

SEQ ID NO: 732029 - DNA, 25 bp, Mus musculus
gttgagtttttaggccaaagactga

SEQ ID NO: 732030 - DNA, 25 bp, Mus musculus
gttgataacaaactggaaacctgtc

SEQ ID NO: 732031 - DNA, 25 bp, Mus musculus
gttgataacaaagtggaaacctgtc

SEQ ID NO: 732032 - DNA, 25 bp, Mus musculus
gttgataacctccagagcccttggg

SEQ ID NO: 732033 - DNA, 25 bp, Mus musculus
gttgataacctcgagagcccttggg

SEQ ID NO: 732034 - DNA, 25 bp, Mus musculus
gttgataaggtgcatctgtagtgtc

SEQ ID NO: 732035 - DNA, 25 bp, Mus musculus
gttgataaggtggatctgtagtgtc

SEQ ID NO: 732036 - DNA, 25 bp, Mus musculus
gttgataagttcatcctattcctag

SEQ ID NO: 732037 - DNA, 25 bp, Mus musculus
gttgataagttcttcctattcctag

SEQ ID NO: 732038 - DNA, 25 bp, Mus musculus
gttgataatccccttgctgaattca

SEQ ID NO: 732039 - DNA, 25 bp, Mus musculus
gttgataatcccgttgctgaattca

SEQ ID NO: 732040 - DNA, 25 bp, Mus musculus
gttgataatgacatagtgacactat

SEQ ID NO: 732041 - DNA, 25 bp, Mus musculus
gttgataatgacttagtgacactat

SEQ ID NO: 732042 - DNA, 25 bp, Mus musculus
gttgataatgccagagtgtccccag

SEQ ID NO: 732043 - DNA, 25 bp, Mus musculus
gttgataatgcctgagtgtccccag

SEQ ID NO: 732044 - DNA, 25 bp, Mus musculus
gttgataatggtatttgacgttctt

SEQ ID NO: 732045 - DNA, 25 bp, Mus musculus
gttgataatggtttttgacgttctt

SEQ ID NO: 732046 - DNA, 25 bp, Mus musculus
gttgatacacctacaagtgcctagt

SEQ ID NO: 732047 - DNA, 25 bp, Mus musculus
gttgatacaccttcaagtgcctagt

SEQ ID NO: 732048 - DNA, 25 bp, Mus musculus
gttgatacaggtactaaagtccaaa

SEQ ID NO: 732049 - DNA, 25 bp, Mus musculus
gttgatacaggttctaaagtccaaa

SEQ ID NO: 732050 - DNA, 25 bp, Mus musculus
gttgatacattgaggcagttatttc

SEQ ID NO: 732051 - DNA, 25 bp, Mus musculus
gttgatacattgtggcagttatttc

SEQ ID NO: 732052 - DNA, 25 bp, Mus musculus
gttgatacctgtcgcatttttattt

SEQ ID NO: 732053 - DNA, 25 bp, Mus musculus
gttgatacctgtggcatttttattt

SEQ ID NO: 732054 - DNA, 25 bp, Mus musculus
gttgatactcaaaccatagtgcatc

SEQ ID NO: 732055 - DNA, 25 bp, Mus musculus
gttgatactcaatccatagtgcatc

SEQ ID NO: 732056 - DNA, 25 bp, Mus musculus
gttgatactctgagtaatgactgga

SEQ ID NO: 732057 - DNA, 25 bp, Mus musculus
gttgatactctgtgtaatgactgga

SEQ ID NO: 732058 - DNA, 25 bp, Mus musculus
gttgatactgacatagcccctttta

SEQ ID NO: 732059 - DNA, 25 bp, Mus musculus
gttgatactgacttagcccctttta

SEQ ID NO: 732060 - DNA, 25 bp, Mus musculus
gttgatactgatcataactggccat

SEQ ID NO: 732061 - DNA, 25 bp, Mus musculus
gttgatactgatgataactggccat

SEQ ID NO: 732062 - DNA, 25 bp, Mus musculus
gttgatactgcaagctcttagaatt

SEQ ID NO: 732063 - DNA, 25 bp, Mus musculus
gttgatactgcatgctcttagaatt

SEQ ID NO: 732064 - DNA, 25 bp, Mus musculus
gttgatactgccaagaagtgctttt

SEQ ID NO: 732065 - DNA, 25 bp, Mus musculus
gttgatactgcctagaagtgctttt

SEQ ID NO: 732066 - DNA, 25 bp, Mus musculus
gttgatactttcagagcagtgacat

SEQ ID NO: 732067 - DNA, 25 bp, Mus musculus
gttgatactttctgagcagtgacat

SEQ ID NO: 732068 - DNA, 25 bp, Mus musculus
gttgatagatttaccaacccctgac

SEQ ID NO: 732069 - DNA, 25 bp, Mus musculus
gttgatagattttccaacccctgac

SEQ ID NO: 732070 - DNA, 25 bp, Mus musculus
gttgatagcttcaataactttgctg

SEQ ID NO: 732071 - DNA, 25 bp, Mus musculus
gttgatagcttctataactttgctg

SEQ ID NO: 732072 - DNA, 25 bp, Mus musculus
gttgataggaccacaggccggttta

SEQ ID NO: 732073 - DNA, 25 bp, Mus musculus
gttgataggacctcaggccggttta

SEQ ID NO: 732074 - DNA, 25 bp, Mus musculus
gttgataggcccaattttgcggagg

SEQ ID NO: 732075 - DNA, 25 bp, Mus musculus
gttgataggccctattttgcggagg

SEQ ID NO: 732076 - DNA, 25 bp, Mus musculus
gttgataggctcacagcagcttgct

SEQ ID NO: 732077 - DNA, 25 bp, Mus musculus
gttgataggctctcagcagcttgct

SEQ ID NO: 732078 - DNA, 25 bp, Mus musculus
gttgatagtcctataaccctagtga

SEQ ID NO: 732079 - DNA, 25 bp, Mus musculus
gttgatagtcctttaaccctagtga

SEQ ID NO: 732080 - DNA, 25 bp, Mus musculus
gttgatagtgcacatgaggcctcgt

SEQ ID NO: 732081 - DNA, 25 bp, Mus musculus
gttgatagtgcagatgaggcctcgt

SEQ ID NO: 732082 - DNA, 25 bp, Mus musculus
gttgatatacctacagatatgcagt

SEQ ID NO: 732083 - DNA, 25 bp, Mus musculus
gttgatataccttcagatatgcagt

SEQ ID NO: 732084 - DNA, 25 bp, Mus musculus
gttgatatcacaattatccccaaaa

SEQ ID NO: 732085 - DNA, 25 bp, Mus musculus
gttgatatcacatttatccccaaaa

SEQ ID NO: 732086 - DNA, 25 bp, Mus musculus
gttgatatccacagaggctggccct

SEQ ID NO: 732087 - DNA, 25 bp, Mus musculus
gttgatatccactgaggctggccct

SEQ ID NO: 732088 - DNA, 25 bp, Mus musculus
gttgatatccttcccattcttgcca

SEQ ID NO: 732089 - DNA, 25 bp, Mus musculus
gttgatatccttgccattcttgcca

SEQ ID NO: 732090 - DNA, 25 bp, Mus musculus
gttgatatgaataccctctaaaagg

SEQ ID NO: 732091 - DNA, 25 bp, Mus musculus
gttgatatgaattccctctaaaagg

SEQ ID NO: 732092 - DNA, 25 bp, Mus musculus
gttgatatgtgtcccttgattgtat

SEQ ID NO: 732093 - DNA, 25 bp, Mus musculus
gttgatatgtgtgccttgattgtat

SEQ ID NO: 732094 - DNA, 25 bp, Mus musculus
gttgatattccactcagcttttata

SEQ ID NO: 732095 - DNA, 25 bp, Mus musculus
gttgatattccagtcagcttttata

SEQ ID NO: 732096 - DNA, 25 bp, Mus musculus
gttgatattttcaccactgtaacca

SEQ ID NO: 732097 - DNA, 25 bp, Mus musculus
gttgatattttctccactgtaacca

SEQ ID NO: 732098 - DNA, 25 bp, Mus musculus
gttgatcaacagaactaccccaaga

SEQ ID NO: 732099 - DNA, 25 bp, Mus musculus
gttgatcaacagtactaccccaaga

SEQ ID NO: 732100 - DNA, 25 bp, Mus musculus
gttgatcaagtgaaaatgtgctgtt

SEQ ID NO: 732101 - DNA, 25 bp, Mus musculus
gttgatcaagtgtaaatgtgctgtt

SEQ ID NO: 732102 - DNA, 25 bp, Mus musculus
gttgatcaatctccctgttttcagg

SEQ ID NO: 732103 - DNA, 25 bp, Mus musculus
gttgatcaatctgcctgttttcagg

SEQ ID NO: 732104 - DNA, 25 bp, Mus musculus
gttgatcagatgaatcccgtctcct

SEQ ID NO: 732105 - DNA, 25 bp, Mus musculus
gttgatcagatgtatcccgtctcct

SEQ ID NO: 732106 - DNA, 25 bp, Mus musculus
gttgatcagcagcatgtgaatccag

SEQ ID NO: 732107 - DNA, 25 bp, Mus musculus
gttgatcagcaggatgtgaatccag

SEQ ID NO: 732108 - DNA, 25 bp, Mus musculus
gttgatcagctaagtagtgtgcaat

SEQ ID NO: 732109 - DNA, 25 bp, Mus musculus
gttgatcagctatgtagtgtgcaat

SEQ ID NO: 732110 - DNA, 25 bp, Mus musculus
gttgatcatatccattgtttgttta

SEQ ID NO: 732111 - DNA, 25 bp, Mus musculus
gttgatcatatcgattgtttgttta

SEQ ID NO: 732112 - DNA, 25 bp, Mus musculus
gttgatcatgacattcctcagattt

SEQ ID NO: 732113 - DNA, 25 bp, Mus musculus
gttgatcatgactttcctcagattt

SEQ ID NO: 732114 - DNA, 25 bp, Mus musculus
gttgatcattctattgcttaccaaa

SEQ ID NO: 732115 - DNA, 25 bp, Mus musculus
gttgatcattcttttgcttaccaaa

SEQ ID NO: 732116 - DNA, 25 bp, Mus musculus
gttgatccatacatgagagtttgtt

SEQ ID NO: 732117 - DNA, 25 bp, Mus musculus
gttgatccatacttgagagtttgtt

SEQ ID NO: 732118 - DNA, 25 bp, Mus musculus
gttgatcctaatcatttcagcccat

SEQ ID NO: 732119 - DNA, 25 bp, Mus musculus
gttgatcctaatgatttcagcccat

SEQ ID NO: 732120 - DNA, 25 bp, Mus musculus
gttgatcctattagactagccaggc

SEQ ID NO: 732121 - DNA, 25 bp, Mus musculus
gttgatcctatttgactagccaggc

SEQ ID NO: 732122 - DNA, 25 bp, Mus musculus
gttgatcctctcagaactagcgtat

SEQ ID NO: 732123 - DNA, 25 bp, Mus musculus
gttgatcctctctgaactagcgtat

SEQ ID NO: 732124 - DNA, 25 bp, Mus musculus
gttgatccttaaattgctagcacat

SEQ ID NO: 732125 - DNA, 25 bp, Mus musculus
gttgatccttaatttgctagcacat

SEQ ID NO: 732126 - DNA, 25 bp, Mus musculus
gttgatctaaacaatgctgcacctg

SEQ ID NO: 732127 - DNA, 25 bp, Mus musculus
gttgatctaaactatgctgcacctg

SEQ ID NO: 732128 - DNA, 25 bp, Mus musculus
gttgatctagcacacaggctccaga

SEQ ID NO: 732129 - DNA, 25 bp, Mus musculus
gttgatctagcagacaggctccaga

SEQ ID NO: 732130 - DNA, 25 bp, Mus musculus
gttgatctaggacactcacctgagg

SEQ ID NO: 732131 - DNA, 25 bp, Mus musculus
gttgatctaggagactcacctgagg

SEQ ID NO: 732132 - DNA, 25 bp, Mus musculus
gttgatctccagagatctgtatcac

SEQ ID NO: 732133 - DNA, 25 bp, Mus musculus
gttgatctccagtgatctgtatcac

SEQ ID NO: 732134 - DNA, 25 bp, Mus musculus
gttgatctccctactagtgaggaat

SEQ ID NO: 732135 - DNA, 25 bp, Mus musculus
gttgatctcccttctagtgaggaat

SEQ ID NO: 732136 - DNA, 25 bp, Mus musculus
gttgatctccgaagatgacaccaag

SEQ ID NO: 732137 - DNA, 25 bp, Mus musculus
gttgatctccgatgatgacaccaag

SEQ ID NO: 732138 - DNA, 25 bp, Mus musculus
gttgatctcgtgcaactgttgtctc

SEQ ID NO: 732139 - DNA, 25 bp, Mus musculus
gttgatctcgtggaactgttgtctc

SEQ ID NO: 732140 - DNA, 25 bp, Mus musculus
gttgatctctcactcagaaacacta

SEQ ID NO: 732141 - DNA, 25 bp, Mus musculus
gttgatctctcagtcagaaacacta

SEQ ID NO: 732142 - DNA, 25 bp, Mus musculus
gttgatctcttcatcacagcgtaaa

SEQ ID NO: 732143 - DNA, 25 bp, Mus musculus
gttgatctcttcttcacagcgtaaa

SEQ ID NO: 732144 - DNA, 25 bp, Mus musculus
gttgatctgccaccatactgttgtc

SEQ ID NO: 732145 - DNA, 25 bp, Mus musculus
gttgatctgccagcatactgttgtc

SEQ ID NO: 732146 - DNA, 25 bp, Mus musculus
gttgatctgtacattggtaactccc

SEQ ID NO: 732147 - DNA, 25 bp, Mus musculus
gttgatctgtactttggtaactccc

SEQ ID NO: 732148 - DNA, 25 bp, Mus musculus
gttgatcttagaaactccctacctg

SEQ ID NO: 732149 - DNA, 25 bp, Mus musculus
gttgatcttagatactccctacctg

SEQ ID NO: 732150 - DNA, 25 bp, Mus musculus
gttgatcttattctgctcatcactg

SEQ ID NO: 732151 - DNA, 25 bp, Mus musculus
gttgatcttattgtgctcatcactg

SEQ ID NO: 732152 - DNA, 25 bp, Mus musculus
gttgatcttcagcaaacttgcccca

SEQ ID NO: 732153 - DNA, 25 bp, Mus musculus
gttgatcttcaggaaacttgcccca

SEQ ID NO: 732154 - DNA, 25 bp, Mus musculus
gttgatcttccactactccttggtt

SEQ ID NO: 732155 - DNA, 25 bp, Mus musculus
gttgatcttccactgcagattttga

SEQ ID NO: 732156 - DNA, 25 bp, Mus musculus
gttgatcttccagtactccttggtt

SEQ ID NO: 732157 - DNA, 25 bp, Mus musculus
gttgatcttccagtgcagattttga

SEQ ID NO: 732158 - DNA, 25 bp, Mus musculus
gttgatcttttcatgtccttgatga

SEQ ID NO: 732159 - DNA, 25 bp, Mus musculus
gttgatcttttcttgtccttgatga

SEQ ID NO: 732160 - DNA, 25 bp, Mus musculus
gttgatgaaagaagacggctccttc

SEQ ID NO: 732161 - DNA, 25 bp, Mus musculus
gttgatgaaagatgacggctccttc

SEQ ID NO: 732162 - DNA, 25 bp, Mus musculus
gttgatgaaccccaggttcagtgag

SEQ ID NO: 732163 - DNA, 25 bp, Mus musculus
gttgatgaacccgaggttcagtgag

SEQ ID NO: 732164 - DNA, 25 bp, Mus musculus
gttgatgacatcaggcacttttcag

SEQ ID NO: 732165 - DNA, 25 bp, Mus musculus
gttgatgacatctggcacttttcag

SEQ ID NO: 732166 - DNA, 25 bp, Mus musculus
gttgatgacgctcaactaaaggatt

SEQ ID NO: 732167 - DNA, 25 bp, Mus musculus
gttgatgacgctgaactaaaggatt

SEQ ID NO: 732168 - DNA, 25 bp, Mus musculus
gttgatgagaccactaatccgcctt

SEQ ID NO: 732169 - DNA, 25 bp, Mus musculus
gttgatgagacctctaatccgcctt

SEQ ID NO: 732170 - DNA, 25 bp, Mus musculus
gttgatgagtaaatactgtcctagt

SEQ ID NO: 732171 - DNA, 25 bp, Mus musculus
gttgatgagtaattactgtcctagt

SEQ ID NO: 732172 - DNA, 25 bp, Mus musculus
gttgatgatttgatcctgagaagtg

SEQ ID NO: 732173 - DNA, 25 bp, Mus musculus
gttgatgatttgttcctgagaagtg

SEQ ID NO: 732174 - DNA, 25 bp, Mus musculus
gttgatgcaaacattccagatattg

SEQ ID NO: 732175 - DNA, 25 bp, Mus musculus
gttgatgcaaactttccagatattg

SEQ ID NO: 732176 - DNA, 25 bp, Mus musculus
gttgatgcacctacagggtatcctt

SEQ ID NO: 732177 - DNA, 25 bp, Mus musculus
gttgatgcaccttcagggtatcctt

SEQ ID NO: 732178 - DNA, 25 bp, Mus musculus
gttgatgcagcaattcccattggat

SEQ ID NO: 732179 - DNA, 25 bp, Mus musculus
gttgatgcagcatttcccattggat

SEQ ID NO: 732180 - DNA, 25 bp, Mus musculus
gttgatgccatccatacccagatct

SEQ ID NO: 732181 - DNA, 25 bp, Mus musculus
gttgatgccatcgatacccagatct

SEQ ID NO: 732182 - DNA, 25 bp, Mus musculus
gttgatgcccacaggtgtattgtgc

SEQ ID NO: 732183 - DNA, 25 bp, Mus musculus
gttgatgcccactggtgtattgtgc

SEQ ID NO: 732184 - DNA, 25 bp, Mus musculus
gttgatgcctgtcacccatgaagaa

SEQ ID NO: 732185 - DNA, 25 bp, Mus musculus
gttgatgcctgtgacccatgaagaa

SEQ ID NO: 732186 - DNA, 25 bp, Mus musculus
gttgatgccttcattattgtactgg

SEQ ID NO: 732187 - DNA, 25 bp, Mus musculus
gttgatgccttctttattgtactgg

SEQ ID NO: 732188 - DNA, 25 bp, Mus musculus
gttgatgcgatcatggtgttaccta

SEQ ID NO: 732189 - DNA, 25 bp, Mus musculus
gttgatgcgatcttggtgttaccta

SEQ ID NO: 732190 - DNA, 25 bp, Mus musculus
gttgatgctaacactgtgcgcacta

SEQ ID NO: 732191 - DNA, 25 bp, Mus musculus
gttgatgctaactctgtgcgcacta

SEQ ID NO: 732192 - DNA, 25 bp, Mus musculus
gttgatgctgacaaaccgctcaggc

SEQ ID NO: 732193 - DNA, 25 bp, Mus musculus
gttgatgctgactaaccgctcaggc

SEQ ID NO: 732194 - DNA, 25 bp, Mus musculus
gttgatgctgtaaaactctatggct

SEQ ID NO: 732195 - DNA, 25 bp, Mus musculus
gttgatgctgtataactctatggct

SEQ ID NO: 732196 - DNA, 25 bp, Mus musculus
gttgatgctgtgatgtccctgtctg

SEQ ID NO: 732197 - DNA, 25 bp, Mus musculus
gttgatgctgtgttgtccctgtctg

SEQ ID NO: 732198 - DNA, 25 bp, Mus musculus
gttgatgcttaacttcacgcagttt

SEQ ID NO: 732199 - DNA, 25 bp, Mus musculus
gttgatgcttaagttcacgcagttt

SEQ ID NO: 732200 - DNA, 25 bp, Mus musculus
gttgatgcttctcagatgcacttca

SEQ ID NO: 732201 - DNA, 25 bp, Mus musculus
gttgatgcttctgagatgcacttca

SEQ ID NO: 732202 - DNA, 25 bp, Mus musculus
gttgatgctttacgcctgaatattt

SEQ ID NO: 732203 - DNA, 25 bp, Mus musculus
gttgatgctttaggcctgaatattt

SEQ ID NO: 732204 - DNA, 25 bp, Mus musculus
gttgatgctttgacacggtgatgaa

SEQ ID NO: 732205 - DNA, 25 bp, Mus musculus
gttgatgctttgtcacggtgatgaa

SEQ ID NO: 732206 - DNA, 25 bp, Mus musculus
gttgatgcttttatgctgtctggcc

SEQ ID NO: 732207 - DNA, 25 bp, Mus musculus
gttgatgcttttttgctgtctggcc

SEQ ID NO: 732208 - DNA, 25 bp, Mus musculus
gttgatggacctacaggagctcctg

SEQ ID NO: 732209 - DNA, 25 bp, Mus musculus
gttgatggaccttcaggagctcctg

SEQ ID NO: 732210 - DNA, 25 bp, Mus musculus
gttgatggcggaagtgcatgcacac

SEQ ID NO: 732211 - DNA, 25 bp, Mus musculus
gttgatggcggatgtgcatgcacac

SEQ ID NO: 732212 - DNA, 25 bp, Mus musculus
gttgatggctacagggtttatttgg

SEQ ID NO: 732213 - DNA, 25 bp, Mus musculus
gttgatggctactgggtttatttgg

SEQ ID NO: 732214 - DNA, 25 bp, Mus musculus
gttgatggctcactgctcaagttaa

SEQ ID NO: 732215 - DNA, 25 bp, Mus musculus
gttgatggctcagtgctcaagttaa

SEQ ID NO: 732216 - DNA, 25 bp, Mus musculus
gttgatggctttcgctccctggtgc

SEQ ID NO: 732217 - DNA, 25 bp, Mus musculus
gttgatggctttggctccctggtgc

SEQ ID NO: 732218 - DNA, 25 bp, Mus musculus
gttgatgggtccagaagtccggtac

SEQ ID NO: 732219 - DNA, 25 bp, Mus musculus
gttgatgggtcctgaagtccggtac

SEQ ID NO: 732220 - DNA, 25 bp, Mus musculus
gttgatgggtctattgtataatttc

SEQ ID NO: 732221 - DNA, 25 bp, Mus musculus
gttgatgggtcttttgtataatttc

SEQ ID NO: 732222 - DNA, 25 bp, Mus musculus
gttgatgggtgacctccctctaaag

SEQ ID NO: 732223 - DNA, 25 bp, Mus musculus
gttgatgggtgagctccctctaaag

SEQ ID NO: 732224 - DNA, 25 bp, Mus musculus
gttgatgggtggattctgttttgac

SEQ ID NO: 732225 - DNA, 25 bp, Mus musculus
gttgatgggtggtttctgttttgac

SEQ ID NO: 732226 - DNA, 25 bp, Mus musculus
gttgatgggttccactattaccacc

SEQ ID NO: 732227 - DNA, 25 bp, Mus musculus
gttgatgggttcgactattaccacc

SEQ ID NO: 732228 - DNA, 25 bp, Mus musculus
gttgatggtggtaatcctcttggaa

SEQ ID NO: 732229 - DNA, 25 bp, Mus musculus
gttgatggtggttatcctcttggaa

SEQ ID NO: 732230 - DNA, 25 bp, Mus musculus
gttgatggtgtcaccagtgagcgcc

SEQ ID NO: 732231 - DNA, 25 bp, Mus musculus
gttgatggtgtctccagtgagcgcc

SEQ ID NO: 732232 - DNA, 25 bp, Mus musculus
gttgatgtactgcagggcaccctgc

SEQ ID NO: 732233 - DNA, 25 bp, Mus musculus
gttgatgtactggagggcaccctgc

SEQ ID NO: 732234 - DNA, 25 bp, Mus musculus
gttgatgtagcccaatactgcatct

SEQ ID NO: 732235 - DNA, 25 bp, Mus musculus
gttgatgtagccgaatactgcatct

SEQ ID NO: 732236 - DNA, 25 bp, Mus musculus
gttgatgtcagaattttgccagctt

SEQ ID NO: 732237 - DNA, 25 bp, Mus musculus
gttgatgtcagatttttgccagctt

SEQ ID NO: 732238 - DNA, 25 bp, Mus musculus
gttgatgtctaactatgcctcagtg

SEQ ID NO: 732239 - DNA, 25 bp, Mus musculus
gttgatgtctaagtatgcctcagtg

SEQ ID NO: 732240 - DNA, 25 bp, Mus musculus
gttgatgtctggcttctatttttat

SEQ ID NO: 732241 - DNA, 25 bp, Mus musculus
gttgatgtctgggttctatttttat

SEQ ID NO: 732242 - DNA, 25 bp, Mus musculus
gttgatgttcgtacacaagccatgt

SEQ ID NO: 732243 - DNA, 25 bp, Mus musculus
gttgatgttcgttcacaagccatgt

SEQ ID NO: 732244 - DNA, 25 bp, Mus musculus
gttgatgttgagaatacttgatgaa

SEQ ID NO: 732245 - DNA, 25 bp, Mus musculus
gttgatgttgagtatacttgatgaa

SEQ ID NO: 732246 - DNA, 25 bp, Mus musculus
gttgatgttgggagattccgtatta

SEQ ID NO: 732247 - DNA, 25 bp, Mus musculus
gttgatgttgggtgattccgtatta

SEQ ID NO: 732248 - DNA, 25 bp, Mus musculus
gttgattactttatactactgcttc

SEQ ID NO: 732249 - DNA, 25 bp, Mus musculus
gttgattactttttactactgcttc

SEQ ID NO: 732250 - DNA, 25 bp, Mus musculus
gttgattagactcgaccctggatct

SEQ ID NO: 732251 - DNA, 25 bp, Mus musculus
gttgattagactggaccctggatct

SEQ ID NO: 732252 - DNA, 25 bp, Mus musculus
gttgattagcgtcttcctggattct

SEQ ID NO: 732253 - DNA, 25 bp, Mus musculus
gttgattagcgtgttcctggattct

SEQ ID NO: 732254 - DNA, 25 bp, Mus musculus
gttgattatcctatctgatgtctgt

SEQ ID NO: 732255 - DNA, 25 bp, Mus musculus
gttgattatcctttctgatgtctgt

SEQ ID NO: 732256 - DNA, 25 bp, Mus musculus
gttgattatgcaaacatctgagtct

SEQ ID NO: 732257 - DNA, 25 bp, Mus musculus
gttgattatgcatacatctgagtct

SEQ ID NO: 732258 - DNA, 25 bp, Mus musculus
gttgattcaacaactatttcatctt

SEQ ID NO: 732259 - DNA, 25 bp, Mus musculus
gttgattcaacatctatttcatctt

SEQ ID NO: 732260 - DNA, 25 bp, Mus musculus
gttgattccaacaaaccagtccgag

SEQ ID NO: 732261 - DNA, 25 bp, Mus musculus
gttgattccaactaaccagtccgag

SEQ ID NO: 732262 - DNA, 25 bp, Mus musculus
gttgattcgaaaagagacggtgccc

SEQ ID NO: 732263 - DNA, 25 bp, Mus musculus
gttgattcgaaatgagacggtgccc

SEQ ID NO: 732264 - DNA, 25 bp, Mus musculus
gttgattcgaatatgctaggtagct

SEQ ID NO: 732265 - DNA, 25 bp, Mus musculus
gttgattcgaatttgctaggtagct

SEQ ID NO: 732266 - DNA, 25 bp, Mus musculus
gttgattctaaactccaatacattt

SEQ ID NO: 732267 - DNA, 25 bp, Mus musculus
gttgattctaaagtccaatacattt

SEQ ID NO: 732268 - DNA, 25 bp, Mus musculus
gttgattctctgatggtaactgaca

SEQ ID NO: 732269 - DNA, 25 bp, Mus musculus
gttgattctctgttggtaactgaca

SEQ ID NO: 732270 - DNA, 25 bp, Mus musculus
gttgattctggaaactcctacgata

SEQ ID NO: 732271 - DNA, 25 bp, Mus musculus
gttgattctggatactcctacgata

SEQ ID NO: 732272 - DNA, 25 bp, Mus musculus
gttgattctgtacctggtaaaacct

SEQ ID NO: 732273 - DNA, 25 bp, Mus musculus
gttgattctgtagctggtaaaacct

SEQ ID NO: 732274 - DNA, 25 bp, Mus musculus
gttgattcttgtctaacatgctttt

SEQ ID NO: 732275 - DNA, 25 bp, Mus musculus
gttgattcttgtgtaacatgctttt

SEQ ID NO: 732276 - DNA, 25 bp, Mus musculus
gttgattcttttcccatttcctgga

SEQ ID NO: 732277 - DNA, 25 bp, Mus musculus
gttgattcttttgccatttcctgga

SEQ ID NO: 732278 - DNA, 25 bp, Mus musculus
gttgattgactgcagtgcttcccaa

SEQ ID NO: 732279 - DNA, 25 bp, Mus musculus
gttgattgactggagtgcttcccaa

SEQ ID NO: 732280 - DNA, 25 bp, Mus musculus
gttgattgattgaacccgagtctcg

SEQ ID NO: 732281 - DNA, 25 bp, Mus musculus
gttgattgattgtacccgagtctcg

SEQ ID NO: 732282 - DNA, 25 bp, Mus musculus
gttgattgccacatttgaagatacc

SEQ ID NO: 732283 - DNA, 25 bp, Mus musculus
gttgattgccacttttgaagatacc

SEQ ID NO: 732284 - DNA, 25 bp, Mus musculus
gttgattgcttgataatttaatggt

SEQ ID NO: 732285 - DNA, 25 bp, Mus musculus
gttgattgcttgttaatttaatggt

SEQ ID NO: 732286 - DNA, 25 bp, Mus musculus
gttgattgctttatctctcgaatga

SEQ ID NO: 732287 - DNA, 25 bp, Mus musculus
gttgattgctttttctctcgaatga

SEQ ID NO: 732288 - DNA, 25 bp, Mus musculus
gttgattgtcagaattgaatcctaa

SEQ ID NO: 732289 - DNA, 25 bp, Mus musculus
gttgattgtcagtattgaatcctaa

SEQ ID NO: 732290 - DNA, 25 bp, Mus musculus
gttgattgtgtcataatggttacca

SEQ ID NO: 732291 - DNA, 25 bp, Mus musculus
gttgattgtgtcttaatggttacca

SEQ ID NO: 732292 - DNA, 25 bp, Mus musculus
gttgatttaaggatctctcctctga

SEQ ID NO: 732293 - DNA, 25 bp, Mus musculus
gttgatttaaggttctctcctctga

SEQ ID NO: 732294 - DNA, 25 bp, Mus musculus
gttgatttattaagtctccatggtt

SEQ ID NO: 732295 - DNA, 25 bp, Mus musculus
gttgatttattatgtctccatggtt

SEQ ID NO: 732296 - DNA, 25 bp, Mus musculus
gttgatttcagtcgcccgggaacga

SEQ ID NO: 732297 - DNA, 25 bp, Mus musculus
gttgatttcagtggcccgggaacga

SEQ ID NO: 732298 - DNA, 25 bp, Mus musculus
gttgatttcgagcttactttttata

SEQ ID NO: 732299 - DNA, 25 bp, Mus musculus
gttgatttcgaggttactttttata

SEQ ID NO: 732300 - DNA, 25 bp, Mus musculus
gttgatttcttcagcacaaggtgag

SEQ ID NO: 732301 - DNA, 25 bp, Mus musculus
gttgatttcttcagtagcgcttctc

SEQ ID NO: 732302 - DNA, 25 bp, Mus musculus
gttgatttcttctgcacaaggtgag

SEQ ID NO: 732303 - DNA, 25 bp, Mus musculus
gttgatttcttctgtagcgcttctc

SEQ ID NO: 732304 - DNA, 25 bp, Mus musculus
gttgatttgctgagttgattttgaa

SEQ ID NO: 732305 - DNA, 25 bp, Mus musculus
gttgatttgctgtgttgattttgaa

SEQ ID NO: 732306 - DNA, 25 bp, Mus musculus
gttgatttgttcactacttccgata

SEQ ID NO: 732307 - DNA, 25 bp, Mus musculus
gttgatttgttctctacttccgata

SEQ ID NO: 732308 - DNA, 25 bp, Mus musculus
gttgattttccaattaaagttctca

SEQ ID NO: 732309 - DNA, 25 bp, Mus musculus
gttgattttccatttaaagttctca

SEQ ID NO: 732310 - DNA, 25 bp, Mus musculus
gttgattttctcagtccatcctgta

SEQ ID NO: 732311 - DNA, 25 bp, Mus musculus
gttgattttctctgtccatcctgta

SEQ ID NO: 732312 - DNA, 25 bp, Mus musculus
gttgattttgagatagtgcctctac

SEQ ID NO: 732313 - DNA, 25 bp, Mus musculus
gttgattttgagttagtgcctctac

SEQ ID NO: 732314 - DNA, 25 bp, Mus musculus
gttgattttgtcacacggacacctg

SEQ ID NO: 732315 - DNA, 25 bp, Mus musculus
gttgattttgtctcacggacacctg

SEQ ID NO: 732316 - DNA, 25 bp, Mus musculus
gttgcaaaacatagcctagagccac

SEQ ID NO: 732317 - DNA, 25 bp, Mus musculus
gttgcaaaacattgcctagagccac

SEQ ID NO: 732318 - DNA, 25 bp, Mus musculus
gttgcaaaacctctagcttgggaac

SEQ ID NO: 732319 - DNA, 25 bp, Mus musculus
gttgcaaaacctgtagcttgggaac

SEQ ID NO: 732320 - DNA, 25 bp, Mus musculus
gttgcaaaactgctatcttgtcctc

SEQ ID NO: 732321 - DNA, 25 bp, Mus musculus
gttgcaaaactggtatcttgtcctc

SEQ ID NO: 732322 - DNA, 25 bp, Mus musculus
gttgcaaaaggcatacgccttcgct

SEQ ID NO: 732323 - DNA, 25 bp, Mus musculus
gttgcaaaaggcttacgccttcgct

SEQ ID NO: 732324 - DNA, 25 bp, Mus musculus
gttgcaaaccttcatgaccacagct

SEQ ID NO: 732325 - DNA, 25 bp, Mus musculus
gttgcaaaccttgatgaccacagct

SEQ ID NO: 732326 - DNA, 25 bp, Mus musculus
gttgcaaactgtagttgtttgtgaa

SEQ ID NO: 732327 - DNA, 25 bp, Mus musculus
gttgcaaactgttgttgtttgtgaa

SEQ ID NO: 732328 - DNA, 25 bp, Mus musculus
gttgcaaagcaacggagacactatc

SEQ ID NO: 732329 - DNA, 25 bp, Mus musculus
gttgcaaagcaagggagacactatc

SEQ ID NO: 732330 - DNA, 25 bp, Mus musculus
gttgcaaaggttctagctgccagat

SEQ ID NO: 732331 - DNA, 25 bp, Mus musculus
gttgcaaaggttgtagctgccagat

SEQ ID NO: 732332 - DNA, 25 bp, Mus musculus
gttgcaaagtctaggactgccacta

SEQ ID NO: 732333 - DNA, 25 bp, Mus musculus
gttgcaaagtcttggactgccacta

SEQ ID NO: 732334 - DNA, 25 bp, Mus musculus
gttgcaaagtgtagactaaactcag

SEQ ID NO: 732335 - DNA, 25 bp, Mus musculus
gttgcaaagtgttgactaaactcag

SEQ ID NO: 732336 - DNA, 25 bp, Mus musculus
gttgcaaatgcccaaagctttaatg

SEQ ID NO: 732337 - DNA, 25 bp, Mus musculus
gttgcaaatgccgaaagctttaatg

SEQ ID NO: 732338 - DNA, 25 bp, Mus musculus
gttgcaacagaacactttggtcttc

SEQ ID NO: 732339 - DNA, 25 bp, Mus musculus
gttgcaacagaagactttggtcttc

SEQ ID NO: 732340 - DNA, 25 bp, Mus musculus
gttgcaacaggaaaatattacacta

SEQ ID NO: 732341 - DNA, 25 bp, Mus musculus
gttgcaacaggataatattacacta

SEQ ID NO: 732342 - DNA, 25 bp, Mus musculus
gttgcaacatcgctgagctgtcgaa

SEQ ID NO: 732343 - DNA, 25 bp, Mus musculus
gttgcaacatcggtgagctgtcgaa

SEQ ID NO: 732344 - DNA, 25 bp, Mus musculus
gttgcaacccggagaccttacttgc

SEQ ID NO: 732345 - DNA, 25 bp, Mus musculus
gttgcaacccggtgaccttacttgc

SEQ ID NO: 732346 - DNA, 25 bp, Mus musculus
gttgcaaccctgacaggagtccagt

SEQ ID NO: 732347 - DNA, 25 bp, Mus musculus
gttgcaaccctgtcaggagtccagt

SEQ ID NO: 732348 - DNA, 25 bp, Mus musculus
gttgcaaccgataaattccattgga

SEQ ID NO: 732349 - DNA, 25 bp, Mus musculus
gttgcaaccgattaattccattgga

SEQ ID NO: 732350 - DNA, 25 bp, Mus musculus
gttgcaactcacaacataatatatt

SEQ ID NO: 732351 - DNA, 25 bp, Mus musculus
gttgcaactcactacataatatatt

SEQ ID NO: 732352 - DNA, 25 bp, Mus musculus
gttgcaactgcaatcaaaacctgta

SEQ ID NO: 732353 - DNA, 25 bp, Mus musculus
gttgcaactgcattcaaaacctgta

SEQ ID NO: 732354 - DNA, 25 bp, Mus musculus
gttgcaactggcaatttactgactg

SEQ ID NO: 732355 - DNA, 25 bp, Mus musculus
gttgcaactggctatttactgactg

SEQ ID NO: 732356 - DNA, 25 bp, Mus musculus
gttgcaacttcacataacttctttg

SEQ ID NO: 732357 - DNA, 25 bp, Mus musculus
gttgcaacttcagataacttctttg

SEQ ID NO: 732358 - DNA, 25 bp, Mus musculus
gttgcaagaattcccctgacgttaa

SEQ ID NO: 732359 - DNA, 25 bp, Mus musculus
gttgcaagaattgccctgacgttaa

SEQ ID NO: 732360 - DNA, 25 bp, Mus musculus
gttgcaagcgcaagtattaccctgg

SEQ ID NO: 732361 - DNA, 25 bp, Mus musculus
gttgcaagcgcatgtattaccctgg

SEQ ID NO: 732362 - DNA, 25 bp, Mus musculus
gttgcaaggcatacgaagggacaga

SEQ ID NO: 732363 - DNA, 25 bp, Mus musculus
gttgcaaggcattcgaagggacaga

SEQ ID NO: 732364 - DNA, 25 bp, Mus musculus
gttgcaaggccaccagttgtcttaa

SEQ ID NO: 732365 - DNA, 25 bp, Mus musculus
gttgcaaggccagcagttgtcttaa

SEQ ID NO: 732366 - DNA, 25 bp, Mus musculus
gttgcaaggctcacactatatgtcc

SEQ ID NO: 732367 - DNA, 25 bp, Mus musculus
gttgcaaggctctcactatatgtcc

SEQ ID NO: 732368 - DNA, 25 bp, Mus musculus
gttgcaaggtgaaaacaaccttcta

SEQ ID NO: 732369 - DNA, 25 bp, Mus musculus
gttgcaaggtgataacaaccttcta

SEQ ID NO: 732370 - DNA, 25 bp, Mus musculus
gttgcaagtacaaggctgggctcca

SEQ ID NO: 732371 - DNA, 25 bp, Mus musculus
gttgcaagtacatggctgggctcca

SEQ ID NO: 732372 - DNA, 25 bp, Mus musculus
gttgcaatactaacttatcacctgt

SEQ ID NO: 732373 - DNA, 25 bp, Mus musculus
gttgcaatactatcttatcacctgt

SEQ ID NO: 732374 - DNA, 25 bp, Mus musculus
gttgcaatccacaggatacgctgta

SEQ ID NO: 732375 - DNA, 25 bp, Mus musculus
gttgcaatccactggatacgctgta

SEQ ID NO: 732376 - DNA, 25 bp, Mus musculus
gttgcaatcctacacttaaagcttg

SEQ ID NO: 732377 - DNA, 25 bp, Mus musculus
gttgcaatcctagacttaaagcttg

SEQ ID NO: 732378 - DNA, 25 bp, Mus musculus
gttgcaatcgatccaaggcatgcat

SEQ ID NO: 732379 - DNA, 25 bp, Mus musculus
gttgcaatcgatgcaaggcatgcat

SEQ ID NO: 732380 - DNA, 25 bp, Mus musculus
gttgcaatcggcagtcagaggtgca

SEQ ID NO: 732381 - DNA, 25 bp, Mus musculus
gttgcaatcggctgtcagaggtgca

SEQ ID NO: 732382 - DNA, 25 bp, Mus musculus
gttgcaatctttacagagaattcta

SEQ ID NO: 732383 - DNA, 25 bp, Mus musculus
gttgcaatcttttcagagaattcta

SEQ ID NO: 732384 - DNA, 25 bp, Mus musculus
gttgcaatgaacaacacacactttc

SEQ ID NO: 732385 - DNA, 25 bp, Mus musculus
gttgcaatgaactacacacactttc

SEQ ID NO: 732386 - DNA, 25 bp, Mus musculus
gttgcaatggaaccttgttgatact

SEQ ID NO: 732387 - DNA, 25 bp, Mus musculus
gttgcaatggaagcttgttgatact

SEQ ID NO: 732388 - DNA, 25 bp, Mus musculus
gttgcaattcccattcgccaaatga

SEQ ID NO: 732389 - DNA, 25 bp, Mus musculus
gttgcaattccctttcgccaaatga

SEQ ID NO: 732390 - DNA, 25 bp, Mus musculus
gttgcacaaaatagctttccactat

SEQ ID NO: 732391 - DNA, 25 bp, Mus musculus
gttgcacaaaattgctttccactat

SEQ ID NO: 732392 - DNA, 25 bp, Mus musculus
gttgcacacaggattattcatgctg

SEQ ID NO: 732393 - DNA, 25 bp, Mus musculus
gttgcacacaggtttattcatgctg

SEQ ID NO: 732394 - DNA, 25 bp, Mus musculus
gttgcacacagtatacgctggctag

SEQ ID NO: 732395 - DNA, 25 bp, Mus musculus
gttgcacacagtttacgctggctag

SEQ ID NO: 732396 - DNA, 25 bp, Mus musculus
gttgcacacgtcagcgtaatggtga

SEQ ID NO: 732397 - DNA, 25 bp, Mus musculus
gttgcacacgtctgcgtaatggtga

SEQ ID NO: 732398 - DNA, 25 bp, Mus musculus
gttgcacagagacactttccagctg

SEQ ID NO: 732399 - DNA, 25 bp, Mus musculus
gttgcacagagagactttccagctg

SEQ ID NO: 732400 - DNA, 25 bp, Mus musculus
gttgcacagatcctgattcagacca

SEQ ID NO: 732401 - DNA, 25 bp, Mus musculus
gttgcacagatcgtgattcagacca

SEQ ID NO: 732402 - DNA, 25 bp, Mus musculus
gttgcacagcagctctttagttttc

SEQ ID NO: 732403 - DNA, 25 bp, Mus musculus
gttgcacagcaggtctttagttttc

SEQ ID NO: 732404 - DNA, 25 bp, Mus musculus
gttgcacagcatcactttaccacag

SEQ ID NO: 732405 - DNA, 25 bp, Mus musculus
gttgcacagcatgactttaccacag

SEQ ID NO: 732406 - DNA, 25 bp, Mus musculus
gttgcacagccaaaacctaagactt

SEQ ID NO: 732407 - DNA, 25 bp, Mus musculus
gttgcacagccataacctaagactt

SEQ ID NO: 732408 - DNA, 25 bp, Mus musculus
gttgcacaggcactacttgttctct

SEQ ID NO: 732409 - DNA, 25 bp, Mus musculus
gttgcacaggcacttggatttgaat

SEQ ID NO: 732410 - DNA, 25 bp, Mus musculus
gttgcacaggcagtacttgttctct

SEQ ID NO: 732411 - DNA, 25 bp, Mus musculus
gttgcacaggcagttggatttgaat

SEQ ID NO: 732412 - DNA, 25 bp, Mus musculus
gttgcacagtggaatgactcctctc

SEQ ID NO: 732413 - DNA, 25 bp, Mus musculus
gttgcacagtggtatgactcctctc

SEQ ID NO: 732414 - DNA, 25 bp, Mus musculus
gttgcacataacatttttggtataa

SEQ ID NO: 732415 - DNA, 25 bp, Mus musculus
gttgcacataacttttttggtataa

SEQ ID NO: 732416 - DNA, 25 bp, Mus musculus
gttgcacatactacactctgacttg

SEQ ID NO: 732417 - DNA, 25 bp, Mus musculus
gttgcacatacttcactctgacttg

SEQ ID NO: 732418 - DNA, 25 bp, Mus musculus
gttgcacatcgacatatagcattgt

SEQ ID NO: 732419 - DNA, 25 bp, Mus musculus
gttgcacatcgagatatagcattgt

SEQ ID NO: 732420 - DNA, 25 bp, Mus musculus
gttgcacatggcatcttcagattcg

SEQ ID NO: 732421 - DNA, 25 bp, Mus musculus
gttgcacatggcttcttcagattcg

SEQ ID NO: 732422 - DNA, 25 bp, Mus musculus
gttgcacatgtaaaatacctcctgt

SEQ ID NO: 732423 - DNA, 25 bp, Mus musculus
gttgcacatgtataatacctcctgt

SEQ ID NO: 732424 - DNA, 25 bp, Mus musculus
gttgcacatgtgcagttggactaca

SEQ ID NO: 732425 - DNA, 25 bp, Mus musculus
gttgcacatgtggagttggactaca

SEQ ID NO: 732426 - DNA, 25 bp, Mus musculus
gttgcacattacattcctttgaggg

SEQ ID NO: 732427 - DNA, 25 bp, Mus musculus
gttgcacattactttcctttgaggg

SEQ ID NO: 732428 - DNA, 25 bp, Mus musculus
gttgcacccagcaagagggagtgct

SEQ ID NO: 732429 - DNA, 25 bp, Mus musculus
gttgcacccagctagagggagtgct

SEQ ID NO: 732430 - DNA, 25 bp, Mus musculus
gttgcaccgataccatggccgccag

SEQ ID NO: 732431 - DNA, 25 bp, Mus musculus
gttgcaccgatagcatggccgccag

SEQ ID NO: 732432 - DNA, 25 bp, Mus musculus
gttgcacctgcaacttctgagccaa

SEQ ID NO: 732433 - DNA, 25 bp, Mus musculus
gttgcacctgcatcttctgagccaa

SEQ ID NO: 732434 - DNA, 25 bp, Mus musculus
gttgcacctggcacgggcagaggct

SEQ ID NO: 732435 - DNA, 25 bp, Mus musculus
gttgcacctggctcgggcagaggct

SEQ ID NO: 732436 - DNA, 25 bp, Mus musculus
gttgcacgaaccactaattgtcctg

SEQ ID NO: 732437 - DNA, 25 bp, Mus musculus
gttgcacgaacctctaattgtcctg

SEQ ID NO: 732438 - DNA, 25 bp, Mus musculus
gttgcacgaactctctaggacttag

SEQ ID NO: 732439 - DNA, 25 bp, Mus musculus
gttgcacgaactgtctaggacttag

SEQ ID NO: 732440 - DNA, 25 bp, Mus musculus
gttgcacgactcagagattccagga

SEQ ID NO: 732441 - DNA, 25 bp, Mus musculus
gttgcacgactctgagattccagga

SEQ ID NO: 732442 - DNA, 25 bp, Mus musculus
gttgcacggttgcaagccttgtttc

SEQ ID NO: 732443 - DNA, 25 bp, Mus musculus
gttgcacggttggaagccttgtttc

SEQ ID NO: 732444 - DNA, 25 bp, Mus musculus
gttgcacgtaaacaatcacattgtc

SEQ ID NO: 732445 - DNA, 25 bp, Mus musculus
gttgcacgtaaagaatcacattgtc

SEQ ID NO: 732446 - DNA, 25 bp, Mus musculus
gttgcacgtagtaacctaccagaat

SEQ ID NO: 732447 - DNA, 25 bp, Mus musculus
gttgcacgtagttacctaccagaat

SEQ ID NO: 732448 - DNA, 25 bp, Mus musculus
gttgcacgtgcaaacaaatccaaat

SEQ ID NO: 732449 - DNA, 25 bp, Mus musculus
gttgcacgtgcatacaaatccaaat

SEQ ID NO: 732450 - DNA, 25 bp, Mus musculus
gttgcactacaaacactgaccaaat

SEQ ID NO: 732451 - DNA, 25 bp, Mus musculus
gttgcactacaatcactgaccaaat

SEQ ID NO: 732452 - DNA, 25 bp, Mus musculus
gttgcactagtaatttaccaccaga

SEQ ID NO: 732453 - DNA, 25 bp, Mus musculus
gttgcactagtattttaccaccaga

SEQ ID NO: 732454 - DNA, 25 bp, Mus musculus
gttgcactcgaacacgttttgtttt

SEQ ID NO: 732455 - DNA, 25 bp, Mus musculus
gttgcactcgaagacgttttgtttt

SEQ ID NO: 732456 - DNA, 25 bp, Mus musculus
gttgcactcgggaccaccagaggag

SEQ ID NO: 732457 - DNA, 25 bp, Mus musculus
gttgcactcgggtccaccagaggag

SEQ ID NO: 732458 - DNA, 25 bp, Mus musculus
gttgcactcgtacttattcactcaa

SEQ ID NO: 732459 - DNA, 25 bp, Mus musculus
gttgcactcgtagttattcactcaa

SEQ ID NO: 732460 - DNA, 25 bp, Mus musculus
gttgcactctcactgacgagttcgc

SEQ ID NO: 732461 - DNA, 25 bp, Mus musculus
gttgcactctcagtgacgagttcgc

SEQ ID NO: 732462 - DNA, 25 bp, Mus musculus
gttgcactgctcagctgttgcaaag

SEQ ID NO: 732463 - DNA, 25 bp, Mus musculus
gttgcactgctctgctgttgcaaag

SEQ ID NO: 732464 - DNA, 25 bp, Mus musculus
gttgcactgtgaaagaggaggaaat

SEQ ID NO: 732465 - DNA, 25 bp, Mus musculus
gttgcactgtgatagaggaggaaat

SEQ ID NO: 732466 - DNA, 25 bp, Mus musculus
gttgcactgtgtagcatacacttgg

SEQ ID NO: 732467 - DNA, 25 bp, Mus musculus
gttgcactgtgttgcatacacttgg

SEQ ID NO: 732468 - DNA, 25 bp, Mus musculus
gttgcacttataacatcctctgaca

SEQ ID NO: 732469 - DNA, 25 bp, Mus musculus
gttgcacttatatcatcctctgaca

SEQ ID NO: 732470 - DNA, 25 bp, Mus musculus
gttgcacttcacacttcagactgat

SEQ ID NO: 732471 - DNA, 25 bp, Mus musculus
gttgcacttcactcttcagactgat

SEQ ID NO: 732472 - DNA, 25 bp, Mus musculus
gttgcactttggcatggcgcatttg

SEQ ID NO: 732473 - DNA, 25 bp, Mus musculus
gttgcactttgggatggcgcatttg

SEQ ID NO: 732474 - DNA, 25 bp, Mus musculus
gttgcactttgtagtcagtttgaat

SEQ ID NO: 732475 - DNA, 25 bp, Mus musculus
gttgcactttgttgtcagtttgaat

SEQ ID NO: 732476 - DNA, 25 bp, Mus musculus
gttgcagaaggcaggcctggcacca

SEQ ID NO: 732477 - DNA, 25 bp, Mus musculus
gttgcagaaggctggcctggcacca

SEQ ID NO: 732478 - DNA, 25 bp, Mus musculus
gttgcagaatcactagtcttcgttt

SEQ ID NO: 732479 - DNA, 25 bp, Mus musculus
gttgcagaatcagtagtcttcgttt

SEQ ID NO: 732480 - DNA, 25 bp, Mus musculus
gttgcagaatgcaattcttttagtt

SEQ ID NO: 732481 - DNA, 25 bp, Mus musculus
gttgcagaatgctattcttttagtt

SEQ ID NO: 732482 - DNA, 25 bp, Mus musculus
gttgcagacctgctgagtaatcttt

SEQ ID NO: 732483 - DNA, 25 bp, Mus musculus
gttgcagacctggtgagtaatcttt

SEQ ID NO: 732484 - DNA, 25 bp, Mus musculus
gttgcagactcacaacaactgggct

SEQ ID NO: 732485 - DNA, 25 bp, Mus musculus
gttgcagactcagaacaactgggct

SEQ ID NO: 732486 - DNA, 25 bp, Mus musculus
gttgcagagcaaattccaaaaagac

SEQ ID NO: 732487 - DNA, 25 bp, Mus musculus
gttgcagagcaatttccaaaaagac

SEQ ID NO: 732488 - DNA, 25 bp, Mus musculus
gttgcagagtataacctcctggtgt

SEQ ID NO: 732489 - DNA, 25 bp, Mus musculus
gttgcagagtattacctcctggtgt

SEQ ID NO: 732490 - DNA, 25 bp, Mus musculus
gttgcagagtcacagttcacccact

SEQ ID NO: 732491 - DNA, 25 bp, Mus musculus
gttgcagagtcagagttcacccact

SEQ ID NO: 732492 - DNA, 25 bp, Mus musculus
gttgcagatcagctttctgtgctag

SEQ ID NO: 732493 - DNA, 25 bp, Mus musculus
gttgcagatcaggtttctgtgctag

SEQ ID NO: 732494 - DNA, 25 bp, Mus musculus
gttgcagatggtccgaggacactta

SEQ ID NO: 732495 - DNA, 25 bp, Mus musculus
gttgcagatggtgcgaggacactta

SEQ ID NO: 732496 - DNA, 25 bp, Mus musculus
gttgcagatgttacacagttcaaag

SEQ ID NO: 732497 - DNA, 25 bp, Mus musculus
gttgcagatgtttcacagttcaaag

SEQ ID NO: 732498 - DNA, 25 bp, Mus musculus
gttgcagcaaggaagcttgggtctt

SEQ ID NO: 732499 - DNA, 25 bp, Mus musculus
gttgcagcaaggtagcttgggtctt

SEQ ID NO: 732500 - DNA, 25 bp, Mus musculus
gttgcagcacaactaaaatgcctta

SEQ ID NO: 732501 - DNA, 25 bp, Mus musculus
gttgcagcacaagtaaaatgcctta

SEQ ID NO: 732502 - DNA, 25 bp, Mus musculus
gttgcagcagctctaacatctggct

SEQ ID NO: 732503 - DNA, 25 bp, Mus musculus
gttgcagcagctgtaacatctggct

SEQ ID NO: 732504 - DNA, 25 bp, Mus musculus
gttgcagcattaacagttacacagt

SEQ ID NO: 732505 - DNA, 25 bp, Mus musculus
gttgcagcattatcagttacacagt

SEQ ID NO: 732506 - DNA, 25 bp, Mus musculus
gttgcagccagcaatcctaggagat

SEQ ID NO: 732507 - DNA, 25 bp, Mus musculus
gttgcagccagctatcctaggagat

SEQ ID NO: 732508 - DNA, 25 bp, Mus musculus
gttgcagccattcttcagactggtg

SEQ ID NO: 732509 - DNA, 25 bp, Mus musculus
gttgcagccattgttcagactggtg

SEQ ID NO: 732510 - DNA, 25 bp, Mus musculus
gttgcagcccagaatctgattcaga

SEQ ID NO: 732511 - DNA, 25 bp, Mus musculus
gttgcagcccagtatctgattcaga

SEQ ID NO: 732512 - DNA, 25 bp, Mus musculus
gttgcagccgttccagccgcagctg

SEQ ID NO: 732513 - DNA, 25 bp, Mus musculus
gttgcagccgttgcagccgcagctg

SEQ ID NO: 732514 - DNA, 25 bp, Mus musculus
gttgcagcctcaatccggtgcttta

SEQ ID NO: 732515 - DNA, 25 bp, Mus musculus
gttgcagcctcattccggtgcttta

SEQ ID NO: 732516 - DNA, 25 bp, Mus musculus
gttgcagcgcatcctattttgagaa

SEQ ID NO: 732517 - DNA, 25 bp, Mus musculus
gttgcagcgcatgctattttgagaa

SEQ ID NO: 732518 - DNA, 25 bp, Mus musculus
gttgcagcggtaagaacgggtcctc

SEQ ID NO: 732519 - DNA, 25 bp, Mus musculus
gttgcagcggtatgaacgggtcctc

SEQ ID NO: 732520 - DNA, 25 bp, Mus musculus
gttgcagctacacatacctcggata

SEQ ID NO: 732521 - DNA, 25 bp, Mus musculus
gttgcagctacagatacctcggata

SEQ ID NO: 732522 - DNA, 25 bp, Mus musculus
gttgcagctgtaaggcagttacatc

SEQ ID NO: 732523 - DNA, 25 bp, Mus musculus
gttgcagctgtatggcagttacatc

SEQ ID NO: 732524 - DNA, 25 bp, Mus musculus
gttgcagctgtgattaacgtagagt

SEQ ID NO: 732525 - DNA, 25 bp, Mus musculus
gttgcagctgtgtttaacgtagagt

SEQ ID NO: 732526 - DNA, 25 bp, Mus musculus
gttgcagcttgtactctgagcacaa

SEQ ID NO: 732527 - DNA, 25 bp, Mus musculus
gttgcagcttgttctctgagcacaa

SEQ ID NO: 732528 - DNA, 25 bp, Mus musculus
gttgcaggacagcatctctcagata

SEQ ID NO: 732529 - DNA, 25 bp, Mus musculus
gttgcaggacaggatctctcagata

SEQ ID NO: 732530 - DNA, 25 bp, Mus musculus
gttgcaggatttactatgtcccatt

SEQ ID NO: 732531 - DNA, 25 bp, Mus musculus
gttgcaggattttctatgtcccatt

SEQ ID NO: 732532 - DNA, 25 bp, Mus musculus
gttgcaggcaacctgaagatatatc

SEQ ID NO: 732533 - DNA, 25 bp, Mus musculus
gttgcaggcaacctttaagcatcag

SEQ ID NO: 732534 - DNA, 25 bp, Mus musculus
gttgcaggcaacgtgaagatatatc

SEQ ID NO: 732535 - DNA, 25 bp, Mus musculus
gttgcaggcaacgtttaagcatcag

SEQ ID NO: 732536 - DNA, 25 bp, Mus musculus
gttgcaggcacacgctgggttctaa

SEQ ID NO: 732537 - DNA, 25 bp, Mus musculus
gttgcaggcacacttgactgctctt

SEQ ID NO: 732538 - DNA, 25 bp, Mus musculus
gttgcaggcacaggctgggttctaa

SEQ ID NO: 732539 - DNA, 25 bp, Mus musculus
gttgcaggcacagttgactgctctt

SEQ ID NO: 732540 - DNA, 25 bp, Mus musculus
gttgcaggcactcatgcttctgtgc

SEQ ID NO: 732541 - DNA, 25 bp, Mus musculus
gttgcaggcactgatgcttctgtgc

SEQ ID NO: 732542 - DNA, 25 bp, Mus musculus
gttgcaggcctgagtttacctggga

SEQ ID NO: 732543 - DNA, 25 bp, Mus musculus
gttgcaggcctgtgtttacctggga

SEQ ID NO: 732544 - DNA, 25 bp, Mus musculus
gttgcaggccttcgactttctgcca

SEQ ID NO: 732545 - DNA, 25 bp, Mus musculus
gttgcaggccttggactttctgcca

SEQ ID NO: 732546 - DNA, 25 bp, Mus musculus
gttgcaggcgaacttgattttgctt

SEQ ID NO: 732547 - DNA, 25 bp, Mus musculus
gttgcaggcgaagttgattttgctt

SEQ ID NO: 732548 - DNA, 25 bp, Mus musculus
gttgcaggctcacatgaccagacat

SEQ ID NO: 732549 - DNA, 25 bp, Mus musculus
gttgcaggctcagatgaccagacat

SEQ ID NO: 732550 - DNA, 25 bp, Mus musculus
gttgcaggcttactgctcagtgaga

SEQ ID NO: 732551 - DNA, 25 bp, Mus musculus
gttgcaggcttagtgctcagtgaga

SEQ ID NO: 732552 - DNA, 25 bp, Mus musculus
gttgcagggaccacattactcattg

SEQ ID NO: 732553 - DNA, 25 bp, Mus musculus
gttgcagggacctcattactcattg

SEQ ID NO: 732554 - DNA, 25 bp, Mus musculus
gttgcagggctaaccccaaaagtgt

SEQ ID NO: 732555 - DNA, 25 bp, Mus musculus
gttgcagggctatccccaaaagtgt

SEQ ID NO: 732556 - DNA, 25 bp, Mus musculus
gttgcaggtctcaaacaattgagag

SEQ ID NO: 732557 - DNA, 25 bp, Mus musculus
gttgcaggtctctaacaattgagag

SEQ ID NO: 732558 - DNA, 25 bp, Mus musculus
gttgcaggtgttactaccagtgctg

SEQ ID NO: 732559 - DNA, 25 bp, Mus musculus
gttgcaggtgttacttgctaagagg

SEQ ID NO: 732560 - DNA, 25 bp, Mus musculus
gttgcaggtgtttctaccagtgctg

SEQ ID NO: 732561 - DNA, 25 bp, Mus musculus
gttgcaggtgtttcttgctaagagg

SEQ ID NO: 732562 - DNA, 25 bp, Mus musculus
gttgcaggtttacttttctcatatg

SEQ ID NO: 732563 - DNA, 25 bp, Mus musculus
gttgcaggtttagttttctcatatg

SEQ ID NO: 732564 - DNA, 25 bp, Mus musculus
gttgcagtcataccgcaccaacggg

SEQ ID NO: 732565 - DNA, 25 bp, Mus musculus
gttgcagtcatagcgcaccaacggg

SEQ ID NO: 732566 - DNA, 25 bp, Mus musculus
gttgcagtctcacatgattcataac

SEQ ID NO: 732567 - DNA, 25 bp, Mus musculus
gttgcagtctcagatgattcataac

SEQ ID NO: 732568 - DNA, 25 bp, Mus musculus
gttgcagtcttcatcatctgttgga

SEQ ID NO: 732569 - DNA, 25 bp, Mus musculus
gttgcagtcttcttcatctgttgga

SEQ ID NO: 732570 - DNA, 25 bp, Mus musculus
gttgcagtctttacagtcacaccag

SEQ ID NO: 732571 - DNA, 25 bp, Mus musculus
gttgcagtcttttcagtcacaccag

SEQ ID NO: 732572 - DNA, 25 bp, Mus musculus
gttgcagtgattctggtcaccctga

SEQ ID NO: 732573 - DNA, 25 bp, Mus musculus
gttgcagtgattgtggtcaccctga

SEQ ID NO: 732574 - DNA, 25 bp, Mus musculus
gttgcagtgcacaaaaggggcccag

SEQ ID NO: 732575 - DNA, 25 bp, Mus musculus
gttgcagtgcactaaaggggcccag

SEQ ID NO: 732576 - DNA, 25 bp, Mus musculus
gttgcagtgcctcgatccttctcag

SEQ ID NO: 732577 - DNA, 25 bp, Mus musculus
gttgcagtgcctggatccttctcag

SEQ ID NO: 732578 - DNA, 25 bp, Mus musculus
gttgcagttcatagccaaacagggc

SEQ ID NO: 732579 - DNA, 25 bp, Mus musculus
gttgcagttcattgccaaacagggc

SEQ ID NO: 732580 - DNA, 25 bp, Mus musculus
gttgcagttctgagtaatgggctat

SEQ ID NO: 732581 - DNA, 25 bp, Mus musculus
gttgcagttctgtgtaatgggctat

SEQ ID NO: 732582 - DNA, 25 bp, Mus musculus
gttgcataaacaatttctgaacttt

SEQ ID NO: 732583 - DNA, 25 bp, Mus musculus
gttgcataaacattttctgaacttt

SEQ ID NO: 732584 - DNA, 25 bp, Mus musculus
gttgcataagctacttttataagta

SEQ ID NO: 732585 - DNA, 25 bp, Mus musculus
gttgcataagctagtgatcagatcg

SEQ ID NO: 732586 - DNA, 25 bp, Mus musculus
gttgcataagcttcttttataagta

SEQ ID NO: 732587 - DNA, 25 bp, Mus musculus
gttgcataagcttgtgatcagatcg

SEQ ID NO: 732588 - DNA, 25 bp, Mus musculus
gttgcataaggacccgtgtttcctt

SEQ ID NO: 732589 - DNA, 25 bp, Mus musculus
gttgcataaggagccgtgtttcctt

SEQ ID NO: 732590 - DNA, 25 bp, Mus musculus
gttgcatacagtctaggctggccta

SEQ ID NO: 732591 - DNA, 25 bp, Mus musculus
gttgcatacagtgtaggctggccta

SEQ ID NO: 732592 - DNA, 25 bp, Mus musculus
gttgcatacctgattacaaatgtgt

SEQ ID NO: 732593 - DNA, 25 bp, Mus musculus
gttgcatacctgtttacaaatgtgt

SEQ ID NO: 732594 - DNA, 25 bp, Mus musculus
gttgcatactaaatctgactacaga

SEQ ID NO: 732595 - DNA, 25 bp, Mus musculus
gttgcatactaattctgactacaga

SEQ ID NO: 732596 - DNA, 25 bp, Mus musculus
gttgcatagattattcacataatac

SEQ ID NO: 732597 - DNA, 25 bp, Mus musculus
gttgcatagatttttcacataatac

SEQ ID NO: 732598 - DNA, 25 bp, Mus musculus
gttgcatagcaacacatgtctcaac

SEQ ID NO: 732599 - DNA, 25 bp, Mus musculus
gttgcatagcaagacatgtctcaac

SEQ ID NO: 732600 - DNA, 25 bp, Mus musculus
gttgcatatggccaagttcttggag

SEQ ID NO: 732601 - DNA, 25 bp, Mus musculus
gttgcatatggcgaagttcttggag

SEQ ID NO: 732602 - DNA, 25 bp, Mus musculus
gttgcatatttcatgtgcacaaata

SEQ ID NO: 732603 - DNA, 25 bp, Mus musculus
gttgcatatttcttgtgcacaaata

SEQ ID NO: 732604 - DNA, 25 bp, Mus musculus
gttgcatatttgatgaaaccactaa

SEQ ID NO: 732605 - DNA, 25 bp, Mus musculus
gttgcatatttgttgaaaccactaa

SEQ ID NO: 732606 - DNA, 25 bp, Mus musculus
gttgcatcaaccctatcatataccc

SEQ ID NO: 732607 - DNA, 25 bp, Mus musculus
gttgcatcaaccgtatcatataccc

SEQ ID NO: 732608 - DNA, 25 bp, Mus musculus
gttgcatcaagaacccatagggtgt

SEQ ID NO: 732609 - DNA, 25 bp, Mus musculus
gttgcatcaagatcccatagggtgt

SEQ ID NO: 732610 - DNA, 25 bp, Mus musculus
gttgcatcatctctactattctgtg

SEQ ID NO: 732611 - DNA, 25 bp, Mus musculus
gttgcatcatctgtactattctgtg

SEQ ID NO: 732612 - DNA, 25 bp, Mus musculus
gttgcatccctacgtttttcagttt

SEQ ID NO: 732613 - DNA, 25 bp, Mus musculus
gttgcatccctaggtttttcagttt

SEQ ID NO: 732614 - DNA, 25 bp, Mus musculus
gttgcatcgattctggcctctgggt

SEQ ID NO: 732615 - DNA, 25 bp, Mus musculus
gttgcatcgattgtggcctctgggt

SEQ ID NO: 732616 - DNA, 25 bp, Mus musculus
gttgcatctggtaccctagactaaa

SEQ ID NO: 732617 - DNA, 25 bp, Mus musculus
gttgcatctggtctactcagcgctt

SEQ ID NO: 732618 - DNA, 25 bp, Mus musculus
gttgcatctggtgtactcagcgctt

SEQ ID NO: 732619 - DNA, 25 bp, Mus musculus
gttgcatctggttccctagactaaa

SEQ ID NO: 732620 - DNA, 25 bp, Mus musculus
gttgcatcttcacagcaccgagatt

SEQ ID NO: 732621 - DNA, 25 bp, Mus musculus
gttgcatcttcagagcaccgagatt

SEQ ID NO: 732622 - DNA, 25 bp, Mus musculus
gttgcatctttaactttgtagttca

SEQ ID NO: 732623 - DNA, 25 bp, Mus musculus
gttgcatctttatctttgtagttca

SEQ ID NO: 732624 - DNA, 25 bp, Mus musculus
gttgcatctttcctatggccaagga

SEQ ID NO: 732625 - DNA, 25 bp, Mus musculus
gttgcatctttcgtatggccaagga

SEQ ID NO: 732626 - DNA, 25 bp, Mus musculus
gttgcatctttgaatttattacttg

SEQ ID NO: 732627 - DNA, 25 bp, Mus musculus
gttgcatctttgtatttattacttg

SEQ ID NO: 732628 - DNA, 25 bp, Mus musculus
gttgcatgaagtatccttgtaggat

SEQ ID NO: 732629 - DNA, 25 bp, Mus musculus
gttgcatgaagtttccttgtaggat

SEQ ID NO: 732630 - DNA, 25 bp, Mus musculus
gttgcatgagagattcacctgataa

SEQ ID NO: 732631 - DNA, 25 bp, Mus musculus
gttgcatgagagtttcacctgataa

SEQ ID NO: 732632 - DNA, 25 bp, Mus musculus
gttgcatgagttattcttcgttgtt

SEQ ID NO: 732633 - DNA, 25 bp, Mus musculus
gttgcatgagtttttcttcgttgtt

SEQ ID NO: 732634 - DNA, 25 bp, Mus musculus
gttgcatgatgacatctaccagggc

SEQ ID NO: 732635 - DNA, 25 bp, Mus musculus
gttgcatgatgagatctaccagggc

SEQ ID NO: 732636 - DNA, 25 bp, Mus musculus
gttgcatgattaatgtccctgttga

SEQ ID NO: 732637 - DNA, 25 bp, Mus musculus
gttgcatgattattgtccctgttga

SEQ ID NO: 732638 - DNA, 25 bp, Mus musculus
gttgcatgcaagctgtgacaccctc

SEQ ID NO: 732639 - DNA, 25 bp, Mus musculus
gttgcatgcaaggtgtgacaccctc

SEQ ID NO: 732640 - DNA, 25 bp, Mus musculus
gttgcatgcatacttgatttttcct

SEQ ID NO: 732641 - DNA, 25 bp, Mus musculus
gttgcatgcatagttgatttttcct

SEQ ID NO: 732642 - DNA, 25 bp, Mus musculus
gttgcatgccttaaaagatgtcagt

SEQ ID NO: 732643 - DNA, 25 bp, Mus musculus
gttgcatgccttaatctaaacacat

SEQ ID NO: 732644 - DNA, 25 bp, Mus musculus
gttgcatgcctttaaagatgtcagt

SEQ ID NO: 732645 - DNA, 25 bp, Mus musculus
gttgcatgcctttatctaaacacat

SEQ ID NO: 732646 - DNA, 25 bp, Mus musculus
gttgcatgctttaggtgatgtgtct

SEQ ID NO: 732647 - DNA, 25 bp, Mus musculus
gttgcatgcttttggtgatgtgtct

SEQ ID NO: 732648 - DNA, 25 bp, Mus musculus
gttgcatggctgaatgaccgatcac

SEQ ID NO: 732649 - DNA, 25 bp, Mus musculus
gttgcatggctgtatgaccgatcac

SEQ ID NO: 732650 - DNA, 25 bp, Mus musculus
gttgcatgtagtagcaccctgacat

SEQ ID NO: 732651 - DNA, 25 bp, Mus musculus
gttgcatgtagttgcaccctgacat

SEQ ID NO: 732652 - DNA, 25 bp, Mus musculus
gttgcatgtgttacataccaggcga

SEQ ID NO: 732653 - DNA, 25 bp, Mus musculus
gttgcatgtgtttcataccaggcga

SEQ ID NO: 732654 - DNA, 25 bp, Mus musculus
gttgcattcaaaaaccgtgttcatt

SEQ ID NO: 732655 - DNA, 25 bp, Mus musculus
gttgcattcaaataccgtgttcatt

SEQ ID NO: 732656 - DNA, 25 bp, Mus musculus
gttgcattcatgatcacatcctgat

SEQ ID NO: 732657 - DNA, 25 bp, Mus musculus
gttgcattcatgttcacatcctgat

SEQ ID NO: 732658 - DNA, 25 bp, Mus musculus
gttgcattccctcttgcagtggaaa

SEQ ID NO: 732659 - DNA, 25 bp, Mus musculus
gttgcattccctgttgcagtggaaa

SEQ ID NO: 732660 - DNA, 25 bp, Mus musculus
gttgcattcgtcagctaatctgtaa

SEQ ID NO: 732661 - DNA, 25 bp, Mus musculus
gttgcattcgtctgctaatctgtaa

SEQ ID NO: 732662 - DNA, 25 bp, Mus musculus
gttgcattcttactgggataactca

SEQ ID NO: 732663 - DNA, 25 bp, Mus musculus
gttgcattcttagtgggataactca

SEQ ID NO: 732664 - DNA, 25 bp, Mus musculus
gttgcattgtggcacattcctcgga

SEQ ID NO: 732665 - DNA, 25 bp, Mus musculus
gttgcattgtgggacattcctcgga

SEQ ID NO: 732666 - DNA, 25 bp, Mus musculus
gttgcattgttcagtttagcccata

SEQ ID NO: 732667 - DNA, 25 bp, Mus musculus
gttgcattgttctgtttagcccata

SEQ ID NO: 732668 - DNA, 25 bp, Mus musculus
gttgcatttctcagacaatgaagtg

SEQ ID NO: 732669 - DNA, 25 bp, Mus musculus
gttgcatttctctgacaatgaagtg

SEQ ID NO: 732670 - DNA, 25 bp, Mus musculus
gttgcatttgatacttttcacttga

SEQ ID NO: 732671 - DNA, 25 bp, Mus musculus
gttgcatttgattcttttcacttga

SEQ ID NO: 732672 - DNA, 25 bp, Mus musculus
gttgcatttgtaatgaagttttccc

SEQ ID NO: 732673 - DNA, 25 bp, Mus musculus
gttgcatttgtattgaagttttccc

SEQ ID NO: 732674 - DNA, 25 bp, Mus musculus
gttgcatttttgaaggactccactg

SEQ ID NO: 732675 - DNA, 25 bp, Mus musculus
gttgcatttttgtaggactccactg

SEQ ID NO: 732676 - DNA, 25 bp, Mus musculus
gttgcattttttccctatgtagtct

SEQ ID NO: 732677 - DNA, 25 bp, Mus musculus
gttgcattttttgcctatgtagtct

SEQ ID NO: 732678 - DNA, 25 bp, Mus musculus
gttgccaaagccctctgtgtcttct

SEQ ID NO: 732679 - DNA, 25 bp, Mus musculus
gttgccaaagccgtctgtgtcttct

SEQ ID NO: 732680 - DNA, 25 bp, Mus musculus
gttgccaaagtcagtattcggtcct

SEQ ID NO: 732681 - DNA, 25 bp, Mus musculus
gttgccaaagtctgtattcggtcct

SEQ ID NO: 732682 - DNA, 25 bp, Mus musculus
gttgccaaagtgctgtccagaattt

SEQ ID NO: 732683 - DNA, 25 bp, Mus musculus
gttgccaaagtggtgtccagaattt

SEQ ID NO: 732684 - DNA, 25 bp, Mus musculus
gttgccaacaacatattacacttaa

SEQ ID NO: 732685 - DNA, 25 bp, Mus musculus
gttgccaacaacttattacacttaa

SEQ ID NO: 732686 - DNA, 25 bp, Mus musculus
gttgccaacttgaaactgcacttga

SEQ ID NO: 732687 - DNA, 25 bp, Mus musculus
gttgccaacttgtaactgcacttga

SEQ ID NO: 732688 - DNA, 25 bp, Mus musculus
gttgccaagcaactgtttccttaat

SEQ ID NO: 732689 - DNA, 25 bp, Mus musculus
gttgccaagcaagtgtttccttaat

SEQ ID NO: 732690 - DNA, 25 bp, Mus musculus
gttgccaagcagaatataaccctat

SEQ ID NO: 732691 - DNA, 25 bp, Mus musculus
gttgccaagcagtatataaccctat

SEQ ID NO: 732692 - DNA, 25 bp, Mus musculus
gttgccaagctaactgtcattcttt

SEQ ID NO: 732693 - DNA, 25 bp, Mus musculus
gttgccaagctatctgtcattcttt

SEQ ID NO: 732694 - DNA, 25 bp, Mus musculus
gttgccaaggttcagaataccacaa

SEQ ID NO: 732695 - DNA, 25 bp, Mus musculus
gttgccaaggttgagaataccacaa

SEQ ID NO: 732696 - DNA, 25 bp, Mus musculus
gttgccaagtaaccagaactgctga

SEQ ID NO: 732697 - DNA, 25 bp, Mus musculus
gttgccaagtaagcagaactgctga

SEQ ID NO: 732698 - DNA, 25 bp, Mus musculus
gttgccaatagaacactgtgtccca

SEQ ID NO: 732699 - DNA, 25 bp, Mus musculus
gttgccaatagatcactgtgtccca

SEQ ID NO: 732700 - DNA, 25 bp, Mus musculus
gttgccaatgttactagggattcca

SEQ ID NO: 732701 - DNA, 25 bp, Mus musculus
gttgccaatgtttctagggattcca

SEQ ID NO: 732702 - DNA, 25 bp, Mus musculus
gttgccacacttcaggaagcttcag

SEQ ID NO: 732703 - DNA, 25 bp, Mus musculus
gttgccacacttgaggaagcttcag

SEQ ID NO: 732704 - DNA, 25 bp, Mus musculus
gttgccacagagatcttaccatcat

SEQ ID NO: 732705 - DNA, 25 bp, Mus musculus
gttgccacagagttcttaccatcat

SEQ ID NO: 732706 - DNA, 25 bp, Mus musculus
gttgccacagcaaacatcctgcatg

SEQ ID NO: 732707 - DNA, 25 bp, Mus musculus
gttgccacagcacagtttcatgcag

SEQ ID NO: 732708 - DNA, 25 bp, Mus musculus
gttgccacagcagagtttcatgcag

SEQ ID NO: 732709 - DNA, 25 bp, Mus musculus
gttgccacagcatacatcctgcatg

SEQ ID NO: 732710 - DNA, 25 bp, Mus musculus
gttgccacagctagcattgtgcaca

SEQ ID NO: 732711 - DNA, 25 bp, Mus musculus
gttgccacagcttgcattgtgcaca

SEQ ID NO: 732712 - DNA, 25 bp, Mus musculus
gttgccaccaaaaggaagtatttgc

SEQ ID NO: 732713 - DNA, 25 bp, Mus musculus
gttgccaccaaatggaagtatttgc

SEQ ID NO: 732714 - DNA, 25 bp, Mus musculus
gttgccaccaacagaaaccttgagt

SEQ ID NO: 732715 - DNA, 25 bp, Mus musculus
gttgccaccaacctaaatcctgtgc

SEQ ID NO: 732716 - DNA, 25 bp, Mus musculus
gttgccaccaacgtaaatcctgtgc

SEQ ID NO: 732717 - DNA, 25 bp, Mus musculus
gttgccaccaactgaaaccttgagt

SEQ ID NO: 732718 - DNA, 25 bp, Mus musculus
gttgccaccatcagattataagctc

SEQ ID NO: 732719 - DNA, 25 bp, Mus musculus
gttgccaccatctgattataagctc

SEQ ID NO: 732720 - DNA, 25 bp, Mus musculus
gttgccacggatacagtcctagggt

SEQ ID NO: 732721 - DNA, 25 bp, Mus musculus
gttgccacggattcagtcctagggt

SEQ ID NO: 732722 - DNA, 25 bp, Mus musculus
gttgccactaagcagatcacctggg

SEQ ID NO: 732723 - DNA, 25 bp, Mus musculus
gttgccactaaggagatcacctggg

SEQ ID NO: 732724 - DNA, 25 bp, Mus musculus
gttgccactacccttttgttaggca

SEQ ID NO: 732725 - DNA, 25 bp, Mus musculus
gttgccactaccgttttgttaggca

SEQ ID NO: 732726 - DNA, 25 bp, Mus musculus
gttgccactactatataatgcctcc

SEQ ID NO: 732727 - DNA, 25 bp, Mus musculus
gttgccactactttataatgcctcc

SEQ ID NO: 732728 - DNA, 25 bp, Mus musculus
gttgccactcatagttaaccctgat

SEQ ID NO: 732729 - DNA, 25 bp, Mus musculus
gttgccactcattgttaaccctgat

SEQ ID NO: 732730 - DNA, 25 bp, Mus musculus
gttgccactccaattagttacctgt

SEQ ID NO: 732731 - DNA, 25 bp, Mus musculus
gttgccactccatttagttacctgt

SEQ ID NO: 732732 - DNA, 25 bp, Mus musculus
gttgccacttagatgcatttcagat

SEQ ID NO: 732733 - DNA, 25 bp, Mus musculus
gttgccacttagttgcatttcagat

SEQ ID NO: 732734 - DNA, 25 bp, Mus musculus
gttgccactttactgagatacgctg

SEQ ID NO: 732735 - DNA, 25 bp, Mus musculus
gttgccactttagtgagatacgctg

SEQ ID NO: 732736 - DNA, 25 bp, Mus musculus
gttgccagactccatgacagttcaa

SEQ ID NO: 732737 - DNA, 25 bp, Mus musculus
gttgccagactcgatgacagttcaa

SEQ ID NO: 732738 - DNA, 25 bp, Mus musculus
gttgccagaggcaacacaagaagat

SEQ ID NO: 732739 - DNA, 25 bp, Mus musculus
gttgccagaggctacacaagaagat

SEQ ID NO: 732740 - DNA, 25 bp, Mus musculus
gttgccagatgaataacctgccaca

SEQ ID NO: 732741 - DNA, 25 bp, Mus musculus
gttgccagatgattaacctgccaca

SEQ ID NO: 732742 - DNA, 25 bp, Mus musculus
gttgccagccgtatataacgtccct

SEQ ID NO: 732743 - DNA, 25 bp, Mus musculus
gttgccagccgtttataacgtccct

SEQ ID NO: 732744 - DNA, 25 bp, Mus musculus
gttgccaggaagaaaaccctcacga

SEQ ID NO: 732745 - DNA, 25 bp, Mus musculus
gttgccaggaagtaaaccctcacga

SEQ ID NO: 732746 - DNA, 25 bp, Mus musculus
gttgccaggacaacgaccctcaatc

SEQ ID NO: 732747 - DNA, 25 bp, Mus musculus
gttgccaggacatcgaccctcaatc

SEQ ID NO: 732748 - DNA, 25 bp, Mus musculus
gttgccaggcatcctagggaaagat

SEQ ID NO: 732749 - DNA, 25 bp, Mus musculus
gttgccaggcatgctagggaaagat

SEQ ID NO: 732750 - DNA, 25 bp, Mus musculus
gttgccaggtcaacttacagtttaa

SEQ ID NO: 732751 - DNA, 25 bp, Mus musculus
gttgccaggtcatcttacagtttaa

SEQ ID NO: 732752 - DNA, 25 bp, Mus musculus
gttgccaggttaacatcggagcctt

SEQ ID NO: 732753 - DNA, 25 bp, Mus musculus
gttgccaggttatcatcggagcctt

SEQ ID NO: 732754 - DNA, 25 bp, Mus musculus
gttgccagtagtaatcagggtgcca

SEQ ID NO: 732755 - DNA, 25 bp, Mus musculus
gttgccagtagttatcagggtgcca

SEQ ID NO: 732756 - DNA, 25 bp, Mus musculus
gttgccagtccacactgtgcaatat

SEQ ID NO: 732757 - DNA, 25 bp, Mus musculus
gttgccagtccagactgtgcaatat

SEQ ID NO: 732758 - DNA, 25 bp, Mus musculus
gttgccagttccaggctataattga

SEQ ID NO: 732759 - DNA, 25 bp, Mus musculus
gttgccagttcctggctataattga

SEQ ID NO: 732760 - DNA, 25 bp, Mus musculus
gttgccatagacaatgccagagctc

SEQ ID NO: 732761 - DNA, 25 bp, Mus musculus
gttgccatagactatgccagagctc

SEQ ID NO: 732762 - DNA, 25 bp, Mus musculus
gttgccatcccacgctgagggccaa

SEQ ID NO: 732763 - DNA, 25 bp, Mus musculus
gttgccatcccaggctgagggccaa

SEQ ID NO: 732764 - DNA, 25 bp, Mus musculus
gttgccatcctgagaataaccaaag

SEQ ID NO: 732765 - DNA, 25 bp, Mus musculus
gttgccatcctgtgaataaccaaag

SEQ ID NO: 732766 - DNA, 25 bp, Mus musculus
gttgccatcgccagtgaaagccaca

SEQ ID NO: 732767 - DNA, 25 bp, Mus musculus
gttgccatcgcctgtgaaagccaca

SEQ ID NO: 732768 - DNA, 25 bp, Mus musculus
gttgccatctaccttgggataaaac

SEQ ID NO: 732769 - DNA, 25 bp, Mus musculus
gttgccatctacgttgggataaaac

SEQ ID NO: 732770 - DNA, 25 bp, Mus musculus
gttgccatctctccttggcctgtaa

SEQ ID NO: 732771 - DNA, 25 bp, Mus musculus
gttgccatctctgcttggcctgtaa

SEQ ID NO: 732772 - DNA, 25 bp, Mus musculus
gttgccatcttacaaacagctgcct

SEQ ID NO: 732773 - DNA, 25 bp, Mus musculus
gttgccatcttagaaacagctgcct

SEQ ID NO: 732774 - DNA, 25 bp, Mus musculus
gttgccatgaaaatatacacagtgc

SEQ ID NO: 732775 - DNA, 25 bp, Mus musculus
gttgccatgaaattatacacagtgc

SEQ ID NO: 732776 - DNA, 25 bp, Mus musculus
gttgccatgatgctactgattgccc

SEQ ID NO: 732777 - DNA, 25 bp, Mus musculus
gttgccatgatggtactgattgccc

SEQ ID NO: 732778 - DNA, 25 bp, Mus musculus
gttgccatgcaaaactctggttcgt

SEQ ID NO: 732779 - DNA, 25 bp, Mus musculus
gttgccatgcaatactctggttcgt

SEQ ID NO: 732780 - DNA, 25 bp, Mus musculus
gttgccatgctcacagcactgatgg

SEQ ID NO: 732781 - DNA, 25 bp, Mus musculus
gttgccatgctctcagcactgatgg

SEQ ID NO: 732782 - DNA, 25 bp, Mus musculus
gttgccatggtgattgatcgcattt

SEQ ID NO: 732783 - DNA, 25 bp, Mus musculus
gttgccatggtgtttgatcgcattt

SEQ ID NO: 732784 - DNA, 25 bp, Mus musculus
gttgccatgtctcgttggttatgaa

SEQ ID NO: 732785 - DNA, 25 bp, Mus musculus
gttgccatgtctggttggttatgaa

SEQ ID NO: 732786 - DNA, 25 bp, Mus musculus
gttgccattcccctagatgctggag

SEQ ID NO: 732787 - DNA, 25 bp, Mus musculus
gttgccattcccgtagatgctggag

SEQ ID NO: 732788 - DNA, 25 bp, Mus musculus
gttgccattgccattgctcatttag

SEQ ID NO: 732789 - DNA, 25 bp, Mus musculus
gttgccattgcctttgctcatttag

SEQ ID NO: 732790 - DNA, 25 bp, Mus musculus
gttgccattggaatagagatctcag

SEQ ID NO: 732791 - DNA, 25 bp, Mus musculus
gttgccattggattagagatctcag

SEQ ID NO: 732792 - DNA, 25 bp, Mus musculus
gttgccatttatactcttttcgacg

SEQ ID NO: 732793 - DNA, 25 bp, Mus musculus
gttgccatttattctcttttcgacg

SEQ ID NO: 732794 - DNA, 25 bp, Mus musculus
gttgccatttgaaatttccttccct

SEQ ID NO: 732795 - DNA, 25 bp, Mus musculus
gttgccatttgatatttccttccct

SEQ ID NO: 732796 - DNA, 25 bp, Mus musculus
gttgccatttgtctaaatactagtc

SEQ ID NO: 732797 - DNA, 25 bp, Mus musculus
gttgccatttgtgtaaatactagtc

SEQ ID NO: 732798 - DNA, 25 bp, Mus musculus
gttgccattttgactgactgtggcc

SEQ ID NO: 732799 - DNA, 25 bp, Mus musculus
gttgccattttgagggagtaatatt

SEQ ID NO: 732800 - DNA, 25 bp, Mus musculus
gttgccattttgtctgactgtggcc

SEQ ID NO: 732801 - DNA, 25 bp, Mus musculus
gttgccattttgtgggagtaatatt

SEQ ID NO: 732802 - DNA, 25 bp, Mus musculus
gttgcccaaagcagtcacgcagtca

SEQ ID NO: 732803 - DNA, 25 bp, Mus musculus
gttgcccaaagctgtcacgcagtca

SEQ ID NO: 732804 - DNA, 25 bp, Mus musculus
gttgcccaactaattattgactcca

SEQ ID NO: 732805 - DNA, 25 bp, Mus musculus
gttgcccaactatttattgactcca

SEQ ID NO: 732806 - DNA, 25 bp, Mus musculus
gttgcccaaggtcgatgaatcctct

SEQ ID NO: 732807 - DNA, 25 bp, Mus musculus
gttgcccaaggtggatgaatcctct

SEQ ID NO: 732808 - DNA, 25 bp, Mus musculus
gttgcccacagactcatacatttaa

SEQ ID NO: 732809 - DNA, 25 bp, Mus musculus
gttgcccacagagtcatacatttaa

SEQ ID NO: 732810 - DNA, 25 bp, Mus musculus
gttgcccactgaacaaagattcctg

SEQ ID NO: 732811 - DNA, 25 bp, Mus musculus
gttgcccactgatcaaagattcctg

SEQ ID NO: 732812 - DNA, 25 bp, Mus musculus
gttgcccagaagattagtaactgct

SEQ ID NO: 732813 - DNA, 25 bp, Mus musculus
gttgcccagaagtttagtaactgct

SEQ ID NO: 732814 - DNA, 25 bp, Mus musculus
gttgcccagacgataagaacagttt

SEQ ID NO: 732815 - DNA, 25 bp, Mus musculus
gttgcccagacgttaagaacagttt

SEQ ID NO: 732816 - DNA, 25 bp, Mus musculus
gttgcccagtacattaagttcgaaa

SEQ ID NO: 732817 - DNA, 25 bp, Mus musculus
gttgcccagtactttaagttcgaaa

SEQ ID NO: 732818 - DNA, 25 bp, Mus musculus
gttgcccagtcgcaaataggtttca

SEQ ID NO: 732819 - DNA, 25 bp, Mus musculus
gttgcccagtcggaaataggtttca

SEQ ID NO: 732820 - DNA, 25 bp, Mus musculus
gttgcccatcaccacagttctgata

SEQ ID NO: 732821 - DNA, 25 bp, Mus musculus
gttgcccatcacgacagttctgata

SEQ ID NO: 732822 - DNA, 25 bp, Mus musculus
gttgcccatgcaagtcagaagatgt

SEQ ID NO: 732823 - DNA, 25 bp, Mus musculus
gttgcccatgcatgtcagaagatgt

SEQ ID NO: 732824 - DNA, 25 bp, Mus musculus
gttgcccatgctatgtgattcttta

SEQ ID NO: 732825 - DNA, 25 bp, Mus musculus
gttgcccatgctttgtgattcttta

SEQ ID NO: 732826 - DNA, 25 bp, Mus musculus
gttgcccattgtctagctttataga

SEQ ID NO: 732827 - DNA, 25 bp, Mus musculus
gttgcccattgtgtagctttataga

SEQ ID NO: 732828 - DNA, 25 bp, Mus musculus
gttgccccaagtctcttgtaaatgt

SEQ ID NO: 732829 - DNA, 25 bp, Mus musculus
gttgccccaagtgtcttgtaaatgt

SEQ ID NO: 732830 - DNA, 25 bp, Mus musculus
gttgccccatatctacaattagatt

SEQ ID NO: 732831 - DNA, 25 bp, Mus musculus
gttgccccatatgtacaattagatt

SEQ ID NO: 732832 - DNA, 25 bp, Mus musculus
gttgccccgtagaggattggaccaa

SEQ ID NO: 732833 - DNA, 25 bp, Mus musculus
gttgccccgtagtggattggaccaa

SEQ ID NO: 732834 - DNA, 25 bp, Mus musculus
gttgccccttatcagctgcatacaa

SEQ ID NO: 732835 - DNA, 25 bp, Mus musculus
gttgccccttatgagctgcatacaa

SEQ ID NO: 732836 - DNA, 25 bp, Mus musculus
gttgcccgacgcctgatacttacag

SEQ ID NO: 732837 - DNA, 25 bp, Mus musculus
gttgcccgacgcgtgatacttacag

SEQ ID NO: 732838 - DNA, 25 bp, Mus musculus
gttgcccgtactcgcgagtgcatcc

SEQ ID NO: 732839 - DNA, 25 bp, Mus musculus
gttgcccgtactggcgagtgcatcc

SEQ ID NO: 732840 - DNA, 25 bp, Mus musculus
gttgcccgtagaagtttttcctcat

SEQ ID NO: 732841 - DNA, 25 bp, Mus musculus
gttgcccgtagatgtttttcctcat

SEQ ID NO: 732842 - DNA, 25 bp, Mus musculus
gttgccctaccaagccaccttttgg

SEQ ID NO: 732843 - DNA, 25 bp, Mus musculus
gttgccctaccatgccaccttttgg

SEQ ID NO: 732844 - DNA, 25 bp, Mus musculus
gttgccctacccagtaggatttagt

SEQ ID NO: 732845 - DNA, 25 bp, Mus musculus
gttgccctaccctgtaggatttagt

SEQ ID NO: 732846 - DNA, 25 bp, Mus musculus
gttgccctcaataaggcccagtgtt

SEQ ID NO: 732847 - DNA, 25 bp, Mus musculus
gttgccctcaattaggcccagtgtt

SEQ ID NO: 732848 - DNA, 25 bp, Mus musculus
gttgccctcaggatgtctaacttga

SEQ ID NO: 732849 - DNA, 25 bp, Mus musculus
gttgccctcaggttgtctaacttga

SEQ ID NO: 732850 - DNA, 25 bp, Mus musculus
gttgccctctacaccatgaactgat

SEQ ID NO: 732851 - DNA, 25 bp, Mus musculus
gttgccctctactccatgaactgat

SEQ ID NO: 732852 - DNA, 25 bp, Mus musculus
gttgccctcttaaaagccactagtt

SEQ ID NO: 732853 - DNA, 25 bp, Mus musculus
gttgccctcttataagccactagtt

SEQ ID NO: 732854 - DNA, 25 bp, Mus musculus
gttgccctgacaagctattgcacat

SEQ ID NO: 732855 - DNA, 25 bp, Mus musculus
gttgccctgacatgctattgcacat

SEQ ID NO: 732856 - DNA, 25 bp, Mus musculus
gttgccctgactccagaagctcaga

SEQ ID NO: 732857 - DNA, 25 bp, Mus musculus
gttgccctgactgcagaagctcaga

SEQ ID NO: 732858 - DNA, 25 bp, Mus musculus
gttgccctgcagagtttagggtctt

SEQ ID NO: 732859 - DNA, 25 bp, Mus musculus
gttgccctgcagtgtttagggtctt

SEQ ID NO: 732860 - DNA, 25 bp, Mus musculus
gttgccctgttaaaaagggtgcttc

SEQ ID NO: 732861 - DNA, 25 bp, Mus musculus
gttgccctgttataaagggtgcttc

SEQ ID NO: 732862 - DNA, 25 bp, Mus musculus
gttgcccttattcagagtatgccca

SEQ ID NO: 732863 - DNA, 25 bp, Mus musculus
gttgcccttattgagagtatgccca

SEQ ID NO: 732864 - DNA, 25 bp, Mus musculus
gttgcccttcacaatgatcactggt

SEQ ID NO: 732865 - DNA, 25 bp, Mus musculus
gttgcccttcactatgatcactggt

SEQ ID NO: 732866 - DNA, 25 bp, Mus musculus
gttgcccttgccctaagtggagaga

SEQ ID NO: 732867 - DNA, 25 bp, Mus musculus
gttgcccttgccgtaagtggagaga

SEQ ID NO: 732868 - DNA, 25 bp, Mus musculus
gttgccctttagaatagctcttggt

SEQ ID NO: 732869 - DNA, 25 bp, Mus musculus
gttgccctttagtatagctcttggt

SEQ ID NO: 732870 - DNA, 25 bp, Mus musculus
gttgccctttctatatccataatca

SEQ ID NO: 732871 - DNA, 25 bp, Mus musculus
gttgccctttctttatccataatca

SEQ ID NO: 732872 - DNA, 25 bp, Mus musculus
gttgccctttgtccttgcaggaaaa

SEQ ID NO: 732873 - DNA, 25 bp, Mus musculus
gttgccctttgtgcttgcaggaaaa

SEQ ID NO: 732874 - DNA, 25 bp, Mus musculus
gttgccgaaacaagccatcgcttgc

SEQ ID NO: 732875 - DNA, 25 bp, Mus musculus
gttgccgaaacatgccatcgcttgc

SEQ ID NO: 732876 - DNA, 25 bp, Mus musculus
gttgccgaagaacctggctacgctt

SEQ ID NO: 732877 - DNA, 25 bp, Mus musculus
gttgccgaagaagctggctacgctt

SEQ ID NO: 732878 - DNA, 25 bp, Mus musculus
gttgccgactttactagaaacggat

SEQ ID NO: 732879 - DNA, 25 bp, Mus musculus
gttgccgacttttctagaaacggat

SEQ ID NO: 732880 - DNA, 25 bp, Mus musculus
gttgccgcaccgaacatcgagaaat

SEQ ID NO: 732881 - DNA, 25 bp, Mus musculus
gttgccgcaccgtacatcgagaaat

SEQ ID NO: 732882 - DNA, 25 bp, Mus musculus
gttgccgcatctagttctgataatg

SEQ ID NO: 732883 - DNA, 25 bp, Mus musculus
gttgccgcatcttgttctgataatg

SEQ ID NO: 732884 - DNA, 25 bp, Mus musculus
gttgccgctgcaagcacacgaacag

SEQ ID NO: 732885 - DNA, 25 bp, Mus musculus
gttgccgctgcatgcacacgaacag

SEQ ID NO: 732886 - DNA, 25 bp, Mus musculus
gttgccgtcactctactaagtcgat

SEQ ID NO: 732887 - DNA, 25 bp, Mus musculus
gttgccgtcactgtactaagtcgat

SEQ ID NO: 732888 - DNA, 25 bp, Mus musculus
gttgccgtcctacctgctgcatttc

SEQ ID NO: 732889 - DNA, 25 bp, Mus musculus
gttgccgtcctagctgctgcatttc

SEQ ID NO: 732890 - DNA, 25 bp, Mus musculus
gttgccgtggagactaagtgagtta

SEQ ID NO: 732891 - DNA, 25 bp, Mus musculus
gttgccgtggagtctaagtgagtta

SEQ ID NO: 732892 - DNA, 25 bp, Mus musculus
gttgccgtggttagcggactctgct

SEQ ID NO: 732893 - DNA, 25 bp, Mus musculus
gttgccgtggtttgcggactctgct

SEQ ID NO: 732894 - DNA, 25 bp, Mus musculus
gttgccgttctgagcactgagtaaa

SEQ ID NO: 732895 - DNA, 25 bp, Mus musculus
gttgccgttctgtgcactgagtaaa

SEQ ID NO: 732896 - DNA, 25 bp, Mus musculus
gttgcctaacttcaactgttgtcca

SEQ ID NO: 732897 - DNA, 25 bp, Mus musculus
gttgcctaacttcaccaggattatt

SEQ ID NO: 732898 - DNA, 25 bp, Mus musculus
gttgcctaacttgaactgttgtcca

SEQ ID NO: 732899 - DNA, 25 bp, Mus musculus
gttgcctaacttgaccaggattatt

SEQ ID NO: 732900 - DNA, 25 bp, Mus musculus
gttgcctaagacactctcaatgttt

SEQ ID NO: 732901 - DNA, 25 bp, Mus musculus
gttgcctaagactctctcaatgttt

SEQ ID NO: 732902 - DNA, 25 bp, Mus musculus
gttgcctaaggcatgagagcaggga

SEQ ID NO: 732903 - DNA, 25 bp, Mus musculus
gttgcctaaggcttgagagcaggga

SEQ ID NO: 732904 - DNA, 25 bp, Mus musculus
gttgcctacagtagaaggaacccaa

SEQ ID NO: 732905 - DNA, 25 bp, Mus musculus
gttgcctacagttgaaggaacccaa

SEQ ID NO: 732906 - DNA, 25 bp, Mus musculus
gttgcctaccagatcttgcagggta

SEQ ID NO: 732907 - DNA, 25 bp, Mus musculus
gttgcctaccagttcttgcagggta

SEQ ID NO: 732908 - DNA, 25 bp, Mus musculus
gttgcctacgttctctattctaata

SEQ ID NO: 732909 - DNA, 25 bp, Mus musculus
gttgcctacgttgtctattctaata

SEQ ID NO: 732910 - DNA, 25 bp, Mus musculus
gttgcctagaaacccggagtctggt

SEQ ID NO: 732911 - DNA, 25 bp, Mus musculus
gttgcctagaaagccggagtctggt

SEQ ID NO: 732912 - DNA, 25 bp, Mus musculus
gttgcctagcatatctgatgtcctg

SEQ ID NO: 732913 - DNA, 25 bp, Mus musculus
gttgcctagcatttctgatgtcctg

SEQ ID NO: 732914 - DNA, 25 bp, Mus musculus
gttgcctataatcaatgtgcttggg

SEQ ID NO: 732915 - DNA, 25 bp, Mus musculus
gttgcctataatgaatgtgcttggg

SEQ ID NO: 732916 - DNA, 25 bp, Mus musculus
gttgcctatcttattgacatctggg

SEQ ID NO: 732917 - DNA, 25 bp, Mus musculus
gttgcctatctttttgacatctggg

SEQ ID NO: 732918 - DNA, 25 bp, Mus musculus
gttgcctattaactaactcctacta

SEQ ID NO: 732919 - DNA, 25 bp, Mus musculus
gttgcctattaagtaactcctacta

SEQ ID NO: 732920 - DNA, 25 bp, Mus musculus
gttgcctattataccatgttttctt

SEQ ID NO: 732921 - DNA, 25 bp, Mus musculus
gttgcctattattccatgttttctt

SEQ ID NO: 732922 - DNA, 25 bp, Mus musculus
gttgcctcatatcctgtcaagttaa

SEQ ID NO: 732923 - DNA, 25 bp, Mus musculus
gttgcctcatatgctgtcaagttaa

SEQ ID NO: 732924 - DNA, 25 bp, Mus musculus
gttgcctccagaatgttcttgctaa

SEQ ID NO: 732925 - DNA, 25 bp, Mus musculus
gttgcctccagattgttcttgctaa

SEQ ID NO: 732926 - DNA, 25 bp, Mus musculus
gttgcctcctatacccaaatattta

SEQ ID NO: 732927 - DNA, 25 bp, Mus musculus
gttgcctcctattcccaaatattta

SEQ ID NO: 732928 - DNA, 25 bp, Mus musculus
gttgcctcgatgaactatatttgtt

SEQ ID NO: 732929 - DNA, 25 bp, Mus musculus
gttgcctcgatgtactatatttgtt

SEQ ID NO: 732930 - DNA, 25 bp, Mus musculus
gttgcctcggcacctggtgcgaaaa

SEQ ID NO: 732931 - DNA, 25 bp, Mus musculus
gttgcctcggcagctggtgcgaaaa

SEQ ID NO: 732932 - DNA, 25 bp, Mus musculus
gttgcctctccacgctgtctctgaa

SEQ ID NO: 732933 - DNA, 25 bp, Mus musculus
gttgcctctccaggctgtctctgaa

SEQ ID NO: 732934 - DNA, 25 bp, Mus musculus
gttgcctctctcaggaatttgatca

SEQ ID NO: 732935 - DNA, 25 bp, Mus musculus
gttgcctctctctggaatttgatca

SEQ ID NO: 732936 - DNA, 25 bp, Mus musculus
gttgcctctgcaaatggagctgaag

SEQ ID NO: 732937 - DNA, 25 bp, Mus musculus
gttgcctctgcatatggagctgaag

SEQ ID NO: 732938 - DNA, 25 bp, Mus musculus
gttgcctctggcagacactgaaaag

SEQ ID NO: 732939 - DNA, 25 bp, Mus musculus
gttgcctctggctgacactgaaaag

SEQ ID NO: 732940 - DNA, 25 bp, Mus musculus
gttgcctctttgaaccggaagcaga

SEQ ID NO: 732941 - DNA, 25 bp, Mus musculus
gttgcctctttgtaccggaagcaga

SEQ ID NO: 732942 - DNA, 25 bp, Mus musculus
gttgcctgaggcctagcaagtgctt

SEQ ID NO: 732943 - DNA, 25 bp, Mus musculus
gttgcctgaggcgtagcaagtgctt

SEQ ID NO: 732944 - DNA, 25 bp, Mus musculus
gttgcctgagtacacaatgcacccc

SEQ ID NO: 732945 - DNA, 25 bp, Mus musculus
gttgcctgagtagacaatgcacccc

SEQ ID NO: 732946 - DNA, 25 bp, Mus musculus
gttgcctgcaatatgtacacatcct

SEQ ID NO: 732947 - DNA, 25 bp, Mus musculus
gttgcctgcaatttgtacacatcct

SEQ ID NO: 732948 - DNA, 25 bp, Mus musculus
gttgcctgcggtctgccacagtgaa

SEQ ID NO: 732949 - DNA, 25 bp, Mus musculus
gttgcctgcggtgtgccacagtgaa

SEQ ID NO: 732950 - DNA, 25 bp, Mus musculus
gttgcctgcgttagggaaattgctg

SEQ ID NO: 732951 - DNA, 25 bp, Mus musculus
gttgcctgcgtttgggaaattgctg

SEQ ID NO: 732952 - DNA, 25 bp, Mus musculus
gttgcctgctgcaaaccaggagctt

SEQ ID NO: 732953 - DNA, 25 bp, Mus musculus
gttgcctgctgctaaccaggagctt

SEQ ID NO: 732954 - DNA, 25 bp, Mus musculus
gttgcctgctggaagaatctgtcat

SEQ ID NO: 732955 - DNA, 25 bp, Mus musculus
gttgcctgctggtagaatctgtcat

SEQ ID NO: 732956 - DNA, 25 bp, Mus musculus
gttgcctggaaactgatggttgcta

SEQ ID NO: 732957 - DNA, 25 bp, Mus musculus
gttgcctggaaagtgatggttgcta

SEQ ID NO: 732958 - DNA, 25 bp, Mus musculus
gttgcctggacgatatctttgagga

SEQ ID NO: 732959 - DNA, 25 bp, Mus musculus
gttgcctggacgttatctttgagga

SEQ ID NO: 732960 - DNA, 25 bp, Mus musculus
gttgcctggagacttcgatatttca

SEQ ID NO: 732961 - DNA, 25 bp, Mus musculus
gttgcctggagagttcgatatttca

SEQ ID NO: 732962 - DNA, 25 bp, Mus musculus
gttgcctggaggatgtgtattttca

SEQ ID NO: 732963 - DNA, 25 bp, Mus musculus
gttgcctggaggttgtgtattttca

SEQ ID NO: 732964 - DNA, 25 bp, Mus musculus
gttgcctggcatctgagaattccta

SEQ ID NO: 732965 - DNA, 25 bp, Mus musculus
gttgcctggcatgtgagaattccta

SEQ ID NO: 732966 - DNA, 25 bp, Mus musculus
gttgcctggcctagggacggctccc

SEQ ID NO: 732967 - DNA, 25 bp, Mus musculus
gttgcctggcctaggttttacgagc

SEQ ID NO: 732968 - DNA, 25 bp, Mus musculus
gttgcctggccttgggacggctccc

SEQ ID NO: 732969 - DNA, 25 bp, Mus musculus
gttgcctggccttggttttacgagc

SEQ ID NO: 732970 - DNA, 25 bp, Mus musculus
gttgcctggctgagatttttgtaaa

SEQ ID NO: 732971 - DNA, 25 bp, Mus musculus
gttgcctggctgtgatttttgtaaa

SEQ ID NO: 732972 - DNA, 25 bp, Mus musculus
gttgcctgggcaatgaggaccttct

SEQ ID NO: 732973 - DNA, 25 bp, Mus musculus
gttgcctgggcacttttgagaacat

SEQ ID NO: 732974 - DNA, 25 bp, Mus musculus
gttgcctgggcagttttgagaacat

SEQ ID NO: 732975 - DNA, 25 bp, Mus musculus
gttgcctgggcattgaggaccttct

SEQ ID NO: 732976 - DNA, 25 bp, Mus musculus
gttgcctgtggaagagaatcccctt

SEQ ID NO: 732977 - DNA, 25 bp, Mus musculus
gttgcctgtggatgagaatcccctt

SEQ ID NO: 732978 - DNA, 25 bp, Mus musculus
gttgccttacagaggactacaagta

SEQ ID NO: 732979 - DNA, 25 bp, Mus musculus
gttgccttacagtggactacaagta

SEQ ID NO: 732980 - DNA, 25 bp, Mus musculus
gttgccttatacacacttcagatga

SEQ ID NO: 732981 - DNA, 25 bp, Mus musculus
gttgccttatactcacttcagatga

SEQ ID NO: 732982 - DNA, 25 bp, Mus musculus
gttgccttattaagatcttgtacct

SEQ ID NO: 732983 - DNA, 25 bp, Mus musculus
gttgccttattatgatcttgtacct

SEQ ID NO: 732984 - DNA, 25 bp, Mus musculus
gttgccttcacacaggttaactcgg

SEQ ID NO: 732985 - DNA, 25 bp, Mus musculus
gttgccttcacagaggttaactcgg

SEQ ID NO: 732986 - DNA, 25 bp, Mus musculus
gttgccttcagactactaatgtgtt

SEQ ID NO: 732987 - DNA, 25 bp, Mus musculus
gttgccttcagagtactaatgtgtt

SEQ ID NO: 732988 - DNA, 25 bp, Mus musculus
gttgccttcattctgatcccagagt

SEQ ID NO: 732989 - DNA, 25 bp, Mus musculus
gttgccttcattgtgatcccagagt

SEQ ID NO: 732990 - DNA, 25 bp, Mus musculus
gttgccttcgtaacaccaatatgaa

SEQ ID NO: 732991 - DNA, 25 bp, Mus musculus
gttgccttcgtatcaccaatatgaa

SEQ ID NO: 732992 - DNA, 25 bp, Mus musculus
gttgccttctccatttaagactatg

SEQ ID NO: 732993 - DNA, 25 bp, Mus musculus
gttgccttctcccactatcagaaag

SEQ ID NO: 732994 - DNA, 25 bp, Mus musculus
gttgccttctccgactatcagaaag

SEQ ID NO: 732995 - DNA, 25 bp, Mus musculus
gttgccttctccttttaagactatg

SEQ ID NO: 732996 - DNA, 25 bp, Mus musculus
gttgccttctgtcgactcgtggaca

SEQ ID NO: 732997 - DNA, 25 bp, Mus musculus
gttgccttctgtggactcgtggaca

SEQ ID NO: 732998 - DNA, 25 bp, Mus musculus
gttgccttgcagctgtctcataaag

SEQ ID NO: 732999 - DNA, 25 bp, Mus musculus
gttgccttgcaggtgtctcataaag

SEQ ID NO: 733000 - DNA, 25 bp, Mus musculus
gttgccttgcctctagggaggtaaa

SEQ ID NO: 733001 - DNA, 25 bp, Mus musculus
gttgccttgcctgtagggaggtaaa

SEQ ID NO: 733002 - DNA, 25 bp, Mus musculus
gttgccttggaaacttcccgctgta

SEQ ID NO: 733003 - DNA, 25 bp, Mus musculus
gttgccttggaatcttcccgctgta

SEQ ID NO: 733004 - DNA, 25 bp, Mus musculus
gttgccttgggaattgtatggagtt

SEQ ID NO: 733005 - DNA, 25 bp, Mus musculus
gttgccttgggatttgtatggagtt

SEQ ID NO: 733006 - DNA, 25 bp, Mus musculus
gttgcctttaataagccacctaggt

SEQ ID NO: 733007 - DNA, 25 bp, Mus musculus
gttgcctttaattagccacctaggt

SEQ ID NO: 733008 - DNA, 25 bp, Mus musculus
gttgcctttactctattttctatga

SEQ ID NO: 733009 - DNA, 25 bp, Mus musculus
gttgcctttactgtattttctatga

SEQ ID NO: 733010 - DNA, 25 bp, Mus musculus
gttgcctttcaacggactgcctggc

SEQ ID NO: 733011 - DNA, 25 bp, Mus musculus
gttgcctttcaagggactgcctggc

SEQ ID NO: 733012 - DNA, 25 bp, Mus musculus
gttgcctttcctctgatgacctcct

SEQ ID NO: 733013 - DNA, 25 bp, Mus musculus
gttgcctttcctgtgatgacctcct

SEQ ID NO: 733014 - DNA, 25 bp, Mus musculus
gttgcctttctcagtaagaccctgt

SEQ ID NO: 733015 - DNA, 25 bp, Mus musculus
gttgcctttctctgtaagaccctgt

SEQ ID NO: 733016 - DNA, 25 bp, Mus musculus
gttgcctttgagattcttggaattg

SEQ ID NO: 733017 - DNA, 25 bp, Mus musculus
gttgcctttgagtttcttggaattg

SEQ ID NO: 733018 - DNA, 25 bp, Mus musculus
gttgcctttgccctgaagatatctt

SEQ ID NO: 733019 - DNA, 25 bp, Mus musculus
gttgcctttgccgtgaagatatctt

SEQ ID NO: 733020 - DNA, 25 bp, Mus musculus
gttgcctttggcctcggtcatgcac

SEQ ID NO: 733021 - DNA, 25 bp, Mus musculus
gttgcctttggcgtcggtcatgcac

SEQ ID NO: 733022 - DNA, 25 bp, Mus musculus
gttgcctttggtcaacttcaaccct

SEQ ID NO: 733023 - DNA, 25 bp, Mus musculus
gttgcctttggtgaacttcaaccct

SEQ ID NO: 733024 - DNA, 25 bp, Mus musculus
gttgccttttaactacttggtagct

SEQ ID NO: 733025 - DNA, 25 bp, Mus musculus
gttgccttttaagtacttggtagct

SEQ ID NO: 733026 - DNA, 25 bp, Mus musculus
gttgccttttgaattcagtgacctt

SEQ ID NO: 733027 - DNA, 25 bp, Mus musculus
gttgccttttgatttcagtgacctt

SEQ ID NO: 733028 - DNA, 25 bp, Mus musculus
gttgccttttgccactctaattgac

SEQ ID NO: 733029 - DNA, 25 bp, Mus musculus
gttgccttttgcgactctaattgac

SEQ ID NO: 733030 - DNA, 25 bp, Mus musculus
gttgcgaactcactaacaggtttat

SEQ ID NO: 733031 - DNA, 25 bp, Mus musculus
gttgcgaactcagtaacaggtttat

SEQ ID NO: 733032 - DNA, 25 bp, Mus musculus
gttgcgaagattaaaacccacactt

SEQ ID NO: 733033 - DNA, 25 bp, Mus musculus
gttgcgaagatttaaacccacactt

SEQ ID NO: 733034 - DNA, 25 bp, Mus musculus
gttgcgaatgggatcttgacaagat

SEQ ID NO: 733035 - DNA, 25 bp, Mus musculus
gttgcgaatgggttcttgacaagat

SEQ ID NO: 733036 - DNA, 25 bp, Mus musculus
gttgcgagactgcatatacagcctc

SEQ ID NO: 733037 - DNA, 25 bp, Mus musculus
gttgcgagactggatatacagcctc

SEQ ID NO: 733038 - DNA, 25 bp, Mus musculus
gttgcgagtcacagaataggtgcta

SEQ ID NO: 733039 - DNA, 25 bp, Mus musculus
gttgcgagtcactgaataggtgcta

SEQ ID NO: 733040 - DNA, 25 bp, Mus musculus
gttgcgagtgatctcagcaccgtat

SEQ ID NO: 733041 - DNA, 25 bp, Mus musculus
gttgcgagtgatgtcagcaccgtat

SEQ ID NO: 733042 - DNA, 25 bp, Mus musculus
gttgcgatacatagctaacgtttac

SEQ ID NO: 733043 - DNA, 25 bp, Mus musculus
gttgcgatacattgctaacgtttac

SEQ ID NO: 733044 - DNA, 25 bp, Mus musculus
gttgcgatcagacacaagccctgga

SEQ ID NO: 733045 - DNA, 25 bp, Mus musculus
gttgcgatcagagacaagccctgga

SEQ ID NO: 733046 - DNA, 25 bp, Mus musculus
gttgcgcacgcgaacggaaattcca

SEQ ID NO: 733047 - DNA, 25 bp, Mus musculus
gttgcgcacgcgtacggaaattcca

SEQ ID NO: 733048 - DNA, 25 bp, Mus musculus
gttgcgcagattatgggtgtccacc

SEQ ID NO: 733049 - DNA, 25 bp, Mus musculus
gttgcgcagattttgggtgtccacc

SEQ ID NO: 733050 - DNA, 25 bp, Mus musculus
gttgcgccaaatcttaatctccaag

SEQ ID NO: 733051 - DNA, 25 bp, Mus musculus
gttgcgccaaatgttaatctccaag

SEQ ID NO: 733052 - DNA, 25 bp, Mus musculus
gttgcgctatataaccaatcccttc

SEQ ID NO: 733053 - DNA, 25 bp, Mus musculus
gttgcgctatattaccaatcccttc

SEQ ID NO: 733054 - DNA, 25 bp, Mus musculus
gttgcgctccagcatatccgacttt

SEQ ID NO: 733055 - DNA, 25 bp, Mus musculus
gttgcgctccaggatatccgacttt

SEQ ID NO: 733056 - DNA, 25 bp, Mus musculus
gttgcggataagatacagattttca

SEQ ID NO: 733057 - DNA, 25 bp, Mus musculus
gttgcggataagttacagattttca

SEQ ID NO: 733058 - DNA, 25 bp, Mus musculus
gttgcggctgacaggtggtactcac

SEQ ID NO: 733059 - DNA, 25 bp, Mus musculus
gttgcggctgactggtggtactcac

SEQ ID NO: 733060 - DNA, 25 bp, Mus musculus
gttgcgggccatcctggccattgaa

SEQ ID NO: 733061 - DNA, 25 bp, Mus musculus
gttgcgggccatgctggccattgaa

SEQ ID NO: 733062 - DNA, 25 bp, Mus musculus
gttgcgtccaacctgtaaagaagtt

SEQ ID NO: 733063 - DNA, 25 bp, Mus musculus
gttgcgtccaacgtgtaaagaagtt

SEQ ID NO: 733064 - DNA, 25 bp, Mus musculus
gttgcgtgactgagccgcttcgtgc

SEQ ID NO: 733065 - DNA, 25 bp, Mus musculus
gttgcgtgactgtgccgcttcgtgc

SEQ ID NO: 733066 - DNA, 25 bp, Mus musculus
gttgcgtgcacccaaggctccagac

SEQ ID NO: 733067 - DNA, 25 bp, Mus musculus
gttgcgtgcaccgaaggctccagac

SEQ ID NO: 733068 - DNA, 25 bp, Mus musculus
gttgcgtgctccagccaaatatttt

SEQ ID NO: 733069 - DNA, 25 bp, Mus musculus
gttgcgtgctcctgccaaatatttt

SEQ ID NO: 733070 - DNA, 25 bp, Mus musculus
gttgcgtgtaatcccctgaggaaat

SEQ ID NO: 733071 - DNA, 25 bp, Mus musculus
gttgcgtgtaatgccctgaggaaat

SEQ ID NO: 733072 - DNA, 25 bp, Mus musculus
gttgcgtgtgaacacgagcactcca

SEQ ID NO: 733073 - DNA, 25 bp, Mus musculus
gttgcgtgtgaagacgagcactcca

SEQ ID NO: 733074 - DNA, 25 bp, Mus musculus
gttgcgtgtgctcagtccagacaaa

SEQ ID NO: 733075 - DNA, 25 bp, Mus musculus
gttgcgtgtgctgagtccagacaaa

SEQ ID NO: 733076 - DNA, 25 bp, Mus musculus
gttgcgttctatagaaaaacgagac

SEQ ID NO: 733077 - DNA, 25 bp, Mus musculus
gttgcgttctattgaaaaacgagac

SEQ ID NO: 733078 - DNA, 25 bp, Mus musculus
gttgcgttttgaagttgttgcccct

SEQ ID NO: 733079 - DNA, 25 bp, Mus musculus
gttgcgttttgatgttgttgcccct

SEQ ID NO: 733080 - DNA, 25 bp, Mus musculus
gttgctaaaagccaatcagttcctg

SEQ ID NO: 733081 - DNA, 25 bp, Mus musculus
gttgctaaaagcgaatcagttcctg

SEQ ID NO: 733082 - DNA, 25 bp, Mus musculus
gttgctaaacacacgagctggcatg

SEQ ID NO: 733083 - DNA, 25 bp, Mus musculus
gttgctaaacactcgagctggcatg

SEQ ID NO: 733084 - DNA, 25 bp, Mus musculus
gttgctaacagtcctcaattgagac

SEQ ID NO: 733085 - DNA, 25 bp, Mus musculus
gttgctaacagtgctcaattgagac

SEQ ID NO: 733086 - DNA, 25 bp, Mus musculus
gttgctaacggtaaccacttccgat

SEQ ID NO: 733087 - DNA, 25 bp, Mus musculus
gttgctaacggttaccacttccgat

SEQ ID NO: 733088 - DNA, 25 bp, Mus musculus
gttgctaacgtacatgaagtcactt

SEQ ID NO: 733089 - DNA, 25 bp, Mus musculus
gttgctaacgtagatgaagtcactt

SEQ ID NO: 733090 - DNA, 25 bp, Mus musculus
gttgctaagagaactggcattgctt

SEQ ID NO: 733091 - DNA, 25 bp, Mus musculus
gttgctaagagatctggcattgctt

SEQ ID NO: 733092 - DNA, 25 bp, Mus musculus
gttgctaagcaaatcagtcttcagg

SEQ ID NO: 733093 - DNA, 25 bp, Mus musculus
gttgctaagcaattcagtcttcagg

SEQ ID NO: 733094 - DNA, 25 bp, Mus musculus
gttgctaagcccaatcctttacaaa

SEQ ID NO: 733095 - DNA, 25 bp, Mus musculus
gttgctaagccctatcctttacaaa

SEQ ID NO: 733096 - DNA, 25 bp, Mus musculus
gttgctaaggctagttgggcagctc

SEQ ID NO: 733097 - DNA, 25 bp, Mus musculus
gttgctaaggcttgttgggcagctc

SEQ ID NO: 733098 - DNA, 25 bp, Mus musculus
gttgctaagggaatgaattatggtt

SEQ ID NO: 733099 - DNA, 25 bp, Mus musculus
gttgctaagggattgaattatggtt

SEQ ID NO: 733100 - DNA, 25 bp, Mus musculus
gttgctaagtccaatccagttcatg

SEQ ID NO: 733101 - DNA, 25 bp, Mus musculus
gttgctaagtccacaagctgctatg

SEQ ID NO: 733102 - DNA, 25 bp, Mus musculus
gttgctaagtcctatccagttcatg

SEQ ID NO: 733103 - DNA, 25 bp, Mus musculus
gttgctaagtcctcaagctgctatg

SEQ ID NO: 733104 - DNA, 25 bp, Mus musculus
gttgctaatccgaaggagccctccg

SEQ ID NO: 733105 - DNA, 25 bp, Mus musculus
gttgctaatccgtaggagccctccg

SEQ ID NO: 733106 - DNA, 25 bp, Mus musculus
gttgctaatcttaacccattgtcag

SEQ ID NO: 733107 - DNA, 25 bp, Mus musculus
gttgctaatctttacccattgtcag

SEQ ID NO: 733108 - DNA, 25 bp, Mus musculus
gttgctaatgtgctgctaatatggc

SEQ ID NO: 733109 - DNA, 25 bp, Mus musculus
gttgctaatgtggtgctaatatggc

SEQ ID NO: 733110 - DNA, 25 bp, Mus musculus
gttgctacaagaatccttctccagt

SEQ ID NO: 733111 - DNA, 25 bp, Mus musculus
gttgctacaagattccttctccagt

SEQ ID NO: 733112 - DNA, 25 bp, Mus musculus
gttgctacacacacagtaaactcct

SEQ ID NO: 733113 - DNA, 25 bp, Mus musculus
gttgctacacactcagtaaactcct

SEQ ID NO: 733114 - DNA, 25 bp, Mus musculus
gttgctacacatcttgactttggga

SEQ ID NO: 733115 - DNA, 25 bp, Mus musculus
gttgctacacatgttgactttggga

SEQ ID NO: 733116 - DNA, 25 bp, Mus musculus
gttgctacagcaaaacgccatggtc

SEQ ID NO: 733117 - DNA, 25 bp, Mus musculus
gttgctacagcataacgccatggtc

SEQ ID NO: 733118 - DNA, 25 bp, Mus musculus
gttgctacatttcgcccaccacggg

SEQ ID NO: 733119 - DNA, 25 bp, Mus musculus
gttgctacatttggcccaccacggg

SEQ ID NO: 733120 - DNA, 25 bp, Mus musculus
gttgctaccagtctatgcagtaatt

SEQ ID NO: 733121 - DNA, 25 bp, Mus musculus
gttgctaccagtgtatgcagtaatt

SEQ ID NO: 733122 - DNA, 25 bp, Mus musculus
gttgctaccttgcagaaccgttaga

SEQ ID NO: 733123 - DNA, 25 bp, Mus musculus
gttgctaccttgcttcattaaacaa

SEQ ID NO: 733124 - DNA, 25 bp, Mus musculus
gttgctaccttggagaaccgttaga

SEQ ID NO: 733125 - DNA, 25 bp, Mus musculus
gttgctaccttggttcattaaacaa

SEQ ID NO: 733126 - DNA, 25 bp, Mus musculus
gttgctacggttctatctaattcca

SEQ ID NO: 733127 - DNA, 25 bp, Mus musculus
gttgctacggttgtatctaattcca

SEQ ID NO: 733128 - DNA, 25 bp, Mus musculus
gttgctactaacagagggtcctctt

SEQ ID NO: 733129 - DNA, 25 bp, Mus musculus
gttgctactaactgagggtcctctt

SEQ ID NO: 733130 - DNA, 25 bp, Mus musculus
gttgctactaggagcgaaccagagt

SEQ ID NO: 733131 - DNA, 25 bp, Mus musculus
gttgctactaggtgcgaaccagagt

SEQ ID NO: 733132 - DNA, 25 bp, Mus musculus
gttgctactgagactcctcgaatac

SEQ ID NO: 733133 - DNA, 25 bp, Mus musculus
gttgctactgagtctcctcgaatac

SEQ ID NO: 733134 - DNA, 25 bp, Mus musculus
gttgctactgccattaaaggcacta

SEQ ID NO: 733135 - DNA, 25 bp, Mus musculus
gttgctactgcctttaaaggcacta

SEQ ID NO: 733136 - DNA, 25 bp, Mus musculus
gttgctactgctcaccactttccat

SEQ ID NO: 733137 - DNA, 25 bp, Mus musculus
gttgctactgctgaccactttccat

SEQ ID NO: 733138 - DNA, 25 bp, Mus musculus
gttgctagaaacagagcaccctgct

SEQ ID NO: 733139 - DNA, 25 bp, Mus musculus
gttgctagaaactgagcaccctgct

SEQ ID NO: 733140 - DNA, 25 bp, Mus musculus
gttgctagaactagtgctggtccca

SEQ ID NO: 733141 - DNA, 25 bp, Mus musculus
gttgctagaacttgtgctggtccca

SEQ ID NO: 733142 - DNA, 25 bp, Mus musculus
gttgctagacaaatattctcctttt

SEQ ID NO: 733143 - DNA, 25 bp, Mus musculus
gttgctagacaattattctcctttt

SEQ ID NO: 733144 - DNA, 25 bp, Mus musculus
gttgctagagcaacagcctgtgata

SEQ ID NO: 733145 - DNA, 25 bp, Mus musculus
gttgctagagcatcagcctgtgata

SEQ ID NO: 733146 - DNA, 25 bp, Mus musculus
gttgctagagttcctcatcacactg

SEQ ID NO: 733147 - DNA, 25 bp, Mus musculus
gttgctagagttgctcatcacactg

SEQ ID NO: 733148 - DNA, 25 bp, Mus musculus
gttgctagcactaatgtcagaccta

SEQ ID NO: 733149 - DNA, 25 bp, Mus musculus
gttgctagcacttatgtcagaccta

SEQ ID NO: 733150 - DNA, 25 bp, Mus musculus
gttgctagcataagccatggacttt

SEQ ID NO: 733151 - DNA, 25 bp, Mus musculus
gttgctagcatatgccatggacttt

SEQ ID NO: 733152 - DNA, 25 bp, Mus musculus
gttgctagccatcttgtgagtgcca

SEQ ID NO: 733153 - DNA, 25 bp, Mus musculus
gttgctagccatgttgtgagtgcca

SEQ ID NO: 733154 - DNA, 25 bp, Mus musculus
gttgctagcttaaccgtccagaaaa

SEQ ID NO: 733155 - DNA, 25 bp, Mus musculus
gttgctagcttatccgtccagaaaa

SEQ ID NO: 733156 - DNA, 25 bp, Mus musculus
gttgctaggcacagaacacctggct

SEQ ID NO: 733157 - DNA, 25 bp, Mus musculus
gttgctaggcactgaacacctggct

SEQ ID NO: 733158 - DNA, 25 bp, Mus musculus
gttgctagggatctacaccctccct

SEQ ID NO: 733159 - DNA, 25 bp, Mus musculus
gttgctagggatgtacaccctccct

SEQ ID NO: 733160 - DNA, 25 bp, Mus musculus
gttgctagtactcactccattttct

SEQ ID NO: 733161 - DNA, 25 bp, Mus musculus
gttgctagtactgactccattttct

SEQ ID NO: 733162 - DNA, 25 bp, Mus musculus
gttgctataacaatcatttcgacta

SEQ ID NO: 733163 - DNA, 25 bp, Mus musculus
gttgctataacattcatttcgacta

SEQ ID NO: 733164 - DNA, 25 bp, Mus musculus
gttgctataataagataccatgacc

SEQ ID NO: 733165 - DNA, 25 bp, Mus musculus
gttgctataatatgataccatgacc

SEQ ID NO: 733166 - DNA, 25 bp, Mus musculus
gttgctataattattagaacccttt

SEQ ID NO: 733167 - DNA, 25 bp, Mus musculus
gttgctataatttttagaacccttt

SEQ ID NO: 733168 - DNA, 25 bp, Mus musculus
gttgctataggcacctctgatctag

SEQ ID NO: 733169 - DNA, 25 bp, Mus musculus
gttgctataggctcctctgatctag

SEQ ID NO: 733170 - DNA, 25 bp, Mus musculus
gttgctatataaatactcagtaggg

SEQ ID NO: 733171 - DNA, 25 bp, Mus musculus
gttgctatataattactcagtaggg

SEQ ID NO: 733172 - DNA, 25 bp, Mus musculus
gttgctatatgcctgagaagcccaa

SEQ ID NO: 733173 - DNA, 25 bp, Mus musculus
gttgctatatgcgtgagaagcccaa

SEQ ID NO: 733174 - DNA, 25 bp, Mus musculus
gttgctatcaccacttacttgtcat

SEQ ID NO: 733175 - DNA, 25 bp, Mus musculus
gttgctatcacctcttacttgtcat

SEQ ID NO: 733176 - DNA, 25 bp, Mus musculus
gttgctatcccaccatctcttaaaa

SEQ ID NO: 733177 - DNA, 25 bp, Mus musculus
gttgctatcccagcatctcttaaaa

SEQ ID NO: 733178 - DNA, 25 bp, Mus musculus
gttgctatctgaagtgttcccatca

SEQ ID NO: 733179 - DNA, 25 bp, Mus musculus
gttgctatctgatgtgttcccatca

SEQ ID NO: 733180 - DNA, 25 bp, Mus musculus
gttgctatggagagtacagcttccc

SEQ ID NO: 733181 - DNA, 25 bp, Mus musculus
gttgctatggagtgtacagcttccc

SEQ ID NO: 733182 - DNA, 25 bp, Mus musculus
gttgctatggccatgaaaacggctt

SEQ ID NO: 733183 - DNA, 25 bp, Mus musculus
gttgctatggccttgaaaacggctt

SEQ ID NO: 733184 - DNA, 25 bp, Mus musculus
gttgctatgtagagccaagctggcc

SEQ ID NO: 733185 - DNA, 25 bp, Mus musculus
gttgctatgtagtgccaagctggcc

SEQ ID NO: 733186 - DNA, 25 bp, Mus musculus
gttgctattagaatgtacctgtgaa

SEQ ID NO: 733187 - DNA, 25 bp, Mus musculus
gttgctattagattgtacctgtgaa

SEQ ID NO: 733188 - DNA, 25 bp, Mus musculus
gttgctattggtaatgatcagggat

SEQ ID NO: 733189 - DNA, 25 bp, Mus musculus
gttgctattggttatgatcagggat

SEQ ID NO: 733190 - DNA, 25 bp, Mus musculus
gttgctattgttccggtttttgtac

SEQ ID NO: 733191 - DNA, 25 bp, Mus musculus
gttgctattgttgcggtttttgtac

SEQ ID NO: 733192 - DNA, 25 bp, Mus musculus
gttgctatttgtagtgtttacagtt

SEQ ID NO: 733193 - DNA, 25 bp, Mus musculus
gttgctatttgttgtgtttacagtt

SEQ ID NO: 733194 - DNA, 25 bp, Mus musculus
gttgctattttaaggaaatgcctct

SEQ ID NO: 733195 - DNA, 25 bp, Mus musculus
gttgctattttatggaaatgcctct

SEQ ID NO: 733196 - DNA, 25 bp, Mus musculus
gttgctcaaaacctattccgactac

SEQ ID NO: 733197 - DNA, 25 bp, Mus musculus
gttgctcaaaacgtattccgactac

SEQ ID NO: 733198 - DNA, 25 bp, Mus musculus
gttgctcaaatcaaacttgacccag

SEQ ID NO: 733199 - DNA, 25 bp, Mus musculus
gttgctcaaatctaacttgacccag

SEQ ID NO: 733200 - DNA, 25 bp, Mus musculus
gttgctcaaattcaggttgaaatac

SEQ ID NO: 733201 - DNA, 25 bp, Mus musculus
gttgctcaaattgaggttgaaatac

SEQ ID NO: 733202 - DNA, 25 bp, Mus musculus
gttgctcaactcaagggcccataag

SEQ ID NO: 733203 - DNA, 25 bp, Mus musculus
gttgctcaactctagggcccataag

SEQ ID NO: 733204 - DNA, 25 bp, Mus musculus
gttgctcaagacaaagtgccaggct

SEQ ID NO: 733205 - DNA, 25 bp, Mus musculus
gttgctcaagactaagtgccaggct

SEQ ID NO: 733206 - DNA, 25 bp, Mus musculus
gttgctcaatctcaaactggatcgg

SEQ ID NO: 733207 - DNA, 25 bp, Mus musculus
gttgctcaatctgaaactggatcgg

SEQ ID NO: 733208 - DNA, 25 bp, Mus musculus
gttgctcacatcatctcttacagtg

SEQ ID NO: 733209 - DNA, 25 bp, Mus musculus
gttgctcacatcttctcttacagtg

SEQ ID NO: 733210 - DNA, 25 bp, Mus musculus
gttgctcacatgcacaaagcccagg

SEQ ID NO: 733211 - DNA, 25 bp, Mus musculus
gttgctcacatggacaaagcccagg

SEQ ID NO: 733212 - DNA, 25 bp, Mus musculus
gttgctcaccatagtcccaatgaga

SEQ ID NO: 733213 - DNA, 25 bp, Mus musculus
gttgctcaccattgtcccaatgaga

SEQ ID NO: 733214 - DNA, 25 bp, Mus musculus
gttgctcacctacaatataggtcca

SEQ ID NO: 733215 - DNA, 25 bp, Mus musculus
gttgctcacctagaatataggtcca

SEQ ID NO: 733216 - DNA, 25 bp, Mus musculus
gttgctcaccttcaccttgtaagat

SEQ ID NO: 733217 - DNA, 25 bp, Mus musculus
gttgctcaccttgaccttgtaagat

SEQ ID NO: 733218 - DNA, 25 bp, Mus musculus
gttgctcactgcagaagtcattcaa

SEQ ID NO: 733219 - DNA, 25 bp, Mus musculus
gttgctcactgctgaagtcattcaa

SEQ ID NO: 733220 - DNA, 25 bp, Mus musculus
gttgctcagctgataattagcccga

SEQ ID NO: 733221 - DNA, 25 bp, Mus musculus
gttgctcagctgttaattagcccga

SEQ ID NO: 733222 - DNA, 25 bp, Mus musculus
gttgctcagcttccagtcgttttaa

SEQ ID NO: 733223 - DNA, 25 bp, Mus musculus
gttgctcagcttgcagtcgttttaa

SEQ ID NO: 733224 - DNA, 25 bp, Mus musculus
gttgctcaggtaattcctcacgtat

SEQ ID NO: 733225 - DNA, 25 bp, Mus musculus
gttgctcaggtatttcctcacgtat

SEQ ID NO: 733226 - DNA, 25 bp, Mus musculus
gttgctcaggttatcctcactggat

SEQ ID NO: 733227 - DNA, 25 bp, Mus musculus
gttgctcaggttttcctcactggat

SEQ ID NO: 733228 - DNA, 25 bp, Mus musculus
gttgctcagtgaattctgatgtgta

SEQ ID NO: 733229 - DNA, 25 bp, Mus musculus
gttgctcagtgatttctgatgtgta

SEQ ID NO: 733230 - DNA, 25 bp, Mus musculus
gttgctcatctgatgtaactcaata

SEQ ID NO: 733231 - DNA, 25 bp, Mus musculus
gttgctcatctgttgtaactcaata

SEQ ID NO: 733232 - DNA, 25 bp, Mus musculus
gttgctcattaaaagtccacataca

SEQ ID NO: 733233 - DNA, 25 bp, Mus musculus
gttgctcattaatagtccacataca

SEQ ID NO: 733234 - DNA, 25 bp, Mus musculus
gttgctcattgcactccatgggagg

SEQ ID NO: 733235 - DNA, 25 bp, Mus musculus
gttgctcattgctctccatgggagg

SEQ ID NO: 733236 - DNA, 25 bp, Mus musculus
gttgctccaaatattatattgggac

SEQ ID NO: 733237 - DNA, 25 bp, Mus musculus
gttgctccaaattttatattgggac

SEQ ID NO: 733238 - DNA, 25 bp, Mus musculus
gttgctccaggccagagacgtttag

SEQ ID NO: 733239 - DNA, 25 bp, Mus musculus
gttgctccaggcgagagacgtttag

SEQ ID NO: 733240 - DNA, 25 bp, Mus musculus
gttgctccagggaccacagtgaggc

SEQ ID NO: 733241 - DNA, 25 bp, Mus musculus
gttgctccagggtccacagtgaggc

SEQ ID NO: 733242 - DNA, 25 bp, Mus musculus
gttgctcccagtacatttaagaata

SEQ ID NO: 733243 - DNA, 25 bp, Mus musculus
gttgctcccagttcatttaagaata

SEQ ID NO: 733244 - DNA, 25 bp, Mus musculus
gttgctcctaagagtttcgtctatc

SEQ ID NO: 733245 - DNA, 25 bp, Mus musculus
gttgctcctaagctttcttctaaag

SEQ ID NO: 733246 - DNA, 25 bp, Mus musculus
gttgctcctaaggtttcttctaaag

SEQ ID NO: 733247 - DNA, 25 bp, Mus musculus
gttgctcctaagtgtttcgtctatc

SEQ ID NO: 733248 - DNA, 25 bp, Mus musculus
gttgctcctccaaaggtgcagagat

SEQ ID NO: 733249 - DNA, 25 bp, Mus musculus
gttgctcctccataggtgcagagat

SEQ ID NO: 733250 - DNA, 25 bp, Mus musculus
gttgctcctctgcagcttgtacgtt

SEQ ID NO: 733251 - DNA, 25 bp, Mus musculus
gttgctcctctggagcttgtacgtt

SEQ ID NO: 733252 - DNA, 25 bp, Mus musculus
gttgctcctgggagcagtagtacag

SEQ ID NO: 733253 - DNA, 25 bp, Mus musculus
gttgctcctgggtgcagtagtacag

SEQ ID NO: 733254 - DNA, 25 bp, Mus musculus
gttgctcctgtaaagacgatcatct

SEQ ID NO: 733255 - DNA, 25 bp, Mus musculus
gttgctcctgtatagacgatcatct

SEQ ID NO: 733256 - DNA, 25 bp, Mus musculus
gttgctcgccccagagggattgtga

SEQ ID NO: 733257 - DNA, 25 bp, Mus musculus
gttgctcgcccctgagggattgtga

SEQ ID NO: 733258 - DNA, 25 bp, Mus musculus
gttgctcgggttcgcctacaaaata

SEQ ID NO: 733259 - DNA, 25 bp, Mus musculus
gttgctcgggttggcctacaaaata

SEQ ID NO: 733260 - DNA, 25 bp, Mus musculus
gttgctcgtaccatttgaacatcgg

SEQ ID NO: 733261 - DNA, 25 bp, Mus musculus
gttgctcgtaccttttgaacatcgg

SEQ ID NO: 733262 - DNA, 25 bp, Mus musculus
gttgctcgtgaaagcacatctggat

SEQ ID NO: 733263 - DNA, 25 bp, Mus musculus
gttgctcgtgaatgcacatctggat

SEQ ID NO: 733264 - DNA, 25 bp, Mus musculus
gttgctctatatctgctggtctaca

SEQ ID NO: 733265 - DNA, 25 bp, Mus musculus
gttgctctatatgtgctggtctaca

SEQ ID NO: 733266 - DNA, 25 bp, Mus musculus
gttgctctcaccagtgaaacgcttt

SEQ ID NO: 733267 - DNA, 25 bp, Mus musculus
gttgctctcacctgtgaaacgcttt

SEQ ID NO: 733268 - DNA, 25 bp, Mus musculus
gttgctctcagaacaggagtgtggc

SEQ ID NO: 733269 - DNA, 25 bp, Mus musculus
gttgctctcagatcaggagtgtggc

SEQ ID NO: 733270 - DNA, 25 bp, Mus musculus
gttgctctcaggcaagggagtccat

SEQ ID NO: 733271 - DNA, 25 bp, Mus musculus
gttgctctcagggaagggagtccat

SEQ ID NO: 733272 - DNA, 25 bp, Mus musculus
gttgctctccaacctaagggaccat

SEQ ID NO: 733273 - DNA, 25 bp, Mus musculus
gttgctctccaagctaagggaccat

SEQ ID NO: 733274 - DNA, 25 bp, Mus musculus
gttgctctccgcaacactagtgaat

SEQ ID NO: 733275 - DNA, 25 bp, Mus musculus
gttgctctccgctacactagtgaat

SEQ ID NO: 733276 - DNA, 25 bp, Mus musculus
gttgctctctatcagtatgctctct

SEQ ID NO: 733277 - DNA, 25 bp, Mus musculus
gttgctctctatgagtatgctctct

SEQ ID NO: 733278 - DNA, 25 bp, Mus musculus
gttgctctctgccagaagaatctga

SEQ ID NO: 733279 - DNA, 25 bp, Mus musculus
gttgctctctgcgagaagaatctga

SEQ ID NO: 733280 - DNA, 25 bp, Mus musculus
gttgctctgaacactgcatacactg

SEQ ID NO: 733281 - DNA, 25 bp, Mus musculus
gttgctctgaactctgcatacactg

SEQ ID NO: 733282 - DNA, 25 bp, Mus musculus
gttgctctgacaaaaacatatgtat

SEQ ID NO: 733283 - DNA, 25 bp, Mus musculus
gttgctctgacataaacatatgtat

SEQ ID NO: 733284 - DNA, 25 bp, Mus musculus
gttgctctgccacctgagtgagtaa

SEQ ID NO: 733285 - DNA, 25 bp, Mus musculus
gttgctctgccagctgagtgagtaa

SEQ ID NO: 733286 - DNA, 25 bp, Mus musculus
gttgctctggagctttctgagctat

SEQ ID NO: 733287 - DNA, 25 bp, Mus musculus
gttgctctggaggtttctgagctat

SEQ ID NO: 733288 - DNA, 25 bp, Mus musculus
gttgctctggcaaatcaaggcttct

SEQ ID NO: 733289 - DNA, 25 bp, Mus musculus
gttgctctggcatatcaaggcttct

SEQ ID NO: 733290 - DNA, 25 bp, Mus musculus
gttgctctgtagagtccagcttcct

SEQ ID NO: 733291 - DNA, 25 bp, Mus musculus
gttgctctgtagtgtccagcttcct

SEQ ID NO: 733292 - DNA, 25 bp, Mus musculus
gttgctctgtcccaggctaagaagc

SEQ ID NO: 733293 - DNA, 25 bp, Mus musculus
gttgctctgtccgaggctaagaagc

SEQ ID NO: 733294 - DNA, 25 bp, Mus musculus
gttgctctgtctcaaatgtgacccc

SEQ ID NO: 733295 - DNA, 25 bp, Mus musculus
gttgctctgtctgaaatgtgacccc

SEQ ID NO: 733296 - DNA, 25 bp, Mus musculus
gttgctctgtgacagggtcacactt

SEQ ID NO: 733297 - DNA, 25 bp, Mus musculus
gttgctctgtgagagggtcacactt

SEQ ID NO: 733298 - DNA, 25 bp, Mus musculus
gttgctctgtgtatatctcttggaa

SEQ ID NO: 733299 - DNA, 25 bp, Mus musculus
gttgctctgtgtttatctcttggaa

SEQ ID NO: 733300 - DNA, 25 bp, Mus musculus
gttgctcttacaaatcccttcagaa

SEQ ID NO: 733301 - DNA, 25 bp, Mus musculus
gttgctcttacatatcccttcagaa

SEQ ID NO: 733302 - DNA, 25 bp, Mus musculus
gttgctcttataccacaatacatcg

SEQ ID NO: 733303 - DNA, 25 bp, Mus musculus
gttgctcttatagcacaatacatcg

SEQ ID NO: 733304 - DNA, 25 bp, Mus musculus
gttgctcttcatctctacttactag

SEQ ID NO: 733305 - DNA, 25 bp, Mus musculus
gttgctcttcatgtctacttactag

SEQ ID NO: 733306 - DNA, 25 bp, Mus musculus
gttgctcttccacttgtcctaagtt

SEQ ID NO: 733307 - DNA, 25 bp, Mus musculus
gttgctcttccagttgtcctaagtt

SEQ ID NO: 733308 - DNA, 25 bp, Mus musculus
gttgctcttctgcatgcttgatgat

SEQ ID NO: 733309 - DNA, 25 bp, Mus musculus
gttgctcttctggatgcttgatgat

SEQ ID NO: 733310 - DNA, 25 bp, Mus musculus
gttgctcttggtcaccatttgttat

SEQ ID NO: 733311 - DNA, 25 bp, Mus musculus
gttgctcttggtgaccatttgttat

SEQ ID NO: 733312 - DNA, 25 bp, Mus musculus
gttgctcttgtaaatggttgtctca

SEQ ID NO: 733313 - DNA, 25 bp, Mus musculus
gttgctcttgtatatggttgtctca

SEQ ID NO: 733314 - DNA, 25 bp, Mus musculus
gttgctcttgtcagggatctgagct

SEQ ID NO: 733315 - DNA, 25 bp, Mus musculus
gttgctcttgtctgggatctgagct

SEQ ID NO: 733316 - DNA, 25 bp, Mus musculus
gttgctctttgtataaactggacag

SEQ ID NO: 733317 - DNA, 25 bp, Mus musculus
gttgctctttgtttaaactggacag

SEQ ID NO: 733318 - DNA, 25 bp, Mus musculus
gttgctcttttcctttgaatgtttt

SEQ ID NO: 733319 - DNA, 25 bp, Mus musculus
gttgctcttttcgtttgaatgtttt

SEQ ID NO: 733320 - DNA, 25 bp, Mus musculus
gttgctgaaatcctcaagtctatcg

SEQ ID NO: 733321 - DNA, 25 bp, Mus musculus
gttgctgaaatcgtcaagtctatcg

SEQ ID NO: 733322 - DNA, 25 bp, Mus musculus
gttgctgaacatacacaaaactgta

SEQ ID NO: 733323 - DNA, 25 bp, Mus musculus
gttgctgaacattcacaaaactgta

SEQ ID NO: 733324 - DNA, 25 bp, Mus musculus
gttgctgaagcacccagtgaacaga

SEQ ID NO: 733325 - DNA, 25 bp, Mus musculus
gttgctgaagcagccagtgaacaga

SEQ ID NO: 733326 - DNA, 25 bp, Mus musculus
gttgctgaaggacccacaatcctat

SEQ ID NO: 733327 - DNA, 25 bp, Mus musculus
gttgctgaaggagccacaatcctat

SEQ ID NO: 733328 - DNA, 25 bp, Mus musculus
gttgctgaagtcagtgacccaggca

SEQ ID NO: 733329 - DNA, 25 bp, Mus musculus
gttgctgaagtctgtgacccaggca

SEQ ID NO: 733330 - DNA, 25 bp, Mus musculus
gttgctgaatcaacacatcctgata

SEQ ID NO: 733331 - DNA, 25 bp, Mus musculus
gttgctgaatcatcacatcctgata

SEQ ID NO: 733332 - DNA, 25 bp, Mus musculus
gttgctgacattcccacgctttgag

SEQ ID NO: 733333 - DNA, 25 bp, Mus musculus
gttgctgacattgccacgctttgag

SEQ ID NO: 733334 - DNA, 25 bp, Mus musculus
gttgctgacctcagtcattgacact

SEQ ID NO: 733335 - DNA, 25 bp, Mus musculus
gttgctgacctctgtcattgacact

SEQ ID NO: 733336 - DNA, 25 bp, Mus musculus
gttgctgactaactcctggtggcaa

SEQ ID NO: 733337 - DNA, 25 bp, Mus musculus
gttgctgactaagtcctggtggcaa

SEQ ID NO: 733338 - DNA, 25 bp, Mus musculus
gttgctgactacatttgctttttgt

SEQ ID NO: 733339 - DNA, 25 bp, Mus musculus
gttgctgactacttttgctttttgt

SEQ ID NO: 733340 - DNA, 25 bp, Mus musculus
gttgctgacttgaaacaccctggca

SEQ ID NO: 733341 - DNA, 25 bp, Mus musculus
gttgctgacttgtaacaccctggca

SEQ ID NO: 733342 - DNA, 25 bp, Mus musculus
gttgctgagacaatcgtgaacccaa

SEQ ID NO: 733343 - DNA, 25 bp, Mus musculus
gttgctgagacattcgtgaacccaa

SEQ ID NO: 733344 - DNA, 25 bp, Mus musculus
gttgctgaggcccaagcagtttatt

SEQ ID NO: 733345 - DNA, 25 bp, Mus musculus
gttgctgaggccgaagcagtttatt

SEQ ID NO: 733346 - DNA, 25 bp, Mus musculus
gttgctgaggctatcatacacatca

SEQ ID NO: 733347 - DNA, 25 bp, Mus musculus
gttgctgaggctttcatacacatca

SEQ ID NO: 733348 - DNA, 25 bp, Mus musculus
gttgctgagggcagaggtccatcat

SEQ ID NO: 733349 - DNA, 25 bp, Mus musculus
gttgctgagggctgaggtccatcat

SEQ ID NO: 733350 - DNA, 25 bp, Mus musculus
gttgctgagtacacagtgcgctcga

SEQ ID NO: 733351 - DNA, 25 bp, Mus musculus
gttgctgagtactcagtgcgctcga

SEQ ID NO: 733352 - DNA, 25 bp, Mus musculus
gttgctgagtagctattcagtacta

SEQ ID NO: 733353 - DNA, 25 bp, Mus musculus
gttgctgagtaggtattcagtacta

SEQ ID NO: 733354 - DNA, 25 bp, Mus musculus
gttgctgagttccacctgatgcaca

SEQ ID NO: 733355 - DNA, 25 bp, Mus musculus
gttgctgagttcgacctgatgcaca

SEQ ID NO: 733356 - DNA, 25 bp, Mus musculus
gttgctgatctaaggtctatttttg

SEQ ID NO: 733357 - DNA, 25 bp, Mus musculus
gttgctgatctatggtctatttttg

SEQ ID NO: 733358 - DNA, 25 bp, Mus musculus
gttgctgattagaacagttgacttg

SEQ ID NO: 733359 - DNA, 25 bp, Mus musculus
gttgctgattagtacagttgacttg

SEQ ID NO: 733360 - DNA, 25 bp, Mus musculus
gttgctgattatattgatcctgcta

SEQ ID NO: 733361 - DNA, 25 bp, Mus musculus
gttgctgattattttgatcctgcta

SEQ ID NO: 733362 - DNA, 25 bp, Mus musculus
gttgctgattcaagagctcatccat

SEQ ID NO: 733363 - DNA, 25 bp, Mus musculus
gttgctgattcatgagctcatccat

SEQ ID NO: 733364 - DNA, 25 bp, Mus musculus
gttgctgatttaattgtccgtgcca

SEQ ID NO: 733365 - DNA, 25 bp, Mus musculus
gttgctgatttatttgtccgtgcca

SEQ ID NO: 733366 - DNA, 25 bp, Mus musculus
gttgctgatttgaccatttctttcc

SEQ ID NO: 733367 - DNA, 25 bp, Mus musculus
gttgctgatttgtccatttctttcc

SEQ ID NO: 733368 - DNA, 25 bp, Mus musculus
gttgctgcaagtcaaatatacacca

SEQ ID NO: 733369 - DNA, 25 bp, Mus musculus
gttgctgcaagtgaaatatacacca

SEQ ID NO: 733370 - DNA, 25 bp, Mus musculus
gttgctgcaatgatatctcacaccc

SEQ ID NO: 733371 - DNA, 25 bp, Mus musculus
gttgctgcaatgttatctcacaccc

SEQ ID NO: 733372 - DNA, 25 bp, Mus musculus
gttgctgcacagagcctccgaagag

SEQ ID NO: 733373 - DNA, 25 bp, Mus musculus
gttgctgcacagtgcctccgaagag

SEQ ID NO: 733374 - DNA, 25 bp, Mus musculus
gttgctgcacatctattttaactgt

SEQ ID NO: 733375 - DNA, 25 bp, Mus musculus
gttgctgcacatgtattttaactgt

SEQ ID NO: 733376 - DNA, 25 bp, Mus musculus
gttgctgcagatctagtaccaccca

SEQ ID NO: 733377 - DNA, 25 bp, Mus musculus
gttgctgcagatgtagtaccaccca

SEQ ID NO: 733378 - DNA, 25 bp, Mus musculus
gttgctgcagctcttaaaccacaat

SEQ ID NO: 733379 - DNA, 25 bp, Mus musculus
gttgctgcagctgttaaaccacaat

SEQ ID NO: 733380 - DNA, 25 bp, Mus musculus
gttgctgcagggatcctgaagacca

SEQ ID NO: 733381 - DNA, 25 bp, Mus musculus
gttgctgcagggttcctgaagacca

SEQ ID NO: 733382 - DNA, 25 bp, Mus musculus
gttgctgcatagaaactgacctgaa

SEQ ID NO: 733383 - DNA, 25 bp, Mus musculus
gttgctgcatagtaactgacctgaa

SEQ ID NO: 733384 - DNA, 25 bp, Mus musculus
gttgctgccacaatgagcagaccaa

SEQ ID NO: 733385 - DNA, 25 bp, Mus musculus
gttgctgccacattgagcagaccaa

SEQ ID NO: 733386 - DNA, 25 bp, Mus musculus
gttgctgccagactgacacctttta

SEQ ID NO: 733387 - DNA, 25 bp, Mus musculus
gttgctgccagagtgacacctttta

SEQ ID NO: 733388 - DNA, 25 bp, Mus musculus
gttgctgccctaccctcggatgtga

SEQ ID NO: 733389 - DNA, 25 bp, Mus musculus
gttgctgccctagcctcggatgtga

SEQ ID NO: 733390 - DNA, 25 bp, Mus musculus
gttgctgcccttacatgactttaca

SEQ ID NO: 733391 - DNA, 25 bp, Mus musculus
gttgctgccctttcatgactttaca

SEQ ID NO: 733392 - DNA, 25 bp, Mus musculus
gttgctgcctatcaaagaagactac

SEQ ID NO: 733393 - DNA, 25 bp, Mus musculus
gttgctgcctatgaaagaagactac

SEQ ID NO: 733394 - DNA, 25 bp, Mus musculus
gttgctgcctccctgaatggaaata

SEQ ID NO: 733395 - DNA, 25 bp, Mus musculus
gttgctgcctccgtgaatggaaata

SEQ ID NO: 733396 - DNA, 25 bp, Mus musculus
gttgctgcctctatgaaattatgtt

SEQ ID NO: 733397 - DNA, 25 bp, Mus musculus
gttgctgcctctttgaaattatgtt

SEQ ID NO: 733398 - DNA, 25 bp, Mus musculus
gttgctgcctgactttcgtgatgcc

SEQ ID NO: 733399 - DNA, 25 bp, Mus musculus
gttgctgcctgagtttcgtgatgcc

SEQ ID NO: 733400 - DNA, 25 bp, Mus musculus
gttgctgctaaaattagtcgttata

SEQ ID NO: 733401 - DNA, 25 bp, Mus musculus
gttgctgctaaatttagtcgttata

SEQ ID NO: 733402 - DNA, 25 bp, Mus musculus
gttgctgctaacactccaagtatgt

SEQ ID NO: 733403 - DNA, 25 bp, Mus musculus
gttgctgctaactctccaagtatgt

SEQ ID NO: 733404 - DNA, 25 bp, Mus musculus
gttgctgctactcctagcattgcag

SEQ ID NO: 733405 - DNA, 25 bp, Mus musculus
gttgctgctactctcttactattat

SEQ ID NO: 733406 - DNA, 25 bp, Mus musculus
gttgctgctactctgtaacatctgt

SEQ ID NO: 733407 - DNA, 25 bp, Mus musculus
gttgctgctactgctagcattgcag

SEQ ID NO: 733408 - DNA, 25 bp, Mus musculus
gttgctgctactgtcttactattat

SEQ ID NO: 733409 - DNA, 25 bp, Mus musculus
gttgctgctactgtgtaacatctgt

SEQ ID NO: 733410 - DNA, 25 bp, Mus musculus
gttgctgctattacagcttctgaaa

SEQ ID NO: 733411 - DNA, 25 bp, Mus musculus
gttgctgctatttcagcttctgaaa

SEQ ID NO: 733412 - DNA, 25 bp, Mus musculus
gttgctgctcaaaccattttatgaa

SEQ ID NO: 733413 - DNA, 25 bp, Mus musculus
gttgctgctcaatccattttatgaa

SEQ ID NO: 733414 - DNA, 25 bp, Mus musculus
gttgctgctcagcaggaacgataga

SEQ ID NO: 733415 - DNA, 25 bp, Mus musculus
gttgctgctcaggaggaacgataga

SEQ ID NO: 733416 - DNA, 25 bp, Mus musculus
gttgctgctcatcgctgccattgtg

SEQ ID NO: 733417 - DNA, 25 bp, Mus musculus
gttgctgctcatggctgccattgtg

SEQ ID NO: 733418 - DNA, 25 bp, Mus musculus
gttgctgctgaacttgtactaaatc

SEQ ID NO: 733419 - DNA, 25 bp, Mus musculus
gttgctgctgaagttgtactaaatc

SEQ ID NO: 733420 - DNA, 25 bp, Mus musculus
gttgctgctgacaactatcgccaga

SEQ ID NO: 733421 - DNA, 25 bp, Mus musculus
gttgctgctgacaatgcctaagaaa

SEQ ID NO: 733422 - DNA, 25 bp, Mus musculus
gttgctgctgactactatcgccaga

SEQ ID NO: 733423 - DNA, 25 bp, Mus musculus
gttgctgctgactatgcctaagaaa

SEQ ID NO: 733424 - DNA, 25 bp, Mus musculus
gttgctgctgagagcagatcgcact

SEQ ID NO: 733425 - DNA, 25 bp, Mus musculus
gttgctgctgagtgcagatcgcact

SEQ ID NO: 733426 - DNA, 25 bp, Mus musculus
gttgctgctgctacaatactggctg

SEQ ID NO: 733427 - DNA, 25 bp, Mus musculus
gttgctgctgcttcaatactggctg

SEQ ID NO: 733428 - DNA, 25 bp, Mus musculus
gttgctgctgtaatccacagcagac

SEQ ID NO: 733429 - DNA, 25 bp, Mus musculus
gttgctgctgtattccacagcagac

SEQ ID NO: 733430 - DNA, 25 bp, Mus musculus
gttgctgctgtgacaaaacaatgac

SEQ ID NO: 733431 - DNA, 25 bp, Mus musculus
gttgctgctgtgtcaaaacaatgac

SEQ ID NO: 733432 - DNA, 25 bp, Mus musculus
gttgctgcttccaatgatatacgag

SEQ ID NO: 733433 - DNA, 25 bp, Mus musculus
gttgctgcttcctatgatatacgag

SEQ ID NO: 733434 - DNA, 25 bp, Mus musculus
gttgctggaaatcgcccactctcac

SEQ ID NO: 733435 - DNA, 25 bp, Mus musculus
gttgctggaaatggcccactctcac

SEQ ID NO: 733436 - DNA, 25 bp, Mus musculus
gttgctggacagattatggccatag

SEQ ID NO: 733437 - DNA, 25 bp, Mus musculus
gttgctggacagtttatggccatag

SEQ ID NO: 733438 - DNA, 25 bp, Mus musculus
gttgctggacttaacactgggcctt

SEQ ID NO: 733439 - DNA, 25 bp, Mus musculus
gttgctggactttacactgggcctt

SEQ ID NO: 733440 - DNA, 25 bp, Mus musculus
gttgctggagctcgccaaacaggat

SEQ ID NO: 733441 - DNA, 25 bp, Mus musculus
gttgctggagctggccaaacaggat

SEQ ID NO: 733442 - DNA, 25 bp, Mus musculus
gttgctggatctcctgtttgaagcg

SEQ ID NO: 733443 - DNA, 25 bp, Mus musculus
gttgctggatctgctgtttgaagcg

SEQ ID NO: 733444 - DNA, 25 bp, Mus musculus
gttgctggcacaaagtcaaactgag

SEQ ID NO: 733445 - DNA, 25 bp, Mus musculus
gttgctggcacatagtcaaactgag

SEQ ID NO: 733446 - DNA, 25 bp, Mus musculus
gttgctggcaggcttctaaccagat

SEQ ID NO: 733447 - DNA, 25 bp, Mus musculus
gttgctggcagggttctaaccagat

SEQ ID NO: 733448 - DNA, 25 bp, Mus musculus
gttgctggccagatatttgttgatt

SEQ ID NO: 733449 - DNA, 25 bp, Mus musculus
gttgctggccagttatttgttgatt

SEQ ID NO: 733450 - DNA, 25 bp, Mus musculus
gttgctggcgtaactctgaagtcac

SEQ ID NO: 733451 - DNA, 25 bp, Mus musculus
gttgctggcgtatctctgaagtcac

SEQ ID NO: 733452 - DNA, 25 bp, Mus musculus
gttgctggctggacagattcattta

SEQ ID NO: 733453 - DNA, 25 bp, Mus musculus
gttgctggctggtcagattcattta

SEQ ID NO: 733454 - DNA, 25 bp, Mus musculus
gttgctgggaacaagtcatttttgt

SEQ ID NO: 733455 - DNA, 25 bp, Mus musculus
gttgctgggaactagtcatttttgt

SEQ ID NO: 733456 - DNA, 25 bp, Mus musculus
gttgctgggataaaatactgacctt

SEQ ID NO: 733457 - DNA, 25 bp, Mus musculus
gttgctgggatataatactgacctt

SEQ ID NO: 733458 - DNA, 25 bp, Mus musculus
gttgctgggattaccaaattaacat

SEQ ID NO: 733459 - DNA, 25 bp, Mus musculus
gttgctgggattcaattggcatctt

SEQ ID NO: 733460 - DNA, 25 bp, Mus musculus
gttgctgggattgaattggcatctt

SEQ ID NO: 733461 - DNA, 25 bp, Mus musculus
gttgctgggatttccaaattaacat

SEQ ID NO: 733462 - DNA, 25 bp, Mus musculus
gttgctgggcatatctgagggctac

SEQ ID NO: 733463 - DNA, 25 bp, Mus musculus
gttgctgggcatttctgagggctac

SEQ ID NO: 733464 - DNA, 25 bp, Mus musculus
gttgctggtcaaaagttttacagtg

SEQ ID NO: 733465 - DNA, 25 bp, Mus musculus
gttgctggtcaatagttttacagtg

SEQ ID NO: 733466 - DNA, 25 bp, Mus musculus
gttgctggttggaatttttgtgttc

SEQ ID NO: 733467 - DNA, 25 bp, Mus musculus
gttgctggttggtatttttgtgttc

SEQ ID NO: 733468 - DNA, 25 bp, Mus musculus
gttgctggtttaatcactgtgtctg

SEQ ID NO: 733469 - DNA, 25 bp, Mus musculus
gttgctggtttattcactgtgtctg

SEQ ID NO: 733470 - DNA, 25 bp, Mus musculus
gttgctggtttcatgggatgaaaga

SEQ ID NO: 733471 - DNA, 25 bp, Mus musculus
gttgctggtttcttgggatgaaaga

SEQ ID NO: 733472 - DNA, 25 bp, Mus musculus
gttgctgtaccccataagactttgt

SEQ ID NO: 733473 - DNA, 25 bp, Mus musculus
gttgctgtacccgataagactttgt

SEQ ID NO: 733474 - DNA, 25 bp, Mus musculus
gttgctgtacttagacatgccaata

SEQ ID NO: 733475 - DNA, 25 bp, Mus musculus
gttgctgtactttgacatgccaata

SEQ ID NO: 733476 - DNA, 25 bp, Mus musculus
gttgctgtcagacttgaacctccat

SEQ ID NO: 733477 - DNA, 25 bp, Mus musculus
gttgctgtcagagttgaacctccat

SEQ ID NO: 733478 - DNA, 25 bp, Mus musculus
gttgctgtcaggaaaacgttgtcac

SEQ ID NO: 733479 - DNA, 25 bp, Mus musculus
gttgctgtcaggtaaacgttgtcac

SEQ ID NO: 733480 - DNA, 25 bp, Mus musculus
gttgctgtcatccttggtcagtcat

SEQ ID NO: 733481 - DNA, 25 bp, Mus musculus
gttgctgtcatcgttggtcagtcat

SEQ ID NO: 733482 - DNA, 25 bp, Mus musculus
gttgctgtcattcaggtctgtccct

SEQ ID NO: 733483 - DNA, 25 bp, Mus musculus
gttgctgtcattgaggtctgtccct

SEQ ID NO: 733484 - DNA, 25 bp, Mus musculus
gttgctgtccaaatctctgggtgca

SEQ ID NO: 733485 - DNA, 25 bp, Mus musculus
gttgctgtccaattctctgggtgca

SEQ ID NO: 733486 - DNA, 25 bp, Mus musculus
gttgctgtcctcagactcagtgttc

SEQ ID NO: 733487 - DNA, 25 bp, Mus musculus
gttgctgtcctctgactcagtgttc

SEQ ID NO: 733488 - DNA, 25 bp, Mus musculus
gttgctgtccttattcctgttaaaa

SEQ ID NO: 733489 - DNA, 25 bp, Mus musculus
gttgctgtcctttttcctgttaaaa

SEQ ID NO: 733490 - DNA, 25 bp, Mus musculus
gttgctgtctgtaggacagaagctc

SEQ ID NO: 733491 - DNA, 25 bp, Mus musculus
gttgctgtctgttggacagaagctc

SEQ ID NO: 733492 - DNA, 25 bp, Mus musculus
gttgctgtcttcaaggccctgggag

SEQ ID NO: 733493 - DNA, 25 bp, Mus musculus
gttgctgtcttctaggccctgggag

SEQ ID NO: 733494 - DNA, 25 bp, Mus musculus
gttgctgtgaacaggaccaacttca

SEQ ID NO: 733495 - DNA, 25 bp, Mus musculus
gttgctgtgaactggaccaacttca

SEQ ID NO: 733496 - DNA, 25 bp, Mus musculus
gttgctgtgaatagtaggcactgca

SEQ ID NO: 733497 - DNA, 25 bp, Mus musculus
gttgctgtgaattgtaggcactgca

SEQ ID NO: 733498 - DNA, 25 bp, Mus musculus
gttgctgtgacgcaaccccacgaag

SEQ ID NO: 733499 - DNA, 25 bp, Mus musculus
gttgctgtgacggaaccccacgaag

SEQ ID NO: 733500 - DNA, 25 bp, Mus musculus
gttgctgtgcacaagatgacccagt

SEQ ID NO: 733501 - DNA, 25 bp, Mus musculus
gttgctgtgcactagatgacccagt

SEQ ID NO: 733502 - DNA, 25 bp, Mus musculus
gttgctgtgcgtatgctagtggcta

SEQ ID NO: 733503 - DNA, 25 bp, Mus musculus
gttgctgtgcgtcccaccatggctg

SEQ ID NO: 733504 - DNA, 25 bp, Mus musculus
gttgctgtgcgtgccaccatggctg

SEQ ID NO: 733505 - DNA, 25 bp, Mus musculus
gttgctgtgcgtttgctagtggcta

SEQ ID NO: 733506 - DNA, 25 bp, Mus musculus
gttgctgtgctgagcgcagttgtct

SEQ ID NO: 733507 - DNA, 25 bp, Mus musculus
gttgctgtgctgagttaggctacaa

SEQ ID NO: 733508 - DNA, 25 bp, Mus musculus
gttgctgtgctgtgcgcagttgtct

SEQ ID NO: 733509 - DNA, 25 bp, Mus musculus
gttgctgtgctgtgttaggctacaa

SEQ ID NO: 733510 - DNA, 25 bp, Mus musculus
gttgctgtgcttcccgctatgaaga

SEQ ID NO: 733511 - DNA, 25 bp, Mus musculus
gttgctgtgcttgccgctatgaaga

SEQ ID NO: 733512 - DNA, 25 bp, Mus musculus
gttgctgtggcaaacgacttgacct

SEQ ID NO: 733513 - DNA, 25 bp, Mus musculus
gttgctgtggcatacgacttgacct

SEQ ID NO: 733514 - DNA, 25 bp, Mus musculus
gttgctgtggctatgactgcccaaa

SEQ ID NO: 733515 - DNA, 25 bp, Mus musculus
gttgctgtggctttgactgcccaaa

SEQ ID NO: 733516 - DNA, 25 bp, Mus musculus
gttgctgtgtcccaagtgtctgtag

SEQ ID NO: 733517 - DNA, 25 bp, Mus musculus
gttgctgtgtccgaagtgtctgtag

SEQ ID NO: 733518 - DNA, 25 bp, Mus musculus
gttgctgtgtttctaggaaccgtgt

SEQ ID NO: 733519 - DNA, 25 bp, Mus musculus
gttgctgtgtttgtaggaaccgtgt

SEQ ID NO: 733520 - DNA, 25 bp, Mus musculus
gttgctgttaaaagtgtcatgctta

SEQ ID NO: 733521 - DNA, 25 bp, Mus musculus
gttgctgttaaatgtgtcatgctta

SEQ ID NO: 733522 - DNA, 25 bp, Mus musculus
gttgctgttagcatcccctttgttg

SEQ ID NO: 733523 - DNA, 25 bp, Mus musculus
gttgctgttagcttcccctttgttg

SEQ ID NO: 733524 - DNA, 25 bp, Mus musculus
gttgctgttcctaacacttacgaaa

SEQ ID NO: 733525 - DNA, 25 bp, Mus musculus
gttgctgttcctcgtggatactgaa

SEQ ID NO: 733526 - DNA, 25 bp, Mus musculus
gttgctgttcctggtggatactgaa

SEQ ID NO: 733527 - DNA, 25 bp, Mus musculus
gttgctgttccttacacttacgaaa

SEQ ID NO: 733528 - DNA, 25 bp, Mus musculus
gttgctgttctaatattgctaggac

SEQ ID NO: 733529 - DNA, 25 bp, Mus musculus
gttgctgttctattattgctaggac

SEQ ID NO: 733530 - DNA, 25 bp, Mus musculus
gttgctgttgttaactgagcatgtg

SEQ ID NO: 733531 - DNA, 25 bp, Mus musculus
gttgctgttgtttactgagcatgtg

SEQ ID NO: 733532 - DNA, 25 bp, Mus musculus
gttgctgtttatagtctggcccgtg

SEQ ID NO: 733533 - DNA, 25 bp, Mus musculus
gttgctgtttattgtctggcccgtg

SEQ ID NO: 733534 - DNA, 25 bp, Mus musculus
gttgctgtttgcaatggactcattg

SEQ ID NO: 733535 - DNA, 25 bp, Mus musculus
gttgctgtttgctatggactcattg

SEQ ID NO: 733536 - DNA, 25 bp, Mus musculus
gttgctgttttcaccagctaatttg

SEQ ID NO: 733537 - DNA, 25 bp, Mus musculus
gttgctgttttctccagctaatttg

SEQ ID NO: 733538 - DNA, 25 bp, Mus musculus
gttgcttaacctctaactgacctta

SEQ ID NO: 733539 - DNA, 25 bp, Mus musculus
gttgcttaacctgtaactgacctta

SEQ ID NO: 733540 - DNA, 25 bp, Mus musculus
gttgcttaagttctggagacatttt

SEQ ID NO: 733541 - DNA, 25 bp, Mus musculus
gttgcttaagttgtggagacatttt

SEQ ID NO: 733542 - DNA, 25 bp, Mus musculus
gttgcttaatgtatgcatgtacaat

SEQ ID NO: 733543 - DNA, 25 bp, Mus musculus
gttgcttaatgtttgcatgtacaat

SEQ ID NO: 733544 - DNA, 25 bp, Mus musculus
gttgcttaattcatttcctgctgta

SEQ ID NO: 733545 - DNA, 25 bp, Mus musculus
gttgcttaattcttttcctgctgta

SEQ ID NO: 733546 - DNA, 25 bp, Mus musculus
gttgcttacaagcattgctattcaa

SEQ ID NO: 733547 - DNA, 25 bp, Mus musculus
gttgcttacaaggattgctattcaa

SEQ ID NO: 733548 - DNA, 25 bp, Mus musculus
gttgcttacactatcaattatcttg

SEQ ID NO: 733549 - DNA, 25 bp, Mus musculus
gttgcttacactttcaattatcttg

SEQ ID NO: 733550 - DNA, 25 bp, Mus musculus
gttgcttacagtcctctgggaagcc

SEQ ID NO: 733551 - DNA, 25 bp, Mus musculus
gttgcttacagtgctctgggaagcc

SEQ ID NO: 733552 - DNA, 25 bp, Mus musculus
gttgcttaccaactactgcccctgt

SEQ ID NO: 733553 - DNA, 25 bp, Mus musculus
gttgcttaccaagtactgcccctgt

SEQ ID NO: 733554 - DNA, 25 bp, Mus musculus
gttgcttaccttaagtgatggaagt

SEQ ID NO: 733555 - DNA, 25 bp, Mus musculus
gttgcttacctttagtgatggaagt

SEQ ID NO: 733556 - DNA, 25 bp, Mus musculus
gttgcttagagtctgatcttgccaa

SEQ ID NO: 733557 - DNA, 25 bp, Mus musculus
gttgcttagagtgtgatcttgccaa

SEQ ID NO: 733558 - DNA, 25 bp, Mus musculus
gttgcttagcaacgctgggtgccat

SEQ ID NO: 733559 - DNA, 25 bp, Mus musculus
gttgcttagcaaggctgggtgccat

SEQ ID NO: 733560 - DNA, 25 bp, Mus musculus
gttgcttaggctaggacttttggag

SEQ ID NO: 733561 - DNA, 25 bp, Mus musculus
gttgcttaggcttggacttttggag

SEQ ID NO: 733562 - DNA, 25 bp, Mus musculus
gttgcttaggtacacttcaggttag

SEQ ID NO: 733563 - DNA, 25 bp, Mus musculus
gttgcttaggtagacttcaggttag

SEQ ID NO: 733564 - DNA, 25 bp, Mus musculus
gttgcttaggtgctttttcctttgt

SEQ ID NO: 733565 - DNA, 25 bp, Mus musculus
gttgcttaggtggtttttcctttgt

SEQ ID NO: 733566 - DNA, 25 bp, Mus musculus
gttgcttagtctctcagggtctgtc

SEQ ID NO: 733567 - DNA, 25 bp, Mus musculus
gttgcttagtctgtcagggtctgtc

SEQ ID NO: 733568 - DNA, 25 bp, Mus musculus
gttgcttataagctttttcatattc

SEQ ID NO: 733569 - DNA, 25 bp, Mus musculus
gttgcttataaggtttttcatattc

SEQ ID NO: 733570 - DNA, 25 bp, Mus musculus
gttgcttatatcagatcacttttgt

SEQ ID NO: 733571 - DNA, 25 bp, Mus musculus
gttgcttatatctgatcacttttgt

SEQ ID NO: 733572 - DNA, 25 bp, Mus musculus
gttgcttatctcctttaaataactc

SEQ ID NO: 733573 - DNA, 25 bp, Mus musculus
gttgcttatctcgtttaaataactc

SEQ ID NO: 733574 - DNA, 25 bp, Mus musculus
gttgcttattataggccttggccta

SEQ ID NO: 733575 - DNA, 25 bp, Mus musculus
gttgcttattattggccttggccta

SEQ ID NO: 733576 - DNA, 25 bp, Mus musculus
gttgcttcaacgatgttctgacctc

SEQ ID NO: 733577 - DNA, 25 bp, Mus musculus
gttgcttcaacgttgttctgacctc

SEQ ID NO: 733578 - DNA, 25 bp, Mus musculus
gttgcttcaagcatccagacaccgg

SEQ ID NO: 733579 - DNA, 25 bp, Mus musculus
gttgcttcaagcatgtctgttatgg

SEQ ID NO: 733580 - DNA, 25 bp, Mus musculus
gttgcttcaagcttccagacaccgg

SEQ ID NO: 733581 - DNA, 25 bp, Mus musculus
gttgcttcaagcttgtctgttatgg

SEQ ID NO: 733582 - DNA, 25 bp, Mus musculus
gttgcttcaataaattacccaggga

SEQ ID NO: 733583 - DNA, 25 bp, Mus musculus
gttgcttcaatatattacccaggga

SEQ ID NO: 733584 - DNA, 25 bp, Mus musculus
gttgcttcacaacagagaaccaaag

SEQ ID NO: 733585 - DNA, 25 bp, Mus musculus
gttgcttcacaagagagaaccaaag

SEQ ID NO: 733586 - DNA, 25 bp, Mus musculus
gttgcttcactcaccaagtctagat

SEQ ID NO: 733587 - DNA, 25 bp, Mus musculus
gttgcttcactctccaagtctagat

SEQ ID NO: 733588 - DNA, 25 bp, Mus musculus
gttgcttcaggcaggctgtggtcct

SEQ ID NO: 733589 - DNA, 25 bp, Mus musculus
gttgcttcaggctggctgtggtcct

SEQ ID NO: 733590 - DNA, 25 bp, Mus musculus
gttgcttcagtgcaaggctcatctt

SEQ ID NO: 733591 - DNA, 25 bp, Mus musculus
gttgcttcagtggaaggctcatctt

SEQ ID NO: 733592 - DNA, 25 bp, Mus musculus
gttgcttcatgccttgataacgctt

SEQ ID NO: 733593 - DNA, 25 bp, Mus musculus
gttgcttcatgcgttgataacgctt

SEQ ID NO: 733594 - DNA, 25 bp, Mus musculus
gttgcttccaacactgattcaaatc

SEQ ID NO: 733595 - DNA, 25 bp, Mus musculus
gttgcttccaactctgattcaaatc

SEQ ID NO: 733596 - DNA, 25 bp, Mus musculus
gttgcttccaatcaatggctcccac

SEQ ID NO: 733597 - DNA, 25 bp, Mus musculus
gttgcttccaatgaatggctcccac

SEQ ID NO: 733598 - DNA, 25 bp, Mus musculus
gttgcttccaggcagtagaagagaa

SEQ ID NO: 733599 - DNA, 25 bp, Mus musculus
gttgcttccagggagtagaagagaa

SEQ ID NO: 733600 - DNA, 25 bp, Mus musculus
gttgcttcccagatcatgtgagcat

SEQ ID NO: 733601 - DNA, 25 bp, Mus musculus
gttgcttcccagttcatgtgagcat

SEQ ID NO: 733602 - DNA, 25 bp, Mus musculus
gttgcttcccgacttaggttttcag

SEQ ID NO: 733603 - DNA, 25 bp, Mus musculus
gttgcttcccgagttaggttttcag

SEQ ID NO: 733604 - DNA, 25 bp, Mus musculus
gttgcttccctgaagtgatgctttc

SEQ ID NO: 733605 - DNA, 25 bp, Mus musculus
gttgcttccctgtagtgatgctttc

SEQ ID NO: 733606 - DNA, 25 bp, Mus musculus
gttgcttccgaacgctgaccgagtg

SEQ ID NO: 733607 - DNA, 25 bp, Mus musculus
gttgcttccgaaggctgaccgagtg

SEQ ID NO: 733608 - DNA, 25 bp, Mus musculus
gttgcttccgatcatcagctttgaa

SEQ ID NO: 733609 - DNA, 25 bp, Mus musculus
gttgcttccgatgatcagctttgaa

SEQ ID NO: 733610 - DNA, 25 bp, Mus musculus
gttgcttccttcaatctggaatgtg

SEQ ID NO: 733611 - DNA, 25 bp, Mus musculus
gttgcttccttctatctggaatgtg

SEQ ID NO: 733612 - DNA, 25 bp, Mus musculus
gttgcttcgggtacttaaaatcaca

SEQ ID NO: 733613 - DNA, 25 bp, Mus musculus
gttgcttcgggttcttaaaatcaca

SEQ ID NO: 733614 - DNA, 25 bp, Mus musculus
gttgcttctcaacgtgtaaataggc

SEQ ID NO: 733615 - DNA, 25 bp, Mus musculus
gttgcttctcaaggtgtaaataggc

SEQ ID NO: 733616 - DNA, 25 bp, Mus musculus
gttgcttctgaactccgtgtcacaa

SEQ ID NO: 733617 - DNA, 25 bp, Mus musculus
gttgcttctgaagtccgtgtcacaa

SEQ ID NO: 733618 - DNA, 25 bp, Mus musculus
gttgcttctgagcttgagaaaatac

SEQ ID NO: 733619 - DNA, 25 bp, Mus musculus
gttgcttctgaggttgagaaaatac

SEQ ID NO: 733620 - DNA, 25 bp, Mus musculus
gttgcttctgggacctttaaatctt

SEQ ID NO: 733621 - DNA, 25 bp, Mus musculus
gttgcttctgggtcctttaaatctt

SEQ ID NO: 733622 - DNA, 25 bp, Mus musculus
gttgcttctgttcagtgcgttgcca

SEQ ID NO: 733623 - DNA, 25 bp, Mus musculus
gttgcttctgttgagtgcgttgcca

SEQ ID NO: 733624 - DNA, 25 bp, Mus musculus
gttgcttcttcaaaccacaatgatg

SEQ ID NO: 733625 - DNA, 25 bp, Mus musculus
gttgcttcttcataccacaatgatg

SEQ ID NO: 733626 - DNA, 25 bp, Mus musculus
gttgcttcttgtaggttagtctgtc

SEQ ID NO: 733627 - DNA, 25 bp, Mus musculus
gttgcttcttgttggttagtctgtc

SEQ ID NO: 733628 - DNA, 25 bp, Mus musculus
gttgcttgaagcctgtgtcatgtca

SEQ ID NO: 733629 - DNA, 25 bp, Mus musculus
gttgcttgaagcgtgtgtcatgtca

SEQ ID NO: 733630 - DNA, 25 bp, Mus musculus
gttgcttgaattctcagatgaccta

SEQ ID NO: 733631 - DNA, 25 bp, Mus musculus
gttgcttgaattgtcagatgaccta

SEQ ID NO: 733632 - DNA, 25 bp, Mus musculus
gttgcttgacttactagcagtccta

SEQ ID NO: 733633 - DNA, 25 bp, Mus musculus
gttgcttgactttctagcagtccta

SEQ ID NO: 733634 - DNA, 25 bp, Mus musculus
gttgcttgagaacaggctaaccctt

SEQ ID NO: 733635 - DNA, 25 bp, Mus musculus
gttgcttgagaagaggctaaccctt

SEQ ID NO: 733636 - DNA, 25 bp, Mus musculus
gttgcttgatccaactgttcaaaag

SEQ ID NO: 733637 - DNA, 25 bp, Mus musculus
gttgcttgatcctactgttcaaaag

SEQ ID NO: 733638 - DNA, 25 bp, Mus musculus
gttgcttgcagaaatttcattggtc

SEQ ID NO: 733639 - DNA, 25 bp, Mus musculus
gttgcttgcagatatttcattggtc

SEQ ID NO: 733640 - DNA, 25 bp, Mus musculus
gttgcttgcagtcataggcagccac

SEQ ID NO: 733641 - DNA, 25 bp, Mus musculus
gttgcttgcagtgataggcagccac

SEQ ID NO: 733642 - DNA, 25 bp, Mus musculus
gttgcttgcctgagaatccaattcc

SEQ ID NO: 733643 - DNA, 25 bp, Mus musculus
gttgcttgcctgtgaatccaattcc

SEQ ID NO: 733644 - DNA, 25 bp, Mus musculus
gttgcttgctgtctacttgcataca

SEQ ID NO: 733645 - DNA, 25 bp, Mus musculus
gttgcttgctgtgtacttgcataca

SEQ ID NO: 733646 - DNA, 25 bp, Mus musculus
gttgcttggatgaatagtctttcct

SEQ ID NO: 733647 - DNA, 25 bp, Mus musculus
gttgcttggatgtatagtctttcct

SEQ ID NO: 733648 - DNA, 25 bp, Mus musculus
gttgcttggcctacatgtgagatca

SEQ ID NO: 733649 - DNA, 25 bp, Mus musculus
gttgcttggccttcatgtgagatca

SEQ ID NO: 733650 - DNA, 25 bp, Mus musculus
gttgcttggctccttgacatggttc

SEQ ID NO: 733651 - DNA, 25 bp, Mus musculus
gttgcttggctcgttgacatggttc

SEQ ID NO: 733652 - DNA, 25 bp, Mus musculus
gttgcttggctgacattgtagtgaa

SEQ ID NO: 733653 - DNA, 25 bp, Mus musculus
gttgcttggctgagctcggttgcca

SEQ ID NO: 733654 - DNA, 25 bp, Mus musculus
gttgcttggctgtcattgtagtgaa

SEQ ID NO: 733655 - DNA, 25 bp, Mus musculus
gttgcttggctgtgctcggttgcca

SEQ ID NO: 733656 - DNA, 25 bp, Mus musculus
gttgcttgggctacctccgatgaca

SEQ ID NO: 733657 - DNA, 25 bp, Mus musculus
gttgcttgggcttcctccgatgaca

SEQ ID NO: 733658 - DNA, 25 bp, Mus musculus
gttgcttgtaatacagttttgcctg

SEQ ID NO: 733659 - DNA, 25 bp, Mus musculus
gttgcttgtaattcagttttgcctg

SEQ ID NO: 733660 - DNA, 25 bp, Mus musculus
gttgcttgtacaatgtgagactgga

SEQ ID NO: 733661 - DNA, 25 bp, Mus musculus
gttgcttgtacattgtgagactgga

SEQ ID NO: 733662 - DNA, 25 bp, Mus musculus
gttgctttaatgaggacatgtccag

SEQ ID NO: 733663 - DNA, 25 bp, Mus musculus
gttgctttaatgcatttcatggatt

SEQ ID NO: 733664 - DNA, 25 bp, Mus musculus
gttgctttaatggatttcatggatt

SEQ ID NO: 733665 - DNA, 25 bp, Mus musculus
gttgctttaatgtggacatgtccag

SEQ ID NO: 733666 - DNA, 25 bp, Mus musculus
gttgctttacccacaacagacaagt

SEQ ID NO: 733667 - DNA, 25 bp, Mus musculus
gttgctttacccagtattaacattt

SEQ ID NO: 733668 - DNA, 25 bp, Mus musculus
gttgctttaccctcaacagacaagt

SEQ ID NO: 733669 - DNA, 25 bp, Mus musculus
gttgctttaccctgtattaacattt

SEQ ID NO: 733670 - DNA, 25 bp, Mus musculus
gttgctttagtgactgtgtgctttc

SEQ ID NO: 733671 - DNA, 25 bp, Mus musculus
gttgctttagtgtctgtgtgctttc

SEQ ID NO: 733672 - DNA, 25 bp, Mus musculus
gttgctttagttcttccctggataa

SEQ ID NO: 733673 - DNA, 25 bp, Mus musculus
gttgctttagttgttccctggataa

SEQ ID NO: 733674 - DNA, 25 bp, Mus musculus
gttgctttatatcctaaccaaactt

SEQ ID NO: 733675 - DNA, 25 bp, Mus musculus
gttgctttatatgctaaccaaactt

SEQ ID NO: 733676 - DNA, 25 bp, Mus musculus
gttgctttatctatgagcgaggcat

SEQ ID NO: 733677 - DNA, 25 bp, Mus musculus
gttgctttatctttgagcgaggcat

SEQ ID NO: 733678 - DNA, 25 bp, Mus musculus
gttgctttatttaagttgaacccat

SEQ ID NO: 733679 - DNA, 25 bp, Mus musculus
gttgctttattttagttgaacccat

SEQ ID NO: 733680 - DNA, 25 bp, Mus musculus
gttgctttcaatattgtctcctcac

SEQ ID NO: 733681 - DNA, 25 bp, Mus musculus
gttgctttcaattttgtctcctcac

SEQ ID NO: 733682 - DNA, 25 bp, Mus musculus
gttgctttcactacgtcttctcttt

SEQ ID NO: 733683 - DNA, 25 bp, Mus musculus
gttgctttcacttcgtcttctcttt

SEQ ID NO: 733684 - DNA, 25 bp, Mus musculus
gttgctttccatccatcaaaggcat

SEQ ID NO: 733685 - DNA, 25 bp, Mus musculus
gttgctttccatgcatcaaaggcat

SEQ ID NO: 733686 - DNA, 25 bp, Mus musculus
gttgctttcccaaggcgatgattaa

SEQ ID NO: 733687 - DNA, 25 bp, Mus musculus
gttgctttcccactagaagatgtag

SEQ ID NO: 733688 - DNA, 25 bp, Mus musculus
gttgctttcccagtagaagatgtag

SEQ ID NO: 733689 - DNA, 25 bp, Mus musculus
gttgctttcccatggcgatgattaa

SEQ ID NO: 733690 - DNA, 25 bp, Mus musculus
gttgctttgactcatgacttctaaa

SEQ ID NO: 733691 - DNA, 25 bp, Mus musculus
gttgctttgactgatgacttctaaa

SEQ ID NO: 733692 - DNA, 25 bp, Mus musculus
gttgctttgcccaggatagcccggc

SEQ ID NO: 733693 - DNA, 25 bp, Mus musculus
gttgctttgccctggatagcccggc

SEQ ID NO: 733694 - DNA, 25 bp, Mus musculus
gttgctttgctgaccttcaagtaac

SEQ ID NO: 733695 - DNA, 25 bp, Mus musculus
gttgctttgctgtccttcaagtaac

SEQ ID NO: 733696 - DNA, 25 bp, Mus musculus
gttgctttgcttagggaatacttaa

SEQ ID NO: 733697 - DNA, 25 bp, Mus musculus
gttgctttgctttgggaatacttaa

SEQ ID NO: 733698 - DNA, 25 bp, Mus musculus
gttgctttggaaacctgtcagtgac

SEQ ID NO: 733699 - DNA, 25 bp, Mus musculus
gttgctttggaatcctgtcagtgac

SEQ ID NO: 733700 - DNA, 25 bp, Mus musculus
gttgctttggcacaagatcttagtt

SEQ ID NO: 733701 - DNA, 25 bp, Mus musculus
gttgctttggcagaagatcttagtt

SEQ ID NO: 733702 - DNA, 25 bp, Mus musculus
gttgctttgggtattaggcacctac

SEQ ID NO: 733703 - DNA, 25 bp, Mus musculus
gttgctttgggttttaggcacctac

SEQ ID NO: 733704 - DNA, 25 bp, Mus musculus
gttgctttgtcaagtccaggtttaa

SEQ ID NO: 733705 - DNA, 25 bp, Mus musculus
gttgctttgtcatgtccaggtttaa

SEQ ID NO: 733706 - DNA, 25 bp, Mus musculus
gttgcttttcaacgcactggctgat

SEQ ID NO: 733707 - DNA, 25 bp, Mus musculus
gttgcttttcaaggcactggctgat

SEQ ID NO: 733708 - DNA, 25 bp, Mus musculus
gttgcttttccaaatgggctccaag

SEQ ID NO: 733709 - DNA, 25 bp, Mus musculus
gttgcttttccatatgggctccaag

SEQ ID NO: 733710 - DNA, 25 bp, Mus musculus
gttgcttttcccctacagtttatat

SEQ ID NO: 733711 - DNA, 25 bp, Mus musculus
gttgcttttcccgtacagtttatat

SEQ ID NO: 733712 - DNA, 25 bp, Mus musculus
gttgcttttctaagttgtattcctg

SEQ ID NO: 733713 - DNA, 25 bp, Mus musculus
gttgcttttctatgttgtattcctg

SEQ ID NO: 733714 - DNA, 25 bp, Mus musculus
gttgcttttctcaacgagcttgtag

SEQ ID NO: 733715 - DNA, 25 bp, Mus musculus
gttgcttttctctacgagcttgtag

SEQ ID NO: 733716 - DNA, 25 bp, Mus musculus
gttgcttttctgcagaactcaggtt

SEQ ID NO: 733717 - DNA, 25 bp, Mus musculus
gttgcttttctggagaactcaggtt

SEQ ID NO: 733718 - DNA, 25 bp, Mus musculus
gttgcttttgtactgcgacatctta

SEQ ID NO: 733719 - DNA, 25 bp, Mus musculus
gttgcttttgtagtgcgacatctta

SEQ ID NO: 733720 - DNA, 25 bp, Mus musculus
gttgcttttgtgatggacaaggtac

SEQ ID NO: 733721 - DNA, 25 bp, Mus musculus
gttgcttttgtgttggacaaggtac

SEQ ID NO: 733722 - DNA, 25 bp, Mus musculus
gttgctttttaaatggtatgcatta

SEQ ID NO: 733723 - DNA, 25 bp, Mus musculus
gttgctttttaattggtatgcatta

SEQ ID NO: 733724 - DNA, 25 bp, Mus musculus
gttggaaaacatcttagagacgtgg

SEQ ID NO: 733725 - DNA, 25 bp, Mus musculus
gttggaaaacatgttagagacgtgg

SEQ ID NO: 733726 - DNA, 25 bp, Mus musculus
gttggaaaagacacatccctgctct

SEQ ID NO: 733727 - DNA, 25 bp, Mus musculus
gttggaaaagactcatccctgctct

SEQ ID NO: 733728 - DNA, 25 bp, Mus musculus
gttggaaaatagacgccttactgca

SEQ ID NO: 733729 - DNA, 25 bp, Mus musculus
gttggaaaatagtcgccttactgca

SEQ ID NO: 733730 - DNA, 25 bp, Mus musculus
gttggaaacccacacagcttttgtg

SEQ ID NO: 733731 - DNA, 25 bp, Mus musculus
gttggaaacccagacagcttttgtg

SEQ ID NO: 733732 - DNA, 25 bp, Mus musculus
gttggaaacgcaaacgccagaggtg

SEQ ID NO: 733733 - DNA, 25 bp, Mus musculus
gttggaaacgcatacgccagaggtg

SEQ ID NO: 733734 - DNA, 25 bp, Mus musculus
gttggaaacttcaactccaggttgg

SEQ ID NO: 733735 - DNA, 25 bp, Mus musculus
gttggaaacttctactccaggttgg

SEQ ID NO: 733736 - DNA, 25 bp, Mus musculus
gttggaaagaacctaaagtcatact

SEQ ID NO: 733737 - DNA, 25 bp, Mus musculus
gttggaaagaacgtaaagtcatact

SEQ ID NO: 733738 - DNA, 25 bp, Mus musculus
gttggaaagctaattcagctgtatt

SEQ ID NO: 733739 - DNA, 25 bp, Mus musculus
gttggaaagctatttcagctgtatt

SEQ ID NO: 733740 - DNA, 25 bp, Mus musculus
gttggaaaggatctcctgtctgccc

SEQ ID NO: 733741 - DNA, 25 bp, Mus musculus
gttggaaaggatgtcctgtctgccc

SEQ ID NO: 733742 - DNA, 25 bp, Mus musculus
gttggaaataaaaaacggtgatggt

SEQ ID NO: 733743 - DNA, 25 bp, Mus musculus
gttggaaataaaccatgctcttgct

SEQ ID NO: 733744 - DNA, 25 bp, Mus musculus
gttggaaataaagcatgctcttgct

SEQ ID NO: 733745 - DNA, 25 bp, Mus musculus
gttggaaataaataacggtgatggt

SEQ ID NO: 733746 - DNA, 25 bp, Mus musculus
gttggaaatatgaccttactgtttt

SEQ ID NO: 733747 - DNA, 25 bp, Mus musculus
gttggaaatatgtccttactgtttt

SEQ ID NO: 733748 - DNA, 25 bp, Mus musculus
gttggaaatcctatcgtgagtttta

SEQ ID NO: 733749 - DNA, 25 bp, Mus musculus
gttggaaatcctttcgtgagtttta

SEQ ID NO: 733750 - DNA, 25 bp, Mus musculus
gttggaaatctacacatagatcagg

SEQ ID NO: 733751 - DNA, 25 bp, Mus musculus
gttggaaatctagacatagatcagg

SEQ ID NO: 733752 - DNA, 25 bp, Mus musculus
gttggaaattcaccacaattctgga

SEQ ID NO: 733753 - DNA, 25 bp, Mus musculus
gttggaaattcagcacaattctgga

SEQ ID NO: 733754 - DNA, 25 bp, Mus musculus
gttggaaattgcacataccccatcc

SEQ ID NO: 733755 - DNA, 25 bp, Mus musculus
gttggaaattgctcataccccatcc

SEQ ID NO: 733756 - DNA, 25 bp, Mus musculus
gttggaacacacagcctttcagaat

SEQ ID NO: 733757 - DNA, 25 bp, Mus musculus
gttggaacacactgcctttcagaat

SEQ ID NO: 733758 - DNA, 25 bp, Mus musculus
gttggaacacatccagtcctgctga

SEQ ID NO: 733759 - DNA, 25 bp, Mus musculus
gttggaacacatgcagtcctgctga

SEQ ID NO: 733760 - DNA, 25 bp, Mus musculus
gttggaacactgctggacttttggt

SEQ ID NO: 733761 - DNA, 25 bp, Mus musculus
gttggaacactggtggacttttggt

SEQ ID NO: 733762 - DNA, 25 bp, Mus musculus
gttggaacagctctttcccacagct

SEQ ID NO: 733763 - DNA, 25 bp, Mus musculus
gttggaacagctgtttcccacagct

SEQ ID NO: 733764 - DNA, 25 bp, Mus musculus
gttggaaccacgactgtgggattga

SEQ ID NO: 733765 - DNA, 25 bp, Mus musculus
gttggaaccacgtctgtgggattga

SEQ ID NO: 733766 - DNA, 25 bp, Mus musculus
gttggaaccatcaggagtgtttctt

SEQ ID NO: 733767 - DNA, 25 bp, Mus musculus
gttggaaccatctggagtgtttctt

SEQ ID NO: 733768 - DNA, 25 bp, Mus musculus
gttggaaccattccaatacacctca

SEQ ID NO: 733769 - DNA, 25 bp, Mus musculus
gttggaaccattgcaatacacctca

SEQ ID NO: 733770 - DNA, 25 bp, Mus musculus
gttggaaccccaccagctacaggaa

SEQ ID NO: 733771 - DNA, 25 bp, Mus musculus
gttggaaccccagcagctacaggaa

SEQ ID NO: 733772 - DNA, 25 bp, Mus musculus
gttggaacctgaccacatggcacat

SEQ ID NO: 733773 - DNA, 25 bp, Mus musculus
gttggaacctgagcacatggcacat

SEQ ID NO: 733774 - DNA, 25 bp, Mus musculus
gttggaaccttcagtcttcacaaac

SEQ ID NO: 733775 - DNA, 25 bp, Mus musculus
gttggaaccttctgtcttcacaaac

SEQ ID NO: 733776 - DNA, 25 bp, Mus musculus
gttggaactaagcttcggctgcaag

SEQ ID NO: 733777 - DNA, 25 bp, Mus musculus
gttggaactaaggttcggctgcaag

SEQ ID NO: 733778 - DNA, 25 bp, Mus musculus
gttggaactcttagtgccgttagtt

SEQ ID NO: 733779 - DNA, 25 bp, Mus musculus
gttggaactctttgtgccgttagtt

SEQ ID NO: 733780 - DNA, 25 bp, Mus musculus
gttggaactgtaataggtggcctat

SEQ ID NO: 733781 - DNA, 25 bp, Mus musculus
gttggaactgtattaggtggcctat

SEQ ID NO: 733782 - DNA, 25 bp, Mus musculus
gttggaactgttcaaaatgaccgat

SEQ ID NO: 733783 - DNA, 25 bp, Mus musculus
gttggaactgttgaaaatgaccgat

SEQ ID NO: 733784 - DNA, 25 bp, Mus musculus
gttggaacttccaacctaggtggat

SEQ ID NO: 733785 - DNA, 25 bp, Mus musculus
gttggaacttcctacctaggtggat

SEQ ID NO: 733786 - DNA, 25 bp, Mus musculus
gttggaagacatcggctccgactct

SEQ ID NO: 733787 - DNA, 25 bp, Mus musculus
gttggaagacatgggctccgactct

SEQ ID NO: 733788 - DNA, 25 bp, Mus musculus
gttggaagcaatagctgtctcccct

SEQ ID NO: 733789 - DNA, 25 bp, Mus musculus
gttggaagcaattgctgtctcccct

SEQ ID NO: 733790 - DNA, 25 bp, Mus musculus
gttggaagcacacggcatgtacata

SEQ ID NO: 733791 - DNA, 25 bp, Mus musculus
gttggaagcacagggcatgtacata

SEQ ID NO: 733792 - DNA, 25 bp, Mus musculus
gttggaagccatcgaccgactatga

SEQ ID NO: 733793 - DNA, 25 bp, Mus musculus
gttggaagccatggaccgactatga

SEQ ID NO: 733794 - DNA, 25 bp, Mus musculus
gttggaagcctcaaagaagcccgaa

SEQ ID NO: 733795 - DNA, 25 bp, Mus musculus
gttggaagcctctaagaagcccgaa

SEQ ID NO: 733796 - DNA, 25 bp, Mus musculus
gttggaagcgtccagcccctctctg

SEQ ID NO: 733797 - DNA, 25 bp, Mus musculus
gttggaagcgtcgagcccctctctg

SEQ ID NO: 733798 - DNA, 25 bp, Mus musculus
gttggaagctagaggctgcttccct

SEQ ID NO: 733799 - DNA, 25 bp, Mus musculus
gttggaagctagtggctgcttccct

SEQ ID NO: 733800 - DNA, 25 bp, Mus musculus
gttggaagctatacccgatttaatt

SEQ ID NO: 733801 - DNA, 25 bp, Mus musculus
gttggaagctattcccgatttaatt

SEQ ID NO: 733802 - DNA, 25 bp, Mus musculus
gttggaaggatccaggcccttttca

SEQ ID NO: 733803 - DNA, 25 bp, Mus musculus
gttggaaggatcgaggcccttttca

SEQ ID NO: 733804 - DNA, 25 bp, Mus musculus
gttggaagtaagaaggtgccattgt

SEQ ID NO: 733805 - DNA, 25 bp, Mus musculus
gttggaagtaagtaggtgccattgt

SEQ ID NO: 733806 - DNA, 25 bp, Mus musculus
gttggaatacgcaaacatataagtt

SEQ ID NO: 733807 - DNA, 25 bp, Mus musculus
gttggaatacgctaacatataagtt

SEQ ID NO: 733808 - DNA, 25 bp, Mus musculus
gttggaatctaaatcacccacatga

SEQ ID NO: 733809 - DNA, 25 bp, Mus musculus
gttggaatctaattcacccacatga

SEQ ID NO: 733810 - DNA, 25 bp, Mus musculus
gttggaatctttcccaggcccctga

SEQ ID NO: 733811 - DNA, 25 bp, Mus musculus
gttggaatctttgccaggcccctga

SEQ ID NO: 733812 - DNA, 25 bp, Mus musculus
gttggaatgactattatctcagcag

SEQ ID NO: 733813 - DNA, 25 bp, Mus musculus
gttggaatgacttttatctcagcag

SEQ ID NO: 733814 - DNA, 25 bp, Mus musculus
gttggaatggtcactacttccctgg

SEQ ID NO: 733815 - DNA, 25 bp, Mus musculus
gttggaatggtctctacttccctgg

SEQ ID NO: 733816 - DNA, 25 bp, Mus musculus
gttggaattataagatctgcattta

SEQ ID NO: 733817 - DNA, 25 bp, Mus musculus
gttggaattatatgatctgcattta

SEQ ID NO: 733818 - DNA, 25 bp, Mus musculus
gttggaattcaacatgaacaccacc

SEQ ID NO: 733819 - DNA, 25 bp, Mus musculus
gttggaattcaagatgaacaccacc

SEQ ID NO: 733820 - DNA, 25 bp, Mus musculus
gttggaattcaccacagtaggactg

SEQ ID NO: 733821 - DNA, 25 bp, Mus musculus
gttggaattcacgacagtaggactg

SEQ ID NO: 733822 - DNA, 25 bp, Mus musculus
gttggaattcagctcctagtctgag

SEQ ID NO: 733823 - DNA, 25 bp, Mus musculus
gttggaattcaggtcctagtctgag

SEQ ID NO: 733824 - DNA, 25 bp, Mus musculus
gttggaattccacctactcactagt

SEQ ID NO: 733825 - DNA, 25 bp, Mus musculus
gttggaattccagctactcactagt

SEQ ID NO: 733826 - DNA, 25 bp, Mus musculus
gttggaattcccatagataatcctc

SEQ ID NO: 733827 - DNA, 25 bp, Mus musculus
gttggaattcccttagataatcctc

SEQ ID NO: 733828 - DNA, 25 bp, Mus musculus
gttggaattgccagagagacagccc

SEQ ID NO: 733829 - DNA, 25 bp, Mus musculus
gttggaattgcctgagagacagccc

SEQ ID NO: 733830 - DNA, 25 bp, Mus musculus
gttggaatttaacctccagcagacc

SEQ ID NO: 733831 - DNA, 25 bp, Mus musculus
gttggaatttaagctccagcagacc

SEQ ID NO: 733832 - DNA, 25 bp, Mus musculus
gttggaatttgaaccctgtctaggg

SEQ ID NO: 733833 - DNA, 25 bp, Mus musculus
gttggaatttgatccctgtctaggg

SEQ ID NO: 733834 - DNA, 25 bp, Mus musculus
gttggacaacagatagcatagcatt

SEQ ID NO: 733835 - DNA, 25 bp, Mus musculus
gttggacaacagttagcatagcatt

SEQ ID NO: 733836 - DNA, 25 bp, Mus musculus
gttggacaacgaatgctaaaattga

SEQ ID NO: 733837 - DNA, 25 bp, Mus musculus
gttggacaacgattgctaaaattga

SEQ ID NO: 733838 - DNA, 25 bp, Mus musculus
gttggacaagtgcaagcttcagaca

SEQ ID NO: 733839 - DNA, 25 bp, Mus musculus
gttggacaagtggaagcttcagaca

SEQ ID NO: 733840 - DNA, 25 bp, Mus musculus
gttggacacagtcctgtcactactc

SEQ ID NO: 733841 - DNA, 25 bp, Mus musculus
gttggacacagtgctgtcactactc

SEQ ID NO: 733842 - DNA, 25 bp, Mus musculus
gttggacacccaagagaacctgctg

SEQ ID NO: 733843 - DNA, 25 bp, Mus musculus
gttggacacccatgagaacctgctg

SEQ ID NO: 733844 - DNA, 25 bp, Mus musculus
gttggacacgtgaacaatcctgtat

SEQ ID NO: 733845 - DNA, 25 bp, Mus musculus
gttggacacgtgtacaatcctgtat

SEQ ID NO: 733846 - DNA, 25 bp, Mus musculus
gttggacactgacggactgcaggca

SEQ ID NO: 733847 - DNA, 25 bp, Mus musculus
gttggacactgagggactgcaggca

SEQ ID NO: 733848 - DNA, 25 bp, Mus musculus
gttggacagaaaaatccctgccctc

SEQ ID NO: 733849 - DNA, 25 bp, Mus musculus
gttggacagaaatatccctgccctc

SEQ ID NO: 733850 - DNA, 25 bp, Mus musculus
gttggacagccaccttctagggaaa

SEQ ID NO: 733851 - DNA, 25 bp, Mus musculus
gttggacagccagcttctagggaaa

SEQ ID NO: 733852 - DNA, 25 bp, Mus musculus
gttggacagtaccagcacagcttta

SEQ ID NO: 733853 - DNA, 25 bp, Mus musculus
gttggacagtacgagcacagcttta

SEQ ID NO: 733854 - DNA, 25 bp, Mus musculus
gttggacatcaaaacaaggctggaa

SEQ ID NO: 733855 - DNA, 25 bp, Mus musculus
gttggacatcaatacaaggctggaa

SEQ ID NO: 733856 - DNA, 25 bp, Mus musculus
gttggacatccacgaagctatcagt

SEQ ID NO: 733857 - DNA, 25 bp, Mus musculus
gttggacatccaggaagctatcagt

SEQ ID NO: 733858 - DNA, 25 bp, Mus musculus
gttggacatctgacaagtctactgt

SEQ ID NO: 733859 - DNA, 25 bp, Mus musculus
gttggacatctgtcaagtctactgt

SEQ ID NO: 733860 - DNA, 25 bp, Mus musculus
gttggacatcttagaaccatctcta

SEQ ID NO: 733861 - DNA, 25 bp, Mus musculus
gttggacatctttgaaccatctcta

SEQ ID NO: 733862 - DNA, 25 bp, Mus musculus
gttggacatgtacactagctttctt

SEQ ID NO: 733863 - DNA, 25 bp, Mus musculus
gttggacatgtagactagctttctt

SEQ ID NO: 733864 - DNA, 25 bp, Mus musculus
gttggaccaaggcacttcacagcat

SEQ ID NO: 733865 - DNA, 25 bp, Mus musculus
gttggaccaagggacttcacagcat

SEQ ID NO: 733866 - DNA, 25 bp, Mus musculus
gttggaccaatcatgggcgctgtgc

SEQ ID NO: 733867 - DNA, 25 bp, Mus musculus
gttggaccaatcttgggcgctgtgc

SEQ ID NO: 733868 - DNA, 25 bp, Mus musculus
gttggaccacgtattcaacgatatg

SEQ ID NO: 733869 - DNA, 25 bp, Mus musculus
gttggaccacgttttcaacgatatg

SEQ ID NO: 733870 - DNA, 25 bp, Mus musculus
gttggaccagcaaggctcctgcgga

SEQ ID NO: 733871 - DNA, 25 bp, Mus musculus
gttggaccagcatggctcctgcgga

SEQ ID NO: 733872 - DNA, 25 bp, Mus musculus
gttggaccagtaatgcaattctgta

SEQ ID NO: 733873 - DNA, 25 bp, Mus musculus
gttggaccagtactatttattgctt

SEQ ID NO: 733874 - DNA, 25 bp, Mus musculus
gttggaccagtagtatttattgctt

SEQ ID NO: 733875 - DNA, 25 bp, Mus musculus
gttggaccagtattgcaattctgta

SEQ ID NO: 733876 - DNA, 25 bp, Mus musculus
gttggacccagcataccaagggaga

SEQ ID NO: 733877 - DNA, 25 bp, Mus musculus
gttggacccagcttaccaagggaga

SEQ ID NO: 733878 - DNA, 25 bp, Mus musculus
gttggaccccacctagatggctaga

SEQ ID NO: 733879 - DNA, 25 bp, Mus musculus
gttggaccccacgtagatggctaga

SEQ ID NO: 733880 - DNA, 25 bp, Mus musculus
gttggaccccttaccatgtggacag

SEQ ID NO: 733881 - DNA, 25 bp, Mus musculus
gttggacccctttccatgtggacag

SEQ ID NO: 733882 - DNA, 25 bp, Mus musculus
gttggaccctgaacagcgctggcta

SEQ ID NO: 733883 - DNA, 25 bp, Mus musculus
gttggaccctgatcagcgctggcta

SEQ ID NO: 733884 - DNA, 25 bp, Mus musculus
gttggacctggacatttagagcttt

SEQ ID NO: 733885 - DNA, 25 bp, Mus musculus
gttggacctggagatttagagcttt

SEQ ID NO: 733886 - DNA, 25 bp, Mus musculus
gttggaccttaaagtgactattctg

SEQ ID NO: 733887 - DNA, 25 bp, Mus musculus
gttggaccttaatgtgactattctg

SEQ ID NO: 733888 - DNA, 25 bp, Mus musculus
gttggaccttgaactcagtgagtgc

SEQ ID NO: 733889 - DNA, 25 bp, Mus musculus
gttggaccttgatctcagtgagtgc

SEQ ID NO: 733890 - DNA, 25 bp, Mus musculus
gttggaccttgtaagtaattagagc

SEQ ID NO: 733891 - DNA, 25 bp, Mus musculus
gttggaccttgttagtaattagagc

SEQ ID NO: 733892 - DNA, 25 bp, Mus musculus
gttggacgcacacctggatgcttac

SEQ ID NO: 733893 - DNA, 25 bp, Mus musculus
gttggacgcacagctggatgcttac

SEQ ID NO: 733894 - DNA, 25 bp, Mus musculus
gttggacgcactatcaatcactttc

SEQ ID NO: 733895 - DNA, 25 bp, Mus musculus
gttggacgcactttcaatcactttc

SEQ ID NO: 733896 - DNA, 25 bp, Mus musculus
gttggactaagccaccttgaatgga

SEQ ID NO: 733897 - DNA, 25 bp, Mus musculus
gttggactaagcgaccttgaatgga

SEQ ID NO: 733898 - DNA, 25 bp, Mus musculus
gttggactacctcatggatgtacta

SEQ ID NO: 733899 - DNA, 25 bp, Mus musculus
gttggactacctgatggatgtacta

SEQ ID NO: 733900 - DNA, 25 bp, Mus musculus
gttggactcctgaagcatgctgacc

SEQ ID NO: 733901 - DNA, 25 bp, Mus musculus
gttggactcctgtagcatgctgacc

SEQ ID NO: 733902 - DNA, 25 bp, Mus musculus
gttggactgaccagactatagacac

SEQ ID NO: 733903 - DNA, 25 bp, Mus musculus
gttggactgacctgactatagacac

SEQ ID NO: 733904 - DNA, 25 bp, Mus musculus
gttggactgactcgaggaccccgaa

SEQ ID NO: 733905 - DNA, 25 bp, Mus musculus
gttggactgactggaggaccccgaa

SEQ ID NO: 733906 - DNA, 25 bp, Mus musculus
gttggactggtcctggccaatctct

SEQ ID NO: 733907 - DNA, 25 bp, Mus musculus
gttggactggtcgtggccaatctct

SEQ ID NO: 733908 - DNA, 25 bp, Mus musculus
gttggactgtgtacccggttctgtc

SEQ ID NO: 733909 - DNA, 25 bp, Mus musculus
gttggactgtgtcgcataacccttg

SEQ ID NO: 733910 - DNA, 25 bp, Mus musculus
gttggactgtgtggcataacccttg

SEQ ID NO: 733911 - DNA, 25 bp, Mus musculus
gttggactgtgttcccggttctgtc

SEQ ID NO: 733912 - DNA, 25 bp, Mus musculus
gttggacttgtgacttggttctcaa

SEQ ID NO: 733913 - DNA, 25 bp, Mus musculus
gttggacttgtgtcttggttctcaa

SEQ ID NO: 733914 - DNA, 25 bp, Mus musculus
gttggacttttccagatgaccttcc

SEQ ID NO: 733915 - DNA, 25 bp, Mus musculus
gttggacttttcgagatgaccttcc

SEQ ID NO: 733916 - DNA, 25 bp, Mus musculus
gttggagaactcaagtgtagataca

SEQ ID NO: 733917 - DNA, 25 bp, Mus musculus
gttggagaactctagtgtagataca

SEQ ID NO: 733918 - DNA, 25 bp, Mus musculus
gttggagacccacattgcataagct

SEQ ID NO: 733919 - DNA, 25 bp, Mus musculus
gttggagacccagattgcataagct

SEQ ID NO: 733920 - DNA, 25 bp, Mus musculus
gttggagagaatctggcaccctctt

SEQ ID NO: 733921 - DNA, 25 bp, Mus musculus
gttggagagaatgtggcaccctctt

SEQ ID NO: 733922 - DNA, 25 bp, Mus musculus
gttggagagacccttgtcactgacc

SEQ ID NO: 733923 - DNA, 25 bp, Mus musculus
gttggagagaccgttgtcactgacc

SEQ ID NO: 733924 - DNA, 25 bp, Mus musculus
gttggagagatgatacaccctttta

SEQ ID NO: 733925 - DNA, 25 bp, Mus musculus
gttggagagatgttacaccctttta

SEQ ID NO: 733926 - DNA, 25 bp, Mus musculus
gttggagagtggcaacccagccatc

SEQ ID NO: 733927 - DNA, 25 bp, Mus musculus
gttggagagtgggaacccagccatc

SEQ ID NO: 733928 - DNA, 25 bp, Mus musculus
gttggagagttaccacggcggttaa

SEQ ID NO: 733929 - DNA, 25 bp, Mus musculus
gttggagagttagcacggcggttaa

SEQ ID NO: 733930 - DNA, 25 bp, Mus musculus
gttggagataacacttgcctcctct

SEQ ID NO: 733931 - DNA, 25 bp, Mus musculus
gttggagataactcttgcctcctct

SEQ ID NO: 733932 - DNA, 25 bp, Mus musculus
gttggagataggcacacctcttcct

SEQ ID NO: 733933 - DNA, 25 bp, Mus musculus
gttggagatagggacacctcttcct

SEQ ID NO: 733934 - DNA, 25 bp, Mus musculus
gttggagatcaacgctgcagacaga

SEQ ID NO: 733935 - DNA, 25 bp, Mus musculus
gttggagatcaaggctgcagacaga

SEQ ID NO: 733936 - DNA, 25 bp, Mus musculus
gttggagattatctgactgctggca

SEQ ID NO: 733937 - DNA, 25 bp, Mus musculus
gttggagattatgtgactgctggca

SEQ ID NO: 733938 - DNA, 25 bp, Mus musculus
gttggagattcacctgccttaagtg

SEQ ID NO: 733939 - DNA, 25 bp, Mus musculus
gttggagattcagctgccttaagtg

SEQ ID NO: 733940 - DNA, 25 bp, Mus musculus
gttggagattttacagtgatccttg

SEQ ID NO: 733941 - DNA, 25 bp, Mus musculus
gttggagatttttcagtgatccttg

SEQ ID NO: 733942 - DNA, 25 bp, Mus musculus
gttggagcacaccagcgacattcta

SEQ ID NO: 733943 - DNA, 25 bp, Mus musculus
gttggagcacacgagcgacattcta

SEQ ID NO: 733944 - DNA, 25 bp, Mus musculus
gttggagcacagaattaaggaacaa

SEQ ID NO: 733945 - DNA, 25 bp, Mus musculus
gttggagcacagtattaaggaacaa

SEQ ID NO: 733946 - DNA, 25 bp, Mus musculus
gttggagcagcaacaactctgggat

SEQ ID NO: 733947 - DNA, 25 bp, Mus musculus
gttggagcagcatcaactctgggat

SEQ ID NO: 733948 - DNA, 25 bp, Mus musculus
gttggagccatcaagctattgagct

SEQ ID NO: 733949 - DNA, 25 bp, Mus musculus
gttggagccatctagctattgagct

SEQ ID NO: 733950 - DNA, 25 bp, Mus musculus
gttggagccatgaagacttcagtca

SEQ ID NO: 733951 - DNA, 25 bp, Mus musculus
gttggagccatgtagacttcagtca

SEQ ID NO: 733952 - DNA, 25 bp, Mus musculus
gttggagcctgtccttcagggtata

SEQ ID NO: 733953 - DNA, 25 bp, Mus musculus
gttggagcctgtgcttcagggtata

SEQ ID NO: 733954 - DNA, 25 bp, Mus musculus
gttggagcgagaattgtttaaacaa

SEQ ID NO: 733955 - DNA, 25 bp, Mus musculus
gttggagcgagatttgtttaaacaa

SEQ ID NO: 733956 - DNA, 25 bp, Mus musculus
gttggagcggctatggactcaccca

SEQ ID NO: 733957 - DNA, 25 bp, Mus musculus
gttggagcggctttggactcaccca

SEQ ID NO: 733958 - DNA, 25 bp, Mus musculus
gttggagctctacaacctcactgtg

SEQ ID NO: 733959 - DNA, 25 bp, Mus musculus
gttggagctctagaacctcactgtg

SEQ ID NO: 733960 - DNA, 25 bp, Mus musculus
gttggagctcttcagatggcagaaa

SEQ ID NO: 733961 - DNA, 25 bp, Mus musculus
gttggagctcttgagatggcagaaa

SEQ ID NO: 733962 - DNA, 25 bp, Mus musculus
gttggagctgctaaagcgagtgtta

SEQ ID NO: 733963 - DNA, 25 bp, Mus musculus
gttggagctgcttaagcgagtgtta

SEQ ID NO: 733964 - DNA, 25 bp, Mus musculus
gttggagcttaaaccccttgtatat

SEQ ID NO: 733965 - DNA, 25 bp, Mus musculus
gttggagcttaatccccttgtatat

SEQ ID NO: 733966 - DNA, 25 bp, Mus musculus
gttggaggacaaccatctggctcaa

SEQ ID NO: 733967 - DNA, 25 bp, Mus musculus
gttggaggacaagcatctggctcaa

SEQ ID NO: 733968 - DNA, 25 bp, Mus musculus
gttggaggagacactagagcccatt

SEQ ID NO: 733969 - DNA, 25 bp, Mus musculus
gttggaggagactctagagcccatt

SEQ ID NO: 733970 - DNA, 25 bp, Mus musculus
gttggaggagcacctcacacgtggt

SEQ ID NO: 733971 - DNA, 25 bp, Mus musculus
gttggaggagcagctcacacgtggt

SEQ ID NO: 733972 - DNA, 25 bp, Mus musculus
gttggaggagttatctcgtgtccga

SEQ ID NO: 733973 - DNA, 25 bp, Mus musculus
gttggaggagttttctcgtgtccga

SEQ ID NO: 733974 - DNA, 25 bp, Mus musculus
gttggaggatatacaatcacatggt

SEQ ID NO: 733975 - DNA, 25 bp, Mus musculus
gttggaggatatattctgccgtttt

SEQ ID NO: 733976 - DNA, 25 bp, Mus musculus
gttggaggatattcaatcacatggt

SEQ ID NO: 733977 - DNA, 25 bp, Mus musculus
gttggaggatattttctgccgtttt

SEQ ID NO: 733978 - DNA, 25 bp, Mus musculus
gttggaggattacacacctacgatc

SEQ ID NO: 733979 - DNA, 25 bp, Mus musculus
gttggaggattagacacctacgatc

SEQ ID NO: 733980 - DNA, 25 bp, Mus musculus
gttggaggctgtatccagtggaata

SEQ ID NO: 733981 - DNA, 25 bp, Mus musculus
gttggaggctgtttccagtggaata

SEQ ID NO: 733982 - DNA, 25 bp, Mus musculus
gttggagggcaaagtgttctacata

SEQ ID NO: 733983 - DNA, 25 bp, Mus musculus
gttggagggcaatgtgttctacata

SEQ ID NO: 733984 - DNA, 25 bp, Mus musculus
gttggagggtacatcggcattcagc

SEQ ID NO: 733985 - DNA, 25 bp, Mus musculus
gttggagggtacttcggcattcagc

SEQ ID NO: 733986 - DNA, 25 bp, Mus musculus
gttggaggtagtacatcaggagatt

SEQ ID NO: 733987 - DNA, 25 bp, Mus musculus
gttggaggtagttcatcaggagatt

SEQ ID NO: 733988 - DNA, 25 bp, Mus musculus
gttggaggtctcaggcacatatgcc

SEQ ID NO: 733989 - DNA, 25 bp, Mus musculus
gttggaggtctctggcacatatgcc

SEQ ID NO: 733990 - DNA, 25 bp, Mus musculus
gttggagtagccacctttgaggact

SEQ ID NO: 733991 - DNA, 25 bp, Mus musculus
gttggagtagcctcctttgaggact

SEQ ID NO: 733992 - DNA, 25 bp, Mus musculus
gttggagtcacaattctggtactga

SEQ ID NO: 733993 - DNA, 25 bp, Mus musculus
gttggagtcacatttctggtactga

SEQ ID NO: 733994 - DNA, 25 bp, Mus musculus
gttggagtcagaatactcctgcccc

SEQ ID NO: 733995 - DNA, 25 bp, Mus musculus
gttggagtcagattactcctgcccc

SEQ ID NO: 733996 - DNA, 25 bp, Mus musculus
gttggagtcatgctctccagaaaca

SEQ ID NO: 733997 - DNA, 25 bp, Mus musculus
gttggagtcatggtctccagaaaca

SEQ ID NO: 733998 - DNA, 25 bp, Mus musculus
gttggagtctgcaaaccgcgatgca

SEQ ID NO: 733999 - DNA, 25 bp, Mus musculus
gttggagtctgcaacagctgaccat

SEQ ID NO: 734000 - DNA, 25 bp, Mus musculus
gttggagtctgctaaccgcgatgca

SEQ ID NO: 734001 - DNA, 25 bp, Mus musculus
gttggagtctgctacagctgaccat

SEQ ID NO: 734002 - DNA, 25 bp, Mus musculus
gttggagtcttgaggcttctcgaaa

SEQ ID NO: 734003 - DNA, 25 bp, Mus musculus
gttggagtcttgtggcttctcgaaa

SEQ ID NO: 734004 - DNA, 25 bp, Mus musculus
gttggagtgatgacggcctctcaat

SEQ ID NO: 734005 - DNA, 25 bp, Mus musculus
gttggagtgatgtcggcctctcaat

SEQ ID NO: 734006 - DNA, 25 bp, Mus musculus
gttggagtgcacattggacaaggac

SEQ ID NO: 734007 - DNA, 25 bp, Mus musculus
gttggagtgcactttggacaaggac

SEQ ID NO: 734008 - DNA, 25 bp, Mus musculus
gttggagtgccaagttcatcgtgtc

SEQ ID NO: 734009 - DNA, 25 bp, Mus musculus
gttggagtgccatgttcatcgtgtc

SEQ ID NO: 734010 - DNA, 25 bp, Mus musculus
gttggagtggaaactgtctgagtca

SEQ ID NO: 734011 - DNA, 25 bp, Mus musculus
gttggagtggaatctgtctgagtca

SEQ ID NO: 734012 - DNA, 25 bp, Mus musculus
gttggagtggacatgccaccaggct

SEQ ID NO: 734013 - DNA, 25 bp, Mus musculus
gttggagtggacttgccaccaggct

SEQ ID NO: 734014 - DNA, 25 bp, Mus musculus
gttggagtgttcacctgtgcacttg

SEQ ID NO: 734015 - DNA, 25 bp, Mus musculus
gttggagtgttctcctgtgcacttg

SEQ ID NO: 734016 - DNA, 25 bp, Mus musculus
gttggagttcatcatgaccccttta

SEQ ID NO: 734017 - DNA, 25 bp, Mus musculus
gttggagttcatgatgaccccttta

SEQ ID NO: 734018 - DNA, 25 bp, Mus musculus
gttggagttgcaacagtctccccag

SEQ ID NO: 734019 - DNA, 25 bp, Mus musculus
gttggagttgcatcagtctccccag

SEQ ID NO: 734020 - DNA, 25 bp, Mus musculus
gttggagttgcccagagttctacat

SEQ ID NO: 734021 - DNA, 25 bp, Mus musculus
gttggagttgccgagagttctacat

SEQ ID NO: 734022 - DNA, 25 bp, Mus musculus
gttggagtttgtacttcagcttcct

SEQ ID NO: 734023 - DNA, 25 bp, Mus musculus
gttggagtttgttcttcagcttcct

SEQ ID NO: 734024 - DNA, 25 bp, Mus musculus
gttggagttttcacatcatggacaa

SEQ ID NO: 734025 - DNA, 25 bp, Mus musculus
gttggagttttctcatcatggacaa

SEQ ID NO: 734026 - DNA, 25 bp, Mus musculus
gttggagttttgcttgatgctatca

SEQ ID NO: 734027 - DNA, 25 bp, Mus musculus
gttggagttttggttgatgctatca

SEQ ID NO: 734028 - DNA, 25 bp, Mus musculus
gttggataaactcacctggagccta

SEQ ID NO: 734029 - DNA, 25 bp, Mus musculus
gttggataaactgacctggagccta

SEQ ID NO: 734030 - DNA, 25 bp, Mus musculus
gttggataacgcactgtcactactg

SEQ ID NO: 734031 - DNA, 25 bp, Mus musculus
gttggataacgctctgtcactactg

SEQ ID NO: 734032 - DNA, 25 bp, Mus musculus
gttggatacattcccacagtaactg

SEQ ID NO: 734033 - DNA, 25 bp, Mus musculus
gttggatacattgccacagtaactg

SEQ ID NO: 734034 - DNA, 25 bp, Mus musculus
gttggatagagtcaccctgtcccga

SEQ ID NO: 734035 - DNA, 25 bp, Mus musculus
gttggatagagtgaccctgtcccga

SEQ ID NO: 734036 - DNA, 25 bp, Mus musculus
gttggatatatacgtctccgtccta

SEQ ID NO: 734037 - DNA, 25 bp, Mus musculus
gttggatatataggtctccgtccta

SEQ ID NO: 734038 - DNA, 25 bp, Mus musculus
gttggatatcaactctagtgtaaca

SEQ ID NO: 734039 - DNA, 25 bp, Mus musculus
gttggatatcaagtctagtgtaaca

SEQ ID NO: 734040 - DNA, 25 bp, Mus musculus
gttggatatttcactacattcctga

SEQ ID NO: 734041 - DNA, 25 bp, Mus musculus
gttggatatttctctacattcctga

SEQ ID NO: 734042 - DNA, 25 bp, Mus musculus
gttggatcactgctctttaactccc

SEQ ID NO: 734043 - DNA, 25 bp, Mus musculus
gttggatcactggtctttaactccc

SEQ ID NO: 734044 - DNA, 25 bp, Mus musculus
gttggatcagatcaactcttgtctg

SEQ ID NO: 734045 - DNA, 25 bp, Mus musculus
gttggatcagatgaactcttgtctg

SEQ ID NO: 734046 - DNA, 25 bp, Mus musculus
gttggatcaggcctgaacccgtcca

SEQ ID NO: 734047 - DNA, 25 bp, Mus musculus
gttggatcaggcgtgaacccgtcca

SEQ ID NO: 734048 - DNA, 25 bp, Mus musculus
gttggatccattatcacttaagtag

SEQ ID NO: 734049 - DNA, 25 bp, Mus musculus
gttggatccattttcacttaagtag

SEQ ID NO: 734050 - DNA, 25 bp, Mus musculus
gttggatcccaacacattgcacaca

SEQ ID NO: 734051 - DNA, 25 bp, Mus musculus
gttggatcccaagacattgcacaca

SEQ ID NO: 734052 - DNA, 25 bp, Mus musculus
gttggatccgatcctgtcaggagca

SEQ ID NO: 734053 - DNA, 25 bp, Mus musculus
gttggatccgatgctgtcaggagca

SEQ ID NO: 734054 - DNA, 25 bp, Mus musculus
gttggatctatcatagtcctggctc

SEQ ID NO: 734055 - DNA, 25 bp, Mus musculus
gttggatctatcttagtcctggctc

SEQ ID NO: 734056 - DNA, 25 bp, Mus musculus
gttggatctcttcgaacttaaccct

SEQ ID NO: 734057 - DNA, 25 bp, Mus musculus
gttggatctcttggaacttaaccct

SEQ ID NO: 734058 - DNA, 25 bp, Mus musculus
gttggatctgacatataaggcaccc

SEQ ID NO: 734059 - DNA, 25 bp, Mus musculus
gttggatctgacttataaggcaccc

SEQ ID NO: 734060 - DNA, 25 bp, Mus musculus
gttggatgactcattgacagtgcct

SEQ ID NO: 734061 - DNA, 25 bp, Mus musculus
gttggatgactctttgacagtgcct

SEQ ID NO: 734062 - DNA, 25 bp, Mus musculus
gttggatgcatcagtggaccacctt

SEQ ID NO: 734063 - DNA, 25 bp, Mus musculus
gttggatgcatctgtggaccacctt

SEQ ID NO: 734064 - DNA, 25 bp, Mus musculus
gttggatgggctctggaccttaaat

SEQ ID NO: 734065 - DNA, 25 bp, Mus musculus
gttggatgggctgtggaccttaaat

SEQ ID NO: 734066 - DNA, 25 bp, Mus musculus
gttggatggttaacagtgctgccgt

SEQ ID NO: 734067 - DNA, 25 bp, Mus musculus
gttggatggttatcagtgctgccgt

SEQ ID NO: 734068 - DNA, 25 bp, Mus musculus
gttggatgttacattctagttacaa

SEQ ID NO: 734069 - DNA, 25 bp, Mus musculus
gttggatgttactttctagttacaa

SEQ ID NO: 734070 - DNA, 25 bp, Mus musculus
gttggatgttcaccatgacttcact

SEQ ID NO: 734071 - DNA, 25 bp, Mus musculus
gttggatgttcagcatgacttcact

SEQ ID NO: 734072 - DNA, 25 bp, Mus musculus
gttggattatccatatacagtatag

SEQ ID NO: 734073 - DNA, 25 bp, Mus musculus
gttggattatccttatacagtatag

SEQ ID NO: 734074 - DNA, 25 bp, Mus musculus
gttggattatctattctccagtaca

SEQ ID NO: 734075 - DNA, 25 bp, Mus musculus
gttggattatcttttctccagtaca

SEQ ID NO: 734076 - DNA, 25 bp, Mus musculus
gttggattcccacgaatccgtatgg

SEQ ID NO: 734077 - DNA, 25 bp, Mus musculus
gttggattcccaggaatccgtatgg

SEQ ID NO: 734078 - DNA, 25 bp, Mus musculus
gttggattccttcttacatggtata

SEQ ID NO: 734079 - DNA, 25 bp, Mus musculus
gttggattccttgttacatggtata

SEQ ID NO: 734080 - DNA, 25 bp, Mus musculus
gttggattcttcacaaggttaacat

SEQ ID NO: 734081 - DNA, 25 bp, Mus musculus
gttggattcttctcaaggttaacat

SEQ ID NO: 734082 - DNA, 25 bp, Mus musculus
gttggattctttagcagccttgcca

SEQ ID NO: 734083 - DNA, 25 bp, Mus musculus
gttggattcttttgcagccttgcca

SEQ ID NO: 734084 - DNA, 25 bp, Mus musculus
gttggattgaggatcttgttacata

SEQ ID NO: 734085 - DNA, 25 bp, Mus musculus
gttggattgaggttcttgttacata

SEQ ID NO: 734086 - DNA, 25 bp, Mus musculus
gttggattgggaatcgctgcccttg

SEQ ID NO: 734087 - DNA, 25 bp, Mus musculus
gttggattgggattcgctgcccttg

SEQ ID NO: 734088 - DNA, 25 bp, Mus musculus
gttggatttcaactcattcctgaca

SEQ ID NO: 734089 - DNA, 25 bp, Mus musculus
gttggatttcaagtcattcctgaca

SEQ ID NO: 734090 - DNA, 25 bp, Mus musculus
gttggatttcatacaggagcctgga

SEQ ID NO: 734091 - DNA, 25 bp, Mus musculus
gttggatttcattcaggagcctgga

SEQ ID NO: 734092 - DNA, 25 bp, Mus musculus
gttggatttccacaccccagaaatg

SEQ ID NO: 734093 - DNA, 25 bp, Mus musculus
gttggatttccagaccccagaaatg

SEQ ID NO: 734094 - DNA, 25 bp, Mus musculus
gttggatttcggactcagaagtcaa

SEQ ID NO: 734095 - DNA, 25 bp, Mus musculus
gttggatttcggtctcagaagtcaa

SEQ ID NO: 734096 - DNA, 25 bp, Mus musculus
gttggatttgccacagctgctgtat

SEQ ID NO: 734097 - DNA, 25 bp, Mus musculus
gttggatttgcctcagctgctgtat

SEQ ID NO: 734098 - DNA, 25 bp, Mus musculus
gttggatttgtgaaccatcatcata

SEQ ID NO: 734099 - DNA, 25 bp, Mus musculus
gttggatttgtgtaccatcatcata

SEQ ID NO: 734100 - DNA, 25 bp, Mus musculus
gttggattttaactatgccatcaga

SEQ ID NO: 734101 - DNA, 25 bp, Mus musculus
gttggattttaagtatgccatcaga

SEQ ID NO: 734102 - DNA, 25 bp, Mus musculus
gttggattttgaagccctgtggcca

SEQ ID NO: 734103 - DNA, 25 bp, Mus musculus
gttggattttgatgccctgtggcca

SEQ ID NO: 734104 - DNA, 25 bp, Mus musculus
gttggcaaacgtaaccactgttatt

SEQ ID NO: 734105 - DNA, 25 bp, Mus musculus
gttggcaaacgttaccactgttatt

SEQ ID NO: 734106 - DNA, 25 bp, Mus musculus
gttggcaaagcccagttctgactta

SEQ ID NO: 734107 - DNA, 25 bp, Mus musculus
gttggcaaagccgagttctgactta

SEQ ID NO: 734108 - DNA, 25 bp, Mus musculus
gttggcaaatgtctaatctcatcta

SEQ ID NO: 734109 - DNA, 25 bp, Mus musculus
gttggcaaatgtgtaatctcatcta

SEQ ID NO: 734110 - DNA, 25 bp, Mus musculus
gttggcaaccaacatcagccttcgc

SEQ ID NO: 734111 - DNA, 25 bp, Mus musculus
gttggcaaccaagatcagccttcgc

SEQ ID NO: 734112 - DNA, 25 bp, Mus musculus
gttggcaaccgacctaagtgactac

SEQ ID NO: 734113 - DNA, 25 bp, Mus musculus
gttggcaaccgagctaagtgactac

SEQ ID NO: 734114 - DNA, 25 bp, Mus musculus
gttggcaagcctcgagggttctcca

SEQ ID NO: 734115 - DNA, 25 bp, Mus musculus
gttggcaagcctggagggttctcca

SEQ ID NO: 734116 - DNA, 25 bp, Mus musculus
gttggcaagcgcctggatcaccacg

SEQ ID NO: 734117 - DNA, 25 bp, Mus musculus
gttggcaagcgcgtggatcaccacg

SEQ ID NO: 734118 - DNA, 25 bp, Mus musculus
gttggcaagctccagtaagataaat

SEQ ID NO: 734119 - DNA, 25 bp, Mus musculus
gttggcaagctcgagtaagataaat

SEQ ID NO: 734120 - DNA, 25 bp, Mus musculus
gttggcaagctgcagctccatcaag

SEQ ID NO: 734121 - DNA, 25 bp, Mus musculus
gttggcaagctggagctccatcaag

SEQ ID NO: 734122 - DNA, 25 bp, Mus musculus
gttggcaaggaaacctggctgccca

SEQ ID NO: 734123 - DNA, 25 bp, Mus musculus
gttggcaaggaatcctggctgccca

SEQ ID NO: 734124 - DNA, 25 bp, Mus musculus
gttggcaaggatagaggcctctgtt

SEQ ID NO: 734125 - DNA, 25 bp, Mus musculus
gttggcaaggattgaggcctctgtt

SEQ ID NO: 734126 - DNA, 25 bp, Mus musculus
gttggcaagttcctgtattgtttgt

SEQ ID NO: 734127 - DNA, 25 bp, Mus musculus
gttggcaagttcgtgtattgtttgt

SEQ ID NO: 734128 - DNA, 25 bp, Mus musculus
gttggcaatattactaggatcagca

SEQ ID NO: 734129 - DNA, 25 bp, Mus musculus
gttggcaatatttctaggatcagca

SEQ ID NO: 734130 - DNA, 25 bp, Mus musculus
gttggcaatcagctaccttttgtag

SEQ ID NO: 734131 - DNA, 25 bp, Mus musculus
gttggcaatcaggtaccttttgtag

SEQ ID NO: 734132 - DNA, 25 bp, Mus musculus
gttggcaatcccctcttagtgaaca

SEQ ID NO: 734133 - DNA, 25 bp, Mus musculus
gttggcaatcccgtcttagtgaaca

SEQ ID NO: 734134 - DNA, 25 bp, Mus musculus
gttggcaatgccactgtaagcccac

SEQ ID NO: 734135 - DNA, 25 bp, Mus musculus
gttggcaatgcctctgtaagcccac

SEQ ID NO: 734136 - DNA, 25 bp, Mus musculus
gttggcaattccatgttctcattga

SEQ ID NO: 734137 - DNA, 25 bp, Mus musculus
gttggcaattccttgttctcattga

SEQ ID NO: 734138 - DNA, 25 bp, Mus musculus
gttggcacagtgatggcctgtgtca

SEQ ID NO: 734139 - DNA, 25 bp, Mus musculus
gttggcacagtgttggcctgtgtca

SEQ ID NO: 734140 - DNA, 25 bp, Mus musculus
gttggcacatcacaccttaaaagta

SEQ ID NO: 734141 - DNA, 25 bp, Mus musculus
gttggcacatcagaccttaaaagta

SEQ ID NO: 734142 - DNA, 25 bp, Mus musculus
gttggcacgacaccttcagggactg

SEQ ID NO: 734143 - DNA, 25 bp, Mus musculus
gttggcacgacagcttcagggactg

SEQ ID NO: 734144 - DNA, 25 bp, Mus musculus
gttggcacgttaaatcccagacaga

SEQ ID NO: 734145 - DNA, 25 bp, Mus musculus
gttggcacgttatatcccagacaga

SEQ ID NO: 734146 - DNA, 25 bp, Mus musculus
gttggcactcacacacttggaattc

SEQ ID NO: 734147 - DNA, 25 bp, Mus musculus
gttggcactcactcacttggaattc

SEQ ID NO: 734148 - DNA, 25 bp, Mus musculus
gttggcactgatattgggcaccttc

SEQ ID NO: 734149 - DNA, 25 bp, Mus musculus
gttggcactgattttgggcaccttc

SEQ ID NO: 734150 - DNA, 25 bp, Mus musculus
gttggcagagacacatcagcaggaa

SEQ ID NO: 734151 - DNA, 25 bp, Mus musculus
gttggcagagactcatcagcaggaa

SEQ ID NO: 734152 - DNA, 25 bp, Mus musculus
gttggcagagcactaagagactttt

SEQ ID NO: 734153 - DNA, 25 bp, Mus musculus
gttggcagagcagtaagagactttt

SEQ ID NO: 734154 - DNA, 25 bp, Mus musculus
gttggcagatatactgttgcttaaa

SEQ ID NO: 734155 - DNA, 25 bp, Mus musculus
gttggcagatattctgttgcttaaa

SEQ ID NO: 734156 - DNA, 25 bp, Mus musculus
gttggcagatgtatgggttgctcct

SEQ ID NO: 734157 - DNA, 25 bp, Mus musculus
gttggcagatgtttgggttgctcct

SEQ ID NO: 734158 - DNA, 25 bp, Mus musculus
gttggcagggttaaagcataaacta

SEQ ID NO: 734159 - DNA, 25 bp, Mus musculus
gttggcagggtttaagcataaacta

SEQ ID NO: 734160 - DNA, 25 bp, Mus musculus
gttggcagtaagaatctttcttttg

SEQ ID NO: 734161 - DNA, 25 bp, Mus musculus
gttggcagtaagtatctttcttttg

SEQ ID NO: 734162 - DNA, 25 bp, Mus musculus
gttggcagtcacattggagttcaca

SEQ ID NO: 734163 - DNA, 25 bp, Mus musculus
gttggcagtcactttggagttcaca

SEQ ID NO: 734164 - DNA, 25 bp, Mus musculus
gttggcagtttacgacctgctgtca

SEQ ID NO: 734165 - DNA, 25 bp, Mus musculus
gttggcagtttaggacctgctgtca

SEQ ID NO: 734166 - DNA, 25 bp, Mus musculus
gttggcatagttagctgctgtctgt

SEQ ID NO: 734167 - DNA, 25 bp, Mus musculus
gttggcatagtttgctgctgtctgt

SEQ ID NO: 734168 - DNA, 25 bp, Mus musculus
gttggcatcaacagtctattgaatc

SEQ ID NO: 734169 - DNA, 25 bp, Mus musculus
gttggcatcaactgtctattgaatc

SEQ ID NO: 734170 - DNA, 25 bp, Mus musculus
gttggcatctatcctagcatctttc

SEQ ID NO: 734171 - DNA, 25 bp, Mus musculus
gttggcatctatgctagcatctttc

SEQ ID NO: 734172 - DNA, 25 bp, Mus musculus
gttggcatcttgattctttaatatg

SEQ ID NO: 734173 - DNA, 25 bp, Mus musculus
gttggcatcttgtttctttaatatg

SEQ ID NO: 734174 - DNA, 25 bp, Mus musculus
gttggcatgaaacgctctgaacagc

SEQ ID NO: 734175 - DNA, 25 bp, Mus musculus
gttggcatgaaaggctctgaacagc

SEQ ID NO: 734176 - DNA, 25 bp, Mus musculus
gttggcatgggtattttctttttca

SEQ ID NO: 734177 - DNA, 25 bp, Mus musculus
gttggcatgggttttttctttttca

SEQ ID NO: 734178 - DNA, 25 bp, Mus musculus
gttggcatggtcacagggaatcact

SEQ ID NO: 734179 - DNA, 25 bp, Mus musculus
gttggcatggtctcagggaatcact

SEQ ID NO: 734180 - DNA, 25 bp, Mus musculus
gttggcattcccaccaataggtagc

SEQ ID NO: 734181 - DNA, 25 bp, Mus musculus
gttggcattccctccaataggtagc

SEQ ID NO: 734182 - DNA, 25 bp, Mus musculus
gttggcattgctaattcctatagat

SEQ ID NO: 734183 - DNA, 25 bp, Mus musculus
gttggcattgcttattcctatagat

SEQ ID NO: 734184 - DNA, 25 bp, Mus musculus
gttggcatttccatagccagaggca

SEQ ID NO: 734185 - DNA, 25 bp, Mus musculus
gttggcatttccttagccagaggca

SEQ ID NO: 734186 - DNA, 25 bp, Mus musculus
gttggccaaacaccacaactggaaa

SEQ ID NO: 734187 - DNA, 25 bp, Mus musculus
gttggccaaacagcacaactggaaa

SEQ ID NO: 734188 - DNA, 25 bp, Mus musculus
gttggccaacacaaaatgagcaaat

SEQ ID NO: 734189 - DNA, 25 bp, Mus musculus
gttggccaacactaaatgagcaaat

SEQ ID NO: 734190 - DNA, 25 bp, Mus musculus
gttggccaactgcaacttcagttct

SEQ ID NO: 734191 - DNA, 25 bp, Mus musculus
gttggccaactggaacttcagttct

SEQ ID NO: 734192 - DNA, 25 bp, Mus musculus
gttggccaagtgaacttcactatta

SEQ ID NO: 734193 - DNA, 25 bp, Mus musculus
gttggccaagtgtacttcactatta

SEQ ID NO: 734194 - DNA, 25 bp, Mus musculus
gttggccaatacagcctgagtccag

SEQ ID NO: 734195 - DNA, 25 bp, Mus musculus
gttggccaatactgcctgagtccag

SEQ ID NO: 734196 - DNA, 25 bp, Mus musculus
gttggccaatagctacggtagccca

SEQ ID NO: 734197 - DNA, 25 bp, Mus musculus
gttggccaataggtacggtagccca

SEQ ID NO: 734198 - DNA, 25 bp, Mus musculus
gttggccactgtaaccagggtctac

SEQ ID NO: 734199 - DNA, 25 bp, Mus musculus
gttggccactgttaccagggtctac

SEQ ID NO: 734200 - DNA, 25 bp, Mus musculus
gttggccactttatgtccacagaaa

SEQ ID NO: 734201 - DNA, 25 bp, Mus musculus
gttggccactttttgtccacagaaa

SEQ ID NO: 734202 - DNA, 25 bp, Mus musculus
gttggccagaagagcatcatatcag

SEQ ID NO: 734203 - DNA, 25 bp, Mus musculus
gttggccagaagtgcatcatatcag

SEQ ID NO: 734204 - DNA, 25 bp, Mus musculus
gttggccagagacagcagagtcaaa

SEQ ID NO: 734205 - DNA, 25 bp, Mus musculus
gttggccagagagagcagagtcaaa

SEQ ID NO: 734206 - DNA, 25 bp, Mus musculus
gttggccagatcagctgccgagagc

SEQ ID NO: 734207 - DNA, 25 bp, Mus musculus
gttggccagatctgctgccgagagc

SEQ ID NO: 734208 - DNA, 25 bp, Mus musculus
gttggccagattcatcttttctatg

SEQ ID NO: 734209 - DNA, 25 bp, Mus musculus
gttggccagattgatcttttctatg

SEQ ID NO: 734210 - DNA, 25 bp, Mus musculus
gttggccagcaaacagagacagctt

SEQ ID NO: 734211 - DNA, 25 bp, Mus musculus
gttggccagcaatcagagacagctt

SEQ ID NO: 734212 - DNA, 25 bp, Mus musculus
gttggccaggcaagtacttggtaca

SEQ ID NO: 734213 - DNA, 25 bp, Mus musculus
gttggccaggcatgtacttggtaca

SEQ ID NO: 734214 - DNA, 25 bp, Mus musculus
gttggccaggcgagttaagtatgtt

SEQ ID NO: 734215 - DNA, 25 bp, Mus musculus
gttggccaggcgtgttaagtatgtt

SEQ ID NO: 734216 - DNA, 25 bp, Mus musculus
gttggccagtggcactgacagacaa

SEQ ID NO: 734217 - DNA, 25 bp, Mus musculus
gttggccagtgggactgacagacaa

SEQ ID NO: 734218 - DNA, 25 bp, Mus musculus
gttggccatccacggtaaaccaaat

SEQ ID NO: 734219 - DNA, 25 bp, Mus musculus
gttggccatccagggtaaaccaaat

SEQ ID NO: 734220 - DNA, 25 bp, Mus musculus
gttggccattccactgtgcgtggag

SEQ ID NO: 734221 - DNA, 25 bp, Mus musculus
gttggccattcctctgtgcgtggag

SEQ ID NO: 734222 - DNA, 25 bp, Mus musculus
gttggccatttgctagttctgctgc

SEQ ID NO: 734223 - DNA, 25 bp, Mus musculus
gttggccatttggtagttctgctgc

SEQ ID NO: 734224 - DNA, 25 bp, Mus musculus
gttggcccacaaatgcttgaggaga

SEQ ID NO: 734225 - DNA, 25 bp, Mus musculus
gttggcccacaattgcttgaggaga

SEQ ID NO: 734226 - DNA, 25 bp, Mus musculus
gttggcccacatcaagcaaaaacat

SEQ ID NO: 734227 - DNA, 25 bp, Mus musculus
gttggcccacatgaagcaaaaacat

SEQ ID NO: 734228 - DNA, 25 bp, Mus musculus
gttggcccactcactgtatgattaa

SEQ ID NO: 734229 - DNA, 25 bp, Mus musculus
gttggcccactctctgtatgattaa

SEQ ID NO: 734230 - DNA, 25 bp, Mus musculus
gttggcccaggacgcaccggatcca

SEQ ID NO: 734231 - DNA, 25 bp, Mus musculus
gttggcccaggaggcaccggatcca

SEQ ID NO: 734232 - DNA, 25 bp, Mus musculus
gttggcccagttaaacctaacatct

SEQ ID NO: 734233 - DNA, 25 bp, Mus musculus
gttggcccagtttaacctaacatct

SEQ ID NO: 734234 - DNA, 25 bp, Mus musculus
gttggcccatctagctgaatgttat

SEQ ID NO: 734235 - DNA, 25 bp, Mus musculus
gttggcccatcttgctgaatgttat

SEQ ID NO: 734236 - DNA, 25 bp, Mus musculus
gttggcccattcattattgaagcat

SEQ ID NO: 734237 - DNA, 25 bp, Mus musculus
gttggcccattctttattgaagcat

SEQ ID NO: 734238 - DNA, 25 bp, Mus musculus
gttggccctcagagtgacggagaca

SEQ ID NO: 734239 - DNA, 25 bp, Mus musculus
gttggccctcagtgtgacggagaca

SEQ ID NO: 734240 - DNA, 25 bp, Mus musculus
gttggccctggcaataattttctgg

SEQ ID NO: 734241 - DNA, 25 bp, Mus musculus
gttggccctggctataattttctgg

SEQ ID NO: 734242 - DNA, 25 bp, Mus musculus
gttggccctgtgaaaacctcattag

SEQ ID NO: 734243 - DNA, 25 bp, Mus musculus
gttggccctgtgtaaacctcattag

SEQ ID NO: 734244 - DNA, 25 bp, Mus musculus
gttggccgagaaccagcatgatatt

SEQ ID NO: 734245 - DNA, 25 bp, Mus musculus
gttggccgagaagcagcatgatatt

SEQ ID NO: 734246 - DNA, 25 bp, Mus musculus
gttggccgctacaaagactggaact

SEQ ID NO: 734247 - DNA, 25 bp, Mus musculus
gttggccgctactaagactggaact

SEQ ID NO: 734248 - DNA, 25 bp, Mus musculus
gttggccgctctctggatgagatta

SEQ ID NO: 734249 - DNA, 25 bp, Mus musculus
gttggccgctctgtggatgagatta

SEQ ID NO: 734250 - DNA, 25 bp, Mus musculus
gttggccggaccaaaagagcactag

SEQ ID NO: 734251 - DNA, 25 bp, Mus musculus
gttggccggacctaaagagcactag

SEQ ID NO: 734252 - DNA, 25 bp, Mus musculus
gttggccgtcacacgaatttttgaa

SEQ ID NO: 734253 - DNA, 25 bp, Mus musculus
gttggccgtcactcgaatttttgaa

SEQ ID NO: 734254 - DNA, 25 bp, Mus musculus
gttggcctactgactgtcaggacaa

SEQ ID NO: 734255 - DNA, 25 bp, Mus musculus
gttggcctactgtctgtcaggacaa

SEQ ID NO: 734256 - DNA, 25 bp, Mus musculus
gttggcctatacagacacattaccc

SEQ ID NO: 734257 - DNA, 25 bp, Mus musculus
gttggcctatactgacacattaccc

SEQ ID NO: 734258 - DNA, 25 bp, Mus musculus
gttggcctatgcaggattgaactaa

SEQ ID NO: 734259 - DNA, 25 bp, Mus musculus
gttggcctatgctggattgaactaa

SEQ ID NO: 734260 - DNA, 25 bp, Mus musculus
gttggcctcaatatgatagagatct

SEQ ID NO: 734261 - DNA, 25 bp, Mus musculus
gttggcctcaatttgatagagatct

SEQ ID NO: 734262 - DNA, 25 bp, Mus musculus
gttggcctccaacagttcccttggg

SEQ ID NO: 734263 - DNA, 25 bp, Mus musculus
gttggcctccaagagttcccttggg

SEQ ID NO: 734264 - DNA, 25 bp, Mus musculus
gttggcctgcaacaagtcctgatac

SEQ ID NO: 734265 - DNA, 25 bp, Mus musculus
gttggcctgcaacacacttttattg

SEQ ID NO: 734266 - DNA, 25 bp, Mus musculus
gttggcctgcaagaagtcctgatac

SEQ ID NO: 734267 - DNA, 25 bp, Mus musculus
gttggcctgcaagacacttttattg

SEQ ID NO: 734268 - DNA, 25 bp, Mus musculus
gttggcctgcccaaagtggtataat

SEQ ID NO: 734269 - DNA, 25 bp, Mus musculus
gttggcctgccctaagtggtataat

SEQ ID NO: 734270 - DNA, 25 bp, Mus musculus
gttggcctggatccagactgtattt

SEQ ID NO: 734271 - DNA, 25 bp, Mus musculus
gttggcctggatgcagactgtattt

SEQ ID NO: 734272 - DNA, 25 bp, Mus musculus
gttggcctggttaaagcgctcaaac

SEQ ID NO: 734273 - DNA, 25 bp, Mus musculus
gttggcctggtttaagcgctcaaac

SEQ ID NO: 734274 - DNA, 25 bp, Mus musculus
gttggccttacccatgctgaggcag

SEQ ID NO: 734275 - DNA, 25 bp, Mus musculus
gttggccttaccgatgctgaggcag

SEQ ID NO: 734276 - DNA, 25 bp, Mus musculus
gttggccttagtacttttgcatttg

SEQ ID NO: 734277 - DNA, 25 bp, Mus musculus
gttggccttagtctagcaagctcca

SEQ ID NO: 734278 - DNA, 25 bp, Mus musculus
gttggccttagtgtagcaagctcca

SEQ ID NO: 734279 - DNA, 25 bp, Mus musculus
gttggccttagttcttttgcatttg

SEQ ID NO: 734280 - DNA, 25 bp, Mus musculus
gttggccttcatcgacttgagacaa

SEQ ID NO: 734281 - DNA, 25 bp, Mus musculus
gttggccttcatggacttgagacaa

SEQ ID NO: 734282 - DNA, 25 bp, Mus musculus
gttggccttccaagagatcggtgtg

SEQ ID NO: 734283 - DNA, 25 bp, Mus musculus
gttggccttccatgagatcggtgtg

SEQ ID NO: 734284 - DNA, 25 bp, Mus musculus
gttggccttggcaatttacactgga

SEQ ID NO: 734285 - DNA, 25 bp, Mus musculus
gttggccttggctatttacactgga

SEQ ID NO: 734286 - DNA, 25 bp, Mus musculus
gttggccttggtattgagatctttt

SEQ ID NO: 734287 - DNA, 25 bp, Mus musculus
gttggccttggttttgagatctttt

SEQ ID NO: 734288 - DNA, 25 bp, Mus musculus
gttggccttttcaaccatctgtctt

SEQ ID NO: 734289 - DNA, 25 bp, Mus musculus
gttggccttttctaccatctgtctt

SEQ ID NO: 734290 - DNA, 25 bp, Mus musculus
gttggccttttgaatcagcagagat

SEQ ID NO: 734291 - DNA, 25 bp, Mus musculus
gttggccttttgtatcagcagagat

SEQ ID NO: 734292 - DNA, 25 bp, Mus musculus
gttggcgaagatccatcagatgaga

SEQ ID NO: 734293 - DNA, 25 bp, Mus musculus
gttggcgaagatgcatcagatgaga

SEQ ID NO: 734294 - DNA, 25 bp, Mus musculus
gttggcgattacaaacaggagctgt

SEQ ID NO: 734295 - DNA, 25 bp, Mus musculus
gttggcgattactaacaggagctgt

SEQ ID NO: 734296 - DNA, 25 bp, Mus musculus
gttggcggcaagaaaactaacaagc

SEQ ID NO: 734297 - DNA, 25 bp, Mus musculus
gttggcggcaagtaaactaacaagc

SEQ ID NO: 734298 - DNA, 25 bp, Mus musculus
gttggcggtaccaggtgactgtcac

SEQ ID NO: 734299 - DNA, 25 bp, Mus musculus
gttggcggtacctggtgactgtcac

SEQ ID NO: 734300 - DNA, 25 bp, Mus musculus
gttggcggtcacaatggcaacgcgt

SEQ ID NO: 734301 - DNA, 25 bp, Mus musculus
gttggcggtcactatggcaacgcgt

SEQ ID NO: 734302 - DNA, 25 bp, Mus musculus
gttggcggtggcactactaataatt

SEQ ID NO: 734303 - DNA, 25 bp, Mus musculus
gttggcggtggctctactaataatt

SEQ ID NO: 734304 - DNA, 25 bp, Mus musculus
gttggcgtattaagaaatcccttgt

SEQ ID NO: 734305 - DNA, 25 bp, Mus musculus
gttggcgtattatgaaatcccttgt

SEQ ID NO: 734306 - DNA, 25 bp, Mus musculus
gttggcgtgaccaaagagtcgctga

SEQ ID NO: 734307 - DNA, 25 bp, Mus musculus
gttggcgtgacctaagagtcgctga

SEQ ID NO: 734308 - DNA, 25 bp, Mus musculus
gttggcgttcttagcttttttgaca

SEQ ID NO: 734309 - DNA, 25 bp, Mus musculus
gttggcgttctttgcttttttgaca

SEQ ID NO: 734310 - DNA, 25 bp, Mus musculus
gttggctaaatcagagctgttcatt

SEQ ID NO: 734311 - DNA, 25 bp, Mus musculus
gttggctaaatctgagctgttcatt

SEQ ID NO: 734312 - DNA, 25 bp, Mus musculus
gttggctaaatgatagacatttgaa

SEQ ID NO: 734313 - DNA, 25 bp, Mus musculus
gttggctaaatgttagacatttgaa

SEQ ID NO: 734314 - DNA, 25 bp, Mus musculus
gttggctacgaacctggcagctcag

SEQ ID NO: 734315 - DNA, 25 bp, Mus musculus
gttggctacgaagctggcagctcag

SEQ ID NO: 734316 - DNA, 25 bp, Mus musculus
gttggctagcatatctggtccccat

SEQ ID NO: 734317 - DNA, 25 bp, Mus musculus
gttggctagcatttctggtccccat

SEQ ID NO: 734318 - DNA, 25 bp, Mus musculus
gttggctaggttacagctaacagac

SEQ ID NO: 734319 - DNA, 25 bp, Mus musculus
gttggctaggtttcagctaacagac

SEQ ID NO: 734320 - DNA, 25 bp, Mus musculus
gttggctatgatcatgttacttctg

SEQ ID NO: 734321 - DNA, 25 bp, Mus musculus
gttggctatgatgatgttacttctg

SEQ ID NO: 734322 - DNA, 25 bp, Mus musculus
gttggctatgtcatggtgaaattcc

SEQ ID NO: 734323 - DNA, 25 bp, Mus musculus
gttggctatgtcttggtgaaattcc

SEQ ID NO: 734324 - DNA, 25 bp, Mus musculus
gttggctatgtgcttttgtgttcca

SEQ ID NO: 734325 - DNA, 25 bp, Mus musculus
gttggctatgtggttttgtgttcca

SEQ ID NO: 734326 - DNA, 25 bp, Mus musculus
gttggctcaagcctgcatgtcactc

SEQ ID NO: 734327 - DNA, 25 bp, Mus musculus
gttggctcaagcgtgcatgtcactc

SEQ ID NO: 734328 - DNA, 25 bp, Mus musculus
gttggctcacatccacagtattgga

SEQ ID NO: 734329 - DNA, 25 bp, Mus musculus
gttggctcacatgcacagtattgga

SEQ ID NO: 734330 - DNA, 25 bp, Mus musculus
gttggctcacttaactgacttatgt

SEQ ID NO: 734331 - DNA, 25 bp, Mus musculus
gttggctcactttactgacttatgt

SEQ ID NO: 734332 - DNA, 25 bp, Mus musculus
gttggctcagagctttatctatgga

SEQ ID NO: 734333 - DNA, 25 bp, Mus musculus
gttggctcagaggtttatctatgga

SEQ ID NO: 734334 - DNA, 25 bp, Mus musculus
gttggctcagtgatgaacactcgtt

SEQ ID NO: 734335 - DNA, 25 bp, Mus musculus
gttggctcagtgcagttgctaagca

SEQ ID NO: 734336 - DNA, 25 bp, Mus musculus
gttggctcagtggagttgctaagca

SEQ ID NO: 734337 - DNA, 25 bp, Mus musculus
gttggctcagtgttgaacactcgtt

SEQ ID NO: 734338 - DNA, 25 bp, Mus musculus
gttggctcatcgaaaggcgtggcac

SEQ ID NO: 734339 - DNA, 25 bp, Mus musculus
gttggctcatcgtaaggcgtggcac

SEQ ID NO: 734340 - DNA, 25 bp, Mus musculus
gttggctccattctgcctttttaag

SEQ ID NO: 734341 - DNA, 25 bp, Mus musculus
gttggctccattgtgcctttttaag

SEQ ID NO: 734342 - DNA, 25 bp, Mus musculus
gttggctcccaacatgtgattattt

SEQ ID NO: 734343 - DNA, 25 bp, Mus musculus
gttggctcccaaccattaaggaatc

SEQ ID NO: 734344 - DNA, 25 bp, Mus musculus
gttggctcccaagatgtgattattt

SEQ ID NO: 734345 - DNA, 25 bp, Mus musculus
gttggctcccaagcattaaggaatc

SEQ ID NO: 734346 - DNA, 25 bp, Mus musculus
gttggctccctcatgatgtttacat

SEQ ID NO: 734347 - DNA, 25 bp, Mus musculus
gttggctccctcttgatgtttacat

SEQ ID NO: 734348 - DNA, 25 bp, Mus musculus
gttggctcctaacctgtagcttttt

SEQ ID NO: 734349 - DNA, 25 bp, Mus musculus
gttggctcctaagctgtagcttttt

SEQ ID NO: 734350 - DNA, 25 bp, Mus musculus
gttggctcctttcatacctttatca

SEQ ID NO: 734351 - DNA, 25 bp, Mus musculus
gttggctcctttgatacctttatca

SEQ ID NO: 734352 - DNA, 25 bp, Mus musculus
gttggctcgaatcatggagacttat

SEQ ID NO: 734353 - DNA, 25 bp, Mus musculus
gttggctcgaatgatggagacttat

SEQ ID NO: 734354 - DNA, 25 bp, Mus musculus
gttggctctaataccagaaacctca

SEQ ID NO: 734355 - DNA, 25 bp, Mus musculus
gttggctctaattccagaaacctca

SEQ ID NO: 734356 - DNA, 25 bp, Mus musculus
gttggctctccccaagagaaagcag

SEQ ID NO: 734357 - DNA, 25 bp, Mus musculus
gttggctctcccgaagagaaagcag

SEQ ID NO: 734358 - DNA, 25 bp, Mus musculus
gttggctctgaaatagtgtcactgc

SEQ ID NO: 734359 - DNA, 25 bp, Mus musculus
gttggctctgaattagtgtcactgc

SEQ ID NO: 734360 - DNA, 25 bp, Mus musculus
gttggctctgttctttctatggagt

SEQ ID NO: 734361 - DNA, 25 bp, Mus musculus
gttggctctgttgtttctatggagt

SEQ ID NO: 734362 - DNA, 25 bp, Mus musculus
gttggctcttcactattttcattta

SEQ ID NO: 734363 - DNA, 25 bp, Mus musculus
gttggctcttcagtattttcattta

SEQ ID NO: 734364 - DNA, 25 bp, Mus musculus
gttggctcttggatctagaggagct

SEQ ID NO: 734365 - DNA, 25 bp, Mus musculus
gttggctcttggttctagaggagct

SEQ ID NO: 734366 - DNA, 25 bp, Mus musculus
gttggctcttgtcattgtccttatc

SEQ ID NO: 734367 - DNA, 25 bp, Mus musculus
gttggctcttgtgattgtccttatc

SEQ ID NO: 734368 - DNA, 25 bp, Mus musculus
gttggctgaaacaacaaattacggc

SEQ ID NO: 734369 - DNA, 25 bp, Mus musculus
gttggctgaaactacaaattacggc

SEQ ID NO: 734370 - DNA, 25 bp, Mus musculus
gttggctgacctagatgtctgacca

SEQ ID NO: 734371 - DNA, 25 bp, Mus musculus
gttggctgaccttgatgtctgacca

SEQ ID NO: 734372 - DNA, 25 bp, Mus musculus
gttggctgagcaagcacaaatccct

SEQ ID NO: 734373 - DNA, 25 bp, Mus musculus
gttggctgagcatgcacaaatccct

SEQ ID NO: 734374 - DNA, 25 bp, Mus musculus
gttggctgcaaactgagtcatctct

SEQ ID NO: 734375 - DNA, 25 bp, Mus musculus
gttggctgcaaagtgagtcatctct

SEQ ID NO: 734376 - DNA, 25 bp, Mus musculus
gttggctgcatgatctttgaagggc

SEQ ID NO: 734377 - DNA, 25 bp, Mus musculus
gttggctgcatgttctttgaagggc

SEQ ID NO: 734378 - DNA, 25 bp, Mus musculus
gttggctgccaaatttgttttattt

SEQ ID NO: 734379 - DNA, 25 bp, Mus musculus
gttggctgccaattttgttttattt

SEQ ID NO: 734380 - DNA, 25 bp, Mus musculus
gttggctgcttaacagactctctag

SEQ ID NO: 734381 - DNA, 25 bp, Mus musculus
gttggctgcttatcagactctctag

SEQ ID NO: 734382 - DNA, 25 bp, Mus musculus
gttggctggctcaaagcaggcacta

SEQ ID NO: 734383 - DNA, 25 bp, Mus musculus
gttggctggctctaagcaggcacta

SEQ ID NO: 734384 - DNA, 25 bp, Mus musculus
gttggctgtgctcaaatactataag

SEQ ID NO: 734385 - DNA, 25 bp, Mus musculus
gttggctgtgctgaaatactataag

SEQ ID NO: 734386 - DNA, 25 bp, Mus musculus
gttggctgttgcagctacttgtcaa

SEQ ID NO: 734387 - DNA, 25 bp, Mus musculus
gttggctgttgctgctacttgtcaa

SEQ ID NO: 734388 - DNA, 25 bp, Mus musculus
gttggcttacaacaattgttttcag

SEQ ID NO: 734389 - DNA, 25 bp, Mus musculus
gttggcttacaagaattgttttcag

SEQ ID NO: 734390 - DNA, 25 bp, Mus musculus
gttggcttacatctggttgtcccac

SEQ ID NO: 734391 - DNA, 25 bp, Mus musculus
gttggcttacatgtggttgtcccac

SEQ ID NO: 734392 - DNA, 25 bp, Mus musculus
gttggcttactgcttgcaggaccct

SEQ ID NO: 734393 - DNA, 25 bp, Mus musculus
gttggcttactggttgcaggaccct

SEQ ID NO: 734394 - DNA, 25 bp, Mus musculus
gttggcttagaaacccatctgttta

SEQ ID NO: 734395 - DNA, 25 bp, Mus musculus
gttggcttagaatcccatctgttta

SEQ ID NO: 734396 - DNA, 25 bp, Mus musculus
gttggcttataaccgctggtaccag

SEQ ID NO: 734397 - DNA, 25 bp, Mus musculus
gttggcttataagcgctggtaccag

SEQ ID NO: 734398 - DNA, 25 bp, Mus musculus
gttggcttatcccaggagcctactt

SEQ ID NO: 734399 - DNA, 25 bp, Mus musculus
gttggcttatccgaggagcctactt

SEQ ID NO: 734400 - DNA, 25 bp, Mus musculus
gttggcttcacactaataaccgtgc

SEQ ID NO: 734401 - DNA, 25 bp, Mus musculus
gttggcttcacagtaataaccgtgc

SEQ ID NO: 734402 - DNA, 25 bp, Mus musculus
gttggcttcaccaattcattctttg

SEQ ID NO: 734403 - DNA, 25 bp, Mus musculus
gttggcttcacctattcattctttg

SEQ ID NO: 734404 - DNA, 25 bp, Mus musculus
gttggcttcatgcttccagcaggat

SEQ ID NO: 734405 - DNA, 25 bp, Mus musculus
gttggcttcatggttccagcaggat

SEQ ID NO: 734406 - DNA, 25 bp, Mus musculus
gttggcttccatacactcagtgaga

SEQ ID NO: 734407 - DNA, 25 bp, Mus musculus
gttggcttccattcactcagtgaga

SEQ ID NO: 734408 - DNA, 25 bp, Mus musculus
gttggcttccgacctatttttctag

SEQ ID NO: 734409 - DNA, 25 bp, Mus musculus
gttggcttccgagctatttttctag

SEQ ID NO: 734410 - DNA, 25 bp, Mus musculus
gttggcttccttccagtacagtaaa

SEQ ID NO: 734411 - DNA, 25 bp, Mus musculus
gttggcttccttgcagtacagtaaa

SEQ ID NO: 734412 - DNA, 25 bp, Mus musculus
gttggcttcgcaactgtatctccca

SEQ ID NO: 734413 - DNA, 25 bp, Mus musculus
gttggcttcgcatctgtatctccca

SEQ ID NO: 734414 - DNA, 25 bp, Mus musculus
gttggcttcggtacagttcttattc

SEQ ID NO: 734415 - DNA, 25 bp, Mus musculus
gttggcttcggttcagttcttattc

SEQ ID NO: 734416 - DNA, 25 bp, Mus musculus
gttggcttctaactatagtacaaat

SEQ ID NO: 734417 - DNA, 25 bp, Mus musculus
gttggcttctaagtatagtacaaat

SEQ ID NO: 734418 - DNA, 25 bp, Mus musculus
gttggcttctttctcagatgcggga

SEQ ID NO: 734419 - DNA, 25 bp, Mus musculus
gttggcttctttgtcagatgcggga

SEQ ID NO: 734420 - DNA, 25 bp, Mus musculus
gttggcttgctgaatgacactctgt

SEQ ID NO: 734421 - DNA, 25 bp, Mus musculus
gttggcttgctgtatgacactctgt

SEQ ID NO: 734422 - DNA, 25 bp, Mus musculus
gttggcttggagctctcatcagaga

SEQ ID NO: 734423 - DNA, 25 bp, Mus musculus
gttggcttggaggtctcatcagaga

SEQ ID NO: 734424 - DNA, 25 bp, Mus musculus
gttggcttggttctggcagcttaca

SEQ ID NO: 734425 - DNA, 25 bp, Mus musculus
gttggcttggttgtggcagcttaca

SEQ ID NO: 734426 - DNA, 25 bp, Mus musculus
gttggctttaagagtcaaatgccta

SEQ ID NO: 734427 - DNA, 25 bp, Mus musculus
gttggctttaagtgtcaaatgccta

SEQ ID NO: 734428 - DNA, 25 bp, Mus musculus
gttggctttcagacagccacagtta

SEQ ID NO: 734429 - DNA, 25 bp, Mus musculus
gttggctttcagtcagccacagtta

SEQ ID NO: 734430 - DNA, 25 bp, Mus musculus
gttggctttctcagggactccgaca

SEQ ID NO: 734431 - DNA, 25 bp, Mus musculus
gttggctttctctgggactccgaca

SEQ ID NO: 734432 - DNA, 25 bp, Mus musculus
gttggctttcttcaataacctagga

SEQ ID NO: 734433 - DNA, 25 bp, Mus musculus
gttggctttcttgaataacctagga

SEQ ID NO: 734434 - DNA, 25 bp, Mus musculus
gttggctttggaatttgcccacaaa

SEQ ID NO: 734435 - DNA, 25 bp, Mus musculus
gttggctttggattttgcccacaaa

SEQ ID NO: 734436 - DNA, 25 bp, Mus musculus
gttggctttgttagaacgcagtcat

SEQ ID NO: 734437 - DNA, 25 bp, Mus musculus
gttggctttgtttgaacgcagtcat

SEQ ID NO: 734438 - DNA, 25 bp, Mus musculus
gttggcttttctaaaattgatctga

SEQ ID NO: 734439 - DNA, 25 bp, Mus musculus
gttggcttttctaatgcttgatgag

SEQ ID NO: 734440 - DNA, 25 bp, Mus musculus
gttggcttttcttaaattgatctga

SEQ ID NO: 734441 - DNA, 25 bp, Mus musculus
gttggcttttcttatgcttgatgag

SEQ ID NO: 734442 - DNA, 25 bp, Mus musculus
gttggcttttgtcatgccagagctc

SEQ ID NO: 734443 - DNA, 25 bp, Mus musculus
gttggcttttgtgatgccagagctc

SEQ ID NO: 734444 - DNA, 25 bp, Mus musculus
gttggctttttaaatccattggcat

SEQ ID NO: 734445 - DNA, 25 bp, Mus musculus
gttggctttttatatccattggcat

SEQ ID NO: 734446 - DNA, 25 bp, Mus musculus
gttgggaaaattccttttctgacat

SEQ ID NO: 734447 - DNA, 25 bp, Mus musculus
gttgggaaaattgcttttctgacat

SEQ ID NO: 734448 - DNA, 25 bp, Mus musculus
gttgggaaaccaaatcttaagaaag

SEQ ID NO: 734449 - DNA, 25 bp, Mus musculus
gttgggaaaccatatcttaagaaag

SEQ ID NO: 734450 - DNA, 25 bp, Mus musculus
gttgggaaacctcagccttatagag

SEQ ID NO: 734451 - DNA, 25 bp, Mus musculus
gttgggaaacctgagccttatagag

SEQ ID NO: 734452 - DNA, 25 bp, Mus musculus
gttgggaaagtacttgctaatatat

SEQ ID NO: 734453 - DNA, 25 bp, Mus musculus
gttgggaaagtagttgctaatatat

SEQ ID NO: 734454 - DNA, 25 bp, Mus musculus
gttgggaacagtcgtagcccctcct

SEQ ID NO: 734455 - DNA, 25 bp, Mus musculus
gttgggaacagtggtagcccctcct

SEQ ID NO: 734456 - DNA, 25 bp, Mus musculus
gttgggaacccactactcacagaaa

SEQ ID NO: 734457 - DNA, 25 bp, Mus musculus
gttgggaacccagtactcacagaaa

SEQ ID NO: 734458 - DNA, 25 bp, Mus musculus
gttgggaaccccagcattagggtct

SEQ ID NO: 734459 - DNA, 25 bp, Mus musculus
gttgggaacccctgcattagggtct

SEQ ID NO: 734460 - DNA, 25 bp, Mus musculus
gttgggaacttcacttgatctgcct

SEQ ID NO: 734461 - DNA, 25 bp, Mus musculus
gttgggaacttccagatatgtactc

SEQ ID NO: 734462 - DNA, 25 bp, Mus musculus
gttgggaacttcgagatatgtactc

SEQ ID NO: 734463 - DNA, 25 bp, Mus musculus
gttgggaacttctcttgatctgcct

SEQ ID NO: 734464 - DNA, 25 bp, Mus musculus
gttgggaagactctagacgtacgat

SEQ ID NO: 734465 - DNA, 25 bp, Mus musculus
gttgggaagactgtagacgtacgat

SEQ ID NO: 734466 - DNA, 25 bp, Mus musculus
gttgggaaggttaccatctgacctg

SEQ ID NO: 734467 - DNA, 25 bp, Mus musculus
gttgggaaggtttccatctgacctg

SEQ ID NO: 734468 - DNA, 25 bp, Mus musculus
gttgggaagttaaactggcattctt

SEQ ID NO: 734469 - DNA, 25 bp, Mus musculus
gttgggaagttatactggcattctt

SEQ ID NO: 734470 - DNA, 25 bp, Mus musculus
gttgggaatacacggcctcttgcct

SEQ ID NO: 734471 - DNA, 25 bp, Mus musculus
gttgggaatacagggcctcttgcct

SEQ ID NO: 734472 - DNA, 25 bp, Mus musculus
gttgggaatcacaccatttatttaa

SEQ ID NO: 734473 - DNA, 25 bp, Mus musculus
gttgggaatcactccatttatttaa

SEQ ID NO: 734474 - DNA, 25 bp, Mus musculus
gttgggaatcgcatgcaatgagacc

SEQ ID NO: 734475 - DNA, 25 bp, Mus musculus
gttgggaatcgcttgcaatgagacc

SEQ ID NO: 734476 - DNA, 25 bp, Mus musculus
gttgggaatttcatagctggccaca

SEQ ID NO: 734477 - DNA, 25 bp, Mus musculus
gttgggaatttcttagctggccaca

SEQ ID NO: 734478 - DNA, 25 bp, Mus musculus
gttgggacaagccaccccagcggct

SEQ ID NO: 734479 - DNA, 25 bp, Mus musculus
gttgggacaagcgaccccagcggct

SEQ ID NO: 734480 - DNA, 25 bp, Mus musculus
gttgggacacagacggtcagcagcc

SEQ ID NO: 734481 - DNA, 25 bp, Mus musculus
gttgggacacagtcggtcagcagcc

SEQ ID NO: 734482 - DNA, 25 bp, Mus musculus
gttgggacacgtagggttctatgtt

SEQ ID NO: 734483 - DNA, 25 bp, Mus musculus
gttgggacacgttgggttctatgtt

SEQ ID NO: 734484 - DNA, 25 bp, Mus musculus
gttgggacagtaacttaactcaagg

SEQ ID NO: 734485 - DNA, 25 bp, Mus musculus
gttgggacagtatcttaactcaagg

SEQ ID NO: 734486 - DNA, 25 bp, Mus musculus
gttgggacagttagcctcaatggaa

SEQ ID NO: 734487 - DNA, 25 bp, Mus musculus
gttgggacagtttgcctcaatggaa

SEQ ID NO: 734488 - DNA, 25 bp, Mus musculus
gttgggacatagacagaatcctaca

SEQ ID NO: 734489 - DNA, 25 bp, Mus musculus
gttgggacatagtcagaatcctaca

SEQ ID NO: 734490 - DNA, 25 bp, Mus musculus
gttgggacatcaatgctggtgctaa

SEQ ID NO: 734491 - DNA, 25 bp, Mus musculus
gttgggacatcattgctggtgctaa

SEQ ID NO: 734492 - DNA, 25 bp, Mus musculus
gttgggacccaaattgatctcagag

SEQ ID NO: 734493 - DNA, 25 bp, Mus musculus
gttgggacccaatttgatctcagag

SEQ ID NO: 734494 - DNA, 25 bp, Mus musculus
gttgggaccctgaagattctggagt

SEQ ID NO: 734495 - DNA, 25 bp, Mus musculus
gttgggaccctgtagattctggagt

SEQ ID NO: 734496 - DNA, 25 bp, Mus musculus
gttgggactccaaaacttctggtgc

SEQ ID NO: 734497 - DNA, 25 bp, Mus musculus
gttgggactccataacttctggtgc

SEQ ID NO: 734498 - DNA, 25 bp, Mus musculus
gttgggactcctaggagagccgtct

SEQ ID NO: 734499 - DNA, 25 bp, Mus musculus
gttgggactccttggagagccgtct

SEQ ID NO: 734500 - DNA, 25 bp, Mus musculus
gttgggactcttcaccaggtgaaga

SEQ ID NO: 734501 - DNA, 25 bp, Mus musculus
gttgggactcttgaccaggtgaaga

SEQ ID NO: 734502 - DNA, 25 bp, Mus musculus
gttgggactgtgaccacccacgata

SEQ ID NO: 734503 - DNA, 25 bp, Mus musculus
gttgggactgtgtccacccacgata

SEQ ID NO: 734504 - DNA, 25 bp, Mus musculus
gttgggacttctacagactggttgc

SEQ ID NO: 734505 - DNA, 25 bp, Mus musculus
gttgggacttcttcagactggttgc

SEQ ID NO: 734506 - DNA, 25 bp, Mus musculus
gttgggagagtgagtaaaacaaagt

SEQ ID NO: 734507 - DNA, 25 bp, Mus musculus
gttgggagagtgattatgcagtttt

SEQ ID NO: 734508 - DNA, 25 bp, Mus musculus
gttgggagagtgtgtaaaacaaagt

SEQ ID NO: 734509 - DNA, 25 bp, Mus musculus
gttgggagagtgtttatgcagtttt

SEQ ID NO: 734510 - DNA, 25 bp, Mus musculus
gttgggagcaaaatcatagtacata

SEQ ID NO: 734511 - DNA, 25 bp, Mus musculus
gttgggagcaaattcatagtacata

SEQ ID NO: 734512 - DNA, 25 bp, Mus musculus
gttgggagcggccatgtccataaaa

SEQ ID NO: 734513 - DNA, 25 bp, Mus musculus
gttgggagcggcgatgtccataaaa

SEQ ID NO: 734514 - DNA, 25 bp, Mus musculus
gttgggagggcaagtatcgaaccct

SEQ ID NO: 734515 - DNA, 25 bp, Mus musculus
gttgggagggcatgtatcgaaccct

SEQ ID NO: 734516 - DNA, 25 bp, Mus musculus
gttgggagtaatcctgcacactgca

SEQ ID NO: 734517 - DNA, 25 bp, Mus musculus
gttgggagtaatgctgcacactgca

SEQ ID NO: 734518 - DNA, 25 bp, Mus musculus
gttgggagtacacatttctgctttc

SEQ ID NO: 734519 - DNA, 25 bp, Mus musculus
gttgggagtacagatttctgctttc

SEQ ID NO: 734520 - DNA, 25 bp, Mus musculus
gttgggagtcacattgtggcatctt

SEQ ID NO: 734521 - DNA, 25 bp, Mus musculus
gttgggagtcactttgtggcatctt

SEQ ID NO: 734522 - DNA, 25 bp, Mus musculus
gttgggagtgatcgcagaaaacctt

SEQ ID NO: 734523 - DNA, 25 bp, Mus musculus
gttgggagtgatggcagaaaacctt

SEQ ID NO: 734524 - DNA, 25 bp, Mus musculus
gttgggatacaaagctcagtcactt

SEQ ID NO: 734525 - DNA, 25 bp, Mus musculus
gttgggatacaatgctcagtcactt

SEQ ID NO: 734526 - DNA, 25 bp, Mus musculus
gttgggatccttaggccagatgtta

SEQ ID NO: 734527 - DNA, 25 bp, Mus musculus
gttgggatcctttggccagatgtta

SEQ ID NO: 734528 - DNA, 25 bp, Mus musculus
gttgggattactcacaccaggtcat

SEQ ID NO: 734529 - DNA, 25 bp, Mus musculus
gttgggattactgacaccaggtcat

SEQ ID NO: 734530 - DNA, 25 bp, Mus musculus
gttgggattagtcatgacccctttt

SEQ ID NO: 734531 - DNA, 25 bp, Mus musculus
gttgggattagtgatgacccctttt

SEQ ID NO: 734532 - DNA, 25 bp, Mus musculus
gttgggattctacagttaactgcct

SEQ ID NO: 734533 - DNA, 25 bp, Mus musculus
gttgggattctagagttaactgcct

SEQ ID NO: 734534 - DNA, 25 bp, Mus musculus
gttgggattgatataggctcttcta

SEQ ID NO: 734535 - DNA, 25 bp, Mus musculus
gttgggattgatttaggctcttcta

SEQ ID NO: 734536 - DNA, 25 bp, Mus musculus
gttgggattgttcctggttccgact

SEQ ID NO: 734537 - DNA, 25 bp, Mus musculus
gttgggattgttgctggttccgact

SEQ ID NO: 734538 - DNA, 25 bp, Mus musculus
gttgggattttacatagcttgcatt

SEQ ID NO: 734539 - DNA, 25 bp, Mus musculus
gttgggattttagatagcttgcatt

SEQ ID NO: 734540 - DNA, 25 bp, Mus musculus
gttgggcaatgacgcttctgttcac

SEQ ID NO: 734541 - DNA, 25 bp, Mus musculus
gttgggcaatgaggcttctgttcac

SEQ ID NO: 734542 - DNA, 25 bp, Mus musculus
gttgggcaattaattcttctcttac

SEQ ID NO: 734543 - DNA, 25 bp, Mus musculus
gttgggcaattatttcttctcttac

SEQ ID NO: 734544 - DNA, 25 bp, Mus musculus
gttgggcacactcatcccagtgtga

SEQ ID NO: 734545 - DNA, 25 bp, Mus musculus
gttgggcacactgatcccagtgtga

SEQ ID NO: 734546 - DNA, 25 bp, Mus musculus
gttgggcacattctctattggtcag

SEQ ID NO: 734547 - DNA, 25 bp, Mus musculus
gttgggcacattgtctattggtcag

SEQ ID NO: 734548 - DNA, 25 bp, Mus musculus
gttgggcactcaagtcttcttagac

SEQ ID NO: 734549 - DNA, 25 bp, Mus musculus
gttgggcactcatgtcttcttagac

SEQ ID NO: 734550 - DNA, 25 bp, Mus musculus
gttgggcagcttaggatgaatttct

SEQ ID NO: 734551 - DNA, 25 bp, Mus musculus
gttgggcagctttggatgaatttct

SEQ ID NO: 734552 - DNA, 25 bp, Mus musculus
gttgggcaggccagagttgtcatcc

SEQ ID NO: 734553 - DNA, 25 bp, Mus musculus
gttgggcaggcctgagttgtcatcc

SEQ ID NO: 734554 - DNA, 25 bp, Mus musculus
gttgggcagtacacgattatcagta

SEQ ID NO: 734555 - DNA, 25 bp, Mus musculus
gttgggcagtactcgattatcagta

SEQ ID NO: 734556 - DNA, 25 bp, Mus musculus
gttgggcataggcatttcactctaa

SEQ ID NO: 734557 - DNA, 25 bp, Mus musculus
gttgggcatagggatttcactctaa

SEQ ID NO: 734558 - DNA, 25 bp, Mus musculus
gttgggcatcctctaaacgcattca

SEQ ID NO: 734559 - DNA, 25 bp, Mus musculus
gttgggcatcctgtaaacgcattca

SEQ ID NO: 734560 - DNA, 25 bp, Mus musculus
gttgggcatcttcgcattgctgctc

SEQ ID NO: 734561 - DNA, 25 bp, Mus musculus
gttgggcatcttggcattgctgctc

SEQ ID NO: 734562 - DNA, 25 bp, Mus musculus
gttgggcatggaaccatctggagaa

SEQ ID NO: 734563 - DNA, 25 bp, Mus musculus
gttgggcatggatccatctggagaa

SEQ ID NO: 734564 - DNA, 25 bp, Mus musculus
gttgggcattctcatcaaagctcgt

SEQ ID NO: 734565 - DNA, 25 bp, Mus musculus
gttgggcattctgatcaaagctcgt

SEQ ID NO: 734566 - DNA, 25 bp, Mus musculus
gttgggccaatcatgtccttcacta

SEQ ID NO: 734567 - DNA, 25 bp, Mus musculus
gttgggccaatcttgtccttcacta

SEQ ID NO: 734568 - DNA, 25 bp, Mus musculus
gttgggccaattatagatacctgag

SEQ ID NO: 734569 - DNA, 25 bp, Mus musculus
gttgggccaattttagatacctgag

SEQ ID NO: 734570 - DNA, 25 bp, Mus musculus
gttgggccacagaagaagatcatca

SEQ ID NO: 734571 - DNA, 25 bp, Mus musculus
gttgggccacagtagaagatcatca

SEQ ID NO: 734572 - DNA, 25 bp, Mus musculus
gttgggccagtcaagtttacctgct

SEQ ID NO: 734573 - DNA, 25 bp, Mus musculus
gttgggccagtctagtttacctgct

SEQ ID NO: 734574 - DNA, 25 bp, Mus musculus
gttgggccccacatcatgggaaaag

SEQ ID NO: 734575 - DNA, 25 bp, Mus musculus
gttgggccccacttcatgggaaaag

SEQ ID NO: 734576 - DNA, 25 bp, Mus musculus
gttgggccctatcgtgcctggatcc

SEQ ID NO: 734577 - DNA, 25 bp, Mus musculus
gttgggccctatggtgcctggatcc

SEQ ID NO: 734578 - DNA, 25 bp, Mus musculus
gttgggcctaataagtgacttacag

SEQ ID NO: 734579 - DNA, 25 bp, Mus musculus
gttgggcctaattagtgacttacag

SEQ ID NO: 734580 - DNA, 25 bp, Mus musculus
gttgggccttcaacctcagctagga

SEQ ID NO: 734581 - DNA, 25 bp, Mus musculus
gttgggccttcatcctcagctagga

SEQ ID NO: 734582 - DNA, 25 bp, Mus musculus
gttgggcctttaagttggacaaaca

SEQ ID NO: 734583 - DNA, 25 bp, Mus musculus
gttgggcctttatgttggacaaaca

SEQ ID NO: 734584 - DNA, 25 bp, Mus musculus
gttgggctaaccactatagctccag

SEQ ID NO: 734585 - DNA, 25 bp, Mus musculus
gttgggctaacctctatagctccag

SEQ ID NO: 734586 - DNA, 25 bp, Mus musculus
gttgggctattcaaattccttcttc

SEQ ID NO: 734587 - DNA, 25 bp, Mus musculus
gttgggctattctaattccttcttc

SEQ ID NO: 734588 - DNA, 25 bp, Mus musculus
gttgggctcccaacctcggatggtg

SEQ ID NO: 734589 - DNA, 25 bp, Mus musculus
gttgggctcccatcctcggatggtg

SEQ ID NO: 734590 - DNA, 25 bp, Mus musculus
gttgggctctggcatacactatcac

SEQ ID NO: 734591 - DNA, 25 bp, Mus musculus
gttgggctctgggatacactatcac

SEQ ID NO: 734592 - DNA, 25 bp, Mus musculus
gttgggctcttcagatttatgcaca

SEQ ID NO: 734593 - DNA, 25 bp, Mus musculus
gttgggctcttctgatttatgcaca

SEQ ID NO: 734594 - DNA, 25 bp, Mus musculus
gttgggctgagacatttaaccttct

SEQ ID NO: 734595 - DNA, 25 bp, Mus musculus
gttgggctgagagatttaaccttct

SEQ ID NO: 734596 - DNA, 25 bp, Mus musculus
gttgggctgcttaaatcatcagtac

SEQ ID NO: 734597 - DNA, 25 bp, Mus musculus
gttgggctgcttacacagcctgtga

SEQ ID NO: 734598 - DNA, 25 bp, Mus musculus
gttgggctgctttaatcatcagtac

SEQ ID NO: 734599 - DNA, 25 bp, Mus musculus
gttgggctgctttcacagcctgtga

SEQ ID NO: 734600 - DNA, 25 bp, Mus musculus
gttgggctggatagtacataatgtt

SEQ ID NO: 734601 - DNA, 25 bp, Mus musculus
gttgggctggattgtacataatgtt

SEQ ID NO: 734602 - DNA, 25 bp, Mus musculus
gttgggctgggaacttaccatgcat

SEQ ID NO: 734603 - DNA, 25 bp, Mus musculus
gttgggctgggatcttaccatgcat

SEQ ID NO: 734604 - DNA, 25 bp, Mus musculus
gttgggctgtaaactcagagcctca

SEQ ID NO: 734605 - DNA, 25 bp, Mus musculus
gttgggctgtaatctcagagcctca

SEQ ID NO: 734606 - DNA, 25 bp, Mus musculus
gttgggcttcgcctttacctgctga

SEQ ID NO: 734607 - DNA, 25 bp, Mus musculus
gttgggcttcgcgtttacctgctga

SEQ ID NO: 734608 - DNA, 25 bp, Mus musculus
gttgggcttctgaagtccatacaaa

SEQ ID NO: 734609 - DNA, 25 bp, Mus musculus
gttgggcttctgtagtccatacaaa

SEQ ID NO: 734610 - DNA, 25 bp, Mus musculus
gttgggcttgccattcatgtatgag

SEQ ID NO: 734611 - DNA, 25 bp, Mus musculus
gttgggcttgcctttcatgtatgag

SEQ ID NO: 734612 - DNA, 25 bp, Mus musculus
gttgggcttgtgcataattgactga

SEQ ID NO: 734613 - DNA, 25 bp, Mus musculus
gttgggcttgtggataattgactga

SEQ ID NO: 734614 - DNA, 25 bp, Mus musculus
gttgggtaaatgacttttctgcctt

SEQ ID NO: 734615 - DNA, 25 bp, Mus musculus
gttgggtaaatgtcttttctgcctt

SEQ ID NO: 734616 - DNA, 25 bp, Mus musculus
gttgggtacacaaactcgaaattaa

SEQ ID NO: 734617 - DNA, 25 bp, Mus musculus
gttgggtacacatactcgaaattaa

SEQ ID NO: 734618 - DNA, 25 bp, Mus musculus
gttgggtactgtaagtgtcatgatt

SEQ ID NO: 734619 - DNA, 25 bp, Mus musculus
gttgggtactgttagtgtcatgatt

SEQ ID NO: 734620 - DNA, 25 bp, Mus musculus
gttgggtagaacaaggaagccatca

SEQ ID NO: 734621 - DNA, 25 bp, Mus musculus
gttgggtagaactaggaagccatca

SEQ ID NO: 734622 - DNA, 25 bp, Mus musculus
gttgggtagcaccagaaatcccctg

SEQ ID NO: 734623 - DNA, 25 bp, Mus musculus
gttgggtagcacgagaaatcccctg

SEQ ID NO: 734624 - DNA, 25 bp, Mus musculus
gttgggtatagtcgtctgtaattcc

SEQ ID NO: 734625 - DNA, 25 bp, Mus musculus
gttgggtatagtggtctgtaattcc

SEQ ID NO: 734626 - DNA, 25 bp, Mus musculus
gttgggtcaattcgacacaaaatga

SEQ ID NO: 734627 - DNA, 25 bp, Mus musculus
gttgggtcaattggacacaaaatga

SEQ ID NO: 734628 - DNA, 25 bp, Mus musculus
gttgggtcacctcgccaaagaactc

SEQ ID NO: 734629 - DNA, 25 bp, Mus musculus
gttgggtcacctggccaaagaactc

SEQ ID NO: 734630 - DNA, 25 bp, Mus musculus
gttgggtccagaactttcaaagttt

SEQ ID NO: 734631 - DNA, 25 bp, Mus musculus
gttgggtccagatctttcaaagttt

SEQ ID NO: 734632 - DNA, 25 bp, Mus musculus
gttgggtccattacagccttggagc

SEQ ID NO: 734633 - DNA, 25 bp, Mus musculus
gttgggtccatttcagccttggagc

SEQ ID NO: 734634 - DNA, 25 bp, Mus musculus
gttgggtctcatatgtgcttttatc

SEQ ID NO: 734635 - DNA, 25 bp, Mus musculus
gttgggtctcatttgtgcttttatc

SEQ ID NO: 734636 - DNA, 25 bp, Mus musculus
gttgggtctgtcacatggtttaatc

SEQ ID NO: 734637 - DNA, 25 bp, Mus musculus
gttgggtctgtctcatggtttaatc

SEQ ID NO: 734638 - DNA, 25 bp, Mus musculus
gttgggtgaaacagattgtcctatc

SEQ ID NO: 734639 - DNA, 25 bp, Mus musculus
gttgggtgaaactgattgtcctatc

SEQ ID NO: 734640 - DNA, 25 bp, Mus musculus
gttgggtgaagaactgcagtatcat

SEQ ID NO: 734641 - DNA, 25 bp, Mus musculus
gttgggtgaagatctgcagtatcat

SEQ ID NO: 734642 - DNA, 25 bp, Mus musculus
gttgggtgaatgaaagggccacaaa

SEQ ID NO: 734643 - DNA, 25 bp, Mus musculus
gttgggtgaatgtaagggccacaaa

SEQ ID NO: 734644 - DNA, 25 bp, Mus musculus
gttgggtgacatcccggtaagatac

SEQ ID NO: 734645 - DNA, 25 bp, Mus musculus
gttgggtgacatgccggtaagatac

SEQ ID NO: 734646 - DNA, 25 bp, Mus musculus
gttgggtgactccacaaagcacttc

SEQ ID NO: 734647 - DNA, 25 bp, Mus musculus
gttgggtgactcgacaaagcacttc

SEQ ID NO: 734648 - DNA, 25 bp, Mus musculus
gttgggtgatacaggcacatccact

SEQ ID NO: 734649 - DNA, 25 bp, Mus musculus
gttgggtgatactggcacatccact

SEQ ID NO: 734650 - DNA, 25 bp, Mus musculus
gttgggtgggccaagcataaactgt

SEQ ID NO: 734651 - DNA, 25 bp, Mus musculus
gttgggtgggcctagcataaactgt

SEQ ID NO: 734652 - DNA, 25 bp, Mus musculus
gttgggttcaaccaatgggaagcat

SEQ ID NO: 734653 - DNA, 25 bp, Mus musculus
gttgggttcaacgaatgggaagcat

SEQ ID NO: 734654 - DNA, 25 bp, Mus musculus
gttgggttctatatttcatattgtt

SEQ ID NO: 734655 - DNA, 25 bp, Mus musculus
gttgggttctatttttcatattgtt

SEQ ID NO: 734656 - DNA, 25 bp, Mus musculus
gttgggttgcccctattctgagagt

SEQ ID NO: 734657 - DNA, 25 bp, Mus musculus
gttgggttgcccgtattctgagagt

SEQ ID NO: 734658 - DNA, 25 bp, Mus musculus
gttgggttgcctctttctttcttga

SEQ ID NO: 734659 - DNA, 25 bp, Mus musculus
gttgggttgcctgtttctttcttga

SEQ ID NO: 734660 - DNA, 25 bp, Mus musculus
gttgggttggtacaagtctcttctg

SEQ ID NO: 734661 - DNA, 25 bp, Mus musculus
gttgggttggtagaagtctcttctg

SEQ ID NO: 734662 - DNA, 25 bp, Mus musculus
gttgggtttccccagagccagacaa

SEQ ID NO: 734663 - DNA, 25 bp, Mus musculus
gttgggtttcccgagagccagacaa

SEQ ID NO: 734664 - DNA, 25 bp, Mus musculus
gttgggtttgccatattttgctcat

SEQ ID NO: 734665 - DNA, 25 bp, Mus musculus
gttgggtttgccttattttgctcat

SEQ ID NO: 734666 - DNA, 25 bp, Mus musculus
gttgggttttagctgtactgctaaa

SEQ ID NO: 734667 - DNA, 25 bp, Mus musculus
gttgggttttaggtgtactgctaaa

SEQ ID NO: 734668 - DNA, 25 bp, Mus musculus
gttgggttttgaatctctaattctt

SEQ ID NO: 734669 - DNA, 25 bp, Mus musculus
gttgggttttgattctctaattctt

SEQ ID NO: 734670 - DNA, 25 bp, Mus musculus
gttggtaaaatcattgtcttctgga

SEQ ID NO: 734671 - DNA, 25 bp, Mus musculus
gttggtaaaatctttgtcttctgga

SEQ ID NO: 734672 - DNA, 25 bp, Mus musculus
gttggtaaagcccacgatacacatt

SEQ ID NO: 734673 - DNA, 25 bp, Mus musculus
gttggtaaagccgacgatacacatt

SEQ ID NO: 734674 - DNA, 25 bp, Mus musculus
gttggtaaccagagttgctccagga

SEQ ID NO: 734675 - DNA, 25 bp, Mus musculus
gttggtaaccagtgttgctccagga

SEQ ID NO: 734676 - DNA, 25 bp, Mus musculus
gttggtaaggacatgctagagtcca

SEQ ID NO: 734677 - DNA, 25 bp, Mus musculus
gttggtaaggacttgctagagtcca

SEQ ID NO: 734678 - DNA, 25 bp, Mus musculus
gttggtaaggctccacaatgtcttt

SEQ ID NO: 734679 - DNA, 25 bp, Mus musculus
gttggtaaggctgcacaatgtcttt

SEQ ID NO: 734680 - DNA, 25 bp, Mus musculus
gttggtaagtgcagcagccagctcc

SEQ ID NO: 734681 - DNA, 25 bp, Mus musculus
gttggtaagtgctgcagccagctcc

SEQ ID NO: 734682 - DNA, 25 bp, Mus musculus
gttggtacacaacgttctcagagtt

SEQ ID NO: 734683 - DNA, 25 bp, Mus musculus
gttggtacacaaggttctcagagtt

SEQ ID NO: 734684 - DNA, 25 bp, Mus musculus
gttggtacctctaatgtgttccatg

SEQ ID NO: 734685 - DNA, 25 bp, Mus musculus
gttggtacctcttatgtgttccatg

SEQ ID NO: 734686 - DNA, 25 bp, Mus musculus
gttggtactcttcacagtgaataca

SEQ ID NO: 734687 - DNA, 25 bp, Mus musculus
gttggtactcttgacagtgaataca

SEQ ID NO: 734688 - DNA, 25 bp, Mus musculus
gttggtactgccaatgccctaggca

SEQ ID NO: 734689 - DNA, 25 bp, Mus musculus
gttggtactgcctatgccctaggca

SEQ ID NO: 734690 - DNA, 25 bp, Mus musculus
gttggtactgctaaagacgacattt

SEQ ID NO: 734691 - DNA, 25 bp, Mus musculus
gttggtactgcttaagacgacattt

SEQ ID NO: 734692 - DNA, 25 bp, Mus musculus
gttggtagaattcgaccagggccaa

SEQ ID NO: 734693 - DNA, 25 bp, Mus musculus
gttggtagaattggaccagggccaa

SEQ ID NO: 734694 - DNA, 25 bp, Mus musculus
gttggtagcatccagttggcttact

SEQ ID NO: 734695 - DNA, 25 bp, Mus musculus
gttggtagcatcgagttggcttact

SEQ ID NO: 734696 - DNA, 25 bp, Mus musculus
gttggtagccacaaacattctgtga

SEQ ID NO: 734697 - DNA, 25 bp, Mus musculus
gttggtagccactaacattctgtga

SEQ ID NO: 734698 - DNA, 25 bp, Mus musculus
gttggtatctctaccttctcgaaga

SEQ ID NO: 734699 - DNA, 25 bp, Mus musculus
gttggtatctcttccttctcgaaga

SEQ ID NO: 734700 - DNA, 25 bp, Mus musculus
gttggtatgaccagggagtcccttc

SEQ ID NO: 734701 - DNA, 25 bp, Mus musculus
gttggtatgacctgggagtcccttc

SEQ ID NO: 734702 - DNA, 25 bp, Mus musculus
gttggtatgcggcattaccacttga

SEQ ID NO: 734703 - DNA, 25 bp, Mus musculus
gttggtatgcgggattaccacttga

SEQ ID NO: 734704 - DNA, 25 bp, Mus musculus
gttggtattcacatccggttatgcc

SEQ ID NO: 734705 - DNA, 25 bp, Mus musculus
gttggtattcacttccggttatgcc

SEQ ID NO: 734706 - DNA, 25 bp, Mus musculus
gttggtattgttcaaacgggtacat

SEQ ID NO: 734707 - DNA, 25 bp, Mus musculus
gttggtattgttgaaacgggtacat

SEQ ID NO: 734708 - DNA, 25 bp, Mus musculus
gttggtatttcacggcgaatgcccc

SEQ ID NO: 734709 - DNA, 25 bp, Mus musculus
gttggtatttcagggcgaatgcccc

SEQ ID NO: 734710 - DNA, 25 bp, Mus musculus
gttggtcaaatgcttgctgcacaaa

SEQ ID NO: 734711 - DNA, 25 bp, Mus musculus
gttggtcaaatggttgctgcacaaa

SEQ ID NO: 734712 - DNA, 25 bp, Mus musculus
gttggtcacactcgattaactcatg

SEQ ID NO: 734713 - DNA, 25 bp, Mus musculus
gttggtcacactggattaactcatg

SEQ ID NO: 734714 - DNA, 25 bp, Mus musculus
gttggtcacagaacattaggtcata

SEQ ID NO: 734715 - DNA, 25 bp, Mus musculus
gttggtcacagatcattaggtcata

SEQ ID NO: 734716 - DNA, 25 bp, Mus musculus
gttggtcacattaagcacagcagag

SEQ ID NO: 734717 - DNA, 25 bp, Mus musculus
gttggtcacatttagcacagcagag

SEQ ID NO: 734718 - DNA, 25 bp, Mus musculus
gttggtcaccataggttaaggagat

SEQ ID NO: 734719 - DNA, 25 bp, Mus musculus
gttggtcaccattggttaaggagat

SEQ ID NO: 734720 - DNA, 25 bp, Mus musculus
gttggtcactcgacatcttttaaaa

SEQ ID NO: 734721 - DNA, 25 bp, Mus musculus
gttggtcactcgtcatcttttaaaa

SEQ ID NO: 734722 - DNA, 25 bp, Mus musculus
gttggtcactgtccttaagtagagc

SEQ ID NO: 734723 - DNA, 25 bp, Mus musculus
gttggtcactgtgcttaagtagagc

SEQ ID NO: 734724 - DNA, 25 bp, Mus musculus
gttggtcatcaacacttgttaaagg

SEQ ID NO: 734725 - DNA, 25 bp, Mus musculus
gttggtcatcaagacttgttaaagg

SEQ ID NO: 734726 - DNA, 25 bp, Mus musculus
gttggtcatcttattcagccttaaa

SEQ ID NO: 734727 - DNA, 25 bp, Mus musculus
gttggtcatctttttcagccttaaa

SEQ ID NO: 734728 - DNA, 25 bp, Mus musculus
gttggtcatgccagagccgcgcgcc

SEQ ID NO: 734729 - DNA, 25 bp, Mus musculus
gttggtcatgcctgagccgcgcgcc

SEQ ID NO: 734730 - DNA, 25 bp, Mus musculus
gttggtcattacacaaggctatgca

SEQ ID NO: 734731 - DNA, 25 bp, Mus musculus
gttggtcattactcaaggctatgca

SEQ ID NO: 734732 - DNA, 25 bp, Mus musculus
gttggtcattctcgcatagatctca

SEQ ID NO: 734733 - DNA, 25 bp, Mus musculus
gttggtcattctggcatagatctca

SEQ ID NO: 734734 - DNA, 25 bp, Mus musculus
gttggtcattttagtacacccacag

SEQ ID NO: 734735 - DNA, 25 bp, Mus musculus
gttggtcatttttgtacacccacag

SEQ ID NO: 734736 - DNA, 25 bp, Mus musculus
gttggtccaactatcacagatgtga

SEQ ID NO: 734737 - DNA, 25 bp, Mus musculus
gttggtccaactttcacagatgtga

SEQ ID NO: 734738 - DNA, 25 bp, Mus musculus
gttggtccagctcaaatcctcaaat

SEQ ID NO: 734739 - DNA, 25 bp, Mus musculus
gttggtccagctgaaatcctcaaat

SEQ ID NO: 734740 - DNA, 25 bp, Mus musculus
gttggtccccagcaaataccaggag

SEQ ID NO: 734741 - DNA, 25 bp, Mus musculus
gttggtccccaggaaataccaggag

SEQ ID NO: 734742 - DNA, 25 bp, Mus musculus
gttggtccgatacatgcttgtttgt

SEQ ID NO: 734743 - DNA, 25 bp, Mus musculus
gttggtccgatagatgcttgtttgt

SEQ ID NO: 734744 - DNA, 25 bp, Mus musculus
gttggtcctaaccttttacatcaca

SEQ ID NO: 734745 - DNA, 25 bp, Mus musculus
gttggtcctaacgttttacatcaca

SEQ ID NO: 734746 - DNA, 25 bp, Mus musculus
gttggtccttaaaaagctatcacag

SEQ ID NO: 734747 - DNA, 25 bp, Mus musculus
gttggtccttaataagctatcacag

SEQ ID NO: 734748 - DNA, 25 bp, Mus musculus
gttggtccttctacagtgtgtcttc

SEQ ID NO: 734749 - DNA, 25 bp, Mus musculus
gttggtccttcttcagtgtgtcttc

SEQ ID NO: 734750 - DNA, 25 bp, Mus musculus
gttggtccttggatatccagatcat

SEQ ID NO: 734751 - DNA, 25 bp, Mus musculus
gttggtccttggttatccagatcat

SEQ ID NO: 734752 - DNA, 25 bp, Mus musculus
gttggtctaatcatacaccttcctt

SEQ ID NO: 734753 - DNA, 25 bp, Mus musculus
gttggtctaatcttacaccttcctt

SEQ ID NO: 734754 - DNA, 25 bp, Mus musculus
gttggtctacaaacggatgacagaa

SEQ ID NO: 734755 - DNA, 25 bp, Mus musculus
gttggtctacaatcggatgacagaa

SEQ ID NO: 734756 - DNA, 25 bp, Mus musculus
gttggtctcaacatagatccttctg

SEQ ID NO: 734757 - DNA, 25 bp, Mus musculus
gttggtctcaacttagatccttctg

SEQ ID NO: 734758 - DNA, 25 bp, Mus musculus
gttggtctccatcttaagcttaaat

SEQ ID NO: 734759 - DNA, 25 bp, Mus musculus
gttggtctccatgttaagcttaaat

SEQ ID NO: 734760 - DNA, 25 bp, Mus musculus
gttggtctccttactttctgagaac

SEQ ID NO: 734761 - DNA, 25 bp, Mus musculus
gttggtctcctttctttctgagaac

SEQ ID NO: 734762 - DNA, 25 bp, Mus musculus
gttggtctcgagaactcaccaagaa

SEQ ID NO: 734763 - DNA, 25 bp, Mus musculus
gttggtctcgagtactcaccaagaa

SEQ ID NO: 734764 - DNA, 25 bp, Mus musculus
gttggtctgtccctctatatcatac

SEQ ID NO: 734765 - DNA, 25 bp, Mus musculus
gttggtctgtccgtctatatcatac

SEQ ID NO: 734766 - DNA, 25 bp, Mus musculus
gttggtctgtttaccagccaaaggt

SEQ ID NO: 734767 - DNA, 25 bp, Mus musculus
gttggtctgttttccagccaaaggt

SEQ ID NO: 734768 - DNA, 25 bp, Mus musculus
gttggtcttactctattgcccaata

SEQ ID NO: 734769 - DNA, 25 bp, Mus musculus
gttggtcttactgtattgcccaata

SEQ ID NO: 734770 - DNA, 25 bp, Mus musculus
gttggtcttatgaaactgtgtgcat

SEQ ID NO: 734771 - DNA, 25 bp, Mus musculus
gttggtcttatgctgcttaattcag

SEQ ID NO: 734772 - DNA, 25 bp, Mus musculus
gttggtcttatggtgcttaattcag

SEQ ID NO: 734773 - DNA, 25 bp, Mus musculus
gttggtcttatgtaactgtgtgcat

SEQ ID NO: 734774 - DNA, 25 bp, Mus musculus
gttggtcttcatcaacacaagtatt

SEQ ID NO: 734775 - DNA, 25 bp, Mus musculus
gttggtcttcatgaacacaagtatt

SEQ ID NO: 734776 - DNA, 25 bp, Mus musculus
gttggtcttcgaatggagttgtcta

SEQ ID NO: 734777 - DNA, 25 bp, Mus musculus
gttggtcttcgattggagttgtcta

SEQ ID NO: 734778 - DNA, 25 bp, Mus musculus
gttggtcttcggatgtaatcctgaa

SEQ ID NO: 734779 - DNA, 25 bp, Mus musculus
gttggtcttcggttgtaatcctgaa

SEQ ID NO: 734780 - DNA, 25 bp, Mus musculus
gttggtcttggtcttaagtgctcca

SEQ ID NO: 734781 - DNA, 25 bp, Mus musculus
gttggtcttggtgttaagtgctcca

SEQ ID NO: 734782 - DNA, 25 bp, Mus musculus
gttggtgaaaacatgtgcccctctg

SEQ ID NO: 734783 - DNA, 25 bp, Mus musculus
gttggtgaaaacttgtgcccctctg

SEQ ID NO: 734784 - DNA, 25 bp, Mus musculus
gttggtgaacaacctggtgccttca

SEQ ID NO: 734785 - DNA, 25 bp, Mus musculus
gttggtgaacaagctggtgccttca

SEQ ID NO: 734786 - DNA, 25 bp, Mus musculus
gttggtgaacataagacacaaggat

SEQ ID NO: 734787 - DNA, 25 bp, Mus musculus
gttggtgaacattagacacaaggat

SEQ ID NO: 734788 - DNA, 25 bp, Mus musculus
gttggtgaccaaacagttgagccac

SEQ ID NO: 734789 - DNA, 25 bp, Mus musculus
gttggtgaccaatcagttgagccac

SEQ ID NO: 734790 - DNA, 25 bp, Mus musculus
gttggtgacccaagatgctgtgaga

SEQ ID NO: 734791 - DNA, 25 bp, Mus musculus
gttggtgacccatgatgctgtgaga

SEQ ID NO: 734792 - DNA, 25 bp, Mus musculus
gttggtgacctgaacatgatcccta

SEQ ID NO: 734793 - DNA, 25 bp, Mus musculus
gttggtgacctgtacatgatcccta

SEQ ID NO: 734794 - DNA, 25 bp, Mus musculus
gttggtgactttcctatgactagat

SEQ ID NO: 734795 - DNA, 25 bp, Mus musculus
gttggtgactttgctatgactagat

SEQ ID NO: 734796 - DNA, 25 bp, Mus musculus
gttggtgagaccctaaccattgcta

SEQ ID NO: 734797 - DNA, 25 bp, Mus musculus
gttggtgagaccgtaaccattgcta

SEQ ID NO: 734798 - DNA, 25 bp, Mus musculus
gttggtgcaaaacaaggccctactt

SEQ ID NO: 734799 - DNA, 25 bp, Mus musculus
gttggtgcaaaagaaggccctactt

SEQ ID NO: 734800 - DNA, 25 bp, Mus musculus
gttggtgcagtgattgtcacacaaa

SEQ ID NO: 734801 - DNA, 25 bp, Mus musculus
gttggtgcagtgtttgtcacacaaa

SEQ ID NO: 734802 - DNA, 25 bp, Mus musculus
gttggtgcattaatcacctctccag

SEQ ID NO: 734803 - DNA, 25 bp, Mus musculus
gttggtgcattattcacctctccag

SEQ ID NO: 734804 - DNA, 25 bp, Mus musculus
gttggtgcatttaggacgtaatctc

SEQ ID NO: 734805 - DNA, 25 bp, Mus musculus
gttggtgcattttggacgtaatctc

SEQ ID NO: 734806 - DNA, 25 bp, Mus musculus
gttggtgccactatatttatttact

SEQ ID NO: 734807 - DNA, 25 bp, Mus musculus
gttggtgccactttatttatttact

SEQ ID NO: 734808 - DNA, 25 bp, Mus musculus
gttggtgccatacaggccaggtctc

SEQ ID NO: 734809 - DNA, 25 bp, Mus musculus
gttggtgccatagaggccaggtctc

SEQ ID NO: 734810 - DNA, 25 bp, Mus musculus
gttggtgcctaaacacttaagttat

SEQ ID NO: 734811 - DNA, 25 bp, Mus musculus
gttggtgcctaatcacttaagttat

SEQ ID NO: 734812 - DNA, 25 bp, Mus musculus
gttggtgcggaacggctaggatcct

SEQ ID NO: 734813 - DNA, 25 bp, Mus musculus
gttggtgcggaagggctaggatcct

SEQ ID NO: 734814 - DNA, 25 bp, Mus musculus
gttggtgctataaattcttctggtt

SEQ ID NO: 734815 - DNA, 25 bp, Mus musculus
gttggtgctatatattcttctggtt

SEQ ID NO: 734816 - DNA, 25 bp, Mus musculus
gttggtgctctactctgtatgttca

SEQ ID NO: 734817 - DNA, 25 bp, Mus musculus
gttggtgctctagtctgtatgttca

SEQ ID NO: 734818 - DNA, 25 bp, Mus musculus
gttggtgctctgaagctgaatctca

SEQ ID NO: 734819 - DNA, 25 bp, Mus musculus
gttggtgctctgtagctgaatctca

SEQ ID NO: 734820 - DNA, 25 bp, Mus musculus
gttggtgcttataccaatgtgagtg

SEQ ID NO: 734821 - DNA, 25 bp, Mus musculus
gttggtgcttattccaatgtgagtg

SEQ ID NO: 734822 - DNA, 25 bp, Mus musculus
gttggtggaaatccccagccaagta

SEQ ID NO: 734823 - DNA, 25 bp, Mus musculus
gttggtggaaatgcccagccaagta

SEQ ID NO: 734824 - DNA, 25 bp, Mus musculus
gttggtggacggatcaagcttccca

SEQ ID NO: 734825 - DNA, 25 bp, Mus musculus
gttggtggacggttcaagcttccca

SEQ ID NO: 734826 - DNA, 25 bp, Mus musculus
gttggtggagcacccacatagtcaa

SEQ ID NO: 734827 - DNA, 25 bp, Mus musculus
gttggtggagcagccacatagtcaa

SEQ ID NO: 734828 - DNA, 25 bp, Mus musculus
gttggtggcacactagtcaccagca

SEQ ID NO: 734829 - DNA, 25 bp, Mus musculus
gttggtggcacagtagtcaccagca

SEQ ID NO: 734830 - DNA, 25 bp, Mus musculus
gttggtggcagaccctcaatcccag

SEQ ID NO: 734831 - DNA, 25 bp, Mus musculus
gttggtggcagagcctcaatcccag

SEQ ID NO: 734832 - DNA, 25 bp, Mus musculus
gttggtggcctcacaggaagcagct

SEQ ID NO: 734833 - DNA, 25 bp, Mus musculus
gttggtggcctctcaggaagcagct

SEQ ID NO: 734834 - DNA, 25 bp, Mus musculus
gttggtggctttagcttgggatcag

SEQ ID NO: 734835 - DNA, 25 bp, Mus musculus
gttggtggcttttgcttgggatcag

SEQ ID NO: 734836 - DNA, 25 bp, Mus musculus
gttggtggtactcactaccgcactg

SEQ ID NO: 734837 - DNA, 25 bp, Mus musculus
gttggtggtactgactaccgcactg

SEQ ID NO: 734838 - DNA, 25 bp, Mus musculus
gttggtggtcatagtgcacaccttt

SEQ ID NO: 734839 - DNA, 25 bp, Mus musculus
gttggtggtcattgtgcacaccttt

SEQ ID NO: 734840 - DNA, 25 bp, Mus musculus
gttggtggtctaattgagcttgttg

SEQ ID NO: 734841 - DNA, 25 bp, Mus musculus
gttggtggtctatttgagcttgttg

SEQ ID NO: 734842 - DNA, 25 bp, Mus musculus
gttggtggtggccatgccatcaatc

SEQ ID NO: 734843 - DNA, 25 bp, Mus musculus
gttggtggtggcgatgccatcaatc

SEQ ID NO: 734844 - DNA, 25 bp, Mus musculus
gttggtggtgtgaactgaacccaga

SEQ ID NO: 734845 - DNA, 25 bp, Mus musculus
gttggtggtgtgtactgaacccaga

SEQ ID NO: 734846 - DNA, 25 bp, Mus musculus
gttggtggttttaaatgagcctctc

SEQ ID NO: 734847 - DNA, 25 bp, Mus musculus
gttggtggtttttaatgagcctctc

SEQ ID NO: 734848 - DNA, 25 bp, Mus musculus
gttggtgtacgaatcctgggaagct

SEQ ID NO: 734849 - DNA, 25 bp, Mus musculus
gttggtgtacgattcctgggaagct

SEQ ID NO: 734850 - DNA, 25 bp, Mus musculus
gttggtgtaggtaactaaactcaca

SEQ ID NO: 734851 - DNA, 25 bp, Mus musculus
gttggtgtaggttactaaactcaca

SEQ ID NO: 734852 - DNA, 25 bp, Mus musculus
gttggtgtcacactcatccagtgga

SEQ ID NO: 734853 - DNA, 25 bp, Mus musculus
gttggtgtcacagtcatccagtgga

SEQ ID NO: 734854 - DNA, 25 bp, Mus musculus
gttggtgtccctcgccatgtttttt

SEQ ID NO: 734855 - DNA, 25 bp, Mus musculus
gttggtgtccctggccatgtttttt

SEQ ID NO: 734856 - DNA, 25 bp, Mus musculus
gttggtgtgactactaacaaacctg

SEQ ID NO: 734857 - DNA, 25 bp, Mus musculus
gttggtgtgacttctaacaaacctg

SEQ ID NO: 734858 - DNA, 25 bp, Mus musculus
gttggtgtgcacagccactgtcagt

SEQ ID NO: 734859 - DNA, 25 bp, Mus musculus
gttggtgtgcactgccactgtcagt

SEQ ID NO: 734860 - DNA, 25 bp, Mus musculus
gttggtgtgttaagactaatcctca

SEQ ID NO: 734861 - DNA, 25 bp, Mus musculus
gttggtgtgttatgactaatcctca

SEQ ID NO: 734862 - DNA, 25 bp, Mus musculus
gttggtgttagtcagccaggctctt

SEQ ID NO: 734863 - DNA, 25 bp, Mus musculus
gttggtgttagtgagccaggctctt

SEQ ID NO: 734864 - DNA, 25 bp, Mus musculus
gttggtgttccaaacagataggaca

SEQ ID NO: 734865 - DNA, 25 bp, Mus musculus
gttggtgttccatacagataggaca

SEQ ID NO: 734866 - DNA, 25 bp, Mus musculus
gttggtgttctgaggtgcctttgca

SEQ ID NO: 734867 - DNA, 25 bp, Mus musculus
gttggtgttctgtggtgcctttgca

SEQ ID NO: 734868 - DNA, 25 bp, Mus musculus
gttggtgttgacagttgactctgta

SEQ ID NO: 734869 - DNA, 25 bp, Mus musculus
gttggtgttgactgttgactctgta

SEQ ID NO: 734870 - DNA, 25 bp, Mus musculus
gttggttaacaactctgttttctgt

SEQ ID NO: 734871 - DNA, 25 bp, Mus musculus
gttggttaacaagtctgttttctgt

SEQ ID NO: 734872 - DNA, 25 bp, Mus musculus
gttggttaataaaccctgtgttctg

SEQ ID NO: 734873 - DNA, 25 bp, Mus musculus
gttggttaataatccctgtgttctg

SEQ ID NO: 734874 - DNA, 25 bp, Mus musculus
gttggttaccgacagctccctgaaa

SEQ ID NO: 734875 - DNA, 25 bp, Mus musculus
gttggttaccgagagctccctgaaa

SEQ ID NO: 734876 - DNA, 25 bp, Mus musculus
gttggttagcacattttgtcttcct

SEQ ID NO: 734877 - DNA, 25 bp, Mus musculus
gttggttagcactttttgtcttcct

SEQ ID NO: 734878 - DNA, 25 bp, Mus musculus
gttggttatccacaaattatgcttt

SEQ ID NO: 734879 - DNA, 25 bp, Mus musculus
gttggttatccagaaattatgcttt

SEQ ID NO: 734880 - DNA, 25 bp, Mus musculus
gttggttatctcctatgtctttaag

SEQ ID NO: 734881 - DNA, 25 bp, Mus musculus
gttggttatctcgtatgtctttaag

SEQ ID NO: 734882 - DNA, 25 bp, Mus musculus
gttggttatcttataggcgctctcc

SEQ ID NO: 734883 - DNA, 25 bp, Mus musculus
gttggttatcttttaggcgctctcc

SEQ ID NO: 734884 - DNA, 25 bp, Mus musculus
gttggttatgaaccaggttctctat

SEQ ID NO: 734885 - DNA, 25 bp, Mus musculus
gttggttatgaagcaggttctctat

SEQ ID NO: 734886 - DNA, 25 bp, Mus musculus
gttggttcaagtcaacagcgactca

SEQ ID NO: 734887 - DNA, 25 bp, Mus musculus
gttggttcaagtgaacagcgactca

SEQ ID NO: 734888 - DNA, 25 bp, Mus musculus
gttggttcaccaaacatcatttgtt

SEQ ID NO: 734889 - DNA, 25 bp, Mus musculus
gttggttcaccatacatcatttgtt

SEQ ID NO: 734890 - DNA, 25 bp, Mus musculus
gttggttcagtcaccataggacttt

SEQ ID NO: 734891 - DNA, 25 bp, Mus musculus
gttggttcagtctccataggacttt

SEQ ID NO: 734892 - DNA, 25 bp, Mus musculus
gttggttctattaaatggacacgag

SEQ ID NO: 734893 - DNA, 25 bp, Mus musculus
gttggttctatttaatggacacgag

SEQ ID NO: 734894 - DNA, 25 bp, Mus musculus
gttggttctcctcagcctgggtttc

SEQ ID NO: 734895 - DNA, 25 bp, Mus musculus
gttggttctcctgagcctgggtttc

SEQ ID NO: 734896 - DNA, 25 bp, Mus musculus
gttggttctctgatagagctgtaca

SEQ ID NO: 734897 - DNA, 25 bp, Mus musculus
gttggttctctgttagagctgtaca

SEQ ID NO: 734898 - DNA, 25 bp, Mus musculus
gttggttctgtcaggagtctagata

SEQ ID NO: 734899 - DNA, 25 bp, Mus musculus
gttggttctgtctggagtctagata

SEQ ID NO: 734900 - DNA, 25 bp, Mus musculus
gttggttgagccagtgttttctgat

SEQ ID NO: 734901 - DNA, 25 bp, Mus musculus
gttggttgagcctgtgttttctgat

SEQ ID NO: 734902 - DNA, 25 bp, Mus musculus
gttggttgatagctttggtttgatt

SEQ ID NO: 734903 - DNA, 25 bp, Mus musculus
gttggttgataggtttggtttgatt

SEQ ID NO: 734904 - DNA, 25 bp, Mus musculus
gttggttgcagacagtcgccacgta

SEQ ID NO: 734905 - DNA, 25 bp, Mus musculus
gttggttgcagagagtcgccacgta

SEQ ID NO: 734906 - DNA, 25 bp, Mus musculus
gttggttgcataactgtagcatatt

SEQ ID NO: 734907 - DNA, 25 bp, Mus musculus
gttggttgcatatctgtagcatatt

SEQ ID NO: 734908 - DNA, 25 bp, Mus musculus
gttggttgccatcttatcatactta

SEQ ID NO: 734909 - DNA, 25 bp, Mus musculus
gttggttgccatgttatcatactta

SEQ ID NO: 734910 - DNA, 25 bp, Mus musculus
gttggttgcgccctagaagaaaata

SEQ ID NO: 734911 - DNA, 25 bp, Mus musculus
gttggttgcgccgtagaagaaaata

SEQ ID NO: 734912 - DNA, 25 bp, Mus musculus
gttggttgctataggtcacagtttg

SEQ ID NO: 734913 - DNA, 25 bp, Mus musculus
gttggttgctatcggcatgttccct

SEQ ID NO: 734914 - DNA, 25 bp, Mus musculus
gttggttgctatgggcatgttccct

SEQ ID NO: 734915 - DNA, 25 bp, Mus musculus
gttggttgctattggtcacagtttg

SEQ ID NO: 734916 - DNA, 25 bp, Mus musculus
gttggttgctgtccaagcgcgattt

SEQ ID NO: 734917 - DNA, 25 bp, Mus musculus
gttggttgctgtgcaagcgcgattt

SEQ ID NO: 734918 - DNA, 25 bp, Mus musculus
gttggttgggctacacagctaacta

SEQ ID NO: 734919 - DNA, 25 bp, Mus musculus
gttggttgggcttcacagctaacta

SEQ ID NO: 734920 - DNA, 25 bp, Mus musculus
gttggttggttaattcctgctttgt

SEQ ID NO: 734921 - DNA, 25 bp, Mus musculus
gttggttggttatttcctgctttgt

SEQ ID NO: 734922 - DNA, 25 bp, Mus musculus
gttggtttaggaaggcactttgaat

SEQ ID NO: 734923 - DNA, 25 bp, Mus musculus
gttggtttaggacatctgagctctg

SEQ ID NO: 734924 - DNA, 25 bp, Mus musculus
gttggtttaggagatctgagctctg

SEQ ID NO: 734925 - DNA, 25 bp, Mus musculus
gttggtttaggatggcactttgaat

SEQ ID NO: 734926 - DNA, 25 bp, Mus musculus
gttggtttagtcatggtgtcagttc

SEQ ID NO: 734927 - DNA, 25 bp, Mus musculus
gttggtttagtcttggtgtcagttc

SEQ ID NO: 734928 - DNA, 25 bp, Mus musculus
gttggtttcagtcatcagcactttc

SEQ ID NO: 734929 - DNA, 25 bp, Mus musculus
gttggtttcagtgatcagcactttc

SEQ ID NO: 734930 - DNA, 25 bp, Mus musculus
gttggtttccaaaactgggaactga

SEQ ID NO: 734931 - DNA, 25 bp, Mus musculus
gttggtttccaatactgggaactga

SEQ ID NO: 734932 - DNA, 25 bp, Mus musculus
gttggtttccttacatgtgacactg

SEQ ID NO: 734933 - DNA, 25 bp, Mus musculus
gttggtttcctttcatgtgacactg

SEQ ID NO: 734934 - DNA, 25 bp, Mus musculus
gttggtttcgagctacaggcagttt

SEQ ID NO: 734935 - DNA, 25 bp, Mus musculus
gttggtttcgaggtacaggcagttt

SEQ ID NO: 734936 - DNA, 25 bp, Mus musculus
gttggtttctaacagactacttcca

SEQ ID NO: 734937 - DNA, 25 bp, Mus musculus
gttggtttctaagagactacttcca

SEQ ID NO: 734938 - DNA, 25 bp, Mus musculus
gttggtttctagcatggaggttcat

SEQ ID NO: 734939 - DNA, 25 bp, Mus musculus
gttggtttctaggatggaggttcat

SEQ ID NO: 734940 - DNA, 25 bp, Mus musculus
gttggtttgcatcagctgccacaga

SEQ ID NO: 734941 - DNA, 25 bp, Mus musculus
gttggtttgcatgagctgccacaga

SEQ ID NO: 734942 - DNA, 25 bp, Mus musculus
gttggtttgcctattgaagagcatt

SEQ ID NO: 734943 - DNA, 25 bp, Mus musculus
gttggtttgccttttgaagagcatt

SEQ ID NO: 734944 - DNA, 25 bp, Mus musculus
gttggtttggaacagacccctctct

SEQ ID NO: 734945 - DNA, 25 bp, Mus musculus
gttggtttggaagagacccctctct

SEQ ID NO: 734946 - DNA, 25 bp, Mus musculus
gttggtttgtcacaactcactgtaa

SEQ ID NO: 734947 - DNA, 25 bp, Mus musculus
gttggtttgtcagaactcactgtaa

SEQ ID NO: 734948 - DNA, 25 bp, Mus musculus
gttggtttgtttctctcttcccagt

SEQ ID NO: 734949 - DNA, 25 bp, Mus musculus
gttggtttgtttgtctcttcccagt

SEQ ID NO: 734950 - DNA, 25 bp, Mus musculus
gttggttttcctccattgtatcttt

SEQ ID NO: 734951 - DNA, 25 bp, Mus musculus
gttggttttcctgcattgtatcttt

SEQ ID NO: 734952 - DNA, 25 bp, Mus musculus
gttggttttctaacagccttggtct

SEQ ID NO: 734953 - DNA, 25 bp, Mus musculus
gttggttttctatcagccttggtct

SEQ ID NO: 734954 - DNA, 25 bp, Mus musculus
gttggttttgctattccatggacat

SEQ ID NO: 734955 - DNA, 25 bp, Mus musculus
gttggttttgcttttccatggacat

SEQ ID NO: 734956 - DNA, 25 bp, Mus musculus
gttggttttgttactgggagctata

SEQ ID NO: 734957 - DNA, 25 bp, Mus musculus
gttggttttgtttctgggagctata

SEQ ID NO: 734958 - DNA, 25 bp, Mus musculus
gttggttttttgacagctttccaca

SEQ ID NO: 734959 - DNA, 25 bp, Mus musculus
gttggttttttgtcagctttccaca

SEQ ID NO: 734960 - DNA, 25 bp, Mus musculus
gttgtaaacctaagcacatcccttg

SEQ ID NO: 734961 - DNA, 25 bp, Mus musculus
gttgtaaacctatgcacatcccttg

SEQ ID NO: 734962 - DNA, 25 bp, Mus musculus
gttgtaaagataagttcctgggcca

SEQ ID NO: 734963 - DNA, 25 bp, Mus musculus
gttgtaaagatatgttcctgggcca

SEQ ID NO: 734964 - DNA, 25 bp, Mus musculus
gttgtaaatactcagaagcgttttg

SEQ ID NO: 734965 - DNA, 25 bp, Mus musculus
gttgtaaatactgagaagcgttttg

SEQ ID NO: 734966 - DNA, 25 bp, Mus musculus
gttgtaaatatcacccattctgaag

SEQ ID NO: 734967 - DNA, 25 bp, Mus musculus
gttgtaaatatctcccattctgaag

SEQ ID NO: 734968 - DNA, 25 bp, Mus musculus
gttgtaaatatgattgttccctgct

SEQ ID NO: 734969 - DNA, 25 bp, Mus musculus
gttgtaaatatgtttgttccctgct

SEQ ID NO: 734970 - DNA, 25 bp, Mus musculus
gttgtaaatattatctaggagttct

SEQ ID NO: 734971 - DNA, 25 bp, Mus musculus
gttgtaaatattttctaggagttct

SEQ ID NO: 734972 - DNA, 25 bp, Mus musculus
gttgtaaatctaaagcagttttgct

SEQ ID NO: 734973 - DNA, 25 bp, Mus musculus
gttgtaaatctatagcagttttgct

SEQ ID NO: 734974 - DNA, 25 bp, Mus musculus
gttgtaaatgataaccggccccata

SEQ ID NO: 734975 - DNA, 25 bp, Mus musculus
gttgtaaatgattaccggccccata

SEQ ID NO: 734976 - DNA, 25 bp, Mus musculus
gttgtaaatgctccagctccttcca

SEQ ID NO: 734977 - DNA, 25 bp, Mus musculus
gttgtaaatgctgcagctccttcca

SEQ ID NO: 734978 - DNA, 25 bp, Mus musculus
gttgtaaatgtcacggactcccaga

SEQ ID NO: 734979 - DNA, 25 bp, Mus musculus
gttgtaaatgtcagtgccacttcaa

SEQ ID NO: 734980 - DNA, 25 bp, Mus musculus
gttgtaaatgtctcggactcccaga

SEQ ID NO: 734981 - DNA, 25 bp, Mus musculus
gttgtaaatgtctgtgccacttcaa

SEQ ID NO: 734982 - DNA, 25 bp, Mus musculus
gttgtaaatgttcccctaacttctg

SEQ ID NO: 734983 - DNA, 25 bp, Mus musculus
gttgtaaatgttgccctaacttctg

SEQ ID NO: 734984 - DNA, 25 bp, Mus musculus
gttgtaacactcactttcttggaaa

SEQ ID NO: 734985 - DNA, 25 bp, Mus musculus
gttgtaacactctctttcttggaaa

SEQ ID NO: 734986 - DNA, 25 bp, Mus musculus
gttgtaacatttcaacagagacctg

SEQ ID NO: 734987 - DNA, 25 bp, Mus musculus
gttgtaacatttgaacagagacctg

SEQ ID NO: 734988 - DNA, 25 bp, Mus musculus
gttgtaaccaaaagcttctgcactt

SEQ ID NO: 734989 - DNA, 25 bp, Mus musculus
gttgtaaccaaatgcttctgcactt

SEQ ID NO: 734990 - DNA, 25 bp, Mus musculus
gttgtaaccactattcacggctggt

SEQ ID NO: 734991 - DNA, 25 bp, Mus musculus
gttgtaaccacttttcacggctggt

SEQ ID NO: 734992 - DNA, 25 bp, Mus musculus
gttgtaaccagaattcaccaaggaa

SEQ ID NO: 734993 - DNA, 25 bp, Mus musculus
gttgtaaccagatttcaccaaggaa

SEQ ID NO: 734994 - DNA, 25 bp, Mus musculus
gttgtaaccttacttgtgtggtgcc

SEQ ID NO: 734995 - DNA, 25 bp, Mus musculus
gttgtaaccttagttgtgtggtgcc

SEQ ID NO: 734996 - DNA, 25 bp, Mus musculus
gttgtaacgcccacactgtaaagct

SEQ ID NO: 734997 - DNA, 25 bp, Mus musculus
gttgtaacgccctcactgtaaagct

SEQ ID NO: 734998 - DNA, 25 bp, Mus musculus
gttgtaactgataacctgtcataca

SEQ ID NO: 734999 - DNA, 25 bp, Mus musculus
gttgtaactgattacctgtcataca

SEQ ID NO: 735000 - DNA, 25 bp, Mus musculus
gttgtaactgcaacttttggaatct

SEQ ID NO: 735001 - DNA, 25 bp, Mus musculus
gttgtaactgcatcttttggaatct

SEQ ID NO: 735002 - DNA, 25 bp, Mus musculus
gttgtaacttaccttgtagcagcaa

SEQ ID NO: 735003 - DNA, 25 bp, Mus musculus
gttgtaacttacgttgtagcagcaa

SEQ ID NO: 735004 - DNA, 25 bp, Mus musculus
gttgtaacttttaattccactcatt

SEQ ID NO: 735005 - DNA, 25 bp, Mus musculus
gttgtaactttttattccactcatt

SEQ ID NO: 735006 - DNA, 25 bp, Mus musculus
gttgtaagactgagtagccggccta

SEQ ID NO: 735007 - DNA, 25 bp, Mus musculus
gttgtaagactgtgtagccggccta

SEQ ID NO: 735008 - DNA, 25 bp, Mus musculus
gttgtaagattgcttgttcaaacca

SEQ ID NO: 735009 - DNA, 25 bp, Mus musculus
gttgtaagattggttgttcaaacca

SEQ ID NO: 735010 - DNA, 25 bp, Mus musculus
gttgtaagcgttacctaatctgtgt

SEQ ID NO: 735011 - DNA, 25 bp, Mus musculus
gttgtaagcgtttcctaatctgtgt

SEQ ID NO: 735012 - DNA, 25 bp, Mus musculus
gttgtaaggagtacccttgttcagc

SEQ ID NO: 735013 - DNA, 25 bp, Mus musculus
gttgtaaggagttcccttgttcagc

SEQ ID NO: 735014 - DNA, 25 bp, Mus musculus
gttgtaagtaatctcatttctgaga

SEQ ID NO: 735015 - DNA, 25 bp, Mus musculus
gttgtaagtaatgtcatttctgaga

SEQ ID NO: 735016 - DNA, 25 bp, Mus musculus
gttgtaataaagatgtctgtaccgt

SEQ ID NO: 735017 - DNA, 25 bp, Mus musculus
gttgtaataaagttgtctgtaccgt

SEQ ID NO: 735018 - DNA, 25 bp, Mus musculus
gttgtaatcaggatcaacccacttc

SEQ ID NO: 735019 - DNA, 25 bp, Mus musculus
gttgtaatcaggttcaacccacttc

SEQ ID NO: 735020 - DNA, 25 bp, Mus musculus
gttgtaatcggtcactgagaagcac

SEQ ID NO: 735021 - DNA, 25 bp, Mus musculus
gttgtaatcggtgactgagaagcac

SEQ ID NO: 735022 - DNA, 25 bp, Mus musculus
gttgtaatctctctatgcactttgc

SEQ ID NO: 735023 - DNA, 25 bp, Mus musculus
gttgtaatctctgtatgcactttgc

SEQ ID NO: 735024 - DNA, 25 bp, Mus musculus
gttgtaatgaccactcccataaggg

SEQ ID NO: 735025 - DNA, 25 bp, Mus musculus
gttgtaatgacctctcccataaggg

SEQ ID NO: 735026 - DNA, 25 bp, Mus musculus
gttgtaatgactaacctatcactga

SEQ ID NO: 735027 - DNA, 25 bp, Mus musculus
gttgtaatgacttacctatcactga

SEQ ID NO: 735028 - DNA, 25 bp, Mus musculus
gttgtaatgcacacagatcctctag

SEQ ID NO: 735029 - DNA, 25 bp, Mus musculus
gttgtaatgcactcagatcctctag

SEQ ID NO: 735030 - DNA, 25 bp, Mus musculus
gttgtaatgcagctgccttggcaat

SEQ ID NO: 735031 - DNA, 25 bp, Mus musculus
gttgtaatgcaggtgccttggcaat

SEQ ID NO: 735032 - DNA, 25 bp, Mus musculus
gttgtaatgttaatttctgcctttt

SEQ ID NO: 735033 - DNA, 25 bp, Mus musculus
gttgtaatgttattttctgcctttt

SEQ ID NO: 735034 - DNA, 25 bp, Mus musculus
gttgtaattaggaacatcctcagag

SEQ ID NO: 735035 - DNA, 25 bp, Mus musculus
gttgtaattaggtacatcctcagag

SEQ ID NO: 735036 - DNA, 25 bp, Mus musculus
gttgtaattcttcgatgattctgta

SEQ ID NO: 735037 - DNA, 25 bp, Mus musculus
gttgtaattcttggatgattctgta

SEQ ID NO: 735038 - DNA, 25 bp, Mus musculus
gttgtacaaactaatttccatatgg

SEQ ID NO: 735039 - DNA, 25 bp, Mus musculus
gttgtacaaacttatttccatatgg

SEQ ID NO: 735040 - DNA, 25 bp, Mus musculus
gttgtacaacctagcgatgtgtgct

SEQ ID NO: 735041 - DNA, 25 bp, Mus musculus
gttgtacaaccttgcgatgtgtgct

SEQ ID NO: 735042 - DNA, 25 bp, Mus musculus
gttgtacaagatcaccattctgctg

SEQ ID NO: 735043 - DNA, 25 bp, Mus musculus
gttgtacaagatgaccattctgctg

SEQ ID NO: 735044 - DNA, 25 bp, Mus musculus
gttgtacaaggacagaactcagcat

SEQ ID NO: 735045 - DNA, 25 bp, Mus musculus
gttgtacaaggagagaactcagcat

SEQ ID NO: 735046 - DNA, 25 bp, Mus musculus
gttgtacaagttaacattcctccat

SEQ ID NO: 735047 - DNA, 25 bp, Mus musculus
gttgtacaagtttacattcctccat

SEQ ID NO: 735048 - DNA, 25 bp, Mus musculus
gttgtacacagtcacaatcagattc

SEQ ID NO: 735049 - DNA, 25 bp, Mus musculus
gttgtacacagtgacaatcagattc

SEQ ID NO: 735050 - DNA, 25 bp, Mus musculus
gttgtacaccttactagtaaacact

SEQ ID NO: 735051 - DNA, 25 bp, Mus musculus
gttgtacacctttctagtaaacact

SEQ ID NO: 735052 - DNA, 25 bp, Mus musculus
gttgtacacgtacctgcgtttaaca

SEQ ID NO: 735053 - DNA, 25 bp, Mus musculus
gttgtacacgtagctgcgtttaaca

SEQ ID NO: 735054 - DNA, 25 bp, Mus musculus
gttgtacacgttctactgaatccct

SEQ ID NO: 735055 - DNA, 25 bp, Mus musculus
gttgtacacgttgtactgaatccct

SEQ ID NO: 735056 - DNA, 25 bp, Mus musculus
gttgtacagaacacttccagtcttt

SEQ ID NO: 735057 - DNA, 25 bp, Mus musculus
gttgtacagaactcttccagtcttt

SEQ ID NO: 735058 - DNA, 25 bp, Mus musculus
gttgtacagaggacatgactgctga

SEQ ID NO: 735059 - DNA, 25 bp, Mus musculus
gttgtacagaggtcatgactgctga

SEQ ID NO: 735060 - DNA, 25 bp, Mus musculus
gttgtacagcacagatcctcaggaa

SEQ ID NO: 735061 - DNA, 25 bp, Mus musculus
gttgtacagcactgatcctcaggaa

SEQ ID NO: 735062 - DNA, 25 bp, Mus musculus
gttgtacaggacctatctgacttct

SEQ ID NO: 735063 - DNA, 25 bp, Mus musculus
gttgtacaggacctgtttccacatc

SEQ ID NO: 735064 - DNA, 25 bp, Mus musculus
gttgtacaggacgtatctgacttct

SEQ ID NO: 735065 - DNA, 25 bp, Mus musculus
gttgtacaggacgtgtttccacatc

SEQ ID NO: 735066 - DNA, 25 bp, Mus musculus
gttgtacagttacttcctaggctat

SEQ ID NO: 735067 - DNA, 25 bp, Mus musculus
gttgtacagttagttcctaggctat

SEQ ID NO: 735068 - DNA, 25 bp, Mus musculus
gttgtacagttgacatttagtactt

SEQ ID NO: 735069 - DNA, 25 bp, Mus musculus
gttgtacagttgtcatttagtactt

SEQ ID NO: 735070 - DNA, 25 bp, Mus musculus
gttgtacatagaacttgcttcctag

SEQ ID NO: 735071 - DNA, 25 bp, Mus musculus
gttgtacatagatcttgcttcctag

SEQ ID NO: 735072 - DNA, 25 bp, Mus musculus
gttgtacatattactaactaggctg

SEQ ID NO: 735073 - DNA, 25 bp, Mus musculus
gttgtacatatttctaactaggctg

SEQ ID NO: 735074 - DNA, 25 bp, Mus musculus
gttgtacatcagaatcacctgtgaa

SEQ ID NO: 735075 - DNA, 25 bp, Mus musculus
gttgtacatcagtatcacctgtgaa

SEQ ID NO: 735076 - DNA, 25 bp, Mus musculus
gttgtacattaaacataccctcatt

SEQ ID NO: 735077 - DNA, 25 bp, Mus musculus
gttgtacattaatcataccctcatt

SEQ ID NO: 735078 - DNA, 25 bp, Mus musculus
gttgtacattttagctgttatcttg

SEQ ID NO: 735079 - DNA, 25 bp, Mus musculus
gttgtacatttttgctgttatcttg

SEQ ID NO: 735080 - DNA, 25 bp, Mus musculus
gttgtaccagacatcaatgagccag

SEQ ID NO: 735081 - DNA, 25 bp, Mus musculus
gttgtaccagacttcaatgagccag

SEQ ID NO: 735082 - DNA, 25 bp, Mus musculus
gttgtaccagcgcatgccttggaaa

SEQ ID NO: 735083 - DNA, 25 bp, Mus musculus
gttgtaccagcggatgccttggaaa

SEQ ID NO: 735084 - DNA, 25 bp, Mus musculus
gttgtaccaggtattgcatcttcac

SEQ ID NO: 735085 - DNA, 25 bp, Mus musculus
gttgtaccaggttttgcatcttcac

SEQ ID NO: 735086 - DNA, 25 bp, Mus musculus
gttgtacccctcaggacagaggagc

SEQ ID NO: 735087 - DNA, 25 bp, Mus musculus
gttgtacccctctggacagaggagc

SEQ ID NO: 735088 - DNA, 25 bp, Mus musculus
gttgtaccgtaccattttatcttct

SEQ ID NO: 735089 - DNA, 25 bp, Mus musculus
gttgtaccgtacgattttatcttct

SEQ ID NO: 735090 - DNA, 25 bp, Mus musculus
gttgtacctaacatgcacttgtaat

SEQ ID NO: 735091 - DNA, 25 bp, Mus musculus
gttgtacctaacttgcacttgtaat

SEQ ID NO: 735092 - DNA, 25 bp, Mus musculus
gttgtacctcttaagttttccatga

SEQ ID NO: 735093 - DNA, 25 bp, Mus musculus
gttgtacctctttagttttccatga

SEQ ID NO: 735094 - DNA, 25 bp, Mus musculus
gttgtacgtctcagggatgcccgga

SEQ ID NO: 735095 - DNA, 25 bp, Mus musculus
gttgtacgtctctgggatgcccgga

SEQ ID NO: 735096 - DNA, 25 bp, Mus musculus
gttgtactatctattgtatgtgaat

SEQ ID NO: 735097 - DNA, 25 bp, Mus musculus
gttgtactatcttttgtatgtgaat

SEQ ID NO: 735098 - DNA, 25 bp, Mus musculus
gttgtactcgagcttatatggtttt

SEQ ID NO: 735099 - DNA, 25 bp, Mus musculus
gttgtactcgaggttatatggtttt

SEQ ID NO: 735100 - DNA, 25 bp, Mus musculus
gttgtactcggactcagctaatgtg

SEQ ID NO: 735101 - DNA, 25 bp, Mus musculus
gttgtactcggagtcagctaatgtg

SEQ ID NO: 735102 - DNA, 25 bp, Mus musculus
gttgtactgaggcaggacatcacag

SEQ ID NO: 735103 - DNA, 25 bp, Mus musculus
gttgtactgagggaggacatcacag

SEQ ID NO: 735104 - DNA, 25 bp, Mus musculus
gttgtactgcgacaagcatgcccgc

SEQ ID NO: 735105 - DNA, 25 bp, Mus musculus
gttgtactgcgagaagcatgcccgc

SEQ ID NO: 735106 - DNA, 25 bp, Mus musculus
gttgtactgctaaggctagccttat

SEQ ID NO: 735107 - DNA, 25 bp, Mus musculus
gttgtactgctaattatattaccga

SEQ ID NO: 735108 - DNA, 25 bp, Mus musculus
gttgtactgctatggctagccttat

SEQ ID NO: 735109 - DNA, 25 bp, Mus musculus
gttgtactgctatttatattaccga

SEQ ID NO: 735110 - DNA, 25 bp, Mus musculus
gttgtactggaccttgggatcctga

SEQ ID NO: 735111 - DNA, 25 bp, Mus musculus
gttgtactggacgttgggatcctga

SEQ ID NO: 735112 - DNA, 25 bp, Mus musculus
gttgtactgtctatacttctgtcag

SEQ ID NO: 735113 - DNA, 25 bp, Mus musculus
gttgtactgtctttacttctgtcag

SEQ ID NO: 735114 - DNA, 25 bp, Mus musculus
gttgtacttaacactaccactccat

SEQ ID NO: 735115 - DNA, 25 bp, Mus musculus
gttgtacttaactctaccactccat

SEQ ID NO: 735116 - DNA, 25 bp, Mus musculus
gttgtacttaatctttactgtctgt

SEQ ID NO: 735117 - DNA, 25 bp, Mus musculus
gttgtacttaatgtttactgtctgt

SEQ ID NO: 735118 - DNA, 25 bp, Mus musculus
gttgtacttactaccacttttcatt

SEQ ID NO: 735119 - DNA, 25 bp, Mus musculus
gttgtacttacttccacttttcatt

SEQ ID NO: 735120 - DNA, 25 bp, Mus musculus
gttgtacttagcaaacggagttatt

SEQ ID NO: 735121 - DNA, 25 bp, Mus musculus
gttgtacttagctaacggagttatt

SEQ ID NO: 735122 - DNA, 25 bp, Mus musculus
gttgtacttgaaatgtgtgcaccat

SEQ ID NO: 735123 - DNA, 25 bp, Mus musculus
gttgtacttgaattgtgtgcaccat

SEQ ID NO: 735124 - DNA, 25 bp, Mus musculus
gttgtacttgttacactaagactgt

SEQ ID NO: 735125 - DNA, 25 bp, Mus musculus
gttgtacttgtttcactaagactgt

SEQ ID NO: 735126 - DNA, 25 bp, Mus musculus
gttgtagaagttcctctgcctggag

SEQ ID NO: 735127 - DNA, 25 bp, Mus musculus
gttgtagaagttgctctgcctggag

SEQ ID NO: 735128 - DNA, 25 bp, Mus musculus
gttgtagaattaacccaccttcata

SEQ ID NO: 735129 - DNA, 25 bp, Mus musculus
gttgtagaattatcccaccttcata

SEQ ID NO: 735130 - DNA, 25 bp, Mus musculus
gttgtagacctcatagtgaatgtta

SEQ ID NO: 735131 - DNA, 25 bp, Mus musculus
gttgtagacctcttagtgaatgtta

SEQ ID NO: 735132 - DNA, 25 bp, Mus musculus
gttgtagagattacagcaagaagca

SEQ ID NO: 735133 - DNA, 25 bp, Mus musculus
gttgtagagatttcagcaagaagca

SEQ ID NO: 735134 - DNA, 25 bp, Mus musculus
gttgtagagtctactctgtgccaaa

SEQ ID NO: 735135 - DNA, 25 bp, Mus musculus
gttgtagagtcttctctgtgccaaa

SEQ ID NO: 735136 - DNA, 25 bp, Mus musculus
gttgtagattgaaactgctccaagg

SEQ ID NO: 735137 - DNA, 25 bp, Mus musculus
gttgtagattgatactgctccaagg

SEQ ID NO: 735138 - DNA, 25 bp, Mus musculus
gttgtagatttaaccattgggcctg

SEQ ID NO: 735139 - DNA, 25 bp, Mus musculus
gttgtagatttatccattgggcctg

SEQ ID NO: 735140 - DNA, 25 bp, Mus musculus
gttgtagatttgacctttgatagtg

SEQ ID NO: 735141 - DNA, 25 bp, Mus musculus
gttgtagatttgtcctttgatagtg

SEQ ID NO: 735142 - DNA, 25 bp, Mus musculus
gttgtagcaaagagcacacctctga

SEQ ID NO: 735143 - DNA, 25 bp, Mus musculus
gttgtagcaaagtgcacacctctga

SEQ ID NO: 735144 - DNA, 25 bp, Mus musculus
gttgtagcaactagtttgtgtccaa

SEQ ID NO: 735145 - DNA, 25 bp, Mus musculus
gttgtagcaacttgtttgtgtccaa

SEQ ID NO: 735146 - DNA, 25 bp, Mus musculus
gttgtagcagtacactccaacccct

SEQ ID NO: 735147 - DNA, 25 bp, Mus musculus
gttgtagcagtagactccaacccct

SEQ ID NO: 735148 - DNA, 25 bp, Mus musculus
gttgtagccatacgtctgtttttta

SEQ ID NO: 735149 - DNA, 25 bp, Mus musculus
gttgtagccataggtctgtttttta

SEQ ID NO: 735150 - DNA, 25 bp, Mus musculus
gttgtagcctttcgctgtagtccca

SEQ ID NO: 735151 - DNA, 25 bp, Mus musculus
gttgtagcctttggctgtagtccca

SEQ ID NO: 735152 - DNA, 25 bp, Mus musculus
gttgtagcggcacccgctccggtca

SEQ ID NO: 735153 - DNA, 25 bp, Mus musculus
gttgtagcggcagccgctccggtca

SEQ ID NO: 735154 - DNA, 25 bp, Mus musculus
gttgtagctaaccaattcttaatca

SEQ ID NO: 735155 - DNA, 25 bp, Mus musculus
gttgtagctaacgaattcttaatca

SEQ ID NO: 735156 - DNA, 25 bp, Mus musculus
gttgtagctactcattttttctggt

SEQ ID NO: 735157 - DNA, 25 bp, Mus musculus
gttgtagctactgattttttctggt

SEQ ID NO: 735158 - DNA, 25 bp, Mus musculus
gttgtagctgacagaaccgctcttg

SEQ ID NO: 735159 - DNA, 25 bp, Mus musculus
gttgtagctgactgaaccgctcttg

SEQ ID NO: 735160 - DNA, 25 bp, Mus musculus
gttgtagcttctcttctacttgaag

SEQ ID NO: 735161 - DNA, 25 bp, Mus musculus
gttgtagcttctgttctacttgaag

SEQ ID NO: 735162 - DNA, 25 bp, Mus musculus
gttgtagcttttattgtcctgttat

SEQ ID NO: 735163 - DNA, 25 bp, Mus musculus
gttgtagctttttttgtcctgttat

SEQ ID NO: 735164 - DNA, 25 bp, Mus musculus
gttgtaggatctcgctgccttttag

SEQ ID NO: 735165 - DNA, 25 bp, Mus musculus
gttgtaggatctggctgccttttag

SEQ ID NO: 735166 - DNA, 25 bp, Mus musculus
gttgtagggaagactagcagctcaa

SEQ ID NO: 735167 - DNA, 25 bp, Mus musculus
gttgtagggaagtctagcagctcaa

SEQ ID NO: 735168 - DNA, 25 bp, Mus musculus
gttgtaggtcctatgtattcagcat

SEQ ID NO: 735169 - DNA, 25 bp, Mus musculus
gttgtaggtcctttgtattcagcat

SEQ ID NO: 735170 - DNA, 25 bp, Mus musculus
gttgtaggttgtattaagtccatat

SEQ ID NO: 735171 - DNA, 25 bp, Mus musculus
gttgtaggttgttttaagtccatat

SEQ ID NO: 735172 - DNA, 25 bp, Mus musculus
gttgtagtcaccatggaacactgca

SEQ ID NO: 735173 - DNA, 25 bp, Mus musculus
gttgtagtcaccttggaacactgca

SEQ ID NO: 735174 - DNA, 25 bp, Mus musculus
gttgtagtccaaactgtaaagccag

SEQ ID NO: 735175 - DNA, 25 bp, Mus musculus
gttgtagtccaatctgtaaagccag

SEQ ID NO: 735176 - DNA, 25 bp, Mus musculus
gttgtagtccacaatattgtcagga

SEQ ID NO: 735177 - DNA, 25 bp, Mus musculus
gttgtagtccactatattgtcagga

SEQ ID NO: 735178 - DNA, 25 bp, Mus musculus
gttgtagtccttcagttgtttgttt

SEQ ID NO: 735179 - DNA, 25 bp, Mus musculus
gttgtagtccttgagttgtttgttt

SEQ ID NO: 735180 - DNA, 25 bp, Mus musculus
gttgtagtggaactttccctccagg

SEQ ID NO: 735181 - DNA, 25 bp, Mus musculus
gttgtagtggaagtttccctccagg

SEQ ID NO: 735182 - DNA, 25 bp, Mus musculus
gttgtagttcctatattaacacctg

SEQ ID NO: 735183 - DNA, 25 bp, Mus musculus
gttgtagttcctttattaacacctg

SEQ ID NO: 735184 - DNA, 25 bp, Mus musculus
gttgtagtttttaattcatgctgaa

SEQ ID NO: 735185 - DNA, 25 bp, Mus musculus
gttgtagttttttattcatgctgaa

SEQ ID NO: 735186 - DNA, 25 bp, Mus musculus
gttgtataagaaccacttatcccaa

SEQ ID NO: 735187 - DNA, 25 bp, Mus musculus
gttgtataagaagcacttatcccaa

SEQ ID NO: 735188 - DNA, 25 bp, Mus musculus
gttgtatacccaaatacgcaccgaa

SEQ ID NO: 735189 - DNA, 25 bp, Mus musculus
gttgtatacccatatacgcaccgaa

SEQ ID NO: 735190 - DNA, 25 bp, Mus musculus
gttgtatacctgaagtcccagcact

SEQ ID NO: 735191 - DNA, 25 bp, Mus musculus
gttgtatacctgtagtcccagcact

SEQ ID NO: 735192 - DNA, 25 bp, Mus musculus
gttgtataccttcaatctgcagtta

SEQ ID NO: 735193 - DNA, 25 bp, Mus musculus
gttgtataccttgaatctgcagtta

SEQ ID NO: 735194 - DNA, 25 bp, Mus musculus
gttgtatactcaatatggttttact

SEQ ID NO: 735195 - DNA, 25 bp, Mus musculus
gttgtatactcattatggttttact

SEQ ID NO: 735196 - DNA, 25 bp, Mus musculus
gttgtatagctaccattgtattgta

SEQ ID NO: 735197 - DNA, 25 bp, Mus musculus
gttgtatagctagcattgtattgta

SEQ ID NO: 735198 - DNA, 25 bp, Mus musculus
gttgtatatctgaacctgaaattct

SEQ ID NO: 735199 - DNA, 25 bp, Mus musculus
gttgtatatctgtacctgaaattct

SEQ ID NO: 735200 - DNA, 25 bp, Mus musculus
gttgtatcacagcttaaaactcatg

SEQ ID NO: 735201 - DNA, 25 bp, Mus musculus
gttgtatcacaggttaaaactcatg

SEQ ID NO: 735202 - DNA, 25 bp, Mus musculus
gttgtatcactacttacctgaagtt

SEQ ID NO: 735203 - DNA, 25 bp, Mus musculus
gttgtatcactagttacctgaagtt

SEQ ID NO: 735204 - DNA, 25 bp, Mus musculus
gttgtatcattccaagacagctccc

SEQ ID NO: 735205 - DNA, 25 bp, Mus musculus
gttgtatcattcgaagacagctccc

SEQ ID NO: 735206 - DNA, 25 bp, Mus musculus
gttgtatccaaaattctctttgtga

SEQ ID NO: 735207 - DNA, 25 bp, Mus musculus
gttgtatccaaatttctctttgtga

SEQ ID NO: 735208 - DNA, 25 bp, Mus musculus
gttgtatccaatattacctcttcct

SEQ ID NO: 735209 - DNA, 25 bp, Mus musculus
gttgtatccaattttacctcttcct

SEQ ID NO: 735210 - DNA, 25 bp, Mus musculus
gttgtatccatgaatctatactgca

SEQ ID NO: 735211 - DNA, 25 bp, Mus musculus
gttgtatccatgtatctatactgca

SEQ ID NO: 735212 - DNA, 25 bp, Mus musculus
gttgtatctacacttcctgttaaca

SEQ ID NO: 735213 - DNA, 25 bp, Mus musculus
gttgtatctacagttcctgttaaca

SEQ ID NO: 735214 - DNA, 25 bp, Mus musculus
gttgtatctataatccacatgtgga

SEQ ID NO: 735215 - DNA, 25 bp, Mus musculus
gttgtatctatattccacatgtgga

SEQ ID NO: 735216 - DNA, 25 bp, Mus musculus
gttgtatctcatagtgagggcctca

SEQ ID NO: 735217 - DNA, 25 bp, Mus musculus
gttgtatctcatatggctgtgcatt

SEQ ID NO: 735218 - DNA, 25 bp, Mus musculus
gttgtatctcattgtgagggcctca

SEQ ID NO: 735219 - DNA, 25 bp, Mus musculus
gttgtatctcatttggctgtgcatt

SEQ ID NO: 735220 - DNA, 25 bp, Mus musculus
gttgtatctctgagggagttgccct

SEQ ID NO: 735221 - DNA, 25 bp, Mus musculus
gttgtatctctgtgggagttgccct

SEQ ID NO: 735222 - DNA, 25 bp, Mus musculus
gttgtatctgagactagccacagta

SEQ ID NO: 735223 - DNA, 25 bp, Mus musculus
gttgtatctgagtctagccacagta

SEQ ID NO: 735224 - DNA, 25 bp, Mus musculus
gttgtatctgcaatcctagtcacag

SEQ ID NO: 735225 - DNA, 25 bp, Mus musculus
gttgtatctgcattcctagtcacag

SEQ ID NO: 735226 - DNA, 25 bp, Mus musculus
gttgtatctggtatattcagccata

SEQ ID NO: 735227 - DNA, 25 bp, Mus musculus
gttgtatctggtttattcagccata

SEQ ID NO: 735228 - DNA, 25 bp, Mus musculus
gttgtatctgtacggcgacatgttt

SEQ ID NO: 735229 - DNA, 25 bp, Mus musculus
gttgtatctgtagggcgacatgttt

SEQ ID NO: 735230 - DNA, 25 bp, Mus musculus
gttgtatctgttacctgttttcatt

SEQ ID NO: 735231 - DNA, 25 bp, Mus musculus
gttgtatctgtttcctgttttcatt

SEQ ID NO: 735232 - DNA, 25 bp, Mus musculus
gttgtatcttttcctggccatgggc

SEQ ID NO: 735233 - DNA, 25 bp, Mus musculus
gttgtatcttttgctggccatgggc

SEQ ID NO: 735234 - DNA, 25 bp, Mus musculus
gttgtatgacaaccagcagtctgtt

SEQ ID NO: 735235 - DNA, 25 bp, Mus musculus
gttgtatgacaagcagcagtctgtt

SEQ ID NO: 735236 - DNA, 25 bp, Mus musculus
gttgtatgatagaccccacactttt

SEQ ID NO: 735237 - DNA, 25 bp, Mus musculus
gttgtatgatagtccccacactttt

SEQ ID NO: 735238 - DNA, 25 bp, Mus musculus
gttgtatgatttaaaacccactaga

SEQ ID NO: 735239 - DNA, 25 bp, Mus musculus
gttgtatgattttaaacccactaga

SEQ ID NO: 735240 - DNA, 25 bp, Mus musculus
gttgtatgcacaagcattcagcagt

SEQ ID NO: 735241 - DNA, 25 bp, Mus musculus
gttgtatgcacatgcattcagcagt

SEQ ID NO: 735242 - DNA, 25 bp, Mus musculus
gttgtatgccaacctgtcctggaaa

SEQ ID NO: 735243 - DNA, 25 bp, Mus musculus
gttgtatgccaagctgtcctggaaa

SEQ ID NO: 735244 - DNA, 25 bp, Mus musculus
gttgtatgtgaacatgggcccctca

SEQ ID NO: 735245 - DNA, 25 bp, Mus musculus
gttgtatgtgaagatgggcccctca

SEQ ID NO: 735246 - DNA, 25 bp, Mus musculus
gttgtatgtgacactgtatccaata

SEQ ID NO: 735247 - DNA, 25 bp, Mus musculus
gttgtatgtgactctgtatccaata

SEQ ID NO: 735248 - DNA, 25 bp, Mus musculus
gttgtattacttaattggcttggaa

SEQ ID NO: 735249 - DNA, 25 bp, Mus musculus
gttgtattactttattggcttggaa

SEQ ID NO: 735250 - DNA, 25 bp, Mus musculus
gttgtattagagacctcctcacagg

SEQ ID NO: 735251 - DNA, 25 bp, Mus musculus
gttgtattagagtcctcctcacagg

SEQ ID NO: 735252 - DNA, 25 bp, Mus musculus
gttgtattagctctttcaatgtgat

SEQ ID NO: 735253 - DNA, 25 bp, Mus musculus
gttgtattagctgtttcaatgtgat

SEQ ID NO: 735254 - DNA, 25 bp, Mus musculus
gttgtattattacacccttgggcac

SEQ ID NO: 735255 - DNA, 25 bp, Mus musculus
gttgtattattagacccttgggcac

SEQ ID NO: 735256 - DNA, 25 bp, Mus musculus
gttgtattattcagggtcttctaga

SEQ ID NO: 735257 - DNA, 25 bp, Mus musculus
gttgtattattctgggtcttctaga

SEQ ID NO: 735258 - DNA, 25 bp, Mus musculus
gttgtattcaagattcactgaccag

SEQ ID NO: 735259 - DNA, 25 bp, Mus musculus
gttgtattcaagtttcactgaccag

SEQ ID NO: 735260 - DNA, 25 bp, Mus musculus
gttgtattcaccataatcccgagag

SEQ ID NO: 735261 - DNA, 25 bp, Mus musculus
gttgtattcaccttaatcccgagag

SEQ ID NO: 735262 - DNA, 25 bp, Mus musculus
gttgtattcagacatgggccttatc

SEQ ID NO: 735263 - DNA, 25 bp, Mus musculus
gttgtattcagagatgggccttatc

SEQ ID NO: 735264 - DNA, 25 bp, Mus musculus
gttgtattcatcatcagcttgactg

SEQ ID NO: 735265 - DNA, 25 bp, Mus musculus
gttgtattcatcttcagcttgactg

SEQ ID NO: 735266 - DNA, 25 bp, Mus musculus
gttgtattcctgcactagtttccct

SEQ ID NO: 735267 - DNA, 25 bp, Mus musculus
gttgtattcctggactagtttccct

SEQ ID NO: 735268 - DNA, 25 bp, Mus musculus
gttgtattctggaaagacacatatg

SEQ ID NO: 735269 - DNA, 25 bp, Mus musculus
gttgtattctggtaagacacatatg

SEQ ID NO: 735270 - DNA, 25 bp, Mus musculus
gttgtattgaagacctatggctttt

SEQ ID NO: 735271 - DNA, 25 bp, Mus musculus
gttgtattgaagtcctatggctttt

SEQ ID NO: 735272 - DNA, 25 bp, Mus musculus
gttgtatttagcacaatctcacctg

SEQ ID NO: 735273 - DNA, 25 bp, Mus musculus
gttgtatttagctcaatctcacctg

SEQ ID NO: 735274 - DNA, 25 bp, Mus musculus
gttgtatttattcagcccatatcct

SEQ ID NO: 735275 - DNA, 25 bp, Mus musculus
gttgtatttattccactattttgca

SEQ ID NO: 735276 - DNA, 25 bp, Mus musculus
gttgtatttattgagcccatatcct

SEQ ID NO: 735277 - DNA, 25 bp, Mus musculus
gttgtatttattgcactattttgca

SEQ ID NO: 735278 - DNA, 25 bp, Mus musculus
gttgtatttcctacatatagtagca

SEQ ID NO: 735279 - DNA, 25 bp, Mus musculus
gttgtatttccttcatatagtagca

SEQ ID NO: 735280 - DNA, 25 bp, Mus musculus
gttgtcaaagaaaacttgccttttt

SEQ ID NO: 735281 - DNA, 25 bp, Mus musculus
gttgtcaaagaatacttgccttttt

SEQ ID NO: 735282 - DNA, 25 bp, Mus musculus
gttgtcaaattcacatgccctcttt

SEQ ID NO: 735283 - DNA, 25 bp, Mus musculus
gttgtcaaattctcatgccctcttt

SEQ ID NO: 735284 - DNA, 25 bp, Mus musculus
gttgtcaaattgaggcctccatgtg

SEQ ID NO: 735285 - DNA, 25 bp, Mus musculus
gttgtcaaattgtggcctccatgtg

SEQ ID NO: 735286 - DNA, 25 bp, Mus musculus
gttgtcaacaacacaaagaatttgt

SEQ ID NO: 735287 - DNA, 25 bp, Mus musculus
gttgtcaacaactcaaagaatttgt

SEQ ID NO: 735288 - DNA, 25 bp, Mus musculus
gttgtcaacacccaaatgagaccca

SEQ ID NO: 735289 - DNA, 25 bp, Mus musculus
gttgtcaacaccgaaatgagaccca

SEQ ID NO: 735290 - DNA, 25 bp, Mus musculus
gttgtcaactgtacatatctatagt

SEQ ID NO: 735291 - DNA, 25 bp, Mus musculus
gttgtcaactgttcatatctatagt

SEQ ID NO: 735292 - DNA, 25 bp, Mus musculus
gttgtcaacttgactgagatccaaa

SEQ ID NO: 735293 - DNA, 25 bp, Mus musculus
gttgtcaacttgtctgagatccaaa

SEQ ID NO: 735294 - DNA, 25 bp, Mus musculus
gttgtcaagaaaatcaaggcctggg

SEQ ID NO: 735295 - DNA, 25 bp, Mus musculus
gttgtcaagaaattcaaggcctggg

SEQ ID NO: 735296 - DNA, 25 bp, Mus musculus
gttgtcaagagcacataccggattg

SEQ ID NO: 735297 - DNA, 25 bp, Mus musculus
gttgtcaagagctcataccggattg

SEQ ID NO: 735298 - DNA, 25 bp, Mus musculus
gttgtcaagtgacatgtgcagcatc

SEQ ID NO: 735299 - DNA, 25 bp, Mus musculus
gttgtcaagtgagatgtgcagcatc

SEQ ID NO: 735300 - DNA, 25 bp, Mus musculus
gttgtcacacacactgcctgaaaat

SEQ ID NO: 735301 - DNA, 25 bp, Mus musculus
gttgtcacacactctgcctgaaaat

SEQ ID NO: 735302 - DNA, 25 bp, Mus musculus
gttgtcacacatactatgttactag

SEQ ID NO: 735303 - DNA, 25 bp, Mus musculus
gttgtcacacattctatgttactag

SEQ ID NO: 735304 - DNA, 25 bp, Mus musculus
gttgtcaccaacacaattccacaag

SEQ ID NO: 735305 - DNA, 25 bp, Mus musculus
gttgtcaccaactcaattccacaag

SEQ ID NO: 735306 - DNA, 25 bp, Mus musculus
gttgtcacccaactgttagtctaca

SEQ ID NO: 735307 - DNA, 25 bp, Mus musculus
gttgtcacccaagtgttagtctaca

SEQ ID NO: 735308 - DNA, 25 bp, Mus musculus
gttgtcacctacagcaaaatgtact

SEQ ID NO: 735309 - DNA, 25 bp, Mus musculus
gttgtcacctactgcaaaatgtact

SEQ ID NO: 735310 - DNA, 25 bp, Mus musculus
gttgtcacctgaaaacctacctgga

SEQ ID NO: 735311 - DNA, 25 bp, Mus musculus
gttgtcacctgataacctacctgga

SEQ ID NO: 735312 - DNA, 25 bp, Mus musculus
gttgtcacgctactcaatgaactga

SEQ ID NO: 735313 - DNA, 25 bp, Mus musculus
gttgtcacgctagtcaatgaactga

SEQ ID NO: 735314 - DNA, 25 bp, Mus musculus
gttgtcacggcaaaagcctttggcc

SEQ ID NO: 735315 - DNA, 25 bp, Mus musculus
gttgtcacggcataagcctttggcc

SEQ ID NO: 735316 - DNA, 25 bp, Mus musculus
gttgtcacggccatattttattttc

SEQ ID NO: 735317 - DNA, 25 bp, Mus musculus
gttgtcacggccttattttattttc

SEQ ID NO: 735318 - DNA, 25 bp, Mus musculus
gttgtcactccgactgagcatttct

SEQ ID NO: 735319 - DNA, 25 bp, Mus musculus
gttgtcactccgtctgagcatttct

SEQ ID NO: 735320 - DNA, 25 bp, Mus musculus
gttgtcactgggacttaactgctga

SEQ ID NO: 735321 - DNA, 25 bp, Mus musculus
gttgtcactgggtcttaactgctga

SEQ ID NO: 735322 - DNA, 25 bp, Mus musculus
gttgtcagcaatacatccttaggga

SEQ ID NO: 735323 - DNA, 25 bp, Mus musculus
gttgtcagcaattcatccttaggga

SEQ ID NO: 735324 - DNA, 25 bp, Mus musculus
gttgtcagcaccattttcttatcat

SEQ ID NO: 735325 - DNA, 25 bp, Mus musculus
gttgtcagcacctttttcttatcat

SEQ ID NO: 735326 - DNA, 25 bp, Mus musculus
gttgtcagccagcaactgttttgtt

SEQ ID NO: 735327 - DNA, 25 bp, Mus musculus
gttgtcagccaggaactgttttgtt

SEQ ID NO: 735328 - DNA, 25 bp, Mus musculus
gttgtcaggcccagccagcaaaggc

SEQ ID NO: 735329 - DNA, 25 bp, Mus musculus
gttgtcaggccctgccagcaaaggc

SEQ ID NO: 735330 - DNA, 25 bp, Mus musculus
gttgtcagtcctaggcaaactgggt

SEQ ID NO: 735331 - DNA, 25 bp, Mus musculus
gttgtcagtccttggcaaactgggt

SEQ ID NO: 735332 - DNA, 25 bp, Mus musculus
gttgtcagtgccctttctaagaaga

SEQ ID NO: 735333 - DNA, 25 bp, Mus musculus
gttgtcagtgccgtttctaagaaga

SEQ ID NO: 735334 - DNA, 25 bp, Mus musculus
gttgtcatatctacacttccttgaa

SEQ ID NO: 735335 - DNA, 25 bp, Mus musculus
gttgtcatatcttcacttccttgaa

SEQ ID NO: 735336 - DNA, 25 bp, Mus musculus
gttgtcatcagaaatctacaggcct

SEQ ID NO: 735337 - DNA, 25 bp, Mus musculus
gttgtcatcagatatctacaggcct

SEQ ID NO: 735338 - DNA, 25 bp, Mus musculus
gttgtcatcatcaaatgcttctgta

SEQ ID NO: 735339 - DNA, 25 bp, Mus musculus
gttgtcatcatctaatgcttctgta

SEQ ID NO: 735340 - DNA, 25 bp, Mus musculus
gttgtcatccaacatcagagagatt

SEQ ID NO: 735341 - DNA, 25 bp, Mus musculus
gttgtcatccaagatcagagagatt

SEQ ID NO: 735342 - DNA, 25 bp, Mus musculus
gttgtcatcgccaggattttgagaa

SEQ ID NO: 735343 - DNA, 25 bp, Mus musculus
gttgtcatcgcctggattttgagaa

SEQ ID NO: 735344 - DNA, 25 bp, Mus musculus
gttgtcatctgtacttatgggcaca

SEQ ID NO: 735345 - DNA, 25 bp, Mus musculus
gttgtcatctgttcttatgggcaca

SEQ ID NO: 735346 - DNA, 25 bp, Mus musculus
gttgtcatcttaactgaaacagaat

SEQ ID NO: 735347 - DNA, 25 bp, Mus musculus
gttgtcatcttatctgaaacagaat

SEQ ID NO: 735348 - DNA, 25 bp, Mus musculus
gttgtcatcttcagtctggagcaga

SEQ ID NO: 735349 - DNA, 25 bp, Mus musculus
gttgtcatcttctgtctggagcaga

SEQ ID NO: 735350 - DNA, 25 bp, Mus musculus
gttgtcatcttgcaggatctaccct

SEQ ID NO: 735351 - DNA, 25 bp, Mus musculus
gttgtcatcttggaggatctaccct

SEQ ID NO: 735352 - DNA, 25 bp, Mus musculus
gttgtcatgtccataactgattctt

SEQ ID NO: 735353 - DNA, 25 bp, Mus musculus
gttgtcatgtccttaactgattctt

SEQ ID NO: 735354 - DNA, 25 bp, Mus musculus
gttgtcattgatacacgctgggcga

SEQ ID NO: 735355 - DNA, 25 bp, Mus musculus
gttgtcattgattcacgctgggcga

SEQ ID NO: 735356 - DNA, 25 bp, Mus musculus
gttgtcattgccatactgtgaccat

SEQ ID NO: 735357 - DNA, 25 bp, Mus musculus
gttgtcattgccatgctaggaattt

SEQ ID NO: 735358 - DNA, 25 bp, Mus musculus
gttgtcattgccttactgtgaccat

SEQ ID NO: 735359 - DNA, 25 bp, Mus musculus
gttgtcattgccttgctaggaattt

SEQ ID NO: 735360 - DNA, 25 bp, Mus musculus
gttgtcattgtcactctttcacatt

SEQ ID NO: 735361 - DNA, 25 bp, Mus musculus
gttgtcattgtctctctttcacatt

SEQ ID NO: 735362 - DNA, 25 bp, Mus musculus
gttgtcattgttccaaatttccaga

SEQ ID NO: 735363 - DNA, 25 bp, Mus musculus
gttgtcattgttgcaaatttccaga

SEQ ID NO: 735364 - DNA, 25 bp, Mus musculus
gttgtcatttacaggtggtgacctt

SEQ ID NO: 735365 - DNA, 25 bp, Mus musculus
gttgtcatttactggtggtgacctt

SEQ ID NO: 735366 - DNA, 25 bp, Mus musculus
gttgtcatttataatcttttgtatt

SEQ ID NO: 735367 - DNA, 25 bp, Mus musculus
gttgtcatttattatcttttgtatt

SEQ ID NO: 735368 - DNA, 25 bp, Mus musculus
gttgtcattttccatgtctcttgat

SEQ ID NO: 735369 - DNA, 25 bp, Mus musculus
gttgtcattttcgatgtctcttgat

SEQ ID NO: 735370 - DNA, 25 bp, Mus musculus
gttgtcattttgaggaactactatt

SEQ ID NO: 735371 - DNA, 25 bp, Mus musculus
gttgtcattttgtggaactactatt

SEQ ID NO: 735372 - DNA, 25 bp, Mus musculus
gttgtccaaacaaatgctggaactg

SEQ ID NO: 735373 - DNA, 25 bp, Mus musculus
gttgtccaaacatatgctggaactg

SEQ ID NO: 735374 - DNA, 25 bp, Mus musculus
gttgtccaagttctttaactccatt

SEQ ID NO: 735375 - DNA, 25 bp, Mus musculus
gttgtccaagttgtttaactccatt

SEQ ID NO: 735376 - DNA, 25 bp, Mus musculus
gttgtccaccatcatacccatatgt

SEQ ID NO: 735377 - DNA, 25 bp, Mus musculus
gttgtccaccatgatacccatatgt

SEQ ID NO: 735378 - DNA, 25 bp, Mus musculus
gttgtccagaacacatctgccacgt

SEQ ID NO: 735379 - DNA, 25 bp, Mus musculus
gttgtccagaactcatctgccacgt

SEQ ID NO: 735380 - DNA, 25 bp, Mus musculus
gttgtccagagaataagctagaaat

SEQ ID NO: 735381 - DNA, 25 bp, Mus musculus
gttgtccagagattaagctagaaat

SEQ ID NO: 735382 - DNA, 25 bp, Mus musculus
gttgtccagccaaaggtaactatag

SEQ ID NO: 735383 - DNA, 25 bp, Mus musculus
gttgtccagccataggtaactatag

SEQ ID NO: 735384 - DNA, 25 bp, Mus musculus
gttgtccaggctcaggaccacggaa

SEQ ID NO: 735385 - DNA, 25 bp, Mus musculus
gttgtccaggctgaggaccacggaa

SEQ ID NO: 735386 - DNA, 25 bp, Mus musculus
gttgtccagggaattgtcccctggt

SEQ ID NO: 735387 - DNA, 25 bp, Mus musculus
gttgtccagggatttgtcccctggt

SEQ ID NO: 735388 - DNA, 25 bp, Mus musculus
gttgtccatcgtaggtatacagcac

SEQ ID NO: 735389 - DNA, 25 bp, Mus musculus
gttgtccatcgttggtatacagcac

SEQ ID NO: 735390 - DNA, 25 bp, Mus musculus
gttgtcccaggaaaagctaatctta

SEQ ID NO: 735391 - DNA, 25 bp, Mus musculus
gttgtcccaggataagctaatctta

SEQ ID NO: 735392 - DNA, 25 bp, Mus musculus
gttgtcccagggactgcagtaccag

SEQ ID NO: 735393 - DNA, 25 bp, Mus musculus
gttgtcccagggtctgcagtaccag

SEQ ID NO: 735394 - DNA, 25 bp, Mus musculus
gttgtcccagttacttggaaaactg

SEQ ID NO: 735395 - DNA, 25 bp, Mus musculus
gttgtcccagtttcttggaaaactg

SEQ ID NO: 735396 - DNA, 25 bp, Mus musculus
gttgtcccataaattaccccaatgt

SEQ ID NO: 735397 - DNA, 25 bp, Mus musculus
gttgtcccataatttaccccaatgt

SEQ ID NO: 735398 - DNA, 25 bp, Mus musculus
gttgtccccacaacagaaacggtgg

SEQ ID NO: 735399 - DNA, 25 bp, Mus musculus
gttgtccccacatcagaaacggtgg

SEQ ID NO: 735400 - DNA, 25 bp, Mus musculus
gttgtccccatgacctgtaaagtat

SEQ ID NO: 735401 - DNA, 25 bp, Mus musculus
gttgtccccatgtcctgtaaagtat

SEQ ID NO: 735402 - DNA, 25 bp, Mus musculus
gttgtccccattcactactttgttc

SEQ ID NO: 735403 - DNA, 25 bp, Mus musculus
gttgtccccattgactactttgttc

SEQ ID NO: 735404 - DNA, 25 bp, Mus musculus
gttgtcccgacgagtgtctccgccg

SEQ ID NO: 735405 - DNA, 25 bp, Mus musculus
gttgtcccgacgtgtgtctccgccg

SEQ ID NO: 735406 - DNA, 25 bp, Mus musculus
gttgtccctgagatggctgaactct

SEQ ID NO: 735407 - DNA, 25 bp, Mus musculus
gttgtccctgagttggctgaactct

SEQ ID NO: 735408 - DNA, 25 bp, Mus musculus
gttgtccctgggaaaacagcagcac

SEQ ID NO: 735409 - DNA, 25 bp, Mus musculus
gttgtccctgggtaaacagcagcac

SEQ ID NO: 735410 - DNA, 25 bp, Mus musculus
gttgtccctgtgacttagtccagag

SEQ ID NO: 735411 - DNA, 25 bp, Mus musculus
gttgtccctgtgtcttagtccagag

SEQ ID NO: 735412 - DNA, 25 bp, Mus musculus
gttgtcccttctcgaatcaattcat

SEQ ID NO: 735413 - DNA, 25 bp, Mus musculus
gttgtcccttctggaatcaattcat

SEQ ID NO: 735414 - DNA, 25 bp, Mus musculus
gttgtcccttgacgctccttagcat

SEQ ID NO: 735415 - DNA, 25 bp, Mus musculus
gttgtcccttgaggctccttagcat

SEQ ID NO: 735416 - DNA, 25 bp, Mus musculus
gttgtccgccatacagaaggctcag

SEQ ID NO: 735417 - DNA, 25 bp, Mus musculus
gttgtccgccattcagaaggctcag

SEQ ID NO: 735418 - DNA, 25 bp, Mus musculus
gttgtccgtcacagatacactggta

SEQ ID NO: 735419 - DNA, 25 bp, Mus musculus
gttgtccgtcactgatacactggta

SEQ ID NO: 735420 - DNA, 25 bp, Mus musculus
gttgtcctacagctaacaccagttt

SEQ ID NO: 735421 - DNA, 25 bp, Mus musculus
gttgtcctacaggtaacaccagttt

SEQ ID NO: 735422 - DNA, 25 bp, Mus musculus
gttgtcctatgtccctgtaatctca

SEQ ID NO: 735423 - DNA, 25 bp, Mus musculus
gttgtcctatgtgcctgtaatctca

SEQ ID NO: 735424 - DNA, 25 bp, Mus musculus
gttgtcctcacacgccgtgtggtac

SEQ ID NO: 735425 - DNA, 25 bp, Mus musculus
gttgtcctcacaggccgtgtggtac

SEQ ID NO: 735426 - DNA, 25 bp, Mus musculus
gttgtcctccaaaaatagaattgtc

SEQ ID NO: 735427 - DNA, 25 bp, Mus musculus
gttgtcctccaataatagaattgtc

SEQ ID NO: 735428 - DNA, 25 bp, Mus musculus
gttgtcctccagaaagggtttcttg

SEQ ID NO: 735429 - DNA, 25 bp, Mus musculus
gttgtcctccagtaagggtttcttg

SEQ ID NO: 735430 - DNA, 25 bp, Mus musculus
gttgtcctccatcctctagaaggaa

SEQ ID NO: 735431 - DNA, 25 bp, Mus musculus
gttgtcctccatgctctagaaggaa

SEQ ID NO: 735432 - DNA, 25 bp, Mus musculus
gttgtcctcgtgctctgtgctttca

SEQ ID NO: 735433 - DNA, 25 bp, Mus musculus
gttgtcctcgtggtctgtgctttca

SEQ ID NO: 735434 - DNA, 25 bp, Mus musculus
gttgtcctgagtaaggcgcgtttat

SEQ ID NO: 735435 - DNA, 25 bp, Mus musculus
gttgtcctgagttaggcgcgtttat

SEQ ID NO: 735436 - DNA, 25 bp, Mus musculus
gttgtcctgccccactaagaggagc

SEQ ID NO: 735437 - DNA, 25 bp, Mus musculus
gttgtcctgcccgactaagaggagc

SEQ ID NO: 735438 - DNA, 25 bp, Mus musculus
gttgtcctgcttatctatagcacta

SEQ ID NO: 735439 - DNA, 25 bp, Mus musculus
gttgtcctgcttttctatagcacta

SEQ ID NO: 735440 - DNA, 25 bp, Mus musculus
gttgtcctggtgagccctcagactg

SEQ ID NO: 735441 - DNA, 25 bp, Mus musculus
gttgtcctggtgtgccctcagactg

SEQ ID NO: 735442 - DNA, 25 bp, Mus musculus
gttgtcctgttcctcgaattccagc

SEQ ID NO: 735443 - DNA, 25 bp, Mus musculus
gttgtcctgttcgtcgaattccagc

SEQ ID NO: 735444 - DNA, 25 bp, Mus musculus
gttgtccttcagacttagcttcatt

SEQ ID NO: 735445 - DNA, 25 bp, Mus musculus
gttgtccttcagactttacactgta

SEQ ID NO: 735446 - DNA, 25 bp, Mus musculus
gttgtccttcagtcttagcttcatt

SEQ ID NO: 735447 - DNA, 25 bp, Mus musculus
gttgtccttcagtctttacactgta

SEQ ID NO: 735448 - DNA, 25 bp, Mus musculus
gttgtccttcatctgtaccgaagta

SEQ ID NO: 735449 - DNA, 25 bp, Mus musculus
gttgtccttcatgtgtaccgaagta

SEQ ID NO: 735450 - DNA, 25 bp, Mus musculus
gttgtccttgagactggcagtgtgc

SEQ ID NO: 735451 - DNA, 25 bp, Mus musculus
gttgtccttgagtctggcagtgtgc

SEQ ID NO: 735452 - DNA, 25 bp, Mus musculus
gttgtccttggtactagtaacttca

SEQ ID NO: 735453 - DNA, 25 bp, Mus musculus
gttgtccttggttctagtaacttca

SEQ ID NO: 735454 - DNA, 25 bp, Mus musculus
gttgtccttgttcatgtccatgaaa

SEQ ID NO: 735455 - DNA, 25 bp, Mus musculus
gttgtccttgttgatgtccatgaaa

SEQ ID NO: 735456 - DNA, 25 bp, Mus musculus
gttgtcctttagaaatgttgccatg

SEQ ID NO: 735457 - DNA, 25 bp, Mus musculus
gttgtcctttagtaatgttgccatg

SEQ ID NO: 735458 - DNA, 25 bp, Mus musculus
gttgtcctttataaccatctaagta

SEQ ID NO: 735459 - DNA, 25 bp, Mus musculus
gttgtcctttattaccatctaagta

SEQ ID NO: 735460 - DNA, 25 bp, Mus musculus
gttgtccttttcatcatgcttccaa

SEQ ID NO: 735461 - DNA, 25 bp, Mus musculus
gttgtccttttcttcatgcttccaa

SEQ ID NO: 735462 - DNA, 25 bp, Mus musculus
gttgtcgaccagactgctaagtaga

SEQ ID NO: 735463 - DNA, 25 bp, Mus musculus
gttgtcgaccagtctgctaagtaga

SEQ ID NO: 735464 - DNA, 25 bp, Mus musculus
gttgtcgcacagcaaaatccacaag

SEQ ID NO: 735465 - DNA, 25 bp, Mus musculus
gttgtcgcacaggaaaatccacaag

SEQ ID NO: 735466 - DNA, 25 bp, Mus musculus
gttgtcggtgccacattgtggttca

SEQ ID NO: 735467 - DNA, 25 bp, Mus musculus
gttgtcggtgcctcattgtggttca

SEQ ID NO: 735468 - DNA, 25 bp, Mus musculus
gttgtcgtctttaggagtatagcat

SEQ ID NO: 735469 - DNA, 25 bp, Mus musculus
gttgtcgtcttttggagtatagcat

SEQ ID NO: 735470 - DNA, 25 bp, Mus musculus
gttgtcgtggttatggtgtttcttc

SEQ ID NO: 735471 - DNA, 25 bp, Mus musculus
gttgtcgtggttttggtgtttcttc

SEQ ID NO: 735472 - DNA, 25 bp, Mus musculus
gttgtcgttttcatatggtcacctg

SEQ ID NO: 735473 - DNA, 25 bp, Mus musculus
gttgtcgttttcttatggtcacctg

SEQ ID NO: 735474 - DNA, 25 bp, Mus musculus
gttgtctaaaacaacctgatctcat

SEQ ID NO: 735475 - DNA, 25 bp, Mus musculus
gttgtctaaaactacctgatctcat

SEQ ID NO: 735476 - DNA, 25 bp, Mus musculus
gttgtctaactcctaaagtactttg

SEQ ID NO: 735477 - DNA, 25 bp, Mus musculus
gttgtctaactcgtaaagtactttg

SEQ ID NO: 735478 - DNA, 25 bp, Mus musculus
gttgtctaccctacaaggcagagtg

SEQ ID NO: 735479 - DNA, 25 bp, Mus musculus
gttgtctacccttcaaggcagagtg

SEQ ID NO: 735480 - DNA, 25 bp, Mus musculus
gttgtctacttgatgaattatctag

SEQ ID NO: 735481 - DNA, 25 bp, Mus musculus
gttgtctacttgttgaattatctag

SEQ ID NO: 735482 - DNA, 25 bp, Mus musculus
gttgtctagagcatcttggtctcca

SEQ ID NO: 735483 - DNA, 25 bp, Mus musculus
gttgtctagagcttcttggtctcca

SEQ ID NO: 735484 - DNA, 25 bp, Mus musculus
gttgtctatacaataccttcgagga

SEQ ID NO: 735485 - DNA, 25 bp, Mus musculus
gttgtctatacattaccttcgagga

SEQ ID NO: 735486 - DNA, 25 bp, Mus musculus
gttgtctatcatcctttcttgttaa

SEQ ID NO: 735487 - DNA, 25 bp, Mus musculus
gttgtctatcatgctttcttgttaa

SEQ ID NO: 735488 - DNA, 25 bp, Mus musculus
gttgtctatgatctgactctccagc

SEQ ID NO: 735489 - DNA, 25 bp, Mus musculus
gttgtctatgatgtgactctccagc

SEQ ID NO: 735490 - DNA, 25 bp, Mus musculus
gttgtctcagctcactgacctggga

SEQ ID NO: 735491 - DNA, 25 bp, Mus musculus
gttgtctcagctgactgacctggga

SEQ ID NO: 735492 - DNA, 25 bp, Mus musculus
gttgtctcatttactcaaccagaga

SEQ ID NO: 735493 - DNA, 25 bp, Mus musculus
gttgtctcattttctcaaccagaga

SEQ ID NO: 735494 - DNA, 25 bp, Mus musculus
gttgtctccattcatgaagtaacca

SEQ ID NO: 735495 - DNA, 25 bp, Mus musculus
gttgtctccattctctgtcattcat

SEQ ID NO: 735496 - DNA, 25 bp, Mus musculus
gttgtctccattgatgaagtaacca

SEQ ID NO: 735497 - DNA, 25 bp, Mus musculus
gttgtctccattgtctgtcattcat

SEQ ID NO: 735498 - DNA, 25 bp, Mus musculus
gttgtctcccagaacacatgtctga

SEQ ID NO: 735499 - DNA, 25 bp, Mus musculus
gttgtctcccagactgagaaagaac

SEQ ID NO: 735500 - DNA, 25 bp, Mus musculus
gttgtctcccagtacacatgtctga

SEQ ID NO: 735501 - DNA, 25 bp, Mus musculus
gttgtctcccagtctgagaaagaac

SEQ ID NO: 735502 - DNA, 25 bp, Mus musculus
gttgtctccggcagtaaggttgaat

SEQ ID NO: 735503 - DNA, 25 bp, Mus musculus
gttgtctccggctgtaaggttgaat

SEQ ID NO: 735504 - DNA, 25 bp, Mus musculus
gttgtctcctgccacttcaacagca

SEQ ID NO: 735505 - DNA, 25 bp, Mus musculus
gttgtctcctgcgacttcaacagca

SEQ ID NO: 735506 - DNA, 25 bp, Mus musculus
gttgtctctcatagatgtcacgcta

SEQ ID NO: 735507 - DNA, 25 bp, Mus musculus
gttgtctctcattgatgtcacgcta

SEQ ID NO: 735508 - DNA, 25 bp, Mus musculus
gttgtctctccaccctagaggatga

SEQ ID NO: 735509 - DNA, 25 bp, Mus musculus
gttgtctctccagcctagaggatga

SEQ ID NO: 735510 - DNA, 25 bp, Mus musculus
gttgtctctgagattgtcgctcatg

SEQ ID NO: 735511 - DNA, 25 bp, Mus musculus
gttgtctctgagtttgtcgctcatg

SEQ ID NO: 735512 - DNA, 25 bp, Mus musculus
gttgtctctgctaaacactgaaatc

SEQ ID NO: 735513 - DNA, 25 bp, Mus musculus
gttgtctctgctaaaggaatgatgt

SEQ ID NO: 735514 - DNA, 25 bp, Mus musculus
gttgtctctgcttaacactgaaatc

SEQ ID NO: 735515 - DNA, 25 bp, Mus musculus
gttgtctctgcttaaggaatgatgt

SEQ ID NO: 735516 - DNA, 25 bp, Mus musculus
gttgtctctttcaaggatgtgggtc

SEQ ID NO: 735517 - DNA, 25 bp, Mus musculus
gttgtctctttctaggatgtgggtc

SEQ ID NO: 735518 - DNA, 25 bp, Mus musculus
gttgtctgaagactctacctgaggc

SEQ ID NO: 735519 - DNA, 25 bp, Mus musculus
gttgtctgaagagtctacctgaggc

SEQ ID NO: 735520 - DNA, 25 bp, Mus musculus
gttgtctgaccgacagtctaaccag

SEQ ID NO: 735521 - DNA, 25 bp, Mus musculus
gttgtctgaccgtcagtctaaccag

SEQ ID NO: 735522 - DNA, 25 bp, Mus musculus
gttgtctgactgagaactgctaaca

SEQ ID NO: 735523 - DNA, 25 bp, Mus musculus
gttgtctgactgtgaactgctaaca

SEQ ID NO: 735524 - DNA, 25 bp, Mus musculus
gttgtctgagaaatctttcctctta

SEQ ID NO: 735525 - DNA, 25 bp, Mus musculus
gttgtctgagaattctttcctctta

SEQ ID NO: 735526 - DNA, 25 bp, Mus musculus
gttgtctgagttcaaacagctcaag

SEQ ID NO: 735527 - DNA, 25 bp, Mus musculus
gttgtctgagttgaaacagctcaag

SEQ ID NO: 735528 - DNA, 25 bp, Mus musculus
gttgtctgcacaccctgctgggagc

SEQ ID NO: 735529 - DNA, 25 bp, Mus musculus
gttgtctgcacagcctgctgggagc

SEQ ID NO: 735530 - DNA, 25 bp, Mus musculus
gttgtctgcaggaatgtaacttctc

SEQ ID NO: 735531 - DNA, 25 bp, Mus musculus
gttgtctgcaggtatgtaacttctc

SEQ ID NO: 735532 - DNA, 25 bp, Mus musculus
gttgtctgctctagttgacatgtgt

SEQ ID NO: 735533 - DNA, 25 bp, Mus musculus
gttgtctgctcttgttgacatgtgt

SEQ ID NO: 735534 - DNA, 25 bp, Mus musculus
gttgtctgctgtaaccagctttgtg

SEQ ID NO: 735535 - DNA, 25 bp, Mus musculus
gttgtctgctgttaccagctttgtg

SEQ ID NO: 735536 - DNA, 25 bp, Mus musculus
gttgtctgcttaacattcaatggga

SEQ ID NO: 735537 - DNA, 25 bp, Mus musculus
gttgtctgcttatcattcaatggga

SEQ ID NO: 735538 - DNA, 25 bp, Mus musculus
gttgtctgtctccttttttgcaaag

SEQ ID NO: 735539 - DNA, 25 bp, Mus musculus
gttgtctgtctcgttttttgcaaag

SEQ ID NO: 735540 - DNA, 25 bp, Mus musculus
gttgtctgtcttaatagcctctgtt

SEQ ID NO: 735541 - DNA, 25 bp, Mus musculus
gttgtctgtctttatagcctctgtt

SEQ ID NO: 735542 - DNA, 25 bp, Mus musculus
gttgtctgtggtaagtcacgctaaa

SEQ ID NO: 735543 - DNA, 25 bp, Mus musculus
gttgtctgtggttagtcacgctaaa

SEQ ID NO: 735544 - DNA, 25 bp, Mus musculus
gttgtctgtgtaatcatccagccat

SEQ ID NO: 735545 - DNA, 25 bp, Mus musculus
gttgtctgtgtattcatccagccat

SEQ ID NO: 735546 - DNA, 25 bp, Mus musculus
gttgtctgtgtcagcaggacctcag

SEQ ID NO: 735547 - DNA, 25 bp, Mus musculus
gttgtctgtgtctgcaggacctcag

SEQ ID NO: 735548 - DNA, 25 bp, Mus musculus
gttgtctgttaactactctcagcca

SEQ ID NO: 735549 - DNA, 25 bp, Mus musculus
gttgtctgttaagtactctcagcca

SEQ ID NO: 735550 - DNA, 25 bp, Mus musculus
gttgtcttaaacaactgcctaggtt

SEQ ID NO: 735551 - DNA, 25 bp, Mus musculus
gttgtcttaaactactgcctaggtt

SEQ ID NO: 735552 - DNA, 25 bp, Mus musculus
gttgtcttaactatcagcagtgtca

SEQ ID NO: 735553 - DNA, 25 bp, Mus musculus
gttgtcttaactttcagcagtgtca

SEQ ID NO: 735554 - DNA, 25 bp, Mus musculus
gttgtcttattacttattcctgtgt

SEQ ID NO: 735555 - DNA, 25 bp, Mus musculus
gttgtcttattagttattcctgtgt

SEQ ID NO: 735556 - DNA, 25 bp, Mus musculus
gttgtcttcatgcttccacatgcat

SEQ ID NO: 735557 - DNA, 25 bp, Mus musculus
gttgtcttcatggttccacatgcat

SEQ ID NO: 735558 - DNA, 25 bp, Mus musculus
gttgtcttctcgagattagagctca

SEQ ID NO: 735559 - DNA, 25 bp, Mus musculus
gttgtcttctcgtgattagagctca

SEQ ID NO: 735560 - DNA, 25 bp, Mus musculus
gttgtcttctctattcgttacttca

SEQ ID NO: 735561 - DNA, 25 bp, Mus musculus
gttgtcttctctcctaacctaggaa

SEQ ID NO: 735562 - DNA, 25 bp, Mus musculus
gttgtcttctctgctaacctaggaa

SEQ ID NO: 735563 - DNA, 25 bp, Mus musculus
gttgtcttctcttttcgttacttca

SEQ ID NO: 735564 - DNA, 25 bp, Mus musculus
gttgtcttcttcatgcttcgaaata

SEQ ID NO: 735565 - DNA, 25 bp, Mus musculus
gttgtcttcttcttgcttcgaaata

SEQ ID NO: 735566 - DNA, 25 bp, Mus musculus
gttgtcttcttgatatgacgtggct

SEQ ID NO: 735567 - DNA, 25 bp, Mus musculus
gttgtcttcttgttatgacgtggct

SEQ ID NO: 735568 - DNA, 25 bp, Mus musculus
gttgtcttggctacacatctgtgtg

SEQ ID NO: 735569 - DNA, 25 bp, Mus musculus
gttgtcttggctctttgtccttagc

SEQ ID NO: 735570 - DNA, 25 bp, Mus musculus
gttgtcttggctgtttgtccttagc

SEQ ID NO: 735571 - DNA, 25 bp, Mus musculus
gttgtcttggcttcacatctgtgtg

SEQ ID NO: 735572 - DNA, 25 bp, Mus musculus
gttgtcttggtacccaggtgactga

SEQ ID NO: 735573 - DNA, 25 bp, Mus musculus
gttgtcttggtagccaggtgactga

SEQ ID NO: 735574 - DNA, 25 bp, Mus musculus
gttgtcttggttatgtgcctcaaag

SEQ ID NO: 735575 - DNA, 25 bp, Mus musculus
gttgtcttggttttgtgcctcaaag

SEQ ID NO: 735576 - DNA, 25 bp, Mus musculus
gttgtcttgtttctaatttctccca

SEQ ID NO: 735577 - DNA, 25 bp, Mus musculus
gttgtcttgtttgtaatttctccca

SEQ ID NO: 735578 - DNA, 25 bp, Mus musculus
gttgtctttactctacttgttttag

SEQ ID NO: 735579 - DNA, 25 bp, Mus musculus
gttgtctttactgtacttgttttag

SEQ ID NO: 735580 - DNA, 25 bp, Mus musculus
gttgtctttattctaatatccatca

SEQ ID NO: 735581 - DNA, 25 bp, Mus musculus
gttgtctttattgtaatatccatca

SEQ ID NO: 735582 - DNA, 25 bp, Mus musculus
gttgtctttcagagataccctcttc

SEQ ID NO: 735583 - DNA, 25 bp, Mus musculus
gttgtctttcagtgataccctcttc

SEQ ID NO: 735584 - DNA, 25 bp, Mus musculus
gttgtctttcccctattcagtagta

SEQ ID NO: 735585 - DNA, 25 bp, Mus musculus
gttgtctttcccgtattcagtagta

SEQ ID NO: 735586 - DNA, 25 bp, Mus musculus
gttgtctttggtatgaggttgctct

SEQ ID NO: 735587 - DNA, 25 bp, Mus musculus
gttgtctttggtccttagtttgttt

SEQ ID NO: 735588 - DNA, 25 bp, Mus musculus
gttgtctttggtgcttagtttgttt

SEQ ID NO: 735589 - DNA, 25 bp, Mus musculus
gttgtctttggtttgaggttgctct

SEQ ID NO: 735590 - DNA, 25 bp, Mus musculus
gttgtgaaagtcaaacctgccaccc

SEQ ID NO: 735591 - DNA, 25 bp, Mus musculus
gttgtgaaagtctaacctgccaccc

SEQ ID NO: 735592 - DNA, 25 bp, Mus musculus
gttgtgaacatcctccacactatga

SEQ ID NO: 735593 - DNA, 25 bp, Mus musculus
gttgtgaacatcgtccacactatga

SEQ ID NO: 735594 - DNA, 25 bp, Mus musculus
gttgtgaactctcagccctaaagct

SEQ ID NO: 735595 - DNA, 25 bp, Mus musculus
gttgtgaactctgagccctaaagct

SEQ ID NO: 735596 - DNA, 25 bp, Mus musculus
gttgtgaaggtcaattcctggctgc

SEQ ID NO: 735597 - DNA, 25 bp, Mus musculus
gttgtgaaggtctattcctggctgc

SEQ ID NO: 735598 - DNA, 25 bp, Mus musculus
gttgtgaattctcagactatcgtag

SEQ ID NO: 735599 - DNA, 25 bp, Mus musculus
gttgtgaattctgagactatcgtag

SEQ ID NO: 735600 - DNA, 25 bp, Mus musculus
gttgtgacaagcatcggcgagtcta

SEQ ID NO: 735601 - DNA, 25 bp, Mus musculus
gttgtgacaagcttcggcgagtcta

SEQ ID NO: 735602 - DNA, 25 bp, Mus musculus
gttgtgacacacagtatagcctcag

SEQ ID NO: 735603 - DNA, 25 bp, Mus musculus
gttgtgacacactgtatagcctcag

SEQ ID NO: 735604 - DNA, 25 bp, Mus musculus
gttgtgaccacaataaagtaccatt

SEQ ID NO: 735605 - DNA, 25 bp, Mus musculus
gttgtgaccacattaaagtaccatt

SEQ ID NO: 735606 - DNA, 25 bp, Mus musculus
gttgtgacccagatgataacttttc

SEQ ID NO: 735607 - DNA, 25 bp, Mus musculus
gttgtgacccagttgataacttttc

SEQ ID NO: 735608 - DNA, 25 bp, Mus musculus
gttgtgaccttcagacaagcactgg

SEQ ID NO: 735609 - DNA, 25 bp, Mus musculus
gttgtgaccttctgacaagcactgg

SEQ ID NO: 735610 - DNA, 25 bp, Mus musculus
gttgtgacgtctacgagatctttac

SEQ ID NO: 735611 - DNA, 25 bp, Mus musculus
gttgtgacgtcttcgagatctttac

SEQ ID NO: 735612 - DNA, 25 bp, Mus musculus
gttgtgacttgtcggcgctttcaaa

SEQ ID NO: 735613 - DNA, 25 bp, Mus musculus
gttgtgacttgtgggcgctttcaaa

SEQ ID NO: 735614 - DNA, 25 bp, Mus musculus
gttgtgactttacataatgctggtt

SEQ ID NO: 735615 - DNA, 25 bp, Mus musculus
gttgtgactttagataatgctggtt

SEQ ID NO: 735616 - DNA, 25 bp, Mus musculus
gttgtgactttgagtgccgatccaa

SEQ ID NO: 735617 - DNA, 25 bp, Mus musculus
gttgtgactttgtgtgccgatccaa

SEQ ID NO: 735618 - DNA, 25 bp, Mus musculus
gttgtgagaaatattcaccttgcat

SEQ ID NO: 735619 - DNA, 25 bp, Mus musculus
gttgtgagaaattttcaccttgcat

SEQ ID NO: 735620 - DNA, 25 bp, Mus musculus
gttgtgagacaacctacctttcaga

SEQ ID NO: 735621 - DNA, 25 bp, Mus musculus
gttgtgagacaagctacctttcaga

SEQ ID NO: 735622 - DNA, 25 bp, Mus musculus
gttgtgagccaacctcaattgtgct

SEQ ID NO: 735623 - DNA, 25 bp, Mus musculus
gttgtgagccaagctcaattgtgct

SEQ ID NO: 735624 - DNA, 25 bp, Mus musculus
gttgtgagcttgatctttaactttt

SEQ ID NO: 735625 - DNA, 25 bp, Mus musculus
gttgtgagcttgttctttaactttt

SEQ ID NO: 735626 - DNA, 25 bp, Mus musculus
gttgtgagtaccactgctctgggac

SEQ ID NO: 735627 - DNA, 25 bp, Mus musculus
gttgtgagtacctctgctctgggac

SEQ ID NO: 735628 - DNA, 25 bp, Mus musculus
gttgtgagtcttcctagatgtcatt

SEQ ID NO: 735629 - DNA, 25 bp, Mus musculus
gttgtgagtcttgctagatgtcatt

SEQ ID NO: 735630 - DNA, 25 bp, Mus musculus
gttgtgagtgtaattttccctgcct

SEQ ID NO: 735631 - DNA, 25 bp, Mus musculus
gttgtgagtgtatttttccctgcct

SEQ ID NO: 735632 - DNA, 25 bp, Mus musculus
gttgtgataaacagtgccattccta

SEQ ID NO: 735633 - DNA, 25 bp, Mus musculus
gttgtgataaactgtgccattccta

SEQ ID NO: 735634 - DNA, 25 bp, Mus musculus
gttgtgatatatcttcttgttaaat

SEQ ID NO: 735635 - DNA, 25 bp, Mus musculus
gttgtgatatatgttcttgttaaat

SEQ ID NO: 735636 - DNA, 25 bp, Mus musculus
gttgtgatcactacagccaaggtta

SEQ ID NO: 735637 - DNA, 25 bp, Mus musculus
gttgtgatcacttcagccaaggtta

SEQ ID NO: 735638 - DNA, 25 bp, Mus musculus
gttgtgatccacagaacacatagtt

SEQ ID NO: 735639 - DNA, 25 bp, Mus musculus
gttgtgatccacagtaggaatctgg

SEQ ID NO: 735640 - DNA, 25 bp, Mus musculus
gttgtgatccaccagcctaagatta

SEQ ID NO: 735641 - DNA, 25 bp, Mus musculus
gttgtgatccacgagcctaagatta

SEQ ID NO: 735642 - DNA, 25 bp, Mus musculus
gttgtgatccactgaacacatagtt

SEQ ID NO: 735643 - DNA, 25 bp, Mus musculus
gttgtgatccactgtaggaatctgg

SEQ ID NO: 735644 - DNA, 25 bp, Mus musculus
gttgtgatgcccatttgtgtagtta

SEQ ID NO: 735645 - DNA, 25 bp, Mus musculus
gttgtgatgcccttttgtgtagtta

SEQ ID NO: 735646 - DNA, 25 bp, Mus musculus
gttgtgatgtccagtgtttgggatc

SEQ ID NO: 735647 - DNA, 25 bp, Mus musculus
gttgtgatgtcctgtgtttgggatc

SEQ ID NO: 735648 - DNA, 25 bp, Mus musculus
gttgtgatgttgatctatatgtctg

SEQ ID NO: 735649 - DNA, 25 bp, Mus musculus
gttgtgatgttgttctatatgtctg

SEQ ID NO: 735650 - DNA, 25 bp, Mus musculus
gttgtgattaccacaggcactggaa

SEQ ID NO: 735651 - DNA, 25 bp, Mus musculus
gttgtgattacctcaggcactggaa

SEQ ID NO: 735652 - DNA, 25 bp, Mus musculus
gttgtgattctcaaactgcgttgta

SEQ ID NO: 735653 - DNA, 25 bp, Mus musculus
gttgtgattctctaactgcgttgta

SEQ ID NO: 735654 - DNA, 25 bp, Mus musculus
gttgtgattcttacccatgttaaaa

SEQ ID NO: 735655 - DNA, 25 bp, Mus musculus
gttgtgattctttcccatgttaaaa

SEQ ID NO: 735656 - DNA, 25 bp, Mus musculus
gttgtgatttgactgcatgctttag

SEQ ID NO: 735657 - DNA, 25 bp, Mus musculus
gttgtgatttgagtgcatgctttag

SEQ ID NO: 735658 - DNA, 25 bp, Mus musculus
gttgtgcaacaaatcatggagatag

SEQ ID NO: 735659 - DNA, 25 bp, Mus musculus
gttgtgcaacaattcatggagatag

SEQ ID NO: 735660 - DNA, 25 bp, Mus musculus
gttgtgcaccaaactgtggctggac

SEQ ID NO: 735661 - DNA, 25 bp, Mus musculus
gttgtgcaccaatctgtggctggac

SEQ ID NO: 735662 - DNA, 25 bp, Mus musculus
gttgtgcacccaaattacattaaaa

SEQ ID NO: 735663 - DNA, 25 bp, Mus musculus
gttgtgcacccatattacattaaaa

SEQ ID NO: 735664 - DNA, 25 bp, Mus musculus
gttgtgcagcaactattcattttct

SEQ ID NO: 735665 - DNA, 25 bp, Mus musculus
gttgtgcagcaagtattcattttct

SEQ ID NO: 735666 - DNA, 25 bp, Mus musculus
gttgtgcagcttaggacctgagagc

SEQ ID NO: 735667 - DNA, 25 bp, Mus musculus
gttgtgcagctttggacctgagagc

SEQ ID NO: 735668 - DNA, 25 bp, Mus musculus
gttgtgcatcatataaaacattttg

SEQ ID NO: 735669 - DNA, 25 bp, Mus musculus
gttgtgcatcatttaaaacattttg

SEQ ID NO: 735670 - DNA, 25 bp, Mus musculus
gttgtgcatgtgcaagctacaggtt

SEQ ID NO: 735671 - DNA, 25 bp, Mus musculus
gttgtgcatgtggaagctacaggtt

SEQ ID NO: 735672 - DNA, 25 bp, Mus musculus
gttgtgcattcaagggatggtcagt

SEQ ID NO: 735673 - DNA, 25 bp, Mus musculus
gttgtgcattcaatgatacccggga

SEQ ID NO: 735674 - DNA, 25 bp, Mus musculus
gttgtgcattcatgggatggtcagt

SEQ ID NO: 735675 - DNA, 25 bp, Mus musculus
gttgtgcattcattgatacccggga

SEQ ID NO: 735676 - DNA, 25 bp, Mus musculus
gttgtgccacttctaacttatttta

SEQ ID NO: 735677 - DNA, 25 bp, Mus musculus
gttgtgccacttgtaacttatttta

SEQ ID NO: 735678 - DNA, 25 bp, Mus musculus
gttgtgccaggtcattttggctttt

SEQ ID NO: 735679 - DNA, 25 bp, Mus musculus
gttgtgccaggtgattttggctttt

SEQ ID NO: 735680 - DNA, 25 bp, Mus musculus
gttgtgcctaaaagctactgctctg

SEQ ID NO: 735681 - DNA, 25 bp, Mus musculus
gttgtgcctaaatgctactgctctg

SEQ ID NO: 735682 - DNA, 25 bp, Mus musculus
gttgtgcctatcatattacagggac

SEQ ID NO: 735683 - DNA, 25 bp, Mus musculus
gttgtgcctatcttattacagggac

SEQ ID NO: 735684 - DNA, 25 bp, Mus musculus
gttgtgcctcccacaatcatcatgt

SEQ ID NO: 735685 - DNA, 25 bp, Mus musculus
gttgtgcctccctcaatcatcatgt

SEQ ID NO: 735686 - DNA, 25 bp, Mus musculus
gttgtgcctggcactgctctggatc

SEQ ID NO: 735687 - DNA, 25 bp, Mus musculus
gttgtgcctggctctgctctggatc

SEQ ID NO: 735688 - DNA, 25 bp, Mus musculus
gttgtgctacgaacaccattttgag

SEQ ID NO: 735689 - DNA, 25 bp, Mus musculus
gttgtgctacgatcaccattttgag

SEQ ID NO: 735690 - DNA, 25 bp, Mus musculus
gttgtgctagctctaaaggcgactt

SEQ ID NO: 735691 - DNA, 25 bp, Mus musculus
gttgtgctagctgtaaaggcgactt

SEQ ID NO: 735692 - DNA, 25 bp, Mus musculus
gttgtgctagtaatccatgttccag

SEQ ID NO: 735693 - DNA, 25 bp, Mus musculus
gttgtgctagtattccatgttccag

SEQ ID NO: 735694 - DNA, 25 bp, Mus musculus
gttgtgctatatatgccacagaaac

SEQ ID NO: 735695 - DNA, 25 bp, Mus musculus
gttgtgctatatttgccacagaaac

SEQ ID NO: 735696 - DNA, 25 bp, Mus musculus
gttgtgctccgaagaacctttccat

SEQ ID NO: 735697 - DNA, 25 bp, Mus musculus
gttgtgctccgatgaacctttccat

SEQ ID NO: 735698 - DNA, 25 bp, Mus musculus
gttgtgctcgatatcccaaaggaag

SEQ ID NO: 735699 - DNA, 25 bp, Mus musculus
gttgtgctcgatttcccaaaggaag

SEQ ID NO: 735700 - DNA, 25 bp, Mus musculus
gttgtgctctgtctggttttgataa

SEQ ID NO: 735701 - DNA, 25 bp, Mus musculus
gttgtgctctgtgtggttttgataa

SEQ ID NO: 735702 - DNA, 25 bp, Mus musculus
gttgtgctggacatggtcaggacct

SEQ ID NO: 735703 - DNA, 25 bp, Mus musculus
gttgtgctggacttggtcaggacct

SEQ ID NO: 735704 - DNA, 25 bp, Mus musculus
gttgtgctggcaaatagtccctggc

SEQ ID NO: 735705 - DNA, 25 bp, Mus musculus
gttgtgctggcatatagtccctggc

SEQ ID NO: 735706 - DNA, 25 bp, Mus musculus
gttgtgctgggactcaaagccttgc

SEQ ID NO: 735707 - DNA, 25 bp, Mus musculus
gttgtgctgggagtcaaagccttgc

SEQ ID NO: 735708 - DNA, 25 bp, Mus musculus
gttgtgctgtatcctgtgctttttc

SEQ ID NO: 735709 - DNA, 25 bp, Mus musculus
gttgtgctgtatgctgtgctttttc

SEQ ID NO: 735710 - DNA, 25 bp, Mus musculus
gttgtgcttacaactccctgggcag

SEQ ID NO: 735711 - DNA, 25 bp, Mus musculus
gttgtgcttacatctccctgggcag

SEQ ID NO: 735712 - DNA, 25 bp, Mus musculus
gttgtgcttcttcacctggttttat

SEQ ID NO: 735713 - DNA, 25 bp, Mus musculus
gttgtgcttcttgacctggttttat

SEQ ID NO: 735714 - DNA, 25 bp, Mus musculus
gttgtgctttaaccaccctaagaag

SEQ ID NO: 735715 - DNA, 25 bp, Mus musculus
gttgtgctttaagcaccctaagaag

SEQ ID NO: 735716 - DNA, 25 bp, Mus musculus
gttgtggaaactcaactagtaggtt

SEQ ID NO: 735717 - DNA, 25 bp, Mus musculus
gttgtggaaactgaactagtaggtt

SEQ ID NO: 735718 - DNA, 25 bp, Mus musculus
gttgtggaacatccttggcagccat

SEQ ID NO: 735719 - DNA, 25 bp, Mus musculus
gttgtggaacatcggcagacagtta

SEQ ID NO: 735720 - DNA, 25 bp, Mus musculus
gttgtggaacatgcttggcagccat

SEQ ID NO: 735721 - DNA, 25 bp, Mus musculus
gttgtggaacatgggcagacagtta

SEQ ID NO: 735722 - DNA, 25 bp, Mus musculus
gttgtggaattgcacctgtggctca

SEQ ID NO: 735723 - DNA, 25 bp, Mus musculus
gttgtggaattggacctgtggctca

SEQ ID NO: 735724 - DNA, 25 bp, Mus musculus
gttgtggacattctcggcccaaatc

SEQ ID NO: 735725 - DNA, 25 bp, Mus musculus
gttgtggacattgtcggcccaaatc

SEQ ID NO: 735726 - DNA, 25 bp, Mus musculus
gttgtggagctccaatgtctgagaa

SEQ ID NO: 735727 - DNA, 25 bp, Mus musculus
gttgtggagctcgaatgtctgagaa

SEQ ID NO: 735728 - DNA, 25 bp, Mus musculus
gttgtggagtttacagggtcgatca

SEQ ID NO: 735729 - DNA, 25 bp, Mus musculus
gttgtggagttttcagggtcgatca

SEQ ID NO: 735730 - DNA, 25 bp, Mus musculus
gttgtggataggctcatccctggct

SEQ ID NO: 735731 - DNA, 25 bp, Mus musculus
gttgtggatagggtcatccctggct

SEQ ID NO: 735732 - DNA, 25 bp, Mus musculus
gttgtggatcatcccgaagtcccga

SEQ ID NO: 735733 - DNA, 25 bp, Mus musculus
gttgtggatcatgccgaagtcccga

SEQ ID NO: 735734 - DNA, 25 bp, Mus musculus
gttgtggatgaacgcttagtcccag

SEQ ID NO: 735735 - DNA, 25 bp, Mus musculus
gttgtggatgaaggcttagtcccag

SEQ ID NO: 735736 - DNA, 25 bp, Mus musculus
gttgtggatggcattaacctggttt

SEQ ID NO: 735737 - DNA, 25 bp, Mus musculus
gttgtggatggctttaacctggttt

SEQ ID NO: 735738 - DNA, 25 bp, Mus musculus
gttgtggcacaaacctagtaacccc

SEQ ID NO: 735739 - DNA, 25 bp, Mus musculus
gttgtggcacaaagtattatatgac

SEQ ID NO: 735740 - DNA, 25 bp, Mus musculus
gttgtggcacaatcctagtaacccc

SEQ ID NO: 735741 - DNA, 25 bp, Mus musculus
gttgtggcacaatgtattatatgac

SEQ ID NO: 735742 - DNA, 25 bp, Mus musculus
gttgtggcacatagctctggtagta

SEQ ID NO: 735743 - DNA, 25 bp, Mus musculus
gttgtggcacattgctctggtagta

SEQ ID NO: 735744 - DNA, 25 bp, Mus musculus
gttgtggcattcaagtctttacatt

SEQ ID NO: 735745 - DNA, 25 bp, Mus musculus
gttgtggcattctagtctttacatt

SEQ ID NO: 735746 - DNA, 25 bp, Mus musculus
gttgtggcccatccacatatgtgca

SEQ ID NO: 735747 - DNA, 25 bp, Mus musculus
gttgtggcccatcggacacctgtag

SEQ ID NO: 735748 - DNA, 25 bp, Mus musculus
gttgtggcccatgcacatatgtgca

SEQ ID NO: 735749 - DNA, 25 bp, Mus musculus
gttgtggcccatgggacacctgtag

SEQ ID NO: 735750 - DNA, 25 bp, Mus musculus
gttgtggcctacaaacaagtcccga

SEQ ID NO: 735751 - DNA, 25 bp, Mus musculus
gttgtggcctactaacaagtcccga

SEQ ID NO: 735752 - DNA, 25 bp, Mus musculus
gttgtggctactactaaatattatc

SEQ ID NO: 735753 - DNA, 25 bp, Mus musculus
gttgtggctacttctaaatattatc

SEQ ID NO: 735754 - DNA, 25 bp, Mus musculus
gttgtggctctactatccctacaga

SEQ ID NO: 735755 - DNA, 25 bp, Mus musculus
gttgtggctctagtatccctacaga

SEQ ID NO: 735756 - DNA, 25 bp, Mus musculus
gttgtggctgctatgggatcaccca

SEQ ID NO: 735757 - DNA, 25 bp, Mus musculus
gttgtggctgctttgggatcaccca

SEQ ID NO: 735758 - DNA, 25 bp, Mus musculus
gttgtggctttaacagctgctacct

SEQ ID NO: 735759 - DNA, 25 bp, Mus musculus
gttgtggctttatcagctgctacct

SEQ ID NO: 735760 - DNA, 25 bp, Mus musculus
gttgtgggaactcagatttgtagca

SEQ ID NO: 735761 - DNA, 25 bp, Mus musculus
gttgtgggaactgagatttgtagca

SEQ ID NO: 735762 - DNA, 25 bp, Mus musculus
gttgtgggagctcagttatttttca

SEQ ID NO: 735763 - DNA, 25 bp, Mus musculus
gttgtgggagctgagttatttttca

SEQ ID NO: 735764 - DNA, 25 bp, Mus musculus
gttgtgggatttcttaccggtcata

SEQ ID NO: 735765 - DNA, 25 bp, Mus musculus
gttgtgggatttgttaccggtcata

SEQ ID NO: 735766 - DNA, 25 bp, Mus musculus
gttgtggggcctcggtttttcattg

SEQ ID NO: 735767 - DNA, 25 bp, Mus musculus
gttgtggggcctgggtttttcattg

SEQ ID NO: 735768 - DNA, 25 bp, Mus musculus
gttgtggtaatcaccatactattaa

SEQ ID NO: 735769 - DNA, 25 bp, Mus musculus
gttgtggtaatctccatactattaa

SEQ ID NO: 735770 - DNA, 25 bp, Mus musculus
gttgtggtacacactttaatttcag

SEQ ID NO: 735771 - DNA, 25 bp, Mus musculus
gttgtggtacactctttaatttcag

SEQ ID NO: 735772 - DNA, 25 bp, Mus musculus
gttgtggtatcaactgttccccaaa

SEQ ID NO: 735773 - DNA, 25 bp, Mus musculus
gttgtggtatcatctgttccccaaa

SEQ ID NO: 735774 - DNA, 25 bp, Mus musculus
gttgtggtatttatacttcagtact

SEQ ID NO: 735775 - DNA, 25 bp, Mus musculus
gttgtggtatttttacttcagtact

SEQ ID NO: 735776 - DNA, 25 bp, Mus musculus
gttgtggtctgacctgatttctcaa

SEQ ID NO: 735777 - DNA, 25 bp, Mus musculus
gttgtggtctgagctgatttctcaa

SEQ ID NO: 735778 - DNA, 25 bp, Mus musculus
gttgtggtcttgatttctctagcta

SEQ ID NO: 735779 - DNA, 25 bp, Mus musculus
gttgtggtcttgttttctctagcta

SEQ ID NO: 735780 - DNA, 25 bp, Mus musculus
gttgtggtgcagaactggattttct

SEQ ID NO: 735781 - DNA, 25 bp, Mus musculus
gttgtggtgcagtactggattttct

SEQ ID NO: 735782 - DNA, 25 bp, Mus musculus
gttgtggttaataaaggaggctttg

SEQ ID NO: 735783 - DNA, 25 bp, Mus musculus
gttgtggttaattaaggaggctttg

SEQ ID NO: 735784 - DNA, 25 bp, Mus musculus
gttgtggttattcaggcagaccatc

SEQ ID NO: 735785 - DNA, 25 bp, Mus musculus
gttgtggttattgaggcagaccatc

SEQ ID NO: 735786 - DNA, 25 bp, Mus musculus
gttgtggttttaatgtgtccaacac

SEQ ID NO: 735787 - DNA, 25 bp, Mus musculus
gttgtggttttattgtgtccaacac

SEQ ID NO: 735788 - DNA, 25 bp, Mus musculus
gttgtggttttcaatgctgcagccc

SEQ ID NO: 735789 - DNA, 25 bp, Mus musculus
gttgtggttttctatgctgcagccc

SEQ ID NO: 735790 - DNA, 25 bp, Mus musculus
gttgtgtaccaaacagcatttctaa

SEQ ID NO: 735791 - DNA, 25 bp, Mus musculus
gttgtgtaccaatcagcatttctaa

SEQ ID NO: 735792 - DNA, 25 bp, Mus musculus
gttgtgtaccccagtgaaaccagct

SEQ ID NO: 735793 - DNA, 25 bp, Mus musculus
gttgtgtacccctgtgaaaccagct

SEQ ID NO: 735794 - DNA, 25 bp, Mus musculus
gttgtgtaccttaacgtctgaaaat

SEQ ID NO: 735795 - DNA, 25 bp, Mus musculus
gttgtgtacctttacgtctgaaaat

SEQ ID NO: 735796 - DNA, 25 bp, Mus musculus
gttgtgtagggtatttcagcatcca

SEQ ID NO: 735797 - DNA, 25 bp, Mus musculus
gttgtgtagggtttttcagcatcca

SEQ ID NO: 735798 - DNA, 25 bp, Mus musculus
gttgtgtatctcagcttttctacca

SEQ ID NO: 735799 - DNA, 25 bp, Mus musculus
gttgtgtatctctgcttttctacca

SEQ ID NO: 735800 - DNA, 25 bp, Mus musculus
gttgtgtcaaacatgtctcaggaat

SEQ ID NO: 735801 - DNA, 25 bp, Mus musculus
gttgtgtcaaacttgtctcaggaat

SEQ ID NO: 735802 - DNA, 25 bp, Mus musculus
gttgtgtcaacgactggaccagagt

SEQ ID NO: 735803 - DNA, 25 bp, Mus musculus
gttgtgtcaacgtctggaccagagt

SEQ ID NO: 735804 - DNA, 25 bp, Mus musculus
gttgtgtcactgattcatatggtat

SEQ ID NO: 735805 - DNA, 25 bp, Mus musculus
gttgtgtcactgtttcatatggtat

SEQ ID NO: 735806 - DNA, 25 bp, Mus musculus
gttgtgtcacttacattgctctgtc

SEQ ID NO: 735807 - DNA, 25 bp, Mus musculus
gttgtgtcactttcattgctctgtc

SEQ ID NO: 735808 - DNA, 25 bp, Mus musculus
gttgtgtcaggaacacattcaattc

SEQ ID NO: 735809 - DNA, 25 bp, Mus musculus
gttgtgtcaggatcacattcaattc

SEQ ID NO: 735810 - DNA, 25 bp, Mus musculus
gttgtgtccaccagtgccgggccag

SEQ ID NO: 735811 - DNA, 25 bp, Mus musculus
gttgtgtccacctgtgccgggccag

SEQ ID NO: 735812 - DNA, 25 bp, Mus musculus
gttgtgtcccgcagatggaatagct

SEQ ID NO: 735813 - DNA, 25 bp, Mus musculus
gttgtgtcccgctgatggaatagct

SEQ ID NO: 735814 - DNA, 25 bp, Mus musculus
gttgtgtccgtcctttattgagaga

SEQ ID NO: 735815 - DNA, 25 bp, Mus musculus
gttgtgtccgtcgtttattgagaga

SEQ ID NO: 735816 - DNA, 25 bp, Mus musculus
gttgtgtctccacgaggaaacccat

SEQ ID NO: 735817 - DNA, 25 bp, Mus musculus
gttgtgtctccaggaggaaacccat

SEQ ID NO: 735818 - DNA, 25 bp, Mus musculus
gttgtgtcttaacattgctctacgt

SEQ ID NO: 735819 - DNA, 25 bp, Mus musculus
gttgtgtcttaagattgctctacgt

SEQ ID NO: 735820 - DNA, 25 bp, Mus musculus
gttgtgtcttacctgagcttgttgc

SEQ ID NO: 735821 - DNA, 25 bp, Mus musculus
gttgtgtcttacgtgagcttgttgc

SEQ ID NO: 735822 - DNA, 25 bp, Mus musculus
gttgtgtcttgtacagtggtgctgc

SEQ ID NO: 735823 - DNA, 25 bp, Mus musculus
gttgtgtcttgttcagtggtgctgc

SEQ ID NO: 735824 - DNA, 25 bp, Mus musculus
gttgtgtgaagcatagcacctttca

SEQ ID NO: 735825 - DNA, 25 bp, Mus musculus
gttgtgtgaagcttagcacctttca

SEQ ID NO: 735826 - DNA, 25 bp, Mus musculus
gttgtgtgagggaggaattccattt

SEQ ID NO: 735827 - DNA, 25 bp, Mus musculus
gttgtgtgagggtggaattccattt

SEQ ID NO: 735828 - DNA, 25 bp, Mus musculus
gttgtgtgagtaatcatggaggact

SEQ ID NO: 735829 - DNA, 25 bp, Mus musculus
gttgtgtgagtattcatggaggact

SEQ ID NO: 735830 - DNA, 25 bp, Mus musculus
gttgtgtgatttcaaagtctaacac

SEQ ID NO: 735831 - DNA, 25 bp, Mus musculus
gttgtgtgatttgaaagtctaacac

SEQ ID NO: 735832 - DNA, 25 bp, Mus musculus
gttgtgtgcagcattagcggcatca

SEQ ID NO: 735833 - DNA, 25 bp, Mus musculus
gttgtgtgcagctttagcggcatca

SEQ ID NO: 735834 - DNA, 25 bp, Mus musculus
gttgtgtgctgtagagtgactgcca

SEQ ID NO: 735835 - DNA, 25 bp, Mus musculus
gttgtgtgctgttgagtgactgcca

SEQ ID NO: 735836 - DNA, 25 bp, Mus musculus
gttgtgtggagcaatcatcctcata

SEQ ID NO: 735837 - DNA, 25 bp, Mus musculus
gttgtgtggagctatcatcctcata

SEQ ID NO: 735838 - DNA, 25 bp, Mus musculus
gttgtgtggattctgtattctgtac

SEQ ID NO: 735839 - DNA, 25 bp, Mus musculus
gttgtgtggattgtgtattctgtac

SEQ ID NO: 735840 - DNA, 25 bp, Mus musculus
gttgtgtggcaaactggtaacatca

SEQ ID NO: 735841 - DNA, 25 bp, Mus musculus
gttgtgtggcaatctggtaacatca

SEQ ID NO: 735842 - DNA, 25 bp, Mus musculus
gttgtgtgggaccttaactctcccg

SEQ ID NO: 735843 - DNA, 25 bp, Mus musculus
gttgtgtgggacgttaactctcccg

SEQ ID NO: 735844 - DNA, 25 bp, Mus musculus
gttgtgtggtgccattacaccccag

SEQ ID NO: 735845 - DNA, 25 bp, Mus musculus
gttgtgtggtgcgattacaccccag

SEQ ID NO: 735846 - DNA, 25 bp, Mus musculus
gttgtgtggttcaatgaaactcagt

SEQ ID NO: 735847 - DNA, 25 bp, Mus musculus
gttgtgtggttctatgaaactcagt

SEQ ID NO: 735848 - DNA, 25 bp, Mus musculus
gttgtgtgtacacagctccggagct

SEQ ID NO: 735849 - DNA, 25 bp, Mus musculus
gttgtgtgtacagagctccggagct

SEQ ID NO: 735850 - DNA, 25 bp, Mus musculus
gttgtgtgtatgactttgcgtgtaa

SEQ ID NO: 735851 - DNA, 25 bp, Mus musculus
gttgtgtgtatgtctttgcgtgtaa

SEQ ID NO: 735852 - DNA, 25 bp, Mus musculus
gttgtgttacggagacccatgtcaa

SEQ ID NO: 735853 - DNA, 25 bp, Mus musculus
gttgtgttacggtgacccatgtcaa

SEQ ID NO: 735854 - DNA, 25 bp, Mus musculus
gttgtgttagagagacccaatccaa

SEQ ID NO: 735855 - DNA, 25 bp, Mus musculus
gttgtgttagagtgacccaatccaa

SEQ ID NO: 735856 - DNA, 25 bp, Mus musculus
gttgtgttcacaacatgattactgt

SEQ ID NO: 735857 - DNA, 25 bp, Mus musculus
gttgtgttcacatcatgattactgt

SEQ ID NO: 735858 - DNA, 25 bp, Mus musculus
gttgtgttctggaggtggctttaca

SEQ ID NO: 735859 - DNA, 25 bp, Mus musculus
gttgtgttctggtggtggctttaca

SEQ ID NO: 735860 - DNA, 25 bp, Mus musculus
gttgtgttctgtagaaggtgccatt

SEQ ID NO: 735861 - DNA, 25 bp, Mus musculus
gttgtgttctgtagagggcctcatt

SEQ ID NO: 735862 - DNA, 25 bp, Mus musculus
gttgtgttctgttgaaggtgccatt

SEQ ID NO: 735863 - DNA, 25 bp, Mus musculus
gttgtgttctgttgagggcctcatt

SEQ ID NO: 735864 - DNA, 25 bp, Mus musculus
gttgtgttctttccctaggttacca

SEQ ID NO: 735865 - DNA, 25 bp, Mus musculus
gttgtgttctttgcctaggttacca

SEQ ID NO: 735866 - DNA, 25 bp, Mus musculus
gttgtgttgattactacctgtagcc

SEQ ID NO: 735867 - DNA, 25 bp, Mus musculus
gttgtgttgatttctacctgtagcc

SEQ ID NO: 735868 - DNA, 25 bp, Mus musculus
gttgtgttgtgtcccatcatgtcta

SEQ ID NO: 735869 - DNA, 25 bp, Mus musculus
gttgtgttgtgtgccatcatgtcta

SEQ ID NO: 735870 - DNA, 25 bp, Mus musculus
gttgtgtttacactttgcattttgg

SEQ ID NO: 735871 - DNA, 25 bp, Mus musculus
gttgtgtttacagtttgcattttgg

SEQ ID NO: 735872 - DNA, 25 bp, Mus musculus
gttgtgtttaccatgtaagcaccgt

SEQ ID NO: 735873 - DNA, 25 bp, Mus musculus
gttgtgtttaccttgtaagcaccgt

SEQ ID NO: 735874 - DNA, 25 bp, Mus musculus
gttgtgtttcataacagcagtagaa

SEQ ID NO: 735875 - DNA, 25 bp, Mus musculus
gttgtgtttcattacagcagtagaa

SEQ ID NO: 735876 - DNA, 25 bp, Mus musculus
gttgtgtttcttacagggataccat

SEQ ID NO: 735877 - DNA, 25 bp, Mus musculus
gttgtgtttctttcagggataccat

SEQ ID NO: 735878 - DNA, 25 bp, Mus musculus
gttgtgtttgttcccatcagtttag

SEQ ID NO: 735879 - DNA, 25 bp, Mus musculus
gttgtgtttgttgccatcagtttag

SEQ ID NO: 735880 - DNA, 25 bp, Mus musculus
gttgtgttttcactgactggcactg

SEQ ID NO: 735881 - DNA, 25 bp, Mus musculus
gttgtgttttcagtgactggcactg

SEQ ID NO: 735882 - DNA, 25 bp, Mus musculus
gttgtgttttccatgttatattcgg

SEQ ID NO: 735883 - DNA, 25 bp, Mus musculus
gttgtgttttccttgttatattcgg

SEQ ID NO: 735884 - DNA, 25 bp, Mus musculus
gttgttaaaacacgctccacgcaga

SEQ ID NO: 735885 - DNA, 25 bp, Mus musculus
gttgttaaaacaggctccacgcaga

SEQ ID NO: 735886 - DNA, 25 bp, Mus musculus
gttgttaaacaaaacccacttgcca

SEQ ID NO: 735887 - DNA, 25 bp, Mus musculus
gttgttaaacaatacccacttgcca

SEQ ID NO: 735888 - DNA, 25 bp, Mus musculus
gttgttaaacatcttcctacagaag

SEQ ID NO: 735889 - DNA, 25 bp, Mus musculus
gttgttaaacatgttcctacagaag

SEQ ID NO: 735890 - DNA, 25 bp, Mus musculus
gttgttaaagacacgactgtgactc

SEQ ID NO: 735891 - DNA, 25 bp, Mus musculus
gttgttaaagactcgactgtgactc

SEQ ID NO: 735892 - DNA, 25 bp, Mus musculus
gttgttaaagtaaagaccctggatc

SEQ ID NO: 735893 - DNA, 25 bp, Mus musculus
gttgttaaagtatagaccctggatc

SEQ ID NO: 735894 - DNA, 25 bp, Mus musculus
gttgttaagaacaggacctgcccca

SEQ ID NO: 735895 - DNA, 25 bp, Mus musculus
gttgttaagaactggacctgcccca

SEQ ID NO: 735896 - DNA, 25 bp, Mus musculus
gttgttacagttacaggcagccggg

SEQ ID NO: 735897 - DNA, 25 bp, Mus musculus
gttgttacagtttcaggcagccggg

SEQ ID NO: 735898 - DNA, 25 bp, Mus musculus
gttgttacatttataagtgctgcat

SEQ ID NO: 735899 - DNA, 25 bp, Mus musculus
gttgttacatttttaagtgctgcat

SEQ ID NO: 735900 - DNA, 25 bp, Mus musculus
gttgttaccacccagggctcagagg

SEQ ID NO: 735901 - DNA, 25 bp, Mus musculus
gttgttaccaccgagggctcagagg

SEQ ID NO: 735902 - DNA, 25 bp, Mus musculus
gttgttaccatgatctttctttgtg

SEQ ID NO: 735903 - DNA, 25 bp, Mus musculus
gttgttaccatgttctttctttgtg

SEQ ID NO: 735904 - DNA, 25 bp, Mus musculus
gttgttaccgagaatctgaatctct

SEQ ID NO: 735905 - DNA, 25 bp, Mus musculus
gttgttaccgagtatctgaatctct

SEQ ID NO: 735906 - DNA, 25 bp, Mus musculus
gttgttacctgactggttacggtca

SEQ ID NO: 735907 - DNA, 25 bp, Mus musculus
gttgttacctgagtggttacggtca

SEQ ID NO: 735908 - DNA, 25 bp, Mus musculus
gttgttaccttgaagtctcttattc

SEQ ID NO: 735909 - DNA, 25 bp, Mus musculus
gttgttaccttgtagtctcttattc

SEQ ID NO: 735910 - DNA, 25 bp, Mus musculus
gttgttacgaagatttgcccctaag

SEQ ID NO: 735911 - DNA, 25 bp, Mus musculus
gttgttacgaagttttgcccctaag

SEQ ID NO: 735912 - DNA, 25 bp, Mus musculus
gttgttacgtagattcttcgtcatc

SEQ ID NO: 735913 - DNA, 25 bp, Mus musculus
gttgttacgtagtttcttcgtcatc

SEQ ID NO: 735914 - DNA, 25 bp, Mus musculus
gttgttactacacttccaggacctg

SEQ ID NO: 735915 - DNA, 25 bp, Mus musculus
gttgttactacagttccaggacctg

SEQ ID NO: 735916 - DNA, 25 bp, Mus musculus
gttgttactcagagtccaagttgga

SEQ ID NO: 735917 - DNA, 25 bp, Mus musculus
gttgttactcagtgtccaagttgga

SEQ ID NO: 735918 - DNA, 25 bp, Mus musculus
gttgttactcatctttttctactgg

SEQ ID NO: 735919 - DNA, 25 bp, Mus musculus
gttgttactcatgtttttctactgg

SEQ ID NO: 735920 - DNA, 25 bp, Mus musculus
gttgttacttacagtaaatgtgcta

SEQ ID NO: 735921 - DNA, 25 bp, Mus musculus
gttgttacttactgtaaatgtgcta

SEQ ID NO: 735922 - DNA, 25 bp, Mus musculus
gttgttactttaacttttaagagat

SEQ ID NO: 735923 - DNA, 25 bp, Mus musculus
gttgttactttatcttttaagagat

SEQ ID NO: 735924 - DNA, 25 bp, Mus musculus
gttgttagactacttctgcttaggt

SEQ ID NO: 735925 - DNA, 25 bp, Mus musculus
gttgttagactagttctgcttaggt

SEQ ID NO: 735926 - DNA, 25 bp, Mus musculus
gttgttagcactcgacagatgtctc

SEQ ID NO: 735927 - DNA, 25 bp, Mus musculus
gttgttagcactggacagatgtctc

SEQ ID NO: 735928 - DNA, 25 bp, Mus musculus
gttgttagccatcgcagcctaagct

SEQ ID NO: 735929 - DNA, 25 bp, Mus musculus
gttgttagccatggcagcctaagct

SEQ ID NO: 735930 - DNA, 25 bp, Mus musculus
gttgttaggaagatcacagcccaga

SEQ ID NO: 735931 - DNA, 25 bp, Mus musculus
gttgttaggaagttcacagcccaga

SEQ ID NO: 735932 - DNA, 25 bp, Mus musculus
gttgttaggaatctgcttttagttt

SEQ ID NO: 735933 - DNA, 25 bp, Mus musculus
gttgttaggaatgtgcttttagttt

SEQ ID NO: 735934 - DNA, 25 bp, Mus musculus
gttgttagtgcaacacaccaagtat

SEQ ID NO: 735935 - DNA, 25 bp, Mus musculus
gttgttagtgcatcacaccaagtat

SEQ ID NO: 735936 - DNA, 25 bp, Mus musculus
gttgttagtgctccaatctaaataa

SEQ ID NO: 735937 - DNA, 25 bp, Mus musculus
gttgttagtgctgcaatctaaataa

SEQ ID NO: 735938 - DNA, 25 bp, Mus musculus
gttgttatatacctgtattgtatta

SEQ ID NO: 735939 - DNA, 25 bp, Mus musculus
gttgttatatacgtgtattgtatta

SEQ ID NO: 735940 - DNA, 25 bp, Mus musculus
gttgttatcaggaaacacagtttct

SEQ ID NO: 735941 - DNA, 25 bp, Mus musculus
gttgttatcaggtaacacagtttct

SEQ ID NO: 735942 - DNA, 25 bp, Mus musculus
gttgttatctgtcccttggaccacc

SEQ ID NO: 735943 - DNA, 25 bp, Mus musculus
gttgttatctgtgccttggaccacc

SEQ ID NO: 735944 - DNA, 25 bp, Mus musculus
gttgttatggctagtatctttccgt

SEQ ID NO: 735945 - DNA, 25 bp, Mus musculus
gttgttatggcttgtatctttccgt

SEQ ID NO: 735946 - DNA, 25 bp, Mus musculus
gttgttatgtgtcccttcatagtcc

SEQ ID NO: 735947 - DNA, 25 bp, Mus musculus
gttgttatgtgtgccttcatagtcc

SEQ ID NO: 735948 - DNA, 25 bp, Mus musculus
gttgttattctccacagttaatgtt

SEQ ID NO: 735949 - DNA, 25 bp, Mus musculus
gttgttattctcgacagttaatgtt

SEQ ID NO: 735950 - DNA, 25 bp, Mus musculus
gttgttattcttattgaccacacag

SEQ ID NO: 735951 - DNA, 25 bp, Mus musculus
gttgttattctttttgaccacacag

SEQ ID NO: 735952 - DNA, 25 bp, Mus musculus
gttgttatttccaccttgtgtcaca

SEQ ID NO: 735953 - DNA, 25 bp, Mus musculus
gttgttatttcctccttgtgtcaca

SEQ ID NO: 735954 - DNA, 25 bp, Mus musculus
gttgttcaagctccctcaggcgatg

SEQ ID NO: 735955 - DNA, 25 bp, Mus musculus
gttgttcaagctgcctcaggcgatg

SEQ ID NO: 735956 - DNA, 25 bp, Mus musculus
gttgttcaataaacctccagacttt

SEQ ID NO: 735957 - DNA, 25 bp, Mus musculus
gttgttcaataatcctccagacttt

SEQ ID NO: 735958 - DNA, 25 bp, Mus musculus
gttgttcacaaaagcttcctgcaag

SEQ ID NO: 735959 - DNA, 25 bp, Mus musculus
gttgttcacaaatgcttcctgcaag

SEQ ID NO: 735960 - DNA, 25 bp, Mus musculus
gttgttcacccaatatggagctaga

SEQ ID NO: 735961 - DNA, 25 bp, Mus musculus
gttgttcacccattatggagctaga

SEQ ID NO: 735962 - DNA, 25 bp, Mus musculus
gttgttcactttatcatagctactt

SEQ ID NO: 735963 - DNA, 25 bp, Mus musculus
gttgttcactttttcatagctactt

SEQ ID NO: 735964 - DNA, 25 bp, Mus musculus
gttgttcagaacctattaactcttg

SEQ ID NO: 735965 - DNA, 25 bp, Mus musculus
gttgttcagaacgtattaactcttg

SEQ ID NO: 735966 - DNA, 25 bp, Mus musculus
gttgttcagataagcctaccggtca

SEQ ID NO: 735967 - DNA, 25 bp, Mus musculus
gttgttcagatatgcctaccggtca

SEQ ID NO: 735968 - DNA, 25 bp, Mus musculus
gttgttcagatgacctttgccataa

SEQ ID NO: 735969 - DNA, 25 bp, Mus musculus
gttgttcagatgtcctttgccataa

SEQ ID NO: 735970 - DNA, 25 bp, Mus musculus
gttgttcagcacatacatgctccat

SEQ ID NO: 735971 - DNA, 25 bp, Mus musculus
gttgttcagcacttacatgctccat

SEQ ID NO: 735972 - DNA, 25 bp, Mus musculus
gttgttcaggatctcctgaccatct

SEQ ID NO: 735973 - DNA, 25 bp, Mus musculus
gttgttcaggatgtcctgaccatct

SEQ ID NO: 735974 - DNA, 25 bp, Mus musculus
gttgttcatattacagggtagcttg

SEQ ID NO: 735975 - DNA, 25 bp, Mus musculus
gttgttcatatttcagggtagcttg

SEQ ID NO: 735976 - DNA, 25 bp, Mus musculus
gttgttcattttcgatgctggtgct

SEQ ID NO: 735977 - DNA, 25 bp, Mus musculus
gttgttcattttggatgctggtgct

SEQ ID NO: 735978 - DNA, 25 bp, Mus musculus
gttgttccaactagggacccgatag

SEQ ID NO: 735979 - DNA, 25 bp, Mus musculus
gttgttccaacttgggacccgatag

SEQ ID NO: 735980 - DNA, 25 bp, Mus musculus
gttgttccaattaccattcccacat

SEQ ID NO: 735981 - DNA, 25 bp, Mus musculus
gttgttccaatttccattcccacat

SEQ ID NO: 735982 - DNA, 25 bp, Mus musculus
gttgttccactgctgaactgtcaag

SEQ ID NO: 735983 - DNA, 25 bp, Mus musculus
gttgttccactggtgaactgtcaag

SEQ ID NO: 735984 - DNA, 25 bp, Mus musculus
gttgttcccagtatgcattaatgat

SEQ ID NO: 735985 - DNA, 25 bp, Mus musculus
gttgttcccagtttgcattaatgat

SEQ ID NO: 735986 - DNA, 25 bp, Mus musculus
gttgttccccatcttgacaacccaa

SEQ ID NO: 735987 - DNA, 25 bp, Mus musculus
gttgttccccatgttgacaacccaa

SEQ ID NO: 735988 - DNA, 25 bp, Mus musculus
gttgttcctcctacctatgtcctta

SEQ ID NO: 735989 - DNA, 25 bp, Mus musculus
gttgttcctccttcctatgtcctta

SEQ ID NO: 735990 - DNA, 25 bp, Mus musculus
gttgttcctgcccatattgggagag

SEQ ID NO: 735991 - DNA, 25 bp, Mus musculus
gttgttcctgccgatattgggagag

SEQ ID NO: 735992 - DNA, 25 bp, Mus musculus
gttgttcctggcctgagttcagctc

SEQ ID NO: 735993 - DNA, 25 bp, Mus musculus
gttgttcctggcgtgagttcagctc

SEQ ID NO: 735994 - DNA, 25 bp, Mus musculus
gttgttcctgtgacagctagctgtt

SEQ ID NO: 735995 - DNA, 25 bp, Mus musculus
gttgttcctgtgtcagctagctgtt

SEQ ID NO: 735996 - DNA, 25 bp, Mus musculus
gttgttccttagagggtcttgagac

SEQ ID NO: 735997 - DNA, 25 bp, Mus musculus
gttgttccttagtgggtcttgagac

SEQ ID NO: 735998 - DNA, 25 bp, Mus musculus
gttgttccttatattaatcttgaga

SEQ ID NO: 735999 - DNA, 25 bp, Mus musculus
gttgttccttattttaatcttgaga

SEQ ID NO: 736000 - DNA, 25 bp, Mus musculus
gttgttccttctagaccgacattaa

SEQ ID NO: 736001 - DNA, 25 bp, Mus musculus
gttgttccttcttgaccgacattaa

SEQ ID NO: 736002 - DNA, 25 bp, Mus musculus
gttgttccttgtactgtgacactta

SEQ ID NO: 736003 - DNA, 25 bp, Mus musculus
gttgttccttgttctgtgacactta

SEQ ID NO: 736004 - DNA, 25 bp, Mus musculus
gttgttcctttccctgcatggcacc

SEQ ID NO: 736005 - DNA, 25 bp, Mus musculus
gttgttcctttcgctgcatggcacc

SEQ ID NO: 736006 - DNA, 25 bp, Mus musculus
gttgttccttttcatcaaaccatcc

SEQ ID NO: 736007 - DNA, 25 bp, Mus musculus
gttgttccttttgatcaaaccatcc

SEQ ID NO: 736008 - DNA, 25 bp, Mus musculus
gttgttcgagtacgctaaggaccat

SEQ ID NO: 736009 - DNA, 25 bp, Mus musculus
gttgttcgagtaggctaaggaccat

SEQ ID NO: 736010 - DNA, 25 bp, Mus musculus
gttgttcgagtccttgctatagcct

SEQ ID NO: 736011 - DNA, 25 bp, Mus musculus
gttgttcgagtcgttgctatagcct

SEQ ID NO: 736012 - DNA, 25 bp, Mus musculus
gttgttcgagttatcctatgtcagt

SEQ ID NO: 736013 - DNA, 25 bp, Mus musculus
gttgttcgagttttcctatgtcagt

SEQ ID NO: 736014 - DNA, 25 bp, Mus musculus
gttgttcgccagagtgaggagctac

SEQ ID NO: 736015 - DNA, 25 bp, Mus musculus
gttgttcgccagtgtgaggagctac

SEQ ID NO: 736016 - DNA, 25 bp, Mus musculus
gttgttcggctgaagcctaccagaa

SEQ ID NO: 736017 - DNA, 25 bp, Mus musculus
gttgttcggctgtagcctaccagaa

SEQ ID NO: 736018 - DNA, 25 bp, Mus musculus
gttgttctaccacaaaacctcagca

SEQ ID NO: 736019 - DNA, 25 bp, Mus musculus
gttgttctaccagaaaacctcagca

SEQ ID NO: 736020 - DNA, 25 bp, Mus musculus
gttgttctacttcctttagcagcat

SEQ ID NO: 736021 - DNA, 25 bp, Mus musculus
gttgttctacttgctttagcagcat

SEQ ID NO: 736022 - DNA, 25 bp, Mus musculus
gttgttctatcaccgtcgggatgac

SEQ ID NO: 736023 - DNA, 25 bp, Mus musculus
gttgttctatcagcgtcgggatgac

SEQ ID NO: 736024 - DNA, 25 bp, Mus musculus
gttgttctcaatcatgttagccaaa

SEQ ID NO: 736025 - DNA, 25 bp, Mus musculus
gttgttctcaatgatgttagccaaa

SEQ ID NO: 736026 - DNA, 25 bp, Mus musculus
gttgttctccctcagttcagtaata

SEQ ID NO: 736027 - DNA, 25 bp, Mus musculus
gttgttctccctgagttcagtaata

SEQ ID NO: 736028 - DNA, 25 bp, Mus musculus
gttgttctgacaattatcacaaaaa

SEQ ID NO: 736029 - DNA, 25 bp, Mus musculus
gttgttctgacatttatcacaaaaa

SEQ ID NO: 736030 - DNA, 25 bp, Mus musculus
gttgttctgattacttgcacctacc

SEQ ID NO: 736031 - DNA, 25 bp, Mus musculus
gttgttctgatttcttgcacctacc

SEQ ID NO: 736032 - DNA, 25 bp, Mus musculus
gttgttctgcaaatctgtcagctaa

SEQ ID NO: 736033 - DNA, 25 bp, Mus musculus
gttgttctgcaattctgtcagctaa

SEQ ID NO: 736034 - DNA, 25 bp, Mus musculus
gttgttctggaaaatgcctgcattt

SEQ ID NO: 736035 - DNA, 25 bp, Mus musculus
gttgttctggaatatgcctgcattt

SEQ ID NO: 736036 - DNA, 25 bp, Mus musculus
gttgttctgttaatcagtcttcttc

SEQ ID NO: 736037 - DNA, 25 bp, Mus musculus
gttgttctgttattcagtcttcttc

SEQ ID NO: 736038 - DNA, 25 bp, Mus musculus
gttgttcttaatcgctatttccctt

SEQ ID NO: 736039 - DNA, 25 bp, Mus musculus
gttgttcttaatggctatttccctt

SEQ ID NO: 736040 - DNA, 25 bp, Mus musculus
gttgttcttactaccttaccaagtg

SEQ ID NO: 736041 - DNA, 25 bp, Mus musculus
gttgttcttacttccttaccaagtg

SEQ ID NO: 736042 - DNA, 25 bp, Mus musculus
gttgttcttcagaatggatttcagc

SEQ ID NO: 736043 - DNA, 25 bp, Mus musculus
gttgttcttcagtatggatttcagc

SEQ ID NO: 736044 - DNA, 25 bp, Mus musculus
gttgttcttggcacttaaaattctg

SEQ ID NO: 736045 - DNA, 25 bp, Mus musculus
gttgttcttggctcttaaaattctg

SEQ ID NO: 736046 - DNA, 25 bp, Mus musculus
gttgttctttcgattctgtctaaat

SEQ ID NO: 736047 - DNA, 25 bp, Mus musculus
gttgttctttcgtttctgtctaaat

SEQ ID NO: 736048 - DNA, 25 bp, Mus musculus
gttgttctttgcaggacgtccttcc

SEQ ID NO: 736049 - DNA, 25 bp, Mus musculus
gttgttctttgctggacgtccttcc

SEQ ID NO: 736050 - DNA, 25 bp, Mus musculus
gttgttgactcacttcagatagccc

SEQ ID NO: 736051 - DNA, 25 bp, Mus musculus
gttgttgactcagttcagatagccc

SEQ ID NO: 736052 - DNA, 25 bp, Mus musculus
gttgttgactctcttaataacggac

SEQ ID NO: 736053 - DNA, 25 bp, Mus musculus
gttgttgactctgttaataacggac

SEQ ID NO: 736054 - DNA, 25 bp, Mus musculus
gttgttgagaatactgcgggccacc

SEQ ID NO: 736055 - DNA, 25 bp, Mus musculus
gttgttgagaattctgcgggccacc

SEQ ID NO: 736056 - DNA, 25 bp, Mus musculus
gttgttgagactaccactttggaag

SEQ ID NO: 736057 - DNA, 25 bp, Mus musculus
gttgttgagacttccactttggaag

SEQ ID NO: 736058 - DNA, 25 bp, Mus musculus
gttgttgagcatcttcttaacagga

SEQ ID NO: 736059 - DNA, 25 bp, Mus musculus
gttgttgagcatgttcttaacagga

SEQ ID NO: 736060 - DNA, 25 bp, Mus musculus
gttgttgaggcacaccttgcactct

SEQ ID NO: 736061 - DNA, 25 bp, Mus musculus
gttgttgaggcagaccttgcactct

SEQ ID NO: 736062 - DNA, 25 bp, Mus musculus
gttgttgataaaactttttgcctaa

SEQ ID NO: 736063 - DNA, 25 bp, Mus musculus
gttgttgataaatctttttgcctaa

SEQ ID NO: 736064 - DNA, 25 bp, Mus musculus
gttgttgataagcttcgccccatta

SEQ ID NO: 736065 - DNA, 25 bp, Mus musculus
gttgttgataaggttcgccccatta

SEQ ID NO: 736066 - DNA, 25 bp, Mus musculus
gttgttgatgtactgttccttctta

SEQ ID NO: 736067 - DNA, 25 bp, Mus musculus
gttgttgatgtagtgttccttctta

SEQ ID NO: 736068 - DNA, 25 bp, Mus musculus
gttgttgatgttactaaccccgaga

SEQ ID NO: 736069 - DNA, 25 bp, Mus musculus
gttgttgatgtttctaaccccgaga

SEQ ID NO: 736070 - DNA, 25 bp, Mus musculus
gttgttgcagtaaagactccattta

SEQ ID NO: 736071 - DNA, 25 bp, Mus musculus
gttgttgcagtatagactccattta

SEQ ID NO: 736072 - DNA, 25 bp, Mus musculus
gttgttgcagtgacttttgaacttg

SEQ ID NO: 736073 - DNA, 25 bp, Mus musculus
gttgttgcagtgtcttttgaacttg

SEQ ID NO: 736074 - DNA, 25 bp, Mus musculus
gttgttgccaatccagctgttgcaa

SEQ ID NO: 736075 - DNA, 25 bp, Mus musculus
gttgttgccaatcgagacacagcca

SEQ ID NO: 736076 - DNA, 25 bp, Mus musculus
gttgttgccaatgcagctgttgcaa

SEQ ID NO: 736077 - DNA, 25 bp, Mus musculus
gttgttgccaatggagacacagcca

SEQ ID NO: 736078 - DNA, 25 bp, Mus musculus
gttgttgccacccaacacgggagag

SEQ ID NO: 736079 - DNA, 25 bp, Mus musculus
gttgttgccaccgaacacgggagag

SEQ ID NO: 736080 - DNA, 25 bp, Mus musculus
gttgttgccatacctggtttgtata

SEQ ID NO: 736081 - DNA, 25 bp, Mus musculus
gttgttgccatagctggtttgtata

SEQ ID NO: 736082 - DNA, 25 bp, Mus musculus
gttgttgccattcttactgtagttc

SEQ ID NO: 736083 - DNA, 25 bp, Mus musculus
gttgttgccattgttactgtagttc

SEQ ID NO: 736084 - DNA, 25 bp, Mus musculus
gttgttgcccctaagactgggaaag

SEQ ID NO: 736085 - DNA, 25 bp, Mus musculus
gttgttgcccctattcgttactctg

SEQ ID NO: 736086 - DNA, 25 bp, Mus musculus
gttgttgccccttagactgggaaag

SEQ ID NO: 736087 - DNA, 25 bp, Mus musculus
gttgttgccccttttcgttactctg

SEQ ID NO: 736088 - DNA, 25 bp, Mus musculus
gttgttgccttcaaaagtacctgaa

SEQ ID NO: 736089 - DNA, 25 bp, Mus musculus
gttgttgccttctaaagtacctgaa

SEQ ID NO: 736090 - DNA, 25 bp, Mus musculus
gttgttgcgaagagagccatggtat

SEQ ID NO: 736091 - DNA, 25 bp, Mus musculus
gttgttgcgaagtgagccatggtat

SEQ ID NO: 736092 - DNA, 25 bp, Mus musculus
gttgttgctagcagaaccagcgttc

SEQ ID NO: 736093 - DNA, 25 bp, Mus musculus
gttgttgctagctgaaccagcgttc

SEQ ID NO: 736094 - DNA, 25 bp, Mus musculus
gttgttgctcctcttcttacaaaga

SEQ ID NO: 736095 - DNA, 25 bp, Mus musculus
gttgttgctcctgttcttacaaaga

SEQ ID NO: 736096 - DNA, 25 bp, Mus musculus
gttgttgctgaacattcacaaaact

SEQ ID NO: 736097 - DNA, 25 bp, Mus musculus
gttgttgctgaagattcacaaaact

SEQ ID NO: 736098 - DNA, 25 bp, Mus musculus
gttgttgctgcaccttaattaagga

SEQ ID NO: 736099 - DNA, 25 bp, Mus musculus
gttgttgctgcactgggaagacctt

SEQ ID NO: 736100 - DNA, 25 bp, Mus musculus
gttgttgctgcagcttaattaagga

SEQ ID NO: 736101 - DNA, 25 bp, Mus musculus
gttgttgctgcagtgggaagacctt

SEQ ID NO: 736102 - DNA, 25 bp, Mus musculus
gttgttgctgtaatttccaaggtta

SEQ ID NO: 736103 - DNA, 25 bp, Mus musculus
gttgttgctgtactcgttctcgtcg

SEQ ID NO: 736104 - DNA, 25 bp, Mus musculus
gttgttgctgtagtcgttctcgtcg

SEQ ID NO: 736105 - DNA, 25 bp, Mus musculus
gttgttgctgtattttccaaggtta

SEQ ID NO: 736106 - DNA, 25 bp, Mus musculus
gttgttggaaacaaccctagcgaat

SEQ ID NO: 736107 - DNA, 25 bp, Mus musculus
gttgttggaaactaccctagcgaat

SEQ ID NO: 736108 - DNA, 25 bp, Mus musculus
gttgttggaacaatgttccttccat

SEQ ID NO: 736109 - DNA, 25 bp, Mus musculus
gttgttggaacattgttccttccat

SEQ ID NO: 736110 - DNA, 25 bp, Mus musculus
gttgttggacctcttctttgcatct

SEQ ID NO: 736111 - DNA, 25 bp, Mus musculus
gttgttggacctgttctttgcatct

SEQ ID NO: 736112 - DNA, 25 bp, Mus musculus
gttgttggcaagaccatgaggcgac

SEQ ID NO: 736113 - DNA, 25 bp, Mus musculus
gttgttggcaagtccatgaggcgac

SEQ ID NO: 736114 - DNA, 25 bp, Mus musculus
gttgttggcaataaaggctactgtg

SEQ ID NO: 736115 - DNA, 25 bp, Mus musculus
gttgttggcaattaaggctactgtg

SEQ ID NO: 736116 - DNA, 25 bp, Mus musculus
gttgttggcacgcatgacacgtaca

SEQ ID NO: 736117 - DNA, 25 bp, Mus musculus
gttgttggcacggatgacacgtaca

SEQ ID NO: 736118 - DNA, 25 bp, Mus musculus
gttgttggccttagatcgagtttag

SEQ ID NO: 736119 - DNA, 25 bp, Mus musculus
gttgttggcctttgatcgagtttag

SEQ ID NO: 736120 - DNA, 25 bp, Mus musculus
gttgttgggccaccagggtaccttc

SEQ ID NO: 736121 - DNA, 25 bp, Mus musculus
gttgttgggccagcagggtaccttc

SEQ ID NO: 736122 - DNA, 25 bp, Mus musculus
gttgttggtcatagtcccgtgctgc

SEQ ID NO: 736123 - DNA, 25 bp, Mus musculus
gttgttggtcattgtcccgtgctgc

SEQ ID NO: 736124 - DNA, 25 bp, Mus musculus
gttgttggtgaaccacaagcatcta

SEQ ID NO: 736125 - DNA, 25 bp, Mus musculus
gttgttggtgaaccctttctttgca

SEQ ID NO: 736126 - DNA, 25 bp, Mus musculus
gttgttggtgaagcacaagcatcta

SEQ ID NO: 736127 - DNA, 25 bp, Mus musculus
gttgttggtgaagcctttctttgca

SEQ ID NO: 736128 - DNA, 25 bp, Mus musculus
gttgttggtgacattgctatgacta

SEQ ID NO: 736129 - DNA, 25 bp, Mus musculus
gttgttggtgactttgctatgacta

SEQ ID NO: 736130 - DNA, 25 bp, Mus musculus
gttgttggtggcatgattgatttga

SEQ ID NO: 736131 - DNA, 25 bp, Mus musculus
gttgttggtggcttgattgatttga

SEQ ID NO: 736132 - DNA, 25 bp, Mus musculus
gttgttggtttcaatagcctcagat

SEQ ID NO: 736133 - DNA, 25 bp, Mus musculus
gttgttggtttctatagcctcagat

SEQ ID NO: 736134 - DNA, 25 bp, Mus musculus
gttgttgtaattcctacctctatta

SEQ ID NO: 736135 - DNA, 25 bp, Mus musculus
gttgttgtaattgctacctctatta

SEQ ID NO: 736136 - DNA, 25 bp, Mus musculus
gttgttgtcaaaaagccttttatcc

SEQ ID NO: 736137 - DNA, 25 bp, Mus musculus
gttgttgtcaaatagccttttatcc

SEQ ID NO: 736138 - DNA, 25 bp, Mus musculus
gttgttgtcatccttacccagtaac

SEQ ID NO: 736139 - DNA, 25 bp, Mus musculus
gttgttgtcatcgttacccagtaac

SEQ ID NO: 736140 - DNA, 25 bp, Mus musculus
gttgttgtccaacttgttctggaac

SEQ ID NO: 736141 - DNA, 25 bp, Mus musculus
gttgttgtccaagttgttctggaac

SEQ ID NO: 736142 - DNA, 25 bp, Mus musculus
gttgttgtcctgcttttgagattga

SEQ ID NO: 736143 - DNA, 25 bp, Mus musculus
gttgttgtcctggttttgagattga

SEQ ID NO: 736144 - DNA, 25 bp, Mus musculus
gttgttgtctatcctgccaagttat

SEQ ID NO: 736145 - DNA, 25 bp, Mus musculus
gttgttgtctatgctgccaagttat

SEQ ID NO: 736146 - DNA, 25 bp, Mus musculus
gttgttgtgagtagacacctcagga

SEQ ID NO: 736147 - DNA, 25 bp, Mus musculus
gttgttgtgagttgacacctcagga

SEQ ID NO: 736148 - DNA, 25 bp, Mus musculus
gttgttgtgataccagatgtctctt

SEQ ID NO: 736149 - DNA, 25 bp, Mus musculus
gttgttgtgatagcagatgtctctt

SEQ ID NO: 736150 - DNA, 25 bp, Mus musculus
gttgttgtgttcataagaggcctca

SEQ ID NO: 736151 - DNA, 25 bp, Mus musculus
gttgttgtgttcttaagaggcctca

SEQ ID NO: 736152 - DNA, 25 bp, Mus musculus
gttgttgttaagcttacgtatgtac

SEQ ID NO: 736153 - DNA, 25 bp, Mus musculus
gttgttgttaaggttacgtatgtac

SEQ ID NO: 736154 - DNA, 25 bp, Mus musculus
gttgttgttaatcagtagataatgc

SEQ ID NO: 736155 - DNA, 25 bp, Mus musculus
gttgttgttaatgagtagataatgc

SEQ ID NO: 736156 - DNA, 25 bp, Mus musculus
gttgttgttacgattcattccagtt

SEQ ID NO: 736157 - DNA, 25 bp, Mus musculus
gttgttgttacgtttcattccagtt

SEQ ID NO: 736158 - DNA, 25 bp, Mus musculus
gttgttgttactactgtcctttcat

SEQ ID NO: 736159 - DNA, 25 bp, Mus musculus
gttgttgttacttctgtcctttcat

SEQ ID NO: 736160 - DNA, 25 bp, Mus musculus
gttgttgttatcagtgtcaccgacg

SEQ ID NO: 736161 - DNA, 25 bp, Mus musculus
gttgttgttatcattttgcctacat

SEQ ID NO: 736162 - DNA, 25 bp, Mus musculus
gttgttgttatctgtgtcaccgacg

SEQ ID NO: 736163 - DNA, 25 bp, Mus musculus
gttgttgttatctttttgcctacat

SEQ ID NO: 736164 - DNA, 25 bp, Mus musculus
gttgttgttccacatgacgaccgct

SEQ ID NO: 736165 - DNA, 25 bp, Mus musculus
gttgttgttccagatgacgaccgct

SEQ ID NO: 736166 - DNA, 25 bp, Mus musculus
gttgttgttgagagcctgtcctttc

SEQ ID NO: 736167 - DNA, 25 bp, Mus musculus
gttgttgttgagtgcctgtcctttc

SEQ ID NO: 736168 - DNA, 25 bp, Mus musculus
gttgttgttgctatattttagttga

SEQ ID NO: 736169 - DNA, 25 bp, Mus musculus
gttgttgttgctttattttagttga

SEQ ID NO: 736170 - DNA, 25 bp, Mus musculus
gttgttgtttctagaaccccagcat

SEQ ID NO: 736171 - DNA, 25 bp, Mus musculus
gttgttgtttcttgaaccccagcat

SEQ ID NO: 736172 - DNA, 25 bp, Mus musculus
gttgttgtttttaatctatttggat

SEQ ID NO: 736173 - DNA, 25 bp, Mus musculus
gttgttgttttttatctatttggat

SEQ ID NO: 736174 - DNA, 25 bp, Mus musculus
gttgtttaaacacctaagactcaga

SEQ ID NO: 736175 - DNA, 25 bp, Mus musculus
gttgtttaaacagctaagactcaga

SEQ ID NO: 736176 - DNA, 25 bp, Mus musculus
gttgtttaacttctatcctcaaggt

SEQ ID NO: 736177 - DNA, 25 bp, Mus musculus
gttgtttaacttgtatcctcaaggt

SEQ ID NO: 736178 - DNA, 25 bp, Mus musculus
gttgtttaatatatcttctgtcacc

SEQ ID NO: 736179 - DNA, 25 bp, Mus musculus
gttgtttaatatttcttctgtcacc

SEQ ID NO: 736180 - DNA, 25 bp, Mus musculus
gttgtttacactatgaattcttttg

SEQ ID NO: 736181 - DNA, 25 bp, Mus musculus
gttgtttacactttgaattcttttg

SEQ ID NO: 736182 - DNA, 25 bp, Mus musculus
gttgtttaccagatagacctctgtc

SEQ ID NO: 736183 - DNA, 25 bp, Mus musculus
gttgtttaccagttagacctctgtc

SEQ ID NO: 736184 - DNA, 25 bp, Mus musculus
gttgtttacccaacaagttcctatt

SEQ ID NO: 736185 - DNA, 25 bp, Mus musculus
gttgtttacccatcaagttcctatt

SEQ ID NO: 736186 - DNA, 25 bp, Mus musculus
gttgtttagaaaagttcactgaact

SEQ ID NO: 736187 - DNA, 25 bp, Mus musculus
gttgtttagaaatgttcactgaact

SEQ ID NO: 736188 - DNA, 25 bp, Mus musculus
gttgtttagactatgggaatcctat

SEQ ID NO: 736189 - DNA, 25 bp, Mus musculus
gttgtttagactttgggaatcctat

SEQ ID NO: 736190 - DNA, 25 bp, Mus musculus
gttgtttagcctattctgtgtatac

SEQ ID NO: 736191 - DNA, 25 bp, Mus musculus
gttgtttagccttttctgtgtatac

SEQ ID NO: 736192 - DNA, 25 bp, Mus musculus
gttgtttagggcacacttccactaa

SEQ ID NO: 736193 - DNA, 25 bp, Mus musculus
gttgtttagggctcacttccactaa

SEQ ID NO: 736194 - DNA, 25 bp, Mus musculus
gttgtttaggtcacaattttcccag

SEQ ID NO: 736195 - DNA, 25 bp, Mus musculus
gttgtttaggtctcaattttcccag

SEQ ID NO: 736196 - DNA, 25 bp, Mus musculus
gttgtttagttcatccttgcacaga

SEQ ID NO: 736197 - DNA, 25 bp, Mus musculus
gttgtttagttcttccttgcacaga

SEQ ID NO: 736198 - DNA, 25 bp, Mus musculus
gttgtttatcatcagctgtgctgtg

SEQ ID NO: 736199 - DNA, 25 bp, Mus musculus
gttgtttatcatgagctgtgctgtg

SEQ ID NO: 736200 - DNA, 25 bp, Mus musculus
gttgtttcaagtatacatctctttc

SEQ ID NO: 736201 - DNA, 25 bp, Mus musculus
gttgtttcaagtttacatctctttc

SEQ ID NO: 736202 - DNA, 25 bp, Mus musculus
gttgtttcaatcctgtggacacaca

SEQ ID NO: 736203 - DNA, 25 bp, Mus musculus
gttgtttcaatcgtgtggacacaca

SEQ ID NO: 736204 - DNA, 25 bp, Mus musculus
gttgtttcaattaaggccaagtact

SEQ ID NO: 736205 - DNA, 25 bp, Mus musculus
gttgtttcaatttaggccaagtact

SEQ ID NO: 736206 - DNA, 25 bp, Mus musculus
gttgtttcataaacatgaattccaa

SEQ ID NO: 736207 - DNA, 25 bp, Mus musculus
gttgtttcataatcatgaattccaa

SEQ ID NO: 736208 - DNA, 25 bp, Mus musculus
gttgtttccagaccaccagagacct

SEQ ID NO: 736209 - DNA, 25 bp, Mus musculus
gttgtttccagagcaccagagacct

SEQ ID NO: 736210 - DNA, 25 bp, Mus musculus
gttgtttccagtactctgtcatacc

SEQ ID NO: 736211 - DNA, 25 bp, Mus musculus
gttgtttccagttctctgtcatacc

SEQ ID NO: 736212 - DNA, 25 bp, Mus musculus
gttgtttccatcaatctgcatcagc

SEQ ID NO: 736213 - DNA, 25 bp, Mus musculus
gttgtttccatctatctgcatcagc

SEQ ID NO: 736214 - DNA, 25 bp, Mus musculus
gttgtttcctgtaatgagcattgga

SEQ ID NO: 736215 - DNA, 25 bp, Mus musculus
gttgtttcctgttatgagcattgga

SEQ ID NO: 736216 - DNA, 25 bp, Mus musculus
gttgtttccttgaattggataactg

SEQ ID NO: 736217 - DNA, 25 bp, Mus musculus
gttgtttccttgtattggataactg

SEQ ID NO: 736218 - DNA, 25 bp, Mus musculus
gttgtttcgcggcatacctccagcc

SEQ ID NO: 736219 - DNA, 25 bp, Mus musculus
gttgtttcgcgggatacctccagcc

SEQ ID NO: 736220 - DNA, 25 bp, Mus musculus
gttgtttctcgtcgttgtgtgtgtt

SEQ ID NO: 736221 - DNA, 25 bp, Mus musculus
gttgtttctcgtggttgtgtgtgtt

SEQ ID NO: 736222 - DNA, 25 bp, Mus musculus
gttgtttctggcatttcagggcctg

SEQ ID NO: 736223 - DNA, 25 bp, Mus musculus
gttgtttctggcttttcagggcctg

SEQ ID NO: 736224 - DNA, 25 bp, Mus musculus
gttgtttcttccactaggttgagca

SEQ ID NO: 736225 - DNA, 25 bp, Mus musculus
gttgtttcttcctctaggttgagca

SEQ ID NO: 736226 - DNA, 25 bp, Mus musculus
gttgtttcttgaccgtgatgtttac

SEQ ID NO: 736227 - DNA, 25 bp, Mus musculus
gttgtttcttgagcgtgatgtttac

SEQ ID NO: 736228 - DNA, 25 bp, Mus musculus
gttgtttctttcaagtggtctttgt

SEQ ID NO: 736229 - DNA, 25 bp, Mus musculus
gttgtttctttctagtggtctttgt

SEQ ID NO: 736230 - DNA, 25 bp, Mus musculus
gttgtttgaaaacgccagatcatgg

SEQ ID NO: 736231 - DNA, 25 bp, Mus musculus
gttgtttgaaaaggccagatcatgg

SEQ ID NO: 736232 - DNA, 25 bp, Mus musculus
gttgtttgaactctgcgcgctgtgc

SEQ ID NO: 736233 - DNA, 25 bp, Mus musculus
gttgtttgaactgtgcgcgctgtgc

SEQ ID NO: 736234 - DNA, 25 bp, Mus musculus
gttgtttgaatgagttgctgtgctt

SEQ ID NO: 736235 - DNA, 25 bp, Mus musculus
gttgtttgaatgtgttgctgtgctt

SEQ ID NO: 736236 - DNA, 25 bp, Mus musculus
gttgtttgaattcatctctcatctt

SEQ ID NO: 736237 - DNA, 25 bp, Mus musculus
gttgtttgaattgatctctcatctt

SEQ ID NO: 736238 - DNA, 25 bp, Mus musculus
gttgtttgacaccactgacaggcat

SEQ ID NO: 736239 - DNA, 25 bp, Mus musculus
gttgtttgacacgactgacaggcat

SEQ ID NO: 736240 - DNA, 25 bp, Mus musculus
gttgtttgaggcatgtgactgtcag

SEQ ID NO: 736241 - DNA, 25 bp, Mus musculus
gttgtttgaggcttgtgactgtcag

SEQ ID NO: 736242 - DNA, 25 bp, Mus musculus
gttgtttgatgccacacctgtacag

SEQ ID NO: 736243 - DNA, 25 bp, Mus musculus
gttgtttgatgcgacacctgtacag

SEQ ID NO: 736244 - DNA, 25 bp, Mus musculus
gttgtttgcaaacacccacacaggt

SEQ ID NO: 736245 - DNA, 25 bp, Mus musculus
gttgtttgcaaagacccacacaggt

SEQ ID NO: 736246 - DNA, 25 bp, Mus musculus
gttgtttgcatcctaccccaagtga

SEQ ID NO: 736247 - DNA, 25 bp, Mus musculus
gttgtttgcatcgtaccccaagtga

SEQ ID NO: 736248 - DNA, 25 bp, Mus musculus
gttgtttgcattaaccttaccaata

SEQ ID NO: 736249 - DNA, 25 bp, Mus musculus
gttgtttgcatttaccttaccaata

SEQ ID NO: 736250 - DNA, 25 bp, Mus musculus
gttgtttgccccacagatagcattt

SEQ ID NO: 736251 - DNA, 25 bp, Mus musculus
gttgtttgcccctcagatagcattt

SEQ ID NO: 736252 - DNA, 25 bp, Mus musculus
gttgtttgcgtgaattgtgttttat

SEQ ID NO: 736253 - DNA, 25 bp, Mus musculus
gttgtttgcgtgtattgtgttttat

SEQ ID NO: 736254 - DNA, 25 bp, Mus musculus
gttgtttgtaaacaacaagcccttg

SEQ ID NO: 736255 - DNA, 25 bp, Mus musculus
gttgtttgtaaagaacaagcccttg

SEQ ID NO: 736256 - DNA, 25 bp, Mus musculus
gttgtttgtaaccattggccggttg

SEQ ID NO: 736257 - DNA, 25 bp, Mus musculus
gttgtttgtaacgattggccggttg

SEQ ID NO: 736258 - DNA, 25 bp, Mus musculus
gttgtttgtagccattttctgcttc

SEQ ID NO: 736259 - DNA, 25 bp, Mus musculus
gttgtttgtagcgattttctgcttc

SEQ ID NO: 736260 - DNA, 25 bp, Mus musculus
gttgtttgtatcatcttgctcttat

SEQ ID NO: 736261 - DNA, 25 bp, Mus musculus
gttgtttgtatcttcttgctcttat

SEQ ID NO: 736262 - DNA, 25 bp, Mus musculus
gttgtttgttgcactcgtgaatcaa

SEQ ID NO: 736263 - DNA, 25 bp, Mus musculus
gttgtttgttgctctcgtgaatcaa

SEQ ID NO: 736264 - DNA, 25 bp, Mus musculus
gttgttttaaagacctagagagcac

SEQ ID NO: 736265 - DNA, 25 bp, Mus musculus
gttgttttaaagtcctagagagcac

SEQ ID NO: 736266 - DNA, 25 bp, Mus musculus
gttgttttagtaacctttcagcaag

SEQ ID NO: 736267 - DNA, 25 bp, Mus musculus
gttgttttagtacatgtgcgcctga

SEQ ID NO: 736268 - DNA, 25 bp, Mus musculus
gttgttttagtagatgtgcgcctga

SEQ ID NO: 736269 - DNA, 25 bp, Mus musculus
gttgttttagtatcctttcagcaag

SEQ ID NO: 736270 - DNA, 25 bp, Mus musculus
gttgttttcagtaatctttgcttga

SEQ ID NO: 736271 - DNA, 25 bp, Mus musculus
gttgttttcagttatctttgcttga

SEQ ID NO: 736272 - DNA, 25 bp, Mus musculus
gttgttttcatgaaatgtcctccct

SEQ ID NO: 736273 - DNA, 25 bp, Mus musculus
gttgttttcatgtaatgtcctccct

SEQ ID NO: 736274 - DNA, 25 bp, Mus musculus
gttgttttcctacttaccaagtctg

SEQ ID NO: 736275 - DNA, 25 bp, Mus musculus
gttgttttcctagttaccaagtctg

SEQ ID NO: 736276 - DNA, 25 bp, Mus musculus
gttgttttcgctacactactgagct

SEQ ID NO: 736277 - DNA, 25 bp, Mus musculus
gttgttttcgcttcactactgagct

SEQ ID NO: 736278 - DNA, 25 bp, Mus musculus
gttgttttctccaagactgactaca

SEQ ID NO: 736279 - DNA, 25 bp, Mus musculus
gttgttttctcctagactgactaca

SEQ ID NO: 736280 - DNA, 25 bp, Mus musculus
gttgttttcttcatcattcacaatg

SEQ ID NO: 736281 - DNA, 25 bp, Mus musculus
gttgttttcttcttcattcacaatg

SEQ ID NO: 736282 - DNA, 25 bp, Mus musculus
gttgttttgagaatctgtcatattc

SEQ ID NO: 736283 - DNA, 25 bp, Mus musculus
gttgttttgagattctgtcatattc

SEQ ID NO: 736284 - DNA, 25 bp, Mus musculus
gttgttttgcaacgccgcccacagt

SEQ ID NO: 736285 - DNA, 25 bp, Mus musculus
gttgttttgcaaggccgcccacagt

SEQ ID NO: 736286 - DNA, 25 bp, Mus musculus
gttgttttggtaccctgctttgact

SEQ ID NO: 736287 - DNA, 25 bp, Mus musculus
gttgttttggtagcctgctttgact

SEQ ID NO: 736288 - DNA, 25 bp, Mus musculus
gttgttttgtaaattcaccctgaag

SEQ ID NO: 736289 - DNA, 25 bp, Mus musculus
gttgttttgtaactgatggttcatt

SEQ ID NO: 736290 - DNA, 25 bp, Mus musculus
gttgttttgtaagtgatggttcatt

SEQ ID NO: 736291 - DNA, 25 bp, Mus musculus
gttgttttgtaatttcaccctgaag

SEQ ID NO: 736292 - DNA, 25 bp, Mus musculus
gttgttttgtctaaactatcagtta

SEQ ID NO: 736293 - DNA, 25 bp, Mus musculus
gttgttttgtctaattctgattggt

SEQ ID NO: 736294 - DNA, 25 bp, Mus musculus
gttgttttgtcttaactatcagtta

SEQ ID NO: 736295 - DNA, 25 bp, Mus musculus
gttgttttgtcttattctgattggt

SEQ ID NO: 736296 - DNA, 25 bp, Mus musculus
gttgttttgtggctaggtgactttt

SEQ ID NO: 736297 - DNA, 25 bp, Mus musculus
gttgttttgtgggtaggtgactttt

SEQ ID NO: 736298 - DNA, 25 bp, Mus musculus
gttgttttgttcaccattcacatga

SEQ ID NO: 736299 - DNA, 25 bp, Mus musculus
gttgttttgttctccattcacatga

SEQ ID NO: 736300 - DNA, 25 bp, Mus musculus
gttgtttttcaaagactggctgcag

SEQ ID NO: 736301 - DNA, 25 bp, Mus musculus
gttgtttttcaatgactggctgcag

SEQ ID NO: 736302 - DNA, 25 bp, Mus musculus
gttgtttttgaaccacctagctcca

SEQ ID NO: 736303 - DNA, 25 bp, Mus musculus
gttgtttttgaactttacaagctat

SEQ ID NO: 736304 - DNA, 25 bp, Mus musculus
gttgtttttgaagcacctagctcca

SEQ ID NO: 736305 - DNA, 25 bp, Mus musculus
gttgtttttgaagtttacaagctat

SEQ ID NO: 736306 - DNA, 25 bp, Mus musculus
gttgtttttgatactctggctatta

SEQ ID NO: 736307 - DNA, 25 bp, Mus musculus
gttgtttttgattctctggctatta

SEQ ID NO: 736308 - DNA, 25 bp, Mus musculus
gttgtttttgtaaatccattcagtt

SEQ ID NO: 736309 - DNA, 25 bp, Mus musculus
gttgtttttgtatatccattcagtt

SEQ ID NO: 736310 - DNA, 25 bp, Mus musculus
gtttaaaaaattctgcagaagttgc

SEQ ID NO: 736311 - DNA, 25 bp, Mus musculus
gtttaaaaaattgtgcagaagttgc

SEQ ID NO: 736312 - DNA, 25 bp, Mus musculus
gtttaaaaccctagagccacagaat

SEQ ID NO: 736313 - DNA, 25 bp, Mus musculus
gtttaaaacccttgagccacagaat

SEQ ID NO: 736314 - DNA, 25 bp, Mus musculus
gtttaaaacctaaggcatctgcggg

SEQ ID NO: 736315 - DNA, 25 bp, Mus musculus
gtttaaaacctatggcatctgcggg

SEQ ID NO: 736316 - DNA, 25 bp, Mus musculus
gtttaaaagtaaatggctgccattc

SEQ ID NO: 736317 - DNA, 25 bp, Mus musculus
gtttaaaagtaattggctgccattc

SEQ ID NO: 736318 - DNA, 25 bp, Mus musculus
gtttaaacactcactgtaccgaatt

SEQ ID NO: 736319 - DNA, 25 bp, Mus musculus
gtttaaacactctctgtaccgaatt

SEQ ID NO: 736320 - DNA, 25 bp, Mus musculus
gtttaaaccattactgatagctgat

SEQ ID NO: 736321 - DNA, 25 bp, Mus musculus
gtttaaaccatttctgatagctgat

SEQ ID NO: 736322 - DNA, 25 bp, Mus musculus
gtttaaacctctaaacctctcagct

SEQ ID NO: 736323 - DNA, 25 bp, Mus musculus
gtttaaacctcttaacctctcagct

SEQ ID NO: 736324 - DNA, 25 bp, Mus musculus
gtttaaactcttatgaacctgactg

SEQ ID NO: 736325 - DNA, 25 bp, Mus musculus
gtttaaactcttttgaacctgactg

SEQ ID NO: 736326 - DNA, 25 bp, Mus musculus
gtttaaactgaacactttgccactg

SEQ ID NO: 736327 - DNA, 25 bp, Mus musculus
gtttaaactgaagactttgccactg

SEQ ID NO: 736328 - DNA, 25 bp, Mus musculus
gtttaaactgctctgttggtccttt

SEQ ID NO: 736329 - DNA, 25 bp, Mus musculus
gtttaaactgctgtgttggtccttt

SEQ ID NO: 736330 - DNA, 25 bp, Mus musculus
gtttaaacttgcacatgccccaccg

SEQ ID NO: 736331 - DNA, 25 bp, Mus musculus
gtttaaacttgctcatgccccaccg

SEQ ID NO: 736332 - DNA, 25 bp, Mus musculus
gtttaaagcagcagagtttgccaaa

SEQ ID NO: 736333 - DNA, 25 bp, Mus musculus
gtttaaagcagctgagtttgccaaa

SEQ ID NO: 736334 - DNA, 25 bp, Mus musculus
gtttaaagctggacactcctagtgc

SEQ ID NO: 736335 - DNA, 25 bp, Mus musculus
gtttaaagctggtcactcctagtgc

SEQ ID NO: 736336 - DNA, 25 bp, Mus musculus
gtttaaagctgtacctgtatccaac

SEQ ID NO: 736337 - DNA, 25 bp, Mus musculus
gtttaaagctgttcctgtatccaac

SEQ ID NO: 736338 - DNA, 25 bp, Mus musculus
gtttaaaggccactgtatctcgtac

SEQ ID NO: 736339 - DNA, 25 bp, Mus musculus
gtttaaaggccagtgtatctcgtac

SEQ ID NO: 736340 - DNA, 25 bp, Mus musculus
gtttaaagtgctagcgcctcggttc

SEQ ID NO: 736341 - DNA, 25 bp, Mus musculus
gtttaaagtgcttgcgcctcggttc

SEQ ID NO: 736342 - DNA, 25 bp, Mus musculus
gtttaaagttcaaaccatactgtca

SEQ ID NO: 736343 - DNA, 25 bp, Mus musculus
gtttaaagttcataccatactgtca

SEQ ID NO: 736344 - DNA, 25 bp, Mus musculus
gtttaaataaaaaaggctgctcctt

SEQ ID NO: 736345 - DNA, 25 bp, Mus musculus
gtttaaataaaataggctgctcctt

SEQ ID NO: 736346 - DNA, 25 bp, Mus musculus
gtttaaatactgactagcatatata

SEQ ID NO: 736347 - DNA, 25 bp, Mus musculus
gtttaaatactgaggctcagacaca

SEQ ID NO: 736348 - DNA, 25 bp, Mus musculus
gtttaaatactgtctagcatatata

SEQ ID NO: 736349 - DNA, 25 bp, Mus musculus
gtttaaatactgtggctcagacaca

SEQ ID NO: 736350 - DNA, 25 bp, Mus musculus
gtttaaatagcacccacatatcctg

SEQ ID NO: 736351 - DNA, 25 bp, Mus musculus
gtttaaatagcagccacatatcctg

SEQ ID NO: 736352 - DNA, 25 bp, Mus musculus
gtttaaatctagaactcagtagcca

SEQ ID NO: 736353 - DNA, 25 bp, Mus musculus
gtttaaatctagtactcagtagcca

SEQ ID NO: 736354 - DNA, 25 bp, Mus musculus
gtttaaatgaaccttttgacattca

SEQ ID NO: 736355 - DNA, 25 bp, Mus musculus
gtttaaatgaacgttttgacattca

SEQ ID NO: 736356 - DNA, 25 bp, Mus musculus
gtttaaatgccaagtcagtgcacaa

SEQ ID NO: 736357 - DNA, 25 bp, Mus musculus
gtttaaatgccatgtcagtgcacaa

SEQ ID NO: 736358 - DNA, 25 bp, Mus musculus
gtttaaattgaaactcgtggtggtt

SEQ ID NO: 736359 - DNA, 25 bp, Mus musculus
gtttaaattgaatctcgtggtggtt

SEQ ID NO: 736360 - DNA, 25 bp, Mus musculus
gtttaacaagacattcacaggcact

SEQ ID NO: 736361 - DNA, 25 bp, Mus musculus
gtttaacaagactttcacaggcact

SEQ ID NO: 736362 - DNA, 25 bp, Mus musculus
gtttaacaattacatgcttggcctg

SEQ ID NO: 736363 - DNA, 25 bp, Mus musculus
gtttaacaattagatgcttggcctg

SEQ ID NO: 736364 - DNA, 25 bp, Mus musculus
gtttaacaatttagctgctcagctt

SEQ ID NO: 736365 - DNA, 25 bp, Mus musculus
gtttaacaattttgctgctcagctt

SEQ ID NO: 736366 - DNA, 25 bp, Mus musculus
gtttaacactagcacgaacgctgtt

SEQ ID NO: 736367 - DNA, 25 bp, Mus musculus
gtttaacactaggacgaacgctgtt

SEQ ID NO: 736368 - DNA, 25 bp, Mus musculus
gtttaacaggaactgactcctctca

SEQ ID NO: 736369 - DNA, 25 bp, Mus musculus
gtttaacaggaagtgactcctctca

SEQ ID NO: 736370 - DNA, 25 bp, Mus musculus
gtttaacatctcagatgctctgtta

SEQ ID NO: 736371 - DNA, 25 bp, Mus musculus
gtttaacatctctgatgctctgtta

SEQ ID NO: 736372 - DNA, 25 bp, Mus musculus
gtttaacatgcactcggtatgtttg

SEQ ID NO: 736373 - DNA, 25 bp, Mus musculus
gtttaacatgcagtcggtatgtttg

SEQ ID NO: 736374 - DNA, 25 bp, Mus musculus
gtttaacatgccaattcttttcagt

SEQ ID NO: 736375 - DNA, 25 bp, Mus musculus
gtttaacatgcctattcttttcagt

SEQ ID NO: 736376 - DNA, 25 bp, Mus musculus
gtttaacatgtacctcacacgggac

SEQ ID NO: 736377 - DNA, 25 bp, Mus musculus
gtttaacatgtagctcacacgggac

SEQ ID NO: 736378 - DNA, 25 bp, Mus musculus
gtttaaccaaatctacccttgcatt

SEQ ID NO: 736379 - DNA, 25 bp, Mus musculus
gtttaaccaaatgtacccttgcatt

SEQ ID NO: 736380 - DNA, 25 bp, Mus musculus
gtttaaccacctattgaatatggtg

SEQ ID NO: 736381 - DNA, 25 bp, Mus musculus
gtttaaccaccttttgaatatggtg

SEQ ID NO: 736382 - DNA, 25 bp, Mus musculus
gtttaacccctgagagcctcagttt

SEQ ID NO: 736383 - DNA, 25 bp, Mus musculus
gtttaacccctgtgagcctcagttt

SEQ ID NO: 736384 - DNA, 25 bp, Mus musculus
gtttaaccgcttcagtactgcgact

SEQ ID NO: 736385 - DNA, 25 bp, Mus musculus
gtttaaccgcttgagtactgcgact

SEQ ID NO: 736386 - DNA, 25 bp, Mus musculus
gtttaacctcagacgttatcacaca

SEQ ID NO: 736387 - DNA, 25 bp, Mus musculus
gtttaacctcagtcgttatcacaca

SEQ ID NO: 736388 - DNA, 25 bp, Mus musculus
gtttaacgagagcttcgccgagatg

SEQ ID NO: 736389 - DNA, 25 bp, Mus musculus
gtttaacgagaggttcgccgagatg

SEQ ID NO: 736390 - DNA, 25 bp, Mus musculus
gtttaacgatgcaaggaggctccat

SEQ ID NO: 736391 - DNA, 25 bp, Mus musculus
gtttaacgatgctaggaggctccat

SEQ ID NO: 736392 - DNA, 25 bp, Mus musculus
gtttaacgatggagaaaggcccttg

SEQ ID NO: 736393 - DNA, 25 bp, Mus musculus
gtttaacgatggtgaaaggcccttg

SEQ ID NO: 736394 - DNA, 25 bp, Mus musculus
gtttaacggatgagccgagccatgg

SEQ ID NO: 736395 - DNA, 25 bp, Mus musculus
gtttaacggatgtgccgagccatgg

SEQ ID NO: 736396 - DNA, 25 bp, Mus musculus
gtttaactaaacctcagcttgcctt

SEQ ID NO: 736397 - DNA, 25 bp, Mus musculus
gtttaactaaacgtcagcttgcctt

SEQ ID NO: 736398 - DNA, 25 bp, Mus musculus
gtttaactaactacgggcagggctg

SEQ ID NO: 736399 - DNA, 25 bp, Mus musculus
gtttaactaacttcgggcagggctg

SEQ ID NO: 736400 - DNA, 25 bp, Mus musculus
gtttaactagccagatccgagacgt

SEQ ID NO: 736401 - DNA, 25 bp, Mus musculus
gtttaactagcctgatccgagacgt

SEQ ID NO: 736402 - DNA, 25 bp, Mus musculus
gtttaactcacacatcttagatttg

SEQ ID NO: 736403 - DNA, 25 bp, Mus musculus
gtttaactcacagatcttagatttg

SEQ ID NO: 736404 - DNA, 25 bp, Mus musculus
gtttaactcagacatcacgtgccag

SEQ ID NO: 736405 - DNA, 25 bp, Mus musculus
gtttaactcagagatcacgtgccag

SEQ ID NO: 736406 - DNA, 25 bp, Mus musculus
gtttaactggatctgaggagctgct

SEQ ID NO: 736407 - DNA, 25 bp, Mus musculus
gtttaactggatgtgaggagctgct

SEQ ID NO: 736408 - DNA, 25 bp, Mus musculus
gtttaactgtctcagaagggaccat

SEQ ID NO: 736409 - DNA, 25 bp, Mus musculus
gtttaactgtctgagaagggaccat

SEQ ID NO: 736410 - DNA, 25 bp, Mus musculus
gtttaacttcatagcttgtttggtt

SEQ ID NO: 736411 - DNA, 25 bp, Mus musculus
gtttaacttcattgcttgtttggtt

SEQ ID NO: 736412 - DNA, 25 bp, Mus musculus
gtttaacttcttagggtcagtgcag

SEQ ID NO: 736413 - DNA, 25 bp, Mus musculus
gtttaacttctttgggtcagtgcag

SEQ ID NO: 736414 - DNA, 25 bp, Mus musculus
gtttaacttggaatcaggtcactgt

SEQ ID NO: 736415 - DNA, 25 bp, Mus musculus
gtttaacttggattcaggtcactgt

SEQ ID NO: 736416 - DNA, 25 bp, Mus musculus
gtttaagaactcaacagcttgtata

SEQ ID NO: 736417 - DNA, 25 bp, Mus musculus
gtttaagaactccatctcaaggtct

SEQ ID NO: 736418 - DNA, 25 bp, Mus musculus
gtttaagaactcgatctcaaggtct

SEQ ID NO: 736419 - DNA, 25 bp, Mus musculus
gtttaagaactctacagcttgtata

SEQ ID NO: 736420 - DNA, 25 bp, Mus musculus
gtttaagaagcccaacttgcactca

SEQ ID NO: 736421 - DNA, 25 bp, Mus musculus
gtttaagaagccgaacttgcactca

SEQ ID NO: 736422 - DNA, 25 bp, Mus musculus
gtttaagaatatacactgctcagct

SEQ ID NO: 736423 - DNA, 25 bp, Mus musculus
gtttaagaatattcactgctcagct

SEQ ID NO: 736424 - DNA, 25 bp, Mus musculus
gtttaagaatcaccagaggccaaag

SEQ ID NO: 736425 - DNA, 25 bp, Mus musculus
gtttaagaatcagcagaggccaaag

SEQ ID NO: 736426 - DNA, 25 bp, Mus musculus
gtttaagaggcacagccttcctgga

SEQ ID NO: 736427 - DNA, 25 bp, Mus musculus
gtttaagaggcagagccttcctgga

SEQ ID NO: 736428 - DNA, 25 bp, Mus musculus
gtttaagagtctaccagagtatctg

SEQ ID NO: 736429 - DNA, 25 bp, Mus musculus
gtttaagagtcttccagagtatctg

SEQ ID NO: 736430 - DNA, 25 bp, Mus musculus
gtttaagatgttccctcgtattgta

SEQ ID NO: 736431 - DNA, 25 bp, Mus musculus
gtttaagatgttgcctcgtattgta

SEQ ID NO: 736432 - DNA, 25 bp, Mus musculus
gtttaagattcacaccatgtccttg

SEQ ID NO: 736433 - DNA, 25 bp, Mus musculus
gtttaagattcagaccatgtccttg

SEQ ID NO: 736434 - DNA, 25 bp, Mus musculus
gtttaagattgacaacctaagggat

SEQ ID NO: 736435 - DNA, 25 bp, Mus musculus
gtttaagattgagaacctaagggat

SEQ ID NO: 736436 - DNA, 25 bp, Mus musculus
gtttaagcagttactcctgtcagga

SEQ ID NO: 736437 - DNA, 25 bp, Mus musculus
gtttaagcagtttctcctgtcagga

SEQ ID NO: 736438 - DNA, 25 bp, Mus musculus
gtttaagcgggcatgctccagaggt

SEQ ID NO: 736439 - DNA, 25 bp, Mus musculus
gtttaagcgggcttgctccagaggt

SEQ ID NO: 736440 - DNA, 25 bp, Mus musculus
gtttaagctagcatcagggtctggg

SEQ ID NO: 736441 - DNA, 25 bp, Mus musculus
gtttaagctagcttcagggtctggg

SEQ ID NO: 736442 - DNA, 25 bp, Mus musculus
gtttaagctcaacgtcatccgctct

SEQ ID NO: 736443 - DNA, 25 bp, Mus musculus
gtttaagctcaaggtcatccgctct

SEQ ID NO: 736444 - DNA, 25 bp, Mus musculus
gtttaagctgttactatgtatgtga

SEQ ID NO: 736445 - DNA, 25 bp, Mus musculus
gtttaagctgtttctatgtatgtga

SEQ ID NO: 736446 - DNA, 25 bp, Mus musculus
gtttaaggagcacactcagtattca

SEQ ID NO: 736447 - DNA, 25 bp, Mus musculus
gtttaaggagcacccaccacagagc

SEQ ID NO: 736448 - DNA, 25 bp, Mus musculus
gtttaaggagcagactcagtattca

SEQ ID NO: 736449 - DNA, 25 bp, Mus musculus
gtttaaggagcagccaccacagagc

SEQ ID NO: 736450 - DNA, 25 bp, Mus musculus
gtttaaggctaacacctgagctttg

SEQ ID NO: 736451 - DNA, 25 bp, Mus musculus
gtttaaggctaagacctgagctttg

SEQ ID NO: 736452 - DNA, 25 bp, Mus musculus
gtttaaggcttgcacatcttccctc

SEQ ID NO: 736453 - DNA, 25 bp, Mus musculus
gtttaaggcttggacatcttccctc

SEQ ID NO: 736454 - DNA, 25 bp, Mus musculus
gtttaagggtccacacaggcagagt

SEQ ID NO: 736455 - DNA, 25 bp, Mus musculus
gtttaagggtcctcacaggcagagt

SEQ ID NO: 736456 - DNA, 25 bp, Mus musculus
gtttaaggtcatactcagtttgagg

SEQ ID NO: 736457 - DNA, 25 bp, Mus musculus
gtttaaggtcattctcagtttgagg

SEQ ID NO: 736458 - DNA, 25 bp, Mus musculus
gtttaaggtttaatctgcagtatca

SEQ ID NO: 736459 - DNA, 25 bp, Mus musculus
gtttaaggtttattctgcagtatca

SEQ ID NO: 736460 - DNA, 25 bp, Mus musculus
gtttaagtagatatctcatggtcat

SEQ ID NO: 736461 - DNA, 25 bp, Mus musculus
gtttaagtagatttctcatggtcat

SEQ ID NO: 736462 - DNA, 25 bp, Mus musculus
gtttaagtatttctgactatgctaa

SEQ ID NO: 736463 - DNA, 25 bp, Mus musculus
gtttaagtatttgtgactatgctaa

SEQ ID NO: 736464 - DNA, 25 bp, Mus musculus
gtttaagtcaaacgctccacaataa

SEQ ID NO: 736465 - DNA, 25 bp, Mus musculus
gtttaagtcaaaggctccacaataa

SEQ ID NO: 736466 - DNA, 25 bp, Mus musculus
gtttaagtcacaattacagtatcat

SEQ ID NO: 736467 - DNA, 25 bp, Mus musculus
gtttaagtcacatttacagtatcat

SEQ ID NO: 736468 - DNA, 25 bp, Mus musculus
gtttaagtcaccagcttactcgtca

SEQ ID NO: 736469 - DNA, 25 bp, Mus musculus
gtttaagtcacctgcttactcgtca

SEQ ID NO: 736470 - DNA, 25 bp, Mus musculus
gtttaagtccatctcgggaaccatc

SEQ ID NO: 736471 - DNA, 25 bp, Mus musculus
gtttaagtccatcttccttgttcag

SEQ ID NO: 736472 - DNA, 25 bp, Mus musculus
gtttaagtccatgtcgggaaccatc

SEQ ID NO: 736473 - DNA, 25 bp, Mus musculus
gtttaagtccatgttccttgttcag

SEQ ID NO: 736474 - DNA, 25 bp, Mus musculus
gtttaagtcctaccctccaacatga

SEQ ID NO: 736475 - DNA, 25 bp, Mus musculus
gtttaagtcctagcctccaacatga

SEQ ID NO: 736476 - DNA, 25 bp, Mus musculus
gtttaagtctgtctgatcacccaag

SEQ ID NO: 736477 - DNA, 25 bp, Mus musculus
gtttaagtctgtgtgatcacccaag

SEQ ID NO: 736478 - DNA, 25 bp, Mus musculus
gtttaagtcttcaggcagttaccat

SEQ ID NO: 736479 - DNA, 25 bp, Mus musculus
gtttaagtcttctggcagttaccat

SEQ ID NO: 736480 - DNA, 25 bp, Mus musculus
gtttaagttcctagacgccgttgcg

SEQ ID NO: 736481 - DNA, 25 bp, Mus musculus
gtttaagttccttgacgccgttgcg

SEQ ID NO: 736482 - DNA, 25 bp, Mus musculus
gtttaagttgacactacccttccag

SEQ ID NO: 736483 - DNA, 25 bp, Mus musculus
gtttaagttgactctacccttccag

SEQ ID NO: 736484 - DNA, 25 bp, Mus musculus
gtttaagtttcaagcactggtacca

SEQ ID NO: 736485 - DNA, 25 bp, Mus musculus
gtttaagtttcatgcactggtacca

SEQ ID NO: 736486 - DNA, 25 bp, Mus musculus
gtttaataagagaacccatgcccac

SEQ ID NO: 736487 - DNA, 25 bp, Mus musculus
gtttaataagagtacccatgcccac

SEQ ID NO: 736488 - DNA, 25 bp, Mus musculus
gtttaatacactccattctaggcca

SEQ ID NO: 736489 - DNA, 25 bp, Mus musculus
gtttaatacactgcattctaggcca

SEQ ID NO: 736490 - DNA, 25 bp, Mus musculus
gtttaatacagacttctgacctcca

SEQ ID NO: 736491 - DNA, 25 bp, Mus musculus
gtttaatacagagttctgacctcca

SEQ ID NO: 736492 - DNA, 25 bp, Mus musculus
gtttaataccttctgtttatccatt

SEQ ID NO: 736493 - DNA, 25 bp, Mus musculus
gtttaataccttgtgtttatccatt

SEQ ID NO: 736494 - DNA, 25 bp, Mus musculus
gtttaatacgacagattcccatccc

SEQ ID NO: 736495 - DNA, 25 bp, Mus musculus
gtttaatacgactgattcccatccc

SEQ ID NO: 736496 - DNA, 25 bp, Mus musculus
gtttaatacttgacaaaccttggca

SEQ ID NO: 736497 - DNA, 25 bp, Mus musculus
gtttaatacttgtcaaaccttggca

SEQ ID NO: 736498 - DNA, 25 bp, Mus musculus
gtttaatattgtacctcactgtgga

SEQ ID NO: 736499 - DNA, 25 bp, Mus musculus
gtttaatattgttcctcactgtgga

SEQ ID NO: 736500 - DNA, 25 bp, Mus musculus
gtttaatcaaacagccaggcgtccc

SEQ ID NO: 736501 - DNA, 25 bp, Mus musculus
gtttaatcaaactgccaggcgtccc

SEQ ID NO: 736502 - DNA, 25 bp, Mus musculus
gtttaatcacagctagggtccttta

SEQ ID NO: 736503 - DNA, 25 bp, Mus musculus
gtttaatcacaggtagggtccttta

SEQ ID NO: 736504 - DNA, 25 bp, Mus musculus
gtttaatcactgacttcaaaggagg

SEQ ID NO: 736505 - DNA, 25 bp, Mus musculus
gtttaatcactgtcttcaaaggagg

SEQ ID NO: 736506 - DNA, 25 bp, Mus musculus
gtttaatccataattgtcctctcca

SEQ ID NO: 736507 - DNA, 25 bp, Mus musculus
gtttaatccatatttgtcctctcca

SEQ ID NO: 736508 - DNA, 25 bp, Mus musculus
gtttaatccgatactgtggaatcaa

SEQ ID NO: 736509 - DNA, 25 bp, Mus musculus
gtttaatccgattctgtggaatcaa

SEQ ID NO: 736510 - DNA, 25 bp, Mus musculus
gtttaatccttgagtcccaggtggc

SEQ ID NO: 736511 - DNA, 25 bp, Mus musculus
gtttaatccttgtgtcccaggtggc

SEQ ID NO: 736512 - DNA, 25 bp, Mus musculus
gtttaatcgcccacgaaaccagaag

SEQ ID NO: 736513 - DNA, 25 bp, Mus musculus
gtttaatcgccctcgaaaccagaag

SEQ ID NO: 736514 - DNA, 25 bp, Mus musculus
gtttaatctattctcacgcacacat

SEQ ID NO: 736515 - DNA, 25 bp, Mus musculus
gtttaatctattgtcacgcacacat

SEQ ID NO: 736516 - DNA, 25 bp, Mus musculus
gtttaatctcggcaatattttcagt

SEQ ID NO: 736517 - DNA, 25 bp, Mus musculus
gtttaatctcgggaatattttcagt

SEQ ID NO: 736518 - DNA, 25 bp, Mus musculus
gtttaatgaccgatacagatggaca

SEQ ID NO: 736519 - DNA, 25 bp, Mus musculus
gtttaatgaccgttacagatggaca

SEQ ID NO: 736520 - DNA, 25 bp, Mus musculus
gtttaatgccataaggcgtcaacgt

SEQ ID NO: 736521 - DNA, 25 bp, Mus musculus
gtttaatgccattaggcgtcaacgt

SEQ ID NO: 736522 - DNA, 25 bp, Mus musculus
gtttaatggcatctgttactccgaa

SEQ ID NO: 736523 - DNA, 25 bp, Mus musculus
gtttaatggcatgtgttactccgaa

SEQ ID NO: 736524 - DNA, 25 bp, Mus musculus
gtttaatgggtgatctcttctcgaa

SEQ ID NO: 736525 - DNA, 25 bp, Mus musculus
gtttaatgggtgttctcttctcgaa

SEQ ID NO: 736526 - DNA, 25 bp, Mus musculus
gtttaatgtcatctatccccggaca

SEQ ID NO: 736527 - DNA, 25 bp, Mus musculus
gtttaatgtcatgtatccccggaca

SEQ ID NO: 736528 - DNA, 25 bp, Mus musculus
gtttaatgtggccttggtcttgcaa

SEQ ID NO: 736529 - DNA, 25 bp, Mus musculus
gtttaatgtggcgttggtcttgcaa

SEQ ID NO: 736530 - DNA, 25 bp, Mus musculus
gtttaatgttaaatgagggcctggg

SEQ ID NO: 736531 - DNA, 25 bp, Mus musculus
gtttaatgttaattgagggcctggg

SEQ ID NO: 736532 - DNA, 25 bp, Mus musculus
gtttaatgttttcgcttgtaattca

SEQ ID NO: 736533 - DNA, 25 bp, Mus musculus
gtttaatgttttcgtcctcacacag

SEQ ID NO: 736534 - DNA, 25 bp, Mus musculus
gtttaatgttttggcttgtaattca

SEQ ID NO: 736535 - DNA, 25 bp, Mus musculus
gtttaatgttttggtcctcacacag

SEQ ID NO: 736536 - DNA, 25 bp, Mus musculus
gtttaattaaccattgctccactct

SEQ ID NO: 736537 - DNA, 25 bp, Mus musculus
gtttaattaacctttgctccactct

SEQ ID NO: 736538 - DNA, 25 bp, Mus musculus
gtttaattaaggaccatcgtcacca

SEQ ID NO: 736539 - DNA, 25 bp, Mus musculus
gtttaattaaggtccatcgtcacca

SEQ ID NO: 736540 - DNA, 25 bp, Mus musculus
gtttaattacacaactccacatttg

SEQ ID NO: 736541 - DNA, 25 bp, Mus musculus
gtttaattacactactccacatttg

SEQ ID NO: 736542 - DNA, 25 bp, Mus musculus
gtttaattagtaaagtagcacacga

SEQ ID NO: 736543 - DNA, 25 bp, Mus musculus
gtttaattagtatagtagcacacga

SEQ ID NO: 736544 - DNA, 25 bp, Mus musculus
gtttaattccgaaaagcacctgtca

SEQ ID NO: 736545 - DNA, 25 bp, Mus musculus
gtttaattccgataagcacctgtca

SEQ ID NO: 736546 - DNA, 25 bp, Mus musculus
gtttaattcgataccgtgcacgctg

SEQ ID NO: 736547 - DNA, 25 bp, Mus musculus
gtttaattcgattccgtgcacgctg

SEQ ID NO: 736548 - DNA, 25 bp, Mus musculus
gtttaatttccgacctgaatcatgc

SEQ ID NO: 736549 - DNA, 25 bp, Mus musculus
gtttaatttccgtcctgaatcatgc

SEQ ID NO: 736550 - DNA, 25 bp, Mus musculus
gtttacaaacctaacgacttcagat

SEQ ID NO: 736551 - DNA, 25 bp, Mus musculus
gtttacaaaccttacgacttcagat

SEQ ID NO: 736552 - DNA, 25 bp, Mus musculus
gtttacaaagaccaccaggtggtgg

SEQ ID NO: 736553 - DNA, 25 bp, Mus musculus
gtttacaaagacgaccaggtggtgg

SEQ ID NO: 736554 - DNA, 25 bp, Mus musculus
gtttacaaagccaaccatcctaagt

SEQ ID NO: 736555 - DNA, 25 bp, Mus musculus
gtttacaaagcctaccatcctaagt

SEQ ID NO: 736556 - DNA, 25 bp, Mus musculus
gtttacaaatgcctcctgtttgatc

SEQ ID NO: 736557 - DNA, 25 bp, Mus musculus
gtttacaaatgcgtcctgtttgatc

SEQ ID NO: 736558 - DNA, 25 bp, Mus musculus
gtttacaacactacacgttttgaat

SEQ ID NO: 736559 - DNA, 25 bp, Mus musculus
gtttacaacacttcacgttttgaat

SEQ ID NO: 736560 - DNA, 25 bp, Mus musculus
gtttacaacatcattggaggacttg

SEQ ID NO: 736561 - DNA, 25 bp, Mus musculus
gtttacaacatctttggaggacttg

SEQ ID NO: 736562 - DNA, 25 bp, Mus musculus
gtttacaaccacctgtgattccggc

SEQ ID NO: 736563 - DNA, 25 bp, Mus musculus
gtttacaaccacgtgtgattccggc

SEQ ID NO: 736564 - DNA, 25 bp, Mus musculus
gtttacaacctcacaaaatccatgg

SEQ ID NO: 736565 - DNA, 25 bp, Mus musculus
gtttacaacctctcaaaatccatgg

SEQ ID NO: 736566 - DNA, 25 bp, Mus musculus
gtttacaactgaactacaactatag

SEQ ID NO: 736567 - DNA, 25 bp, Mus musculus
gtttacaactgaaggctcacccaca

SEQ ID NO: 736568 - DNA, 25 bp, Mus musculus
gtttacaactgatctacaactatag

SEQ ID NO: 736569 - DNA, 25 bp, Mus musculus
gtttacaactgatggctcacccaca

SEQ ID NO: 736570 - DNA, 25 bp, Mus musculus
gtttacaaggctctgtctgttcaca

SEQ ID NO: 736571 - DNA, 25 bp, Mus musculus
gtttacaaggctgtgtctgttcaca

SEQ ID NO: 736572 - DNA, 25 bp, Mus musculus
gtttacaagttaagccacacaaaaa

SEQ ID NO: 736573 - DNA, 25 bp, Mus musculus
gtttacaagttatgccacacaaaaa

SEQ ID NO: 736574 - DNA, 25 bp, Mus musculus
gtttacaatacacccctgttaggct

SEQ ID NO: 736575 - DNA, 25 bp, Mus musculus
gtttacaatacagccctgttaggct

SEQ ID NO: 736576 - DNA, 25 bp, Mus musculus
gtttacaatcaacacgactacatgg

SEQ ID NO: 736577 - DNA, 25 bp, Mus musculus
gtttacaatcaagacgactacatgg

SEQ ID NO: 736578 - DNA, 25 bp, Mus musculus
gtttacaatgcaactgacctgtact

SEQ ID NO: 736579 - DNA, 25 bp, Mus musculus
gtttacaatgcatctgacctgtact

SEQ ID NO: 736580 - DNA, 25 bp, Mus musculus
gtttacaattgacctccgagataca

SEQ ID NO: 736581 - DNA, 25 bp, Mus musculus
gtttacaattgagctccgagataca

SEQ ID NO: 736582 - DNA, 25 bp, Mus musculus
gtttacacaaaccattgatagccat

SEQ ID NO: 736583 - DNA, 25 bp, Mus musculus
gtttacacaaacgattgatagccat

SEQ ID NO: 736584 - DNA, 25 bp, Mus musculus
gtttacacactgaattatctcccga

SEQ ID NO: 736585 - DNA, 25 bp, Mus musculus
gtttacacactgtattatctcccga

SEQ ID NO: 736586 - DNA, 25 bp, Mus musculus
gtttacacagcacacacctttgaaa

SEQ ID NO: 736587 - DNA, 25 bp, Mus musculus
gtttacacagcagacacctttgaaa

SEQ ID NO: 736588 - DNA, 25 bp, Mus musculus
gtttacacaggcaagtagtcccgaa

SEQ ID NO: 736589 - DNA, 25 bp, Mus musculus
gtttacacaggctagtagtcccgaa

SEQ ID NO: 736590 - DNA, 25 bp, Mus musculus
gtttacacagttaatcgacaacctg

SEQ ID NO: 736591 - DNA, 25 bp, Mus musculus
gtttacacagtttatcgacaacctg

SEQ ID NO: 736592 - DNA, 25 bp, Mus musculus
gtttacacatcacagctgttcagat

SEQ ID NO: 736593 - DNA, 25 bp, Mus musculus
gtttacacatcagagctgttcagat

SEQ ID NO: 736594 - DNA, 25 bp, Mus musculus
gtttacacattaagattactacaaa

SEQ ID NO: 736595 - DNA, 25 bp, Mus musculus
gtttacacattactgatgggctgat

SEQ ID NO: 736596 - DNA, 25 bp, Mus musculus
gtttacacattagtgatgggctgat

SEQ ID NO: 736597 - DNA, 25 bp, Mus musculus
gtttacacattatgattactacaaa

SEQ ID NO: 736598 - DNA, 25 bp, Mus musculus
gtttacacatttagcacttgggagg

SEQ ID NO: 736599 - DNA, 25 bp, Mus musculus
gtttacacattttgcacttgggagg

SEQ ID NO: 736600 - DNA, 25 bp, Mus musculus
gtttacaccacgagcattgttccta

SEQ ID NO: 736601 - DNA, 25 bp, Mus musculus
gtttacaccacgtgcattgttccta

SEQ ID NO: 736602 - DNA, 25 bp, Mus musculus
gtttacaccccgcataatctagcag

SEQ ID NO: 736603 - DNA, 25 bp, Mus musculus
gtttacaccccggataatctagcag

SEQ ID NO: 736604 - DNA, 25 bp, Mus musculus
gtttacactgacattggcattttta

SEQ ID NO: 736605 - DNA, 25 bp, Mus musculus
gtttacactgactttggcattttta

SEQ ID NO: 736606 - DNA, 25 bp, Mus musculus
gtttacagaaccatttgcagcctca

SEQ ID NO: 736607 - DNA, 25 bp, Mus musculus
gtttacagaaccttttgcagcctca

SEQ ID NO: 736608 - DNA, 25 bp, Mus musculus
gtttacagacacattgattggcaat

SEQ ID NO: 736609 - DNA, 25 bp, Mus musculus
gtttacagacactttgattggcaat

SEQ ID NO: 736610 - DNA, 25 bp, Mus musculus
gtttacagaccaaagtgtgatctca

SEQ ID NO: 736611 - DNA, 25 bp, Mus musculus
gtttacagaccatagtgtgatctca

SEQ ID NO: 736612 - DNA, 25 bp, Mus musculus
gtttacagactacaccacacatttg

SEQ ID NO: 736613 - DNA, 25 bp, Mus musculus
gtttacagactagaccacacatttg

SEQ ID NO: 736614 - DNA, 25 bp, Mus musculus
gtttacagacttacatcgccattga

SEQ ID NO: 736615 - DNA, 25 bp, Mus musculus
gtttacagactttcatcgccattga

SEQ ID NO: 736616 - DNA, 25 bp, Mus musculus
gtttacagccacagacatgtctaag

SEQ ID NO: 736617 - DNA, 25 bp, Mus musculus
gtttacagccactgacatgtctaag

SEQ ID NO: 736618 - DNA, 25 bp, Mus musculus
gtttacagccctaatctataccaat

SEQ ID NO: 736619 - DNA, 25 bp, Mus musculus
gtttacagcccttatctataccaat

SEQ ID NO: 736620 - DNA, 25 bp, Mus musculus
gtttacagggaaaggtctaagcata

SEQ ID NO: 736621 - DNA, 25 bp, Mus musculus
gtttacagggaatggtctaagcata

SEQ ID NO: 736622 - DNA, 25 bp, Mus musculus
gtttacaggtacctcttggactcct

SEQ ID NO: 736623 - DNA, 25 bp, Mus musculus
gtttacaggtacgtcttggactcct

SEQ ID NO: 736624 - DNA, 25 bp, Mus musculus
gtttacaggtttctccttttgagca

SEQ ID NO: 736625 - DNA, 25 bp, Mus musculus
gtttacaggtttgtccttttgagca

SEQ ID NO: 736626 - DNA, 25 bp, Mus musculus
gtttacagtaggctcaggccttctc

SEQ ID NO: 736627 - DNA, 25 bp, Mus musculus
gtttacagtagggtcaggccttctc

SEQ ID NO: 736628 - DNA, 25 bp, Mus musculus
gtttacagtagtcatgacccattga

SEQ ID NO: 736629 - DNA, 25 bp, Mus musculus
gtttacagtagtgatgacccattga

SEQ ID NO: 736630 - DNA, 25 bp, Mus musculus
gtttacagtatacgtctttagaggg

SEQ ID NO: 736631 - DNA, 25 bp, Mus musculus
gtttacagtataggtctttagaggg

SEQ ID NO: 736632 - DNA, 25 bp, Mus musculus
gtttacagtctcacatacccaatga

SEQ ID NO: 736633 - DNA, 25 bp, Mus musculus
gtttacagtctctcatacccaatga

SEQ ID NO: 736634 - DNA, 25 bp, Mus musculus
gtttacagtgtcatcatccacacgc

SEQ ID NO: 736635 - DNA, 25 bp, Mus musculus
gtttacagtgtcttcatccacacgc

SEQ ID NO: 736636 - DNA, 25 bp, Mus musculus
gtttacagttctcctcattgactat

SEQ ID NO: 736637 - DNA, 25 bp, Mus musculus
gtttacagttctgctcattgactat

SEQ ID NO: 736638 - DNA, 25 bp, Mus musculus
gtttacataaagagttcagggcagc

SEQ ID NO: 736639 - DNA, 25 bp, Mus musculus
gtttacataaagtgttcagggcagc

SEQ ID NO: 736640 - DNA, 25 bp, Mus musculus
gtttacataagacccagttgcccat

SEQ ID NO: 736641 - DNA, 25 bp, Mus musculus
gtttacataagagccagttgcccat

SEQ ID NO: 736642 - DNA, 25 bp, Mus musculus
gtttacataccaattcataagtgaa

SEQ ID NO: 736643 - DNA, 25 bp, Mus musculus
gtttacataccatttcataagtgaa

SEQ ID NO: 736644 - DNA, 25 bp, Mus musculus
gtttacatacgcatatcgctgcact

SEQ ID NO: 736645 - DNA, 25 bp, Mus musculus
gtttacatacgcttatcgctgcact

SEQ ID NO: 736646 - DNA, 25 bp, Mus musculus
gtttacatagcaactcataccagga

SEQ ID NO: 736647 - DNA, 25 bp, Mus musculus
gtttacatagcatctcataccagga

SEQ ID NO: 736648 - DNA, 25 bp, Mus musculus
gtttacatcgagcaccagggaattc

SEQ ID NO: 736649 - DNA, 25 bp, Mus musculus
gtttacatcgaggaccagggaattc

SEQ ID NO: 736650 - DNA, 25 bp, Mus musculus
gtttacatctcgaatggtcaggtgt

SEQ ID NO: 736651 - DNA, 25 bp, Mus musculus
gtttacatctcgtatggtcaggtgt

SEQ ID NO: 736652 - DNA, 25 bp, Mus musculus
gtttacatgaagacccactgttcga

SEQ ID NO: 736653 - DNA, 25 bp, Mus musculus
gtttacatgaagtcccactgttcga

SEQ ID NO: 736654 - DNA, 25 bp, Mus musculus
gtttacatgaataccagctactcct

SEQ ID NO: 736655 - DNA, 25 bp, Mus musculus
gtttacatgaattccagctactcct

SEQ ID NO: 736656 - DNA, 25 bp, Mus musculus
gtttacatgccgcttgaggaatgga

SEQ ID NO: 736657 - DNA, 25 bp, Mus musculus
gtttacatgccggttgaggaatgga

SEQ ID NO: 736658 - DNA, 25 bp, Mus musculus
gtttacatgcttattccatgactgc

SEQ ID NO: 736659 - DNA, 25 bp, Mus musculus
gtttacatgctttttccatgactgc

SEQ ID NO: 736660 - DNA, 25 bp, Mus musculus
gtttacatgggcacacccttatcac

SEQ ID NO: 736661 - DNA, 25 bp, Mus musculus
gtttacatgggctcacccttatcac

SEQ ID NO: 736662 - DNA, 25 bp, Mus musculus
gtttacattccacaggtaccttaat

SEQ ID NO: 736663 - DNA, 25 bp, Mus musculus
gtttacattccagaggtaccttaat

SEQ ID NO: 736664 - DNA, 25 bp, Mus musculus
gtttacattccccaaatgccaggat

SEQ ID NO: 736665 - DNA, 25 bp, Mus musculus
gtttacattcccgaaatgccaggat

SEQ ID NO: 736666 - DNA, 25 bp, Mus musculus
gtttacattgttactacccagtgct

SEQ ID NO: 736667 - DNA, 25 bp, Mus musculus
gtttacattgtttctacccagtgct

SEQ ID NO: 736668 - DNA, 25 bp, Mus musculus
gtttacatttacaatggcagtgttg

SEQ ID NO: 736669 - DNA, 25 bp, Mus musculus
gtttacatttactatggcagtgttg

SEQ ID NO: 736670 - DNA, 25 bp, Mus musculus
gtttacatttcacaagcgtcagctg

SEQ ID NO: 736671 - DNA, 25 bp, Mus musculus
gtttacatttcagaagcgtcagctg

SEQ ID NO: 736672 - DNA, 25 bp, Mus musculus
gtttaccaagcaagggccacggaca

SEQ ID NO: 736673 - DNA, 25 bp, Mus musculus
gtttaccaagcatgggccacggaca

SEQ ID NO: 736674 - DNA, 25 bp, Mus musculus
gtttaccacctccttcctatgtata

SEQ ID NO: 736675 - DNA, 25 bp, Mus musculus
gtttaccacctcgttcctatgtata

SEQ ID NO: 736676 - DNA, 25 bp, Mus musculus
gtttaccactggctactgggctcca

SEQ ID NO: 736677 - DNA, 25 bp, Mus musculus
gtttaccactgggtactgggctcca

SEQ ID NO: 736678 - DNA, 25 bp, Mus musculus
gtttaccacttcagttcaaagtgtt

SEQ ID NO: 736679 - DNA, 25 bp, Mus musculus
gtttaccacttctgttcaaagtgtt

SEQ ID NO: 736680 - DNA, 25 bp, Mus musculus
gtttaccaggaaagtcttaggacca

SEQ ID NO: 736681 - DNA, 25 bp, Mus musculus
gtttaccaggaatgtcttaggacca

SEQ ID NO: 736682 - DNA, 25 bp, Mus musculus
gtttaccaggagctgcaaaagctga

SEQ ID NO: 736683 - DNA, 25 bp, Mus musculus
gtttaccaggaggtgcaaaagctga

SEQ ID NO: 736684 - DNA, 25 bp, Mus musculus
gtttaccagtcacagtactggcatt

SEQ ID NO: 736685 - DNA, 25 bp, Mus musculus
gtttaccagtcagagtactggcatt

SEQ ID NO: 736686 - DNA, 25 bp, Mus musculus
gtttaccagtgtaccttccaaggag

SEQ ID NO: 736687 - DNA, 25 bp, Mus musculus
gtttaccagtgttccttccaaggag

SEQ ID NO: 736688 - DNA, 25 bp, Mus musculus
gtttaccataagactatgactctga

SEQ ID NO: 736689 - DNA, 25 bp, Mus musculus
gtttaccataagtctatgactctga

SEQ ID NO: 736690 - DNA, 25 bp, Mus musculus
gtttaccatgcaattgtttaccaaa

SEQ ID NO: 736691 - DNA, 25 bp, Mus musculus
gtttaccatgcatttgtttaccaaa

SEQ ID NO: 736692 - DNA, 25 bp, Mus musculus
gtttaccatgctataattttgcaca

SEQ ID NO: 736693 - DNA, 25 bp, Mus musculus
gtttaccatgctatcacatgtgtga

SEQ ID NO: 736694 - DNA, 25 bp, Mus musculus
gtttaccatgctttaattttgcaca

SEQ ID NO: 736695 - DNA, 25 bp, Mus musculus
gtttaccatgctttcacatgtgtga

SEQ ID NO: 736696 - DNA, 25 bp, Mus musculus
gtttaccatgggacactgtatatat

SEQ ID NO: 736697 - DNA, 25 bp, Mus musculus
gtttaccatgggtcactgtatatat

SEQ ID NO: 736698 - DNA, 25 bp, Mus musculus
gtttaccattaaatgctttgttcta

SEQ ID NO: 736699 - DNA, 25 bp, Mus musculus
gtttaccattaattgctttgttcta

SEQ ID NO: 736700 - DNA, 25 bp, Mus musculus
gtttacccaagcctaactgtagcgg

SEQ ID NO: 736701 - DNA, 25 bp, Mus musculus
gtttacccaagcgtaactgtagcgg

SEQ ID NO: 736702 - DNA, 25 bp, Mus musculus
gtttacccaggaacattcctttggt

SEQ ID NO: 736703 - DNA, 25 bp, Mus musculus
gtttacccaggatcattcctttggt

SEQ ID NO: 736704 - DNA, 25 bp, Mus musculus
gtttacccaggtatttgacacatag

SEQ ID NO: 736705 - DNA, 25 bp, Mus musculus
gtttacccaggtttttgacacatag

SEQ ID NO: 736706 - DNA, 25 bp, Mus musculus
gtttacccatgcatgccctgacact

SEQ ID NO: 736707 - DNA, 25 bp, Mus musculus
gtttacccatgcttgccctgacact

SEQ ID NO: 736708 - DNA, 25 bp, Mus musculus
gtttacccgttaaatctgctttaag

SEQ ID NO: 736709 - DNA, 25 bp, Mus musculus
gtttacccgttatatctgctttaag

SEQ ID NO: 736710 - DNA, 25 bp, Mus musculus
gtttaccctagaattcagtggcatt

SEQ ID NO: 736711 - DNA, 25 bp, Mus musculus
gtttaccctagatttcagtggcatt

SEQ ID NO: 736712 - DNA, 25 bp, Mus musculus
gtttaccctcggatattttctgaat

SEQ ID NO: 736713 - DNA, 25 bp, Mus musculus
gtttaccctcggttattttctgaat

SEQ ID NO: 736714 - DNA, 25 bp, Mus musculus
gtttaccctttgagttattcaaatg

SEQ ID NO: 736715 - DNA, 25 bp, Mus musculus
gtttaccctttgtgttattcaaatg

SEQ ID NO: 736716 - DNA, 25 bp, Mus musculus
gtttaccgacaacactgcgagactt

SEQ ID NO: 736717 - DNA, 25 bp, Mus musculus
gtttaccgacaagactgcgagactt

SEQ ID NO: 736718 - DNA, 25 bp, Mus musculus
gtttacctcaaaaccaactgactgt

SEQ ID NO: 736719 - DNA, 25 bp, Mus musculus
gtttacctcaaatccaactgactgt

SEQ ID NO: 736720 - DNA, 25 bp, Mus musculus
gtttacctcactcgtgcatttaaaa

SEQ ID NO: 736721 - DNA, 25 bp, Mus musculus
gtttacctcactggtgcatttaaaa

SEQ ID NO: 736722 - DNA, 25 bp, Mus musculus
gtttacctccagagcaggcgattaa

SEQ ID NO: 736723 - DNA, 25 bp, Mus musculus
gtttacctccagtgcaggcgattaa

SEQ ID NO: 736724 - DNA, 25 bp, Mus musculus
gtttacctctcaagctctcatagag

SEQ ID NO: 736725 - DNA, 25 bp, Mus musculus
gtttacctctcatgctctcatagag

SEQ ID NO: 736726 - DNA, 25 bp, Mus musculus
gtttacctctggctatgtctcagga

SEQ ID NO: 736727 - DNA, 25 bp, Mus musculus
gtttacctctgggtatgtctcagga

SEQ ID NO: 736728 - DNA, 25 bp, Mus musculus
gtttacctgcctcggacaacatttt

SEQ ID NO: 736729 - DNA, 25 bp, Mus musculus
gtttacctgcctgggacaacatttt

SEQ ID NO: 736730 - DNA, 25 bp, Mus musculus
gtttacctgctaatggacctgggct

SEQ ID NO: 736731 - DNA, 25 bp, Mus musculus
gtttacctgctattggacctgggct

SEQ ID NO: 736732 - DNA, 25 bp, Mus musculus
gtttacctgcttactatctcagtgg

SEQ ID NO: 736733 - DNA, 25 bp, Mus musculus
gtttacctgctttctatctcagtgg

SEQ ID NO: 736734 - DNA, 25 bp, Mus musculus
gtttacctgtgcagcatgctaaccc

SEQ ID NO: 736735 - DNA, 25 bp, Mus musculus
gtttacctgtgctgcatgctaaccc

SEQ ID NO: 736736 - DNA, 25 bp, Mus musculus
gtttacctgttcatttggattggag

SEQ ID NO: 736737 - DNA, 25 bp, Mus musculus
gtttacctgttcttttggattggag

SEQ ID NO: 736738 - DNA, 25 bp, Mus musculus
gtttaccttacaagcaccacttatg

SEQ ID NO: 736739 - DNA, 25 bp, Mus musculus
gtttaccttacatgcaccacttatg

SEQ ID NO: 736740 - DNA, 25 bp, Mus musculus
gtttaccttctgattttcatatgag

SEQ ID NO: 736741 - DNA, 25 bp, Mus musculus
gtttaccttctgtttttcatatgag

SEQ ID NO: 736742 - DNA, 25 bp, Mus musculus
gtttacctttctcatgacacatgtg

SEQ ID NO: 736743 - DNA, 25 bp, Mus musculus
gtttacctttctgatgacacatgtg

SEQ ID NO: 736744 - DNA, 25 bp, Mus musculus
gtttacgaaaccactgcggaagcca

SEQ ID NO: 736745 - DNA, 25 bp, Mus musculus
gtttacgaaacctctgcggaagcca

SEQ ID NO: 736746 - DNA, 25 bp, Mus musculus
gtttacgagagcagcttgatggcct

SEQ ID NO: 736747 - DNA, 25 bp, Mus musculus
gtttacgagagctgcttgatggcct

SEQ ID NO: 736748 - DNA, 25 bp, Mus musculus
gtttacgatccccaggcgatggagt

SEQ ID NO: 736749 - DNA, 25 bp, Mus musculus
gtttacgatcccgaggcgatggagt

SEQ ID NO: 736750 - DNA, 25 bp, Mus musculus
gtttacgcacctacaccagggtatt

SEQ ID NO: 736751 - DNA, 25 bp, Mus musculus
gtttacgcaccttcaccagggtatt

SEQ ID NO: 736752 - DNA, 25 bp, Mus musculus
gtttacgctgaaatggacttgacca

SEQ ID NO: 736753 - DNA, 25 bp, Mus musculus
gtttacgctgaattggacttgacca

SEQ ID NO: 736754 - DNA, 25 bp, Mus musculus
gtttacggccacaaactaagaatgc

SEQ ID NO: 736755 - DNA, 25 bp, Mus musculus
gtttacggccactaactaagaatgc

SEQ ID NO: 736756 - DNA, 25 bp, Mus musculus
gtttacggccataagcattgcacat

SEQ ID NO: 736757 - DNA, 25 bp, Mus musculus
gtttacggccattagcattgcacat

SEQ ID NO: 736758 - DNA, 25 bp, Mus musculus
gtttacggctatcttccgccggaag

SEQ ID NO: 736759 - DNA, 25 bp, Mus musculus
gtttacggctatgttccgccggaag

SEQ ID NO: 736760 - DNA, 25 bp, Mus musculus
gtttacgtatgtctctggagccaat

SEQ ID NO: 736761 - DNA, 25 bp, Mus musculus
gtttacgtatgtgtctggagccaat

SEQ ID NO: 736762 - DNA, 25 bp, Mus musculus
gtttacgtgattatggcgcaccctg

SEQ ID NO: 736763 - DNA, 25 bp, Mus musculus
gtttacgtgattttggcgcaccctg

SEQ ID NO: 736764 - DNA, 25 bp, Mus musculus
gtttacgttttactgacctcaggat

SEQ ID NO: 736765 - DNA, 25 bp, Mus musculus
gtttacgttttagtgacctcaggat

SEQ ID NO: 736766 - DNA, 25 bp, Mus musculus
gtttactaaacgagccatatctttt

SEQ ID NO: 736767 - DNA, 25 bp, Mus musculus
gtttactaaacgtgccatatctttt

SEQ ID NO: 736768 - DNA, 25 bp, Mus musculus
gtttactacaccacgagcagacaga

SEQ ID NO: 736769 - DNA, 25 bp, Mus musculus
gtttactacacctcgagcagacaga

SEQ ID NO: 736770 - DNA, 25 bp, Mus musculus
gtttactacctcagtttgtcaactt

SEQ ID NO: 736771 - DNA, 25 bp, Mus musculus
gtttactacctctgtttgtcaactt

SEQ ID NO: 736772 - DNA, 25 bp, Mus musculus
gtttactacgccacctttaagagat

SEQ ID NO: 736773 - DNA, 25 bp, Mus musculus
gtttactacgcctcctttaagagat

SEQ ID NO: 736774 - DNA, 25 bp, Mus musculus
gtttactacttcaggttcttgtgga

SEQ ID NO: 736775 - DNA, 25 bp, Mus musculus
gtttactacttctggttcttgtgga

SEQ ID NO: 736776 - DNA, 25 bp, Mus musculus
gtttactacttgaatgcctgatgcc

SEQ ID NO: 736777 - DNA, 25 bp, Mus musculus
gtttactacttgtatgcctgatgcc

SEQ ID NO: 736778 - DNA, 25 bp, Mus musculus
gtttactagcacctgccagagaggc

SEQ ID NO: 736779 - DNA, 25 bp, Mus musculus
gtttactagcacgtgccagagaggc

SEQ ID NO: 736780 - DNA, 25 bp, Mus musculus
gtttactatactacaatatactgca

SEQ ID NO: 736781 - DNA, 25 bp, Mus musculus
gtttactatacttcaatatactgca

SEQ ID NO: 736782 - DNA, 25 bp, Mus musculus
gtttactatatgaaagcgcactgta

SEQ ID NO: 736783 - DNA, 25 bp, Mus musculus
gtttactatatgtaagcgcactgta

SEQ ID NO: 736784 - DNA, 25 bp, Mus musculus
gtttactcaatactattcccttgtg

SEQ ID NO: 736785 - DNA, 25 bp, Mus musculus
gtttactcaatagtattcccttgtg

SEQ ID NO: 736786 - DNA, 25 bp, Mus musculus
gtttactcagagagattccttcccc

SEQ ID NO: 736787 - DNA, 25 bp, Mus musculus
gtttactcagagtgattccttcccc

SEQ ID NO: 736788 - DNA, 25 bp, Mus musculus
gtttactcagttactgttgtggcat

SEQ ID NO: 736789 - DNA, 25 bp, Mus musculus
gtttactcagtttctgttgtggcat

SEQ ID NO: 736790 - DNA, 25 bp, Mus musculus
gtttactcatctaatattgttggaa

SEQ ID NO: 736791 - DNA, 25 bp, Mus musculus
gtttactcatcttatattgttggaa

SEQ ID NO: 736792 - DNA, 25 bp, Mus musculus
gtttactccaaaagccttgtcaagg

SEQ ID NO: 736793 - DNA, 25 bp, Mus musculus
gtttactccaaatgccttgtcaagg

SEQ ID NO: 736794 - DNA, 25 bp, Mus musculus
gtttactcccttatttgagtgatgg

SEQ ID NO: 736795 - DNA, 25 bp, Mus musculus
gtttactcccttttttgagtgatgg

SEQ ID NO: 736796 - DNA, 25 bp, Mus musculus
gtttactccgagctgatctatatat

SEQ ID NO: 736797 - DNA, 25 bp, Mus musculus
gtttactccgaggtgatctatatat

SEQ ID NO: 736798 - DNA, 25 bp, Mus musculus
gtttactccgctccagaaagaccca

SEQ ID NO: 736799 - DNA, 25 bp, Mus musculus
gtttactccgctgcagaaagaccca

SEQ ID NO: 736800 - DNA, 25 bp, Mus musculus
gtttactccgtcattctttgtagat

SEQ ID NO: 736801 - DNA, 25 bp, Mus musculus
gtttactccgtctttctttgtagat

SEQ ID NO: 736802 - DNA, 25 bp, Mus musculus
gtttactccgttattcattagcttc

SEQ ID NO: 736803 - DNA, 25 bp, Mus musculus
gtttactccgtttttcattagcttc

SEQ ID NO: 736804 - DNA, 25 bp, Mus musculus
gtttactcctagacctaccagtaag

SEQ ID NO: 736805 - DNA, 25 bp, Mus musculus
gtttactcctagtcctaccagtaag

SEQ ID NO: 736806 - DNA, 25 bp, Mus musculus
gtttactcctgtcctctgggaatca

SEQ ID NO: 736807 - DNA, 25 bp, Mus musculus
gtttactcctgtgctctgggaatca

SEQ ID NO: 736808 - DNA, 25 bp, Mus musculus
gtttactccttaaggtttgcccaag

SEQ ID NO: 736809 - DNA, 25 bp, Mus musculus
gtttactccttatggtttgcccaag

SEQ ID NO: 736810 - DNA, 25 bp, Mus musculus
gtttactccttcacttggaaggcga

SEQ ID NO: 736811 - DNA, 25 bp, Mus musculus
gtttactccttctcttggaaggcga

SEQ ID NO: 736812 - DNA, 25 bp, Mus musculus
gtttactcggtcacacatgactgtc

SEQ ID NO: 736813 - DNA, 25 bp, Mus musculus
gtttactcggtctcacatgactgtc

SEQ ID NO: 736814 - DNA, 25 bp, Mus musculus
gtttactctacaagtttcacaacta

SEQ ID NO: 736815 - DNA, 25 bp, Mus musculus
gtttactctacatgtttcacaacta

SEQ ID NO: 736816 - DNA, 25 bp, Mus musculus
gtttactctaccagttgtgtacgtt

SEQ ID NO: 736817 - DNA, 25 bp, Mus musculus
gtttactctacctgttgtgtacgtt

SEQ ID NO: 736818 - DNA, 25 bp, Mus musculus
gtttactctgcccaggagaaggacg

SEQ ID NO: 736819 - DNA, 25 bp, Mus musculus
gtttactctgccgaggagaaggacg

SEQ ID NO: 736820 - DNA, 25 bp, Mus musculus
gtttactctgtaccacctacaaagg

SEQ ID NO: 736821 - DNA, 25 bp, Mus musculus
gtttactctgtagcacctacaaagg

SEQ ID NO: 736822 - DNA, 25 bp, Mus musculus
gtttactgaactcttggcaactgtg

SEQ ID NO: 736823 - DNA, 25 bp, Mus musculus
gtttactgaactgttggcaactgtg

SEQ ID NO: 736824 - DNA, 25 bp, Mus musculus
gtttactgaattatgtctagacgcc

SEQ ID NO: 736825 - DNA, 25 bp, Mus musculus
gtttactgaattttgtctagacgcc

SEQ ID NO: 736826 - DNA, 25 bp, Mus musculus
gtttactgacttatctctgttggtt

SEQ ID NO: 736827 - DNA, 25 bp, Mus musculus
gtttactgacttttctctgttggtt

SEQ ID NO: 736828 - DNA, 25 bp, Mus musculus
gtttactgagcaattgcactgcaca

SEQ ID NO: 736829 - DNA, 25 bp, Mus musculus
gtttactgagcatttgcactgcaca

SEQ ID NO: 736830 - DNA, 25 bp, Mus musculus
gtttactgcctcagttttttatagg

SEQ ID NO: 736831 - DNA, 25 bp, Mus musculus
gtttactgcctctgttttttatagg

SEQ ID NO: 736832 - DNA, 25 bp, Mus musculus
gtttactgctgaaagtacccacttg

SEQ ID NO: 736833 - DNA, 25 bp, Mus musculus
gtttactgctgatagtacccacttg

SEQ ID NO: 736834 - DNA, 25 bp, Mus musculus
gtttactgctgtcagcagactccat

SEQ ID NO: 736835 - DNA, 25 bp, Mus musculus
gtttactgctgtgagcagactccat

SEQ ID NO: 736836 - DNA, 25 bp, Mus musculus
gtttactggcacaggttggtattca

SEQ ID NO: 736837 - DNA, 25 bp, Mus musculus
gtttactggcactggttggtattca

SEQ ID NO: 736838 - DNA, 25 bp, Mus musculus
gtttactggcatatgttctcatcgt

SEQ ID NO: 736839 - DNA, 25 bp, Mus musculus
gtttactggcatttgttctcatcgt

SEQ ID NO: 736840 - DNA, 25 bp, Mus musculus
gtttactggccaatttcttctggaa

SEQ ID NO: 736841 - DNA, 25 bp, Mus musculus
gtttactggccattttcttctggaa

SEQ ID NO: 736842 - DNA, 25 bp, Mus musculus
gtttactgggtgcactcgcagcaga

SEQ ID NO: 736843 - DNA, 25 bp, Mus musculus
gtttactgggtggactcgcagcaga

SEQ ID NO: 736844 - DNA, 25 bp, Mus musculus
gtttactgtagcatgatgcttagcc

SEQ ID NO: 736845 - DNA, 25 bp, Mus musculus
gtttactgtagcattgtttcgccca

SEQ ID NO: 736846 - DNA, 25 bp, Mus musculus
gtttactgtagcttgatgcttagcc

SEQ ID NO: 736847 - DNA, 25 bp, Mus musculus
gtttactgtagctttgtttcgccca

SEQ ID NO: 736848 - DNA, 25 bp, Mus musculus
gtttactgtccaatgtatatacaca

SEQ ID NO: 736849 - DNA, 25 bp, Mus musculus
gtttactgtccattgtatatacaca

SEQ ID NO: 736850 - DNA, 25 bp, Mus musculus
gtttactgtctgataatactccaaa

SEQ ID NO: 736851 - DNA, 25 bp, Mus musculus
gtttactgtctgttaatactccaaa

SEQ ID NO: 736852 - DNA, 25 bp, Mus musculus
gtttactgtcttcagaggctaggtc

SEQ ID NO: 736853 - DNA, 25 bp, Mus musculus
gtttactgtcttgagaggctaggtc

SEQ ID NO: 736854 - DNA, 25 bp, Mus musculus
gtttactgtgagacgctttagcctg

SEQ ID NO: 736855 - DNA, 25 bp, Mus musculus
gtttactgtgagtcgctttagcctg

SEQ ID NO: 736856 - DNA, 25 bp, Mus musculus
gtttactgtgatctagcttcctcat

SEQ ID NO: 736857 - DNA, 25 bp, Mus musculus
gtttactgtgatgtagcttcctcat

SEQ ID NO: 736858 - DNA, 25 bp, Mus musculus
gtttactgtgttatgtgagaacttt

SEQ ID NO: 736859 - DNA, 25 bp, Mus musculus
gtttactgtgttttgtgagaacttt

SEQ ID NO: 736860 - DNA, 25 bp, Mus musculus
gtttactgttgcaagactctacatt

SEQ ID NO: 736861 - DNA, 25 bp, Mus musculus
gtttactgttgctagactctacatt

SEQ ID NO: 736862 - DNA, 25 bp, Mus musculus
gtttacttaatcagagctgctccac

SEQ ID NO: 736863 - DNA, 25 bp, Mus musculus
gtttacttaatctgagctgctccac

SEQ ID NO: 736864 - DNA, 25 bp, Mus musculus
gtttacttacccaggaatcagtcca

SEQ ID NO: 736865 - DNA, 25 bp, Mus musculus
gtttacttaccctggaatcagtcca

SEQ ID NO: 736866 - DNA, 25 bp, Mus musculus
gtttacttatgtctacaattctgga

SEQ ID NO: 736867 - DNA, 25 bp, Mus musculus
gtttacttatgtgtacaattctgga

SEQ ID NO: 736868 - DNA, 25 bp, Mus musculus
gtttacttcagcacttaaatccctg

SEQ ID NO: 736869 - DNA, 25 bp, Mus musculus
gtttacttcagctcttaaatccctg

SEQ ID NO: 736870 - DNA, 25 bp, Mus musculus
gtttacttctcaacccacttggata

SEQ ID NO: 736871 - DNA, 25 bp, Mus musculus
gtttacttctcatcccacttggata

SEQ ID NO: 736872 - DNA, 25 bp, Mus musculus
gtttacttgctcacatctcagatta

SEQ ID NO: 736873 - DNA, 25 bp, Mus musculus
gtttacttgctcatcctaagtgttt

SEQ ID NO: 736874 - DNA, 25 bp, Mus musculus
gtttacttgctctcatctcagatta

SEQ ID NO: 736875 - DNA, 25 bp, Mus musculus
gtttacttgctcttcctaagtgttt

SEQ ID NO: 736876 - DNA, 25 bp, Mus musculus
gtttacttgttgcatttagttctaa

SEQ ID NO: 736877 - DNA, 25 bp, Mus musculus
gtttacttgttggatttagttctaa

SEQ ID NO: 736878 - DNA, 25 bp, Mus musculus
gtttactttgaaaattgctgttgaa

SEQ ID NO: 736879 - DNA, 25 bp, Mus musculus
gtttactttgaatattgctgttgaa

SEQ ID NO: 736880 - DNA, 25 bp, Mus musculus
gtttactttgttcaggcgttgtgtt

SEQ ID NO: 736881 - DNA, 25 bp, Mus musculus
gtttactttgttctatacacctgga

SEQ ID NO: 736882 - DNA, 25 bp, Mus musculus
gtttactttgttgaggcgttgtgtt

SEQ ID NO: 736883 - DNA, 25 bp, Mus musculus
gtttactttgttgtatacacctgga

SEQ ID NO: 736884 - DNA, 25 bp, Mus musculus
gtttagaaaagcacaagcatgtcac

SEQ ID NO: 736885 - DNA, 25 bp, Mus musculus
gtttagaaaagctcaagcatgtcac

SEQ ID NO: 736886 - DNA, 25 bp, Mus musculus
gtttagaaacttcagtgtctctcga

SEQ ID NO: 736887 - DNA, 25 bp, Mus musculus
gtttagaaacttgagtgtctctcga

SEQ ID NO: 736888 - DNA, 25 bp, Mus musculus
gtttagaaatccaaccatcctggaa

SEQ ID NO: 736889 - DNA, 25 bp, Mus musculus
gtttagaaatcctaccatcctggaa

SEQ ID NO: 736890 - DNA, 25 bp, Mus musculus
gtttagaagattctcctagcacttg

SEQ ID NO: 736891 - DNA, 25 bp, Mus musculus
gtttagaagattgtcctagcacttg

SEQ ID NO: 736892 - DNA, 25 bp, Mus musculus
gtttagaagttgacaggttttgcca

SEQ ID NO: 736893 - DNA, 25 bp, Mus musculus
gtttagaagttgtcaggttttgcca

SEQ ID NO: 736894 - DNA, 25 bp, Mus musculus
gtttagaatgtcagtttaccaatta

SEQ ID NO: 736895 - DNA, 25 bp, Mus musculus
gtttagaatgtctgtttaccaatta

SEQ ID NO: 736896 - DNA, 25 bp, Mus musculus
gtttagaattcaatgtgagaggaag

SEQ ID NO: 736897 - DNA, 25 bp, Mus musculus
gtttagaattcattgtgagaggaag

SEQ ID NO: 736898 - DNA, 25 bp, Mus musculus
gtttagaattgcagcccgcacgatt

SEQ ID NO: 736899 - DNA, 25 bp, Mus musculus
gtttagaattgctgcccgcacgatt

SEQ ID NO: 736900 - DNA, 25 bp, Mus musculus
gtttagacaaacatcgacaggaact

SEQ ID NO: 736901 - DNA, 25 bp, Mus musculus
gtttagacaaacttcgacaggaact

SEQ ID NO: 736902 - DNA, 25 bp, Mus musculus
gtttagacaactcgactcaaagctt

SEQ ID NO: 736903 - DNA, 25 bp, Mus musculus
gtttagacaactggactcaaagctt

SEQ ID NO: 736904 - DNA, 25 bp, Mus musculus
gtttagacaccactagcatctgtag

SEQ ID NO: 736905 - DNA, 25 bp, Mus musculus
gtttagacaccagtagcatctgtag

SEQ ID NO: 736906 - DNA, 25 bp, Mus musculus
gtttagacacctaagaatattctgg

SEQ ID NO: 736907 - DNA, 25 bp, Mus musculus
gtttagacaccttagaatattctgg

SEQ ID NO: 736908 - DNA, 25 bp, Mus musculus
gtttagacactgacctctagaaagg

SEQ ID NO: 736909 - DNA, 25 bp, Mus musculus
gtttagacactgtcctctagaaagg

SEQ ID NO: 736910 - DNA, 25 bp, Mus musculus
gtttagacaggcactcacaatacag

SEQ ID NO: 736911 - DNA, 25 bp, Mus musculus
gtttagacaggctctcacaatacag

SEQ ID NO: 736912 - DNA, 25 bp, Mus musculus
gtttagacataacttctagcaagct

SEQ ID NO: 736913 - DNA, 25 bp, Mus musculus
gtttagacataagttctagcaagct

SEQ ID NO: 736914 - DNA, 25 bp, Mus musculus
gtttagactcttccatacattttag

SEQ ID NO: 736915 - DNA, 25 bp, Mus musculus
gtttagactcttgcatacattttag

SEQ ID NO: 736916 - DNA, 25 bp, Mus musculus
gtttagactgttacctcacttgaca

SEQ ID NO: 736917 - DNA, 25 bp, Mus musculus
gtttagactgtttcctcacttgaca

SEQ ID NO: 736918 - DNA, 25 bp, Mus musculus
gtttagactttactctcaatggtat

SEQ ID NO: 736919 - DNA, 25 bp, Mus musculus
gtttagactttagtctcaatggtat

SEQ ID NO: 736920 - DNA, 25 bp, Mus musculus
gtttagagacataaactctcgccag

SEQ ID NO: 736921 - DNA, 25 bp, Mus musculus
gtttagagacattaactctcgccag

SEQ ID NO: 736922 - DNA, 25 bp, Mus musculus
gtttagagagagcacgtgtgaccac

SEQ ID NO: 736923 - DNA, 25 bp, Mus musculus
gtttagagagaggacgtgtgaccac

SEQ ID NO: 736924 - DNA, 25 bp, Mus musculus
gtttagagatcacaactccccagaa

SEQ ID NO: 736925 - DNA, 25 bp, Mus musculus
gtttagagatcagaactccccagaa

SEQ ID NO: 736926 - DNA, 25 bp, Mus musculus
gtttagagcctactgccagatgcat

SEQ ID NO: 736927 - DNA, 25 bp, Mus musculus
gtttagagcctagtgccagatgcat

SEQ ID NO: 736928 - DNA, 25 bp, Mus musculus
gtttagagctttcttgtccacttca

SEQ ID NO: 736929 - DNA, 25 bp, Mus musculus
gtttagagctttgttgtccacttca

SEQ ID NO: 736930 - DNA, 25 bp, Mus musculus
gtttagagggctcaggcagtttccc

SEQ ID NO: 736931 - DNA, 25 bp, Mus musculus
gtttagagggctgaggcagtttccc

SEQ ID NO: 736932 - DNA, 25 bp, Mus musculus
gtttagagtaaaagttacctcctgt

SEQ ID NO: 736933 - DNA, 25 bp, Mus musculus
gtttagagtaaatgttacctcctgt

SEQ ID NO: 736934 - DNA, 25 bp, Mus musculus
gtttagagtcaacttctgttcatga

SEQ ID NO: 736935 - DNA, 25 bp, Mus musculus
gtttagagtcaagttctgttcatga

SEQ ID NO: 736936 - DNA, 25 bp, Mus musculus
gtttagagtgccctcattctgcaaa

SEQ ID NO: 736937 - DNA, 25 bp, Mus musculus
gtttagagtgccgtcattctgcaaa

SEQ ID NO: 736938 - DNA, 25 bp, Mus musculus
gtttagagtgttctcagctgcctta

SEQ ID NO: 736939 - DNA, 25 bp, Mus musculus
gtttagagtgttgtcagctgcctta

SEQ ID NO: 736940 - DNA, 25 bp, Mus musculus
gtttagataatcaccttccccagtc

SEQ ID NO: 736941 - DNA, 25 bp, Mus musculus
gtttagataatctccttccccagtc

SEQ ID NO: 736942 - DNA, 25 bp, Mus musculus
gtttagatacttacacattgagact

SEQ ID NO: 736943 - DNA, 25 bp, Mus musculus
gtttagatactttcacattgagact

SEQ ID NO: 736944 - DNA, 25 bp, Mus musculus
gtttagatccccaacacgaggacct

SEQ ID NO: 736945 - DNA, 25 bp, Mus musculus
gtttagatcccctacacgaggacct

SEQ ID NO: 736946 - DNA, 25 bp, Mus musculus
gtttagatgaacaggggactttata

SEQ ID NO: 736947 - DNA, 25 bp, Mus musculus
gtttagatgaactggggactttata

SEQ ID NO: 736948 - DNA, 25 bp, Mus musculus
gtttagatgctaagcctaggctcat

SEQ ID NO: 736949 - DNA, 25 bp, Mus musculus
gtttagatgctatgcctaggctcat

SEQ ID NO: 736950 - DNA, 25 bp, Mus musculus
gtttagatgtgcctcactcgagttg

SEQ ID NO: 736951 - DNA, 25 bp, Mus musculus
gtttagatgtgcgtcactcgagttg

SEQ ID NO: 736952 - DNA, 25 bp, Mus musculus
gtttagattcttacacacagcagtg

SEQ ID NO: 736953 - DNA, 25 bp, Mus musculus
gtttagattctttcacacagcagtg

SEQ ID NO: 736954 - DNA, 25 bp, Mus musculus
gtttagattttcctgatccttctca

SEQ ID NO: 736955 - DNA, 25 bp, Mus musculus
gtttagattttcgtgatccttctca

SEQ ID NO: 736956 - DNA, 25 bp, Mus musculus
gtttagcaaagtagacagccccgtt

SEQ ID NO: 736957 - DNA, 25 bp, Mus musculus
gtttagcaaagttgacagccccgtt

SEQ ID NO: 736958 - DNA, 25 bp, Mus musculus
gtttagcaaatcatgtcgcctctac

SEQ ID NO: 736959 - DNA, 25 bp, Mus musculus
gtttagcaaatcttgtcgcctctac

SEQ ID NO: 736960 - DNA, 25 bp, Mus musculus
gtttagcaagctagagaaattaccc

SEQ ID NO: 736961 - DNA, 25 bp, Mus musculus
gtttagcaagcttgagaaattaccc

SEQ ID NO: 736962 - DNA, 25 bp, Mus musculus
gtttagcaagggagcttgtccagta

SEQ ID NO: 736963 - DNA, 25 bp, Mus musculus
gtttagcaagggtgcttgtccagta

SEQ ID NO: 736964 - DNA, 25 bp, Mus musculus
gtttagcaattgctaggtacagcat

SEQ ID NO: 736965 - DNA, 25 bp, Mus musculus
gtttagcaattggtaggtacagcat

SEQ ID NO: 736966 - DNA, 25 bp, Mus musculus
gtttagcaccaaatcttaatgggaa

SEQ ID NO: 736967 - DNA, 25 bp, Mus musculus
gtttagcaccaattcttaatgggaa

SEQ ID NO: 736968 - DNA, 25 bp, Mus musculus
gtttagcaggccactattaggttct

SEQ ID NO: 736969 - DNA, 25 bp, Mus musculus
gtttagcaggcctctattaggttct

SEQ ID NO: 736970 - DNA, 25 bp, Mus musculus
gtttagcagtgcaccttgagcattg

SEQ ID NO: 736971 - DNA, 25 bp, Mus musculus
gtttagcagtgctccttgagcattg

SEQ ID NO: 736972 - DNA, 25 bp, Mus musculus
gtttagcagtttcgaccgctggcat

SEQ ID NO: 736973 - DNA, 25 bp, Mus musculus
gtttagcagtttggaccgctggcat

SEQ ID NO: 736974 - DNA, 25 bp, Mus musculus
gtttagcatacgaactcagtccggg

SEQ ID NO: 736975 - DNA, 25 bp, Mus musculus
gtttagcatacgtactcagtccggg

SEQ ID NO: 736976 - DNA, 25 bp, Mus musculus
gtttagcatataattacgaattcca

SEQ ID NO: 736977 - DNA, 25 bp, Mus musculus
gtttagcatatatttacgaattcca

SEQ ID NO: 736978 - DNA, 25 bp, Mus musculus
gtttagccaactccattcattttag

SEQ ID NO: 736979 - DNA, 25 bp, Mus musculus
gtttagccaactgcattcattttag

SEQ ID NO: 736980 - DNA, 25 bp, Mus musculus
gtttagccacataaaattgtactag

SEQ ID NO: 736981 - DNA, 25 bp, Mus musculus
gtttagccacattaaattgtactag

SEQ ID NO: 736982 - DNA, 25 bp, Mus musculus
gtttagccacctcttacctagggct

SEQ ID NO: 736983 - DNA, 25 bp, Mus musculus
gtttagccacctgttacctagggct

SEQ ID NO: 736984 - DNA, 25 bp, Mus musculus
gtttagccagctatcttaaaacagg

SEQ ID NO: 736985 - DNA, 25 bp, Mus musculus
gtttagccagctttcttaaaacagg

SEQ ID NO: 736986 - DNA, 25 bp, Mus musculus
gtttagccatctacctgatgtgtca

SEQ ID NO: 736987 - DNA, 25 bp, Mus musculus
gtttagccatcttcctgatgtgtca

SEQ ID NO: 736988 - DNA, 25 bp, Mus musculus
gtttagccccggaattgactggatt

SEQ ID NO: 736989 - DNA, 25 bp, Mus musculus
gtttagccccggtattgactggatt

SEQ ID NO: 736990 - DNA, 25 bp, Mus musculus
gtttagcccgccaatcttgacgact

SEQ ID NO: 736991 - DNA, 25 bp, Mus musculus
gtttagcccgcctatcttgacgact

SEQ ID NO: 736992 - DNA, 25 bp, Mus musculus
gtttagccctgtcacacatttgata

SEQ ID NO: 736993 - DNA, 25 bp, Mus musculus
gtttagccctgtgacacatttgata

SEQ ID NO: 736994 - DNA, 25 bp, Mus musculus
gtttagcgagaaccactgcaatagg

SEQ ID NO: 736995 - DNA, 25 bp, Mus musculus
gtttagcgagaagcactgcaatagg

SEQ ID NO: 736996 - DNA, 25 bp, Mus musculus
gtttagcgtctactggcggtaagcc

SEQ ID NO: 736997 - DNA, 25 bp, Mus musculus
gtttagcgtctagtggcggtaagcc

SEQ ID NO: 736998 - DNA, 25 bp, Mus musculus
gtttagctatcaagtggcatccacg

SEQ ID NO: 736999 - DNA, 25 bp, Mus musculus
gtttagctatcatgtggcatccacg

SEQ ID NO: 737000 - DNA, 25 bp, Mus musculus
gtttagctcctgctattttcatttg

SEQ ID NO: 737001 - DNA, 25 bp, Mus musculus
gtttagctcctggtattttcatttg

SEQ ID NO: 737002 - DNA, 25 bp, Mus musculus
gtttagctctgacttgcctccagtc

SEQ ID NO: 737003 - DNA, 25 bp, Mus musculus
gtttagctctgagttgcctccagtc

SEQ ID NO: 737004 - DNA, 25 bp, Mus musculus
gtttagctgtaaattgtcactgcat

SEQ ID NO: 737005 - DNA, 25 bp, Mus musculus
gtttagctgtaatttgtcactgcat

SEQ ID NO: 737006 - DNA, 25 bp, Mus musculus
gtttagcttagtcgttttttgatat

SEQ ID NO: 737007 - DNA, 25 bp, Mus musculus
gtttagcttagtggttttttgatat

SEQ ID NO: 737008 - DNA, 25 bp, Mus musculus
gtttagcttatacaagtaacctggt

SEQ ID NO: 737009 - DNA, 25 bp, Mus musculus
gtttagcttatagaagtaacctggt

SEQ ID NO: 737010 - DNA, 25 bp, Mus musculus
gtttagcttcaacacaccctgagaa

SEQ ID NO: 737011 - DNA, 25 bp, Mus musculus
gtttagcttcaagacaccctgagaa

SEQ ID NO: 737012 - DNA, 25 bp, Mus musculus
gtttagcttccacgttggtagcgtt

SEQ ID NO: 737013 - DNA, 25 bp, Mus musculus
gtttagcttccaggttggtagcgtt

SEQ ID NO: 737014 - DNA, 25 bp, Mus musculus
gtttagcttgggatagatctctgaa

SEQ ID NO: 737015 - DNA, 25 bp, Mus musculus
gtttagcttgggttagatctctgaa

SEQ ID NO: 737016 - DNA, 25 bp, Mus musculus
gtttagcttgtcatcttaactcgtg

SEQ ID NO: 737017 - DNA, 25 bp, Mus musculus
gtttagcttgtcttcttaactcgtg

SEQ ID NO: 737018 - DNA, 25 bp, Mus musculus
gtttagctttgtaaccaacatctga

SEQ ID NO: 737019 - DNA, 25 bp, Mus musculus
gtttagctttgttaccaacatctga

SEQ ID NO: 737020 - DNA, 25 bp, Mus musculus
gtttagcttttcatctgttaccctt

SEQ ID NO: 737021 - DNA, 25 bp, Mus musculus
gtttagcttttcttctgttaccctt

SEQ ID NO: 737022 - DNA, 25 bp, Mus musculus
gtttaggaactactcatctgggatg

SEQ ID NO: 737023 - DNA, 25 bp, Mus musculus
gtttaggaactagtcatctgggatg

SEQ ID NO: 737024 - DNA, 25 bp, Mus musculus
gtttaggactgacatgcactcccca

SEQ ID NO: 737025 - DNA, 25 bp, Mus musculus
gtttaggactgagatgcactcccca

SEQ ID NO: 737026 - DNA, 25 bp, Mus musculus
gtttaggatacaaactgctctcttc

SEQ ID NO: 737027 - DNA, 25 bp, Mus musculus
gtttaggatacatactgctctcttc

SEQ ID NO: 737028 - DNA, 25 bp, Mus musculus
gtttaggatcctcttgtgtgtcccc

SEQ ID NO: 737029 - DNA, 25 bp, Mus musculus
gtttaggatcctgttgtgtgtcccc

SEQ ID NO: 737030 - DNA, 25 bp, Mus musculus
gtttaggcagttcatccaggactat

SEQ ID NO: 737031 - DNA, 25 bp, Mus musculus
gtttaggcagttgatccaggactat

SEQ ID NO: 737032 - DNA, 25 bp, Mus musculus
gtttaggcatgcagtttgcttagcc

SEQ ID NO: 737033 - DNA, 25 bp, Mus musculus
gtttaggcatgctgtttgcttagcc

SEQ ID NO: 737034 - DNA, 25 bp, Mus musculus
gtttaggcccacatggaatcccaga

SEQ ID NO: 737035 - DNA, 25 bp, Mus musculus
gtttaggcccacttggaatcccaga

SEQ ID NO: 737036 - DNA, 25 bp, Mus musculus
gtttaggctaacaaaagcttcacag

SEQ ID NO: 737037 - DNA, 25 bp, Mus musculus
gtttaggctaactaaagcttcacag

SEQ ID NO: 737038 - DNA, 25 bp, Mus musculus
gtttaggctcttagcctgttgaagc

SEQ ID NO: 737039 - DNA, 25 bp, Mus musculus
gtttaggctctttgcctgttgaagc

SEQ ID NO: 737040 - DNA, 25 bp, Mus musculus
gtttaggcttaactgtttcatctga

SEQ ID NO: 737041 - DNA, 25 bp, Mus musculus
gtttaggcttaagtgtttcatctga

SEQ ID NO: 737042 - DNA, 25 bp, Mus musculus
gtttagggacacatgttagctcatt

SEQ ID NO: 737043 - DNA, 25 bp, Mus musculus
gtttagggacacttgttagctcatt

SEQ ID NO: 737044 - DNA, 25 bp, Mus musculus
gtttagggatgcaaaacccacagca

SEQ ID NO: 737045 - DNA, 25 bp, Mus musculus
gtttagggatgctaaacccacagca

SEQ ID NO: 737046 - DNA, 25 bp, Mus musculus
gtttagggttagctcttcacagctc

SEQ ID NO: 737047 - DNA, 25 bp, Mus musculus
gtttagggttaggtcttcacagctc

SEQ ID NO: 737048 - DNA, 25 bp, Mus musculus
gtttagggttcgatattttctctag

SEQ ID NO: 737049 - DNA, 25 bp, Mus musculus
gtttagggttcgttattttctctag

SEQ ID NO: 737050 - DNA, 25 bp, Mus musculus
gtttaggtagctattcttgtgatca

SEQ ID NO: 737051 - DNA, 25 bp, Mus musculus
gtttaggtagcttttcttgtgatca

SEQ ID NO: 737052 - DNA, 25 bp, Mus musculus
gtttaggtatctaatttgcagtatt

SEQ ID NO: 737053 - DNA, 25 bp, Mus musculus
gtttaggtatcttatttgcagtatt

SEQ ID NO: 737054 - DNA, 25 bp, Mus musculus
gtttaggtggtgagtctttgtcaga

SEQ ID NO: 737055 - DNA, 25 bp, Mus musculus
gtttaggtggtgtgtctttgtcaga

SEQ ID NO: 737056 - DNA, 25 bp, Mus musculus
gtttaggtgttccttacactcaact

SEQ ID NO: 737057 - DNA, 25 bp, Mus musculus
gtttaggtgttcgttacactcaact

SEQ ID NO: 737058 - DNA, 25 bp, Mus musculus
gtttaggttatcataatacccacct

SEQ ID NO: 737059 - DNA, 25 bp, Mus musculus
gtttaggttatcttaatacccacct

SEQ ID NO: 737060 - DNA, 25 bp, Mus musculus
gtttaggtttacatgaccctcttct

SEQ ID NO: 737061 - DNA, 25 bp, Mus musculus
gtttaggtttacttgaccctcttct

SEQ ID NO: 737062 - DNA, 25 bp, Mus musculus
gtttaggtttgtcacgcacattctt

SEQ ID NO: 737063 - DNA, 25 bp, Mus musculus
gtttaggtttgtgacgcacattctt

SEQ ID NO: 737064 - DNA, 25 bp, Mus musculus
gtttaggttttcaagggcttcatgt

SEQ ID NO: 737065 - DNA, 25 bp, Mus musculus
gtttaggttttctagggcttcatgt

SEQ ID NO: 737066 - DNA, 25 bp, Mus musculus
gtttagtaagaaagacactgtttat

SEQ ID NO: 737067 - DNA, 25 bp, Mus musculus
gtttagtaagaatgacactgtttat

SEQ ID NO: 737068 - DNA, 25 bp, Mus musculus
gtttagtaagctaagatctcggatt

SEQ ID NO: 737069 - DNA, 25 bp, Mus musculus
gtttagtaagcttagatctcggatt

SEQ ID NO: 737070 - DNA, 25 bp, Mus musculus
gtttagtaataaaagcctacccatg

SEQ ID NO: 737071 - DNA, 25 bp, Mus musculus
gtttagtaataatagcctacccatg

SEQ ID NO: 737072 - DNA, 25 bp, Mus musculus
gtttagtacaagctgatccctgcga

SEQ ID NO: 737073 - DNA, 25 bp, Mus musculus
gtttagtacaaggtgatccctgcga

SEQ ID NO: 737074 - DNA, 25 bp, Mus musculus
gtttagtatattaaattctctcgag

SEQ ID NO: 737075 - DNA, 25 bp, Mus musculus
gtttagtatatttaattctctcgag

SEQ ID NO: 737076 - DNA, 25 bp, Mus musculus
gtttagtcactcagttatgtcattt

SEQ ID NO: 737077 - DNA, 25 bp, Mus musculus
gtttagtcactctgttatgtcattt

SEQ ID NO: 737078 - DNA, 25 bp, Mus musculus
gtttagtcactgcatcgatgtctct

SEQ ID NO: 737079 - DNA, 25 bp, Mus musculus
gtttagtcactggatcgatgtctct

SEQ ID NO: 737080 - DNA, 25 bp, Mus musculus
gtttagtctaggaatcagtgctgtt

SEQ ID NO: 737081 - DNA, 25 bp, Mus musculus
gtttagtctaggtatcagtgctgtt

SEQ ID NO: 737082 - DNA, 25 bp, Mus musculus
gtttagtctggaaactggtctgttt

SEQ ID NO: 737083 - DNA, 25 bp, Mus musculus
gtttagtctggatactggtctgttt

SEQ ID NO: 737084 - DNA, 25 bp, Mus musculus
gtttagtgctccagccttgcatgca

SEQ ID NO: 737085 - DNA, 25 bp, Mus musculus
gtttagtgctcctgccttgcatgca

SEQ ID NO: 737086 - DNA, 25 bp, Mus musculus
gtttagtggcgaaaaagaacccaat

SEQ ID NO: 737087 - DNA, 25 bp, Mus musculus
gtttagtggcgataaagaacccaat

SEQ ID NO: 737088 - DNA, 25 bp, Mus musculus
gtttagtgggctcctacgtgtccct

SEQ ID NO: 737089 - DNA, 25 bp, Mus musculus
gtttagtgggctgctacgtgtccct

SEQ ID NO: 737090 - DNA, 25 bp, Mus musculus
gtttagtgtcagaatgagtacagtt

SEQ ID NO: 737091 - DNA, 25 bp, Mus musculus
gtttagtgtcagtatgagtacagtt

SEQ ID NO: 737092 - DNA, 25 bp, Mus musculus
gtttagttatgtaaatgtcctactc

SEQ ID NO: 737093 - DNA, 25 bp, Mus musculus
gtttagttatgttaatgtcctactc

SEQ ID NO: 737094 - DNA, 25 bp, Mus musculus
gtttagttcaagcttcaattgcccc

SEQ ID NO: 737095 - DNA, 25 bp, Mus musculus
gtttagttcaaggttcaattgcccc

SEQ ID NO: 737096 - DNA, 25 bp, Mus musculus
gtttagttcattatgctatctgaca

SEQ ID NO: 737097 - DNA, 25 bp, Mus musculus
gtttagttcattttgctatctgaca

SEQ ID NO: 737098 - DNA, 25 bp, Mus musculus
gtttagttcccgacacccatgctgt

SEQ ID NO: 737099 - DNA, 25 bp, Mus musculus
gtttagttcccgtcacccatgctgt

SEQ ID NO: 737100 - DNA, 25 bp, Mus musculus
gtttagttctagagtggcactctcc

SEQ ID NO: 737101 - DNA, 25 bp, Mus musculus
gtttagttctagtgtggcactctcc

SEQ ID NO: 737102 - DNA, 25 bp, Mus musculus
gtttagttctcaacactacacaaat

SEQ ID NO: 737103 - DNA, 25 bp, Mus musculus
gtttagttctcatcactacacaaat

SEQ ID NO: 737104 - DNA, 25 bp, Mus musculus
gtttagttctttcctttttcaacag

SEQ ID NO: 737105 - DNA, 25 bp, Mus musculus
gtttagttctttgctttttcaacag

SEQ ID NO: 737106 - DNA, 25 bp, Mus musculus
gtttagttgaaccacctattcctca

SEQ ID NO: 737107 - DNA, 25 bp, Mus musculus
gtttagttgaacgacctattcctca

SEQ ID NO: 737108 - DNA, 25 bp, Mus musculus
gtttagttgagtctaacccatcagt

SEQ ID NO: 737109 - DNA, 25 bp, Mus musculus
gtttagttgagtgtaacccatcagt

SEQ ID NO: 737110 - DNA, 25 bp, Mus musculus
gtttagttgcacagatctccccatc

SEQ ID NO: 737111 - DNA, 25 bp, Mus musculus
gtttagttgcactgatctccccatc

SEQ ID NO: 737112 - DNA, 25 bp, Mus musculus
gtttagttgccaacacccatttggt

SEQ ID NO: 737113 - DNA, 25 bp, Mus musculus
gtttagttgccatcacccatttggt

SEQ ID NO: 737114 - DNA, 25 bp, Mus musculus
gtttagttgctcagtagtgtccagc

SEQ ID NO: 737115 - DNA, 25 bp, Mus musculus
gtttagttgctctgtagtgtccagc

SEQ ID NO: 737116 - DNA, 25 bp, Mus musculus
gtttagtttaacctctgtgctgttt

SEQ ID NO: 737117 - DNA, 25 bp, Mus musculus
gtttagtttaacgtctgtgctgttt

SEQ ID NO: 737118 - DNA, 25 bp, Mus musculus
gtttagtttacacataaggcctcat

SEQ ID NO: 737119 - DNA, 25 bp, Mus musculus
gtttagtttacagataaggcctcat

SEQ ID NO: 737120 - DNA, 25 bp, Mus musculus
gtttagtttctaccatgcacatcat

SEQ ID NO: 737121 - DNA, 25 bp, Mus musculus
gtttagtttctagcatgcacatcat

SEQ ID NO: 737122 - DNA, 25 bp, Mus musculus
gtttagtttgttcttgtcctttgag

SEQ ID NO: 737123 - DNA, 25 bp, Mus musculus
gtttagtttgttgttgtcctttgag

SEQ ID NO: 737124 - DNA, 25 bp, Mus musculus
gtttagttttcaacatgtgtgagat

SEQ ID NO: 737125 - DNA, 25 bp, Mus musculus
gtttagttttcatcatgtgtgagat

SEQ ID NO: 737126 - DNA, 25 bp, Mus musculus
gtttataaacacctacctcgcaggg

SEQ ID NO: 737127 - DNA, 25 bp, Mus musculus
gtttataaacacgtacctcgcaggg

SEQ ID NO: 737128 - DNA, 25 bp, Mus musculus
gtttataacacacaggaccattcgc

SEQ ID NO: 737129 - DNA, 25 bp, Mus musculus
gtttataacacagaggaccattcgc

SEQ ID NO: 737130 - DNA, 25 bp, Mus musculus
gtttataacccaagaacacctggag

SEQ ID NO: 737131 - DNA, 25 bp, Mus musculus
gtttataacccacaaatgcgcactc

SEQ ID NO: 737132 - DNA, 25 bp, Mus musculus
gtttataacccagaaatgcgcactc

SEQ ID NO: 737133 - DNA, 25 bp, Mus musculus
gtttataacccatgaacacctggag

SEQ ID NO: 737134 - DNA, 25 bp, Mus musculus
gtttataactacaaccacctcatgc

SEQ ID NO: 737135 - DNA, 25 bp, Mus musculus
gtttataactaccagatgccaccgc

SEQ ID NO: 737136 - DNA, 25 bp, Mus musculus
gtttataactacgagatgccaccgc

SEQ ID NO: 737137 - DNA, 25 bp, Mus musculus
gtttataactactaccacctcatgc

SEQ ID NO: 737138 - DNA, 25 bp, Mus musculus
gtttataatcaccttctgcaccaca

SEQ ID NO: 737139 - DNA, 25 bp, Mus musculus
gtttataatcacgttctgcaccaca

SEQ ID NO: 737140 - DNA, 25 bp, Mus musculus
gtttataatttaattcatctactga

SEQ ID NO: 737141 - DNA, 25 bp, Mus musculus
gtttataatttatttcatctactga

SEQ ID NO: 737142 - DNA, 25 bp, Mus musculus
gtttatacagaactggcatctccca

SEQ ID NO: 737143 - DNA, 25 bp, Mus musculus
gtttatacagaagtggcatctccca

SEQ ID NO: 737144 - DNA, 25 bp, Mus musculus
gtttatacctatagtcctacttggg

SEQ ID NO: 737145 - DNA, 25 bp, Mus musculus
gtttatacctattgtcctacttggg

SEQ ID NO: 737146 - DNA, 25 bp, Mus musculus
gtttatacctgcagcaagtccactg

SEQ ID NO: 737147 - DNA, 25 bp, Mus musculus
gtttatacctgctgcaagtccactg

SEQ ID NO: 737148 - DNA, 25 bp, Mus musculus
gtttatacgaacactgcactaccac

SEQ ID NO: 737149 - DNA, 25 bp, Mus musculus
gtttatacgaactctgcactaccac

SEQ ID NO: 737150 - DNA, 25 bp, Mus musculus
gtttatacgggaatgtgccttcaga

SEQ ID NO: 737151 - DNA, 25 bp, Mus musculus
gtttatacgggattgtgccttcaga

SEQ ID NO: 737152 - DNA, 25 bp, Mus musculus
gtttatactcagaactgacgcctcc

SEQ ID NO: 737153 - DNA, 25 bp, Mus musculus
gtttatactcagtactgacgcctcc

SEQ ID NO: 737154 - DNA, 25 bp, Mus musculus
gtttatactcgcctcttctttaaga

SEQ ID NO: 737155 - DNA, 25 bp, Mus musculus
gtttatactcgcgtcttctttaaga

SEQ ID NO: 737156 - DNA, 25 bp, Mus musculus
gtttatactgatcatcttcccggat

SEQ ID NO: 737157 - DNA, 25 bp, Mus musculus
gtttatactgatgatcttcccggat

SEQ ID NO: 737158 - DNA, 25 bp, Mus musculus
gtttatagactgcaccgagggcata

SEQ ID NO: 737159 - DNA, 25 bp, Mus musculus
gtttatagactggaccgagggcata

SEQ ID NO: 737160 - DNA, 25 bp, Mus musculus
gtttatagcctcaattccagctctt

SEQ ID NO: 737161 - DNA, 25 bp, Mus musculus
gtttatagcctctattccagctctt

SEQ ID NO: 737162 - DNA, 25 bp, Mus musculus
gtttatagccttattcagatacaaa

SEQ ID NO: 737163 - DNA, 25 bp, Mus musculus
gtttatagcctttttcagatacaaa

SEQ ID NO: 737164 - DNA, 25 bp, Mus musculus
gtttatataactcgattttatgcta

SEQ ID NO: 737165 - DNA, 25 bp, Mus musculus
gtttatataactggattttatgcta

SEQ ID NO: 737166 - DNA, 25 bp, Mus musculus
gtttatataatcacaggagccctca

SEQ ID NO: 737167 - DNA, 25 bp, Mus musculus
gtttatataatctcaggagccctca

SEQ ID NO: 737168 - DNA, 25 bp, Mus musculus
gtttatataccccatgaccctgcgg

SEQ ID NO: 737169 - DNA, 25 bp, Mus musculus
gtttatatacccgatgaccctgcgg

SEQ ID NO: 737170 - DNA, 25 bp, Mus musculus
gtttatatactaacctctcgatgga

SEQ ID NO: 737171 - DNA, 25 bp, Mus musculus
gtttatatactatcctctcgatgga

SEQ ID NO: 737172 - DNA, 25 bp, Mus musculus
gtttatatactgagacccttgagtg

SEQ ID NO: 737173 - DNA, 25 bp, Mus musculus
gtttatatactgtgacccttgagtg

SEQ ID NO: 737174 - DNA, 25 bp, Mus musculus
gtttatatcaacacagcccaggagt

SEQ ID NO: 737175 - DNA, 25 bp, Mus musculus
gtttatatcaactcagcccaggagt

SEQ ID NO: 737176 - DNA, 25 bp, Mus musculus
gtttatatcaccaccaaatcctgga

SEQ ID NO: 737177 - DNA, 25 bp, Mus musculus
gtttatatcacctccaaatcctgga

SEQ ID NO: 737178 - DNA, 25 bp, Mus musculus
gtttatatcatgcttccttttctct

SEQ ID NO: 737179 - DNA, 25 bp, Mus musculus
gtttatatcatggttccttttctct

SEQ ID NO: 737180 - DNA, 25 bp, Mus musculus
gtttatatggatcttttcaccctca

SEQ ID NO: 737181 - DNA, 25 bp, Mus musculus
gtttatatggatgttttcaccctca

SEQ ID NO: 737182 - DNA, 25 bp, Mus musculus
gtttatattactctcaccatgaatc

SEQ ID NO: 737183 - DNA, 25 bp, Mus musculus
gtttatattactgtcaccatgaatc

SEQ ID NO: 737184 - DNA, 25 bp, Mus musculus
gtttatattccccaggcctgctaat

SEQ ID NO: 737185 - DNA, 25 bp, Mus musculus
gtttatattcccgaggcctgctaat

SEQ ID NO: 737186 - DNA, 25 bp, Mus musculus
gtttatattcttctcgcctcttgcc

SEQ ID NO: 737187 - DNA, 25 bp, Mus musculus
gtttatattcttgtcgcctcttgcc

SEQ ID NO: 737188 - DNA, 25 bp, Mus musculus
gtttatattgttaaccttagtgatg

SEQ ID NO: 737189 - DNA, 25 bp, Mus musculus
gtttatattgtttaccttagtgatg

SEQ ID NO: 737190 - DNA, 25 bp, Mus musculus
gtttatattttgcatgctgcttgaa

SEQ ID NO: 737191 - DNA, 25 bp, Mus musculus
gtttatattttggatgctgcttgaa

SEQ ID NO: 737192 - DNA, 25 bp, Mus musculus
gtttatcaactcaaaggtctgctca

SEQ ID NO: 737193 - DNA, 25 bp, Mus musculus
gtttatcaactctaaggtctgctca

SEQ ID NO: 737194 - DNA, 25 bp, Mus musculus
gtttatcaagataactgccaatgga

SEQ ID NO: 737195 - DNA, 25 bp, Mus musculus
gtttatcaagattactgccaatgga

SEQ ID NO: 737196 - DNA, 25 bp, Mus musculus
gtttatcaaggcacagggcccagcc

SEQ ID NO: 737197 - DNA, 25 bp, Mus musculus
gtttatcaaggctcagggcccagcc

SEQ ID NO: 737198 - DNA, 25 bp, Mus musculus
gtttatcacacaagccaaatgtccg

SEQ ID NO: 737199 - DNA, 25 bp, Mus musculus
gtttatcacacatgccaaatgtccg

SEQ ID NO: 737200 - DNA, 25 bp, Mus musculus
gtttatcacatgaaggccaggtgag

SEQ ID NO: 737201 - DNA, 25 bp, Mus musculus
gtttatcacatgtaggccaggtgag

SEQ ID NO: 737202 - DNA, 25 bp, Mus musculus
gtttatcacccaagcatattttgca

SEQ ID NO: 737203 - DNA, 25 bp, Mus musculus
gtttatcacccatgcatattttgca

SEQ ID NO: 737204 - DNA, 25 bp, Mus musculus
gtttatcactagacctttgtaatgt

SEQ ID NO: 737205 - DNA, 25 bp, Mus musculus
gtttatcactagataatgcaagaat

SEQ ID NO: 737206 - DNA, 25 bp, Mus musculus
gtttatcactagtcctttgtaatgt

SEQ ID NO: 737207 - DNA, 25 bp, Mus musculus
gtttatcactagttaatgcaagaat

SEQ ID NO: 737208 - DNA, 25 bp, Mus musculus
gtttatcactatctgttctgtatgt

SEQ ID NO: 737209 - DNA, 25 bp, Mus musculus
gtttatcactatgtgttctgtatgt

SEQ ID NO: 737210 - DNA, 25 bp, Mus musculus
gtttatcactgtctaattgcatatg

SEQ ID NO: 737211 - DNA, 25 bp, Mus musculus
gtttatcactgtgtaattgcatatg

SEQ ID NO: 737212 - DNA, 25 bp, Mus musculus
gtttatcataccataaatgcagttg

SEQ ID NO: 737213 - DNA, 25 bp, Mus musculus
gtttatcataccttaaatgcagttg

SEQ ID NO: 737214 - DNA, 25 bp, Mus musculus
gtttatcatatccacttacaaggtt

SEQ ID NO: 737215 - DNA, 25 bp, Mus musculus
gtttatcatatcgacttacaaggtt

SEQ ID NO: 737216 - DNA, 25 bp, Mus musculus
gtttatcatcttatatcccgttgga

SEQ ID NO: 737217 - DNA, 25 bp, Mus musculus
gtttatcatcttttatcccgttgga

SEQ ID NO: 737218 - DNA, 25 bp, Mus musculus
gtttatcatggcatatagtgtcaga

SEQ ID NO: 737219 - DNA, 25 bp, Mus musculus
gtttatcatggcttatagtgtcaga

SEQ ID NO: 737220 - DNA, 25 bp, Mus musculus
gtttatcatgggatcaactgtgtct

SEQ ID NO: 737221 - DNA, 25 bp, Mus musculus
gtttatcatgggttcaactgtgtct

SEQ ID NO: 737222 - DNA, 25 bp, Mus musculus
gtttatcattagaaccccattgcct

SEQ ID NO: 737223 - DNA, 25 bp, Mus musculus
gtttatcattagtaccccattgcct

SEQ ID NO: 737224 - DNA, 25 bp, Mus musculus
gtttatcatttgactcatttgcatg

SEQ ID NO: 737225 - DNA, 25 bp, Mus musculus
gtttatcatttgtctcatttgcatg

SEQ ID NO: 737226 - DNA, 25 bp, Mus musculus
gtttatccactcacaccctttcgtg

SEQ ID NO: 737227 - DNA, 25 bp, Mus musculus
gtttatccactctcaccctttcgtg

SEQ ID NO: 737228 - DNA, 25 bp, Mus musculus
gtttatccagctcccgtagtttgaa

SEQ ID NO: 737229 - DNA, 25 bp, Mus musculus
gtttatccagctgccgtagtttgaa

SEQ ID NO: 737230 - DNA, 25 bp, Mus musculus
gtttatccattaccaagttgaactg

SEQ ID NO: 737231 - DNA, 25 bp, Mus musculus
gtttatccattagcaagttgaactg

SEQ ID NO: 737232 - DNA, 25 bp, Mus musculus
gtttatccctagaaaggcatgccag

SEQ ID NO: 737233 - DNA, 25 bp, Mus musculus
gtttatccctagacaccttcctggt

SEQ ID NO: 737234 - DNA, 25 bp, Mus musculus
gtttatccctagtaaggcatgccag

SEQ ID NO: 737235 - DNA, 25 bp, Mus musculus
gtttatccctagtcaccttcctggt

SEQ ID NO: 737236 - DNA, 25 bp, Mus musculus
gtttatccgagaagatcagctctga

SEQ ID NO: 737237 - DNA, 25 bp, Mus musculus
gtttatccgagatgatcagctctga

SEQ ID NO: 737238 - DNA, 25 bp, Mus musculus
gtttatcctggaacctaacaccaag

SEQ ID NO: 737239 - DNA, 25 bp, Mus musculus
gtttatcctggatcctaacaccaag

SEQ ID NO: 737240 - DNA, 25 bp, Mus musculus
gtttatcgaaacacttgccaagaaa

SEQ ID NO: 737241 - DNA, 25 bp, Mus musculus
gtttatcgaaactcttgccaagaaa

SEQ ID NO: 737242 - DNA, 25 bp, Mus musculus
gtttatcgctaaatgtttggtgtaa

SEQ ID NO: 737243 - DNA, 25 bp, Mus musculus
gtttatcgctaattgtttggtgtaa

SEQ ID NO: 737244 - DNA, 25 bp, Mus musculus
gtttatctacaaagcccaggttggc

SEQ ID NO: 737245 - DNA, 25 bp, Mus musculus
gtttatctacaatgcccaggttggc

SEQ ID NO: 737246 - DNA, 25 bp, Mus musculus
gtttatctattccatgtggatgcag

SEQ ID NO: 737247 - DNA, 25 bp, Mus musculus
gtttatctattcgatgtggatgcag

SEQ ID NO: 737248 - DNA, 25 bp, Mus musculus
gtttatctccaacctctgatgtgac

SEQ ID NO: 737249 - DNA, 25 bp, Mus musculus
gtttatctccaagctctgatgtgac

SEQ ID NO: 737250 - DNA, 25 bp, Mus musculus
gtttatctccagaaacagcttggga

SEQ ID NO: 737251 - DNA, 25 bp, Mus musculus
gtttatctccagtaacagcttggga

SEQ ID NO: 737252 - DNA, 25 bp, Mus musculus
gtttatctccatactgataagagct

SEQ ID NO: 737253 - DNA, 25 bp, Mus musculus
gtttatctccattctgataagagct

SEQ ID NO: 737254 - DNA, 25 bp, Mus musculus
gtttatctccccaaaggatggttca

SEQ ID NO: 737255 - DNA, 25 bp, Mus musculus
gtttatctcccctaaggatggttca

SEQ ID NO: 737256 - DNA, 25 bp, Mus musculus
gtttatctctatatcagtctgtccc

SEQ ID NO: 737257 - DNA, 25 bp, Mus musculus
gtttatctctatttcagtctgtccc

SEQ ID NO: 737258 - DNA, 25 bp, Mus musculus
gtttatctctcccacttgtacgtat

SEQ ID NO: 737259 - DNA, 25 bp, Mus musculus
gtttatctctccgacttgtacgtat

SEQ ID NO: 737260 - DNA, 25 bp, Mus musculus
gtttatctggccatctgataggatg

SEQ ID NO: 737261 - DNA, 25 bp, Mus musculus
gtttatctggccttctgataggatg

SEQ ID NO: 737262 - DNA, 25 bp, Mus musculus
gtttatctgtaaccacctttatcca

SEQ ID NO: 737263 - DNA, 25 bp, Mus musculus
gtttatctgtaagcacctttatcca

SEQ ID NO: 737264 - DNA, 25 bp, Mus musculus
gtttatctgtgaatgcttttgcatt

SEQ ID NO: 737265 - DNA, 25 bp, Mus musculus
gtttatctgtgactgacttggcctc

SEQ ID NO: 737266 - DNA, 25 bp, Mus musculus
gtttatctgtgagtgacttggcctc

SEQ ID NO: 737267 - DNA, 25 bp, Mus musculus
gtttatctgtgattgcttttgcatt

SEQ ID NO: 737268 - DNA, 25 bp, Mus musculus
gtttatcttcaccagtgagtcacgt

SEQ ID NO: 737269 - DNA, 25 bp, Mus musculus
gtttatcttcacgagtgagtcacgt

SEQ ID NO: 737270 - DNA, 25 bp, Mus musculus
gtttatcttctaaagcgcactgctc

SEQ ID NO: 737271 - DNA, 25 bp, Mus musculus
gtttatcttctatagcgcactgctc

SEQ ID NO: 737272 - DNA, 25 bp, Mus musculus
gtttatcttgacaatcgtatcatga

SEQ ID NO: 737273 - DNA, 25 bp, Mus musculus
gtttatcttgactatcgtatcatga

SEQ ID NO: 737274 - DNA, 25 bp, Mus musculus
gtttatctttcaaaactagcctcta

SEQ ID NO: 737275 - DNA, 25 bp, Mus musculus
gtttatctttcataactagcctcta

SEQ ID NO: 737276 - DNA, 25 bp, Mus musculus
gtttatctttgaccatgtgttcata

SEQ ID NO: 737277 - DNA, 25 bp, Mus musculus
gtttatctttgagcatgtgttcata

SEQ ID NO: 737278 - DNA, 25 bp, Mus musculus
gtttatctttgtacagaacctctga

SEQ ID NO: 737279 - DNA, 25 bp, Mus musculus
gtttatctttgttcagaacctctga

SEQ ID NO: 737280 - DNA, 25 bp, Mus musculus
gtttatcttttcaatgcaatcacca

SEQ ID NO: 737281 - DNA, 25 bp, Mus musculus
gtttatcttttctatgcaatcacca

SEQ ID NO: 737282 - DNA, 25 bp, Mus musculus
gtttatgaaaacagtgacggaaatt

SEQ ID NO: 737283 - DNA, 25 bp, Mus musculus
gtttatgaaaactgtgacggaaatt

SEQ ID NO: 737284 - DNA, 25 bp, Mus musculus
gtttatgaacagaccacctgctggt

SEQ ID NO: 737285 - DNA, 25 bp, Mus musculus
gtttatgaacagtccacctgctggt

SEQ ID NO: 737286 - DNA, 25 bp, Mus musculus
gtttatgaaccccacagaccaagcc

SEQ ID NO: 737287 - DNA, 25 bp, Mus musculus
gtttatgaacccgacagaccaagcc

SEQ ID NO: 737288 - DNA, 25 bp, Mus musculus
gtttatgaccctatattctgcgaga

SEQ ID NO: 737289 - DNA, 25 bp, Mus musculus
gtttatgaccctttattctgcgaga

SEQ ID NO: 737290 - DNA, 25 bp, Mus musculus
gtttatgagagcacagtagcccctt

SEQ ID NO: 737291 - DNA, 25 bp, Mus musculus
gtttatgagagctcagtagcccctt

SEQ ID NO: 737292 - DNA, 25 bp, Mus musculus
gtttatgattctcgcctcgccaagg

SEQ ID NO: 737293 - DNA, 25 bp, Mus musculus
gtttatgattctggcctcgccaagg

SEQ ID NO: 737294 - DNA, 25 bp, Mus musculus
gtttatgcaatgcatgctcggcctc

SEQ ID NO: 737295 - DNA, 25 bp, Mus musculus
gtttatgcaatggatgctcggcctc

SEQ ID NO: 737296 - DNA, 25 bp, Mus musculus
gtttatgcacctcacaagggacaga

SEQ ID NO: 737297 - DNA, 25 bp, Mus musculus
gtttatgcacctgacaagggacaga

SEQ ID NO: 737298 - DNA, 25 bp, Mus musculus
gtttatgcccagacttgaactgcag

SEQ ID NO: 737299 - DNA, 25 bp, Mus musculus
gtttatgcccagtcttgaactgcag

SEQ ID NO: 737300 - DNA, 25 bp, Mus musculus
gtttatgccctaactgcgtgcagta

SEQ ID NO: 737301 - DNA, 25 bp, Mus musculus
gtttatgccctatctgcgtgcagta

SEQ ID NO: 737302 - DNA, 25 bp, Mus musculus
gtttatgcgatgcttggtcactgtc

SEQ ID NO: 737303 - DNA, 25 bp, Mus musculus
gtttatgcgatggttggtcactgtc

SEQ ID NO: 737304 - DNA, 25 bp, Mus musculus
gtttatgctagacccaaggtacttt

SEQ ID NO: 737305 - DNA, 25 bp, Mus musculus
gtttatgctagagccaaggtacttt

SEQ ID NO: 737306 - DNA, 25 bp, Mus musculus
gtttatgctatcacaggatgccgaa

SEQ ID NO: 737307 - DNA, 25 bp, Mus musculus
gtttatgctatccattctgttttta

SEQ ID NO: 737308 - DNA, 25 bp, Mus musculus
gtttatgctatcgattctgttttta

SEQ ID NO: 737309 - DNA, 25 bp, Mus musculus
gtttatgctatctcaggatgccgaa

SEQ ID NO: 737310 - DNA, 25 bp, Mus musculus
gtttatgctcatctaatcttgacag

SEQ ID NO: 737311 - DNA, 25 bp, Mus musculus
gtttatgctcatgtaatcttgacag

SEQ ID NO: 737312 - DNA, 25 bp, Mus musculus
gtttatgctgcacccggactactta

SEQ ID NO: 737313 - DNA, 25 bp, Mus musculus
gtttatgctgcagccggactactta

SEQ ID NO: 737314 - DNA, 25 bp, Mus musculus
gtttatgctgggactagtgactttt

SEQ ID NO: 737315 - DNA, 25 bp, Mus musculus
gtttatgctgggtctagtgactttt

SEQ ID NO: 737316 - DNA, 25 bp, Mus musculus
gtttatgctggtcctcttattgctg

SEQ ID NO: 737317 - DNA, 25 bp, Mus musculus
gtttatgctggtgctcttattgctg

SEQ ID NO: 737318 - DNA, 25 bp, Mus musculus
gtttatgcttataactgtctagccc

SEQ ID NO: 737319 - DNA, 25 bp, Mus musculus
gtttatgcttattactgtctagccc

SEQ ID NO: 737320 - DNA, 25 bp, Mus musculus
gtttatgcttttcgaaatctggtga

SEQ ID NO: 737321 - DNA, 25 bp, Mus musculus
gtttatgcttttggaaatctggtga

SEQ ID NO: 737322 - DNA, 25 bp, Mus musculus
gtttatggaatcagttttgtacttg

SEQ ID NO: 737323 - DNA, 25 bp, Mus musculus
gtttatggaatctgttttgtacttg

SEQ ID NO: 737324 - DNA, 25 bp, Mus musculus
gtttatggacacactgtgcccaggt

SEQ ID NO: 737325 - DNA, 25 bp, Mus musculus
gtttatggacactctgtgcccaggt

SEQ ID NO: 737326 - DNA, 25 bp, Mus musculus
gtttatggacatactgcccttttta

SEQ ID NO: 737327 - DNA, 25 bp, Mus musculus
gtttatggacattctgcccttttta

SEQ ID NO: 737328 - DNA, 25 bp, Mus musculus
gtttatggactaaatgctgcaggtc

SEQ ID NO: 737329 - DNA, 25 bp, Mus musculus
gtttatggactatatgctgcaggtc

SEQ ID NO: 737330 - DNA, 25 bp, Mus musculus
gtttatggagaaaagctgttgtgaa

SEQ ID NO: 737331 - DNA, 25 bp, Mus musculus
gtttatggagaatagctgttgtgaa

SEQ ID NO: 737332 - DNA, 25 bp, Mus musculus
gtttatggcaaacttccagggtcca

SEQ ID NO: 737333 - DNA, 25 bp, Mus musculus
gtttatggcaaagttccagggtcca

SEQ ID NO: 737334 - DNA, 25 bp, Mus musculus
gtttatggccctcagaatggcttca

SEQ ID NO: 737335 - DNA, 25 bp, Mus musculus
gtttatggccctgagaatggcttca

SEQ ID NO: 737336 - DNA, 25 bp, Mus musculus
gtttatggctaaagtttctgtatgg

SEQ ID NO: 737337 - DNA, 25 bp, Mus musculus
gtttatggctaatgtttctgtatgg

SEQ ID NO: 737338 - DNA, 25 bp, Mus musculus
gtttatggctatcaaaacaccagct

SEQ ID NO: 737339 - DNA, 25 bp, Mus musculus
gtttatggctatgaaaacaccagct

SEQ ID NO: 737340 - DNA, 25 bp, Mus musculus
gtttatgggatcatctgtgccacac

SEQ ID NO: 737341 - DNA, 25 bp, Mus musculus
gtttatgggatcttctgtgccacac

SEQ ID NO: 737342 - DNA, 25 bp, Mus musculus
gtttatgggatgagactggcccagt

SEQ ID NO: 737343 - DNA, 25 bp, Mus musculus
gtttatgggatgtgactggcccagt

SEQ ID NO: 737344 - DNA, 25 bp, Mus musculus
gtttatggtcacagtccagaaccct

SEQ ID NO: 737345 - DNA, 25 bp, Mus musculus
gtttatggtcactgtccagaaccct

SEQ ID NO: 737346 - DNA, 25 bp, Mus musculus
gtttatggtgaaatccgaagcctta

SEQ ID NO: 737347 - DNA, 25 bp, Mus musculus
gtttatggtgaattccgaagcctta

SEQ ID NO: 737348 - DNA, 25 bp, Mus musculus
gtttatgtaacacagtccagctagc

SEQ ID NO: 737349 - DNA, 25 bp, Mus musculus
gtttatgtaacagagtccagctagc

SEQ ID NO: 737350 - DNA, 25 bp, Mus musculus
gtttatgtactaaagctgatcagaa

SEQ ID NO: 737351 - DNA, 25 bp, Mus musculus
gtttatgtactatagctgatcagaa

SEQ ID NO: 737352 - DNA, 25 bp, Mus musculus
gtttatgtacttactcttcaaaaga

SEQ ID NO: 737353 - DNA, 25 bp, Mus musculus
gtttatgtactttctcttcaaaaga

SEQ ID NO: 737354 - DNA, 25 bp, Mus musculus
gtttatgtagtaaatgcttgactca

SEQ ID NO: 737355 - DNA, 25 bp, Mus musculus
gtttatgtagtatatgcttgactca

SEQ ID NO: 737356 - DNA, 25 bp, Mus musculus
gtttatgtatatccatgtgctgtct

SEQ ID NO: 737357 - DNA, 25 bp, Mus musculus
gtttatgtatatgcatgtgctgtct

SEQ ID NO: 737358 - DNA, 25 bp, Mus musculus
gtttatgtatgccttttcacttttg

SEQ ID NO: 737359 - DNA, 25 bp, Mus musculus
gtttatgtatgcgttttcacttttg

SEQ ID NO: 737360 - DNA, 25 bp, Mus musculus
gtttatgtcatcacatggtcatttt

SEQ ID NO: 737361 - DNA, 25 bp, Mus musculus
gtttatgtcatctcatggtcatttt

SEQ ID NO: 737362 - DNA, 25 bp, Mus musculus
gtttatgtcattaacctatcctagt

SEQ ID NO: 737363 - DNA, 25 bp, Mus musculus
gtttatgtcatttacctatcctagt

SEQ ID NO: 737364 - DNA, 25 bp, Mus musculus
gtttatgtctgtaatcacgctgctc

SEQ ID NO: 737365 - DNA, 25 bp, Mus musculus
gtttatgtctgttatcacgctgctc

SEQ ID NO: 737366 - DNA, 25 bp, Mus musculus
gtttatgtgacgaagcaatcttggt

SEQ ID NO: 737367 - DNA, 25 bp, Mus musculus
gtttatgtgacgtagcaatcttggt

SEQ ID NO: 737368 - DNA, 25 bp, Mus musculus
gtttatgtgatgaactccacccacc

SEQ ID NO: 737369 - DNA, 25 bp, Mus musculus
gtttatgtgatgtactccacccacc

SEQ ID NO: 737370 - DNA, 25 bp, Mus musculus
gtttatgtgccaatttaggaactgt

SEQ ID NO: 737371 - DNA, 25 bp, Mus musculus
gtttatgtgccattttaggaactgt

SEQ ID NO: 737372 - DNA, 25 bp, Mus musculus
gtttatgtgccccttgttgcatgta

SEQ ID NO: 737373 - DNA, 25 bp, Mus musculus
gtttatgtgcccgttgttgcatgta

SEQ ID NO: 737374 - DNA, 25 bp, Mus musculus
gtttatgtgtgtccgtatctttttt

SEQ ID NO: 737375 - DNA, 25 bp, Mus musculus
gtttatgtgtgtgcgtatctttttt

SEQ ID NO: 737376 - DNA, 25 bp, Mus musculus
gtttatgtgttgattactgcctccc

SEQ ID NO: 737377 - DNA, 25 bp, Mus musculus
gtttatgtgttgtttactgcctccc

SEQ ID NO: 737378 - DNA, 25 bp, Mus musculus
gtttatgttactcatcttatttggg

SEQ ID NO: 737379 - DNA, 25 bp, Mus musculus
gtttatgttactgatcttatttggg

SEQ ID NO: 737380 - DNA, 25 bp, Mus musculus
gtttatgttcatacctttagctaaa

SEQ ID NO: 737381 - DNA, 25 bp, Mus musculus
gtttatgttcattcctttagctaaa

SEQ ID NO: 737382 - DNA, 25 bp, Mus musculus
gtttatgttccaaatagttcttcag

SEQ ID NO: 737383 - DNA, 25 bp, Mus musculus
gtttatgttccatatagttcttcag

SEQ ID NO: 737384 - DNA, 25 bp, Mus musculus
gtttatgttcctctagtttttgtga

SEQ ID NO: 737385 - DNA, 25 bp, Mus musculus
gtttatgttcctgtagtttttgtga

SEQ ID NO: 737386 - DNA, 25 bp, Mus musculus
gtttatgttctcagtttaggcccaa

SEQ ID NO: 737387 - DNA, 25 bp, Mus musculus
gtttatgttctccatgctgtaactt

SEQ ID NO: 737388 - DNA, 25 bp, Mus musculus
gtttatgttctcgatgctgtaactt

SEQ ID NO: 737389 - DNA, 25 bp, Mus musculus
gtttatgttctctgtttaggcccaa

SEQ ID NO: 737390 - DNA, 25 bp, Mus musculus
gtttatgttcttctcactgctccag

SEQ ID NO: 737391 - DNA, 25 bp, Mus musculus
gtttatgttcttgtcactgctccag

SEQ ID NO: 737392 - DNA, 25 bp, Mus musculus
gtttatgttgctagaaacacttatt

SEQ ID NO: 737393 - DNA, 25 bp, Mus musculus
gtttatgttgcttgaaacacttatt

SEQ ID NO: 737394 - DNA, 25 bp, Mus musculus
gtttatgtttcaatggtcaccgagc

SEQ ID NO: 737395 - DNA, 25 bp, Mus musculus
gtttatgtttcattggtcaccgagc

SEQ ID NO: 737396 - DNA, 25 bp, Mus musculus
gtttatgttttgaacccagactggc

SEQ ID NO: 737397 - DNA, 25 bp, Mus musculus
gtttatgttttgacattctccttat

SEQ ID NO: 737398 - DNA, 25 bp, Mus musculus
gtttatgttttgtacccagactggc

SEQ ID NO: 737399 - DNA, 25 bp, Mus musculus
gtttatgttttgtcattctccttat

SEQ ID NO: 737400 - DNA, 25 bp, Mus musculus
gtttatgtttttaagcaatcgaggc

SEQ ID NO: 737401 - DNA, 25 bp, Mus musculus
gtttatgttttttagcaatcgaggc

SEQ ID NO: 737402 - DNA, 25 bp, Mus musculus
gtttattaaacaatgtatttcttat

SEQ ID NO: 737403 - DNA, 25 bp, Mus musculus
gtttattaaacattgtatttcttat

SEQ ID NO: 737404 - DNA, 25 bp, Mus musculus
gtttattaccatctacattactagg

SEQ ID NO: 737405 - DNA, 25 bp, Mus musculus
gtttattaccatgtacattactagg

SEQ ID NO: 737406 - DNA, 25 bp, Mus musculus
gtttattacgtaattctggttctca

SEQ ID NO: 737407 - DNA, 25 bp, Mus musculus
gtttattacgtatttctggttctca

SEQ ID NO: 737408 - DNA, 25 bp, Mus musculus
gtttattactccattatgttttaag

SEQ ID NO: 737409 - DNA, 25 bp, Mus musculus
gtttattactcctttatgttttaag

SEQ ID NO: 737410 - DNA, 25 bp, Mus musculus
gtttattagcacctcaatcctgccc

SEQ ID NO: 737411 - DNA, 25 bp, Mus musculus
gtttattagcacgtcaatcctgccc

SEQ ID NO: 737412 - DNA, 25 bp, Mus musculus
gtttattagctccaagtgtgacacc

SEQ ID NO: 737413 - DNA, 25 bp, Mus musculus
gtttattagctcgaagtgtgacacc

SEQ ID NO: 737414 - DNA, 25 bp, Mus musculus
gtttattatggactttgatgctcaa

SEQ ID NO: 737415 - DNA, 25 bp, Mus musculus
gtttattatggagtttgatgctcaa

SEQ ID NO: 737416 - DNA, 25 bp, Mus musculus
gtttattattctcgtgtgtgtgcat

SEQ ID NO: 737417 - DNA, 25 bp, Mus musculus
gtttattattctggtgtgtgtgcat

SEQ ID NO: 737418 - DNA, 25 bp, Mus musculus
gtttattcaacaattcttacccaga

SEQ ID NO: 737419 - DNA, 25 bp, Mus musculus
gtttattcaacatttcttacccaga

SEQ ID NO: 737420 - DNA, 25 bp, Mus musculus
gtttattcaacgatgattcccagtt

SEQ ID NO: 737421 - DNA, 25 bp, Mus musculus
gtttattcaacgttgattcccagtt

SEQ ID NO: 737422 - DNA, 25 bp, Mus musculus
gtttattcaaggaactacactgcac

SEQ ID NO: 737423 - DNA, 25 bp, Mus musculus
gtttattcaaggtactacactgcac

SEQ ID NO: 737424 - DNA, 25 bp, Mus musculus
gtttattcacagattgcttctcatc

SEQ ID NO: 737425 - DNA, 25 bp, Mus musculus
gtttattcacagtttgcttctcatc

SEQ ID NO: 737426 - DNA, 25 bp, Mus musculus
gtttattcatgtcaatatactacag

SEQ ID NO: 737427 - DNA, 25 bp, Mus musculus
gtttattcatgtgaatatactacag

SEQ ID NO: 737428 - DNA, 25 bp, Mus musculus
gtttattccatgctccctgtaattg

SEQ ID NO: 737429 - DNA, 25 bp, Mus musculus
gtttattccatggtccctgtaattg

SEQ ID NO: 737430 - DNA, 25 bp, Mus musculus
gtttattccgctatatgttctctac

SEQ ID NO: 737431 - DNA, 25 bp, Mus musculus
gtttattccgctttatgttctctac

SEQ ID NO: 737432 - DNA, 25 bp, Mus musculus
gtttattcgaaaaacgcgccgtgct

SEQ ID NO: 737433 - DNA, 25 bp, Mus musculus
gtttattcgaaatacgcgccgtgct

SEQ ID NO: 737434 - DNA, 25 bp, Mus musculus
gtttattctactagtctgtgaccat

SEQ ID NO: 737435 - DNA, 25 bp, Mus musculus
gtttattctacttgtctgtgaccat

SEQ ID NO: 737436 - DNA, 25 bp, Mus musculus
gtttattctccacttttcagtctca

SEQ ID NO: 737437 - DNA, 25 bp, Mus musculus
gtttattctccagttttcagtctca

SEQ ID NO: 737438 - DNA, 25 bp, Mus musculus
gtttattctgatccattctgatggg

SEQ ID NO: 737439 - DNA, 25 bp, Mus musculus
gtttattctgatgcattctgatggg

SEQ ID NO: 737440 - DNA, 25 bp, Mus musculus
gtttattctgcaccatgtgagaact

SEQ ID NO: 737441 - DNA, 25 bp, Mus musculus
gtttattctgcagcatgtgagaact

SEQ ID NO: 737442 - DNA, 25 bp, Mus musculus
gtttattctgctaaaggactttgtt

SEQ ID NO: 737443 - DNA, 25 bp, Mus musculus
gtttattctgcttaaggactttgtt

SEQ ID NO: 737444 - DNA, 25 bp, Mus musculus
gtttattctgtactttatcctcaag

SEQ ID NO: 737445 - DNA, 25 bp, Mus musculus
gtttattctgtagtttatcctcaag

SEQ ID NO: 737446 - DNA, 25 bp, Mus musculus
gtttattctgttatgagataaggtc

SEQ ID NO: 737447 - DNA, 25 bp, Mus musculus
gtttattctgttttgagataaggtc

SEQ ID NO: 737448 - DNA, 25 bp, Mus musculus
gtttattcttcgagttaatgcttta

SEQ ID NO: 737449 - DNA, 25 bp, Mus musculus
gtttattcttcgtgttaatgcttta

SEQ ID NO: 737450 - DNA, 25 bp, Mus musculus
gtttattcttgtaatactgggcaga

SEQ ID NO: 737451 - DNA, 25 bp, Mus musculus
gtttattcttgtcatgtggagcact

SEQ ID NO: 737452 - DNA, 25 bp, Mus musculus
gtttattcttgtgatgtggagcact

SEQ ID NO: 737453 - DNA, 25 bp, Mus musculus
gtttattcttgttatactgggcaga

SEQ ID NO: 737454 - DNA, 25 bp, Mus musculus
gtttattctttaatccacaggcatg

SEQ ID NO: 737455 - DNA, 25 bp, Mus musculus
gtttattctttattccacaggcatg

SEQ ID NO: 737456 - DNA, 25 bp, Mus musculus
gtttattcttttctccattggtatc

SEQ ID NO: 737457 - DNA, 25 bp, Mus musculus
gtttattcttttgtccattggtatc

SEQ ID NO: 737458 - DNA, 25 bp, Mus musculus
gtttattgaaatagatcaggcatgg

SEQ ID NO: 737459 - DNA, 25 bp, Mus musculus
gtttattgaaattgatcaggcatgg

SEQ ID NO: 737460 - DNA, 25 bp, Mus musculus
gtttattgacttagtgcaccaggca

SEQ ID NO: 737461 - DNA, 25 bp, Mus musculus
gtttattgactttgtgcaccaggca

SEQ ID NO: 737462 - DNA, 25 bp, Mus musculus
gtttattgatccctttacaacacaa

SEQ ID NO: 737463 - DNA, 25 bp, Mus musculus
gtttattgatccgtttacaacacaa

SEQ ID NO: 737464 - DNA, 25 bp, Mus musculus
gtttattgcaagcatcattcagtgt

SEQ ID NO: 737465 - DNA, 25 bp, Mus musculus
gtttattgcaaggatcattcagtgt

SEQ ID NO: 737466 - DNA, 25 bp, Mus musculus
gtttattgcacaattgctcccactg

SEQ ID NO: 737467 - DNA, 25 bp, Mus musculus
gtttattgcacatttgctcccactg

SEQ ID NO: 737468 - DNA, 25 bp, Mus musculus
gtttattgccacaactcaagttatt

SEQ ID NO: 737469 - DNA, 25 bp, Mus musculus
gtttattgccactactcaagttatt

SEQ ID NO: 737470 - DNA, 25 bp, Mus musculus
gtttattgccataatagcgcctgta

SEQ ID NO: 737471 - DNA, 25 bp, Mus musculus
gtttattgccattatagcgcctgta

SEQ ID NO: 737472 - DNA, 25 bp, Mus musculus
gtttattgcctgctgtaggacactt

SEQ ID NO: 737473 - DNA, 25 bp, Mus musculus
gtttattgcctggtgtaggacactt

SEQ ID NO: 737474 - DNA, 25 bp, Mus musculus
gtttattgcgcgcaataccctgagg

SEQ ID NO: 737475 - DNA, 25 bp, Mus musculus
gtttattgcgcggaataccctgagg

SEQ ID NO: 737476 - DNA, 25 bp, Mus musculus
gtttattggactctgactccacaca

SEQ ID NO: 737477 - DNA, 25 bp, Mus musculus
gtttattggactgtgactccacaca

SEQ ID NO: 737478 - DNA, 25 bp, Mus musculus
gtttattggcttccctttcatgact

SEQ ID NO: 737479 - DNA, 25 bp, Mus musculus
gtttattggcttgcctttcatgact

SEQ ID NO: 737480 - DNA, 25 bp, Mus musculus
gtttattgggtgaaactagtccaca

SEQ ID NO: 737481 - DNA, 25 bp, Mus musculus
gtttattgggtgctgttgcttgcta

SEQ ID NO: 737482 - DNA, 25 bp, Mus musculus
gtttattgggtggtgttgcttgcta

SEQ ID NO: 737483 - DNA, 25 bp, Mus musculus
gtttattgggtgtaactagtccaca

SEQ ID NO: 737484 - DNA, 25 bp, Mus musculus
gtttattggtctacaatcccagcct

SEQ ID NO: 737485 - DNA, 25 bp, Mus musculus
gtttattggtcttcaatcccagcct

SEQ ID NO: 737486 - DNA, 25 bp, Mus musculus
gtttattggttacggccatcaccag

SEQ ID NO: 737487 - DNA, 25 bp, Mus musculus
gtttattggttagggccatcaccag

SEQ ID NO: 737488 - DNA, 25 bp, Mus musculus
gtttattgtcggaagctggaccctc

SEQ ID NO: 737489 - DNA, 25 bp, Mus musculus
gtttattgtcggtagctggaccctc

SEQ ID NO: 737490 - DNA, 25 bp, Mus musculus
gtttattgtgtgaaccccatttgta

SEQ ID NO: 737491 - DNA, 25 bp, Mus musculus
gtttattgtgtgtaccccatttgta

SEQ ID NO: 737492 - DNA, 25 bp, Mus musculus
gtttatttaagacatccctgctgaa

SEQ ID NO: 737493 - DNA, 25 bp, Mus musculus
gtttatttaagagatccctgctgaa

SEQ ID NO: 737494 - DNA, 25 bp, Mus musculus
gtttatttataacaactctttccat

SEQ ID NO: 737495 - DNA, 25 bp, Mus musculus
gtttatttataagaactctttccat

SEQ ID NO: 737496 - DNA, 25 bp, Mus musculus
gtttatttcaccagttcacttactg

SEQ ID NO: 737497 - DNA, 25 bp, Mus musculus
gtttatttcacctgttcacttactg

SEQ ID NO: 737498 - DNA, 25 bp, Mus musculus
gtttatttcattatctgcttcaatt

SEQ ID NO: 737499 - DNA, 25 bp, Mus musculus
gtttatttcattttctgcttcaatt

SEQ ID NO: 737500 - DNA, 25 bp, Mus musculus
gtttatttcctaaagctcttacctg

SEQ ID NO: 737501 - DNA, 25 bp, Mus musculus
gtttatttcctaagtggcggttctg

SEQ ID NO: 737502 - DNA, 25 bp, Mus musculus
gtttatttcctacagctacgcagag

SEQ ID NO: 737503 - DNA, 25 bp, Mus musculus
gtttatttcctagagctacgcagag

SEQ ID NO: 737504 - DNA, 25 bp, Mus musculus
gtttatttcctatagctcttacctg

SEQ ID NO: 737505 - DNA, 25 bp, Mus musculus
gtttatttcctatgtggcggttctg

SEQ ID NO: 737506 - DNA, 25 bp, Mus musculus
gtttatttctgcagcattccttgag

SEQ ID NO: 737507 - DNA, 25 bp, Mus musculus
gtttatttctgctgcattccttgag

SEQ ID NO: 737508 - DNA, 25 bp, Mus musculus
gtttatttctgtcgcctgggaagga

SEQ ID NO: 737509 - DNA, 25 bp, Mus musculus
gtttatttctgtggcctgggaagga

SEQ ID NO: 737510 - DNA, 25 bp, Mus musculus
gtttatttcttcagtgcgtgagcac

SEQ ID NO: 737511 - DNA, 25 bp, Mus musculus
gtttatttcttctgtgcgtgagcac

SEQ ID NO: 737512 - DNA, 25 bp, Mus musculus
gtttatttgagtacactgtcctccc

SEQ ID NO: 737513 - DNA, 25 bp, Mus musculus
gtttatttgagttcactgtcctccc

SEQ ID NO: 737514 - DNA, 25 bp, Mus musculus
gtttatttgcaacacgacgacagtt

SEQ ID NO: 737515 - DNA, 25 bp, Mus musculus
gtttatttgcaagacgacgacagtt

SEQ ID NO: 737516 - DNA, 25 bp, Mus musculus
gtttatttgcataaagccccatgaa

SEQ ID NO: 737517 - DNA, 25 bp, Mus musculus
gtttatttgcattaagccccatgaa

SEQ ID NO: 737518 - DNA, 25 bp, Mus musculus
gtttatttgctacctactcatacca

SEQ ID NO: 737519 - DNA, 25 bp, Mus musculus
gtttatttgctagctactcatacca

SEQ ID NO: 737520 - DNA, 25 bp, Mus musculus
gtttattttcgtctgtaaagcgtat

SEQ ID NO: 737521 - DNA, 25 bp, Mus musculus
gtttattttcgtgtgtaaagcgtat

SEQ ID NO: 737522 - DNA, 25 bp, Mus musculus
gtttattttctcactgtttatacca

SEQ ID NO: 737523 - DNA, 25 bp, Mus musculus
gtttattttctctctgtttatacca

SEQ ID NO: 737524 - DNA, 25 bp, Mus musculus
gtttattttgttctcagtaccagcc

SEQ ID NO: 737525 - DNA, 25 bp, Mus musculus
gtttattttgttgtcagtaccagcc

SEQ ID NO: 737526 - DNA, 25 bp, Mus musculus
gtttatttttacatttgcctctcag

SEQ ID NO: 737527 - DNA, 25 bp, Mus musculus
gtttatttttacttttgcctctcag

SEQ ID NO: 737528 - DNA, 25 bp, Mus musculus
gtttcaaacaaacgcctgtaggctt

SEQ ID NO: 737529 - DNA, 25 bp, Mus musculus
gtttcaaacaaaggcctgtaggctt

SEQ ID NO: 737530 - DNA, 25 bp, Mus musculus
gtttcaaacaagatagagcctctgg

SEQ ID NO: 737531 - DNA, 25 bp, Mus musculus
gtttcaaacaagcaccaggctgtgt

SEQ ID NO: 737532 - DNA, 25 bp, Mus musculus
gtttcaaacaaggaccaggctgtgt

SEQ ID NO: 737533 - DNA, 25 bp, Mus musculus
gtttcaaacaagttagagcctctgg

SEQ ID NO: 737534 - DNA, 25 bp, Mus musculus
gtttcaaacaatacacagcacacag

SEQ ID NO: 737535 - DNA, 25 bp, Mus musculus
gtttcaaacaattcacagcacacag

SEQ ID NO: 737536 - DNA, 25 bp, Mus musculus
gtttcaaacatgactgctgtccctg

SEQ ID NO: 737537 - DNA, 25 bp, Mus musculus
gtttcaaacatgtctgctgtccctg

SEQ ID NO: 737538 - DNA, 25 bp, Mus musculus
gtttcaaagacacgctgtagctcag

SEQ ID NO: 737539 - DNA, 25 bp, Mus musculus
gtttcaaagacaggctgtagctcag

SEQ ID NO: 737540 - DNA, 25 bp, Mus musculus
gtttcaaagggcacatcagaatttt

SEQ ID NO: 737541 - DNA, 25 bp, Mus musculus
gtttcaaagggctcatcagaatttt

SEQ ID NO: 737542 - DNA, 25 bp, Mus musculus
gtttcaaatagcctcctctttatac

SEQ ID NO: 737543 - DNA, 25 bp, Mus musculus
gtttcaaatagcgtcctctttatac

SEQ ID NO: 737544 - DNA, 25 bp, Mus musculus
gtttcaaatcagctggtcctaggag

SEQ ID NO: 737545 - DNA, 25 bp, Mus musculus
gtttcaaatcaggtggtcctaggag

SEQ ID NO: 737546 - DNA, 25 bp, Mus musculus
gtttcaaatctcaaagcctttccat

SEQ ID NO: 737547 - DNA, 25 bp, Mus musculus
gtttcaaatctcaagtacccacata

SEQ ID NO: 737548 - DNA, 25 bp, Mus musculus
gtttcaaatctctaagcctttccat

SEQ ID NO: 737549 - DNA, 25 bp, Mus musculus
gtttcaaatctctagtacccacata

SEQ ID NO: 737550 - DNA, 25 bp, Mus musculus
gtttcaaatgaactcccttaataga

SEQ ID NO: 737551 - DNA, 25 bp, Mus musculus
gtttcaaatgaagtcccttaataga

SEQ ID NO: 737552 - DNA, 25 bp, Mus musculus
gtttcaaatgagctcagtcattggg

SEQ ID NO: 737553 - DNA, 25 bp, Mus musculus
gtttcaaatgaggtcagtcattggg

SEQ ID NO: 737554 - DNA, 25 bp, Mus musculus
gtttcaaattcaacaaaggctcaaa

SEQ ID NO: 737555 - DNA, 25 bp, Mus musculus
gtttcaaattcatcaaaggctcaaa

SEQ ID NO: 737556 - DNA, 25 bp, Mus musculus
gtttcaaattccaactgtacttggt

SEQ ID NO: 737557 - DNA, 25 bp, Mus musculus
gtttcaaattcctactgtacttggt

SEQ ID NO: 737558 - DNA, 25 bp, Mus musculus
gtttcaacacacagcttggagaaga

SEQ ID NO: 737559 - DNA, 25 bp, Mus musculus
gtttcaacacactgcttggagaaga

SEQ ID NO: 737560 - DNA, 25 bp, Mus musculus
gtttcaacacctatcaactcaggac

SEQ ID NO: 737561 - DNA, 25 bp, Mus musculus
gtttcaacacctttcaactcaggac

SEQ ID NO: 737562 - DNA, 25 bp, Mus musculus
gtttcaacaggccagatgtattgcc

SEQ ID NO: 737563 - DNA, 25 bp, Mus musculus
gtttcaacaggcgagatgtattgcc

SEQ ID NO: 737564 - DNA, 25 bp, Mus musculus
gtttcaacatacagcaggaccctac

SEQ ID NO: 737565 - DNA, 25 bp, Mus musculus
gtttcaacatactgcaggaccctac

SEQ ID NO: 737566 - DNA, 25 bp, Mus musculus
gtttcaaccataccagcatatctgc

SEQ ID NO: 737567 - DNA, 25 bp, Mus musculus
gtttcaaccatagcagcatatctgc

SEQ ID NO: 737568 - DNA, 25 bp, Mus musculus
gtttcaaccctaatgacaacctgaa

SEQ ID NO: 737569 - DNA, 25 bp, Mus musculus
gtttcaaccctattgacaacctgaa

SEQ ID NO: 737570 - DNA, 25 bp, Mus musculus
gtttcaaccgggcagtgccacctgc

SEQ ID NO: 737571 - DNA, 25 bp, Mus musculus
gtttcaaccggggagtgccacctgc

SEQ ID NO: 737572 - DNA, 25 bp, Mus musculus
gtttcaacgcctcgagtcggcaaag

SEQ ID NO: 737573 - DNA, 25 bp, Mus musculus
gtttcaacgcctggagtcggcaaag

SEQ ID NO: 737574 - DNA, 25 bp, Mus musculus
gtttcaactctactaatctctaggg

SEQ ID NO: 737575 - DNA, 25 bp, Mus musculus
gtttcaactctagtaatctctaggg

SEQ ID NO: 737576 - DNA, 25 bp, Mus musculus
gtttcaacttgcaaccagagaatag

SEQ ID NO: 737577 - DNA, 25 bp, Mus musculus
gtttcaacttgctaccagagaatag

SEQ ID NO: 737578 - DNA, 25 bp, Mus musculus
gtttcaactttaaatgcagtttcag

SEQ ID NO: 737579 - DNA, 25 bp, Mus musculus
gtttcaactttatatgcagtttcag

SEQ ID NO: 737580 - DNA, 25 bp, Mus musculus
gtttcaagactgacctatttgtttt

SEQ ID NO: 737581 - DNA, 25 bp, Mus musculus
gtttcaagactgtcctatttgtttt

SEQ ID NO: 737582 - DNA, 25 bp, Mus musculus
gtttcaagagataacctgtccccag

SEQ ID NO: 737583 - DNA, 25 bp, Mus musculus
gtttcaagagattacctgtccccag

SEQ ID NO: 737584 - DNA, 25 bp, Mus musculus
gtttcaagattgagtccaacctata

SEQ ID NO: 737585 - DNA, 25 bp, Mus musculus
gtttcaagattgtgtccaacctata

SEQ ID NO: 737586 - DNA, 25 bp, Mus musculus
gtttcaagcccaacccgattcttag

SEQ ID NO: 737587 - DNA, 25 bp, Mus musculus
gtttcaagcccatcccgattcttag

SEQ ID NO: 737588 - DNA, 25 bp, Mus musculus
gtttcaagcggaccgcgccggcttc

SEQ ID NO: 737589 - DNA, 25 bp, Mus musculus
gtttcaagcggagcgcgccggcttc

SEQ ID NO: 737590 - DNA, 25 bp, Mus musculus
gtttcaagcttgactttctggttct

SEQ ID NO: 737591 - DNA, 25 bp, Mus musculus
gtttcaagcttgattgccataattt

SEQ ID NO: 737592 - DNA, 25 bp, Mus musculus
gtttcaagcttgtctttctggttct

SEQ ID NO: 737593 - DNA, 25 bp, Mus musculus
gtttcaagcttgtttgccataattt

SEQ ID NO: 737594 - DNA, 25 bp, Mus musculus
gtttcaagctttcagtatttctgca

SEQ ID NO: 737595 - DNA, 25 bp, Mus musculus
gtttcaagctttgagtatttctgca

SEQ ID NO: 737596 - DNA, 25 bp, Mus musculus
gtttcaagggtcacatccccacagt

SEQ ID NO: 737597 - DNA, 25 bp, Mus musculus
gtttcaagggtctcatccccacagt

SEQ ID NO: 737598 - DNA, 25 bp, Mus musculus
gtttcaagtacgagtgtcgcctaca

SEQ ID NO: 737599 - DNA, 25 bp, Mus musculus
gtttcaagtacgtgtgtcgcctaca

SEQ ID NO: 737600 - DNA, 25 bp, Mus musculus
gtttcaagtagtaccagtgtttctg

SEQ ID NO: 737601 - DNA, 25 bp, Mus musculus
gtttcaagtagttccagtgtttctg

SEQ ID NO: 737602 - DNA, 25 bp, Mus musculus
gtttcaagtcacagaatgtggatga

SEQ ID NO: 737603 - DNA, 25 bp, Mus musculus
gtttcaagtcactgaatgtggatga

SEQ ID NO: 737604 - DNA, 25 bp, Mus musculus
gtttcaagtcttaacctcatgacaa

SEQ ID NO: 737605 - DNA, 25 bp, Mus musculus
gtttcaagtctttacctcatgacaa

SEQ ID NO: 737606 - DNA, 25 bp, Mus musculus
gtttcaatattgatagcaatgctgt

SEQ ID NO: 737607 - DNA, 25 bp, Mus musculus
gtttcaatattgttagcaatgctgt

SEQ ID NO: 737608 - DNA, 25 bp, Mus musculus
gtttcaatcctgcaaatcaacatga

SEQ ID NO: 737609 - DNA, 25 bp, Mus musculus
gtttcaatcctggaaatcaacatga

SEQ ID NO: 737610 - DNA, 25 bp, Mus musculus
gtttcaatctatctactaccctctg

SEQ ID NO: 737611 - DNA, 25 bp, Mus musculus
gtttcaatctatgtactaccctctg

SEQ ID NO: 737612 - DNA, 25 bp, Mus musculus
gtttcaatgaccaacatgtgagcag

SEQ ID NO: 737613 - DNA, 25 bp, Mus musculus
gtttcaatgaccagtctattggtga

SEQ ID NO: 737614 - DNA, 25 bp, Mus musculus
gtttcaatgacctacatgtgagcag

SEQ ID NO: 737615 - DNA, 25 bp, Mus musculus
gtttcaatgacctgtctattggtga

SEQ ID NO: 737616 - DNA, 25 bp, Mus musculus
gtttcaatgcctcatgatacaataa

SEQ ID NO: 737617 - DNA, 25 bp, Mus musculus
gtttcaatgcctgatgatacaataa

SEQ ID NO: 737618 - DNA, 25 bp, Mus musculus
gtttcaatgctaccccaatataaat

SEQ ID NO: 737619 - DNA, 25 bp, Mus musculus
gtttcaatgctagcccaatataaat

SEQ ID NO: 737620 - DNA, 25 bp, Mus musculus
gtttcaatgtatctccttgaggatt

SEQ ID NO: 737621 - DNA, 25 bp, Mus musculus
gtttcaatgtatgtccttgaggatt

SEQ ID NO: 737622 - DNA, 25 bp, Mus musculus
gtttcaattaacatcaccgtcacta

SEQ ID NO: 737623 - DNA, 25 bp, Mus musculus
gtttcaattaacttcaccgtcacta

SEQ ID NO: 737624 - DNA, 25 bp, Mus musculus
gtttcaattctacgaacaactggta

SEQ ID NO: 737625 - DNA, 25 bp, Mus musculus
gtttcaattctaggaacaactggta

SEQ ID NO: 737626 - DNA, 25 bp, Mus musculus
gtttcaattggacaaggtggcatac

SEQ ID NO: 737627 - DNA, 25 bp, Mus musculus
gtttcaattggagaaggtggcatac

SEQ ID NO: 737628 - DNA, 25 bp, Mus musculus
gtttcacaaaacagttgccttaggt

SEQ ID NO: 737629 - DNA, 25 bp, Mus musculus
gtttcacaaaactgttgccttaggt

SEQ ID NO: 737630 - DNA, 25 bp, Mus musculus
gtttcacaaacaatgcttttttcag

SEQ ID NO: 737631 - DNA, 25 bp, Mus musculus
gtttcacaaacattgcttttttcag

SEQ ID NO: 737632 - DNA, 25 bp, Mus musculus
gtttcacaactccattacttcaggc

SEQ ID NO: 737633 - DNA, 25 bp, Mus musculus
gtttcacaactcgattacttcaggc

SEQ ID NO: 737634 - DNA, 25 bp, Mus musculus
gtttcacaagctctttgtactcaaa

SEQ ID NO: 737635 - DNA, 25 bp, Mus musculus
gtttcacaagctgtttgtactcaaa

SEQ ID NO: 737636 - DNA, 25 bp, Mus musculus
gtttcacaaggtaccactcctgaag

SEQ ID NO: 737637 - DNA, 25 bp, Mus musculus
gtttcacaaggttccactcctgaag

SEQ ID NO: 737638 - DNA, 25 bp, Mus musculus
gtttcacaatacaactagtgctcac

SEQ ID NO: 737639 - DNA, 25 bp, Mus musculus
gtttcacaatactactagtgctcac

SEQ ID NO: 737640 - DNA, 25 bp, Mus musculus
gtttcacaatatcttgccttctgag

SEQ ID NO: 737641 - DNA, 25 bp, Mus musculus
gtttcacaatatgttgccttctgag

SEQ ID NO: 737642 - DNA, 25 bp, Mus musculus
gtttcacaatcccacaatactggta

SEQ ID NO: 737643 - DNA, 25 bp, Mus musculus
gtttcacaatccgacaatactggta

SEQ ID NO: 737644 - DNA, 25 bp, Mus musculus
gtttcacaatgccaatcagctagct

SEQ ID NO: 737645 - DNA, 25 bp, Mus musculus
gtttcacaatgcgaatcagctagct

SEQ ID NO: 737646 - DNA, 25 bp, Mus musculus
gtttcacacaaaatcccttgtattt

SEQ ID NO: 737647 - DNA, 25 bp, Mus musculus
gtttcacacaaattcccttgtattt

SEQ ID NO: 737648 - DNA, 25 bp, Mus musculus
gtttcacactagactcgggctttat

SEQ ID NO: 737649 - DNA, 25 bp, Mus musculus
gtttcacactagtctcgggctttat

SEQ ID NO: 737650 - DNA, 25 bp, Mus musculus
gtttcacactcacaatcaggattct

SEQ ID NO: 737651 - DNA, 25 bp, Mus musculus
gtttcacactcagaatcaggattct

SEQ ID NO: 737652 - DNA, 25 bp, Mus musculus
gtttcacagaaaaacttaaggctga

SEQ ID NO: 737653 - DNA, 25 bp, Mus musculus
gtttcacagaaatacttaaggctga

SEQ ID NO: 737654 - DNA, 25 bp, Mus musculus
gtttcacaggctcagccggccctga

SEQ ID NO: 737655 - DNA, 25 bp, Mus musculus
gtttcacaggctgagccggccctga

SEQ ID NO: 737656 - DNA, 25 bp, Mus musculus
gtttcacaggttctctaacctccag

SEQ ID NO: 737657 - DNA, 25 bp, Mus musculus
gtttcacaggttgtctaacctccag

SEQ ID NO: 737658 - DNA, 25 bp, Mus musculus
gtttcacagtaacctagtcttcccc

SEQ ID NO: 737659 - DNA, 25 bp, Mus musculus
gtttcacagtaagctagtcttcccc

SEQ ID NO: 737660 - DNA, 25 bp, Mus musculus
gtttcacagtgactttccataagag

SEQ ID NO: 737661 - DNA, 25 bp, Mus musculus
gtttcacagtgagtttccataagag

SEQ ID NO: 737662 - DNA, 25 bp, Mus musculus
gtttcacatacacttcagcagcaga

SEQ ID NO: 737663 - DNA, 25 bp, Mus musculus
gtttcacatacagttcagcagcaga

SEQ ID NO: 737664 - DNA, 25 bp, Mus musculus
gtttcacatcttcaatgcgtggaat

SEQ ID NO: 737665 - DNA, 25 bp, Mus musculus
gtttcacatcttgaatgcgtggaat

SEQ ID NO: 737666 - DNA, 25 bp, Mus musculus
gtttcacatgtaacatttctactcc

SEQ ID NO: 737667 - DNA, 25 bp, Mus musculus
gtttcacatgtatcatttctactcc

SEQ ID NO: 737668 - DNA, 25 bp, Mus musculus
gtttcacattccatatcacttactg

SEQ ID NO: 737669 - DNA, 25 bp, Mus musculus
gtttcacattccttatcacttactg

SEQ ID NO: 737670 - DNA, 25 bp, Mus musculus
gtttcaccaaacctaggagccttat

SEQ ID NO: 737671 - DNA, 25 bp, Mus musculus
gtttcaccaaacgtaggagccttat

SEQ ID NO: 737672 - DNA, 25 bp, Mus musculus
gtttcaccaatgaatcaactactta

SEQ ID NO: 737673 - DNA, 25 bp, Mus musculus
gtttcaccaatgtatcaactactta

SEQ ID NO: 737674 - DNA, 25 bp, Mus musculus
gtttcacccacaatacactaggctg

SEQ ID NO: 737675 - DNA, 25 bp, Mus musculus
gtttcacccacattacactaggctg

SEQ ID NO: 737676 - DNA, 25 bp, Mus musculus
gtttcacccgctacgtggaggacag

SEQ ID NO: 737677 - DNA, 25 bp, Mus musculus
gtttcacccgcttcgtggaggacag

SEQ ID NO: 737678 - DNA, 25 bp, Mus musculus
gtttcaccctcaccggcaaaattaa

SEQ ID NO: 737679 - DNA, 25 bp, Mus musculus
gtttcaccctcagcggcaaaattaa

SEQ ID NO: 737680 - DNA, 25 bp, Mus musculus
gtttcaccgatcatctttatcgcag

SEQ ID NO: 737681 - DNA, 25 bp, Mus musculus
gtttcaccgatcttctttatcgcag

SEQ ID NO: 737682 - DNA, 25 bp, Mus musculus
gtttcacctgagaaccatttctaag

SEQ ID NO: 737683 - DNA, 25 bp, Mus musculus
gtttcacctgagtaccatttctaag

SEQ ID NO: 737684 - DNA, 25 bp, Mus musculus
gtttcacctgcaaaggtcagaagag

SEQ ID NO: 737685 - DNA, 25 bp, Mus musculus
gtttcacctgcataggtcagaagag

SEQ ID NO: 737686 - DNA, 25 bp, Mus musculus
gtttcacctgcccataaagacattt

SEQ ID NO: 737687 - DNA, 25 bp, Mus musculus
gtttcacctgccgataaagacattt

SEQ ID NO: 737688 - DNA, 25 bp, Mus musculus
gtttcacctgcgagagattcattcc

SEQ ID NO: 737689 - DNA, 25 bp, Mus musculus
gtttcacctgcgtgagattcattcc

SEQ ID NO: 737690 - DNA, 25 bp, Mus musculus
gtttcacctgtcaatatatcaggaa

SEQ ID NO: 737691 - DNA, 25 bp, Mus musculus
gtttcacctgtctatatatcaggaa

SEQ ID NO: 737692 - DNA, 25 bp, Mus musculus
gtttcaccttacacagagtaatcag

SEQ ID NO: 737693 - DNA, 25 bp, Mus musculus
gtttcaccttactcagagtaatcag

SEQ ID NO: 737694 - DNA, 25 bp, Mus musculus
gtttcaccttatcctgtgacaagaa

SEQ ID NO: 737695 - DNA, 25 bp, Mus musculus
gtttcaccttatgctgtgacaagaa

SEQ ID NO: 737696 - DNA, 25 bp, Mus musculus
gtttcacggcatagctccacaagaa

SEQ ID NO: 737697 - DNA, 25 bp, Mus musculus
gtttcacggcattgctccacaagaa

SEQ ID NO: 737698 - DNA, 25 bp, Mus musculus
gtttcacgggtcagagactgttctc

SEQ ID NO: 737699 - DNA, 25 bp, Mus musculus
gtttcacgggtctgagactgttctc

SEQ ID NO: 737700 - DNA, 25 bp, Mus musculus
gtttcacggtgaatctagcagatgc

SEQ ID NO: 737701 - DNA, 25 bp, Mus musculus
gtttcacggtgattctagcagatgc

SEQ ID NO: 737702 - DNA, 25 bp, Mus musculus
gtttcacgtgtcatcctgatattga

SEQ ID NO: 737703 - DNA, 25 bp, Mus musculus
gtttcacgtgtcttcctgatattga

SEQ ID NO: 737704 - DNA, 25 bp, Mus musculus
gtttcactaatgctggttggcacca

SEQ ID NO: 737705 - DNA, 25 bp, Mus musculus
gtttcactaatggtggttggcacca

SEQ ID NO: 737706 - DNA, 25 bp, Mus musculus
gtttcactaccaatcgcgtttcggc

SEQ ID NO: 737707 - DNA, 25 bp, Mus musculus
gtttcactaccattcgcgtttcggc

SEQ ID NO: 737708 - DNA, 25 bp, Mus musculus
gtttcactacgactagtttctcaga

SEQ ID NO: 737709 - DNA, 25 bp, Mus musculus
gtttcactacgagtagtttctcaga

SEQ ID NO: 737710 - DNA, 25 bp, Mus musculus
gtttcactagtgactcttacaggag

SEQ ID NO: 737711 - DNA, 25 bp, Mus musculus
gtttcactagtgtctcttacaggag

SEQ ID NO: 737712 - DNA, 25 bp, Mus musculus
gtttcactatggcattttcatgaaa

SEQ ID NO: 737713 - DNA, 25 bp, Mus musculus
gtttcactatgggattttcatgaaa

SEQ ID NO: 737714 - DNA, 25 bp, Mus musculus
gtttcactcactacacaagcgaggg

SEQ ID NO: 737715 - DNA, 25 bp, Mus musculus
gtttcactcacttcacaagcgaggg

SEQ ID NO: 737716 - DNA, 25 bp, Mus musculus
gtttcactcattaacccactggatt

SEQ ID NO: 737717 - DNA, 25 bp, Mus musculus
gtttcactcatttacccactggatt

SEQ ID NO: 737718 - DNA, 25 bp, Mus musculus
gtttcactcccaagtagcttgaaaa

SEQ ID NO: 737719 - DNA, 25 bp, Mus musculus
gtttcactcccatgtagcttgaaaa

SEQ ID NO: 737720 - DNA, 25 bp, Mus musculus
gtttcactctaaattgttgtaggac

SEQ ID NO: 737721 - DNA, 25 bp, Mus musculus
gtttcactctaatttgttgtaggac

SEQ ID NO: 737722 - DNA, 25 bp, Mus musculus
gtttcactctggaggttggcaccat

SEQ ID NO: 737723 - DNA, 25 bp, Mus musculus
gtttcactctggtggttggcaccat

SEQ ID NO: 737724 - DNA, 25 bp, Mus musculus
gtttcactgactaaccagtcttaga

SEQ ID NO: 737725 - DNA, 25 bp, Mus musculus
gtttcactgacttaccagtcttaga

SEQ ID NO: 737726 - DNA, 25 bp, Mus musculus
gtttcactgagacaccaaggctagg

SEQ ID NO: 737727 - DNA, 25 bp, Mus musculus
gtttcactgagacccatcatgagtt

SEQ ID NO: 737728 - DNA, 25 bp, Mus musculus
gtttcactgagaccgacaattacct

SEQ ID NO: 737729 - DNA, 25 bp, Mus musculus
gtttcactgagagaccaaggctagg

SEQ ID NO: 737730 - DNA, 25 bp, Mus musculus
gtttcactgagagccatcatgagtt

SEQ ID NO: 737731 - DNA, 25 bp, Mus musculus
gtttcactgagagcgacaattacct

SEQ ID NO: 737732 - DNA, 25 bp, Mus musculus
gtttcactggagcactcggtttcca

SEQ ID NO: 737733 - DNA, 25 bp, Mus musculus
gtttcactggaggactcggtttcca

SEQ ID NO: 737734 - DNA, 25 bp, Mus musculus
gtttcactggatatatactttctaa

SEQ ID NO: 737735 - DNA, 25 bp, Mus musculus
gtttcactggatttatactttctaa

SEQ ID NO: 737736 - DNA, 25 bp, Mus musculus
gtttcactggctcaaccaatcctgt

SEQ ID NO: 737737 - DNA, 25 bp, Mus musculus
gtttcactggctgaaccaatcctgt

SEQ ID NO: 737738 - DNA, 25 bp, Mus musculus
gtttcactgtccatgggactgtata

SEQ ID NO: 737739 - DNA, 25 bp, Mus musculus
gtttcactgtccttgggactgtata

SEQ ID NO: 737740 - DNA, 25 bp, Mus musculus
gtttcactgttaaggcaactccccg

SEQ ID NO: 737741 - DNA, 25 bp, Mus musculus
gtttcactgttatggcaactccccg

SEQ ID NO: 737742 - DNA, 25 bp, Mus musculus
gtttcacttacgataaatgttgctc

SEQ ID NO: 737743 - DNA, 25 bp, Mus musculus
gtttcacttacgttaaatgttgctc

SEQ ID NO: 737744 - DNA, 25 bp, Mus musculus
gtttcacttcagcttgtctgtcaca

SEQ ID NO: 737745 - DNA, 25 bp, Mus musculus
gtttcacttcaggttgtctgtcaca

SEQ ID NO: 737746 - DNA, 25 bp, Mus musculus
gtttcacttgtcactggttgaaagc

SEQ ID NO: 737747 - DNA, 25 bp, Mus musculus
gtttcacttgtctctggttgaaagc

SEQ ID NO: 737748 - DNA, 25 bp, Mus musculus
gtttcacttgtgaaccctcagcaaa

SEQ ID NO: 737749 - DNA, 25 bp, Mus musculus
gtttcacttgtgtaccctcagcaaa

SEQ ID NO: 737750 - DNA, 25 bp, Mus musculus
gtttcactttagctagactgtgtca

SEQ ID NO: 737751 - DNA, 25 bp, Mus musculus
gtttcactttaggtagactgtgtca

SEQ ID NO: 737752 - DNA, 25 bp, Mus musculus
gtttcagaacagacacaaagcctta

SEQ ID NO: 737753 - DNA, 25 bp, Mus musculus
gtttcagaacagtcacaaagcctta

SEQ ID NO: 737754 - DNA, 25 bp, Mus musculus
gtttcagaactaaacatgccacaag

SEQ ID NO: 737755 - DNA, 25 bp, Mus musculus
gtttcagaactatacatgccacaag

SEQ ID NO: 737756 - DNA, 25 bp, Mus musculus
gtttcagaagctcttgcatctgtaa

SEQ ID NO: 737757 - DNA, 25 bp, Mus musculus
gtttcagaagctgttgcatctgtaa

SEQ ID NO: 737758 - DNA, 25 bp, Mus musculus
gtttcagaatagaaactgaacctga

SEQ ID NO: 737759 - DNA, 25 bp, Mus musculus
gtttcagaatagtaactgaacctga

SEQ ID NO: 737760 - DNA, 25 bp, Mus musculus
gtttcagaatccacagaactgtttc

SEQ ID NO: 737761 - DNA, 25 bp, Mus musculus
gtttcagaatcctcagaactgtttc

SEQ ID NO: 737762 - DNA, 25 bp, Mus musculus
gtttcagaatctcgacaccaagcag

SEQ ID NO: 737763 - DNA, 25 bp, Mus musculus
gtttcagaatctggacaccaagcag

SEQ ID NO: 737764 - DNA, 25 bp, Mus musculus
gtttcagaccaactgtcttctgtga

SEQ ID NO: 737765 - DNA, 25 bp, Mus musculus
gtttcagaccaagtgtcttctgtga

SEQ ID NO: 737766 - DNA, 25 bp, Mus musculus
gtttcagaccggaccttattgtcat

SEQ ID NO: 737767 - DNA, 25 bp, Mus musculus
gtttcagaccggtccttattgtcat

SEQ ID NO: 737768 - DNA, 25 bp, Mus musculus
gtttcagagaccatgtttttacact

SEQ ID NO: 737769 - DNA, 25 bp, Mus musculus
gtttcagagaccttgtttttacact

SEQ ID NO: 737770 - DNA, 25 bp, Mus musculus
gtttcagagattcggcttagtacta

SEQ ID NO: 737771 - DNA, 25 bp, Mus musculus
gtttcagagattcttcacggcagtc

SEQ ID NO: 737772 - DNA, 25 bp, Mus musculus
gtttcagagattgggcttagtacta

SEQ ID NO: 737773 - DNA, 25 bp, Mus musculus
gtttcagagattgttcacggcagtc

SEQ ID NO: 737774 - DNA, 25 bp, Mus musculus
gtttcagagcatacccttttaaatc

SEQ ID NO: 737775 - DNA, 25 bp, Mus musculus
gtttcagagcattcccttttaaatc

SEQ ID NO: 737776 - DNA, 25 bp, Mus musculus
gtttcagaggaccatgaccatcgta

SEQ ID NO: 737777 - DNA, 25 bp, Mus musculus
gtttcagaggacgatgaccatcgta

SEQ ID NO: 737778 - DNA, 25 bp, Mus musculus
gtttcagagggacacctacgactat

SEQ ID NO: 737779 - DNA, 25 bp, Mus musculus
gtttcagagggagacctacgactat

SEQ ID NO: 737780 - DNA, 25 bp, Mus musculus
gtttcagagtaaaggccaccgcgtt

SEQ ID NO: 737781 - DNA, 25 bp, Mus musculus
gtttcagagtaatggccaccgcgtt

SEQ ID NO: 737782 - DNA, 25 bp, Mus musculus
gtttcagagtctctcttccaaacaa

SEQ ID NO: 737783 - DNA, 25 bp, Mus musculus
gtttcagagtctgtcttccaaacaa

SEQ ID NO: 737784 - DNA, 25 bp, Mus musculus
gtttcagatagtagtgtgctcccat

SEQ ID NO: 737785 - DNA, 25 bp, Mus musculus
gtttcagatagttgtgtgctcccat

SEQ ID NO: 737786 - DNA, 25 bp, Mus musculus
gtttcagatcaacacctttaaccta

SEQ ID NO: 737787 - DNA, 25 bp, Mus musculus
gtttcagatcaagacctttaaccta

SEQ ID NO: 737788 - DNA, 25 bp, Mus musculus
gtttcagatcctctgacgtttcagt

SEQ ID NO: 737789 - DNA, 25 bp, Mus musculus
gtttcagatcctgtgacgtttcagt

SEQ ID NO: 737790 - DNA, 25 bp, Mus musculus
gtttcagatctgattctagagcact

SEQ ID NO: 737791 - DNA, 25 bp, Mus musculus
gtttcagatctgtttctagagcact

SEQ ID NO: 737792 - DNA, 25 bp, Mus musculus
gtttcagatgatatgagcgtcccat

SEQ ID NO: 737793 - DNA, 25 bp, Mus musculus
gtttcagatgatttgagcgtcccat

SEQ ID NO: 737794 - DNA, 25 bp, Mus musculus
gtttcagatgtcaacacttagtaac

SEQ ID NO: 737795 - DNA, 25 bp, Mus musculus
gtttcagatgtctacacttagtaac

SEQ ID NO: 737796 - DNA, 25 bp, Mus musculus
gtttcagatgttacctgccttgggc

SEQ ID NO: 737797 - DNA, 25 bp, Mus musculus
gtttcagatgtttcctgccttgggc

SEQ ID NO: 737798 - DNA, 25 bp, Mus musculus
gtttcagattgtatttgcttatgtc

SEQ ID NO: 737799 - DNA, 25 bp, Mus musculus
gtttcagattgtcagctgacttaaa

SEQ ID NO: 737800 - DNA, 25 bp, Mus musculus
gtttcagattgtgagctgacttaaa

SEQ ID NO: 737801 - DNA, 25 bp, Mus musculus
gtttcagattgtttttgcttatgtc

SEQ ID NO: 737802 - DNA, 25 bp, Mus musculus
gtttcagatttacaagtgacccact

SEQ ID NO: 737803 - DNA, 25 bp, Mus musculus
gtttcagatttagaagtgacccact

SEQ ID NO: 737804 - DNA, 25 bp, Mus musculus
gtttcagatttgcacaatggagccc

SEQ ID NO: 737805 - DNA, 25 bp, Mus musculus
gtttcagatttggacaatggagccc

SEQ ID NO: 737806 - DNA, 25 bp, Mus musculus
gtttcagcatgccttctttgtagaa

SEQ ID NO: 737807 - DNA, 25 bp, Mus musculus
gtttcagcatgcgttctttgtagaa

SEQ ID NO: 737808 - DNA, 25 bp, Mus musculus
gtttcagcatttcgccacgttgttg

SEQ ID NO: 737809 - DNA, 25 bp, Mus musculus
gtttcagcatttggccacgttgttg

SEQ ID NO: 737810 - DNA, 25 bp, Mus musculus
gtttcagcccacattgatttacaaa

SEQ ID NO: 737811 - DNA, 25 bp, Mus musculus
gtttcagcccactttgatttacaaa

SEQ ID NO: 737812 - DNA, 25 bp, Mus musculus
gtttcagccccacaggtttggcaga

SEQ ID NO: 737813 - DNA, 25 bp, Mus musculus
gtttcagccccagaggtttggcaga

SEQ ID NO: 737814 - DNA, 25 bp, Mus musculus
gtttcagcctctaaatgcttttgta

SEQ ID NO: 737815 - DNA, 25 bp, Mus musculus
gtttcagcctcttaatgcttttgta

SEQ ID NO: 737816 - DNA, 25 bp, Mus musculus
gtttcagcctgaactatttaatgag

SEQ ID NO: 737817 - DNA, 25 bp, Mus musculus
gtttcagcctgatctatttaatgag

SEQ ID NO: 737818 - DNA, 25 bp, Mus musculus
gtttcagcctggaaacgcatagatg

SEQ ID NO: 737819 - DNA, 25 bp, Mus musculus
gtttcagcctggtaacgcatagatg

SEQ ID NO: 737820 - DNA, 25 bp, Mus musculus
gtttcagctccactgagccatcata

SEQ ID NO: 737821 - DNA, 25 bp, Mus musculus
gtttcagctccagtgagccatcata

SEQ ID NO: 737822 - DNA, 25 bp, Mus musculus
gtttcagctgctcaagtctggagtt

SEQ ID NO: 737823 - DNA, 25 bp, Mus musculus
gtttcagctgctgaagtctggagtt

SEQ ID NO: 737824 - DNA, 25 bp, Mus musculus
gtttcagctggaaatcaagcagtct

SEQ ID NO: 737825 - DNA, 25 bp, Mus musculus
gtttcagctggatatcaagcagtct

SEQ ID NO: 737826 - DNA, 25 bp, Mus musculus
gtttcagctgtgcactatttatagt

SEQ ID NO: 737827 - DNA, 25 bp, Mus musculus
gtttcagctgtggactatttatagt

SEQ ID NO: 737828 - DNA, 25 bp, Mus musculus
gtttcagcttgcatgtatccatcac

SEQ ID NO: 737829 - DNA, 25 bp, Mus musculus
gtttcagcttgcttgtatccatcac

SEQ ID NO: 737830 - DNA, 25 bp, Mus musculus
gtttcagcttggcttgtgacaggat

SEQ ID NO: 737831 - DNA, 25 bp, Mus musculus
gtttcagcttgggttgtgacaggat

SEQ ID NO: 737832 - DNA, 25 bp, Mus musculus
gtttcagcttttcagacatagattg

SEQ ID NO: 737833 - DNA, 25 bp, Mus musculus
gtttcagcttttgagacatagattg

SEQ ID NO: 737834 - DNA, 25 bp, Mus musculus
gtttcaggaacccatttgacgttag

SEQ ID NO: 737835 - DNA, 25 bp, Mus musculus
gtttcaggaaccgatttgacgttag

SEQ ID NO: 737836 - DNA, 25 bp, Mus musculus
gtttcaggaattccagttgggctca

SEQ ID NO: 737837 - DNA, 25 bp, Mus musculus
gtttcaggaattgcagttgggctca

SEQ ID NO: 737838 - DNA, 25 bp, Mus musculus
gtttcaggacaccatgtccttttct

SEQ ID NO: 737839 - DNA, 25 bp, Mus musculus
gtttcaggacacgatgtccttttct

SEQ ID NO: 737840 - DNA, 25 bp, Mus musculus
gtttcaggatatatgacctgccatt

SEQ ID NO: 737841 - DNA, 25 bp, Mus musculus
gtttcaggatatttgacctgccatt

SEQ ID NO: 737842 - DNA, 25 bp, Mus musculus
gtttcaggcataaggctctgctcca

SEQ ID NO: 737843 - DNA, 25 bp, Mus musculus
gtttcaggcatatggctctgctcca

SEQ ID NO: 737844 - DNA, 25 bp, Mus musculus
gtttcaggctacagcaggactgctc

SEQ ID NO: 737845 - DNA, 25 bp, Mus musculus
gtttcaggctactgcaggactgctc

SEQ ID NO: 737846 - DNA, 25 bp, Mus musculus
gtttcaggctctatgatctctttat

SEQ ID NO: 737847 - DNA, 25 bp, Mus musculus
gtttcaggctctttgatctctttat

SEQ ID NO: 737848 - DNA, 25 bp, Mus musculus
gtttcagggaccatgaaaagggcag

SEQ ID NO: 737849 - DNA, 25 bp, Mus musculus
gtttcagggaccttgaaaagggcag

SEQ ID NO: 737850 - DNA, 25 bp, Mus musculus
gtttcagggcaaccgcggtacagac

SEQ ID NO: 737851 - DNA, 25 bp, Mus musculus
gtttcagggcaagcgcggtacagac

SEQ ID NO: 737852 - DNA, 25 bp, Mus musculus
gtttcagggcttcagcacctggaat

SEQ ID NO: 737853 - DNA, 25 bp, Mus musculus
gtttcagggcttgagcacctggaat

SEQ ID NO: 737854 - DNA, 25 bp, Mus musculus
gtttcaggtagtactgtccttctta

SEQ ID NO: 737855 - DNA, 25 bp, Mus musculus
gtttcaggtagttctgtccttctta

SEQ ID NO: 737856 - DNA, 25 bp, Mus musculus
gtttcaggtcagcctagcctctata

SEQ ID NO: 737857 - DNA, 25 bp, Mus musculus
gtttcaggtcaggctagcctctata

SEQ ID NO: 737858 - DNA, 25 bp, Mus musculus
gtttcaggtcttatttgctgttgtg

SEQ ID NO: 737859 - DNA, 25 bp, Mus musculus
gtttcaggtcttttttgctgttgtg

SEQ ID NO: 737860 - DNA, 25 bp, Mus musculus
gtttcaggtgtgcttagctggcata

SEQ ID NO: 737861 - DNA, 25 bp, Mus musculus
gtttcaggtgtggttagctggcata

SEQ ID NO: 737862 - DNA, 25 bp, Mus musculus
gtttcaggtgttcaaagccagctta

SEQ ID NO: 737863 - DNA, 25 bp, Mus musculus
gtttcaggtgttgaaagccagctta

SEQ ID NO: 737864 - DNA, 25 bp, Mus musculus
gtttcagtaacaaccaaagtaatgg

SEQ ID NO: 737865 - DNA, 25 bp, Mus musculus
gtttcagtaacatccaaagtaatgg

SEQ ID NO: 737866 - DNA, 25 bp, Mus musculus
gtttcagtaaccctccaagacaata

SEQ ID NO: 737867 - DNA, 25 bp, Mus musculus
gtttcagtaaccgtccaagacaata

SEQ ID NO: 737868 - DNA, 25 bp, Mus musculus
gtttcagtaataaaacatctttctg

SEQ ID NO: 737869 - DNA, 25 bp, Mus musculus
gtttcagtaatataacatctttctg

SEQ ID NO: 737870 - DNA, 25 bp, Mus musculus
gtttcagtattcaactctccactcc

SEQ ID NO: 737871 - DNA, 25 bp, Mus musculus
gtttcagtattctactctccactcc

SEQ ID NO: 737872 - DNA, 25 bp, Mus musculus
gtttcagtcaacaaattatccgtta

SEQ ID NO: 737873 - DNA, 25 bp, Mus musculus
gtttcagtcaactaattatccgtta

SEQ ID NO: 737874 - DNA, 25 bp, Mus musculus
gtttcagtccctcttgagttgggct

SEQ ID NO: 737875 - DNA, 25 bp, Mus musculus
gtttcagtccctgttgagttgggct

SEQ ID NO: 737876 - DNA, 25 bp, Mus musculus
gtttcagtctgcatgcatagttgga

SEQ ID NO: 737877 - DNA, 25 bp, Mus musculus
gtttcagtctgcttgcatagttgga

SEQ ID NO: 737878 - DNA, 25 bp, Mus musculus
gtttcagtctgtagtgtcctggagg

SEQ ID NO: 737879 - DNA, 25 bp, Mus musculus
gtttcagtctgttgtgtcctggagg

SEQ ID NO: 737880 - DNA, 25 bp, Mus musculus
gtttcagtgatcagcaaacatccta

SEQ ID NO: 737881 - DNA, 25 bp, Mus musculus
gtttcagtgatctgcaaacatccta

SEQ ID NO: 737882 - DNA, 25 bp, Mus musculus
gtttcagtgtggcatccctaggcac

SEQ ID NO: 737883 - DNA, 25 bp, Mus musculus
gtttcagtgtgggatccctaggcac

SEQ ID NO: 737884 - DNA, 25 bp, Mus musculus
gtttcagttcaacttcagctggtgt

SEQ ID NO: 737885 - DNA, 25 bp, Mus musculus
gtttcagttcaagttcagctggtgt

SEQ ID NO: 737886 - DNA, 25 bp, Mus musculus
gtttcagttgccagttgacacctca

SEQ ID NO: 737887 - DNA, 25 bp, Mus musculus
gtttcagttgcctgttgacacctca

SEQ ID NO: 737888 - DNA, 25 bp, Mus musculus
gtttcagtttaaagtacttcctcct

SEQ ID NO: 737889 - DNA, 25 bp, Mus musculus
gtttcagtttaatgtacttcctcct

SEQ ID NO: 737890 - DNA, 25 bp, Mus musculus
gtttcagtttccatactgctggtat

SEQ ID NO: 737891 - DNA, 25 bp, Mus musculus
gtttcagtttccttactgctggtat

SEQ ID NO: 737892 - DNA, 25 bp, Mus musculus
gtttcagtttgcaggtgtgaccaca

SEQ ID NO: 737893 - DNA, 25 bp, Mus musculus
gtttcagtttgctggtgtgaccaca

SEQ ID NO: 737894 - DNA, 25 bp, Mus musculus
gtttcagtttttcatatcatttcca

SEQ ID NO: 737895 - DNA, 25 bp, Mus musculus
gtttcagtttttcctaacttcctct

SEQ ID NO: 737896 - DNA, 25 bp, Mus musculus
gtttcagtttttgatatcatttcca

SEQ ID NO: 737897 - DNA, 25 bp, Mus musculus
gtttcagtttttgctaacttcctct

SEQ ID NO: 737898 - DNA, 25 bp, Mus musculus
gtttcataaccaccagccaattcta

SEQ ID NO: 737899 - DNA, 25 bp, Mus musculus
gtttcataaccagcagccaattcta

SEQ ID NO: 737900 - DNA, 25 bp, Mus musculus
gtttcataacttcctgcttctctga

SEQ ID NO: 737901 - DNA, 25 bp, Mus musculus
gtttcataacttgctgcttctctga

SEQ ID NO: 737902 - DNA, 25 bp, Mus musculus
gtttcatacgtaagctttgcttttt

SEQ ID NO: 737903 - DNA, 25 bp, Mus musculus
gtttcatacgtatgctttgcttttt

SEQ ID NO: 737904 - DNA, 25 bp, Mus musculus
gtttcatacgttcaacatcctttct

SEQ ID NO: 737905 - DNA, 25 bp, Mus musculus
gtttcatacgttgaacatcctttct

SEQ ID NO: 737906 - DNA, 25 bp, Mus musculus
gtttcatactacagaggaagtcaat

SEQ ID NO: 737907 - DNA, 25 bp, Mus musculus
gtttcatactactgaggaagtcaat

SEQ ID NO: 737908 - DNA, 25 bp, Mus musculus
gtttcatactctcgaggccagcctg

SEQ ID NO: 737909 - DNA, 25 bp, Mus musculus
gtttcatactctggaggccagcctg

SEQ ID NO: 737910 - DNA, 25 bp, Mus musculus
gtttcatagagtctaagccttctga

SEQ ID NO: 737911 - DNA, 25 bp, Mus musculus
gtttcatagagtgtaagccttctga

SEQ ID NO: 737912 - DNA, 25 bp, Mus musculus
gtttcatagattacttaggcacagt

SEQ ID NO: 737913 - DNA, 25 bp, Mus musculus
gtttcatagatttcttaggcacagt

SEQ ID NO: 737914 - DNA, 25 bp, Mus musculus
gtttcatagcatcgtgtatgtgcaa

SEQ ID NO: 737915 - DNA, 25 bp, Mus musculus
gtttcatagcatggtgtatgtgcaa

SEQ ID NO: 737916 - DNA, 25 bp, Mus musculus
gtttcatagcgaagtttagtccctt

SEQ ID NO: 737917 - DNA, 25 bp, Mus musculus
gtttcatagcgatgtttagtccctt

SEQ ID NO: 737918 - DNA, 25 bp, Mus musculus
gtttcatagggtcctcagtattcgt

SEQ ID NO: 737919 - DNA, 25 bp, Mus musculus
gtttcatagggtgctcagtattcgt

SEQ ID NO: 737920 - DNA, 25 bp, Mus musculus
gtttcataggtaaactctccatcta

SEQ ID NO: 737921 - DNA, 25 bp, Mus musculus
gtttcataggtatactctccatcta

SEQ ID NO: 737922 - DNA, 25 bp, Mus musculus
gtttcatattcccattcttttggcc

SEQ ID NO: 737923 - DNA, 25 bp, Mus musculus
gtttcatattccgattcttttggcc

SEQ ID NO: 737924 - DNA, 25 bp, Mus musculus
gtttcatattttcctctttagagac

SEQ ID NO: 737925 - DNA, 25 bp, Mus musculus
gtttcatattttgctctttagagac

SEQ ID NO: 737926 - DNA, 25 bp, Mus musculus
gtttcatcaaaaacactgctgccta

SEQ ID NO: 737927 - DNA, 25 bp, Mus musculus
gtttcatcaaaatcactgctgccta

SEQ ID NO: 737928 - DNA, 25 bp, Mus musculus
gtttcatcaaagcaacagtaaccaa

SEQ ID NO: 737929 - DNA, 25 bp, Mus musculus
gtttcatcaaaggaacagtaaccaa

SEQ ID NO: 737930 - DNA, 25 bp, Mus musculus
gtttcatcacccctagtcttgggca

SEQ ID NO: 737931 - DNA, 25 bp, Mus musculus
gtttcatcacccgtagtcttgggca

SEQ ID NO: 737932 - DNA, 25 bp, Mus musculus
gtttcatcacttatacatggttttg

SEQ ID NO: 737933 - DNA, 25 bp, Mus musculus
gtttcatcacttttacatggttttg

SEQ ID NO: 737934 - DNA, 25 bp, Mus musculus
gtttcatcagaaacacgcagagtca

SEQ ID NO: 737935 - DNA, 25 bp, Mus musculus
gtttcatcagaatcacgcagagtca

SEQ ID NO: 737936 - DNA, 25 bp, Mus musculus
gtttcatcagcgaaattgccctggc

SEQ ID NO: 737937 - DNA, 25 bp, Mus musculus
gtttcatcagcgtaattgccctggc

SEQ ID NO: 737938 - DNA, 25 bp, Mus musculus
gtttcatcagttctctgtaccacat

SEQ ID NO: 737939 - DNA, 25 bp, Mus musculus
gtttcatcagttgtctgtaccacat

SEQ ID NO: 737940 - DNA, 25 bp, Mus musculus
gtttcatcatttcggttctcacaca

SEQ ID NO: 737941 - DNA, 25 bp, Mus musculus
gtttcatcatttgggttctcacaca

SEQ ID NO: 737942 - DNA, 25 bp, Mus musculus
gtttcatccaaaagtgtatgctgat

SEQ ID NO: 737943 - DNA, 25 bp, Mus musculus
gtttcatccaaatgtgtatgctgat

SEQ ID NO: 737944 - DNA, 25 bp, Mus musculus
gtttcatccacacttgacatccatt

SEQ ID NO: 737945 - DNA, 25 bp, Mus musculus
gtttcatccacagttgacatccatt

SEQ ID NO: 737946 - DNA, 25 bp, Mus musculus
gtttcatcccaaccaaaatattttc

SEQ ID NO: 737947 - DNA, 25 bp, Mus musculus
gtttcatcccaagcaaaatattttc

SEQ ID NO: 737948 - DNA, 25 bp, Mus musculus
gtttcatccgagagacaacagacaa

SEQ ID NO: 737949 - DNA, 25 bp, Mus musculus
gtttcatccgagtgacaacagacaa

SEQ ID NO: 737950 - DNA, 25 bp, Mus musculus
gtttcatcctcaaaacacatacaca

SEQ ID NO: 737951 - DNA, 25 bp, Mus musculus
gtttcatcctcactgcaggcatgta

SEQ ID NO: 737952 - DNA, 25 bp, Mus musculus
gtttcatcctcagtgcaggcatgta

SEQ ID NO: 737953 - DNA, 25 bp, Mus musculus
gtttcatcctcataacacatacaca

SEQ ID NO: 737954 - DNA, 25 bp, Mus musculus
gtttcatcctgtcaacagttctatt

SEQ ID NO: 737955 - DNA, 25 bp, Mus musculus
gtttcatcctgtgaacagttctatt

SEQ ID NO: 737956 - DNA, 25 bp, Mus musculus
gtttcatcgcgcattcttggcagaa

SEQ ID NO: 737957 - DNA, 25 bp, Mus musculus
gtttcatcgcgctttcttggcagaa

SEQ ID NO: 737958 - DNA, 25 bp, Mus musculus
gtttcatcggtgatgagtctgtttc

SEQ ID NO: 737959 - DNA, 25 bp, Mus musculus
gtttcatcggtgttgagtctgtttc

SEQ ID NO: 737960 - DNA, 25 bp, Mus musculus
gtttcatcgtaactatagatttcct

SEQ ID NO: 737961 - DNA, 25 bp, Mus musculus
gtttcatcgtaagtatagatttcct

SEQ ID NO: 737962 - DNA, 25 bp, Mus musculus
gtttcatcgtcccaggacacggcaa

SEQ ID NO: 737963 - DNA, 25 bp, Mus musculus
gtttcatcgtccgaggacacggcaa

SEQ ID NO: 737964 - DNA, 25 bp, Mus musculus
gtttcatctcagaagtctatcacag

SEQ ID NO: 737965 - DNA, 25 bp, Mus musculus
gtttcatctcagtagtctatcacag

SEQ ID NO: 737966 - DNA, 25 bp, Mus musculus
gtttcatctttgctcttcttaggga

SEQ ID NO: 737967 - DNA, 25 bp, Mus musculus
gtttcatctttggtcttcttaggga

SEQ ID NO: 737968 - DNA, 25 bp, Mus musculus
gtttcatgaactctgctaactcacc

SEQ ID NO: 737969 - DNA, 25 bp, Mus musculus
gtttcatgaactgtgctaactcacc

SEQ ID NO: 737970 - DNA, 25 bp, Mus musculus
gtttcatgacccaggttaaattcag

SEQ ID NO: 737971 - DNA, 25 bp, Mus musculus
gtttcatgaccctggttaaattcag

SEQ ID NO: 737972 - DNA, 25 bp, Mus musculus
gtttcatgagttaactttcgtccat

SEQ ID NO: 737973 - DNA, 25 bp, Mus musculus
gtttcatgagttcgctcctttgcca

SEQ ID NO: 737974 - DNA, 25 bp, Mus musculus
gtttcatgagttggctcctttgcca

SEQ ID NO: 737975 - DNA, 25 bp, Mus musculus
gtttcatgagtttactttcgtccat

SEQ ID NO: 737976 - DNA, 25 bp, Mus musculus
gtttcatgatttattgccatcaccc

SEQ ID NO: 737977 - DNA, 25 bp, Mus musculus
gtttcatgattttttgccatcaccc

SEQ ID NO: 737978 - DNA, 25 bp, Mus musculus
gtttcatgcacaccttagacactta

SEQ ID NO: 737979 - DNA, 25 bp, Mus musculus
gtttcatgcacagcttagacactta

SEQ ID NO: 737980 - DNA, 25 bp, Mus musculus
gtttcatgccagagtatttctacct

SEQ ID NO: 737981 - DNA, 25 bp, Mus musculus
gtttcatgccagtgtatttctacct

SEQ ID NO: 737982 - DNA, 25 bp, Mus musculus
gtttcatgcctacctcaaagtatgg

SEQ ID NO: 737983 - DNA, 25 bp, Mus musculus
gtttcatgcctagctcaaagtatgg

SEQ ID NO: 737984 - DNA, 25 bp, Mus musculus
gtttcatgctacatctgtatcttca

SEQ ID NO: 737985 - DNA, 25 bp, Mus musculus
gtttcatgctacttctgtatcttca

SEQ ID NO: 737986 - DNA, 25 bp, Mus musculus
gtttcatggaaaactaccactgcca

SEQ ID NO: 737987 - DNA, 25 bp, Mus musculus
gtttcatggaaatctaccactgcca

SEQ ID NO: 737988 - DNA, 25 bp, Mus musculus
gtttcatggagcagtctacgtctaa

SEQ ID NO: 737989 - DNA, 25 bp, Mus musculus
gtttcatggagctgtctacgtctaa

SEQ ID NO: 737990 - DNA, 25 bp, Mus musculus
gtttcatggctaacccacagctcct

SEQ ID NO: 737991 - DNA, 25 bp, Mus musculus
gtttcatggctatcccacagctcct

SEQ ID NO: 737992 - DNA, 25 bp, Mus musculus
gtttcatggcttacaatgtgtgtca

SEQ ID NO: 737993 - DNA, 25 bp, Mus musculus
gtttcatggcttagtcagactggat

SEQ ID NO: 737994 - DNA, 25 bp, Mus musculus
gtttcatggctttcaatgtgtgtca

SEQ ID NO: 737995 - DNA, 25 bp, Mus musculus
gtttcatggctttgtcagactggat

SEQ ID NO: 737996 - DNA, 25 bp, Mus musculus
gtttcatgggatcacagcaacatca

SEQ ID NO: 737997 - DNA, 25 bp, Mus musculus
gtttcatgggatgacagcaacatca

SEQ ID NO: 737998 - DNA, 25 bp, Mus musculus
gtttcatgtgtaagcttgactgtat

SEQ ID NO: 737999 - DNA, 25 bp, Mus musculus
gtttcatgtgtatgcttgactgtat

SEQ ID NO: 738000 - DNA, 25 bp, Mus musculus
gtttcatgttataccacccatctaa

SEQ ID NO: 738001 - DNA, 25 bp, Mus musculus
gtttcatgttattccacccatctaa

SEQ ID NO: 738002 - DNA, 25 bp, Mus musculus
gtttcatgttctatctaatttacaa

SEQ ID NO: 738003 - DNA, 25 bp, Mus musculus
gtttcatgttctttctaatttacaa

SEQ ID NO: 738004 - DNA, 25 bp, Mus musculus
gtttcatgttgaagccatttccctt

SEQ ID NO: 738005 - DNA, 25 bp, Mus musculus
gtttcatgttgatgccatttccctt

SEQ ID NO: 738006 - DNA, 25 bp, Mus musculus
gtttcatgtttaatggactgtacca

SEQ ID NO: 738007 - DNA, 25 bp, Mus musculus
gtttcatgtttattggactgtacca

SEQ ID NO: 738008 - DNA, 25 bp, Mus musculus
gtttcattaaaccatcaattcatct

SEQ ID NO: 738009 - DNA, 25 bp, Mus musculus
gtttcattaaacgatcaattcatct

SEQ ID NO: 738010 - DNA, 25 bp, Mus musculus
gtttcattaatacagagcttctgat

SEQ ID NO: 738011 - DNA, 25 bp, Mus musculus
gtttcattaatagagagcttctgat

SEQ ID NO: 738012 - DNA, 25 bp, Mus musculus
gtttcattaggcatatatggagtaa

SEQ ID NO: 738013 - DNA, 25 bp, Mus musculus
gtttcattaggcttatatggagtaa

SEQ ID NO: 738014 - DNA, 25 bp, Mus musculus
gtttcattatataaccacaaagtgt

SEQ ID NO: 738015 - DNA, 25 bp, Mus musculus
gtttcattatataagctttcccaaa

SEQ ID NO: 738016 - DNA, 25 bp, Mus musculus
gtttcattatattaccacaaagtgt

SEQ ID NO: 738017 - DNA, 25 bp, Mus musculus
gtttcattatattagctttcccaaa

SEQ ID NO: 738018 - DNA, 25 bp, Mus musculus
gtttcattatgtagctacacaccaa

SEQ ID NO: 738019 - DNA, 25 bp, Mus musculus
gtttcattatgtatgctaccatccg

SEQ ID NO: 738020 - DNA, 25 bp, Mus musculus
gtttcattatgttgctacacaccaa

SEQ ID NO: 738021 - DNA, 25 bp, Mus musculus
gtttcattatgtttgctaccatccg

SEQ ID NO: 738022 - DNA, 25 bp, Mus musculus
gtttcattcaaacactgtgcactat

SEQ ID NO: 738023 - DNA, 25 bp, Mus musculus
gtttcattcaaagactgtgcactat

SEQ ID NO: 738024 - DNA, 25 bp, Mus musculus
gtttcattcacaaaaaagtcttcaa

SEQ ID NO: 738025 - DNA, 25 bp, Mus musculus
gtttcattcacataaaagtcttcaa

SEQ ID NO: 738026 - DNA, 25 bp, Mus musculus
gtttcattcctaaataccttatctg

SEQ ID NO: 738027 - DNA, 25 bp, Mus musculus
gtttcattcctatataccttatctg

SEQ ID NO: 738028 - DNA, 25 bp, Mus musculus
gtttcattcggtattagttctgcat

SEQ ID NO: 738029 - DNA, 25 bp, Mus musculus
gtttcattcggttttagttctgcat

SEQ ID NO: 738030 - DNA, 25 bp, Mus musculus
gtttcattctatatcatggagctac

SEQ ID NO: 738031 - DNA, 25 bp, Mus musculus
gtttcattctatttcatggagctac

SEQ ID NO: 738032 - DNA, 25 bp, Mus musculus
gtttcattgcaactgcagccctcgg

SEQ ID NO: 738033 - DNA, 25 bp, Mus musculus
gtttcattgcaagtgcagccctcgg

SEQ ID NO: 738034 - DNA, 25 bp, Mus musculus
gtttcattggcacgctacaataatg

SEQ ID NO: 738035 - DNA, 25 bp, Mus musculus
gtttcattggcaggctacaataatg

SEQ ID NO: 738036 - DNA, 25 bp, Mus musculus
gtttcattgtatcacccagactgga

SEQ ID NO: 738037 - DNA, 25 bp, Mus musculus
gtttcattgtatgacccagactgga

SEQ ID NO: 738038 - DNA, 25 bp, Mus musculus
gtttcatttctcctctcgttggtgc

SEQ ID NO: 738039 - DNA, 25 bp, Mus musculus
gtttcatttctcgtctcgttggtgc

SEQ ID NO: 738040 - DNA, 25 bp, Mus musculus
gtttcatttgcaaatgagcccttct

SEQ ID NO: 738041 - DNA, 25 bp, Mus musculus
gtttcatttgcatatgagcccttct

SEQ ID NO: 738042 - DNA, 25 bp, Mus musculus
gtttcatttgctctaatcagttttt

SEQ ID NO: 738043 - DNA, 25 bp, Mus musculus
gtttcatttgctgtaatcagttttt

SEQ ID NO: 738044 - DNA, 25 bp, Mus musculus
gtttcatttgtactttcaggactta

SEQ ID NO: 738045 - DNA, 25 bp, Mus musculus
gtttcatttgtagtttcaggactta

SEQ ID NO: 738046 - DNA, 25 bp, Mus musculus
gtttcattttgactgttgttcacaa

SEQ ID NO: 738047 - DNA, 25 bp, Mus musculus
gtttcattttgagtgttgttcacaa

SEQ ID NO: 738048 - DNA, 25 bp, Mus musculus
gtttccaaaaaccatctataactga

SEQ ID NO: 738049 - DNA, 25 bp, Mus musculus
gtttccaaaaacgatctataactga

SEQ ID NO: 738050 - DNA, 25 bp, Mus musculus
gtttccaaaacccttgcattctggt

SEQ ID NO: 738051 - DNA, 25 bp, Mus musculus
gtttccaaaaccgttgcattctggt

SEQ ID NO: 738052 - DNA, 25 bp, Mus musculus
gtttccaaacttctctgaatttcac

SEQ ID NO: 738053 - DNA, 25 bp, Mus musculus
gtttccaaacttgtctgaatttcac

SEQ ID NO: 738054 - DNA, 25 bp, Mus musculus
gtttccaaagtaagtgtacctccaa

SEQ ID NO: 738055 - DNA, 25 bp, Mus musculus
gtttccaaagtatgtgtacctccaa

SEQ ID NO: 738056 - DNA, 25 bp, Mus musculus
gtttccaaatgtaccccaaagtgct

SEQ ID NO: 738057 - DNA, 25 bp, Mus musculus
gtttccaaatgttccccaaagtgct

SEQ ID NO: 738058 - DNA, 25 bp, Mus musculus
gtttccaacaccaattcatctgagc

SEQ ID NO: 738059 - DNA, 25 bp, Mus musculus
gtttccaacacctattcatctgagc

SEQ ID NO: 738060 - DNA, 25 bp, Mus musculus
gtttccaaccatatgaacctgtggg

SEQ ID NO: 738061 - DNA, 25 bp, Mus musculus
gtttccaaccatttgaacctgtggg

SEQ ID NO: 738062 - DNA, 25 bp, Mus musculus
gtttccaacgctaagggagcctaat

SEQ ID NO: 738063 - DNA, 25 bp, Mus musculus
gtttccaacgcttagggagcctaat

SEQ ID NO: 738064 - DNA, 25 bp, Mus musculus
gtttccaactacagcttggcagtgg

SEQ ID NO: 738065 - DNA, 25 bp, Mus musculus
gtttccaactactgcttggcagtgg

SEQ ID NO: 738066 - DNA, 25 bp, Mus musculus
gtttccaactagataacagtgctaa

SEQ ID NO: 738067 - DNA, 25 bp, Mus musculus
gtttccaactagttaacagtgctaa

SEQ ID NO: 738068 - DNA, 25 bp, Mus musculus
gtttccaactgactctacccagcat

SEQ ID NO: 738069 - DNA, 25 bp, Mus musculus
gtttccaactgagtctacccagcat

SEQ ID NO: 738070 - DNA, 25 bp, Mus musculus
gtttccaagaaccatcaagtcagtg

SEQ ID NO: 738071 - DNA, 25 bp, Mus musculus
gtttccaagaacgatcaagtcagtg

SEQ ID NO: 738072 - DNA, 25 bp, Mus musculus
gtttccaagaggcatgacctgcccc

SEQ ID NO: 738073 - DNA, 25 bp, Mus musculus
gtttccaagagggatgacctgcccc

SEQ ID NO: 738074 - DNA, 25 bp, Mus musculus
gtttccaagagtcttgacaccctct

SEQ ID NO: 738075 - DNA, 25 bp, Mus musculus
gtttccaagagtgttgacaccctct

SEQ ID NO: 738076 - DNA, 25 bp, Mus musculus
gtttccaagctacgtgtggtagaaa

SEQ ID NO: 738077 - DNA, 25 bp, Mus musculus
gtttccaagctaggtgtggtagaaa

SEQ ID NO: 738078 - DNA, 25 bp, Mus musculus
gtttccaaggtcaatgcactgctgc

SEQ ID NO: 738079 - DNA, 25 bp, Mus musculus
gtttccaaggtctatgcactgctgc

SEQ ID NO: 738080 - DNA, 25 bp, Mus musculus
gtttccaataccaggcagtttctct

SEQ ID NO: 738081 - DNA, 25 bp, Mus musculus
gtttccaatacctggcagtttctct

SEQ ID NO: 738082 - DNA, 25 bp, Mus musculus
gtttccaatctgattgtgtgctaga

SEQ ID NO: 738083 - DNA, 25 bp, Mus musculus
gtttccaatctgtttgtgtgctaga

SEQ ID NO: 738084 - DNA, 25 bp, Mus musculus
gtttccaatgttactcttacgggtg

SEQ ID NO: 738085 - DNA, 25 bp, Mus musculus
gtttccaatgtttctcttacgggtg

SEQ ID NO: 738086 - DNA, 25 bp, Mus musculus
gtttccaattggctattgccgtttt

SEQ ID NO: 738087 - DNA, 25 bp, Mus musculus
gtttccaattgggtattgccgtttt

SEQ ID NO: 738088 - DNA, 25 bp, Mus musculus
gtttccaatttaaagtggccattac

SEQ ID NO: 738089 - DNA, 25 bp, Mus musculus
gtttccaatttatagtggccattac

SEQ ID NO: 738090 - DNA, 25 bp, Mus musculus
gtttccaatttcaggcttgtgtcac

SEQ ID NO: 738091 - DNA, 25 bp, Mus musculus
gtttccaatttctggcttgtgtcac

SEQ ID NO: 738092 - DNA, 25 bp, Mus musculus
gtttccacacctcccatgggtggga

SEQ ID NO: 738093 - DNA, 25 bp, Mus musculus
gtttccacacctgccatgggtggga

SEQ ID NO: 738094 - DNA, 25 bp, Mus musculus
gtttccacagaaccattgttacgct

SEQ ID NO: 738095 - DNA, 25 bp, Mus musculus
gtttccacagaagcattgttacgct

SEQ ID NO: 738096 - DNA, 25 bp, Mus musculus
gtttccacagataggacagatccag

SEQ ID NO: 738097 - DNA, 25 bp, Mus musculus
gtttccacagattggacagatccag

SEQ ID NO: 738098 - DNA, 25 bp, Mus musculus
gtttccacaggacacttttgctgca

SEQ ID NO: 738099 - DNA, 25 bp, Mus musculus
gtttccacaggagacttttgctgca

SEQ ID NO: 738100 - DNA, 25 bp, Mus musculus
gtttccacatcaaaacaaagttcaa

SEQ ID NO: 738101 - DNA, 25 bp, Mus musculus
gtttccacatcactgttattccatg

SEQ ID NO: 738102 - DNA, 25 bp, Mus musculus
gtttccacatcagtgttattccatg

SEQ ID NO: 738103 - DNA, 25 bp, Mus musculus
gtttccacatcataacaaagttcaa

SEQ ID NO: 738104 - DNA, 25 bp, Mus musculus
gtttccaccaggatgctgcgtgcag

SEQ ID NO: 738105 - DNA, 25 bp, Mus musculus
gtttccaccaggttgctgcgtgcag

SEQ ID NO: 738106 - DNA, 25 bp, Mus musculus
gtttccaccagtcgcattggagatg

SEQ ID NO: 738107 - DNA, 25 bp, Mus musculus
gtttccaccagtggcattggagatg

SEQ ID NO: 738108 - DNA, 25 bp, Mus musculus
gtttccaccattccgacaggccgag

SEQ ID NO: 738109 - DNA, 25 bp, Mus musculus
gtttccaccattgcgacaggccgag

SEQ ID NO: 738110 - DNA, 25 bp, Mus musculus
gtttccaccctaattatctgcaaaa

SEQ ID NO: 738111 - DNA, 25 bp, Mus musculus
gtttccaccctatttatctgcaaaa

SEQ ID NO: 738112 - DNA, 25 bp, Mus musculus
gtttccacctagaatacagcgtgca

SEQ ID NO: 738113 - DNA, 25 bp, Mus musculus
gtttccacctagtatacagcgtgca

SEQ ID NO: 738114 - DNA, 25 bp, Mus musculus
gtttccaccttacggaccaatgtca

SEQ ID NO: 738115 - DNA, 25 bp, Mus musculus
gtttccaccttagggaccaatgtca

SEQ ID NO: 738116 - DNA, 25 bp, Mus musculus
gtttccaccttgaaaaatgttgttg

SEQ ID NO: 738117 - DNA, 25 bp, Mus musculus
gtttccaccttgtaaaatgttgttg

SEQ ID NO: 738118 - DNA, 25 bp, Mus musculus
gtttccacgctgatctaaatacctg

SEQ ID NO: 738119 - DNA, 25 bp, Mus musculus
gtttccacgctgttctaaatacctg

SEQ ID NO: 738120 - DNA, 25 bp, Mus musculus
gtttccactaataactttccagagg

SEQ ID NO: 738121 - DNA, 25 bp, Mus musculus
gtttccactaattactttccagagg

SEQ ID NO: 738122 - DNA, 25 bp, Mus musculus
gtttccactatactggttcagcgtt

SEQ ID NO: 738123 - DNA, 25 bp, Mus musculus
gtttccactatagtggttcagcgtt

SEQ ID NO: 738124 - DNA, 25 bp, Mus musculus
gtttccactcatagtcctggactat

SEQ ID NO: 738125 - DNA, 25 bp, Mus musculus
gtttccactcatctttagagtgctc

SEQ ID NO: 738126 - DNA, 25 bp, Mus musculus
gtttccactcatgtttagagtgctc

SEQ ID NO: 738127 - DNA, 25 bp, Mus musculus
gtttccactcattgtcctggactat

SEQ ID NO: 738128 - DNA, 25 bp, Mus musculus
gtttccactctccagtaatgctaaa

SEQ ID NO: 738129 - DNA, 25 bp, Mus musculus
gtttccactctcgagtaatgctaaa

SEQ ID NO: 738130 - DNA, 25 bp, Mus musculus
gtttccactgatatccaagctatca

SEQ ID NO: 738131 - DNA, 25 bp, Mus musculus
gtttccactgatttccaagctatca

SEQ ID NO: 738132 - DNA, 25 bp, Mus musculus
gtttccactgctcgataatccacca

SEQ ID NO: 738133 - DNA, 25 bp, Mus musculus
gtttccactgctggataatccacca

SEQ ID NO: 738134 - DNA, 25 bp, Mus musculus
gtttccactgtgaggttcttaaaat

SEQ ID NO: 738135 - DNA, 25 bp, Mus musculus
gtttccactgtgtggttcttaaaat

SEQ ID NO: 738136 - DNA, 25 bp, Mus musculus
gtttccactgttaagtcactgctag

SEQ ID NO: 738137 - DNA, 25 bp, Mus musculus
gtttccactgtttagtcactgctag

SEQ ID NO: 738138 - DNA, 25 bp, Mus musculus
gtttccagaaccaaaagggctgctc

SEQ ID NO: 738139 - DNA, 25 bp, Mus musculus
gtttccagaacctaaagggctgctc

SEQ ID NO: 738140 - DNA, 25 bp, Mus musculus
gtttccagaagaaatcgggccagca

SEQ ID NO: 738141 - DNA, 25 bp, Mus musculus
gtttccagaagatatcgggccagca

SEQ ID NO: 738142 - DNA, 25 bp, Mus musculus
gtttccagacaaaccatggctgctg

SEQ ID NO: 738143 - DNA, 25 bp, Mus musculus
gtttccagacaatccatggctgctg

SEQ ID NO: 738144 - DNA, 25 bp, Mus musculus
gtttccagatcgaatttcctcatag

SEQ ID NO: 738145 - DNA, 25 bp, Mus musculus
gtttccagatcgtatttcctcatag

SEQ ID NO: 738146 - DNA, 25 bp, Mus musculus
gtttccagcaaacagggaatcccta

SEQ ID NO: 738147 - DNA, 25 bp, Mus musculus
gtttccagcaaagagggaatcccta

SEQ ID NO: 738148 - DNA, 25 bp, Mus musculus
gtttccagcacaactggaatgcctc

SEQ ID NO: 738149 - DNA, 25 bp, Mus musculus
gtttccagcacatctggaatgcctc

SEQ ID NO: 738150 - DNA, 25 bp, Mus musculus
gtttccagcactcatgatggtggtt

SEQ ID NO: 738151 - DNA, 25 bp, Mus musculus
gtttccagcactgatgatggtggtt

SEQ ID NO: 738152 - DNA, 25 bp, Mus musculus
gtttccagccaactggtgttcaaca

SEQ ID NO: 738153 - DNA, 25 bp, Mus musculus
gtttccagccaagtggtgttcaaca

SEQ ID NO: 738154 - DNA, 25 bp, Mus musculus
gtttccagcctgatcagacatcaga

SEQ ID NO: 738155 - DNA, 25 bp, Mus musculus
gtttccagcctgttcagacatcaga

SEQ ID NO: 738156 - DNA, 25 bp, Mus musculus
gtttccagctcaaagacttcctgat

SEQ ID NO: 738157 - DNA, 25 bp, Mus musculus
gtttccagctcatagacttcctgat

SEQ ID NO: 738158 - DNA, 25 bp, Mus musculus
gtttccagctggagcttcagaagtg

SEQ ID NO: 738159 - DNA, 25 bp, Mus musculus
gtttccagctggtgcttcagaagtg

SEQ ID NO: 738160 - DNA, 25 bp, Mus musculus
gtttccagcttcatccgagcaatag

SEQ ID NO: 738161 - DNA, 25 bp, Mus musculus
gtttccagcttcttccgagcaatag

SEQ ID NO: 738162 - DNA, 25 bp, Mus musculus
gtttccaggcaaccagagttccaca

SEQ ID NO: 738163 - DNA, 25 bp, Mus musculus
gtttccaggcaagcagagttccaca

SEQ ID NO: 738164 - DNA, 25 bp, Mus musculus
gtttccaggcagagcaagccgggca

SEQ ID NO: 738165 - DNA, 25 bp, Mus musculus
gtttccaggcagtgcaagccgggca

SEQ ID NO: 738166 - DNA, 25 bp, Mus musculus
gtttccaggcataactttgacagca

SEQ ID NO: 738167 - DNA, 25 bp, Mus musculus
gtttccaggcattactttgacagca

SEQ ID NO: 738168 - DNA, 25 bp, Mus musculus
gtttccagggagacaggactgctac

SEQ ID NO: 738169 - DNA, 25 bp, Mus musculus
gtttccagggagtcaggactgctac

SEQ ID NO: 738170 - DNA, 25 bp, Mus musculus
gtttccagggccagatgggtgcaca

SEQ ID NO: 738171 - DNA, 25 bp, Mus musculus
gtttccagggcctgatgggtgcaca

SEQ ID NO: 738172 - DNA, 25 bp, Mus musculus
gtttccagggtcagagcagctgctt

SEQ ID NO: 738173 - DNA, 25 bp, Mus musculus
gtttccagggtctgagcagctgctt

SEQ ID NO: 738174 - DNA, 25 bp, Mus musculus
gtttccaggtacagccacttataca

SEQ ID NO: 738175 - DNA, 25 bp, Mus musculus
gtttccaggtactgccacttataca

SEQ ID NO: 738176 - DNA, 25 bp, Mus musculus
gtttccaggtgcaacaaaacctgct

SEQ ID NO: 738177 - DNA, 25 bp, Mus musculus
gtttccaggtgctacaaaacctgct

SEQ ID NO: 738178 - DNA, 25 bp, Mus musculus
gtttccagtccaacgtgagcggatg

SEQ ID NO: 738179 - DNA, 25 bp, Mus musculus
gtttccagtccatcgtgagcggatg

SEQ ID NO: 738180 - DNA, 25 bp, Mus musculus
gtttccagtgtgctagacttgagcc

SEQ ID NO: 738181 - DNA, 25 bp, Mus musculus
gtttccagtgtggtagacttgagcc

SEQ ID NO: 738182 - DNA, 25 bp, Mus musculus
gtttccataaatctagcagctcgcc

SEQ ID NO: 738183 - DNA, 25 bp, Mus musculus
gtttccataaatgtagcagctcgcc

SEQ ID NO: 738184 - DNA, 25 bp, Mus musculus
gtttccatacagaacccaggatttt

SEQ ID NO: 738185 - DNA, 25 bp, Mus musculus
gtttccatacagtacccaggatttt

SEQ ID NO: 738186 - DNA, 25 bp, Mus musculus
gtttccatagcaaaagatttctagt

SEQ ID NO: 738187 - DNA, 25 bp, Mus musculus
gtttccatagcaacgggtcctctag

SEQ ID NO: 738188 - DNA, 25 bp, Mus musculus
gtttccatagcataagatttctagt

SEQ ID NO: 738189 - DNA, 25 bp, Mus musculus
gtttccatagcatcgggtcctctag

SEQ ID NO: 738190 - DNA, 25 bp, Mus musculus
gtttccataggcacctgggtattca

SEQ ID NO: 738191 - DNA, 25 bp, Mus musculus
gtttccataggctcctgggtattca

SEQ ID NO: 738192 - DNA, 25 bp, Mus musculus
gtttccatatcaattagttccaccc

SEQ ID NO: 738193 - DNA, 25 bp, Mus musculus
gtttccatatcatttagttccaccc

SEQ ID NO: 738194 - DNA, 25 bp, Mus musculus
gtttccatcaaaacctcttcaagtt

SEQ ID NO: 738195 - DNA, 25 bp, Mus musculus
gtttccatcaaatcctcttcaagtt

SEQ ID NO: 738196 - DNA, 25 bp, Mus musculus
gtttccatcagtacatgctgaagta

SEQ ID NO: 738197 - DNA, 25 bp, Mus musculus
gtttccatcagttcatgctgaagta

SEQ ID NO: 738198 - DNA, 25 bp, Mus musculus
gtttccatcataatggtacccacca

SEQ ID NO: 738199 - DNA, 25 bp, Mus musculus
gtttccatcatattggtacccacca

SEQ ID NO: 738200 - DNA, 25 bp, Mus musculus
gtttccatccagaacaggctctaat

SEQ ID NO: 738201 - DNA, 25 bp, Mus musculus
gtttccatccagaataaaggcagtt

SEQ ID NO: 738202 - DNA, 25 bp, Mus musculus
gtttccatccagtacaggctctaat

SEQ ID NO: 738203 - DNA, 25 bp, Mus musculus
gtttccatccagtataaaggcagtt

SEQ ID NO: 738204 - DNA, 25 bp, Mus musculus
gtttccatccatctggtgctaacat

SEQ ID NO: 738205 - DNA, 25 bp, Mus musculus
gtttccatccatgtggtgctaacat

SEQ ID NO: 738206 - DNA, 25 bp, Mus musculus
gtttccatccctataccagatatga

SEQ ID NO: 738207 - DNA, 25 bp, Mus musculus
gtttccatccctttaccagatatga

SEQ ID NO: 738208 - DNA, 25 bp, Mus musculus
gtttccatcctcatcctccatgatg

SEQ ID NO: 738209 - DNA, 25 bp, Mus musculus
gtttccatcctcttcctccatgatg

SEQ ID NO: 738210 - DNA, 25 bp, Mus musculus
gtttccatccttagtttgataccga

SEQ ID NO: 738211 - DNA, 25 bp, Mus musculus
gtttccatcctttgtttgataccga

SEQ ID NO: 738212 - DNA, 25 bp, Mus musculus
gtttccatctaaaagcacttcaggg

SEQ ID NO: 738213 - DNA, 25 bp, Mus musculus
gtttccatctaacaagagctgccct

SEQ ID NO: 738214 - DNA, 25 bp, Mus musculus
gtttccatctaagaagagctgccct

SEQ ID NO: 738215 - DNA, 25 bp, Mus musculus
gtttccatctaatagcacttcaggg

SEQ ID NO: 738216 - DNA, 25 bp, Mus musculus
gtttccatctttcttggatctacac

SEQ ID NO: 738217 - DNA, 25 bp, Mus musculus
gtttccatctttgttggatctacac

SEQ ID NO: 738218 - DNA, 25 bp, Mus musculus
gtttccatgaccagaccagattctt

SEQ ID NO: 738219 - DNA, 25 bp, Mus musculus
gtttccatgacctgaccagattctt

SEQ ID NO: 738220 - DNA, 25 bp, Mus musculus
gtttccatgctaagccctcggagat

SEQ ID NO: 738221 - DNA, 25 bp, Mus musculus
gtttccatgctatgccctcggagat

SEQ ID NO: 738222 - DNA, 25 bp, Mus musculus
gtttccatggtgagagtgctttact

SEQ ID NO: 738223 - DNA, 25 bp, Mus musculus
gtttccatggtgtgagtgctttact

SEQ ID NO: 738224 - DNA, 25 bp, Mus musculus
gtttccatgtaacaatcacagggct

SEQ ID NO: 738225 - DNA, 25 bp, Mus musculus
gtttccatgtaagaatcacagggct

SEQ ID NO: 738226 - DNA, 25 bp, Mus musculus
gtttccatgttgacaggtagttgta

SEQ ID NO: 738227 - DNA, 25 bp, Mus musculus
gtttccatgttgtcaggtagttgta

SEQ ID NO: 738228 - DNA, 25 bp, Mus musculus
gtttccatgtttaagcttttcaact

SEQ ID NO: 738229 - DNA, 25 bp, Mus musculus
gtttccatgtttcaatgagggtcag

SEQ ID NO: 738230 - DNA, 25 bp, Mus musculus
gtttccatgtttgaatgagggtcag

SEQ ID NO: 738231 - DNA, 25 bp, Mus musculus
gtttccatgttttagcttttcaact

SEQ ID NO: 738232 - DNA, 25 bp, Mus musculus
gtttccattctcattgtatactgtc

SEQ ID NO: 738233 - DNA, 25 bp, Mus musculus
gtttccattctctttgtatactgtc

SEQ ID NO: 738234 - DNA, 25 bp, Mus musculus
gtttccattctgaaggttcattgca

SEQ ID NO: 738235 - DNA, 25 bp, Mus musculus
gtttccattctgtaggttcattgca

SEQ ID NO: 738236 - DNA, 25 bp, Mus musculus
gtttccattgaaatttcagctctga

SEQ ID NO: 738237 - DNA, 25 bp, Mus musculus
gtttccattgaattttcagctctga

SEQ ID NO: 738238 - DNA, 25 bp, Mus musculus
gtttccattgcaaccgtgtcataga

SEQ ID NO: 738239 - DNA, 25 bp, Mus musculus
gtttccattgcatccgtgtcataga

SEQ ID NO: 738240 - DNA, 25 bp, Mus musculus
gtttccattgctagtaccatagaat

SEQ ID NO: 738241 - DNA, 25 bp, Mus musculus
gtttccattgcttgtaccatagaat

SEQ ID NO: 738242 - DNA, 25 bp, Mus musculus
gtttccattgtgagggacccatagc

SEQ ID NO: 738243 - DNA, 25 bp, Mus musculus
gtttccattgtgtgggacccatagc

SEQ ID NO: 738244 - DNA, 25 bp, Mus musculus
gtttccatttcaacagtccattttc

SEQ ID NO: 738245 - DNA, 25 bp, Mus musculus
gtttccatttcaatcagaactcgtg

SEQ ID NO: 738246 - DNA, 25 bp, Mus musculus
gtttccatttcaccccaacagagaa

SEQ ID NO: 738247 - DNA, 25 bp, Mus musculus
gtttccatttcagcccaacagagaa

SEQ ID NO: 738248 - DNA, 25 bp, Mus musculus
gtttccatttcatcagtccattttc

SEQ ID NO: 738249 - DNA, 25 bp, Mus musculus
gtttccatttcattcagaactcgtg

SEQ ID NO: 738250 - DNA, 25 bp, Mus musculus
gtttccatttgacgtgtatccccaa

SEQ ID NO: 738251 - DNA, 25 bp, Mus musculus
gtttccatttgaggtgtatccccaa

SEQ ID NO: 738252 - DNA, 25 bp, Mus musculus
gtttccatttggatgtagagacgat

SEQ ID NO: 738253 - DNA, 25 bp, Mus musculus
gtttccatttggttgtagagacgat

SEQ ID NO: 738254 - DNA, 25 bp, Mus musculus
gtttcccaaactacttagcagacct

SEQ ID NO: 738255 - DNA, 25 bp, Mus musculus
gtttcccaaacttcttagcagacct

SEQ ID NO: 738256 - DNA, 25 bp, Mus musculus
gtttcccaaagcaagaggaggctat

SEQ ID NO: 738257 - DNA, 25 bp, Mus musculus
gtttcccaaagctagaggaggctat

SEQ ID NO: 738258 - DNA, 25 bp, Mus musculus
gtttcccaaggaatgtagtgtattt

SEQ ID NO: 738259 - DNA, 25 bp, Mus musculus
gtttcccaaggattgtagtgtattt

SEQ ID NO: 738260 - DNA, 25 bp, Mus musculus
gtttcccaagtaccctgaacaatat

SEQ ID NO: 738261 - DNA, 25 bp, Mus musculus
gtttcccaagtagcctgaacaatat

SEQ ID NO: 738262 - DNA, 25 bp, Mus musculus
gtttcccaagtgagacagctcagta

SEQ ID NO: 738263 - DNA, 25 bp, Mus musculus
gtttcccaagtgtgacagctcagta

SEQ ID NO: 738264 - DNA, 25 bp, Mus musculus
gtttcccaataaaacatgctcacca

SEQ ID NO: 738265 - DNA, 25 bp, Mus musculus
gtttcccaataatacatgctcacca

SEQ ID NO: 738266 - DNA, 25 bp, Mus musculus
gtttcccaatcactcaaaggcagca

SEQ ID NO: 738267 - DNA, 25 bp, Mus musculus
gtttcccaatcagtcaaaggcagca

SEQ ID NO: 738268 - DNA, 25 bp, Mus musculus
gtttcccaatgtaatgctcgcttgc

SEQ ID NO: 738269 - DNA, 25 bp, Mus musculus
gtttcccaatgttatgctcgcttgc

SEQ ID NO: 738270 - DNA, 25 bp, Mus musculus
gtttcccaatttcatttaagacaca

SEQ ID NO: 738271 - DNA, 25 bp, Mus musculus
gtttcccaatttgatttaagacaca

SEQ ID NO: 738272 - DNA, 25 bp, Mus musculus
gtttcccagcagcacaacagacagt

SEQ ID NO: 738273 - DNA, 25 bp, Mus musculus
gtttcccagcaggacaacagacagt

SEQ ID NO: 738274 - DNA, 25 bp, Mus musculus
gtttcccagctgcttgatgccaagg

SEQ ID NO: 738275 - DNA, 25 bp, Mus musculus
gtttcccagctggttgatgccaagg

SEQ ID NO: 738276 - DNA, 25 bp, Mus musculus
gtttcccaggaccagtgccaaaaat

SEQ ID NO: 738277 - DNA, 25 bp, Mus musculus
gtttcccaggacgagtgccaaaaat

SEQ ID NO: 738278 - DNA, 25 bp, Mus musculus
gtttcccaggagctacgcgaggcca

SEQ ID NO: 738279 - DNA, 25 bp, Mus musculus
gtttcccaggagcttctaaccgaag

SEQ ID NO: 738280 - DNA, 25 bp, Mus musculus
gtttcccaggaggtacgcgaggcca

SEQ ID NO: 738281 - DNA, 25 bp, Mus musculus
gtttcccaggaggttctaaccgaag

SEQ ID NO: 738282 - DNA, 25 bp, Mus musculus
gtttcccaggatcgccttatatgca

SEQ ID NO: 738283 - DNA, 25 bp, Mus musculus
gtttcccaggatggccttatatgca

SEQ ID NO: 738284 - DNA, 25 bp, Mus musculus
gtttcccagtgacacatgagccagt

SEQ ID NO: 738285 - DNA, 25 bp, Mus musculus
gtttcccagtgagacatgagccagt

SEQ ID NO: 738286 - DNA, 25 bp, Mus musculus
gtttcccagttcattctagaggtgt

SEQ ID NO: 738287 - DNA, 25 bp, Mus musculus
gtttcccagttctttctagaggtgt

SEQ ID NO: 738288 - DNA, 25 bp, Mus musculus
gtttcccagttgagctgggccccag

SEQ ID NO: 738289 - DNA, 25 bp, Mus musculus
gtttcccagttgtgctgggccccag

SEQ ID NO: 738290 - DNA, 25 bp, Mus musculus
gtttcccatagcctaagttttactg

SEQ ID NO: 738291 - DNA, 25 bp, Mus musculus
gtttcccatagcgtaagttttactg

SEQ ID NO: 738292 - DNA, 25 bp, Mus musculus
gtttcccatatcaagatttctgcta

SEQ ID NO: 738293 - DNA, 25 bp, Mus musculus
gtttcccatatctagatttctgcta

SEQ ID NO: 738294 - DNA, 25 bp, Mus musculus
gtttcccatgaaagctactttagct

SEQ ID NO: 738295 - DNA, 25 bp, Mus musculus
gtttcccatgaatgctactttagct

SEQ ID NO: 738296 - DNA, 25 bp, Mus musculus
gtttcccatggaagagtaggacatt

SEQ ID NO: 738297 - DNA, 25 bp, Mus musculus
gtttcccatggatgagtaggacatt

SEQ ID NO: 738298 - DNA, 25 bp, Mus musculus
gtttcccatggtctcaactgtagaa

SEQ ID NO: 738299 - DNA, 25 bp, Mus musculus
gtttcccatggtgtcaactgtagaa

SEQ ID NO: 738300 - DNA, 25 bp, Mus musculus
gtttcccattacagtttgaggctga

SEQ ID NO: 738301 - DNA, 25 bp, Mus musculus
gtttcccattactgtttgaggctga

SEQ ID NO: 738302 - DNA, 25 bp, Mus musculus
gtttcccattccataatgcctgatg

SEQ ID NO: 738303 - DNA, 25 bp, Mus musculus
gtttcccattccttaatgcctgatg

SEQ ID NO: 738304 - DNA, 25 bp, Mus musculus
gtttccccaaaactaagcaagcatg

SEQ ID NO: 738305 - DNA, 25 bp, Mus musculus
gtttccccaaaagtaagcaagcatg

SEQ ID NO: 738306 - DNA, 25 bp, Mus musculus
gtttccccacaaatgaagtcagttc

SEQ ID NO: 738307 - DNA, 25 bp, Mus musculus
gtttccccacaattgaagtcagttc

SEQ ID NO: 738308 - DNA, 25 bp, Mus musculus
gtttccccacctctaagtaattgca

SEQ ID NO: 738309 - DNA, 25 bp, Mus musculus
gtttccccacctgtaagtaattgca

SEQ ID NO: 738310 - DNA, 25 bp, Mus musculus
gtttccccactacatctaacactag

SEQ ID NO: 738311 - DNA, 25 bp, Mus musculus
gtttccccactagatctaacactag

SEQ ID NO: 738312 - DNA, 25 bp, Mus musculus
gtttccccactgaggcctagtctca

SEQ ID NO: 738313 - DNA, 25 bp, Mus musculus
gtttccccactgtggcctagtctca

SEQ ID NO: 738314 - DNA, 25 bp, Mus musculus
gtttccccagcccttgagaattggg

SEQ ID NO: 738315 - DNA, 25 bp, Mus musculus
gtttccccagccgttgagaattggg

SEQ ID NO: 738316 - DNA, 25 bp, Mus musculus
gtttccccaggcagacgcgtttgaa

SEQ ID NO: 738317 - DNA, 25 bp, Mus musculus
gtttccccaggctgacgcgtttgaa

SEQ ID NO: 738318 - DNA, 25 bp, Mus musculus
gtttccccagtgctcaatgagaata

SEQ ID NO: 738319 - DNA, 25 bp, Mus musculus
gtttccccagtggtcaatgagaata

SEQ ID NO: 738320 - DNA, 25 bp, Mus musculus
gtttccccagttctcagagttcaga

SEQ ID NO: 738321 - DNA, 25 bp, Mus musculus
gtttccccagttgtcagagttcaga

SEQ ID NO: 738322 - DNA, 25 bp, Mus musculus
gtttccccatgtatgttatagcttg

SEQ ID NO: 738323 - DNA, 25 bp, Mus musculus
gtttccccatgtttgttatagcttg

SEQ ID NO: 738324 - DNA, 25 bp, Mus musculus
gtttcccccatcaacaaaagtctgt

SEQ ID NO: 738325 - DNA, 25 bp, Mus musculus
gtttcccccatctacaaaagtctgt

SEQ ID NO: 738326 - DNA, 25 bp, Mus musculus
gtttcccctcatacttgtcttggta

SEQ ID NO: 738327 - DNA, 25 bp, Mus musculus
gtttcccctcattcttgtcttggta

SEQ ID NO: 738328 - DNA, 25 bp, Mus musculus
gtttcccctgaaagtgtagcacttt

SEQ ID NO: 738329 - DNA, 25 bp, Mus musculus
gtttcccctgaatgtgtagcacttt

SEQ ID NO: 738330 - DNA, 25 bp, Mus musculus
gtttcccctgacactgaatcttaat

SEQ ID NO: 738331 - DNA, 25 bp, Mus musculus
gtttcccctgactctgaatcttaat

SEQ ID NO: 738332 - DNA, 25 bp, Mus musculus
gtttcccctgtaactgctgaactgt

SEQ ID NO: 738333 - DNA, 25 bp, Mus musculus
gtttcccctgtatctgctgaactgt

SEQ ID NO: 738334 - DNA, 25 bp, Mus musculus
gtttcccctgtgaggttctgatata

SEQ ID NO: 738335 - DNA, 25 bp, Mus musculus
gtttcccctgtgtggttctgatata

SEQ ID NO: 738336 - DNA, 25 bp, Mus musculus
gtttcccctgttccagcacagatga

SEQ ID NO: 738337 - DNA, 25 bp, Mus musculus
gtttcccctgttgcagcacagatga

SEQ ID NO: 738338 - DNA, 25 bp, Mus musculus
gtttccccttatatagcttcccaga

SEQ ID NO: 738339 - DNA, 25 bp, Mus musculus
gtttccccttatttagcttcccaga

SEQ ID NO: 738340 - DNA, 25 bp, Mus musculus
gtttcccgaatactgtgcattccag

SEQ ID NO: 738341 - DNA, 25 bp, Mus musculus
gtttcccgaatagtgtgcattccag

SEQ ID NO: 738342 - DNA, 25 bp, Mus musculus
gtttcccgagatactgtaaagaata

SEQ ID NO: 738343 - DNA, 25 bp, Mus musculus
gtttcccgagattctgtaaagaata

SEQ ID NO: 738344 - DNA, 25 bp, Mus musculus
gtttcccgccatcacagtgatggat

SEQ ID NO: 738345 - DNA, 25 bp, Mus musculus
gtttcccgccatgacagtgatggat

SEQ ID NO: 738346 - DNA, 25 bp, Mus musculus
gtttcccggcagagtgtacatgagg

SEQ ID NO: 738347 - DNA, 25 bp, Mus musculus
gtttcccggcagtgtgtacatgagg

SEQ ID NO: 738348 - DNA, 25 bp, Mus musculus
gtttcccgggctacaggatagactc

SEQ ID NO: 738349 - DNA, 25 bp, Mus musculus
gtttcccgggcttcaggatagactc

SEQ ID NO: 738350 - DNA, 25 bp, Mus musculus
gtttcccgtgggagacctaagagtg

SEQ ID NO: 738351 - DNA, 25 bp, Mus musculus
gtttcccgtgggtgacctaagagtg

SEQ ID NO: 738352 - DNA, 25 bp, Mus musculus
gtttcccgttctcagaaaggccgtg

SEQ ID NO: 738353 - DNA, 25 bp, Mus musculus
gtttcccgttctgagaaaggccgtg

SEQ ID NO: 738354 - DNA, 25 bp, Mus musculus
gtttccctaaccctctgcagaagga

SEQ ID NO: 738355 - DNA, 25 bp, Mus musculus
gtttccctaaccgtctgcagaagga

SEQ ID NO: 738356 - DNA, 25 bp, Mus musculus
gtttccctaatacaaaatttctgtg

SEQ ID NO: 738357 - DNA, 25 bp, Mus musculus
gtttccctaatactgcatttcttat

SEQ ID NO: 738358 - DNA, 25 bp, Mus musculus
gtttccctaatagaaaatttctgtg

SEQ ID NO: 738359 - DNA, 25 bp, Mus musculus
gtttccctaatagtgcatttcttat

SEQ ID NO: 738360 - DNA, 25 bp, Mus musculus
gtttccctagggaaccacagatatt

SEQ ID NO: 738361 - DNA, 25 bp, Mus musculus
gtttccctagggtaccacagatatt

SEQ ID NO: 738362 - DNA, 25 bp, Mus musculus
gtttccctaggtctcttacttactg

SEQ ID NO: 738363 - DNA, 25 bp, Mus musculus
gtttccctaggtgtcttacttactg

SEQ ID NO: 738364 - DNA, 25 bp, Mus musculus
gtttccctcaaacccagtctacgga

SEQ ID NO: 738365 - DNA, 25 bp, Mus musculus
gtttccctcaaagccagtctacgga

SEQ ID NO: 738366 - DNA, 25 bp, Mus musculus
gtttccctcccaagagaataccagg

SEQ ID NO: 738367 - DNA, 25 bp, Mus musculus
gtttccctcccatgagaataccagg

SEQ ID NO: 738368 - DNA, 25 bp, Mus musculus
gtttccctccgtatgtctccagtct

SEQ ID NO: 738369 - DNA, 25 bp, Mus musculus
gtttccctccgtttgtctccagtct

SEQ ID NO: 738370 - DNA, 25 bp, Mus musculus
gtttccctctagactaaggctggca

SEQ ID NO: 738371 - DNA, 25 bp, Mus musculus
gtttccctctagtctaaggctggca

SEQ ID NO: 738372 - DNA, 25 bp, Mus musculus
gtttccctgaaaaaggctctctgaa

SEQ ID NO: 738373 - DNA, 25 bp, Mus musculus
gtttccctgaaataggctctctgaa

SEQ ID NO: 738374 - DNA, 25 bp, Mus musculus
gtttccctgatgacccagagtcaag

SEQ ID NO: 738375 - DNA, 25 bp, Mus musculus
gtttccctgatgtcccagagtcaag

SEQ ID NO: 738376 - DNA, 25 bp, Mus musculus
gtttccctgcaaatcagtgttgact

SEQ ID NO: 738377 - DNA, 25 bp, Mus musculus
gtttccctgcaattcagtgttgact

SEQ ID NO: 738378 - DNA, 25 bp, Mus musculus
gtttccctgcagatctggaaggttc

SEQ ID NO: 738379 - DNA, 25 bp, Mus musculus
gtttccctgcagttctggaaggttc

SEQ ID NO: 738380 - DNA, 25 bp, Mus musculus
gtttccctggaacattcctatggtt

SEQ ID NO: 738381 - DNA, 25 bp, Mus musculus
gtttccctggaagattcctatggtt

SEQ ID NO: 738382 - DNA, 25 bp, Mus musculus
gtttccctgtagctctacaatatag

SEQ ID NO: 738383 - DNA, 25 bp, Mus musculus
gtttccctgtaggtctacaatatag

SEQ ID NO: 738384 - DNA, 25 bp, Mus musculus
gtttccctgtggctgccctccaaat

SEQ ID NO: 738385 - DNA, 25 bp, Mus musculus
gtttccctgtgggtgccctccaaat

SEQ ID NO: 738386 - DNA, 25 bp, Mus musculus
gtttccctgttgaatgttacctgtt

SEQ ID NO: 738387 - DNA, 25 bp, Mus musculus
gtttccctgttgtatgttacctgtt

SEQ ID NO: 738388 - DNA, 25 bp, Mus musculus
gtttcccttcatagacttctttatg

SEQ ID NO: 738389 - DNA, 25 bp, Mus musculus
gtttcccttcattgacttctttatg

SEQ ID NO: 738390 - DNA, 25 bp, Mus musculus
gtttcccttccaaagaatcaagatt

SEQ ID NO: 738391 - DNA, 25 bp, Mus musculus
gtttcccttccaacacataggagtg

SEQ ID NO: 738392 - DNA, 25 bp, Mus musculus
gtttcccttccatagaatcaagatt

SEQ ID NO: 738393 - DNA, 25 bp, Mus musculus
gtttcccttccatcacataggagtg

SEQ ID NO: 738394 - DNA, 25 bp, Mus musculus
gtttcccttgctcccttgagcaaaa

SEQ ID NO: 738395 - DNA, 25 bp, Mus musculus
gtttcccttgctgccttgagcaaaa

SEQ ID NO: 738396 - DNA, 25 bp, Mus musculus
gtttcccttgggaacaggatagaat

SEQ ID NO: 738397 - DNA, 25 bp, Mus musculus
gtttcccttgggtacaggatagaat

SEQ ID NO: 738398 - DNA, 25 bp, Mus musculus
gtttcccttttgagtgttgtccatc

SEQ ID NO: 738399 - DNA, 25 bp, Mus musculus
gtttcccttttgtgtgttgtccatc

SEQ ID NO: 738400 - DNA, 25 bp, Mus musculus
gtttccgacactaggtattctaaga

SEQ ID NO: 738401 - DNA, 25 bp, Mus musculus
gtttccgacacttggtattctaaga

SEQ ID NO: 738402 - DNA, 25 bp, Mus musculus
gtttccgccatcacagtcatcaggg

SEQ ID NO: 738403 - DNA, 25 bp, Mus musculus
gtttccgccatctcagtcatcaggg

SEQ ID NO: 738404 - DNA, 25 bp, Mus musculus
gtttccgctaccagacatattttct

SEQ ID NO: 738405 - DNA, 25 bp, Mus musculus
gtttccgctacctgacatattttct

SEQ ID NO: 738406 - DNA, 25 bp, Mus musculus
gtttccgctgacaagtaagcgggac

SEQ ID NO: 738407 - DNA, 25 bp, Mus musculus
gtttccgctgactagtaagcgggac

SEQ ID NO: 738408 - DNA, 25 bp, Mus musculus
gtttccggacaaaggaggaccacag

SEQ ID NO: 738409 - DNA, 25 bp, Mus musculus
gtttccggacaatggaggaccacag

SEQ ID NO: 738410 - DNA, 25 bp, Mus musculus
gtttccgggtcaccagttattatta

SEQ ID NO: 738411 - DNA, 25 bp, Mus musculus
gtttccgggtcagcagttattatta

SEQ ID NO: 738412 - DNA, 25 bp, Mus musculus
gtttccgtgggacctttaagaatgc

SEQ ID NO: 738413 - DNA, 25 bp, Mus musculus
gtttccgtgggagctttaagaatgc

SEQ ID NO: 738414 - DNA, 25 bp, Mus musculus
gtttccgttctcacactgaagaata

SEQ ID NO: 738415 - DNA, 25 bp, Mus musculus
gtttccgttctctcactgaagaata

SEQ ID NO: 738416 - DNA, 25 bp, Mus musculus
gtttccgttttccacttgtatgaca

SEQ ID NO: 738417 - DNA, 25 bp, Mus musculus
gtttccgttttcgacttgtatgaca

SEQ ID NO: 738418 - DNA, 25 bp, Mus musculus
gtttcctaaaagcatccttcatctg

SEQ ID NO: 738419 - DNA, 25 bp, Mus musculus
gtttcctaaaaggatccttcatctg

SEQ ID NO: 738420 - DNA, 25 bp, Mus musculus
gtttcctaaactagagcacatgttg

SEQ ID NO: 738421 - DNA, 25 bp, Mus musculus
gtttcctaaacttgagcacatgttg

SEQ ID NO: 738422 - DNA, 25 bp, Mus musculus
gtttcctaaagcattgaagcattta

SEQ ID NO: 738423 - DNA, 25 bp, Mus musculus
gtttcctaaagctttgaagcattta

SEQ ID NO: 738424 - DNA, 25 bp, Mus musculus
gtttcctaacgcagactatgtgata

SEQ ID NO: 738425 - DNA, 25 bp, Mus musculus
gtttcctaacgctgactatgtgata

SEQ ID NO: 738426 - DNA, 25 bp, Mus musculus
gtttcctaactcatcttatccttat

SEQ ID NO: 738427 - DNA, 25 bp, Mus musculus
gtttcctaactcttcttatccttat

SEQ ID NO: 738428 - DNA, 25 bp, Mus musculus
gtttcctaagaacttggctaagcca

SEQ ID NO: 738429 - DNA, 25 bp, Mus musculus
gtttcctaagaagttggctaagcca

SEQ ID NO: 738430 - DNA, 25 bp, Mus musculus
gtttcctaataaaatcatagctctg

SEQ ID NO: 738431 - DNA, 25 bp, Mus musculus
gtttcctaataatatcatagctctg

SEQ ID NO: 738432 - DNA, 25 bp, Mus musculus
gtttcctacaacagtgagatgatct

SEQ ID NO: 738433 - DNA, 25 bp, Mus musculus
gtttcctacaactgtgagatgatct

SEQ ID NO: 738434 - DNA, 25 bp, Mus musculus
gtttcctagcagcattctctggtgg

SEQ ID NO: 738435 - DNA, 25 bp, Mus musculus
gtttcctagcaggattctctggtgg

SEQ ID NO: 738436 - DNA, 25 bp, Mus musculus
gtttcctagcggaacctggacacca

SEQ ID NO: 738437 - DNA, 25 bp, Mus musculus
gtttcctagcggtacctggacacca

SEQ ID NO: 738438 - DNA, 25 bp, Mus musculus
gtttcctaggaaacttcatctacaa

SEQ ID NO: 738439 - DNA, 25 bp, Mus musculus
gtttcctaggaatcttcatctacaa

SEQ ID NO: 738440 - DNA, 25 bp, Mus musculus
gtttcctaggatccgcatttgggtg

SEQ ID NO: 738441 - DNA, 25 bp, Mus musculus
gtttcctaggatgcgcatttgggtg

SEQ ID NO: 738442 - DNA, 25 bp, Mus musculus
gtttcctaggtccaggctgaacagt

SEQ ID NO: 738443 - DNA, 25 bp, Mus musculus
gtttcctaggtcgaggctgaacagt

SEQ ID NO: 738444 - DNA, 25 bp, Mus musculus
gtttcctagtctaatacacgtgtgg

SEQ ID NO: 738445 - DNA, 25 bp, Mus musculus
gtttcctagtcttatacacgtgtgg

SEQ ID NO: 738446 - DNA, 25 bp, Mus musculus
gtttcctagtgtcatctgtcttgtt

SEQ ID NO: 738447 - DNA, 25 bp, Mus musculus
gtttcctagtgtgatctgtcttgtt

SEQ ID NO: 738448 - DNA, 25 bp, Mus musculus
gtttcctagttcattctgacaccat

SEQ ID NO: 738449 - DNA, 25 bp, Mus musculus
gtttcctagttctttctgacaccat

SEQ ID NO: 738450 - DNA, 25 bp, Mus musculus
gtttcctatcttcaggtttaatatg

SEQ ID NO: 738451 - DNA, 25 bp, Mus musculus
gtttcctatcttgaggtttaatatg

SEQ ID NO: 738452 - DNA, 25 bp, Mus musculus
gtttcctattcaactggtgtcattc

SEQ ID NO: 738453 - DNA, 25 bp, Mus musculus
gtttcctattcatctggtgtcattc

SEQ ID NO: 738454 - DNA, 25 bp, Mus musculus
gtttcctattcgagataattaatgt

SEQ ID NO: 738455 - DNA, 25 bp, Mus musculus
gtttcctattcgtgataattaatgt

SEQ ID NO: 738456 - DNA, 25 bp, Mus musculus
gtttcctatttaagtgaccctgttc

SEQ ID NO: 738457 - DNA, 25 bp, Mus musculus
gtttcctatttacactgagtttttg

SEQ ID NO: 738458 - DNA, 25 bp, Mus musculus
gtttcctatttagactgagtttttg

SEQ ID NO: 738459 - DNA, 25 bp, Mus musculus
gtttcctatttatgtgaccctgttc

SEQ ID NO: 738460 - DNA, 25 bp, Mus musculus
gtttcctattttcttgcatcgtaca

SEQ ID NO: 738461 - DNA, 25 bp, Mus musculus
gtttcctattttgttgcatcgtaca

SEQ ID NO: 738462 - DNA, 25 bp, Mus musculus
gtttcctcaatcatagttgctgtcc

SEQ ID NO: 738463 - DNA, 25 bp, Mus musculus
gtttcctcaatcttagttgctgtcc

SEQ ID NO: 738464 - DNA, 25 bp, Mus musculus
gtttcctcacacctaactcaatatg

SEQ ID NO: 738465 - DNA, 25 bp, Mus musculus
gtttcctcacacgtaactcaatatg

SEQ ID NO: 738466 - DNA, 25 bp, Mus musculus
gtttcctcacctccttagatgtata

SEQ ID NO: 738467 - DNA, 25 bp, Mus musculus
gtttcctcacctgcttagatgtata

SEQ ID NO: 738468 - DNA, 25 bp, Mus musculus
gtttcctcactgatagttacgcatt

SEQ ID NO: 738469 - DNA, 25 bp, Mus musculus
gtttcctcactgttagttacgcatt

SEQ ID NO: 738470 - DNA, 25 bp, Mus musculus
gtttcctcagatatagtgcagctac

SEQ ID NO: 738471 - DNA, 25 bp, Mus musculus
gtttcctcagatttagtgcagctac

SEQ ID NO: 738472 - DNA, 25 bp, Mus musculus
gtttcctcagctctattttcatatg

SEQ ID NO: 738473 - DNA, 25 bp, Mus musculus
gtttcctcagctgtattttcatatg

SEQ ID NO: 738474 - DNA, 25 bp, Mus musculus
gtttcctcatcacgtaccgaattga

SEQ ID NO: 738475 - DNA, 25 bp, Mus musculus
gtttcctcatcaggtaccgaattga

SEQ ID NO: 738476 - DNA, 25 bp, Mus musculus
gtttcctcatctcaatttctctaaa

SEQ ID NO: 738477 - DNA, 25 bp, Mus musculus
gtttcctcatctgaatttctctaaa

SEQ ID NO: 738478 - DNA, 25 bp, Mus musculus
gtttcctcatggaggttttgtatcc

SEQ ID NO: 738479 - DNA, 25 bp, Mus musculus
gtttcctcatggtggttttgtatcc

SEQ ID NO: 738480 - DNA, 25 bp, Mus musculus
gtttcctccaaaagtccagtattca

SEQ ID NO: 738481 - DNA, 25 bp, Mus musculus
gtttcctccaaacagttcttcagac

SEQ ID NO: 738482 - DNA, 25 bp, Mus musculus
gtttcctccaaagagttcttcagac

SEQ ID NO: 738483 - DNA, 25 bp, Mus musculus
gtttcctccaaatgtccagtattca

SEQ ID NO: 738484 - DNA, 25 bp, Mus musculus
gtttcctccaagaactcactggagt

SEQ ID NO: 738485 - DNA, 25 bp, Mus musculus
gtttcctccaagtactcactggagt

SEQ ID NO: 738486 - DNA, 25 bp, Mus musculus
gtttcctccactctatactgtcaca

SEQ ID NO: 738487 - DNA, 25 bp, Mus musculus
gtttcctccactgtatactgtcaca

SEQ ID NO: 738488 - DNA, 25 bp, Mus musculus
gtttcctccagaacattgcagtaga

SEQ ID NO: 738489 - DNA, 25 bp, Mus musculus
gtttcctccagatcattgcagtaga

SEQ ID NO: 738490 - DNA, 25 bp, Mus musculus
gtttcctccgaacctctcgcgagag

SEQ ID NO: 738491 - DNA, 25 bp, Mus musculus
gtttcctccgaagctctcgcgagag

SEQ ID NO: 738492 - DNA, 25 bp, Mus musculus
gtttcctcctataatctgagcacct

SEQ ID NO: 738493 - DNA, 25 bp, Mus musculus
gtttcctcctattatctgagcacct

SEQ ID NO: 738494 - DNA, 25 bp, Mus musculus
gtttcctcctgaatgcagagactgt

SEQ ID NO: 738495 - DNA, 25 bp, Mus musculus
gtttcctcctgattgcagagactgt

SEQ ID NO: 738496 - DNA, 25 bp, Mus musculus
gtttcctcctgccattaacgagtta

SEQ ID NO: 738497 - DNA, 25 bp, Mus musculus
gtttcctcctgcgattaacgagtta

SEQ ID NO: 738498 - DNA, 25 bp, Mus musculus
gtttcctcgaagacctgataatcag

SEQ ID NO: 738499 - DNA, 25 bp, Mus musculus
gtttcctcgaagtcctgataatcag

SEQ ID NO: 738500 - DNA, 25 bp, Mus musculus
gtttcctcgaccaacatatttctgt

SEQ ID NO: 738501 - DNA, 25 bp, Mus musculus
gtttcctcgacctacatatttctgt

SEQ ID NO: 738502 - DNA, 25 bp, Mus musculus
gtttcctcggaaaatgctgtacctt

SEQ ID NO: 738503 - DNA, 25 bp, Mus musculus
gtttcctcggaatatgctgtacctt

SEQ ID NO: 738504 - DNA, 25 bp, Mus musculus
gtttcctcgtaaacaggtcgcactt

SEQ ID NO: 738505 - DNA, 25 bp, Mus musculus
gtttcctcgtaatcaggtcgcactt

SEQ ID NO: 738506 - DNA, 25 bp, Mus musculus
gtttcctcgttgcttcagtattgat

SEQ ID NO: 738507 - DNA, 25 bp, Mus musculus
gtttcctcgttggttcagtattgat

SEQ ID NO: 738508 - DNA, 25 bp, Mus musculus
gtttcctctaaaatcagctttccca

SEQ ID NO: 738509 - DNA, 25 bp, Mus musculus
gtttcctctaaattcagctttccca

SEQ ID NO: 738510 - DNA, 25 bp, Mus musculus
gtttcctctatgaagctaagctgct

SEQ ID NO: 738511 - DNA, 25 bp, Mus musculus
gtttcctctatgtagctaagctgct

SEQ ID NO: 738512 - DNA, 25 bp, Mus musculus
gtttcctctcctagcatttatttaa

SEQ ID NO: 738513 - DNA, 25 bp, Mus musculus
gtttcctctccttgcatttatttaa

SEQ ID NO: 738514 - DNA, 25 bp, Mus musculus
gtttcctctctaacagagtatgtac

SEQ ID NO: 738515 - DNA, 25 bp, Mus musculus
gtttcctctctatcagagtatgtac

SEQ ID NO: 738516 - DNA, 25 bp, Mus musculus
gtttcctctgaaccggctgagtgat

SEQ ID NO: 738517 - DNA, 25 bp, Mus musculus
gtttcctctgaagcggctgagtgat

SEQ ID NO: 738518 - DNA, 25 bp, Mus musculus
gtttcctctgctctaagagtgacag

SEQ ID NO: 738519 - DNA, 25 bp, Mus musculus
gtttcctctgctgtaagagtgacag

SEQ ID NO: 738520 - DNA, 25 bp, Mus musculus
gtttcctctggtactgtcatatatg

SEQ ID NO: 738521 - DNA, 25 bp, Mus musculus
gtttcctctggttctgtcatatatg

SEQ ID NO: 738522 - DNA, 25 bp, Mus musculus
gtttcctctgtgacaggcttttcaa

SEQ ID NO: 738523 - DNA, 25 bp, Mus musculus
gtttcctctgtgtcaggcttttcaa

SEQ ID NO: 738524 - DNA, 25 bp, Mus musculus
gtttcctcttctaggtctgatctgg

SEQ ID NO: 738525 - DNA, 25 bp, Mus musculus
gtttcctcttcttggtctgatctgg

SEQ ID NO: 738526 - DNA, 25 bp, Mus musculus
gtttcctctttacttgagcaccact

SEQ ID NO: 738527 - DNA, 25 bp, Mus musculus
gtttcctctttagttgagcaccact

SEQ ID NO: 738528 - DNA, 25 bp, Mus musculus
gtttcctgaaagattacattgcagt

SEQ ID NO: 738529 - DNA, 25 bp, Mus musculus
gtttcctgaaagtttacattgcagt

SEQ ID NO: 738530 - DNA, 25 bp, Mus musculus
gtttcctgaacgagcgcctgggcca

SEQ ID NO: 738531 - DNA, 25 bp, Mus musculus
gtttcctgaacgtgcgcctgggcca

SEQ ID NO: 738532 - DNA, 25 bp, Mus musculus
gtttcctgaaggcttacacacttgc

SEQ ID NO: 738533 - DNA, 25 bp, Mus musculus
gtttcctgaagggttacacacttgc

SEQ ID NO: 738534 - DNA, 25 bp, Mus musculus
gtttcctgaattcaccatggttgca

SEQ ID NO: 738535 - DNA, 25 bp, Mus musculus
gtttcctgaattgaccatggttgca

SEQ ID NO: 738536 - DNA, 25 bp, Mus musculus
gtttcctgacaaagactgggctcac

SEQ ID NO: 738537 - DNA, 25 bp, Mus musculus
gtttcctgacaatgactgggctcac

SEQ ID NO: 738538 - DNA, 25 bp, Mus musculus
gtttcctgactcctgatgaggcaca

SEQ ID NO: 738539 - DNA, 25 bp, Mus musculus
gtttcctgactcgtgatgaggcaca

SEQ ID NO: 738540 - DNA, 25 bp, Mus musculus
gtttcctgagacctgtcagtgtgtg

SEQ ID NO: 738541 - DNA, 25 bp, Mus musculus
gtttcctgagacgtgtcagtgtgtg

SEQ ID NO: 738542 - DNA, 25 bp, Mus musculus
gtttcctgagcaaattgtcaatcac

SEQ ID NO: 738543 - DNA, 25 bp, Mus musculus
gtttcctgagcatattgtcaatcac

SEQ ID NO: 738544 - DNA, 25 bp, Mus musculus
gtttcctgagccatataagacttaa

SEQ ID NO: 738545 - DNA, 25 bp, Mus musculus
gtttcctgagccttataagacttaa

SEQ ID NO: 738546 - DNA, 25 bp, Mus musculus
gtttcctgaggacaaaggtcgctct

SEQ ID NO: 738547 - DNA, 25 bp, Mus musculus
gtttcctgaggagaaaggtcgctct

SEQ ID NO: 738548 - DNA, 25 bp, Mus musculus
gtttcctgccaaagctaagcagaca

SEQ ID NO: 738549 - DNA, 25 bp, Mus musculus
gtttcctgccaaataccatgtgttg

SEQ ID NO: 738550 - DNA, 25 bp, Mus musculus
gtttcctgccaatgctaagcagaca

SEQ ID NO: 738551 - DNA, 25 bp, Mus musculus
gtttcctgccaattaccatgtgttg

SEQ ID NO: 738552 - DNA, 25 bp, Mus musculus
gtttcctgcctacagcaagatcgga

SEQ ID NO: 738553 - DNA, 25 bp, Mus musculus
gtttcctgcctagagcaagatcgga

SEQ ID NO: 738554 - DNA, 25 bp, Mus musculus
gtttcctgcgctacaaactgaagat

SEQ ID NO: 738555 - DNA, 25 bp, Mus musculus
gtttcctgcgcttcaaactgaagat

SEQ ID NO: 738556 - DNA, 25 bp, Mus musculus
gtttcctggacaattgactacttag

SEQ ID NO: 738557 - DNA, 25 bp, Mus musculus
gtttcctggacatttgactacttag

SEQ ID NO: 738558 - DNA, 25 bp, Mus musculus
gtttcctggagcacggtatttattc

SEQ ID NO: 738559 - DNA, 25 bp, Mus musculus
gtttcctggagctcggtatttattc

SEQ ID NO: 738560 - DNA, 25 bp, Mus musculus
gtttcctggcatcctctagggaata

SEQ ID NO: 738561 - DNA, 25 bp, Mus musculus
gtttcctggcatgctctagggaata

SEQ ID NO: 738562 - DNA, 25 bp, Mus musculus
gtttcctggccccatgagaaagttg

SEQ ID NO: 738563 - DNA, 25 bp, Mus musculus
gtttcctggcccgatgagaaagttg

SEQ ID NO: 738564 - DNA, 25 bp, Mus musculus
gtttcctgggatcactggcttagta

SEQ ID NO: 738565 - DNA, 25 bp, Mus musculus
gtttcctgggatgactggcttagta

SEQ ID NO: 738566 - DNA, 25 bp, Mus musculus
gtttcctgggctacttagaggccaa

SEQ ID NO: 738567 - DNA, 25 bp, Mus musculus
gtttcctgggcttcttagaggccaa

SEQ ID NO: 738568 - DNA, 25 bp, Mus musculus
gtttcctggtaaaaatctcaagtgt

SEQ ID NO: 738569 - DNA, 25 bp, Mus musculus
gtttcctggtaataatctcaagtgt

SEQ ID NO: 738570 - DNA, 25 bp, Mus musculus
gtttcctggtacagaccatattgat

SEQ ID NO: 738571 - DNA, 25 bp, Mus musculus
gtttcctggtactgaccatattgat

SEQ ID NO: 738572 - DNA, 25 bp, Mus musculus
gtttcctgtaacaagcattgttcca

SEQ ID NO: 738573 - DNA, 25 bp, Mus musculus
gtttcctgtaactagcattgttcca

SEQ ID NO: 738574 - DNA, 25 bp, Mus musculus
gtttcctgtaataagctctggtctg

SEQ ID NO: 738575 - DNA, 25 bp, Mus musculus
gtttcctgtaattagctctggtctg

SEQ ID NO: 738576 - DNA, 25 bp, Mus musculus
gtttcctgtacccaaacatgtgtta

SEQ ID NO: 738577 - DNA, 25 bp, Mus musculus
gtttcctgtaccgaaacatgtgtta

SEQ ID NO: 738578 - DNA, 25 bp, Mus musculus
gtttcctgtcctatgggatattaca

SEQ ID NO: 738579 - DNA, 25 bp, Mus musculus
gtttcctgtcctttgggatattaca

SEQ ID NO: 738580 - DNA, 25 bp, Mus musculus
gtttcctgtctacctgtgtgttctc

SEQ ID NO: 738581 - DNA, 25 bp, Mus musculus
gtttcctgtctagctgtgtgttctc

SEQ ID NO: 738582 - DNA, 25 bp, Mus musculus
gtttcctgtctcaggaaagtcagca

SEQ ID NO: 738583 - DNA, 25 bp, Mus musculus
gtttcctgtctctggaaagtcagca

SEQ ID NO: 738584 - DNA, 25 bp, Mus musculus
gtttcctgtctgacctagcatgctc

SEQ ID NO: 738585 - DNA, 25 bp, Mus musculus
gtttcctgtctgtcctagcatgctc

SEQ ID NO: 738586 - DNA, 25 bp, Mus musculus
gtttcctgtggaaacactcttccaa

SEQ ID NO: 738587 - DNA, 25 bp, Mus musculus
gtttcctgtggatacactcttccaa

SEQ ID NO: 738588 - DNA, 25 bp, Mus musculus
gtttcctgtggcagcaatgggagct

SEQ ID NO: 738589 - DNA, 25 bp, Mus musculus
gtttcctgtggctgcaatgggagct

SEQ ID NO: 738590 - DNA, 25 bp, Mus musculus
gtttcctgtgttaaggactgtggta

SEQ ID NO: 738591 - DNA, 25 bp, Mus musculus
gtttcctgtgtttaggactgtggta

SEQ ID NO: 738592 - DNA, 25 bp, Mus musculus
gtttcctgttagagaaagttcccag

SEQ ID NO: 738593 - DNA, 25 bp, Mus musculus
gtttcctgttagtgaaagttcccag

SEQ ID NO: 738594 - DNA, 25 bp, Mus musculus
gtttccttaaagaggatacaggtgt

SEQ ID NO: 738595 - DNA, 25 bp, Mus musculus
gtttccttaaagtggatacaggtgt

SEQ ID NO: 738596 - DNA, 25 bp, Mus musculus
gtttccttaaatatctgcgcgttat

SEQ ID NO: 738597 - DNA, 25 bp, Mus musculus
gtttccttaaatttctgcgcgttat

SEQ ID NO: 738598 - DNA, 25 bp, Mus musculus
gtttccttaatcatacacagtttgt

SEQ ID NO: 738599 - DNA, 25 bp, Mus musculus
gtttccttaatcttacacagtttgt

SEQ ID NO: 738600 - DNA, 25 bp, Mus musculus
gtttccttacatctttgctgtctct

SEQ ID NO: 738601 - DNA, 25 bp, Mus musculus
gtttccttacatgtttgctgtctct

SEQ ID NO: 738602 - DNA, 25 bp, Mus musculus
gtttccttaccaattgcacctgaaa

SEQ ID NO: 738603 - DNA, 25 bp, Mus musculus
gtttccttaccatttgcacctgaaa

SEQ ID NO: 738604 - DNA, 25 bp, Mus musculus
gtttccttactcctttgaagggctg

SEQ ID NO: 738605 - DNA, 25 bp, Mus musculus
gtttccttactcgtttgaagggctg

SEQ ID NO: 738606 - DNA, 25 bp, Mus musculus
gtttccttactgaggagaccattta

SEQ ID NO: 738607 - DNA, 25 bp, Mus musculus
gtttccttactgtggagaccattta

SEQ ID NO: 738608 - DNA, 25 bp, Mus musculus
gtttccttacttctgggataacagg

SEQ ID NO: 738609 - DNA, 25 bp, Mus musculus
gtttccttacttgtgggataacagg

SEQ ID NO: 738610 - DNA, 25 bp, Mus musculus
gtttccttagctacaaaagagtggc

SEQ ID NO: 738611 - DNA, 25 bp, Mus musculus
gtttccttagcttcaaaagagtggc

SEQ ID NO: 738612 - DNA, 25 bp, Mus musculus
gtttccttaggaagagctctgttga

SEQ ID NO: 738613 - DNA, 25 bp, Mus musculus
gtttccttaggatgagctctgttga

SEQ ID NO: 738614 - DNA, 25 bp, Mus musculus
gtttccttagtgctgagatgggtat

SEQ ID NO: 738615 - DNA, 25 bp, Mus musculus
gtttccttagtggtgagatgggtat

SEQ ID NO: 738616 - DNA, 25 bp, Mus musculus
gtttccttcaacagtatttattgct

SEQ ID NO: 738617 - DNA, 25 bp, Mus musculus
gtttccttcaactgtatttattgct

SEQ ID NO: 738618 - DNA, 25 bp, Mus musculus
gtttccttcaccagggatgtgaacg

SEQ ID NO: 738619 - DNA, 25 bp, Mus musculus
gtttccttcacctgggatgtgaacg

SEQ ID NO: 738620 - DNA, 25 bp, Mus musculus
gtttccttcagactcagtcactgct

SEQ ID NO: 738621 - DNA, 25 bp, Mus musculus
gtttccttcagagtcagtcactgct

SEQ ID NO: 738622 - DNA, 25 bp, Mus musculus
gtttccttccaaactggcggcccat

SEQ ID NO: 738623 - DNA, 25 bp, Mus musculus
gtttccttccaatctggcggcccat

SEQ ID NO: 738624 - DNA, 25 bp, Mus musculus
gtttccttccagaagggactataga

SEQ ID NO: 738625 - DNA, 25 bp, Mus musculus
gtttccttccagtagggactataga

SEQ ID NO: 738626 - DNA, 25 bp, Mus musculus
gtttccttccatcatagttgactaa

SEQ ID NO: 738627 - DNA, 25 bp, Mus musculus
gtttccttccatgatagttgactaa

SEQ ID NO: 738628 - DNA, 25 bp, Mus musculus
gtttccttcccaaaaggctgtatgt

SEQ ID NO: 738629 - DNA, 25 bp, Mus musculus
gtttccttcccataaggctgtatgt

SEQ ID NO: 738630 - DNA, 25 bp, Mus musculus
gtttccttccctcaatacttacaat

SEQ ID NO: 738631 - DNA, 25 bp, Mus musculus
gtttccttccctgaatacttacaat

SEQ ID NO: 738632 - DNA, 25 bp, Mus musculus
gtttccttctagcttggattgttgt

SEQ ID NO: 738633 - DNA, 25 bp, Mus musculus
gtttccttctaggttggattgttgt

SEQ ID NO: 738634 - DNA, 25 bp, Mus musculus
gtttccttctggacctatgtacaca

SEQ ID NO: 738635 - DNA, 25 bp, Mus musculus
gtttccttctggtcctatgtacaca

SEQ ID NO: 738636 - DNA, 25 bp, Mus musculus
gtttccttctgtagtatttctaatt

SEQ ID NO: 738637 - DNA, 25 bp, Mus musculus
gtttccttctgttgtatttctaatt

SEQ ID NO: 738638 - DNA, 25 bp, Mus musculus
gtttccttctttactgtgtcagaca

SEQ ID NO: 738639 - DNA, 25 bp, Mus musculus
gtttccttcttttctgtgtcagaca

SEQ ID NO: 738640 - DNA, 25 bp, Mus musculus
gtttccttgcagactgtgacacttg

SEQ ID NO: 738641 - DNA, 25 bp, Mus musculus
gtttccttgcagtctgtgacacttg

SEQ ID NO: 738642 - DNA, 25 bp, Mus musculus
gtttccttggctataagttagttga

SEQ ID NO: 738643 - DNA, 25 bp, Mus musculus
gtttccttggctttaagttagttga

SEQ ID NO: 738644 - DNA, 25 bp, Mus musculus
gtttccttggtgcagtgtgagtttt

SEQ ID NO: 738645 - DNA, 25 bp, Mus musculus
gtttccttggtggagtgtgagtttt

SEQ ID NO: 738646 - DNA, 25 bp, Mus musculus
gtttccttgtgacttaacacgtgaa

SEQ ID NO: 738647 - DNA, 25 bp, Mus musculus
gtttccttgtgagttaacacgtgaa

SEQ ID NO: 738648 - DNA, 25 bp, Mus musculus
gtttccttgtgtatgacttgagcca

SEQ ID NO: 738649 - DNA, 25 bp, Mus musculus
gtttccttgtgtcggtgtactcaca

SEQ ID NO: 738650 - DNA, 25 bp, Mus musculus
gtttccttgtgtgggtgtactcaca

SEQ ID NO: 738651 - DNA, 25 bp, Mus musculus
gtttccttgtgtttgacttgagcca

SEQ ID NO: 738652 - DNA, 25 bp, Mus musculus
gtttcctttagacaatccaagagaa

SEQ ID NO: 738653 - DNA, 25 bp, Mus musculus
gtttcctttagagaatccaagagaa

SEQ ID NO: 738654 - DNA, 25 bp, Mus musculus
gtttcctttcatctagtacctggac

SEQ ID NO: 738655 - DNA, 25 bp, Mus musculus
gtttcctttcatgtagtacctggac

SEQ ID NO: 738656 - DNA, 25 bp, Mus musculus
gtttcctttctaaccagtccctagt

SEQ ID NO: 738657 - DNA, 25 bp, Mus musculus
gtttcctttctatccagtccctagt

SEQ ID NO: 738658 - DNA, 25 bp, Mus musculus
gtttcctttctgaatttcaaagata

SEQ ID NO: 738659 - DNA, 25 bp, Mus musculus
gtttcctttctgtatttcaaagata

SEQ ID NO: 738660 - DNA, 25 bp, Mus musculus
gtttcctttggccatgtctttaagt

SEQ ID NO: 738661 - DNA, 25 bp, Mus musculus
gtttcctttggcgatgtctttaagt

SEQ ID NO: 738662 - DNA, 25 bp, Mus musculus
gtttcctttggtctcaactgtgtct

SEQ ID NO: 738663 - DNA, 25 bp, Mus musculus
gtttcctttggtgtcaactgtgtct

SEQ ID NO: 738664 - DNA, 25 bp, Mus musculus
gtttcgaaacatcacatctcttcct

SEQ ID NO: 738665 - DNA, 25 bp, Mus musculus
gtttcgaaacatgacatctcttcct

SEQ ID NO: 738666 - DNA, 25 bp, Mus musculus
gtttcgaagaccatcttggagtagt

SEQ ID NO: 738667 - DNA, 25 bp, Mus musculus
gtttcgaagaccttcttggagtagt

SEQ ID NO: 738668 - DNA, 25 bp, Mus musculus
gtttcgaagcgacaccatcacagag

SEQ ID NO: 738669 - DNA, 25 bp, Mus musculus
gtttcgaagcgagaccatcacagag

SEQ ID NO: 738670 - DNA, 25 bp, Mus musculus
gtttcgaccataaacaaggccccag

SEQ ID NO: 738671 - DNA, 25 bp, Mus musculus
gtttcgaccatatacaaggccccag

SEQ ID NO: 738672 - DNA, 25 bp, Mus musculus
gtttcgagaagaacgaggccatcca

SEQ ID NO: 738673 - DNA, 25 bp, Mus musculus
gtttcgagaagatcgaggccatcca

SEQ ID NO: 738674 - DNA, 25 bp, Mus musculus
gtttcgagcccaacagccagatggt

SEQ ID NO: 738675 - DNA, 25 bp, Mus musculus
gtttcgagcccatcagccagatggt

SEQ ID NO: 738676 - DNA, 25 bp, Mus musculus
gtttcgaggcgtataacatgtagtt

SEQ ID NO: 738677 - DNA, 25 bp, Mus musculus
gtttcgaggcgtttaacatgtagtt

SEQ ID NO: 738678 - DNA, 25 bp, Mus musculus
gtttcgagggtgaccatgacctagt

SEQ ID NO: 738679 - DNA, 25 bp, Mus musculus
gtttcgagggtgtccatgacctagt

SEQ ID NO: 738680 - DNA, 25 bp, Mus musculus
gtttcgaggtcaacatcagcgagct

SEQ ID NO: 738681 - DNA, 25 bp, Mus musculus
gtttcgaggtcatcatcagcgagct

SEQ ID NO: 738682 - DNA, 25 bp, Mus musculus
gtttcgagtctcatctcaaggtgac

SEQ ID NO: 738683 - DNA, 25 bp, Mus musculus
gtttcgagtctcttctcaaggtgac

SEQ ID NO: 738684 - DNA, 25 bp, Mus musculus
gtttcgatagtaattccagccaggc

SEQ ID NO: 738685 - DNA, 25 bp, Mus musculus
gtttcgatagtatttccagccaggc

SEQ ID NO: 738686 - DNA, 25 bp, Mus musculus
gtttcgatgatgcaatacacacgta

SEQ ID NO: 738687 - DNA, 25 bp, Mus musculus
gtttcgatgatggaatacacacgta

SEQ ID NO: 738688 - DNA, 25 bp, Mus musculus
gtttcgatgcctcaagataggccct

SEQ ID NO: 738689 - DNA, 25 bp, Mus musculus
gtttcgatgcctgaagataggccct

SEQ ID NO: 738690 - DNA, 25 bp, Mus musculus
gtttcgatgtataggcccggctggc

SEQ ID NO: 738691 - DNA, 25 bp, Mus musculus
gtttcgatgtattggcccggctggc

SEQ ID NO: 738692 - DNA, 25 bp, Mus musculus
gtttcgcaagtcatcctggtttgaa

SEQ ID NO: 738693 - DNA, 25 bp, Mus musculus
gtttcgcaagtcttcctggtttgaa

SEQ ID NO: 738694 - DNA, 25 bp, Mus musculus
gtttcgccaggacctttgtaggact

SEQ ID NO: 738695 - DNA, 25 bp, Mus musculus
gtttcgccaggagctttgtaggact

SEQ ID NO: 738696 - DNA, 25 bp, Mus musculus
gtttcgcgtttgagtttcagtatca

SEQ ID NO: 738697 - DNA, 25 bp, Mus musculus
gtttcgcgtttgtgtttcagtatca

SEQ ID NO: 738698 - DNA, 25 bp, Mus musculus
gtttcgctatgccaagatgccagat

SEQ ID NO: 738699 - DNA, 25 bp, Mus musculus
gtttcgctatgcgaagatgccagat

SEQ ID NO: 738700 - DNA, 25 bp, Mus musculus
gtttcgctcttcattacagtcatgg

SEQ ID NO: 738701 - DNA, 25 bp, Mus musculus
gtttcgctcttctttacagtcatgg

SEQ ID NO: 738702 - DNA, 25 bp, Mus musculus
gtttcgctgatgatggttattaaag

SEQ ID NO: 738703 - DNA, 25 bp, Mus musculus
gtttcgctgatgttggttattaaag

SEQ ID NO: 738704 - DNA, 25 bp, Mus musculus
gtttcgcttctcataagcagtttca

SEQ ID NO: 738705 - DNA, 25 bp, Mus musculus
gtttcgcttctcttaagcagtttca

SEQ ID NO: 738706 - DNA, 25 bp, Mus musculus
gtttcggaaagtcaatgtgcctgtt

SEQ ID NO: 738707 - DNA, 25 bp, Mus musculus
gtttcggaaagtgaatgtgcctgtt

SEQ ID NO: 738708 - DNA, 25 bp, Mus musculus
gtttcggcaacgaaaaaacaagcag

SEQ ID NO: 738709 - DNA, 25 bp, Mus musculus
gtttcggcaacgtaaaaacaagcag

SEQ ID NO: 738710 - DNA, 25 bp, Mus musculus
gtttcggcaccaattcttgcatgcg

SEQ ID NO: 738711 - DNA, 25 bp, Mus musculus
gtttcggcaccatttcttgcatgcg

SEQ ID NO: 738712 - DNA, 25 bp, Mus musculus
gtttcggctaatcactcaggactac

SEQ ID NO: 738713 - DNA, 25 bp, Mus musculus
gtttcggctaatgactcaggactac

SEQ ID NO: 738714 - DNA, 25 bp, Mus musculus
gtttcgggaaatctgttactcttat

SEQ ID NO: 738715 - DNA, 25 bp, Mus musculus
gtttcgggaaatgtgttactcttat

SEQ ID NO: 738716 - DNA, 25 bp, Mus musculus
gtttcggtaggaagcaagcgtctct

SEQ ID NO: 738717 - DNA, 25 bp, Mus musculus
gtttcggtaggatgcaagcgtctct

SEQ ID NO: 738718 - DNA, 25 bp, Mus musculus
gtttcggttatgactcttttcagtt

SEQ ID NO: 738719 - DNA, 25 bp, Mus musculus
gtttcggttatgtctcttttcagtt

SEQ ID NO: 738720 - DNA, 25 bp, Mus musculus
gtttcggtttcaaatggatctacac

SEQ ID NO: 738721 - DNA, 25 bp, Mus musculus
gtttcggtttcatatggatctacac

SEQ ID NO: 738722 - DNA, 25 bp, Mus musculus
gtttcgtagtctagtatatgtgcag

SEQ ID NO: 738723 - DNA, 25 bp, Mus musculus
gtttcgtagtcttgtatatgtgcag

SEQ ID NO: 738724 - DNA, 25 bp, Mus musculus
gtttcgtatcgtatgctgatgccaa

SEQ ID NO: 738725 - DNA, 25 bp, Mus musculus
gtttcgtatcgtttgctgatgccaa

SEQ ID NO: 738726 - DNA, 25 bp, Mus musculus
gtttcgtcacttaccgttatgctga

SEQ ID NO: 738727 - DNA, 25 bp, Mus musculus
gtttcgtcactttccgttatgctga

SEQ ID NO: 738728 - DNA, 25 bp, Mus musculus
gtttcgtcatgccagagaactcagg

SEQ ID NO: 738729 - DNA, 25 bp, Mus musculus
gtttcgtcatgcgagagaactcagg

SEQ ID NO: 738730 - DNA, 25 bp, Mus musculus
gtttcgtcgtcgcagtcaagaacaa

SEQ ID NO: 738731 - DNA, 25 bp, Mus musculus
gtttcgtcgtcggagtcaagaacaa

SEQ ID NO: 738732 - DNA, 25 bp, Mus musculus
gtttcgtctatgatttctgtgctat

SEQ ID NO: 738733 - DNA, 25 bp, Mus musculus
gtttcgtctatgttttctgtgctat

SEQ ID NO: 738734 - DNA, 25 bp, Mus musculus
gtttcgtggaggacagtcggttatt

SEQ ID NO: 738735 - DNA, 25 bp, Mus musculus
gtttcgtggaggtcagtcggttatt

SEQ ID NO: 738736 - DNA, 25 bp, Mus musculus
gtttcgtgtcatacgtcatcagtat

SEQ ID NO: 738737 - DNA, 25 bp, Mus musculus
gtttcgtgtcattcgtcatcagtat

SEQ ID NO: 738738 - DNA, 25 bp, Mus musculus
gtttcgttcaccaaattctcatgta

SEQ ID NO: 738739 - DNA, 25 bp, Mus musculus
gtttcgttcacctaattctcatgta

SEQ ID NO: 738740 - DNA, 25 bp, Mus musculus
gtttcgttcctaatgctgtgtacag

SEQ ID NO: 738741 - DNA, 25 bp, Mus musculus
gtttcgttcctattgctgtgtacag

SEQ ID NO: 738742 - DNA, 25 bp, Mus musculus
gtttcgttgaaacctaagtttgcag

SEQ ID NO: 738743 - DNA, 25 bp, Mus musculus
gtttcgttgaaagctaagtttgcag

SEQ ID NO: 738744 - DNA, 25 bp, Mus musculus
gtttcgttgttcatgagactcggta

SEQ ID NO: 738745 - DNA, 25 bp, Mus musculus
gtttcgttgttcttgagactcggta

SEQ ID NO: 738746 - DNA, 25 bp, Mus musculus
gtttcgtttcgcaggagccccgaag

SEQ ID NO: 738747 - DNA, 25 bp, Mus musculus
gtttcgtttcgctggagccccgaag

SEQ ID NO: 738748 - DNA, 25 bp, Mus musculus
gtttctaaaaacatgcagcttcctt

SEQ ID NO: 738749 - DNA, 25 bp, Mus musculus
gtttctaaaaacttgcagcttcctt

SEQ ID NO: 738750 - DNA, 25 bp, Mus musculus
gtttctaaaaatacctgttctctca

SEQ ID NO: 738751 - DNA, 25 bp, Mus musculus
gtttctaaaaattcctgttctctca

SEQ ID NO: 738752 - DNA, 25 bp, Mus musculus
gtttctaaacctagtagcttatgtc

SEQ ID NO: 738753 - DNA, 25 bp, Mus musculus
gtttctaaaccttgtagcttatgtc

SEQ ID NO: 738754 - DNA, 25 bp, Mus musculus
gtttctaaacgaatgcaaattcact

SEQ ID NO: 738755 - DNA, 25 bp, Mus musculus
gtttctaaacgattgcaaattcact

SEQ ID NO: 738756 - DNA, 25 bp, Mus musculus
gtttctaaacttcggccacctgaga

SEQ ID NO: 738757 - DNA, 25 bp, Mus musculus
gtttctaaacttgggccacctgaga

SEQ ID NO: 738758 - DNA, 25 bp, Mus musculus
gtttctaaagaactgccagctgttg

SEQ ID NO: 738759 - DNA, 25 bp, Mus musculus
gtttctaaagaagtgccagctgttg

SEQ ID NO: 738760 - DNA, 25 bp, Mus musculus
gtttctaaagggaggtcagaggcca

SEQ ID NO: 738761 - DNA, 25 bp, Mus musculus
gtttctaaagggtggtcagaggcca

SEQ ID NO: 738762 - DNA, 25 bp, Mus musculus
gtttctaaatgcagagacctaacca

SEQ ID NO: 738763 - DNA, 25 bp, Mus musculus
gtttctaaatgctgagacctaacca

SEQ ID NO: 738764 - DNA, 25 bp, Mus musculus
gtttctaaattacggtctcactctg

SEQ ID NO: 738765 - DNA, 25 bp, Mus musculus
gtttctaaattagggtctcactctg

SEQ ID NO: 738766 - DNA, 25 bp, Mus musculus
gtttctaacactacaaagtctacaa

SEQ ID NO: 738767 - DNA, 25 bp, Mus musculus
gtttctaacacttcaaagtctacaa

SEQ ID NO: 738768 - DNA, 25 bp, Mus musculus
gtttctaacataccagctgaggcct

SEQ ID NO: 738769 - DNA, 25 bp, Mus musculus
gtttctaacatagcagctgaggcct

SEQ ID NO: 738770 - DNA, 25 bp, Mus musculus
gtttctaaccaccatgcagtcatta

SEQ ID NO: 738771 - DNA, 25 bp, Mus musculus
gtttctaaccacgatgcagtcatta

SEQ ID NO: 738772 - DNA, 25 bp, Mus musculus
gtttctaacttactatgtacttcct

SEQ ID NO: 738773 - DNA, 25 bp, Mus musculus
gtttctaacttagtatgtacttcct

SEQ ID NO: 738774 - DNA, 25 bp, Mus musculus
gtttctaactttacagaattgcctg

SEQ ID NO: 738775 - DNA, 25 bp, Mus musculus
gtttctaacttttcagaattgcctg

SEQ ID NO: 738776 - DNA, 25 bp, Mus musculus
gtttctaagaaactgagcatggtat

SEQ ID NO: 738777 - DNA, 25 bp, Mus musculus
gtttctaagaaagtgagcatggtat

SEQ ID NO: 738778 - DNA, 25 bp, Mus musculus
gtttctaagacacagcctcatagcc

SEQ ID NO: 738779 - DNA, 25 bp, Mus musculus
gtttctaagacagagcctcatagcc

SEQ ID NO: 738780 - DNA, 25 bp, Mus musculus
gtttctaagagacccgtcccatttt

SEQ ID NO: 738781 - DNA, 25 bp, Mus musculus
gtttctaagagagccgtcccatttt

SEQ ID NO: 738782 - DNA, 25 bp, Mus musculus
gtttctaagatgctccttttggtct

SEQ ID NO: 738783 - DNA, 25 bp, Mus musculus
gtttctaagatggtccttttggtct

SEQ ID NO: 738784 - DNA, 25 bp, Mus musculus
gtttctaagcaccatttatccattg

SEQ ID NO: 738785 - DNA, 25 bp, Mus musculus
gtttctaagcacgatttatccattg

SEQ ID NO: 738786 - DNA, 25 bp, Mus musculus
gtttctaagggaagtgcctcctgca

SEQ ID NO: 738787 - DNA, 25 bp, Mus musculus
gtttctaagggatgtgcctcctgca

SEQ ID NO: 738788 - DNA, 25 bp, Mus musculus
gtttctaaggttctcagttccatct

SEQ ID NO: 738789 - DNA, 25 bp, Mus musculus
gtttctaaggttgtcagttccatct

SEQ ID NO: 738790 - DNA, 25 bp, Mus musculus
gtttctaagtaactcttttgctcct

SEQ ID NO: 738791 - DNA, 25 bp, Mus musculus
gtttctaagtaagtcttttgctcct

SEQ ID NO: 738792 - DNA, 25 bp, Mus musculus
gtttctaatacccagtttcaaatgc

SEQ ID NO: 738793 - DNA, 25 bp, Mus musculus
gtttctaataccgagtttcaaatgc

SEQ ID NO: 738794 - DNA, 25 bp, Mus musculus
gtttctaatcacaggtattactcaa

SEQ ID NO: 738795 - DNA, 25 bp, Mus musculus
gtttctaatcactggtattactcaa

SEQ ID NO: 738796 - DNA, 25 bp, Mus musculus
gtttctaattcaatccagttcttta

SEQ ID NO: 738797 - DNA, 25 bp, Mus musculus
gtttctaattcattccagttcttta

SEQ ID NO: 738798 - DNA, 25 bp, Mus musculus
gtttctaattcccttttcaggagat

SEQ ID NO: 738799 - DNA, 25 bp, Mus musculus
gtttctaattccgttttcaggagat

SEQ ID NO: 738800 - DNA, 25 bp, Mus musculus
gtttctacaagtcaaggacagtgca

SEQ ID NO: 738801 - DNA, 25 bp, Mus musculus
gtttctacaagtgaaggacagtgca

SEQ ID NO: 738802 - DNA, 25 bp, Mus musculus
gtttctacacacctgttatatatga

SEQ ID NO: 738803 - DNA, 25 bp, Mus musculus
gtttctacacacgtgttatatatga

SEQ ID NO: 738804 - DNA, 25 bp, Mus musculus
gtttctacacatatggagcaggcag

SEQ ID NO: 738805 - DNA, 25 bp, Mus musculus
gtttctacacatttggagcaggcag

SEQ ID NO: 738806 - DNA, 25 bp, Mus musculus
gtttctacaccccagcagtggagaa

SEQ ID NO: 738807 - DNA, 25 bp, Mus musculus
gtttctacacccgagcagtggagaa

SEQ ID NO: 738808 - DNA, 25 bp, Mus musculus
gtttctacagtaaggtgtctctgac

SEQ ID NO: 738809 - DNA, 25 bp, Mus musculus
gtttctacagtatggtgtctctgac

SEQ ID NO: 738810 - DNA, 25 bp, Mus musculus
gtttctacagttcctgattcaggca

SEQ ID NO: 738811 - DNA, 25 bp, Mus musculus
gtttctacagttgctgattcaggca

SEQ ID NO: 738812 - DNA, 25 bp, Mus musculus
gtttctacatcaacttatgcctagg

SEQ ID NO: 738813 - DNA, 25 bp, Mus musculus
gtttctacatcaccagagtccaggt

SEQ ID NO: 738814 - DNA, 25 bp, Mus musculus
gtttctacatcagcagagtccaggt

SEQ ID NO: 738815 - DNA, 25 bp, Mus musculus
gtttctacatcatcttatgcctagg

SEQ ID NO: 738816 - DNA, 25 bp, Mus musculus
gtttctacatctcaccgttggtaat

SEQ ID NO: 738817 - DNA, 25 bp, Mus musculus
gtttctacatctctctcttcattgg

SEQ ID NO: 738818 - DNA, 25 bp, Mus musculus
gtttctacatctgaccgttggtaat

SEQ ID NO: 738819 - DNA, 25 bp, Mus musculus
gtttctacatctgtctcttcattgg

SEQ ID NO: 738820 - DNA, 25 bp, Mus musculus
gtttctacatgaccgcgtgctggat

SEQ ID NO: 738821 - DNA, 25 bp, Mus musculus
gtttctacatgagcgcgtgctggat

SEQ ID NO: 738822 - DNA, 25 bp, Mus musculus
gtttctacccgcagctgatgctgca

SEQ ID NO: 738823 - DNA, 25 bp, Mus musculus
gtttctacccgctgctgatgctgca

SEQ ID NO: 738824 - DNA, 25 bp, Mus musculus
gtttctaccctgaagtccaatggga

SEQ ID NO: 738825 - DNA, 25 bp, Mus musculus
gtttctaccctgtagtccaatggga

SEQ ID NO: 738826 - DNA, 25 bp, Mus musculus
gtttctacctgaaccttaagccagt

SEQ ID NO: 738827 - DNA, 25 bp, Mus musculus
gtttctacctgatccttaagccagt

SEQ ID NO: 738828 - DNA, 25 bp, Mus musculus
gtttctaccttcaggcagacaggca

SEQ ID NO: 738829 - DNA, 25 bp, Mus musculus
gtttctaccttctggcagacaggca

SEQ ID NO: 738830 - DNA, 25 bp, Mus musculus
gtttctactgatccctttgtttttg

SEQ ID NO: 738831 - DNA, 25 bp, Mus musculus
gtttctactgatgcctttgtttttg

SEQ ID NO: 738832 - DNA, 25 bp, Mus musculus
gtttctactgctatgaagagacact

SEQ ID NO: 738833 - DNA, 25 bp, Mus musculus
gtttctactgctttgaagagacact

SEQ ID NO: 738834 - DNA, 25 bp, Mus musculus
gtttctacttagatctctggctgag

SEQ ID NO: 738835 - DNA, 25 bp, Mus musculus
gtttctacttagttctctggctgag

SEQ ID NO: 738836 - DNA, 25 bp, Mus musculus
gtttctactttacatcaatacacgt

SEQ ID NO: 738837 - DNA, 25 bp, Mus musculus
gtttctactttagatcaatacacgt

SEQ ID NO: 738838 - DNA, 25 bp, Mus musculus
gtttctagaagcatgcatttgggcc

SEQ ID NO: 738839 - DNA, 25 bp, Mus musculus
gtttctagaagccatttgcattact

SEQ ID NO: 738840 - DNA, 25 bp, Mus musculus
gtttctagaagcgatttgcattact

SEQ ID NO: 738841 - DNA, 25 bp, Mus musculus
gtttctagaagcttgcatttgggcc

SEQ ID NO: 738842 - DNA, 25 bp, Mus musculus
gtttctagaagtaacaccactgggc

SEQ ID NO: 738843 - DNA, 25 bp, Mus musculus
gtttctagaagttacaccactgggc

SEQ ID NO: 738844 - DNA, 25 bp, Mus musculus
gtttctagacctactttacctcaga

SEQ ID NO: 738845 - DNA, 25 bp, Mus musculus
gtttctagaccttctttacctcaga

SEQ ID NO: 738846 - DNA, 25 bp, Mus musculus
gtttctagagatagtctcccactat

SEQ ID NO: 738847 - DNA, 25 bp, Mus musculus
gtttctagagattgtctcccactat

SEQ ID NO: 738848 - DNA, 25 bp, Mus musculus
gtttctagagtcatgagtgctggat

SEQ ID NO: 738849 - DNA, 25 bp, Mus musculus
gtttctagagtcttgagtgctggat

SEQ ID NO: 738850 - DNA, 25 bp, Mus musculus
gtttctagcacactcagaatagtct

SEQ ID NO: 738851 - DNA, 25 bp, Mus musculus
gtttctagcacagtcagaatagtct

SEQ ID NO: 738852 - DNA, 25 bp, Mus musculus
gtttctagccacaccaggcagatga

SEQ ID NO: 738853 - DNA, 25 bp, Mus musculus
gtttctagccactccaggcagatga

SEQ ID NO: 738854 - DNA, 25 bp, Mus musculus
gtttctagccccatggttatgaacc

SEQ ID NO: 738855 - DNA, 25 bp, Mus musculus
gtttctagccccttggttatgaacc

SEQ ID NO: 738856 - DNA, 25 bp, Mus musculus
gtttctagggacaccagacactgct

SEQ ID NO: 738857 - DNA, 25 bp, Mus musculus
gtttctagggactccagacactgct

SEQ ID NO: 738858 - DNA, 25 bp, Mus musculus
gtttctagtagaccaagtactccca

SEQ ID NO: 738859 - DNA, 25 bp, Mus musculus
gtttctagtagagcaagtactccca

SEQ ID NO: 738860 - DNA, 25 bp, Mus musculus
gtttctagtaggcaaagttgctgta

SEQ ID NO: 738861 - DNA, 25 bp, Mus musculus
gtttctagtagggaaagttgctgta

SEQ ID NO: 738862 - DNA, 25 bp, Mus musculus
gtttctagtctgatcactgaagcca

SEQ ID NO: 738863 - DNA, 25 bp, Mus musculus
gtttctagtctgttcactgaagcca

SEQ ID NO: 738864 - DNA, 25 bp, Mus musculus
gtttctagtgctcctactgttcaaa

SEQ ID NO: 738865 - DNA, 25 bp, Mus musculus
gtttctagtgctgctactgttcaaa

SEQ ID NO: 738866 - DNA, 25 bp, Mus musculus
gtttctagttgaaccttagtgagct

SEQ ID NO: 738867 - DNA, 25 bp, Mus musculus
gtttctagttgatccttagtgagct

SEQ ID NO: 738868 - DNA, 25 bp, Mus musculus
gtttctataaatctccctcactgga

SEQ ID NO: 738869 - DNA, 25 bp, Mus musculus
gtttctataaatgtccctcactgga

SEQ ID NO: 738870 - DNA, 25 bp, Mus musculus
gtttctataatcatgggttggacac

SEQ ID NO: 738871 - DNA, 25 bp, Mus musculus
gtttctataatcttgggttggacac

SEQ ID NO: 738872 - DNA, 25 bp, Mus musculus
gtttctatacatactatgttgtctt

SEQ ID NO: 738873 - DNA, 25 bp, Mus musculus
gtttctatacattctatgttgtctt

SEQ ID NO: 738874 - DNA, 25 bp, Mus musculus
gtttctatagagacacagccgcagt

SEQ ID NO: 738875 - DNA, 25 bp, Mus musculus
gtttctatagagtcacagccgcagt

SEQ ID NO: 738876 - DNA, 25 bp, Mus musculus
gtttctatagcgcacaaagcatgtg

SEQ ID NO: 738877 - DNA, 25 bp, Mus musculus
gtttctatagcggacaaagcatgtg

SEQ ID NO: 738878 - DNA, 25 bp, Mus musculus
gtttctataggtaatgctatcacat

SEQ ID NO: 738879 - DNA, 25 bp, Mus musculus
gtttctataggttatgctatcacat

SEQ ID NO: 738880 - DNA, 25 bp, Mus musculus
gtttctatctgtagtgtacctgact

SEQ ID NO: 738881 - DNA, 25 bp, Mus musculus
gtttctatctgttgtgtacctgact

SEQ ID NO: 738882 - DNA, 25 bp, Mus musculus
gtttctatgactagttgactgttcc

SEQ ID NO: 738883 - DNA, 25 bp, Mus musculus
gtttctatgacttgttgactgttcc

SEQ ID NO: 738884 - DNA, 25 bp, Mus musculus
gtttctatgataaagtcttctcggg

SEQ ID NO: 738885 - DNA, 25 bp, Mus musculus
gtttctatgatatagtcttctcggg

SEQ ID NO: 738886 - DNA, 25 bp, Mus musculus
gtttctatgccaacctatggacaca

SEQ ID NO: 738887 - DNA, 25 bp, Mus musculus
gtttctatgccatcctatggacaca

SEQ ID NO: 738888 - DNA, 25 bp, Mus musculus
gtttctatgctaagggtggaaccca

SEQ ID NO: 738889 - DNA, 25 bp, Mus musculus
gtttctatgctatgggtggaaccca

SEQ ID NO: 738890 - DNA, 25 bp, Mus musculus
gtttctatggatagcctgtttttga

SEQ ID NO: 738891 - DNA, 25 bp, Mus musculus
gtttctatggattgcctgtttttga

SEQ ID NO: 738892 - DNA, 25 bp, Mus musculus
gtttctatggcaaccaggcttcctg

SEQ ID NO: 738893 - DNA, 25 bp, Mus musculus
gtttctatggcatccaggcttcctg

SEQ ID NO: 738894 - DNA, 25 bp, Mus musculus
gtttctatgggcatttggaggtcag

SEQ ID NO: 738895 - DNA, 25 bp, Mus musculus
gtttctatgggcttttggaggtcag

SEQ ID NO: 738896 - DNA, 25 bp, Mus musculus
gtttctatggtgcttctctacaata

SEQ ID NO: 738897 - DNA, 25 bp, Mus musculus
gtttctatggtggttctctacaata

SEQ ID NO: 738898 - DNA, 25 bp, Mus musculus
gtttctatgtagatctctcaggaac

SEQ ID NO: 738899 - DNA, 25 bp, Mus musculus
gtttctatgtagatttgtgtccaat

SEQ ID NO: 738900 - DNA, 25 bp, Mus musculus
gtttctatgtagttctctcaggaac

SEQ ID NO: 738901 - DNA, 25 bp, Mus musculus
gtttctatgtagttttgtgtccaat

SEQ ID NO: 738902 - DNA, 25 bp, Mus musculus
gtttctatgtgtactccaggtgagc

SEQ ID NO: 738903 - DNA, 25 bp, Mus musculus
gtttctatgtgttctccaggtgagc

SEQ ID NO: 738904 - DNA, 25 bp, Mus musculus
gtttctattcaacttggtatcttga

SEQ ID NO: 738905 - DNA, 25 bp, Mus musculus
gtttctattcaagttggtatcttga

SEQ ID NO: 738906 - DNA, 25 bp, Mus musculus
gtttctattctgattttgtgcatca

SEQ ID NO: 738907 - DNA, 25 bp, Mus musculus
gtttctattctgtttttgtgcatca

SEQ ID NO: 738908 - DNA, 25 bp, Mus musculus
gtttctattcttacacaaatcacca

SEQ ID NO: 738909 - DNA, 25 bp, Mus musculus
gtttctattctttcacaaatcacca

SEQ ID NO: 738910 - DNA, 25 bp, Mus musculus
gtttctattgcaagttctccaactg

SEQ ID NO: 738911 - DNA, 25 bp, Mus musculus
gtttctattgcatgttctccaactg

SEQ ID NO: 738912 - DNA, 25 bp, Mus musculus
gtttctatttctaggcagctcacta

SEQ ID NO: 738913 - DNA, 25 bp, Mus musculus
gtttctatttcttggcagctcacta

SEQ ID NO: 738914 - DNA, 25 bp, Mus musculus
gtttctatttgcatactcatttttt

SEQ ID NO: 738915 - DNA, 25 bp, Mus musculus
gtttctatttgcttactcatttttt

SEQ ID NO: 738916 - DNA, 25 bp, Mus musculus
gtttctattttgatctttacttgag

SEQ ID NO: 738917 - DNA, 25 bp, Mus musculus
gtttctattttgttctttacttgag

SEQ ID NO: 738918 - DNA, 25 bp, Mus musculus
gtttctcaaaatattactcagcctt

SEQ ID NO: 738919 - DNA, 25 bp, Mus musculus
gtttctcaaaattttactcagcctt

SEQ ID NO: 738920 - DNA, 25 bp, Mus musculus
gtttctcaaattaccagaccttggg

SEQ ID NO: 738921 - DNA, 25 bp, Mus musculus
gtttctcaaatttccagaccttggg

SEQ ID NO: 738922 - DNA, 25 bp, Mus musculus
gtttctcaacttatgtgtctacttg

SEQ ID NO: 738923 - DNA, 25 bp, Mus musculus
gtttctcaacttctgttttgggtca

SEQ ID NO: 738924 - DNA, 25 bp, Mus musculus
gtttctcaacttgtgttttgggtca

SEQ ID NO: 738925 - DNA, 25 bp, Mus musculus
gtttctcaacttttgtgtctacttg

SEQ ID NO: 738926 - DNA, 25 bp, Mus musculus
gtttctcaagtgagacatgtcgatt

SEQ ID NO: 738927 - DNA, 25 bp, Mus musculus
gtttctcaagtgatcaacctgttca

SEQ ID NO: 738928 - DNA, 25 bp, Mus musculus
gtttctcaagtgtgacatgtcgatt

SEQ ID NO: 738929 - DNA, 25 bp, Mus musculus
gtttctcaagtgttcaacctgttca

SEQ ID NO: 738930 - DNA, 25 bp, Mus musculus
gtttctcaataacaggtacaccaaa

SEQ ID NO: 738931 - DNA, 25 bp, Mus musculus
gtttctcaataagaggtacaccaaa

SEQ ID NO: 738932 - DNA, 25 bp, Mus musculus
gtttctcaatatctggacaccaagt

SEQ ID NO: 738933 - DNA, 25 bp, Mus musculus
gtttctcaatatgtggacaccaagt

SEQ ID NO: 738934 - DNA, 25 bp, Mus musculus
gtttctcaatgtcttttgctttcag

SEQ ID NO: 738935 - DNA, 25 bp, Mus musculus
gtttctcaatgtgttttgctttcag

SEQ ID NO: 738936 - DNA, 25 bp, Mus musculus
gtttctcacggccagctgtggttgt

SEQ ID NO: 738937 - DNA, 25 bp, Mus musculus
gtttctcacggcgagctgtggttgt

SEQ ID NO: 738938 - DNA, 25 bp, Mus musculus
gtttctcacgttcatgtttttgcca

SEQ ID NO: 738939 - DNA, 25 bp, Mus musculus
gtttctcacgttgatgtttttgcca

SEQ ID NO: 738940 - DNA, 25 bp, Mus musculus
gtttctcactggataacacctctac

SEQ ID NO: 738941 - DNA, 25 bp, Mus musculus
gtttctcactggttaacacctctac

SEQ ID NO: 738942 - DNA, 25 bp, Mus musculus
gtttctcactgtcgcatcaggacaa

SEQ ID NO: 738943 - DNA, 25 bp, Mus musculus
gtttctcactgtggcatcaggacaa

SEQ ID NO: 738944 - DNA, 25 bp, Mus musculus
gtttctcagactctgttaactcccc

SEQ ID NO: 738945 - DNA, 25 bp, Mus musculus
gtttctcagactgtgttaactcccc

SEQ ID NO: 738946 - DNA, 25 bp, Mus musculus
gtttctcagagacaggttgcaagtg

SEQ ID NO: 738947 - DNA, 25 bp, Mus musculus
gtttctcagagagaggttgcaagtg

SEQ ID NO: 738948 - DNA, 25 bp, Mus musculus
gtttctcagaggcattttttacagc

SEQ ID NO: 738949 - DNA, 25 bp, Mus musculus
gtttctcagaggctgtctgccttgt

SEQ ID NO: 738950 - DNA, 25 bp, Mus musculus
gtttctcagagggattttttacagc

SEQ ID NO: 738951 - DNA, 25 bp, Mus musculus
gtttctcagagggtgtctgccttgt

SEQ ID NO: 738952 - DNA, 25 bp, Mus musculus
gtttctcagcataaacttatcccat

SEQ ID NO: 738953 - DNA, 25 bp, Mus musculus
gtttctcagcattaacttatcccat

SEQ ID NO: 738954 - DNA, 25 bp, Mus musculus
gtttctcaggccaacgggacctaga

SEQ ID NO: 738955 - DNA, 25 bp, Mus musculus
gtttctcaggcctacgggacctaga

SEQ ID NO: 738956 - DNA, 25 bp, Mus musculus
gtttctcagggacaggcttcgtatt

SEQ ID NO: 738957 - DNA, 25 bp, Mus musculus
gtttctcagggagaggcttcgtatt

SEQ ID NO: 738958 - DNA, 25 bp, Mus musculus
gtttctcaggttatctttgagctgt

SEQ ID NO: 738959 - DNA, 25 bp, Mus musculus
gtttctcaggttttctttgagctgt

SEQ ID NO: 738960 - DNA, 25 bp, Mus musculus
gtttctcagtataagtgatgcccgt

SEQ ID NO: 738961 - DNA, 25 bp, Mus musculus
gtttctcagtattagtgatgcccgt

SEQ ID NO: 738962 - DNA, 25 bp, Mus musculus
gtttctcagtgtatgctggatgctc

SEQ ID NO: 738963 - DNA, 25 bp, Mus musculus
gtttctcagtgtttgctggatgctc

SEQ ID NO: 738964 - DNA, 25 bp, Mus musculus
gtttctcagttaccacatgtgtcca

SEQ ID NO: 738965 - DNA, 25 bp, Mus musculus
gtttctcagttagcacatgtgtcca

SEQ ID NO: 738966 - DNA, 25 bp, Mus musculus
gtttctcatagtcgcttgtgtcagt

SEQ ID NO: 738967 - DNA, 25 bp, Mus musculus
gtttctcatagtggcttgtgtcagt

SEQ ID NO: 738968 - DNA, 25 bp, Mus musculus
gtttctcatatgagtggtgtcatag

SEQ ID NO: 738969 - DNA, 25 bp, Mus musculus
gtttctcatatgtgtggtgtcatag

SEQ ID NO: 738970 - DNA, 25 bp, Mus musculus
gtttctcatctaaagggccctaggg

SEQ ID NO: 738971 - DNA, 25 bp, Mus musculus
gtttctcatctatagggccctaggg

SEQ ID NO: 738972 - DNA, 25 bp, Mus musculus
gtttctcatctgattggtgtccgtc

SEQ ID NO: 738973 - DNA, 25 bp, Mus musculus
gtttctcatctgtttggtgtccgtc

SEQ ID NO: 738974 - DNA, 25 bp, Mus musculus
gtttctcatgagcattcctctctct

SEQ ID NO: 738975 - DNA, 25 bp, Mus musculus
gtttctcatgaggattcctctctct

SEQ ID NO: 738976 - DNA, 25 bp, Mus musculus
gtttctcatgatccggcgccacaag

SEQ ID NO: 738977 - DNA, 25 bp, Mus musculus
gtttctcatgatgcggcgccacaag

SEQ ID NO: 738978 - DNA, 25 bp, Mus musculus
gtttctcatgcaaagaccagtgttt

SEQ ID NO: 738979 - DNA, 25 bp, Mus musculus
gtttctcatgcatagaccagtgttt

SEQ ID NO: 738980 - DNA, 25 bp, Mus musculus
gtttctcatgcccataccactgtac

SEQ ID NO: 738981 - DNA, 25 bp, Mus musculus
gtttctcatgccgataccactgtac

SEQ ID NO: 738982 - DNA, 25 bp, Mus musculus
gtttctcatggcagtgttacatatg

SEQ ID NO: 738983 - DNA, 25 bp, Mus musculus
gtttctcatggctgtgttacatatg

SEQ ID NO: 738984 - DNA, 25 bp, Mus musculus
gtttctcatgttctccgcgtacctc

SEQ ID NO: 738985 - DNA, 25 bp, Mus musculus
gtttctcatgttgtccgcgtacctc

SEQ ID NO: 738986 - DNA, 25 bp, Mus musculus
gtttctcattcacagcagcattgca

SEQ ID NO: 738987 - DNA, 25 bp, Mus musculus
gtttctcattcagagcagcattgca

SEQ ID NO: 738988 - DNA, 25 bp, Mus musculus
gtttctcattctatcacttgggcaa

SEQ ID NO: 738989 - DNA, 25 bp, Mus musculus
gtttctcattctttcacttgggcaa

SEQ ID NO: 738990 - DNA, 25 bp, Mus musculus
gtttctcattgtcaagtcccttaag

SEQ ID NO: 738991 - DNA, 25 bp, Mus musculus
gtttctcattgtgaagtcccttaag

SEQ ID NO: 738992 - DNA, 25 bp, Mus musculus
gtttctccacaaagagttctcttcc

SEQ ID NO: 738993 - DNA, 25 bp, Mus musculus
gtttctccacaatgagttctcttcc

SEQ ID NO: 738994 - DNA, 25 bp, Mus musculus
gtttctccacacaaacttccaaggg

SEQ ID NO: 738995 - DNA, 25 bp, Mus musculus
gtttctccacactaacttccaaggg

SEQ ID NO: 738996 - DNA, 25 bp, Mus musculus
gtttctccagcacagaattctcaac

SEQ ID NO: 738997 - DNA, 25 bp, Mus musculus
gtttctccagcagagaattctcaac

SEQ ID NO: 738998 - DNA, 25 bp, Mus musculus
gtttctccaggcagttagagtgtca

SEQ ID NO: 738999 - DNA, 25 bp, Mus musculus
gtttctccaggctgttagagtgtca

SEQ ID NO: 739000 - DNA, 25 bp, Mus musculus
gtttctccatagattgcctactaca

SEQ ID NO: 739001 - DNA, 25 bp, Mus musculus
gtttctccatagtttgcctactaca

SEQ ID NO: 739002 - DNA, 25 bp, Mus musculus
gtttctccattaaatatgcgccttt

SEQ ID NO: 739003 - DNA, 25 bp, Mus musculus
gtttctccattatatatgcgccttt

SEQ ID NO: 739004 - DNA, 25 bp, Mus musculus
gtttctccatttcattgtgtcccag

SEQ ID NO: 739005 - DNA, 25 bp, Mus musculus
gtttctccatttgattgtgtcccag

SEQ ID NO: 739006 - DNA, 25 bp, Mus musculus
gtttctcccaagatcttagctggat

SEQ ID NO: 739007 - DNA, 25 bp, Mus musculus
gtttctcccaagttcttagctggat

SEQ ID NO: 739008 - DNA, 25 bp, Mus musculus
gtttctcccatactgaggcaggaat

SEQ ID NO: 739009 - DNA, 25 bp, Mus musculus
gtttctcccatagtgaggcaggaat

SEQ ID NO: 739010 - DNA, 25 bp, Mus musculus
gtttctccctcaccaggatttcatt

SEQ ID NO: 739011 - DNA, 25 bp, Mus musculus
gtttctccctcagcaggatttcatt

SEQ ID NO: 739012 - DNA, 25 bp, Mus musculus
gtttctccctgaccagcggtctcat

SEQ ID NO: 739013 - DNA, 25 bp, Mus musculus
gtttctccctgagcagcggtctcat

SEQ ID NO: 739014 - DNA, 25 bp, Mus musculus
gtttctcccttgcagaggtaaccag

SEQ ID NO: 739015 - DNA, 25 bp, Mus musculus
gtttctcccttggagaggtaaccag

SEQ ID NO: 739016 - DNA, 25 bp, Mus musculus
gtttctccctttaatgaagagttct

SEQ ID NO: 739017 - DNA, 25 bp, Mus musculus
gtttctccctttccagagaatgaca

SEQ ID NO: 739018 - DNA, 25 bp, Mus musculus
gtttctccctttgcagagaatgaca

SEQ ID NO: 739019 - DNA, 25 bp, Mus musculus
gtttctcccttttatgaagagttct

SEQ ID NO: 739020 - DNA, 25 bp, Mus musculus
gtttctccgaggcaaagcagccaat

SEQ ID NO: 739021 - DNA, 25 bp, Mus musculus
gtttctccgagggaaagcagccaat

SEQ ID NO: 739022 - DNA, 25 bp, Mus musculus
gtttctccgcacagtattccaaggt

SEQ ID NO: 739023 - DNA, 25 bp, Mus musculus
gtttctccgcactgtattccaaggt

SEQ ID NO: 739024 - DNA, 25 bp, Mus musculus
gtttctccggaacacatgctgtgac

SEQ ID NO: 739025 - DNA, 25 bp, Mus musculus
gtttctccggaagacatgctgtgac

SEQ ID NO: 739026 - DNA, 25 bp, Mus musculus
gtttctcctagtatgctgcagggta

SEQ ID NO: 739027 - DNA, 25 bp, Mus musculus
gtttctcctagtttgctgcagggta

SEQ ID NO: 739028 - DNA, 25 bp, Mus musculus
gtttctcctcaactacaacatggaa

SEQ ID NO: 739029 - DNA, 25 bp, Mus musculus
gtttctcctcaagtacaacatggaa

SEQ ID NO: 739030 - DNA, 25 bp, Mus musculus
gtttctcctggcacctggaaatagt

SEQ ID NO: 739031 - DNA, 25 bp, Mus musculus
gtttctcctggctcctggaaatagt

SEQ ID NO: 739032 - DNA, 25 bp, Mus musculus
gtttctcctgtacatacctcttttt

SEQ ID NO: 739033 - DNA, 25 bp, Mus musculus
gtttctcctgtagatacctcttttt

SEQ ID NO: 739034 - DNA, 25 bp, Mus musculus
gtttctccttttccaattgaactga

SEQ ID NO: 739035 - DNA, 25 bp, Mus musculus
gtttctccttttgcaattgaactga

SEQ ID NO: 739036 - DNA, 25 bp, Mus musculus
gtttctcgcgcgacagatacgagct

SEQ ID NO: 739037 - DNA, 25 bp, Mus musculus
gtttctcgcgcgtcagatacgagct

SEQ ID NO: 739038 - DNA, 25 bp, Mus musculus
gtttctcgtagtattcctttgtcat

SEQ ID NO: 739039 - DNA, 25 bp, Mus musculus
gtttctcgtagttttcctttgtcat

SEQ ID NO: 739040 - DNA, 25 bp, Mus musculus
gtttctcgtcaaccatgtctactac

SEQ ID NO: 739041 - DNA, 25 bp, Mus musculus
gtttctcgtcaagcatgtctactac

SEQ ID NO: 739042 - DNA, 25 bp, Mus musculus
gtttctctaaaaaacatagtcctat

SEQ ID NO: 739043 - DNA, 25 bp, Mus musculus
gtttctctaaaatacatagtcctat

SEQ ID NO: 739044 - DNA, 25 bp, Mus musculus
gtttctctaaacacttaagtgtcat

SEQ ID NO: 739045 - DNA, 25 bp, Mus musculus
gtttctctaaactcttaagtgtcat

SEQ ID NO: 739046 - DNA, 25 bp, Mus musculus
gtttctctaatcatggctcacagtc

SEQ ID NO: 739047 - DNA, 25 bp, Mus musculus
gtttctctaatcttggctcacagtc

SEQ ID NO: 739048 - DNA, 25 bp, Mus musculus
gtttctctaattaatactggctacc

SEQ ID NO: 739049 - DNA, 25 bp, Mus musculus
gtttctctaatttatactggctacc

SEQ ID NO: 739050 - DNA, 25 bp, Mus musculus
gtttctctagctacatcaggttctt

SEQ ID NO: 739051 - DNA, 25 bp, Mus musculus
gtttctctagcttcatcaggttctt

SEQ ID NO: 739052 - DNA, 25 bp, Mus musculus
gtttctctagtaatgttcttatgca

SEQ ID NO: 739053 - DNA, 25 bp, Mus musculus
gtttctctagtattgttcttatgca

SEQ ID NO: 739054 - DNA, 25 bp, Mus musculus
gtttctctatcaaattgtgccccag

SEQ ID NO: 739055 - DNA, 25 bp, Mus musculus
gtttctctatcatattgtgccccag

SEQ ID NO: 739056 - DNA, 25 bp, Mus musculus
gtttctctcagtatgccaaagagac

SEQ ID NO: 739057 - DNA, 25 bp, Mus musculus
gtttctctcagtttgccaaagagac

SEQ ID NO: 739058 - DNA, 25 bp, Mus musculus
gtttctctcatcactgcatgcatga

SEQ ID NO: 739059 - DNA, 25 bp, Mus musculus
gtttctctcatctctgcatgcatga

SEQ ID NO: 739060 - DNA, 25 bp, Mus musculus
gtttctctccacagaactgcaataa

SEQ ID NO: 739061 - DNA, 25 bp, Mus musculus
gtttctctccactgaactgcaataa

SEQ ID NO: 739062 - DNA, 25 bp, Mus musculus
gtttctctccataaattacagggtg

SEQ ID NO: 739063 - DNA, 25 bp, Mus musculus
gtttctctccattaattacagggtg

SEQ ID NO: 739064 - DNA, 25 bp, Mus musculus
gtttctctccctatagtgtagatgg

SEQ ID NO: 739065 - DNA, 25 bp, Mus musculus
gtttctctccctttagtgtagatgg

SEQ ID NO: 739066 - DNA, 25 bp, Mus musculus
gtttctctcgaaaatgactcttgga

SEQ ID NO: 739067 - DNA, 25 bp, Mus musculus
gtttctctcgaatatgactcttgga

SEQ ID NO: 739068 - DNA, 25 bp, Mus musculus
gtttctctctccatttcagaaataa

SEQ ID NO: 739069 - DNA, 25 bp, Mus musculus
gtttctctctccttttcagaaataa

SEQ ID NO: 739070 - DNA, 25 bp, Mus musculus
gtttctctctgtataaccccaactg

SEQ ID NO: 739071 - DNA, 25 bp, Mus musculus
gtttctctctgtttaaccccaactg

SEQ ID NO: 739072 - DNA, 25 bp, Mus musculus
gtttctctcttcagaccgtagcgta

SEQ ID NO: 739073 - DNA, 25 bp, Mus musculus
gtttctctcttctgaccgtagcgta

SEQ ID NO: 739074 - DNA, 25 bp, Mus musculus
gtttctctcttgcttcatgatagta

SEQ ID NO: 739075 - DNA, 25 bp, Mus musculus
gtttctctcttggttcatgatagta

SEQ ID NO: 739076 - DNA, 25 bp, Mus musculus
gtttctctgaaaacttaagtgctac

SEQ ID NO: 739077 - DNA, 25 bp, Mus musculus
gtttctctgaaatcttaagtgctac

SEQ ID NO: 739078 - DNA, 25 bp, Mus musculus
gtttctctgaagcactactgtacca

SEQ ID NO: 739079 - DNA, 25 bp, Mus musculus
gtttctctgaaggactactgtacca

SEQ ID NO: 739080 - DNA, 25 bp, Mus musculus
gtttctctgggcatagggctcactg

SEQ ID NO: 739081 - DNA, 25 bp, Mus musculus
gtttctctgggcttagggctcactg

SEQ ID NO: 739082 - DNA, 25 bp, Mus musculus
gtttctctggttcccaagggaatcc

SEQ ID NO: 739083 - DNA, 25 bp, Mus musculus
gtttctctggttgccaagggaatcc

SEQ ID NO: 739084 - DNA, 25 bp, Mus musculus
gtttctctgtgtcgttcatattgaa

SEQ ID NO: 739085 - DNA, 25 bp, Mus musculus
gtttctctgtgtggttcatattgaa

SEQ ID NO: 739086 - DNA, 25 bp, Mus musculus
gtttctctgttactaataagggact

SEQ ID NO: 739087 - DNA, 25 bp, Mus musculus
gtttctctgttagtaataagggact

SEQ ID NO: 739088 - DNA, 25 bp, Mus musculus
gtttctcttcagcaacgttattcta

SEQ ID NO: 739089 - DNA, 25 bp, Mus musculus
gtttctcttcaggaacgttattcta

SEQ ID NO: 739090 - DNA, 25 bp, Mus musculus
gtttctcttcctatgatgacatgaa

SEQ ID NO: 739091 - DNA, 25 bp, Mus musculus
gtttctcttcctttgatgacatgaa

SEQ ID NO: 739092 - DNA, 25 bp, Mus musculus
gtttctcttctcaactgatctaaag

SEQ ID NO: 739093 - DNA, 25 bp, Mus musculus
gtttctcttctctactgatctaaag

SEQ ID NO: 739094 - DNA, 25 bp, Mus musculus
gtttctcttcttacagatttccgtc

SEQ ID NO: 739095 - DNA, 25 bp, Mus musculus
gtttctcttctttcagatttccgtc

SEQ ID NO: 739096 - DNA, 25 bp, Mus musculus
gtttctcttgaactttggtccattc

SEQ ID NO: 739097 - DNA, 25 bp, Mus musculus
gtttctcttgaagtttggtccattc

SEQ ID NO: 739098 - DNA, 25 bp, Mus musculus
gtttctcttgagaattgccagggct

SEQ ID NO: 739099 - DNA, 25 bp, Mus musculus
gtttctcttgagtattgccagggct

SEQ ID NO: 739100 - DNA, 25 bp, Mus musculus
gtttctcttgccaatgcaaagatca

SEQ ID NO: 739101 - DNA, 25 bp, Mus musculus
gtttctcttgcctatgcaaagatca

SEQ ID NO: 739102 - DNA, 25 bp, Mus musculus
gtttctcttgtgaattcagcacagt

SEQ ID NO: 739103 - DNA, 25 bp, Mus musculus
gtttctcttgtgtattcagcacagt

SEQ ID NO: 739104 - DNA, 25 bp, Mus musculus
gtttctctttaaatggagagtctct

SEQ ID NO: 739105 - DNA, 25 bp, Mus musculus
gtttctctttaactctctggaccat

SEQ ID NO: 739106 - DNA, 25 bp, Mus musculus
gtttctctttaagtctctggaccat

SEQ ID NO: 739107 - DNA, 25 bp, Mus musculus
gtttctctttaattggagagtctct

SEQ ID NO: 739108 - DNA, 25 bp, Mus musculus
gtttctctttcgacctcatcgctca

SEQ ID NO: 739109 - DNA, 25 bp, Mus musculus
gtttctctttcgtcctcatcgctca

SEQ ID NO: 739110 - DNA, 25 bp, Mus musculus
gtttctgaaaaacgctctcatgtat

SEQ ID NO: 739111 - DNA, 25 bp, Mus musculus
gtttctgaaaaaggctctcatgtat

SEQ ID NO: 739112 - DNA, 25 bp, Mus musculus
gtttctgaaaagcacacggccacat

SEQ ID NO: 739113 - DNA, 25 bp, Mus musculus
gtttctgaaaaggacacggccacat

SEQ ID NO: 739114 - DNA, 25 bp, Mus musculus
gtttctgaaagcaccacaactaata

SEQ ID NO: 739115 - DNA, 25 bp, Mus musculus
gtttctgaaagctccacaactaata

SEQ ID NO: 739116 - DNA, 25 bp, Mus musculus
gtttctgaaatcacttttacctcaa

SEQ ID NO: 739117 - DNA, 25 bp, Mus musculus
gtttctgaaatctcttttacctcaa

SEQ ID NO: 739118 - DNA, 25 bp, Mus musculus
gtttctgaacatcggagcacccctg

SEQ ID NO: 739119 - DNA, 25 bp, Mus musculus
gtttctgaacatgggagcacccctg

SEQ ID NO: 739120 - DNA, 25 bp, Mus musculus
gtttctgaacctcgagtctgtcttt

SEQ ID NO: 739121 - DNA, 25 bp, Mus musculus
gtttctgaacctggagtctgtcttt

SEQ ID NO: 739122 - DNA, 25 bp, Mus musculus
gtttctgaactgatggtctactgtg

SEQ ID NO: 739123 - DNA, 25 bp, Mus musculus
gtttctgaactgttggtctactgtg

SEQ ID NO: 739124 - DNA, 25 bp, Mus musculus
gtttctgaagtgctaactgtatgcc

SEQ ID NO: 739125 - DNA, 25 bp, Mus musculus
gtttctgaagtggtaactgtatgcc

SEQ ID NO: 739126 - DNA, 25 bp, Mus musculus
gtttctgaatcacggtctcacactg

SEQ ID NO: 739127 - DNA, 25 bp, Mus musculus
gtttctgaatcagggtctcacactg

SEQ ID NO: 739128 - DNA, 25 bp, Mus musculus
gtttctgaatggcacacctgaaaag

SEQ ID NO: 739129 - DNA, 25 bp, Mus musculus
gtttctgaatgggacacctgaaaag

SEQ ID NO: 739130 - DNA, 25 bp, Mus musculus
gtttctgacaacaacatactatggc

SEQ ID NO: 739131 - DNA, 25 bp, Mus musculus
gtttctgacaactacatactatggc

SEQ ID NO: 739132 - DNA, 25 bp, Mus musculus
gtttctgacattccttatgcccaaa

SEQ ID NO: 739133 - DNA, 25 bp, Mus musculus
gtttctgacattgcttatgcccaaa

SEQ ID NO: 739134 - DNA, 25 bp, Mus musculus
gtttctgacccaattttgtcagtat

SEQ ID NO: 739135 - DNA, 25 bp, Mus musculus
gtttctgacccatttttgtcagtat

SEQ ID NO: 739136 - DNA, 25 bp, Mus musculus
gtttctgacggacaagcttgtgaag

SEQ ID NO: 739137 - DNA, 25 bp, Mus musculus
gtttctgacggagaagcttgtgaag

SEQ ID NO: 739138 - DNA, 25 bp, Mus musculus
gtttctgactgtcctggtcatcatt

SEQ ID NO: 739139 - DNA, 25 bp, Mus musculus
gtttctgactgtgctggtcatcatt

SEQ ID NO: 739140 - DNA, 25 bp, Mus musculus
gtttctgactttagtacggtgacca

SEQ ID NO: 739141 - DNA, 25 bp, Mus musculus
gtttctgactttcaggttgcttctt

SEQ ID NO: 739142 - DNA, 25 bp, Mus musculus
gtttctgactttgaggttgcttctt

SEQ ID NO: 739143 - DNA, 25 bp, Mus musculus
gtttctgacttttgtacggtgacca

SEQ ID NO: 739144 - DNA, 25 bp, Mus musculus
gtttctgagaatcccacatagatgg

SEQ ID NO: 739145 - DNA, 25 bp, Mus musculus
gtttctgagaatgccacatagatgg

SEQ ID NO: 739146 - DNA, 25 bp, Mus musculus
gtttctgagaggattactgatcaca

SEQ ID NO: 739147 - DNA, 25 bp, Mus musculus
gtttctgagaggtttactgatcaca

SEQ ID NO: 739148 - DNA, 25 bp, Mus musculus
gtttctgagatcctttctctgtagc

SEQ ID NO: 739149 - DNA, 25 bp, Mus musculus
gtttctgagatcgtttctctgtagc

SEQ ID NO: 739150 - DNA, 25 bp, Mus musculus
gtttctgagatgctccatagccgac

SEQ ID NO: 739151 - DNA, 25 bp, Mus musculus
gtttctgagatggtccatagccgac

SEQ ID NO: 739152 - DNA, 25 bp, Mus musculus
gtttctgagcagagacatctttggt

SEQ ID NO: 739153 - DNA, 25 bp, Mus musculus
gtttctgagcagtgacatctttggt

SEQ ID NO: 739154 - DNA, 25 bp, Mus musculus
gtttctgagcctcttttgtttgcaa

SEQ ID NO: 739155 - DNA, 25 bp, Mus musculus
gtttctgagcctgttttgtttgcaa

SEQ ID NO: 739156 - DNA, 25 bp, Mus musculus
gtttctgagcttactgtcactactg

SEQ ID NO: 739157 - DNA, 25 bp, Mus musculus
gtttctgagcttaggtcgcacccca

SEQ ID NO: 739158 - DNA, 25 bp, Mus musculus
gtttctgagcttagttctatgttcc

SEQ ID NO: 739159 - DNA, 25 bp, Mus musculus
gtttctgagctttctgtcactactg

SEQ ID NO: 739160 - DNA, 25 bp, Mus musculus
gtttctgagctttggtcgcacccca

SEQ ID NO: 739161 - DNA, 25 bp, Mus musculus
gtttctgagctttgttctatgttcc

SEQ ID NO: 739162 - DNA, 25 bp, Mus musculus
gtttctgagtggcaccccagattcc

SEQ ID NO: 739163 - DNA, 25 bp, Mus musculus
gtttctgagtgggaccccagattcc

SEQ ID NO: 739164 - DNA, 25 bp, Mus musculus
gtttctgagtgtcatcctgatcttt

SEQ ID NO: 739165 - DNA, 25 bp, Mus musculus
gtttctgagtgtgatcctgatcttt

SEQ ID NO: 739166 - DNA, 25 bp, Mus musculus
gtttctgagtttctttccgagctga

SEQ ID NO: 739167 - DNA, 25 bp, Mus musculus
gtttctgagtttgtttccgagctga

SEQ ID NO: 739168 - DNA, 25 bp, Mus musculus
gtttctgataatagactgacgctga

SEQ ID NO: 739169 - DNA, 25 bp, Mus musculus
gtttctgataattgactgacgctga

SEQ ID NO: 739170 - DNA, 25 bp, Mus musculus
gtttctgataccaagtgagggccat

SEQ ID NO: 739171 - DNA, 25 bp, Mus musculus
gtttctgataccaattaggctctca

SEQ ID NO: 739172 - DNA, 25 bp, Mus musculus
gtttctgatacctagtgagggccat

SEQ ID NO: 739173 - DNA, 25 bp, Mus musculus
gtttctgatacctattaggctctca

SEQ ID NO: 739174 - DNA, 25 bp, Mus musculus
gtttctgatataagcttatcccaca

SEQ ID NO: 739175 - DNA, 25 bp, Mus musculus
gtttctgatatatgcttatcccaca

SEQ ID NO: 739176 - DNA, 25 bp, Mus musculus
gtttctgatcagctgcatacatagc

SEQ ID NO: 739177 - DNA, 25 bp, Mus musculus
gtttctgatcaggtgcatacatagc

SEQ ID NO: 739178 - DNA, 25 bp, Mus musculus
gtttctgatcatcgcctctcaagta

SEQ ID NO: 739179 - DNA, 25 bp, Mus musculus
gtttctgatcatggcctctcaagta

SEQ ID NO: 739180 - DNA, 25 bp, Mus musculus
gtttctgatccactacgtgcaaagg

SEQ ID NO: 739181 - DNA, 25 bp, Mus musculus
gtttctgatccagtacgtgcaaagg

SEQ ID NO: 739182 - DNA, 25 bp, Mus musculus
gtttctgatggtcgaactctcggct

SEQ ID NO: 739183 - DNA, 25 bp, Mus musculus
gtttctgatggtggaactctcggct

SEQ ID NO: 739184 - DNA, 25 bp, Mus musculus
gtttctgatttcatcagtatcctga

SEQ ID NO: 739185 - DNA, 25 bp, Mus musculus
gtttctgatttcttcagtatcctga

SEQ ID NO: 739186 - DNA, 25 bp, Mus musculus
gtttctgcaaatcttatgccccagt

SEQ ID NO: 739187 - DNA, 25 bp, Mus musculus
gtttctgcaaatgttatgccccagt

SEQ ID NO: 739188 - DNA, 25 bp, Mus musculus
gtttctgcacacaccagacagtctg

SEQ ID NO: 739189 - DNA, 25 bp, Mus musculus
gtttctgcacactccagacagtctg

SEQ ID NO: 739190 - DNA, 25 bp, Mus musculus
gtttctgcacgcctagttttacatc

SEQ ID NO: 739191 - DNA, 25 bp, Mus musculus
gtttctgcacgcgtagttttacatc

SEQ ID NO: 739192 - DNA, 25 bp, Mus musculus
gtttctgcactactttccagagagt

SEQ ID NO: 739193 - DNA, 25 bp, Mus musculus
gtttctgcactagtttccagagagt

SEQ ID NO: 739194 - DNA, 25 bp, Mus musculus
gtttctgcagatcagcttgttacaa

SEQ ID NO: 739195 - DNA, 25 bp, Mus musculus
gtttctgcagatgagcttgttacaa

SEQ ID NO: 739196 - DNA, 25 bp, Mus musculus
gtttctgcattccagtccaccatga

SEQ ID NO: 739197 - DNA, 25 bp, Mus musculus
gtttctgcattcgagtccaccatga

SEQ ID NO: 739198 - DNA, 25 bp, Mus musculus
gtttctgccacaaccattttctgga

SEQ ID NO: 739199 - DNA, 25 bp, Mus musculus
gtttctgccacatccattttctgga

SEQ ID NO: 739200 - DNA, 25 bp, Mus musculus
gtttctgccagtccttttgtatgca

SEQ ID NO: 739201 - DNA, 25 bp, Mus musculus
gtttctgccagtgcttttgtatgca

SEQ ID NO: 739202 - DNA, 25 bp, Mus musculus
gtttctgcccagcttttcaagacaa

SEQ ID NO: 739203 - DNA, 25 bp, Mus musculus
gtttctgcccaggttttcaagacaa

SEQ ID NO: 739204 - DNA, 25 bp, Mus musculus
gtttctgcccatcatgcaagctatc

SEQ ID NO: 739205 - DNA, 25 bp, Mus musculus
gtttctgcccatgatgcaagctatc

SEQ ID NO: 739206 - DNA, 25 bp, Mus musculus
gtttctgccccaagcaaaatagatc

SEQ ID NO: 739207 - DNA, 25 bp, Mus musculus
gtttctgccccatgcaaaatagatc

SEQ ID NO: 739208 - DNA, 25 bp, Mus musculus
gtttctgccctgatctggatctgcc

SEQ ID NO: 739209 - DNA, 25 bp, Mus musculus
gtttctgccctgttctggatctgcc

SEQ ID NO: 739210 - DNA, 25 bp, Mus musculus
gtttctgccgcacacattgtctaac

SEQ ID NO: 739211 - DNA, 25 bp, Mus musculus
gtttctgccgcagacattgtctaac

SEQ ID NO: 739212 - DNA, 25 bp, Mus musculus
gtttctgccgctcgtgaagtaagcc

SEQ ID NO: 739213 - DNA, 25 bp, Mus musculus
gtttctgccgctggtgaagtaagcc

SEQ ID NO: 739214 - DNA, 25 bp, Mus musculus
gtttctgcctccaggaactttggta

SEQ ID NO: 739215 - DNA, 25 bp, Mus musculus
gtttctgcctcctggaactttggta

SEQ ID NO: 739216 - DNA, 25 bp, Mus musculus
gtttctgcctcgatactgttttaca

SEQ ID NO: 739217 - DNA, 25 bp, Mus musculus
gtttctgcctcgttactgttttaca

SEQ ID NO: 739218 - DNA, 25 bp, Mus musculus
gtttctgccttaactgagtctaaat

SEQ ID NO: 739219 - DNA, 25 bp, Mus musculus
gtttctgccttatctgagtctaaat

SEQ ID NO: 739220 - DNA, 25 bp, Mus musculus
gtttctgccttcacagtttctgaag

SEQ ID NO: 739221 - DNA, 25 bp, Mus musculus
gtttctgccttctcagtttctgaag

SEQ ID NO: 739222 - DNA, 25 bp, Mus musculus
gtttctgctaatcctacttttgatt

SEQ ID NO: 739223 - DNA, 25 bp, Mus musculus
gtttctgctaatgctacttttgatt

SEQ ID NO: 739224 - DNA, 25 bp, Mus musculus
gtttctgctcagaggattaagtaag

SEQ ID NO: 739225 - DNA, 25 bp, Mus musculus
gtttctgctcagtggattaagtaag

SEQ ID NO: 739226 - DNA, 25 bp, Mus musculus
gtttctgctctgcttcatttaggag

SEQ ID NO: 739227 - DNA, 25 bp, Mus musculus
gtttctgctctggttcatttaggag

SEQ ID NO: 739228 - DNA, 25 bp, Mus musculus
gtttctgctgttactaaataacaca

SEQ ID NO: 739229 - DNA, 25 bp, Mus musculus
gtttctgctgttcttttaagtgtgc

SEQ ID NO: 739230 - DNA, 25 bp, Mus musculus
gtttctgctgttgttttaagtgtgc

SEQ ID NO: 739231 - DNA, 25 bp, Mus musculus
gtttctgctgtttctaaataacaca

SEQ ID NO: 739232 - DNA, 25 bp, Mus musculus
gtttctgcttatcgcttcaactaga

SEQ ID NO: 739233 - DNA, 25 bp, Mus musculus
gtttctgcttatggcttcaactaga

SEQ ID NO: 739234 - DNA, 25 bp, Mus musculus
gtttctgcttttcaagacgtcctat

SEQ ID NO: 739235 - DNA, 25 bp, Mus musculus
gtttctgcttttgaagacgtcctat

SEQ ID NO: 739236 - DNA, 25 bp, Mus musculus
gtttctggaaagagctatgaagcta

SEQ ID NO: 739237 - DNA, 25 bp, Mus musculus
gtttctggaaagtgctatgaagcta

SEQ ID NO: 739238 - DNA, 25 bp, Mus musculus
gtttctggaacccatttgagtccgg

SEQ ID NO: 739239 - DNA, 25 bp, Mus musculus
gtttctggaaccgatttgagtccgg

SEQ ID NO: 739240 - DNA, 25 bp, Mus musculus
gtttctggaagcatacatatgatta

SEQ ID NO: 739241 - DNA, 25 bp, Mus musculus
gtttctggaagcttacatatgatta

SEQ ID NO: 739242 - DNA, 25 bp, Mus musculus
gtttctggaatgaatcacccacagt

SEQ ID NO: 739243 - DNA, 25 bp, Mus musculus
gtttctggaatgctttcttagactc

SEQ ID NO: 739244 - DNA, 25 bp, Mus musculus
gtttctggaatggtttcttagactc

SEQ ID NO: 739245 - DNA, 25 bp, Mus musculus
gtttctggaatgtatcacccacagt

SEQ ID NO: 739246 - DNA, 25 bp, Mus musculus
gtttctggaccgactgggttcacag

SEQ ID NO: 739247 - DNA, 25 bp, Mus musculus
gtttctggaccgtctgggttcacag

SEQ ID NO: 739248 - DNA, 25 bp, Mus musculus
gtttctggacgtatgtgcagtattg

SEQ ID NO: 739249 - DNA, 25 bp, Mus musculus
gtttctggacgtttgtgcagtattg

SEQ ID NO: 739250 - DNA, 25 bp, Mus musculus
gtttctggactgagccaatctgtga

SEQ ID NO: 739251 - DNA, 25 bp, Mus musculus
gtttctggactgtgccaatctgtga

SEQ ID NO: 739252 - DNA, 25 bp, Mus musculus
gtttctggacttaccaacgttgtga

SEQ ID NO: 739253 - DNA, 25 bp, Mus musculus
gtttctggactttccaacgttgtga

SEQ ID NO: 739254 - DNA, 25 bp, Mus musculus
gtttctggatggaggttacttctca

SEQ ID NO: 739255 - DNA, 25 bp, Mus musculus
gtttctggatggtggttacttctca

SEQ ID NO: 739256 - DNA, 25 bp, Mus musculus
gtttctggcaaacgtaccttatctc

SEQ ID NO: 739257 - DNA, 25 bp, Mus musculus
gtttctggcaaaggtaccttatctc

SEQ ID NO: 739258 - DNA, 25 bp, Mus musculus
gtttctggcaacaataatacacgga

SEQ ID NO: 739259 - DNA, 25 bp, Mus musculus
gtttctggcaactataatacacgga

SEQ ID NO: 739260 - DNA, 25 bp, Mus musculus
gtttctggcaccaagtgtgttgcaa

SEQ ID NO: 739261 - DNA, 25 bp, Mus musculus
gtttctggcacctagtgtgttgcaa

SEQ ID NO: 739262 - DNA, 25 bp, Mus musculus
gtttctggcataatcatccatccat

SEQ ID NO: 739263 - DNA, 25 bp, Mus musculus
gtttctggcatattcatccatccat

SEQ ID NO: 739264 - DNA, 25 bp, Mus musculus
gtttctggcccacaaggctatgagg

SEQ ID NO: 739265 - DNA, 25 bp, Mus musculus
gtttctggcccagaaggctatgagg

SEQ ID NO: 739266 - DNA, 25 bp, Mus musculus
gtttctggcgatccagcaattccaa

SEQ ID NO: 739267 - DNA, 25 bp, Mus musculus
gtttctggcgatgcagcaattccaa

SEQ ID NO: 739268 - DNA, 25 bp, Mus musculus
gtttctggcggaattcctcaaagga

SEQ ID NO: 739269 - DNA, 25 bp, Mus musculus
gtttctggcggatttcctcaaagga

SEQ ID NO: 739270 - DNA, 25 bp, Mus musculus
gtttctgggaataattcgcctcctc

SEQ ID NO: 739271 - DNA, 25 bp, Mus musculus
gtttctgggaattattcgcctcctc

SEQ ID NO: 739272 - DNA, 25 bp, Mus musculus
gtttctgggattattggcatatgtc

SEQ ID NO: 739273 - DNA, 25 bp, Mus musculus
gtttctgggatttttggcatatgtc

SEQ ID NO: 739274 - DNA, 25 bp, Mus musculus
gtttctgggttgcatcacggacgta

SEQ ID NO: 739275 - DNA, 25 bp, Mus musculus
gtttctgggttggatcacggacgta

SEQ ID NO: 739276 - DNA, 25 bp, Mus musculus
gtttctgggtttctccaagctctaa

SEQ ID NO: 739277 - DNA, 25 bp, Mus musculus
gtttctgggtttgtccaagctctaa

SEQ ID NO: 739278 - DNA, 25 bp, Mus musculus
gtttctggtaaactggtccatgcta

SEQ ID NO: 739279 - DNA, 25 bp, Mus musculus
gtttctggtaaagtggtccatgcta

SEQ ID NO: 739280 - DNA, 25 bp, Mus musculus
gtttctggtcttactaaggactcaa

SEQ ID NO: 739281 - DNA, 25 bp, Mus musculus
gtttctggtctttctaaggactcaa

SEQ ID NO: 739282 - DNA, 25 bp, Mus musculus
gtttctggtgacactttgggacaca

SEQ ID NO: 739283 - DNA, 25 bp, Mus musculus
gtttctggtgactctttgggacaca

SEQ ID NO: 739284 - DNA, 25 bp, Mus musculus
gtttctgtaaacaactagacctcta

SEQ ID NO: 739285 - DNA, 25 bp, Mus musculus
gtttctgtaaactactagacctcta

SEQ ID NO: 739286 - DNA, 25 bp, Mus musculus
gtttctgtaaccctatgcaatatat

SEQ ID NO: 739287 - DNA, 25 bp, Mus musculus
gtttctgtaaccgtatgcaatatat

SEQ ID NO: 739288 - DNA, 25 bp, Mus musculus
gtttctgtaattcttctccatgtac

SEQ ID NO: 739289 - DNA, 25 bp, Mus musculus
gtttctgtaattgttctccatgtac

SEQ ID NO: 739290 - DNA, 25 bp, Mus musculus
gtttctgtacaacaatttggctact

SEQ ID NO: 739291 - DNA, 25 bp, Mus musculus
gtttctgtacaagaatttggctact

SEQ ID NO: 739292 - DNA, 25 bp, Mus musculus
gtttctgtaccaaggacggctggaa

SEQ ID NO: 739293 - DNA, 25 bp, Mus musculus
gtttctgtaccatggacggctggaa

SEQ ID NO: 739294 - DNA, 25 bp, Mus musculus
gtttctgtacccatatgtgtgagtg

SEQ ID NO: 739295 - DNA, 25 bp, Mus musculus
gtttctgtacccttatgtgtgagtg

SEQ ID NO: 739296 - DNA, 25 bp, Mus musculus
gtttctgtactcattttaatccaaa

SEQ ID NO: 739297 - DNA, 25 bp, Mus musculus
gtttctgtactctttttaatccaaa

SEQ ID NO: 739298 - DNA, 25 bp, Mus musculus
gtttctgtagagaggaatttctgtt

SEQ ID NO: 739299 - DNA, 25 bp, Mus musculus
gtttctgtagagctctttagatgta

SEQ ID NO: 739300 - DNA, 25 bp, Mus musculus
gtttctgtagaggtctttagatgta

SEQ ID NO: 739301 - DNA, 25 bp, Mus musculus
gtttctgtagagtggaatttctgtt

SEQ ID NO: 739302 - DNA, 25 bp, Mus musculus
gtttctgtagcaccagtgtacacca

SEQ ID NO: 739303 - DNA, 25 bp, Mus musculus
gtttctgtagcagcagtgtacacca

SEQ ID NO: 739304 - DNA, 25 bp, Mus musculus
gtttctgtatttaagaggccttgtc

SEQ ID NO: 739305 - DNA, 25 bp, Mus musculus
gtttctgtattttagaggccttgtc

SEQ ID NO: 739306 - DNA, 25 bp, Mus musculus
gtttctgtcaaaatgctacttctat

SEQ ID NO: 739307 - DNA, 25 bp, Mus musculus
gtttctgtcaaattgctacttctat

SEQ ID NO: 739308 - DNA, 25 bp, Mus musculus
gtttctgtcaagcatattgggaatt

SEQ ID NO: 739309 - DNA, 25 bp, Mus musculus
gtttctgtcaaggatattgggaatt

SEQ ID NO: 739310 - DNA, 25 bp, Mus musculus
gtttctgtcacactttaggcagtct

SEQ ID NO: 739311 - DNA, 25 bp, Mus musculus
gtttctgtcacagtttaggcagtct

SEQ ID NO: 739312 - DNA, 25 bp, Mus musculus
gtttctgtcagaagccacgggacaa

SEQ ID NO: 739313 - DNA, 25 bp, Mus musculus
gtttctgtcagatgccacgggacaa

SEQ ID NO: 739314 - DNA, 25 bp, Mus musculus
gtttctgtcagtaccatcatgtcaa

SEQ ID NO: 739315 - DNA, 25 bp, Mus musculus
gtttctgtcagtcgaatgagtggca

SEQ ID NO: 739316 - DNA, 25 bp, Mus musculus
gtttctgtcagtcgctctgttccag

SEQ ID NO: 739317 - DNA, 25 bp, Mus musculus
gtttctgtcagtggaatgagtggca

SEQ ID NO: 739318 - DNA, 25 bp, Mus musculus
gtttctgtcagtggctctgttccag

SEQ ID NO: 739319 - DNA, 25 bp, Mus musculus
gtttctgtcagttccatcatgtcaa

SEQ ID NO: 739320 - DNA, 25 bp, Mus musculus
gtttctgtcatcagactgtttctca

SEQ ID NO: 739321 - DNA, 25 bp, Mus musculus
gtttctgtcatctgactgtttctca

SEQ ID NO: 739322 - DNA, 25 bp, Mus musculus
gtttctgtccccagatgtggtgtca

SEQ ID NO: 739323 - DNA, 25 bp, Mus musculus
gtttctgtcccctgatgtggtgtca

SEQ ID NO: 739324 - DNA, 25 bp, Mus musculus
gtttctgtcctcaccaggtctgtga

SEQ ID NO: 739325 - DNA, 25 bp, Mus musculus
gtttctgtcctctccaggtctgtga

SEQ ID NO: 739326 - DNA, 25 bp, Mus musculus
gtttctgtcggacctcacccagcag

SEQ ID NO: 739327 - DNA, 25 bp, Mus musculus
gtttctgtcggagctcacccagcag

SEQ ID NO: 739328 - DNA, 25 bp, Mus musculus
gtttctgtctctctaaatccttatt

SEQ ID NO: 739329 - DNA, 25 bp, Mus musculus
gtttctgtctctgtaaatccttatt

SEQ ID NO: 739330 - DNA, 25 bp, Mus musculus
gtttctgtcttgatttctctcacaa

SEQ ID NO: 739331 - DNA, 25 bp, Mus musculus
gtttctgtcttgctgttcctgccgt

SEQ ID NO: 739332 - DNA, 25 bp, Mus musculus
gtttctgtcttggtgttcctgccgt

SEQ ID NO: 739333 - DNA, 25 bp, Mus musculus
gtttctgtcttgttttctctcacaa

SEQ ID NO: 739334 - DNA, 25 bp, Mus musculus
gtttctgtctttacggttgttggca

SEQ ID NO: 739335 - DNA, 25 bp, Mus musculus
gtttctgtctttagctcaacagcgg

SEQ ID NO: 739336 - DNA, 25 bp, Mus musculus
gtttctgtcttttcggttgttggca

SEQ ID NO: 739337 - DNA, 25 bp, Mus musculus
gtttctgtcttttgctcaacagcgg

SEQ ID NO: 739338 - DNA, 25 bp, Mus musculus
gtttctgtgaacatactgatgtaat

SEQ ID NO: 739339 - DNA, 25 bp, Mus musculus
gtttctgtgaacttactgatgtaat

SEQ ID NO: 739340 - DNA, 25 bp, Mus musculus
gtttctgtgaccctggtgtgactaa

SEQ ID NO: 739341 - DNA, 25 bp, Mus musculus
gtttctgtgaccgtggtgtgactaa

SEQ ID NO: 739342 - DNA, 25 bp, Mus musculus
gtttctgtgatcaggaaccacatgg

SEQ ID NO: 739343 - DNA, 25 bp, Mus musculus
gtttctgtgatctggaaccacatgg

SEQ ID NO: 739344 - DNA, 25 bp, Mus musculus
gtttctgtgctcatcctaaatatca

SEQ ID NO: 739345 - DNA, 25 bp, Mus musculus
gtttctgtgctccagagatatcctg

SEQ ID NO: 739346 - DNA, 25 bp, Mus musculus
gtttctgtgctcgagagatatcctg

SEQ ID NO: 739347 - DNA, 25 bp, Mus musculus
gtttctgtgctcttcctaaatatca

SEQ ID NO: 739348 - DNA, 25 bp, Mus musculus
gtttctgtggcaattaagaaccaat

SEQ ID NO: 739349 - DNA, 25 bp, Mus musculus
gtttctgtggcatttaagaaccaat

SEQ ID NO: 739350 - DNA, 25 bp, Mus musculus
gtttctgtggctacgtgcatgacac

SEQ ID NO: 739351 - DNA, 25 bp, Mus musculus
gtttctgtggctactaacaaaccag

SEQ ID NO: 739352 - DNA, 25 bp, Mus musculus
gtttctgtggcttcgtgcatgacac

SEQ ID NO: 739353 - DNA, 25 bp, Mus musculus
gtttctgtggcttctaacaaaccag

SEQ ID NO: 739354 - DNA, 25 bp, Mus musculus
gtttctgtggtaatgtattctctaa

SEQ ID NO: 739355 - DNA, 25 bp, Mus musculus
gtttctgtggtattgtattctctaa

SEQ ID NO: 739356 - DNA, 25 bp, Mus musculus
gtttctgtggtcatcaaccatggtt

SEQ ID NO: 739357 - DNA, 25 bp, Mus musculus
gtttctgtggtcttcaaccatggtt

SEQ ID NO: 739358 - DNA, 25 bp, Mus musculus
gtttctgtgtgaaggctccctctct

SEQ ID NO: 739359 - DNA, 25 bp, Mus musculus
gtttctgtgtgatggctccctctct

SEQ ID NO: 739360 - DNA, 25 bp, Mus musculus
gtttctgtgtgtatttgccactgca

SEQ ID NO: 739361 - DNA, 25 bp, Mus musculus
gtttctgtgtgtttttgccactgca

SEQ ID NO: 739362 - DNA, 25 bp, Mus musculus
gtttctgttaagcacgcgagctgga

SEQ ID NO: 739363 - DNA, 25 bp, Mus musculus
gtttctgttaaggacgcgagctgga

SEQ ID NO: 739364 - DNA, 25 bp, Mus musculus
gtttctgttattacttgctactgta

SEQ ID NO: 739365 - DNA, 25 bp, Mus musculus
gtttctgttattccagtctctggtc

SEQ ID NO: 739366 - DNA, 25 bp, Mus musculus
gtttctgttattgcagtctctggtc

SEQ ID NO: 739367 - DNA, 25 bp, Mus musculus
gtttctgttatttcttgctactgta

SEQ ID NO: 739368 - DNA, 25 bp, Mus musculus
gtttctgttcagatcttaatctcat

SEQ ID NO: 739369 - DNA, 25 bp, Mus musculus
gtttctgttcagttcttaatctcat

SEQ ID NO: 739370 - DNA, 25 bp, Mus musculus
gtttctgttcctcttttgacaatcg

SEQ ID NO: 739371 - DNA, 25 bp, Mus musculus
gtttctgttcctgttttgacaatcg

SEQ ID NO: 739372 - DNA, 25 bp, Mus musculus
gtttctgttctactgctttaattgc

SEQ ID NO: 739373 - DNA, 25 bp, Mus musculus
gtttctgttctagtgctttaattgc

SEQ ID NO: 739374 - DNA, 25 bp, Mus musculus
gtttctgttctccacatgagtgcaa

SEQ ID NO: 739375 - DNA, 25 bp, Mus musculus
gtttctgttctcgacatgagtgcaa

SEQ ID NO: 739376 - DNA, 25 bp, Mus musculus
gtttctgttctgcagcgtttgtaac

SEQ ID NO: 739377 - DNA, 25 bp, Mus musculus
gtttctgttctggagcgtttgtaac

SEQ ID NO: 739378 - DNA, 25 bp, Mus musculus
gtttctgttggccatcaggtctgga

SEQ ID NO: 739379 - DNA, 25 bp, Mus musculus
gtttctgttggcgatcaggtctgga

SEQ ID NO: 739380 - DNA, 25 bp, Mus musculus
gtttctgtttagaacaaggaaggat

SEQ ID NO: 739381 - DNA, 25 bp, Mus musculus
gtttctgtttagtacaaggaaggat

SEQ ID NO: 739382 - DNA, 25 bp, Mus musculus
gtttctgtttctaccattgtattgg

SEQ ID NO: 739383 - DNA, 25 bp, Mus musculus
gtttctgtttcttccattgtattgg

SEQ ID NO: 739384 - DNA, 25 bp, Mus musculus
gtttctgtttgaatgtgcatccatg

SEQ ID NO: 739385 - DNA, 25 bp, Mus musculus
gtttctgtttgattgtgcatccatg

SEQ ID NO: 739386 - DNA, 25 bp, Mus musculus
gtttctgtttgtaagccctgtggac

SEQ ID NO: 739387 - DNA, 25 bp, Mus musculus
gtttctgtttgttagccctgtggac

SEQ ID NO: 739388 - DNA, 25 bp, Mus musculus
gtttctgttttgagccctacaacat

SEQ ID NO: 739389 - DNA, 25 bp, Mus musculus
gtttctgttttgtgccctacaacat

SEQ ID NO: 739390 - DNA, 25 bp, Mus musculus
gtttcttaaaacagagattcataat

SEQ ID NO: 739391 - DNA, 25 bp, Mus musculus
gtttcttaaaactgagattcataat

SEQ ID NO: 739392 - DNA, 25 bp, Mus musculus
gtttcttaaactattaccagctcaa

SEQ ID NO: 739393 - DNA, 25 bp, Mus musculus
gtttcttaaactcgacacatgtctt

SEQ ID NO: 739394 - DNA, 25 bp, Mus musculus
gtttcttaaactggacacatgtctt

SEQ ID NO: 739395 - DNA, 25 bp, Mus musculus
gtttcttaaacttttaccagctcaa

SEQ ID NO: 739396 - DNA, 25 bp, Mus musculus
gtttcttaaattaaagctggtgcca

SEQ ID NO: 739397 - DNA, 25 bp, Mus musculus
gtttcttaaatttaagctggtgcca

SEQ ID NO: 739398 - DNA, 25 bp, Mus musculus
gtttcttaatagacgctgggatctt

SEQ ID NO: 739399 - DNA, 25 bp, Mus musculus
gtttcttaatagtcgctgggatctt

SEQ ID NO: 739400 - DNA, 25 bp, Mus musculus
gtttcttaatgtagcagtgaccagt

SEQ ID NO: 739401 - DNA, 25 bp, Mus musculus
gtttcttaatgttgcagtgaccagt

SEQ ID NO: 739402 - DNA, 25 bp, Mus musculus
gtttcttacaacatacaggtccttt

SEQ ID NO: 739403 - DNA, 25 bp, Mus musculus
gtttcttacaacattctgtgcgtat

SEQ ID NO: 739404 - DNA, 25 bp, Mus musculus
gtttcttacaacttacaggtccttt

SEQ ID NO: 739405 - DNA, 25 bp, Mus musculus
gtttcttacaactttctgtgcgtat

SEQ ID NO: 739406 - DNA, 25 bp, Mus musculus
gtttcttacagcacctgaacactta

SEQ ID NO: 739407 - DNA, 25 bp, Mus musculus
gtttcttacagctcctgaacactta

SEQ ID NO: 739408 - DNA, 25 bp, Mus musculus
gtttcttacatcaccacaagagctt

SEQ ID NO: 739409 - DNA, 25 bp, Mus musculus
gtttcttacatctccacaagagctt

SEQ ID NO: 739410 - DNA, 25 bp, Mus musculus
gtttcttacctgaacaatcttgcca

SEQ ID NO: 739411 - DNA, 25 bp, Mus musculus
gtttcttacctgtacaatcttgcca

SEQ ID NO: 739412 - DNA, 25 bp, Mus musculus
gtttcttactctacaactctcttaa

SEQ ID NO: 739413 - DNA, 25 bp, Mus musculus
gtttcttactcttcaactctcttaa

SEQ ID NO: 739414 - DNA, 25 bp, Mus musculus
gtttcttagaatatccagtgccggc

SEQ ID NO: 739415 - DNA, 25 bp, Mus musculus
gtttcttagaatttccagtgccggc

SEQ ID NO: 739416 - DNA, 25 bp, Mus musculus
gtttcttagagtcctccagtgactt

SEQ ID NO: 739417 - DNA, 25 bp, Mus musculus
gtttcttagagtgctccagtgactt

SEQ ID NO: 739418 - DNA, 25 bp, Mus musculus
gtttcttagcacatacggatgtcag

SEQ ID NO: 739419 - DNA, 25 bp, Mus musculus
gtttcttagcacttacggatgtcag

SEQ ID NO: 739420 - DNA, 25 bp, Mus musculus
gtttcttagggaaatcactctcatg

SEQ ID NO: 739421 - DNA, 25 bp, Mus musculus
gtttcttagggatatcactctcatg

SEQ ID NO: 739422 - DNA, 25 bp, Mus musculus
gtttcttagggtaccatgtagctca

SEQ ID NO: 739423 - DNA, 25 bp, Mus musculus
gtttcttagggttccatgtagctca

SEQ ID NO: 739424 - DNA, 25 bp, Mus musculus
gtttcttagtgcacttcacaagcaa

SEQ ID NO: 739425 - DNA, 25 bp, Mus musculus
gtttcttagtgctcttcacaagcaa

SEQ ID NO: 739426 - DNA, 25 bp, Mus musculus
gtttcttagtggcaaaacgcctttg

SEQ ID NO: 739427 - DNA, 25 bp, Mus musculus
gtttcttagtgggaaaacgcctttg

SEQ ID NO: 739428 - DNA, 25 bp, Mus musculus
gtttcttataaccatcgcagtcttt

SEQ ID NO: 739429 - DNA, 25 bp, Mus musculus
gtttcttataacgatcgcagtcttt

SEQ ID NO: 739430 - DNA, 25 bp, Mus musculus
gtttcttatactatgtgtgggatct

SEQ ID NO: 739431 - DNA, 25 bp, Mus musculus
gtttcttatactttgtgtgggatct

SEQ ID NO: 739432 - DNA, 25 bp, Mus musculus
gtttcttatatacgcacaccagtta

SEQ ID NO: 739433 - DNA, 25 bp, Mus musculus
gtttcttatataggcacaccagtta

SEQ ID NO: 739434 - DNA, 25 bp, Mus musculus
gtttcttatctacagcttgaccaca

SEQ ID NO: 739435 - DNA, 25 bp, Mus musculus
gtttcttatctagagcttgaccaca

SEQ ID NO: 739436 - DNA, 25 bp, Mus musculus
gtttcttatctcattctggcaattg

SEQ ID NO: 739437 - DNA, 25 bp, Mus musculus
gtttcttatctctttctggcaattg

SEQ ID NO: 739438 - DNA, 25 bp, Mus musculus
gtttcttatgggagacaggcctgca

SEQ ID NO: 739439 - DNA, 25 bp, Mus musculus
gtttcttatgggtgacaggcctgca

SEQ ID NO: 739440 - DNA, 25 bp, Mus musculus
gtttcttatttaattagccgtgttg

SEQ ID NO: 739441 - DNA, 25 bp, Mus musculus
gtttcttatttatttagccgtgttg

SEQ ID NO: 739442 - DNA, 25 bp, Mus musculus
gtttcttcaaaaacatccccagaac

SEQ ID NO: 739443 - DNA, 25 bp, Mus musculus
gtttcttcaaaaccaatgacactgc

SEQ ID NO: 739444 - DNA, 25 bp, Mus musculus
gtttcttcaaaagcaatgacactgc

SEQ ID NO: 739445 - DNA, 25 bp, Mus musculus
gtttcttcaaaatcatccccagaac

SEQ ID NO: 739446 - DNA, 25 bp, Mus musculus
gtttcttcaaacctccatttgttga

SEQ ID NO: 739447 - DNA, 25 bp, Mus musculus
gtttcttcaaacctttcttgatggt

SEQ ID NO: 739448 - DNA, 25 bp, Mus musculus
gtttcttcaaacgtccatttgttga

SEQ ID NO: 739449 - DNA, 25 bp, Mus musculus
gtttcttcaaacgtttcttgatggt

SEQ ID NO: 739450 - DNA, 25 bp, Mus musculus
gtttcttcacagcaaaatcccagag

SEQ ID NO: 739451 - DNA, 25 bp, Mus musculus
gtttcttcacaggaaaatcccagag

SEQ ID NO: 739452 - DNA, 25 bp, Mus musculus
gtttcttcagaactcaccttacttg

SEQ ID NO: 739453 - DNA, 25 bp, Mus musculus
gtttcttcagaagtcaccttacttg

SEQ ID NO: 739454 - DNA, 25 bp, Mus musculus
gtttcttcaggcaaaccagactgtt

SEQ ID NO: 739455 - DNA, 25 bp, Mus musculus
gtttcttcaggctaaccagactgtt

SEQ ID NO: 739456 - DNA, 25 bp, Mus musculus
gtttcttcagttagcacgaacctca

SEQ ID NO: 739457 - DNA, 25 bp, Mus musculus
gtttcttcagtttgcacgaacctca

SEQ ID NO: 739458 - DNA, 25 bp, Mus musculus
gtttcttcatgacattattgtgggt

SEQ ID NO: 739459 - DNA, 25 bp, Mus musculus
gtttcttcatgagattattgtgggt

SEQ ID NO: 739460 - DNA, 25 bp, Mus musculus
gtttcttcatgcctgaatacttcag

SEQ ID NO: 739461 - DNA, 25 bp, Mus musculus
gtttcttcatgcgtgaatacttcag

SEQ ID NO: 739462 - DNA, 25 bp, Mus musculus
gtttcttcattaagagtgctgtgat

SEQ ID NO: 739463 - DNA, 25 bp, Mus musculus
gtttcttcattatgagtgctgtgat

SEQ ID NO: 739464 - DNA, 25 bp, Mus musculus
gtttcttcattgatcaagcctttcc

SEQ ID NO: 739465 - DNA, 25 bp, Mus musculus
gtttcttcattgttcaagcctttcc

SEQ ID NO: 739466 - DNA, 25 bp, Mus musculus
gtttcttccacaagctatctctatt

SEQ ID NO: 739467 - DNA, 25 bp, Mus musculus
gtttcttccacatgctatctctatt

SEQ ID NO: 739468 - DNA, 25 bp, Mus musculus
gtttcttccagtcaagacatccttc

SEQ ID NO: 739469 - DNA, 25 bp, Mus musculus
gtttcttccagtgaagacatccttc

SEQ ID NO: 739470 - DNA, 25 bp, Mus musculus
gtttcttcccatatgaagcctctgt

SEQ ID NO: 739471 - DNA, 25 bp, Mus musculus
gtttcttcccatttgaagcctctgt

SEQ ID NO: 739472 - DNA, 25 bp, Mus musculus
gtttcttccctgaaacaaatctgat

SEQ ID NO: 739473 - DNA, 25 bp, Mus musculus
gtttcttccctgtaacaaatctgat

SEQ ID NO: 739474 - DNA, 25 bp, Mus musculus
gtttcttcctcacttgacatttcct

SEQ ID NO: 739475 - DNA, 25 bp, Mus musculus
gtttcttcctcagttgacatttcct

SEQ ID NO: 739476 - DNA, 25 bp, Mus musculus
gtttcttcctttatccaggagcatg

SEQ ID NO: 739477 - DNA, 25 bp, Mus musculus
gtttcttcctttttccaggagcatg

SEQ ID NO: 739478 - DNA, 25 bp, Mus musculus
gtttcttcgctaaacttaactatat

SEQ ID NO: 739479 - DNA, 25 bp, Mus musculus
gtttcttcgctatacttaactatat

SEQ ID NO: 739480 - DNA, 25 bp, Mus musculus
gtttcttctaacacttctgactcag

SEQ ID NO: 739481 - DNA, 25 bp, Mus musculus
gtttcttctaactcttctgactcag

SEQ ID NO: 739482 - DNA, 25 bp, Mus musculus
gtttcttctataaccatgcacagag

SEQ ID NO: 739483 - DNA, 25 bp, Mus musculus
gtttcttctatatccatgcacagag

SEQ ID NO: 739484 - DNA, 25 bp, Mus musculus
gtttcttctccaccccttgcagctg

SEQ ID NO: 739485 - DNA, 25 bp, Mus musculus
gtttcttctccagcccttgcagctg

SEQ ID NO: 739486 - DNA, 25 bp, Mus musculus
gtttcttctcctcttaaaagtctag

SEQ ID NO: 739487 - DNA, 25 bp, Mus musculus
gtttcttctcctgttaaaagtctag

SEQ ID NO: 739488 - DNA, 25 bp, Mus musculus
gtttcttctgctccccttagtttga

SEQ ID NO: 739489 - DNA, 25 bp, Mus musculus
gtttcttctgctgcccttagtttga

SEQ ID NO: 739490 - DNA, 25 bp, Mus musculus
gtttcttctggcaagggctatggca

SEQ ID NO: 739491 - DNA, 25 bp, Mus musculus
gtttcttctggctagggctatggca

SEQ ID NO: 739492 - DNA, 25 bp, Mus musculus
gtttcttctgttctgcactttggag

SEQ ID NO: 739493 - DNA, 25 bp, Mus musculus
gtttcttctgttgtgcactttggag

SEQ ID NO: 739494 - DNA, 25 bp, Mus musculus
gtttcttcttggctatgatcattgt

SEQ ID NO: 739495 - DNA, 25 bp, Mus musculus
gtttcttcttgggtatgatcattgt

SEQ ID NO: 739496 - DNA, 25 bp, Mus musculus
gtttcttctttgaacgactggaatc

SEQ ID NO: 739497 - DNA, 25 bp, Mus musculus
gtttcttctttgtacgactggaatc

SEQ ID NO: 739498 - DNA, 25 bp, Mus musculus
gtttcttcttttatgaccgctgtga

SEQ ID NO: 739499 - DNA, 25 bp, Mus musculus
gtttcttcttttttgaccgctgtga

SEQ ID NO: 739500 - DNA, 25 bp, Mus musculus
gtttcttgaagacgtcctttgctcc

SEQ ID NO: 739501 - DNA, 25 bp, Mus musculus
gtttcttgaagaggtcctttgctcc

SEQ ID NO: 739502 - DNA, 25 bp, Mus musculus
gtttcttgacttcatctacggtata

SEQ ID NO: 739503 - DNA, 25 bp, Mus musculus
gtttcttgacttgatctacggtata

SEQ ID NO: 739504 - DNA, 25 bp, Mus musculus
gtttcttgataaccagtctccaaca

SEQ ID NO: 739505 - DNA, 25 bp, Mus musculus
gtttcttgataagcagtctccaaca

SEQ ID NO: 739506 - DNA, 25 bp, Mus musculus
gtttcttgattcagaccctgtatac

SEQ ID NO: 739507 - DNA, 25 bp, Mus musculus
gtttcttgattctgaccctgtatac

SEQ ID NO: 739508 - DNA, 25 bp, Mus musculus
gtttcttgccctatggttctaaatg

SEQ ID NO: 739509 - DNA, 25 bp, Mus musculus
gtttcttgccctttggttctaaatg

SEQ ID NO: 739510 - DNA, 25 bp, Mus musculus
gtttcttgccggacagcaagtgact

SEQ ID NO: 739511 - DNA, 25 bp, Mus musculus
gtttcttgccggtcagcaagtgact

SEQ ID NO: 739512 - DNA, 25 bp, Mus musculus
gtttcttgcctaccaaacgaagctt

SEQ ID NO: 739513 - DNA, 25 bp, Mus musculus
gtttcttgcctagcaaacgaagctt

SEQ ID NO: 739514 - DNA, 25 bp, Mus musculus
gtttcttgccttcgatctttgggcc

SEQ ID NO: 739515 - DNA, 25 bp, Mus musculus
gtttcttgccttggatctttgggcc

SEQ ID NO: 739516 - DNA, 25 bp, Mus musculus
gtttcttgctgcagtaacttaccag

SEQ ID NO: 739517 - DNA, 25 bp, Mus musculus
gtttcttgctgcatttagtcagatt

SEQ ID NO: 739518 - DNA, 25 bp, Mus musculus
gtttcttgctgctgtaacttaccag

SEQ ID NO: 739519 - DNA, 25 bp, Mus musculus
gtttcttgctgcttttagtcagatt

SEQ ID NO: 739520 - DNA, 25 bp, Mus musculus
gtttcttggaaacaggcctcaccta

SEQ ID NO: 739521 - DNA, 25 bp, Mus musculus
gtttcttggaaagaggcctcaccta

SEQ ID NO: 739522 - DNA, 25 bp, Mus musculus
gtttcttggagcagggaatcatcta

SEQ ID NO: 739523 - DNA, 25 bp, Mus musculus
gtttcttggagctgggaatcatcta

SEQ ID NO: 739524 - DNA, 25 bp, Mus musculus
gtttcttggatgaggctgcagccac

SEQ ID NO: 739525 - DNA, 25 bp, Mus musculus
gtttcttggatgtggctgcagccac

SEQ ID NO: 739526 - DNA, 25 bp, Mus musculus
gtttcttggctgaagatgacaatgt

SEQ ID NO: 739527 - DNA, 25 bp, Mus musculus
gtttcttggctgtagatgacaatgt

SEQ ID NO: 739528 - DNA, 25 bp, Mus musculus
gtttcttggtaaacttcacctgcca

SEQ ID NO: 739529 - DNA, 25 bp, Mus musculus
gtttcttggtaatcttcacctgcca

SEQ ID NO: 739530 - DNA, 25 bp, Mus musculus
gtttcttgtatcctggctgatgtat

SEQ ID NO: 739531 - DNA, 25 bp, Mus musculus
gtttcttgtatcgtggctgatgtat

SEQ ID NO: 739532 - DNA, 25 bp, Mus musculus
gtttcttgtcaactctcagagtctg

SEQ ID NO: 739533 - DNA, 25 bp, Mus musculus
gtttcttgtcaagtctcagagtctg

SEQ ID NO: 739534 - DNA, 25 bp, Mus musculus
gtttcttgtctcatcacaggatccc

SEQ ID NO: 739535 - DNA, 25 bp, Mus musculus
gtttcttgtctcttcacaggatccc

SEQ ID NO: 739536 - DNA, 25 bp, Mus musculus
gtttcttgtcttcgattgtgttctc

SEQ ID NO: 739537 - DNA, 25 bp, Mus musculus
gtttcttgtcttggattgtgttctc

SEQ ID NO: 739538 - DNA, 25 bp, Mus musculus
gtttcttgtgtgagtgagctttgtc

SEQ ID NO: 739539 - DNA, 25 bp, Mus musculus
gtttcttgtgtgtgtgagctttgtc

SEQ ID NO: 739540 - DNA, 25 bp, Mus musculus
gtttcttgttacactaagagacatc

SEQ ID NO: 739541 - DNA, 25 bp, Mus musculus
gtttcttgttactctaagagacatc

SEQ ID NO: 739542 - DNA, 25 bp, Mus musculus
gtttcttgttatcctacaaagttga

SEQ ID NO: 739543 - DNA, 25 bp, Mus musculus
gtttcttgttatcctgcacttttta

SEQ ID NO: 739544 - DNA, 25 bp, Mus musculus
gtttcttgttatgctacaaagttga

SEQ ID NO: 739545 - DNA, 25 bp, Mus musculus
gtttcttgttatgctgcacttttta

SEQ ID NO: 739546 - DNA, 25 bp, Mus musculus
gtttcttgttttcggcaccatggaa

SEQ ID NO: 739547 - DNA, 25 bp, Mus musculus
gtttcttgttttgggcaccatggaa

SEQ ID NO: 739548 - DNA, 25 bp, Mus musculus
gtttctttaaatactatccctgtgg

SEQ ID NO: 739549 - DNA, 25 bp, Mus musculus
gtttctttaaattctatccctgtgg

SEQ ID NO: 739550 - DNA, 25 bp, Mus musculus
gtttctttaactcctatatttatgg

SEQ ID NO: 739551 - DNA, 25 bp, Mus musculus
gtttctttaactcggagacacactg

SEQ ID NO: 739552 - DNA, 25 bp, Mus musculus
gtttctttaactgctatatttatgg

SEQ ID NO: 739553 - DNA, 25 bp, Mus musculus
gtttctttaactgggagacacactg

SEQ ID NO: 739554 - DNA, 25 bp, Mus musculus
gtttctttaagtcaatgctaataca

SEQ ID NO: 739555 - DNA, 25 bp, Mus musculus
gtttctttaagtgaatgctaataca

SEQ ID NO: 739556 - DNA, 25 bp, Mus musculus
gtttctttacccattgaagatttct

SEQ ID NO: 739557 - DNA, 25 bp, Mus musculus
gtttctttaccctttgaagatttct

SEQ ID NO: 739558 - DNA, 25 bp, Mus musculus
gtttctttataaagcctcctggtga

SEQ ID NO: 739559 - DNA, 25 bp, Mus musculus
gtttctttataatgcctcctggtga

SEQ ID NO: 739560 - DNA, 25 bp, Mus musculus
gtttctttcaaaaacattatccggt

SEQ ID NO: 739561 - DNA, 25 bp, Mus musculus
gtttctttcaaatacattatccggt

SEQ ID NO: 739562 - DNA, 25 bp, Mus musculus
gtttctttcagaatgtggccatgct

SEQ ID NO: 739563 - DNA, 25 bp, Mus musculus
gtttctttcagattgtggccatgct

SEQ ID NO: 739564 - DNA, 25 bp, Mus musculus
gtttctttcagtcagagacatcatt

SEQ ID NO: 739565 - DNA, 25 bp, Mus musculus
gtttctttcagtgagagacatcatt

SEQ ID NO: 739566 - DNA, 25 bp, Mus musculus
gtttctttcatcagtacacgacgca

SEQ ID NO: 739567 - DNA, 25 bp, Mus musculus
gtttctttcatctgtacacgacgca

SEQ ID NO: 739568 - DNA, 25 bp, Mus musculus
gtttctttcatgaagtgaggacagt

SEQ ID NO: 739569 - DNA, 25 bp, Mus musculus
gtttctttcatgtagtgaggacagt

SEQ ID NO: 739570 - DNA, 25 bp, Mus musculus
gtttctttcccacttgatgctttta

SEQ ID NO: 739571 - DNA, 25 bp, Mus musculus
gtttctttcccagttgatgctttta

SEQ ID NO: 739572 - DNA, 25 bp, Mus musculus
gtttctttccctcagataggagtgt

SEQ ID NO: 739573 - DNA, 25 bp, Mus musculus
gtttctttccctgagataggagtgt

SEQ ID NO: 739574 - DNA, 25 bp, Mus musculus
gtttctttcctcagtatgacaagat

SEQ ID NO: 739575 - DNA, 25 bp, Mus musculus
gtttctttcctctgtatgacaagat

SEQ ID NO: 739576 - DNA, 25 bp, Mus musculus
gtttctttctagcactttttgctca

SEQ ID NO: 739577 - DNA, 25 bp, Mus musculus
gtttctttctaggactttttgctca

SEQ ID NO: 739578 - DNA, 25 bp, Mus musculus
gtttctttctcacactaccatagca

SEQ ID NO: 739579 - DNA, 25 bp, Mus musculus
gtttctttctcagactaccatagca

SEQ ID NO: 739580 - DNA, 25 bp, Mus musculus
gtttctttctctattttgttctcac

SEQ ID NO: 739581 - DNA, 25 bp, Mus musculus
gtttctttctcttttttgttctcac

SEQ ID NO: 739582 - DNA, 25 bp, Mus musculus
gtttctttcttgaggtttgattctt

SEQ ID NO: 739583 - DNA, 25 bp, Mus musculus
gtttctttcttgtggtttgattctt

SEQ ID NO: 739584 - DNA, 25 bp, Mus musculus
gtttctttctttacactagctggat

SEQ ID NO: 739585 - DNA, 25 bp, Mus musculus
gtttctttctttcacgaaccacctg

SEQ ID NO: 739586 - DNA, 25 bp, Mus musculus
gtttctttctttccaatcaatagct

SEQ ID NO: 739587 - DNA, 25 bp, Mus musculus
gtttctttctttgacgaaccacctg

SEQ ID NO: 739588 - DNA, 25 bp, Mus musculus
gtttctttctttgcaatcaatagct

SEQ ID NO: 739589 - DNA, 25 bp, Mus musculus
gtttctttcttttcactagctggat

SEQ ID NO: 739590 - DNA, 25 bp, Mus musculus
gtttctttgaccaattgttaactga

SEQ ID NO: 739591 - DNA, 25 bp, Mus musculus
gtttctttgacctattgttaactga

SEQ ID NO: 739592 - DNA, 25 bp, Mus musculus
gtttctttgagtcctcgaagccgaa

SEQ ID NO: 739593 - DNA, 25 bp, Mus musculus
gtttctttgagtgctcgaagccgaa

SEQ ID NO: 739594 - DNA, 25 bp, Mus musculus
gtttctttgcggaaatccaggcaat

SEQ ID NO: 739595 - DNA, 25 bp, Mus musculus
gtttctttgcggtaatccaggcaat

SEQ ID NO: 739596 - DNA, 25 bp, Mus musculus
gtttctttggatcccagcgctactg

SEQ ID NO: 739597 - DNA, 25 bp, Mus musculus
gtttctttggatgccagcgctactg

SEQ ID NO: 739598 - DNA, 25 bp, Mus musculus
gtttctttgggacctgcgagcgaca

SEQ ID NO: 739599 - DNA, 25 bp, Mus musculus
gtttctttgggagctgcgagcgaca

SEQ ID NO: 739600 - DNA, 25 bp, Mus musculus
gtttctttgtagcacctgtcctgga

SEQ ID NO: 739601 - DNA, 25 bp, Mus musculus
gtttctttgtaggacctgtcctgga

SEQ ID NO: 739602 - DNA, 25 bp, Mus musculus
gtttctttgtctatcacactttgat

SEQ ID NO: 739603 - DNA, 25 bp, Mus musculus
gtttctttgtctttcacactttgat

SEQ ID NO: 739604 - DNA, 25 bp, Mus musculus
gtttctttgtgtccaccttggtgca

SEQ ID NO: 739605 - DNA, 25 bp, Mus musculus
gtttctttgtgtgcaccttggtgca

SEQ ID NO: 739606 - DNA, 25 bp, Mus musculus
gtttctttgttcattactgaccaga

SEQ ID NO: 739607 - DNA, 25 bp, Mus musculus
gtttctttgttctttactgaccaga

SEQ ID NO: 739608 - DNA, 25 bp, Mus musculus
gtttctttgtttcagattgtcagct

SEQ ID NO: 739609 - DNA, 25 bp, Mus musculus
gtttctttgtttgagattgtcagct

SEQ ID NO: 739610 - DNA, 25 bp, Mus musculus
gtttcttttagcctaaagcatcgtt

SEQ ID NO: 739611 - DNA, 25 bp, Mus musculus
gtttcttttagcgtaaagcatcgtt

SEQ ID NO: 739612 - DNA, 25 bp, Mus musculus
gtttcttttcaacgatgtgtctgac

SEQ ID NO: 739613 - DNA, 25 bp, Mus musculus
gtttcttttcaaggatgtgtctgac

SEQ ID NO: 739614 - DNA, 25 bp, Mus musculus
gtttcttttcagagttctgcaaaat

SEQ ID NO: 739615 - DNA, 25 bp, Mus musculus
gtttcttttcagtgttctgcaaaat

SEQ ID NO: 739616 - DNA, 25 bp, Mus musculus
gtttcttttccacttgtgtggtatc

SEQ ID NO: 739617 - DNA, 25 bp, Mus musculus
gtttcttttccagttgtgtggtatc

SEQ ID NO: 739618 - DNA, 25 bp, Mus musculus
gtttcttttcgtcctgtctgaaagg

SEQ ID NO: 739619 - DNA, 25 bp, Mus musculus
gtttcttttcgtgctgtctgaaagg

SEQ ID NO: 739620 - DNA, 25 bp, Mus musculus
gtttcttttcttctgacatgggtct

SEQ ID NO: 739621 - DNA, 25 bp, Mus musculus
gtttcttttcttgtgacatgggtct

SEQ ID NO: 739622 - DNA, 25 bp, Mus musculus
gtttcttttgctaactggataccat

SEQ ID NO: 739623 - DNA, 25 bp, Mus musculus
gtttcttttgcttactggataccat

SEQ ID NO: 739624 - DNA, 25 bp, Mus musculus
gtttcttttggcagcagggtcttcc

SEQ ID NO: 739625 - DNA, 25 bp, Mus musculus
gtttcttttggctgcagggtcttcc

SEQ ID NO: 739626 - DNA, 25 bp, Mus musculus
gtttctttttacacttgcttgccca

SEQ ID NO: 739627 - DNA, 25 bp, Mus musculus
gtttctttttactcttgcttgccca

SEQ ID NO: 739628 - DNA, 25 bp, Mus musculus
gtttctttttcacttatggtgatca

SEQ ID NO: 739629 - DNA, 25 bp, Mus musculus
gtttctttttcagttatggtgatca

SEQ ID NO: 739630 - DNA, 25 bp, Mus musculus
gtttctttttgaacattttctcggt

SEQ ID NO: 739631 - DNA, 25 bp, Mus musculus
gtttctttttgatcattttctcggt

SEQ ID NO: 739632 - DNA, 25 bp, Mus musculus
gtttcttttttcctatgtatgccaa

SEQ ID NO: 739633 - DNA, 25 bp, Mus musculus
gtttcttttttcgtatgtatgccaa

SEQ ID NO: 739634 - DNA, 25 bp, Mus musculus
gtttcttttttgcacacacacctag

SEQ ID NO: 739635 - DNA, 25 bp, Mus musculus
gtttcttttttggacacacacctag

SEQ ID NO: 739636 - DNA, 25 bp, Mus musculus
gtttgaaaacttaatagccaccctg

SEQ ID NO: 739637 - DNA, 25 bp, Mus musculus
gtttgaaaactttatagccaccctg

SEQ ID NO: 739638 - DNA, 25 bp, Mus musculus
gtttgaaaatccatggtccttctcc

SEQ ID NO: 739639 - DNA, 25 bp, Mus musculus
gtttgaaaatccttggtccttctcc

SEQ ID NO: 739640 - DNA, 25 bp, Mus musculus
gtttgaaacaagagcagccaagctc

SEQ ID NO: 739641 - DNA, 25 bp, Mus musculus
gtttgaaacaagagctgccaagttg

SEQ ID NO: 739642 - DNA, 25 bp, Mus musculus
gtttgaaacaagtgcagccaagctc

SEQ ID NO: 739643 - DNA, 25 bp, Mus musculus
gtttgaaacaagtgctgccaagttg

SEQ ID NO: 739644 - DNA, 25 bp, Mus musculus
gtttgaaacccaatgtgtatcaggg

SEQ ID NO: 739645 - DNA, 25 bp, Mus musculus
gtttgaaacccattgtgtatcaggg

SEQ ID NO: 739646 - DNA, 25 bp, Mus musculus
gtttgaaactcaactttgtcatctt

SEQ ID NO: 739647 - DNA, 25 bp, Mus musculus
gtttgaaactcatctttgtcatctt

SEQ ID NO: 739648 - DNA, 25 bp, Mus musculus
gtttgaaactgcactttgtggactt

SEQ ID NO: 739649 - DNA, 25 bp, Mus musculus
gtttgaaactgctctttgtggactt

SEQ ID NO: 739650 - DNA, 25 bp, Mus musculus
gtttgaaagaggacccctggagcgt

SEQ ID NO: 739651 - DNA, 25 bp, Mus musculus
gtttgaaagaggtcccctggagcgt

SEQ ID NO: 739652 - DNA, 25 bp, Mus musculus
gtttgaaagcctatgcgtgcaaaag

SEQ ID NO: 739653 - DNA, 25 bp, Mus musculus
gtttgaaagcctttgcgtgcaaaag

SEQ ID NO: 739654 - DNA, 25 bp, Mus musculus
gtttgaaagctacagcccagccaga

SEQ ID NO: 739655 - DNA, 25 bp, Mus musculus
gtttgaaagctagagcccagccaga

SEQ ID NO: 739656 - DNA, 25 bp, Mus musculus
gtttgaaagctcattgacctcctca

SEQ ID NO: 739657 - DNA, 25 bp, Mus musculus
gtttgaaagctctttgacctcctca

SEQ ID NO: 739658 - DNA, 25 bp, Mus musculus
gtttgaaagtcaacactcatactag

SEQ ID NO: 739659 - DNA, 25 bp, Mus musculus
gtttgaaagtcatcactcatactag

SEQ ID NO: 739660 - DNA, 25 bp, Mus musculus
gtttgaaatctccacggctgtagca

SEQ ID NO: 739661 - DNA, 25 bp, Mus musculus
gtttgaaatctcgacggctgtagca

SEQ ID NO: 739662 - DNA, 25 bp, Mus musculus
gtttgaaatggacatcgatgatgag

SEQ ID NO: 739663 - DNA, 25 bp, Mus musculus
gtttgaaatggagatcgatgatgag

SEQ ID NO: 739664 - DNA, 25 bp, Mus musculus
gtttgaacaagtagcaagctagcca

SEQ ID NO: 739665 - DNA, 25 bp, Mus musculus
gtttgaacaagttgcaagctagcca

SEQ ID NO: 739666 - DNA, 25 bp, Mus musculus
gtttgaacaatgcagggcctcctgg

SEQ ID NO: 739667 - DNA, 25 bp, Mus musculus
gtttgaacaatggagggcctcctgg

SEQ ID NO: 739668 - DNA, 25 bp, Mus musculus
gtttgaacacacatcacaagcttga

SEQ ID NO: 739669 - DNA, 25 bp, Mus musculus
gtttgaacacacttcacaagcttga

SEQ ID NO: 739670 - DNA, 25 bp, Mus musculus
gtttgaacagctatctgaatctgca

SEQ ID NO: 739671 - DNA, 25 bp, Mus musculus
gtttgaacagctttctgaatctgca

SEQ ID NO: 739672 - DNA, 25 bp, Mus musculus
gtttgaacaggcatgcacttgcaca

SEQ ID NO: 739673 - DNA, 25 bp, Mus musculus
gtttgaacaggcttgcacttgcaca

SEQ ID NO: 739674 - DNA, 25 bp, Mus musculus
gtttgaacatctcacacttggaaaa

SEQ ID NO: 739675 - DNA, 25 bp, Mus musculus
gtttgaacatctgacacttggaaaa

SEQ ID NO: 739676 - DNA, 25 bp, Mus musculus
gtttgaaccattctgggctacttga

SEQ ID NO: 739677 - DNA, 25 bp, Mus musculus
gtttgaaccattgtgggctacttga

SEQ ID NO: 739678 - DNA, 25 bp, Mus musculus
gtttgaacccaaatctggctggctg

SEQ ID NO: 739679 - DNA, 25 bp, Mus musculus
gtttgaacccaattctggctggctg

SEQ ID NO: 739680 - DNA, 25 bp, Mus musculus
gtttgaacccttactgtgggacttg

SEQ ID NO: 739681 - DNA, 25 bp, Mus musculus
gtttgaaccctttctgtgggacttg

SEQ ID NO: 739682 - DNA, 25 bp, Mus musculus
gtttgaacctgcacattctctagta

SEQ ID NO: 739683 - DNA, 25 bp, Mus musculus
gtttgaacctgctcattctctagta

SEQ ID NO: 739684 - DNA, 25 bp, Mus musculus
gtttgaacgaggctcaactttcatc

SEQ ID NO: 739685 - DNA, 25 bp, Mus musculus
gtttgaacgagggtcaactttcatc

SEQ ID NO: 739686 - DNA, 25 bp, Mus musculus
gtttgaactcagagccctgggtaag

SEQ ID NO: 739687 - DNA, 25 bp, Mus musculus
gtttgaactcagctccaggtgtatg

SEQ ID NO: 739688 - DNA, 25 bp, Mus musculus
gtttgaactcaggtccaggtgtatg

SEQ ID NO: 739689 - DNA, 25 bp, Mus musculus
gtttgaactcagtgccctgggtaag

SEQ ID NO: 739690 - DNA, 25 bp, Mus musculus
gtttgaactgagagagcttgggcca

SEQ ID NO: 739691 - DNA, 25 bp, Mus musculus
gtttgaactgagtgagcttgggcca

SEQ ID NO: 739692 - DNA, 25 bp, Mus musculus
gtttgaactgctcatgtgatacaca

SEQ ID NO: 739693 - DNA, 25 bp, Mus musculus
gtttgaactgctgatgtgatacaca

SEQ ID NO: 739694 - DNA, 25 bp, Mus musculus
gtttgaacttgtaaagtgtctagca

SEQ ID NO: 739695 - DNA, 25 bp, Mus musculus
gtttgaacttgttaagtgtctagca

SEQ ID NO: 739696 - DNA, 25 bp, Mus musculus
gtttgaacttttctcatttttgtgg

SEQ ID NO: 739697 - DNA, 25 bp, Mus musculus
gtttgaacttttgtcatttttgtgg

SEQ ID NO: 739698 - DNA, 25 bp, Mus musculus
gtttgaagactaccctacagtactt

SEQ ID NO: 739699 - DNA, 25 bp, Mus musculus
gtttgaagactagcctacagtactt

SEQ ID NO: 739700 - DNA, 25 bp, Mus musculus
gtttgaagagaacccgcagccctgt

SEQ ID NO: 739701 - DNA, 25 bp, Mus musculus
gtttgaagagaagccgcagccctgt

SEQ ID NO: 739702 - DNA, 25 bp, Mus musculus
gtttgaagagcgattgcctcctcac

SEQ ID NO: 739703 - DNA, 25 bp, Mus musculus
gtttgaagagcgtttgcctcctcac

SEQ ID NO: 739704 - DNA, 25 bp, Mus musculus
gtttgaagagctctttccagattgg

SEQ ID NO: 739705 - DNA, 25 bp, Mus musculus
gtttgaagagctgtttccagattgg

SEQ ID NO: 739706 - DNA, 25 bp, Mus musculus
gtttgaagataactttaggccagat

SEQ ID NO: 739707 - DNA, 25 bp, Mus musculus
gtttgaagataagtttaggccagat

SEQ ID NO: 739708 - DNA, 25 bp, Mus musculus
gtttgaagatttcctcagagtggct

SEQ ID NO: 739709 - DNA, 25 bp, Mus musculus
gtttgaagatttgctcagagtggct

SEQ ID NO: 739710 - DNA, 25 bp, Mus musculus
gtttgaagccataatagcctataca

SEQ ID NO: 739711 - DNA, 25 bp, Mus musculus
gtttgaagccattatagcctataca

SEQ ID NO: 739712 - DNA, 25 bp, Mus musculus
gtttgaagcctactgacttttaatt

SEQ ID NO: 739713 - DNA, 25 bp, Mus musculus
gtttgaagcctagtgacttttaatt

SEQ ID NO: 739714 - DNA, 25 bp, Mus musculus
gtttgaagcgacagcagtctccagt

SEQ ID NO: 739715 - DNA, 25 bp, Mus musculus
gtttgaagcgactgcagtctccagt

SEQ ID NO: 739716 - DNA, 25 bp, Mus musculus
gtttgaagcgataccacgggcactg

SEQ ID NO: 739717 - DNA, 25 bp, Mus musculus
gtttgaagcgattccacgggcactg

SEQ ID NO: 739718 - DNA, 25 bp, Mus musculus
gtttgaagctggactttctttctgt

SEQ ID NO: 739719 - DNA, 25 bp, Mus musculus
gtttgaagctggtctttctttctgt

SEQ ID NO: 739720 - DNA, 25 bp, Mus musculus
gtttgaagcttaatttgcccctcaa

SEQ ID NO: 739721 - DNA, 25 bp, Mus musculus
gtttgaagcttattttgcccctcaa

SEQ ID NO: 739722 - DNA, 25 bp, Mus musculus
gtttgaaggccaaaattagatcata

SEQ ID NO: 739723 - DNA, 25 bp, Mus musculus
gtttgaaggccataattagatcata

SEQ ID NO: 739724 - DNA, 25 bp, Mus musculus
gtttgaagggttaacctgttgagct

SEQ ID NO: 739725 - DNA, 25 bp, Mus musculus
gtttgaagggtttacctgttgagct

SEQ ID NO: 739726 - DNA, 25 bp, Mus musculus
gtttgaagtcggcatccactttgcc

SEQ ID NO: 739727 - DNA, 25 bp, Mus musculus
gtttgaagtcgggatccactttgcc

SEQ ID NO: 739728 - DNA, 25 bp, Mus musculus
gtttgaagtgtaccacatctccagc

SEQ ID NO: 739729 - DNA, 25 bp, Mus musculus
gtttgaagtgtagcacatctccagc

SEQ ID NO: 739730 - DNA, 25 bp, Mus musculus
gtttgaatactcatgggatatcagg

SEQ ID NO: 739731 - DNA, 25 bp, Mus musculus
gtttgaatactcttgggatatcagg

SEQ ID NO: 739732 - DNA, 25 bp, Mus musculus
gtttgaatagccaaccacccacaga

SEQ ID NO: 739733 - DNA, 25 bp, Mus musculus
gtttgaatagcctaccacccacaga

SEQ ID NO: 739734 - DNA, 25 bp, Mus musculus
gtttgaatagctatggccccattgt

SEQ ID NO: 739735 - DNA, 25 bp, Mus musculus
gtttgaatagctttggccccattgt

SEQ ID NO: 739736 - DNA, 25 bp, Mus musculus
gtttgaatagtgactcctacaagag

SEQ ID NO: 739737 - DNA, 25 bp, Mus musculus
gtttgaatagtgtctcctacaagag

SEQ ID NO: 739738 - DNA, 25 bp, Mus musculus
gtttgaatagttccttccatcccat

SEQ ID NO: 739739 - DNA, 25 bp, Mus musculus
gtttgaatagttgcttccatcccat

SEQ ID NO: 739740 - DNA, 25 bp, Mus musculus
gtttgaatcaagacaatcaagtgaa

SEQ ID NO: 739741 - DNA, 25 bp, Mus musculus
gtttgaatcaagtcaatcaagtgaa

SEQ ID NO: 739742 - DNA, 25 bp, Mus musculus
gtttgaatccatctcctggcaacag

SEQ ID NO: 739743 - DNA, 25 bp, Mus musculus
gtttgaatccatgtcctggcaacag

SEQ ID NO: 739744 - DNA, 25 bp, Mus musculus
gtttgaatcccaacccctacaggat

SEQ ID NO: 739745 - DNA, 25 bp, Mus musculus
gtttgaatcccatcccctacaggat

SEQ ID NO: 739746 - DNA, 25 bp, Mus musculus
gtttgaatccccacagcacacataa

SEQ ID NO: 739747 - DNA, 25 bp, Mus musculus
gtttgaatcccctcagcacacataa

SEQ ID NO: 739748 - DNA, 25 bp, Mus musculus
gtttgaatcctaacaaccacatgga

SEQ ID NO: 739749 - DNA, 25 bp, Mus musculus
gtttgaatcctatcaaccacatgga

SEQ ID NO: 739750 - DNA, 25 bp, Mus musculus
gtttgaatctctctactcatgtaga

SEQ ID NO: 739751 - DNA, 25 bp, Mus musculus
gtttgaatctctgtactcatgtaga

SEQ ID NO: 739752 - DNA, 25 bp, Mus musculus
gtttgaatgtgcagttctactcgaa

SEQ ID NO: 739753 - DNA, 25 bp, Mus musculus
gtttgaatgtgctgttctactcgaa

SEQ ID NO: 739754 - DNA, 25 bp, Mus musculus
gtttgaattatcatcgccgttcttt

SEQ ID NO: 739755 - DNA, 25 bp, Mus musculus
gtttgaattatcttcgccgttcttt

SEQ ID NO: 739756 - DNA, 25 bp, Mus musculus
gtttgaattcatcttgggaacaata

SEQ ID NO: 739757 - DNA, 25 bp, Mus musculus
gtttgaattcatgttgggaacaata

SEQ ID NO: 739758 - DNA, 25 bp, Mus musculus
gtttgaatttacagtcttgtcaaga

SEQ ID NO: 739759 - DNA, 25 bp, Mus musculus
gtttgaatttactgtcttgtcaaga

SEQ ID NO: 739760 - DNA, 25 bp, Mus musculus
gtttgacaaaaaaccccatagctcc

SEQ ID NO: 739761 - DNA, 25 bp, Mus musculus
gtttgacaaaaatccccatagctcc

SEQ ID NO: 739762 - DNA, 25 bp, Mus musculus
gtttgacaacggcacttatcactgt

SEQ ID NO: 739763 - DNA, 25 bp, Mus musculus
gtttgacaacgggacttatcactgt

SEQ ID NO: 739764 - DNA, 25 bp, Mus musculus
gtttgacaagccatagtgtacattt

SEQ ID NO: 739765 - DNA, 25 bp, Mus musculus
gtttgacaagccttagtgtacattt

SEQ ID NO: 739766 - DNA, 25 bp, Mus musculus
gtttgacaaggcattaagttccatc

SEQ ID NO: 739767 - DNA, 25 bp, Mus musculus
gtttgacaaggctttaagttccatc

SEQ ID NO: 739768 - DNA, 25 bp, Mus musculus
gtttgacaagtgctatctgtgccac

SEQ ID NO: 739769 - DNA, 25 bp, Mus musculus
gtttgacaagtggtatctgtgccac

SEQ ID NO: 739770 - DNA, 25 bp, Mus musculus
gtttgacaagttcttttgagctctg

SEQ ID NO: 739771 - DNA, 25 bp, Mus musculus
gtttgacaagttgttttgagctctg

SEQ ID NO: 739772 - DNA, 25 bp, Mus musculus
gtttgacacactcagatgcttgcta

SEQ ID NO: 739773 - DNA, 25 bp, Mus musculus
gtttgacacactgagatgcttgcta

SEQ ID NO: 739774 - DNA, 25 bp, Mus musculus
gtttgacaccaaaatctgacctcct

SEQ ID NO: 739775 - DNA, 25 bp, Mus musculus
gtttgacaccaatatctgacctcct

SEQ ID NO: 739776 - DNA, 25 bp, Mus musculus
gtttgacaccggcagggctctgaac

SEQ ID NO: 739777 - DNA, 25 bp, Mus musculus
gtttgacaccgggagggctctgaac

SEQ ID NO: 739778 - DNA, 25 bp, Mus musculus
gtttgacaccttattctagctttga

SEQ ID NO: 739779 - DNA, 25 bp, Mus musculus
gtttgacaccttcttaaatcataga

SEQ ID NO: 739780 - DNA, 25 bp, Mus musculus
gtttgacaccttgttaaatcataga

SEQ ID NO: 739781 - DNA, 25 bp, Mus musculus
gtttgacacctttttctagctttga

SEQ ID NO: 739782 - DNA, 25 bp, Mus musculus
gtttgacactttagggccagtctcc

SEQ ID NO: 739783 - DNA, 25 bp, Mus musculus
gtttgacacttttgggccagtctcc

SEQ ID NO: 739784 - DNA, 25 bp, Mus musculus
gtttgacagagcaaggaggcccaga

SEQ ID NO: 739785 - DNA, 25 bp, Mus musculus
gtttgacagagctaggaggcccaga

SEQ ID NO: 739786 - DNA, 25 bp, Mus musculus
gtttgacaggccaggctaagctctt

SEQ ID NO: 739787 - DNA, 25 bp, Mus musculus
gtttgacaggcctggctaagctctt

SEQ ID NO: 739788 - DNA, 25 bp, Mus musculus
gtttgaccaaacacgtacacggcac

SEQ ID NO: 739789 - DNA, 25 bp, Mus musculus
gtttgaccaaactcgtacacggcac

SEQ ID NO: 739790 - DNA, 25 bp, Mus musculus
gtttgaccaactattgtttactgat

SEQ ID NO: 739791 - DNA, 25 bp, Mus musculus
gtttgaccaacttttgtttactgat

SEQ ID NO: 739792 - DNA, 25 bp, Mus musculus
gtttgaccataaccagatgctaata

SEQ ID NO: 739793 - DNA, 25 bp, Mus musculus
gtttgaccataagcagatgctaata

SEQ ID NO: 739794 - DNA, 25 bp, Mus musculus
gtttgaccattccacgctgtcagca

SEQ ID NO: 739795 - DNA, 25 bp, Mus musculus
gtttgaccattcgacgctgtcagca

SEQ ID NO: 739796 - DNA, 25 bp, Mus musculus
gtttgacccaacacgttggctggaa

SEQ ID NO: 739797 - DNA, 25 bp, Mus musculus
gtttgacccaactcgttggctggaa

SEQ ID NO: 739798 - DNA, 25 bp, Mus musculus
gtttgaccccaaactacatggcaag

SEQ ID NO: 739799 - DNA, 25 bp, Mus musculus
gtttgaccccaatctacatggcaag

SEQ ID NO: 739800 - DNA, 25 bp, Mus musculus
gtttgaccccgtcctgaacaagtgg

SEQ ID NO: 739801 - DNA, 25 bp, Mus musculus
gtttgaccccgtgctgaacaagtgg

SEQ ID NO: 739802 - DNA, 25 bp, Mus musculus
gtttgacccctaaggaacttaaatg

SEQ ID NO: 739803 - DNA, 25 bp, Mus musculus
gtttgacccctatggaacttaaatg

SEQ ID NO: 739804 - DNA, 25 bp, Mus musculus
gtttgaccgtggaacaagccttcca

SEQ ID NO: 739805 - DNA, 25 bp, Mus musculus
gtttgaccgtggtacaagccttcca

SEQ ID NO: 739806 - DNA, 25 bp, Mus musculus
gtttgacctaccatgttcttaattt

SEQ ID NO: 739807 - DNA, 25 bp, Mus musculus
gtttgacctaccttgttcttaattt

SEQ ID NO: 739808 - DNA, 25 bp, Mus musculus
gtttgacctcatcagcaggcattcc

SEQ ID NO: 739809 - DNA, 25 bp, Mus musculus
gtttgacctcatgagcaggcattcc

SEQ ID NO: 739810 - DNA, 25 bp, Mus musculus
gtttgacctggaaacaccttgccaa

SEQ ID NO: 739811 - DNA, 25 bp, Mus musculus
gtttgacctggatacaccttgccaa

SEQ ID NO: 739812 - DNA, 25 bp, Mus musculus
gtttgaccttgaacacattttattg

SEQ ID NO: 739813 - DNA, 25 bp, Mus musculus
gtttgaccttgatcacattttattg

SEQ ID NO: 739814 - DNA, 25 bp, Mus musculus
gtttgacctttcctgttacatgcaa

SEQ ID NO: 739815 - DNA, 25 bp, Mus musculus
gtttgacctttcgtgttacatgcaa

SEQ ID NO: 739816 - DNA, 25 bp, Mus musculus
gtttgactaaccagctgagagccga

SEQ ID NO: 739817 - DNA, 25 bp, Mus musculus
gtttgactaacctgctgagagccga

SEQ ID NO: 739818 - DNA, 25 bp, Mus musculus
gtttgactagctcatgctggcttga

SEQ ID NO: 739819 - DNA, 25 bp, Mus musculus
gtttgactagctgatgctggcttga

SEQ ID NO: 739820 - DNA, 25 bp, Mus musculus
gtttgactcttgagaaatgggcctg

SEQ ID NO: 739821 - DNA, 25 bp, Mus musculus
gtttgactcttgtgaaatgggcctg

SEQ ID NO: 739822 - DNA, 25 bp, Mus musculus
gtttgactctttaggctttcagatg

SEQ ID NO: 739823 - DNA, 25 bp, Mus musculus
gtttgactcttttggctttcagatg

SEQ ID NO: 739824 - DNA, 25 bp, Mus musculus
gtttgactgatgagactgtctcccg

SEQ ID NO: 739825 - DNA, 25 bp, Mus musculus
gtttgactgatgtgactgtctcccg

SEQ ID NO: 739826 - DNA, 25 bp, Mus musculus
gtttgactgtaccatcgactgttat

SEQ ID NO: 739827 - DNA, 25 bp, Mus musculus
gtttgactgtacgatcgactgttat

SEQ ID NO: 739828 - DNA, 25 bp, Mus musculus
gtttgactgtataccttcctctgta

SEQ ID NO: 739829 - DNA, 25 bp, Mus musculus
gtttgactgtattccttcctctgta

SEQ ID NO: 739830 - DNA, 25 bp, Mus musculus
gtttgactgtcaactttgtaaccac

SEQ ID NO: 739831 - DNA, 25 bp, Mus musculus
gtttgactgtcatctttgtaaccac

SEQ ID NO: 739832 - DNA, 25 bp, Mus musculus
gtttgactgtctatcattccaggaa

SEQ ID NO: 739833 - DNA, 25 bp, Mus musculus
gtttgactgtctttcattccaggaa

SEQ ID NO: 739834 - DNA, 25 bp, Mus musculus
gtttgacttaaaatcagtgctcctc

SEQ ID NO: 739835 - DNA, 25 bp, Mus musculus
gtttgacttaaacagtgatctctca

SEQ ID NO: 739836 - DNA, 25 bp, Mus musculus
gtttgacttaaagagtgatctctca

SEQ ID NO: 739837 - DNA, 25 bp, Mus musculus
gtttgacttaaattcagtgctcctc

SEQ ID NO: 739838 - DNA, 25 bp, Mus musculus
gtttgacttcacattttcaatttgt

SEQ ID NO: 739839 - DNA, 25 bp, Mus musculus
gtttgacttcactttttcaatttgt

SEQ ID NO: 739840 - DNA, 25 bp, Mus musculus
gtttgacttcataaaactatccttt

SEQ ID NO: 739841 - DNA, 25 bp, Mus musculus
gtttgacttcatcttggtacactgt

SEQ ID NO: 739842 - DNA, 25 bp, Mus musculus
gtttgacttcatgttggtacactgt

SEQ ID NO: 739843 - DNA, 25 bp, Mus musculus
gtttgacttcattaaactatccttt

SEQ ID NO: 739844 - DNA, 25 bp, Mus musculus
gtttgacttgatcctcacttgtgaa

SEQ ID NO: 739845 - DNA, 25 bp, Mus musculus
gtttgacttgatgctcacttgtgaa

SEQ ID NO: 739846 - DNA, 25 bp, Mus musculus
gtttgactttacatctcggcatcta

SEQ ID NO: 739847 - DNA, 25 bp, Mus musculus
gtttgactttacttctcggcatcta

SEQ ID NO: 739848 - DNA, 25 bp, Mus musculus
gtttgactttggacactctcttttg

SEQ ID NO: 739849 - DNA, 25 bp, Mus musculus
gtttgactttggtcactctcttttg

SEQ ID NO: 739850 - DNA, 25 bp, Mus musculus
gtttgacttttaaacccagccagaa

SEQ ID NO: 739851 - DNA, 25 bp, Mus musculus
gtttgacttttatacccagccagaa

SEQ ID NO: 739852 - DNA, 25 bp, Mus musculus
gtttgagaacttctgtccagcctat

SEQ ID NO: 739853 - DNA, 25 bp, Mus musculus
gtttgagaacttgtgtccagcctat

SEQ ID NO: 739854 - DNA, 25 bp, Mus musculus
gtttgagaagatatgaaagggcaca

SEQ ID NO: 739855 - DNA, 25 bp, Mus musculus
gtttgagaagatttgaaagggcaca

SEQ ID NO: 739856 - DNA, 25 bp, Mus musculus
gtttgagaatctagcccatcttgga

SEQ ID NO: 739857 - DNA, 25 bp, Mus musculus
gtttgagaatcttgcccatcttgga

SEQ ID NO: 739858 - DNA, 25 bp, Mus musculus
gtttgagacactactgcctcagctt

SEQ ID NO: 739859 - DNA, 25 bp, Mus musculus
gtttgagacactatgccaccatatg

SEQ ID NO: 739860 - DNA, 25 bp, Mus musculus
gtttgagacacttctgcctcagctt

SEQ ID NO: 739861 - DNA, 25 bp, Mus musculus
gtttgagacactttgccaccatatg

SEQ ID NO: 739862 - DNA, 25 bp, Mus musculus
gtttgagaccaacatgggttgcata

SEQ ID NO: 739863 - DNA, 25 bp, Mus musculus
gtttgagaccaagatgggttgcata

SEQ ID NO: 739864 - DNA, 25 bp, Mus musculus
gtttgagaccacagctttgggattc

SEQ ID NO: 739865 - DNA, 25 bp, Mus musculus
gtttgagaccactgctttgggattc

SEQ ID NO: 739866 - DNA, 25 bp, Mus musculus
gtttgagaccagacagctaggtcta

SEQ ID NO: 739867 - DNA, 25 bp, Mus musculus
gtttgagaccagtcagctaggtcta

SEQ ID NO: 739868 - DNA, 25 bp, Mus musculus
gtttgagagagaccctccgcgctta

SEQ ID NO: 739869 - DNA, 25 bp, Mus musculus
gtttgagagagagcctccgcgctta

SEQ ID NO: 739870 - DNA, 25 bp, Mus musculus
gtttgagagcttcatggatccttcc

SEQ ID NO: 739871 - DNA, 25 bp, Mus musculus
gtttgagagcttgatggatccttcc

SEQ ID NO: 739872 - DNA, 25 bp, Mus musculus
gtttgagaggatccaacaacacccc

SEQ ID NO: 739873 - DNA, 25 bp, Mus musculus
gtttgagaggatgcaacaacacccc

SEQ ID NO: 739874 - DNA, 25 bp, Mus musculus
gtttgagagtccacttaggcagaac

SEQ ID NO: 739875 - DNA, 25 bp, Mus musculus
gtttgagagtcctcttaggcagaac

SEQ ID NO: 739876 - DNA, 25 bp, Mus musculus
gtttgagatcaaactgttcgtgagt

SEQ ID NO: 739877 - DNA, 25 bp, Mus musculus
gtttgagatcaacctagactatgta

SEQ ID NO: 739878 - DNA, 25 bp, Mus musculus
gtttgagatcaagctagactatgta

SEQ ID NO: 739879 - DNA, 25 bp, Mus musculus
gtttgagatcaatctgttcgtgagt

SEQ ID NO: 739880 - DNA, 25 bp, Mus musculus
gtttgagatgccatatgtggttcgg

SEQ ID NO: 739881 - DNA, 25 bp, Mus musculus
gtttgagatgccttatgtggttcgg

SEQ ID NO: 739882 - DNA, 25 bp, Mus musculus
gtttgagattccatactttaccgtt

SEQ ID NO: 739883 - DNA, 25 bp, Mus musculus
gtttgagattccttactttaccgtt

SEQ ID NO: 739884 - DNA, 25 bp, Mus musculus
gtttgagcaactaactaaccacgtt

SEQ ID NO: 739885 - DNA, 25 bp, Mus musculus
gtttgagcaacttactaaccacgtt

SEQ ID NO: 739886 - DNA, 25 bp, Mus musculus
gtttgagcacaaattgaagcccaga

SEQ ID NO: 739887 - DNA, 25 bp, Mus musculus
gtttgagcacaatttgaagcccaga

SEQ ID NO: 739888 - DNA, 25 bp, Mus musculus
gtttgagcacatagttccacgcatc

SEQ ID NO: 739889 - DNA, 25 bp, Mus musculus
gtttgagcacattgttccacgcatc

SEQ ID NO: 739890 - DNA, 25 bp, Mus musculus
gtttgagcagacagaggtccagcca

SEQ ID NO: 739891 - DNA, 25 bp, Mus musculus
gtttgagcagactgaggtccagcca

SEQ ID NO: 739892 - DNA, 25 bp, Mus musculus
gtttgagcagtaagaacccggccag

SEQ ID NO: 739893 - DNA, 25 bp, Mus musculus
gtttgagcagtatgaacccggccag

SEQ ID NO: 739894 - DNA, 25 bp, Mus musculus
gtttgagcagttacttggttatctt

SEQ ID NO: 739895 - DNA, 25 bp, Mus musculus
gtttgagcagtttcttggttatctt

SEQ ID NO: 739896 - DNA, 25 bp, Mus musculus
gtttgagcatgtaatattcttgtaa

SEQ ID NO: 739897 - DNA, 25 bp, Mus musculus
gtttgagcatgttatattcttgtaa

SEQ ID NO: 739898 - DNA, 25 bp, Mus musculus
gtttgagccaccagaacctgatgac

SEQ ID NO: 739899 - DNA, 25 bp, Mus musculus
gtttgagccacctgaacctgatgac

SEQ ID NO: 739900 - DNA, 25 bp, Mus musculus
gtttgagcccctaaaggagccaggc

SEQ ID NO: 739901 - DNA, 25 bp, Mus musculus
gtttgagccccttaaggagccaggc

SEQ ID NO: 739902 - DNA, 25 bp, Mus musculus
gtttgagctcagaaggcccgactat

SEQ ID NO: 739903 - DNA, 25 bp, Mus musculus
gtttgagctcagtaggcccgactat

SEQ ID NO: 739904 - DNA, 25 bp, Mus musculus
gtttgagctgcgaggagaatcacgt

SEQ ID NO: 739905 - DNA, 25 bp, Mus musculus
gtttgagctgcgtggagaatcacgt

SEQ ID NO: 739906 - DNA, 25 bp, Mus musculus
gtttgagcttgtagccagaattcca

SEQ ID NO: 739907 - DNA, 25 bp, Mus musculus
gtttgagcttgttgccagaattcca

SEQ ID NO: 739908 - DNA, 25 bp, Mus musculus
gtttgaggaactactttcctatgtt

SEQ ID NO: 739909 - DNA, 25 bp, Mus musculus
gtttgaggaacttctttcctatgtt

SEQ ID NO: 739910 - DNA, 25 bp, Mus musculus
gtttgaggacacatctccagctgat

SEQ ID NO: 739911 - DNA, 25 bp, Mus musculus
gtttgaggacacttctccagctgat

SEQ ID NO: 739912 - DNA, 25 bp, Mus musculus
gtttgaggacccactgagtaatgtt

SEQ ID NO: 739913 - DNA, 25 bp, Mus musculus
gtttgaggaccctctgagtaatgtt

SEQ ID NO: 739914 - DNA, 25 bp, Mus musculus
gtttgaggactgctaacagccctgc

SEQ ID NO: 739915 - DNA, 25 bp, Mus musculus
gtttgaggactggtaacagccctgc

SEQ ID NO: 739916 - DNA, 25 bp, Mus musculus
gtttgaggacttagcccggctccgg

SEQ ID NO: 739917 - DNA, 25 bp, Mus musculus
gtttgaggactttgcccggctccgg

SEQ ID NO: 739918 - DNA, 25 bp, Mus musculus
gtttgaggagatactcactcgcctt

SEQ ID NO: 739919 - DNA, 25 bp, Mus musculus
gtttgaggagatctccatcccagct

SEQ ID NO: 739920 - DNA, 25 bp, Mus musculus
gtttgaggagatgtccatcccagct

SEQ ID NO: 739921 - DNA, 25 bp, Mus musculus
gtttgaggagattctcactcgcctt

SEQ ID NO: 739922 - DNA, 25 bp, Mus musculus
gtttgaggagttaggttcgaccatt

SEQ ID NO: 739923 - DNA, 25 bp, Mus musculus
gtttgaggagtttggttcgaccatt

SEQ ID NO: 739924 - DNA, 25 bp, Mus musculus
gtttgaggcaacactgggcatcaac

SEQ ID NO: 739925 - DNA, 25 bp, Mus musculus
gtttgaggcaactctgggcatcaac

SEQ ID NO: 739926 - DNA, 25 bp, Mus musculus
gtttgaggccagaaggtctcaccag

SEQ ID NO: 739927 - DNA, 25 bp, Mus musculus
gtttgaggccagtaggtctcaccag

SEQ ID NO: 739928 - DNA, 25 bp, Mus musculus
gtttgaggcctaattgcctgccagt

SEQ ID NO: 739929 - DNA, 25 bp, Mus musculus
gtttgaggcctatttgcctgccagt

SEQ ID NO: 739930 - DNA, 25 bp, Mus musculus
gtttgaggctaactggcctgcagaa

SEQ ID NO: 739931 - DNA, 25 bp, Mus musculus
gtttgaggctaagtggcctgcagaa

SEQ ID NO: 739932 - DNA, 25 bp, Mus musculus
gtttgaggctacaattcttcatggt

SEQ ID NO: 739933 - DNA, 25 bp, Mus musculus
gtttgaggctactattcttcatggt

SEQ ID NO: 739934 - DNA, 25 bp, Mus musculus
gtttgaggctctctctattgcattc

SEQ ID NO: 739935 - DNA, 25 bp, Mus musculus
gtttgaggctctgtctattgcattc

SEQ ID NO: 739936 - DNA, 25 bp, Mus musculus
gtttgaggctggaccagtcagcatt

SEQ ID NO: 739937 - DNA, 25 bp, Mus musculus
gtttgaggctggtccagtcagcatt

SEQ ID NO: 739938 - DNA, 25 bp, Mus musculus
gtttgagggagccatctatagaaag

SEQ ID NO: 739939 - DNA, 25 bp, Mus musculus
gtttgagggagcgatctatagaaag

SEQ ID NO: 739940 - DNA, 25 bp, Mus musculus
gtttgaggtaccagtgggacatcca

SEQ ID NO: 739941 - DNA, 25 bp, Mus musculus
gtttgaggtacctgtgggacatcca

SEQ ID NO: 739942 - DNA, 25 bp, Mus musculus
gtttgaggtcagacttatatacata

SEQ ID NO: 739943 - DNA, 25 bp, Mus musculus
gtttgaggtcagtcttatatacata

SEQ ID NO: 739944 - DNA, 25 bp, Mus musculus
gtttgagtaactatgcagggcgcta

SEQ ID NO: 739945 - DNA, 25 bp, Mus musculus
gtttgagtaactttgcagggcgcta

SEQ ID NO: 739946 - DNA, 25 bp, Mus musculus
gtttgagtacagagcttgaaccact

SEQ ID NO: 739947 - DNA, 25 bp, Mus musculus
gtttgagtacagtgcttgaaccact

SEQ ID NO: 739948 - DNA, 25 bp, Mus musculus
gtttgagtaggtatgtatggtctgt

SEQ ID NO: 739949 - DNA, 25 bp, Mus musculus
gtttgagtaggtttgtatggtctgt

SEQ ID NO: 739950 - DNA, 25 bp, Mus musculus
gtttgagtcaatattacaacttcta

SEQ ID NO: 739951 - DNA, 25 bp, Mus musculus
gtttgagtcaattttacaacttcta

SEQ ID NO: 739952 - DNA, 25 bp, Mus musculus
gtttgagtccacactttggaagaga

SEQ ID NO: 739953 - DNA, 25 bp, Mus musculus
gtttgagtccactctttggaagaga

SEQ ID NO: 739954 - DNA, 25 bp, Mus musculus
gtttgagtctcaatcatttaaagtt

SEQ ID NO: 739955 - DNA, 25 bp, Mus musculus
gtttgagtctcattcatttaaagtt

SEQ ID NO: 739956 - DNA, 25 bp, Mus musculus
gtttgagtcttgacgtgagtcctac

SEQ ID NO: 739957 - DNA, 25 bp, Mus musculus
gtttgagtcttgtcgtgagtcctac

SEQ ID NO: 739958 - DNA, 25 bp, Mus musculus
gtttgagtgactactgcattaggtg

SEQ ID NO: 739959 - DNA, 25 bp, Mus musculus
gtttgagtgacttctgcattaggtg

SEQ ID NO: 739960 - DNA, 25 bp, Mus musculus
gtttgagtgccacccatgtatacca

SEQ ID NO: 739961 - DNA, 25 bp, Mus musculus
gtttgagtgccagccatgtatacca

SEQ ID NO: 739962 - DNA, 25 bp, Mus musculus
gtttgagtgggaactgcccctggat

SEQ ID NO: 739963 - DNA, 25 bp, Mus musculus
gtttgagtgggatctgcccctggat

SEQ ID NO: 739964 - DNA, 25 bp, Mus musculus
gtttgagtgtttcgattctccacct

SEQ ID NO: 739965 - DNA, 25 bp, Mus musculus
gtttgagtgtttggattctccacct

SEQ ID NO: 739966 - DNA, 25 bp, Mus musculus
gtttgagttgcacttcattgaacct

SEQ ID NO: 739967 - DNA, 25 bp, Mus musculus
gtttgagttgcagttcattgaacct

SEQ ID NO: 739968 - DNA, 25 bp, Mus musculus
gtttgagtttctcattcgtttccca

SEQ ID NO: 739969 - DNA, 25 bp, Mus musculus
gtttgagtttctgattcgtttccca

SEQ ID NO: 739970 - DNA, 25 bp, Mus musculus
gtttgataacaacactgctgtctgt

SEQ ID NO: 739971 - DNA, 25 bp, Mus musculus
gtttgataacaagactgctgtctgt

SEQ ID NO: 739972 - DNA, 25 bp, Mus musculus
gtttgataagggactagccactctg

SEQ ID NO: 739973 - DNA, 25 bp, Mus musculus
gtttgataagggtctagccactctg

SEQ ID NO: 739974 - DNA, 25 bp, Mus musculus
gtttgataatctacctgggcaccat

SEQ ID NO: 739975 - DNA, 25 bp, Mus musculus
gtttgataatcttcctgggcaccat

SEQ ID NO: 739976 - DNA, 25 bp, Mus musculus
gtttgatacaaaatcctgttaattt

SEQ ID NO: 739977 - DNA, 25 bp, Mus musculus
gtttgatacaaattcctgttaattt

SEQ ID NO: 739978 - DNA, 25 bp, Mus musculus
gtttgatagatgctgacccgtacct

SEQ ID NO: 739979 - DNA, 25 bp, Mus musculus
gtttgatagatggtgacccgtacct

SEQ ID NO: 739980 - DNA, 25 bp, Mus musculus
gtttgatagggcattatggtttcct

SEQ ID NO: 739981 - DNA, 25 bp, Mus musculus
gtttgatagggctttatggtttcct

SEQ ID NO: 739982 - DNA, 25 bp, Mus musculus
gtttgataggttccagccatgacaa

SEQ ID NO: 739983 - DNA, 25 bp, Mus musculus
gtttgataggttgcagccatgacaa

SEQ ID NO: 739984 - DNA, 25 bp, Mus musculus
gtttgatatccacactttgctgact

SEQ ID NO: 739985 - DNA, 25 bp, Mus musculus
gtttgatatccagactttgctgact

SEQ ID NO: 739986 - DNA, 25 bp, Mus musculus
gtttgatatctgaaacatactgtat

SEQ ID NO: 739987 - DNA, 25 bp, Mus musculus
gtttgatatctgtaacatactgtat

SEQ ID NO: 739988 - DNA, 25 bp, Mus musculus
gtttgatatgaaccccaagcacttg

SEQ ID NO: 739989 - DNA, 25 bp, Mus musculus
gtttgatatgaagcccaagcacttg

SEQ ID NO: 739990 - DNA, 25 bp, Mus musculus
gtttgatattcactccagcgtttat

SEQ ID NO: 739991 - DNA, 25 bp, Mus musculus
gtttgatattcagtccagcgtttat

SEQ ID NO: 739992 - DNA, 25 bp, Mus musculus
gtttgatattggatgtttgacacac

SEQ ID NO: 739993 - DNA, 25 bp, Mus musculus
gtttgatattggttgtttgacacac

SEQ ID NO: 739994 - DNA, 25 bp, Mus musculus
gtttgatcacagaagcacccctgga

SEQ ID NO: 739995 - DNA, 25 bp, Mus musculus
gtttgatcacagtagcacccctgga

SEQ ID NO: 739996 - DNA, 25 bp, Mus musculus
gtttgatcactacaagtttgctgca

SEQ ID NO: 739997 - DNA, 25 bp, Mus musculus
gtttgatcactagaagtttgctgca

SEQ ID NO: 739998 - DNA, 25 bp, Mus musculus
gtttgatcactcaccagttactgag

SEQ ID NO: 739999 - DNA, 25 bp, Mus musculus
gtttgatcactctccagttactgag

SEQ ID NO: 740000 - DNA, 25 bp, Mus musculus
gtttgatcagcacacatgttacagg

SEQ ID NO: 740001 - DNA, 25 bp, Mus musculus
gtttgatcagcagacatgttacagg

SEQ ID NO: 740002 - DNA, 25 bp, Mus musculus
gtttgatcagctccttctaatgatg

SEQ ID NO: 740003 - DNA, 25 bp, Mus musculus
gtttgatcagctgcttctaatgatg

SEQ ID NO: 740004 - DNA, 25 bp, Mus musculus
gtttgatcagggaaatccctcaatt

SEQ ID NO: 740005 - DNA, 25 bp, Mus musculus
gtttgatcagggtaatccctcaatt

SEQ ID NO: 740006 - DNA, 25 bp, Mus musculus
gtttgatcatctaaaggctactggt

SEQ ID NO: 740007 - DNA, 25 bp, Mus musculus
gtttgatcatcttaaggctactggt

SEQ ID NO: 740008 - DNA, 25 bp, Mus musculus
gtttgatcattcacttgtgtgccaa

SEQ ID NO: 740009 - DNA, 25 bp, Mus musculus
gtttgatcattctcttgtgtgccaa

SEQ ID NO: 740010 - DNA, 25 bp, Mus musculus
gtttgatcctgcatcatatataata

SEQ ID NO: 740011 - DNA, 25 bp, Mus musculus
gtttgatcctgcttcatatataata

SEQ ID NO: 740012 - DNA, 25 bp, Mus musculus
gtttgatccttgagttgttcgtgaa

SEQ ID NO: 740013 - DNA, 25 bp, Mus musculus
gtttgatccttgtgttgttcgtgaa

SEQ ID NO: 740014 - DNA, 25 bp, Mus musculus
gtttgatcgcagaatctcacacaca

SEQ ID NO: 740015 - DNA, 25 bp, Mus musculus
gtttgatcgcagtatctcacacaca

SEQ ID NO: 740016 - DNA, 25 bp, Mus musculus
gtttgatcggcaaaacaatcgcatt

SEQ ID NO: 740017 - DNA, 25 bp, Mus musculus
gtttgatcggcataacaatcgcatt

SEQ ID NO: 740018 - DNA, 25 bp, Mus musculus
gtttgatctcaaagctccatttttg

SEQ ID NO: 740019 - DNA, 25 bp, Mus musculus
gtttgatctcaatgctccatttttg

SEQ ID NO: 740020 - DNA, 25 bp, Mus musculus
gtttgatctcacattcttggtattt

SEQ ID NO: 740021 - DNA, 25 bp, Mus musculus
gtttgatctcactttcttggtattt

SEQ ID NO: 740022 - DNA, 25 bp, Mus musculus
gtttgatctcataattatgtggtaa

SEQ ID NO: 740023 - DNA, 25 bp, Mus musculus
gtttgatctcattattatgtggtaa

SEQ ID NO: 740024 - DNA, 25 bp, Mus musculus
gtttgatctcttaactcccaaccaa

SEQ ID NO: 740025 - DNA, 25 bp, Mus musculus
gtttgatctctttactcccaaccaa

SEQ ID NO: 740026 - DNA, 25 bp, Mus musculus
gtttgatctggaccctgttgactaa

SEQ ID NO: 740027 - DNA, 25 bp, Mus musculus
gtttgatctggagcctgttgactaa

SEQ ID NO: 740028 - DNA, 25 bp, Mus musculus
gtttgatctgtaattattgcatcct

SEQ ID NO: 740029 - DNA, 25 bp, Mus musculus
gtttgatctgtatttattgcatcct

SEQ ID NO: 740030 - DNA, 25 bp, Mus musculus
gtttgatgacagatctatgctaaat

SEQ ID NO: 740031 - DNA, 25 bp, Mus musculus
gtttgatgacagttctatgctaaat

SEQ ID NO: 740032 - DNA, 25 bp, Mus musculus
gtttgatgactacattgcctgctgt

SEQ ID NO: 740033 - DNA, 25 bp, Mus musculus
gtttgatgactagattgcctgctgt

SEQ ID NO: 740034 - DNA, 25 bp, Mus musculus
gtttgatgagcgacatgcgtacatt

SEQ ID NO: 740035 - DNA, 25 bp, Mus musculus
gtttgatgagcgtcatgcgtacatt

SEQ ID NO: 740036 - DNA, 25 bp, Mus musculus
gtttgatgcagaactggcctgccaa

SEQ ID NO: 740037 - DNA, 25 bp, Mus musculus
gtttgatgcagatctggcctgccaa

SEQ ID NO: 740038 - DNA, 25 bp, Mus musculus
gtttgatgccaaacatcctagaaga

SEQ ID NO: 740039 - DNA, 25 bp, Mus musculus
gtttgatgccaatcatcctagaaga

SEQ ID NO: 740040 - DNA, 25 bp, Mus musculus
gtttgatgcccaaacattactcgga

SEQ ID NO: 740041 - DNA, 25 bp, Mus musculus
gtttgatgcccatacattactcgga

SEQ ID NO: 740042 - DNA, 25 bp, Mus musculus
gtttgatgctatatccattgctgta

SEQ ID NO: 740043 - DNA, 25 bp, Mus musculus
gtttgatgctatttccattgctgta

SEQ ID NO: 740044 - DNA, 25 bp, Mus musculus
gtttgatgctcgctgggtgacatat

SEQ ID NO: 740045 - DNA, 25 bp, Mus musculus
gtttgatgctcggtgggtgacatat

SEQ ID NO: 740046 - DNA, 25 bp, Mus musculus
gtttgatgtaagaggcctgacccgc

SEQ ID NO: 740047 - DNA, 25 bp, Mus musculus
gtttgatgtaagtggcctgacccgc

SEQ ID NO: 740048 - DNA, 25 bp, Mus musculus
gtttgatgtaataaatcttgctgct

SEQ ID NO: 740049 - DNA, 25 bp, Mus musculus
gtttgatgtaattaatcttgctgct

SEQ ID NO: 740050 - DNA, 25 bp, Mus musculus
gtttgatgtatccatccaaccgcaa

SEQ ID NO: 740051 - DNA, 25 bp, Mus musculus
gtttgatgtatcgatccaaccgcaa

SEQ ID NO: 740052 - DNA, 25 bp, Mus musculus
gtttgatgttccacatgatccatat

SEQ ID NO: 740053 - DNA, 25 bp, Mus musculus
gtttgatgttcctcatgatccatat

SEQ ID NO: 740054 - DNA, 25 bp, Mus musculus
gtttgatgtttgcactaggagctcc

SEQ ID NO: 740055 - DNA, 25 bp, Mus musculus
gtttgatgtttggactaggagctcc

SEQ ID NO: 740056 - DNA, 25 bp, Mus musculus
gtttgattacgccttcgatgactca

SEQ ID NO: 740057 - DNA, 25 bp, Mus musculus
gtttgattacgcgttcgatgactca

SEQ ID NO: 740058 - DNA, 25 bp, Mus musculus
gtttgattagctccccaattgtctt

SEQ ID NO: 740059 - DNA, 25 bp, Mus musculus
gtttgattagctgcccaattgtctt

SEQ ID NO: 740060 - DNA, 25 bp, Mus musculus
gtttgattatctacctttcaatcaa

SEQ ID NO: 740061 - DNA, 25 bp, Mus musculus
gtttgattatctccagatacctaag

SEQ ID NO: 740062 - DNA, 25 bp, Mus musculus
gtttgattatctgcagatacctaag

SEQ ID NO: 740063 - DNA, 25 bp, Mus musculus
gtttgattatcttcctttcaatcaa

SEQ ID NO: 740064 - DNA, 25 bp, Mus musculus
gtttgattcaacacttgctctactt

SEQ ID NO: 740065 - DNA, 25 bp, Mus musculus
gtttgattcaactcttgctctactt

SEQ ID NO: 740066 - DNA, 25 bp, Mus musculus
gtttgattcatcaggactttgcctc

SEQ ID NO: 740067 - DNA, 25 bp, Mus musculus
gtttgattcatctggactttgcctc

SEQ ID NO: 740068 - DNA, 25 bp, Mus musculus
gtttgattccagcttatcagcttgt

SEQ ID NO: 740069 - DNA, 25 bp, Mus musculus
gtttgattccaggttatcagcttgt

SEQ ID NO: 740070 - DNA, 25 bp, Mus musculus
gtttgattcccactagcttatatta

SEQ ID NO: 740071 - DNA, 25 bp, Mus musculus
gtttgattcccagtagcttatatta

SEQ ID NO: 740072 - DNA, 25 bp, Mus musculus
gtttgattccttcatcaggcagaat

SEQ ID NO: 740073 - DNA, 25 bp, Mus musculus
gtttgattccttgatcaggcagaat

SEQ ID NO: 740074 - DNA, 25 bp, Mus musculus
gtttgattctagacagctccagctt

SEQ ID NO: 740075 - DNA, 25 bp, Mus musculus
gtttgattctagtcagctccagctt

SEQ ID NO: 740076 - DNA, 25 bp, Mus musculus
gtttgattctcaaaaaggcttctgg

SEQ ID NO: 740077 - DNA, 25 bp, Mus musculus
gtttgattctcataaaggcttctgg

SEQ ID NO: 740078 - DNA, 25 bp, Mus musculus
gtttgattgaataatcctcctatgg

SEQ ID NO: 740079 - DNA, 25 bp, Mus musculus
gtttgattgaattatcctcctatgg

SEQ ID NO: 740080 - DNA, 25 bp, Mus musculus
gtttgattgagtataggttccgtct

SEQ ID NO: 740081 - DNA, 25 bp, Mus musculus
gtttgattgagtttaggttccgtct

SEQ ID NO: 740082 - DNA, 25 bp, Mus musculus
gtttgattgattatggcagccagct

SEQ ID NO: 740083 - DNA, 25 bp, Mus musculus
gtttgattgattttggcagccagct

SEQ ID NO: 740084 - DNA, 25 bp, Mus musculus
gtttgattgccactttaatacactc

SEQ ID NO: 740085 - DNA, 25 bp, Mus musculus
gtttgattgccagtttaatacactc

SEQ ID NO: 740086 - DNA, 25 bp, Mus musculus
gtttgatttcacatcagcctttcac

SEQ ID NO: 740087 - DNA, 25 bp, Mus musculus
gtttgatttcacttcagcctttcac

SEQ ID NO: 740088 - DNA, 25 bp, Mus musculus
gtttgattttcaaagcctcagtgtt

SEQ ID NO: 740089 - DNA, 25 bp, Mus musculus
gtttgattttcatagcctcagtgtt

SEQ ID NO: 740090 - DNA, 25 bp, Mus musculus
gtttgattttgcctcatggtcaaga

SEQ ID NO: 740091 - DNA, 25 bp, Mus musculus
gtttgattttgcgtcatggtcaaga

SEQ ID NO: 740092 - DNA, 25 bp, Mus musculus
gtttgcaaaaagaactgttttccat

SEQ ID NO: 740093 - DNA, 25 bp, Mus musculus
gtttgcaaaaagtactgttttccat

SEQ ID NO: 740094 - DNA, 25 bp, Mus musculus
gtttgcaaaactcctctagtgattc

SEQ ID NO: 740095 - DNA, 25 bp, Mus musculus
gtttgcaaaactcgtggtccatttt

SEQ ID NO: 740096 - DNA, 25 bp, Mus musculus
gtttgcaaaactgctctagtgattc

SEQ ID NO: 740097 - DNA, 25 bp, Mus musculus
gtttgcaaaactggtggtccatttt

SEQ ID NO: 740098 - DNA, 25 bp, Mus musculus
gtttgcaaacacctgaagtatccat

SEQ ID NO: 740099 - DNA, 25 bp, Mus musculus
gtttgcaaacacgtgaagtatccat

SEQ ID NO: 740100 - DNA, 25 bp, Mus musculus
gtttgcaaacctacagataaggatg

SEQ ID NO: 740101 - DNA, 25 bp, Mus musculus
gtttgcaaaccttcagataaggatg

SEQ ID NO: 740102 - DNA, 25 bp, Mus musculus
gtttgcaaacgcatctgtttcttcc

SEQ ID NO: 740103 - DNA, 25 bp, Mus musculus
gtttgcaaacgcttctgtttcttcc

SEQ ID NO: 740104 - DNA, 25 bp, Mus musculus
gtttgcaaagcactgaacccaagga

SEQ ID NO: 740105 - DNA, 25 bp, Mus musculus
gtttgcaaagcagtgaacccaagga

SEQ ID NO: 740106 - DNA, 25 bp, Mus musculus
gtttgcaaatgcaaaaacagtgcct

SEQ ID NO: 740107 - DNA, 25 bp, Mus musculus
gtttgcaaatgcaatgatggtacag

SEQ ID NO: 740108 - DNA, 25 bp, Mus musculus
gtttgcaaatgctaaaacagtgcct

SEQ ID NO: 740109 - DNA, 25 bp, Mus musculus
gtttgcaaatgctatgatggtacag

SEQ ID NO: 740110 - DNA, 25 bp, Mus musculus
gtttgcaacaccagacctgatggaa

SEQ ID NO: 740111 - DNA, 25 bp, Mus musculus
gtttgcaacacctgacctgatggaa

SEQ ID NO: 740112 - DNA, 25 bp, Mus musculus
gtttgcaacactaaccacagactga

SEQ ID NO: 740113 - DNA, 25 bp, Mus musculus
gtttgcaacacttaccacagactga

SEQ ID NO: 740114 - DNA, 25 bp, Mus musculus
gtttgcaacatcattcctgtttggt

SEQ ID NO: 740115 - DNA, 25 bp, Mus musculus
gtttgcaacatctttcctgtttggt

SEQ ID NO: 740116 - DNA, 25 bp, Mus musculus
gtttgcaacccacttaggacacatt

SEQ ID NO: 740117 - DNA, 25 bp, Mus musculus
gtttgcaacccagttaggacacatt

SEQ ID NO: 740118 - DNA, 25 bp, Mus musculus
gtttgcaacccgctacaggatgatg

SEQ ID NO: 740119 - DNA, 25 bp, Mus musculus
gtttgcaacccggtacaggatgatg

SEQ ID NO: 740120 - DNA, 25 bp, Mus musculus
gtttgcaacgcactggaccgagcac

SEQ ID NO: 740121 - DNA, 25 bp, Mus musculus
gtttgcaacgcagtggaccgagcac

SEQ ID NO: 740122 - DNA, 25 bp, Mus musculus
gtttgcaactccaactggaagtttt

SEQ ID NO: 740123 - DNA, 25 bp, Mus musculus
gtttgcaactcctactggaagtttt

SEQ ID NO: 740124 - DNA, 25 bp, Mus musculus
gtttgcaactgacggtcttccaacc

SEQ ID NO: 740125 - DNA, 25 bp, Mus musculus
gtttgcaactgagggtcttccaacc

SEQ ID NO: 740126 - DNA, 25 bp, Mus musculus
gtttgcaagcaccaatacattttaa

SEQ ID NO: 740127 - DNA, 25 bp, Mus musculus
gtttgcaagcacgaatacattttaa

SEQ ID NO: 740128 - DNA, 25 bp, Mus musculus
gtttgcaaggccctatgtctaagta

SEQ ID NO: 740129 - DNA, 25 bp, Mus musculus
gtttgcaaggccgtatgtctaagta

SEQ ID NO: 740130 - DNA, 25 bp, Mus musculus
gtttgcaagtcactagtaattctca

SEQ ID NO: 740131 - DNA, 25 bp, Mus musculus
gtttgcaagtcagtagtaattctca

SEQ ID NO: 740132 - DNA, 25 bp, Mus musculus
gtttgcaatcagacagttcagttcc

SEQ ID NO: 740133 - DNA, 25 bp, Mus musculus
gtttgcaatcagtcagttcagttcc

SEQ ID NO: 740134 - DNA, 25 bp, Mus musculus
gtttgcaatgtgagttttagataat

SEQ ID NO: 740135 - DNA, 25 bp, Mus musculus
gtttgcaatgtgatcctgaggtggt

SEQ ID NO: 740136 - DNA, 25 bp, Mus musculus
gtttgcaatgtgtgttttagataat

SEQ ID NO: 740137 - DNA, 25 bp, Mus musculus
gtttgcaatgtgttcctgaggtggt

SEQ ID NO: 740138 - DNA, 25 bp, Mus musculus
gtttgcacacagaacagtttagcgt

SEQ ID NO: 740139 - DNA, 25 bp, Mus musculus
gtttgcacacagtacagtttagcgt

SEQ ID NO: 740140 - DNA, 25 bp, Mus musculus
gtttgcacacataggtagactgtta

SEQ ID NO: 740141 - DNA, 25 bp, Mus musculus
gtttgcacacattggtagactgtta

SEQ ID NO: 740142 - DNA, 25 bp, Mus musculus
gtttgcacagccaggtgagaatcct

SEQ ID NO: 740143 - DNA, 25 bp, Mus musculus
gtttgcacagcctggtgagaatcct

SEQ ID NO: 740144 - DNA, 25 bp, Mus musculus
gtttgcacagggacagtatgatttg

SEQ ID NO: 740145 - DNA, 25 bp, Mus musculus
gtttgcacagggtcagtatgatttg

SEQ ID NO: 740146 - DNA, 25 bp, Mus musculus
gtttgcacagtgacatccaggtgtt

SEQ ID NO: 740147 - DNA, 25 bp, Mus musculus
gtttgcacagtgtcatccaggtgtt

SEQ ID NO: 740148 - DNA, 25 bp, Mus musculus
gtttgcacatacaataagcctgaat

SEQ ID NO: 740149 - DNA, 25 bp, Mus musculus
gtttgcacatactataagcctgaat

SEQ ID NO: 740150 - DNA, 25 bp, Mus musculus
gtttgcacatcccagatttgcactg

SEQ ID NO: 740151 - DNA, 25 bp, Mus musculus
gtttgcacatccgagatttgcactg

SEQ ID NO: 740152 - DNA, 25 bp, Mus musculus
gtttgcacattcaaatcactttcca

SEQ ID NO: 740153 - DNA, 25 bp, Mus musculus
gtttgcacattctaatcactttcca

SEQ ID NO: 740154 - DNA, 25 bp, Mus musculus
gtttgcaccactcagcctgaatcta

SEQ ID NO: 740155 - DNA, 25 bp, Mus musculus
gtttgcaccactgagcctgaatcta

SEQ ID NO: 740156 - DNA, 25 bp, Mus musculus
gtttgcacgagaacgaagccgcttt

SEQ ID NO: 740157 - DNA, 25 bp, Mus musculus
gtttgcacgagatcgaagccgcttt

SEQ ID NO: 740158 - DNA, 25 bp, Mus musculus
gtttgcacgcagataactcaaggta

SEQ ID NO: 740159 - DNA, 25 bp, Mus musculus
gtttgcacgcagttaactcaaggta

SEQ ID NO: 740160 - DNA, 25 bp, Mus musculus
gtttgcacgtcaccttgtctgaggg

SEQ ID NO: 740161 - DNA, 25 bp, Mus musculus
gtttgcacgtcagcttgtctgaggg

SEQ ID NO: 740162 - DNA, 25 bp, Mus musculus
gtttgcactaggagctcctgatcaa

SEQ ID NO: 740163 - DNA, 25 bp, Mus musculus
gtttgcactaggtgctcctgatcaa

SEQ ID NO: 740164 - DNA, 25 bp, Mus musculus
gtttgcactattaacacaacttcac

SEQ ID NO: 740165 - DNA, 25 bp, Mus musculus
gtttgcactatttacacaacttcac

SEQ ID NO: 740166 - DNA, 25 bp, Mus musculus
gtttgcactcaaattgccttgagat

SEQ ID NO: 740167 - DNA, 25 bp, Mus musculus
gtttgcactcaatttgccttgagat

SEQ ID NO: 740168 - DNA, 25 bp, Mus musculus
gtttgcactcctagtgggtactgac

SEQ ID NO: 740169 - DNA, 25 bp, Mus musculus
gtttgcactccttgtgggtactgac

SEQ ID NO: 740170 - DNA, 25 bp, Mus musculus
gtttgcactgttactcagcagcagt

SEQ ID NO: 740171 - DNA, 25 bp, Mus musculus
gtttgcactgtttctcagcagcagt

SEQ ID NO: 740172 - DNA, 25 bp, Mus musculus
gtttgcagaacacccaagagcgagc

SEQ ID NO: 740173 - DNA, 25 bp, Mus musculus
gtttgcagaacagccaagagcgagc

SEQ ID NO: 740174 - DNA, 25 bp, Mus musculus
gtttgcagacccaatgaccgcaggt

SEQ ID NO: 740175 - DNA, 25 bp, Mus musculus
gtttgcagaccctatgaccgcaggt

SEQ ID NO: 740176 - DNA, 25 bp, Mus musculus
gtttgcagacggacagcagtgctct

SEQ ID NO: 740177 - DNA, 25 bp, Mus musculus
gtttgcagacggtcagcagtgctct

SEQ ID NO: 740178 - DNA, 25 bp, Mus musculus
gtttgcagagatcaaccctccacga

SEQ ID NO: 740179 - DNA, 25 bp, Mus musculus
gtttgcagagatgaaccctccacga

SEQ ID NO: 740180 - DNA, 25 bp, Mus musculus
gtttgcagaggcctagcctcatccc

SEQ ID NO: 740181 - DNA, 25 bp, Mus musculus
gtttgcagaggcgtagcctcatccc

SEQ ID NO: 740182 - DNA, 25 bp, Mus musculus
gtttgcagatgcacttaacaaccaa

SEQ ID NO: 740183 - DNA, 25 bp, Mus musculus
gtttgcagatgctcttaacaaccaa

SEQ ID NO: 740184 - DNA, 25 bp, Mus musculus
gtttgcagcagacatttctaaacag

SEQ ID NO: 740185 - DNA, 25 bp, Mus musculus
gtttgcagcagagatttctaaacag

SEQ ID NO: 740186 - DNA, 25 bp, Mus musculus
gtttgcagcattctgttcttttgca

SEQ ID NO: 740187 - DNA, 25 bp, Mus musculus
gtttgcagcattgtgttcttttgca

SEQ ID NO: 740188 - DNA, 25 bp, Mus musculus
gtttgcagcggaatactggacatca

SEQ ID NO: 740189 - DNA, 25 bp, Mus musculus
gtttgcagcggattactggacatca

SEQ ID NO: 740190 - DNA, 25 bp, Mus musculus
gtttgcaggacgatattattcatct

SEQ ID NO: 740191 - DNA, 25 bp, Mus musculus
gtttgcaggacgttattattcatct

SEQ ID NO: 740192 - DNA, 25 bp, Mus musculus
gtttgcaggaggaacagatctggtt

SEQ ID NO: 740193 - DNA, 25 bp, Mus musculus
gtttgcaggaggtacagatctggtt

SEQ ID NO: 740194 - DNA, 25 bp, Mus musculus
gtttgcaggatgagccccactggaa

SEQ ID NO: 740195 - DNA, 25 bp, Mus musculus
gtttgcaggatgtgccccactggaa

SEQ ID NO: 740196 - DNA, 25 bp, Mus musculus
gtttgcaggcttaactccggccggg

SEQ ID NO: 740197 - DNA, 25 bp, Mus musculus
gtttgcaggctttactccggccggg

SEQ ID NO: 740198 - DNA, 25 bp, Mus musculus
gtttgcaggtttccactgcccacac

SEQ ID NO: 740199 - DNA, 25 bp, Mus musculus
gtttgcaggtttgcactgcccacac

SEQ ID NO: 740200 - DNA, 25 bp, Mus musculus
gtttgcagtaagcacccatagctga

SEQ ID NO: 740201 - DNA, 25 bp, Mus musculus
gtttgcagtaaggacccatagctga

SEQ ID NO: 740202 - DNA, 25 bp, Mus musculus
gtttgcagtcatatctcttgtagga

SEQ ID NO: 740203 - DNA, 25 bp, Mus musculus
gtttgcagtcatttctcttgtagga

SEQ ID NO: 740204 - DNA, 25 bp, Mus musculus
gtttgcagtgaaagccaggcatcct

SEQ ID NO: 740205 - DNA, 25 bp, Mus musculus
gtttgcagtgaatgccaggcatcct

SEQ ID NO: 740206 - DNA, 25 bp, Mus musculus
gtttgcagtgtcacttccaaggtct

SEQ ID NO: 740207 - DNA, 25 bp, Mus musculus
gtttgcagtgtctcttccaaggtct

SEQ ID NO: 740208 - DNA, 25 bp, Mus musculus
gtttgcagtgttaagttgaaggaca

SEQ ID NO: 740209 - DNA, 25 bp, Mus musculus
gtttgcagtgtttagttgaaggaca

SEQ ID NO: 740210 - DNA, 25 bp, Mus musculus
gtttgcataattaggtctgtgtttt

SEQ ID NO: 740211 - DNA, 25 bp, Mus musculus
gtttgcataatttggtctgtgtttt

SEQ ID NO: 740212 - DNA, 25 bp, Mus musculus
gtttgcatcataatgtcatcttggg

SEQ ID NO: 740213 - DNA, 25 bp, Mus musculus
gtttgcatcatattgtcatcttggg

SEQ ID NO: 740214 - DNA, 25 bp, Mus musculus
gtttgcatccagcttttataactgt

SEQ ID NO: 740215 - DNA, 25 bp, Mus musculus
gtttgcatccaggttttataactgt

SEQ ID NO: 740216 - DNA, 25 bp, Mus musculus
gtttgcatccataagttggagtcca

SEQ ID NO: 740217 - DNA, 25 bp, Mus musculus
gtttgcatccattagttggagtcca

SEQ ID NO: 740218 - DNA, 25 bp, Mus musculus
gtttgcatcgacacctgtaaatgta

SEQ ID NO: 740219 - DNA, 25 bp, Mus musculus
gtttgcatcgactcctgtaaatgta

SEQ ID NO: 740220 - DNA, 25 bp, Mus musculus
gtttgcatctatctaaagccccatc

SEQ ID NO: 740221 - DNA, 25 bp, Mus musculus
gtttgcatctatgtaaagccccatc

SEQ ID NO: 740222 - DNA, 25 bp, Mus musculus
gtttgcatctttattcagctactaa

SEQ ID NO: 740223 - DNA, 25 bp, Mus musculus
gtttgcatcttttttcagctactaa

SEQ ID NO: 740224 - DNA, 25 bp, Mus musculus
gtttgcatgacaacacctgagtaca

SEQ ID NO: 740225 - DNA, 25 bp, Mus musculus
gtttgcatgacatcacctgagtaca

SEQ ID NO: 740226 - DNA, 25 bp, Mus musculus
gtttgcatgactctttcctcaatga

SEQ ID NO: 740227 - DNA, 25 bp, Mus musculus
gtttgcatgactgtttcctcaatga

SEQ ID NO: 740228 - DNA, 25 bp, Mus musculus
gtttgcatgatcacctttgcacata

SEQ ID NO: 740229 - DNA, 25 bp, Mus musculus
gtttgcatgatctcctttgcacata

SEQ ID NO: 740230 - DNA, 25 bp, Mus musculus
gtttgcatgcctatttaactggaaa

SEQ ID NO: 740231 - DNA, 25 bp, Mus musculus
gtttgcatgcctttttaactggaaa

SEQ ID NO: 740232 - DNA, 25 bp, Mus musculus
gtttgcatgcttcttacactttcaa

SEQ ID NO: 740233 - DNA, 25 bp, Mus musculus
gtttgcatgcttgttacactttcaa

SEQ ID NO: 740234 - DNA, 25 bp, Mus musculus
gtttgcatgtacacttattttcagt

SEQ ID NO: 740235 - DNA, 25 bp, Mus musculus
gtttgcatgtactcttattttcagt

SEQ ID NO: 740236 - DNA, 25 bp, Mus musculus
gtttgcatgtctcttctgatgaatt

SEQ ID NO: 740237 - DNA, 25 bp, Mus musculus
gtttgcatgtctgttctgatgaatt

SEQ ID NO: 740238 - DNA, 25 bp, Mus musculus
gtttgcattactacccagcagttcc

SEQ ID NO: 740239 - DNA, 25 bp, Mus musculus
gtttgcattactattaactgctatg

SEQ ID NO: 740240 - DNA, 25 bp, Mus musculus
gtttgcattacttcccagcagttcc

SEQ ID NO: 740241 - DNA, 25 bp, Mus musculus
gtttgcattacttttaactgctatg

SEQ ID NO: 740242 - DNA, 25 bp, Mus musculus
gtttgcattagaatggcacccattt

SEQ ID NO: 740243 - DNA, 25 bp, Mus musculus
gtttgcattagattggcacccattt

SEQ ID NO: 740244 - DNA, 25 bp, Mus musculus
gtttgcattcacagacacggctaag

SEQ ID NO: 740245 - DNA, 25 bp, Mus musculus
gtttgcattcactgacacggctaag

SEQ ID NO: 740246 - DNA, 25 bp, Mus musculus
gtttgcattgcgcttgttactgtaa

SEQ ID NO: 740247 - DNA, 25 bp, Mus musculus
gtttgcattgcggttgttactgtaa

SEQ ID NO: 740248 - DNA, 25 bp, Mus musculus
gtttgcatttcacaaatctgtaaat

SEQ ID NO: 740249 - DNA, 25 bp, Mus musculus
gtttgcatttcagaaatctgtaaat

SEQ ID NO: 740250 - DNA, 25 bp, Mus musculus
gtttgcatttcgctatgtatatgta

SEQ ID NO: 740251 - DNA, 25 bp, Mus musculus
gtttgcatttcggtatgtatatgta

SEQ ID NO: 740252 - DNA, 25 bp, Mus musculus
gtttgcatttctagcagtgtccatg

SEQ ID NO: 740253 - DNA, 25 bp, Mus musculus
gtttgcatttcttgcagtgtccatg

SEQ ID NO: 740254 - DNA, 25 bp, Mus musculus
gtttgcattttaatatgtccctccc

SEQ ID NO: 740255 - DNA, 25 bp, Mus musculus
gtttgcattttattatgtccctccc

SEQ ID NO: 740256 - DNA, 25 bp, Mus musculus
gtttgcattttgcatgaattagttg

SEQ ID NO: 740257 - DNA, 25 bp, Mus musculus
gtttgcattttggatgaattagttg

SEQ ID NO: 740258 - DNA, 25 bp, Mus musculus
gtttgccaaaatccatgagctgcct

SEQ ID NO: 740259 - DNA, 25 bp, Mus musculus
gtttgccaaaatgcatgagctgcct

SEQ ID NO: 740260 - DNA, 25 bp, Mus musculus
gtttgccaaaccaataagctgctca

SEQ ID NO: 740261 - DNA, 25 bp, Mus musculus
gtttgccaaacctataagctgctca

SEQ ID NO: 740262 - DNA, 25 bp, Mus musculus
gtttgccaaagaacgacaactggat

SEQ ID NO: 740263 - DNA, 25 bp, Mus musculus
gtttgccaaagatcgacaactggat

SEQ ID NO: 740264 - DNA, 25 bp, Mus musculus
gtttgccaactgcaagttctcttct

SEQ ID NO: 740265 - DNA, 25 bp, Mus musculus
gtttgccaactggaagttctcttct

SEQ ID NO: 740266 - DNA, 25 bp, Mus musculus
gtttgccaagcacacaggccagtgg

SEQ ID NO: 740267 - DNA, 25 bp, Mus musculus
gtttgccaagcagacaggccagtgg

SEQ ID NO: 740268 - DNA, 25 bp, Mus musculus
gtttgccaatcaatgctggtggtgt

SEQ ID NO: 740269 - DNA, 25 bp, Mus musculus
gtttgccaatcattgctggtggtgt

SEQ ID NO: 740270 - DNA, 25 bp, Mus musculus
gtttgccaatgaattcacgtgcgtt

SEQ ID NO: 740271 - DNA, 25 bp, Mus musculus
gtttgccaatgatttcacgtgcgtt

SEQ ID NO: 740272 - DNA, 25 bp, Mus musculus
gtttgccacaacaatctgcttggga

SEQ ID NO: 740273 - DNA, 25 bp, Mus musculus
gtttgccacaactatctgcttggga

SEQ ID NO: 740274 - DNA, 25 bp, Mus musculus
gtttgccacaagatggatctctctc

SEQ ID NO: 740275 - DNA, 25 bp, Mus musculus
gtttgccacaagttggatctctctc

SEQ ID NO: 740276 - DNA, 25 bp, Mus musculus
gtttgccacctgcaactcagaaaat

SEQ ID NO: 740277 - DNA, 25 bp, Mus musculus
gtttgccacctggaactcagaaaat

SEQ ID NO: 740278 - DNA, 25 bp, Mus musculus
gtttgccactacatttcaacagttt

SEQ ID NO: 740279 - DNA, 25 bp, Mus musculus
gtttgccactacttttcaacagttt

SEQ ID NO: 740280 - DNA, 25 bp, Mus musculus
gtttgccactcgagagaagcacaga

SEQ ID NO: 740281 - DNA, 25 bp, Mus musculus
gtttgccactcgtgagaagcacaga

SEQ ID NO: 740282 - DNA, 25 bp, Mus musculus
gtttgccactgtagtcaaattttca

SEQ ID NO: 740283 - DNA, 25 bp, Mus musculus
gtttgccactgttgtcaaattttca

SEQ ID NO: 740284 - DNA, 25 bp, Mus musculus
gtttgccagctcagagcctgtgcca

SEQ ID NO: 740285 - DNA, 25 bp, Mus musculus
gtttgccagctctgagcctgtgcca

SEQ ID NO: 740286 - DNA, 25 bp, Mus musculus
gtttgccaggaaagagaggactgcc

SEQ ID NO: 740287 - DNA, 25 bp, Mus musculus
gtttgccaggaatgagaggactgcc

SEQ ID NO: 740288 - DNA, 25 bp, Mus musculus
gtttgccaggcacttacatagccat

SEQ ID NO: 740289 - DNA, 25 bp, Mus musculus
gtttgccaggcagttacatagccat

SEQ ID NO: 740290 - DNA, 25 bp, Mus musculus
gtttgccagtaacttgctcatcaca

SEQ ID NO: 740291 - DNA, 25 bp, Mus musculus
gtttgccagtaagttgctcatcaca

SEQ ID NO: 740292 - DNA, 25 bp, Mus musculus
gtttgccagttcctgtaagactaag

SEQ ID NO: 740293 - DNA, 25 bp, Mus musculus
gtttgccagttcgtgtaagactaag

SEQ ID NO: 740294 - DNA, 25 bp, Mus musculus
gtttgccagtttaacatcagccagt

SEQ ID NO: 740295 - DNA, 25 bp, Mus musculus
gtttgccagttttacatcagccagt

SEQ ID NO: 740296 - DNA, 25 bp, Mus musculus
gtttgccatatgaattcaatactaa

SEQ ID NO: 740297 - DNA, 25 bp, Mus musculus
gtttgccatatgtattcaatactaa

SEQ ID NO: 740298 - DNA, 25 bp, Mus musculus
gtttgccatcttcccggttgtgtat

SEQ ID NO: 740299 - DNA, 25 bp, Mus musculus
gtttgccatcttgccggttgtgtat

SEQ ID NO: 740300 - DNA, 25 bp, Mus musculus
gtttgccatgcgatttgatgactga

SEQ ID NO: 740301 - DNA, 25 bp, Mus musculus
gtttgccatgcgttttgatgactga

SEQ ID NO: 740302 - DNA, 25 bp, Mus musculus
gtttgccattcccagtgagtgatga

SEQ ID NO: 740303 - DNA, 25 bp, Mus musculus
gtttgccattccgagtgagtgatga

SEQ ID NO: 740304 - DNA, 25 bp, Mus musculus
gtttgccattgaccccacattggaa

SEQ ID NO: 740305 - DNA, 25 bp, Mus musculus
gtttgccattgagcccacattggaa

SEQ ID NO: 740306 - DNA, 25 bp, Mus musculus
gtttgccatttaacctcatatgcca

SEQ ID NO: 740307 - DNA, 25 bp, Mus musculus
gtttgccatttatcctcatatgcca

SEQ ID NO: 740308 - DNA, 25 bp, Mus musculus
gtttgcccaaaaatgcttctaaatc

SEQ ID NO: 740309 - DNA, 25 bp, Mus musculus
gtttgcccaaaattgcttctaaatc

SEQ ID NO: 740310 - DNA, 25 bp, Mus musculus
gtttgcccaaacatacagtcttttt

SEQ ID NO: 740311 - DNA, 25 bp, Mus musculus
gtttgcccaaacttacagtcttttt

SEQ ID NO: 740312 - DNA, 25 bp, Mus musculus
gtttgcccactgaactaagtaattt

SEQ ID NO: 740313 - DNA, 25 bp, Mus musculus
gtttgcccactgaggcaaatggttt

SEQ ID NO: 740314 - DNA, 25 bp, Mus musculus
gtttgcccactgtactaagtaattt

SEQ ID NO: 740315 - DNA, 25 bp, Mus musculus
gtttgcccactgtggcaaatggttt

SEQ ID NO: 740316 - DNA, 25 bp, Mus musculus
gtttgcccatccagtatgaacatgt

SEQ ID NO: 740317 - DNA, 25 bp, Mus musculus
gtttgcccatcctgtatgaacatgt

SEQ ID NO: 740318 - DNA, 25 bp, Mus musculus
gtttgcccattgatcttgcagttac

SEQ ID NO: 740319 - DNA, 25 bp, Mus musculus
gtttgcccattgttcttgcagttac

SEQ ID NO: 740320 - DNA, 25 bp, Mus musculus
gtttgcccatttatctcttgaacag

SEQ ID NO: 740321 - DNA, 25 bp, Mus musculus
gtttgcccatttttctcttgaacag

SEQ ID NO: 740322 - DNA, 25 bp, Mus musculus
gtttgccccagcacagagtcaagat

SEQ ID NO: 740323 - DNA, 25 bp, Mus musculus
gtttgccccagctcagagtcaagat

SEQ ID NO: 740324 - DNA, 25 bp, Mus musculus
gtttgcccctagcagccatggaaaa

SEQ ID NO: 740325 - DNA, 25 bp, Mus musculus
gtttgcccctaggagccatggaaaa

SEQ ID NO: 740326 - DNA, 25 bp, Mus musculus
gtttgcccctgtaagtagtaagtgt

SEQ ID NO: 740327 - DNA, 25 bp, Mus musculus
gtttgcccctgttagtagtaagtgt

SEQ ID NO: 740328 - DNA, 25 bp, Mus musculus
gtttgcccgcggcaactcagctgag

SEQ ID NO: 740329 - DNA, 25 bp, Mus musculus
gtttgcccgcgggaactcagctgag

SEQ ID NO: 740330 - DNA, 25 bp, Mus musculus
gtttgcccgcgtctgtatttgtgca

SEQ ID NO: 740331 - DNA, 25 bp, Mus musculus
gtttgcccgcgtgtgtatttgtgca

SEQ ID NO: 740332 - DNA, 25 bp, Mus musculus
gtttgcccgtgtattgacttggtta

SEQ ID NO: 740333 - DNA, 25 bp, Mus musculus
gtttgcccgtgttttgacttggtta

SEQ ID NO: 740334 - DNA, 25 bp, Mus musculus
gtttgccctccactctgatgtggat

SEQ ID NO: 740335 - DNA, 25 bp, Mus musculus
gtttgccctccagtctgatgtggat

SEQ ID NO: 740336 - DNA, 25 bp, Mus musculus
gtttgccctgaaccatccagcatat

SEQ ID NO: 740337 - DNA, 25 bp, Mus musculus
gtttgccctgaagcatccagcatat

SEQ ID NO: 740338 - DNA, 25 bp, Mus musculus
gtttgccgggcaagcaaaggaccaa

SEQ ID NO: 740339 - DNA, 25 bp, Mus musculus
gtttgccgggcatgcaaaggaccaa

SEQ ID NO: 740340 - DNA, 25 bp, Mus musculus
gtttgcctaaggacttgcttgcctg

SEQ ID NO: 740341 - DNA, 25 bp, Mus musculus
gtttgcctaaggtcttgcttgcctg

SEQ ID NO: 740342 - DNA, 25 bp, Mus musculus
gtttgcctacagagtgtgtctgttc

SEQ ID NO: 740343 - DNA, 25 bp, Mus musculus
gtttgcctacagtgtgtgtctgttc

SEQ ID NO: 740344 - DNA, 25 bp, Mus musculus
gtttgcctacctcacaactactttg

SEQ ID NO: 740345 - DNA, 25 bp, Mus musculus
gtttgcctacctgacaactactttg

SEQ ID NO: 740346 - DNA, 25 bp, Mus musculus
gtttgcctacttcaacctgctgaag

SEQ ID NO: 740347 - DNA, 25 bp, Mus musculus
gtttgcctacttgaacctgctgaag

SEQ ID NO: 740348 - DNA, 25 bp, Mus musculus
gtttgcctagatcctgcaatgcttt

SEQ ID NO: 740349 - DNA, 25 bp, Mus musculus
gtttgcctagatgctgcaatgcttt

SEQ ID NO: 740350 - DNA, 25 bp, Mus musculus
gtttgcctagcaactgattttctga

SEQ ID NO: 740351 - DNA, 25 bp, Mus musculus
gtttgcctagcatctgattttctga

SEQ ID NO: 740352 - DNA, 25 bp, Mus musculus
gtttgcctcacaattacattggtgg

SEQ ID NO: 740353 - DNA, 25 bp, Mus musculus
gtttgcctcacactaagttactacc

SEQ ID NO: 740354 - DNA, 25 bp, Mus musculus
gtttgcctcacagtaagttactacc

SEQ ID NO: 740355 - DNA, 25 bp, Mus musculus
gtttgcctcacatttacattggtgg

SEQ ID NO: 740356 - DNA, 25 bp, Mus musculus
gtttgcctccagcttatctggcttt

SEQ ID NO: 740357 - DNA, 25 bp, Mus musculus
gtttgcctccaggttatctggcttt

SEQ ID NO: 740358 - DNA, 25 bp, Mus musculus
gtttgcctccctaggaaatgtcaca

SEQ ID NO: 740359 - DNA, 25 bp, Mus musculus
gtttgcctcccttggaaatgtcaca

SEQ ID NO: 740360 - DNA, 25 bp, Mus musculus
gtttgcctctgtataaatacaagct

SEQ ID NO: 740361 - DNA, 25 bp, Mus musculus
gtttgcctctgtttaaatacaagct

SEQ ID NO: 740362 - DNA, 25 bp, Mus musculus
gtttgcctgacaagtatgaggactt

SEQ ID NO: 740363 - DNA, 25 bp, Mus musculus
gtttgcctgacatgtatgaggactt

SEQ ID NO: 740364 - DNA, 25 bp, Mus musculus
gtttgcctgactaagtatttctcaa

SEQ ID NO: 740365 - DNA, 25 bp, Mus musculus
gtttgcctgacttagtatttctcaa

SEQ ID NO: 740366 - DNA, 25 bp, Mus musculus
gtttgcctgatcactattgaatgtt

SEQ ID NO: 740367 - DNA, 25 bp, Mus musculus
gtttgcctgatctctattgaatgtt

SEQ ID NO: 740368 - DNA, 25 bp, Mus musculus
gtttgcctgattcaagtgtctgaga

SEQ ID NO: 740369 - DNA, 25 bp, Mus musculus
gtttgcctgattgaagtgtctgaga

SEQ ID NO: 740370 - DNA, 25 bp, Mus musculus
gtttgcctgcctccttaaataatta

SEQ ID NO: 740371 - DNA, 25 bp, Mus musculus
gtttgcctgcctgcttaaataatta

SEQ ID NO: 740372 - DNA, 25 bp, Mus musculus
gtttgcctggagaatccattcacgt

SEQ ID NO: 740373 - DNA, 25 bp, Mus musculus
gtttgcctggagtatccattcacgt

SEQ ID NO: 740374 - DNA, 25 bp, Mus musculus
gtttgcctgggaatcttactgttga

SEQ ID NO: 740375 - DNA, 25 bp, Mus musculus
gtttgcctgggattcttactgttga

SEQ ID NO: 740376 - DNA, 25 bp, Mus musculus
gtttgcctggtgcaatagatcatgt

SEQ ID NO: 740377 - DNA, 25 bp, Mus musculus
gtttgcctggtggaatagatcatgt

SEQ ID NO: 740378 - DNA, 25 bp, Mus musculus
gtttgcctgtctaaacatctttctt

SEQ ID NO: 740379 - DNA, 25 bp, Mus musculus
gtttgcctgtcttaacatctttctt

SEQ ID NO: 740380 - DNA, 25 bp, Mus musculus
gtttgccttatcagctcacatttat

SEQ ID NO: 740381 - DNA, 25 bp, Mus musculus
gtttgccttatctgctcacatttat

SEQ ID NO: 740382 - DNA, 25 bp, Mus musculus
gtttgccttcacacacaagaggtgg

SEQ ID NO: 740383 - DNA, 25 bp, Mus musculus
gtttgccttcactcacaagaggtgg

SEQ ID NO: 740384 - DNA, 25 bp, Mus musculus
gtttgccttcagagttcacttggaa

SEQ ID NO: 740385 - DNA, 25 bp, Mus musculus
gtttgccttcagtgttcacttggaa

SEQ ID NO: 740386 - DNA, 25 bp, Mus musculus
gtttgccttcctctgttttattgaa

SEQ ID NO: 740387 - DNA, 25 bp, Mus musculus
gtttgccttcctgtgttttattgaa

SEQ ID NO: 740388 - DNA, 25 bp, Mus musculus
gtttgccttgtaagaatgacctaga

SEQ ID NO: 740389 - DNA, 25 bp, Mus musculus
gtttgccttgtatgaatgacctaga

SEQ ID NO: 740390 - DNA, 25 bp, Mus musculus
gtttgcctttggagaacaggttcat

SEQ ID NO: 740391 - DNA, 25 bp, Mus musculus
gtttgcctttggatactaatgtact

SEQ ID NO: 740392 - DNA, 25 bp, Mus musculus
gtttgcctttggtgaacaggttcat

SEQ ID NO: 740393 - DNA, 25 bp, Mus musculus
gtttgcctttggttactaatgtact

SEQ ID NO: 740394 - DNA, 25 bp, Mus musculus
gtttgcgagagaacagttggccaat

SEQ ID NO: 740395 - DNA, 25 bp, Mus musculus
gtttgcgagagatcagttggccaat

SEQ ID NO: 740396 - DNA, 25 bp, Mus musculus
gtttgcgagagcagttcgtggcact

SEQ ID NO: 740397 - DNA, 25 bp, Mus musculus
gtttgcgagagctgttcgtggcact

SEQ ID NO: 740398 - DNA, 25 bp, Mus musculus
gtttgcgatctcataattgctacgt

SEQ ID NO: 740399 - DNA, 25 bp, Mus musculus
gtttgcgatctcttaattgctacgt

SEQ ID NO: 740400 - DNA, 25 bp, Mus musculus
gtttgcgcaataagtcagatcaact

SEQ ID NO: 740401 - DNA, 25 bp, Mus musculus
gtttgcgcaatatgtcagatcaact

SEQ ID NO: 740402 - DNA, 25 bp, Mus musculus
gtttgcgcactcaggaagacaatga

SEQ ID NO: 740403 - DNA, 25 bp, Mus musculus
gtttgcgcactctggaagacaatga

SEQ ID NO: 740404 - DNA, 25 bp, Mus musculus
gtttgcgctttcctgatgtccggtc

SEQ ID NO: 740405 - DNA, 25 bp, Mus musculus
gtttgcgctttcgtgatgtccggtc

SEQ ID NO: 740406 - DNA, 25 bp, Mus musculus
gtttgcgggaccactgatatttcag

SEQ ID NO: 740407 - DNA, 25 bp, Mus musculus
gtttgcgggacctctgatatttcag

SEQ ID NO: 740408 - DNA, 25 bp, Mus musculus
gtttgcgggaggaagcatttgtaca

SEQ ID NO: 740409 - DNA, 25 bp, Mus musculus
gtttgcgggaggtagcatttgtaca

SEQ ID NO: 740410 - DNA, 25 bp, Mus musculus
gtttgcgtctgaattgctatctcct

SEQ ID NO: 740411 - DNA, 25 bp, Mus musculus
gtttgcgtctgatttgctatctcct

SEQ ID NO: 740412 - DNA, 25 bp, Mus musculus
gtttgcgttagtcctgcgtaataat

SEQ ID NO: 740413 - DNA, 25 bp, Mus musculus
gtttgcgttagtgctgcgtaataat

SEQ ID NO: 740414 - DNA, 25 bp, Mus musculus
gtttgctaaggtcgtcctacactct

SEQ ID NO: 740415 - DNA, 25 bp, Mus musculus
gtttgctaaggtggtcctacactct

SEQ ID NO: 740416 - DNA, 25 bp, Mus musculus
gtttgctacagccagctcagatcaa

SEQ ID NO: 740417 - DNA, 25 bp, Mus musculus
gtttgctacagcgagctcagatcaa

SEQ ID NO: 740418 - DNA, 25 bp, Mus musculus
gtttgctactacatccatctgtttg

SEQ ID NO: 740419 - DNA, 25 bp, Mus musculus
gtttgctactacttccatctgtttg

SEQ ID NO: 740420 - DNA, 25 bp, Mus musculus
gtttgctactggctactgttaacct

SEQ ID NO: 740421 - DNA, 25 bp, Mus musculus
gtttgctactgggtactgttaacct

SEQ ID NO: 740422 - DNA, 25 bp, Mus musculus
gtttgctacttaatggaacacctga

SEQ ID NO: 740423 - DNA, 25 bp, Mus musculus
gtttgctacttattggaacacctga

SEQ ID NO: 740424 - DNA, 25 bp, Mus musculus
gtttgctagtgactttcacccatga

SEQ ID NO: 740425 - DNA, 25 bp, Mus musculus
gtttgctagtgagtttcacccatga

SEQ ID NO: 740426 - DNA, 25 bp, Mus musculus
gtttgctatattcctttttctatga

SEQ ID NO: 740427 - DNA, 25 bp, Mus musculus
gtttgctatattgctttttctatga

SEQ ID NO: 740428 - DNA, 25 bp, Mus musculus
gtttgctatgcacacctcacagatc

SEQ ID NO: 740429 - DNA, 25 bp, Mus musculus
gtttgctatgcagacctcacagatc

SEQ ID NO: 740430 - DNA, 25 bp, Mus musculus
gtttgctattaaacgagaactgagt

SEQ ID NO: 740431 - DNA, 25 bp, Mus musculus
gtttgctattaatcgagaactgagt

SEQ ID NO: 740432 - DNA, 25 bp, Mus musculus
gtttgctattagacaggtgcacgct

SEQ ID NO: 740433 - DNA, 25 bp, Mus musculus
gtttgctattagtcaggtgcacgct

SEQ ID NO: 740434 - DNA, 25 bp, Mus musculus
gtttgctattttatgcaggcggtag

SEQ ID NO: 740435 - DNA, 25 bp, Mus musculus
gtttgctattttttgcaggcggtag

SEQ ID NO: 740436 - DNA, 25 bp, Mus musculus
gtttgctcaaatcctctgttctgta

SEQ ID NO: 740437 - DNA, 25 bp, Mus musculus
gtttgctcaaatgctctgttctgta

SEQ ID NO: 740438 - DNA, 25 bp, Mus musculus
gtttgctcaacgaatctggaaggat

SEQ ID NO: 740439 - DNA, 25 bp, Mus musculus
gtttgctcaacgtatctggaaggat

SEQ ID NO: 740440 - DNA, 25 bp, Mus musculus
gtttgctcaactcgcagtttgctca

SEQ ID NO: 740441 - DNA, 25 bp, Mus musculus
gtttgctcaactggcagtttgctca

SEQ ID NO: 740442 - DNA, 25 bp, Mus musculus
gtttgctcagttaattcagttcatc

SEQ ID NO: 740443 - DNA, 25 bp, Mus musculus
gtttgctcagtttattcagttcatc

SEQ ID NO: 740444 - DNA, 25 bp, Mus musculus
gtttgctcatgaagaagagggctcc

SEQ ID NO: 740445 - DNA, 25 bp, Mus musculus
gtttgctcatgatgaagagggctcc

SEQ ID NO: 740446 - DNA, 25 bp, Mus musculus
gtttgctcatgcagcgactgtcaga

SEQ ID NO: 740447 - DNA, 25 bp, Mus musculus
gtttgctcatgctgcgactgtcaga

SEQ ID NO: 740448 - DNA, 25 bp, Mus musculus
gtttgctccacactactttctctgg

SEQ ID NO: 740449 - DNA, 25 bp, Mus musculus
gtttgctccacagtactttctctgg

SEQ ID NO: 740450 - DNA, 25 bp, Mus musculus
gtttgctccagcagtattacacatc

SEQ ID NO: 740451 - DNA, 25 bp, Mus musculus
gtttgctccagctgtattacacatc

SEQ ID NO: 740452 - DNA, 25 bp, Mus musculus
gtttgctccatgacccaaagacttg

SEQ ID NO: 740453 - DNA, 25 bp, Mus musculus
gtttgctccatgtcccaaagacttg

SEQ ID NO: 740454 - DNA, 25 bp, Mus musculus
gtttgctccattcttgtttcttact

SEQ ID NO: 740455 - DNA, 25 bp, Mus musculus
gtttgctccattgttgtttcttact

SEQ ID NO: 740456 - DNA, 25 bp, Mus musculus
gtttgctcccgaaaaataggaatga

SEQ ID NO: 740457 - DNA, 25 bp, Mus musculus
gtttgctcccgataaataggaatga

SEQ ID NO: 740458 - DNA, 25 bp, Mus musculus
gtttgctcctccaacagctagaggt

SEQ ID NO: 740459 - DNA, 25 bp, Mus musculus
gtttgctcctcctacagctagaggt

SEQ ID NO: 740460 - DNA, 25 bp, Mus musculus
gtttgctcctgaactgtagttctca

SEQ ID NO: 740461 - DNA, 25 bp, Mus musculus
gtttgctcctgatctgtagttctca

SEQ ID NO: 740462 - DNA, 25 bp, Mus musculus
gtttgctcgtgtattctggttattt

SEQ ID NO: 740463 - DNA, 25 bp, Mus musculus
gtttgctcgtgttttctggttattt

SEQ ID NO: 740464 - DNA, 25 bp, Mus musculus
gtttgctcgtttcccgtggatgtgc

SEQ ID NO: 740465 - DNA, 25 bp, Mus musculus
gtttgctcgtttgccgtggatgtgc

SEQ ID NO: 740466 - DNA, 25 bp, Mus musculus
gtttgctctcacaagctagtctatt

SEQ ID NO: 740467 - DNA, 25 bp, Mus musculus
gtttgctctcactagctagtctatt

SEQ ID NO: 740468 - DNA, 25 bp, Mus musculus
gtttgctctcatagttagacttgtt

SEQ ID NO: 740469 - DNA, 25 bp, Mus musculus
gtttgctctcattgttagacttgtt

SEQ ID NO: 740470 - DNA, 25 bp, Mus musculus
gtttgctctccaaccaggtgagcgg

SEQ ID NO: 740471 - DNA, 25 bp, Mus musculus
gtttgctctccatccaggtgagcgg

SEQ ID NO: 740472 - DNA, 25 bp, Mus musculus
gtttgctctcccctagttgaagaga

SEQ ID NO: 740473 - DNA, 25 bp, Mus musculus
gtttgctctcccgtagttgaagaga

SEQ ID NO: 740474 - DNA, 25 bp, Mus musculus
gtttgctctctgaagactgcttttt

SEQ ID NO: 740475 - DNA, 25 bp, Mus musculus
gtttgctctctgtagactgcttttt

SEQ ID NO: 740476 - DNA, 25 bp, Mus musculus
gtttgctctgagacgctgcttctac

SEQ ID NO: 740477 - DNA, 25 bp, Mus musculus
gtttgctctgagataagccctggga

SEQ ID NO: 740478 - DNA, 25 bp, Mus musculus
gtttgctctgagtcgctgcttctac

SEQ ID NO: 740479 - DNA, 25 bp, Mus musculus
gtttgctctgagttaagccctggga

SEQ ID NO: 740480 - DNA, 25 bp, Mus musculus
gtttgctctggactgttaatctgtt

SEQ ID NO: 740481 - DNA, 25 bp, Mus musculus
gtttgctctggagtgttaatctgtt

SEQ ID NO: 740482 - DNA, 25 bp, Mus musculus
gtttgctctgttcttattgcttgga

SEQ ID NO: 740483 - DNA, 25 bp, Mus musculus
gtttgctctgttgttattgcttgga

SEQ ID NO: 740484 - DNA, 25 bp, Mus musculus
gtttgctcttgaatgtttcactcca

SEQ ID NO: 740485 - DNA, 25 bp, Mus musculus
gtttgctcttgattgtttcactcca

SEQ ID NO: 740486 - DNA, 25 bp, Mus musculus
gtttgctctttcagacaacacactg

SEQ ID NO: 740487 - DNA, 25 bp, Mus musculus
gtttgctctttcatgatttttacag

SEQ ID NO: 740488 - DNA, 25 bp, Mus musculus
gtttgctctttctgacaacacactg

SEQ ID NO: 740489 - DNA, 25 bp, Mus musculus
gtttgctctttcttgatttttacag

SEQ ID NO: 740490 - DNA, 25 bp, Mus musculus
gtttgctgaaaacatgccatatttt

SEQ ID NO: 740491 - DNA, 25 bp, Mus musculus
gtttgctgaaaagatgccatatttt

SEQ ID NO: 740492 - DNA, 25 bp, Mus musculus
gtttgctgaacacataattcctggc

SEQ ID NO: 740493 - DNA, 25 bp, Mus musculus
gtttgctgaacagataattcctggc

SEQ ID NO: 740494 - DNA, 25 bp, Mus musculus
gtttgctgaactctatggctcgaat

SEQ ID NO: 740495 - DNA, 25 bp, Mus musculus
gtttgctgaactgtatggctcgaat

SEQ ID NO: 740496 - DNA, 25 bp, Mus musculus
gtttgctgaccccagaactgatgtt

SEQ ID NO: 740497 - DNA, 25 bp, Mus musculus
gtttgctgacccgagaactgatgtt

SEQ ID NO: 740498 - DNA, 25 bp, Mus musculus
gtttgctgacctatctagatgactt

SEQ ID NO: 740499 - DNA, 25 bp, Mus musculus
gtttgctgacctttctagatgactt

SEQ ID NO: 740500 - DNA, 25 bp, Mus musculus
gtttgctgagcgaaactggctgcgc

SEQ ID NO: 740501 - DNA, 25 bp, Mus musculus
gtttgctgagcgtaactggctgcgc

SEQ ID NO: 740502 - DNA, 25 bp, Mus musculus
gtttgctgagtgcttctcttttaat

SEQ ID NO: 740503 - DNA, 25 bp, Mus musculus
gtttgctgagtggttctcttttaat

SEQ ID NO: 740504 - DNA, 25 bp, Mus musculus
gtttgctgcacgatacatagaatgt

SEQ ID NO: 740505 - DNA, 25 bp, Mus musculus
gtttgctgcacgttacatagaatgt

SEQ ID NO: 740506 - DNA, 25 bp, Mus musculus
gtttgctgcattagttgctgcactt

SEQ ID NO: 740507 - DNA, 25 bp, Mus musculus
gtttgctgcatttgttgctgcactt

SEQ ID NO: 740508 - DNA, 25 bp, Mus musculus
gtttgctgccaaccccaagaaggag

SEQ ID NO: 740509 - DNA, 25 bp, Mus musculus
gtttgctgccaagcccaagaaggag

SEQ ID NO: 740510 - DNA, 25 bp, Mus musculus
gtttgctgctgacctaatgagtatc

SEQ ID NO: 740511 - DNA, 25 bp, Mus musculus
gtttgctgctgagctaatgagtatc

SEQ ID NO: 740512 - DNA, 25 bp, Mus musculus
gtttgctgctgcattgccacttctt

SEQ ID NO: 740513 - DNA, 25 bp, Mus musculus
gtttgctgctgctttgccacttctt

SEQ ID NO: 740514 - DNA, 25 bp, Mus musculus
gtttgctgctgtcattgtgacttca

SEQ ID NO: 740515 - DNA, 25 bp, Mus musculus
gtttgctgctgtgattgtgacttca

SEQ ID NO: 740516 - DNA, 25 bp, Mus musculus
gtttgctggaaaatatgacttagtt

SEQ ID NO: 740517 - DNA, 25 bp, Mus musculus
gtttgctggaaattatgacttagtt

SEQ ID NO: 740518 - DNA, 25 bp, Mus musculus
gtttgctggctacttctattcattt

SEQ ID NO: 740519 - DNA, 25 bp, Mus musculus
gtttgctggctagttctattcattt

SEQ ID NO: 740520 - DNA, 25 bp, Mus musculus
gtttgctggctgctctcagttaagt

SEQ ID NO: 740521 - DNA, 25 bp, Mus musculus
gtttgctggctggtctcagttaagt

SEQ ID NO: 740522 - DNA, 25 bp, Mus musculus
gtttgctggcttctcgtatactaac

SEQ ID NO: 740523 - DNA, 25 bp, Mus musculus
gtttgctggcttgtcgtatactaac

SEQ ID NO: 740524 - DNA, 25 bp, Mus musculus
gtttgctgggttcactgtaaatttt

SEQ ID NO: 740525 - DNA, 25 bp, Mus musculus
gtttgctgggttgactgtaaatttt

SEQ ID NO: 740526 - DNA, 25 bp, Mus musculus
gtttgctggtgaaagattagcttcc

SEQ ID NO: 740527 - DNA, 25 bp, Mus musculus
gtttgctggtgatagattagcttcc

SEQ ID NO: 740528 - DNA, 25 bp, Mus musculus
gtttgctggttgagctgagtgacct

SEQ ID NO: 740529 - DNA, 25 bp, Mus musculus
gtttgctggttgtgctgagtgacct

SEQ ID NO: 740530 - DNA, 25 bp, Mus musculus
gtttgctgtaaacctctcagttgtc

SEQ ID NO: 740531 - DNA, 25 bp, Mus musculus
gtttgctgtaaagctctcagttgtc

SEQ ID NO: 740532 - DNA, 25 bp, Mus musculus
gtttgctgtaccaggtcaaggcatt

SEQ ID NO: 740533 - DNA, 25 bp, Mus musculus
gtttgctgtacctggtcaaggcatt

SEQ ID NO: 740534 - DNA, 25 bp, Mus musculus
gtttgctgtatgaagtaatatggtt

SEQ ID NO: 740535 - DNA, 25 bp, Mus musculus
gtttgctgtatgtagtaatatggtt

SEQ ID NO: 740536 - DNA, 25 bp, Mus musculus
gtttgctgtcagattctaagtatac

SEQ ID NO: 740537 - DNA, 25 bp, Mus musculus
gtttgctgtcagtttctaagtatac

SEQ ID NO: 740538 - DNA, 25 bp, Mus musculus
gtttgctgtcccagaaagctgagta

SEQ ID NO: 740539 - DNA, 25 bp, Mus musculus
gtttgctgtccctgaaagctgagta

SEQ ID NO: 740540 - DNA, 25 bp, Mus musculus
gtttgctgtgtcatatatccctttc

SEQ ID NO: 740541 - DNA, 25 bp, Mus musculus
gtttgctgtgtcatcatttgattaa

SEQ ID NO: 740542 - DNA, 25 bp, Mus musculus
gtttgctgtgtcttatatccctttc

SEQ ID NO: 740543 - DNA, 25 bp, Mus musculus
gtttgctgtgtcttcatttgattaa

SEQ ID NO: 740544 - DNA, 25 bp, Mus musculus
gtttgctgtgtgcaccttctgtaga

SEQ ID NO: 740545 - DNA, 25 bp, Mus musculus
gtttgctgtgtggaccttctgtaga

SEQ ID NO: 740546 - DNA, 25 bp, Mus musculus
gtttgctgttatcctctgaggttga

SEQ ID NO: 740547 - DNA, 25 bp, Mus musculus
gtttgctgttatgctctgaggttga

SEQ ID NO: 740548 - DNA, 25 bp, Mus musculus
gtttgctgttctcgcaataaacttg

SEQ ID NO: 740549 - DNA, 25 bp, Mus musculus
gtttgctgttctggcaataaacttg

SEQ ID NO: 740550 - DNA, 25 bp, Mus musculus
gtttgctgttggatgtgatttgtta

SEQ ID NO: 740551 - DNA, 25 bp, Mus musculus
gtttgctgttggttgtgatttgtta

SEQ ID NO: 740552 - DNA, 25 bp, Mus musculus
gtttgctgttgtagtatgttgtctc

SEQ ID NO: 740553 - DNA, 25 bp, Mus musculus
gtttgctgttgttgtatgttgtctc

SEQ ID NO: 740554 - DNA, 25 bp, Mus musculus
gtttgcttaaaaagatccaattcta

SEQ ID NO: 740555 - DNA, 25 bp, Mus musculus
gtttgcttaaaatgatccaattcta

SEQ ID NO: 740556 - DNA, 25 bp, Mus musculus
gtttgcttaaatactactgaatctg

SEQ ID NO: 740557 - DNA, 25 bp, Mus musculus
gtttgcttaaattctactgaatctg

SEQ ID NO: 740558 - DNA, 25 bp, Mus musculus
gtttgcttacaaccaaaactgtgca

SEQ ID NO: 740559 - DNA, 25 bp, Mus musculus
gtttgcttacaagcaaaactgtgca

SEQ ID NO: 740560 - DNA, 25 bp, Mus musculus
gtttgcttacatcggtcttcagtca

SEQ ID NO: 740561 - DNA, 25 bp, Mus musculus
gtttgcttacatgggtcttcagtca

SEQ ID NO: 740562 - DNA, 25 bp, Mus musculus
gtttgcttacccagcgtgcatgtga

SEQ ID NO: 740563 - DNA, 25 bp, Mus musculus
gtttgcttaccctgcgtgcatgtga

SEQ ID NO: 740564 - DNA, 25 bp, Mus musculus
gtttgcttacctcaaagagtcactt

SEQ ID NO: 740565 - DNA, 25 bp, Mus musculus
gtttgcttacctgaaagagtcactt

SEQ ID NO: 740566 - DNA, 25 bp, Mus musculus
gtttgcttagacacacagtgggctt

SEQ ID NO: 740567 - DNA, 25 bp, Mus musculus
gtttgcttagactcacagtgggctt

SEQ ID NO: 740568 - DNA, 25 bp, Mus musculus
gtttgcttagcaatatcctggtttg

SEQ ID NO: 740569 - DNA, 25 bp, Mus musculus
gtttgcttagcattatcctggtttg

SEQ ID NO: 740570 - DNA, 25 bp, Mus musculus
gtttgcttagcccactaatgaggat

SEQ ID NO: 740571 - DNA, 25 bp, Mus musculus
gtttgcttagccgactaatgaggat

SEQ ID NO: 740572 - DNA, 25 bp, Mus musculus
gtttgcttagcgatactgaccaggt

SEQ ID NO: 740573 - DNA, 25 bp, Mus musculus
gtttgcttagcgttactgaccaggt

SEQ ID NO: 740574 - DNA, 25 bp, Mus musculus
gtttgcttagttacagagtcacaga

SEQ ID NO: 740575 - DNA, 25 bp, Mus musculus
gtttgcttagtttcagagtcacaga

SEQ ID NO: 740576 - DNA, 25 bp, Mus musculus
gtttgcttatttctcatactcctga

SEQ ID NO: 740577 - DNA, 25 bp, Mus musculus
gtttgcttatttgtcatactcctga

SEQ ID NO: 740578 - DNA, 25 bp, Mus musculus
gtttgcttccttctaattcaagtca

SEQ ID NO: 740579 - DNA, 25 bp, Mus musculus
gtttgcttccttgtaattcaagtca

SEQ ID NO: 740580 - DNA, 25 bp, Mus musculus
gtttgcttctccaggtcgctgtctt

SEQ ID NO: 740581 - DNA, 25 bp, Mus musculus
gtttgcttctcctggtcgctgtctt

SEQ ID NO: 740582 - DNA, 25 bp, Mus musculus
gtttgcttctgaaagtaacactgat

SEQ ID NO: 740583 - DNA, 25 bp, Mus musculus
gtttgcttctgaccttgtatgtgtc

SEQ ID NO: 740584 - DNA, 25 bp, Mus musculus
gtttgcttctgagcttgtatgtgtc

SEQ ID NO: 740585 - DNA, 25 bp, Mus musculus
gtttgcttctgatagtaacactgat

SEQ ID NO: 740586 - DNA, 25 bp, Mus musculus
gtttgcttctgtactggagactaaa

SEQ ID NO: 740587 - DNA, 25 bp, Mus musculus
gtttgcttctgttctggagactaaa

SEQ ID NO: 740588 - DNA, 25 bp, Mus musculus
gtttgcttcttgagtgctagggatt

SEQ ID NO: 740589 - DNA, 25 bp, Mus musculus
gtttgcttcttgcagattttgccgg

SEQ ID NO: 740590 - DNA, 25 bp, Mus musculus
gtttgcttcttggagattttgccgg

SEQ ID NO: 740591 - DNA, 25 bp, Mus musculus
gtttgcttcttgtgtgctagggatt

SEQ ID NO: 740592 - DNA, 25 bp, Mus musculus
gtttgcttgagacacatgtatacat

SEQ ID NO: 740593 - DNA, 25 bp, Mus musculus
gtttgcttgagagacatgtatacat

SEQ ID NO: 740594 - DNA, 25 bp, Mus musculus
gtttgcttgggtatggctttataga

SEQ ID NO: 740595 - DNA, 25 bp, Mus musculus
gtttgcttgggtttggctttataga

SEQ ID NO: 740596 - DNA, 25 bp, Mus musculus
gtttgcttggtcatgtgcgggtacc

SEQ ID NO: 740597 - DNA, 25 bp, Mus musculus
gtttgcttggtcttgtgcgggtacc

SEQ ID NO: 740598 - DNA, 25 bp, Mus musculus
gtttgcttgttaacacatccacagg

SEQ ID NO: 740599 - DNA, 25 bp, Mus musculus
gtttgcttgttaatctctcagtccc

SEQ ID NO: 740600 - DNA, 25 bp, Mus musculus
gtttgcttgttatcacatccacagg

SEQ ID NO: 740601 - DNA, 25 bp, Mus musculus
gtttgcttgttattctctcagtccc

SEQ ID NO: 740602 - DNA, 25 bp, Mus musculus
gtttgcttgttcaagtgactccaca

SEQ ID NO: 740603 - DNA, 25 bp, Mus musculus
gtttgcttgttctagtgactccaca

SEQ ID NO: 740604 - DNA, 25 bp, Mus musculus
gtttgctttaccaaatagtgattgt

SEQ ID NO: 740605 - DNA, 25 bp, Mus musculus
gtttgctttacctaatagtgattgt

SEQ ID NO: 740606 - DNA, 25 bp, Mus musculus
gtttgctttagacttaataccttga

SEQ ID NO: 740607 - DNA, 25 bp, Mus musculus
gtttgctttagagttaataccttga

SEQ ID NO: 740608 - DNA, 25 bp, Mus musculus
gtttgctttattagcccaacttcta

SEQ ID NO: 740609 - DNA, 25 bp, Mus musculus
gtttgctttatttgcccaacttcta

SEQ ID NO: 740610 - DNA, 25 bp, Mus musculus
gtttgctttcaaacatccttaagaa

SEQ ID NO: 740611 - DNA, 25 bp, Mus musculus
gtttgctttcaatcatccttaagaa

SEQ ID NO: 740612 - DNA, 25 bp, Mus musculus
gtttgctttcggcactgacagacaa

SEQ ID NO: 740613 - DNA, 25 bp, Mus musculus
gtttgctttcgggactgacagacaa

SEQ ID NO: 740614 - DNA, 25 bp, Mus musculus
gtttgctttcttctatcttctggaa

SEQ ID NO: 740615 - DNA, 25 bp, Mus musculus
gtttgctttcttgtatcttctggaa

SEQ ID NO: 740616 - DNA, 25 bp, Mus musculus
gtttgctttgtactggcatacagat

SEQ ID NO: 740617 - DNA, 25 bp, Mus musculus
gtttgctttgtagtggcatacagat

SEQ ID NO: 740618 - DNA, 25 bp, Mus musculus
gtttgctttgtgatagcttattgta

SEQ ID NO: 740619 - DNA, 25 bp, Mus musculus
gtttgctttgtgttagcttattgta

SEQ ID NO: 740620 - DNA, 25 bp, Mus musculus
gtttgcttttcaactataccatctc

SEQ ID NO: 740621 - DNA, 25 bp, Mus musculus
gtttgcttttcacttgtgtgtgatg

SEQ ID NO: 740622 - DNA, 25 bp, Mus musculus
gtttgcttttcagttgtgtgtgatg

SEQ ID NO: 740623 - DNA, 25 bp, Mus musculus
gtttgcttttcatctataccatctc

SEQ ID NO: 740624 - DNA, 25 bp, Mus musculus
gtttgcttttctctatctggaaact

SEQ ID NO: 740625 - DNA, 25 bp, Mus musculus
gtttgcttttctgtatctggaaact

SEQ ID NO: 740626 - DNA, 25 bp, Mus musculus
gtttgcttttgaagacagctgaggc

SEQ ID NO: 740627 - DNA, 25 bp, Mus musculus
gtttgcttttgatgacagctgaggc

SEQ ID NO: 740628 - DNA, 25 bp, Mus musculus
gtttgcttttgtccgttactatgac

SEQ ID NO: 740629 - DNA, 25 bp, Mus musculus
gtttgcttttgtccttaccttgcat

SEQ ID NO: 740630 - DNA, 25 bp, Mus musculus
gtttgcttttgtgcgttactatgac

SEQ ID NO: 740631 - DNA, 25 bp, Mus musculus
gtttgcttttgtgcttaccttgcat

SEQ ID NO: 740632 - DNA, 25 bp, Mus musculus
gtttgctttttgcatacacatctca

SEQ ID NO: 740633 - DNA, 25 bp, Mus musculus
gtttgctttttggatacacatctca

SEQ ID NO: 740634 - DNA, 25 bp, Mus musculus
gtttggaaaaccacggcattcctga

SEQ ID NO: 740635 - DNA, 25 bp, Mus musculus
gtttggaaaacctcggcattcctga

SEQ ID NO: 740636 - DNA, 25 bp, Mus musculus
gtttggaaactgataggctgaaagt

SEQ ID NO: 740637 - DNA, 25 bp, Mus musculus
gtttggaaactgttaggctgaaagt

SEQ ID NO: 740638 - DNA, 25 bp, Mus musculus
gtttggaaattgatcactctcacat

SEQ ID NO: 740639 - DNA, 25 bp, Mus musculus
gtttggaaattgttcactctcacat

SEQ ID NO: 740640 - DNA, 25 bp, Mus musculus
gtttggaacaaaatcattgggaagt

SEQ ID NO: 740641 - DNA, 25 bp, Mus musculus
gtttggaacaaattcattgggaagt

SEQ ID NO: 740642 - DNA, 25 bp, Mus musculus
gtttggaacaatcttctctctctct

SEQ ID NO: 740643 - DNA, 25 bp, Mus musculus
gtttggaacaatgttctctctctct

SEQ ID NO: 740644 - DNA, 25 bp, Mus musculus
gtttggaaccgaagtcagacctgag

SEQ ID NO: 740645 - DNA, 25 bp, Mus musculus
gtttggaaccgatgtcagacctgag

SEQ ID NO: 740646 - DNA, 25 bp, Mus musculus
gtttggaactgtcgccgcgcatcta

SEQ ID NO: 740647 - DNA, 25 bp, Mus musculus
gtttggaactgtggccgcgcatcta

SEQ ID NO: 740648 - DNA, 25 bp, Mus musculus
gtttggaagtgaagacagctcagct

SEQ ID NO: 740649 - DNA, 25 bp, Mus musculus
gtttggaagtgatgacagctcagct

SEQ ID NO: 740650 - DNA, 25 bp, Mus musculus
gtttggaatctacacctgcacactt

SEQ ID NO: 740651 - DNA, 25 bp, Mus musculus
gtttggaatctagacctgcacactt

SEQ ID NO: 740652 - DNA, 25 bp, Mus musculus
gtttggaatcttcaggatttttaag

SEQ ID NO: 740653 - DNA, 25 bp, Mus musculus
gtttggaatcttgaggatttttaag

SEQ ID NO: 740654 - DNA, 25 bp, Mus musculus
gtttggacacagacctaacagtggc

SEQ ID NO: 740655 - DNA, 25 bp, Mus musculus
gtttggacacagtcctaacagtggc

SEQ ID NO: 740656 - DNA, 25 bp, Mus musculus
gtttggacactcctttcagagccta

SEQ ID NO: 740657 - DNA, 25 bp, Mus musculus
gtttggacactcgtttcagagccta

SEQ ID NO: 740658 - DNA, 25 bp, Mus musculus
gtttggacacttaggatctgaaatc

SEQ ID NO: 740659 - DNA, 25 bp, Mus musculus
gtttggacactttggatctgaaatc

SEQ ID NO: 740660 - DNA, 25 bp, Mus musculus
gtttggacatatatgtaccttccta

SEQ ID NO: 740661 - DNA, 25 bp, Mus musculus
gtttggacatatttgtaccttccta

SEQ ID NO: 740662 - DNA, 25 bp, Mus musculus
gtttggaccagaattctcggacttc

SEQ ID NO: 740663 - DNA, 25 bp, Mus musculus
gtttggaccagatttctcggacttc

SEQ ID NO: 740664 - DNA, 25 bp, Mus musculus
gtttggaccatgctctgtagtgtag

SEQ ID NO: 740665 - DNA, 25 bp, Mus musculus
gtttggaccatggtctgtagtgtag

SEQ ID NO: 740666 - DNA, 25 bp, Mus musculus
gtttggaccattccttcagtgattt

SEQ ID NO: 740667 - DNA, 25 bp, Mus musculus
gtttggaccattgcttcagtgattt

SEQ ID NO: 740668 - DNA, 25 bp, Mus musculus
gtttggaccccaataagcataggat

SEQ ID NO: 740669 - DNA, 25 bp, Mus musculus
gtttggaccccattaagcataggat

SEQ ID NO: 740670 - DNA, 25 bp, Mus musculus
gtttggacctgaagacctgcagaag

SEQ ID NO: 740671 - DNA, 25 bp, Mus musculus
gtttggacctgatgacctgcagaag

SEQ ID NO: 740672 - DNA, 25 bp, Mus musculus
gtttggacgatcagattcatctctc

SEQ ID NO: 740673 - DNA, 25 bp, Mus musculus
gtttggacgatctgattcatctctc

SEQ ID NO: 740674 - DNA, 25 bp, Mus musculus
gtttggacgcggagtgaacacaatt

SEQ ID NO: 740675 - DNA, 25 bp, Mus musculus
gtttggacgcggtgtgaacacaatt

SEQ ID NO: 740676 - DNA, 25 bp, Mus musculus
gtttggacgtgcatcgagtctcatt

SEQ ID NO: 740677 - DNA, 25 bp, Mus musculus
gtttggacgtgcttcgagtctcatt

SEQ ID NO: 740678 - DNA, 25 bp, Mus musculus
gtttggactcataccgagaaaccca

SEQ ID NO: 740679 - DNA, 25 bp, Mus musculus
gtttggactcattccgagaaaccca

SEQ ID NO: 740680 - DNA, 25 bp, Mus musculus
gtttggactgaacgagtaacctgga

SEQ ID NO: 740681 - DNA, 25 bp, Mus musculus
gtttggactgaaggagtaacctgga

SEQ ID NO: 740682 - DNA, 25 bp, Mus musculus
gtttggactgtacttatagaccgcc

SEQ ID NO: 740683 - DNA, 25 bp, Mus musculus
gtttggactgtagttatagaccgcc

SEQ ID NO: 740684 - DNA, 25 bp, Mus musculus
gtttggactgtgcttgccatggcaa

SEQ ID NO: 740685 - DNA, 25 bp, Mus musculus
gtttggactgtggttgccatggcaa

SEQ ID NO: 740686 - DNA, 25 bp, Mus musculus
gtttggacttaacttccctctatag

SEQ ID NO: 740687 - DNA, 25 bp, Mus musculus
gtttggacttaagttccctctatag

SEQ ID NO: 740688 - DNA, 25 bp, Mus musculus
gtttggacttagagcctgcctggca

SEQ ID NO: 740689 - DNA, 25 bp, Mus musculus
gtttggacttagcacgacacactct

SEQ ID NO: 740690 - DNA, 25 bp, Mus musculus
gtttggacttaggacgacacactct

SEQ ID NO: 740691 - DNA, 25 bp, Mus musculus
gtttggacttagtgcctgcctggca

SEQ ID NO: 740692 - DNA, 25 bp, Mus musculus
gtttggagataccactgctcctata

SEQ ID NO: 740693 - DNA, 25 bp, Mus musculus
gtttggagataccatttcaccccat

SEQ ID NO: 740694 - DNA, 25 bp, Mus musculus
gtttggagatacgactgctcctata

SEQ ID NO: 740695 - DNA, 25 bp, Mus musculus
gtttggagatacgatttcaccccat

SEQ ID NO: 740696 - DNA, 25 bp, Mus musculus
gtttggagatccagtcatcaaaaaa

SEQ ID NO: 740697 - DNA, 25 bp, Mus musculus
gtttggagatcctgtcatcaaaaaa

SEQ ID NO: 740698 - DNA, 25 bp, Mus musculus
gtttggagattcatgcccctgggct

SEQ ID NO: 740699 - DNA, 25 bp, Mus musculus
gtttggagattcttgcccctgggct

SEQ ID NO: 740700 - DNA, 25 bp, Mus musculus
gtttggagcccaagaaccctgatgc

SEQ ID NO: 740701 - DNA, 25 bp, Mus musculus
gtttggagcccatgaaccctgatgc

SEQ ID NO: 740702 - DNA, 25 bp, Mus musculus
gtttggagcctcagacagactttca

SEQ ID NO: 740703 - DNA, 25 bp, Mus musculus
gtttggagcctctgacagactttca

SEQ ID NO: 740704 - DNA, 25 bp, Mus musculus
gtttggagtcccagataaatctcta

SEQ ID NO: 740705 - DNA, 25 bp, Mus musculus
gtttggagtccctgataaatctcta

SEQ ID NO: 740706 - DNA, 25 bp, Mus musculus
gtttggagtgcaactctgatcttga

SEQ ID NO: 740707 - DNA, 25 bp, Mus musculus
gtttggagtgcatctctgatcttga

SEQ ID NO: 740708 - DNA, 25 bp, Mus musculus
gtttggagtgccagcaatcccacag

SEQ ID NO: 740709 - DNA, 25 bp, Mus musculus
gtttggagtgcctgcaatcccacag

SEQ ID NO: 740710 - DNA, 25 bp, Mus musculus
gtttggataccacaggtgctcttct

SEQ ID NO: 740711 - DNA, 25 bp, Mus musculus
gtttggataccagaggtgctcttct

SEQ ID NO: 740712 - DNA, 25 bp, Mus musculus
gtttggatcaagatcttggttctta

SEQ ID NO: 740713 - DNA, 25 bp, Mus musculus
gtttggatcaagttcttggttctta

SEQ ID NO: 740714 - DNA, 25 bp, Mus musculus
gtttggatcacactcttccatttca

SEQ ID NO: 740715 - DNA, 25 bp, Mus musculus
gtttggatcacagtcttccatttca

SEQ ID NO: 740716 - DNA, 25 bp, Mus musculus
gtttggatcccaccacgcagagaaa

SEQ ID NO: 740717 - DNA, 25 bp, Mus musculus
gtttggatcccagcacgcagagaaa

SEQ ID NO: 740718 - DNA, 25 bp, Mus musculus
gtttggatccctaagcactagagtt

SEQ ID NO: 740719 - DNA, 25 bp, Mus musculus
gtttggatcccttagcactagagtt

SEQ ID NO: 740720 - DNA, 25 bp, Mus musculus
gtttggatctccatctggtcttaag

SEQ ID NO: 740721 - DNA, 25 bp, Mus musculus
gtttggatctccttctggtcttaag

SEQ ID NO: 740722 - DNA, 25 bp, Mus musculus
gtttggatcttcctttgatagcagt

SEQ ID NO: 740723 - DNA, 25 bp, Mus musculus
gtttggatcttcgtttgatagcagt

SEQ ID NO: 740724 - DNA, 25 bp, Mus musculus
gtttggatgctgaataagtctagta

SEQ ID NO: 740725 - DNA, 25 bp, Mus musculus
gtttggatgctgtataagtctagta

SEQ ID NO: 740726 - DNA, 25 bp, Mus musculus
gtttggatgcttcgtcacagtgatg

SEQ ID NO: 740727 - DNA, 25 bp, Mus musculus
gtttggatgcttggtcacagtgatg

SEQ ID NO: 740728 - DNA, 25 bp, Mus musculus
gtttggatggcacctatgtcatagt

SEQ ID NO: 740729 - DNA, 25 bp, Mus musculus
gtttggatggcagctatgtcatagt

SEQ ID NO: 740730 - DNA, 25 bp, Mus musculus
gtttggatgtgcagtgtcctggtcc

SEQ ID NO: 740731 - DNA, 25 bp, Mus musculus
gtttggatgtgctgtgtcctggtcc

SEQ ID NO: 740732 - DNA, 25 bp, Mus musculus
gtttggattgtgaaatgctcttatt

SEQ ID NO: 740733 - DNA, 25 bp, Mus musculus
gtttggattgtgtaatgctcttatt

SEQ ID NO: 740734 - DNA, 25 bp, Mus musculus
gtttggattgttacacctatacctt

SEQ ID NO: 740735 - DNA, 25 bp, Mus musculus
gtttggattgtttcacctatacctt

SEQ ID NO: 740736 - DNA, 25 bp, Mus musculus
gtttggatttacaaacctgacacta

SEQ ID NO: 740737 - DNA, 25 bp, Mus musculus
gtttggatttacctatggcattagc

SEQ ID NO: 740738 - DNA, 25 bp, Mus musculus
gtttggatttacgtatggcattagc

SEQ ID NO: 740739 - DNA, 25 bp, Mus musculus
gtttggatttactaacctgacacta

SEQ ID NO: 740740 - DNA, 25 bp, Mus musculus
gtttggatttccattatactgtgaa

SEQ ID NO: 740741 - DNA, 25 bp, Mus musculus
gtttggatttcctttatactgtgaa

SEQ ID NO: 740742 - DNA, 25 bp, Mus musculus
gtttggattttaattgtgatgcaga

SEQ ID NO: 740743 - DNA, 25 bp, Mus musculus
gtttggattttatttgtgatgcaga

SEQ ID NO: 740744 - DNA, 25 bp, Mus musculus
gtttggcaaaacctgtcaacttcta

SEQ ID NO: 740745 - DNA, 25 bp, Mus musculus
gtttggcaaaacgtgtcaacttcta

SEQ ID NO: 740746 - DNA, 25 bp, Mus musculus
gtttggcaaactcttcaccacatta

SEQ ID NO: 740747 - DNA, 25 bp, Mus musculus
gtttggcaaactgttcaccacatta

SEQ ID NO: 740748 - DNA, 25 bp, Mus musculus
gtttggcaaataagcaactcccact

SEQ ID NO: 740749 - DNA, 25 bp, Mus musculus
gtttggcaaatatgcaactcccact

SEQ ID NO: 740750 - DNA, 25 bp, Mus musculus
gtttggcaacttctagcaggccttc

SEQ ID NO: 740751 - DNA, 25 bp, Mus musculus
gtttggcaacttgtagcaggccttc

SEQ ID NO: 740752 - DNA, 25 bp, Mus musculus
gtttggcaataactctctttctgaa

SEQ ID NO: 740753 - DNA, 25 bp, Mus musculus
gtttggcaataagtctctttctgaa

SEQ ID NO: 740754 - DNA, 25 bp, Mus musculus
gtttggcaatcacagatatccccaa

SEQ ID NO: 740755 - DNA, 25 bp, Mus musculus
gtttggcaatcagagatatccccaa

SEQ ID NO: 740756 - DNA, 25 bp, Mus musculus
gtttggcaccatcttgattcaggct

SEQ ID NO: 740757 - DNA, 25 bp, Mus musculus
gtttggcaccatgttgattcaggct

SEQ ID NO: 740758 - DNA, 25 bp, Mus musculus
gtttggcacccacgacagagtttta

SEQ ID NO: 740759 - DNA, 25 bp, Mus musculus
gtttggcacccaggacagagtttta

SEQ ID NO: 740760 - DNA, 25 bp, Mus musculus
gtttggcactaaaactttatacatg

SEQ ID NO: 740761 - DNA, 25 bp, Mus musculus
gtttggcactaatactttatacatg

SEQ ID NO: 740762 - DNA, 25 bp, Mus musculus
gtttggcactgaaaagctcactttc

SEQ ID NO: 740763 - DNA, 25 bp, Mus musculus
gtttggcactgataagctcactttc

SEQ ID NO: 740764 - DNA, 25 bp, Mus musculus
gtttggcactttcatggccattgga

SEQ ID NO: 740765 - DNA, 25 bp, Mus musculus
gtttggcactttgatggccattgga

SEQ ID NO: 740766 - DNA, 25 bp, Mus musculus
gtttggcagagtcaaaaggtctttc

SEQ ID NO: 740767 - DNA, 25 bp, Mus musculus
gtttggcagagtgaaaaggtctttc

SEQ ID NO: 740768 - DNA, 25 bp, Mus musculus
gtttggcatagtctccatcaacatt

SEQ ID NO: 740769 - DNA, 25 bp, Mus musculus
gtttggcatagtgtccatcaacatt

SEQ ID NO: 740770 - DNA, 25 bp, Mus musculus
gtttggcatccacaggttacttctt

SEQ ID NO: 740771 - DNA, 25 bp, Mus musculus
gtttggcatccagaggttacttctt

SEQ ID NO: 740772 - DNA, 25 bp, Mus musculus
gtttggcatcgaagagttcgctgca

SEQ ID NO: 740773 - DNA, 25 bp, Mus musculus
gtttggcatcgatgagttcgctgca

SEQ ID NO: 740774 - DNA, 25 bp, Mus musculus
gtttggcatgtcatcaggaacactt

SEQ ID NO: 740775 - DNA, 25 bp, Mus musculus
gtttggcatgtcttcaggaacactt

SEQ ID NO: 740776 - DNA, 25 bp, Mus musculus
gtttggcattagcatttgcactgaa

SEQ ID NO: 740777 - DNA, 25 bp, Mus musculus
gtttggcattaggatttgcactgaa

SEQ ID NO: 740778 - DNA, 25 bp, Mus musculus
gtttggcattctaactaatagtagt

SEQ ID NO: 740779 - DNA, 25 bp, Mus musculus
gtttggcattcttactaatagtagt

SEQ ID NO: 740780 - DNA, 25 bp, Mus musculus
gtttggccaggcatactgcaggcat

SEQ ID NO: 740781 - DNA, 25 bp, Mus musculus
gtttggccaggcttactgcaggcat

SEQ ID NO: 740782 - DNA, 25 bp, Mus musculus
gtttggccagttcatgttttgtcta

SEQ ID NO: 740783 - DNA, 25 bp, Mus musculus
gtttggccagttgatgttttgtcta

SEQ ID NO: 740784 - DNA, 25 bp, Mus musculus
gtttggccatatcttcatgctcata

SEQ ID NO: 740785 - DNA, 25 bp, Mus musculus
gtttggccatatgttcatgctcata

SEQ ID NO: 740786 - DNA, 25 bp, Mus musculus
gtttggccatgaatttgacctctat

SEQ ID NO: 740787 - DNA, 25 bp, Mus musculus
gtttggccatgattttgacctctat

SEQ ID NO: 740788 - DNA, 25 bp, Mus musculus
gtttggcccacaaatattgaagtct

SEQ ID NO: 740789 - DNA, 25 bp, Mus musculus
gtttggcccacatatattgaagtct

SEQ ID NO: 740790 - DNA, 25 bp, Mus musculus
gtttggccctgaagctaactgaaga

SEQ ID NO: 740791 - DNA, 25 bp, Mus musculus
gtttggccctgatgctaactgaaga

SEQ ID NO: 740792 - DNA, 25 bp, Mus musculus
gtttggccctttcttatttgcacag

SEQ ID NO: 740793 - DNA, 25 bp, Mus musculus
gtttggccctttgttatttgcacag

SEQ ID NO: 740794 - DNA, 25 bp, Mus musculus
gtttggcctatgacctatgacagca

SEQ ID NO: 740795 - DNA, 25 bp, Mus musculus
gtttggcctatgtcctatgacagca

SEQ ID NO: 740796 - DNA, 25 bp, Mus musculus
gtttggcctggaacttactaaatgc

SEQ ID NO: 740797 - DNA, 25 bp, Mus musculus
gtttggcctggacatacatctagac

SEQ ID NO: 740798 - DNA, 25 bp, Mus musculus
gtttggcctggagatacatctagac

SEQ ID NO: 740799 - DNA, 25 bp, Mus musculus
gtttggcctggatcttactaaatgc

SEQ ID NO: 740800 - DNA, 25 bp, Mus musculus
gtttggcggtagaggcttctgcaaa

SEQ ID NO: 740801 - DNA, 25 bp, Mus musculus
gtttggcggtagtggcttctgcaaa

SEQ ID NO: 740802 - DNA, 25 bp, Mus musculus
gtttggcggtgtaaatgcccacgat

SEQ ID NO: 740803 - DNA, 25 bp, Mus musculus
gtttggcggtgttaatgcccacgat

SEQ ID NO: 740804 - DNA, 25 bp, Mus musculus
gtttggctaattcagtttactaagt

SEQ ID NO: 740805 - DNA, 25 bp, Mus musculus
gtttggctaattgagtttactaagt

SEQ ID NO: 740806 - DNA, 25 bp, Mus musculus
gtttggctacttctcatttggtgga

SEQ ID NO: 740807 - DNA, 25 bp, Mus musculus
gtttggctacttgtcatttggtgga

SEQ ID NO: 740808 - DNA, 25 bp, Mus musculus
gtttggctagagactgcaaggtcac

SEQ ID NO: 740809 - DNA, 25 bp, Mus musculus
gtttggctagagtctgcaaggtcac

SEQ ID NO: 740810 - DNA, 25 bp, Mus musculus
gtttggctatgcaactgttcgtttt

SEQ ID NO: 740811 - DNA, 25 bp, Mus musculus
gtttggctatgctactgttcgtttt

SEQ ID NO: 740812 - DNA, 25 bp, Mus musculus
gtttggctcacacacatgacattca

SEQ ID NO: 740813 - DNA, 25 bp, Mus musculus
gtttggctcacagacatgacattca

SEQ ID NO: 740814 - DNA, 25 bp, Mus musculus
gtttggctcattcctttacttcctg

SEQ ID NO: 740815 - DNA, 25 bp, Mus musculus
gtttggctcattgctttacttcctg

SEQ ID NO: 740816 - DNA, 25 bp, Mus musculus
gtttggctccacatggtagcacagt

SEQ ID NO: 740817 - DNA, 25 bp, Mus musculus
gtttggctccacttggtagcacagt

SEQ ID NO: 740818 - DNA, 25 bp, Mus musculus
gtttggctccatcatcactggagag

SEQ ID NO: 740819 - DNA, 25 bp, Mus musculus
gtttggctccatgatcactggagag

SEQ ID NO: 740820 - DNA, 25 bp, Mus musculus
gtttggctctagatctggccaggca

SEQ ID NO: 740821 - DNA, 25 bp, Mus musculus
gtttggctctagttctggccaggca

SEQ ID NO: 740822 - DNA, 25 bp, Mus musculus
gtttggctctgtccttctgaatata

SEQ ID NO: 740823 - DNA, 25 bp, Mus musculus
gtttggctctgtgcttctgaatata

SEQ ID NO: 740824 - DNA, 25 bp, Mus musculus
gtttggctgagaagctaccgtccgt

SEQ ID NO: 740825 - DNA, 25 bp, Mus musculus
gtttggctgagacatgcacattgca

SEQ ID NO: 740826 - DNA, 25 bp, Mus musculus
gtttggctgagagatgcacattgca

SEQ ID NO: 740827 - DNA, 25 bp, Mus musculus
gtttggctgagatgctaccgtccgt

SEQ ID NO: 740828 - DNA, 25 bp, Mus musculus
gtttggctgccccaaaagacgcatt

SEQ ID NO: 740829 - DNA, 25 bp, Mus musculus
gtttggctgcccgaaaagacgcatt

SEQ ID NO: 740830 - DNA, 25 bp, Mus musculus
gtttggctggtgatcgcatcttcaa

SEQ ID NO: 740831 - DNA, 25 bp, Mus musculus
gtttggctggtgttcgcatcttcaa

SEQ ID NO: 740832 - DNA, 25 bp, Mus musculus
gtttggctgtggacttagcccatca

SEQ ID NO: 740833 - DNA, 25 bp, Mus musculus
gtttggctgtggtcttagcccatca

SEQ ID NO: 740834 - DNA, 25 bp, Mus musculus
gtttggcttcatatcatccgagagt

SEQ ID NO: 740835 - DNA, 25 bp, Mus musculus
gtttggcttcatttcatccgagagt

SEQ ID NO: 740836 - DNA, 25 bp, Mus musculus
gtttggcttccaagtatgtgtatat

SEQ ID NO: 740837 - DNA, 25 bp, Mus musculus
gtttggcttccatgtatgtgtatat

SEQ ID NO: 740838 - DNA, 25 bp, Mus musculus
gtttggcttcttatcaaagctggtt

SEQ ID NO: 740839 - DNA, 25 bp, Mus musculus
gtttggcttcttttcaaagctggtt

SEQ ID NO: 740840 - DNA, 25 bp, Mus musculus
gtttggctttataaatctcatcaca

SEQ ID NO: 740841 - DNA, 25 bp, Mus musculus
gtttggctttattaatctcatcaca

SEQ ID NO: 740842 - DNA, 25 bp, Mus musculus
gtttggcttttgacaatccattgca

SEQ ID NO: 740843 - DNA, 25 bp, Mus musculus
gtttggcttttgtcaatccattgca

SEQ ID NO: 740844 - DNA, 25 bp, Mus musculus
gtttgggaagctacctgatgcgtaa

SEQ ID NO: 740845 - DNA, 25 bp, Mus musculus
gtttgggaagcttcctgatgcgtaa

SEQ ID NO: 740846 - DNA, 25 bp, Mus musculus
gtttgggaatgccaccttcttcaat

SEQ ID NO: 740847 - DNA, 25 bp, Mus musculus
gtttgggaatgcgaccttcttcaat

SEQ ID NO: 740848 - DNA, 25 bp, Mus musculus
gtttgggacttgataatctctatag

SEQ ID NO: 740849 - DNA, 25 bp, Mus musculus
gtttgggacttgttaatctctatag

SEQ ID NO: 740850 - DNA, 25 bp, Mus musculus
gtttgggagccaagaagagcactga

SEQ ID NO: 740851 - DNA, 25 bp, Mus musculus
gtttgggagccatgaagagcactga

SEQ ID NO: 740852 - DNA, 25 bp, Mus musculus
gtttgggagtttatcttccactgat

SEQ ID NO: 740853 - DNA, 25 bp, Mus musculus
gtttgggagtttttcttccactgat

SEQ ID NO: 740854 - DNA, 25 bp, Mus musculus
gtttgggcatctaggactctagcat

SEQ ID NO: 740855 - DNA, 25 bp, Mus musculus
gtttgggcatcttggactctagcat

SEQ ID NO: 740856 - DNA, 25 bp, Mus musculus
gtttgggcatgcacctagaaaggat

SEQ ID NO: 740857 - DNA, 25 bp, Mus musculus
gtttgggcatgctcctagaaaggat

SEQ ID NO: 740858 - DNA, 25 bp, Mus musculus
gtttgggcattgatgattacactgt

SEQ ID NO: 740859 - DNA, 25 bp, Mus musculus
gtttgggcattgttgattacactgt

SEQ ID NO: 740860 - DNA, 25 bp, Mus musculus
gtttgggcctaaaagttgaagagct

SEQ ID NO: 740861 - DNA, 25 bp, Mus musculus
gtttgggcctaatagttgaagagct

SEQ ID NO: 740862 - DNA, 25 bp, Mus musculus
gtttgggccttaacaaccattgtat

SEQ ID NO: 740863 - DNA, 25 bp, Mus musculus
gtttgggccttatcaaccattgtat

SEQ ID NO: 740864 - DNA, 25 bp, Mus musculus
gtttgggctcccacctgtttacaga

SEQ ID NO: 740865 - DNA, 25 bp, Mus musculus
gtttgggctccctcctgtttacaga

SEQ ID NO: 740866 - DNA, 25 bp, Mus musculus
gtttgggtaactagtcctgtgcaca

SEQ ID NO: 740867 - DNA, 25 bp, Mus musculus
gtttgggtaactagttcaagatatg

SEQ ID NO: 740868 - DNA, 25 bp, Mus musculus
gtttgggtaacttgtcctgtgcaca

SEQ ID NO: 740869 - DNA, 25 bp, Mus musculus
gtttgggtaacttgttcaagatatg

SEQ ID NO: 740870 - DNA, 25 bp, Mus musculus
gtttgggtacatatcttattcatca

SEQ ID NO: 740871 - DNA, 25 bp, Mus musculus
gtttgggtacatttcttattcatca

SEQ ID NO: 740872 - DNA, 25 bp, Mus musculus
gtttgggtacgtcaacacagtatat

SEQ ID NO: 740873 - DNA, 25 bp, Mus musculus
gtttgggtacgtgaacacagtatat

SEQ ID NO: 740874 - DNA, 25 bp, Mus musculus
gtttgggtcaccatggaacctacag

SEQ ID NO: 740875 - DNA, 25 bp, Mus musculus
gtttgggtcaccttggaacctacag

SEQ ID NO: 740876 - DNA, 25 bp, Mus musculus
gtttgggtctctccgctgtgtgttc

SEQ ID NO: 740877 - DNA, 25 bp, Mus musculus
gtttgggtctctgcgctgtgtgttc

SEQ ID NO: 740878 - DNA, 25 bp, Mus musculus
gtttgggtcttaatcgcggacacac

SEQ ID NO: 740879 - DNA, 25 bp, Mus musculus
gtttgggtcttattcgcggacacac

SEQ ID NO: 740880 - DNA, 25 bp, Mus musculus
gtttgggtgaggagaccccgattct

SEQ ID NO: 740881 - DNA, 25 bp, Mus musculus
gtttgggtgaggtgaccccgattct

SEQ ID NO: 740882 - DNA, 25 bp, Mus musculus
gtttgggtttgaatcctactatggc

SEQ ID NO: 740883 - DNA, 25 bp, Mus musculus
gtttgggtttgattcctactatggc

SEQ ID NO: 740884 - DNA, 25 bp, Mus musculus
gtttggtaacagatgccttcaagct

SEQ ID NO: 740885 - DNA, 25 bp, Mus musculus
gtttggtaacagttgccttcaagct

SEQ ID NO: 740886 - DNA, 25 bp, Mus musculus
gtttggtaactgcctgcattttatt

SEQ ID NO: 740887 - DNA, 25 bp, Mus musculus
gtttggtaactggctgcattttatt

SEQ ID NO: 740888 - DNA, 25 bp, Mus musculus
gtttggtacatccttgaattcagta

SEQ ID NO: 740889 - DNA, 25 bp, Mus musculus
gtttggtacatcgttgaattcagta

SEQ ID NO: 740890 - DNA, 25 bp, Mus musculus
gtttggtaccatcatgtcagctgat

SEQ ID NO: 740891 - DNA, 25 bp, Mus musculus
gtttggtaccatgatgtcagctgat

SEQ ID NO: 740892 - DNA, 25 bp, Mus musculus
gtttggtacctgagtcatttttaga

SEQ ID NO: 740893 - DNA, 25 bp, Mus musculus
gtttggtacctgtgtcatttttaga

SEQ ID NO: 740894 - DNA, 25 bp, Mus musculus
gtttggtactgcattcctggaaatc

SEQ ID NO: 740895 - DNA, 25 bp, Mus musculus
gtttggtactgctttcctggaaatc

SEQ ID NO: 740896 - DNA, 25 bp, Mus musculus
gtttggtatccaaagtgcgccacca

SEQ ID NO: 740897 - DNA, 25 bp, Mus musculus
gtttggtatccatagtgcgccacca

SEQ ID NO: 740898 - DNA, 25 bp, Mus musculus
gtttggtatctgacatcctgagcac

SEQ ID NO: 740899 - DNA, 25 bp, Mus musculus
gtttggtatctgtcatcctgagcac

SEQ ID NO: 740900 - DNA, 25 bp, Mus musculus
gtttggtatgtgagctacagtgtgt

SEQ ID NO: 740901 - DNA, 25 bp, Mus musculus
gtttggtatgtgtgctacagtgtgt

SEQ ID NO: 740902 - DNA, 25 bp, Mus musculus
gtttggtattacattgactatgtcc

SEQ ID NO: 740903 - DNA, 25 bp, Mus musculus
gtttggtattactttgactatgtcc

SEQ ID NO: 740904 - DNA, 25 bp, Mus musculus
gtttggtatttgattcccagtgctg

SEQ ID NO: 740905 - DNA, 25 bp, Mus musculus
gtttggtatttgtttcccagtgctg

SEQ ID NO: 740906 - DNA, 25 bp, Mus musculus
gtttggtcaacgacatagtattcat

SEQ ID NO: 740907 - DNA, 25 bp, Mus musculus
gtttggtcaacgtcatagtattcat

SEQ ID NO: 740908 - DNA, 25 bp, Mus musculus
gtttggtcactgaaacctctcttgt

SEQ ID NO: 740909 - DNA, 25 bp, Mus musculus
gtttggtcactgtaacctctcttgt

SEQ ID NO: 740910 - DNA, 25 bp, Mus musculus
gtttggtcacttcccatacttgaag

SEQ ID NO: 740911 - DNA, 25 bp, Mus musculus
gtttggtcacttgccatacttgaag

SEQ ID NO: 740912 - DNA, 25 bp, Mus musculus
gtttggtcagatccgagtccttact

SEQ ID NO: 740913 - DNA, 25 bp, Mus musculus
gtttggtcagatgcgagtccttact

SEQ ID NO: 740914 - DNA, 25 bp, Mus musculus
gtttggtcaggcagcatcccttatc

SEQ ID NO: 740915 - DNA, 25 bp, Mus musculus
gtttggtcaggctgcatcccttatc

SEQ ID NO: 740916 - DNA, 25 bp, Mus musculus
gtttggtcagttactcatttgggtt

SEQ ID NO: 740917 - DNA, 25 bp, Mus musculus
gtttggtcagtttctcatttgggtt

SEQ ID NO: 740918 - DNA, 25 bp, Mus musculus
gtttggtcatacaagtctgtaatca

SEQ ID NO: 740919 - DNA, 25 bp, Mus musculus
gtttggtcatactagtctgtaatca

SEQ ID NO: 740920 - DNA, 25 bp, Mus musculus
gtttggtcattcaagagttcttgca

SEQ ID NO: 740921 - DNA, 25 bp, Mus musculus
gtttggtcattctagagttcttgca

SEQ ID NO: 740922 - DNA, 25 bp, Mus musculus
gtttggtccacacgattactgccag

SEQ ID NO: 740923 - DNA, 25 bp, Mus musculus
gtttggtccacaggattactgccag

SEQ ID NO: 740924 - DNA, 25 bp, Mus musculus
gtttggtccactcagggtgaaacct

SEQ ID NO: 740925 - DNA, 25 bp, Mus musculus
gtttggtccactgagggtgaaacct

SEQ ID NO: 740926 - DNA, 25 bp, Mus musculus
gtttggtcctatcaacttcttccac

SEQ ID NO: 740927 - DNA, 25 bp, Mus musculus
gtttggtcctatgaacttcttccac

SEQ ID NO: 740928 - DNA, 25 bp, Mus musculus
gtttggtctacacattcttacagta

SEQ ID NO: 740929 - DNA, 25 bp, Mus musculus
gtttggtctacagattcttacagta

SEQ ID NO: 740930 - DNA, 25 bp, Mus musculus
gtttggtctagcatagccagtgact

SEQ ID NO: 740931 - DNA, 25 bp, Mus musculus
gtttggtctagcttagccagtgact

SEQ ID NO: 740932 - DNA, 25 bp, Mus musculus
gtttggtctgatcttttatctcata

SEQ ID NO: 740933 - DNA, 25 bp, Mus musculus
gtttggtctgatgttttatctcata

SEQ ID NO: 740934 - DNA, 25 bp, Mus musculus
gtttggtctgtaactttgtgtttta

SEQ ID NO: 740935 - DNA, 25 bp, Mus musculus
gtttggtctgtatctttgtgtttta

SEQ ID NO: 740936 - DNA, 25 bp, Mus musculus
gtttggtgaaatcgcccagctggct

SEQ ID NO: 740937 - DNA, 25 bp, Mus musculus
gtttggtgaaatggcccagctggct

SEQ ID NO: 740938 - DNA, 25 bp, Mus musculus
gtttggtgatacagcctacaggaga

SEQ ID NO: 740939 - DNA, 25 bp, Mus musculus
gtttggtgatactgcctacaggaga

SEQ ID NO: 740940 - DNA, 25 bp, Mus musculus
gtttggtgatataatttcagctgct

SEQ ID NO: 740941 - DNA, 25 bp, Mus musculus
gtttggtgatattatttcagctgct

SEQ ID NO: 740942 - DNA, 25 bp, Mus musculus
gtttggtgctgcaatatgctgtgga

SEQ ID NO: 740943 - DNA, 25 bp, Mus musculus
gtttggtgctgctatatgctgtgga

SEQ ID NO: 740944 - DNA, 25 bp, Mus musculus
gtttggtggaaactcccattcagtt

SEQ ID NO: 740945 - DNA, 25 bp, Mus musculus
gtttggtggaaagtcccattcagtt

SEQ ID NO: 740946 - DNA, 25 bp, Mus musculus
gtttggtggagcagtggcctttaaa

SEQ ID NO: 740947 - DNA, 25 bp, Mus musculus
gtttggtggagctgtggcctttaaa

SEQ ID NO: 740948 - DNA, 25 bp, Mus musculus
gtttggtgtggaaccatcactgact

SEQ ID NO: 740949 - DNA, 25 bp, Mus musculus
gtttggtgtggatccatcactgact

SEQ ID NO: 740950 - DNA, 25 bp, Mus musculus
gtttggtgtgtgaattccagttcct

SEQ ID NO: 740951 - DNA, 25 bp, Mus musculus
gtttggtgtgtgtattccagttcct

SEQ ID NO: 740952 - DNA, 25 bp, Mus musculus
gtttggtgtttgactcagttatact

SEQ ID NO: 740953 - DNA, 25 bp, Mus musculus
gtttggtgtttgtctcagttatact

SEQ ID NO: 740954 - DNA, 25 bp, Mus musculus
gtttggttacacacagcttttgaca

SEQ ID NO: 740955 - DNA, 25 bp, Mus musculus
gtttggttacactcagcttttgaca

SEQ ID NO: 740956 - DNA, 25 bp, Mus musculus
gtttggttacatcttaggcttcgat

SEQ ID NO: 740957 - DNA, 25 bp, Mus musculus
gtttggttacatgttaggcttcgat

SEQ ID NO: 740958 - DNA, 25 bp, Mus musculus
gtttggttacttcttgcatgatcat

SEQ ID NO: 740959 - DNA, 25 bp, Mus musculus
gtttggttacttgttgcatgatcat

SEQ ID NO: 740960 - DNA, 25 bp, Mus musculus
gtttggttatagatgctgcctggca

SEQ ID NO: 740961 - DNA, 25 bp, Mus musculus
gtttggttatagttgctgcctggca

SEQ ID NO: 740962 - DNA, 25 bp, Mus musculus
gtttggttatctaactgtcttggaa

SEQ ID NO: 740963 - DNA, 25 bp, Mus musculus
gtttggttatcttactgtcttggaa

SEQ ID NO: 740964 - DNA, 25 bp, Mus musculus
gtttggttattaattacactatgga

SEQ ID NO: 740965 - DNA, 25 bp, Mus musculus
gtttggttattatttacactatgga

SEQ ID NO: 740966 - DNA, 25 bp, Mus musculus
gtttggttattgataacagcccaat

SEQ ID NO: 740967 - DNA, 25 bp, Mus musculus
gtttggttattgttaacagcccaat

SEQ ID NO: 740968 - DNA, 25 bp, Mus musculus
gtttggttcactattcttgtgctga

SEQ ID NO: 740969 - DNA, 25 bp, Mus musculus
gtttggttcacttttcttgtgctga

SEQ ID NO: 740970 - DNA, 25 bp, Mus musculus
gtttggttcaggacttagctcagta

SEQ ID NO: 740971 - DNA, 25 bp, Mus musculus
gtttggttcaggtcttagctcagta

SEQ ID NO: 740972 - DNA, 25 bp, Mus musculus
gtttggttcataactgtgagactca

SEQ ID NO: 740973 - DNA, 25 bp, Mus musculus
gtttggttcatatctgtgagactca

SEQ ID NO: 740974 - DNA, 25 bp, Mus musculus
gtttggttccccacagataatgtac

SEQ ID NO: 740975 - DNA, 25 bp, Mus musculus
gtttggttcccctcagataatgtac

SEQ ID NO: 740976 - DNA, 25 bp, Mus musculus
gtttggttccttcgcagttttgaag

SEQ ID NO: 740977 - DNA, 25 bp, Mus musculus
gtttggttccttggcagttttgaag

SEQ ID NO: 740978 - DNA, 25 bp, Mus musculus
gtttggttcggtattcttgcataaa

SEQ ID NO: 740979 - DNA, 25 bp, Mus musculus
gtttggttcggttttcttgcataaa

SEQ ID NO: 740980 - DNA, 25 bp, Mus musculus
gtttggttctagactccatcagctt

SEQ ID NO: 740981 - DNA, 25 bp, Mus musculus
gtttggttctagtctccatcagctt

SEQ ID NO: 740982 - DNA, 25 bp, Mus musculus
gtttggttgtacatagcagccctgg

SEQ ID NO: 740983 - DNA, 25 bp, Mus musculus
gtttggttgtacttagcagccctgg

SEQ ID NO: 740984 - DNA, 25 bp, Mus musculus
gtttggttgttgaggatcatcccga

SEQ ID NO: 740985 - DNA, 25 bp, Mus musculus
gtttggttgttgtggatcatcccga

SEQ ID NO: 740986 - DNA, 25 bp, Mus musculus
gtttggtttacaattcaagcattgc

SEQ ID NO: 740987 - DNA, 25 bp, Mus musculus
gtttggtttacatttcaagcattgc

SEQ ID NO: 740988 - DNA, 25 bp, Mus musculus
gtttggtttcacatgtattgttcca

SEQ ID NO: 740989 - DNA, 25 bp, Mus musculus
gtttggtttcacttgtattgttcca

SEQ ID NO: 740990 - DNA, 25 bp, Mus musculus
gtttggtttctaagactgcttgcct

SEQ ID NO: 740991 - DNA, 25 bp, Mus musculus
gtttggtttctaccactcacattgt

SEQ ID NO: 740992 - DNA, 25 bp, Mus musculus
gtttggtttctagcactcacattgt

SEQ ID NO: 740993 - DNA, 25 bp, Mus musculus
gtttggtttctatgactgcttgcct

SEQ ID NO: 740994 - DNA, 25 bp, Mus musculus
gtttggtttgatactggtacatggc

SEQ ID NO: 740995 - DNA, 25 bp, Mus musculus
gtttggtttgattctggtacatggc

SEQ ID NO: 740996 - DNA, 25 bp, Mus musculus
gtttggtttgcactgttaggattga

SEQ ID NO: 740997 - DNA, 25 bp, Mus musculus
gtttggtttgcagtgttaggattga

SEQ ID NO: 740998 - DNA, 25 bp, Mus musculus
gtttggtttgctctgccttgctatt

SEQ ID NO: 740999 - DNA, 25 bp, Mus musculus
gtttggtttgctgtgccttgctatt

SEQ ID NO: 741000 - DNA, 25 bp, Mus musculus
gtttggttttgcatgacattttgtt

SEQ ID NO: 741001 - DNA, 25 bp, Mus musculus
gtttggttttgcttgacattttgtt

SEQ ID NO: 741002 - DNA, 25 bp, Mus musculus
gtttgtaaaagacatgatgacgcat

SEQ ID NO: 741003 - DNA, 25 bp, Mus musculus
gtttgtaaaagagatgatgacgcat

SEQ ID NO: 741004 - DNA, 25 bp, Mus musculus
gtttgtaaacaacaagcccttgttg

SEQ ID NO: 741005 - DNA, 25 bp, Mus musculus
gtttgtaaacaagaagcccttgttg

SEQ ID NO: 741006 - DNA, 25 bp, Mus musculus
gtttgtaaatccatagacgcttgag

SEQ ID NO: 741007 - DNA, 25 bp, Mus musculus
gtttgtaaatccttagacgcttgag

SEQ ID NO: 741008 - DNA, 25 bp, Mus musculus
gtttgtaaccataggccggttgagt

SEQ ID NO: 741009 - DNA, 25 bp, Mus musculus
gtttgtaaccatcctgttaatgaac

SEQ ID NO: 741010 - DNA, 25 bp, Mus musculus
gtttgtaaccatgctgttaatgaac

SEQ ID NO: 741011 - DNA, 25 bp, Mus musculus
gtttgtaaccattggccggttgagt

SEQ ID NO: 741012 - DNA, 25 bp, Mus musculus
gtttgtaacgcgatattctttgtga

SEQ ID NO: 741013 - DNA, 25 bp, Mus musculus
gtttgtaacgcgttattctttgtga

SEQ ID NO: 741014 - DNA, 25 bp, Mus musculus
gtttgtaagcaccatggactttata

SEQ ID NO: 741015 - DNA, 25 bp, Mus musculus
gtttgtaagcacgatggactttata

SEQ ID NO: 741016 - DNA, 25 bp, Mus musculus
gtttgtaataatcatacacgacgaa

SEQ ID NO: 741017 - DNA, 25 bp, Mus musculus
gtttgtaataatgatacacgacgaa

SEQ ID NO: 741018 - DNA, 25 bp, Mus musculus
gtttgtacagaaaagccttgtccta

SEQ ID NO: 741019 - DNA, 25 bp, Mus musculus
gtttgtacagaatagccttgtccta

SEQ ID NO: 741020 - DNA, 25 bp, Mus musculus
gtttgtacagccatttctagagact

SEQ ID NO: 741021 - DNA, 25 bp, Mus musculus
gtttgtacagccttttctagagact

SEQ ID NO: 741022 - DNA, 25 bp, Mus musculus
gtttgtacatccattgtttgaattt

SEQ ID NO: 741023 - DNA, 25 bp, Mus musculus
gtttgtacatcctttgtttgaattt

SEQ ID NO: 741024 - DNA, 25 bp, Mus musculus
gtttgtacatgtatggcccaggaat

SEQ ID NO: 741025 - DNA, 25 bp, Mus musculus
gtttgtacatgtttggcccaggaat

SEQ ID NO: 741026 - DNA, 25 bp, Mus musculus
gtttgtacctacatgcttggactca

SEQ ID NO: 741027 - DNA, 25 bp, Mus musculus
gtttgtacctacttgcttggactca

SEQ ID NO: 741028 - DNA, 25 bp, Mus musculus
gtttgtacgcaaccttgccaacacg

SEQ ID NO: 741029 - DNA, 25 bp, Mus musculus
gtttgtacgcaagcttgccaacacg

SEQ ID NO: 741030 - DNA, 25 bp, Mus musculus
gtttgtactacgcatgcctgcattg

SEQ ID NO: 741031 - DNA, 25 bp, Mus musculus
gtttgtactacggatgcctgcattg

SEQ ID NO: 741032 - DNA, 25 bp, Mus musculus
gtttgtactagtcaacccatctcag

SEQ ID NO: 741033 - DNA, 25 bp, Mus musculus
gtttgtactagtgaacccatctcag

SEQ ID NO: 741034 - DNA, 25 bp, Mus musculus
gtttgtactatgatccatgcactca

SEQ ID NO: 741035 - DNA, 25 bp, Mus musculus
gtttgtactatgttccatgcactca

SEQ ID NO: 741036 - DNA, 25 bp, Mus musculus
gtttgtactcaaaatggccatgttg

SEQ ID NO: 741037 - DNA, 25 bp, Mus musculus
gtttgtactcaatatggccatgttg

SEQ ID NO: 741038 - DNA, 25 bp, Mus musculus
gtttgtactccaacaatgtttactt

SEQ ID NO: 741039 - DNA, 25 bp, Mus musculus
gtttgtactccatcaatgtttactt

SEQ ID NO: 741040 - DNA, 25 bp, Mus musculus
gtttgtactcgccatgttaagcagg

SEQ ID NO: 741041 - DNA, 25 bp, Mus musculus
gtttgtactcgcgatgttaagcagg

SEQ ID NO: 741042 - DNA, 25 bp, Mus musculus
gtttgtacttttagctaatagtttg

SEQ ID NO: 741043 - DNA, 25 bp, Mus musculus
gtttgtactttttgctaatagtttg

SEQ ID NO: 741044 - DNA, 25 bp, Mus musculus
gtttgtagaaatatgcccagtggta

SEQ ID NO: 741045 - DNA, 25 bp, Mus musculus
gtttgtagaaatttgcccagtggta

SEQ ID NO: 741046 - DNA, 25 bp, Mus musculus
gtttgtagaaccagagcttgtccct

SEQ ID NO: 741047 - DNA, 25 bp, Mus musculus
gtttgtagaacctgagcttgtccct

SEQ ID NO: 741048 - DNA, 25 bp, Mus musculus
gtttgtagacagagcccttcttgca

SEQ ID NO: 741049 - DNA, 25 bp, Mus musculus
gtttgtagacagtgcccttcttgca

SEQ ID NO: 741050 - DNA, 25 bp, Mus musculus
gtttgtagactgaaaccctgccaag

SEQ ID NO: 741051 - DNA, 25 bp, Mus musculus
gtttgtagactgtaaccctgccaag

SEQ ID NO: 741052 - DNA, 25 bp, Mus musculus
gtttgtagatacagtcgctggtcat

SEQ ID NO: 741053 - DNA, 25 bp, Mus musculus
gtttgtagatactgtcgctggtcat

SEQ ID NO: 741054 - DNA, 25 bp, Mus musculus
gtttgtagcattcgcctcttaagca

SEQ ID NO: 741055 - DNA, 25 bp, Mus musculus
gtttgtagcattggcctcttaagca

SEQ ID NO: 741056 - DNA, 25 bp, Mus musculus
gtttgtagccaccaagccacaagta

SEQ ID NO: 741057 - DNA, 25 bp, Mus musculus
gtttgtagccacgaagccacaagta

SEQ ID NO: 741058 - DNA, 25 bp, Mus musculus
gtttgtagctgacagattacttgga

SEQ ID NO: 741059 - DNA, 25 bp, Mus musculus
gtttgtagctgagagattacttgga

SEQ ID NO: 741060 - DNA, 25 bp, Mus musculus
gtttgtagtgtgagctccctaaaat

SEQ ID NO: 741061 - DNA, 25 bp, Mus musculus
gtttgtagtgtgtgctccctaaaat

SEQ ID NO: 741062 - DNA, 25 bp, Mus musculus
gtttgtagtttgcttgaccgcatcg

SEQ ID NO: 741063 - DNA, 25 bp, Mus musculus
gtttgtagtttggttgaccgcatcg

SEQ ID NO: 741064 - DNA, 25 bp, Mus musculus
gtttgtatacatcaagcacttgaat

SEQ ID NO: 741065 - DNA, 25 bp, Mus musculus
gtttgtatacatgaagcacttgaat

SEQ ID NO: 741066 - DNA, 25 bp, Mus musculus
gtttgtatacggaacaggcagctgc

SEQ ID NO: 741067 - DNA, 25 bp, Mus musculus
gtttgtatacggtacaggcagctgc

SEQ ID NO: 741068 - DNA, 25 bp, Mus musculus
gtttgtatcaccagaaatttttctc

SEQ ID NO: 741069 - DNA, 25 bp, Mus musculus
gtttgtatcacctgaaatttttctc

SEQ ID NO: 741070 - DNA, 25 bp, Mus musculus
gtttgtatccatccttgggtaccca

SEQ ID NO: 741071 - DNA, 25 bp, Mus musculus
gtttgtatccatgcttgggtaccca

SEQ ID NO: 741072 - DNA, 25 bp, Mus musculus
gtttgtatcctaacttgcccatatt

SEQ ID NO: 741073 - DNA, 25 bp, Mus musculus
gtttgtatcctatcttgcccatatt

SEQ ID NO: 741074 - DNA, 25 bp, Mus musculus
gtttgtatcggtctctgtttttagg

SEQ ID NO: 741075 - DNA, 25 bp, Mus musculus
gtttgtatcggtgtctgtttttagg

SEQ ID NO: 741076 - DNA, 25 bp, Mus musculus
gtttgtatctatcacgtacctaatc

SEQ ID NO: 741077 - DNA, 25 bp, Mus musculus
gtttgtatctatgacgtacctaatc

SEQ ID NO: 741078 - DNA, 25 bp, Mus musculus
gtttgtatctctacaaaacaatagg

SEQ ID NO: 741079 - DNA, 25 bp, Mus musculus
gtttgtatctcttcaaaacaatagg

SEQ ID NO: 741080 - DNA, 25 bp, Mus musculus
gtttgtatgaacctccaggagcacc

SEQ ID NO: 741081 - DNA, 25 bp, Mus musculus
gtttgtatgaacgtccaggagcacc

SEQ ID NO: 741082 - DNA, 25 bp, Mus musculus
gtttgtatgcgtattgtctttggtt

SEQ ID NO: 741083 - DNA, 25 bp, Mus musculus
gtttgtatgcgttttgtctttggtt

SEQ ID NO: 741084 - DNA, 25 bp, Mus musculus
gtttgtatgcttctatgtgtatata

SEQ ID NO: 741085 - DNA, 25 bp, Mus musculus
gtttgtatgcttgtatgtgtatata

SEQ ID NO: 741086 - DNA, 25 bp, Mus musculus
gtttgtatggctcacacaggcctat

SEQ ID NO: 741087 - DNA, 25 bp, Mus musculus
gtttgtatggctgacacaggcctat

SEQ ID NO: 741088 - DNA, 25 bp, Mus musculus
gtttgtatgtacaatcttttccttg

SEQ ID NO: 741089 - DNA, 25 bp, Mus musculus
gtttgtatgtactatcttttccttg

SEQ ID NO: 741090 - DNA, 25 bp, Mus musculus
gtttgtatgtatccgcccacacggc

SEQ ID NO: 741091 - DNA, 25 bp, Mus musculus
gtttgtatgtatgcgcccacacggc

SEQ ID NO: 741092 - DNA, 25 bp, Mus musculus
gtttgtattcaccagttggcaccat

SEQ ID NO: 741093 - DNA, 25 bp, Mus musculus
gtttgtattcacctgctttttagtt

SEQ ID NO: 741094 - DNA, 25 bp, Mus musculus
gtttgtattcacgagttggcaccat

SEQ ID NO: 741095 - DNA, 25 bp, Mus musculus
gtttgtattcacgtgctttttagtt

SEQ ID NO: 741096 - DNA, 25 bp, Mus musculus
gtttgtattcctcataattcctatt

SEQ ID NO: 741097 - DNA, 25 bp, Mus musculus
gtttgtattcctgataattcctatt

SEQ ID NO: 741098 - DNA, 25 bp, Mus musculus
gtttgtattcgtcttcattgtgatt

SEQ ID NO: 741099 - DNA, 25 bp, Mus musculus
gtttgtattcgtgttcattgtgatt

SEQ ID NO: 741100 - DNA, 25 bp, Mus musculus
gtttgtattctaaccttgtcattag

SEQ ID NO: 741101 - DNA, 25 bp, Mus musculus
gtttgtattctatccttgtcattag

SEQ ID NO: 741102 - DNA, 25 bp, Mus musculus
gtttgtatttatatccagaccaata

SEQ ID NO: 741103 - DNA, 25 bp, Mus musculus
gtttgtatttatttccagaccaata

SEQ ID NO: 741104 - DNA, 25 bp, Mus musculus
gtttgtatttctccagtttctgaca

SEQ ID NO: 741105 - DNA, 25 bp, Mus musculus
gtttgtatttctgcagtttctgaca

SEQ ID NO: 741106 - DNA, 25 bp, Mus musculus
gtttgtattttcagtagggctacac

SEQ ID NO: 741107 - DNA, 25 bp, Mus musculus
gtttgtattttctgtagggctacac

SEQ ID NO: 741108 - DNA, 25 bp, Mus musculus
gtttgtcaaactccaggtgacccat

SEQ ID NO: 741109 - DNA, 25 bp, Mus musculus
gtttgtcaaactgcaggtgacccat

SEQ ID NO: 741110 - DNA, 25 bp, Mus musculus
gtttgtcaaaggaggcatagctttt

SEQ ID NO: 741111 - DNA, 25 bp, Mus musculus
gtttgtcaaaggtggcatagctttt

SEQ ID NO: 741112 - DNA, 25 bp, Mus musculus
gtttgtcaaatacgtctcatacttc

SEQ ID NO: 741113 - DNA, 25 bp, Mus musculus
gtttgtcaaataggtctcatacttc

SEQ ID NO: 741114 - DNA, 25 bp, Mus musculus
gtttgtcaaggtatcccctttgcag

SEQ ID NO: 741115 - DNA, 25 bp, Mus musculus
gtttgtcaaggtttcccctttgcag

SEQ ID NO: 741116 - DNA, 25 bp, Mus musculus
gtttgtcaagtccagtggctcctaa

SEQ ID NO: 741117 - DNA, 25 bp, Mus musculus
gtttgtcaagtcgagtggctcctaa

SEQ ID NO: 741118 - DNA, 25 bp, Mus musculus
gtttgtcacaagcatggtactgggt

SEQ ID NO: 741119 - DNA, 25 bp, Mus musculus
gtttgtcacaaggatggtactgggt

SEQ ID NO: 741120 - DNA, 25 bp, Mus musculus
gtttgtcacaggaacttccaaggta

SEQ ID NO: 741121 - DNA, 25 bp, Mus musculus
gtttgtcacaggtacttccaaggta

SEQ ID NO: 741122 - DNA, 25 bp, Mus musculus
gtttgtcacatcaatgtgtggcaga

SEQ ID NO: 741123 - DNA, 25 bp, Mus musculus
gtttgtcacatctatgtgtggcaga

SEQ ID NO: 741124 - DNA, 25 bp, Mus musculus
gtttgtcacattaggactttctcca

SEQ ID NO: 741125 - DNA, 25 bp, Mus musculus
gtttgtcacatttggactttctcca

SEQ ID NO: 741126 - DNA, 25 bp, Mus musculus
gtttgtcaccccacgataaagaaag

SEQ ID NO: 741127 - DNA, 25 bp, Mus musculus
gtttgtcacccctcgataaagaaag

SEQ ID NO: 741128 - DNA, 25 bp, Mus musculus
gtttgtcactacacatcatgggctt

SEQ ID NO: 741129 - DNA, 25 bp, Mus musculus
gtttgtcactactcatcatgggctt

SEQ ID NO: 741130 - DNA, 25 bp, Mus musculus
gtttgtcactcgaaggaaccgccaa

SEQ ID NO: 741131 - DNA, 25 bp, Mus musculus
gtttgtcactcgtaggaaccgccaa

SEQ ID NO: 741132 - DNA, 25 bp, Mus musculus
gtttgtcagctacccaacatgcttg

SEQ ID NO: 741133 - DNA, 25 bp, Mus musculus
gtttgtcagctagccaacatgcttg

SEQ ID NO: 741134 - DNA, 25 bp, Mus musculus
gtttgtcagtagatgtaaatccaga

SEQ ID NO: 741135 - DNA, 25 bp, Mus musculus
gtttgtcagtagctgcagaactcca

SEQ ID NO: 741136 - DNA, 25 bp, Mus musculus
gtttgtcagtaggtgcagaactcca

SEQ ID NO: 741137 - DNA, 25 bp, Mus musculus
gtttgtcagtagttgtaaatccaga

SEQ ID NO: 741138 - DNA, 25 bp, Mus musculus
gtttgtcagttacttccggtaatct

SEQ ID NO: 741139 - DNA, 25 bp, Mus musculus
gtttgtcagttagttccggtaatct

SEQ ID NO: 741140 - DNA, 25 bp, Mus musculus
gtttgtcatacactttcagggtaca

SEQ ID NO: 741141 - DNA, 25 bp, Mus musculus
gtttgtcatacagtttcagggtaca

SEQ ID NO: 741142 - DNA, 25 bp, Mus musculus
gtttgtcatcgtatcatacttcata

SEQ ID NO: 741143 - DNA, 25 bp, Mus musculus
gtttgtcatcgtttcatacttcata

SEQ ID NO: 741144 - DNA, 25 bp, Mus musculus
gtttgtcatctactactttgtgtgt

SEQ ID NO: 741145 - DNA, 25 bp, Mus musculus
gtttgtcatctagtactttgtgtgt

SEQ ID NO: 741146 - DNA, 25 bp, Mus musculus
gtttgtcatctcagattctgcctga

SEQ ID NO: 741147 - DNA, 25 bp, Mus musculus
gtttgtcatctctgattctgcctga

SEQ ID NO: 741148 - DNA, 25 bp, Mus musculus
gtttgtcattgccaagccggatgtc

SEQ ID NO: 741149 - DNA, 25 bp, Mus musculus
gtttgtcattgcgaagccggatgtc

SEQ ID NO: 741150 - DNA, 25 bp, Mus musculus
gtttgtcatttcaccctagttattc

SEQ ID NO: 741151 - DNA, 25 bp, Mus musculus
gtttgtcatttctccctagttattc

SEQ ID NO: 741152 - DNA, 25 bp, Mus musculus
gtttgtccacaaagttctgtagtac

SEQ ID NO: 741153 - DNA, 25 bp, Mus musculus
gtttgtccacaatgttctgtagtac

SEQ ID NO: 741154 - DNA, 25 bp, Mus musculus
gtttgtccagcaaattgtccaagcc

SEQ ID NO: 741155 - DNA, 25 bp, Mus musculus
gtttgtccagcatattgtccaagcc

SEQ ID NO: 741156 - DNA, 25 bp, Mus musculus
gtttgtccagtacgcacagggctct

SEQ ID NO: 741157 - DNA, 25 bp, Mus musculus
gtttgtccagtaggcacagggctct

SEQ ID NO: 741158 - DNA, 25 bp, Mus musculus
gtttgtccatctcctgaaatatgaa

SEQ ID NO: 741159 - DNA, 25 bp, Mus musculus
gtttgtccatctgctgaaatatgaa

SEQ ID NO: 741160 - DNA, 25 bp, Mus musculus
gtttgtcccagcctattacacatgt

SEQ ID NO: 741161 - DNA, 25 bp, Mus musculus
gtttgtcccagcgtattacacatgt

SEQ ID NO: 741162 - DNA, 25 bp, Mus musculus
gtttgtccccaaacacttttaagtg

SEQ ID NO: 741163 - DNA, 25 bp, Mus musculus
gtttgtccccaatcacttttaagtg

SEQ ID NO: 741164 - DNA, 25 bp, Mus musculus
gtttgtccctaaatgctcggtagca

SEQ ID NO: 741165 - DNA, 25 bp, Mus musculus
gtttgtccctaattgctcggtagca

SEQ ID NO: 741166 - DNA, 25 bp, Mus musculus
gtttgtccctggcatctgataccag

SEQ ID NO: 741167 - DNA, 25 bp, Mus musculus
gtttgtccctgggatctgataccag

SEQ ID NO: 741168 - DNA, 25 bp, Mus musculus
gtttgtccctttctctggtcgtgga

SEQ ID NO: 741169 - DNA, 25 bp, Mus musculus
gtttgtccctttgtctggtcgtgga

SEQ ID NO: 741170 - DNA, 25 bp, Mus musculus
gtttgtccgtccatcaagcagttaa

SEQ ID NO: 741171 - DNA, 25 bp, Mus musculus
gtttgtccgtccttcaagcagttaa

SEQ ID NO: 741172 - DNA, 25 bp, Mus musculus
gtttgtcctgacaggagtactcaca

SEQ ID NO: 741173 - DNA, 25 bp, Mus musculus
gtttgtcctgactggagtactcaca

SEQ ID NO: 741174 - DNA, 25 bp, Mus musculus
gtttgtcctgtcatttccttgtgtt

SEQ ID NO: 741175 - DNA, 25 bp, Mus musculus
gtttgtcctgtcttttccttgtgtt

SEQ ID NO: 741176 - DNA, 25 bp, Mus musculus
gtttgtccttctcttggtggtcgtc

SEQ ID NO: 741177 - DNA, 25 bp, Mus musculus
gtttgtccttctgttggtggtcgtc

SEQ ID NO: 741178 - DNA, 25 bp, Mus musculus
gtttgtccttgaagtagtctttcct

SEQ ID NO: 741179 - DNA, 25 bp, Mus musculus
gtttgtccttgatgtagtctttcct

SEQ ID NO: 741180 - DNA, 25 bp, Mus musculus
gtttgtcgcccacaagaaactcatt

SEQ ID NO: 741181 - DNA, 25 bp, Mus musculus
gtttgtcgcccagaagaaactcatt

SEQ ID NO: 741182 - DNA, 25 bp, Mus musculus
gtttgtcggtgaattctatcgcttc

SEQ ID NO: 741183 - DNA, 25 bp, Mus musculus
gtttgtcggtgatttctatcgcttc

SEQ ID NO: 741184 - DNA, 25 bp, Mus musculus
gtttgtctaagaacagccccatctt

SEQ ID NO: 741185 - DNA, 25 bp, Mus musculus
gtttgtctaagaaccacaagccgat

SEQ ID NO: 741186 - DNA, 25 bp, Mus musculus
gtttgtctaagatcagccccatctt

SEQ ID NO: 741187 - DNA, 25 bp, Mus musculus
gtttgtctaagatccacaagccgat

SEQ ID NO: 741188 - DNA, 25 bp, Mus musculus
gtttgtctagtaatacttccaccca

SEQ ID NO: 741189 - DNA, 25 bp, Mus musculus
gtttgtctagtattacttccaccca

SEQ ID NO: 741190 - DNA, 25 bp, Mus musculus
gtttgtctatacattatacatctga

SEQ ID NO: 741191 - DNA, 25 bp, Mus musculus
gtttgtctatactttatacatctga

SEQ ID NO: 741192 - DNA, 25 bp, Mus musculus
gtttgtctcaccatgtttcatacag

SEQ ID NO: 741193 - DNA, 25 bp, Mus musculus
gtttgtctcaccttgtttcatacag

SEQ ID NO: 741194 - DNA, 25 bp, Mus musculus
gtttgtctcatgacaaaggaacatc

SEQ ID NO: 741195 - DNA, 25 bp, Mus musculus
gtttgtctcatgtcaaaggaacatc

SEQ ID NO: 741196 - DNA, 25 bp, Mus musculus
gtttgtctccatctctgagcgaaga

SEQ ID NO: 741197 - DNA, 25 bp, Mus musculus
gtttgtctccatgtctgagcgaaga

SEQ ID NO: 741198 - DNA, 25 bp, Mus musculus
gtttgtctccctagactggatttag

SEQ ID NO: 741199 - DNA, 25 bp, Mus musculus
gtttgtctcccttgactggatttag

SEQ ID NO: 741200 - DNA, 25 bp, Mus musculus
gtttgtctccttcgcagttttctga

SEQ ID NO: 741201 - DNA, 25 bp, Mus musculus
gtttgtctccttctacagatagcca

SEQ ID NO: 741202 - DNA, 25 bp, Mus musculus
gtttgtctccttggcagttttctga

SEQ ID NO: 741203 - DNA, 25 bp, Mus musculus
gtttgtctccttgtacagatagcca

SEQ ID NO: 741204 - DNA, 25 bp, Mus musculus
gtttgtctcttgattgaaacttcct

SEQ ID NO: 741205 - DNA, 25 bp, Mus musculus
gtttgtctcttgtttgaaacttcct

SEQ ID NO: 741206 - DNA, 25 bp, Mus musculus
gtttgtctgaacaatgggcctttgt

SEQ ID NO: 741207 - DNA, 25 bp, Mus musculus
gtttgtctgaactatgggcctttgt

SEQ ID NO: 741208 - DNA, 25 bp, Mus musculus
gtttgtctgcctcgttctttcttgc

SEQ ID NO: 741209 - DNA, 25 bp, Mus musculus
gtttgtctgcctggttctttcttgc

SEQ ID NO: 741210 - DNA, 25 bp, Mus musculus
gtttgtctggctacatttatggcaa

SEQ ID NO: 741211 - DNA, 25 bp, Mus musculus
gtttgtctggcttcatttatggcaa

SEQ ID NO: 741212 - DNA, 25 bp, Mus musculus
gtttgtctgtatagccaagtgccaa

SEQ ID NO: 741213 - DNA, 25 bp, Mus musculus
gtttgtctgtattgccaagtgccaa

SEQ ID NO: 741214 - DNA, 25 bp, Mus musculus
gtttgtctgtcaaggattgctctat

SEQ ID NO: 741215 - DNA, 25 bp, Mus musculus
gtttgtctgtcatggattgctctat

SEQ ID NO: 741216 - DNA, 25 bp, Mus musculus
gtttgtctgtgtcccgtgtcggatc

SEQ ID NO: 741217 - DNA, 25 bp, Mus musculus
gtttgtctgtgtgccgtgtcggatc

SEQ ID NO: 741218 - DNA, 25 bp, Mus musculus
gtttgtcttacaactctcaagccac

SEQ ID NO: 741219 - DNA, 25 bp, Mus musculus
gtttgtcttacatctctcaagccac

SEQ ID NO: 741220 - DNA, 25 bp, Mus musculus
gtttgtcttactatctgactttaga

SEQ ID NO: 741221 - DNA, 25 bp, Mus musculus
gtttgtcttactttctgactttaga

SEQ ID NO: 741222 - DNA, 25 bp, Mus musculus
gtttgtcttgacagtttgcaactga

SEQ ID NO: 741223 - DNA, 25 bp, Mus musculus
gtttgtcttgactgtttgcaactga

SEQ ID NO: 741224 - DNA, 25 bp, Mus musculus
gtttgtcttgatattatcatctgga

SEQ ID NO: 741225 - DNA, 25 bp, Mus musculus
gtttgtcttgattttatcatctgga

SEQ ID NO: 741226 - DNA, 25 bp, Mus musculus
gtttgtcttgcaataccctgggatc

SEQ ID NO: 741227 - DNA, 25 bp, Mus musculus
gtttgtcttgcattaccctgggatc

SEQ ID NO: 741228 - DNA, 25 bp, Mus musculus
gtttgtctttaaatctccttcagcc

SEQ ID NO: 741229 - DNA, 25 bp, Mus musculus
gtttgtctttaattctccttcagcc

SEQ ID NO: 741230 - DNA, 25 bp, Mus musculus
gtttgtctttaccaggtcaaattat

SEQ ID NO: 741231 - DNA, 25 bp, Mus musculus
gtttgtctttacgaggtcaaattat

SEQ ID NO: 741232 - DNA, 25 bp, Mus musculus
gtttgtcttttacctttctggttca

SEQ ID NO: 741233 - DNA, 25 bp, Mus musculus
gtttgtcttttagctttctggttca

SEQ ID NO: 741234 - DNA, 25 bp, Mus musculus
gtttgtgaaactagcaactggaatc

SEQ ID NO: 741235 - DNA, 25 bp, Mus musculus
gtttgtgaaacttgcaactggaatc

SEQ ID NO: 741236 - DNA, 25 bp, Mus musculus
gtttgtgaaagccatttgtgagtgc

SEQ ID NO: 741237 - DNA, 25 bp, Mus musculus
gtttgtgaaagcgatttgtgagtgc

SEQ ID NO: 741238 - DNA, 25 bp, Mus musculus
gtttgtgaactcaagcagctcagct

SEQ ID NO: 741239 - DNA, 25 bp, Mus musculus
gtttgtgaactctagcagctcagct

SEQ ID NO: 741240 - DNA, 25 bp, Mus musculus
gtttgtgaacttccaaatcgatcgg

SEQ ID NO: 741241 - DNA, 25 bp, Mus musculus
gtttgtgaacttgcaaatcgatcgg

SEQ ID NO: 741242 - DNA, 25 bp, Mus musculus
gtttgtgaagccagcacccattgac

SEQ ID NO: 741243 - DNA, 25 bp, Mus musculus
gtttgtgaagcctgcacccattgac

SEQ ID NO: 741244 - DNA, 25 bp, Mus musculus
gtttgtgaatgcaaaatttgccatc

SEQ ID NO: 741245 - DNA, 25 bp, Mus musculus
gtttgtgaatgctaaatttgccatc

SEQ ID NO: 741246 - DNA, 25 bp, Mus musculus
gtttgtgaattacttcccacgatta

SEQ ID NO: 741247 - DNA, 25 bp, Mus musculus
gtttgtgaattagttcccacgatta

SEQ ID NO: 741248 - DNA, 25 bp, Mus musculus
gtttgtgacacgatatcccaggtga

SEQ ID NO: 741249 - DNA, 25 bp, Mus musculus
gtttgtgacacgttatcccaggtga

SEQ ID NO: 741250 - DNA, 25 bp, Mus musculus
gtttgtgacattagcaccagcaccc

SEQ ID NO: 741251 - DNA, 25 bp, Mus musculus
gtttgtgacatttgcaccagcaccc

SEQ ID NO: 741252 - DNA, 25 bp, Mus musculus
gtttgtgaccacaaagcttgcttct

SEQ ID NO: 741253 - DNA, 25 bp, Mus musculus
gtttgtgaccactaagcttgcttct

SEQ ID NO: 741254 - DNA, 25 bp, Mus musculus
gtttgtgactgacgctatgtaccct

SEQ ID NO: 741255 - DNA, 25 bp, Mus musculus
gtttgtgactgaggctatgtaccct

SEQ ID NO: 741256 - DNA, 25 bp, Mus musculus
gtttgtgagcaccatttaatcccag

SEQ ID NO: 741257 - DNA, 25 bp, Mus musculus
gtttgtgagcacgatttaatcccag

SEQ ID NO: 741258 - DNA, 25 bp, Mus musculus
gtttgtgagccgcaatcgtcagttc

SEQ ID NO: 741259 - DNA, 25 bp, Mus musculus
gtttgtgagccggaatcgtcagttc

SEQ ID NO: 741260 - DNA, 25 bp, Mus musculus
gtttgtgagtgtctacagcacctga

SEQ ID NO: 741261 - DNA, 25 bp, Mus musculus
gtttgtgagtgtgtacagcacctga

SEQ ID NO: 741262 - DNA, 25 bp, Mus musculus
gtttgtgataatagctccagttcta

SEQ ID NO: 741263 - DNA, 25 bp, Mus musculus
gtttgtgataattgctccagttcta

SEQ ID NO: 741264 - DNA, 25 bp, Mus musculus
gtttgtgatcacataggcactatgt

SEQ ID NO: 741265 - DNA, 25 bp, Mus musculus
gtttgtgatcacttaggcactatgt

SEQ ID NO: 741266 - DNA, 25 bp, Mus musculus
gtttgtgattccagttacgactcca

SEQ ID NO: 741267 - DNA, 25 bp, Mus musculus
gtttgtgattcctgttacgactcca

SEQ ID NO: 741268 - DNA, 25 bp, Mus musculus
gtttgtgattctactgatttttccc

SEQ ID NO: 741269 - DNA, 25 bp, Mus musculus
gtttgtgattcttctgatttttccc

SEQ ID NO: 741270 - DNA, 25 bp, Mus musculus
gtttgtgattgactttagattccca

SEQ ID NO: 741271 - DNA, 25 bp, Mus musculus
gtttgtgattgagtttagattccca

SEQ ID NO: 741272 - DNA, 25 bp, Mus musculus
gtttgtgattttccagcagaccagg

SEQ ID NO: 741273 - DNA, 25 bp, Mus musculus
gtttgtgattttgcagcagaccagg

SEQ ID NO: 741274 - DNA, 25 bp, Mus musculus
gtttgtgcacagctcaggacacctt

SEQ ID NO: 741275 - DNA, 25 bp, Mus musculus
gtttgtgcacaggtcaggacacctt

SEQ ID NO: 741276 - DNA, 25 bp, Mus musculus
gtttgtgcacccaatcttgcaaagt

SEQ ID NO: 741277 - DNA, 25 bp, Mus musculus
gtttgtgcaccctatcttgcaaagt

SEQ ID NO: 741278 - DNA, 25 bp, Mus musculus
gtttgtgcacttagtgttaatctca

SEQ ID NO: 741279 - DNA, 25 bp, Mus musculus
gtttgtgcactttgtgttaatctca

SEQ ID NO: 741280 - DNA, 25 bp, Mus musculus
gtttgtgccaccagggaagaattct

SEQ ID NO: 741281 - DNA, 25 bp, Mus musculus
gtttgtgccacctgggaagaattct

SEQ ID NO: 741282 - DNA, 25 bp, Mus musculus
gtttgtgcccaaagtagagacccta

SEQ ID NO: 741283 - DNA, 25 bp, Mus musculus
gtttgtgcccaatgtagagacccta

SEQ ID NO: 741284 - DNA, 25 bp, Mus musculus
gtttgtgccgcacttggagccagca

SEQ ID NO: 741285 - DNA, 25 bp, Mus musculus
gtttgtgccgcagttggagccagca

SEQ ID NO: 741286 - DNA, 25 bp, Mus musculus
gtttgtgcctaaatcttcttgctca

SEQ ID NO: 741287 - DNA, 25 bp, Mus musculus
gtttgtgcctaattcttcttgctca

SEQ ID NO: 741288 - DNA, 25 bp, Mus musculus
gtttgtgcctatcaacgtttatctt

SEQ ID NO: 741289 - DNA, 25 bp, Mus musculus
gtttgtgcctatgaacgtttatctt

SEQ ID NO: 741290 - DNA, 25 bp, Mus musculus
gtttgtgctacaaaaaatcccatct

SEQ ID NO: 741291 - DNA, 25 bp, Mus musculus
gtttgtgctacataaaatcccatct

SEQ ID NO: 741292 - DNA, 25 bp, Mus musculus
gtttgtgctatacaacacgtggctt

SEQ ID NO: 741293 - DNA, 25 bp, Mus musculus
gtttgtgctatagaacacgtggctt

SEQ ID NO: 741294 - DNA, 25 bp, Mus musculus
gtttgtgctcagaggatagctttca

SEQ ID NO: 741295 - DNA, 25 bp, Mus musculus
gtttgtgctcagtggatagctttca

SEQ ID NO: 741296 - DNA, 25 bp, Mus musculus
gtttgtgctcctatgtttgtattga

SEQ ID NO: 741297 - DNA, 25 bp, Mus musculus
gtttgtgctcctttgtttgtattga

SEQ ID NO: 741298 - DNA, 25 bp, Mus musculus
gtttgtgctctgataactccaaccc

SEQ ID NO: 741299 - DNA, 25 bp, Mus musculus
gtttgtgctctgttaactccaaccc

SEQ ID NO: 741300 - DNA, 25 bp, Mus musculus
gtttgtgctgtaagcttagggaaaa

SEQ ID NO: 741301 - DNA, 25 bp, Mus musculus
gtttgtgctgtatgcttagggaaaa

SEQ ID NO: 741302 - DNA, 25 bp, Mus musculus
gtttgtgctgttaccagccgactag

SEQ ID NO: 741303 - DNA, 25 bp, Mus musculus
gtttgtgctgtttccagccgactag

SEQ ID NO: 741304 - DNA, 25 bp, Mus musculus
gtttgtggacacaccgagttaacaa

SEQ ID NO: 741305 - DNA, 25 bp, Mus musculus
gtttgtggacactccgagttaacaa

SEQ ID NO: 741306 - DNA, 25 bp, Mus musculus
gtttgtggactcaacattctatctc

SEQ ID NO: 741307 - DNA, 25 bp, Mus musculus
gtttgtggactctacattctatctc

SEQ ID NO: 741308 - DNA, 25 bp, Mus musculus
gtttgtggacttagtgactttttct

SEQ ID NO: 741309 - DNA, 25 bp, Mus musculus
gtttgtggactttgtgactttttct

SEQ ID NO: 741310 - DNA, 25 bp, Mus musculus
gtttgtggagtaaacctgtcctaca

SEQ ID NO: 741311 - DNA, 25 bp, Mus musculus
gtttgtggagtatacctgtcctaca

SEQ ID NO: 741312 - DNA, 25 bp, Mus musculus
gtttgtggcaagaggtcaccatctc

SEQ ID NO: 741313 - DNA, 25 bp, Mus musculus
gtttgtggcaagtggtcaccatctc

SEQ ID NO: 741314 - DNA, 25 bp, Mus musculus
gtttgtggccaaagtccataaccag

SEQ ID NO: 741315 - DNA, 25 bp, Mus musculus
gtttgtggccaatgtccataaccag

SEQ ID NO: 741316 - DNA, 25 bp, Mus musculus
gtttgtggctctagtgcctgatgga

SEQ ID NO: 741317 - DNA, 25 bp, Mus musculus
gtttgtggctcttgtgcctgatgga

SEQ ID NO: 741318 - DNA, 25 bp, Mus musculus
gtttgtgggcagattgactttttat

SEQ ID NO: 741319 - DNA, 25 bp, Mus musculus
gtttgtgggcagtttgactttttat

SEQ ID NO: 741320 - DNA, 25 bp, Mus musculus
gtttgtggtcacatgcacctgtttt

SEQ ID NO: 741321 - DNA, 25 bp, Mus musculus
gtttgtggtcacttgcacctgtttt

SEQ ID NO: 741322 - DNA, 25 bp, Mus musculus
gtttgtggtgagatgtttgttgctt

SEQ ID NO: 741323 - DNA, 25 bp, Mus musculus
gtttgtggtgagttgtttgttgctt

SEQ ID NO: 741324 - DNA, 25 bp, Mus musculus
gtttgtggtttgacctaccagccac

SEQ ID NO: 741325 - DNA, 25 bp, Mus musculus
gtttgtggtttgtcctaccagccac

SEQ ID NO: 741326 - DNA, 25 bp, Mus musculus
gtttgtgtaaccaatacgtaatcta

SEQ ID NO: 741327 - DNA, 25 bp, Mus musculus
gtttgtgtaacctatacgtaatcta

SEQ ID NO: 741328 - DNA, 25 bp, Mus musculus
gtttgtgtaatgctgcagctacctt

SEQ ID NO: 741329 - DNA, 25 bp, Mus musculus
gtttgtgtaatggtgcagctacctt

SEQ ID NO: 741330 - DNA, 25 bp, Mus musculus
gtttgtgtaattccttcgcaccatg

SEQ ID NO: 741331 - DNA, 25 bp, Mus musculus
gtttgtgtaattgcttcgcaccatg

SEQ ID NO: 741332 - DNA, 25 bp, Mus musculus
gtttgtgtacgtctgggacaccaca

SEQ ID NO: 741333 - DNA, 25 bp, Mus musculus
gtttgtgtacgtgtgggacaccaca

SEQ ID NO: 741334 - DNA, 25 bp, Mus musculus
gtttgtgtactaataatgatccttg

SEQ ID NO: 741335 - DNA, 25 bp, Mus musculus
gtttgtgtactattaatgatccttg

SEQ ID NO: 741336 - DNA, 25 bp, Mus musculus
gtttgtgtactgctgagaggaccat

SEQ ID NO: 741337 - DNA, 25 bp, Mus musculus
gtttgtgtactggtgagaggaccat

SEQ ID NO: 741338 - DNA, 25 bp, Mus musculus
gtttgtgtagaaaggcctcctcctt

SEQ ID NO: 741339 - DNA, 25 bp, Mus musculus
gtttgtgtagaatggcctcctcctt

SEQ ID NO: 741340 - DNA, 25 bp, Mus musculus
gtttgtgtagtaccagctagcacgg

SEQ ID NO: 741341 - DNA, 25 bp, Mus musculus
gtttgtgtagtagcagctagcacgg

SEQ ID NO: 741342 - DNA, 25 bp, Mus musculus
gtttgtgtatggaccataactctgg

SEQ ID NO: 741343 - DNA, 25 bp, Mus musculus
gtttgtgtatggtccataactctgg

SEQ ID NO: 741344 - DNA, 25 bp, Mus musculus
gtttgtgtatgtaagctctgcattc

SEQ ID NO: 741345 - DNA, 25 bp, Mus musculus
gtttgtgtatgttagctctgcattc

SEQ ID NO: 741346 - DNA, 25 bp, Mus musculus
gtttgtgtatttatgctttgattca

SEQ ID NO: 741347 - DNA, 25 bp, Mus musculus
gtttgtgtatttttgctttgattca

SEQ ID NO: 741348 - DNA, 25 bp, Mus musculus
gtttgtgtcaacaggtcgagataca

SEQ ID NO: 741349 - DNA, 25 bp, Mus musculus
gtttgtgtcaactggtcgagataca

SEQ ID NO: 741350 - DNA, 25 bp, Mus musculus
gtttgtgtcatcagaacgtgcaatt

SEQ ID NO: 741351 - DNA, 25 bp, Mus musculus
gtttgtgtcatctgaacgtgcaatt

SEQ ID NO: 741352 - DNA, 25 bp, Mus musculus
gtttgtgtccaaagccaatgagcct

SEQ ID NO: 741353 - DNA, 25 bp, Mus musculus
gtttgtgtccaatgccaatgagcct

SEQ ID NO: 741354 - DNA, 25 bp, Mus musculus
gtttgtgtccatcgctgattcaaat

SEQ ID NO: 741355 - DNA, 25 bp, Mus musculus
gtttgtgtccatggctgattcaaat

SEQ ID NO: 741356 - DNA, 25 bp, Mus musculus
gtttgtgtccttcctgcaatatgga

SEQ ID NO: 741357 - DNA, 25 bp, Mus musculus
gtttgtgtccttgctgcaatatgga

SEQ ID NO: 741358 - DNA, 25 bp, Mus musculus
gtttgtgtctaaagtacccgagtgt

SEQ ID NO: 741359 - DNA, 25 bp, Mus musculus
gtttgtgtctaatgtacccgagtgt

SEQ ID NO: 741360 - DNA, 25 bp, Mus musculus
gtttgtgtctagacttattgggcca

SEQ ID NO: 741361 - DNA, 25 bp, Mus musculus
gtttgtgtctagtcttattgggcca

SEQ ID NO: 741362 - DNA, 25 bp, Mus musculus
gtttgtgtctcacctctgtgaagat

SEQ ID NO: 741363 - DNA, 25 bp, Mus musculus
gtttgtgtctcagctctgtgaagat

SEQ ID NO: 741364 - DNA, 25 bp, Mus musculus
gtttgtgtctttccatggtccatac

SEQ ID NO: 741365 - DNA, 25 bp, Mus musculus
gtttgtgtctttgcatggtccatac

SEQ ID NO: 741366 - DNA, 25 bp, Mus musculus
gtttgtgtgaaaaacctgcagctta

SEQ ID NO: 741367 - DNA, 25 bp, Mus musculus
gtttgtgtgaaatacctgcagctta

SEQ ID NO: 741368 - DNA, 25 bp, Mus musculus
gtttgtgtgaatactgtgtcgctct

SEQ ID NO: 741369 - DNA, 25 bp, Mus musculus
gtttgtgtgaattctgtgtcgctct

SEQ ID NO: 741370 - DNA, 25 bp, Mus musculus
gtttgtgtgccactggaaacaagag

SEQ ID NO: 741371 - DNA, 25 bp, Mus musculus
gtttgtgtgccagtggaaacaagag

SEQ ID NO: 741372 - DNA, 25 bp, Mus musculus
gtttgtgtgctgaggtctaaagaaa

SEQ ID NO: 741373 - DNA, 25 bp, Mus musculus
gtttgtgtgctgtggtctaaagaaa

SEQ ID NO: 741374 - DNA, 25 bp, Mus musculus
gtttgtgttcacatgcttagagagc

SEQ ID NO: 741375 - DNA, 25 bp, Mus musculus
gtttgtgttcacttgcttagagagc

SEQ ID NO: 741376 - DNA, 25 bp, Mus musculus
gtttgtgttggtcagtctttaaatt

SEQ ID NO: 741377 - DNA, 25 bp, Mus musculus
gtttgtgttggtgagtctttaaatt

SEQ ID NO: 741378 - DNA, 25 bp, Mus musculus
gtttgtgtttgccttagttctcata

SEQ ID NO: 741379 - DNA, 25 bp, Mus musculus
gtttgtgtttgcgttagttctcata

SEQ ID NO: 741380 - DNA, 25 bp, Mus musculus
gtttgttaactacgatcttcgaaat

SEQ ID NO: 741381 - DNA, 25 bp, Mus musculus
gtttgttaactaggatcttcgaaat

SEQ ID NO: 741382 - DNA, 25 bp, Mus musculus
gtttgttaatctatagcatggtggt

SEQ ID NO: 741383 - DNA, 25 bp, Mus musculus
gtttgttaatctttagcatggtggt

SEQ ID NO: 741384 - DNA, 25 bp, Mus musculus
gtttgttaatttattgtgcttcctt

SEQ ID NO: 741385 - DNA, 25 bp, Mus musculus
gtttgttaattttttgtgcttcctt

SEQ ID NO: 741386 - DNA, 25 bp, Mus musculus
gtttgttacatactcatgggatttt

SEQ ID NO: 741387 - DNA, 25 bp, Mus musculus
gtttgttacatagtcatgggatttt

SEQ ID NO: 741388 - DNA, 25 bp, Mus musculus
gtttgttacctcagcgttctaaagt

SEQ ID NO: 741389 - DNA, 25 bp, Mus musculus
gtttgttacctctgcgttctaaagt

SEQ ID NO: 741390 - DNA, 25 bp, Mus musculus
gtttgttaggtaagactcggctgca

SEQ ID NO: 741391 - DNA, 25 bp, Mus musculus
gtttgttaggtatgactcggctgca

SEQ ID NO: 741392 - DNA, 25 bp, Mus musculus
gtttgttagtgaagaggtcgtacca

SEQ ID NO: 741393 - DNA, 25 bp, Mus musculus
gtttgttagtgatgaggtcgtacca

SEQ ID NO: 741394 - DNA, 25 bp, Mus musculus
gtttgttatacccagctactatcag

SEQ ID NO: 741395 - DNA, 25 bp, Mus musculus
gtttgttataccgagctactatcag

SEQ ID NO: 741396 - DNA, 25 bp, Mus musculus
gtttgttatcttcaactgttgcatt

SEQ ID NO: 741397 - DNA, 25 bp, Mus musculus
gtttgttatcttgaactgttgcatt

SEQ ID NO: 741398 - DNA, 25 bp, Mus musculus
gtttgttcaaatctccttaatccac

SEQ ID NO: 741399 - DNA, 25 bp, Mus musculus
gtttgttcaaatgtccttaatccac

SEQ ID NO: 741400 - DNA, 25 bp, Mus musculus
gtttgttcacgtacgcacacatatg

SEQ ID NO: 741401 - DNA, 25 bp, Mus musculus
gtttgttcacgttcgcacacatatg

SEQ ID NO: 741402 - DNA, 25 bp, Mus musculus
gtttgttcagacaagcgctgcactg

SEQ ID NO: 741403 - DNA, 25 bp, Mus musculus
gtttgttcagactagcgctgcactg

SEQ ID NO: 741404 - DNA, 25 bp, Mus musculus
gtttgttcagtccatgcttagactt

SEQ ID NO: 741405 - DNA, 25 bp, Mus musculus
gtttgttcagtcgatgcttagactt

SEQ ID NO: 741406 - DNA, 25 bp, Mus musculus
gtttgttccacaatctgtcagtttt

SEQ ID NO: 741407 - DNA, 25 bp, Mus musculus
gtttgttccacattctgtcagtttt

SEQ ID NO: 741408 - DNA, 25 bp, Mus musculus
gtttgttccatcacaaccaagtgcc

SEQ ID NO: 741409 - DNA, 25 bp, Mus musculus
gtttgttccatctcaaccaagtgcc

SEQ ID NO: 741410 - DNA, 25 bp, Mus musculus
gtttgttcccaacatgggcatccga

SEQ ID NO: 741411 - DNA, 25 bp, Mus musculus
gtttgttcccaagatgggcatccga

SEQ ID NO: 741412 - DNA, 25 bp, Mus musculus
gtttgttcccagatagacagacagt

SEQ ID NO: 741413 - DNA, 25 bp, Mus musculus
gtttgttcccagctcaatgcatggg

SEQ ID NO: 741414 - DNA, 25 bp, Mus musculus
gtttgttcccaggtcaatgcatggg

SEQ ID NO: 741415 - DNA, 25 bp, Mus musculus
gtttgttcccagttagacagacagt

SEQ ID NO: 741416 - DNA, 25 bp, Mus musculus
gtttgttcctgcagagtactcctaa

SEQ ID NO: 741417 - DNA, 25 bp, Mus musculus
gtttgttcctgctgagtactcctaa

SEQ ID NO: 741418 - DNA, 25 bp, Mus musculus
gtttgttcctgtacactaactcaat

SEQ ID NO: 741419 - DNA, 25 bp, Mus musculus
gtttgttcctgtatatgtctacatc

SEQ ID NO: 741420 - DNA, 25 bp, Mus musculus
gtttgttcctgttcactaactcaat

SEQ ID NO: 741421 - DNA, 25 bp, Mus musculus
gtttgttcctgtttatgtctacatc

SEQ ID NO: 741422 - DNA, 25 bp, Mus musculus
gtttgttccttacgtcgaatctgac

SEQ ID NO: 741423 - DNA, 25 bp, Mus musculus
gtttgttccttaggtcgaatctgac

SEQ ID NO: 741424 - DNA, 25 bp, Mus musculus
gtttgttcctttaatatgccctcta

SEQ ID NO: 741425 - DNA, 25 bp, Mus musculus
gtttgttccttttatatgccctcta

SEQ ID NO: 741426 - DNA, 25 bp, Mus musculus
gtttgttcgcacatacggagagttg

SEQ ID NO: 741427 - DNA, 25 bp, Mus musculus
gtttgttcgcacttacggagagttg

SEQ ID NO: 741428 - DNA, 25 bp, Mus musculus
gtttgttcgttgctgcattttggac

SEQ ID NO: 741429 - DNA, 25 bp, Mus musculus
gtttgttcgttggtgcattttggac

SEQ ID NO: 741430 - DNA, 25 bp, Mus musculus
gtttgttctaaaaacctcacttgcc

SEQ ID NO: 741431 - DNA, 25 bp, Mus musculus
gtttgttctaaaagccataatgacc

SEQ ID NO: 741432 - DNA, 25 bp, Mus musculus
gtttgttctaaatacctcacttgcc

SEQ ID NO: 741433 - DNA, 25 bp, Mus musculus
gtttgttctaaatgccataatgacc

SEQ ID NO: 741434 - DNA, 25 bp, Mus musculus
gtttgttctagacttgcatcactaa

SEQ ID NO: 741435 - DNA, 25 bp, Mus musculus
gtttgttctagagttgcatcactaa

SEQ ID NO: 741436 - DNA, 25 bp, Mus musculus
gtttgttctcagattgcttacgtag

SEQ ID NO: 741437 - DNA, 25 bp, Mus musculus
gtttgttctcagtttgcttacgtag

SEQ ID NO: 741438 - DNA, 25 bp, Mus musculus
gtttgttctccacatggtattgagc

SEQ ID NO: 741439 - DNA, 25 bp, Mus musculus
gtttgttctccagatggtattgagc

SEQ ID NO: 741440 - DNA, 25 bp, Mus musculus
gtttgttctcctattaaatgtctaa

SEQ ID NO: 741441 - DNA, 25 bp, Mus musculus
gtttgttctccttttaaatgtctaa

SEQ ID NO: 741442 - DNA, 25 bp, Mus musculus
gtttgttcttagagtccataaattt

SEQ ID NO: 741443 - DNA, 25 bp, Mus musculus
gtttgttcttagtgtccataaattt

SEQ ID NO: 741444 - DNA, 25 bp, Mus musculus
gtttgttcttggagtcggacatgtc

SEQ ID NO: 741445 - DNA, 25 bp, Mus musculus
gtttgttcttggtgtcggacatgtc

SEQ ID NO: 741446 - DNA, 25 bp, Mus musculus
gtttgttgaagtaagtacctgctgc

SEQ ID NO: 741447 - DNA, 25 bp, Mus musculus
gtttgttgaagttagtacctgctgc

SEQ ID NO: 741448 - DNA, 25 bp, Mus musculus
gtttgttgactgagtttttcatcct

SEQ ID NO: 741449 - DNA, 25 bp, Mus musculus
gtttgttgactgtgtttttcatcct

SEQ ID NO: 741450 - DNA, 25 bp, Mus musculus
gtttgttgatatcatcacttctcaa

SEQ ID NO: 741451 - DNA, 25 bp, Mus musculus
gtttgttgatatgatcacttctcaa

SEQ ID NO: 741452 - DNA, 25 bp, Mus musculus
gtttgttgcacaatccaggattcag

SEQ ID NO: 741453 - DNA, 25 bp, Mus musculus
gtttgttgcacattccaggattcag

SEQ ID NO: 741454 - DNA, 25 bp, Mus musculus
gtttgttgcactcatgtgtccagct

SEQ ID NO: 741455 - DNA, 25 bp, Mus musculus
gtttgttgcactgatgtgtccagct

SEQ ID NO: 741456 - DNA, 25 bp, Mus musculus
gtttgttgcctgcaacttaatagcc

SEQ ID NO: 741457 - DNA, 25 bp, Mus musculus
gtttgttgcctggaacttaatagcc

SEQ ID NO: 741458 - DNA, 25 bp, Mus musculus
gtttgttgccttaaataagccacct

SEQ ID NO: 741459 - DNA, 25 bp, Mus musculus
gtttgttgcctttaataagccacct

SEQ ID NO: 741460 - DNA, 25 bp, Mus musculus
gtttgttggtgtattctagtttgag

SEQ ID NO: 741461 - DNA, 25 bp, Mus musculus
gtttgttggtgttttctagtttgag

SEQ ID NO: 741462 - DNA, 25 bp, Mus musculus
gtttgttgtaaaattggttcatctt

SEQ ID NO: 741463 - DNA, 25 bp, Mus musculus
gtttgttgtaaatttggttcatctt

SEQ ID NO: 741464 - DNA, 25 bp, Mus musculus
gtttgttgtcaaaatcccatgtggt

SEQ ID NO: 741465 - DNA, 25 bp, Mus musculus
gtttgttgtcaatatcccatgtggt

SEQ ID NO: 741466 - DNA, 25 bp, Mus musculus
gtttgttgtctgattaatgcgttgt

SEQ ID NO: 741467 - DNA, 25 bp, Mus musculus
gtttgttgtctgtttaatgcgttgt

SEQ ID NO: 741468 - DNA, 25 bp, Mus musculus
gtttgttgtcttctcatggttgtat

SEQ ID NO: 741469 - DNA, 25 bp, Mus musculus
gtttgttgtcttgtcatggttgtat

SEQ ID NO: 741470 - DNA, 25 bp, Mus musculus
gtttgttgtggcaacattctacccg

SEQ ID NO: 741471 - DNA, 25 bp, Mus musculus
gtttgttgtggctacattctacccg

SEQ ID NO: 741472 - DNA, 25 bp, Mus musculus
gtttgtttaaaaccagccacattat

SEQ ID NO: 741473 - DNA, 25 bp, Mus musculus
gtttgtttaaaagcagccacattat

SEQ ID NO: 741474 - DNA, 25 bp, Mus musculus
gtttgtttaccaaaactcttcccat

SEQ ID NO: 741475 - DNA, 25 bp, Mus musculus
gtttgtttaccataactcttcccat

SEQ ID NO: 741476 - DNA, 25 bp, Mus musculus
gtttgtttagccatttcttacccat

SEQ ID NO: 741477 - DNA, 25 bp, Mus musculus
gtttgtttagccttttcttacccat

SEQ ID NO: 741478 - DNA, 25 bp, Mus musculus
gtttgtttagctagaaactttggag

SEQ ID NO: 741479 - DNA, 25 bp, Mus musculus
gtttgtttagcttgaaactttggag

SEQ ID NO: 741480 - DNA, 25 bp, Mus musculus
gtttgtttaggacattacctctgat

SEQ ID NO: 741481 - DNA, 25 bp, Mus musculus
gtttgtttaggagattacctctgat

SEQ ID NO: 741482 - DNA, 25 bp, Mus musculus
gtttgtttattgagccaatcacctc

SEQ ID NO: 741483 - DNA, 25 bp, Mus musculus
gtttgtttattgtgccaatcacctc

SEQ ID NO: 741484 - DNA, 25 bp, Mus musculus
gtttgtttcacacccagatatttta

SEQ ID NO: 741485 - DNA, 25 bp, Mus musculus
gtttgtttcacagccagatatttta

SEQ ID NO: 741486 - DNA, 25 bp, Mus musculus
gtttgtttcaccaacatcttttgga

SEQ ID NO: 741487 - DNA, 25 bp, Mus musculus
gtttgtttcaccagtcaatatatca

SEQ ID NO: 741488 - DNA, 25 bp, Mus musculus
gtttgtttcacctacatcttttgga

SEQ ID NO: 741489 - DNA, 25 bp, Mus musculus
gtttgtttcacctgtcaatatatca

SEQ ID NO: 741490 - DNA, 25 bp, Mus musculus
gtttgtttcaggcttggaattctca

SEQ ID NO: 741491 - DNA, 25 bp, Mus musculus
gtttgtttcagggttggaattctca

SEQ ID NO: 741492 - DNA, 25 bp, Mus musculus
gtttgtttcagtattcagtgggtag

SEQ ID NO: 741493 - DNA, 25 bp, Mus musculus
gtttgtttcagttttcagtgggtag

SEQ ID NO: 741494 - DNA, 25 bp, Mus musculus
gtttgtttccataagttgaagtgtt

SEQ ID NO: 741495 - DNA, 25 bp, Mus musculus
gtttgtttccattagttgaagtgtt

SEQ ID NO: 741496 - DNA, 25 bp, Mus musculus
gtttgtttctagattctggctatta

SEQ ID NO: 741497 - DNA, 25 bp, Mus musculus
gtttgtttctagtttctggctatta

SEQ ID NO: 741498 - DNA, 25 bp, Mus musculus
gtttgtttctgaacagacatgactt

SEQ ID NO: 741499 - DNA, 25 bp, Mus musculus
gtttgtttctgatcagacatgactt

SEQ ID NO: 741500 - DNA, 25 bp, Mus musculus
gtttgtttctttacgggattatatg

SEQ ID NO: 741501 - DNA, 25 bp, Mus musculus
gtttgtttcttttcgggattatatg

SEQ ID NO: 741502 - DNA, 25 bp, Mus musculus
gtttgtttgacccaactgcaccaaa

SEQ ID NO: 741503 - DNA, 25 bp, Mus musculus
gtttgtttgaccgaactgcaccaaa

SEQ ID NO: 741504 - DNA, 25 bp, Mus musculus
gtttgtttgagaatcattccacttg

SEQ ID NO: 741505 - DNA, 25 bp, Mus musculus
gtttgtttgagattcattccacttg

SEQ ID NO: 741506 - DNA, 25 bp, Mus musculus
gtttgtttgaggattgtgccacagt

SEQ ID NO: 741507 - DNA, 25 bp, Mus musculus
gtttgtttgaggtttgtgccacagt

SEQ ID NO: 741508 - DNA, 25 bp, Mus musculus
gtttgtttgattcctatgccatgta

SEQ ID NO: 741509 - DNA, 25 bp, Mus musculus
gtttgtttgattgctatgccatgta

SEQ ID NO: 741510 - DNA, 25 bp, Mus musculus
gtttgtttgcatattcttatcctta

SEQ ID NO: 741511 - DNA, 25 bp, Mus musculus
gtttgtttgcattttcttatcctta

SEQ ID NO: 741512 - DNA, 25 bp, Mus musculus
gtttgtttggtgaccctggaactgc

SEQ ID NO: 741513 - DNA, 25 bp, Mus musculus
gtttgtttggtgtccctggaactgc

SEQ ID NO: 741514 - DNA, 25 bp, Mus musculus
gtttgtttgtacaacagttaagcat

SEQ ID NO: 741515 - DNA, 25 bp, Mus musculus
gtttgtttgtactacagttaagcat

SEQ ID NO: 741516 - DNA, 25 bp, Mus musculus
gtttgtttgtatactgtttctccaa

SEQ ID NO: 741517 - DNA, 25 bp, Mus musculus
gtttgtttgtatctccgagattaca

SEQ ID NO: 741518 - DNA, 25 bp, Mus musculus
gtttgtttgtatgtccgagattaca

SEQ ID NO: 741519 - DNA, 25 bp, Mus musculus
gtttgtttgtattctgtttctccaa

SEQ ID NO: 741520 - DNA, 25 bp, Mus musculus
gtttgtttgtgcatgccaactctgc

SEQ ID NO: 741521 - DNA, 25 bp, Mus musculus
gtttgtttgtgcttgccaactctgc

SEQ ID NO: 741522 - DNA, 25 bp, Mus musculus
gtttgtttgttaattagtgcatctt

SEQ ID NO: 741523 - DNA, 25 bp, Mus musculus
gtttgtttgttatttagtgcatctt

SEQ ID NO: 741524 - DNA, 25 bp, Mus musculus
gtttgttttaacctgccatgagatg

SEQ ID NO: 741525 - DNA, 25 bp, Mus musculus
gtttgttttaacgtgccatgagatg

SEQ ID NO: 741526 - DNA, 25 bp, Mus musculus
gtttgttttattcctgccaccagca

SEQ ID NO: 741527 - DNA, 25 bp, Mus musculus
gtttgttttattgctgccaccagca

SEQ ID NO: 741528 - DNA, 25 bp, Mus musculus
gtttgttttcaacgtcttcgacgag

SEQ ID NO: 741529 - DNA, 25 bp, Mus musculus
gtttgttttcaaggtcttcgacgag

SEQ ID NO: 741530 - DNA, 25 bp, Mus musculus
gtttgttttcgaacatcgccacaag

SEQ ID NO: 741531 - DNA, 25 bp, Mus musculus
gtttgttttcgatcatcgccacaag

SEQ ID NO: 741532 - DNA, 25 bp, Mus musculus
gtttgttttgacatgctctgtcatt

SEQ ID NO: 741533 - DNA, 25 bp, Mus musculus
gtttgttttgacttgctctgtcatt

SEQ ID NO: 741534 - DNA, 25 bp, Mus musculus
gtttgttttgcaatgtggttctgat

SEQ ID NO: 741535 - DNA, 25 bp, Mus musculus
gtttgttttgcattgtggttctgat

SEQ ID NO: 741536 - DNA, 25 bp, Mus musculus
gtttgttttgtcatggctatctact

SEQ ID NO: 741537 - DNA, 25 bp, Mus musculus
gtttgttttgtcttggctatctact

SEQ ID NO: 741538 - DNA, 25 bp, Mus musculus
gtttgtttttgaagcagggtgactc

SEQ ID NO: 741539 - DNA, 25 bp, Mus musculus
gtttgtttttgatgcagggtgactc

SEQ ID NO: 741540 - DNA, 25 bp, Mus musculus
gtttgtttttgtccagcaaccctac

SEQ ID NO: 741541 - DNA, 25 bp, Mus musculus
gtttgtttttgtccattcaatgaaa

SEQ ID NO: 741542 - DNA, 25 bp, Mus musculus
gtttgtttttgtgcagcaaccctac

SEQ ID NO: 741543 - DNA, 25 bp, Mus musculus
gtttgtttttgtgcattcaatgaaa

SEQ ID NO: 741544 - DNA, 25 bp, Mus musculus
gtttgttttttgaggaggagatgat

SEQ ID NO: 741545 - DNA, 25 bp, Mus musculus
gtttgttttttgtggaggagatgat

SEQ ID NO: 741546 - DNA, 25 bp, Mus musculus
gttttaaacagaaatgacctcatag

SEQ ID NO: 741547 - DNA, 25 bp, Mus musculus
gttttaaacagatatgacctcatag

SEQ ID NO: 741548 - DNA, 25 bp, Mus musculus
gttttaaactggcacacctctggtt

SEQ ID NO: 741549 - DNA, 25 bp, Mus musculus
gttttaaactgggacacctctggtt

SEQ ID NO: 741550 - DNA, 25 bp, Mus musculus
gttttaaagtacactctgccgtaga

SEQ ID NO: 741551 - DNA, 25 bp, Mus musculus
gttttaaagtactctctgccgtaga

SEQ ID NO: 741552 - DNA, 25 bp, Mus musculus
gttttaaagttacgctagttatgtg

SEQ ID NO: 741553 - DNA, 25 bp, Mus musculus
gttttaaagttaggctagttatgtg

SEQ ID NO: 741554 - DNA, 25 bp, Mus musculus
gttttaaatcaccttagccacctga

SEQ ID NO: 741555 - DNA, 25 bp, Mus musculus
gttttaaatcacgttagccacctga

SEQ ID NO: 741556 - DNA, 25 bp, Mus musculus
gttttaaatgtaaccagacactctt

SEQ ID NO: 741557 - DNA, 25 bp, Mus musculus
gttttaaatgtatccagacactctt

SEQ ID NO: 741558 - DNA, 25 bp, Mus musculus
gttttaaattctacacagcatcaca

SEQ ID NO: 741559 - DNA, 25 bp, Mus musculus
gttttaaattcttcacagcatcaca

SEQ ID NO: 741560 - DNA, 25 bp, Mus musculus
gttttaacaaagacatagccttgac

SEQ ID NO: 741561 - DNA, 25 bp, Mus musculus
gttttaacaaagtcatagccttgac

SEQ ID NO: 741562 - DNA, 25 bp, Mus musculus
gttttaacaccaacactgtaacatt

SEQ ID NO: 741563 - DNA, 25 bp, Mus musculus
gttttaacaccatcactgtaacatt

SEQ ID NO: 741564 - DNA, 25 bp, Mus musculus
gttttaacagtacgctcttagcatc

SEQ ID NO: 741565 - DNA, 25 bp, Mus musculus
gttttaacagtaggctcttagcatc

SEQ ID NO: 741566 - DNA, 25 bp, Mus musculus
gttttaacatctcgagcctttgtgg

SEQ ID NO: 741567 - DNA, 25 bp, Mus musculus
gttttaacatctggagcctttgtgg

SEQ ID NO: 741568 - DNA, 25 bp, Mus musculus
gttttaacatgtatcccacagttgt

SEQ ID NO: 741569 - DNA, 25 bp, Mus musculus
gttttaacatgtttcccacagttgt

SEQ ID NO: 741570 - DNA, 25 bp, Mus musculus
gttttaacattcacaaagtactctc

SEQ ID NO: 741571 - DNA, 25 bp, Mus musculus
gttttaacattctcaaagtactctc

SEQ ID NO: 741572 - DNA, 25 bp, Mus musculus
gttttaaccaaccagtgtatcaagt

SEQ ID NO: 741573 - DNA, 25 bp, Mus musculus
gttttaaccaacgagtgtatcaagt

SEQ ID NO: 741574 - DNA, 25 bp, Mus musculus
gttttaaccaatctttgcaccaaag

SEQ ID NO: 741575 - DNA, 25 bp, Mus musculus
gttttaaccaatgtttgcaccaaag

SEQ ID NO: 741576 - DNA, 25 bp, Mus musculus
gttttaaccagaagctatttagctc

SEQ ID NO: 741577 - DNA, 25 bp, Mus musculus
gttttaaccagatgctatttagctc

SEQ ID NO: 741578 - DNA, 25 bp, Mus musculus
gttttaaccgtgacatgagcataga

SEQ ID NO: 741579 - DNA, 25 bp, Mus musculus
gttttaaccgtgtcatgagcataga

SEQ ID NO: 741580 - DNA, 25 bp, Mus musculus
gttttaacctagaccaagcgtggtg

SEQ ID NO: 741581 - DNA, 25 bp, Mus musculus
gttttaacctagtccaagcgtggtg

SEQ ID NO: 741582 - DNA, 25 bp, Mus musculus
gttttaacctgcaatattttcatgt

SEQ ID NO: 741583 - DNA, 25 bp, Mus musculus
gttttaacctgctatattttcatgt

SEQ ID NO: 741584 - DNA, 25 bp, Mus musculus
gttttaagaattacctgatgctctt

SEQ ID NO: 741585 - DNA, 25 bp, Mus musculus
gttttaagaatttcctgatgctctt

SEQ ID NO: 741586 - DNA, 25 bp, Mus musculus
gttttaagctgcagaccatttaagc

SEQ ID NO: 741587 - DNA, 25 bp, Mus musculus
gttttaagctgctgaccatttaagc

SEQ ID NO: 741588 - DNA, 25 bp, Mus musculus
gttttaagtgccacctactggcagc

SEQ ID NO: 741589 - DNA, 25 bp, Mus musculus
gttttaagtgccagtcattctgaag

SEQ ID NO: 741590 - DNA, 25 bp, Mus musculus
gttttaagtgcctcctactggcagc

SEQ ID NO: 741591 - DNA, 25 bp, Mus musculus
gttttaagtgcctgtcattctgaag

SEQ ID NO: 741592 - DNA, 25 bp, Mus musculus
gttttaatagaaatccttatgttca

SEQ ID NO: 741593 - DNA, 25 bp, Mus musculus
gttttaatagaattccttatgttca

SEQ ID NO: 741594 - DNA, 25 bp, Mus musculus
gttttaatatgcatcctgggccttt

SEQ ID NO: 741595 - DNA, 25 bp, Mus musculus
gttttaatatgcttcctgggccttt

SEQ ID NO: 741596 - DNA, 25 bp, Mus musculus
gttttaatcaacaggacctgcctgc

SEQ ID NO: 741597 - DNA, 25 bp, Mus musculus
gttttaatcaactggacctgcctgc

SEQ ID NO: 741598 - DNA, 25 bp, Mus musculus
gttttaatcaagacagctccgtaag

SEQ ID NO: 741599 - DNA, 25 bp, Mus musculus
gttttaatcaagaccacatcttctt

SEQ ID NO: 741600 - DNA, 25 bp, Mus musculus
gttttaatcaagtcagctccgtaag

SEQ ID NO: 741601 - DNA, 25 bp, Mus musculus
gttttaatcaagtccacatcttctt

SEQ ID NO: 741602 - DNA, 25 bp, Mus musculus
gttttaatcaccatggccattttca

SEQ ID NO: 741603 - DNA, 25 bp, Mus musculus
gttttaatcaccttggccattttca

SEQ ID NO: 741604 - DNA, 25 bp, Mus musculus
gttttaatttctcatccccacttct

SEQ ID NO: 741605 - DNA, 25 bp, Mus musculus
gttttaatttctgatccccacttct

SEQ ID NO: 741606 - DNA, 25 bp, Mus musculus
gttttaatttgcctccaacatgcaa

SEQ ID NO: 741607 - DNA, 25 bp, Mus musculus
gttttaatttgcgtccaacatgcaa

SEQ ID NO: 741608 - DNA, 25 bp, Mus musculus
gttttacaaccgaccactgggctat

SEQ ID NO: 741609 - DNA, 25 bp, Mus musculus
gttttacaaccgtccactgggctat

SEQ ID NO: 741610 - DNA, 25 bp, Mus musculus
gttttacaactgaggcaagatggcc

SEQ ID NO: 741611 - DNA, 25 bp, Mus musculus
gttttacaactgtggcaagatggcc

SEQ ID NO: 741612 - DNA, 25 bp, Mus musculus
gttttacaagtacctccaatgagag

SEQ ID NO: 741613 - DNA, 25 bp, Mus musculus
gttttacaagtagctccaatgagag

SEQ ID NO: 741614 - DNA, 25 bp, Mus musculus
gttttacaagttaatcaggtggcgt

SEQ ID NO: 741615 - DNA, 25 bp, Mus musculus
gttttacaagtttatcaggtggcgt

SEQ ID NO: 741616 - DNA, 25 bp, Mus musculus
gttttacaatctagtcttccttcca

SEQ ID NO: 741617 - DNA, 25 bp, Mus musculus
gttttacaatcttgtcttccttcca

SEQ ID NO: 741618 - DNA, 25 bp, Mus musculus
gttttacagactacttcagcctgga

SEQ ID NO: 741619 - DNA, 25 bp, Mus musculus
gttttacagacttcttcagcctgga

SEQ ID NO: 741620 - DNA, 25 bp, Mus musculus
gttttacagagtcctacttgatggt

SEQ ID NO: 741621 - DNA, 25 bp, Mus musculus
gttttacagagtgctacttgatggt

SEQ ID NO: 741622 - DNA, 25 bp, Mus musculus
gttttacaggcaaggttctggatct

SEQ ID NO: 741623 - DNA, 25 bp, Mus musculus
gttttacaggcatggttctggatct

SEQ ID NO: 741624 - DNA, 25 bp, Mus musculus
gttttacaggctaaatggtgggcat

SEQ ID NO: 741625 - DNA, 25 bp, Mus musculus
gttttacaggcttaatggtgggcat

SEQ ID NO: 741626 - DNA, 25 bp, Mus musculus
gttttacagggtacctgtgtatgca

SEQ ID NO: 741627 - DNA, 25 bp, Mus musculus
gttttacagggttcctgtgtatgca

SEQ ID NO: 741628 - DNA, 25 bp, Mus musculus
gttttacaggtaagggacctacatc

SEQ ID NO: 741629 - DNA, 25 bp, Mus musculus
gttttacaggtatgggacctacatc

SEQ ID NO: 741630 - DNA, 25 bp, Mus musculus
gttttacagtaaaggctcttaagaa

SEQ ID NO: 741631 - DNA, 25 bp, Mus musculus
gttttacagtaatggctcttaagaa

SEQ ID NO: 741632 - DNA, 25 bp, Mus musculus
gttttacagtatcacattccctaat

SEQ ID NO: 741633 - DNA, 25 bp, Mus musculus
gttttacagtatgacattccctaat

SEQ ID NO: 741634 - DNA, 25 bp, Mus musculus
gttttacagtctagccttttcagtc

SEQ ID NO: 741635 - DNA, 25 bp, Mus musculus
gttttacagtctccaatccctgctt

SEQ ID NO: 741636 - DNA, 25 bp, Mus musculus
gttttacagtctgcaatccctgctt

SEQ ID NO: 741637 - DNA, 25 bp, Mus musculus
gttttacagtcttgccttttcagtc

SEQ ID NO: 741638 - DNA, 25 bp, Mus musculus
gttttacagttacccatagcatgca

SEQ ID NO: 741639 - DNA, 25 bp, Mus musculus
gttttacagttagccatagcatgca

SEQ ID NO: 741640 - DNA, 25 bp, Mus musculus
gttttacataacaagacaagaccat

SEQ ID NO: 741641 - DNA, 25 bp, Mus musculus
gttttacataactagacaagaccat

SEQ ID NO: 741642 - DNA, 25 bp, Mus musculus
gttttacatagtattgtgactctta

SEQ ID NO: 741643 - DNA, 25 bp, Mus musculus
gttttacatagttttgtgactctta

SEQ ID NO: 741644 - DNA, 25 bp, Mus musculus
gttttacatcaaaggacatccacat

SEQ ID NO: 741645 - DNA, 25 bp, Mus musculus
gttttacatcaatggacatccacat

SEQ ID NO: 741646 - DNA, 25 bp, Mus musculus
gttttacatcttatccttatgctct

SEQ ID NO: 741647 - DNA, 25 bp, Mus musculus
gttttacatcttatctcatctctaa

SEQ ID NO: 741648 - DNA, 25 bp, Mus musculus
gttttacatcttttccttatgctct

SEQ ID NO: 741649 - DNA, 25 bp, Mus musculus
gttttacatcttttctcatctctaa

SEQ ID NO: 741650 - DNA, 25 bp, Mus musculus
gttttacatggtcaaacagttgcca

SEQ ID NO: 741651 - DNA, 25 bp, Mus musculus
gttttacatggtgaaacagttgcca

SEQ ID NO: 741652 - DNA, 25 bp, Mus musculus
gttttacattctagcgatgctcata

SEQ ID NO: 741653 - DNA, 25 bp, Mus musculus
gttttacattcttgcgatgctcata

SEQ ID NO: 741654 - DNA, 25 bp, Mus musculus
gttttacatttcaatcttcctcaca

SEQ ID NO: 741655 - DNA, 25 bp, Mus musculus
gttttacatttctatcttcctcaca

SEQ ID NO: 741656 - DNA, 25 bp, Mus musculus
gttttacattttaatctgcctgtta

SEQ ID NO: 741657 - DNA, 25 bp, Mus musculus
gttttacatttttatctgcctgtta

SEQ ID NO: 741658 - DNA, 25 bp, Mus musculus
gttttaccacatacttaaacagatt

SEQ ID NO: 741659 - DNA, 25 bp, Mus musculus
gttttaccacattcttaaacagatt

SEQ ID NO: 741660 - DNA, 25 bp, Mus musculus
gttttaccaccgagtgctaatttgc

SEQ ID NO: 741661 - DNA, 25 bp, Mus musculus
gttttaccaccgtgtgctaatttgc

SEQ ID NO: 741662 - DNA, 25 bp, Mus musculus
gttttaccagaaacactctgacccc

SEQ ID NO: 741663 - DNA, 25 bp, Mus musculus
gttttaccagaatcactctgacccc

SEQ ID NO: 741664 - DNA, 25 bp, Mus musculus
gttttaccagagagagattccttgt

SEQ ID NO: 741665 - DNA, 25 bp, Mus musculus
gttttaccagagtgagattccttgt

SEQ ID NO: 741666 - DNA, 25 bp, Mus musculus
gttttaccagtacaacaagagacta

SEQ ID NO: 741667 - DNA, 25 bp, Mus musculus
gttttaccagtagaacaagagacta

SEQ ID NO: 741668 - DNA, 25 bp, Mus musculus
gttttaccagtgacacagaccgtgt

SEQ ID NO: 741669 - DNA, 25 bp, Mus musculus
gttttaccagtgtcacagaccgtgt

SEQ ID NO: 741670 - DNA, 25 bp, Mus musculus
gttttaccattgcacatagactgga

SEQ ID NO: 741671 - DNA, 25 bp, Mus musculus
gttttaccattggacatagactgga

SEQ ID NO: 741672 - DNA, 25 bp, Mus musculus
gttttaccatttaccagtgctattg

SEQ ID NO: 741673 - DNA, 25 bp, Mus musculus
gttttaccatttctcaatattgtat

SEQ ID NO: 741674 - DNA, 25 bp, Mus musculus
gttttaccatttgtcaatattgtat

SEQ ID NO: 741675 - DNA, 25 bp, Mus musculus
gttttaccattttccagtgctattg

SEQ ID NO: 741676 - DNA, 25 bp, Mus musculus
gttttacccagaacgctactatgag

SEQ ID NO: 741677 - DNA, 25 bp, Mus musculus
gttttacccagatcgctactatgag

SEQ ID NO: 741678 - DNA, 25 bp, Mus musculus
gttttacccatcactgacagttttt

SEQ ID NO: 741679 - DNA, 25 bp, Mus musculus
gttttacccatctctgacagttttt

SEQ ID NO: 741680 - DNA, 25 bp, Mus musculus
gttttaccctgactaaagattgtct

SEQ ID NO: 741681 - DNA, 25 bp, Mus musculus
gttttaccctgagtaaagattgtct

SEQ ID NO: 741682 - DNA, 25 bp, Mus musculus
gttttacctgaaagcatttctgtgc

SEQ ID NO: 741683 - DNA, 25 bp, Mus musculus
gttttacctgaatgcatttctgtgc

SEQ ID NO: 741684 - DNA, 25 bp, Mus musculus
gttttacctggcagacacacttcct

SEQ ID NO: 741685 - DNA, 25 bp, Mus musculus
gttttacctggctgacacacttcct

SEQ ID NO: 741686 - DNA, 25 bp, Mus musculus
gttttacctggtagaatctaacatt

SEQ ID NO: 741687 - DNA, 25 bp, Mus musculus
gttttacctggttgaatctaacatt

SEQ ID NO: 741688 - DNA, 25 bp, Mus musculus
gttttaccttagaatcttctcaaca

SEQ ID NO: 741689 - DNA, 25 bp, Mus musculus
gttttaccttagtatcttctcaaca

SEQ ID NO: 741690 - DNA, 25 bp, Mus musculus
gttttaccttcaccaaccaaagtgt

SEQ ID NO: 741691 - DNA, 25 bp, Mus musculus
gttttaccttcagcaaccaaagtgt

SEQ ID NO: 741692 - DNA, 25 bp, Mus musculus
gttttacgacctcgatctggtctgt

SEQ ID NO: 741693 - DNA, 25 bp, Mus musculus
gttttacgacctggatctggtctgt

SEQ ID NO: 741694 - DNA, 25 bp, Mus musculus
gttttacggaaactgcatctgcaca

SEQ ID NO: 741695 - DNA, 25 bp, Mus musculus
gttttacggaaagtgcatctgcaca

SEQ ID NO: 741696 - DNA, 25 bp, Mus musculus
gttttacggagtcggagtactcaat

SEQ ID NO: 741697 - DNA, 25 bp, Mus musculus
gttttacggagtgggagtactcaat

SEQ ID NO: 741698 - DNA, 25 bp, Mus musculus
gttttacggcaaaatcatcaccaca

SEQ ID NO: 741699 - DNA, 25 bp, Mus musculus
gttttacggcaatatcatcaccaca

SEQ ID NO: 741700 - DNA, 25 bp, Mus musculus
gttttacggcatcatggctgccctc

SEQ ID NO: 741701 - DNA, 25 bp, Mus musculus
gttttacggcatgatggctgccctc

SEQ ID NO: 741702 - DNA, 25 bp, Mus musculus
gttttacgtagtagctgtacccatt

SEQ ID NO: 741703 - DNA, 25 bp, Mus musculus
gttttacgtagttgctgtacccatt

SEQ ID NO: 741704 - DNA, 25 bp, Mus musculus
gttttactaatgatgcgtggagcac

SEQ ID NO: 741705 - DNA, 25 bp, Mus musculus
gttttactaatgttgcgtggagcac

SEQ ID NO: 741706 - DNA, 25 bp, Mus musculus
gttttactacgacacaggccgtggg

SEQ ID NO: 741707 - DNA, 25 bp, Mus musculus
gttttactacgactgagaagggaag

SEQ ID NO: 741708 - DNA, 25 bp, Mus musculus
gttttactacgagacaggccgtggg

SEQ ID NO: 741709 - DNA, 25 bp, Mus musculus
gttttactacgagtgagaagggaag

SEQ ID NO: 741710 - DNA, 25 bp, Mus musculus
gttttactactgacatctttagaga

SEQ ID NO: 741711 - DNA, 25 bp, Mus musculus
gttttactactgtcatctttagaga

SEQ ID NO: 741712 - DNA, 25 bp, Mus musculus
gttttactcaagatacccactagct

SEQ ID NO: 741713 - DNA, 25 bp, Mus musculus
gttttactcaagttacccactagct

SEQ ID NO: 741714 - DNA, 25 bp, Mus musculus
gttttactcataaatcccccctatt

SEQ ID NO: 741715 - DNA, 25 bp, Mus musculus
gttttactcatatatcccccctatt

SEQ ID NO: 741716 - DNA, 25 bp, Mus musculus
gttttactccatacatttgtctgcc

SEQ ID NO: 741717 - DNA, 25 bp, Mus musculus
gttttactccattcatttgtctgcc

SEQ ID NO: 741718 - DNA, 25 bp, Mus musculus
gttttactccctcaaaatggcctga

SEQ ID NO: 741719 - DNA, 25 bp, Mus musculus
gttttactccctgaaaatggcctga

SEQ ID NO: 741720 - DNA, 25 bp, Mus musculus
gttttactctagaatgcttgtccta

SEQ ID NO: 741721 - DNA, 25 bp, Mus musculus
gttttactctagtatgcttgtccta

SEQ ID NO: 741722 - DNA, 25 bp, Mus musculus
gttttactctccctatatattgcac

SEQ ID NO: 741723 - DNA, 25 bp, Mus musculus
gttttactctccgtatatattgcac

SEQ ID NO: 741724 - DNA, 25 bp, Mus musculus
gttttactctctccaatgtcctcta

SEQ ID NO: 741725 - DNA, 25 bp, Mus musculus
gttttactctctgcaatgtcctcta

SEQ ID NO: 741726 - DNA, 25 bp, Mus musculus
gttttactgaagaatgccccttgaa

SEQ ID NO: 741727 - DNA, 25 bp, Mus musculus
gttttactgaagtatgccccttgaa

SEQ ID NO: 741728 - DNA, 25 bp, Mus musculus
gttttactggatactcagggagccc

SEQ ID NO: 741729 - DNA, 25 bp, Mus musculus
gttttactggattctcagggagccc

SEQ ID NO: 741730 - DNA, 25 bp, Mus musculus
gttttactgggaagcttggatctga

SEQ ID NO: 741731 - DNA, 25 bp, Mus musculus
gttttactgggatgcttggatctga

SEQ ID NO: 741732 - DNA, 25 bp, Mus musculus
gttttactggtcatttacatgttca

SEQ ID NO: 741733 - DNA, 25 bp, Mus musculus
gttttactggtcctatgtgtgtgcc

SEQ ID NO: 741734 - DNA, 25 bp, Mus musculus
gttttactggtcgtatgtgtgtgcc

SEQ ID NO: 741735 - DNA, 25 bp, Mus musculus
gttttactggtcttttacatgttca

SEQ ID NO: 741736 - DNA, 25 bp, Mus musculus
gttttacttacaattgagctgggtt

SEQ ID NO: 741737 - DNA, 25 bp, Mus musculus
gttttacttacatttgagctgggtt

SEQ ID NO: 741738 - DNA, 25 bp, Mus musculus
gttttacttatgcactacatctggg

SEQ ID NO: 741739 - DNA, 25 bp, Mus musculus
gttttacttatggactacatctggg

SEQ ID NO: 741740 - DNA, 25 bp, Mus musculus
gttttacttctcagtacttgttctc

SEQ ID NO: 741741 - DNA, 25 bp, Mus musculus
gttttacttctctgtacttgttctc

SEQ ID NO: 741742 - DNA, 25 bp, Mus musculus
gttttacttgcacagcgtattcggc

SEQ ID NO: 741743 - DNA, 25 bp, Mus musculus
gttttacttgcagagcgtattcggc

SEQ ID NO: 741744 - DNA, 25 bp, Mus musculus
gttttacttgttcactgtcaaatac

SEQ ID NO: 741745 - DNA, 25 bp, Mus musculus
gttttacttgttgactgtcaaatac

SEQ ID NO: 741746 - DNA, 25 bp, Mus musculus
gttttactttccaaggtctggcaca

SEQ ID NO: 741747 - DNA, 25 bp, Mus musculus
gttttactttcctaggtctggcaca

SEQ ID NO: 741748 - DNA, 25 bp, Mus musculus
gttttacttttactgaactggtgat

SEQ ID NO: 741749 - DNA, 25 bp, Mus musculus
gttttacttttagtgaactggtgat

SEQ ID NO: 741750 - DNA, 25 bp, Mus musculus
gttttacttttcatcagggtagcat

SEQ ID NO: 741751 - DNA, 25 bp, Mus musculus
gttttacttttccatttcagagaga

SEQ ID NO: 741752 - DNA, 25 bp, Mus musculus
gttttacttttcgatttcagagaga

SEQ ID NO: 741753 - DNA, 25 bp, Mus musculus
gttttacttttcttcagggtagcat

SEQ ID NO: 741754 - DNA, 25 bp, Mus musculus
gttttagaaagacccaagatgatag

SEQ ID NO: 741755 - DNA, 25 bp, Mus musculus
gttttagaaagagccaagatgatag

SEQ ID NO: 741756 - DNA, 25 bp, Mus musculus
gttttagaacacagatcctcagcct

SEQ ID NO: 741757 - DNA, 25 bp, Mus musculus
gttttagaacactgatcctcagcct

SEQ ID NO: 741758 - DNA, 25 bp, Mus musculus
gttttagagccaaggcagcacaggc

SEQ ID NO: 741759 - DNA, 25 bp, Mus musculus
gttttagagccatggcagcacaggc

SEQ ID NO: 741760 - DNA, 25 bp, Mus musculus
gttttagaggttattcaggtgtgca

SEQ ID NO: 741761 - DNA, 25 bp, Mus musculus
gttttagaggtttttcaggtgtgca

SEQ ID NO: 741762 - DNA, 25 bp, Mus musculus
gttttagatgctcctgtgcctacat

SEQ ID NO: 741763 - DNA, 25 bp, Mus musculus
gttttagatgctgctgtgcctacat

SEQ ID NO: 741764 - DNA, 25 bp, Mus musculus
gttttagcaatcacatttctttctt

SEQ ID NO: 741765 - DNA, 25 bp, Mus musculus
gttttagcaatcctgtgtttcttgt

SEQ ID NO: 741766 - DNA, 25 bp, Mus musculus
gttttagcaatcgtgtgtttcttgt

SEQ ID NO: 741767 - DNA, 25 bp, Mus musculus
gttttagcaatctcatttctttctt

SEQ ID NO: 741768 - DNA, 25 bp, Mus musculus
gttttagcagacatttaagttaatt

SEQ ID NO: 741769 - DNA, 25 bp, Mus musculus
gttttagcagacttttaagttaatt

SEQ ID NO: 741770 - DNA, 25 bp, Mus musculus
gttttagcagctaatcttctgggaa

SEQ ID NO: 741771 - DNA, 25 bp, Mus musculus
gttttagcagcttatcttctgggaa

SEQ ID NO: 741772 - DNA, 25 bp, Mus musculus
gttttagcagtgcacgttcacttcc

SEQ ID NO: 741773 - DNA, 25 bp, Mus musculus
gttttagcagtggacgttcacttcc

SEQ ID NO: 741774 - DNA, 25 bp, Mus musculus
gttttagcgattactcccaggtaat

SEQ ID NO: 741775 - DNA, 25 bp, Mus musculus
gttttagcgatttctcccaggtaat

SEQ ID NO: 741776 - DNA, 25 bp, Mus musculus
gttttagctgatcgtgactggcata

SEQ ID NO: 741777 - DNA, 25 bp, Mus musculus
gttttagctgatggtgactggcata

SEQ ID NO: 741778 - DNA, 25 bp, Mus musculus
gttttagctggaatggccgtggatt

SEQ ID NO: 741779 - DNA, 25 bp, Mus musculus
gttttagctggattggccgtggatt

SEQ ID NO: 741780 - DNA, 25 bp, Mus musculus
gttttagcttgtatagctctgcctg

SEQ ID NO: 741781 - DNA, 25 bp, Mus musculus
gttttagcttgtttagctctgcctg

SEQ ID NO: 741782 - DNA, 25 bp, Mus musculus
gttttaggaactactcccaaagctg

SEQ ID NO: 741783 - DNA, 25 bp, Mus musculus
gttttaggaacttctcccaaagctg

SEQ ID NO: 741784 - DNA, 25 bp, Mus musculus
gttttaggaggacccatctgaccct

SEQ ID NO: 741785 - DNA, 25 bp, Mus musculus
gttttaggaggagccatctgaccct

SEQ ID NO: 741786 - DNA, 25 bp, Mus musculus
gttttaggcataaaagcttccatca

SEQ ID NO: 741787 - DNA, 25 bp, Mus musculus
gttttaggcatataagcttccatca

SEQ ID NO: 741788 - DNA, 25 bp, Mus musculus
gttttaggcgagcacagtggctctc

SEQ ID NO: 741789 - DNA, 25 bp, Mus musculus
gttttaggcgaggacagtggctctc

SEQ ID NO: 741790 - DNA, 25 bp, Mus musculus
gttttaggcttacgagcaatgactc

SEQ ID NO: 741791 - DNA, 25 bp, Mus musculus
gttttaggcttaggagcaatgactc

SEQ ID NO: 741792 - DNA, 25 bp, Mus musculus
gttttagggattccctgagcttctt

SEQ ID NO: 741793 - DNA, 25 bp, Mus musculus
gttttagggattgcctgagcttctt

SEQ ID NO: 741794 - DNA, 25 bp, Mus musculus
gttttagggcctcaacacctgtgtg

SEQ ID NO: 741795 - DNA, 25 bp, Mus musculus
gttttagggcctgaacacctgtgtg

SEQ ID NO: 741796 - DNA, 25 bp, Mus musculus
gttttaggttgaagaatcctctcat

SEQ ID NO: 741797 - DNA, 25 bp, Mus musculus
gttttaggttgatgaatcctctcat

SEQ ID NO: 741798 - DNA, 25 bp, Mus musculus
gttttagtatctatgctgcttgctg

SEQ ID NO: 741799 - DNA, 25 bp, Mus musculus
gttttagtatctttgctgcttgctg

SEQ ID NO: 741800 - DNA, 25 bp, Mus musculus
gttttagtcagcatgcaggtctcag

SEQ ID NO: 741801 - DNA, 25 bp, Mus musculus
gttttagtcagcttgcaggtctcag

SEQ ID NO: 741802 - DNA, 25 bp, Mus musculus
gttttagtccacagtctttgcttga

SEQ ID NO: 741803 - DNA, 25 bp, Mus musculus
gttttagtccactgtctttgcttga

SEQ ID NO: 741804 - DNA, 25 bp, Mus musculus
gttttagtccagcttagttgacctg

SEQ ID NO: 741805 - DNA, 25 bp, Mus musculus
gttttagtccaggttagttgacctg

SEQ ID NO: 741806 - DNA, 25 bp, Mus musculus
gttttagtctagcaagtctgccagt

SEQ ID NO: 741807 - DNA, 25 bp, Mus musculus
gttttagtctaggaagtctgccagt

SEQ ID NO: 741808 - DNA, 25 bp, Mus musculus
gttttagtgaatcttacccctggag

SEQ ID NO: 741809 - DNA, 25 bp, Mus musculus
gttttagtgaatgttacccctggag

SEQ ID NO: 741810 - DNA, 25 bp, Mus musculus
gttttagtggccaatctttgtattt

SEQ ID NO: 741811 - DNA, 25 bp, Mus musculus
gttttagtggcctatctttgtattt

SEQ ID NO: 741812 - DNA, 25 bp, Mus musculus
gttttagtgttgctaaattcgctca

SEQ ID NO: 741813 - DNA, 25 bp, Mus musculus
gttttagtgttggtaaattcgctca

SEQ ID NO: 741814 - DNA, 25 bp, Mus musculus
gttttagttccaagtagcccagagt

SEQ ID NO: 741815 - DNA, 25 bp, Mus musculus
gttttagttccatgtagcccagagt

SEQ ID NO: 741816 - DNA, 25 bp, Mus musculus
gttttagttcttcaccatcctttat

SEQ ID NO: 741817 - DNA, 25 bp, Mus musculus
gttttagttcttgaccatcctttat

SEQ ID NO: 741818 - DNA, 25 bp, Mus musculus
gttttagttgatcgcacacctgtgt

SEQ ID NO: 741819 - DNA, 25 bp, Mus musculus
gttttagttgatggcacacctgtgt

SEQ ID NO: 741820 - DNA, 25 bp, Mus musculus
gttttagttttgaggcagcttgtcg

SEQ ID NO: 741821 - DNA, 25 bp, Mus musculus
gttttagttttgtggcagcttgtcg

SEQ ID NO: 741822 - DNA, 25 bp, Mus musculus
gttttataaactagtatctggctat

SEQ ID NO: 741823 - DNA, 25 bp, Mus musculus
gttttataaacttgtatctggctat

SEQ ID NO: 741824 - DNA, 25 bp, Mus musculus
gttttatacccactaacaagtgaat

SEQ ID NO: 741825 - DNA, 25 bp, Mus musculus
gttttatacccagtaacaagtgaat

SEQ ID NO: 741826 - DNA, 25 bp, Mus musculus
gttttatagaacacaggcaccctca

SEQ ID NO: 741827 - DNA, 25 bp, Mus musculus
gttttatagaactcaggcaccctca

SEQ ID NO: 741828 - DNA, 25 bp, Mus musculus
gttttatagaccatgactcccatgc

SEQ ID NO: 741829 - DNA, 25 bp, Mus musculus
gttttatagaccttgactcccatgc

SEQ ID NO: 741830 - DNA, 25 bp, Mus musculus
gttttataggctacattttcctaat

SEQ ID NO: 741831 - DNA, 25 bp, Mus musculus
gttttataggcttcattttcctaat

SEQ ID NO: 741832 - DNA, 25 bp, Mus musculus
gttttatagtcaattcagggtgtca

SEQ ID NO: 741833 - DNA, 25 bp, Mus musculus
gttttatagtcatttcagggtgtca

SEQ ID NO: 741834 - DNA, 25 bp, Mus musculus
gttttatatctaccctttctgcagt

SEQ ID NO: 741835 - DNA, 25 bp, Mus musculus
gttttatatctagcctttctgcagt

SEQ ID NO: 741836 - DNA, 25 bp, Mus musculus
gttttatatttaagccttgatgatt

SEQ ID NO: 741837 - DNA, 25 bp, Mus musculus
gttttatatttatgccttgatgatt

SEQ ID NO: 741838 - DNA, 25 bp, Mus musculus
gttttatcactacccagtccaggat

SEQ ID NO: 741839 - DNA, 25 bp, Mus musculus
gttttatcactagccagtccaggat

SEQ ID NO: 741840 - DNA, 25 bp, Mus musculus
gttttatcacttccaagatgctacc

SEQ ID NO: 741841 - DNA, 25 bp, Mus musculus
gttttatcacttgcaagatgctacc

SEQ ID NO: 741842 - DNA, 25 bp, Mus musculus
gttttatcatacagccatctagtta

SEQ ID NO: 741843 - DNA, 25 bp, Mus musculus
gttttatcatactgccatctagtta

SEQ ID NO: 741844 - DNA, 25 bp, Mus musculus
gttttatcatccatgtttcctgtag

SEQ ID NO: 741845 - DNA, 25 bp, Mus musculus
gttttatcatccttgtttcctgtag

SEQ ID NO: 741846 - DNA, 25 bp, Mus musculus
gttttatcattgatacctgctggca

SEQ ID NO: 741847 - DNA, 25 bp, Mus musculus
gttttatcattgttacctgctggca

SEQ ID NO: 741848 - DNA, 25 bp, Mus musculus
gttttatccaagctgaacaccatga

SEQ ID NO: 741849 - DNA, 25 bp, Mus musculus
gttttatccaaggtgaacaccatga

SEQ ID NO: 741850 - DNA, 25 bp, Mus musculus
gttttatccagtcagacccaagcta

SEQ ID NO: 741851 - DNA, 25 bp, Mus musculus
gttttatccagtgagacccaagcta

SEQ ID NO: 741852 - DNA, 25 bp, Mus musculus
gttttatccgctccaaactgtgaga

SEQ ID NO: 741853 - DNA, 25 bp, Mus musculus
gttttatccgctgcaaactgtgaga

SEQ ID NO: 741854 - DNA, 25 bp, Mus musculus
gttttatcctaacatgtcactgccc

SEQ ID NO: 741855 - DNA, 25 bp, Mus musculus
gttttatcctaagatgtcactgccc

SEQ ID NO: 741856 - DNA, 25 bp, Mus musculus
gttttatcctatcctttctgattta

SEQ ID NO: 741857 - DNA, 25 bp, Mus musculus
gttttatcctatgctttctgattta

SEQ ID NO: 741858 - DNA, 25 bp, Mus musculus
gttttatcctccagtgtcaggcaag

SEQ ID NO: 741859 - DNA, 25 bp, Mus musculus
gttttatcctcctgtgtcaggcaag

SEQ ID NO: 741860 - DNA, 25 bp, Mus musculus
gttttatcctctcaacagggcactt

SEQ ID NO: 741861 - DNA, 25 bp, Mus musculus
gttttatcctctgaacagggcactt

SEQ ID NO: 741862 - DNA, 25 bp, Mus musculus
gttttatcgccaagcaggaggaaag

SEQ ID NO: 741863 - DNA, 25 bp, Mus musculus
gttttatcgccatgcaggaggaaag

SEQ ID NO: 741864 - DNA, 25 bp, Mus musculus
gttttatctaaaagtttgacacctt

SEQ ID NO: 741865 - DNA, 25 bp, Mus musculus
gttttatctaaatgtttgacacctt

SEQ ID NO: 741866 - DNA, 25 bp, Mus musculus
gttttatctcaacagccagcatagg

SEQ ID NO: 741867 - DNA, 25 bp, Mus musculus
gttttatctcaagagccagcatagg

SEQ ID NO: 741868 - DNA, 25 bp, Mus musculus
gttttatctctaagttctttcatgt

SEQ ID NO: 741869 - DNA, 25 bp, Mus musculus
gttttatctctatgttctttcatgt

SEQ ID NO: 741870 - DNA, 25 bp, Mus musculus
gttttatcttataactgccaccacc

SEQ ID NO: 741871 - DNA, 25 bp, Mus musculus
gttttatcttattactgccaccacc

SEQ ID NO: 741872 - DNA, 25 bp, Mus musculus
gttttatgacctaaaaagtacacag

SEQ ID NO: 741873 - DNA, 25 bp, Mus musculus
gttttatgaccttaaaagtacacag

SEQ ID NO: 741874 - DNA, 25 bp, Mus musculus
gttttatgccctacattgacaggag

SEQ ID NO: 741875 - DNA, 25 bp, Mus musculus
gttttatgccctcatgagctctgac

SEQ ID NO: 741876 - DNA, 25 bp, Mus musculus
gttttatgccctgatgagctctgac

SEQ ID NO: 741877 - DNA, 25 bp, Mus musculus
gttttatgcccttcattgacaggag

SEQ ID NO: 741878 - DNA, 25 bp, Mus musculus
gttttatgcgtactcaatctgtgga

SEQ ID NO: 741879 - DNA, 25 bp, Mus musculus
gttttatgcgtagtcaatctgtgga

SEQ ID NO: 741880 - DNA, 25 bp, Mus musculus
gttttatgcttacacatatccccaa

SEQ ID NO: 741881 - DNA, 25 bp, Mus musculus
gttttatgcttagacatatccccaa

SEQ ID NO: 741882 - DNA, 25 bp, Mus musculus
gttttatgtcatatagcctggtcta

SEQ ID NO: 741883 - DNA, 25 bp, Mus musculus
gttttatgtcatttagcctggtcta

SEQ ID NO: 741884 - DNA, 25 bp, Mus musculus
gttttatgtcctatcttcatccatt

SEQ ID NO: 741885 - DNA, 25 bp, Mus musculus
gttttatgtcctttcttcatccatt

SEQ ID NO: 741886 - DNA, 25 bp, Mus musculus
gttttatgtgatcggttctgtctac

SEQ ID NO: 741887 - DNA, 25 bp, Mus musculus
gttttatgtgatgggttctgtctac

SEQ ID NO: 741888 - DNA, 25 bp, Mus musculus
gttttatgtgcaagtgaatggccta

SEQ ID NO: 741889 - DNA, 25 bp, Mus musculus
gttttatgtgcatgtgaatggccta

SEQ ID NO: 741890 - DNA, 25 bp, Mus musculus
gttttatgttgtaaactgctattaa

SEQ ID NO: 741891 - DNA, 25 bp, Mus musculus
gttttatgttgttaactgctattaa

SEQ ID NO: 741892 - DNA, 25 bp, Mus musculus
gttttattacagcactcgcaccagg

SEQ ID NO: 741893 - DNA, 25 bp, Mus musculus
gttttattacaggactcgcaccagg

SEQ ID NO: 741894 - DNA, 25 bp, Mus musculus
gttttattacatctctgttaccttt

SEQ ID NO: 741895 - DNA, 25 bp, Mus musculus
gttttattacatgtctgttaccttt

SEQ ID NO: 741896 - DNA, 25 bp, Mus musculus
gttttattcaaccagcaacatgtgg

SEQ ID NO: 741897 - DNA, 25 bp, Mus musculus
gttttattcaacgagcaacatgtgg

SEQ ID NO: 741898 - DNA, 25 bp, Mus musculus
gttttattcaataatacttctcgag

SEQ ID NO: 741899 - DNA, 25 bp, Mus musculus
gttttattcaatactctgtgtctgt

SEQ ID NO: 741900 - DNA, 25 bp, Mus musculus
gttttattcaattatacttctcgag

SEQ ID NO: 741901 - DNA, 25 bp, Mus musculus
gttttattcaattctctgtgtctgt

SEQ ID NO: 741902 - DNA, 25 bp, Mus musculus
gttttattcaccactgatcagttta

SEQ ID NO: 741903 - DNA, 25 bp, Mus musculus
gttttattcacctctgatcagttta

SEQ ID NO: 741904 - DNA, 25 bp, Mus musculus
gttttattcacgatctattcttgac

SEQ ID NO: 741905 - DNA, 25 bp, Mus musculus
gttttattcacgttctattcttgac

SEQ ID NO: 741906 - DNA, 25 bp, Mus musculus
gttttattccaacatcctgggcatg

SEQ ID NO: 741907 - DNA, 25 bp, Mus musculus
gttttattccaagatcctgggcatg

SEQ ID NO: 741908 - DNA, 25 bp, Mus musculus
gttttattccggattcatgtactct

SEQ ID NO: 741909 - DNA, 25 bp, Mus musculus
gttttattccggtttcatgtactct

SEQ ID NO: 741910 - DNA, 25 bp, Mus musculus
gttttattcctgagcatgtgtgaga

SEQ ID NO: 741911 - DNA, 25 bp, Mus musculus
gttttattcctgcaaccaacataga

SEQ ID NO: 741912 - DNA, 25 bp, Mus musculus
gttttattcctggaaccaacataga

SEQ ID NO: 741913 - DNA, 25 bp, Mus musculus
gttttattcctgtgcatgtgtgaga

SEQ ID NO: 741914 - DNA, 25 bp, Mus musculus
gttttattccttatccttgacagag

SEQ ID NO: 741915 - DNA, 25 bp, Mus musculus
gttttattccttttccttgacagag

SEQ ID NO: 741916 - DNA, 25 bp, Mus musculus
gttttattctacagggctacgtgga

SEQ ID NO: 741917 - DNA, 25 bp, Mus musculus
gttttattctactgggctacgtgga

SEQ ID NO: 741918 - DNA, 25 bp, Mus musculus
gttttattggcacctagttctttca

SEQ ID NO: 741919 - DNA, 25 bp, Mus musculus
gttttattggcagctagttctttca

SEQ ID NO: 741920 - DNA, 25 bp, Mus musculus
gttttattggctcattatcccaaga

SEQ ID NO: 741921 - DNA, 25 bp, Mus musculus
gttttattggctgattatcccaaga

SEQ ID NO: 741922 - DNA, 25 bp, Mus musculus
gttttattggttagaggagggcact

SEQ ID NO: 741923 - DNA, 25 bp, Mus musculus
gttttattggtttgaggagggcact

SEQ ID NO: 741924 - DNA, 25 bp, Mus musculus
gttttattgtatctggcctgatgaa

SEQ ID NO: 741925 - DNA, 25 bp, Mus musculus
gttttattgtatgtggcctgatgaa

SEQ ID NO: 741926 - DNA, 25 bp, Mus musculus
gttttattgtctacagatctgcact

SEQ ID NO: 741927 - DNA, 25 bp, Mus musculus
gttttattgtcttcagatctgcact

SEQ ID NO: 741928 - DNA, 25 bp, Mus musculus
gttttatttacactcacacctgaga

SEQ ID NO: 741929 - DNA, 25 bp, Mus musculus
gttttatttacagtcacacctgaga

SEQ ID NO: 741930 - DNA, 25 bp, Mus musculus
gttttatttatcaccatgtgcccac

SEQ ID NO: 741931 - DNA, 25 bp, Mus musculus
gttttatttatcatttgtctctcct

SEQ ID NO: 741932 - DNA, 25 bp, Mus musculus
gttttatttatccaaccacctgcga

SEQ ID NO: 741933 - DNA, 25 bp, Mus musculus
gttttatttatcgaaccacctgcga

SEQ ID NO: 741934 - DNA, 25 bp, Mus musculus
gttttatttatctccatgtgcccac

SEQ ID NO: 741935 - DNA, 25 bp, Mus musculus
gttttatttatcttttgtctctcct

SEQ ID NO: 741936 - DNA, 25 bp, Mus musculus
gttttatttgcaatgcttggtcaat

SEQ ID NO: 741937 - DNA, 25 bp, Mus musculus
gttttatttgcattgcttggtcaat

SEQ ID NO: 741938 - DNA, 25 bp, Mus musculus
gttttatttgctcgacttttatgat

SEQ ID NO: 741939 - DNA, 25 bp, Mus musculus
gttttatttgctggacttttatgat

SEQ ID NO: 741940 - DNA, 25 bp, Mus musculus
gttttatttgttaagctgccagctt

SEQ ID NO: 741941 - DNA, 25 bp, Mus musculus
gttttatttgtttagctgccagctt

SEQ ID NO: 741942 - DNA, 25 bp, Mus musculus
gttttattttaccttgcacagccaa

SEQ ID NO: 741943 - DNA, 25 bp, Mus musculus
gttttattttacgttgcacagccaa

SEQ ID NO: 741944 - DNA, 25 bp, Mus musculus
gttttatttttcatgactgttgagt

SEQ ID NO: 741945 - DNA, 25 bp, Mus musculus
gttttatttttcttgactgttgagt

SEQ ID NO: 741946 - DNA, 25 bp, Mus musculus
gttttcaaacctctgggtatgtcca

SEQ ID NO: 741947 - DNA, 25 bp, Mus musculus
gttttcaaacctgtgggtatgtcca

SEQ ID NO: 741948 - DNA, 25 bp, Mus musculus
gttttcaaatgtcggaaaccaagct

SEQ ID NO: 741949 - DNA, 25 bp, Mus musculus
gttttcaaatgtgggaaaccaagct

SEQ ID NO: 741950 - DNA, 25 bp, Mus musculus
gttttcaacactcaacattggcagc

SEQ ID NO: 741951 - DNA, 25 bp, Mus musculus
gttttcaacactgaacattggcagc

SEQ ID NO: 741952 - DNA, 25 bp, Mus musculus
gttttcaaccctcaactcaggatga

SEQ ID NO: 741953 - DNA, 25 bp, Mus musculus
gttttcaaccctgaactcaggatga

SEQ ID NO: 741954 - DNA, 25 bp, Mus musculus
gttttcaacgtcacagcaggacatg

SEQ ID NO: 741955 - DNA, 25 bp, Mus musculus
gttttcaacgtctcagcaggacatg

SEQ ID NO: 741956 - DNA, 25 bp, Mus musculus
gttttcaagcagctttctgagcaga

SEQ ID NO: 741957 - DNA, 25 bp, Mus musculus
gttttcaagcaggtttctgagcaga

SEQ ID NO: 741958 - DNA, 25 bp, Mus musculus
gttttcaaggcccagtctcagtcct

SEQ ID NO: 741959 - DNA, 25 bp, Mus musculus
gttttcaaggccgagtctcagtcct

SEQ ID NO: 741960 - DNA, 25 bp, Mus musculus
gttttcaaggtaaatgacatccact

SEQ ID NO: 741961 - DNA, 25 bp, Mus musculus
gttttcaaggtatatgacatccact

SEQ ID NO: 741962 - DNA, 25 bp, Mus musculus
gttttcaagtttaagtgtggctgca

SEQ ID NO: 741963 - DNA, 25 bp, Mus musculus
gttttcaagttttagtgtggctgca

SEQ ID NO: 741964 - DNA, 25 bp, Mus musculus
gttttcaataatctatttatcccca

SEQ ID NO: 741965 - DNA, 25 bp, Mus musculus
gttttcaataatgtatttatcccca

SEQ ID NO: 741966 - DNA, 25 bp, Mus musculus
gttttcaatataaccacacctatag

SEQ ID NO: 741967 - DNA, 25 bp, Mus musculus
gttttcaatatatccacacctatag

SEQ ID NO: 741968 - DNA, 25 bp, Mus musculus
gttttcaatcgaacgctgtcagact

SEQ ID NO: 741969 - DNA, 25 bp, Mus musculus
gttttcaatcgatcgctgtcagact

SEQ ID NO: 741970 - DNA, 25 bp, Mus musculus
gttttcaatctgcttttgacctggc

SEQ ID NO: 741971 - DNA, 25 bp, Mus musculus
gttttcaatctggttttgacctggc

SEQ ID NO: 741972 - DNA, 25 bp, Mus musculus
gttttcaatgttatccctatgatat

SEQ ID NO: 741973 - DNA, 25 bp, Mus musculus
gttttcaatgttctttcttggcaaa

SEQ ID NO: 741974 - DNA, 25 bp, Mus musculus
gttttcaatgttgtttcttggcaaa

SEQ ID NO: 741975 - DNA, 25 bp, Mus musculus
gttttcaatgttttccctatgatat

SEQ ID NO: 741976 - DNA, 25 bp, Mus musculus
gttttcaattctctctagatgcgaa

SEQ ID NO: 741977 - DNA, 25 bp, Mus musculus
gttttcaattctgtctagatgcgaa

SEQ ID NO: 741978 - DNA, 25 bp, Mus musculus
gttttcacaaagatcatgtaccatt

SEQ ID NO: 741979 - DNA, 25 bp, Mus musculus
gttttcacaaagttcatgtaccatt

SEQ ID NO: 741980 - DNA, 25 bp, Mus musculus
gttttcacaaggacactggtctcag

SEQ ID NO: 741981 - DNA, 25 bp, Mus musculus
gttttcacaaggtcactggtctcag

SEQ ID NO: 741982 - DNA, 25 bp, Mus musculus
gttttcacacctacctttcattaca

SEQ ID NO: 741983 - DNA, 25 bp, Mus musculus
gttttcacaccttcctttcattaca

SEQ ID NO: 741984 - DNA, 25 bp, Mus musculus
gttttcacagaacacagggtaccaa

SEQ ID NO: 741985 - DNA, 25 bp, Mus musculus
gttttcacagaagacagggtaccaa

SEQ ID NO: 741986 - DNA, 25 bp, Mus musculus
gttttcacagtcctttgtctagaag

SEQ ID NO: 741987 - DNA, 25 bp, Mus musculus
gttttcacagtcgtttgtctagaag

SEQ ID NO: 741988 - DNA, 25 bp, Mus musculus
gttttcacagtgatatcttatgggt

SEQ ID NO: 741989 - DNA, 25 bp, Mus musculus
gttttcacagtgttatcttatgggt

SEQ ID NO: 741990 - DNA, 25 bp, Mus musculus
gttttcacataaactcactggagaa

SEQ ID NO: 741991 - DNA, 25 bp, Mus musculus
gttttcacataatctcactggagaa

SEQ ID NO: 741992 - DNA, 25 bp, Mus musculus
gttttcacatagatagctggcctct

SEQ ID NO: 741993 - DNA, 25 bp, Mus musculus
gttttcacatagttagctggcctct

SEQ ID NO: 741994 - DNA, 25 bp, Mus musculus
gttttcacatcaaagtcttgcctca

SEQ ID NO: 741995 - DNA, 25 bp, Mus musculus
gttttcacatcatagtcttgcctca

SEQ ID NO: 741996 - DNA, 25 bp, Mus musculus
gttttcaccatgaaggctctgactg

SEQ ID NO: 741997 - DNA, 25 bp, Mus musculus
gttttcaccatgtaggctctgactg

SEQ ID NO: 741998 - DNA, 25 bp, Mus musculus
gttttcacctccactatgcttagta

SEQ ID NO: 741999 - DNA, 25 bp, Mus musculus
gttttcacctcctctatgcttagta

SEQ ID NO: 742000 - DNA, 25 bp, Mus musculus
gttttcacctctaggcatactattt

SEQ ID NO: 742001 - DNA, 25 bp, Mus musculus
gttttcacctcttggcatactattt

SEQ ID NO: 742002 - DNA, 25 bp, Mus musculus
gttttcacggagagtccttgcttat

SEQ ID NO: 742003 - DNA, 25 bp, Mus musculus
gttttcacggagtgtccttgcttat

SEQ ID NO: 742004 - DNA, 25 bp, Mus musculus
gttttcactattcggtggtctttgg

SEQ ID NO: 742005 - DNA, 25 bp, Mus musculus
gttttcactattgggtggtctttgg

SEQ ID NO: 742006 - DNA, 25 bp, Mus musculus
gttttcactcgcattggatctataa

SEQ ID NO: 742007 - DNA, 25 bp, Mus musculus
gttttcactcgctttggatctataa

SEQ ID NO: 742008 - DNA, 25 bp, Mus musculus
gttttcactgctacaaagagggctg

SEQ ID NO: 742009 - DNA, 25 bp, Mus musculus
gttttcactgcttcaaagagggctg

SEQ ID NO: 742010 - DNA, 25 bp, Mus musculus
gttttcacttagcatagcagtcatt

SEQ ID NO: 742011 - DNA, 25 bp, Mus musculus
gttttcacttaggatagcagtcatt

SEQ ID NO: 742012 - DNA, 25 bp, Mus musculus
gttttcacttgccagcacatttcag

SEQ ID NO: 742013 - DNA, 25 bp, Mus musculus
gttttcacttgcgagcacatttcag

SEQ ID NO: 742014 - DNA, 25 bp, Mus musculus
gttttcagaactagtgcactcctgt

SEQ ID NO: 742015 - DNA, 25 bp, Mus musculus
gttttcagaacttgtgcactcctgt

SEQ ID NO: 742016 - DNA, 25 bp, Mus musculus
gttttcagaccactttgatccgaaa

SEQ ID NO: 742017 - DNA, 25 bp, Mus musculus
gttttcagaccagtttgatccgaaa

SEQ ID NO: 742018 - DNA, 25 bp, Mus musculus
gttttcagaggaccttggtttccta

SEQ ID NO: 742019 - DNA, 25 bp, Mus musculus
gttttcagaggagcttggtttccta

SEQ ID NO: 742020 - DNA, 25 bp, Mus musculus
gttttcagaggtcatacggaggtcc

SEQ ID NO: 742021 - DNA, 25 bp, Mus musculus
gttttcagaggtgatacggaggtcc

SEQ ID NO: 742022 - DNA, 25 bp, Mus musculus
gttttcagagttatctggttctgag

SEQ ID NO: 742023 - DNA, 25 bp, Mus musculus
gttttcagagttttctggttctgag

SEQ ID NO: 742024 - DNA, 25 bp, Mus musculus
gttttcagatagaagttcagcactt

SEQ ID NO: 742025 - DNA, 25 bp, Mus musculus
gttttcagatagtagttcagcactt

SEQ ID NO: 742026 - DNA, 25 bp, Mus musculus
gttttcagcaccaatttgactactt

SEQ ID NO: 742027 - DNA, 25 bp, Mus musculus
gttttcagcacctatttgactactt

SEQ ID NO: 742028 - DNA, 25 bp, Mus musculus
gttttcagcagtctaactggtaaaa

SEQ ID NO: 742029 - DNA, 25 bp, Mus musculus
gttttcagcagtgtaactggtaaaa

SEQ ID NO: 742030 - DNA, 25 bp, Mus musculus
gttttcagccatctcgatgttctaa

SEQ ID NO: 742031 - DNA, 25 bp, Mus musculus
gttttcagccatgtcgatgttctaa

SEQ ID NO: 742032 - DNA, 25 bp, Mus musculus
gttttcagcccactcttgggtattc

SEQ ID NO: 742033 - DNA, 25 bp, Mus musculus
gttttcagcccagtcttgggtattc

SEQ ID NO: 742034 - DNA, 25 bp, Mus musculus
gttttcagctacagcatttcttaca

SEQ ID NO: 742035 - DNA, 25 bp, Mus musculus
gttttcagctactgcatttcttaca

SEQ ID NO: 742036 - DNA, 25 bp, Mus musculus
gttttcagctttacagagagctctt

SEQ ID NO: 742037 - DNA, 25 bp, Mus musculus
gttttcagctttagtgtacaccaat

SEQ ID NO: 742038 - DNA, 25 bp, Mus musculus
gttttcagcttttcagagagctctt

SEQ ID NO: 742039 - DNA, 25 bp, Mus musculus
gttttcagcttttgtgtacaccaat

SEQ ID NO: 742040 - DNA, 25 bp, Mus musculus
gttttcaggagcctagtccgcagtt

SEQ ID NO: 742041 - DNA, 25 bp, Mus musculus
gttttcaggagcgtagtccgcagtt

SEQ ID NO: 742042 - DNA, 25 bp, Mus musculus
gttttcaggaggacagaccaactag

SEQ ID NO: 742043 - DNA, 25 bp, Mus musculus
gttttcaggaggagctggatcactc

SEQ ID NO: 742044 - DNA, 25 bp, Mus musculus
gttttcaggaggtcagaccaactag

SEQ ID NO: 742045 - DNA, 25 bp, Mus musculus
gttttcaggaggtgctggatcactc

SEQ ID NO: 742046 - DNA, 25 bp, Mus musculus
gttttcaggcttaccaagactgcca

SEQ ID NO: 742047 - DNA, 25 bp, Mus musculus
gttttcaggctttccaagactgcca

SEQ ID NO: 742048 - DNA, 25 bp, Mus musculus
gttttcagggagaaaagactgtcca

SEQ ID NO: 742049 - DNA, 25 bp, Mus musculus
gttttcagggagtaaagactgtcca

SEQ ID NO: 742050 - DNA, 25 bp, Mus musculus
gttttcagggataacaggagcagga

SEQ ID NO: 742051 - DNA, 25 bp, Mus musculus
gttttcagggattacaggagcagga

SEQ ID NO: 742052 - DNA, 25 bp, Mus musculus
gttttcagggtacaactcagttcca

SEQ ID NO: 742053 - DNA, 25 bp, Mus musculus
gttttcagggtagaactcagttcca

SEQ ID NO: 742054 - DNA, 25 bp, Mus musculus
gttttcagggttctagtgtatgctt

SEQ ID NO: 742055 - DNA, 25 bp, Mus musculus
gttttcagggttgtagtgtatgctt

SEQ ID NO: 742056 - DNA, 25 bp, Mus musculus
gttttcagtaggaacatggatctta

SEQ ID NO: 742057 - DNA, 25 bp, Mus musculus
gttttcagtaggtacatggatctta

SEQ ID NO: 742058 - DNA, 25 bp, Mus musculus
gttttcagtatgatgcatgcgctgt

SEQ ID NO: 742059 - DNA, 25 bp, Mus musculus
gttttcagtatgttgcatgcgctgt

SEQ ID NO: 742060 - DNA, 25 bp, Mus musculus
gttttcagtccaacattttactctc

SEQ ID NO: 742061 - DNA, 25 bp, Mus musculus
gttttcagtccatcattttactctc

SEQ ID NO: 742062 - DNA, 25 bp, Mus musculus
gttttcagtcgcctgtaccagtaag

SEQ ID NO: 742063 - DNA, 25 bp, Mus musculus
gttttcagtcgcgtgtaccagtaag

SEQ ID NO: 742064 - DNA, 25 bp, Mus musculus
gttttcagtttcattggctcgatcc

SEQ ID NO: 742065 - DNA, 25 bp, Mus musculus
gttttcagtttctttggctcgatcc

SEQ ID NO: 742066 - DNA, 25 bp, Mus musculus
gttttcagtttgaacttagttctgt

SEQ ID NO: 742067 - DNA, 25 bp, Mus musculus
gttttcagtttgtacttagttctgt

SEQ ID NO: 742068 - DNA, 25 bp, Mus musculus
gttttcataagcagtggtttgaccc

SEQ ID NO: 742069 - DNA, 25 bp, Mus musculus
gttttcataagctgtggtttgaccc

SEQ ID NO: 742070 - DNA, 25 bp, Mus musculus
gttttcataagtcacctgttcccac

SEQ ID NO: 742071 - DNA, 25 bp, Mus musculus
gttttcataagtgacctgttcccac

SEQ ID NO: 742072 - DNA, 25 bp, Mus musculus
gttttcatagtgatcctgttgacat

SEQ ID NO: 742073 - DNA, 25 bp, Mus musculus
gttttcatagtgttcctgttgacat

SEQ ID NO: 742074 - DNA, 25 bp, Mus musculus
gttttcatattgattgctgattggc

SEQ ID NO: 742075 - DNA, 25 bp, Mus musculus
gttttcatattgtttgctgattggc

SEQ ID NO: 742076 - DNA, 25 bp, Mus musculus
gttttcatcacaactatatccactc

SEQ ID NO: 742077 - DNA, 25 bp, Mus musculus
gttttcatcacatctatatccactc

SEQ ID NO: 742078 - DNA, 25 bp, Mus musculus
gttttcatcagccactctcaagaag

SEQ ID NO: 742079 - DNA, 25 bp, Mus musculus
gttttcatcagcgactctcaagaag

SEQ ID NO: 742080 - DNA, 25 bp, Mus musculus
gttttcatcataacgttcttcttcc

SEQ ID NO: 742081 - DNA, 25 bp, Mus musculus
gttttcatcatatcgttcttcttcc

SEQ ID NO: 742082 - DNA, 25 bp, Mus musculus
gttttcatccaaagcatttactgtt

SEQ ID NO: 742083 - DNA, 25 bp, Mus musculus
gttttcatccaatgcatttactgtt

SEQ ID NO: 742084 - DNA, 25 bp, Mus musculus
gttttcatccagaattagtttagtt

SEQ ID NO: 742085 - DNA, 25 bp, Mus musculus
gttttcatccagtattagtttagtt

SEQ ID NO: 742086 - DNA, 25 bp, Mus musculus
gttttcatccatcgaaccgctttta

SEQ ID NO: 742087 - DNA, 25 bp, Mus musculus
gttttcatccatggaaccgctttta

SEQ ID NO: 742088 - DNA, 25 bp, Mus musculus
gttttcatcgaaagctttaggagtg

SEQ ID NO: 742089 - DNA, 25 bp, Mus musculus
gttttcatcgaatgctttaggagtg

SEQ ID NO: 742090 - DNA, 25 bp, Mus musculus
gttttcatctaaagagcgcatgacc

SEQ ID NO: 742091 - DNA, 25 bp, Mus musculus
gttttcatctaatgagcgcatgacc

SEQ ID NO: 742092 - DNA, 25 bp, Mus musculus
gttttcatctagacatggagattca

SEQ ID NO: 742093 - DNA, 25 bp, Mus musculus
gttttcatctagtcatggagattca

SEQ ID NO: 742094 - DNA, 25 bp, Mus musculus
gttttcatctgaatttatactgcaa

SEQ ID NO: 742095 - DNA, 25 bp, Mus musculus
gttttcatctgattttatactgcaa

SEQ ID NO: 742096 - DNA, 25 bp, Mus musculus
gttttcatctgcaaaaatccccagg

SEQ ID NO: 742097 - DNA, 25 bp, Mus musculus
gttttcatctgctaaaatccccagg

SEQ ID NO: 742098 - DNA, 25 bp, Mus musculus
gttttcatctgtccactctgcagaa

SEQ ID NO: 742099 - DNA, 25 bp, Mus musculus
gttttcatctgtgcactctgcagaa

SEQ ID NO: 742100 - DNA, 25 bp, Mus musculus
gttttcatcttaacagggcgcagtc

SEQ ID NO: 742101 - DNA, 25 bp, Mus musculus
gttttcatcttatcagggcgcagtc

SEQ ID NO: 742102 - DNA, 25 bp, Mus musculus
gttttcatgaaacttctggtcgccc

SEQ ID NO: 742103 - DNA, 25 bp, Mus musculus
gttttcatgaaagttctggtcgccc

SEQ ID NO: 742104 - DNA, 25 bp, Mus musculus
gttttcatgcacaatgtctatactg

SEQ ID NO: 742105 - DNA, 25 bp, Mus musculus
gttttcatgcactatgtctatactg

SEQ ID NO: 742106 - DNA, 25 bp, Mus musculus
gttttcatgccaagtcatggcccat

SEQ ID NO: 742107 - DNA, 25 bp, Mus musculus
gttttcatgccatgtcatggcccat

SEQ ID NO: 742108 - DNA, 25 bp, Mus musculus
gttttcatggacaagccctagtgac

SEQ ID NO: 742109 - DNA, 25 bp, Mus musculus
gttttcatggactagccctagtgac

SEQ ID NO: 742110 - DNA, 25 bp, Mus musculus
gttttcatgtctatcgtaccagttg

SEQ ID NO: 742111 - DNA, 25 bp, Mus musculus
gttttcatgtctttcgtaccagttg

SEQ ID NO: 742112 - DNA, 25 bp, Mus musculus
gttttcatgttaaagtctatcatca

SEQ ID NO: 742113 - DNA, 25 bp, Mus musculus
gttttcatgttatagtctatcatca

SEQ ID NO: 742114 - DNA, 25 bp, Mus musculus
gttttcattacacttattggaagct

SEQ ID NO: 742115 - DNA, 25 bp, Mus musculus
gttttcattacagttattggaagct

SEQ ID NO: 742116 - DNA, 25 bp, Mus musculus
gttttcattactccagttactcctt

SEQ ID NO: 742117 - DNA, 25 bp, Mus musculus
gttttcattactgcagttactcctt

SEQ ID NO: 742118 - DNA, 25 bp, Mus musculus
gttttcattatcagacagccagcct

SEQ ID NO: 742119 - DNA, 25 bp, Mus musculus
gttttcattatctgacagccagcct

SEQ ID NO: 742120 - DNA, 25 bp, Mus musculus
gttttcattctgctgctttttatta

SEQ ID NO: 742121 - DNA, 25 bp, Mus musculus
gttttcattctggtgctttttatta

SEQ ID NO: 742122 - DNA, 25 bp, Mus musculus
gttttcattgtaattcctacagtgt

SEQ ID NO: 742123 - DNA, 25 bp, Mus musculus
gttttcattgtatttcctacagtgt

SEQ ID NO: 742124 - DNA, 25 bp, Mus musculus
gttttcattgtgaacacctaggtaa

SEQ ID NO: 742125 - DNA, 25 bp, Mus musculus
gttttcattgtgtacacctaggtaa

SEQ ID NO: 742126 - DNA, 25 bp, Mus musculus
gttttcatttacactagatcaccaa

SEQ ID NO: 742127 - DNA, 25 bp, Mus musculus
gttttcatttactctagatcaccaa

SEQ ID NO: 742128 - DNA, 25 bp, Mus musculus
gttttcatttagagttcagacagtt

SEQ ID NO: 742129 - DNA, 25 bp, Mus musculus
gttttcatttagtgttcagacagtt

SEQ ID NO: 742130 - DNA, 25 bp, Mus musculus
gttttcatttgacaccacagtacag

SEQ ID NO: 742131 - DNA, 25 bp, Mus musculus
gttttcatttgagaccacagtacag

SEQ ID NO: 742132 - DNA, 25 bp, Mus musculus
gttttcattttcctttgataattga

SEQ ID NO: 742133 - DNA, 25 bp, Mus musculus
gttttcattttcgtttgataattga

SEQ ID NO: 742134 - DNA, 25 bp, Mus musculus
gttttcattttgagtaccttgtagg

SEQ ID NO: 742135 - DNA, 25 bp, Mus musculus
gttttcattttgtgtaccttgtagg

SEQ ID NO: 742136 - DNA, 25 bp, Mus musculus
gttttccaaagacctgtgagttttg

SEQ ID NO: 742137 - DNA, 25 bp, Mus musculus
gttttccaaagagctgtgagttttg

SEQ ID NO: 742138 - DNA, 25 bp, Mus musculus
gttttccaaagcaaccagctcttac

SEQ ID NO: 742139 - DNA, 25 bp, Mus musculus
gttttccaaagctaccagctcttac

SEQ ID NO: 742140 - DNA, 25 bp, Mus musculus
gttttccaactacattgtgagctcc

SEQ ID NO: 742141 - DNA, 25 bp, Mus musculus
gttttccaactagattgtgagctcc

SEQ ID NO: 742142 - DNA, 25 bp, Mus musculus
gttttccaactgaatgcttgtaccg

SEQ ID NO: 742143 - DNA, 25 bp, Mus musculus
gttttccaactgtatgcttgtaccg

SEQ ID NO: 742144 - DNA, 25 bp, Mus musculus
gttttccaagaaccgcattttagac

SEQ ID NO: 742145 - DNA, 25 bp, Mus musculus
gttttccaagaagcgcattttagac

SEQ ID NO: 742146 - DNA, 25 bp, Mus musculus
gttttccaatctctcatttacttaa

SEQ ID NO: 742147 - DNA, 25 bp, Mus musculus
gttttccaatctgtcatttacttaa

SEQ ID NO: 742148 - DNA, 25 bp, Mus musculus
gttttccaatggcatctgtatgtac

SEQ ID NO: 742149 - DNA, 25 bp, Mus musculus
gttttccaatgggatctgtatgtac

SEQ ID NO: 742150 - DNA, 25 bp, Mus musculus
gttttccaattgctccaaaccagat

SEQ ID NO: 742151 - DNA, 25 bp, Mus musculus
gttttccaattggtccaaaccagat

SEQ ID NO: 742152 - DNA, 25 bp, Mus musculus
gttttccacaaactcaccataacgt

SEQ ID NO: 742153 - DNA, 25 bp, Mus musculus
gttttccacaaagtcaccataacgt

SEQ ID NO: 742154 - DNA, 25 bp, Mus musculus
gttttccacaacaattgctgtcagg

SEQ ID NO: 742155 - DNA, 25 bp, Mus musculus
gttttccacaactattgctgtcagg

SEQ ID NO: 742156 - DNA, 25 bp, Mus musculus
gttttccacctgatatatgggttac

SEQ ID NO: 742157 - DNA, 25 bp, Mus musculus
gttttccacctgttatatgggttac

SEQ ID NO: 742158 - DNA, 25 bp, Mus musculus
gttttccactccactgcatttcctg

SEQ ID NO: 742159 - DNA, 25 bp, Mus musculus
gttttccactccctaaggactgtag

SEQ ID NO: 742160 - DNA, 25 bp, Mus musculus
gttttccactccgtaaggactgtag

SEQ ID NO: 742161 - DNA, 25 bp, Mus musculus
gttttccactcctctgcatttcctg

SEQ ID NO: 742162 - DNA, 25 bp, Mus musculus
gttttccactcgagccaaaatattg

SEQ ID NO: 742163 - DNA, 25 bp, Mus musculus
gttttccactcgtgccaaaatattg

SEQ ID NO: 742164 - DNA, 25 bp, Mus musculus
gttttccagagcactttgtccttaa

SEQ ID NO: 742165 - DNA, 25 bp, Mus musculus
gttttccagagctctttgtccttaa

SEQ ID NO: 742166 - DNA, 25 bp, Mus musculus
gttttccagagtccagaggccttaa

SEQ ID NO: 742167 - DNA, 25 bp, Mus musculus
gttttccagagtgcagaggccttaa

SEQ ID NO: 742168 - DNA, 25 bp, Mus musculus
gttttccagcctatcttcgatgaaa

SEQ ID NO: 742169 - DNA, 25 bp, Mus musculus
gttttccagcctttcttcgatgaaa

SEQ ID NO: 742170 - DNA, 25 bp, Mus musculus
gttttccaggaacggaatccaatca

SEQ ID NO: 742171 - DNA, 25 bp, Mus musculus
gttttccaggaagggaatccaatca

SEQ ID NO: 742172 - DNA, 25 bp, Mus musculus
gttttccagttcagagagtacctca

SEQ ID NO: 742173 - DNA, 25 bp, Mus musculus
gttttccagttctgagagtacctca

SEQ ID NO: 742174 - DNA, 25 bp, Mus musculus
gttttccagttgacaggaactcacc

SEQ ID NO: 742175 - DNA, 25 bp, Mus musculus
gttttccagttgagatttacagttt

SEQ ID NO: 742176 - DNA, 25 bp, Mus musculus
gttttccagttgtcaggaactcacc

SEQ ID NO: 742177 - DNA, 25 bp, Mus musculus
gttttccagttgtgatttacagttt

SEQ ID NO: 742178 - DNA, 25 bp, Mus musculus
gttttccagtttcttaatgcaaaat

SEQ ID NO: 742179 - DNA, 25 bp, Mus musculus
gttttccagtttgttaatgcaaaat

SEQ ID NO: 742180 - DNA, 25 bp, Mus musculus
gttttccatacgattgacatgctta

SEQ ID NO: 742181 - DNA, 25 bp, Mus musculus
gttttccatacgtttgacatgctta

SEQ ID NO: 742182 - DNA, 25 bp, Mus musculus
gttttccatagtcgtcactgctcag

SEQ ID NO: 742183 - DNA, 25 bp, Mus musculus
gttttccatagtggtcactgctcag

SEQ ID NO: 742184 - DNA, 25 bp, Mus musculus
gttttccatccgctattttatcata

SEQ ID NO: 742185 - DNA, 25 bp, Mus musculus
gttttccatccggtattttatcata

SEQ ID NO: 742186 - DNA, 25 bp, Mus musculus
gttttccatgacactgcttcaatac

SEQ ID NO: 742187 - DNA, 25 bp, Mus musculus
gttttccatgactctgcttcaatac

SEQ ID NO: 742188 - DNA, 25 bp, Mus musculus
gttttccatgtcagacctgtatcca

SEQ ID NO: 742189 - DNA, 25 bp, Mus musculus
gttttccatgtccaatagagcctaa

SEQ ID NO: 742190 - DNA, 25 bp, Mus musculus
gttttccatgtcgaatagagcctaa

SEQ ID NO: 742191 - DNA, 25 bp, Mus musculus
gttttccatgtctgacctgtatcca

SEQ ID NO: 742192 - DNA, 25 bp, Mus musculus
gttttccatgttagttattcttagc

SEQ ID NO: 742193 - DNA, 25 bp, Mus musculus
gttttccatgttcaacgactctgac

SEQ ID NO: 742194 - DNA, 25 bp, Mus musculus
gttttccatgttgaacgactctgac

SEQ ID NO: 742195 - DNA, 25 bp, Mus musculus
gttttccatgtttgttattcttagc

SEQ ID NO: 742196 - DNA, 25 bp, Mus musculus
gttttccattggctagtgtcagaga

SEQ ID NO: 742197 - DNA, 25 bp, Mus musculus
gttttccattgggtagtgtcagaga

SEQ ID NO: 742198 - DNA, 25 bp, Mus musculus
gttttccattgtaccttgaggagcc

SEQ ID NO: 742199 - DNA, 25 bp, Mus musculus
gttttccattgttccttgaggagcc

SEQ ID NO: 742200 - DNA, 25 bp, Mus musculus
gttttccatttcatttgtacactca

SEQ ID NO: 742201 - DNA, 25 bp, Mus musculus
gttttccatttcttttgtacactca

SEQ ID NO: 742202 - DNA, 25 bp, Mus musculus
gttttcccaaataatatgactacat

SEQ ID NO: 742203 - DNA, 25 bp, Mus musculus
gttttcccaaattatatgactacat

SEQ ID NO: 742204 - DNA, 25 bp, Mus musculus
gttttcccacaacagaactttctgt

SEQ ID NO: 742205 - DNA, 25 bp, Mus musculus
gttttcccacaagagaactttctgt

SEQ ID NO: 742206 - DNA, 25 bp, Mus musculus
gttttcccaggaatggctccttcct

SEQ ID NO: 742207 - DNA, 25 bp, Mus musculus
gttttcccaggattggctccttcct

SEQ ID NO: 742208 - DNA, 25 bp, Mus musculus
gttttccccaaaaattattccatgg

SEQ ID NO: 742209 - DNA, 25 bp, Mus musculus
gttttccccaaatattattccatgg

SEQ ID NO: 742210 - DNA, 25 bp, Mus musculus
gttttccccatcactgaaatgtggt

SEQ ID NO: 742211 - DNA, 25 bp, Mus musculus
gttttccccatctctgaaatgtggt

SEQ ID NO: 742212 - DNA, 25 bp, Mus musculus
gttttcccctacagcatatttcata

SEQ ID NO: 742213 - DNA, 25 bp, Mus musculus
gttttcccctactgcatatttcata

SEQ ID NO: 742214 - DNA, 25 bp, Mus musculus
gttttcccctcaagaatgagactct

SEQ ID NO: 742215 - DNA, 25 bp, Mus musculus
gttttcccctcatgaatgagactct

SEQ ID NO: 742216 - DNA, 25 bp, Mus musculus
gttttccccttgctggtggctgaga

SEQ ID NO: 742217 - DNA, 25 bp, Mus musculus
gttttccccttggtggtggctgaga

SEQ ID NO: 742218 - DNA, 25 bp, Mus musculus
gttttcccgctcatgattggtaatt

SEQ ID NO: 742219 - DNA, 25 bp, Mus musculus
gttttcccgctcttgattggtaatt

SEQ ID NO: 742220 - DNA, 25 bp, Mus musculus
gttttccctcatacagagctctgga

SEQ ID NO: 742221 - DNA, 25 bp, Mus musculus
gttttccctcatacatagctctgac

SEQ ID NO: 742222 - DNA, 25 bp, Mus musculus
gttttccctcatcctcgatcatagt

SEQ ID NO: 742223 - DNA, 25 bp, Mus musculus
gttttccctcatgctcgatcatagt

SEQ ID NO: 742224 - DNA, 25 bp, Mus musculus
gttttccctcattcagagctctgga

SEQ ID NO: 742225 - DNA, 25 bp, Mus musculus
gttttccctcattcatagctctgac

SEQ ID NO: 742226 - DNA, 25 bp, Mus musculus
gttttccctctaacttctgattgtt

SEQ ID NO: 742227 - DNA, 25 bp, Mus musculus
gttttccctctatcttctgattgtt

SEQ ID NO: 742228 - DNA, 25 bp, Mus musculus
gttttccctgaacttatatgtgagt

SEQ ID NO: 742229 - DNA, 25 bp, Mus musculus
gttttccctgaagttatatgtgagt

SEQ ID NO: 742230 - DNA, 25 bp, Mus musculus
gttttccctgcaacaaccataaata

SEQ ID NO: 742231 - DNA, 25 bp, Mus musculus
gttttccctgcaacgaggtagccat

SEQ ID NO: 742232 - DNA, 25 bp, Mus musculus
gttttccctgcatcaaccataaata

SEQ ID NO: 742233 - DNA, 25 bp, Mus musculus
gttttccctgcatcgaggtagccat

SEQ ID NO: 742234 - DNA, 25 bp, Mus musculus
gttttcccttgacacaggatcgtcc

SEQ ID NO: 742235 - DNA, 25 bp, Mus musculus
gttttcccttgagacaggatcgtcc

SEQ ID NO: 742236 - DNA, 25 bp, Mus musculus
gttttccctttcaacattttgctat

SEQ ID NO: 742237 - DNA, 25 bp, Mus musculus
gttttccctttctacattttgctat

SEQ ID NO: 742238 - DNA, 25 bp, Mus musculus
gttttccgaaggacatacattgtgt

SEQ ID NO: 742239 - DNA, 25 bp, Mus musculus
gttttccgaaggtcatacattgtgt

SEQ ID NO: 742240 - DNA, 25 bp, Mus musculus
gttttccgactcagtctaaactgga

SEQ ID NO: 742241 - DNA, 25 bp, Mus musculus
gttttccgactctgtctaaactgga

SEQ ID NO: 742242 - DNA, 25 bp, Mus musculus
gttttccgcttgagaatgaaactga

SEQ ID NO: 742243 - DNA, 25 bp, Mus musculus
gttttccgcttgtgaatgaaactga

SEQ ID NO: 742244 - DNA, 25 bp, Mus musculus
gttttcctagggattctaaggctgt

SEQ ID NO: 742245 - DNA, 25 bp, Mus musculus
gttttcctagggtttctaaggctgt

SEQ ID NO: 742246 - DNA, 25 bp, Mus musculus
gttttcctcaatcagtgtgttttgg

SEQ ID NO: 742247 - DNA, 25 bp, Mus musculus
gttttcctcaatgagtgtgttttgg

SEQ ID NO: 742248 - DNA, 25 bp, Mus musculus
gttttcctcactattctgtaggtct

SEQ ID NO: 742249 - DNA, 25 bp, Mus musculus
gttttcctcacttttctgtaggtct

SEQ ID NO: 742250 - DNA, 25 bp, Mus musculus
gttttcctcatgaaagtgccagtgc

SEQ ID NO: 742251 - DNA, 25 bp, Mus musculus
gttttcctcatgtaagtgccagtgc

SEQ ID NO: 742252 - DNA, 25 bp, Mus musculus
gttttcctcggaagtttgattttag

SEQ ID NO: 742253 - DNA, 25 bp, Mus musculus
gttttcctcggatgtttgattttag

SEQ ID NO: 742254 - DNA, 25 bp, Mus musculus
gttttcctcttacatctgactaatg

SEQ ID NO: 742255 - DNA, 25 bp, Mus musculus
gttttcctcttacccggatgatcag

SEQ ID NO: 742256 - DNA, 25 bp, Mus musculus
gttttcctcttagatctgactaatg

SEQ ID NO: 742257 - DNA, 25 bp, Mus musculus
gttttcctcttagccggatgatcag

SEQ ID NO: 742258 - DNA, 25 bp, Mus musculus
gttttcctgaatccaaagacatggg

SEQ ID NO: 742259 - DNA, 25 bp, Mus musculus
gttttcctgaatgcaaagacatggg

SEQ ID NO: 742260 - DNA, 25 bp, Mus musculus
gttttcctgaccattaactgatcca

SEQ ID NO: 742261 - DNA, 25 bp, Mus musculus
gttttcctgacccttctggatgaac

SEQ ID NO: 742262 - DNA, 25 bp, Mus musculus
gttttcctgaccgttctggatgaac

SEQ ID NO: 742263 - DNA, 25 bp, Mus musculus
gttttcctgacctttaactgatcca

SEQ ID NO: 742264 - DNA, 25 bp, Mus musculus
gttttcctgcgaagccattggagaa

SEQ ID NO: 742265 - DNA, 25 bp, Mus musculus
gttttcctgcgatgccattggagaa

SEQ ID NO: 742266 - DNA, 25 bp, Mus musculus
gttttcctggccagtgctgaagtat

SEQ ID NO: 742267 - DNA, 25 bp, Mus musculus
gttttcctggcctgtgctgaagtat

SEQ ID NO: 742268 - DNA, 25 bp, Mus musculus
gttttcctgggtactctgatcctga

SEQ ID NO: 742269 - DNA, 25 bp, Mus musculus
gttttcctgggttctctgatcctga

SEQ ID NO: 742270 - DNA, 25 bp, Mus musculus
gttttcctgtacataccaatcgcag

SEQ ID NO: 742271 - DNA, 25 bp, Mus musculus
gttttcctgtacttaccaatcgcag

SEQ ID NO: 742272 - DNA, 25 bp, Mus musculus
gttttcctgtcaacatagttctttt

SEQ ID NO: 742273 - DNA, 25 bp, Mus musculus
gttttcctgtcatcatagttctttt

SEQ ID NO: 742274 - DNA, 25 bp, Mus musculus
gttttcctgtgtaggccagaatggc

SEQ ID NO: 742275 - DNA, 25 bp, Mus musculus
gttttcctgtgtccagtgaaacttt

SEQ ID NO: 742276 - DNA, 25 bp, Mus musculus
gttttcctgtgtgcagtgaaacttt

SEQ ID NO: 742277 - DNA, 25 bp, Mus musculus
gttttcctgtgttggccagaatggc

SEQ ID NO: 742278 - DNA, 25 bp, Mus musculus
gttttcctgttgcatgacagaatta

SEQ ID NO: 742279 - DNA, 25 bp, Mus musculus
gttttcctgttggatgacagaatta

SEQ ID NO: 742280 - DNA, 25 bp, Mus musculus
gttttccttaccaagtagagttcat

SEQ ID NO: 742281 - DNA, 25 bp, Mus musculus
gttttccttacctagtagagttcat

SEQ ID NO: 742282 - DNA, 25 bp, Mus musculus
gttttccttccaagttactgagtct

SEQ ID NO: 742283 - DNA, 25 bp, Mus musculus
gttttccttccatgttactgagtct

SEQ ID NO: 742284 - DNA, 25 bp, Mus musculus
gttttccttctaacaggaaggccct

SEQ ID NO: 742285 - DNA, 25 bp, Mus musculus
gttttccttctatcaggaaggccct

SEQ ID NO: 742286 - DNA, 25 bp, Mus musculus
gttttccttctcacatacattggag

SEQ ID NO: 742287 - DNA, 25 bp, Mus musculus
gttttccttctcagtatatctgcaa

SEQ ID NO: 742288 - DNA, 25 bp, Mus musculus
gttttccttctctcatacattggag

SEQ ID NO: 742289 - DNA, 25 bp, Mus musculus
gttttccttctctgtatatctgcaa

SEQ ID NO: 742290 - DNA, 25 bp, Mus musculus
gttttccttggaatcttggctgcca

SEQ ID NO: 742291 - DNA, 25 bp, Mus musculus
gttttccttggaatgctcaatctga

SEQ ID NO: 742292 - DNA, 25 bp, Mus musculus
gttttccttggaccaattttcttag

SEQ ID NO: 742293 - DNA, 25 bp, Mus musculus
gttttccttggagcaattttcttag

SEQ ID NO: 742294 - DNA, 25 bp, Mus musculus
gttttccttggattcttggctgcca

SEQ ID NO: 742295 - DNA, 25 bp, Mus musculus
gttttccttggattgctcaatctga

SEQ ID NO: 742296 - DNA, 25 bp, Mus musculus
gttttccttgtcactagtgttccct

SEQ ID NO: 742297 - DNA, 25 bp, Mus musculus
gttttccttgtctctagtgttccct

SEQ ID NO: 742298 - DNA, 25 bp, Mus musculus
gttttcctttagaacatgacttcag

SEQ ID NO: 742299 - DNA, 25 bp, Mus musculus
gttttcctttagtacatgacttcag

SEQ ID NO: 742300 - DNA, 25 bp, Mus musculus
gttttcctttccacgcaaacatagg

SEQ ID NO: 742301 - DNA, 25 bp, Mus musculus
gttttcctttccatcagattaatgc

SEQ ID NO: 742302 - DNA, 25 bp, Mus musculus
gttttcctttcctcgcaaacatagg

SEQ ID NO: 742303 - DNA, 25 bp, Mus musculus
gttttcctttccttcagattaatgc

SEQ ID NO: 742304 - DNA, 25 bp, Mus musculus
gttttcctttctcaataccaggacg

SEQ ID NO: 742305 - DNA, 25 bp, Mus musculus
gttttcctttctgaataccaggacg

SEQ ID NO: 742306 - DNA, 25 bp, Mus musculus
gttttcgaaggtaaggctgtagtca

SEQ ID NO: 742307 - DNA, 25 bp, Mus musculus
gttttcgaaggttaggctgtagtca

SEQ ID NO: 742308 - DNA, 25 bp, Mus musculus
gttttcgatggtctagtgcatgcaa

SEQ ID NO: 742309 - DNA, 25 bp, Mus musculus
gttttcgatggtgtagtgcatgcaa

SEQ ID NO: 742310 - DNA, 25 bp, Mus musculus
gttttcgcataccatcttttactag

SEQ ID NO: 742311 - DNA, 25 bp, Mus musculus
gttttcgcatacgatcttttactag

SEQ ID NO: 742312 - DNA, 25 bp, Mus musculus
gttttcgccagtcagagtccatggg

SEQ ID NO: 742313 - DNA, 25 bp, Mus musculus
gttttcgccagtgagagtccatggg

SEQ ID NO: 742314 - DNA, 25 bp, Mus musculus
gttttcgcttgtaattcaacatgac

SEQ ID NO: 742315 - DNA, 25 bp, Mus musculus
gttttcgcttgttattcaacatgac

SEQ ID NO: 742316 - DNA, 25 bp, Mus musculus
gttttcggaatcacagtcacagaca

SEQ ID NO: 742317 - DNA, 25 bp, Mus musculus
gttttcggaatctcagtcacagaca

SEQ ID NO: 742318 - DNA, 25 bp, Mus musculus
gttttcgggaaaatggacagcctca

SEQ ID NO: 742319 - DNA, 25 bp, Mus musculus
gttttcgggaaattggacagcctca

SEQ ID NO: 742320 - DNA, 25 bp, Mus musculus
gttttcgggagaacaagccatttct

SEQ ID NO: 742321 - DNA, 25 bp, Mus musculus
gttttcgggagatcaagccatttct

SEQ ID NO: 742322 - DNA, 25 bp, Mus musculus
gttttcgtccttaaaagctcattca

SEQ ID NO: 742323 - DNA, 25 bp, Mus musculus
gttttcgtcctttaaagctcattca

SEQ ID NO: 742324 - DNA, 25 bp, Mus musculus
gttttcgtgactacttcaggctaca

SEQ ID NO: 742325 - DNA, 25 bp, Mus musculus
gttttcgtgacttcttcaggctaca

SEQ ID NO: 742326 - DNA, 25 bp, Mus musculus
gttttcgtgccgatcgtctcacgcg

SEQ ID NO: 742327 - DNA, 25 bp, Mus musculus
gttttcgtgccgttcgtctcacgcg

SEQ ID NO: 742328 - DNA, 25 bp, Mus musculus
gttttcgttataacacagtgagcta

SEQ ID NO: 742329 - DNA, 25 bp, Mus musculus
gttttcgttatatcacagtgagcta

SEQ ID NO: 742330 - DNA, 25 bp, Mus musculus
gttttcgttgaacacggttctctat

SEQ ID NO: 742331 - DNA, 25 bp, Mus musculus
gttttcgttgaagacggttctctat

SEQ ID NO: 742332 - DNA, 25 bp, Mus musculus
gttttcgttggtagggattgtctga

SEQ ID NO: 742333 - DNA, 25 bp, Mus musculus
gttttcgttggttgggattgtctga

SEQ ID NO: 742334 - DNA, 25 bp, Mus musculus
gttttctaaaggattctaaatggtg

SEQ ID NO: 742335 - DNA, 25 bp, Mus musculus
gttttctaaaggtttctaaatggtg

SEQ ID NO: 742336 - DNA, 25 bp, Mus musculus
gttttctaaatgcaggcgcccagaa

SEQ ID NO: 742337 - DNA, 25 bp, Mus musculus
gttttctaaatggaggcgcccagaa

SEQ ID NO: 742338 - DNA, 25 bp, Mus musculus
gttttctaagcacttacagccaaag

SEQ ID NO: 742339 - DNA, 25 bp, Mus musculus
gttttctaagcagttacagccaaag

SEQ ID NO: 742340 - DNA, 25 bp, Mus musculus
gttttctaagctcaatgatgcaaag

SEQ ID NO: 742341 - DNA, 25 bp, Mus musculus
gttttctaagctgaatgatgcaaag

SEQ ID NO: 742342 - DNA, 25 bp, Mus musculus
gttttctaattaaacacttgtgtgt

SEQ ID NO: 742343 - DNA, 25 bp, Mus musculus
gttttctaattatacacttgtgtgt

SEQ ID NO: 742344 - DNA, 25 bp, Mus musculus
gttttctacaaccactaaacatgga

SEQ ID NO: 742345 - DNA, 25 bp, Mus musculus
gttttctacaacgactaaacatgga

SEQ ID NO: 742346 - DNA, 25 bp, Mus musculus
gttttctacacactatcattcatta

SEQ ID NO: 742347 - DNA, 25 bp, Mus musculus
gttttctacacagtatcattcatta

SEQ ID NO: 742348 - DNA, 25 bp, Mus musculus
gttttctacaccaaacttctgacag

SEQ ID NO: 742349 - DNA, 25 bp, Mus musculus
gttttctacacctaacttctgacag

SEQ ID NO: 742350 - DNA, 25 bp, Mus musculus
gttttctacagcactatgttcagat

SEQ ID NO: 742351 - DNA, 25 bp, Mus musculus
gttttctacagctctatgttcagat

SEQ ID NO: 742352 - DNA, 25 bp, Mus musculus
gttttctacatcacagttgctggca

SEQ ID NO: 742353 - DNA, 25 bp, Mus musculus
gttttctacatctcagttgctggca

SEQ ID NO: 742354 - DNA, 25 bp, Mus musculus
gttttctaccacctaaaactcagat

SEQ ID NO: 742355 - DNA, 25 bp, Mus musculus
gttttctaccacgtaaaactcagat

SEQ ID NO: 742356 - DNA, 25 bp, Mus musculus
gttttctaccttcagcatcacttaa

SEQ ID NO: 742357 - DNA, 25 bp, Mus musculus
gttttctaccttgagcatcacttaa

SEQ ID NO: 742358 - DNA, 25 bp, Mus musculus
gttttctacgtgaatcggattgctc

SEQ ID NO: 742359 - DNA, 25 bp, Mus musculus
gttttctacgtgtatcggattgctc

SEQ ID NO: 742360 - DNA, 25 bp, Mus musculus
gttttctacttgagccccagtatga

SEQ ID NO: 742361 - DNA, 25 bp, Mus musculus
gttttctacttgtgccccagtatga

SEQ ID NO: 742362 - DNA, 25 bp, Mus musculus
gttttctagcgaagtcccacgtgaa

SEQ ID NO: 742363 - DNA, 25 bp, Mus musculus
gttttctagcgatgtcccacgtgaa

SEQ ID NO: 742364 - DNA, 25 bp, Mus musculus
gttttctaggtaactcactctgtag

SEQ ID NO: 742365 - DNA, 25 bp, Mus musculus
gttttctaggtatctcactctgtag

SEQ ID NO: 742366 - DNA, 25 bp, Mus musculus
gttttctagtccctcagaagtccaa

SEQ ID NO: 742367 - DNA, 25 bp, Mus musculus
gttttctagtccgtcagaagtccaa

SEQ ID NO: 742368 - DNA, 25 bp, Mus musculus
gttttctagttcagcacagtcattg

SEQ ID NO: 742369 - DNA, 25 bp, Mus musculus
gttttctagttctgcacagtcattg

SEQ ID NO: 742370 - DNA, 25 bp, Mus musculus
gttttctataaactttcaagcaagt

SEQ ID NO: 742371 - DNA, 25 bp, Mus musculus
gttttctataaagtttcaagcaagt

SEQ ID NO: 742372 - DNA, 25 bp, Mus musculus
gttttctatattactctaacctgtt

SEQ ID NO: 742373 - DNA, 25 bp, Mus musculus
gttttctatattaggcgtgattgca

SEQ ID NO: 742374 - DNA, 25 bp, Mus musculus
gttttctatatttctctaacctgtt

SEQ ID NO: 742375 - DNA, 25 bp, Mus musculus
gttttctatatttggcgtgattgca

SEQ ID NO: 742376 - DNA, 25 bp, Mus musculus
gttttctatcatactgtttccttgc

SEQ ID NO: 742377 - DNA, 25 bp, Mus musculus
gttttctatcattctgtttccttgc

SEQ ID NO: 742378 - DNA, 25 bp, Mus musculus
gttttctatcccctgaatctgaaat

SEQ ID NO: 742379 - DNA, 25 bp, Mus musculus
gttttctatcccgtgaatctgaaat

SEQ ID NO: 742380 - DNA, 25 bp, Mus musculus
gttttctatctcatgcttgggttaa

SEQ ID NO: 742381 - DNA, 25 bp, Mus musculus
gttttctatctcttgcttgggttaa

SEQ ID NO: 742382 - DNA, 25 bp, Mus musculus
gttttctattcacacctccttcaga

SEQ ID NO: 742383 - DNA, 25 bp, Mus musculus
gttttctattcagacctccttcaga

SEQ ID NO: 742384 - DNA, 25 bp, Mus musculus
gttttctattgtacatgcctaagct

SEQ ID NO: 742385 - DNA, 25 bp, Mus musculus
gttttctattgttcatgcctaagct

SEQ ID NO: 742386 - DNA, 25 bp, Mus musculus
gttttctatttgacctgccttgagc

SEQ ID NO: 742387 - DNA, 25 bp, Mus musculus
gttttctatttgtcctgccttgagc

SEQ ID NO: 742388 - DNA, 25 bp, Mus musculus
gttttctcatccagacttgttgtcg

SEQ ID NO: 742389 - DNA, 25 bp, Mus musculus
gttttctcatccatattgttcagtt

SEQ ID NO: 742390 - DNA, 25 bp, Mus musculus
gttttctcatcccagaggtacaaaa

SEQ ID NO: 742391 - DNA, 25 bp, Mus musculus
gttttctcatccgagaggtacaaaa

SEQ ID NO: 742392 - DNA, 25 bp, Mus musculus
gttttctcatcctgacttgttgtcg

SEQ ID NO: 742393 - DNA, 25 bp, Mus musculus
gttttctcatccttattgttcagtt

SEQ ID NO: 742394 - DNA, 25 bp, Mus musculus
gttttctcatgcactaatgtaaatg

SEQ ID NO: 742395 - DNA, 25 bp, Mus musculus
gttttctcatgctctaatgtaaatg

SEQ ID NO: 742396 - DNA, 25 bp, Mus musculus
gttttctcatttcggtacaggctct

SEQ ID NO: 742397 - DNA, 25 bp, Mus musculus
gttttctcatttgggtacaggctct

SEQ ID NO: 742398 - DNA, 25 bp, Mus musculus
gttttctccatcaatgttgattgag

SEQ ID NO: 742399 - DNA, 25 bp, Mus musculus
gttttctccatctatgttgattgag

SEQ ID NO: 742400 - DNA, 25 bp, Mus musculus
gttttctcccagagtctagtattca

SEQ ID NO: 742401 - DNA, 25 bp, Mus musculus
gttttctcccagtgtctagtattca

SEQ ID NO: 742402 - DNA, 25 bp, Mus musculus
gttttctcctataagttgctacctg

SEQ ID NO: 742403 - DNA, 25 bp, Mus musculus
gttttctcctattagttgctacctg

SEQ ID NO: 742404 - DNA, 25 bp, Mus musculus
gttttctcctcgctttacaaatcag

SEQ ID NO: 742405 - DNA, 25 bp, Mus musculus
gttttctcctcggtttacaaatcag

SEQ ID NO: 742406 - DNA, 25 bp, Mus musculus
gttttctcctgcaattgagatggtg

SEQ ID NO: 742407 - DNA, 25 bp, Mus musculus
gttttctcctgctattgagatggtg

SEQ ID NO: 742408 - DNA, 25 bp, Mus musculus
gttttctcctgtccgaactagttat

SEQ ID NO: 742409 - DNA, 25 bp, Mus musculus
gttttctcctgtgcgaactagttat

SEQ ID NO: 742410 - DNA, 25 bp, Mus musculus
gttttctcgattacttgtaaggcca

SEQ ID NO: 742411 - DNA, 25 bp, Mus musculus
gttttctcgatttcttgtaaggcca

SEQ ID NO: 742412 - DNA, 25 bp, Mus musculus
gttttctctactctggattctcctg

SEQ ID NO: 742413 - DNA, 25 bp, Mus musculus
gttttctctactgtggattctcctg

SEQ ID NO: 742414 - DNA, 25 bp, Mus musculus
gttttctctcatcaccatcaatcag

SEQ ID NO: 742415 - DNA, 25 bp, Mus musculus
gttttctctcatgaccatcaatcag

SEQ ID NO: 742416 - DNA, 25 bp, Mus musculus
gttttctctcccattctgaattcga

SEQ ID NO: 742417 - DNA, 25 bp, Mus musculus
gttttctctccctttctgaattcga

SEQ ID NO: 742418 - DNA, 25 bp, Mus musculus
gttttctctgagattgaattgtcat

SEQ ID NO: 742419 - DNA, 25 bp, Mus musculus
gttttctctgagtttgaattgtcat

SEQ ID NO: 742420 - DNA, 25 bp, Mus musculus
gttttctctgctctcaatcaagaga

SEQ ID NO: 742421 - DNA, 25 bp, Mus musculus
gttttctctgctgtcaatcaagaga

SEQ ID NO: 742422 - DNA, 25 bp, Mus musculus
gttttctctggaatcttcttttgca

SEQ ID NO: 742423 - DNA, 25 bp, Mus musculus
gttttctctggattcttcttttgca

SEQ ID NO: 742424 - DNA, 25 bp, Mus musculus
gttttctctggtattaaggctttag

SEQ ID NO: 742425 - DNA, 25 bp, Mus musculus
gttttctctggttttaaggctttag

SEQ ID NO: 742426 - DNA, 25 bp, Mus musculus
gttttctcttctccaaagattctcc

SEQ ID NO: 742427 - DNA, 25 bp, Mus musculus
gttttctcttctctaccattctaat

SEQ ID NO: 742428 - DNA, 25 bp, Mus musculus
gttttctcttctgcaaagattctcc

SEQ ID NO: 742429 - DNA, 25 bp, Mus musculus
gttttctcttctgtaccattctaat

SEQ ID NO: 742430 - DNA, 25 bp, Mus musculus
gttttctcttgtcacttttgttaca

SEQ ID NO: 742431 - DNA, 25 bp, Mus musculus
gttttctcttgtgacttttgttaca

SEQ ID NO: 742432 - DNA, 25 bp, Mus musculus
gttttctgaaaaataccgacatcca

SEQ ID NO: 742433 - DNA, 25 bp, Mus musculus
gttttctgaaaactatgtatgctat

SEQ ID NO: 742434 - DNA, 25 bp, Mus musculus
gttttctgaaaagtatgtatgctat

SEQ ID NO: 742435 - DNA, 25 bp, Mus musculus
gttttctgaaaattaccgacatcca

SEQ ID NO: 742436 - DNA, 25 bp, Mus musculus
gttttctgaaatcatgtgaacttat

SEQ ID NO: 742437 - DNA, 25 bp, Mus musculus
gttttctgaaatgatgtgaacttat

SEQ ID NO: 742438 - DNA, 25 bp, Mus musculus
gttttctgaacgctttgtccatcaa

SEQ ID NO: 742439 - DNA, 25 bp, Mus musculus
gttttctgaacggtttgtccatcaa

SEQ ID NO: 742440 - DNA, 25 bp, Mus musculus
gttttctgaactatccaattgattt

SEQ ID NO: 742441 - DNA, 25 bp, Mus musculus
gttttctgaactttccaattgattt

SEQ ID NO: 742442 - DNA, 25 bp, Mus musculus
gttttctgaatcaaagagggcttgt

SEQ ID NO: 742443 - DNA, 25 bp, Mus musculus
gttttctgaatctaagagggcttgt

SEQ ID NO: 742444 - DNA, 25 bp, Mus musculus
gttttctgaattagatcttccctta

SEQ ID NO: 742445 - DNA, 25 bp, Mus musculus
gttttctgaatttgatcttccctta

SEQ ID NO: 742446 - DNA, 25 bp, Mus musculus
gttttctgagacactaccaagcatc

SEQ ID NO: 742447 - DNA, 25 bp, Mus musculus
gttttctgagacatggttttggtat

SEQ ID NO: 742448 - DNA, 25 bp, Mus musculus
gttttctgagactctaccaagcatc

SEQ ID NO: 742449 - DNA, 25 bp, Mus musculus
gttttctgagacttggttttggtat

SEQ ID NO: 742450 - DNA, 25 bp, Mus musculus
gttttctgagagatgctaaccggtt

SEQ ID NO: 742451 - DNA, 25 bp, Mus musculus
gttttctgagagttgctaaccggtt

SEQ ID NO: 742452 - DNA, 25 bp, Mus musculus
gttttctgaggcatcgagtttctta

SEQ ID NO: 742453 - DNA, 25 bp, Mus musculus
gttttctgaggcttcgagtttctta

SEQ ID NO: 742454 - DNA, 25 bp, Mus musculus
gttttctgagtgctgctttttcaca

SEQ ID NO: 742455 - DNA, 25 bp, Mus musculus
gttttctgagtggtgctttttcaca

SEQ ID NO: 742456 - DNA, 25 bp, Mus musculus
gttttctgccaacattcaccaatgt

SEQ ID NO: 742457 - DNA, 25 bp, Mus musculus
gttttctgccaagattcaccaatgt

SEQ ID NO: 742458 - DNA, 25 bp, Mus musculus
gttttctgcctcataggtaatccca

SEQ ID NO: 742459 - DNA, 25 bp, Mus musculus
gttttctgcctcttaggtaatccca

SEQ ID NO: 742460 - DNA, 25 bp, Mus musculus
gttttctgctgaatttctttgggat

SEQ ID NO: 742461 - DNA, 25 bp, Mus musculus
gttttctgctgattttctttgggat

SEQ ID NO: 742462 - DNA, 25 bp, Mus musculus
gttttctgctgccatacgaagttcc

SEQ ID NO: 742463 - DNA, 25 bp, Mus musculus
gttttctgctgcgatacgaagttcc

SEQ ID NO: 742464 - DNA, 25 bp, Mus musculus
gttttctgctggaaagtaaatcttc

SEQ ID NO: 742465 - DNA, 25 bp, Mus musculus
gttttctgctggtaagtaaatcttc

SEQ ID NO: 742466 - DNA, 25 bp, Mus musculus
gttttctgctgtaattcctcagtac

SEQ ID NO: 742467 - DNA, 25 bp, Mus musculus
gttttctgctgtaatttttctctcc

SEQ ID NO: 742468 - DNA, 25 bp, Mus musculus
gttttctgctgttattcctcagtac

SEQ ID NO: 742469 - DNA, 25 bp, Mus musculus
gttttctgctgttatttttctctcc

SEQ ID NO: 742470 - DNA, 25 bp, Mus musculus
gttttctggaacagagctttcagga

SEQ ID NO: 742471 - DNA, 25 bp, Mus musculus
gttttctggaactgagctttcagga

SEQ ID NO: 742472 - DNA, 25 bp, Mus musculus
gttttctggagcaagccactgggca

SEQ ID NO: 742473 - DNA, 25 bp, Mus musculus
gttttctggagctagccactgggca

SEQ ID NO: 742474 - DNA, 25 bp, Mus musculus
gttttctgggtaaagtatcacgtta

SEQ ID NO: 742475 - DNA, 25 bp, Mus musculus
gttttctgggtatagtatcacgtta

SEQ ID NO: 742476 - DNA, 25 bp, Mus musculus
gttttctggtaaacacatagtggtt

SEQ ID NO: 742477 - DNA, 25 bp, Mus musculus
gttttctggtaatcacatagtggtt

SEQ ID NO: 742478 - DNA, 25 bp, Mus musculus
gttttctggtacattttattggatt

SEQ ID NO: 742479 - DNA, 25 bp, Mus musculus
gttttctggtactttttattggatt

SEQ ID NO: 742480 - DNA, 25 bp, Mus musculus
gttttctggtagctgcagatgctgt

SEQ ID NO: 742481 - DNA, 25 bp, Mus musculus
gttttctggtaggtgcagatgctgt

SEQ ID NO: 742482 - DNA, 25 bp, Mus musculus
gttttctggtcccattcatcagcac

SEQ ID NO: 742483 - DNA, 25 bp, Mus musculus
gttttctggtccgattcatcagcac

SEQ ID NO: 742484 - DNA, 25 bp, Mus musculus
gttttctggttccttgcatcatcta

SEQ ID NO: 742485 - DNA, 25 bp, Mus musculus
gttttctggttcgttgcatcatcta

SEQ ID NO: 742486 - DNA, 25 bp, Mus musculus
gttttctgtaggaggattgttctca

SEQ ID NO: 742487 - DNA, 25 bp, Mus musculus
gttttctgtaggtggattgttctca

SEQ ID NO: 742488 - DNA, 25 bp, Mus musculus
gttttctgtagtagttgtttgtcgt

SEQ ID NO: 742489 - DNA, 25 bp, Mus musculus
gttttctgtagttgttgtttgtcgt

SEQ ID NO: 742490 - DNA, 25 bp, Mus musculus
gttttctgtattcctgtttgtggta

SEQ ID NO: 742491 - DNA, 25 bp, Mus musculus
gttttctgtattgctgtttgtggta

SEQ ID NO: 742492 - DNA, 25 bp, Mus musculus
gttttctgtccaaacttcttatgac

SEQ ID NO: 742493 - DNA, 25 bp, Mus musculus
gttttctgtccatacttcttatgac

SEQ ID NO: 742494 - DNA, 25 bp, Mus musculus
gttttctgtcctacttcagacttta

SEQ ID NO: 742495 - DNA, 25 bp, Mus musculus
gttttctgtccttcttcagacttta

SEQ ID NO: 742496 - DNA, 25 bp, Mus musculus
gttttctgtcttacatgatattgtg

SEQ ID NO: 742497 - DNA, 25 bp, Mus musculus
gttttctgtcttcaaagtttccatc

SEQ ID NO: 742498 - DNA, 25 bp, Mus musculus
gttttctgtcttcaagatgcatgct

SEQ ID NO: 742499 - DNA, 25 bp, Mus musculus
gttttctgtcttgaaagtttccatc

SEQ ID NO: 742500 - DNA, 25 bp, Mus musculus
gttttctgtcttgaagatgcatgct

SEQ ID NO: 742501 - DNA, 25 bp, Mus musculus
gttttctgtctttcatgatattgtg

SEQ ID NO: 742502 - DNA, 25 bp, Mus musculus
gttttctgtgtacgccaccaagagg

SEQ ID NO: 742503 - DNA, 25 bp, Mus musculus
gttttctgtgtaggccaccaagagg

SEQ ID NO: 742504 - DNA, 25 bp, Mus musculus
gttttctgtgtcagagttctgttgt

SEQ ID NO: 742505 - DNA, 25 bp, Mus musculus
gttttctgtgtctgagttctgttgt

SEQ ID NO: 742506 - DNA, 25 bp, Mus musculus
gttttctgtgttccagtctctgcaa

SEQ ID NO: 742507 - DNA, 25 bp, Mus musculus
gttttctgtgttgcagtctctgcaa

SEQ ID NO: 742508 - DNA, 25 bp, Mus musculus
gttttctgttctcaagatacaatgt

SEQ ID NO: 742509 - DNA, 25 bp, Mus musculus
gttttctgttctgaagatacaatgt

SEQ ID NO: 742510 - DNA, 25 bp, Mus musculus
gttttctgttgcagaggctttcata

SEQ ID NO: 742511 - DNA, 25 bp, Mus musculus
gttttctgttgctgaggctttcata

SEQ ID NO: 742512 - DNA, 25 bp, Mus musculus
gttttctgtttaatgcatgggctga

SEQ ID NO: 742513 - DNA, 25 bp, Mus musculus
gttttctgtttattgcatgggctga

SEQ ID NO: 742514 - DNA, 25 bp, Mus musculus
gttttcttaagactgccatcacaaa

SEQ ID NO: 742515 - DNA, 25 bp, Mus musculus
gttttcttaagagtgccatcacaaa

SEQ ID NO: 742516 - DNA, 25 bp, Mus musculus
gttttcttagctcaggaggtgccaa

SEQ ID NO: 742517 - DNA, 25 bp, Mus musculus
gttttcttagctgaggaggtgccaa

SEQ ID NO: 742518 - DNA, 25 bp, Mus musculus
gttttcttatagattgattcctact

SEQ ID NO: 742519 - DNA, 25 bp, Mus musculus
gttttcttatagtttgattcctact

SEQ ID NO: 742520 - DNA, 25 bp, Mus musculus
gttttcttatgcatttggtctttca

SEQ ID NO: 742521 - DNA, 25 bp, Mus musculus
gttttcttatgcttttggtctttca

SEQ ID NO: 742522 - DNA, 25 bp, Mus musculus
gttttcttcaaaaacagcatcactc

SEQ ID NO: 742523 - DNA, 25 bp, Mus musculus
gttttcttcaaatacagcatcactc

SEQ ID NO: 742524 - DNA, 25 bp, Mus musculus
gttttcttccaacttcacagttgag

SEQ ID NO: 742525 - DNA, 25 bp, Mus musculus
gttttcttccaagttcacagttgag

SEQ ID NO: 742526 - DNA, 25 bp, Mus musculus
gttttcttccctacatagcaattta

SEQ ID NO: 742527 - DNA, 25 bp, Mus musculus
gttttcttcccttcatagcaattta

SEQ ID NO: 742528 - DNA, 25 bp, Mus musculus
gttttcttcctaccagacctgatat

SEQ ID NO: 742529 - DNA, 25 bp, Mus musculus
gttttcttcctagcagacctgatat

SEQ ID NO: 742530 - DNA, 25 bp, Mus musculus
gttttcttcctcagctttaatgatc

SEQ ID NO: 742531 - DNA, 25 bp, Mus musculus
gttttcttcctctgctttaatgatc

SEQ ID NO: 742532 - DNA, 25 bp, Mus musculus
gttttcttcgggagcatgggccctt

SEQ ID NO: 742533 - DNA, 25 bp, Mus musculus
gttttcttcgggtgcatgggccctt

SEQ ID NO: 742534 - DNA, 25 bp, Mus musculus
gttttcttctgtcagactttctctg

SEQ ID NO: 742535 - DNA, 25 bp, Mus musculus
gttttcttctgtgagactttctctg

SEQ ID NO: 742536 - DNA, 25 bp, Mus musculus
gttttcttcttgcatgttagatgta

SEQ ID NO: 742537 - DNA, 25 bp, Mus musculus
gttttcttcttggatgttagatgta

SEQ ID NO: 742538 - DNA, 25 bp, Mus musculus
gttttcttgataactagtctctaat

SEQ ID NO: 742539 - DNA, 25 bp, Mus musculus
gttttcttgatatctagtctctaat

SEQ ID NO: 742540 - DNA, 25 bp, Mus musculus
gttttcttggaaatcatatagctca

SEQ ID NO: 742541 - DNA, 25 bp, Mus musculus
gttttcttggaattcatatagctca

SEQ ID NO: 742542 - DNA, 25 bp, Mus musculus
gttttcttgggaaaagtagctgctg

SEQ ID NO: 742543 - DNA, 25 bp, Mus musculus
gttttcttgggataagtagctgctg

SEQ ID NO: 742544 - DNA, 25 bp, Mus musculus
gttttcttgtaaagtgctgtggcca

SEQ ID NO: 742545 - DNA, 25 bp, Mus musculus
gttttcttgtaatgtgctgtggcca

SEQ ID NO: 742546 - DNA, 25 bp, Mus musculus
gttttcttgtggatccccaagctct

SEQ ID NO: 742547 - DNA, 25 bp, Mus musculus
gttttcttgtggttccccaagctct

SEQ ID NO: 742548 - DNA, 25 bp, Mus musculus
gttttcttgttgatggacaggcaca

SEQ ID NO: 742549 - DNA, 25 bp, Mus musculus
gttttcttgttgttggacaggcaca

SEQ ID NO: 742550 - DNA, 25 bp, Mus musculus
gttttctttcaaccaatctatccta

SEQ ID NO: 742551 - DNA, 25 bp, Mus musculus
gttttctttcaagcaatctatccta

SEQ ID NO: 742552 - DNA, 25 bp, Mus musculus
gttttctttcacagggttctgagca

SEQ ID NO: 742553 - DNA, 25 bp, Mus musculus
gttttctttcactgggttctgagca

SEQ ID NO: 742554 - DNA, 25 bp, Mus musculus
gttttctttcatcgtaagcctgtaa

SEQ ID NO: 742555 - DNA, 25 bp, Mus musculus
gttttctttcatggtaagcctgtaa

SEQ ID NO: 742556 - DNA, 25 bp, Mus musculus
gttttctttgacatggccattttga

SEQ ID NO: 742557 - DNA, 25 bp, Mus musculus
gttttctttgacttggccattttga

SEQ ID NO: 742558 - DNA, 25 bp, Mus musculus
gttttctttgggagaggtacaatga

SEQ ID NO: 742559 - DNA, 25 bp, Mus musculus
gttttctttgggtgaggtacaatga

SEQ ID NO: 742560 - DNA, 25 bp, Mus musculus
gttttctttgtcaatgccaaagaca

SEQ ID NO: 742561 - DNA, 25 bp, Mus musculus
gttttctttgtctatgccaaagaca

SEQ ID NO: 742562 - DNA, 25 bp, Mus musculus
gttttcttttccaagcatgatagta

SEQ ID NO: 742563 - DNA, 25 bp, Mus musculus
gttttcttttccaccagataagatg

SEQ ID NO: 742564 - DNA, 25 bp, Mus musculus
gttttcttttcctagcatgatagta

SEQ ID NO: 742565 - DNA, 25 bp, Mus musculus
gttttcttttcctccagataagatg

SEQ ID NO: 742566 - DNA, 25 bp, Mus musculus
gttttcttttgaagtctcctggacc

SEQ ID NO: 742567 - DNA, 25 bp, Mus musculus
gttttcttttgatgtctcctggacc

SEQ ID NO: 742568 - DNA, 25 bp, Mus musculus
gttttctttttgactgtcagcccca

SEQ ID NO: 742569 - DNA, 25 bp, Mus musculus
gttttctttttgtctgtcagcccca

SEQ ID NO: 742570 - DNA, 25 bp, Mus musculus
gttttgaaagccatgtctctgtggg

SEQ ID NO: 742571 - DNA, 25 bp, Mus musculus
gttttgaaagccttgtctctgtggg

SEQ ID NO: 742572 - DNA, 25 bp, Mus musculus
gttttgaaatgcaccgtgaagggct

SEQ ID NO: 742573 - DNA, 25 bp, Mus musculus
gttttgaaatgctccgtgaagggct

SEQ ID NO: 742574 - DNA, 25 bp, Mus musculus
gttttgaaccacatgagtctacacg

SEQ ID NO: 742575 - DNA, 25 bp, Mus musculus
gttttgaaccacctccatcaaggat

SEQ ID NO: 742576 - DNA, 25 bp, Mus musculus
gttttgaaccacgtccatcaaggat

SEQ ID NO: 742577 - DNA, 25 bp, Mus musculus
gttttgaaccacttgagtctacacg

SEQ ID NO: 742578 - DNA, 25 bp, Mus musculus
gttttgaactacctatgaccagatg

SEQ ID NO: 742579 - DNA, 25 bp, Mus musculus
gttttgaactacgtatgaccagatg

SEQ ID NO: 742580 - DNA, 25 bp, Mus musculus
gttttgaagagtcatacccacccta

SEQ ID NO: 742581 - DNA, 25 bp, Mus musculus
gttttgaagagtgatacccacccta

SEQ ID NO: 742582 - DNA, 25 bp, Mus musculus
gttttgaagatgaagacgtccccgt

SEQ ID NO: 742583 - DNA, 25 bp, Mus musculus
gttttgaagatgtagacgtccccgt

SEQ ID NO: 742584 - DNA, 25 bp, Mus musculus
gttttgaagcccagccttgcaggag

SEQ ID NO: 742585 - DNA, 25 bp, Mus musculus
gttttgaagccctgccttgcaggag

SEQ ID NO: 742586 - DNA, 25 bp, Mus musculus
gttttgaagttcaccctggactgca

SEQ ID NO: 742587 - DNA, 25 bp, Mus musculus
gttttgaagttctccctggactgca

SEQ ID NO: 742588 - DNA, 25 bp, Mus musculus
gttttgaatcctagctctattgccc

SEQ ID NO: 742589 - DNA, 25 bp, Mus musculus
gttttgaatccttgctctattgccc

SEQ ID NO: 742590 - DNA, 25 bp, Mus musculus
gttttgaatgctcacctactttttt

SEQ ID NO: 742591 - DNA, 25 bp, Mus musculus
gttttgaatgctgacctactttttt

SEQ ID NO: 742592 - DNA, 25 bp, Mus musculus
gttttgaattccatggagcccgtct

SEQ ID NO: 742593 - DNA, 25 bp, Mus musculus
gttttgaattccttggagcccgtct

SEQ ID NO: 742594 - DNA, 25 bp, Mus musculus
gttttgacaatccattcgacagtgt

SEQ ID NO: 742595 - DNA, 25 bp, Mus musculus
gttttgacaatcgattcgacagtgt

SEQ ID NO: 742596 - DNA, 25 bp, Mus musculus
gttttgacaggactcactccattga

SEQ ID NO: 742597 - DNA, 25 bp, Mus musculus
gttttgacaggagtcactccattga

SEQ ID NO: 742598 - DNA, 25 bp, Mus musculus
gttttgacagtccacgagatccctg

SEQ ID NO: 742599 - DNA, 25 bp, Mus musculus
gttttgacagtcgacgagatccctg

SEQ ID NO: 742600 - DNA, 25 bp, Mus musculus
gttttgacagttacctatgtttctc

SEQ ID NO: 742601 - DNA, 25 bp, Mus musculus
gttttgacagtttcctatgtttctc

SEQ ID NO: 742602 - DNA, 25 bp, Mus musculus
gttttgacatcaccagacagccgaa

SEQ ID NO: 742603 - DNA, 25 bp, Mus musculus
gttttgacatcagcagacagccgaa

SEQ ID NO: 742604 - DNA, 25 bp, Mus musculus
gttttgaccaatcctcaaccttgaa

SEQ ID NO: 742605 - DNA, 25 bp, Mus musculus
gttttgaccaatgctcaaccttgaa

SEQ ID NO: 742606 - DNA, 25 bp, Mus musculus
gttttgaccagtacctagtgctatt

SEQ ID NO: 742607 - DNA, 25 bp, Mus musculus
gttttgaccagttcctagtgctatt

SEQ ID NO: 742608 - DNA, 25 bp, Mus musculus
gttttgaccatccaataatcccaga

SEQ ID NO: 742609 - DNA, 25 bp, Mus musculus
gttttgaccatcgaataatcccaga

SEQ ID NO: 742610 - DNA, 25 bp, Mus musculus
gttttgacccacagaagctatctgt

SEQ ID NO: 742611 - DNA, 25 bp, Mus musculus
gttttgacccactgaagctatctgt

SEQ ID NO: 742612 - DNA, 25 bp, Mus musculus
gttttgaccttgattggcggctact

SEQ ID NO: 742613 - DNA, 25 bp, Mus musculus
gttttgaccttgtttggcggctact

SEQ ID NO: 742614 - DNA, 25 bp, Mus musculus
gttttgacgagacctcatccctttc

SEQ ID NO: 742615 - DNA, 25 bp, Mus musculus
gttttgacgagagctcatccctttc

SEQ ID NO: 742616 - DNA, 25 bp, Mus musculus
gttttgactcagatgactgtctcag

SEQ ID NO: 742617 - DNA, 25 bp, Mus musculus
gttttgactcagttgactgtctcag

SEQ ID NO: 742618 - DNA, 25 bp, Mus musculus
gttttgactcccaattcatgcaatg

SEQ ID NO: 742619 - DNA, 25 bp, Mus musculus
gttttgactccctattcatgcaatg

SEQ ID NO: 742620 - DNA, 25 bp, Mus musculus
gttttgactctgctcttggtgcaaa

SEQ ID NO: 742621 - DNA, 25 bp, Mus musculus
gttttgactctggtcttggtgcaaa

SEQ ID NO: 742622 - DNA, 25 bp, Mus musculus
gttttgacttaacatttactgtatt

SEQ ID NO: 742623 - DNA, 25 bp, Mus musculus
gttttgacttaagatttactgtatt

SEQ ID NO: 742624 - DNA, 25 bp, Mus musculus
gttttgacttttagagacctattat

SEQ ID NO: 742625 - DNA, 25 bp, Mus musculus
gttttgactttttgagacctattat

SEQ ID NO: 742626 - DNA, 25 bp, Mus musculus
gttttgagagacaataccattattt

SEQ ID NO: 742627 - DNA, 25 bp, Mus musculus
gttttgagagactataccattattt

SEQ ID NO: 742628 - DNA, 25 bp, Mus musculus
gttttgagagcaactggatctgtca

SEQ ID NO: 742629 - DNA, 25 bp, Mus musculus
gttttgagagcatctggatctgtca

SEQ ID NO: 742630 - DNA, 25 bp, Mus musculus
gttttgagatcaaactccctaccct

SEQ ID NO: 742631 - DNA, 25 bp, Mus musculus
gttttgagatcatactccctaccct

SEQ ID NO: 742632 - DNA, 25 bp, Mus musculus
gttttgagcacacgcgtttcagcag

SEQ ID NO: 742633 - DNA, 25 bp, Mus musculus
gttttgagcacaggcgtttcagcag

SEQ ID NO: 742634 - DNA, 25 bp, Mus musculus
gttttgagcagaaaggattccgcct

SEQ ID NO: 742635 - DNA, 25 bp, Mus musculus
gttttgagcagataggattccgcct

SEQ ID NO: 742636 - DNA, 25 bp, Mus musculus
gttttgagcccaagtctagaagatg

SEQ ID NO: 742637 - DNA, 25 bp, Mus musculus
gttttgagcccatgtctagaagatg

SEQ ID NO: 742638 - DNA, 25 bp, Mus musculus
gttttgagcccccaatcaacctgat

SEQ ID NO: 742639 - DNA, 25 bp, Mus musculus
gttttgagccccgaatcaacctgat

SEQ ID NO: 742640 - DNA, 25 bp, Mus musculus
gttttgagcgtaaagtgtccagatt

SEQ ID NO: 742641 - DNA, 25 bp, Mus musculus
gttttgagcgtatagtgtccagatt

SEQ ID NO: 742642 - DNA, 25 bp, Mus musculus
gttttgaggctgaggtcttttatta

SEQ ID NO: 742643 - DNA, 25 bp, Mus musculus
gttttgaggctgtggtcttttatta

SEQ ID NO: 742644 - DNA, 25 bp, Mus musculus
gttttgagggctagaagctgacctg

SEQ ID NO: 742645 - DNA, 25 bp, Mus musculus
gttttgagggcttgaagctgacctg

SEQ ID NO: 742646 - DNA, 25 bp, Mus musculus
gttttgagtatgcactgctctagca

SEQ ID NO: 742647 - DNA, 25 bp, Mus musculus
gttttgagtatggactgctctagca

SEQ ID NO: 742648 - DNA, 25 bp, Mus musculus
gttttgataatgagttcttacagtt

SEQ ID NO: 742649 - DNA, 25 bp, Mus musculus
gttttgataatgtgttcttacagtt

SEQ ID NO: 742650 - DNA, 25 bp, Mus musculus
gttttgatagtgaagcctgccaggt

SEQ ID NO: 742651 - DNA, 25 bp, Mus musculus
gttttgatagtgtagcctgccaggt

SEQ ID NO: 742652 - DNA, 25 bp, Mus musculus
gttttgatatttaaattgtcccatc

SEQ ID NO: 742653 - DNA, 25 bp, Mus musculus
gttttgatattttaattgtcccatc

SEQ ID NO: 742654 - DNA, 25 bp, Mus musculus
gttttgatcattaagccagcacatt

SEQ ID NO: 742655 - DNA, 25 bp, Mus musculus
gttttgatcattagtcattaccgga

SEQ ID NO: 742656 - DNA, 25 bp, Mus musculus
gttttgatcatttagccagcacatt

SEQ ID NO: 742657 - DNA, 25 bp, Mus musculus
gttttgatcatttgtcattaccgga

SEQ ID NO: 742658 - DNA, 25 bp, Mus musculus
gttttgatcccaacttgcaacgagt

SEQ ID NO: 742659 - DNA, 25 bp, Mus musculus
gttttgatcccatcttgcaacgagt

SEQ ID NO: 742660 - DNA, 25 bp, Mus musculus
gttttgatcgatctccatccttgcc

SEQ ID NO: 742661 - DNA, 25 bp, Mus musculus
gttttgatcgatgtccatccttgcc

SEQ ID NO: 742662 - DNA, 25 bp, Mus musculus
gttttgatctaacctctgaatgttc

SEQ ID NO: 742663 - DNA, 25 bp, Mus musculus
gttttgatctaagctctgaatgttc

SEQ ID NO: 742664 - DNA, 25 bp, Mus musculus
gttttgatgcaactactgtctaaat

SEQ ID NO: 742665 - DNA, 25 bp, Mus musculus
gttttgatgcaagtactgtctaaat

SEQ ID NO: 742666 - DNA, 25 bp, Mus musculus
gttttgatgctacatataactgata

SEQ ID NO: 742667 - DNA, 25 bp, Mus musculus
gttttgatgctagatataactgata

SEQ ID NO: 742668 - DNA, 25 bp, Mus musculus
gttttgatgtccagacttgctgtca

SEQ ID NO: 742669 - DNA, 25 bp, Mus musculus
gttttgatgtcctgacttgctgtca

SEQ ID NO: 742670 - DNA, 25 bp, Mus musculus
gttttgattcccagttatcagaagt

SEQ ID NO: 742671 - DNA, 25 bp, Mus musculus
gttttgattccctgttatcagaagt

SEQ ID NO: 742672 - DNA, 25 bp, Mus musculus
gttttgattctgatctcgcttttaa

SEQ ID NO: 742673 - DNA, 25 bp, Mus musculus
gttttgattctgttctcgcttttaa

SEQ ID NO: 742674 - DNA, 25 bp, Mus musculus
gttttgatttgtatgggctttctct

SEQ ID NO: 742675 - DNA, 25 bp, Mus musculus
gttttgatttgtttgggctttctct

SEQ ID NO: 742676 - DNA, 25 bp, Mus musculus
gttttgattttccttgttgagactt

SEQ ID NO: 742677 - DNA, 25 bp, Mus musculus
gttttgattttcgttgttgagactt

SEQ ID NO: 742678 - DNA, 25 bp, Mus musculus
gttttgatttttcagcctggtctca

SEQ ID NO: 742679 - DNA, 25 bp, Mus musculus
gttttgatttttgagcctggtctca

SEQ ID NO: 742680 - DNA, 25 bp, Mus musculus
gttttgcaaaagacagggcgtttct

SEQ ID NO: 742681 - DNA, 25 bp, Mus musculus
gttttgcaaaagtcagggcgtttct

SEQ ID NO: 742682 - DNA, 25 bp, Mus musculus
gttttgcaaagactacactactggg

SEQ ID NO: 742683 - DNA, 25 bp, Mus musculus
gttttgcaaagagtacactactggg

SEQ ID NO: 742684 - DNA, 25 bp, Mus musculus
gttttgcaagctaagagccggtatt

SEQ ID NO: 742685 - DNA, 25 bp, Mus musculus
gttttgcaagcttagagccggtatt

SEQ ID NO: 742686 - DNA, 25 bp, Mus musculus
gttttgcacaaacccatgacaccaa

SEQ ID NO: 742687 - DNA, 25 bp, Mus musculus
gttttgcacaaagccatgacaccaa

SEQ ID NO: 742688 - DNA, 25 bp, Mus musculus
gttttgcacaccaatgcagcagggt

SEQ ID NO: 742689 - DNA, 25 bp, Mus musculus
gttttgcacacctatgcagcagggt

SEQ ID NO: 742690 - DNA, 25 bp, Mus musculus
gttttgcacagacattcatcaatca

SEQ ID NO: 742691 - DNA, 25 bp, Mus musculus
gttttgcacagagattcatcaatca

SEQ ID NO: 742692 - DNA, 25 bp, Mus musculus
gttttgcacatcagtgtaactggag

SEQ ID NO: 742693 - DNA, 25 bp, Mus musculus
gttttgcacatctgtgtaactggag

SEQ ID NO: 742694 - DNA, 25 bp, Mus musculus
gttttgcacattacctgattgcttc

SEQ ID NO: 742695 - DNA, 25 bp, Mus musculus
gttttgcacatttcctgattgcttc

SEQ ID NO: 742696 - DNA, 25 bp, Mus musculus
gttttgcactatattgactttttgg

SEQ ID NO: 742697 - DNA, 25 bp, Mus musculus
gttttgcactattttgactttttgg

SEQ ID NO: 742698 - DNA, 25 bp, Mus musculus
gttttgcactttatcgtacaggaag

SEQ ID NO: 742699 - DNA, 25 bp, Mus musculus
gttttgcactttttcgtacaggaag

SEQ ID NO: 742700 - DNA, 25 bp, Mus musculus
gttttgcagcaacccattatctagc

SEQ ID NO: 742701 - DNA, 25 bp, Mus musculus
gttttgcagcaagccattatctagc

SEQ ID NO: 742702 - DNA, 25 bp, Mus musculus
gttttgcagggacgacacatacaca

SEQ ID NO: 742703 - DNA, 25 bp, Mus musculus
gttttgcagggaggacacatacaca

SEQ ID NO: 742704 - DNA, 25 bp, Mus musculus
gttttgcagggcaaaactctagttt

SEQ ID NO: 742705 - DNA, 25 bp, Mus musculus
gttttgcagggctaaactctagttt

SEQ ID NO: 742706 - DNA, 25 bp, Mus musculus
gttttgcagtgcacaaattcagtct

SEQ ID NO: 742707 - DNA, 25 bp, Mus musculus
gttttgcagtgctcaaattcagtct

SEQ ID NO: 742708 - DNA, 25 bp, Mus musculus
gttttgcagttcatatcaagtttag

SEQ ID NO: 742709 - DNA, 25 bp, Mus musculus
gttttgcagttcttatcaagtttag

SEQ ID NO: 742710 - DNA, 25 bp, Mus musculus
gttttgcagtttcttgctctgtatt

SEQ ID NO: 742711 - DNA, 25 bp, Mus musculus
gttttgcagtttgttgctctgtatt

SEQ ID NO: 742712 - DNA, 25 bp, Mus musculus
gttttgcatatgaccagcactgact

SEQ ID NO: 742713 - DNA, 25 bp, Mus musculus
gttttgcatatgtccagcactgact

SEQ ID NO: 742714 - DNA, 25 bp, Mus musculus
gttttgcatcaacaccatctcgatt

SEQ ID NO: 742715 - DNA, 25 bp, Mus musculus
gttttgcatcaagaccatctcgatt

SEQ ID NO: 742716 - DNA, 25 bp, Mus musculus
gttttgcatcacattctggaaataa

SEQ ID NO: 742717 - DNA, 25 bp, Mus musculus
gttttgcatcactttctggaaataa

SEQ ID NO: 742718 - DNA, 25 bp, Mus musculus
gttttgcatcatcactttctaaaca

SEQ ID NO: 742719 - DNA, 25 bp, Mus musculus
gttttgcatcatgactttctaaaca

SEQ ID NO: 742720 - DNA, 25 bp, Mus musculus
gttttgcatcctcgtgtacattcac

SEQ ID NO: 742721 - DNA, 25 bp, Mus musculus
gttttgcatcctctagctatgtgtt

SEQ ID NO: 742722 - DNA, 25 bp, Mus musculus
gttttgcatcctggtgtacattcac

SEQ ID NO: 742723 - DNA, 25 bp, Mus musculus
gttttgcatcctgtagctatgtgtt

SEQ ID NO: 742724 - DNA, 25 bp, Mus musculus
gttttgcatcgaagctcctgaggac

SEQ ID NO: 742725 - DNA, 25 bp, Mus musculus
gttttgcatcgatgctcctgaggac

SEQ ID NO: 742726 - DNA, 25 bp, Mus musculus
gttttgcattgtatcattttctgta

SEQ ID NO: 742727 - DNA, 25 bp, Mus musculus
gttttgcattgtttcattttctgta

SEQ ID NO: 742728 - DNA, 25 bp, Mus musculus
gttttgcatttgcttgtctgtctca

SEQ ID NO: 742729 - DNA, 25 bp, Mus musculus
gttttgcatttggttgtctgtctca

SEQ ID NO: 742730 - DNA, 25 bp, Mus musculus
gttttgccaacccatactggacaaa

SEQ ID NO: 742731 - DNA, 25 bp, Mus musculus
gttttgccaaccgatactggacaaa

SEQ ID NO: 742732 - DNA, 25 bp, Mus musculus
gttttgccaaggagtctgcatcgga

SEQ ID NO: 742733 - DNA, 25 bp, Mus musculus
gttttgccaaggtgtctgcatcgga

SEQ ID NO: 742734 - DNA, 25 bp, Mus musculus
gttttgccacgtctatttgtgtgct

SEQ ID NO: 742735 - DNA, 25 bp, Mus musculus
gttttgccacgtgtatttgtgtgct

SEQ ID NO: 742736 - DNA, 25 bp, Mus musculus
gttttgccagttatttccgacagta

SEQ ID NO: 742737 - DNA, 25 bp, Mus musculus
gttttgccagttttttccgacagta

SEQ ID NO: 742738 - DNA, 25 bp, Mus musculus
gttttgcccgagagggatgctgtcc

SEQ ID NO: 742739 - DNA, 25 bp, Mus musculus
gttttgcccgagtgggatgctgtcc

SEQ ID NO: 742740 - DNA, 25 bp, Mus musculus
gttttgccctgtaccagttgatcaa

SEQ ID NO: 742741 - DNA, 25 bp, Mus musculus
gttttgccctgttccagttgatcaa

SEQ ID NO: 742742 - DNA, 25 bp, Mus musculus
gttttgcccttccatatttaattca

SEQ ID NO: 742743 - DNA, 25 bp, Mus musculus
gttttgcccttcgatatttaattca

SEQ ID NO: 742744 - DNA, 25 bp, Mus musculus
gttttgccgattagcacattaaatg

SEQ ID NO: 742745 - DNA, 25 bp, Mus musculus
gttttgccgatttgcacattaaatg

SEQ ID NO: 742746 - DNA, 25 bp, Mus musculus
gttttgcctattacagaatcatgag

SEQ ID NO: 742747 - DNA, 25 bp, Mus musculus
gttttgcctatttcagaatcatgag

SEQ ID NO: 742748 - DNA, 25 bp, Mus musculus
gttttgcctcctagacatgtgtata

SEQ ID NO: 742749 - DNA, 25 bp, Mus musculus
gttttgcctcctatattcattatca

SEQ ID NO: 742750 - DNA, 25 bp, Mus musculus
gttttgcctccttgacatgtgtata

SEQ ID NO: 742751 - DNA, 25 bp, Mus musculus
gttttgcctcctttattcattatca

SEQ ID NO: 742752 - DNA, 25 bp, Mus musculus
gttttgcctctcacgtatagacttt

SEQ ID NO: 742753 - DNA, 25 bp, Mus musculus
gttttgcctctctcgtatagacttt

SEQ ID NO: 742754 - DNA, 25 bp, Mus musculus
gttttgcctgagagactagctgcta

SEQ ID NO: 742755 - DNA, 25 bp, Mus musculus
gttttgcctgagtgactagctgcta

SEQ ID NO: 742756 - DNA, 25 bp, Mus musculus
gttttgcctgctctggaatttccag

SEQ ID NO: 742757 - DNA, 25 bp, Mus musculus
gttttgcctgctgtggaatttccag

SEQ ID NO: 742758 - DNA, 25 bp, Mus musculus
gttttgcctttaaagttctttgcat

SEQ ID NO: 742759 - DNA, 25 bp, Mus musculus
gttttgcctttatagttctttgcat

SEQ ID NO: 742760 - DNA, 25 bp, Mus musculus
gttttgcggactaggacatcactga

SEQ ID NO: 742761 - DNA, 25 bp, Mus musculus
gttttgcggacttggacatcactga

SEQ ID NO: 742762 - DNA, 25 bp, Mus musculus
gttttgcgtagcattgtgtgctgcc

SEQ ID NO: 742763 - DNA, 25 bp, Mus musculus
gttttgcgtagctttgtgtgctgcc

SEQ ID NO: 742764 - DNA, 25 bp, Mus musculus
gttttgctaagtagacggtcccatt

SEQ ID NO: 742765 - DNA, 25 bp, Mus musculus
gttttgctaagttgacggtcccatt

SEQ ID NO: 742766 - DNA, 25 bp, Mus musculus
gttttgctacatctttcagacttca

SEQ ID NO: 742767 - DNA, 25 bp, Mus musculus
gttttgctacatgtttcagacttca

SEQ ID NO: 742768 - DNA, 25 bp, Mus musculus
gttttgctagaacctggcgcttcct

SEQ ID NO: 742769 - DNA, 25 bp, Mus musculus
gttttgctagaagctggcgcttcct

SEQ ID NO: 742770 - DNA, 25 bp, Mus musculus
gttttgctcaggacatgccaacggg

SEQ ID NO: 742771 - DNA, 25 bp, Mus musculus
gttttgctcaggtcatgccaacggg

SEQ ID NO: 742772 - DNA, 25 bp, Mus musculus
gttttgctctagattaagacagtta

SEQ ID NO: 742773 - DNA, 25 bp, Mus musculus
gttttgctctagtttaagacagtta

SEQ ID NO: 742774 - DNA, 25 bp, Mus musculus
gttttgctctgaaaatcgcccaaag

SEQ ID NO: 742775 - DNA, 25 bp, Mus musculus
gttttgctctgaatcttgccaaact

SEQ ID NO: 742776 - DNA, 25 bp, Mus musculus
gttttgctctgataatcgcccaaag

SEQ ID NO: 742777 - DNA, 25 bp, Mus musculus
gttttgctctgattcttgccaaact

SEQ ID NO: 742778 - DNA, 25 bp, Mus musculus
gttttgctgaacagtttcgtgcctc

SEQ ID NO: 742779 - DNA, 25 bp, Mus musculus
gttttgctgaactgtttcgtgcctc

SEQ ID NO: 742780 - DNA, 25 bp, Mus musculus
gttttgctgaagatccaagttgcca

SEQ ID NO: 742781 - DNA, 25 bp, Mus musculus
gttttgctgaagttccaagttgcca

SEQ ID NO: 742782 - DNA, 25 bp, Mus musculus
gttttgctgacaattcaccaaccta

SEQ ID NO: 742783 - DNA, 25 bp, Mus musculus
gttttgctgacatttcaccaaccta

SEQ ID NO: 742784 - DNA, 25 bp, Mus musculus
gttttgctgagcatgctaagtgtca

SEQ ID NO: 742785 - DNA, 25 bp, Mus musculus
gttttgctgagcttgctaagtgtca

SEQ ID NO: 742786 - DNA, 25 bp, Mus musculus
gttttgctggttatgtggctgctaa

SEQ ID NO: 742787 - DNA, 25 bp, Mus musculus
gttttgctggttctggacatgtcct

SEQ ID NO: 742788 - DNA, 25 bp, Mus musculus
gttttgctggttgtggacatgtcct

SEQ ID NO: 742789 - DNA, 25 bp, Mus musculus
gttttgctggttttgtggctgctaa

SEQ ID NO: 742790 - DNA, 25 bp, Mus musculus
gttttgctgttcaaagagccctggt

SEQ ID NO: 742791 - DNA, 25 bp, Mus musculus
gttttgctgttctaagagccctggt

SEQ ID NO: 742792 - DNA, 25 bp, Mus musculus
gttttgctgttgctaggacttcatt

SEQ ID NO: 742793 - DNA, 25 bp, Mus musculus
gttttgctgttggtaggacttcatt

SEQ ID NO: 742794 - DNA, 25 bp, Mus musculus
gttttgcttcataattcatctctgt

SEQ ID NO: 742795 - DNA, 25 bp, Mus musculus
gttttgcttcattattcatctctgt

SEQ ID NO: 742796 - DNA, 25 bp, Mus musculus
gttttgcttctgatcttgtgttcta

SEQ ID NO: 742797 - DNA, 25 bp, Mus musculus
gttttgcttctgttcttgtgttcta

SEQ ID NO: 742798 - DNA, 25 bp, Mus musculus
gttttgcttcttatgactcgacttc

SEQ ID NO: 742799 - DNA, 25 bp, Mus musculus
gttttgcttcttttgactcgacttc

SEQ ID NO: 742800 - DNA, 25 bp, Mus musculus
gttttgcttgataaaaatagcttat

SEQ ID NO: 742801 - DNA, 25 bp, Mus musculus
gttttgcttgattaaaatagcttat

SEQ ID NO: 742802 - DNA, 25 bp, Mus musculus
gttttgctttgaagctgttggccag

SEQ ID NO: 742803 - DNA, 25 bp, Mus musculus
gttttgctttgatgctgttggccag

SEQ ID NO: 742804 - DNA, 25 bp, Mus musculus
gttttgctttgcagcagattaggtt

SEQ ID NO: 742805 - DNA, 25 bp, Mus musculus
gttttgctttgctgcagattaggtt

SEQ ID NO: 742806 - DNA, 25 bp, Mus musculus
gttttggaaatgagccacccaccac

SEQ ID NO: 742807 - DNA, 25 bp, Mus musculus
gttttggaaatgtgccacccaccac

SEQ ID NO: 742808 - DNA, 25 bp, Mus musculus
gttttggaacctaattagagctgag

SEQ ID NO: 742809 - DNA, 25 bp, Mus musculus
gttttggaaccttattagagctgag

SEQ ID NO: 742810 - DNA, 25 bp, Mus musculus
gttttggaatatcttagctgggcgt

SEQ ID NO: 742811 - DNA, 25 bp, Mus musculus
gttttggaatatgttagctgggcgt

SEQ ID NO: 742812 - DNA, 25 bp, Mus musculus
gttttggacaacactctgggttctt

SEQ ID NO: 742813 - DNA, 25 bp, Mus musculus
gttttggacaactctctgggttctt

SEQ ID NO: 742814 - DNA, 25 bp, Mus musculus
gttttggaccagatgagcccagctg

SEQ ID NO: 742815 - DNA, 25 bp, Mus musculus
gttttggaccagttgagcccagctg

SEQ ID NO: 742816 - DNA, 25 bp, Mus musculus
gttttggagagcattctgtcctttt

SEQ ID NO: 742817 - DNA, 25 bp, Mus musculus
gttttggagagctttctgtcctttt

SEQ ID NO: 742818 - DNA, 25 bp, Mus musculus
gttttggagaggatagatgttagat

SEQ ID NO: 742819 - DNA, 25 bp, Mus musculus
gttttggagaggttagatgttagat

SEQ ID NO: 742820 - DNA, 25 bp, Mus musculus
gttttggagcccaagctactgaagt

SEQ ID NO: 742821 - DNA, 25 bp, Mus musculus
gttttggagccctagctactgaagt

SEQ ID NO: 742822 - DNA, 25 bp, Mus musculus
gttttggagcctctttgactttgta

SEQ ID NO: 742823 - DNA, 25 bp, Mus musculus
gttttggagcctgtttgactttgta

SEQ ID NO: 742824 - DNA, 25 bp, Mus musculus
gttttggagctacctgcggtttaga

SEQ ID NO: 742825 - DNA, 25 bp, Mus musculus
gttttggagctagctgcggtttaga

SEQ ID NO: 742826 - DNA, 25 bp, Mus musculus
gttttggaggtactttcaaggagca

SEQ ID NO: 742827 - DNA, 25 bp, Mus musculus
gttttggaggtagtttcaaggagca

SEQ ID NO: 742828 - DNA, 25 bp, Mus musculus
gttttggaggtgcacttatgccagt

SEQ ID NO: 742829 - DNA, 25 bp, Mus musculus
gttttggaggtggacttatgccagt

SEQ ID NO: 742830 - DNA, 25 bp, Mus musculus
gttttggatcacatgggaccctcaa

SEQ ID NO: 742831 - DNA, 25 bp, Mus musculus
gttttggatcacttgggaccctcaa

SEQ ID NO: 742832 - DNA, 25 bp, Mus musculus
gttttggatcttcgcctggttgaac

SEQ ID NO: 742833 - DNA, 25 bp, Mus musculus
gttttggatcttggcctggttgaac

SEQ ID NO: 742834 - DNA, 25 bp, Mus musculus
gttttggcactgctacaatgtctcc

SEQ ID NO: 742835 - DNA, 25 bp, Mus musculus
gttttggcactggtacaatgtctcc

SEQ ID NO: 742836 - DNA, 25 bp, Mus musculus
gttttggcagtcctagcccacattc

SEQ ID NO: 742837 - DNA, 25 bp, Mus musculus
gttttggcagtcgtagcccacattc

SEQ ID NO: 742838 - DNA, 25 bp, Mus musculus
gttttggccaggaaccttcacacag

SEQ ID NO: 742839 - DNA, 25 bp, Mus musculus
gttttggccaggtaccttcacacag

SEQ ID NO: 742840 - DNA, 25 bp, Mus musculus
gttttggccagtctgactttacagt

SEQ ID NO: 742841 - DNA, 25 bp, Mus musculus
gttttggccagtgtgactttacagt

SEQ ID NO: 742842 - DNA, 25 bp, Mus musculus
gttttggcccagcaattccttacag

SEQ ID NO: 742843 - DNA, 25 bp, Mus musculus
gttttggcccaggaattccttacag

SEQ ID NO: 742844 - DNA, 25 bp, Mus musculus
gttttggcctaaatggaaattccag

SEQ ID NO: 742845 - DNA, 25 bp, Mus musculus
gttttggcctaattggaaattccag

SEQ ID NO: 742846 - DNA, 25 bp, Mus musculus
gttttggcgcttatgactcaggatt

SEQ ID NO: 742847 - DNA, 25 bp, Mus musculus
gttttggcgcttttgactcaggatt

SEQ ID NO: 742848 - DNA, 25 bp, Mus musculus
gttttggctaatacctattgcctag

SEQ ID NO: 742849 - DNA, 25 bp, Mus musculus
gttttggctaattcctattgcctag

SEQ ID NO: 742850 - DNA, 25 bp, Mus musculus
gttttggctacaacttggagtcccc

SEQ ID NO: 742851 - DNA, 25 bp, Mus musculus
gttttggctacatcttggagtcccc

SEQ ID NO: 742852 - DNA, 25 bp, Mus musculus
gttttggctgcactatcaataagat

SEQ ID NO: 742853 - DNA, 25 bp, Mus musculus
gttttggctgcagtatcaataagat

SEQ ID NO: 742854 - DNA, 25 bp, Mus musculus
gttttggctgccctgcacttaagaa

SEQ ID NO: 742855 - DNA, 25 bp, Mus musculus
gttttggctgccgtgcacttaagaa

SEQ ID NO: 742856 - DNA, 25 bp, Mus musculus
gttttggcttggaaggtagctctaa

SEQ ID NO: 742857 - DNA, 25 bp, Mus musculus
gttttggcttggtaggtagctctaa

SEQ ID NO: 742858 - DNA, 25 bp, Mus musculus
gttttgggactcactcgcttataaa

SEQ ID NO: 742859 - DNA, 25 bp, Mus musculus
gttttgggactctctcgcttataaa

SEQ ID NO: 742860 - DNA, 25 bp, Mus musculus
gttttgggattacgaccactgtctg

SEQ ID NO: 742861 - DNA, 25 bp, Mus musculus
gttttgggattaggaccactgtctg

SEQ ID NO: 742862 - DNA, 25 bp, Mus musculus
gttttgggcctcattatggtcattt

SEQ ID NO: 742863 - DNA, 25 bp, Mus musculus
gttttgggcctctttatggtcattt

SEQ ID NO: 742864 - DNA, 25 bp, Mus musculus
gttttgggctagattcatttttgct

SEQ ID NO: 742865 - DNA, 25 bp, Mus musculus
gttttgggctagtttcatttttgct

SEQ ID NO: 742866 - DNA, 25 bp, Mus musculus
gttttgggcttaccatgtaactaat

SEQ ID NO: 742867 - DNA, 25 bp, Mus musculus
gttttgggcttagcatgtaactaat

SEQ ID NO: 742868 - DNA, 25 bp, Mus musculus
gttttgggtacaagacgcagcagtt

SEQ ID NO: 742869 - DNA, 25 bp, Mus musculus
gttttgggtacatgacgcagcagtt

SEQ ID NO: 742870 - DNA, 25 bp, Mus musculus
gttttggtactaaggcaacttcctc

SEQ ID NO: 742871 - DNA, 25 bp, Mus musculus
gttttggtactatggcaacttcctc

SEQ ID NO: 742872 - DNA, 25 bp, Mus musculus
gttttggtattgacggctttcacca

SEQ ID NO: 742873 - DNA, 25 bp, Mus musculus
gttttggtattgtcggctttcacca

SEQ ID NO: 742874 - DNA, 25 bp, Mus musculus
gttttggtccagaactaacatctat

SEQ ID NO: 742875 - DNA, 25 bp, Mus musculus
gttttggtccagtactaacatctat

SEQ ID NO: 742876 - DNA, 25 bp, Mus musculus
gttttggtctgtaacccacatgttc

SEQ ID NO: 742877 - DNA, 25 bp, Mus musculus
gttttggtctgttacccacatgttc

SEQ ID NO: 742878 - DNA, 25 bp, Mus musculus
gttttggtgaacagtctgtctgaca

SEQ ID NO: 742879 - DNA, 25 bp, Mus musculus
gttttggtgaacatctaggtcctta

SEQ ID NO: 742880 - DNA, 25 bp, Mus musculus
gttttggtgaactgtctgtctgaca

SEQ ID NO: 742881 - DNA, 25 bp, Mus musculus
gttttggtgaacttctaggtcctta

SEQ ID NO: 742882 - DNA, 25 bp, Mus musculus
gttttggtgtatcaagctctagatt

SEQ ID NO: 742883 - DNA, 25 bp, Mus musculus
gttttggtgtatgaagctctagatt

SEQ ID NO: 742884 - DNA, 25 bp, Mus musculus
gttttggtgtctccatccgggtctc

SEQ ID NO: 742885 - DNA, 25 bp, Mus musculus
gttttggtgtctgcatccgggtctc

SEQ ID NO: 742886 - DNA, 25 bp, Mus musculus
gttttggttccactgggtcaggatt

SEQ ID NO: 742887 - DNA, 25 bp, Mus musculus
gttttggttccagtgggtcaggatt

SEQ ID NO: 742888 - DNA, 25 bp, Mus musculus
gttttggtttaaattgaatctcgtg

SEQ ID NO: 742889 - DNA, 25 bp, Mus musculus
gttttggtttaatttgaatctcgtg

SEQ ID NO: 742890 - DNA, 25 bp, Mus musculus
gttttgtaaacacaattccagctaa

SEQ ID NO: 742891 - DNA, 25 bp, Mus musculus
gttttgtaaacagaattccagctaa

SEQ ID NO: 742892 - DNA, 25 bp, Mus musculus
gttttgtaagcaactggactgtcac

SEQ ID NO: 742893 - DNA, 25 bp, Mus musculus
gttttgtaagcaccgatctagtttc

SEQ ID NO: 742894 - DNA, 25 bp, Mus musculus
gttttgtaagcagcgatctagtttc

SEQ ID NO: 742895 - DNA, 25 bp, Mus musculus
gttttgtaagcatctggactgtcac

SEQ ID NO: 742896 - DNA, 25 bp, Mus musculus
gttttgtacaccattcccagagtat

SEQ ID NO: 742897 - DNA, 25 bp, Mus musculus
gttttgtacacctttcccagagtat

SEQ ID NO: 742898 - DNA, 25 bp, Mus musculus
gttttgtacactactgttacaagtg

SEQ ID NO: 742899 - DNA, 25 bp, Mus musculus
gttttgtacacttctgttacaagtg

SEQ ID NO: 742900 - DNA, 25 bp, Mus musculus
gttttgtacagcaaagtgttttcta

SEQ ID NO: 742901 - DNA, 25 bp, Mus musculus
gttttgtacagctaagtgttttcta

SEQ ID NO: 742902 - DNA, 25 bp, Mus musculus
gttttgtaccctatccataaatcat

SEQ ID NO: 742903 - DNA, 25 bp, Mus musculus
gttttgtaccctttccataaatcat

SEQ ID NO: 742904 - DNA, 25 bp, Mus musculus
gttttgtactcaaaactttgggaga

SEQ ID NO: 742905 - DNA, 25 bp, Mus musculus
gttttgtactcataactttgggaga

SEQ ID NO: 742906 - DNA, 25 bp, Mus musculus
gttttgtacttaagttccacaacag

SEQ ID NO: 742907 - DNA, 25 bp, Mus musculus
gttttgtacttatgttccacaacag

SEQ ID NO: 742908 - DNA, 25 bp, Mus musculus
gttttgtacttcatctttgggactg

SEQ ID NO: 742909 - DNA, 25 bp, Mus musculus
gttttgtacttcttctttgggactg

SEQ ID NO: 742910 - DNA, 25 bp, Mus musculus
gttttgtagcttagggtgacgctct

SEQ ID NO: 742911 - DNA, 25 bp, Mus musculus
gttttgtagctttgggtgacgctct

SEQ ID NO: 742912 - DNA, 25 bp, Mus musculus
gttttgtagtctctagcttttccga

SEQ ID NO: 742913 - DNA, 25 bp, Mus musculus
gttttgtagtctgtagcttttccga

SEQ ID NO: 742914 - DNA, 25 bp, Mus musculus
gttttgtatcagatcttttctttgt

SEQ ID NO: 742915 - DNA, 25 bp, Mus musculus
gttttgtatcagttcttttctttgt

SEQ ID NO: 742916 - DNA, 25 bp, Mus musculus
gttttgtatgtgctccctcatttta

SEQ ID NO: 742917 - DNA, 25 bp, Mus musculus
gttttgtatgtggtccctcatttta

SEQ ID NO: 742918 - DNA, 25 bp, Mus musculus
gttttgtattacaatgctaaccggg

SEQ ID NO: 742919 - DNA, 25 bp, Mus musculus
gttttgtattactatgctaaccggg

SEQ ID NO: 742920 - DNA, 25 bp, Mus musculus
gttttgtattcccacaaagagtata

SEQ ID NO: 742921 - DNA, 25 bp, Mus musculus
gttttgtattccgacaaagagtata

SEQ ID NO: 742922 - DNA, 25 bp, Mus musculus
gttttgtatttcacctctttcagta

SEQ ID NO: 742923 - DNA, 25 bp, Mus musculus
gttttgtatttctcctctttcagta

SEQ ID NO: 742924 - DNA, 25 bp, Mus musculus
gttttgtatttgactcagactagct

SEQ ID NO: 742925 - DNA, 25 bp, Mus musculus
gttttgtatttgtctcagactagct

SEQ ID NO: 742926 - DNA, 25 bp, Mus musculus
gttttgtcaacgaccgcatgttcct

SEQ ID NO: 742927 - DNA, 25 bp, Mus musculus
gttttgtcaacgtccgcatgttcct

SEQ ID NO: 742928 - DNA, 25 bp, Mus musculus
gttttgtcaactagtaactgggtca

SEQ ID NO: 742929 - DNA, 25 bp, Mus musculus
gttttgtcaacttgtaactgggtca

SEQ ID NO: 742930 - DNA, 25 bp, Mus musculus
gttttgtcagttatatctttaagct

SEQ ID NO: 742931 - DNA, 25 bp, Mus musculus
gttttgtcagttttatctttaagct

SEQ ID NO: 742932 - DNA, 25 bp, Mus musculus
gttttgtccagaccaatgtcccagg

SEQ ID NO: 742933 - DNA, 25 bp, Mus musculus
gttttgtccagagcaatgtcccagg

SEQ ID NO: 742934 - DNA, 25 bp, Mus musculus
gttttgtccagtcaaagctggtcat

SEQ ID NO: 742935 - DNA, 25 bp, Mus musculus
gttttgtccagtgaaagctggtcat

SEQ ID NO: 742936 - DNA, 25 bp, Mus musculus
gttttgtcccaaagatactcaactc

SEQ ID NO: 742937 - DNA, 25 bp, Mus musculus
gttttgtcccaaagtttactgtgct

SEQ ID NO: 742938 - DNA, 25 bp, Mus musculus
gttttgtcccaatgatactcaactc

SEQ ID NO: 742939 - DNA, 25 bp, Mus musculus
gttttgtcccaatgtttactgtgct

SEQ ID NO: 742940 - DNA, 25 bp, Mus musculus
gttttgtccgtcactgtttctaaga

SEQ ID NO: 742941 - DNA, 25 bp, Mus musculus
gttttgtccgtctctgtttctaaga

SEQ ID NO: 742942 - DNA, 25 bp, Mus musculus
gttttgtcctcaagtaagtctgtgt

SEQ ID NO: 742943 - DNA, 25 bp, Mus musculus
gttttgtcctcatgtaagtctgtgt

SEQ ID NO: 742944 - DNA, 25 bp, Mus musculus
gttttgtctatcaccccattttctt

SEQ ID NO: 742945 - DNA, 25 bp, Mus musculus
gttttgtctatctccccattttctt

SEQ ID NO: 742946 - DNA, 25 bp, Mus musculus
gttttgtctctccttctgatatttg

SEQ ID NO: 742947 - DNA, 25 bp, Mus musculus
gttttgtctctcgttctgatatttg

SEQ ID NO: 742948 - DNA, 25 bp, Mus musculus
gttttgtctctgagcatccccagct

SEQ ID NO: 742949 - DNA, 25 bp, Mus musculus
gttttgtctctgcatttctgtggaa

SEQ ID NO: 742950 - DNA, 25 bp, Mus musculus
gttttgtctctggatttctgtggaa

SEQ ID NO: 742951 - DNA, 25 bp, Mus musculus
gttttgtctctgtgcatccccagct

SEQ ID NO: 742952 - DNA, 25 bp, Mus musculus
gttttgtctgagattctatcctggt

SEQ ID NO: 742953 - DNA, 25 bp, Mus musculus
gttttgtctgagtttctatcctggt

SEQ ID NO: 742954 - DNA, 25 bp, Mus musculus
gttttgtctgcccactgataggaga

SEQ ID NO: 742955 - DNA, 25 bp, Mus musculus
gttttgtctgccgactgataggaga

SEQ ID NO: 742956 - DNA, 25 bp, Mus musculus
gttttgtctggcaactttggataag

SEQ ID NO: 742957 - DNA, 25 bp, Mus musculus
gttttgtctggcatacctcgctata

SEQ ID NO: 742958 - DNA, 25 bp, Mus musculus
gttttgtctggctactttggataag

SEQ ID NO: 742959 - DNA, 25 bp, Mus musculus
gttttgtctggcttacctcgctata

SEQ ID NO: 742960 - DNA, 25 bp, Mus musculus
gttttgtctgtcctccttatgacat

SEQ ID NO: 742961 - DNA, 25 bp, Mus musculus
gttttgtctgtcgtccttatgacat

SEQ ID NO: 742962 - DNA, 25 bp, Mus musculus
gttttgtcttccaaccaagtttgat

SEQ ID NO: 742963 - DNA, 25 bp, Mus musculus
gttttgtcttcctaccaagtttgat

SEQ ID NO: 742964 - DNA, 25 bp, Mus musculus
gttttgtcttttccagggttctgga

SEQ ID NO: 742965 - DNA, 25 bp, Mus musculus
gttttgtcttttgcagggttctgga

SEQ ID NO: 742966 - DNA, 25 bp, Mus musculus
gttttgtgaactagtatttctttct

SEQ ID NO: 742967 - DNA, 25 bp, Mus musculus
gttttgtgaacttgtatttctttct

SEQ ID NO: 742968 - DNA, 25 bp, Mus musculus
gttttgtgaagacctgtagaagcta

SEQ ID NO: 742969 - DNA, 25 bp, Mus musculus
gttttgtgaagagctgtagaagcta

SEQ ID NO: 742970 - DNA, 25 bp, Mus musculus
gttttgtgaaggcaatgcgggcaca

SEQ ID NO: 742971 - DNA, 25 bp, Mus musculus
gttttgtgaagggaatgcgggcaca

SEQ ID NO: 742972 - DNA, 25 bp, Mus musculus
gttttgtgacacacagttattttca

SEQ ID NO: 742973 - DNA, 25 bp, Mus musculus
gttttgtgacactcagttattttca

SEQ ID NO: 742974 - DNA, 25 bp, Mus musculus
gttttgtgacagaggcagaccctat

SEQ ID NO: 742975 - DNA, 25 bp, Mus musculus
gttttgtgacagtggcagaccctat

SEQ ID NO: 742976 - DNA, 25 bp, Mus musculus
gttttgtgacatacggtaccgtggt

SEQ ID NO: 742977 - DNA, 25 bp, Mus musculus
gttttgtgacattcggtaccgtggt

SEQ ID NO: 742978 - DNA, 25 bp, Mus musculus
gttttgtgatccattcacttcttct

SEQ ID NO: 742979 - DNA, 25 bp, Mus musculus
gttttgtgatcctttcacttcttct

SEQ ID NO: 742980 - DNA, 25 bp, Mus musculus
gttttgtgatttcactctgtacagt

SEQ ID NO: 742981 - DNA, 25 bp, Mus musculus
gttttgtgatttgactctgtacagt

SEQ ID NO: 742982 - DNA, 25 bp, Mus musculus
gttttgtgcaacaccatctgttttt

SEQ ID NO: 742983 - DNA, 25 bp, Mus musculus
gttttgtgcaactccatctgttttt

SEQ ID NO: 742984 - DNA, 25 bp, Mus musculus
gttttgtgcagcagttaacctactt

SEQ ID NO: 742985 - DNA, 25 bp, Mus musculus
gttttgtgcagctgttaacctactt

SEQ ID NO: 742986 - DNA, 25 bp, Mus musculus
gttttgtgcatgaccttttaacctt

SEQ ID NO: 742987 - DNA, 25 bp, Mus musculus
gttttgtgcatgtccttttaacctt

SEQ ID NO: 742988 - DNA, 25 bp, Mus musculus
gttttgtgccatatgtaagcattat

SEQ ID NO: 742989 - DNA, 25 bp, Mus musculus
gttttgtgccatttgtaagcattat

SEQ ID NO: 742990 - DNA, 25 bp, Mus musculus
gttttgtgcctcaaagttcggttgg

SEQ ID NO: 742991 - DNA, 25 bp, Mus musculus
gttttgtgcctctaagttcggttgg

SEQ ID NO: 742992 - DNA, 25 bp, Mus musculus
gttttgtgccttaatgtacttgcct

SEQ ID NO: 742993 - DNA, 25 bp, Mus musculus
gttttgtgcctttatgtacttgcct

SEQ ID NO: 742994 - DNA, 25 bp, Mus musculus
gttttgtgcgagaataacatccgga

SEQ ID NO: 742995 - DNA, 25 bp, Mus musculus
gttttgtgcgagtataacatccgga

SEQ ID NO: 742996 - DNA, 25 bp, Mus musculus
gttttgtgctgtattagagttcctt

SEQ ID NO: 742997 - DNA, 25 bp, Mus musculus
gttttgtgctgttttagagttcctt

SEQ ID NO: 742998 - DNA, 25 bp, Mus musculus
gttttgtgcttcagactgtcttttt

SEQ ID NO: 742999 - DNA, 25 bp, Mus musculus
gttttgtgcttctgactgtcttttt

SEQ ID NO: 743000 - DNA, 25 bp, Mus musculus
gttttgtggaacacgcggctggcta

SEQ ID NO: 743001 - DNA, 25 bp, Mus musculus
gttttgtggaactcgcggctggcta

SEQ ID NO: 743002 - DNA, 25 bp, Mus musculus
gttttgtggctcctgctaacagaat

SEQ ID NO: 743003 - DNA, 25 bp, Mus musculus
gttttgtggctcgtgctaacagaat

SEQ ID NO: 743004 - DNA, 25 bp, Mus musculus
gttttgtgggccaatgcatgttcaa

SEQ ID NO: 743005 - DNA, 25 bp, Mus musculus
gttttgtgggcctatgcatgttcaa

SEQ ID NO: 743006 - DNA, 25 bp, Mus musculus
gttttgtgtactcccattgcttgat

SEQ ID NO: 743007 - DNA, 25 bp, Mus musculus
gttttgtgtactgccattgcttgat

SEQ ID NO: 743008 - DNA, 25 bp, Mus musculus
gttttgtgtagtaacttggcatctg

SEQ ID NO: 743009 - DNA, 25 bp, Mus musculus
gttttgtgtagttacttggcatctg

SEQ ID NO: 743010 - DNA, 25 bp, Mus musculus
gttttgtgtcacatgattcctgtgg

SEQ ID NO: 743011 - DNA, 25 bp, Mus musculus
gttttgtgtcacttgattcctgtgg

SEQ ID NO: 743012 - DNA, 25 bp, Mus musculus
gttttgtgtcagagctttagcattt

SEQ ID NO: 743013 - DNA, 25 bp, Mus musculus
gttttgtgtcagtgctttagcattt

SEQ ID NO: 743014 - DNA, 25 bp, Mus musculus
gttttgtgtgatacagttcctctaa

SEQ ID NO: 743015 - DNA, 25 bp, Mus musculus
gttttgtgtgattcagttcctctaa

SEQ ID NO: 743016 - DNA, 25 bp, Mus musculus
gttttgtgtgtgaagctgagtttgc

SEQ ID NO: 743017 - DNA, 25 bp, Mus musculus
gttttgtgtgtgacttgatcattta

SEQ ID NO: 743018 - DNA, 25 bp, Mus musculus
gttttgtgtgtgtagctgagtttgc

SEQ ID NO: 743019 - DNA, 25 bp, Mus musculus
gttttgtgtgtgtcttgatcattta

SEQ ID NO: 743020 - DNA, 25 bp, Mus musculus
gttttgtgttagcagcggaaaaaat

SEQ ID NO: 743021 - DNA, 25 bp, Mus musculus
gttttgtgttaggagcggaaaaaat

SEQ ID NO: 743022 - DNA, 25 bp, Mus musculus
gttttgtgttcaagtgatcctcctg

SEQ ID NO: 743023 - DNA, 25 bp, Mus musculus
gttttgtgttcatgtgatcctcctg

SEQ ID NO: 743024 - DNA, 25 bp, Mus musculus
gttttgttaagcatgggctcctaag

SEQ ID NO: 743025 - DNA, 25 bp, Mus musculus
gttttgttaagcttgggctcctaag

SEQ ID NO: 743026 - DNA, 25 bp, Mus musculus
gttttgttaccacacttccttggca

SEQ ID NO: 743027 - DNA, 25 bp, Mus musculus
gttttgttaccagacttccttggca

SEQ ID NO: 743028 - DNA, 25 bp, Mus musculus
gttttgttatgtacattcgagatgt

SEQ ID NO: 743029 - DNA, 25 bp, Mus musculus
gttttgttatgttcattcgagatgt

SEQ ID NO: 743030 - DNA, 25 bp, Mus musculus
gttttgttcaataacatagccatca

SEQ ID NO: 743031 - DNA, 25 bp, Mus musculus
gttttgttcaattacatagccatca

SEQ ID NO: 743032 - DNA, 25 bp, Mus musculus
gttttgttcactaatttgtccaata

SEQ ID NO: 743033 - DNA, 25 bp, Mus musculus
gttttgttcactcagccaagttcat

SEQ ID NO: 743034 - DNA, 25 bp, Mus musculus
gttttgttcactgagccaagttcat

SEQ ID NO: 743035 - DNA, 25 bp, Mus musculus
gttttgttcacttatttgtccaata

SEQ ID NO: 743036 - DNA, 25 bp, Mus musculus
gttttgttcataaagctatctgtgg

SEQ ID NO: 743037 - DNA, 25 bp, Mus musculus
gttttgttcatatagctatctgtgg

SEQ ID NO: 743038 - DNA, 25 bp, Mus musculus
gttttgttcatgaaaagctgtgttc

SEQ ID NO: 743039 - DNA, 25 bp, Mus musculus
gttttgttcatgtaaagctgtgttc

SEQ ID NO: 743040 - DNA, 25 bp, Mus musculus
gttttgttccttcgatcgaaacaga

SEQ ID NO: 743041 - DNA, 25 bp, Mus musculus
gttttgttccttggatcgaaacaga

SEQ ID NO: 743042 - DNA, 25 bp, Mus musculus
gttttgttctccatcaagtactaga

SEQ ID NO: 743043 - DNA, 25 bp, Mus musculus
gttttgttctccttcaagtactaga

SEQ ID NO: 743044 - DNA, 25 bp, Mus musculus
gttttgttctttacattgcactgag

SEQ ID NO: 743045 - DNA, 25 bp, Mus musculus
gttttgttcttttcattgcactgag

SEQ ID NO: 743046 - DNA, 25 bp, Mus musculus
gttttgttgaaccttatggccgtca

SEQ ID NO: 743047 - DNA, 25 bp, Mus musculus
gttttgttgaacgttatggccgtca

SEQ ID NO: 743048 - DNA, 25 bp, Mus musculus
gttttgttgaagaagctgctcccct

SEQ ID NO: 743049 - DNA, 25 bp, Mus musculus
gttttgttgaagtagctgctcccct

SEQ ID NO: 743050 - DNA, 25 bp, Mus musculus
gttttgttggacacctttttgctag

SEQ ID NO: 743051 - DNA, 25 bp, Mus musculus
gttttgttggactcctttttgctag

SEQ ID NO: 743052 - DNA, 25 bp, Mus musculus
gttttgttggcaagtcaagctccag

SEQ ID NO: 743053 - DNA, 25 bp, Mus musculus
gttttgttggcatgtcaagctccag

SEQ ID NO: 743054 - DNA, 25 bp, Mus musculus
gttttgttggccatgcgagtgcttc

SEQ ID NO: 743055 - DNA, 25 bp, Mus musculus
gttttgttggccttgcgagtgcttc

SEQ ID NO: 743056 - DNA, 25 bp, Mus musculus
gttttgttgtagagtgctgcttagc

SEQ ID NO: 743057 - DNA, 25 bp, Mus musculus
gttttgttgtagtgtgctgcttagc

SEQ ID NO: 743058 - DNA, 25 bp, Mus musculus
gttttgtttaagacaggctggcctt

SEQ ID NO: 743059 - DNA, 25 bp, Mus musculus
gttttgtttaagtcaggctggcctt

SEQ ID NO: 743060 - DNA, 25 bp, Mus musculus
gttttgtttatacctgagcgcttct

SEQ ID NO: 743061 - DNA, 25 bp, Mus musculus
gttttgtttatagctgagcgcttct

SEQ ID NO: 743062 - DNA, 25 bp, Mus musculus
gttttgtttattcccacaactcaag

SEQ ID NO: 743063 - DNA, 25 bp, Mus musculus
gttttgtttattgccacaactcaag

SEQ ID NO: 743064 - DNA, 25 bp, Mus musculus
gttttgtttccactgcataaagacc

SEQ ID NO: 743065 - DNA, 25 bp, Mus musculus
gttttgtttccagtgcataaagacc

SEQ ID NO: 743066 - DNA, 25 bp, Mus musculus
gttttgtttctaagcagcctgttgc

SEQ ID NO: 743067 - DNA, 25 bp, Mus musculus
gttttgtttctatgcagcctgttgc

SEQ ID NO: 743068 - DNA, 25 bp, Mus musculus
gttttgtttctgattgtttcactgg

SEQ ID NO: 743069 - DNA, 25 bp, Mus musculus
gttttgtttctgtttgtttcactgg

SEQ ID NO: 743070 - DNA, 25 bp, Mus musculus
gttttgtttgatcgacagactttca

SEQ ID NO: 743071 - DNA, 25 bp, Mus musculus
gttttgtttgatggacagactttca

SEQ ID NO: 743072 - DNA, 25 bp, Mus musculus
gttttgtttgctaggcggtgtgccc

SEQ ID NO: 743073 - DNA, 25 bp, Mus musculus
gttttgtttgcttggcggtgtgccc

SEQ ID NO: 743074 - DNA, 25 bp, Mus musculus
gttttgtttggcatgaaatccttga

SEQ ID NO: 743075 - DNA, 25 bp, Mus musculus
gttttgtttggcttgaaatccttga

SEQ ID NO: 743076 - DNA, 25 bp, Mus musculus
gttttgtttgtcaatctgcagatat

SEQ ID NO: 743077 - DNA, 25 bp, Mus musculus
gttttgtttgtctatctgcagatat

SEQ ID NO: 743078 - DNA, 25 bp, Mus musculus
gttttgttttcaatatcagcccctt

SEQ ID NO: 743079 - DNA, 25 bp, Mus musculus
gttttgttttcattatcagcccctt

SEQ ID NO: 743080 - DNA, 25 bp, Mus musculus
gttttgttttggagccattatctag

SEQ ID NO: 743081 - DNA, 25 bp, Mus musculus
gttttgttttggtgccattatctag

SEQ ID NO: 743082 - DNA, 25 bp, Mus musculus
gttttgtttttgcttatggccaagt

SEQ ID NO: 743083 - DNA, 25 bp, Mus musculus
gttttgtttttggttatggccaagt

SEQ ID NO: 743084 - DNA, 25 bp, Mus musculus
gtttttaaatagcaaccatgtggct

SEQ ID NO: 743085 - DNA, 25 bp, Mus musculus
gtttttaaataggaaccatgtggct

SEQ ID NO: 743086 - DNA, 25 bp, Mus musculus
gtttttaaatgactggttgggatag

SEQ ID NO: 743087 - DNA, 25 bp, Mus musculus
gtttttaaatgagtggttgggatag

SEQ ID NO: 743088 - DNA, 25 bp, Mus musculus
gtttttaaatgcaagaccccaggct

SEQ ID NO: 743089 - DNA, 25 bp, Mus musculus
gtttttaaatgctagaccccaggct

SEQ ID NO: 743090 - DNA, 25 bp, Mus musculus
gtttttaacaatagcctcatcgagg

SEQ ID NO: 743091 - DNA, 25 bp, Mus musculus
gtttttaacaattgcctcatcgagg

SEQ ID NO: 743092 - DNA, 25 bp, Mus musculus
gtttttaacacaacttctgtctagt

SEQ ID NO: 743093 - DNA, 25 bp, Mus musculus
gtttttaacacatcttctgtctagt

SEQ ID NO: 743094 - DNA, 25 bp, Mus musculus
gtttttaacaccagattctcactga

SEQ ID NO: 743095 - DNA, 25 bp, Mus musculus
gtttttaacacctgattctcactga

SEQ ID NO: 743096 - DNA, 25 bp, Mus musculus
gtttttaacgatcacatgtgtgcat

SEQ ID NO: 743097 - DNA, 25 bp, Mus musculus
gtttttaacgatgacatgtgtgcat

SEQ ID NO: 743098 - DNA, 25 bp, Mus musculus
gtttttaactctcaacatgttctct

SEQ ID NO: 743099 - DNA, 25 bp, Mus musculus
gtttttaactctgaacatgttctct

SEQ ID NO: 743100 - DNA, 25 bp, Mus musculus
gtttttaagtatctcactcggctag

SEQ ID NO: 743101 - DNA, 25 bp, Mus musculus
gtttttaagtatgtcactcggctag

SEQ ID NO: 743102 - DNA, 25 bp, Mus musculus
gtttttaatctgcacagagtccaga

SEQ ID NO: 743103 - DNA, 25 bp, Mus musculus
gtttttaatctggacagagtccaga

SEQ ID NO: 743104 - DNA, 25 bp, Mus musculus
gtttttaatgaactctgctttttat

SEQ ID NO: 743105 - DNA, 25 bp, Mus musculus
gtttttaatgaagtctgctttttat

SEQ ID NO: 743106 - DNA, 25 bp, Mus musculus
gtttttaatggacgcactttggaga

SEQ ID NO: 743107 - DNA, 25 bp, Mus musculus
gtttttaatggaggcactttggaga

SEQ ID NO: 743108 - DNA, 25 bp, Mus musculus
gtttttaatgtgctgcaacctacac

SEQ ID NO: 743109 - DNA, 25 bp, Mus musculus
gtttttaatgtggtgcaacctacac

SEQ ID NO: 743110 - DNA, 25 bp, Mus musculus
gtttttaattataccacaggctgag

SEQ ID NO: 743111 - DNA, 25 bp, Mus musculus
gtttttaattattccacaggctgag

SEQ ID NO: 743112 - DNA, 25 bp, Mus musculus
gtttttacacagaacccaacaagct

SEQ ID NO: 743113 - DNA, 25 bp, Mus musculus
gtttttacacagtacccaacaagct

SEQ ID NO: 743114 - DNA, 25 bp, Mus musculus
gtttttacagaccagcataccagat

SEQ ID NO: 743115 - DNA, 25 bp, Mus musculus
gtttttacagacgagcataccagat

SEQ ID NO: 743116 - DNA, 25 bp, Mus musculus
gtttttacagcaccccgcagattta

SEQ ID NO: 743117 - DNA, 25 bp, Mus musculus
gtttttacagcagcccgcagattta

SEQ ID NO: 743118 - DNA, 25 bp, Mus musculus
gtttttacaggcctgtgcccaagaa

SEQ ID NO: 743119 - DNA, 25 bp, Mus musculus
gtttttacaggcgtgtgcccaagaa

SEQ ID NO: 743120 - DNA, 25 bp, Mus musculus
gtttttacatatatttgatcagtgc

SEQ ID NO: 743121 - DNA, 25 bp, Mus musculus
gtttttacatatttttgatcagtgc

SEQ ID NO: 743122 - DNA, 25 bp, Mus musculus
gtttttacatggcatatacttgcca

SEQ ID NO: 743123 - DNA, 25 bp, Mus musculus
gtttttacatgggatatacttgcca

SEQ ID NO: 743124 - DNA, 25 bp, Mus musculus
gtttttaccaagaccatgtgtgaat

SEQ ID NO: 743125 - DNA, 25 bp, Mus musculus
gtttttaccaagtccatgtgtgaat

SEQ ID NO: 743126 - DNA, 25 bp, Mus musculus
gtttttaccttcactttcacatcaa

SEQ ID NO: 743127 - DNA, 25 bp, Mus musculus
gtttttaccttctctttcacatcaa

SEQ ID NO: 743128 - DNA, 25 bp, Mus musculus
gtttttacgcctcaaaagacacgtg

SEQ ID NO: 743129 - DNA, 25 bp, Mus musculus
gtttttacgcctgaaaagacacgtg

SEQ ID NO: 743130 - DNA, 25 bp, Mus musculus
gtttttactactccactaactggcc

SEQ ID NO: 743131 - DNA, 25 bp, Mus musculus
gtttttactactgcactaactggcc

SEQ ID NO: 743132 - DNA, 25 bp, Mus musculus
gtttttactataatctgccaacata

SEQ ID NO: 743133 - DNA, 25 bp, Mus musculus
gtttttactatattctgccaacata

SEQ ID NO: 743134 - DNA, 25 bp, Mus musculus
gtttttactcctattttgcatttgt

SEQ ID NO: 743135 - DNA, 25 bp, Mus musculus
gtttttactccttttttgcatttgt

SEQ ID NO: 743136 - DNA, 25 bp, Mus musculus
gtttttactgaaatgcacaccggtg

SEQ ID NO: 743137 - DNA, 25 bp, Mus musculus
gtttttactgaattgcacaccggtg

SEQ ID NO: 743138 - DNA, 25 bp, Mus musculus
gtttttactggcatactcttgtgca

SEQ ID NO: 743139 - DNA, 25 bp, Mus musculus
gtttttactggcttactcttgtgca

SEQ ID NO: 743140 - DNA, 25 bp, Mus musculus
gtttttactgtgatcgttcatccta

SEQ ID NO: 743141 - DNA, 25 bp, Mus musculus
gtttttactgtgttcgttcatccta

SEQ ID NO: 743142 - DNA, 25 bp, Mus musculus
gtttttagagcaccctcaattacat

SEQ ID NO: 743143 - DNA, 25 bp, Mus musculus
gtttttagagcagcctcaattacat

SEQ ID NO: 743144 - DNA, 25 bp, Mus musculus
gtttttagccacactacattgatgc

SEQ ID NO: 743145 - DNA, 25 bp, Mus musculus
gtttttagccactctacattgatgc

SEQ ID NO: 743146 - DNA, 25 bp, Mus musculus
gtttttaggtaaacaggctgccact

SEQ ID NO: 743147 - DNA, 25 bp, Mus musculus
gtttttaggtaatcaggctgccact

SEQ ID NO: 743148 - DNA, 25 bp, Mus musculus
gtttttaggtatacagcaccccgat

SEQ ID NO: 743149 - DNA, 25 bp, Mus musculus
gtttttaggtattcagcaccccgat

SEQ ID NO: 743150 - DNA, 25 bp, Mus musculus
gtttttaggttcactgaattcttct

SEQ ID NO: 743151 - DNA, 25 bp, Mus musculus
gtttttaggttctctgaattcttct

SEQ ID NO: 743152 - DNA, 25 bp, Mus musculus
gtttttataactatggtgcgatcag

SEQ ID NO: 743153 - DNA, 25 bp, Mus musculus
gtttttataactttggtgcgatcag

SEQ ID NO: 743154 - DNA, 25 bp, Mus musculus
gtttttataagcactctctgagttc

SEQ ID NO: 743155 - DNA, 25 bp, Mus musculus
gtttttataagctctctctgagttc

SEQ ID NO: 743156 - DNA, 25 bp, Mus musculus
gtttttatacagatagacgcttcgt

SEQ ID NO: 743157 - DNA, 25 bp, Mus musculus
gtttttatacagttagacgcttcgt

SEQ ID NO: 743158 - DNA, 25 bp, Mus musculus
gtttttatactccacatactgcttg

SEQ ID NO: 743159 - DNA, 25 bp, Mus musculus
gtttttatactcgacatactgcttg

SEQ ID NO: 743160 - DNA, 25 bp, Mus musculus
gtttttatatgacacaatccttatt

SEQ ID NO: 743161 - DNA, 25 bp, Mus musculus
gtttttatatgagacaatccttatt

SEQ ID NO: 743162 - DNA, 25 bp, Mus musculus
gtttttatatgtcaccttcctagaa

SEQ ID NO: 743163 - DNA, 25 bp, Mus musculus
gtttttatatgtgaccttcctagaa

SEQ ID NO: 743164 - DNA, 25 bp, Mus musculus
gtttttatcacccacattcttctga

SEQ ID NO: 743165 - DNA, 25 bp, Mus musculus
gtttttatcaccgacattcttctga

SEQ ID NO: 743166 - DNA, 25 bp, Mus musculus
gtttttatcataactctcctgctag

SEQ ID NO: 743167 - DNA, 25 bp, Mus musculus
gtttttatcatatctctcctgctag

SEQ ID NO: 743168 - DNA, 25 bp, Mus musculus
gtttttatccaaaatgtttcatcca

SEQ ID NO: 743169 - DNA, 25 bp, Mus musculus
gtttttatccaatatgtttcatcca

SEQ ID NO: 743170 - DNA, 25 bp, Mus musculus
gtttttatcctcatttatccagcaa

SEQ ID NO: 743171 - DNA, 25 bp, Mus musculus
gtttttatcctcttttatccagcaa

SEQ ID NO: 743172 - DNA, 25 bp, Mus musculus
gtttttatcgtgaccgtgtaccata

SEQ ID NO: 743173 - DNA, 25 bp, Mus musculus
gtttttatcgtgtccgtgtaccata

SEQ ID NO: 743174 - DNA, 25 bp, Mus musculus
gtttttatcttgaccacactgtaca

SEQ ID NO: 743175 - DNA, 25 bp, Mus musculus
gtttttatcttgtccacactgtaca

SEQ ID NO: 743176 - DNA, 25 bp, Mus musculus
gtttttatgaataacactgaggttc

SEQ ID NO: 743177 - DNA, 25 bp, Mus musculus
gtttttatgaattacactgaggttc

SEQ ID NO: 743178 - DNA, 25 bp, Mus musculus
gtttttatgacaagcccattcctgg

SEQ ID NO: 743179 - DNA, 25 bp, Mus musculus
gtttttatgacatgcccattcctgg

SEQ ID NO: 743180 - DNA, 25 bp, Mus musculus
gtttttatgctgctgagtgaggtaa

SEQ ID NO: 743181 - DNA, 25 bp, Mus musculus
gtttttatgctggtgagtgaggtaa

SEQ ID NO: 743182 - DNA, 25 bp, Mus musculus
gtttttatgtttccaactctcctga

SEQ ID NO: 743183 - DNA, 25 bp, Mus musculus
gtttttatgtttgcaactctcctga

SEQ ID NO: 743184 - DNA, 25 bp, Mus musculus
gtttttattacaaacttctattgaa

SEQ ID NO: 743185 - DNA, 25 bp, Mus musculus
gtttttattacatacttctattgaa

SEQ ID NO: 743186 - DNA, 25 bp, Mus musculus
gtttttattgaaccaggtctgccca

SEQ ID NO: 743187 - DNA, 25 bp, Mus musculus
gtttttattgaagcaggtctgccca

SEQ ID NO: 743188 - DNA, 25 bp, Mus musculus
gtttttattgcaagctagtaacagt

SEQ ID NO: 743189 - DNA, 25 bp, Mus musculus
gtttttattgcatgctagtaacagt

SEQ ID NO: 743190 - DNA, 25 bp, Mus musculus
gtttttatttatcctgtaactcgtg

SEQ ID NO: 743191 - DNA, 25 bp, Mus musculus
gtttttatttatgctgtaactcgtg

SEQ ID NO: 743192 - DNA, 25 bp, Mus musculus
gtttttatttctaatgctcacctgg

SEQ ID NO: 743193 - DNA, 25 bp, Mus musculus
gtttttatttcttatgctcacctgg

SEQ ID NO: 743194 - DNA, 25 bp, Mus musculus
gtttttcaaaccagtccagtattca

SEQ ID NO: 743195 - DNA, 25 bp, Mus musculus
gtttttcaaacccagagcctgagta

SEQ ID NO: 743196 - DNA, 25 bp, Mus musculus
gtttttcaaaccgagagcctgagta

SEQ ID NO: 743197 - DNA, 25 bp, Mus musculus
gtttttcaaacctgtccagtattca

SEQ ID NO: 743198 - DNA, 25 bp, Mus musculus
gtttttcaacgcaatcaaagcaagc

SEQ ID NO: 743199 - DNA, 25 bp, Mus musculus
gtttttcaacgctatcaaagcaagc

SEQ ID NO: 743200 - DNA, 25 bp, Mus musculus
gtttttcaacttactctgatactaa

SEQ ID NO: 743201 - DNA, 25 bp, Mus musculus
gtttttcaactttctctgatactaa

SEQ ID NO: 743202 - DNA, 25 bp, Mus musculus
gtttttcaagtgctcattttctaaa

SEQ ID NO: 743203 - DNA, 25 bp, Mus musculus
gtttttcaagtggtcattttctaaa

SEQ ID NO: 743204 - DNA, 25 bp, Mus musculus
gtttttcaatgcatctgacccagag

SEQ ID NO: 743205 - DNA, 25 bp, Mus musculus
gtttttcaatgcttctgacccagag

SEQ ID NO: 743206 - DNA, 25 bp, Mus musculus
gtttttcacacaattcaggttgaca

SEQ ID NO: 743207 - DNA, 25 bp, Mus musculus
gtttttcacacatttcaggttgaca

SEQ ID NO: 743208 - DNA, 25 bp, Mus musculus
gtttttcacatcaaccagacgtatt

SEQ ID NO: 743209 - DNA, 25 bp, Mus musculus
gtttttcacatctaccagacgtatt

SEQ ID NO: 743210 - DNA, 25 bp, Mus musculus
gtttttcaccaccaagccgaatggg

SEQ ID NO: 743211 - DNA, 25 bp, Mus musculus
gtttttcaccacgaagccgaatggg

SEQ ID NO: 743212 - DNA, 25 bp, Mus musculus
gtttttcacccgagaaacattgtat

SEQ ID NO: 743213 - DNA, 25 bp, Mus musculus
gtttttcacccgtgaaacattgtat

SEQ ID NO: 743214 - DNA, 25 bp, Mus musculus
gtttttcacctgagaccaaataact

SEQ ID NO: 743215 - DNA, 25 bp, Mus musculus
gtttttcacctgtgaccaaataact

SEQ ID NO: 743216 - DNA, 25 bp, Mus musculus
gtttttcagaacaatggtggtgggt

SEQ ID NO: 743217 - DNA, 25 bp, Mus musculus
gtttttcagaactatggtggtgggt

SEQ ID NO: 743218 - DNA, 25 bp, Mus musculus
gtttttcagaggcacccgctgcagc

SEQ ID NO: 743219 - DNA, 25 bp, Mus musculus
gtttttcagagggacccgctgcagc

SEQ ID NO: 743220 - DNA, 25 bp, Mus musculus
gtttttcaggaccagaagcattcag

SEQ ID NO: 743221 - DNA, 25 bp, Mus musculus
gtttttcaggaccagtattcagaag

SEQ ID NO: 743222 - DNA, 25 bp, Mus musculus
gtttttcaggacgagaagcattcag

SEQ ID NO: 743223 - DNA, 25 bp, Mus musculus
gtttttcaggacgagtattcagaag

SEQ ID NO: 743224 - DNA, 25 bp, Mus musculus
gtttttcaggagaagacgccgatca

SEQ ID NO: 743225 - DNA, 25 bp, Mus musculus
gtttttcaggagtagacgccgatca

SEQ ID NO: 743226 - DNA, 25 bp, Mus musculus
gtttttcaggttaagagctcgggca

SEQ ID NO: 743227 - DNA, 25 bp, Mus musculus
gtttttcaggtttagagctcgggca

SEQ ID NO: 743228 - DNA, 25 bp, Mus musculus
gtttttcatatacttctcttctaat

SEQ ID NO: 743229 - DNA, 25 bp, Mus musculus
gtttttcatatagttctcttctaat

SEQ ID NO: 743230 - DNA, 25 bp, Mus musculus
gtttttcatcaacctttatgcacaa

SEQ ID NO: 743231 - DNA, 25 bp, Mus musculus
gtttttcatcaactctaaggccctt

SEQ ID NO: 743232 - DNA, 25 bp, Mus musculus
gtttttcatcaagctttatgcacaa

SEQ ID NO: 743233 - DNA, 25 bp, Mus musculus
gtttttcatcaagtctaaggccctt

SEQ ID NO: 743234 - DNA, 25 bp, Mus musculus
gtttttcatcacattgtgtttatac

SEQ ID NO: 743235 - DNA, 25 bp, Mus musculus
gtttttcatcactttgtgtttatac

SEQ ID NO: 743236 - DNA, 25 bp, Mus musculus
gtttttcattacaacactggagcaa

SEQ ID NO: 743237 - DNA, 25 bp, Mus musculus
gtttttcattactacactggagcaa

SEQ ID NO: 743238 - DNA, 25 bp, Mus musculus
gtttttcattctctaacacagagca

SEQ ID NO: 743239 - DNA, 25 bp, Mus musculus
gtttttcattctgtaacacagagca

SEQ ID NO: 743240 - DNA, 25 bp, Mus musculus
gtttttcattgtatgccctttatat

SEQ ID NO: 743241 - DNA, 25 bp, Mus musculus
gtttttcattgtctcacttgtgcat

SEQ ID NO: 743242 - DNA, 25 bp, Mus musculus
gtttttcattgtgtcacttgtgcat

SEQ ID NO: 743243 - DNA, 25 bp, Mus musculus
gtttttcattgtttgccctttatat

SEQ ID NO: 743244 - DNA, 25 bp, Mus musculus
gtttttcattttccagtcctgtcta

SEQ ID NO: 743245 - DNA, 25 bp, Mus musculus
gtttttcattttgcagtcctgtcta

SEQ ID NO: 743246 - DNA, 25 bp, Mus musculus
gtttttccaaagagcaaggtgcggc

SEQ ID NO: 743247 - DNA, 25 bp, Mus musculus
gtttttccaaagagttagcagctaa

SEQ ID NO: 743248 - DNA, 25 bp, Mus musculus
gtttttccaaagtgcaaggtgcggc

SEQ ID NO: 743249 - DNA, 25 bp, Mus musculus
gtttttccaaagtgttagcagctaa

SEQ ID NO: 743250 - DNA, 25 bp, Mus musculus
gtttttccaacaccaaatgacagag

SEQ ID NO: 743251 - DNA, 25 bp, Mus musculus
gtttttccaacagcaaatgacagag

SEQ ID NO: 743252 - DNA, 25 bp, Mus musculus
gtttttccaagacatggttactctg

SEQ ID NO: 743253 - DNA, 25 bp, Mus musculus
gtttttccaagagatggttactctg

SEQ ID NO: 743254 - DNA, 25 bp, Mus musculus
gtttttccaagtattcctctctatg

SEQ ID NO: 743255 - DNA, 25 bp, Mus musculus
gtttttccaagttttcctctctatg

SEQ ID NO: 743256 - DNA, 25 bp, Mus musculus
gtttttccactcctgaagagcacta

SEQ ID NO: 743257 - DNA, 25 bp, Mus musculus
gtttttccactcgtgaagagcacta

SEQ ID NO: 743258 - DNA, 25 bp, Mus musculus
gtttttccaggaattaccagcctca

SEQ ID NO: 743259 - DNA, 25 bp, Mus musculus
gtttttccaggatttaccagcctca

SEQ ID NO: 743260 - DNA, 25 bp, Mus musculus
gtttttccaggtccttaagtcctct

SEQ ID NO: 743261 - DNA, 25 bp, Mus musculus
gtttttccaggtgcttaagtcctct

SEQ ID NO: 743262 - DNA, 25 bp, Mus musculus
gtttttccagtaaagcgcagaacaa

SEQ ID NO: 743263 - DNA, 25 bp, Mus musculus
gtttttccagtatagcgcagaacaa

SEQ ID NO: 743264 - DNA, 25 bp, Mus musculus
gtttttccatatcatgattgttgcc

SEQ ID NO: 743265 - DNA, 25 bp, Mus musculus
gtttttccatatgatgattgttgcc

SEQ ID NO: 743266 - DNA, 25 bp, Mus musculus
gtttttcccatgatggttcttgcat

SEQ ID NO: 743267 - DNA, 25 bp, Mus musculus
gtttttcccatgttggttcttgcat

SEQ ID NO: 743268 - DNA, 25 bp, Mus musculus
gtttttcccttaaagacgcagagat

SEQ ID NO: 743269 - DNA, 25 bp, Mus musculus
gtttttcccttatagacgcagagat

SEQ ID NO: 743270 - DNA, 25 bp, Mus musculus
gtttttcccttgagttctcatcctg

SEQ ID NO: 743271 - DNA, 25 bp, Mus musculus
gtttttcccttgtgttctcatcctg

SEQ ID NO: 743272 - DNA, 25 bp, Mus musculus
gtttttccgttcagcatttctatgt

SEQ ID NO: 743273 - DNA, 25 bp, Mus musculus
gtttttccgttctgcatttctatgt

SEQ ID NO: 743274 - DNA, 25 bp, Mus musculus
gtttttcctaccacttgtatttcat

SEQ ID NO: 743275 - DNA, 25 bp, Mus musculus
gtttttcctacctcttgtatttcat

SEQ ID NO: 743276 - DNA, 25 bp, Mus musculus
gtttttcctctcctaagggcttgat

SEQ ID NO: 743277 - DNA, 25 bp, Mus musculus
gtttttcctctcgtaagggcttgat

SEQ ID NO: 743278 - DNA, 25 bp, Mus musculus
gtttttcctgaaaagtatgtgtaga

SEQ ID NO: 743279 - DNA, 25 bp, Mus musculus
gtttttcctgaatagtatgtgtaga

SEQ ID NO: 743280 - DNA, 25 bp, Mus musculus
gtttttcctgtaactagcttttgct

SEQ ID NO: 743281 - DNA, 25 bp, Mus musculus
gtttttcctgtactgtattcctgct

SEQ ID NO: 743282 - DNA, 25 bp, Mus musculus
gtttttcctgtagtgtattcctgct

SEQ ID NO: 743283 - DNA, 25 bp, Mus musculus
gtttttcctgtatctagcttttgct

SEQ ID NO: 743284 - DNA, 25 bp, Mus musculus
gtttttcctgttactgctgtgttct

SEQ ID NO: 743285 - DNA, 25 bp, Mus musculus
gtttttcctgtttctgctgtgttct

SEQ ID NO: 743286 - DNA, 25 bp, Mus musculus
gtttttccttagattcttctgctgt

SEQ ID NO: 743287 - DNA, 25 bp, Mus musculus
gtttttccttagtttcttctgctgt

SEQ ID NO: 743288 - DNA, 25 bp, Mus musculus
gtttttccttatagtagtgtcctgt

SEQ ID NO: 743289 - DNA, 25 bp, Mus musculus
gtttttccttattgtagtgtcctgt

SEQ ID NO: 743290 - DNA, 25 bp, Mus musculus
gtttttccttgaatgttaattgcaa

SEQ ID NO: 743291 - DNA, 25 bp, Mus musculus
gtttttccttgattgttaattgcaa

SEQ ID NO: 743292 - DNA, 25 bp, Mus musculus
gtttttccttgcactagatctttaa

SEQ ID NO: 743293 - DNA, 25 bp, Mus musculus
gtttttccttgctctagatctttaa

SEQ ID NO: 743294 - DNA, 25 bp, Mus musculus
gtttttcgcaatcttgatgctcagt

SEQ ID NO: 743295 - DNA, 25 bp, Mus musculus
gtttttcgcaatgttgatgctcagt

SEQ ID NO: 743296 - DNA, 25 bp, Mus musculus
gtttttcggcttatctgcctgtgtg

SEQ ID NO: 743297 - DNA, 25 bp, Mus musculus
gtttttcggcttttctgcctgtgtg

SEQ ID NO: 743298 - DNA, 25 bp, Mus musculus
gtttttcgtgtaatattgctggagg

SEQ ID NO: 743299 - DNA, 25 bp, Mus musculus
gtttttcgtgtattattgctggagg

SEQ ID NO: 743300 - DNA, 25 bp, Mus musculus
gtttttctaaaaaatgaccctatgg

SEQ ID NO: 743301 - DNA, 25 bp, Mus musculus
gtttttctaaaatatgaccctatgg

SEQ ID NO: 743302 - DNA, 25 bp, Mus musculus
gtttttctaaccatgctacttggag

SEQ ID NO: 743303 - DNA, 25 bp, Mus musculus
gtttttctaaccttgctacttggag

SEQ ID NO: 743304 - DNA, 25 bp, Mus musculus
gtttttctaagaatcgccctcgtat

SEQ ID NO: 743305 - DNA, 25 bp, Mus musculus
gtttttctaagattcgccctcgtat

SEQ ID NO: 743306 - DNA, 25 bp, Mus musculus
gtttttctaatcacctctgatcctt

SEQ ID NO: 743307 - DNA, 25 bp, Mus musculus
gtttttctaatcatacacctttgaa

SEQ ID NO: 743308 - DNA, 25 bp, Mus musculus
gtttttctaatctcctctgatcctt

SEQ ID NO: 743309 - DNA, 25 bp, Mus musculus
gtttttctaatcttacacctttgaa

SEQ ID NO: 743310 - DNA, 25 bp, Mus musculus
gtttttctaccaatgttggacctgg

SEQ ID NO: 743311 - DNA, 25 bp, Mus musculus
gtttttctaccattgttggacctgg

SEQ ID NO: 743312 - DNA, 25 bp, Mus musculus
gtttttctacctacagtgaccattg

SEQ ID NO: 743313 - DNA, 25 bp, Mus musculus
gtttttctaccttcagtgaccattg

SEQ ID NO: 743314 - DNA, 25 bp, Mus musculus
gtttttctacttcaatcgccttcta

SEQ ID NO: 743315 - DNA, 25 bp, Mus musculus
gtttttctacttgaatcgccttcta

SEQ ID NO: 743316 - DNA, 25 bp, Mus musculus
gtttttctagctactggacacactc

SEQ ID NO: 743317 - DNA, 25 bp, Mus musculus
gtttttctagctcacactgagatgg

SEQ ID NO: 743318 - DNA, 25 bp, Mus musculus
gtttttctagctgacactgagatgg

SEQ ID NO: 743319 - DNA, 25 bp, Mus musculus
gtttttctagcttctggacacactc

SEQ ID NO: 743320 - DNA, 25 bp, Mus musculus
gtttttctaggtaagctgaatgcca

SEQ ID NO: 743321 - DNA, 25 bp, Mus musculus
gtttttctaggttagctgaatgcca

SEQ ID NO: 743322 - DNA, 25 bp, Mus musculus
gtttttctagtgcttcttgatgtgt

SEQ ID NO: 743323 - DNA, 25 bp, Mus musculus
gtttttctagtggttcttgatgtgt

SEQ ID NO: 743324 - DNA, 25 bp, Mus musculus
gtttttctatagaacctcccagaat

SEQ ID NO: 743325 - DNA, 25 bp, Mus musculus
gtttttctatagtacctcccagaat

SEQ ID NO: 743326 - DNA, 25 bp, Mus musculus
gtttttctcaatatcaagtcagaag

SEQ ID NO: 743327 - DNA, 25 bp, Mus musculus
gtttttctcaatatccttggaactg

SEQ ID NO: 743328 - DNA, 25 bp, Mus musculus
gtttttctcaatttcaagtcagaag

SEQ ID NO: 743329 - DNA, 25 bp, Mus musculus
gtttttctcaatttccttggaactg

SEQ ID NO: 743330 - DNA, 25 bp, Mus musculus
gtttttctcctcagaagcttgtggt

SEQ ID NO: 743331 - DNA, 25 bp, Mus musculus
gtttttctcctctgaagcttgtggt

SEQ ID NO: 743332 - DNA, 25 bp, Mus musculus
gtttttctctctatatcgtgactac

SEQ ID NO: 743333 - DNA, 25 bp, Mus musculus
gtttttctctctttatcgtgactac

SEQ ID NO: 743334 - DNA, 25 bp, Mus musculus
gtttttctgaccatagatctgatga

SEQ ID NO: 743335 - DNA, 25 bp, Mus musculus
gtttttctgaccttagatctgatga

SEQ ID NO: 743336 - DNA, 25 bp, Mus musculus
gtttttctgagaccttttcctgaag

SEQ ID NO: 743337 - DNA, 25 bp, Mus musculus
gtttttctgagagcttttcctgaag

SEQ ID NO: 743338 - DNA, 25 bp, Mus musculus
gtttttctggatcttgcttgtttgt

SEQ ID NO: 743339 - DNA, 25 bp, Mus musculus
gtttttctggatgttgcttgtttgt

SEQ ID NO: 743340 - DNA, 25 bp, Mus musculus
gtttttctggttcaccgacagtcga

SEQ ID NO: 743341 - DNA, 25 bp, Mus musculus
gtttttctggttgaccgacagtcga

SEQ ID NO: 743342 - DNA, 25 bp, Mus musculus
gtttttctgtgaagtactgctttaa

SEQ ID NO: 743343 - DNA, 25 bp, Mus musculus
gtttttctgtgatgtactgctttaa

SEQ ID NO: 743344 - DNA, 25 bp, Mus musculus
gtttttctgttaacttgacacacac

SEQ ID NO: 743345 - DNA, 25 bp, Mus musculus
gtttttctgttatcttgacacacac

SEQ ID NO: 743346 - DNA, 25 bp, Mus musculus
gtttttctgttcaactgagtggttt

SEQ ID NO: 743347 - DNA, 25 bp, Mus musculus
gtttttctgttctactgagtggttt

SEQ ID NO: 743348 - DNA, 25 bp, Mus musculus
gtttttcttaatctctggatgtatt

SEQ ID NO: 743349 - DNA, 25 bp, Mus musculus
gtttttcttaatgtctggatgtatt

SEQ ID NO: 743350 - DNA, 25 bp, Mus musculus
gtttttcttaccaggtatacatcca

SEQ ID NO: 743351 - DNA, 25 bp, Mus musculus
gtttttcttacctggtatacatcca

SEQ ID NO: 743352 - DNA, 25 bp, Mus musculus
gtttttcttactcgttattccagca

SEQ ID NO: 743353 - DNA, 25 bp, Mus musculus
gtttttcttactggttattccagca

SEQ ID NO: 743354 - DNA, 25 bp, Mus musculus
gtttttcttagcatcatcttctttt

SEQ ID NO: 743355 - DNA, 25 bp, Mus musculus
gtttttcttagcttcatcttctttt

SEQ ID NO: 743356 - DNA, 25 bp, Mus musculus
gtttttcttattcatactgacagga

SEQ ID NO: 743357 - DNA, 25 bp, Mus musculus
gtttttcttattgatactgacagga

SEQ ID NO: 743358 - DNA, 25 bp, Mus musculus
gtttttcttcaactaccctagtgat

SEQ ID NO: 743359 - DNA, 25 bp, Mus musculus
gtttttcttcaagtaccctagtgat

SEQ ID NO: 743360 - DNA, 25 bp, Mus musculus
gtttttcttccaaggtcaggttcag

SEQ ID NO: 743361 - DNA, 25 bp, Mus musculus
gtttttcttccatggtcaggttcag

SEQ ID NO: 743362 - DNA, 25 bp, Mus musculus
gtttttcttcgcataacagattcac

SEQ ID NO: 743363 - DNA, 25 bp, Mus musculus
gtttttcttcgcttaacagattcac

SEQ ID NO: 743364 - DNA, 25 bp, Mus musculus
gtttttcttctaatgactctggttt

SEQ ID NO: 743365 - DNA, 25 bp, Mus musculus
gtttttcttctacaactagaccaag

SEQ ID NO: 743366 - DNA, 25 bp, Mus musculus
gtttttcttctagaactagaccaag

SEQ ID NO: 743367 - DNA, 25 bp, Mus musculus
gtttttcttctattgactctggttt

SEQ ID NO: 743368 - DNA, 25 bp, Mus musculus
gtttttcttcttcacctatggatct

SEQ ID NO: 743369 - DNA, 25 bp, Mus musculus
gtttttcttcttgacctatggatct

SEQ ID NO: 743370 - DNA, 25 bp, Mus musculus
gtttttcttggactcggtatcctca

SEQ ID NO: 743371 - DNA, 25 bp, Mus musculus
gtttttcttggagtcggtatcctca

SEQ ID NO: 743372 - DNA, 25 bp, Mus musculus
gtttttcttgtaacaagtgcacact

SEQ ID NO: 743373 - DNA, 25 bp, Mus musculus
gtttttcttgtatcaagtgcacact

SEQ ID NO: 743374 - DNA, 25 bp, Mus musculus
gtttttctttgtagtagcccggcat

SEQ ID NO: 743375 - DNA, 25 bp, Mus musculus
gtttttctttgttgtagcccggcat

SEQ ID NO: 743376 - DNA, 25 bp, Mus musculus
gtttttctttttatcaaatgacact

SEQ ID NO: 743377 - DNA, 25 bp, Mus musculus
gtttttctttttttcaaatgacact

SEQ ID NO: 743378 - DNA, 25 bp, Mus musculus
gtttttgaacaaatctgacaacttg

SEQ ID NO: 743379 - DNA, 25 bp, Mus musculus
gtttttgaacaattctgacaacttg

SEQ ID NO: 743380 - DNA, 25 bp, Mus musculus
gtttttgaacaccagggcttcaaag

SEQ ID NO: 743381 - DNA, 25 bp, Mus musculus
gtttttgaacacgagggcttcaaag

SEQ ID NO: 743382 - DNA, 25 bp, Mus musculus
gtttttgaaccacagaatacctcat

SEQ ID NO: 743383 - DNA, 25 bp, Mus musculus
gtttttgaaccagagaatacctcat

SEQ ID NO: 743384 - DNA, 25 bp, Mus musculus
gtttttgaacgaaaaccacttgtga

SEQ ID NO: 743385 - DNA, 25 bp, Mus musculus
gtttttgaacgataaccacttgtga

SEQ ID NO: 743386 - DNA, 25 bp, Mus musculus
gtttttgaagccctgattcaggatg

SEQ ID NO: 743387 - DNA, 25 bp, Mus musculus
gtttttgaagccgtgattcaggatg

SEQ ID NO: 743388 - DNA, 25 bp, Mus musculus
gtttttgacaacattctgccgtact

SEQ ID NO: 743389 - DNA, 25 bp, Mus musculus
gtttttgacaactttctgccgtact

SEQ ID NO: 743390 - DNA, 25 bp, Mus musculus
gtttttgacacaacacactatgcaa

SEQ ID NO: 743391 - DNA, 25 bp, Mus musculus
gtttttgacacatcacactatgcaa

SEQ ID NO: 743392 - DNA, 25 bp, Mus musculus
gtttttgacactctaccttttggat

SEQ ID NO: 743393 - DNA, 25 bp, Mus musculus
gtttttgacactgtaccttttggat

SEQ ID NO: 743394 - DNA, 25 bp, Mus musculus
gtttttgaccacagatgaccctaag

SEQ ID NO: 743395 - DNA, 25 bp, Mus musculus
gtttttgaccactgatgaccctaag

SEQ ID NO: 743396 - DNA, 25 bp, Mus musculus
gtttttgaccttaatttgccatttg

SEQ ID NO: 743397 - DNA, 25 bp, Mus musculus
gtttttgacctttatttgccatttg

SEQ ID NO: 743398 - DNA, 25 bp, Mus musculus
gtttttgagaaacggccctggcaca

SEQ ID NO: 743399 - DNA, 25 bp, Mus musculus
gtttttgagaaagggccctggcaca

SEQ ID NO: 743400 - DNA, 25 bp, Mus musculus
gtttttgagaacagtcattggtaaa

SEQ ID NO: 743401 - DNA, 25 bp, Mus musculus
gtttttgagaactgtcattggtaaa

SEQ ID NO: 743402 - DNA, 25 bp, Mus musculus
gtttttgagaatcctaccatggttc

SEQ ID NO: 743403 - DNA, 25 bp, Mus musculus
gtttttgagaatgctaccatggttc

SEQ ID NO: 743404 - DNA, 25 bp, Mus musculus
gtttttgagactctattccccagca

SEQ ID NO: 743405 - DNA, 25 bp, Mus musculus
gtttttgagactctattccctggca

SEQ ID NO: 743406 - DNA, 25 bp, Mus musculus
gtttttgagactgtattccccagca

SEQ ID NO: 743407 - DNA, 25 bp, Mus musculus
gtttttgagactgtattccctggca

SEQ ID NO: 743408 - DNA, 25 bp, Mus musculus
gtttttgagggcatatttgccatag

SEQ ID NO: 743409 - DNA, 25 bp, Mus musculus
gtttttgagggcttatttgccatag

SEQ ID NO: 743410 - DNA, 25 bp, Mus musculus
gtttttgagtcacgttgcttgcagc

SEQ ID NO: 743411 - DNA, 25 bp, Mus musculus
gtttttgagtcaggttgcttgcagc

SEQ ID NO: 743412 - DNA, 25 bp, Mus musculus
gtttttgagtttagtgtgcttgcct

SEQ ID NO: 743413 - DNA, 25 bp, Mus musculus
gtttttgagttttgtgtgcttgcct

SEQ ID NO: 743414 - DNA, 25 bp, Mus musculus
gtttttgatggacgagctattgaca

SEQ ID NO: 743415 - DNA, 25 bp, Mus musculus
gtttttgatggaggagctattgaca

SEQ ID NO: 743416 - DNA, 25 bp, Mus musculus
gtttttgattctcgcattttgtcca

SEQ ID NO: 743417 - DNA, 25 bp, Mus musculus
gtttttgattctggcattttgtcca

SEQ ID NO: 743418 - DNA, 25 bp, Mus musculus
gtttttgcaagtcggctgcattctc

SEQ ID NO: 743419 - DNA, 25 bp, Mus musculus
gtttttgcaagtgggctgcattctc

SEQ ID NO: 743420 - DNA, 25 bp, Mus musculus
gtttttgcacagctaaatgggattg

SEQ ID NO: 743421 - DNA, 25 bp, Mus musculus
gtttttgcacaggtaaatgggattg

SEQ ID NO: 743422 - DNA, 25 bp, Mus musculus
gtttttgcacataacttgtattttc

SEQ ID NO: 743423 - DNA, 25 bp, Mus musculus
gtttttgcacattacttgtattttc

SEQ ID NO: 743424 - DNA, 25 bp, Mus musculus
gtttttgcagatcacatttctttgt

SEQ ID NO: 743425 - DNA, 25 bp, Mus musculus
gtttttgcagatgacatttctttgt

SEQ ID NO: 743426 - DNA, 25 bp, Mus musculus
gtttttgcagttccgattgtcctgt

SEQ ID NO: 743427 - DNA, 25 bp, Mus musculus
gtttttgcagttgcgattgtcctgt

SEQ ID NO: 743428 - DNA, 25 bp, Mus musculus
gtttttgcatatctctgtacacctg

SEQ ID NO: 743429 - DNA, 25 bp, Mus musculus
gtttttgcatatgtctgtacacctg

SEQ ID NO: 743430 - DNA, 25 bp, Mus musculus
gtttttgcattgacctaaagtaaag

SEQ ID NO: 743431 - DNA, 25 bp, Mus musculus
gtttttgcattgtcctaaagtaaag

SEQ ID NO: 743432 - DNA, 25 bp, Mus musculus
gtttttgccaaacaatattgatggt

SEQ ID NO: 743433 - DNA, 25 bp, Mus musculus
gtttttgccaaagaatattgatggt

SEQ ID NO: 743434 - DNA, 25 bp, Mus musculus
gtttttgccaagatcagtgtttcct

SEQ ID NO: 743435 - DNA, 25 bp, Mus musculus
gtttttgccaagttcagtgtttcct

SEQ ID NO: 743436 - DNA, 25 bp, Mus musculus
gtttttgccattcaacatagtagta

SEQ ID NO: 743437 - DNA, 25 bp, Mus musculus
gtttttgccattgaacatagtagta

SEQ ID NO: 743438 - DNA, 25 bp, Mus musculus
gtttttgcctacagaaccatctttc

SEQ ID NO: 743439 - DNA, 25 bp, Mus musculus
gtttttgcctactgaaccatctttc

SEQ ID NO: 743440 - DNA, 25 bp, Mus musculus
gtttttgccttaaggcaggtcccaa

SEQ ID NO: 743441 - DNA, 25 bp, Mus musculus
gtttttgccttaccattatctgctt

SEQ ID NO: 743442 - DNA, 25 bp, Mus musculus
gtttttgccttagcattatctgctt

SEQ ID NO: 743443 - DNA, 25 bp, Mus musculus
gtttttgccttatggcaggtcccaa

SEQ ID NO: 743444 - DNA, 25 bp, Mus musculus
gtttttgccttcaaagaacgactgc

SEQ ID NO: 743445 - DNA, 25 bp, Mus musculus
gtttttgccttctaagaacgactgc

SEQ ID NO: 743446 - DNA, 25 bp, Mus musculus
gtttttgcgacaaacctttctcaag

SEQ ID NO: 743447 - DNA, 25 bp, Mus musculus
gtttttgcgacatacctttctcaag

SEQ ID NO: 743448 - DNA, 25 bp, Mus musculus
gtttttgcggaaccaactctgattc

SEQ ID NO: 743449 - DNA, 25 bp, Mus musculus
gtttttgcggaagcaactctgattc

SEQ ID NO: 743450 - DNA, 25 bp, Mus musculus
gtttttgcgggcagaagacaccaag

SEQ ID NO: 743451 - DNA, 25 bp, Mus musculus
gtttttgcgggctgaagacaccaag

SEQ ID NO: 743452 - DNA, 25 bp, Mus musculus
gtttttgcgtccactcaggagagca

SEQ ID NO: 743453 - DNA, 25 bp, Mus musculus
gtttttgcgtcctctcaggagagca

SEQ ID NO: 743454 - DNA, 25 bp, Mus musculus
gtttttgctacacattgaaggccac

SEQ ID NO: 743455 - DNA, 25 bp, Mus musculus
gtttttgctacagattgaaggccac

SEQ ID NO: 743456 - DNA, 25 bp, Mus musculus
gtttttgctgcccagtagagtttct

SEQ ID NO: 743457 - DNA, 25 bp, Mus musculus
gtttttgctgccgagtagagtttct

SEQ ID NO: 743458 - DNA, 25 bp, Mus musculus
gtttttgctggcacccccctcagtg

SEQ ID NO: 743459 - DNA, 25 bp, Mus musculus
gtttttgctggctcccccctcagtg

SEQ ID NO: 743460 - DNA, 25 bp, Mus musculus
gtttttgctgtgctgtctatttgag

SEQ ID NO: 743461 - DNA, 25 bp, Mus musculus
gtttttgctgtggtgtctatttgag

SEQ ID NO: 743462 - DNA, 25 bp, Mus musculus
gtttttgcttagagcttagcccatg

SEQ ID NO: 743463 - DNA, 25 bp, Mus musculus
gtttttgcttagtgcttagcccatg

SEQ ID NO: 743464 - DNA, 25 bp, Mus musculus
gtttttggaacacgcacactgcagc

SEQ ID NO: 743465 - DNA, 25 bp, Mus musculus
gtttttggaacaggcacactgcagc

SEQ ID NO: 743466 - DNA, 25 bp, Mus musculus
gtttttggaattcacttggagacaa

SEQ ID NO: 743467 - DNA, 25 bp, Mus musculus
gtttttggaattgacttggagacaa

SEQ ID NO: 743468 - DNA, 25 bp, Mus musculus
gtttttggaggtactgtttgcttgc

SEQ ID NO: 743469 - DNA, 25 bp, Mus musculus
gtttttggaggttctgtttgcttgc

SEQ ID NO: 743470 - DNA, 25 bp, Mus musculus
gtttttggcaagatactcacttcag

SEQ ID NO: 743471 - DNA, 25 bp, Mus musculus
gtttttggcaagttactcacttcag

SEQ ID NO: 743472 - DNA, 25 bp, Mus musculus
gtttttggccctcggaggtctcaag

SEQ ID NO: 743473 - DNA, 25 bp, Mus musculus
gtttttggccctgggaggtctcaag

SEQ ID NO: 743474 - DNA, 25 bp, Mus musculus
gtttttgggaccagcagaaatcttt

SEQ ID NO: 743475 - DNA, 25 bp, Mus musculus
gtttttgggacctgcagaaatcttt

SEQ ID NO: 743476 - DNA, 25 bp, Mus musculus
gtttttgggtttcattgcactacat

SEQ ID NO: 743477 - DNA, 25 bp, Mus musculus
gtttttgggtttgattgcactacat

SEQ ID NO: 743478 - DNA, 25 bp, Mus musculus
gtttttggtacacagtctcagtacc

SEQ ID NO: 743479 - DNA, 25 bp, Mus musculus
gtttttggtacagagtctcagtacc

SEQ ID NO: 743480 - DNA, 25 bp, Mus musculus
gtttttggtctaacaagctatggaa

SEQ ID NO: 743481 - DNA, 25 bp, Mus musculus
gtttttggtctatcaagctatggaa

SEQ ID NO: 743482 - DNA, 25 bp, Mus musculus
gtttttggtgtaattctgatttgta

SEQ ID NO: 743483 - DNA, 25 bp, Mus musculus
gtttttggtgtatttctgatttgta

SEQ ID NO: 743484 - DNA, 25 bp, Mus musculus
gtttttggtgtgattatgtctgtat

SEQ ID NO: 743485 - DNA, 25 bp, Mus musculus
gtttttggtgtgtttatgtctgtat

SEQ ID NO: 743486 - DNA, 25 bp, Mus musculus
gtttttggttgtctattttgctcaa

SEQ ID NO: 743487 - DNA, 25 bp, Mus musculus
gtttttggttgtgtattttgctcaa

SEQ ID NO: 743488 - DNA, 25 bp, Mus musculus
gtttttgtaataaggcacctggtca

SEQ ID NO: 743489 - DNA, 25 bp, Mus musculus
gtttttgtaatatggcacctggtca

SEQ ID NO: 743490 - DNA, 25 bp, Mus musculus
gtttttgtacacctgtgctgatggt

SEQ ID NO: 743491 - DNA, 25 bp, Mus musculus
gtttttgtacacgtgtgctgatggt

SEQ ID NO: 743492 - DNA, 25 bp, Mus musculus
gtttttgtagagcaaataattcgtt

SEQ ID NO: 743493 - DNA, 25 bp, Mus musculus
gtttttgtagaggaaataattcgtt

SEQ ID NO: 743494 - DNA, 25 bp, Mus musculus
gtttttgtatagcagcccaggcagg

SEQ ID NO: 743495 - DNA, 25 bp, Mus musculus
gtttttgtataggagcccaggcagg

SEQ ID NO: 743496 - DNA, 25 bp, Mus musculus
gtttttgtatctaatctctgactat

SEQ ID NO: 743497 - DNA, 25 bp, Mus musculus
gtttttgtatcttatctctgactat

SEQ ID NO: 743498 - DNA, 25 bp, Mus musculus
gtttttgtatgtccggttctgtaga

SEQ ID NO: 743499 - DNA, 25 bp, Mus musculus
gtttttgtatgtcttcagatagcgt

SEQ ID NO: 743500 - DNA, 25 bp, Mus musculus
gtttttgtatgtgcggttctgtaga

SEQ ID NO: 743501 - DNA, 25 bp, Mus musculus
gtttttgtatgtgttcagatagcgt

SEQ ID NO: 743502 - DNA, 25 bp, Mus musculus
gtttttgtcatcatttcgtcattgt

SEQ ID NO: 743503 - DNA, 25 bp, Mus musculus
gtttttgtcatcttttcgtcattgt

SEQ ID NO: 743504 - DNA, 25 bp, Mus musculus
gtttttgtctatcccatgggactca

SEQ ID NO: 743505 - DNA, 25 bp, Mus musculus
gtttttgtctatgccatgggactca

SEQ ID NO: 743506 - DNA, 25 bp, Mus musculus
gtttttgtcttgagtgtgggttatt

SEQ ID NO: 743507 - DNA, 25 bp, Mus musculus
gtttttgtcttgtgtgtgggttatt

SEQ ID NO: 743508 - DNA, 25 bp, Mus musculus
gtttttgtgcttcacttcagaatct

SEQ ID NO: 743509 - DNA, 25 bp, Mus musculus
gtttttgtgcttgacttcagaatct

SEQ ID NO: 743510 - DNA, 25 bp, Mus musculus
gtttttgttcagatgtaatgcctca

SEQ ID NO: 743511 - DNA, 25 bp, Mus musculus
gtttttgttcagttgtaatgcctca

SEQ ID NO: 743512 - DNA, 25 bp, Mus musculus
gtttttgttcgtatgagcaggctct

SEQ ID NO: 743513 - DNA, 25 bp, Mus musculus
gtttttgttcgtttgagcaggctct

SEQ ID NO: 743514 - DNA, 25 bp, Mus musculus
gtttttgttctactgctggattaag

SEQ ID NO: 743515 - DNA, 25 bp, Mus musculus
gtttttgttctagtgctggattaag

SEQ ID NO: 743516 - DNA, 25 bp, Mus musculus
gtttttgttcttacatatcacccag

SEQ ID NO: 743517 - DNA, 25 bp, Mus musculus
gtttttgttctttcatatcacccag

SEQ ID NO: 743518 - DNA, 25 bp, Mus musculus
gtttttgttggtactgctctttggc

SEQ ID NO: 743519 - DNA, 25 bp, Mus musculus
gtttttgttggttctgctctttggc

SEQ ID NO: 743520 - DNA, 25 bp, Mus musculus
gtttttgtttaaagaccacagagat

SEQ ID NO: 743521 - DNA, 25 bp, Mus musculus
gtttttgtttaatgaccacagagat

SEQ ID NO: 743522 - DNA, 25 bp, Mus musculus
gtttttgtttcaatagcgatacaga

SEQ ID NO: 743523 - DNA, 25 bp, Mus musculus
gtttttgtttcattagcgatacaga

SEQ ID NO: 743524 - DNA, 25 bp, Mus musculus
gtttttgtttctcgacttcgtcaca

SEQ ID NO: 743525 - DNA, 25 bp, Mus musculus
gtttttgtttctcgtcaagcatgtc

SEQ ID NO: 743526 - DNA, 25 bp, Mus musculus
gtttttgtttctggacttcgtcaca

SEQ ID NO: 743527 - DNA, 25 bp, Mus musculus
gtttttgtttctggtcaagcatgtc

SEQ ID NO: 743528 - DNA, 25 bp, Mus musculus
gtttttgtttgccatgctacatgct

SEQ ID NO: 743529 - DNA, 25 bp, Mus musculus
gtttttgtttgcgatgctacatgct

SEQ ID NO: 743530 - DNA, 25 bp, Mus musculus
gtttttgttttactctgccaagctt

SEQ ID NO: 743531 - DNA, 25 bp, Mus musculus
gtttttgttttagtctgccaagctt

SEQ ID NO: 743532 - DNA, 25 bp, Mus musculus
gtttttgttttcagccgactcttgg

SEQ ID NO: 743533 - DNA, 25 bp, Mus musculus
gtttttgttttctgccgactcttgg

SEQ ID NO: 743534 - DNA, 25 bp, Mus musculus
gttttttaaacaatacctggcactg

SEQ ID NO: 743535 - DNA, 25 bp, Mus musculus
gttttttaaacattacctggcactg

SEQ ID NO: 743536 - DNA, 25 bp, Mus musculus
gttttttaaatcatcccacagcatg

SEQ ID NO: 743537 - DNA, 25 bp, Mus musculus
gttttttaaatcttcccacagcatg

SEQ ID NO: 743538 - DNA, 25 bp, Mus musculus
gttttttaacatcagagcccttagt

SEQ ID NO: 743539 - DNA, 25 bp, Mus musculus
gttttttaacatcttgtctcctatg

SEQ ID NO: 743540 - DNA, 25 bp, Mus musculus
gttttttaacatgagagcccttagt

SEQ ID NO: 743541 - DNA, 25 bp, Mus musculus
gttttttaacatgttgtctcctatg

SEQ ID NO: 743542 - DNA, 25 bp, Mus musculus
gttttttacatcattacttcagcaa

SEQ ID NO: 743543 - DNA, 25 bp, Mus musculus
gttttttacatctttacttcagcaa

SEQ ID NO: 743544 - DNA, 25 bp, Mus musculus
gttttttaccataatctgaagatgt

SEQ ID NO: 743545 - DNA, 25 bp, Mus musculus
gttttttaccattatctgaagatgt

SEQ ID NO: 743546 - DNA, 25 bp, Mus musculus
gttttttactatctctgactgtcag

SEQ ID NO: 743547 - DNA, 25 bp, Mus musculus
gttttttactatgtctgactgtcag

SEQ ID NO: 743548 - DNA, 25 bp, Mus musculus
gttttttagagtctgtgaggccgcc

SEQ ID NO: 743549 - DNA, 25 bp, Mus musculus
gttttttagagtgtgtgaggccgcc

SEQ ID NO: 743550 - DNA, 25 bp, Mus musculus
gttttttagcagcagaatgtttttc

SEQ ID NO: 743551 - DNA, 25 bp, Mus musculus
gttttttagcaggagaatgtttttc

SEQ ID NO: 743552 - DNA, 25 bp, Mus musculus
gttttttagcatactctgtgagaca

SEQ ID NO: 743553 - DNA, 25 bp, Mus musculus
gttttttagcattctctgtgagaca

SEQ ID NO: 743554 - DNA, 25 bp, Mus musculus
gttttttagcctcgagttaatcata

SEQ ID NO: 743555 - DNA, 25 bp, Mus musculus
gttttttagcctggagttaatcata

SEQ ID NO: 743556 - DNA, 25 bp, Mus musculus
gttttttagtggacatctcctacaa

SEQ ID NO: 743557 - DNA, 25 bp, Mus musculus
gttttttagtggtcatctcctacaa

SEQ ID NO: 743558 - DNA, 25 bp, Mus musculus
gttttttataccctgcactgtttga

SEQ ID NO: 743559 - DNA, 25 bp, Mus musculus
gttttttataccgtgcactgtttga

SEQ ID NO: 743560 - DNA, 25 bp, Mus musculus
gttttttatgccaatagtaattact

SEQ ID NO: 743561 - DNA, 25 bp, Mus musculus
gttttttatgcctatagtaattact

SEQ ID NO: 743562 - DNA, 25 bp, Mus musculus
gttttttcaattctgtcccaatatg

SEQ ID NO: 743563 - DNA, 25 bp, Mus musculus
gttttttcaattgtgtcccaatatg

SEQ ID NO: 743564 - DNA, 25 bp, Mus musculus
gttttttcagccataatatggtgat

SEQ ID NO: 743565 - DNA, 25 bp, Mus musculus
gttttttcagccttaatatggtgat

SEQ ID NO: 743566 - DNA, 25 bp, Mus musculus
gttttttcagtacagaccggtcact

SEQ ID NO: 743567 - DNA, 25 bp, Mus musculus
gttttttcagtagagaccggtcact

SEQ ID NO: 743568 - DNA, 25 bp, Mus musculus
gttttttcatgaagatccatcccat

SEQ ID NO: 743569 - DNA, 25 bp, Mus musculus
gttttttcatgatgatccatcccat

SEQ ID NO: 743570 - DNA, 25 bp, Mus musculus
gttttttccaggcatgttttcatgt

SEQ ID NO: 743571 - DNA, 25 bp, Mus musculus
gttttttccagggatgttttcatgt

SEQ ID NO: 743572 - DNA, 25 bp, Mus musculus
gttttttcctaaatgctggcttgat

SEQ ID NO: 743573 - DNA, 25 bp, Mus musculus
gttttttcctaattgctggcttgat

SEQ ID NO: 743574 - DNA, 25 bp, Mus musculus
gttttttcctacctgacattgctgc

SEQ ID NO: 743575 - DNA, 25 bp, Mus musculus
gttttttcctacgtgacattgctgc

SEQ ID NO: 743576 - DNA, 25 bp, Mus musculus
gttttttcctccctatagattcatc

SEQ ID NO: 743577 - DNA, 25 bp, Mus musculus
gttttttcctccgtatagattcatc

SEQ ID NO: 743578 - DNA, 25 bp, Mus musculus
gttttttctaacatggcttcattaa

SEQ ID NO: 743579 - DNA, 25 bp, Mus musculus
gttttttctaacttggcttcattaa

SEQ ID NO: 743580 - DNA, 25 bp, Mus musculus
gttttttctagtactcttgtgtgct

SEQ ID NO: 743581 - DNA, 25 bp, Mus musculus
gttttttctagttctcttgtgtgct

SEQ ID NO: 743582 - DNA, 25 bp, Mus musculus
gttttttctcatcatcagccgagtg

SEQ ID NO: 743583 - DNA, 25 bp, Mus musculus
gttttttctcatctgcatgtaattg

SEQ ID NO: 743584 - DNA, 25 bp, Mus musculus
gttttttctcatgatcagccgagtg

SEQ ID NO: 743585 - DNA, 25 bp, Mus musculus
gttttttctcatgtgcatgtaattg

SEQ ID NO: 743586 - DNA, 25 bp, Mus musculus
gttttttctgcacagccttgcatct

SEQ ID NO: 743587 - DNA, 25 bp, Mus musculus
gttttttctgcagagccttgcatct

SEQ ID NO: 743588 - DNA, 25 bp, Mus musculus
gttttttcttaactctgctctgtgg

SEQ ID NO: 743589 - DNA, 25 bp, Mus musculus
gttttttcttaagtctgctctgtgg

SEQ ID NO: 743590 - DNA, 25 bp, Mus musculus
gttttttcttccataggtaaagcat

SEQ ID NO: 743591 - DNA, 25 bp, Mus musculus
gttttttcttccttaggtaaagcat

SEQ ID NO: 743592 - DNA, 25 bp, Mus musculus
gttttttcttgtagcccatctgtgc

SEQ ID NO: 743593 - DNA, 25 bp, Mus musculus
gttttttcttgttgcccatctgtgc

SEQ ID NO: 743594 - DNA, 25 bp, Mus musculus
gttttttgaaaccagcgccaaggat

SEQ ID NO: 743595 - DNA, 25 bp, Mus musculus
gttttttgaaacgagcgccaaggat

SEQ ID NO: 743596 - DNA, 25 bp, Mus musculus
gttttttgaacaactgtatgcgatc

SEQ ID NO: 743597 - DNA, 25 bp, Mus musculus
gttttttgaacatctgtatgcgatc

SEQ ID NO: 743598 - DNA, 25 bp, Mus musculus
gttttttgacatccagctgggtatt

SEQ ID NO: 743599 - DNA, 25 bp, Mus musculus
gttttttgacatgcagctgggtatt

SEQ ID NO: 743600 - DNA, 25 bp, Mus musculus
gttttttgaccacgtaaactgcatc

SEQ ID NO: 743601 - DNA, 25 bp, Mus musculus
gttttttgaccaggtaaactgcatc

SEQ ID NO: 743602 - DNA, 25 bp, Mus musculus
gttttttgatgacaatggctaccca

SEQ ID NO: 743603 - DNA, 25 bp, Mus musculus
gttttttgatgagaatggctaccca

SEQ ID NO: 743604 - DNA, 25 bp, Mus musculus
gttttttgcaacatgatgcaggcta

SEQ ID NO: 743605 - DNA, 25 bp, Mus musculus
gttttttgcaacttgatgcaggcta

SEQ ID NO: 743606 - DNA, 25 bp, Mus musculus
gttttttgcatactttgcatcttta

SEQ ID NO: 743607 - DNA, 25 bp, Mus musculus
gttttttgcatagtttgcatcttta

SEQ ID NO: 743608 - DNA, 25 bp, Mus musculus
gttttttgccacaaccagacatgta

SEQ ID NO: 743609 - DNA, 25 bp, Mus musculus
gttttttgccactaccagacatgta

SEQ ID NO: 743610 - DNA, 25 bp, Mus musculus
gttttttgccctagctcatgtgaaa

SEQ ID NO: 743611 - DNA, 25 bp, Mus musculus
gttttttgcccttgctcatgtgaaa

SEQ ID NO: 743612 - DNA, 25 bp, Mus musculus
gttttttgctgactgtttctgggaa

SEQ ID NO: 743613 - DNA, 25 bp, Mus musculus
gttttttgctgagtgtttctgggaa

SEQ ID NO: 743614 - DNA, 25 bp, Mus musculus
gttttttggcaaaagtgactcagtt

SEQ ID NO: 743615 - DNA, 25 bp, Mus musculus
gttttttggcaatagtgactcagtt

SEQ ID NO: 743616 - DNA, 25 bp, Mus musculus
gttttttggcatagcaaccatctct

SEQ ID NO: 743617 - DNA, 25 bp, Mus musculus
gttttttggcattgcaaccatctct

SEQ ID NO: 743618 - DNA, 25 bp, Mus musculus
gttttttggtctagtttcgttgcat

SEQ ID NO: 743619 - DNA, 25 bp, Mus musculus
gttttttggtcttgtttcgttgcat

SEQ ID NO: 743620 - DNA, 25 bp, Mus musculus
gttttttgttgtcgtcaatgtgatt

SEQ ID NO: 743621 - DNA, 25 bp, Mus musculus
gttttttgttgtggtcaatgtgatt

SEQ ID NO: 743622 - DNA, 25 bp, Mus musculus
taaaaaacaaagagaggccaggcat

SEQ ID NO: 743623 - DNA, 25 bp, Mus musculus
taaaaaacaaagtgaggccaggcat

SEQ ID NO: 743624 - DNA, 25 bp, Mus musculus
taaaaaacaccccacgatctcagag

SEQ ID NO: 743625 - DNA, 25 bp, Mus musculus
taaaaaacacccgacgatctcagag

SEQ ID NO: 743626 - DNA, 25 bp, Mus musculus
taaaaaaccaagcttgcctctaccg

SEQ ID NO: 743627 - DNA, 25 bp, Mus musculus
taaaaaaccaaggttgcctctaccg

SEQ ID NO: 743628 - DNA, 25 bp, Mus musculus
taaaaaacctccatcaaactgaatg

SEQ ID NO: 743629 - DNA, 25 bp, Mus musculus
taaaaaacctccttcaaactgaatg

SEQ ID NO: 743630 - DNA, 25 bp, Mus musculus
taaaaaacgctgctgtgctcgccta

SEQ ID NO: 743631 - DNA, 25 bp, Mus musculus
taaaaaacgctggtgtgctcgccta

SEQ ID NO: 743632 - DNA, 25 bp, Mus musculus
taaaaaactcacacgcaggtcttgc

SEQ ID NO: 743633 - DNA, 25 bp, Mus musculus
taaaaaactcactcgcaggtcttgc

SEQ ID NO: 743634 - DNA, 25 bp, Mus musculus
taaaaaactccaagagcctttgctc

SEQ ID NO: 743635 - DNA, 25 bp, Mus musculus
taaaaaactccatgagcctttgctc

SEQ ID NO: 743636 - DNA, 25 bp, Mus musculus
taaaaaagaatgaggctcagcagga

SEQ ID NO: 743637 - DNA, 25 bp, Mus musculus
taaaaaagaatgtggctcagcagga

SEQ ID NO: 743638 - DNA, 25 bp, Mus musculus
taaaaaagaccccagcagccaagaa

SEQ ID NO: 743639 - DNA, 25 bp, Mus musculus
taaaaaagacccgagcagccaagaa

SEQ ID NO: 743640 - DNA, 25 bp, Mus musculus
taaaaaagatccccagttgctagtc

SEQ ID NO: 743641 - DNA, 25 bp, Mus musculus
taaaaaagatccgcagttgctagtc

SEQ ID NO: 743642 - DNA, 25 bp, Mus musculus
taaaaaagcatcctgcgaggcttat

SEQ ID NO: 743643 - DNA, 25 bp, Mus musculus
taaaaaagcatcgtgcgaggcttat

SEQ ID NO: 743644 - DNA, 25 bp, Mus musculus
taaaaaagctggactactacctcct

SEQ ID NO: 743645 - DNA, 25 bp, Mus musculus
taaaaaagctggtctactacctcct

SEQ ID NO: 743646 - DNA, 25 bp, Mus musculus
taaaaaaggtacctctgagctcctc

SEQ ID NO: 743647 - DNA, 25 bp, Mus musculus
taaaaaaggtacgtctgagctcctc

SEQ ID NO: 743648 - DNA, 25 bp, Mus musculus
taaaaaagtgtgactgtgcttgcct

SEQ ID NO: 743649 - DNA, 25 bp, Mus musculus
taaaaaagtgtgtctgtgcttgcct

SEQ ID NO: 743650 - DNA, 25 bp, Mus musculus
taaaaaataatacgcgtgtgtgtgt

SEQ ID NO: 743651 - DNA, 25 bp, Mus musculus
taaaaaataataggcgtgtgtgtgt

SEQ ID NO: 743652 - DNA, 25 bp, Mus musculus
taaaaaataatcatccacaatgtag

SEQ ID NO: 743653 - DNA, 25 bp, Mus musculus
taaaaaataatcttccacaatgtag

SEQ ID NO: 743654 - DNA, 25 bp, Mus musculus
taaaaaatcaccatggttctaccat

SEQ ID NO: 743655 - DNA, 25 bp, Mus musculus
taaaaaatcaccttggttctaccat

SEQ ID NO: 743656 - DNA, 25 bp, Mus musculus
taaaaaatctccactctgcttctca

SEQ ID NO: 743657 - DNA, 25 bp, Mus musculus
taaaaaatctcctctctgcttctca

SEQ ID NO: 743658 - DNA, 25 bp, Mus musculus
taaaaaatggaaaatctctctctct

SEQ ID NO: 743659 - DNA, 25 bp, Mus musculus
taaaaaatggaatatctctctctct

SEQ ID NO: 743660 - DNA, 25 bp, Mus musculus
taaaaaatggctagttgcctctgga

SEQ ID NO: 743661 - DNA, 25 bp, Mus musculus
taaaaaatggcttgttgcctctgga

SEQ ID NO: 743662 - DNA, 25 bp, Mus musculus
taaaaaattccactttcctatgctt

SEQ ID NO: 743663 - DNA, 25 bp, Mus musculus
taaaaaattccagtttcctatgctt

SEQ ID NO: 743664 - DNA, 25 bp, Mus musculus
taaaaacaatcccactccatatgat

SEQ ID NO: 743665 - DNA, 25 bp, Mus musculus
taaaaacaatccgactccatatgat

SEQ ID NO: 743666 - DNA, 25 bp, Mus musculus
taaaaacacactacgaagctggaga

SEQ ID NO: 743667 - DNA, 25 bp, Mus musculus
taaaaacacacttcgaagctggaga

SEQ ID NO: 743668 - DNA, 25 bp, Mus musculus
taaaaacacttcaactcagcctcac

SEQ ID NO: 743669 - DNA, 25 bp, Mus musculus
taaaaacacttctactcagcctcac

SEQ ID NO: 743670 - DNA, 25 bp, Mus musculus
taaaaacagcatacatgggagactc

SEQ ID NO: 743671 - DNA, 25 bp, Mus musculus
taaaaacagcatcctcaccagaaag

SEQ ID NO: 743672 - DNA, 25 bp, Mus musculus
taaaaacagcatgctcaccagaaag

SEQ ID NO: 743673 - DNA, 25 bp, Mus musculus
taaaaacagcattcatgggagactc

SEQ ID NO: 743674 - DNA, 25 bp, Mus musculus
taaaaacagttaatggagccagcag

SEQ ID NO: 743675 - DNA, 25 bp, Mus musculus
taaaaacagttattggagccagcag

SEQ ID NO: 743676 - DNA, 25 bp, Mus musculus
taaaaacatcagaccacattcctag

SEQ ID NO: 743677 - DNA, 25 bp, Mus musculus
taaaaacatcagtccacattcctag

SEQ ID NO: 743678 - DNA, 25 bp, Mus musculus
taaaaacatcccaaactctcctaga

SEQ ID NO: 743679 - DNA, 25 bp, Mus musculus
taaaaacatccctaactctcctaga

SEQ ID NO: 743680 - DNA, 25 bp, Mus musculus
taaaaacatgttccgttgggccact

SEQ ID NO: 743681 - DNA, 25 bp, Mus musculus
taaaaacatgttgcgttgggccact

SEQ ID NO: 743682 - DNA, 25 bp, Mus musculus
taaaaaccacgtattgtcaagtcag

SEQ ID NO: 743683 - DNA, 25 bp, Mus musculus
taaaaaccacgttttgtcaagtcag

SEQ ID NO: 743684 - DNA, 25 bp, Mus musculus
taaaaaccatgacgtcggacatttt

SEQ ID NO: 743685 - DNA, 25 bp, Mus musculus
taaaaaccatgaggtcggacatttt

SEQ ID NO: 743686 - DNA, 25 bp, Mus musculus
taaaaacccagcccttagtggagca

SEQ ID NO: 743687 - DNA, 25 bp, Mus musculus
taaaaacccagcgcttagtggagca

SEQ ID NO: 743688 - DNA, 25 bp, Mus musculus
taaaaaccccagcatggacctgtgc

SEQ ID NO: 743689 - DNA, 25 bp, Mus musculus
taaaaaccccaggatggacctgtgc

SEQ ID NO: 743690 - DNA, 25 bp, Mus musculus
taaaaaccctgactcatgcacctct

SEQ ID NO: 743691 - DNA, 25 bp, Mus musculus
taaaaaccctgagtcatgcacctct

SEQ ID NO: 743692 - DNA, 25 bp, Mus musculus
taaaaaccgcttcctttttcgcctg

SEQ ID NO: 743693 - DNA, 25 bp, Mus musculus
taaaaaccgcttgctttttcgcctg

SEQ ID NO: 743694 - DNA, 25 bp, Mus musculus
taaaaacctaccattgcctagactg

SEQ ID NO: 743695 - DNA, 25 bp, Mus musculus
taaaaacctacctttgcctagactg

SEQ ID NO: 743696 - DNA, 25 bp, Mus musculus
taaaaacctcttagggctcttattg

SEQ ID NO: 743697 - DNA, 25 bp, Mus musculus
taaaaacctctttgggctcttattg

SEQ ID NO: 743698 - DNA, 25 bp, Mus musculus
taaaaacctgttagtaagctgcttt

SEQ ID NO: 743699 - DNA, 25 bp, Mus musculus
taaaaacctgtttgtaagctgcttt

SEQ ID NO: 743700 - DNA, 25 bp, Mus musculus
taaaaaccttgcattggccatcatg

SEQ ID NO: 743701 - DNA, 25 bp, Mus musculus
taaaaaccttgctttggccatcatg

SEQ ID NO: 743702 - DNA, 25 bp, Mus musculus
taaaaacgcaacagtttacgccact

SEQ ID NO: 743703 - DNA, 25 bp, Mus musculus
taaaaacgcaactgtttacgccact

SEQ ID NO: 743704 - DNA, 25 bp, Mus musculus
taaaaacgccgtcccttcaaatctg

SEQ ID NO: 743705 - DNA, 25 bp, Mus musculus
taaaaacgccgtgccttcaaatctg

SEQ ID NO: 743706 - DNA, 25 bp, Mus musculus
taaaaacgctgtcccatttgctgct

SEQ ID NO: 743707 - DNA, 25 bp, Mus musculus
taaaaacgctgtgccatttgctgct

SEQ ID NO: 743708 - DNA, 25 bp, Mus musculus
taaaaacgtcgtactggttgcttct

SEQ ID NO: 743709 - DNA, 25 bp, Mus musculus
taaaaacgtcgttctggttgcttct

SEQ ID NO: 743710 - DNA, 25 bp, Mus musculus
taaaaacgtcttagccgttagctag

SEQ ID NO: 743711 - DNA, 25 bp, Mus musculus
taaaaacgtctttgccgttagctag

SEQ ID NO: 743712 - DNA, 25 bp, Mus musculus
taaaaacgtttaatgccaggctgtg

SEQ ID NO: 743713 - DNA, 25 bp, Mus musculus
taaaaacgtttattgccaggctgtg

SEQ ID NO: 743714 - DNA, 25 bp, Mus musculus
taaaaactaagcattctagtacctg

SEQ ID NO: 743715 - DNA, 25 bp, Mus musculus
taaaaactaagctttctagtacctg

SEQ ID NO: 743716 - DNA, 25 bp, Mus musculus
taaaaactagatccagtccctccca

SEQ ID NO: 743717 - DNA, 25 bp, Mus musculus
taaaaactagatgcagtccctccca

SEQ ID NO: 743718 - DNA, 25 bp, Mus musculus
taaaaactcaaaacagctggctatt

SEQ ID NO: 743719 - DNA, 25 bp, Mus musculus
taaaaactcaaatcagctggctatt

SEQ ID NO: 743720 - DNA, 25 bp, Mus musculus
taaaaactccagagtggcaccgcaa

SEQ ID NO: 743721 - DNA, 25 bp, Mus musculus
taaaaactccagtgtggcaccgcaa

SEQ ID NO: 743722 - DNA, 25 bp, Mus musculus
taaaaactccttaatgtggtaccat

SEQ ID NO: 743723 - DNA, 25 bp, Mus musculus
taaaaactcctttatgtggtaccat

SEQ ID NO: 743724 - DNA, 25 bp, Mus musculus
taaaaactgaagaccctgagggccg

SEQ ID NO: 743725 - DNA, 25 bp, Mus musculus
taaaaactgaagtccctgagggccg

SEQ ID NO: 743726 - DNA, 25 bp, Mus musculus
taaaaactgaggatcaagccgggcg

SEQ ID NO: 743727 - DNA, 25 bp, Mus musculus
taaaaactgaggttcaagccgggcg

SEQ ID NO: 743728 - DNA, 25 bp, Mus musculus
taaaaactgctcatttaggacagga

SEQ ID NO: 743729 - DNA, 25 bp, Mus musculus
taaaaactgctcttttaggacagga

SEQ ID NO: 743730 - DNA, 25 bp, Mus musculus
taaaaactggctcaccacatgcctg

SEQ ID NO: 743731 - DNA, 25 bp, Mus musculus
taaaaactggctgaccacatgcctg

SEQ ID NO: 743732 - DNA, 25 bp, Mus musculus
taaaaactggtaaggactgtggtct

SEQ ID NO: 743733 - DNA, 25 bp, Mus musculus
taaaaactggtatggactgtggtct

SEQ ID NO: 743734 - DNA, 25 bp, Mus musculus
taaaaactgtctatcctctaggcaa

SEQ ID NO: 743735 - DNA, 25 bp, Mus musculus
taaaaactgtctttcctctaggcaa

SEQ ID NO: 743736 - DNA, 25 bp, Mus musculus
taaaaactgtttaccatcacctctg

SEQ ID NO: 743737 - DNA, 25 bp, Mus musculus
taaaaactgttttccatcacctctg

SEQ ID NO: 743738 - DNA, 25 bp, Mus musculus
taaaaacttcgccacgttgttccat

SEQ ID NO: 743739 - DNA, 25 bp, Mus musculus
taaaaacttcgcgacgttgttccat

SEQ ID NO: 743740 - DNA, 25 bp, Mus musculus
taaaaacttgtacagcctcaggagc

SEQ ID NO: 743741 - DNA, 25 bp, Mus musculus
taaaaacttgtagagcctcaggagc

SEQ ID NO: 743742 - DNA, 25 bp, Mus musculus
taaaaactttctctgctggctacta

SEQ ID NO: 743743 - DNA, 25 bp, Mus musculus
taaaaactttctgtgctggctacta

SEQ ID NO: 743744 - DNA, 25 bp, Mus musculus
taaaaagaagacctctcgccaaggg

SEQ ID NO: 743745 - DNA, 25 bp, Mus musculus
taaaaagaagacgtctcgccaaggg

SEQ ID NO: 743746 - DNA, 25 bp, Mus musculus
taaaaagacattaattcagagttct

SEQ ID NO: 743747 - DNA, 25 bp, Mus musculus
taaaaagacatttattcagagttct

SEQ ID NO: 743748 - DNA, 25 bp, Mus musculus
taaaaagaccatactcttcttcctg

SEQ ID NO: 743749 - DNA, 25 bp, Mus musculus
taaaaagaccattctcttcttcctg

SEQ ID NO: 743750 - DNA, 25 bp, Mus musculus
taaaaagaccccatacatcacacca

SEQ ID NO: 743751 - DNA, 25 bp, Mus musculus
taaaaagaccccttacatcacacca

SEQ ID NO: 743752 - DNA, 25 bp, Mus musculus
taaaaagagttgcacacatttcaaa

SEQ ID NO: 743753 - DNA, 25 bp, Mus musculus
taaaaagagttggacacatttcaaa

SEQ ID NO: 743754 - DNA, 25 bp, Mus musculus
taaaaagcactcaatgtcctcattc

SEQ ID NO: 743755 - DNA, 25 bp, Mus musculus
taaaaagcactctatgtcctcattc

SEQ ID NO: 743756 - DNA, 25 bp, Mus musculus
taaaaagcagaactacatttgtaga

SEQ ID NO: 743757 - DNA, 25 bp, Mus musculus
taaaaagcagaagtacatttgtaga

SEQ ID NO: 743758 - DNA, 25 bp, Mus musculus
taaaaagcatggaccctgcacccgt

SEQ ID NO: 743759 - DNA, 25 bp, Mus musculus
taaaaagcatggtccctgcacccgt

SEQ ID NO: 743760 - DNA, 25 bp, Mus musculus
taaaaagccaccatttaccttcctg

SEQ ID NO: 743761 - DNA, 25 bp, Mus musculus
taaaaagccaccttttaccttcctg

SEQ ID NO: 743762 - DNA, 25 bp, Mus musculus
taaaaagctcaccagccacttgttt

SEQ ID NO: 743763 - DNA, 25 bp, Mus musculus
taaaaagctcacgagccacttgttt

SEQ ID NO: 743764 - DNA, 25 bp, Mus musculus
taaaaagctcctctccttagttcct

SEQ ID NO: 743765 - DNA, 25 bp, Mus musculus
taaaaagctcctgtccttagttcct

SEQ ID NO: 743766 - DNA, 25 bp, Mus musculus
taaaaaggccgtcgacatgcgctcc

SEQ ID NO: 743767 - DNA, 25 bp, Mus musculus
taaaaaggccgtggacatgcgctcc

SEQ ID NO: 743768 - DNA, 25 bp, Mus musculus
taaaaaggttggaggcttttgcttg

SEQ ID NO: 743769 - DNA, 25 bp, Mus musculus
taaaaaggttggtggcttttgcttg

SEQ ID NO: 743770 - DNA, 25 bp, Mus musculus
taaaaagtcgtaaagccaggctggt

SEQ ID NO: 743771 - DNA, 25 bp, Mus musculus
taaaaagtcgtatagccaggctggt

SEQ ID NO: 743772 - DNA, 25 bp, Mus musculus
taaaaagttactcctcttcctaaag

SEQ ID NO: 743773 - DNA, 25 bp, Mus musculus
taaaaagttactgctcttcctaaag

SEQ ID NO: 743774 - DNA, 25 bp, Mus musculus
taaaaagttctcaaacctcaatgag

SEQ ID NO: 743775 - DNA, 25 bp, Mus musculus
taaaaagttctctaacctcaatgag

SEQ ID NO: 743776 - DNA, 25 bp, Mus musculus
taaaaagttgagcttgacagcagat

SEQ ID NO: 743777 - DNA, 25 bp, Mus musculus
taaaaagttgaggttgacagcagat

SEQ ID NO: 743778 - DNA, 25 bp, Mus musculus
taaaaataattgaccatgatcttct

SEQ ID NO: 743779 - DNA, 25 bp, Mus musculus
taaaaataattgtccatgatcttct

SEQ ID NO: 743780 - DNA, 25 bp, Mus musculus
taaaaatacctaattgctacttcca

SEQ ID NO: 743781 - DNA, 25 bp, Mus musculus
taaaaatacctatttgctacttcca

SEQ ID NO: 743782 - DNA, 25 bp, Mus musculus
taaaaatactccagtcacccaacca

SEQ ID NO: 743783 - DNA, 25 bp, Mus musculus
taaaaatactcctgtcacccaacca

SEQ ID NO: 743784 - DNA, 25 bp, Mus musculus
taaaaatactgtccttccttccagg

SEQ ID NO: 743785 - DNA, 25 bp, Mus musculus
taaaaatactgtgcttccttccagg

SEQ ID NO: 743786 - DNA, 25 bp, Mus musculus
taaaaatatgcaagcgatctgtctt

SEQ ID NO: 743787 - DNA, 25 bp, Mus musculus
taaaaatatgcatgcgatctgtctt

SEQ ID NO: 743788 - DNA, 25 bp, Mus musculus
taaaaatcaagtatctcccatcctt

SEQ ID NO: 743789 - DNA, 25 bp, Mus musculus
taaaaatcaagtttctcccatcctt

SEQ ID NO: 743790 - DNA, 25 bp, Mus musculus
taaaaatcacatcatagctgggcat

SEQ ID NO: 743791 - DNA, 25 bp, Mus musculus
taaaaatcacatgatagctgggcat

SEQ ID NO: 743792 - DNA, 25 bp, Mus musculus
taaaaatcagccattagatgttgaa

SEQ ID NO: 743793 - DNA, 25 bp, Mus musculus
taaaaatcagcctttagatgttgaa

SEQ ID NO: 743794 - DNA, 25 bp, Mus musculus
taaaaatcatctaacacggcaccca

SEQ ID NO: 743795 - DNA, 25 bp, Mus musculus
taaaaatcatcttacacggcaccca

SEQ ID NO: 743796 - DNA, 25 bp, Mus musculus
taaaaatcatgtcctccggatccgc

SEQ ID NO: 743797 - DNA, 25 bp, Mus musculus
taaaaatcatgtgctccggatccgc

SEQ ID NO: 743798 - DNA, 25 bp, Mus musculus
taaaaatcccctaatcatgctgctc

SEQ ID NO: 743799 - DNA, 25 bp, Mus musculus
taaaaatccccttatcatgctgctc

SEQ ID NO: 743800 - DNA, 25 bp, Mus musculus
taaaaatcccttcgaagcccagatt

SEQ ID NO: 743801 - DNA, 25 bp, Mus musculus
taaaaatcccttggaagcccagatt

SEQ ID NO: 743802 - DNA, 25 bp, Mus musculus
taaaaatcctctcgttctcatgccc

SEQ ID NO: 743803 - DNA, 25 bp, Mus musculus
taaaaatcctctggttctcatgccc

SEQ ID NO: 743804 - DNA, 25 bp, Mus musculus
taaaaatccttactttctgtggcca

SEQ ID NO: 743805 - DNA, 25 bp, Mus musculus
taaaaatccttagtttctgtggcca

SEQ ID NO: 743806 - DNA, 25 bp, Mus musculus
taaaaatccttcagcatcttggctg

SEQ ID NO: 743807 - DNA, 25 bp, Mus musculus
taaaaatccttctgcatcttggctg

SEQ ID NO: 743808 - DNA, 25 bp, Mus musculus
taaaaatccttgaatagtgacgtgt

SEQ ID NO: 743809 - DNA, 25 bp, Mus musculus
taaaaatccttgtatagtgacgtgt

SEQ ID NO: 743810 - DNA, 25 bp, Mus musculus
taaaaatcgcataatctcactttca

SEQ ID NO: 743811 - DNA, 25 bp, Mus musculus
taaaaatcgcattatctcactttca

SEQ ID NO: 743812 - DNA, 25 bp, Mus musculus
taaaaatctcatctagtccagactg

SEQ ID NO: 743813 - DNA, 25 bp, Mus musculus
taaaaatctcatgtagtccagactg

SEQ ID NO: 743814 - DNA, 25 bp, Mus musculus
taaaaatgacctattgctctttttt

SEQ ID NO: 743815 - DNA, 25 bp, Mus musculus
taaaaatgaccttttgctctttttt

SEQ ID NO: 743816 - DNA, 25 bp, Mus musculus
taaaaatgccacattctagaatttc

SEQ ID NO: 743817 - DNA, 25 bp, Mus musculus
taaaaatgccactttctagaatttc

SEQ ID NO: 743818 - DNA, 25 bp, Mus musculus
taaaaatgcctaaaaacccagatgg

SEQ ID NO: 743819 - DNA, 25 bp, Mus musculus
taaaaatgcctataaacccagatgg

SEQ ID NO: 743820 - DNA, 25 bp, Mus musculus
taaaaatggatgctctccacccaca

SEQ ID NO: 743821 - DNA, 25 bp, Mus musculus
taaaaatggatggtctccacccaca

SEQ ID NO: 743822 - DNA, 25 bp, Mus musculus
taaaaatggcccacggatcgtccct

SEQ ID NO: 743823 - DNA, 25 bp, Mus musculus
taaaaatggccctcggatcgtccct

SEQ ID NO: 743824 - DNA, 25 bp, Mus musculus
taaaaattccacacttaaagagcta

SEQ ID NO: 743825 - DNA, 25 bp, Mus musculus
taaaaattccactcttaaagagcta

SEQ ID NO: 743826 - DNA, 25 bp, Mus musculus
taaaaattcctaacggttagtcgtg

SEQ ID NO: 743827 - DNA, 25 bp, Mus musculus
taaaaattcctatcggttagtcgtg

SEQ ID NO: 743828 - DNA, 25 bp, Mus musculus
taaaaattcggtactccacctgtgc

SEQ ID NO: 743829 - DNA, 25 bp, Mus musculus
taaaaattcggttctccacctgtgc

SEQ ID NO: 743830 - DNA, 25 bp, Mus musculus
taaaaatttaataagctgccagcat

SEQ ID NO: 743831 - DNA, 25 bp, Mus musculus
taaaaatttaattagctgccagcat

SEQ ID NO: 743832 - DNA, 25 bp, Mus musculus
taaaacaactacctgaagcttttcg

SEQ ID NO: 743833 - DNA, 25 bp, Mus musculus
taaaacaactacgtgaagcttttcg

SEQ ID NO: 743834 - DNA, 25 bp, Mus musculus
taaaacaagcatcacttctgtaaca

SEQ ID NO: 743835 - DNA, 25 bp, Mus musculus
taaaacaagcatgacttctgtaaca

SEQ ID NO: 743836 - DNA, 25 bp, Mus musculus
taaaacaaggaactttcccatcagt

SEQ ID NO: 743837 - DNA, 25 bp, Mus musculus
taaaacaaggaagtttcccatcagt

SEQ ID NO: 743838 - DNA, 25 bp, Mus musculus
taaaacaaggatccagggtagacag

SEQ ID NO: 743839 - DNA, 25 bp, Mus musculus
taaaacaaggatgcagggtagacag

SEQ ID NO: 743840 - DNA, 25 bp, Mus musculus
taaaacaatccaactgtcccagcag

SEQ ID NO: 743841 - DNA, 25 bp, Mus musculus
taaaacaatccatctgtcccagcag

SEQ ID NO: 743842 - DNA, 25 bp, Mus musculus
taaaacaatgctaagactcccctac

SEQ ID NO: 743843 - DNA, 25 bp, Mus musculus
taaaacaatgcttagactcccctac

SEQ ID NO: 743844 - DNA, 25 bp, Mus musculus
taaaacaattctcagccctctatac

SEQ ID NO: 743845 - DNA, 25 bp, Mus musculus
taaaacaattctgagccctctatac

SEQ ID NO: 743846 - DNA, 25 bp, Mus musculus
taaaacacagctcactagtctcttc

SEQ ID NO: 743847 - DNA, 25 bp, Mus musculus
taaaacacagctgactagtctcttc

SEQ ID NO: 743848 - DNA, 25 bp, Mus musculus
taaaacacccttctctcggaataat

SEQ ID NO: 743849 - DNA, 25 bp, Mus musculus
taaaacacccttgtctcggaataat

SEQ ID NO: 743850 - DNA, 25 bp, Mus musculus
taaaacacctctaatgctgctgatc

SEQ ID NO: 743851 - DNA, 25 bp, Mus musculus
taaaacacctcttatgctgctgatc

SEQ ID NO: 743852 - DNA, 25 bp, Mus musculus
taaaacacgaatatgtttcaactga

SEQ ID NO: 743853 - DNA, 25 bp, Mus musculus
taaaacacgaatttgtttcaactga

SEQ ID NO: 743854 - DNA, 25 bp, Mus musculus
taaaacacgatactactgtccctct

SEQ ID NO: 743855 - DNA, 25 bp, Mus musculus
taaaacacgatagtactgtccctct

SEQ ID NO: 743856 - DNA, 25 bp, Mus musculus
taaaacacgcatccccaggaagcat

SEQ ID NO: 743857 - DNA, 25 bp, Mus musculus
taaaacacgcatgcccaggaagcat

SEQ ID NO: 743858 - DNA, 25 bp, Mus musculus
taaaacactcccattgtgtgctgtt

SEQ ID NO: 743859 - DNA, 25 bp, Mus musculus
taaaacactccctttgtgtgctgtt

SEQ ID NO: 743860 - DNA, 25 bp, Mus musculus
taaaacactgtccaatttaccttga

SEQ ID NO: 743861 - DNA, 25 bp, Mus musculus
taaaacactgtcgaatttaccttga

SEQ ID NO: 743862 - DNA, 25 bp, Mus musculus
taaaacactgtgatcttgccataag

SEQ ID NO: 743863 - DNA, 25 bp, Mus musculus
taaaacactgtgttcttgccataag

SEQ ID NO: 743864 - DNA, 25 bp, Mus musculus
taaaacacttggagtatgtcttctt

SEQ ID NO: 743865 - DNA, 25 bp, Mus musculus
taaaacacttggtgtatgtcttctt

SEQ ID NO: 743866 - DNA, 25 bp, Mus musculus
taaaacagaaggatactgcatcttt

SEQ ID NO: 743867 - DNA, 25 bp, Mus musculus
taaaacagaaggttactgcatcttt

SEQ ID NO: 743868 - DNA, 25 bp, Mus musculus
taaaacagacagagataagtacaac

SEQ ID NO: 743869 - DNA, 25 bp, Mus musculus
taaaacagacagtgataagtacaac

SEQ ID NO: 743870 - DNA, 25 bp, Mus musculus
taaaacagacatacccgaggtgggc

SEQ ID NO: 743871 - DNA, 25 bp, Mus musculus
taaaacagacattcccgaggtgggc

SEQ ID NO: 743872 - DNA, 25 bp, Mus musculus
taaaacagcatcaggcatggtggtg

SEQ ID NO: 743873 - DNA, 25 bp, Mus musculus
taaaacagcatcctctcttcagtga

SEQ ID NO: 743874 - DNA, 25 bp, Mus musculus
taaaacagcatcgtctcttcagtga

SEQ ID NO: 743875 - DNA, 25 bp, Mus musculus
taaaacagcatctggcatggtggtg

SEQ ID NO: 743876 - DNA, 25 bp, Mus musculus
taaaacagcccgcacacagtgactc

SEQ ID NO: 743877 - DNA, 25 bp, Mus musculus
taaaacagcccggacacagtgactc

SEQ ID NO: 743878 - DNA, 25 bp, Mus musculus
taaaacagccctacagactgcagaa

SEQ ID NO: 743879 - DNA, 25 bp, Mus musculus
taaaacagcccttcagactgcagaa

SEQ ID NO: 743880 - DNA, 25 bp, Mus musculus
taaaacagcgagctgataccacctt

SEQ ID NO: 743881 - DNA, 25 bp, Mus musculus
taaaacagcgaggtgataccacctt

SEQ ID NO: 743882 - DNA, 25 bp, Mus musculus
taaaacaggacacgtagtgagtaaa

SEQ ID NO: 743883 - DNA, 25 bp, Mus musculus
taaaacaggacaggtagtgagtaaa

SEQ ID NO: 743884 - DNA, 25 bp, Mus musculus
taaaacaggctcacctttagcaggt

SEQ ID NO: 743885 - DNA, 25 bp, Mus musculus
taaaacaggctctcctttagcaggt

SEQ ID NO: 743886 - DNA, 25 bp, Mus musculus
taaaacatcactaaggacctcctgg

SEQ ID NO: 743887 - DNA, 25 bp, Mus musculus
taaaacatcacttaggacctcctgg

SEQ ID NO: 743888 - DNA, 25 bp, Mus musculus
taaaacatcagcacttgacccgagg

SEQ ID NO: 743889 - DNA, 25 bp, Mus musculus
taaaacatcagctcttgacccgagg

SEQ ID NO: 743890 - DNA, 25 bp, Mus musculus
taaaacatctctaccagcaggtctg

SEQ ID NO: 743891 - DNA, 25 bp, Mus musculus
taaaacatctcttccagcaggtctg

SEQ ID NO: 743892 - DNA, 25 bp, Mus musculus
taaaacatgacactgtagcccataa

SEQ ID NO: 743893 - DNA, 25 bp, Mus musculus
taaaacatgacagtgtagcccataa

SEQ ID NO: 743894 - DNA, 25 bp, Mus musculus
taaaacatgactcaagtgtgacttc

SEQ ID NO: 743895 - DNA, 25 bp, Mus musculus
taaaacatgactgaagtgtgacttc

SEQ ID NO: 743896 - DNA, 25 bp, Mus musculus
taaaacatgcttcgctggttgattt

SEQ ID NO: 743897 - DNA, 25 bp, Mus musculus
taaaacatgcttggctggttgattt

SEQ ID NO: 743898 - DNA, 25 bp, Mus musculus
taaaacattactctgccaggcatgg

SEQ ID NO: 743899 - DNA, 25 bp, Mus musculus
taaaacattactgtgccaggcatgg

SEQ ID NO: 743900 - DNA, 25 bp, Mus musculus
taaaacattgccacgtaacagtcat

SEQ ID NO: 743901 - DNA, 25 bp, Mus musculus
taaaacattgcctcgtaacagtcat

SEQ ID NO: 743902 - DNA, 25 bp, Mus musculus
taaaacatttttcctcagtcatatt

SEQ ID NO: 743903 - DNA, 25 bp, Mus musculus
taaaacatttttgctcagtcatatt

SEQ ID NO: 743904 - DNA, 25 bp, Mus musculus
taaaaccaaccccaacagtagcatt

SEQ ID NO: 743905 - DNA, 25 bp, Mus musculus
taaaaccaacccgaacagtagcatt

SEQ ID NO: 743906 - DNA, 25 bp, Mus musculus
taaaaccaagatccctctattcagc

SEQ ID NO: 743907 - DNA, 25 bp, Mus musculus
taaaaccaagatgcctctattcagc

SEQ ID NO: 743908 - DNA, 25 bp, Mus musculus
taaaaccaatgtcccagcagtgcta

SEQ ID NO: 743909 - DNA, 25 bp, Mus musculus
taaaaccaatgtgccagcagtgcta

SEQ ID NO: 743910 - DNA, 25 bp, Mus musculus
taaaaccacaataagcaccaccgct

SEQ ID NO: 743911 - DNA, 25 bp, Mus musculus
taaaaccacaattagcaccaccgct

SEQ ID NO: 743912 - DNA, 25 bp, Mus musculus
taaaaccacacaattacggaagttg

SEQ ID NO: 743913 - DNA, 25 bp, Mus musculus
taaaaccacacatttacggaagttg

SEQ ID NO: 743914 - DNA, 25 bp, Mus musculus
taaaaccactacactgctactctgc

SEQ ID NO: 743915 - DNA, 25 bp, Mus musculus
taaaaccactactctgctactctgc

SEQ ID NO: 743916 - DNA, 25 bp, Mus musculus
taaaaccactctagtaaagtaccag

SEQ ID NO: 743917 - DNA, 25 bp, Mus musculus
taaaaccactcttgtaaagtaccag

SEQ ID NO: 743918 - DNA, 25 bp, Mus musculus
taaaaccagcgcaaatgctgctttg

SEQ ID NO: 743919 - DNA, 25 bp, Mus musculus
taaaaccagcgctaatgctgctttg

SEQ ID NO: 743920 - DNA, 25 bp, Mus musculus
taaaaccaggaaaggcagtgccatc

SEQ ID NO: 743921 - DNA, 25 bp, Mus musculus
taaaaccaggaatggcagtgccatc

SEQ ID NO: 743922 - DNA, 25 bp, Mus musculus
taaaaccaggctaccttatcttcct

SEQ ID NO: 743923 - DNA, 25 bp, Mus musculus
taaaaccaggcttccttatcttcct

SEQ ID NO: 743924 - DNA, 25 bp, Mus musculus
taaaaccagtttactagtggcctag

SEQ ID NO: 743925 - DNA, 25 bp, Mus musculus
taaaaccagttttctagtggcctag

SEQ ID NO: 743926 - DNA, 25 bp, Mus musculus
taaaaccatattcctgagccagtaa

SEQ ID NO: 743927 - DNA, 25 bp, Mus musculus
taaaaccatattgctgagccagtaa

SEQ ID NO: 743928 - DNA, 25 bp, Mus musculus
taaaaccatcctcttggcagtccta

SEQ ID NO: 743929 - DNA, 25 bp, Mus musculus
taaaaccatcctgttggcagtccta

SEQ ID NO: 743930 - DNA, 25 bp, Mus musculus
taaaaccatggccaacttaaccaga

SEQ ID NO: 743931 - DNA, 25 bp, Mus musculus
taaaaccatggcgaacttaaccaga

SEQ ID NO: 743932 - DNA, 25 bp, Mus musculus
taaaaccatgtactgtctcttctca

SEQ ID NO: 743933 - DNA, 25 bp, Mus musculus
taaaaccatgtagtgtctcttctca

SEQ ID NO: 743934 - DNA, 25 bp, Mus musculus
taaaaccattctcagcaacaaaagt

SEQ ID NO: 743935 - DNA, 25 bp, Mus musculus
taaaaccattctgagcaacaaaagt

SEQ ID NO: 743936 - DNA, 25 bp, Mus musculus
taaaacccagccatctgaatccgag

SEQ ID NO: 743937 - DNA, 25 bp, Mus musculus
taaaacccagccttctgaatccgag

SEQ ID NO: 743938 - DNA, 25 bp, Mus musculus
taaaacccaggacgccatggaagct

SEQ ID NO: 743939 - DNA, 25 bp, Mus musculus
taaaacccaggaggccatggaagct

SEQ ID NO: 743940 - DNA, 25 bp, Mus musculus
taaaacccagtcaacagtgccaatg

SEQ ID NO: 743941 - DNA, 25 bp, Mus musculus
taaaacccagtctacagtgccaatg

SEQ ID NO: 743942 - DNA, 25 bp, Mus musculus
taaaacccatggaaagctctttctt

SEQ ID NO: 743943 - DNA, 25 bp, Mus musculus
taaaacccatggtaagctctttctt

SEQ ID NO: 743944 - DNA, 25 bp, Mus musculus
taaaaccccagtcctttagtgagca

SEQ ID NO: 743945 - DNA, 25 bp, Mus musculus
taaaaccccagtgctttagtgagca

SEQ ID NO: 743946 - DNA, 25 bp, Mus musculus
taaaacccccctcggtgatggagag

SEQ ID NO: 743947 - DNA, 25 bp, Mus musculus
taaaacccccctgggtgatggagag

SEQ ID NO: 743948 - DNA, 25 bp, Mus musculus
taaaacccctcaatcagctagagct

SEQ ID NO: 743949 - DNA, 25 bp, Mus musculus
taaaacccctcattcagctagagct

SEQ ID NO: 743950 - DNA, 25 bp, Mus musculus
taaaacccctctctacactctgtgt

SEQ ID NO: 743951 - DNA, 25 bp, Mus musculus
taaaacccctctgtacactctgtgt

SEQ ID NO: 743952 - DNA, 25 bp, Mus musculus
taaaacccctgtagctaaggcacca

SEQ ID NO: 743953 - DNA, 25 bp, Mus musculus
taaaacccctgtcccgagatgaaca

SEQ ID NO: 743954 - DNA, 25 bp, Mus musculus
taaaacccctgtgccgagatgaaca

SEQ ID NO: 743955 - DNA, 25 bp, Mus musculus
taaaacccctgttgctaaggcacca

SEQ ID NO: 743956 - DNA, 25 bp, Mus musculus
taaaacccgtctaatatccatgcac

SEQ ID NO: 743957 - DNA, 25 bp, Mus musculus
taaaacccgtcttatatccatgcac

SEQ ID NO: 743958 - DNA, 25 bp, Mus musculus
taaaacccttatccctctgagatga

SEQ ID NO: 743959 - DNA, 25 bp, Mus musculus
taaaacccttatgcctctgagatga

SEQ ID NO: 743960 - DNA, 25 bp, Mus musculus
taaaacccttcacattccattacaa

SEQ ID NO: 743961 - DNA, 25 bp, Mus musculus
taaaacccttcagattccattacaa

SEQ ID NO: 743962 - DNA, 25 bp, Mus musculus
taaaacccttccagcagataagcct

SEQ ID NO: 743963 - DNA, 25 bp, Mus musculus
taaaacccttcctgcagataagcct

SEQ ID NO: 743964 - DNA, 25 bp, Mus musculus
taaaaccgagatatcacaactgagg

SEQ ID NO: 743965 - DNA, 25 bp, Mus musculus
taaaaccgagatttcacaactgagg

SEQ ID NO: 743966 - DNA, 25 bp, Mus musculus
taaaaccgaggtcgccactgtgtat

SEQ ID NO: 743967 - DNA, 25 bp, Mus musculus
taaaaccgaggtggccactgtgtat

SEQ ID NO: 743968 - DNA, 25 bp, Mus musculus
taaaaccgtgagcatttaccacttg

SEQ ID NO: 743969 - DNA, 25 bp, Mus musculus
taaaaccgtgaggatttaccacttg

SEQ ID NO: 743970 - DNA, 25 bp, Mus musculus
taaaacctataaatttcatccctct

SEQ ID NO: 743971 - DNA, 25 bp, Mus musculus
taaaacctataattttcatccctct

SEQ ID NO: 743972 - DNA, 25 bp, Mus musculus
taaaacctccacaggagccagagct

SEQ ID NO: 743973 - DNA, 25 bp, Mus musculus
taaaacctccactggagccagagct

SEQ ID NO: 743974 - DNA, 25 bp, Mus musculus
taaaacctcgtgctactagggattg

SEQ ID NO: 743975 - DNA, 25 bp, Mus musculus
taaaacctcgtggtactagggattg

SEQ ID NO: 743976 - DNA, 25 bp, Mus musculus
taaaacctctccctaggtgccaagt

SEQ ID NO: 743977 - DNA, 25 bp, Mus musculus
taaaacctctccgtaggtgccaagt

SEQ ID NO: 743978 - DNA, 25 bp, Mus musculus
taaaacctgcccatctaacaaactg

SEQ ID NO: 743979 - DNA, 25 bp, Mus musculus
taaaacctgcccttctaacaaactg

SEQ ID NO: 743980 - DNA, 25 bp, Mus musculus
taaaacctggagagcacttcgctca

SEQ ID NO: 743981 - DNA, 25 bp, Mus musculus
taaaacctggagtgcacttcgctca

SEQ ID NO: 743982 - DNA, 25 bp, Mus musculus
taaaacctggggaattgactacatt

SEQ ID NO: 743983 - DNA, 25 bp, Mus musculus
taaaacctggggtattgactacatt

SEQ ID NO: 743984 - DNA, 25 bp, Mus musculus
taaaaccttcctctacactttctgt

SEQ ID NO: 743985 - DNA, 25 bp, Mus musculus
taaaaccttcctgtacactttctgt

SEQ ID NO: 743986 - DNA, 25 bp, Mus musculus
taaaaccttggcactgaaaatgaaa

SEQ ID NO: 743987 - DNA, 25 bp, Mus musculus
taaaaccttggctctgaaaatgaaa

SEQ ID NO: 743988 - DNA, 25 bp, Mus musculus
taaaaccttggtccggtgctgcttg

SEQ ID NO: 743989 - DNA, 25 bp, Mus musculus
taaaaccttggtgcggtgctgcttg

SEQ ID NO: 743990 - DNA, 25 bp, Mus musculus
taaaaccttgtaaggtgtgcggtaa

SEQ ID NO: 743991 - DNA, 25 bp, Mus musculus
taaaaccttgtatggtgtgcggtaa

SEQ ID NO: 743992 - DNA, 25 bp, Mus musculus
taaaacctttggctgatgtcagtca

SEQ ID NO: 743993 - DNA, 25 bp, Mus musculus
taaaacctttgggtgatgtcagtca

SEQ ID NO: 743994 - DNA, 25 bp, Mus musculus
taaaacctttttcagatagggcatc

SEQ ID NO: 743995 - DNA, 25 bp, Mus musculus
taaaacctttttgagatagggcatc

SEQ ID NO: 743996 - DNA, 25 bp, Mus musculus
taaaacgcgttgacatgcctctcta

SEQ ID NO: 743997 - DNA, 25 bp, Mus musculus
taaaacgcgttgtcatgcctctcta

SEQ ID NO: 743998 - DNA, 25 bp, Mus musculus
taaaacgctgtcattgggcatctct

SEQ ID NO: 743999 - DNA, 25 bp, Mus musculus
taaaacgctgtctttgggcatctct

SEQ ID NO: 744000 - DNA, 25 bp, Mus musculus
taaaacggatgacccaccaattggc

SEQ ID NO: 744001 - DNA, 25 bp, Mus musculus
taaaacggatgagccaccaattggc

SEQ ID NO: 744002 - DNA, 25 bp, Mus musculus
taaaacggcctgagaccagcagagc

SEQ ID NO: 744003 - DNA, 25 bp, Mus musculus
taaaacggcctgtgaccagcagagc

SEQ ID NO: 744004 - DNA, 25 bp, Mus musculus
taaaacggtaacatacttgtgtctg

SEQ ID NO: 744005 - DNA, 25 bp, Mus musculus
taaaacggtaacttacttgtgtctg

SEQ ID NO: 744006 - DNA, 25 bp, Mus musculus
taaaacgtcacgaaccatgtaaatt

SEQ ID NO: 744007 - DNA, 25 bp, Mus musculus
taaaacgtcacgtaccatgtaaatt

SEQ ID NO: 744008 - DNA, 25 bp, Mus musculus
taaaacgtcatcctttccgtaagag

SEQ ID NO: 744009 - DNA, 25 bp, Mus musculus
taaaacgtcatcgtttccgtaagag

SEQ ID NO: 744010 - DNA, 25 bp, Mus musculus
taaaacgtgaccagtctgcctttat

SEQ ID NO: 744011 - DNA, 25 bp, Mus musculus
taaaacgtgacctgtctgcctttat

SEQ ID NO: 744012 - DNA, 25 bp, Mus musculus
taaaacgttgcaccagcagaccttc

SEQ ID NO: 744013 - DNA, 25 bp, Mus musculus
taaaacgttgcagcagcagaccttc

SEQ ID NO: 744014 - DNA, 25 bp, Mus musculus
taaaacgtttatattcttacagcaa

SEQ ID NO: 744015 - DNA, 25 bp, Mus musculus
taaaacgtttattttcttacagcaa

SEQ ID NO: 744016 - DNA, 25 bp, Mus musculus
taaaactaagttcgcctcactgggc

SEQ ID NO: 744017 - DNA, 25 bp, Mus musculus
taaaactaagttggcctcactgggc

SEQ ID NO: 744018 - DNA, 25 bp, Mus musculus
taaaactaccatatttcactccctg

SEQ ID NO: 744019 - DNA, 25 bp, Mus musculus
taaaactaccatttttcactccctg

SEQ ID NO: 744020 - DNA, 25 bp, Mus musculus
taaaactactacaaaattgctacta

SEQ ID NO: 744021 - DNA, 25 bp, Mus musculus
taaaactactactaaattgctacta

SEQ ID NO: 744022 - DNA, 25 bp, Mus musculus
taaaactactgcatgcttccaactg

SEQ ID NO: 744023 - DNA, 25 bp, Mus musculus
taaaactactgcttgcttccaactg

SEQ ID NO: 744024 - DNA, 25 bp, Mus musculus
taaaactagaacagccatacttaat

SEQ ID NO: 744025 - DNA, 25 bp, Mus musculus
taaaactagaactgccatacttaat

SEQ ID NO: 744026 - DNA, 25 bp, Mus musculus
taaaactagccaccccattgggcac

SEQ ID NO: 744027 - DNA, 25 bp, Mus musculus
taaaactagccagcccattgggcac

SEQ ID NO: 744028 - DNA, 25 bp, Mus musculus
taaaactaggaacccctgatgcagt

SEQ ID NO: 744029 - DNA, 25 bp, Mus musculus
taaaactaggaagccctgatgcagt

SEQ ID NO: 744030 - DNA, 25 bp, Mus musculus
taaaactagggtcctgctcgttggt

SEQ ID NO: 744031 - DNA, 25 bp, Mus musculus
taaaactagggtgctgctcgttggt

SEQ ID NO: 744032 - DNA, 25 bp, Mus musculus
taaaactagtttcagccgtagagga

SEQ ID NO: 744033 - DNA, 25 bp, Mus musculus
taaaactagtttgagccgtagagga

SEQ ID NO: 744034 - DNA, 25 bp, Mus musculus
taaaactatttacttctatggtgaa

SEQ ID NO: 744035 - DNA, 25 bp, Mus musculus
taaaactatttagttctatggtgaa

SEQ ID NO: 744036 - DNA, 25 bp, Mus musculus
taaaactcaacaacgtgtcgggcat

SEQ ID NO: 744037 - DNA, 25 bp, Mus musculus
taaaactcaacatcgtgtcgggcat

SEQ ID NO: 744038 - DNA, 25 bp, Mus musculus
taaaactcccaaattcagagccctt

SEQ ID NO: 744039 - DNA, 25 bp, Mus musculus
taaaactcccaatttcagagccctt

SEQ ID NO: 744040 - DNA, 25 bp, Mus musculus
taaaactcggcaacctggtcctttt

SEQ ID NO: 744041 - DNA, 25 bp, Mus musculus
taaaactcggcatcctggtcctttt

SEQ ID NO: 744042 - DNA, 25 bp, Mus musculus
taaaactctactctctcttagcaaa

SEQ ID NO: 744043 - DNA, 25 bp, Mus musculus
taaaactctactgtctcttagcaaa

SEQ ID NO: 744044 - DNA, 25 bp, Mus musculus
taaaactctattagaaccttctgaa

SEQ ID NO: 744045 - DNA, 25 bp, Mus musculus
taaaactctatttgaaccttctgaa

SEQ ID NO: 744046 - DNA, 25 bp, Mus musculus
taaaactctcacagcccgtaggcag

SEQ ID NO: 744047 - DNA, 25 bp, Mus musculus
taaaactctcactgcccgtaggcag

SEQ ID NO: 744048 - DNA, 25 bp, Mus musculus
taaaactcttgtcccattgtacttg

SEQ ID NO: 744049 - DNA, 25 bp, Mus musculus
taaaactcttgtgccattgtacttg

SEQ ID NO: 744050 - DNA, 25 bp, Mus musculus
taaaactctttgcaaccccatgagc

SEQ ID NO: 744051 - DNA, 25 bp, Mus musculus
taaaactctttgcagtgctcctgac

SEQ ID NO: 744052 - DNA, 25 bp, Mus musculus
taaaactctttggaaccccatgagc

SEQ ID NO: 744053 - DNA, 25 bp, Mus musculus
taaaactctttggagtgctcctgac

SEQ ID NO: 744054 - DNA, 25 bp, Mus musculus
taaaactgaactctggagccgtgat

SEQ ID NO: 744055 - DNA, 25 bp, Mus musculus
taaaactgaactgtggagccgtgat

SEQ ID NO: 744056 - DNA, 25 bp, Mus musculus
taaaactgacagagctcctccgata

SEQ ID NO: 744057 - DNA, 25 bp, Mus musculus
taaaactgacagtgctcctccgata

SEQ ID NO: 744058 - DNA, 25 bp, Mus musculus
taaaactgatgcctatgcatccctg

SEQ ID NO: 744059 - DNA, 25 bp, Mus musculus
taaaactgatgcgtatgcatccctg

SEQ ID NO: 744060 - DNA, 25 bp, Mus musculus
taaaactgcagtcatcttggacctt

SEQ ID NO: 744061 - DNA, 25 bp, Mus musculus
taaaactgcagtgatcttggacctt

SEQ ID NO: 744062 - DNA, 25 bp, Mus musculus
taaaactggtttcaggtgtccaaat

SEQ ID NO: 744063 - DNA, 25 bp, Mus musculus
taaaactggtttgaggtgtccaaat

SEQ ID NO: 744064 - DNA, 25 bp, Mus musculus
taaaactgtcccaatgacctaatcc

SEQ ID NO: 744065 - DNA, 25 bp, Mus musculus
taaaactgtccctatgacctaatcc

SEQ ID NO: 744066 - DNA, 25 bp, Mus musculus
taaaactgtcctagctgtttctctc

SEQ ID NO: 744067 - DNA, 25 bp, Mus musculus
taaaactgtccttgctgtttctctc

SEQ ID NO: 744068 - DNA, 25 bp, Mus musculus
taaaactgtgagcacctgggaggct

SEQ ID NO: 744069 - DNA, 25 bp, Mus musculus
taaaactgtgaggacctgggaggct

SEQ ID NO: 744070 - DNA, 25 bp, Mus musculus
taaaactgtgccctttaatatcagg

SEQ ID NO: 744071 - DNA, 25 bp, Mus musculus
taaaactgtgccgtttaatatcagg

SEQ ID NO: 744072 - DNA, 25 bp, Mus musculus
taaaactgtgtaactctggagacca

SEQ ID NO: 744073 - DNA, 25 bp, Mus musculus
taaaactgtgtatctctggagacca

SEQ ID NO: 744074 - DNA, 25 bp, Mus musculus
taaaactgttcgattctccttgcct

SEQ ID NO: 744075 - DNA, 25 bp, Mus musculus
taaaactgttcgtttctccttgcct

SEQ ID NO: 744076 - DNA, 25 bp, Mus musculus
taaaacttactgcacccgagagctg

SEQ ID NO: 744077 - DNA, 25 bp, Mus musculus
taaaacttactggacccgagagctg

SEQ ID NO: 744078 - DNA, 25 bp, Mus musculus
taaaacttatggacaagaagcttgt

SEQ ID NO: 744079 - DNA, 25 bp, Mus musculus
taaaacttatggtcaagaagcttgt

SEQ ID NO: 744080 - DNA, 25 bp, Mus musculus
taaaacttcactcccctaatgagat

SEQ ID NO: 744081 - DNA, 25 bp, Mus musculus
taaaacttcactgccctaatgagat

SEQ ID NO: 744082 - DNA, 25 bp, Mus musculus
taaaacttcattaggcctccgtgtg

SEQ ID NO: 744083 - DNA, 25 bp, Mus musculus
taaaacttcatttggcctccgtgtg

SEQ ID NO: 744084 - DNA, 25 bp, Mus musculus
taaaacttcttacggcagattctgc

SEQ ID NO: 744085 - DNA, 25 bp, Mus musculus
taaaacttcttagggcagattctgc

SEQ ID NO: 744086 - DNA, 25 bp, Mus musculus
taaaacttggcaccctgactcagtt

SEQ ID NO: 744087 - DNA, 25 bp, Mus musculus
taaaacttggcagcctgactcagtt

SEQ ID NO: 744088 - DNA, 25 bp, Mus musculus
taaaacttggctactgccccttagc

SEQ ID NO: 744089 - DNA, 25 bp, Mus musculus
taaaacttggcttctgccccttagc

SEQ ID NO: 744090 - DNA, 25 bp, Mus musculus
taaaacttgtaccttgtgtcttcag

SEQ ID NO: 744091 - DNA, 25 bp, Mus musculus
taaaacttgtacgttgtgtcttcag

SEQ ID NO: 744092 - DNA, 25 bp, Mus musculus
taaaacttgttgcttacatgcatgc

SEQ ID NO: 744093 - DNA, 25 bp, Mus musculus
taaaacttgttggttacatgcatgc

SEQ ID NO: 744094 - DNA, 25 bp, Mus musculus
taaaactttcttagtccacacgcct

SEQ ID NO: 744095 - DNA, 25 bp, Mus musculus
taaaactttctttgtccacacgcct

SEQ ID NO: 744096 - DNA, 25 bp, Mus musculus
taaaacttttataccacttacatga

SEQ ID NO: 744097 - DNA, 25 bp, Mus musculus
taaaacttttattccacttacatga

SEQ ID NO: 744098 - DNA, 25 bp, Mus musculus
taaaactttttaccgcaacttgtag

SEQ ID NO: 744099 - DNA, 25 bp, Mus musculus
taaaactttttagcgcaacttgtag

SEQ ID NO: 744100 - DNA, 25 bp, Mus musculus
taaaagaatgtcctcgctggcatcc

SEQ ID NO: 744101 - DNA, 25 bp, Mus musculus
taaaagaatgtcgtcgctggcatcc

SEQ ID NO: 744102 - DNA, 25 bp, Mus musculus
taaaagaattcaaaccctgttttgg

SEQ ID NO: 744103 - DNA, 25 bp, Mus musculus
taaaagaattcataccctgttttgg

SEQ ID NO: 744104 - DNA, 25 bp, Mus musculus
taaaagaccaagacctcctgattga

SEQ ID NO: 744105 - DNA, 25 bp, Mus musculus
taaaagaccaagtcctcctgattga

SEQ ID NO: 744106 - DNA, 25 bp, Mus musculus
taaaagaccaggctgattttctgtc

SEQ ID NO: 744107 - DNA, 25 bp, Mus musculus
taaaagaccagggtgattttctgtc

SEQ ID NO: 744108 - DNA, 25 bp, Mus musculus
taaaagaccattcccctgtagaaac

SEQ ID NO: 744109 - DNA, 25 bp, Mus musculus
taaaagaccattgccctgtagaaac

SEQ ID NO: 744110 - DNA, 25 bp, Mus musculus
taaaagaccctgaatagacaaacct

SEQ ID NO: 744111 - DNA, 25 bp, Mus musculus
taaaagaccctgtatagacaaacct

SEQ ID NO: 744112 - DNA, 25 bp, Mus musculus
taaaagacggtaacagtccaagaaa

SEQ ID NO: 744113 - DNA, 25 bp, Mus musculus
taaaagacggtatcagtccaagaaa

SEQ ID NO: 744114 - DNA, 25 bp, Mus musculus
taaaagagagaaccccgctacttgg

SEQ ID NO: 744115 - DNA, 25 bp, Mus musculus
taaaagagagaagcccgctacttgg

SEQ ID NO: 744116 - DNA, 25 bp, Mus musculus
taaaagagcagtccaggtgggccct

SEQ ID NO: 744117 - DNA, 25 bp, Mus musculus
taaaagagcagtgcaggtgggccct

SEQ ID NO: 744118 - DNA, 25 bp, Mus musculus
taaaagagcgttcttgtccctggcg

SEQ ID NO: 744119 - DNA, 25 bp, Mus musculus
taaaagagcgttgttgtccctggcg

SEQ ID NO: 744120 - DNA, 25 bp, Mus musculus
taaaagaggcggcacttcatttctt

SEQ ID NO: 744121 - DNA, 25 bp, Mus musculus
taaaagaggcgggacttcatttctt

SEQ ID NO: 744122 - DNA, 25 bp, Mus musculus
taaaagaggtccattaatattcctt

SEQ ID NO: 744123 - DNA, 25 bp, Mus musculus
taaaagaggtcctttaatattcctt

SEQ ID NO: 744124 - DNA, 25 bp, Mus musculus
taaaagagtggcctctgggctctgt

SEQ ID NO: 744125 - DNA, 25 bp, Mus musculus
taaaagagtggcgtctgggctctgt

SEQ ID NO: 744126 - DNA, 25 bp, Mus musculus
taaaagagttagagcccaagcccca

SEQ ID NO: 744127 - DNA, 25 bp, Mus musculus
taaaagagttagtgcccaagcccca

SEQ ID NO: 744128 - DNA, 25 bp, Mus musculus
taaaagataaggatcttcaagtcct

SEQ ID NO: 744129 - DNA, 25 bp, Mus musculus
taaaagataaggttcttcaagtcct

SEQ ID NO: 744130 - DNA, 25 bp, Mus musculus
taaaagatacttaacactaggcact

SEQ ID NO: 744131 - DNA, 25 bp, Mus musculus
taaaagatactttacactaggcact

SEQ ID NO: 744132 - DNA, 25 bp, Mus musculus
taaaagatagaaacctttgtgtgcc

SEQ ID NO: 744133 - DNA, 25 bp, Mus musculus
taaaagatagaatcctttgtgtgcc

SEQ ID NO: 744134 - DNA, 25 bp, Mus musculus
taaaagatcaagaatgtcagaaaaa

SEQ ID NO: 744135 - DNA, 25 bp, Mus musculus
taaaagatcaagtatgtcagaaaaa

SEQ ID NO: 744136 - DNA, 25 bp, Mus musculus
taaaagatcaccatttccacaagct

SEQ ID NO: 744137 - DNA, 25 bp, Mus musculus
taaaagatcaccttttccacaagct

SEQ ID NO: 744138 - DNA, 25 bp, Mus musculus
taaaagatccacagtggccgggcgt

SEQ ID NO: 744139 - DNA, 25 bp, Mus musculus
taaaagatccactgtggccgggcgt

SEQ ID NO: 744140 - DNA, 25 bp, Mus musculus
taaaagatcctccacactcagcagt

SEQ ID NO: 744141 - DNA, 25 bp, Mus musculus
taaaagatcctcgacactcagcagt

SEQ ID NO: 744142 - DNA, 25 bp, Mus musculus
taaaagatcggccactttcccctct

SEQ ID NO: 744143 - DNA, 25 bp, Mus musculus
taaaagatcggcgactttcccctct

SEQ ID NO: 744144 - DNA, 25 bp, Mus musculus
taaaagatgaagatggctatgccag

SEQ ID NO: 744145 - DNA, 25 bp, Mus musculus
taaaagatgaagttggctatgccag

SEQ ID NO: 744146 - DNA, 25 bp, Mus musculus
taaaagatgaataacgccgggcgtg

SEQ ID NO: 744147 - DNA, 25 bp, Mus musculus
taaaagatgaattacgccgggcgtg

SEQ ID NO: 744148 - DNA, 25 bp, Mus musculus
taaaagatgtccagagataccacct

SEQ ID NO: 744149 - DNA, 25 bp, Mus musculus
taaaagatgtcctgagataccacct

SEQ ID NO: 744150 - DNA, 25 bp, Mus musculus
taaaagattgtgaggcgtttgggaa

SEQ ID NO: 744151 - DNA, 25 bp, Mus musculus
taaaagattgtgtggcgtttgggaa

SEQ ID NO: 744152 - DNA, 25 bp, Mus musculus
taaaagatttgacctattcatgcgt

SEQ ID NO: 744153 - DNA, 25 bp, Mus musculus
taaaagatttgagctattcatgcgt

SEQ ID NO: 744154 - DNA, 25 bp, Mus musculus
taaaagatttggaatattttcctga

SEQ ID NO: 744155 - DNA, 25 bp, Mus musculus
taaaagatttggtatattttcctga

SEQ ID NO: 744156 - DNA, 25 bp, Mus musculus
taaaagcacttacgagcttcccctg

SEQ ID NO: 744157 - DNA, 25 bp, Mus musculus
taaaagcacttaggagcttcccctg

SEQ ID NO: 744158 - DNA, 25 bp, Mus musculus
taaaagcagtctaaaaattcatcag

SEQ ID NO: 744159 - DNA, 25 bp, Mus musculus
taaaagcagtcttaaaattcatcag

SEQ ID NO: 744160 - DNA, 25 bp, Mus musculus
taaaagcagttgatagtactatcac

SEQ ID NO: 744161 - DNA, 25 bp, Mus musculus
taaaagcagttgttagtactatcac

SEQ ID NO: 744162 - DNA, 25 bp, Mus musculus
taaaagcatcaacccttggagcctg

SEQ ID NO: 744163 - DNA, 25 bp, Mus musculus
taaaagcatcaagccttggagcctg

SEQ ID NO: 744164 - DNA, 25 bp, Mus musculus
taaaagcatctcatctggccaggtc

SEQ ID NO: 744165 - DNA, 25 bp, Mus musculus
taaaagcatctcttctggccaggtc

SEQ ID NO: 744166 - DNA, 25 bp, Mus musculus
taaaagccactacttctcctccagg

SEQ ID NO: 744167 - DNA, 25 bp, Mus musculus
taaaagccactagttctcctccagg

SEQ ID NO: 744168 - DNA, 25 bp, Mus musculus
taaaagccagctattgccttttagg

SEQ ID NO: 744169 - DNA, 25 bp, Mus musculus
taaaagccagcttttgccttttagg

SEQ ID NO: 744170 - DNA, 25 bp, Mus musculus
taaaagccaggtacagcggacacac

SEQ ID NO: 744171 - DNA, 25 bp, Mus musculus
taaaagccaggttcagcggacacac

SEQ ID NO: 744172 - DNA, 25 bp, Mus musculus
taaaagccattccacagttgactcc

SEQ ID NO: 744173 - DNA, 25 bp, Mus musculus
taaaagccattcgacagttgactcc

SEQ ID NO: 744174 - DNA, 25 bp, Mus musculus
taaaagcccacgctggcgggtcatt

SEQ ID NO: 744175 - DNA, 25 bp, Mus musculus
taaaagcccacggtggcgggtcatt

SEQ ID NO: 744176 - DNA, 25 bp, Mus musculus
taaaagccctagcaatgtttttctg

SEQ ID NO: 744177 - DNA, 25 bp, Mus musculus
taaaagccctaggaatgtttttctg

SEQ ID NO: 744178 - DNA, 25 bp, Mus musculus
taaaagcccttactatttcctctct

SEQ ID NO: 744179 - DNA, 25 bp, Mus musculus
taaaagcccttagtatttcctctct

SEQ ID NO: 744180 - DNA, 25 bp, Mus musculus
taaaagcccttcaccttgttggagt

SEQ ID NO: 744181 - DNA, 25 bp, Mus musculus
taaaagcccttctccttgttggagt

SEQ ID NO: 744182 - DNA, 25 bp, Mus musculus
taaaagccgctactgtttcttactt

SEQ ID NO: 744183 - DNA, 25 bp, Mus musculus
taaaagccgctagtgtttcttactt

SEQ ID NO: 744184 - DNA, 25 bp, Mus musculus
taaaagcctagcctgaacttccaca

SEQ ID NO: 744185 - DNA, 25 bp, Mus musculus
taaaagcctagcgtgaacttccaca

SEQ ID NO: 744186 - DNA, 25 bp, Mus musculus
taaaagcctcaaccttctctgggcc

SEQ ID NO: 744187 - DNA, 25 bp, Mus musculus
taaaagcctcaagcttctctgggcc

SEQ ID NO: 744188 - DNA, 25 bp, Mus musculus
taaaagccttacagtcgattgccca

SEQ ID NO: 744189 - DNA, 25 bp, Mus musculus
taaaagccttactgtcgattgccca

SEQ ID NO: 744190 - DNA, 25 bp, Mus musculus
taaaagcggcgaagaacttcaggac

SEQ ID NO: 744191 - DNA, 25 bp, Mus musculus
taaaagcggcgatgaacttcaggac

SEQ ID NO: 744192 - DNA, 25 bp, Mus musculus
taaaagctatatacgagaactcaga

SEQ ID NO: 744193 - DNA, 25 bp, Mus musculus
taaaagctatattcgagaactcaga

SEQ ID NO: 744194 - DNA, 25 bp, Mus musculus
taaaagctcacgctattcccagttg

SEQ ID NO: 744195 - DNA, 25 bp, Mus musculus
taaaagctcacggtattcccagttg

SEQ ID NO: 744196 - DNA, 25 bp, Mus musculus
taaaagctccagaagggatcccaga

SEQ ID NO: 744197 - DNA, 25 bp, Mus musculus
taaaagctccagtagggatcccaga

SEQ ID NO: 744198 - DNA, 25 bp, Mus musculus
taaaagctcggcaggaggctcgctg

SEQ ID NO: 744199 - DNA, 25 bp, Mus musculus
taaaagctcggctggaggctcgctg

SEQ ID NO: 744200 - DNA, 25 bp, Mus musculus
taaaagctgactctcaggtctccac

SEQ ID NO: 744201 - DNA, 25 bp, Mus musculus
taaaagctgactgtcaggtctccac

SEQ ID NO: 744202 - DNA, 25 bp, Mus musculus
taaaagctgccaacttgccaggcta

SEQ ID NO: 744203 - DNA, 25 bp, Mus musculus
taaaagctgccatcttgccaggcta

SEQ ID NO: 744204 - DNA, 25 bp, Mus musculus
taaaagctgcctatgatttacctgt

SEQ ID NO: 744205 - DNA, 25 bp, Mus musculus
taaaagctgcctttgatttacctgt

SEQ ID NO: 744206 - DNA, 25 bp, Mus musculus
taaaagctttaacggctggcgagtt

SEQ ID NO: 744207 - DNA, 25 bp, Mus musculus
taaaagctttaagggctggcgagtt

SEQ ID NO: 744208 - DNA, 25 bp, Mus musculus
taaaagctttcaaaccaggcagtgg

SEQ ID NO: 744209 - DNA, 25 bp, Mus musculus
taaaagctttcataccaggcagtgg

SEQ ID NO: 744210 - DNA, 25 bp, Mus musculus
taaaagcttttgaactccatcgaaa

SEQ ID NO: 744211 - DNA, 25 bp, Mus musculus
taaaagcttttgtactccatcgaaa

SEQ ID NO: 744212 - DNA, 25 bp, Mus musculus
taaaagctttttccaggtctgctgc

SEQ ID NO: 744213 - DNA, 25 bp, Mus musculus
taaaagctttttgcaggtctgctgc

SEQ ID NO: 744214 - DNA, 25 bp, Mus musculus
taaaaggaacctcgtgggctgctcc

SEQ ID NO: 744215 - DNA, 25 bp, Mus musculus
taaaaggaacctggtgggctgctcc

SEQ ID NO: 744216 - DNA, 25 bp, Mus musculus
taaaaggactcaaggcctcggctag

SEQ ID NO: 744217 - DNA, 25 bp, Mus musculus
taaaaggactcatggcctcggctag

SEQ ID NO: 744218 - DNA, 25 bp, Mus musculus
taaaaggagatcattgcacaatctt

SEQ ID NO: 744219 - DNA, 25 bp, Mus musculus
taaaaggagatctttgcacaatctt

SEQ ID NO: 744220 - DNA, 25 bp, Mus musculus
taaaaggagggaatggaaccagaat

SEQ ID NO: 744221 - DNA, 25 bp, Mus musculus
taaaaggagggattggaaccagaat

SEQ ID NO: 744222 - DNA, 25 bp, Mus musculus
taaaaggatctcaattttgtggttc

SEQ ID NO: 744223 - DNA, 25 bp, Mus musculus
taaaaggatctctattttgtggttc

SEQ ID NO: 744224 - DNA, 25 bp, Mus musculus
taaaaggatggaaaaagcccacatt

SEQ ID NO: 744225 - DNA, 25 bp, Mus musculus
taaaaggatggataaagcccacatt

SEQ ID NO: 744226 - DNA, 25 bp, Mus musculus
taaaaggcaaaacccgtcccagctg

SEQ ID NO: 744227 - DNA, 25 bp, Mus musculus
taaaaggcaaaagccgtcccagctg

SEQ ID NO: 744228 - DNA, 25 bp, Mus musculus
taaaaggccaccagcagaagcatct

SEQ ID NO: 744229 - DNA, 25 bp, Mus musculus
taaaaggccacctgcagaagcatct

SEQ ID NO: 744230 - DNA, 25 bp, Mus musculus
taaaaggcctgcaaacccaccggag

SEQ ID NO: 744231 - DNA, 25 bp, Mus musculus
taaaaggcctgctaacccaccggag

SEQ ID NO: 744232 - DNA, 25 bp, Mus musculus
taaaaggcggcacaacactagagaa

SEQ ID NO: 744233 - DNA, 25 bp, Mus musculus
taaaaggcggcagaacactagagaa

SEQ ID NO: 744234 - DNA, 25 bp, Mus musculus
taaaaggcggccatatccaagctct

SEQ ID NO: 744235 - DNA, 25 bp, Mus musculus
taaaaggcggccttatccaagctct

SEQ ID NO: 744236 - DNA, 25 bp, Mus musculus
taaaaggcgtggcagagagcttcaa

SEQ ID NO: 744237 - DNA, 25 bp, Mus musculus
taaaaggcgtgggagagagcttcaa

SEQ ID NO: 744238 - DNA, 25 bp, Mus musculus
taaaaggctcttcgccaatactcag

SEQ ID NO: 744239 - DNA, 25 bp, Mus musculus
taaaaggctcttggccaatactcag

SEQ ID NO: 744240 - DNA, 25 bp, Mus musculus
taaaaggctgttattctggatatga

SEQ ID NO: 744241 - DNA, 25 bp, Mus musculus
taaaaggctgtttttctggatatga

SEQ ID NO: 744242 - DNA, 25 bp, Mus musculus
taaaaggctttgcattttgaaggat

SEQ ID NO: 744243 - DNA, 25 bp, Mus musculus
taaaaggctttggattttgaaggat

SEQ ID NO: 744244 - DNA, 25 bp, Mus musculus
taaaagggacttaagccaggtgtgg

SEQ ID NO: 744245 - DNA, 25 bp, Mus musculus
taaaagggactttagccaggtgtgg

SEQ ID NO: 744246 - DNA, 25 bp, Mus musculus
taaaagggagctagccccggtgcat

SEQ ID NO: 744247 - DNA, 25 bp, Mus musculus
taaaagggagcttgccccggtgcat

SEQ ID NO: 744248 - DNA, 25 bp, Mus musculus
taaaagggaggactcgctgcttccc

SEQ ID NO: 744249 - DNA, 25 bp, Mus musculus
taaaagggaggagtcgctgcttccc

SEQ ID NO: 744250 - DNA, 25 bp, Mus musculus
taaaagggcaaacataaggttacat

SEQ ID NO: 744251 - DNA, 25 bp, Mus musculus
taaaagggcaaagataaggttacat

SEQ ID NO: 744252 - DNA, 25 bp, Mus musculus
taaaagggccacaggtccacgtgca

SEQ ID NO: 744253 - DNA, 25 bp, Mus musculus
taaaagggccactggtccacgtgca

SEQ ID NO: 744254 - DNA, 25 bp, Mus musculus
taaaagggccttcttctcattttgg

SEQ ID NO: 744255 - DNA, 25 bp, Mus musculus
taaaagggccttgttctcattttgg

SEQ ID NO: 744256 - DNA, 25 bp, Mus musculus
taaaagggcttgcagcccggcgaca

SEQ ID NO: 744257 - DNA, 25 bp, Mus musculus
taaaagggcttggagcccggcgaca

SEQ ID NO: 744258 - DNA, 25 bp, Mus musculus
taaaagggtgctatatcccactgaa

SEQ ID NO: 744259 - DNA, 25 bp, Mus musculus
taaaagggtgctttatcccactgaa

SEQ ID NO: 744260 - DNA, 25 bp, Mus musculus
taaaagggttgcctgagttgcttcg

SEQ ID NO: 744261 - DNA, 25 bp, Mus musculus
taaaagggttgcgtgagttgcttcg

SEQ ID NO: 744262 - DNA, 25 bp, Mus musculus
taaaagggttgtccagtcactgccg

SEQ ID NO: 744263 - DNA, 25 bp, Mus musculus
taaaagggttgtgcagtcactgccg

SEQ ID NO: 744264 - DNA, 25 bp, Mus musculus
taaaaggtaattagtctcttctctc

SEQ ID NO: 744265 - DNA, 25 bp, Mus musculus
taaaaggtaatttgtctcttctctc

SEQ ID NO: 744266 - DNA, 25 bp, Mus musculus
taaaaggtattaagccccatcatca

SEQ ID NO: 744267 - DNA, 25 bp, Mus musculus
taaaaggtattatgccccatcatca

SEQ ID NO: 744268 - DNA, 25 bp, Mus musculus
taaaaggtcaaacttcgggctggcg

SEQ ID NO: 744269 - DNA, 25 bp, Mus musculus
taaaaggtcaaagttcgggctggcg

SEQ ID NO: 744270 - DNA, 25 bp, Mus musculus
taaaaggtcagcaccactctgtatc

SEQ ID NO: 744271 - DNA, 25 bp, Mus musculus
taaaaggtcagctccactctgtatc

SEQ ID NO: 744272 - DNA, 25 bp, Mus musculus
taaaaggtccccagactactttgca

SEQ ID NO: 744273 - DNA, 25 bp, Mus musculus
taaaaggtcccctgactactttgca

SEQ ID NO: 744274 - DNA, 25 bp, Mus musculus
taaaaggtcgttcctcggtgtgtga

SEQ ID NO: 744275 - DNA, 25 bp, Mus musculus
taaaaggtcgttgctcggtgtgtga

SEQ ID NO: 744276 - DNA, 25 bp, Mus musculus
taaaaggtctggctgtgtaactcgg

SEQ ID NO: 744277 - DNA, 25 bp, Mus musculus
taaaaggtctgggtgtgtaactcgg

SEQ ID NO: 744278 - DNA, 25 bp, Mus musculus
taaaaggtgggactgccctgtccct

SEQ ID NO: 744279 - DNA, 25 bp, Mus musculus
taaaaggtgggagtgccctgtccct

SEQ ID NO: 744280 - DNA, 25 bp, Mus musculus
taaaaggttgctactcttcctgcag

SEQ ID NO: 744281 - DNA, 25 bp, Mus musculus
taaaaggttgcttctcttcctgcag

SEQ ID NO: 744282 - DNA, 25 bp, Mus musculus
taaaagtaacgcaacaccaggtgtg

SEQ ID NO: 744283 - DNA, 25 bp, Mus musculus
taaaagtaacgctacaccaggtgtg

SEQ ID NO: 744284 - DNA, 25 bp, Mus musculus
taaaagtacataccacccatccaat

SEQ ID NO: 744285 - DNA, 25 bp, Mus musculus
taaaagtacatagcacccatccaat

SEQ ID NO: 744286 - DNA, 25 bp, Mus musculus
taaaagtaccaacccctatggctgg

SEQ ID NO: 744287 - DNA, 25 bp, Mus musculus
taaaagtaccaagccctatggctgg

SEQ ID NO: 744288 - DNA, 25 bp, Mus musculus
taaaagtaccgtatcagtgcctccc

SEQ ID NO: 744289 - DNA, 25 bp, Mus musculus
taaaagtaccgtttcagtgcctccc

SEQ ID NO: 744290 - DNA, 25 bp, Mus musculus
taaaagtagtgacctgccagcttaa

SEQ ID NO: 744291 - DNA, 25 bp, Mus musculus
taaaagtagtgacttccccgagtcg

SEQ ID NO: 744292 - DNA, 25 bp, Mus musculus
taaaagtagtgagctgccagcttaa

SEQ ID NO: 744293 - DNA, 25 bp, Mus musculus
taaaagtagtgagttccccgagtcg

SEQ ID NO: 744294 - DNA, 25 bp, Mus musculus
taaaagtattccatgctcagtgttt

SEQ ID NO: 744295 - DNA, 25 bp, Mus musculus
taaaagtattccttgctcagtgttt

SEQ ID NO: 744296 - DNA, 25 bp, Mus musculus
taaaagtccattcgcacaaggttgg

SEQ ID NO: 744297 - DNA, 25 bp, Mus musculus
taaaagtccattggcacaaggttgg

SEQ ID NO: 744298 - DNA, 25 bp, Mus musculus
taaaagtcttagactgtatcctctg

SEQ ID NO: 744299 - DNA, 25 bp, Mus musculus
taaaagtcttagtctgtatcctctg

SEQ ID NO: 744300 - DNA, 25 bp, Mus musculus
taaaagtcttcgatccgcagcacat

SEQ ID NO: 744301 - DNA, 25 bp, Mus musculus
taaaagtcttcgttccgcagcacat

SEQ ID NO: 744302 - DNA, 25 bp, Mus musculus
taaaagtcttctagtaaccatggga

SEQ ID NO: 744303 - DNA, 25 bp, Mus musculus
taaaagtcttcttgtaaccatggga

SEQ ID NO: 744304 - DNA, 25 bp, Mus musculus
taaaagtcttttagtcactccttgt

SEQ ID NO: 744305 - DNA, 25 bp, Mus musculus
taaaagtctttttgtcactccttgt

SEQ ID NO: 744306 - DNA, 25 bp, Mus musculus
taaaagtgaatgagttgtcctcctg

SEQ ID NO: 744307 - DNA, 25 bp, Mus musculus
taaaagtgaatgtgttgtcctcctg

SEQ ID NO: 744308 - DNA, 25 bp, Mus musculus
taaaagtgcaagaccctgcttccat

SEQ ID NO: 744309 - DNA, 25 bp, Mus musculus
taaaagtgcaagtccctgcttccat

SEQ ID NO: 744310 - DNA, 25 bp, Mus musculus
taaaagtgcaccatcaagagaccca

SEQ ID NO: 744311 - DNA, 25 bp, Mus musculus
taaaagtgcaccttcaagagaccca

SEQ ID NO: 744312 - DNA, 25 bp, Mus musculus
taaaagtgccacacctttggccaag

SEQ ID NO: 744313 - DNA, 25 bp, Mus musculus
taaaagtgccactcctttggccaag

SEQ ID NO: 744314 - DNA, 25 bp, Mus musculus
taaaagtgcctcattctcctaactc

SEQ ID NO: 744315 - DNA, 25 bp, Mus musculus
taaaagtgcctctttctcctaactc

SEQ ID NO: 744316 - DNA, 25 bp, Mus musculus
taaaagtgctgtatgtacgcaacct

SEQ ID NO: 744317 - DNA, 25 bp, Mus musculus
taaaagtgctgtttgtacgcaacct

SEQ ID NO: 744318 - DNA, 25 bp, Mus musculus
taaaagtgggatatctctccatcct

SEQ ID NO: 744319 - DNA, 25 bp, Mus musculus
taaaagtgggatttctctccatcct

SEQ ID NO: 744320 - DNA, 25 bp, Mus musculus
taaaagtgtttgctacaataaataa

SEQ ID NO: 744321 - DNA, 25 bp, Mus musculus
taaaagtgtttggtacaataaataa

SEQ ID NO: 744322 - DNA, 25 bp, Mus musculus
taaaagttaatgacgtcccatggag

SEQ ID NO: 744323 - DNA, 25 bp, Mus musculus
taaaagttaatgtcgtcccatggag

SEQ ID NO: 744324 - DNA, 25 bp, Mus musculus
taaaagttagatctcaggcttctct

SEQ ID NO: 744325 - DNA, 25 bp, Mus musculus
taaaagttagatgtcaggcttctct

SEQ ID NO: 744326 - DNA, 25 bp, Mus musculus
taaaagttctctagtgtctcccact

SEQ ID NO: 744327 - DNA, 25 bp, Mus musculus
taaaagttctcttgtgtctcccact

SEQ ID NO: 744328 - DNA, 25 bp, Mus musculus
taaaagttctgtcggcccttgaggt

SEQ ID NO: 744329 - DNA, 25 bp, Mus musculus
taaaagttctgtgggcccttgaggt

SEQ ID NO: 744330 - DNA, 25 bp, Mus musculus
taaaagttgattatgctggtgcaga

SEQ ID NO: 744331 - DNA, 25 bp, Mus musculus
taaaagttgattttgctggtgcaga

SEQ ID NO: 744332 - DNA, 25 bp, Mus musculus
taaaagttgcccctggttggccatt

SEQ ID NO: 744333 - DNA, 25 bp, Mus musculus
taaaagttgcccgtggttggccatt

SEQ ID NO: 744334 - DNA, 25 bp, Mus musculus
taaaagttgctaagatcccagcccc

SEQ ID NO: 744335 - DNA, 25 bp, Mus musculus
taaaagttgctatgatcccagcccc

SEQ ID NO: 744336 - DNA, 25 bp, Mus musculus
taaaagtttaggagcctttgcggat

SEQ ID NO: 744337 - DNA, 25 bp, Mus musculus
taaaagtttaggtgcctttgcggat

SEQ ID NO: 744338 - DNA, 25 bp, Mus musculus
taaaagtttcatcgtattcagcact

SEQ ID NO: 744339 - DNA, 25 bp, Mus musculus
taaaagtttcatggtattcagcact

SEQ ID NO: 744340 - DNA, 25 bp, Mus musculus
taaaagttttggctgctttgctctg

SEQ ID NO: 744341 - DNA, 25 bp, Mus musculus
taaaagttttgggtgctttgctctg

SEQ ID NO: 744342 - DNA, 25 bp, Mus musculus
taaaataacaagaaaccagggctgg

SEQ ID NO: 744343 - DNA, 25 bp, Mus musculus
taaaataacaagtaaccagggctgg

SEQ ID NO: 744344 - DNA, 25 bp, Mus musculus
taaaataacttacgagcaaatgctg

SEQ ID NO: 744345 - DNA, 25 bp, Mus musculus
taaaataacttaggagcaaatgctg

SEQ ID NO: 744346 - DNA, 25 bp, Mus musculus
taaaataatctccagtccttgctga

SEQ ID NO: 744347 - DNA, 25 bp, Mus musculus
taaaataatctcgagtccttgctga

SEQ ID NO: 744348 - DNA, 25 bp, Mus musculus
taaaataatgcacgcctgttttcac

SEQ ID NO: 744349 - DNA, 25 bp, Mus musculus
taaaataatgcaggcctgttttcac

SEQ ID NO: 744350 - DNA, 25 bp, Mus musculus
taaaataattccataatcccttaga

SEQ ID NO: 744351 - DNA, 25 bp, Mus musculus
taaaataattccttaatcccttaga

SEQ ID NO: 744352 - DNA, 25 bp, Mus musculus
taaaatacaaaccggtgtgcctaag

SEQ ID NO: 744353 - DNA, 25 bp, Mus musculus
taaaatacaaacgggtgtgcctaag

SEQ ID NO: 744354 - DNA, 25 bp, Mus musculus
taaaatacaacacttcttggtaagt

SEQ ID NO: 744355 - DNA, 25 bp, Mus musculus
taaaatacaacagttcttggtaagt

SEQ ID NO: 744356 - DNA, 25 bp, Mus musculus
taaaatacagccactctgagtccct

SEQ ID NO: 744357 - DNA, 25 bp, Mus musculus
taaaatacagcctctctgagtccct

SEQ ID NO: 744358 - DNA, 25 bp, Mus musculus
taaaatacatgccaacagggctgga

SEQ ID NO: 744359 - DNA, 25 bp, Mus musculus
taaaatacatgcgaacagggctgga

SEQ ID NO: 744360 - DNA, 25 bp, Mus musculus
taaaatactctcacacaccaggctg

SEQ ID NO: 744361 - DNA, 25 bp, Mus musculus
taaaatactctctcacaccaggctg

SEQ ID NO: 744362 - DNA, 25 bp, Mus musculus
taaaatacttctacttctgggctgg

SEQ ID NO: 744363 - DNA, 25 bp, Mus musculus
taaaatacttcttcttctgggctgg

SEQ ID NO: 744364 - DNA, 25 bp, Mus musculus
taaaatacttgcattgccctcatgg

SEQ ID NO: 744365 - DNA, 25 bp, Mus musculus
taaaatacttgctttgccctcatgg

SEQ ID NO: 744366 - DNA, 25 bp, Mus musculus
taaaatagacccctcttgacctgtt

SEQ ID NO: 744367 - DNA, 25 bp, Mus musculus
taaaatagacccgtcttgacctgtt

SEQ ID NO: 744368 - DNA, 25 bp, Mus musculus
taaaatagctgccacattgtagatg

SEQ ID NO: 744369 - DNA, 25 bp, Mus musculus
taaaatagctgcgacattgtagatg

SEQ ID NO: 744370 - DNA, 25 bp, Mus musculus
taaaatagctggacactgtgttaga

SEQ ID NO: 744371 - DNA, 25 bp, Mus musculus
taaaatagctggtcactgtgttaga

SEQ ID NO: 744372 - DNA, 25 bp, Mus musculus
taaaataggacaatcagagtgctca

SEQ ID NO: 744373 - DNA, 25 bp, Mus musculus
taaaataggacattcagagtgctca

SEQ ID NO: 744374 - DNA, 25 bp, Mus musculus
taaaatagtgccagccagccagagc

SEQ ID NO: 744375 - DNA, 25 bp, Mus musculus
taaaatagtgcctgccagccagagc

SEQ ID NO: 744376 - DNA, 25 bp, Mus musculus
taaaatatcaatcggaactttccta

SEQ ID NO: 744377 - DNA, 25 bp, Mus musculus
taaaatatcaatgggaactttccta

SEQ ID NO: 744378 - DNA, 25 bp, Mus musculus
taaaatatcctcaatagcacactat

SEQ ID NO: 744379 - DNA, 25 bp, Mus musculus
taaaatatcctctatagcacactat

SEQ ID NO: 744380 - DNA, 25 bp, Mus musculus
taaaatattgatacttgattccgct

SEQ ID NO: 744381 - DNA, 25 bp, Mus musculus
taaaatattgattcttgattccgct

SEQ ID NO: 744382 - DNA, 25 bp, Mus musculus
taaaatcacactaagaaactggttg

SEQ ID NO: 744383 - DNA, 25 bp, Mus musculus
taaaatcacacttagaaactggttg

SEQ ID NO: 744384 - DNA, 25 bp, Mus musculus
taaaatcacattacgcttcgtcaga

SEQ ID NO: 744385 - DNA, 25 bp, Mus musculus
taaaatcacatttcgcttcgtcaga

SEQ ID NO: 744386 - DNA, 25 bp, Mus musculus
taaaatcactcacaggaaggccacg

SEQ ID NO: 744387 - DNA, 25 bp, Mus musculus
taaaatcactcagaggaaggccacg

SEQ ID NO: 744388 - DNA, 25 bp, Mus musculus
taaaatcacttgactcaacagttga

SEQ ID NO: 744389 - DNA, 25 bp, Mus musculus
taaaatcacttgtctcaacagttga

SEQ ID NO: 744390 - DNA, 25 bp, Mus musculus
taaaatcatccaagggacgagcgtg

SEQ ID NO: 744391 - DNA, 25 bp, Mus musculus
taaaatcatccatgggacgagcgtg

SEQ ID NO: 744392 - DNA, 25 bp, Mus musculus
taaaatcatgtgctatcgctcccaa

SEQ ID NO: 744393 - DNA, 25 bp, Mus musculus
taaaatcatgtggtatcgctcccaa

SEQ ID NO: 744394 - DNA, 25 bp, Mus musculus
taaaatccactcctccaggttgagg

SEQ ID NO: 744395 - DNA, 25 bp, Mus musculus
taaaatccactcgtccaggttgagg

SEQ ID NO: 744396 - DNA, 25 bp, Mus musculus
taaaatccaggcaccatagtgtgtg

SEQ ID NO: 744397 - DNA, 25 bp, Mus musculus
taaaatccaggctccatagtgtgtg

SEQ ID NO: 744398 - DNA, 25 bp, Mus musculus
taaaatccatgtcggcttgccggtc

SEQ ID NO: 744399 - DNA, 25 bp, Mus musculus
taaaatccatgtgggcttgccggtc

SEQ ID NO: 744400 - DNA, 25 bp, Mus musculus
taaaatcccacactgctttgttctc

SEQ ID NO: 744401 - DNA, 25 bp, Mus musculus
taaaatcccacagtgctttgttctc

SEQ ID NO: 744402 - DNA, 25 bp, Mus musculus
taaaatccctaacagcaagcgccaa

SEQ ID NO: 744403 - DNA, 25 bp, Mus musculus
taaaatccctaagagcaagcgccaa

SEQ ID NO: 744404 - DNA, 25 bp, Mus musculus
taaaatccctgtaagatccaaactc

SEQ ID NO: 744405 - DNA, 25 bp, Mus musculus
taaaatccctgttagatccaaactc

SEQ ID NO: 744406 - DNA, 25 bp, Mus musculus
taaaatccgggaagaggtgccaggt

SEQ ID NO: 744407 - DNA, 25 bp, Mus musculus
taaaatccgggatgaggtgccaggt

SEQ ID NO: 744408 - DNA, 25 bp, Mus musculus
taaaatcctattacagcatccctct

SEQ ID NO: 744409 - DNA, 25 bp, Mus musculus
taaaatcctatttcagcatccctct

SEQ ID NO: 744410 - DNA, 25 bp, Mus musculus
taaaatcctgacattctggttacaa

SEQ ID NO: 744411 - DNA, 25 bp, Mus musculus
taaaatcctgactttctggttacaa

SEQ ID NO: 744412 - DNA, 25 bp, Mus musculus
taaaatcctgtaaagctgggctgag

SEQ ID NO: 744413 - DNA, 25 bp, Mus musculus
taaaatcctgtatagctgggctgag

SEQ ID NO: 744414 - DNA, 25 bp, Mus musculus
taaaatcctgtcatgtgacccatag

SEQ ID NO: 744415 - DNA, 25 bp, Mus musculus
taaaatcctgtcttgtgacccatag

SEQ ID NO: 744416 - DNA, 25 bp, Mus musculus
taaaatccttttctagtccctgtag

SEQ ID NO: 744417 - DNA, 25 bp, Mus musculus
taaaatccttttgtagtccctgtag

SEQ ID NO: 744418 - DNA, 25 bp, Mus musculus
taaaatcgatgcctaccacaccgcg

SEQ ID NO: 744419 - DNA, 25 bp, Mus musculus
taaaatcgatgcgtaccacaccgcg

SEQ ID NO: 744420 - DNA, 25 bp, Mus musculus
taaaatcgcagacttccttttcctc

SEQ ID NO: 744421 - DNA, 25 bp, Mus musculus
taaaatcgcagagttccttttcctc

SEQ ID NO: 744422 - DNA, 25 bp, Mus musculus
taaaatcgctttatccactggtcaa

SEQ ID NO: 744423 - DNA, 25 bp, Mus musculus
taaaatcgctttttccactggtcaa

SEQ ID NO: 744424 - DNA, 25 bp, Mus musculus
taaaatcgttttcctgtttcaggag

SEQ ID NO: 744425 - DNA, 25 bp, Mus musculus
taaaatcgttttgctgtttcaggag

SEQ ID NO: 744426 - DNA, 25 bp, Mus musculus
taaaatctaaaaccccatcctcaag

SEQ ID NO: 744427 - DNA, 25 bp, Mus musculus
taaaatctaaaagcccatcctcaag

SEQ ID NO: 744428 - DNA, 25 bp, Mus musculus
taaaatctaaatctcccctctggtc

SEQ ID NO: 744429 - DNA, 25 bp, Mus musculus
taaaatctaaatgtcccctctggtc

SEQ ID NO: 744430 - DNA, 25 bp, Mus musculus
taaaatctaccactgaatctgcctg

SEQ ID NO: 744431 - DNA, 25 bp, Mus musculus
taaaatctaccagtgaatctgcctg

SEQ ID NO: 744432 - DNA, 25 bp, Mus musculus
taaaatctaggtctccctggaaagt

SEQ ID NO: 744433 - DNA, 25 bp, Mus musculus
taaaatctaggtgtccctggaaagt

SEQ ID NO: 744434 - DNA, 25 bp, Mus musculus
taaaatctgtgcactttgtccaaag

SEQ ID NO: 744435 - DNA, 25 bp, Mus musculus
taaaatctgtgctctttgtccaaag

SEQ ID NO: 744436 - DNA, 25 bp, Mus musculus
taaaatcttctgagtttaactgcca

SEQ ID NO: 744437 - DNA, 25 bp, Mus musculus
taaaatcttctgtgtttaactgcca

SEQ ID NO: 744438 - DNA, 25 bp, Mus musculus
taaaatctttgtactcccaactcac

SEQ ID NO: 744439 - DNA, 25 bp, Mus musculus
taaaatctttgtcggcagccgggag

SEQ ID NO: 744440 - DNA, 25 bp, Mus musculus
taaaatctttgtgggcagccgggag

SEQ ID NO: 744441 - DNA, 25 bp, Mus musculus
taaaatctttgttctcccaactcac

SEQ ID NO: 744442 - DNA, 25 bp, Mus musculus
taaaatctttttcctccctcttcgg

SEQ ID NO: 744443 - DNA, 25 bp, Mus musculus
taaaatctttttgctccctcttcgg

SEQ ID NO: 744444 - DNA, 25 bp, Mus musculus
taaaatgaatgcaccagcctcactc

SEQ ID NO: 744445 - DNA, 25 bp, Mus musculus
taaaatgaatgctccagcctcactc

SEQ ID NO: 744446 - DNA, 25 bp, Mus musculus
taaaatgacagacacccagggctac

SEQ ID NO: 744447 - DNA, 25 bp, Mus musculus
taaaatgacagagacccagggctac

SEQ ID NO: 744448 - DNA, 25 bp, Mus musculus
taaaatgacctaattggcccaaaag

SEQ ID NO: 744449 - DNA, 25 bp, Mus musculus
taaaatgacctatttggcccaaaag

SEQ ID NO: 744450 - DNA, 25 bp, Mus musculus
taaaatgactctacccagcaacttt

SEQ ID NO: 744451 - DNA, 25 bp, Mus musculus
taaaatgactctacctgctctgtgc

SEQ ID NO: 744452 - DNA, 25 bp, Mus musculus
taaaatgactcttcccagcaacttt

SEQ ID NO: 744453 - DNA, 25 bp, Mus musculus
taaaatgactcttcctgctctgtgc

SEQ ID NO: 744454 - DNA, 25 bp, Mus musculus
taaaatgagcccagacctttaccca

SEQ ID NO: 744455 - DNA, 25 bp, Mus musculus
taaaatgagccccagcacaccctta

SEQ ID NO: 744456 - DNA, 25 bp, Mus musculus
taaaatgagcccgagcacaccctta

SEQ ID NO: 744457 - DNA, 25 bp, Mus musculus
taaaatgagccctgacctttaccca

SEQ ID NO: 744458 - DNA, 25 bp, Mus musculus
taaaatgatcctagcccagcggtgg

SEQ ID NO: 744459 - DNA, 25 bp, Mus musculus
taaaatgatccttgcccagcggtgg

SEQ ID NO: 744460 - DNA, 25 bp, Mus musculus
taaaatgatcgtattatttctttca

SEQ ID NO: 744461 - DNA, 25 bp, Mus musculus
taaaatgatcgttttatttctttca

SEQ ID NO: 744462 - DNA, 25 bp, Mus musculus
taaaatgcaccccaaactaggaatt

SEQ ID NO: 744463 - DNA, 25 bp, Mus musculus
taaaatgcacccgaaactaggaatt

SEQ ID NO: 744464 - DNA, 25 bp, Mus musculus
taaaatgcactaaagctggagactt

SEQ ID NO: 744465 - DNA, 25 bp, Mus musculus
taaaatgcactatagctggagactt

SEQ ID NO: 744466 - DNA, 25 bp, Mus musculus
taaaatgcagttctcctttcttaaa

SEQ ID NO: 744467 - DNA, 25 bp, Mus musculus
taaaatgcagttgtcctttcttaaa

SEQ ID NO: 744468 - DNA, 25 bp, Mus musculus
taaaatgccactatccctcctttca

SEQ ID NO: 744469 - DNA, 25 bp, Mus musculus
taaaatgccactttccctcctttca

SEQ ID NO: 744470 - DNA, 25 bp, Mus musculus
taaaatgccatccaacaggtgttaa

SEQ ID NO: 744471 - DNA, 25 bp, Mus musculus
taaaatgccatcgaacaggtgttaa

SEQ ID NO: 744472 - DNA, 25 bp, Mus musculus
taaaatgcccacacagaaatcactg

SEQ ID NO: 744473 - DNA, 25 bp, Mus musculus
taaaatgcccactcagaaatcactg

SEQ ID NO: 744474 - DNA, 25 bp, Mus musculus
taaaatgcccagagtcgagaccaga

SEQ ID NO: 744475 - DNA, 25 bp, Mus musculus
taaaatgcccagtgtcgagaccaga

SEQ ID NO: 744476 - DNA, 25 bp, Mus musculus
taaaatgccctcagagccttgtgtg

SEQ ID NO: 744477 - DNA, 25 bp, Mus musculus
taaaatgccctctgagccttgtgtg

SEQ ID NO: 744478 - DNA, 25 bp, Mus musculus
taaaatgcgaaacctcctcatagcc

SEQ ID NO: 744479 - DNA, 25 bp, Mus musculus
taaaatgcgaaagctcctcatagcc

SEQ ID NO: 744480 - DNA, 25 bp, Mus musculus
taaaatgctgcaacgctttgggcca

SEQ ID NO: 744481 - DNA, 25 bp, Mus musculus
taaaatgctgcatcgctttgggcca

SEQ ID NO: 744482 - DNA, 25 bp, Mus musculus
taaaatgctggcaccccaaagcgga

SEQ ID NO: 744483 - DNA, 25 bp, Mus musculus
taaaatgctggctccccaaagcgga

SEQ ID NO: 744484 - DNA, 25 bp, Mus musculus
taaaatgctggtcacaaaagtcagg

SEQ ID NO: 744485 - DNA, 25 bp, Mus musculus
taaaatgctggtgacaaaagtcagg

SEQ ID NO: 744486 - DNA, 25 bp, Mus musculus
taaaatgctgttacccactgataga

SEQ ID NO: 744487 - DNA, 25 bp, Mus musculus
taaaatgctgtttcccactgataga

SEQ ID NO: 744488 - DNA, 25 bp, Mus musculus
taaaatggatgcctccgatacaggg

SEQ ID NO: 744489 - DNA, 25 bp, Mus musculus
taaaatggatgcgtccgatacaggg

SEQ ID NO: 744490 - DNA, 25 bp, Mus musculus
taaaatggcattactgcacagtttt

SEQ ID NO: 744491 - DNA, 25 bp, Mus musculus
taaaatggcatttctgcacagtttt

SEQ ID NO: 744492 - DNA, 25 bp, Mus musculus
taaaatggctaaccaggctgcctgc

SEQ ID NO: 744493 - DNA, 25 bp, Mus musculus
taaaatggctaagcaggctgcctgc

SEQ ID NO: 744494 - DNA, 25 bp, Mus musculus
taaaatggctcgatcctcagacttt

SEQ ID NO: 744495 - DNA, 25 bp, Mus musculus
taaaatggctcgttcctcagacttt

SEQ ID NO: 744496 - DNA, 25 bp, Mus musculus
taaaatggctgtaccggcctgtatg

SEQ ID NO: 744497 - DNA, 25 bp, Mus musculus
taaaatggctgttccggcctgtatg

SEQ ID NO: 744498 - DNA, 25 bp, Mus musculus
taaaatgtaattacctttgctcttt

SEQ ID NO: 744499 - DNA, 25 bp, Mus musculus
taaaatgtaatttcctttgctcttt

SEQ ID NO: 744500 - DNA, 25 bp, Mus musculus
taaaatgtagttactccaggtgtat

SEQ ID NO: 744501 - DNA, 25 bp, Mus musculus
taaaatgtagtttctccaggtgtat

SEQ ID NO: 744502 - DNA, 25 bp, Mus musculus
taaaatgtcctccttcactttcgta

SEQ ID NO: 744503 - DNA, 25 bp, Mus musculus
taaaatgtcctcgttcactttcgta

SEQ ID NO: 744504 - DNA, 25 bp, Mus musculus
taaaatgtcgttactcctgtgtgca

SEQ ID NO: 744505 - DNA, 25 bp, Mus musculus
taaaatgtcgtttctcctgtgtgca

SEQ ID NO: 744506 - DNA, 25 bp, Mus musculus
taaaatgtctgtactcatggcttcc

SEQ ID NO: 744507 - DNA, 25 bp, Mus musculus
taaaatgtctgttctcatggcttcc

SEQ ID NO: 744508 - DNA, 25 bp, Mus musculus
taaaatgtgaggacatcccatcctg

SEQ ID NO: 744509 - DNA, 25 bp, Mus musculus
taaaatgtgaggtcatcccatcctg

SEQ ID NO: 744510 - DNA, 25 bp, Mus musculus
taaaatgtgattcttggctgaatac

SEQ ID NO: 744511 - DNA, 25 bp, Mus musculus
taaaatgtgattgttggctgaatac

SEQ ID NO: 744512 - DNA, 25 bp, Mus musculus
taaaatgttaataaaggatggagac

SEQ ID NO: 744513 - DNA, 25 bp, Mus musculus
taaaatgttaattaaggatggagac

SEQ ID NO: 744514 - DNA, 25 bp, Mus musculus
taaaatgtttgtccctagcctagag

SEQ ID NO: 744515 - DNA, 25 bp, Mus musculus
taaaatgtttgtgcctagcctagag

SEQ ID NO: 744516 - DNA, 25 bp, Mus musculus
taaaattaaaacagccaagtggctt

SEQ ID NO: 744517 - DNA, 25 bp, Mus musculus
taaaattaaaactgccaagtggctt

SEQ ID NO: 744518 - DNA, 25 bp, Mus musculus
taaaattaaattccctaagacgtca

SEQ ID NO: 744519 - DNA, 25 bp, Mus musculus
taaaattaaattgcctaagacgtca

SEQ ID NO: 744520 - DNA, 25 bp, Mus musculus
taaaattaacatatgccccaagtca

SEQ ID NO: 744521 - DNA, 25 bp, Mus musculus
taaaattaacatttgccccaagtca

SEQ ID NO: 744522 - DNA, 25 bp, Mus musculus
taaaattacaccacattcttcctgc

SEQ ID NO: 744523 - DNA, 25 bp, Mus musculus
taaaattacacctcattcttcctgc

SEQ ID NO: 744524 - DNA, 25 bp, Mus musculus
taaaattaccccacagctactttct

SEQ ID NO: 744525 - DNA, 25 bp, Mus musculus
taaaattacccctcagctactttct

SEQ ID NO: 744526 - DNA, 25 bp, Mus musculus
taaaattacctcatcgagcctgaat

SEQ ID NO: 744527 - DNA, 25 bp, Mus musculus
taaaattacctcttcgagcctgaat

SEQ ID NO: 744528 - DNA, 25 bp, Mus musculus
taaaattagactaccttccctcgct

SEQ ID NO: 744529 - DNA, 25 bp, Mus musculus
taaaattagacttccttccctcgct

SEQ ID NO: 744530 - DNA, 25 bp, Mus musculus
taaaattagcagctgttctagtcct

SEQ ID NO: 744531 - DNA, 25 bp, Mus musculus
taaaattagcaggtgttctagtcct

SEQ ID NO: 744532 - DNA, 25 bp, Mus musculus
taaaattatcagatgcttgggtcct

SEQ ID NO: 744533 - DNA, 25 bp, Mus musculus
taaaattatcagttgcttgggtcct

SEQ ID NO: 744534 - DNA, 25 bp, Mus musculus
taaaattatcctcaaacggagtttg

SEQ ID NO: 744535 - DNA, 25 bp, Mus musculus
taaaattatcctgaaacggagtttg

SEQ ID NO: 744536 - DNA, 25 bp, Mus musculus
taaaattattatcccagctacttgg

SEQ ID NO: 744537 - DNA, 25 bp, Mus musculus
taaaattattatgccagctacttgg

SEQ ID NO: 744538 - DNA, 25 bp, Mus musculus
taaaattattgcatttgcccctacc

SEQ ID NO: 744539 - DNA, 25 bp, Mus musculus
taaaattattgcttttgcccctacc

SEQ ID NO: 744540 - DNA, 25 bp, Mus musculus
taaaattcacttccaattttcaggt

SEQ ID NO: 744541 - DNA, 25 bp, Mus musculus
taaaattcacttgcaattttcaggt

SEQ ID NO: 744542 - DNA, 25 bp, Mus musculus
taaaattcataccacccaccaaaag

SEQ ID NO: 744543 - DNA, 25 bp, Mus musculus
taaaattcatacgacccaccaaaag

SEQ ID NO: 744544 - DNA, 25 bp, Mus musculus
taaaattcatggctgcccttatgga

SEQ ID NO: 744545 - DNA, 25 bp, Mus musculus
taaaattcatgggtgcccttatgga

SEQ ID NO: 744546 - DNA, 25 bp, Mus musculus
taaaattccaacaatctgcccaaag

SEQ ID NO: 744547 - DNA, 25 bp, Mus musculus
taaaattccaactatctgcccaaag

SEQ ID NO: 744548 - DNA, 25 bp, Mus musculus
taaaattccaagagattagggtcct

SEQ ID NO: 744549 - DNA, 25 bp, Mus musculus
taaaattccaagtgattagggtcct

SEQ ID NO: 744550 - DNA, 25 bp, Mus musculus
taaaattcggctatgtaggagcggg

SEQ ID NO: 744551 - DNA, 25 bp, Mus musculus
taaaattcggctttgtaggagcggg

SEQ ID NO: 744552 - DNA, 25 bp, Mus musculus
taaaattctactacctggtgtttct

SEQ ID NO: 744553 - DNA, 25 bp, Mus musculus
taaaattctacttcctggtgtttct

SEQ ID NO: 744554 - DNA, 25 bp, Mus musculus
taaaattctcttcctacccttgatt

SEQ ID NO: 744555 - DNA, 25 bp, Mus musculus
taaaattctcttcgcacactattaa

SEQ ID NO: 744556 - DNA, 25 bp, Mus musculus
taaaattctcttgctacccttgatt

SEQ ID NO: 744557 - DNA, 25 bp, Mus musculus
taaaattctcttggcacactattaa

SEQ ID NO: 744558 - DNA, 25 bp, Mus musculus
taaaattgaccaacctctacgcagc

SEQ ID NO: 744559 - DNA, 25 bp, Mus musculus
taaaattgaccatcctctacgcagc

SEQ ID NO: 744560 - DNA, 25 bp, Mus musculus
taaaattgagttagtgccacctagg

SEQ ID NO: 744561 - DNA, 25 bp, Mus musculus
taaaattgagtttgtgccacctagg

SEQ ID NO: 744562 - DNA, 25 bp, Mus musculus
taaaattgcactacttgtatccgtg

SEQ ID NO: 744563 - DNA, 25 bp, Mus musculus
taaaattgcacttcttgtatccgtg

SEQ ID NO: 744564 - DNA, 25 bp, Mus musculus
taaaattgcttcattgccagggtga

SEQ ID NO: 744565 - DNA, 25 bp, Mus musculus
taaaattgcttctttgccagggtga

SEQ ID NO: 744566 - DNA, 25 bp, Mus musculus
taaaattggtagcactggaatctcc

SEQ ID NO: 744567 - DNA, 25 bp, Mus musculus
taaaattggtaggactggaatctcc

SEQ ID NO: 744568 - DNA, 25 bp, Mus musculus
taaaattgtaaacacatccctagtg

SEQ ID NO: 744569 - DNA, 25 bp, Mus musculus
taaaattgtaaagacatccctagtg

SEQ ID NO: 744570 - DNA, 25 bp, Mus musculus
taaaattgtctaccgtgatgcctgc

SEQ ID NO: 744571 - DNA, 25 bp, Mus musculus
taaaattgtctagcgtgatgcctgc

SEQ ID NO: 744572 - DNA, 25 bp, Mus musculus
taaaatttaatactctgtccttgaa

SEQ ID NO: 744573 - DNA, 25 bp, Mus musculus
taaaatttaatagtctgtccttgaa

SEQ ID NO: 744574 - DNA, 25 bp, Mus musculus
taaaatttagttcctgcagcttgat

SEQ ID NO: 744575 - DNA, 25 bp, Mus musculus
taaaatttagttgctgcagcttgat

SEQ ID NO: 744576 - DNA, 25 bp, Mus musculus
taaaatttcaatctcacctgtgttt

SEQ ID NO: 744577 - DNA, 25 bp, Mus musculus
taaaatttcaatgtcacctgtgttt

SEQ ID NO: 744578 - DNA, 25 bp, Mus musculus
taaaatttcagcatgcctttttgtg

SEQ ID NO: 744579 - DNA, 25 bp, Mus musculus
taaaatttcagcttgcctttttgtg

SEQ ID NO: 744580 - DNA, 25 bp, Mus musculus
taaaatttcagtcatccttcaaggg

SEQ ID NO: 744581 - DNA, 25 bp, Mus musculus
taaaatttcagtgatccttcaaggg

SEQ ID NO: 744582 - DNA, 25 bp, Mus musculus
taaaatttctccaaatgacaccaag

SEQ ID NO: 744583 - DNA, 25 bp, Mus musculus
taaaatttctcctaatgacaccaag

SEQ ID NO: 744584 - DNA, 25 bp, Mus musculus
taaaatttgaacctttgatgtgcaa

SEQ ID NO: 744585 - DNA, 25 bp, Mus musculus
taaaatttgaacgtttgatgtgcaa

SEQ ID NO: 744586 - DNA, 25 bp, Mus musculus
taaaatttgcataccccaagaacca

SEQ ID NO: 744587 - DNA, 25 bp, Mus musculus
taaaatttgcattccccaagaacca

SEQ ID NO: 744588 - DNA, 25 bp, Mus musculus
taaaatttgcctatctgccttgagt

SEQ ID NO: 744589 - DNA, 25 bp, Mus musculus
taaaatttgcctttctgccttgagt

SEQ ID NO: 744590 - DNA, 25 bp, Mus musculus
taaaatttgctcctgtcacccaaag

SEQ ID NO: 744591 - DNA, 25 bp, Mus musculus
taaaatttgctcgtgtcacccaaag

SEQ ID NO: 744592 - DNA, 25 bp, Mus musculus
taaaatttgtcccaccctggtgatc

SEQ ID NO: 744593 - DNA, 25 bp, Mus musculus
taaaatttgtccgaccctggtgatc

SEQ ID NO: 744594 - DNA, 25 bp, Mus musculus
taaaattttcttccttagtccttat

SEQ ID NO: 744595 - DNA, 25 bp, Mus musculus
taaaattttcttgcttagtccttat

SEQ ID NO: 744596 - DNA, 25 bp, Mus musculus
taaaattttgtgacgtgtctttcct

SEQ ID NO: 744597 - DNA, 25 bp, Mus musculus
taaaattttgtgtcgtgtctttcct

SEQ ID NO: 744598 - DNA, 25 bp, Mus musculus
taaacaaacaggaaccactctctcc

SEQ ID NO: 744599 - DNA, 25 bp, Mus musculus
taaacaaacaggtaccactctctcc

SEQ ID NO: 744600 - DNA, 25 bp, Mus musculus
taaacaaacagtccggtcactccta

SEQ ID NO: 744601 - DNA, 25 bp, Mus musculus
taaacaaacagtgcggtcactccta

SEQ ID NO: 744602 - DNA, 25 bp, Mus musculus
taaacaaagaccagcgtcggcacca

SEQ ID NO: 744603 - DNA, 25 bp, Mus musculus
taaacaaagaccattcagcctggtt

SEQ ID NO: 744604 - DNA, 25 bp, Mus musculus
taaacaaagacctgcgtcggcacca

SEQ ID NO: 744605 - DNA, 25 bp, Mus musculus
taaacaaagacctttcagcctggtt

SEQ ID NO: 744606 - DNA, 25 bp, Mus musculus
taaacaacagcacgtgccaggagct

SEQ ID NO: 744607 - DNA, 25 bp, Mus musculus
taaacaacagcaggtgccaggagct

SEQ ID NO: 744608 - DNA, 25 bp, Mus musculus
taaacaaccttgaatcctccttatg

SEQ ID NO: 744609 - DNA, 25 bp, Mus musculus
taaacaaccttgtatcctccttatg

SEQ ID NO: 744610 - DNA, 25 bp, Mus musculus
taaacaacgcatctctcctttagag

SEQ ID NO: 744611 - DNA, 25 bp, Mus musculus
taaacaacgcatgtctcctttagag

SEQ ID NO: 744612 - DNA, 25 bp, Mus musculus
taaacaacttcaaatgcgcccgact

SEQ ID NO: 744613 - DNA, 25 bp, Mus musculus
taaacaacttcatatgcgcccgact

SEQ ID NO: 744614 - DNA, 25 bp, Mus musculus
taaacaacttttagccatccagatg

SEQ ID NO: 744615 - DNA, 25 bp, Mus musculus
taaacaactttttgccatccagatg

SEQ ID NO: 744616 - DNA, 25 bp, Mus musculus
taaacaagacccacagcctgtgtcc

SEQ ID NO: 744617 - DNA, 25 bp, Mus musculus
taaacaagaccctcagcctgtgtcc

SEQ ID NO: 744618 - DNA, 25 bp, Mus musculus
taaacaagcaatcgcggcaaacatc

SEQ ID NO: 744619 - DNA, 25 bp, Mus musculus
taaacaagcaatggcggcaaacatc

SEQ ID NO: 744620 - DNA, 25 bp, Mus musculus
taaacaagcacaacatgtagtctgc

SEQ ID NO: 744621 - DNA, 25 bp, Mus musculus
taaacaagcacatcatgtagtctgc

SEQ ID NO: 744622 - DNA, 25 bp, Mus musculus
taaacaagcatgactctctgtgaat

SEQ ID NO: 744623 - DNA, 25 bp, Mus musculus
taaacaagcatgtctctctgtgaat

SEQ ID NO: 744624 - DNA, 25 bp, Mus musculus
taaacaaggaagagtccctgcctgc

SEQ ID NO: 744625 - DNA, 25 bp, Mus musculus
taaacaaggaagtgtccctgcctgc

SEQ ID NO: 744626 - DNA, 25 bp, Mus musculus
taaacaaggcacaggtttgagtttt

SEQ ID NO: 744627 - DNA, 25 bp, Mus musculus
taaacaaggcactggtttgagtttt

SEQ ID NO: 744628 - DNA, 25 bp, Mus musculus
taaacaagggccagactaggttcct

SEQ ID NO: 744629 - DNA, 25 bp, Mus musculus
taaacaagggccaggtcttctcagt

SEQ ID NO: 744630 - DNA, 25 bp, Mus musculus
taaacaagggcctgactaggttcct

SEQ ID NO: 744631 - DNA, 25 bp, Mus musculus
taaacaagggcctggtcttctcagt

SEQ ID NO: 744632 - DNA, 25 bp, Mus musculus
taaacaaggtctctcccatgttaat

SEQ ID NO: 744633 - DNA, 25 bp, Mus musculus
taaacaaggtctgtcccatgttaat

SEQ ID NO: 744634 - DNA, 25 bp, Mus musculus
taaacaagtgcactactgctgagct

SEQ ID NO: 744635 - DNA, 25 bp, Mus musculus
taaacaagtgcagtactgctgagct

SEQ ID NO: 744636 - DNA, 25 bp, Mus musculus
taaacaatcatactccagctgggcg

SEQ ID NO: 744637 - DNA, 25 bp, Mus musculus
taaacaatcatagtccagctgggcg

SEQ ID NO: 744638 - DNA, 25 bp, Mus musculus
taaacaatccttcgagtggcctgcc

SEQ ID NO: 744639 - DNA, 25 bp, Mus musculus
taaacaatccttggagtggcctgcc

SEQ ID NO: 744640 - DNA, 25 bp, Mus musculus
taaacaatgccgctagaaccgttcc

SEQ ID NO: 744641 - DNA, 25 bp, Mus musculus
taaacaatgccggtagaaccgttcc

SEQ ID NO: 744642 - DNA, 25 bp, Mus musculus
taaacaattatcaggccagccagag

SEQ ID NO: 744643 - DNA, 25 bp, Mus musculus
taaacaattatctggccagccagag

SEQ ID NO: 744644 - DNA, 25 bp, Mus musculus
taaacaatttttctgtagctcttta

SEQ ID NO: 744645 - DNA, 25 bp, Mus musculus
taaacaatttttgtgtagctcttta

SEQ ID NO: 744646 - DNA, 25 bp, Mus musculus
taaacacaaggcctagggtgagatt

SEQ ID NO: 744647 - DNA, 25 bp, Mus musculus
taaacacaaggcgtagggtgagatt

SEQ ID NO: 744648 - DNA, 25 bp, Mus musculus
taaacacacagccaggtgccacaga

SEQ ID NO: 744649 - DNA, 25 bp, Mus musculus
taaacacacagcgaggtgccacaga

SEQ ID NO: 744650 - DNA, 25 bp, Mus musculus
taaacacacccacctatttacttcg

SEQ ID NO: 744651 - DNA, 25 bp, Mus musculus
taaacacacccagctatttacttcg

SEQ ID NO: 744652 - DNA, 25 bp, Mus musculus
taaacacactgtatgcaggcctcat

SEQ ID NO: 744653 - DNA, 25 bp, Mus musculus
taaacacactgtttgcaggcctcat

SEQ ID NO: 744654 - DNA, 25 bp, Mus musculus
taaacacacttgaagtttagctttt

SEQ ID NO: 744655 - DNA, 25 bp, Mus musculus
taaacacacttgtagtttagctttt

SEQ ID NO: 744656 - DNA, 25 bp, Mus musculus
taaacacagagtaacaggaaaacac

SEQ ID NO: 744657 - DNA, 25 bp, Mus musculus
taaacacagagttacaggaaaacac

SEQ ID NO: 744658 - DNA, 25 bp, Mus musculus
taaacacagccaactggagcactca

SEQ ID NO: 744659 - DNA, 25 bp, Mus musculus
taaacacagccatctggagcactca

SEQ ID NO: 744660 - DNA, 25 bp, Mus musculus
taaacacagcttccatgacttcctc

SEQ ID NO: 744661 - DNA, 25 bp, Mus musculus
taaacacagcttgcatgacttcctc

SEQ ID NO: 744662 - DNA, 25 bp, Mus musculus
taaacacagtcacgtctctctagca

SEQ ID NO: 744663 - DNA, 25 bp, Mus musculus
taaacacagtcaggtctctctagca

SEQ ID NO: 744664 - DNA, 25 bp, Mus musculus
taaacacagtctcctcagtgggtgc

SEQ ID NO: 744665 - DNA, 25 bp, Mus musculus
taaacacagtctgctcagtgggtgc

SEQ ID NO: 744666 - DNA, 25 bp, Mus musculus
taaacacatcataaagaccagccaa

SEQ ID NO: 744667 - DNA, 25 bp, Mus musculus
taaacacatcattaagaccagccaa

SEQ ID NO: 744668 - DNA, 25 bp, Mus musculus
taaacacatcttacttccctacagg

SEQ ID NO: 744669 - DNA, 25 bp, Mus musculus
taaacacatctttcttccctacagg

SEQ ID NO: 744670 - DNA, 25 bp, Mus musculus
taaacaccacagacaccgtgacaca

SEQ ID NO: 744671 - DNA, 25 bp, Mus musculus
taaacaccacagtcaccgtgacaca

SEQ ID NO: 744672 - DNA, 25 bp, Mus musculus
taaacaccactaacccaagacagtt

SEQ ID NO: 744673 - DNA, 25 bp, Mus musculus
taaacaccactatcccaagacagtt

SEQ ID NO: 744674 - DNA, 25 bp, Mus musculus
taaacacccataaccaacgttgctg

SEQ ID NO: 744675 - DNA, 25 bp, Mus musculus
taaacacccatatccaacgttgctg

SEQ ID NO: 744676 - DNA, 25 bp, Mus musculus
taaacaccccatcgccagcaggagg

SEQ ID NO: 744677 - DNA, 25 bp, Mus musculus
taaacaccccatggccagcaggagg

SEQ ID NO: 744678 - DNA, 25 bp, Mus musculus
taaacaccgctgatcttccggagtt

SEQ ID NO: 744679 - DNA, 25 bp, Mus musculus
taaacaccgctgttcttccggagtt

SEQ ID NO: 744680 - DNA, 25 bp, Mus musculus
taaacacctctaaagccactgagct

SEQ ID NO: 744681 - DNA, 25 bp, Mus musculus
taaacacctctatagccactgagct

SEQ ID NO: 744682 - DNA, 25 bp, Mus musculus
taaacacctgcgagggcagtggcct

SEQ ID NO: 744683 - DNA, 25 bp, Mus musculus
taaacacctgcgtgggcagtggcct

SEQ ID NO: 744684 - DNA, 25 bp, Mus musculus
taaacacctgctagcctcaagtttg

SEQ ID NO: 744685 - DNA, 25 bp, Mus musculus
taaacacctgcttgcctcaagtttg

SEQ ID NO: 744686 - DNA, 25 bp, Mus musculus
taaacacctgttacctatttagata

SEQ ID NO: 744687 - DNA, 25 bp, Mus musculus
taaacacctgtttcctatttagata

SEQ ID NO: 744688 - DNA, 25 bp, Mus musculus
taaacaccttccaaacagtggcagg

SEQ ID NO: 744689 - DNA, 25 bp, Mus musculus
taaacaccttcctaacagtggcagg

SEQ ID NO: 744690 - DNA, 25 bp, Mus musculus
taaacacgggacatggaaatacttg

SEQ ID NO: 744691 - DNA, 25 bp, Mus musculus
taaacacgggacttggaaatacttg

SEQ ID NO: 744692 - DNA, 25 bp, Mus musculus
taaacacggtctccatttggaggga

SEQ ID NO: 744693 - DNA, 25 bp, Mus musculus
taaacacggtctgcatttggaggga

SEQ ID NO: 744694 - DNA, 25 bp, Mus musculus
taaacactaacccagcaggaccaca

SEQ ID NO: 744695 - DNA, 25 bp, Mus musculus
taaacactaaccgagcaggaccaca

SEQ ID NO: 744696 - DNA, 25 bp, Mus musculus
taaacactacccactgtgtgtggtt

SEQ ID NO: 744697 - DNA, 25 bp, Mus musculus
taaacactaccctctgtgtgtggtt

SEQ ID NO: 744698 - DNA, 25 bp, Mus musculus
taaacactacggatccaacagcttc

SEQ ID NO: 744699 - DNA, 25 bp, Mus musculus
taaacactacggttccaacagcttc

SEQ ID NO: 744700 - DNA, 25 bp, Mus musculus
taaacactagtgaatcattaggtga

SEQ ID NO: 744701 - DNA, 25 bp, Mus musculus
taaacactagtgtatcattaggtga

SEQ ID NO: 744702 - DNA, 25 bp, Mus musculus
taaacactcgaaaacgacctgcctg

SEQ ID NO: 744703 - DNA, 25 bp, Mus musculus
taaacactcgaatacgacctgcctg

SEQ ID NO: 744704 - DNA, 25 bp, Mus musculus
taaacactcttcagcggagtccggg

SEQ ID NO: 744705 - DNA, 25 bp, Mus musculus
taaacactcttctgcggagtccggg

SEQ ID NO: 744706 - DNA, 25 bp, Mus musculus
taaacactgcccatctactgtaagt

SEQ ID NO: 744707 - DNA, 25 bp, Mus musculus
taaacactgcccttctactgtaagt

SEQ ID NO: 744708 - DNA, 25 bp, Mus musculus
taaacactggagcaggcccgccagg

SEQ ID NO: 744709 - DNA, 25 bp, Mus musculus
taaacactggaggaggcccgccagg

SEQ ID NO: 744710 - DNA, 25 bp, Mus musculus
taaacactgtcccttttctgtaagc

SEQ ID NO: 744711 - DNA, 25 bp, Mus musculus
taaacactgtccgttttctgtaagc

SEQ ID NO: 744712 - DNA, 25 bp, Mus musculus
taaacactgtgtatctgcagcctct

SEQ ID NO: 744713 - DNA, 25 bp, Mus musculus
taaacactgtgtttctgcagcctct

SEQ ID NO: 744714 - DNA, 25 bp, Mus musculus
taaacactgtttcttatgccttcaa

SEQ ID NO: 744715 - DNA, 25 bp, Mus musculus
taaacactgtttgttatgccttcaa

SEQ ID NO: 744716 - DNA, 25 bp, Mus musculus
taaacacttcacactgtacctgtag

SEQ ID NO: 744717 - DNA, 25 bp, Mus musculus
taaacacttcactctgtacctgtag

SEQ ID NO: 744718 - DNA, 25 bp, Mus musculus
taaacacttcagctctgtctcccat

SEQ ID NO: 744719 - DNA, 25 bp, Mus musculus
taaacacttcaggtctgtctcccat

SEQ ID NO: 744720 - DNA, 25 bp, Mus musculus
taaacacttcctattagtcaacaga

SEQ ID NO: 744721 - DNA, 25 bp, Mus musculus
taaacacttccttttagtcaacaga

SEQ ID NO: 744722 - DNA, 25 bp, Mus musculus
taaacacttgatacgcatccagcct

SEQ ID NO: 744723 - DNA, 25 bp, Mus musculus
taaacacttgattcgcatccagcct

SEQ ID NO: 744724 - DNA, 25 bp, Mus musculus
taaacacttggcaggaggctccatc

SEQ ID NO: 744725 - DNA, 25 bp, Mus musculus
taaacacttggctggaggctccatc

SEQ ID NO: 744726 - DNA, 25 bp, Mus musculus
taaacacttgtaaatgggtgtaact

SEQ ID NO: 744727 - DNA, 25 bp, Mus musculus
taaacacttgtatatgggtgtaact

SEQ ID NO: 744728 - DNA, 25 bp, Mus musculus
taaacagaaaggcaggtctttgagt

SEQ ID NO: 744729 - DNA, 25 bp, Mus musculus
taaacagaaagggaggtctttgagt

SEQ ID NO: 744730 - DNA, 25 bp, Mus musculus
taaacagacgctcttgacacgaggt

SEQ ID NO: 744731 - DNA, 25 bp, Mus musculus
taaacagacgctgttgacacgaggt

SEQ ID NO: 744732 - DNA, 25 bp, Mus musculus
taaacagactgacctgtcagccacg

SEQ ID NO: 744733 - DNA, 25 bp, Mus musculus
taaacagactgagctgtcagccacg

SEQ ID NO: 744734 - DNA, 25 bp, Mus musculus
taaacagagcgcagagaagccgcca

SEQ ID NO: 744735 - DNA, 25 bp, Mus musculus
taaacagagcgctgagaagccgcca

SEQ ID NO: 744736 - DNA, 25 bp, Mus musculus
taaacagattcacgcacatttacct

SEQ ID NO: 744737 - DNA, 25 bp, Mus musculus
taaacagattcaggcacatttacct

SEQ ID NO: 744738 - DNA, 25 bp, Mus musculus
taaacagattgaaggccttacccaa

SEQ ID NO: 744739 - DNA, 25 bp, Mus musculus
taaacagattgatggccttacccaa

SEQ ID NO: 744740 - DNA, 25 bp, Mus musculus
taaacagcaagcagcttgacctggg

SEQ ID NO: 744741 - DNA, 25 bp, Mus musculus
taaacagcaagctgcttgacctggg

SEQ ID NO: 744742 - DNA, 25 bp, Mus musculus
taaacagcaggcctctgacacagtc

SEQ ID NO: 744743 - DNA, 25 bp, Mus musculus
taaacagcaggcgtctgacacagtc

SEQ ID NO: 744744 - DNA, 25 bp, Mus musculus
taaacagccccactcctgaagtttt

SEQ ID NO: 744745 - DNA, 25 bp, Mus musculus
taaacagccccactgttgaagtcta

SEQ ID NO: 744746 - DNA, 25 bp, Mus musculus
taaacagccccagtcctgaagtttt

SEQ ID NO: 744747 - DNA, 25 bp, Mus musculus
taaacagccccagtgttgaagtcta

SEQ ID NO: 744748 - DNA, 25 bp, Mus musculus
taaacagcccctcgctgttgtcatg

SEQ ID NO: 744749 - DNA, 25 bp, Mus musculus
taaacagcccctggctgttgtcatg

SEQ ID NO: 744750 - DNA, 25 bp, Mus musculus
taaacagcctgtatacataagtaaa

SEQ ID NO: 744751 - DNA, 25 bp, Mus musculus
taaacagcctgtttacataagtaaa

SEQ ID NO: 744752 - DNA, 25 bp, Mus musculus
taaacagccttcatacattttggta

SEQ ID NO: 744753 - DNA, 25 bp, Mus musculus
taaacagccttcttacattttggta

SEQ ID NO: 744754 - DNA, 25 bp, Mus musculus
taaacagccttgacttgcctcacgg

SEQ ID NO: 744755 - DNA, 25 bp, Mus musculus
taaacagccttgtcttgcctcacgg

SEQ ID NO: 744756 - DNA, 25 bp, Mus musculus
taaacagcgacaaatgtagcccttg

SEQ ID NO: 744757 - DNA, 25 bp, Mus musculus
taaacagcgacatatgtagcccttg

SEQ ID NO: 744758 - DNA, 25 bp, Mus musculus
taaacagcgtttcttcattgcctgt

SEQ ID NO: 744759 - DNA, 25 bp, Mus musculus
taaacagcgtttgttcattgcctgt

SEQ ID NO: 744760 - DNA, 25 bp, Mus musculus
taaacaggacaaacactccaggagt

SEQ ID NO: 744761 - DNA, 25 bp, Mus musculus
taaacaggacaatcactccaggagt

SEQ ID NO: 744762 - DNA, 25 bp, Mus musculus
taaacaggacttcccttggaggttg

SEQ ID NO: 744763 - DNA, 25 bp, Mus musculus
taaacaggacttgccttggaggttg

SEQ ID NO: 744764 - DNA, 25 bp, Mus musculus
taaacaggcaataggctcttgtaga

SEQ ID NO: 744765 - DNA, 25 bp, Mus musculus
taaacaggcaattggctcttgtaga

SEQ ID NO: 744766 - DNA, 25 bp, Mus musculus
taaacaggcgtgcttgtgttcttgg

SEQ ID NO: 744767 - DNA, 25 bp, Mus musculus
taaacaggcgtggttgtgttcttgg

SEQ ID NO: 744768 - DNA, 25 bp, Mus musculus
taaacaggctggagggcttcaccaa

SEQ ID NO: 744769 - DNA, 25 bp, Mus musculus
taaacaggctggtgggcttcaccaa

SEQ ID NO: 744770 - DNA, 25 bp, Mus musculus
taaacagggactctttcatagttaa

SEQ ID NO: 744771 - DNA, 25 bp, Mus musculus
taaacagggactgtttcatagttaa

SEQ ID NO: 744772 - DNA, 25 bp, Mus musculus
taaacagggtgtcgctgccctgtga

SEQ ID NO: 744773 - DNA, 25 bp, Mus musculus
taaacagggtgtggctgccctgtga

SEQ ID NO: 744774 - DNA, 25 bp, Mus musculus
taaacaggtgaacttagccattgat

SEQ ID NO: 744775 - DNA, 25 bp, Mus musculus
taaacaggtgaagttagccattgat

SEQ ID NO: 744776 - DNA, 25 bp, Mus musculus
taaacagtaattcctcttgcctcag

SEQ ID NO: 744777 - DNA, 25 bp, Mus musculus
taaacagtaattgctcttgcctcag

SEQ ID NO: 744778 - DNA, 25 bp, Mus musculus
taaacagtactgcttggccggcagt

SEQ ID NO: 744779 - DNA, 25 bp, Mus musculus
taaacagtactggttggccggcagt

SEQ ID NO: 744780 - DNA, 25 bp, Mus musculus
taaacagtctacataccttctgtaa

SEQ ID NO: 744781 - DNA, 25 bp, Mus musculus
taaacagtctacttaccttctgtaa

SEQ ID NO: 744782 - DNA, 25 bp, Mus musculus
taaacagtgtttatgatgagccctc

SEQ ID NO: 744783 - DNA, 25 bp, Mus musculus
taaacagtgtttttgatgagccctc

SEQ ID NO: 744784 - DNA, 25 bp, Mus musculus
taaacagttatacctcttccttctt

SEQ ID NO: 744785 - DNA, 25 bp, Mus musculus
taaacagttatagctcttccttctt

SEQ ID NO: 744786 - DNA, 25 bp, Mus musculus
taaacagttcagctggcatcccagg

SEQ ID NO: 744787 - DNA, 25 bp, Mus musculus
taaacagttcaggtggcatcccagg

SEQ ID NO: 744788 - DNA, 25 bp, Mus musculus
taaacagttgagaggcagtgcagaa

SEQ ID NO: 744789 - DNA, 25 bp, Mus musculus
taaacagttgagtggcagtgcagaa

SEQ ID NO: 744790 - DNA, 25 bp, Mus musculus
taaacataaaaaccctggtgcttat

SEQ ID NO: 744791 - DNA, 25 bp, Mus musculus
taaacataaaaagcctggtgcttat

SEQ ID NO: 744792 - DNA, 25 bp, Mus musculus
taaacatacacactttctcacaaaa

SEQ ID NO: 744793 - DNA, 25 bp, Mus musculus
taaacatacacagtttctcacaaaa

SEQ ID NO: 744794 - DNA, 25 bp, Mus musculus
taaacatacatgaactaacccctcc

SEQ ID NO: 744795 - DNA, 25 bp, Mus musculus
taaacatacatgtactaacccctcc

SEQ ID NO: 744796 - DNA, 25 bp, Mus musculus
taaacatactgtcgcttagtggcgc

SEQ ID NO: 744797 - DNA, 25 bp, Mus musculus
taaacatactgtggcttagtggcgc

SEQ ID NO: 744798 - DNA, 25 bp, Mus musculus
taaacatagacaagacgccccgttc

SEQ ID NO: 744799 - DNA, 25 bp, Mus musculus
taaacatagacatgacgccccgttc

SEQ ID NO: 744800 - DNA, 25 bp, Mus musculus
taaacatagtgtaccccttgggaca

SEQ ID NO: 744801 - DNA, 25 bp, Mus musculus
taaacatagtgttccccttgggaca

SEQ ID NO: 744802 - DNA, 25 bp, Mus musculus
taaacatcaactcatcttcacaggc

SEQ ID NO: 744803 - DNA, 25 bp, Mus musculus
taaacatcaactgatcttcacaggc

SEQ ID NO: 744804 - DNA, 25 bp, Mus musculus
taaacatcaagtacagctttgtctg

SEQ ID NO: 744805 - DNA, 25 bp, Mus musculus
taaacatcaagttcagctttgtctg

SEQ ID NO: 744806 - DNA, 25 bp, Mus musculus
taaacatcacgtcacctctcaggtg

SEQ ID NO: 744807 - DNA, 25 bp, Mus musculus
taaacatcacgtgacctctcaggtg

SEQ ID NO: 744808 - DNA, 25 bp, Mus musculus
taaacatcagacagctccattgtca

SEQ ID NO: 744809 - DNA, 25 bp, Mus musculus
taaacatcagactgctccattgtca

SEQ ID NO: 744810 - DNA, 25 bp, Mus musculus
taaacatcatgcaaccaggtgtccc

SEQ ID NO: 744811 - DNA, 25 bp, Mus musculus
taaacatcatgctaccaggtgtccc

SEQ ID NO: 744812 - DNA, 25 bp, Mus musculus
taaacatctaagcaagccatgctgt

SEQ ID NO: 744813 - DNA, 25 bp, Mus musculus
taaacatctaaggaagccatgctgt

SEQ ID NO: 744814 - DNA, 25 bp, Mus musculus
taaacatctattctctaactcactg

SEQ ID NO: 744815 - DNA, 25 bp, Mus musculus
taaacatctattgtctaactcactg

SEQ ID NO: 744816 - DNA, 25 bp, Mus musculus
taaacatctggaatccctgccatag

SEQ ID NO: 744817 - DNA, 25 bp, Mus musculus
taaacatctggattccctgccatag

SEQ ID NO: 744818 - DNA, 25 bp, Mus musculus
taaacatctgttagcctttcggaac

SEQ ID NO: 744819 - DNA, 25 bp, Mus musculus
taaacatctgtttgcctttcggaac

SEQ ID NO: 744820 - DNA, 25 bp, Mus musculus
taaacatctttaattccataggtga

SEQ ID NO: 744821 - DNA, 25 bp, Mus musculus
taaacatctttatttccataggtga

SEQ ID NO: 744822 - DNA, 25 bp, Mus musculus
taaacatgcaaacccagcccctgaa

SEQ ID NO: 744823 - DNA, 25 bp, Mus musculus
taaacatgcaaagccagcccctgaa

SEQ ID NO: 744824 - DNA, 25 bp, Mus musculus
taaacatgcacaaatctacttcccc

SEQ ID NO: 744825 - DNA, 25 bp, Mus musculus
taaacatgcacatatctacttcccc

SEQ ID NO: 744826 - DNA, 25 bp, Mus musculus
taaacatgccatcgtgcctcacaca

SEQ ID NO: 744827 - DNA, 25 bp, Mus musculus
taaacatgccatggtgcctcacaca

SEQ ID NO: 744828 - DNA, 25 bp, Mus musculus
taaacatggcttcccttaactgcta

SEQ ID NO: 744829 - DNA, 25 bp, Mus musculus
taaacatggcttgccttaactgcta

SEQ ID NO: 744830 - DNA, 25 bp, Mus musculus
taaacatgggcaaaggagatcctaa

SEQ ID NO: 744831 - DNA, 25 bp, Mus musculus
taaacatgggcataggagatcctaa

SEQ ID NO: 744832 - DNA, 25 bp, Mus musculus
taaacatgttctaccgtactgctgt

SEQ ID NO: 744833 - DNA, 25 bp, Mus musculus
taaacatgttcttccgtactgctgt

SEQ ID NO: 744834 - DNA, 25 bp, Mus musculus
taaacatgtttcatgggctccatgg

SEQ ID NO: 744835 - DNA, 25 bp, Mus musculus
taaacatgtttcttgggctccatgg

SEQ ID NO: 744836 - DNA, 25 bp, Mus musculus
taaacattacctcgcactgtgtata

SEQ ID NO: 744837 - DNA, 25 bp, Mus musculus
taaacattacctggcactgtgtata

SEQ ID NO: 744838 - DNA, 25 bp, Mus musculus
taaacattcaggctccgtgggaccc

SEQ ID NO: 744839 - DNA, 25 bp, Mus musculus
taaacattcagggtccgtgggaccc

SEQ ID NO: 744840 - DNA, 25 bp, Mus musculus
taaacattctgtaccacctgtaaag

SEQ ID NO: 744841 - DNA, 25 bp, Mus musculus
taaacattctgttccacctgtaaag

SEQ ID NO: 744842 - DNA, 25 bp, Mus musculus
taaacattcttcagacgggacagtc

SEQ ID NO: 744843 - DNA, 25 bp, Mus musculus
taaacattcttcatacagctaaggg

SEQ ID NO: 744844 - DNA, 25 bp, Mus musculus
taaacattcttctgacgggacagtc

SEQ ID NO: 744845 - DNA, 25 bp, Mus musculus
taaacattcttcttacagctaaggg

SEQ ID NO: 744846 - DNA, 25 bp, Mus musculus
taaacattggctctctgtaagcagg

SEQ ID NO: 744847 - DNA, 25 bp, Mus musculus
taaacattggctgtctgtaagcagg

SEQ ID NO: 744848 - DNA, 25 bp, Mus musculus
taaacattgtcacccaagcttcagc

SEQ ID NO: 744849 - DNA, 25 bp, Mus musculus
taaacattgtcagccaagcttcagc

SEQ ID NO: 744850 - DNA, 25 bp, Mus musculus
taaacatttcccactgaatgccacc

SEQ ID NO: 744851 - DNA, 25 bp, Mus musculus
taaacatttccctctgaatgccacc

SEQ ID NO: 744852 - DNA, 25 bp, Mus musculus
taaacatttcgtagtggttcgtcgc

SEQ ID NO: 744853 - DNA, 25 bp, Mus musculus
taaacatttcgttgtggttcgtcgc

SEQ ID NO: 744854 - DNA, 25 bp, Mus musculus
taaacatttctaattcttcatcatc

SEQ ID NO: 744855 - DNA, 25 bp, Mus musculus
taaacatttctatttcttcatcatc

SEQ ID NO: 744856 - DNA, 25 bp, Mus musculus
taaacatttgatataaagttccctg

SEQ ID NO: 744857 - DNA, 25 bp, Mus musculus
taaacatttgatttaaagttccctg

SEQ ID NO: 744858 - DNA, 25 bp, Mus musculus
taaacatttgggaccacctgggctt

SEQ ID NO: 744859 - DNA, 25 bp, Mus musculus
taaacatttgggtccacctgggctt

SEQ ID NO: 744860 - DNA, 25 bp, Mus musculus
taaacatttgtgaagcgctgctgac

SEQ ID NO: 744861 - DNA, 25 bp, Mus musculus
taaacatttgtgtagcgctgctgac

SEQ ID NO: 744862 - DNA, 25 bp, Mus musculus
taaaccaaaattccgtgacagaaat

SEQ ID NO: 744863 - DNA, 25 bp, Mus musculus
taaaccaaaattgcgtgacagaaat

SEQ ID NO: 744864 - DNA, 25 bp, Mus musculus
taaaccaaaccgaatgctcgctcct

SEQ ID NO: 744865 - DNA, 25 bp, Mus musculus
taaaccaaaccgtatgctcgctcct

SEQ ID NO: 744866 - DNA, 25 bp, Mus musculus
taaaccaacaaaacccagccctggg

SEQ ID NO: 744867 - DNA, 25 bp, Mus musculus
taaaccaacaaatcccagccctggg

SEQ ID NO: 744868 - DNA, 25 bp, Mus musculus
taaaccaaccagacagatttttcca

SEQ ID NO: 744869 - DNA, 25 bp, Mus musculus
taaaccaaccagtcagatttttcca

SEQ ID NO: 744870 - DNA, 25 bp, Mus musculus
taaaccaatctgatcccaagaggcc

SEQ ID NO: 744871 - DNA, 25 bp, Mus musculus
taaaccaatctgttcccaagaggcc

SEQ ID NO: 744872 - DNA, 25 bp, Mus musculus
taaaccacaaccaggaccaaaatgt

SEQ ID NO: 744873 - DNA, 25 bp, Mus musculus
taaaccacaacctggaccaaaatgt

SEQ ID NO: 744874 - DNA, 25 bp, Mus musculus
taaaccacactaatgactccagctg

SEQ ID NO: 744875 - DNA, 25 bp, Mus musculus
taaaccacactattgactccagctg

SEQ ID NO: 744876 - DNA, 25 bp, Mus musculus
taaaccacagcacgagctctacagg

SEQ ID NO: 744877 - DNA, 25 bp, Mus musculus
taaaccacagcaggagctctacagg

SEQ ID NO: 744878 - DNA, 25 bp, Mus musculus
taaaccacaggtcaaccccaggctg

SEQ ID NO: 744879 - DNA, 25 bp, Mus musculus
taaaccacaggtgaaccccaggctg

SEQ ID NO: 744880 - DNA, 25 bp, Mus musculus
taaaccacatgaccctatatcagtc

SEQ ID NO: 744881 - DNA, 25 bp, Mus musculus
taaaccacatgagcctatatcagtc

SEQ ID NO: 744882 - DNA, 25 bp, Mus musculus
taaaccacatggcaaccactttcct

SEQ ID NO: 744883 - DNA, 25 bp, Mus musculus
taaaccacatgggaaccactttcct

SEQ ID NO: 744884 - DNA, 25 bp, Mus musculus
taaaccaccagcactactgtgacat

SEQ ID NO: 744885 - DNA, 25 bp, Mus musculus
taaaccaccagctctactgtgacat

SEQ ID NO: 744886 - DNA, 25 bp, Mus musculus
taaaccacccgaagaacaaccagag

SEQ ID NO: 744887 - DNA, 25 bp, Mus musculus
taaaccacccgatgaacaaccagag

SEQ ID NO: 744888 - DNA, 25 bp, Mus musculus
taaaccactacgcaacccagagaga

SEQ ID NO: 744889 - DNA, 25 bp, Mus musculus
taaaccactacggaacccagagaga

SEQ ID NO: 744890 - DNA, 25 bp, Mus musculus
taaaccactaggacctatgcttttg

SEQ ID NO: 744891 - DNA, 25 bp, Mus musculus
taaaccactaggtcctatgcttttg

SEQ ID NO: 744892 - DNA, 25 bp, Mus musculus
taaaccactataccatgttacccac

SEQ ID NO: 744893 - DNA, 25 bp, Mus musculus
taaaccactatagcatgttacccac

SEQ ID NO: 744894 - DNA, 25 bp, Mus musculus
taaaccactcttaaactgctggctc

SEQ ID NO: 744895 - DNA, 25 bp, Mus musculus
taaaccactctttaactgctggctc

SEQ ID NO: 744896 - DNA, 25 bp, Mus musculus
taaaccacttccaggcactttaaag

SEQ ID NO: 744897 - DNA, 25 bp, Mus musculus
taaaccacttcctggcactttaaag

SEQ ID NO: 744898 - DNA, 25 bp, Mus musculus
taaaccagcaagcacattcctcatt

SEQ ID NO: 744899 - DNA, 25 bp, Mus musculus
taaaccagcaaggacattcctcatt

SEQ ID NO: 744900 - DNA, 25 bp, Mus musculus
taaaccaggaaacttgtgtcaaatt

SEQ ID NO: 744901 - DNA, 25 bp, Mus musculus
taaaccaggaaagttgtgtcaaatt

SEQ ID NO: 744902 - DNA, 25 bp, Mus musculus
taaaccaggcctcacttagttgttt

SEQ ID NO: 744903 - DNA, 25 bp, Mus musculus
taaaccaggcctgacttagttgttt

SEQ ID NO: 744904 - DNA, 25 bp, Mus musculus
taaaccaggctgctcccagatctgc

SEQ ID NO: 744905 - DNA, 25 bp, Mus musculus
taaaccaggctggtcccagatctgc

SEQ ID NO: 744906 - DNA, 25 bp, Mus musculus
taaaccagtgagaccaggccaacgc

SEQ ID NO: 744907 - DNA, 25 bp, Mus musculus
taaaccagtgagtccaggccaacgc

SEQ ID NO: 744908 - DNA, 25 bp, Mus musculus
taaaccagtggaactctaatggcaa

SEQ ID NO: 744909 - DNA, 25 bp, Mus musculus
taaaccagtggatctctaatggcaa

SEQ ID NO: 744910 - DNA, 25 bp, Mus musculus
taaaccagtgtacgctcctgccctg

SEQ ID NO: 744911 - DNA, 25 bp, Mus musculus
taaaccagtgtaggctcctgccctg

SEQ ID NO: 744912 - DNA, 25 bp, Mus musculus
taaaccataaatacctttagctgtg

SEQ ID NO: 744913 - DNA, 25 bp, Mus musculus
taaaccataaattcctttagctgtg

SEQ ID NO: 744914 - DNA, 25 bp, Mus musculus
taaaccatacttcaccattcttaca

SEQ ID NO: 744915 - DNA, 25 bp, Mus musculus
taaaccatacttgaccattcttaca

SEQ ID NO: 744916 - DNA, 25 bp, Mus musculus
taaaccatagtcattccttcatcag

SEQ ID NO: 744917 - DNA, 25 bp, Mus musculus
taaaccatagtctttccttcatcag

SEQ ID NO: 744918 - DNA, 25 bp, Mus musculus
taaaccatattaccaccacagtctg

SEQ ID NO: 744919 - DNA, 25 bp, Mus musculus
taaaccatattagcaccacagtctg

SEQ ID NO: 744920 - DNA, 25 bp, Mus musculus
taaaccatcaggcacacaggcatgc

SEQ ID NO: 744921 - DNA, 25 bp, Mus musculus
taaaccatcagggacacaggcatgc

SEQ ID NO: 744922 - DNA, 25 bp, Mus musculus
taaaccatcatcacctctgcagaca

SEQ ID NO: 744923 - DNA, 25 bp, Mus musculus
taaaccatcatctcctctgcagaca

SEQ ID NO: 744924 - DNA, 25 bp, Mus musculus
taaaccatcatgaggtaaccaaaca

SEQ ID NO: 744925 - DNA, 25 bp, Mus musculus
taaaccatcatgtggtaaccaaaca

SEQ ID NO: 744926 - DNA, 25 bp, Mus musculus
taaaccatccatctagaccttcagg

SEQ ID NO: 744927 - DNA, 25 bp, Mus musculus
taaaccatccatgtagaccttcagg

SEQ ID NO: 744928 - DNA, 25 bp, Mus musculus
taaaccatcgtccaaagtacatgag

SEQ ID NO: 744929 - DNA, 25 bp, Mus musculus
taaaccatcgtcgaaagtacatgag

SEQ ID NO: 744930 - DNA, 25 bp, Mus musculus
taaaccatctctccatcaccatgaa

SEQ ID NO: 744931 - DNA, 25 bp, Mus musculus
taaaccatctctgcatcaccatgaa

SEQ ID NO: 744932 - DNA, 25 bp, Mus musculus
taaaccatcttcatttctttgtcat

SEQ ID NO: 744933 - DNA, 25 bp, Mus musculus
taaaccatcttcttttctttgtcat

SEQ ID NO: 744934 - DNA, 25 bp, Mus musculus
taaaccatctttagctggcatctcc

SEQ ID NO: 744935 - DNA, 25 bp, Mus musculus
taaaccatctttattagttgcacat

SEQ ID NO: 744936 - DNA, 25 bp, Mus musculus
taaaccatcttttgctggcatctcc

SEQ ID NO: 744937 - DNA, 25 bp, Mus musculus
taaaccatcttttttagttgcacat

SEQ ID NO: 744938 - DNA, 25 bp, Mus musculus
taaaccatgctcatgctaatatagt

SEQ ID NO: 744939 - DNA, 25 bp, Mus musculus
taaaccatgctcttgctaatatagt

SEQ ID NO: 744940 - DNA, 25 bp, Mus musculus
taaaccatggacattctcgaagagt

SEQ ID NO: 744941 - DNA, 25 bp, Mus musculus
taaaccatggactttctcgaagagt

SEQ ID NO: 744942 - DNA, 25 bp, Mus musculus
taaaccatgtgcaaggccccaagaa

SEQ ID NO: 744943 - DNA, 25 bp, Mus musculus
taaaccatgtgctaggccccaagaa

SEQ ID NO: 744944 - DNA, 25 bp, Mus musculus
taaaccattgatcttacccttgtct

SEQ ID NO: 744945 - DNA, 25 bp, Mus musculus
taaaccattgatgttacccttgtct

SEQ ID NO: 744946 - DNA, 25 bp, Mus musculus
taaaccattgccaccagaattcctt

SEQ ID NO: 744947 - DNA, 25 bp, Mus musculus
taaaccattgcctccagaattcctt

SEQ ID NO: 744948 - DNA, 25 bp, Mus musculus
taaaccattgttcatccgtaggaaa

SEQ ID NO: 744949 - DNA, 25 bp, Mus musculus
taaaccattgttgatccgtaggaaa

SEQ ID NO: 744950 - DNA, 25 bp, Mus musculus
taaaccatttacaacaggcagactg

SEQ ID NO: 744951 - DNA, 25 bp, Mus musculus
taaaccatttactacaggcagactg

SEQ ID NO: 744952 - DNA, 25 bp, Mus musculus
taaacccaacataagctgggagtaa

SEQ ID NO: 744953 - DNA, 25 bp, Mus musculus
taaacccaacattagctgggagtaa

SEQ ID NO: 744954 - DNA, 25 bp, Mus musculus
taaacccaaggaccggccacaggtt

SEQ ID NO: 744955 - DNA, 25 bp, Mus musculus
taaacccaaggagcggccacaggtt

SEQ ID NO: 744956 - DNA, 25 bp, Mus musculus
taaacccaaggccagtatgtctact

SEQ ID NO: 744957 - DNA, 25 bp, Mus musculus
taaacccaaggcgagtatgtctact

SEQ ID NO: 744958 - DNA, 25 bp, Mus musculus
taaacccacaaacctctgatttaag

SEQ ID NO: 744959 - DNA, 25 bp, Mus musculus
taaacccacaaagctctgatttaag

SEQ ID NO: 744960 - DNA, 25 bp, Mus musculus
taaacccacaaccagctccagacaa

SEQ ID NO: 744961 - DNA, 25 bp, Mus musculus
taaacccacaacgagctccagacaa

SEQ ID NO: 744962 - DNA, 25 bp, Mus musculus
taaacccacataaacactgctcctt

SEQ ID NO: 744963 - DNA, 25 bp, Mus musculus
taaacccacatatacactgctcctt

SEQ ID NO: 744964 - DNA, 25 bp, Mus musculus
taaacccactgtctcgctgaagagt

SEQ ID NO: 744965 - DNA, 25 bp, Mus musculus
taaacccactgtgtcgctgaagagt

SEQ ID NO: 744966 - DNA, 25 bp, Mus musculus
taaacccagacacttgtgctgaaca

SEQ ID NO: 744967 - DNA, 25 bp, Mus musculus
taaacccagacagttgtgctgaaca

SEQ ID NO: 744968 - DNA, 25 bp, Mus musculus
taaacccagcaaactcctgttctgt

SEQ ID NO: 744969 - DNA, 25 bp, Mus musculus
taaacccagcaatctcctgttctgt

SEQ ID NO: 744970 - DNA, 25 bp, Mus musculus
taaacccagctacattcctcaaata

SEQ ID NO: 744971 - DNA, 25 bp, Mus musculus
taaacccagctagattcctcaaata

SEQ ID NO: 744972 - DNA, 25 bp, Mus musculus
taaacccagggcattacatgttgac

SEQ ID NO: 744973 - DNA, 25 bp, Mus musculus
taaacccagggctttacatgttgac

SEQ ID NO: 744974 - DNA, 25 bp, Mus musculus
taaacccagggtatcatcatgcaaa

SEQ ID NO: 744975 - DNA, 25 bp, Mus musculus
taaacccagggtttcatcatgcaaa

SEQ ID NO: 744976 - DNA, 25 bp, Mus musculus
taaacccatgcacaacacctcttat

SEQ ID NO: 744977 - DNA, 25 bp, Mus musculus
taaacccatgcagaacacctcttat

SEQ ID NO: 744978 - DNA, 25 bp, Mus musculus
taaacccatggtcctatattattat

SEQ ID NO: 744979 - DNA, 25 bp, Mus musculus
taaacccatggtgctatattattat

SEQ ID NO: 744980 - DNA, 25 bp, Mus musculus
taaacccatgtcagtgaggaccaga

SEQ ID NO: 744981 - DNA, 25 bp, Mus musculus
taaacccatgtcattcttccttggt

SEQ ID NO: 744982 - DNA, 25 bp, Mus musculus
taaacccatgtctgtgaggaccaga

SEQ ID NO: 744983 - DNA, 25 bp, Mus musculus
taaacccatgtctttcttccttggt

SEQ ID NO: 744984 - DNA, 25 bp, Mus musculus
taaacccattccaactacagcagtt

SEQ ID NO: 744985 - DNA, 25 bp, Mus musculus
taaacccattcctactacagcagtt

SEQ ID NO: 744986 - DNA, 25 bp, Mus musculus
taaacccattgtaatgtcctgaagt

SEQ ID NO: 744987 - DNA, 25 bp, Mus musculus
taaacccattgttatgtcctgaagt

SEQ ID NO: 744988 - DNA, 25 bp, Mus musculus
taaaccccactgaggtgctgactga

SEQ ID NO: 744989 - DNA, 25 bp, Mus musculus
taaaccccactgtggtgctgactga

SEQ ID NO: 744990 - DNA, 25 bp, Mus musculus
taaaccccaggcattgggagcatct

SEQ ID NO: 744991 - DNA, 25 bp, Mus musculus
taaaccccaggctttgggagcatct

SEQ ID NO: 744992 - DNA, 25 bp, Mus musculus
taaacccctctgattgatttccagt

SEQ ID NO: 744993 - DNA, 25 bp, Mus musculus
taaacccctctgtttgatttccagt

SEQ ID NO: 744994 - DNA, 25 bp, Mus musculus
taaacccctgccatgtacagtctac

SEQ ID NO: 744995 - DNA, 25 bp, Mus musculus
taaacccctgccttgtacagtctac

SEQ ID NO: 744996 - DNA, 25 bp, Mus musculus
taaaccccttgcaattttgtgaagt

SEQ ID NO: 744997 - DNA, 25 bp, Mus musculus
taaaccccttgctattttgtgaagt

SEQ ID NO: 744998 - DNA, 25 bp, Mus musculus
taaacccgaaagcttctgaccaact

SEQ ID NO: 744999 - DNA, 25 bp, Mus musculus
taaacccgaaaggttctgaccaact

SEQ ID NO: 745000 - DNA, 25 bp, Mus musculus
taaacccgccatcatctattgttct

SEQ ID NO: 745001 - DNA, 25 bp, Mus musculus
taaacccgccatgatctattgttct

SEQ ID NO: 745002 - DNA, 25 bp, Mus musculus
taaacccgcgctcgatggctttttt

SEQ ID NO: 745003 - DNA, 25 bp, Mus musculus
taaacccgcgctggatggctttttt

SEQ ID NO: 745004 - DNA, 25 bp, Mus musculus
taaacccggcccacgaggaagcact

SEQ ID NO: 745005 - DNA, 25 bp, Mus musculus
taaacccggccctcgaggaagcact

SEQ ID NO: 745006 - DNA, 25 bp, Mus musculus
taaacccggttcatcataagtagtg

SEQ ID NO: 745007 - DNA, 25 bp, Mus musculus
taaacccggttcttcataagtagtg

SEQ ID NO: 745008 - DNA, 25 bp, Mus musculus
taaacccggtttagcttaagcacat

SEQ ID NO: 745009 - DNA, 25 bp, Mus musculus
taaacccggttttgcttaagcacat

SEQ ID NO: 745010 - DNA, 25 bp, Mus musculus
taaaccctagaaaacagcactggtg

SEQ ID NO: 745011 - DNA, 25 bp, Mus musculus
taaaccctagaaaccactggccatg

SEQ ID NO: 745012 - DNA, 25 bp, Mus musculus
taaaccctagaatacagcactggtg

SEQ ID NO: 745013 - DNA, 25 bp, Mus musculus
taaaccctagaatccactggccatg

SEQ ID NO: 745014 - DNA, 25 bp, Mus musculus
taaaccctaggtcttgacctcttgc

SEQ ID NO: 745015 - DNA, 25 bp, Mus musculus
taaaccctaggtgttgacctcttgc

SEQ ID NO: 745016 - DNA, 25 bp, Mus musculus
taaaccctattcaattcaaacttgt

SEQ ID NO: 745017 - DNA, 25 bp, Mus musculus
taaaccctattctattcaaacttgt

SEQ ID NO: 745018 - DNA, 25 bp, Mus musculus
taaaccctcacgaccacgtgattgg

SEQ ID NO: 745019 - DNA, 25 bp, Mus musculus
taaaccctcacgtccacgtgattgg

SEQ ID NO: 745020 - DNA, 25 bp, Mus musculus
taaaccctctctaccccaagttgat

SEQ ID NO: 745021 - DNA, 25 bp, Mus musculus
taaaccctctcttccccaagttgat

SEQ ID NO: 745022 - DNA, 25 bp, Mus musculus
taaaccctgatgatcctggccagga

SEQ ID NO: 745023 - DNA, 25 bp, Mus musculus
taaaccctgatgctctgatccactg

SEQ ID NO: 745024 - DNA, 25 bp, Mus musculus
taaaccctgatggtctgatccactg

SEQ ID NO: 745025 - DNA, 25 bp, Mus musculus
taaaccctgatgttcctggccagga

SEQ ID NO: 745026 - DNA, 25 bp, Mus musculus
taaaccctgattaccggcaggaaat

SEQ ID NO: 745027 - DNA, 25 bp, Mus musculus
taaaccctgatttccggcaggaaat

SEQ ID NO: 745028 - DNA, 25 bp, Mus musculus
taaaccctgcaaacatggaatagtc

SEQ ID NO: 745029 - DNA, 25 bp, Mus musculus
taaaccctgcaaagggaagctccca

SEQ ID NO: 745030 - DNA, 25 bp, Mus musculus
taaaccctgcaatcatggaatagtc

SEQ ID NO: 745031 - DNA, 25 bp, Mus musculus
taaaccctgcaatgggaagctccca

SEQ ID NO: 745032 - DNA, 25 bp, Mus musculus
taaaccctgcgcaagcccactctgt

SEQ ID NO: 745033 - DNA, 25 bp, Mus musculus
taaaccctgcgctagcccactctgt

SEQ ID NO: 745034 - DNA, 25 bp, Mus musculus
taaaccctgctgctactgccatgag

SEQ ID NO: 745035 - DNA, 25 bp, Mus musculus
taaaccctgctggtactgccatgag

SEQ ID NO: 745036 - DNA, 25 bp, Mus musculus
taaaccctggccactgtgttacttt

SEQ ID NO: 745037 - DNA, 25 bp, Mus musculus
taaaccctggcctctgtgttacttt

SEQ ID NO: 745038 - DNA, 25 bp, Mus musculus
taaaccctgtcaactatgcctttgt

SEQ ID NO: 745039 - DNA, 25 bp, Mus musculus
taaaccctgtcatctatgcctttgt

SEQ ID NO: 745040 - DNA, 25 bp, Mus musculus
taaacccttagtctctctgcatttt

SEQ ID NO: 745041 - DNA, 25 bp, Mus musculus
taaacccttagtgtctctgcatttt

SEQ ID NO: 745042 - DNA, 25 bp, Mus musculus
taaacccttctgaagagtctttgaa

SEQ ID NO: 745043 - DNA, 25 bp, Mus musculus
taaacccttctgtagagtctttgaa

SEQ ID NO: 745044 - DNA, 25 bp, Mus musculus
taaacccttgcaacatttcttaaag

SEQ ID NO: 745045 - DNA, 25 bp, Mus musculus
taaacccttgcatcatttcttaaag

SEQ ID NO: 745046 - DNA, 25 bp, Mus musculus
taaacccttggccagtcattaaact

SEQ ID NO: 745047 - DNA, 25 bp, Mus musculus
taaacccttggcgagtcattaaact

SEQ ID NO: 745048 - DNA, 25 bp, Mus musculus
taaaccctttgcagctccattagcc

SEQ ID NO: 745049 - DNA, 25 bp, Mus musculus
taaaccctttgctgctccattagcc

SEQ ID NO: 745050 - DNA, 25 bp, Mus musculus
taaacccttttcattggctgtatct

SEQ ID NO: 745051 - DNA, 25 bp, Mus musculus
taaacccttttctttggctgtatct

SEQ ID NO: 745052 - DNA, 25 bp, Mus musculus
taaaccgaatggcacgaaatcgttt

SEQ ID NO: 745053 - DNA, 25 bp, Mus musculus
taaaccgaatgggacgaaatcgttt

SEQ ID NO: 745054 - DNA, 25 bp, Mus musculus
taaaccgcaagtccatatccagatg

SEQ ID NO: 745055 - DNA, 25 bp, Mus musculus
taaaccgcaagtgcatatccagatg

SEQ ID NO: 745056 - DNA, 25 bp, Mus musculus
taaaccgcactgatgactgcttcct

SEQ ID NO: 745057 - DNA, 25 bp, Mus musculus
taaaccgcactgttgactgcttcct

SEQ ID NO: 745058 - DNA, 25 bp, Mus musculus
taaaccgcagctcgtccagtagttc

SEQ ID NO: 745059 - DNA, 25 bp, Mus musculus
taaaccgcagctggtccagtagttc

SEQ ID NO: 745060 - DNA, 25 bp, Mus musculus
taaaccgcttttcgtacttctcgct

SEQ ID NO: 745061 - DNA, 25 bp, Mus musculus
taaaccgcttttggtacttctcgct

SEQ ID NO: 745062 - DNA, 25 bp, Mus musculus
taaaccggaactcatctgcacactg

SEQ ID NO: 745063 - DNA, 25 bp, Mus musculus
taaaccggaactgatctgcacactg

SEQ ID NO: 745064 - DNA, 25 bp, Mus musculus
taaaccgggcagagagatctgtatg

SEQ ID NO: 745065 - DNA, 25 bp, Mus musculus
taaaccgggcagtgagatctgtatg

SEQ ID NO: 745066 - DNA, 25 bp, Mus musculus
taaaccgggtcacgacaattcatgt

SEQ ID NO: 745067 - DNA, 25 bp, Mus musculus
taaaccgggtcaggacaattcatgt

SEQ ID NO: 745068 - DNA, 25 bp, Mus musculus
taaaccgtctgtccagttgcattcc

SEQ ID NO: 745069 - DNA, 25 bp, Mus musculus
taaaccgtctgtgcagttgcattcc

SEQ ID NO: 745070 - DNA, 25 bp, Mus musculus
taaaccgttcctagtattatgacag

SEQ ID NO: 745071 - DNA, 25 bp, Mus musculus
taaaccgttccttgtattatgacag

SEQ ID NO: 745072 - DNA, 25 bp, Mus musculus
taaacctacttgctgtgttggatgt

SEQ ID NO: 745073 - DNA, 25 bp, Mus musculus
taaacctacttggtgtgttggatgt

SEQ ID NO: 745074 - DNA, 25 bp, Mus musculus
taaacctagcatacgggagggaagg

SEQ ID NO: 745075 - DNA, 25 bp, Mus musculus
taaacctagcatatctgtatattca

SEQ ID NO: 745076 - DNA, 25 bp, Mus musculus
taaacctagcattcgggagggaagg

SEQ ID NO: 745077 - DNA, 25 bp, Mus musculus
taaacctagcatttctgtatattca

SEQ ID NO: 745078 - DNA, 25 bp, Mus musculus
taaacctaggttcccattgctttat

SEQ ID NO: 745079 - DNA, 25 bp, Mus musculus
taaacctaggttccttgcttataca

SEQ ID NO: 745080 - DNA, 25 bp, Mus musculus
taaacctaggttgccattgctttat

SEQ ID NO: 745081 - DNA, 25 bp, Mus musculus
taaacctaggttgcttgcttataca

SEQ ID NO: 745082 - DNA, 25 bp, Mus musculus
taaacctatcaacattgcagaatgc

SEQ ID NO: 745083 - DNA, 25 bp, Mus musculus
taaacctatcaagattgcagaatgc

SEQ ID NO: 745084 - DNA, 25 bp, Mus musculus
taaacctatccacctgtgaagaact

SEQ ID NO: 745085 - DNA, 25 bp, Mus musculus
taaacctatccagctgtgaagaact

SEQ ID NO: 745086 - DNA, 25 bp, Mus musculus
taaacctatgctctccaatctggaa

SEQ ID NO: 745087 - DNA, 25 bp, Mus musculus
taaacctatgctgtccaatctggaa

SEQ ID NO: 745088 - DNA, 25 bp, Mus musculus
taaacctatgtcattattgcacaaa

SEQ ID NO: 745089 - DNA, 25 bp, Mus musculus
taaacctatgtccatgtccatgtcc

SEQ ID NO: 745090 - DNA, 25 bp, Mus musculus
taaacctatgtcgatgtccatgtcc

SEQ ID NO: 745091 - DNA, 25 bp, Mus musculus
taaacctatgtctttattgcacaaa

SEQ ID NO: 745092 - DNA, 25 bp, Mus musculus
taaacctcacacaggtaggtgtggc

SEQ ID NO: 745093 - DNA, 25 bp, Mus musculus
taaacctcacactggtaggtgtggc

SEQ ID NO: 745094 - DNA, 25 bp, Mus musculus
taaacctcaggacacggcatagtaa

SEQ ID NO: 745095 - DNA, 25 bp, Mus musculus
taaacctcaggactactcttttgta

SEQ ID NO: 745096 - DNA, 25 bp, Mus musculus
taaacctcaggagacggcatagtaa

SEQ ID NO: 745097 - DNA, 25 bp, Mus musculus
taaacctcaggagtactcttttgta

SEQ ID NO: 745098 - DNA, 25 bp, Mus musculus
taaacctcagtacaaagcttcctcc

SEQ ID NO: 745099 - DNA, 25 bp, Mus musculus
taaacctcagtagaaagcttcctcc

SEQ ID NO: 745100 - DNA, 25 bp, Mus musculus
taaacctcagtgagggctagtgccc

SEQ ID NO: 745101 - DNA, 25 bp, Mus musculus
taaacctcagtgtgggctagtgccc

SEQ ID NO: 745102 - DNA, 25 bp, Mus musculus
taaacctcattgatttatgtgcggt

SEQ ID NO: 745103 - DNA, 25 bp, Mus musculus
taaacctcattgttttatgtgcggt

SEQ ID NO: 745104 - DNA, 25 bp, Mus musculus
taaacctcccggcagtacagtattc

SEQ ID NO: 745105 - DNA, 25 bp, Mus musculus
taaacctcccgggagtacagtattc

SEQ ID NO: 745106 - DNA, 25 bp, Mus musculus
taaacctcctccatgattaatctgt

SEQ ID NO: 745107 - DNA, 25 bp, Mus musculus
taaacctcctccttgattaatctgt

SEQ ID NO: 745108 - DNA, 25 bp, Mus musculus
taaacctcgcctctactagctatgg

SEQ ID NO: 745109 - DNA, 25 bp, Mus musculus
taaacctcgcctgtactagctatgg

SEQ ID NO: 745110 - DNA, 25 bp, Mus musculus
taaacctctcccaactgtgaaattc

SEQ ID NO: 745111 - DNA, 25 bp, Mus musculus
taaacctctccctactgtgaaattc

SEQ ID NO: 745112 - DNA, 25 bp, Mus musculus
taaacctctgaccttgcggtgatta

SEQ ID NO: 745113 - DNA, 25 bp, Mus musculus
taaacctctgacgttgcggtgatta

SEQ ID NO: 745114 - DNA, 25 bp, Mus musculus
taaacctcttccataggtcatctct

SEQ ID NO: 745115 - DNA, 25 bp, Mus musculus
taaacctcttccttaggtcatctct

SEQ ID NO: 745116 - DNA, 25 bp, Mus musculus
taaacctgaatgactgtagccaaaa

SEQ ID NO: 745117 - DNA, 25 bp, Mus musculus
taaacctgaatgtctgtagccaaaa

SEQ ID NO: 745118 - DNA, 25 bp, Mus musculus
taaacctgacagaatttccctcact

SEQ ID NO: 745119 - DNA, 25 bp, Mus musculus
taaacctgacagtatttccctcact

SEQ ID NO: 745120 - DNA, 25 bp, Mus musculus
taaacctgaccactctttacagtga

SEQ ID NO: 745121 - DNA, 25 bp, Mus musculus
taaacctgaccagtctttacagtga

SEQ ID NO: 745122 - DNA, 25 bp, Mus musculus
taaacctgcactagatggagttgtt

SEQ ID NO: 745123 - DNA, 25 bp, Mus musculus
taaacctgcacttgatggagttgtt

SEQ ID NO: 745124 - DNA, 25 bp, Mus musculus
taaacctgctatccggtgaggagca

SEQ ID NO: 745125 - DNA, 25 bp, Mus musculus
taaacctgctatgcggtgaggagca

SEQ ID NO: 745126 - DNA, 25 bp, Mus musculus
taaacctgctccaaccgagtgagat

SEQ ID NO: 745127 - DNA, 25 bp, Mus musculus
taaacctgctcctaccgagtgagat

SEQ ID NO: 745128 - DNA, 25 bp, Mus musculus
taaacctgcttcctatccatagtaa

SEQ ID NO: 745129 - DNA, 25 bp, Mus musculus
taaacctgcttcgtatccatagtaa

SEQ ID NO: 745130 - DNA, 25 bp, Mus musculus
taaacctggaagcagagcccctggg

SEQ ID NO: 745131 - DNA, 25 bp, Mus musculus
taaacctggaaggagagcccctggg

SEQ ID NO: 745132 - DNA, 25 bp, Mus musculus
taaacctggaccctgagtcacctgg

SEQ ID NO: 745133 - DNA, 25 bp, Mus musculus
taaacctggaccgtgagtcacctgg

SEQ ID NO: 745134 - DNA, 25 bp, Mus musculus
taaacctggatcacttgtgtgctag

SEQ ID NO: 745135 - DNA, 25 bp, Mus musculus
taaacctggatctcttgtgtgctag

SEQ ID NO: 745136 - DNA, 25 bp, Mus musculus
taaacctggatgctactgtaaaact

SEQ ID NO: 745137 - DNA, 25 bp, Mus musculus
taaacctggatggtactgtaaaact

SEQ ID NO: 745138 - DNA, 25 bp, Mus musculus
taaacctgtggaagaatattgttct

SEQ ID NO: 745139 - DNA, 25 bp, Mus musculus
taaacctgtggatgaatattgttct

SEQ ID NO: 745140 - DNA, 25 bp, Mus musculus
taaacctgttgaactcttacgtaca

SEQ ID NO: 745141 - DNA, 25 bp, Mus musculus
taaacctgttgatctcttacgtaca

SEQ ID NO: 745142 - DNA, 25 bp, Mus musculus
taaaccttagctatgttcctatgat

SEQ ID NO: 745143 - DNA, 25 bp, Mus musculus
taaaccttagctttgttcctatgat

SEQ ID NO: 745144 - DNA, 25 bp, Mus musculus
taaaccttccatctaacctgtcagt

SEQ ID NO: 745145 - DNA, 25 bp, Mus musculus
taaaccttccatgtaacctgtcagt

SEQ ID NO: 745146 - DNA, 25 bp, Mus musculus
taaaccttccttccagaccagaagt

SEQ ID NO: 745147 - DNA, 25 bp, Mus musculus
taaaccttccttgcagaccagaagt

SEQ ID NO: 745148 - DNA, 25 bp, Mus musculus
taaaccttgctgatctgagaatccc

SEQ ID NO: 745149 - DNA, 25 bp, Mus musculus
taaaccttgctgttctgagaatccc

SEQ ID NO: 745150 - DNA, 25 bp, Mus musculus
taaacctttcctatcttcagttgcg

SEQ ID NO: 745151 - DNA, 25 bp, Mus musculus
taaacctttcctttcttcagttgcg

SEQ ID NO: 745152 - DNA, 25 bp, Mus musculus
taaacctttgggatccatcatgccc

SEQ ID NO: 745153 - DNA, 25 bp, Mus musculus
taaacctttgggttccatcatgccc

SEQ ID NO: 745154 - DNA, 25 bp, Mus musculus
taaacctttgtaattcagtcacctt

SEQ ID NO: 745155 - DNA, 25 bp, Mus musculus
taaacctttgtatttcagtcacctt

SEQ ID NO: 745156 - DNA, 25 bp, Mus musculus
taaacgaagtgtccggcatggcaat

SEQ ID NO: 745157 - DNA, 25 bp, Mus musculus
taaacgaagtgtgcggcatggcaat

SEQ ID NO: 745158 - DNA, 25 bp, Mus musculus
taaacgaatgctatgaggcccacca

SEQ ID NO: 745159 - DNA, 25 bp, Mus musculus
taaacgaatgctttgaggcccacca

SEQ ID NO: 745160 - DNA, 25 bp, Mus musculus
taaacgaccccactaggtgtggtgc

SEQ ID NO: 745161 - DNA, 25 bp, Mus musculus
taaacgaccccagtaggtgtggtgc

SEQ ID NO: 745162 - DNA, 25 bp, Mus musculus
taaacgactgtaacgggcttcagct

SEQ ID NO: 745163 - DNA, 25 bp, Mus musculus
taaacgactgtatcgggcttcagct

SEQ ID NO: 745164 - DNA, 25 bp, Mus musculus
taaacgacttaaaagctcgccctct

SEQ ID NO: 745165 - DNA, 25 bp, Mus musculus
taaacgacttaatagctcgccctct

SEQ ID NO: 745166 - DNA, 25 bp, Mus musculus
taaacgagagccaacatacccattg

SEQ ID NO: 745167 - DNA, 25 bp, Mus musculus
taaacgagagcctacatacccattg

SEQ ID NO: 745168 - DNA, 25 bp, Mus musculus
taaacgagcattccctcaagtcctg

SEQ ID NO: 745169 - DNA, 25 bp, Mus musculus
taaacgagcattgcctcaagtcctg

SEQ ID NO: 745170 - DNA, 25 bp, Mus musculus
taaacgaggcctacgaccagctgcg

SEQ ID NO: 745171 - DNA, 25 bp, Mus musculus
taaacgaggccttcgaccagctgcg

SEQ ID NO: 745172 - DNA, 25 bp, Mus musculus
taaacgagggcacgagtggcggagc

SEQ ID NO: 745173 - DNA, 25 bp, Mus musculus
taaacgagggcaggagtggcggagc

SEQ ID NO: 745174 - DNA, 25 bp, Mus musculus
taaacgatgtaaacttgaggaatgg

SEQ ID NO: 745175 - DNA, 25 bp, Mus musculus
taaacgatgtaatcttgaggaatgg

SEQ ID NO: 745176 - DNA, 25 bp, Mus musculus
taaacgcatcataattccacttccc

SEQ ID NO: 745177 - DNA, 25 bp, Mus musculus
taaacgcatcattattccacttccc

SEQ ID NO: 745178 - DNA, 25 bp, Mus musculus
taaacgccttggaggagggccagat

SEQ ID NO: 745179 - DNA, 25 bp, Mus musculus
taaacgccttggtggagggccagat

SEQ ID NO: 745180 - DNA, 25 bp, Mus musculus
taaacgcggtgtccaggcaagtgcc

SEQ ID NO: 745181 - DNA, 25 bp, Mus musculus
taaacgcggtgtgcaggcaagtgcc

SEQ ID NO: 745182 - DNA, 25 bp, Mus musculus
taaacgcggtttaatgagtctctgt

SEQ ID NO: 745183 - DNA, 25 bp, Mus musculus
taaacgcggttttatgagtctctgt

SEQ ID NO: 745184 - DNA, 25 bp, Mus musculus
taaacgcgtccaccagaaacatcac

SEQ ID NO: 745185 - DNA, 25 bp, Mus musculus
taaacgcgtccagcagaaacatcac

SEQ ID NO: 745186 - DNA, 25 bp, Mus musculus
taaacgctaggcagacctggcacct

SEQ ID NO: 745187 - DNA, 25 bp, Mus musculus
taaacgctaggctgacctggcacct

SEQ ID NO: 745188 - DNA, 25 bp, Mus musculus
taaacgctccctagaaagctgcaga

SEQ ID NO: 745189 - DNA, 25 bp, Mus musculus
taaacgctcccttgaaagctgcaga

SEQ ID NO: 745190 - DNA, 25 bp, Mus musculus
taaacgctgagtattgggctggtga

SEQ ID NO: 745191 - DNA, 25 bp, Mus musculus
taaacgctgagttttgggctggtga

SEQ ID NO: 745192 - DNA, 25 bp, Mus musculus
taaacgctgttacaaggctggccac

SEQ ID NO: 745193 - DNA, 25 bp, Mus musculus
taaacgctgttagaaggctggccac

SEQ ID NO: 745194 - DNA, 25 bp, Mus musculus
taaacggcgtgtactgaggacctgc

SEQ ID NO: 745195 - DNA, 25 bp, Mus musculus
taaacggcgtgttctgaggacctgc

SEQ ID NO: 745196 - DNA, 25 bp, Mus musculus
taaacggctggcagctgatggaaga

SEQ ID NO: 745197 - DNA, 25 bp, Mus musculus
taaacggctggctgctgatggaaga

SEQ ID NO: 745198 - DNA, 25 bp, Mus musculus
taaacgggacagatctggcccctga

SEQ ID NO: 745199 - DNA, 25 bp, Mus musculus
taaacgggacagttctggcccctga

SEQ ID NO: 745200 - DNA, 25 bp, Mus musculus
taaacgggtgtcaccaaactgcttt

SEQ ID NO: 745201 - DNA, 25 bp, Mus musculus
taaacgggtgtctccaaactgcttt

SEQ ID NO: 745202 - DNA, 25 bp, Mus musculus
taaacggtgaccagagctgatccct

SEQ ID NO: 745203 - DNA, 25 bp, Mus musculus
taaacggtgacctgagctgatccct

SEQ ID NO: 745204 - DNA, 25 bp, Mus musculus
taaacggtgctcaacttttctgcca

SEQ ID NO: 745205 - DNA, 25 bp, Mus musculus
taaacggtgctctacttttctgcca

SEQ ID NO: 745206 - DNA, 25 bp, Mus musculus
taaacggttcttcctgggttctctt

SEQ ID NO: 745207 - DNA, 25 bp, Mus musculus
taaacggttcttgctgggttctctt

SEQ ID NO: 745208 - DNA, 25 bp, Mus musculus
taaacggttgtgatgtgttcccagc

SEQ ID NO: 745209 - DNA, 25 bp, Mus musculus
taaacggttgtgttgtgttcccagc

SEQ ID NO: 745210 - DNA, 25 bp, Mus musculus
taaacgtcacctattggactgtaga

SEQ ID NO: 745211 - DNA, 25 bp, Mus musculus
taaacgtcaccttttggactgtaga

SEQ ID NO: 745212 - DNA, 25 bp, Mus musculus
taaacgtcgtctacctgtacctgaa

SEQ ID NO: 745213 - DNA, 25 bp, Mus musculus
taaacgtcgtcttcctgtacctgaa

SEQ ID NO: 745214 - DNA, 25 bp, Mus musculus
taaacgtctgtgactgtgcagtact

SEQ ID NO: 745215 - DNA, 25 bp, Mus musculus
taaacgtctgtgtctgtgcagtact

SEQ ID NO: 745216 - DNA, 25 bp, Mus musculus
taaacgtgactgaagctggctcaaa

SEQ ID NO: 745217 - DNA, 25 bp, Mus musculus
taaacgtgactgtagctggctcaaa

SEQ ID NO: 745218 - DNA, 25 bp, Mus musculus
taaacgtgcaacacactcgtgcgaa

SEQ ID NO: 745219 - DNA, 25 bp, Mus musculus
taaacgtgcaactcactcgtgcgaa

SEQ ID NO: 745220 - DNA, 25 bp, Mus musculus
taaacgtgtaaacctcctgccccat

SEQ ID NO: 745221 - DNA, 25 bp, Mus musculus
taaacgtgtaaagctcctgccccat

SEQ ID NO: 745222 - DNA, 25 bp, Mus musculus
taaacgttagctccatgctttacaa

SEQ ID NO: 745223 - DNA, 25 bp, Mus musculus
taaacgttagctgcatgctttacaa

SEQ ID NO: 745224 - DNA, 25 bp, Mus musculus
taaacgttgaagcagctctgcatgt

SEQ ID NO: 745225 - DNA, 25 bp, Mus musculus
taaacgttgaaggagctctgcatgt

SEQ ID NO: 745226 - DNA, 25 bp, Mus musculus
taaacgttttgtcccttggtctaat

SEQ ID NO: 745227 - DNA, 25 bp, Mus musculus
taaacgttttgtctaagaccttgtg

SEQ ID NO: 745228 - DNA, 25 bp, Mus musculus
taaacgttttgtgccttggtctaat

SEQ ID NO: 745229 - DNA, 25 bp, Mus musculus
taaacgttttgtgtaagaccttgtg

SEQ ID NO: 745230 - DNA, 25 bp, Mus musculus
taaactacaagccttccacctcagt

SEQ ID NO: 745231 - DNA, 25 bp, Mus musculus
taaactacaagcgttccacctcagt

SEQ ID NO: 745232 - DNA, 25 bp, Mus musculus
taaactacccttcagaatggttctt

SEQ ID NO: 745233 - DNA, 25 bp, Mus musculus
taaactacccttgagaatggttctt

SEQ ID NO: 745234 - DNA, 25 bp, Mus musculus
taaactacctctagctgtagccagg

SEQ ID NO: 745235 - DNA, 25 bp, Mus musculus
taaactacctcttgctgtagccagg

SEQ ID NO: 745236 - DNA, 25 bp, Mus musculus
taaactactaagactggccagcact

SEQ ID NO: 745237 - DNA, 25 bp, Mus musculus
taaactactaagagcgcctggccac

SEQ ID NO: 745238 - DNA, 25 bp, Mus musculus
taaactactaagtctggccagcact

SEQ ID NO: 745239 - DNA, 25 bp, Mus musculus
taaactactaagtgcgcctggccac

SEQ ID NO: 745240 - DNA, 25 bp, Mus musculus
taaactactctacatcaaccttcaa

SEQ ID NO: 745241 - DNA, 25 bp, Mus musculus
taaactactctagatcaaccttcaa

SEQ ID NO: 745242 - DNA, 25 bp, Mus musculus
taaactagaattatcccttgcaaat

SEQ ID NO: 745243 - DNA, 25 bp, Mus musculus
taaactagaattttcccttgcaaat

SEQ ID NO: 745244 - DNA, 25 bp, Mus musculus
taaactagcgacacctttctaaagg

SEQ ID NO: 745245 - DNA, 25 bp, Mus musculus
taaactagcgactcctttctaaagg

SEQ ID NO: 745246 - DNA, 25 bp, Mus musculus
taaactatacctacctggactggct

SEQ ID NO: 745247 - DNA, 25 bp, Mus musculus
taaactataccttcctggactggct

SEQ ID NO: 745248 - DNA, 25 bp, Mus musculus
taaactatcaccatgcccacaggtt

SEQ ID NO: 745249 - DNA, 25 bp, Mus musculus
taaactatcaccttgcccacaggtt

SEQ ID NO: 745250 - DNA, 25 bp, Mus musculus
taaactatggagattttcctgcata

SEQ ID NO: 745251 - DNA, 25 bp, Mus musculus
taaactatggagtttttcctgcata

SEQ ID NO: 745252 - DNA, 25 bp, Mus musculus
taaactattcaccaagagtcgatat

SEQ ID NO: 745253 - DNA, 25 bp, Mus musculus
taaactattcacgaagagtcgatat

SEQ ID NO: 745254 - DNA, 25 bp, Mus musculus
taaactattctgctgactctctgac

SEQ ID NO: 745255 - DNA, 25 bp, Mus musculus
taaactattctggtgactctctgac

SEQ ID NO: 745256 - DNA, 25 bp, Mus musculus
taaactattgtcagtcaccatgtga

SEQ ID NO: 745257 - DNA, 25 bp, Mus musculus
taaactattgtctgtcaccatgtga

SEQ ID NO: 745258 - DNA, 25 bp, Mus musculus
taaactatttggatcaccctagccc

SEQ ID NO: 745259 - DNA, 25 bp, Mus musculus
taaactatttggttcaccctagccc

SEQ ID NO: 745260 - DNA, 25 bp, Mus musculus
taaactattttccttaaagctgaag

SEQ ID NO: 745261 - DNA, 25 bp, Mus musculus
taaactattttcgttaaagctgaag

SEQ ID NO: 745262 - DNA, 25 bp, Mus musculus
taaactcaacacagccacctttggg

SEQ ID NO: 745263 - DNA, 25 bp, Mus musculus
taaactcaacactgccacctttggg

SEQ ID NO: 745264 - DNA, 25 bp, Mus musculus
taaactcaaggaaatttctttgtga

SEQ ID NO: 745265 - DNA, 25 bp, Mus musculus
taaactcaaggatatttctttgtga

SEQ ID NO: 745266 - DNA, 25 bp, Mus musculus
taaactcaagttacatcggcagcaa

SEQ ID NO: 745267 - DNA, 25 bp, Mus musculus
taaactcaagtttcatcggcagcaa

SEQ ID NO: 745268 - DNA, 25 bp, Mus musculus
taaactcacattactgccttttcct

SEQ ID NO: 745269 - DNA, 25 bp, Mus musculus
taaactcacatttctgccttttcct

SEQ ID NO: 745270 - DNA, 25 bp, Mus musculus
taaactcaccacaagatggccggga

SEQ ID NO: 745271 - DNA, 25 bp, Mus musculus
taaactcaccactagatggccggga

SEQ ID NO: 745272 - DNA, 25 bp, Mus musculus
taaactcacctacattacactcaat

SEQ ID NO: 745273 - DNA, 25 bp, Mus musculus
taaactcacctagattacactcaat

SEQ ID NO: 745274 - DNA, 25 bp, Mus musculus
taaactcactgaacaaacacaatat

SEQ ID NO: 745275 - DNA, 25 bp, Mus musculus
taaactcactgatcaaacacaatat

SEQ ID NO: 745276 - DNA, 25 bp, Mus musculus
taaactcagccaacccttatgggaa

SEQ ID NO: 745277 - DNA, 25 bp, Mus musculus
taaactcagccatcccttatgggaa

SEQ ID NO: 745278 - DNA, 25 bp, Mus musculus
taaactcaggcacatctaagaattg

SEQ ID NO: 745279 - DNA, 25 bp, Mus musculus
taaactcaggcagatctaagaattg

SEQ ID NO: 745280 - DNA, 25 bp, Mus musculus
taaactcaggtacctgtgcctcgca

SEQ ID NO: 745281 - DNA, 25 bp, Mus musculus
taaactcaggtagctgtgcctcgca

SEQ ID NO: 745282 - DNA, 25 bp, Mus musculus
taaactcagtatctcttttgcttca

SEQ ID NO: 745283 - DNA, 25 bp, Mus musculus
taaactcagtatgtcttttgcttca

SEQ ID NO: 745284 - DNA, 25 bp, Mus musculus
taaactccaaccacgaggctgggtt

SEQ ID NO: 745285 - DNA, 25 bp, Mus musculus
taaactccaacctcgaggctgggtt

SEQ ID NO: 745286 - DNA, 25 bp, Mus musculus
taaactccaaggatgcttaacttca

SEQ ID NO: 745287 - DNA, 25 bp, Mus musculus
taaactccaaggcagctagcttcct

SEQ ID NO: 745288 - DNA, 25 bp, Mus musculus
taaactccaagggagctagcttcct

SEQ ID NO: 745289 - DNA, 25 bp, Mus musculus
taaactccaaggttgcttaacttca

SEQ ID NO: 745290 - DNA, 25 bp, Mus musculus
taaactccagttactacacttgtat

SEQ ID NO: 745291 - DNA, 25 bp, Mus musculus
taaactccagtttctacacttgtat

SEQ ID NO: 745292 - DNA, 25 bp, Mus musculus
taaactcccagtatattttcacaag

SEQ ID NO: 745293 - DNA, 25 bp, Mus musculus
taaactcccagtttattttcacaag

SEQ ID NO: 745294 - DNA, 25 bp, Mus musculus
taaactcccttcagtgtgtccagat

SEQ ID NO: 745295 - DNA, 25 bp, Mus musculus
taaactcccttctgtgtgtccagat

SEQ ID NO: 745296 - DNA, 25 bp, Mus musculus
taaactccgtagctcttgttttctg

SEQ ID NO: 745297 - DNA, 25 bp, Mus musculus
taaactccgtaggtcttgttttctg

SEQ ID NO: 745298 - DNA, 25 bp, Mus musculus
taaactcctcataaaggcccttcag

SEQ ID NO: 745299 - DNA, 25 bp, Mus musculus
taaactcctcattaaggcccttcag

SEQ ID NO: 745300 - DNA, 25 bp, Mus musculus
taaactcctttccatcctgattttt

SEQ ID NO: 745301 - DNA, 25 bp, Mus musculus
taaactcctttcgatcctgattttt

SEQ ID NO: 745302 - DNA, 25 bp, Mus musculus
taaactcgagatcaccctaggctat

SEQ ID NO: 745303 - DNA, 25 bp, Mus musculus
taaactcgagatgaccctaggctat

SEQ ID NO: 745304 - DNA, 25 bp, Mus musculus
taaactcggaggagtgccttgtcta

SEQ ID NO: 745305 - DNA, 25 bp, Mus musculus
taaactcggaggtgtgccttgtcta

SEQ ID NO: 745306 - DNA, 25 bp, Mus musculus
taaactcggtaccatactctggctt

SEQ ID NO: 745307 - DNA, 25 bp, Mus musculus
taaactcggtacgatactctggctt

SEQ ID NO: 745308 - DNA, 25 bp, Mus musculus
taaactcggtggctattcccattgc

SEQ ID NO: 745309 - DNA, 25 bp, Mus musculus
taaactcggtgggtattcccattgc

SEQ ID NO: 745310 - DNA, 25 bp, Mus musculus
taaactcgtccacaatttacattgg

SEQ ID NO: 745311 - DNA, 25 bp, Mus musculus
taaactcgtccagaatttacattgg

SEQ ID NO: 745312 - DNA, 25 bp, Mus musculus
taaactcgtgggagtctcacaggat

SEQ ID NO: 745313 - DNA, 25 bp, Mus musculus
taaactcgtgggtgtctcacaggat

SEQ ID NO: 745314 - DNA, 25 bp, Mus musculus
taaactctacgacgccgactttgtt

SEQ ID NO: 745315 - DNA, 25 bp, Mus musculus
taaactctacgaggccgactttgtt

SEQ ID NO: 745316 - DNA, 25 bp, Mus musculus
taaactctagtgaggcagcctggta

SEQ ID NO: 745317 - DNA, 25 bp, Mus musculus
taaactctagtgaggtgctcatcag

SEQ ID NO: 745318 - DNA, 25 bp, Mus musculus
taaactctagtgtggcagcctggta

SEQ ID NO: 745319 - DNA, 25 bp, Mus musculus
taaactctagtgtggtgctcatcag

SEQ ID NO: 745320 - DNA, 25 bp, Mus musculus
taaactctcaagcagtccatacatg

SEQ ID NO: 745321 - DNA, 25 bp, Mus musculus
taaactctcaaggagtccatacatg

SEQ ID NO: 745322 - DNA, 25 bp, Mus musculus
taaactctcatgcaagatgtgccct

SEQ ID NO: 745323 - DNA, 25 bp, Mus musculus
taaactctcatggaagatgtgccct

SEQ ID NO: 745324 - DNA, 25 bp, Mus musculus
taaactctcctcacgagttcactga

SEQ ID NO: 745325 - DNA, 25 bp, Mus musculus
taaactctcctctcgagttcactga

SEQ ID NO: 745326 - DNA, 25 bp, Mus musculus
taaactctgaccctgtgctggtgct

SEQ ID NO: 745327 - DNA, 25 bp, Mus musculus
taaactctgaccgtgtgctggtgct

SEQ ID NO: 745328 - DNA, 25 bp, Mus musculus
taaactcttcagctcaggcttagct

SEQ ID NO: 745329 - DNA, 25 bp, Mus musculus
taaactcttcaggtcaggcttagct

SEQ ID NO: 745330 - DNA, 25 bp, Mus musculus
taaactcttcttaatcctcttacca

SEQ ID NO: 745331 - DNA, 25 bp, Mus musculus
taaactcttcttccttttttgattg

SEQ ID NO: 745332 - DNA, 25 bp, Mus musculus
taaactcttcttgcttttttgattg

SEQ ID NO: 745333 - DNA, 25 bp, Mus musculus
taaactcttctttatcctcttacca

SEQ ID NO: 745334 - DNA, 25 bp, Mus musculus
taaactctttgaatcccaagttcct

SEQ ID NO: 745335 - DNA, 25 bp, Mus musculus
taaactctttgattcccaagttcct

SEQ ID NO: 745336 - DNA, 25 bp, Mus musculus
taaactcttttcagtacttgatgac

SEQ ID NO: 745337 - DNA, 25 bp, Mus musculus
taaactcttttctgtacttgatgac

SEQ ID NO: 745338 - DNA, 25 bp, Mus musculus
taaactgaagagagcaccgcaaatg

SEQ ID NO: 745339 - DNA, 25 bp, Mus musculus
taaactgaagagtgcaccgcaaatg

SEQ ID NO: 745340 - DNA, 25 bp, Mus musculus
taaactgaagtgcaccaaagaggag

SEQ ID NO: 745341 - DNA, 25 bp, Mus musculus
taaactgaagtggaccaaagaggag

SEQ ID NO: 745342 - DNA, 25 bp, Mus musculus
taaactgaatcaccgtcagcccaat

SEQ ID NO: 745343 - DNA, 25 bp, Mus musculus
taaactgaatcagcgtcagcccaat

SEQ ID NO: 745344 - DNA, 25 bp, Mus musculus
taaactgacaggacccagctgctta

SEQ ID NO: 745345 - DNA, 25 bp, Mus musculus
taaactgacaggcaacctagccatc

SEQ ID NO: 745346 - DNA, 25 bp, Mus musculus
taaactgacagggaacctagccatc

SEQ ID NO: 745347 - DNA, 25 bp, Mus musculus
taaactgacaggtcccagctgctta

SEQ ID NO: 745348 - DNA, 25 bp, Mus musculus
taaactgacagtccaccgaatcatt

SEQ ID NO: 745349 - DNA, 25 bp, Mus musculus
taaactgacagtgcaccgaatcatt

SEQ ID NO: 745350 - DNA, 25 bp, Mus musculus
taaactgacgagctcccggaaattt

SEQ ID NO: 745351 - DNA, 25 bp, Mus musculus
taaactgacgaggtcccggaaattt

SEQ ID NO: 745352 - DNA, 25 bp, Mus musculus
taaactgagacactgtactcacggg

SEQ ID NO: 745353 - DNA, 25 bp, Mus musculus
taaactgagacagtgtactcacggg

SEQ ID NO: 745354 - DNA, 25 bp, Mus musculus
taaactgagcaaaaacgccacgcct

SEQ ID NO: 745355 - DNA, 25 bp, Mus musculus
taaactgagcaataacgccacgcct

SEQ ID NO: 745356 - DNA, 25 bp, Mus musculus
taaactgatctaccggcaatatgca

SEQ ID NO: 745357 - DNA, 25 bp, Mus musculus
taaactgatctagcggcaatatgca

SEQ ID NO: 745358 - DNA, 25 bp, Mus musculus
taaactgatgcccaggcaacagaat

SEQ ID NO: 745359 - DNA, 25 bp, Mus musculus
taaactgatgccgaggcaacagaat

SEQ ID NO: 745360 - DNA, 25 bp, Mus musculus
taaactgatgttcgccttatttgga

SEQ ID NO: 745361 - DNA, 25 bp, Mus musculus
taaactgatgttggccttatttgga

SEQ ID NO: 745362 - DNA, 25 bp, Mus musculus
taaactgatttactagacatgggaa

SEQ ID NO: 745363 - DNA, 25 bp, Mus musculus
taaactgatttagtagacatgggaa

SEQ ID NO: 745364 - DNA, 25 bp, Mus musculus
taaactgcaagtccttcttacggtt

SEQ ID NO: 745365 - DNA, 25 bp, Mus musculus
taaactgcaagtgcttcttacggtt

SEQ ID NO: 745366 - DNA, 25 bp, Mus musculus
taaactgcaggccactgcacaggtg

SEQ ID NO: 745367 - DNA, 25 bp, Mus musculus
taaactgcaggcgactgcacaggtg

SEQ ID NO: 745368 - DNA, 25 bp, Mus musculus
taaactgcatatacgttctggcttg

SEQ ID NO: 745369 - DNA, 25 bp, Mus musculus
taaactgcatattcgttctggcttg

SEQ ID NO: 745370 - DNA, 25 bp, Mus musculus
taaactgcatggattcggccagctc

SEQ ID NO: 745371 - DNA, 25 bp, Mus musculus
taaactgcatggtttcggccagctc

SEQ ID NO: 745372 - DNA, 25 bp, Mus musculus
taaactgcattgagatccaacaaac

SEQ ID NO: 745373 - DNA, 25 bp, Mus musculus
taaactgcattgtgatccaacaaac

SEQ ID NO: 745374 - DNA, 25 bp, Mus musculus
taaactgcatttccccatcagtttt

SEQ ID NO: 745375 - DNA, 25 bp, Mus musculus
taaactgcatttgcccatcagtttt

SEQ ID NO: 745376 - DNA, 25 bp, Mus musculus
taaactgccaaaatcctgcctgttt

SEQ ID NO: 745377 - DNA, 25 bp, Mus musculus
taaactgccaaattcctgcctgttt

SEQ ID NO: 745378 - DNA, 25 bp, Mus musculus
taaactgccaggacgtgtccttcaa

SEQ ID NO: 745379 - DNA, 25 bp, Mus musculus
taaactgccaggtcgtgtccttcaa

SEQ ID NO: 745380 - DNA, 25 bp, Mus musculus
taaactgccatgagccaacaggaga

SEQ ID NO: 745381 - DNA, 25 bp, Mus musculus
taaactgccatgtgccaacaggaga

SEQ ID NO: 745382 - DNA, 25 bp, Mus musculus
taaactgcccagaggtgagcacctg

SEQ ID NO: 745383 - DNA, 25 bp, Mus musculus
taaactgcccagtggtgagcacctg

SEQ ID NO: 745384 - DNA, 25 bp, Mus musculus
taaactgcctagatgaggccgtttt

SEQ ID NO: 745385 - DNA, 25 bp, Mus musculus
taaactgcctagttgaggccgtttt

SEQ ID NO: 745386 - DNA, 25 bp, Mus musculus
taaactgcctcgagttgtcacattt

SEQ ID NO: 745387 - DNA, 25 bp, Mus musculus
taaactgcctcgtgttgtcacattt

SEQ ID NO: 745388 - DNA, 25 bp, Mus musculus
taaactgctccaatttattgccaga

SEQ ID NO: 745389 - DNA, 25 bp, Mus musculus
taaactgctccattttattgccaga

SEQ ID NO: 745390 - DNA, 25 bp, Mus musculus
taaactgctctgagacagtggcatg

SEQ ID NO: 745391 - DNA, 25 bp, Mus musculus
taaactgctctgtgacagtggcatg

SEQ ID NO: 745392 - DNA, 25 bp, Mus musculus
taaactgctgtcacctttgggactc

SEQ ID NO: 745393 - DNA, 25 bp, Mus musculus
taaactgctgtctcctttgggactc

SEQ ID NO: 745394 - DNA, 25 bp, Mus musculus
taaactgcttacaatgatccaggag

SEQ ID NO: 745395 - DNA, 25 bp, Mus musculus
taaactgcttactatgatccaggag

SEQ ID NO: 745396 - DNA, 25 bp, Mus musculus
taaactgctttgactgataacttag

SEQ ID NO: 745397 - DNA, 25 bp, Mus musculus
taaactgctttgtctgataacttag

SEQ ID NO: 745398 - DNA, 25 bp, Mus musculus
taaactggaattaggcctcatagat

SEQ ID NO: 745399 - DNA, 25 bp, Mus musculus
taaactggaatttggcctcatagat

SEQ ID NO: 745400 - DNA, 25 bp, Mus musculus
taaactggaggaaaaggctgggcct

SEQ ID NO: 745401 - DNA, 25 bp, Mus musculus
taaactggaggataaggctgggcct

SEQ ID NO: 745402 - DNA, 25 bp, Mus musculus
taaactggatttctggaccttaaag

SEQ ID NO: 745403 - DNA, 25 bp, Mus musculus
taaactggatttgtggaccttaaag

SEQ ID NO: 745404 - DNA, 25 bp, Mus musculus
taaactgggaccatgctttaggctc

SEQ ID NO: 745405 - DNA, 25 bp, Mus musculus
taaactgggaccttgctttaggctc

SEQ ID NO: 745406 - DNA, 25 bp, Mus musculus
taaactgggctcatgcatgacctat

SEQ ID NO: 745407 - DNA, 25 bp, Mus musculus
taaactgggctcttgcatgacctat

SEQ ID NO: 745408 - DNA, 25 bp, Mus musculus
taaactgggcttactggtcccttct

SEQ ID NO: 745409 - DNA, 25 bp, Mus musculus
taaactgggctttctggtcccttct

SEQ ID NO: 745410 - DNA, 25 bp, Mus musculus
taaactgggtgcattctgttgcctc

SEQ ID NO: 745411 - DNA, 25 bp, Mus musculus
taaactgggtgctttctgttgcctc

SEQ ID NO: 745412 - DNA, 25 bp, Mus musculus
taaactggtcttactaggtgctgag

SEQ ID NO: 745413 - DNA, 25 bp, Mus musculus
taaactggtctttctaggtgctgag

SEQ ID NO: 745414 - DNA, 25 bp, Mus musculus
taaactggtgagctggattcaatcc

SEQ ID NO: 745415 - DNA, 25 bp, Mus musculus
taaactggtgaggtggattcaatcc

SEQ ID NO: 745416 - DNA, 25 bp, Mus musculus
taaactgtacacaggcttggaatgt

SEQ ID NO: 745417 - DNA, 25 bp, Mus musculus
taaactgtacactggcttggaatgt

SEQ ID NO: 745418 - DNA, 25 bp, Mus musculus
taaactgtacctattcttggcgtgg

SEQ ID NO: 745419 - DNA, 25 bp, Mus musculus
taaactgtaccttttcttggcgtgg

SEQ ID NO: 745420 - DNA, 25 bp, Mus musculus
taaactgtactcacttagcgtgacc

SEQ ID NO: 745421 - DNA, 25 bp, Mus musculus
taaactgtactcctccgtgtggaac

SEQ ID NO: 745422 - DNA, 25 bp, Mus musculus
taaactgtactcgtccgtgtggaac

SEQ ID NO: 745423 - DNA, 25 bp, Mus musculus
taaactgtactctcttagcgtgacc

SEQ ID NO: 745424 - DNA, 25 bp, Mus musculus
taaactgtatcaacggcttccatcc

SEQ ID NO: 745425 - DNA, 25 bp, Mus musculus
taaactgtatcatcggcttccatcc

SEQ ID NO: 745426 - DNA, 25 bp, Mus musculus
taaactgtcaccattttatgagaag

SEQ ID NO: 745427 - DNA, 25 bp, Mus musculus
taaactgtcacctttttatgagaag

SEQ ID NO: 745428 - DNA, 25 bp, Mus musculus
taaactgtgatgctctctcacactt

SEQ ID NO: 745429 - DNA, 25 bp, Mus musculus
taaactgtgatggtctctcacactt

SEQ ID NO: 745430 - DNA, 25 bp, Mus musculus
taaactgtggacacttacattgtgc

SEQ ID NO: 745431 - DNA, 25 bp, Mus musculus
taaactgtggactcttacattgtgc

SEQ ID NO: 745432 - DNA, 25 bp, Mus musculus
taaactgtggatagaagacctgggc

SEQ ID NO: 745433 - DNA, 25 bp, Mus musculus
taaactgtggattgaagacctgggc

SEQ ID NO: 745434 - DNA, 25 bp, Mus musculus
taaactgtgtgtaccaagacatgtc

SEQ ID NO: 745435 - DNA, 25 bp, Mus musculus
taaactgtgtgttccaagacatgtc

SEQ ID NO: 745436 - DNA, 25 bp, Mus musculus
taaactgttcctagagatctgactc

SEQ ID NO: 745437 - DNA, 25 bp, Mus musculus
taaactgttccttgagatctgactc

SEQ ID NO: 745438 - DNA, 25 bp, Mus musculus
taaactgttgttcccagggtctttt

SEQ ID NO: 745439 - DNA, 25 bp, Mus musculus
taaactgttgttgccagggtctttt

SEQ ID NO: 745440 - DNA, 25 bp, Mus musculus
taaactgtttctcctcttcctggga

SEQ ID NO: 745441 - DNA, 25 bp, Mus musculus
taaactgtttctgctcttcctggga

SEQ ID NO: 745442 - DNA, 25 bp, Mus musculus
taaacttaacttctggatttagtat

SEQ ID NO: 745443 - DNA, 25 bp, Mus musculus
taaacttaacttgtggatttagtat

SEQ ID NO: 745444 - DNA, 25 bp, Mus musculus
taaacttaagctattctgatttaat

SEQ ID NO: 745445 - DNA, 25 bp, Mus musculus
taaacttaagcttttctgatttaat

SEQ ID NO: 745446 - DNA, 25 bp, Mus musculus
taaacttagactctgtgagttctca

SEQ ID NO: 745447 - DNA, 25 bp, Mus musculus
taaacttagactgtgtgagttctca

SEQ ID NO: 745448 - DNA, 25 bp, Mus musculus
taaacttagatgagctccccagatt

SEQ ID NO: 745449 - DNA, 25 bp, Mus musculus
taaacttagatgtgctccccagatt

SEQ ID NO: 745450 - DNA, 25 bp, Mus musculus
taaacttatcttcttgacatctgtg

SEQ ID NO: 745451 - DNA, 25 bp, Mus musculus
taaacttatcttgttgacatctgtg

SEQ ID NO: 745452 - DNA, 25 bp, Mus musculus
taaacttcaaatctcatccttccaa

SEQ ID NO: 745453 - DNA, 25 bp, Mus musculus
taaacttcaaatgtcatccttccaa

SEQ ID NO: 745454 - DNA, 25 bp, Mus musculus
taaacttcaatcatggtagcttaga

SEQ ID NO: 745455 - DNA, 25 bp, Mus musculus
taaacttcaatcttggtagcttaga

SEQ ID NO: 745456 - DNA, 25 bp, Mus musculus
taaacttcacctcactatgctacga

SEQ ID NO: 745457 - DNA, 25 bp, Mus musculus
taaacttcacctgactatgctacga

SEQ ID NO: 745458 - DNA, 25 bp, Mus musculus
taaacttcactgatgattactccgt

SEQ ID NO: 745459 - DNA, 25 bp, Mus musculus
taaacttcactgttgattactccgt

SEQ ID NO: 745460 - DNA, 25 bp, Mus musculus
taaacttcagtaatgataactcagc

SEQ ID NO: 745461 - DNA, 25 bp, Mus musculus
taaacttcagtattgataactcagc

SEQ ID NO: 745462 - DNA, 25 bp, Mus musculus
taaacttcatgtccttgcctgggac

SEQ ID NO: 745463 - DNA, 25 bp, Mus musculus
taaacttcatgtgcttgcctgggac

SEQ ID NO: 745464 - DNA, 25 bp, Mus musculus
taaacttccaagaaggtcacagggt

SEQ ID NO: 745465 - DNA, 25 bp, Mus musculus
taaacttccaagtaggtcacagggt

SEQ ID NO: 745466 - DNA, 25 bp, Mus musculus
taaacttccatgcaagctaccacca

SEQ ID NO: 745467 - DNA, 25 bp, Mus musculus
taaacttccatggaagctaccacca

SEQ ID NO: 745468 - DNA, 25 bp, Mus musculus
taaacttcccatccttttatctaag

SEQ ID NO: 745469 - DNA, 25 bp, Mus musculus
taaacttcccatgcttttatctaag

SEQ ID NO: 745470 - DNA, 25 bp, Mus musculus
taaacttcccggattttctggctcg

SEQ ID NO: 745471 - DNA, 25 bp, Mus musculus
taaacttcccggtttttctggctcg

SEQ ID NO: 745472 - DNA, 25 bp, Mus musculus
taaacttccgtaagagctgtctcca

SEQ ID NO: 745473 - DNA, 25 bp, Mus musculus
taaacttccgtatgagctgtctcca

SEQ ID NO: 745474 - DNA, 25 bp, Mus musculus
taaacttcctgtccttagcaactgt

SEQ ID NO: 745475 - DNA, 25 bp, Mus musculus
taaacttcctgtgcttagcaactgt

SEQ ID NO: 745476 - DNA, 25 bp, Mus musculus
taaacttctgaaaccgtcttctgcg

SEQ ID NO: 745477 - DNA, 25 bp, Mus musculus
taaacttctgaatccgtcttctgcg

SEQ ID NO: 745478 - DNA, 25 bp, Mus musculus
taaacttctttgatatacaagcaca

SEQ ID NO: 745479 - DNA, 25 bp, Mus musculus
taaacttctttgttatacaagcaca

SEQ ID NO: 745480 - DNA, 25 bp, Mus musculus
taaacttgaattcacacgtggtgta

SEQ ID NO: 745481 - DNA, 25 bp, Mus musculus
taaacttgaattgacacgtggtgta

SEQ ID NO: 745482 - DNA, 25 bp, Mus musculus
taaacttgcaacacctgacccggtg

SEQ ID NO: 745483 - DNA, 25 bp, Mus musculus
taaacttgcaactcctgacccggtg

SEQ ID NO: 745484 - DNA, 25 bp, Mus musculus
taaacttgccagacgttgctgtgga

SEQ ID NO: 745485 - DNA, 25 bp, Mus musculus
taaacttgccagtcgttgctgtgga

SEQ ID NO: 745486 - DNA, 25 bp, Mus musculus
taaacttgcttaacctgacgccaga

SEQ ID NO: 745487 - DNA, 25 bp, Mus musculus
taaacttgcttaataatcgggactt

SEQ ID NO: 745488 - DNA, 25 bp, Mus musculus
taaacttgcttatcctgacgccaga

SEQ ID NO: 745489 - DNA, 25 bp, Mus musculus
taaacttgcttattaatcgggactt

SEQ ID NO: 745490 - DNA, 25 bp, Mus musculus
taaacttggacaagcaccggctgat

SEQ ID NO: 745491 - DNA, 25 bp, Mus musculus
taaacttggacactgatgccatcaa

SEQ ID NO: 745492 - DNA, 25 bp, Mus musculus
taaacttggacagtgatgccatcaa

SEQ ID NO: 745493 - DNA, 25 bp, Mus musculus
taaacttggacatgcaccggctgat

SEQ ID NO: 745494 - DNA, 25 bp, Mus musculus
taaacttggaccagaaccaaccatc

SEQ ID NO: 745495 - DNA, 25 bp, Mus musculus
taaacttggacctgaaccaaccatc

SEQ ID NO: 745496 - DNA, 25 bp, Mus musculus
taaacttggctcagggtgctaacag

SEQ ID NO: 745497 - DNA, 25 bp, Mus musculus
taaacttggctctgggtgctaacag

SEQ ID NO: 745498 - DNA, 25 bp, Mus musculus
taaacttggcttaaaagagtccctg

SEQ ID NO: 745499 - DNA, 25 bp, Mus musculus
taaacttggctttaaagagtccctg

SEQ ID NO: 745500 - DNA, 25 bp, Mus musculus
taaacttgggagaccagtgggttat

SEQ ID NO: 745501 - DNA, 25 bp, Mus musculus
taaacttgggagtccagtgggttat

SEQ ID NO: 745502 - DNA, 25 bp, Mus musculus
taaacttggtatattggcctgacaa

SEQ ID NO: 745503 - DNA, 25 bp, Mus musculus
taaacttggtattttggcctgacaa

SEQ ID NO: 745504 - DNA, 25 bp, Mus musculus
taaacttggtctaggctgcattctt

SEQ ID NO: 745505 - DNA, 25 bp, Mus musculus
taaacttggtcttggctgcattctt

SEQ ID NO: 745506 - DNA, 25 bp, Mus musculus
taaactttaactcctcttacccaca

SEQ ID NO: 745507 - DNA, 25 bp, Mus musculus
taaactttaactgctcttacccaca

SEQ ID NO: 745508 - DNA, 25 bp, Mus musculus
taaactttagagaaacaggtccaga

SEQ ID NO: 745509 - DNA, 25 bp, Mus musculus
taaactttagagtaacaggtccaga

SEQ ID NO: 745510 - DNA, 25 bp, Mus musculus
taaactttcaacactgacctcgtga

SEQ ID NO: 745511 - DNA, 25 bp, Mus musculus
taaactttcaactctgacctcgtga

SEQ ID NO: 745512 - DNA, 25 bp, Mus musculus
taaactttccttacagttagtcatg

SEQ ID NO: 745513 - DNA, 25 bp, Mus musculus
taaactttcctttcagttagtcatg

SEQ ID NO: 745514 - DNA, 25 bp, Mus musculus
taaactttctcgcagcccgcgtagt

SEQ ID NO: 745515 - DNA, 25 bp, Mus musculus
taaactttctcggagcccgcgtagt

SEQ ID NO: 745516 - DNA, 25 bp, Mus musculus
taaactttgagcagtccttcttcct

SEQ ID NO: 745517 - DNA, 25 bp, Mus musculus
taaactttgagctgtccttcttcct

SEQ ID NO: 745518 - DNA, 25 bp, Mus musculus
taaactttgattccctcaccttagg

SEQ ID NO: 745519 - DNA, 25 bp, Mus musculus
taaactttgattgcctcaccttagg

SEQ ID NO: 745520 - DNA, 25 bp, Mus musculus
taaactttgtaccacaaggctgagt

SEQ ID NO: 745521 - DNA, 25 bp, Mus musculus
taaactttgtacgacaaggctgagt

SEQ ID NO: 745522 - DNA, 25 bp, Mus musculus
taaactttgtctaggctctgcatac

SEQ ID NO: 745523 - DNA, 25 bp, Mus musculus
taaactttgtcttggctctgcatac

SEQ ID NO: 745524 - DNA, 25 bp, Mus musculus
taaacttttatgattgctgacctca

SEQ ID NO: 745525 - DNA, 25 bp, Mus musculus
taaacttttatgtttgctgacctca

SEQ ID NO: 745526 - DNA, 25 bp, Mus musculus
taaacttttgccatatccacacttt

SEQ ID NO: 745527 - DNA, 25 bp, Mus musculus
taaacttttgccttatccacacttt

SEQ ID NO: 745528 - DNA, 25 bp, Mus musculus
taaacttttgttaacttatctcagg

SEQ ID NO: 745529 - DNA, 25 bp, Mus musculus
taaacttttgtttacttatctcagg

SEQ ID NO: 745530 - DNA, 25 bp, Mus musculus
taaagaaaacatccagagtcacttc

SEQ ID NO: 745531 - DNA, 25 bp, Mus musculus
taaagaaaacatgcagagtcacttc

SEQ ID NO: 745532 - DNA, 25 bp, Mus musculus
taaagaaaatcaccccataagtgtc

SEQ ID NO: 745533 - DNA, 25 bp, Mus musculus
taaagaaaatcagcccataagtgtc

SEQ ID NO: 745534 - DNA, 25 bp, Mus musculus
taaagaaacactcttctccctggct

SEQ ID NO: 745535 - DNA, 25 bp, Mus musculus
taaagaaacactgttctccctggct

SEQ ID NO: 745536 - DNA, 25 bp, Mus musculus
taaagaaacagtcgcgtgacctccc

SEQ ID NO: 745537 - DNA, 25 bp, Mus musculus
taaagaaacagtggcgtgacctccc

SEQ ID NO: 745538 - DNA, 25 bp, Mus musculus
taaagaaagaaaccatgttcacagg

SEQ ID NO: 745539 - DNA, 25 bp, Mus musculus
taaagaaagaaagcatgttcacagg

SEQ ID NO: 745540 - DNA, 25 bp, Mus musculus
taaagaaaggcacgcaaggacaatc

SEQ ID NO: 745541 - DNA, 25 bp, Mus musculus
taaagaaaggcaggcaaggacaatc

SEQ ID NO: 745542 - DNA, 25 bp, Mus musculus
taaagaaatctcctgcttgcattga

SEQ ID NO: 745543 - DNA, 25 bp, Mus musculus
taaagaaatctcgtgcttgcattga

SEQ ID NO: 745544 - DNA, 25 bp, Mus musculus
taaagaaatgagatcagcccctcaa

SEQ ID NO: 745545 - DNA, 25 bp, Mus musculus
taaagaaatgagttcagcccctcaa

SEQ ID NO: 745546 - DNA, 25 bp, Mus musculus
taaagaacaactcacctggccttac

SEQ ID NO: 745547 - DNA, 25 bp, Mus musculus
taaagaacaactgacctggccttac

SEQ ID NO: 745548 - DNA, 25 bp, Mus musculus
taaagaacattcaaggcctccagac

SEQ ID NO: 745549 - DNA, 25 bp, Mus musculus
taaagaacattctaggcctccagac

SEQ ID NO: 745550 - DNA, 25 bp, Mus musculus
taaagaaccatgcatcaggccagaa

SEQ ID NO: 745551 - DNA, 25 bp, Mus musculus
taaagaaccatggatcaggccagaa

SEQ ID NO: 745552 - DNA, 25 bp, Mus musculus
taaagaacgcgacttccacaaacct

SEQ ID NO: 745553 - DNA, 25 bp, Mus musculus
taaagaacgcgagttccacaaacct

SEQ ID NO: 745554 - DNA, 25 bp, Mus musculus
taaagaactaagcagaccagaaccg

SEQ ID NO: 745555 - DNA, 25 bp, Mus musculus
taaagaactaaggagaccagaaccg

SEQ ID NO: 745556 - DNA, 25 bp, Mus musculus
taaagaactgatcggctactggaca

SEQ ID NO: 745557 - DNA, 25 bp, Mus musculus
taaagaactgatgggctactggaca

SEQ ID NO: 745558 - DNA, 25 bp, Mus musculus
taaagaagatgtctccccaggagtt

SEQ ID NO: 745559 - DNA, 25 bp, Mus musculus
taaagaagatgtgtccccaggagtt

SEQ ID NO: 745560 - DNA, 25 bp, Mus musculus
taaagaagccttcgccaaccaggat

SEQ ID NO: 745561 - DNA, 25 bp, Mus musculus
taaagaagccttggccaaccaggat

SEQ ID NO: 745562 - DNA, 25 bp, Mus musculus
taaagaagcggaagcctcgagtaaa

SEQ ID NO: 745563 - DNA, 25 bp, Mus musculus
taaagaagcggatgcctcgagtaaa

SEQ ID NO: 745564 - DNA, 25 bp, Mus musculus
taaagaagctagctcccacgcacag

SEQ ID NO: 745565 - DNA, 25 bp, Mus musculus
taaagaagctaggtcccacgcacag

SEQ ID NO: 745566 - DNA, 25 bp, Mus musculus
taaagaagctcccaagtgttcttaa

SEQ ID NO: 745567 - DNA, 25 bp, Mus musculus
taaagaagctccgaagtgttcttaa

SEQ ID NO: 745568 - DNA, 25 bp, Mus musculus
taaagaaggactccggttgaccgct

SEQ ID NO: 745569 - DNA, 25 bp, Mus musculus
taaagaaggactgcggttgaccgct

SEQ ID NO: 745570 - DNA, 25 bp, Mus musculus
taaagaaggattcagccaagttccc

SEQ ID NO: 745571 - DNA, 25 bp, Mus musculus
taaagaaggattgagccaagttccc

SEQ ID NO: 745572 - DNA, 25 bp, Mus musculus
taaagaagttcacccaagtctcagt

SEQ ID NO: 745573 - DNA, 25 bp, Mus musculus
taaagaagttcagccaagtctcagt

SEQ ID NO: 745574 - DNA, 25 bp, Mus musculus
taaagaatagacagttcggtataaa

SEQ ID NO: 745575 - DNA, 25 bp, Mus musculus
taaagaatagactgttcggtataaa

SEQ ID NO: 745576 - DNA, 25 bp, Mus musculus
taaagaatcctaaagcaatagagct

SEQ ID NO: 745577 - DNA, 25 bp, Mus musculus
taaagaatcctatagcaatagagct

SEQ ID NO: 745578 - DNA, 25 bp, Mus musculus
taaagaatcgggatgagatcaacga

SEQ ID NO: 745579 - DNA, 25 bp, Mus musculus
taaagaatcgggttgagatcaacga

SEQ ID NO: 745580 - DNA, 25 bp, Mus musculus
taaagaatgactcctctaggctcat

SEQ ID NO: 745581 - DNA, 25 bp, Mus musculus
taaagaatgactgctctaggctcat

SEQ ID NO: 745582 - DNA, 25 bp, Mus musculus
taaagaatgggaccctgctctccag

SEQ ID NO: 745583 - DNA, 25 bp, Mus musculus
taaagaatgggagcctgctctccag

SEQ ID NO: 745584 - DNA, 25 bp, Mus musculus
taaagaatgggtccctgtctcaggg

SEQ ID NO: 745585 - DNA, 25 bp, Mus musculus
taaagaatgggtgcctgtctcaggg

SEQ ID NO: 745586 - DNA, 25 bp, Mus musculus
taaagaatggtccacgtgcctgcat

SEQ ID NO: 745587 - DNA, 25 bp, Mus musculus
taaagaatggtcgacgtgcctgcat

SEQ ID NO: 745588 - DNA, 25 bp, Mus musculus
taaagaattgaaactgagccaggca

SEQ ID NO: 745589 - DNA, 25 bp, Mus musculus
taaagaattgaatctgagccaggca

SEQ ID NO: 745590 - DNA, 25 bp, Mus musculus
taaagaattgctcgctgccgggcgt

SEQ ID NO: 745591 - DNA, 25 bp, Mus musculus
taaagaattgctggctgccgggcgt

SEQ ID NO: 745592 - DNA, 25 bp, Mus musculus
taaagaatttcacggccatgccaag

SEQ ID NO: 745593 - DNA, 25 bp, Mus musculus
taaagaatttcagggccatgccaag

SEQ ID NO: 745594 - DNA, 25 bp, Mus musculus
taaagaatttctacagccaccctag

SEQ ID NO: 745595 - DNA, 25 bp, Mus musculus
taaagaatttcttcagccaccctag

SEQ ID NO: 745596 - DNA, 25 bp, Mus musculus
taaagacaaaatccccatctgcctg

SEQ ID NO: 745597 - DNA, 25 bp, Mus musculus
taaagacaaaatgcccatctgcctg

SEQ ID NO: 745598 - DNA, 25 bp, Mus musculus
taaagacaagataaggactcctgaa

SEQ ID NO: 745599 - DNA, 25 bp, Mus musculus
taaagacaagattaggactcctgaa

SEQ ID NO: 745600 - DNA, 25 bp, Mus musculus
taaagacacagtctgagccctgccc

SEQ ID NO: 745601 - DNA, 25 bp, Mus musculus
taaagacacagtgtgagccctgccc

SEQ ID NO: 745602 - DNA, 25 bp, Mus musculus
taaagacacccaccagccagagtta

SEQ ID NO: 745603 - DNA, 25 bp, Mus musculus
taaagacacccagcagccagagtta

SEQ ID NO: 745604 - DNA, 25 bp, Mus musculus
taaagacaccggcattttcaggctc

SEQ ID NO: 745605 - DNA, 25 bp, Mus musculus
taaagacaccgggattttcaggctc

SEQ ID NO: 745606 - DNA, 25 bp, Mus musculus
taaagacacggcctttggttcctgg

SEQ ID NO: 745607 - DNA, 25 bp, Mus musculus
taaagacacggcgtttggttcctgg

SEQ ID NO: 745608 - DNA, 25 bp, Mus musculus
taaagacactacagtttattaagga

SEQ ID NO: 745609 - DNA, 25 bp, Mus musculus
taaagacactactgtttattaagga

SEQ ID NO: 745610 - DNA, 25 bp, Mus musculus
taaagacactcacgcaccccgagga

SEQ ID NO: 745611 - DNA, 25 bp, Mus musculus
taaagacactcaggcaccccgagga

SEQ ID NO: 745612 - DNA, 25 bp, Mus musculus
taaagacactgcatctgtcccaagt

SEQ ID NO: 745613 - DNA, 25 bp, Mus musculus
taaagacactgcttctgtcccaagt

SEQ ID NO: 745614 - DNA, 25 bp, Mus musculus
taaagacagagacttgtgttcccaa

SEQ ID NO: 745615 - DNA, 25 bp, Mus musculus
taaagacagagagttgtgttcccaa

SEQ ID NO: 745616 - DNA, 25 bp, Mus musculus
taaagacatcacaagccaagctgct

SEQ ID NO: 745617 - DNA, 25 bp, Mus musculus
taaagacatcactagccaagctgct

SEQ ID NO: 745618 - DNA, 25 bp, Mus musculus
taaagacatccgagtgtcctgctgc

SEQ ID NO: 745619 - DNA, 25 bp, Mus musculus
taaagacatccgtgtgtcctgctgc

SEQ ID NO: 745620 - DNA, 25 bp, Mus musculus
taaagaccactgagaagcgaaaagt

SEQ ID NO: 745621 - DNA, 25 bp, Mus musculus
taaagaccactgtgaagcgaaaagt

SEQ ID NO: 745622 - DNA, 25 bp, Mus musculus
taaagaccaggtcgctgaggagaaa

SEQ ID NO: 745623 - DNA, 25 bp, Mus musculus
taaagaccaggtggctgaggagaaa

SEQ ID NO: 745624 - DNA, 25 bp, Mus musculus
taaagaccagtcacagggacccgca

SEQ ID NO: 745625 - DNA, 25 bp, Mus musculus
taaagaccagtctcagggacccgca

SEQ ID NO: 745626 - DNA, 25 bp, Mus musculus
taaagaccatcaactgtacccctac

SEQ ID NO: 745627 - DNA, 25 bp, Mus musculus
taaagaccatcatctgtacccctac

SEQ ID NO: 745628 - DNA, 25 bp, Mus musculus
taaagacccacgattcgcatggttc

SEQ ID NO: 745629 - DNA, 25 bp, Mus musculus
taaagacccacgtttcgcatggttc

SEQ ID NO: 745630 - DNA, 25 bp, Mus musculus
taaagacccagccacttcacttttc

SEQ ID NO: 745631 - DNA, 25 bp, Mus musculus
taaagacccagcgacttcacttttc

SEQ ID NO: 745632 - DNA, 25 bp, Mus musculus
taaagacccctcaaggaggcagctt

SEQ ID NO: 745633 - DNA, 25 bp, Mus musculus
taaagacccctctaggaggcagctt

SEQ ID NO: 745634 - DNA, 25 bp, Mus musculus
taaagacccgtcagtgcctttcttt

SEQ ID NO: 745635 - DNA, 25 bp, Mus musculus
taaagacccgtctgtgcctttcttt

SEQ ID NO: 745636 - DNA, 25 bp, Mus musculus
taaagaccctcccaaggttagcagt

SEQ ID NO: 745637 - DNA, 25 bp, Mus musculus
taaagaccctccgaaggttagcagt

SEQ ID NO: 745638 - DNA, 25 bp, Mus musculus
taaagaccgcatcccaagtattctg

SEQ ID NO: 745639 - DNA, 25 bp, Mus musculus
taaagaccgcatgccaagtattctg

SEQ ID NO: 745640 - DNA, 25 bp, Mus musculus
taaagaccgtcactttctagcttgc

SEQ ID NO: 745641 - DNA, 25 bp, Mus musculus
taaagaccgtcagtttctagcttgc

SEQ ID NO: 745642 - DNA, 25 bp, Mus musculus
taaagacctctgcactctacgggaa

SEQ ID NO: 745643 - DNA, 25 bp, Mus musculus
taaagacctctggactctacgggaa

SEQ ID NO: 745644 - DNA, 25 bp, Mus musculus
taaagacctgctacttgactaccca

SEQ ID NO: 745645 - DNA, 25 bp, Mus musculus
taaagacctgcttcttgactaccca

SEQ ID NO: 745646 - DNA, 25 bp, Mus musculus
taaagacctttgagctgtatgaaac

SEQ ID NO: 745647 - DNA, 25 bp, Mus musculus
taaagacctttgtgctgtatgaaac

SEQ ID NO: 745648 - DNA, 25 bp, Mus musculus
taaagaccttttacaagttatctat

SEQ ID NO: 745649 - DNA, 25 bp, Mus musculus
taaagacctttttcaagttatctat

SEQ ID NO: 745650 - DNA, 25 bp, Mus musculus
taaagacgacacagcgagttagcaa

SEQ ID NO: 745651 - DNA, 25 bp, Mus musculus
taaagacgacactgcgagttagcaa

SEQ ID NO: 745652 - DNA, 25 bp, Mus musculus
taaagacgattgcagtgggccataa

SEQ ID NO: 745653 - DNA, 25 bp, Mus musculus
taaagacgattggagtgggccataa

SEQ ID NO: 745654 - DNA, 25 bp, Mus musculus
taaagacgctggctgttgctctgga

SEQ ID NO: 745655 - DNA, 25 bp, Mus musculus
taaagacgctgggtgttgctctgga

SEQ ID NO: 745656 - DNA, 25 bp, Mus musculus
taaagacggcacaccagcttacagg

SEQ ID NO: 745657 - DNA, 25 bp, Mus musculus
taaagacggcactccagcttacagg

SEQ ID NO: 745658 - DNA, 25 bp, Mus musculus
taaagacgtaaacttactcaagttg

SEQ ID NO: 745659 - DNA, 25 bp, Mus musculus
taaagacgtaaagttactcaagttg

SEQ ID NO: 745660 - DNA, 25 bp, Mus musculus
taaagacgtgctcgcgtgctgtacc

SEQ ID NO: 745661 - DNA, 25 bp, Mus musculus
taaagacgtgctggcgtgctgtacc

SEQ ID NO: 745662 - DNA, 25 bp, Mus musculus
taaagacgttggctttggatttatt

SEQ ID NO: 745663 - DNA, 25 bp, Mus musculus
taaagacgttgggtttggatttatt

SEQ ID NO: 745664 - DNA, 25 bp, Mus musculus
taaagactactgacattccccgagc

SEQ ID NO: 745665 - DNA, 25 bp, Mus musculus
taaagactactgacctcccggctag

SEQ ID NO: 745666 - DNA, 25 bp, Mus musculus
taaagactactgtcattccccgagc

SEQ ID NO: 745667 - DNA, 25 bp, Mus musculus
taaagactactgtcctcccggctag

SEQ ID NO: 745668 - DNA, 25 bp, Mus musculus
taaagactagaacggcacaactttt

SEQ ID NO: 745669 - DNA, 25 bp, Mus musculus
taaagactagaagggcacaactttt

SEQ ID NO: 745670 - DNA, 25 bp, Mus musculus
taaagactcaatcacctcgctgttg

SEQ ID NO: 745671 - DNA, 25 bp, Mus musculus
taaagactcaatgacctcgctgttg

SEQ ID NO: 745672 - DNA, 25 bp, Mus musculus
taaagactcggaagcctgggtgcct

SEQ ID NO: 745673 - DNA, 25 bp, Mus musculus
taaagactcggatgcctgggtgcct

SEQ ID NO: 745674 - DNA, 25 bp, Mus musculus
taaagactctgcctttgcgaagcca

SEQ ID NO: 745675 - DNA, 25 bp, Mus musculus
taaagactctgcgtttgcgaagcca

SEQ ID NO: 745676 - DNA, 25 bp, Mus musculus
taaagactgaccagcctgtaggctt

SEQ ID NO: 745677 - DNA, 25 bp, Mus musculus
taaagactgacctgcctgtaggctt

SEQ ID NO: 745678 - DNA, 25 bp, Mus musculus
taaagactgtggcaacacacaccct

SEQ ID NO: 745679 - DNA, 25 bp, Mus musculus
taaagactgtgggaacacacaccct

SEQ ID NO: 745680 - DNA, 25 bp, Mus musculus
taaagacttaaccaaacctcagctt

SEQ ID NO: 745681 - DNA, 25 bp, Mus musculus
taaagacttaacgaaacctcagctt

SEQ ID NO: 745682 - DNA, 25 bp, Mus musculus
taaagacttaccataggatctctgg

SEQ ID NO: 745683 - DNA, 25 bp, Mus musculus
taaagacttaccttaggatctctgg

SEQ ID NO: 745684 - DNA, 25 bp, Mus musculus
taaagacttcctagtattcacccca

SEQ ID NO: 745685 - DNA, 25 bp, Mus musculus
taaagacttcctcagggctgtttct

SEQ ID NO: 745686 - DNA, 25 bp, Mus musculus
taaagacttcctgagggctgtttct

SEQ ID NO: 745687 - DNA, 25 bp, Mus musculus
taaagacttccttgtattcacccca

SEQ ID NO: 745688 - DNA, 25 bp, Mus musculus
taaagacttgagatccacaaaggaa

SEQ ID NO: 745689 - DNA, 25 bp, Mus musculus
taaagacttgagttccacaaaggaa

SEQ ID NO: 745690 - DNA, 25 bp, Mus musculus
taaagacttggtcgcagcttctgag

SEQ ID NO: 745691 - DNA, 25 bp, Mus musculus
taaagacttggtggcagcttctgag

SEQ ID NO: 745692 - DNA, 25 bp, Mus musculus
taaagacttgtgcatgccccttcag

SEQ ID NO: 745693 - DNA, 25 bp, Mus musculus
taaagacttgtggatgccccttcag

SEQ ID NO: 745694 - DNA, 25 bp, Mus musculus
taaagagacagcatggccgcaacca

SEQ ID NO: 745695 - DNA, 25 bp, Mus musculus
taaagagacagcttggccgcaacca

SEQ ID NO: 745696 - DNA, 25 bp, Mus musculus
taaagagagagcaggttgtttattt

SEQ ID NO: 745697 - DNA, 25 bp, Mus musculus
taaagagagagctggttgtttattt

SEQ ID NO: 745698 - DNA, 25 bp, Mus musculus
taaagagagcacatccaccttttgg

SEQ ID NO: 745699 - DNA, 25 bp, Mus musculus
taaagagagcacctgttctcctgga

SEQ ID NO: 745700 - DNA, 25 bp, Mus musculus
taaagagagcacgtgttctcctgga

SEQ ID NO: 745701 - DNA, 25 bp, Mus musculus
taaagagagcacttccaccttttgg

SEQ ID NO: 745702 - DNA, 25 bp, Mus musculus
taaagagatcttacccagagacaag

SEQ ID NO: 745703 - DNA, 25 bp, Mus musculus
taaagagatctttcccagagacaag

SEQ ID NO: 745704 - DNA, 25 bp, Mus musculus
taaagagcaatgatcctgacagtct

SEQ ID NO: 745705 - DNA, 25 bp, Mus musculus
taaagagcaatgttcctgacagtct

SEQ ID NO: 745706 - DNA, 25 bp, Mus musculus
taaagagcacatcgcctgacagggt

SEQ ID NO: 745707 - DNA, 25 bp, Mus musculus
taaagagcacatggcctgacagggt

SEQ ID NO: 745708 - DNA, 25 bp, Mus musculus
taaagagcactgatgaccctctggg

SEQ ID NO: 745709 - DNA, 25 bp, Mus musculus
taaagagcactgttgaccctctggg

SEQ ID NO: 745710 - DNA, 25 bp, Mus musculus
taaagagcagaaccagtgggctgaa

SEQ ID NO: 745711 - DNA, 25 bp, Mus musculus
taaagagcagaagcagtgggctgaa

SEQ ID NO: 745712 - DNA, 25 bp, Mus musculus
taaagagcccatcctttgcaagtca

SEQ ID NO: 745713 - DNA, 25 bp, Mus musculus
taaagagcccatgctttgcaagtca

SEQ ID NO: 745714 - DNA, 25 bp, Mus musculus
taaagagcccgcagatgatccaaat

SEQ ID NO: 745715 - DNA, 25 bp, Mus musculus
taaagagcccgctgatgatccaaat

SEQ ID NO: 745716 - DNA, 25 bp, Mus musculus
taaagagccctcaggttcattgcct

SEQ ID NO: 745717 - DNA, 25 bp, Mus musculus
taaagagccctctggttcattgcct

SEQ ID NO: 745718 - DNA, 25 bp, Mus musculus
taaagagccgatcccagcccaggtg

SEQ ID NO: 745719 - DNA, 25 bp, Mus musculus
taaagagccgatgccagcccaggtg

SEQ ID NO: 745720 - DNA, 25 bp, Mus musculus
taaagagcgacaccctgtctgaagc

SEQ ID NO: 745721 - DNA, 25 bp, Mus musculus
taaagagcgacagcctgtctgaagc

SEQ ID NO: 745722 - DNA, 25 bp, Mus musculus
taaagagcggatacagtcccttctt

SEQ ID NO: 745723 - DNA, 25 bp, Mus musculus
taaagagcggattcagtcccttctt

SEQ ID NO: 745724 - DNA, 25 bp, Mus musculus
taaagagcgtcgctttccctaaagc

SEQ ID NO: 745725 - DNA, 25 bp, Mus musculus
taaagagcgtcggtttccctaaagc

SEQ ID NO: 745726 - DNA, 25 bp, Mus musculus
taaagaggacctcgcttccatccag

SEQ ID NO: 745727 - DNA, 25 bp, Mus musculus
taaagaggacctggcttccatccag

SEQ ID NO: 745728 - DNA, 25 bp, Mus musculus
taaagaggcacaacagacccgggac

SEQ ID NO: 745729 - DNA, 25 bp, Mus musculus
taaagaggcacatcagacccgggac

SEQ ID NO: 745730 - DNA, 25 bp, Mus musculus
taaagaggccatcttggttcaccca

SEQ ID NO: 745731 - DNA, 25 bp, Mus musculus
taaagaggccatgttggttcaccca

SEQ ID NO: 745732 - DNA, 25 bp, Mus musculus
taaagaggctgccttgtcctactac

SEQ ID NO: 745733 - DNA, 25 bp, Mus musculus
taaagaggctgcgttgtcctactac

SEQ ID NO: 745734 - DNA, 25 bp, Mus musculus
taaagaggcttgatgcccagagtgt

SEQ ID NO: 745735 - DNA, 25 bp, Mus musculus
taaagaggcttgttgcccagagtgt

SEQ ID NO: 745736 - DNA, 25 bp, Mus musculus
taaagagtaattccttgcccacctc

SEQ ID NO: 745737 - DNA, 25 bp, Mus musculus
taaagagtaattgcttgcccacctc

SEQ ID NO: 745738 - DNA, 25 bp, Mus musculus
taaagagtacagctccgacttccag

SEQ ID NO: 745739 - DNA, 25 bp, Mus musculus
taaagagtacaggtccgacttccag

SEQ ID NO: 745740 - DNA, 25 bp, Mus musculus
taaagagtcacgctcggctttgtgt

SEQ ID NO: 745741 - DNA, 25 bp, Mus musculus
taaagagtcacggtcggctttgtgt

SEQ ID NO: 745742 - DNA, 25 bp, Mus musculus
taaagagtccttacacactttccag

SEQ ID NO: 745743 - DNA, 25 bp, Mus musculus
taaagagtcctttcacactttccag

SEQ ID NO: 745744 - DNA, 25 bp, Mus musculus
taaagagtctggaggctactcaacc

SEQ ID NO: 745745 - DNA, 25 bp, Mus musculus
taaagagtctggtggctactcaacc

SEQ ID NO: 745746 - DNA, 25 bp, Mus musculus
taaagagtgaccatccggccgtggc

SEQ ID NO: 745747 - DNA, 25 bp, Mus musculus
taaagagtgaccttccggccgtggc

SEQ ID NO: 745748 - DNA, 25 bp, Mus musculus
taaagagtgctccaggccatagcta

SEQ ID NO: 745749 - DNA, 25 bp, Mus musculus
taaagagtgctcgaggccatagcta

SEQ ID NO: 745750 - DNA, 25 bp, Mus musculus
taaagagtggcacgaccattgcttt

SEQ ID NO: 745751 - DNA, 25 bp, Mus musculus
taaagagtggcaggaccattgcttt

SEQ ID NO: 745752 - DNA, 25 bp, Mus musculus
taaagagtgttaaagtctggtccat

SEQ ID NO: 745753 - DNA, 25 bp, Mus musculus
taaagagtgttatagtctggtccat

SEQ ID NO: 745754 - DNA, 25 bp, Mus musculus
taaagagtgtttagaggcccagtgg

SEQ ID NO: 745755 - DNA, 25 bp, Mus musculus
taaagagtgttttgaggcccagtgg

SEQ ID NO: 745756 - DNA, 25 bp, Mus musculus
taaagagttacacaactagcccatg

SEQ ID NO: 745757 - DNA, 25 bp, Mus musculus
taaagagttacagaactagcccatg

SEQ ID NO: 745758 - DNA, 25 bp, Mus musculus
taaagagttccgacacttccctttg

SEQ ID NO: 745759 - DNA, 25 bp, Mus musculus
taaagagttccgtcacttccctttg

SEQ ID NO: 745760 - DNA, 25 bp, Mus musculus
taaagagttgatcttccccagtgag

SEQ ID NO: 745761 - DNA, 25 bp, Mus musculus
taaagagttgatgttccccagtgag

SEQ ID NO: 745762 - DNA, 25 bp, Mus musculus
taaagagttgccaaagtggtgtcca

SEQ ID NO: 745763 - DNA, 25 bp, Mus musculus
taaagagttgcctaagtggtgtcca

SEQ ID NO: 745764 - DNA, 25 bp, Mus musculus
taaagagtttgcacatgccgccatc

SEQ ID NO: 745765 - DNA, 25 bp, Mus musculus
taaagagtttgctcatgccgccatc

SEQ ID NO: 745766 - DNA, 25 bp, Mus musculus
taaagataactcaaagctgggcagt

SEQ ID NO: 745767 - DNA, 25 bp, Mus musculus
taaagataactctaagctgggcagt

SEQ ID NO: 745768 - DNA, 25 bp, Mus musculus
taaagatacgctagtcaccactctg

SEQ ID NO: 745769 - DNA, 25 bp, Mus musculus
taaagatacgcttgtcaccactctg

SEQ ID NO: 745770 - DNA, 25 bp, Mus musculus
taaagatatcccatctccttgacca

SEQ ID NO: 745771 - DNA, 25 bp, Mus musculus
taaagatatcccttctccttgacca

SEQ ID NO: 745772 - DNA, 25 bp, Mus musculus
taaagatatgatattccactaataa

SEQ ID NO: 745773 - DNA, 25 bp, Mus musculus
taaagatatgattttccactaataa

SEQ ID NO: 745774 - DNA, 25 bp, Mus musculus
taaagatcagacctcctcatggaaa

SEQ ID NO: 745775 - DNA, 25 bp, Mus musculus
taaagatcagacgtcctcatggaaa

SEQ ID NO: 745776 - DNA, 25 bp, Mus musculus
taaagatcagatcctgtgcggaaag

SEQ ID NO: 745777 - DNA, 25 bp, Mus musculus
taaagatcagatgctgtgcggaaag

SEQ ID NO: 745778 - DNA, 25 bp, Mus musculus
taaagatcccacatctaccatggca

SEQ ID NO: 745779 - DNA, 25 bp, Mus musculus
taaagatcccacttctaccatggca

SEQ ID NO: 745780 - DNA, 25 bp, Mus musculus
taaagatccctaaacctgacaatat

SEQ ID NO: 745781 - DNA, 25 bp, Mus musculus
taaagatccctatacctgacaatat

SEQ ID NO: 745782 - DNA, 25 bp, Mus musculus
taaagatccggccattgttcaataa

SEQ ID NO: 745783 - DNA, 25 bp, Mus musculus
taaagatccggcgattgttcaataa

SEQ ID NO: 745784 - DNA, 25 bp, Mus musculus
taaagatcctgcctttgtgcctaga

SEQ ID NO: 745785 - DNA, 25 bp, Mus musculus
taaagatcctgcgtttgtgcctaga

SEQ ID NO: 745786 - DNA, 25 bp, Mus musculus
taaagatctaccaagctaggccagc

SEQ ID NO: 745787 - DNA, 25 bp, Mus musculus
taaagatctacctagctaggccagc

SEQ ID NO: 745788 - DNA, 25 bp, Mus musculus
taaagatcttccctgactctgagca

SEQ ID NO: 745789 - DNA, 25 bp, Mus musculus
taaagatcttccgtgactctgagca

SEQ ID NO: 745790 - DNA, 25 bp, Mus musculus
taaagatcttgtacattcatagaaa

SEQ ID NO: 745791 - DNA, 25 bp, Mus musculus
taaagatcttgtattctcctctttt

SEQ ID NO: 745792 - DNA, 25 bp, Mus musculus
taaagatcttgttcattcatagaaa

SEQ ID NO: 745793 - DNA, 25 bp, Mus musculus
taaagatcttgttttctcctctttt

SEQ ID NO: 745794 - DNA, 25 bp, Mus musculus
taaagatgcagcactacgttgaaga

SEQ ID NO: 745795 - DNA, 25 bp, Mus musculus
taaagatgcagctctacgttgaaga

SEQ ID NO: 745796 - DNA, 25 bp, Mus musculus
taaagatgccatatctgtcgcctcc

SEQ ID NO: 745797 - DNA, 25 bp, Mus musculus
taaagatgccatttctgtcgcctcc

SEQ ID NO: 745798 - DNA, 25 bp, Mus musculus
taaagatgccgcctgtgtcgtgcag

SEQ ID NO: 745799 - DNA, 25 bp, Mus musculus
taaagatgccgcgtgtgtcgtgcag

SEQ ID NO: 745800 - DNA, 25 bp, Mus musculus
taaagatgctgaacttccaagatgg

SEQ ID NO: 745801 - DNA, 25 bp, Mus musculus
taaagatgctgatcttccaagatgg

SEQ ID NO: 745802 - DNA, 25 bp, Mus musculus
taaagatggagcaggattgccgagc

SEQ ID NO: 745803 - DNA, 25 bp, Mus musculus
taaagatggagctggattgccgagc

SEQ ID NO: 745804 - DNA, 25 bp, Mus musculus
taaagatggctaaatttccaatgga

SEQ ID NO: 745805 - DNA, 25 bp, Mus musculus
taaagatggctatatttccaatgga

SEQ ID NO: 745806 - DNA, 25 bp, Mus musculus
taaagatggctgctccctgtggtat

SEQ ID NO: 745807 - DNA, 25 bp, Mus musculus
taaagatggctggtccctgtggtat

SEQ ID NO: 745808 - DNA, 25 bp, Mus musculus
taaagatgggctcacactacggctc

SEQ ID NO: 745809 - DNA, 25 bp, Mus musculus
taaagatgggctgacactacggctc

SEQ ID NO: 745810 - DNA, 25 bp, Mus musculus
taaagatggtacaggccagaagccg

SEQ ID NO: 745811 - DNA, 25 bp, Mus musculus
taaagatggtactggccagaagccg

SEQ ID NO: 745812 - DNA, 25 bp, Mus musculus
taaagatggtttactttgcccaaag

SEQ ID NO: 745813 - DNA, 25 bp, Mus musculus
taaagatggttttctttgcccaaag

SEQ ID NO: 745814 - DNA, 25 bp, Mus musculus
taaagatgtccaatgttccttgttg

SEQ ID NO: 745815 - DNA, 25 bp, Mus musculus
taaagatgtccattgttccttgttg

SEQ ID NO: 745816 - DNA, 25 bp, Mus musculus
taaagatgtctcacctctaccctaa

SEQ ID NO: 745817 - DNA, 25 bp, Mus musculus
taaagatgtctctcctctaccctaa

SEQ ID NO: 745818 - DNA, 25 bp, Mus musculus
taaagattatggcagcaaagctgtt

SEQ ID NO: 745819 - DNA, 25 bp, Mus musculus
taaagattatgggagcaaagctgtt

SEQ ID NO: 745820 - DNA, 25 bp, Mus musculus
taaagattccttacctaggtgcaga

SEQ ID NO: 745821 - DNA, 25 bp, Mus musculus
taaagattcctttcctaggtgcaga

SEQ ID NO: 745822 - DNA, 25 bp, Mus musculus
taaagattctatcgtatcccccatg

SEQ ID NO: 745823 - DNA, 25 bp, Mus musculus
taaagattctatggtatcccccatg

SEQ ID NO: 745824 - DNA, 25 bp, Mus musculus
taaagattgcagaaaagcttttttc

SEQ ID NO: 745825 - DNA, 25 bp, Mus musculus
taaagattgcagtaaagcttttttc

SEQ ID NO: 745826 - DNA, 25 bp, Mus musculus
taaagattgtgcacatctccgttgc

SEQ ID NO: 745827 - DNA, 25 bp, Mus musculus
taaagattgtgctcatctccgttgc

SEQ ID NO: 745828 - DNA, 25 bp, Mus musculus
taaagatttcaaagtagccctacct

SEQ ID NO: 745829 - DNA, 25 bp, Mus musculus
taaagatttcaatgtagccctacct

SEQ ID NO: 745830 - DNA, 25 bp, Mus musculus
taaagatttcatactgccaacccgc

SEQ ID NO: 745831 - DNA, 25 bp, Mus musculus
taaagatttcattctgccaacccgc

SEQ ID NO: 745832 - DNA, 25 bp, Mus musculus
taaagatttcttatgcgggatacat

SEQ ID NO: 745833 - DNA, 25 bp, Mus musculus
taaagatttcttttgcgggatacat

SEQ ID NO: 745834 - DNA, 25 bp, Mus musculus
taaagatttggaacctttcctggtg

SEQ ID NO: 745835 - DNA, 25 bp, Mus musculus
taaagatttggatcctttcctggtg

SEQ ID NO: 745836 - DNA, 25 bp, Mus musculus
taaagcaaacctctgccttttctct

SEQ ID NO: 745837 - DNA, 25 bp, Mus musculus
taaagcaaacctgtgccttttctct

SEQ ID NO: 745838 - DNA, 25 bp, Mus musculus
taaagcaaagcaaactgagtcgtgt

SEQ ID NO: 745839 - DNA, 25 bp, Mus musculus
taaagcaaagcatactgagtcgtgt

SEQ ID NO: 745840 - DNA, 25 bp, Mus musculus
taaagcaaccacaccagtgtcccag

SEQ ID NO: 745841 - DNA, 25 bp, Mus musculus
taaagcaaccactccagtgtcccag

SEQ ID NO: 745842 - DNA, 25 bp, Mus musculus
taaagcaaccagacactgccttctg

SEQ ID NO: 745843 - DNA, 25 bp, Mus musculus
taaagcaaccagtcactgccttctg

SEQ ID NO: 745844 - DNA, 25 bp, Mus musculus
taaagcaagccaagtctcagtcact

SEQ ID NO: 745845 - DNA, 25 bp, Mus musculus
taaagcaagccatgtctcagtcact

SEQ ID NO: 745846 - DNA, 25 bp, Mus musculus
taaagcaagcccctaaatgccacgt

SEQ ID NO: 745847 - DNA, 25 bp, Mus musculus
taaagcaagcccgtaaatgccacgt

SEQ ID NO: 745848 - DNA, 25 bp, Mus musculus
taaagcaagccgctcaagggtctgg

SEQ ID NO: 745849 - DNA, 25 bp, Mus musculus
taaagcaagccgctggtctctaaac

SEQ ID NO: 745850 - DNA, 25 bp, Mus musculus
taaagcaagccggtcaagggtctgg

SEQ ID NO: 745851 - DNA, 25 bp, Mus musculus
taaagcaagccggtggtctctaaac

SEQ ID NO: 745852 - DNA, 25 bp, Mus musculus
taaagcaaggaccacaccacgttgt

SEQ ID NO: 745853 - DNA, 25 bp, Mus musculus
taaagcaaggacgacaccacgttgt

SEQ ID NO: 745854 - DNA, 25 bp, Mus musculus
taaagcaagtccacgttggccccga

SEQ ID NO: 745855 - DNA, 25 bp, Mus musculus
taaagcaagtcctcgttggccccga

SEQ ID NO: 745856 - DNA, 25 bp, Mus musculus
taaagcaatcgaagcctcgcagcgt

SEQ ID NO: 745857 - DNA, 25 bp, Mus musculus
taaagcaatcgatgcctcgcagcgt

SEQ ID NO: 745858 - DNA, 25 bp, Mus musculus
taaagcacaagacctgtccctcatg

SEQ ID NO: 745859 - DNA, 25 bp, Mus musculus
taaagcacaagagctgtccctcatg

SEQ ID NO: 745860 - DNA, 25 bp, Mus musculus
taaagcacaccactgatcatgtcta

SEQ ID NO: 745861 - DNA, 25 bp, Mus musculus
taaagcacaccagtgatcatgtcta

SEQ ID NO: 745862 - DNA, 25 bp, Mus musculus
taaagcacagcgaggctagccctac

SEQ ID NO: 745863 - DNA, 25 bp, Mus musculus
taaagcacagcgtggctagccctac

SEQ ID NO: 745864 - DNA, 25 bp, Mus musculus
taaagcacagttagacccaggacct

SEQ ID NO: 745865 - DNA, 25 bp, Mus musculus
taaagcacagtttgacccaggacct

SEQ ID NO: 745866 - DNA, 25 bp, Mus musculus
taaagcacatctcgtccatagccca

SEQ ID NO: 745867 - DNA, 25 bp, Mus musculus
taaagcacatctggtccatagccca

SEQ ID NO: 745868 - DNA, 25 bp, Mus musculus
taaagcaccaaaacatccacaccgg

SEQ ID NO: 745869 - DNA, 25 bp, Mus musculus
taaagcaccaaatcatccacaccgg

SEQ ID NO: 745870 - DNA, 25 bp, Mus musculus
taaagcaccagccagttctgcctgg

SEQ ID NO: 745871 - DNA, 25 bp, Mus musculus
taaagcaccagcgagttctgcctgg

SEQ ID NO: 745872 - DNA, 25 bp, Mus musculus
taaagcacccagattcgtctcccag

SEQ ID NO: 745873 - DNA, 25 bp, Mus musculus
taaagcacccagtttcgtctcccag

SEQ ID NO: 745874 - DNA, 25 bp, Mus musculus
taaagcacccatccttttccttgag

SEQ ID NO: 745875 - DNA, 25 bp, Mus musculus
taaagcacccatgcttttccttgag

SEQ ID NO: 745876 - DNA, 25 bp, Mus musculus
taaagcacctgcattacttgccagt

SEQ ID NO: 745877 - DNA, 25 bp, Mus musculus
taaagcacctgctttacttgccagt

SEQ ID NO: 745878 - DNA, 25 bp, Mus musculus
taaagcactcttagcctttgtgtct

SEQ ID NO: 745879 - DNA, 25 bp, Mus musculus
taaagcactctttgcctttgtgtct

SEQ ID NO: 745880 - DNA, 25 bp, Mus musculus
taaagcacttccattctcgttgact

SEQ ID NO: 745881 - DNA, 25 bp, Mus musculus
taaagcacttcctttctcgttgact

SEQ ID NO: 745882 - DNA, 25 bp, Mus musculus
taaagcagacttacctcagcatggg

SEQ ID NO: 745883 - DNA, 25 bp, Mus musculus
taaagcagactttcctcagcatggg

SEQ ID NO: 745884 - DNA, 25 bp, Mus musculus
taaagcagaggcatcagtagctttc

SEQ ID NO: 745885 - DNA, 25 bp, Mus musculus
taaagcagaggcttcagtagctttc

SEQ ID NO: 745886 - DNA, 25 bp, Mus musculus
taaagcagatatcattgtaagaact

SEQ ID NO: 745887 - DNA, 25 bp, Mus musculus
taaagcagatatgattgtaagaact

SEQ ID NO: 745888 - DNA, 25 bp, Mus musculus
taaagcagcaatacctactcaagaa

SEQ ID NO: 745889 - DNA, 25 bp, Mus musculus
taaagcagcaattcctactcaagaa

SEQ ID NO: 745890 - DNA, 25 bp, Mus musculus
taaagcagcctccaccatccacaga

SEQ ID NO: 745891 - DNA, 25 bp, Mus musculus
taaagcagcctcgaccatccacaga

SEQ ID NO: 745892 - DNA, 25 bp, Mus musculus
taaagcaggcttagcattctcaccg

SEQ ID NO: 745893 - DNA, 25 bp, Mus musculus
taaagcaggctttgcattctcaccg

SEQ ID NO: 745894 - DNA, 25 bp, Mus musculus
taaagcagtattcctgactcctgtc

SEQ ID NO: 745895 - DNA, 25 bp, Mus musculus
taaagcagtattgctgactcctgtc

SEQ ID NO: 745896 - DNA, 25 bp, Mus musculus
taaagcagtcccacgggagtcacgg

SEQ ID NO: 745897 - DNA, 25 bp, Mus musculus
taaagcagtccctcgggagtcacgg

SEQ ID NO: 745898 - DNA, 25 bp, Mus musculus
taaagcagtgctctcagactgaaat

SEQ ID NO: 745899 - DNA, 25 bp, Mus musculus
taaagcagtgctgtcagactgaaat

SEQ ID NO: 745900 - DNA, 25 bp, Mus musculus
taaagcagtttgacctactccttgt

SEQ ID NO: 745901 - DNA, 25 bp, Mus musculus
taaagcagtttgtcctactccttgt

SEQ ID NO: 745902 - DNA, 25 bp, Mus musculus
taaagcatagccattcctttcttat

SEQ ID NO: 745903 - DNA, 25 bp, Mus musculus
taaagcatagcctttcctttcttat

SEQ ID NO: 745904 - DNA, 25 bp, Mus musculus
taaagcataggtatcctcacttgga

SEQ ID NO: 745905 - DNA, 25 bp, Mus musculus
taaagcataggtttcctcacttgga

SEQ ID NO: 745906 - DNA, 25 bp, Mus musculus
taaagcatagtcaacaaggagtggt

SEQ ID NO: 745907 - DNA, 25 bp, Mus musculus
taaagcatagtctacaaggagtggt

SEQ ID NO: 745908 - DNA, 25 bp, Mus musculus
taaagcatattccatgtgatcatga

SEQ ID NO: 745909 - DNA, 25 bp, Mus musculus
taaagcatattcgatgtgatcatga

SEQ ID NO: 745910 - DNA, 25 bp, Mus musculus
taaagcatcaaactacaaccctggt

SEQ ID NO: 745911 - DNA, 25 bp, Mus musculus
taaagcatcaaagtacaaccctggt

SEQ ID NO: 745912 - DNA, 25 bp, Mus musculus
taaagcatcagacaccacagccaga

SEQ ID NO: 745913 - DNA, 25 bp, Mus musculus
taaagcatcagagaccacagccaga

SEQ ID NO: 745914 - DNA, 25 bp, Mus musculus
taaagcatccatctccctgtggaga

SEQ ID NO: 745915 - DNA, 25 bp, Mus musculus
taaagcatccatgtccctgtggaga

SEQ ID NO: 745916 - DNA, 25 bp, Mus musculus
taaagcatcgttataacattttctg

SEQ ID NO: 745917 - DNA, 25 bp, Mus musculus
taaagcatcgttttaacattttctg

SEQ ID NO: 745918 - DNA, 25 bp, Mus musculus
taaagcatctcaaaccatccttgcc

SEQ ID NO: 745919 - DNA, 25 bp, Mus musculus
taaagcatctcactagtgcccagag

SEQ ID NO: 745920 - DNA, 25 bp, Mus musculus
taaagcatctcactgccagcttatg

SEQ ID NO: 745921 - DNA, 25 bp, Mus musculus
taaagcatctcagtagtgcccagag

SEQ ID NO: 745922 - DNA, 25 bp, Mus musculus
taaagcatctcagtgccagcttatg

SEQ ID NO: 745923 - DNA, 25 bp, Mus musculus
taaagcatctcataccatccttgcc

SEQ ID NO: 745924 - DNA, 25 bp, Mus musculus
taaagcatctgccagcacactagaa

SEQ ID NO: 745925 - DNA, 25 bp, Mus musculus
taaagcatctgcgagcacactagaa

SEQ ID NO: 745926 - DNA, 25 bp, Mus musculus
taaagcatcttactgtagaaggtca

SEQ ID NO: 745927 - DNA, 25 bp, Mus musculus
taaagcatcttagtgtagaaggtca

SEQ ID NO: 745928 - DNA, 25 bp, Mus musculus
taaagcatgcatcgctcttccacaa

SEQ ID NO: 745929 - DNA, 25 bp, Mus musculus
taaagcatgcatggctcttccacaa

SEQ ID NO: 745930 - DNA, 25 bp, Mus musculus
taaagcatgctcactttccctgttg

SEQ ID NO: 745931 - DNA, 25 bp, Mus musculus
taaagcatgctctctttccctgttg

SEQ ID NO: 745932 - DNA, 25 bp, Mus musculus
taaagcatgtcccagttttcatcca

SEQ ID NO: 745933 - DNA, 25 bp, Mus musculus
taaagcatgtccgagttttcatcca

SEQ ID NO: 745934 - DNA, 25 bp, Mus musculus
taaagcattcatcgagtcggtcatt

SEQ ID NO: 745935 - DNA, 25 bp, Mus musculus
taaagcattcatggagtcggtcatt

SEQ ID NO: 745936 - DNA, 25 bp, Mus musculus
taaagcattctacacacgacatacc

SEQ ID NO: 745937 - DNA, 25 bp, Mus musculus
taaagcattctagacacgacatacc

SEQ ID NO: 745938 - DNA, 25 bp, Mus musculus
taaagcattctgactccgagaggac

SEQ ID NO: 745939 - DNA, 25 bp, Mus musculus
taaagcattctgtctccgagaggac

SEQ ID NO: 745940 - DNA, 25 bp, Mus musculus
taaagcattgtcagactttgagaga

SEQ ID NO: 745941 - DNA, 25 bp, Mus musculus
taaagcattgtctgactttgagaga

SEQ ID NO: 745942 - DNA, 25 bp, Mus musculus
taaagcatttgcacatcaaacgagt

SEQ ID NO: 745943 - DNA, 25 bp, Mus musculus
taaagcatttgctcatcaaacgagt

SEQ ID NO: 745944 - DNA, 25 bp, Mus musculus
taaagccaaactacgtggtgagaat

SEQ ID NO: 745945 - DNA, 25 bp, Mus musculus
taaagccaaacttcgtggtgagaat

SEQ ID NO: 745946 - DNA, 25 bp, Mus musculus
taaagccaacctagctttttcctct

SEQ ID NO: 745947 - DNA, 25 bp, Mus musculus
taaagccaaccttgctttttcctct

SEQ ID NO: 745948 - DNA, 25 bp, Mus musculus
taaagccaatctagaagccaaaaat

SEQ ID NO: 745949 - DNA, 25 bp, Mus musculus
taaagccaatcttgaagccaaaaat

SEQ ID NO: 745950 - DNA, 25 bp, Mus musculus
taaagccacacactgctgccttaag

SEQ ID NO: 745951 - DNA, 25 bp, Mus musculus
taaagccacacagtgctgccttaag

SEQ ID NO: 745952 - DNA, 25 bp, Mus musculus
taaagccacactctgggtcaagtcc

SEQ ID NO: 745953 - DNA, 25 bp, Mus musculus
taaagccacactgtgggtcaagtcc

SEQ ID NO: 745954 - DNA, 25 bp, Mus musculus
taaagccacataccacttcatcttt

SEQ ID NO: 745955 - DNA, 25 bp, Mus musculus
taaagccacatagcacttcatcttt

SEQ ID NO: 745956 - DNA, 25 bp, Mus musculus
taaagccacatcacagtcaactcac

SEQ ID NO: 745957 - DNA, 25 bp, Mus musculus
taaagccacatctcagtcaactcac

SEQ ID NO: 745958 - DNA, 25 bp, Mus musculus
taaagccacatgcagctctccactg

SEQ ID NO: 745959 - DNA, 25 bp, Mus musculus
taaagccacatggagctctccactg

SEQ ID NO: 745960 - DNA, 25 bp, Mus musculus
taaagccagcctatatgtggccatg

SEQ ID NO: 745961 - DNA, 25 bp, Mus musculus
taaagccagcctttatgtggccatg

SEQ ID NO: 745962 - DNA, 25 bp, Mus musculus
taaagccagtctcttcagatgtcaa

SEQ ID NO: 745963 - DNA, 25 bp, Mus musculus
taaagccagtctgttcagatgtcaa

SEQ ID NO: 745964 - DNA, 25 bp, Mus musculus
taaagccatagtcagagcctgaaac

SEQ ID NO: 745965 - DNA, 25 bp, Mus musculus
taaagccatagtgagagcctgaaac

SEQ ID NO: 745966 - DNA, 25 bp, Mus musculus
taaagccatgctcaatctgaatcat

SEQ ID NO: 745967 - DNA, 25 bp, Mus musculus
taaagccatgctccccttgtatgat

SEQ ID NO: 745968 - DNA, 25 bp, Mus musculus
taaagccatgctgaatctgaatcat

SEQ ID NO: 745969 - DNA, 25 bp, Mus musculus
taaagccatgctgcccttgtatgat

SEQ ID NO: 745970 - DNA, 25 bp, Mus musculus
taaagccatggccatctagctccac

SEQ ID NO: 745971 - DNA, 25 bp, Mus musculus
taaagccatggcgatctagctccac

SEQ ID NO: 745972 - DNA, 25 bp, Mus musculus
taaagccatgtaagacattgaagat

SEQ ID NO: 745973 - DNA, 25 bp, Mus musculus
taaagccatgtatgacattgaagat

SEQ ID NO: 745974 - DNA, 25 bp, Mus musculus
taaagccattgtatcccaataaaag

SEQ ID NO: 745975 - DNA, 25 bp, Mus musculus
taaagccattgtttcccaataaaag

SEQ ID NO: 745976 - DNA, 25 bp, Mus musculus
taaagccatttaaccggtacgactg

SEQ ID NO: 745977 - DNA, 25 bp, Mus musculus
taaagccatttatccggtacgactg

SEQ ID NO: 745978 - DNA, 25 bp, Mus musculus
taaagccatttcaagggcgaggatg

SEQ ID NO: 745979 - DNA, 25 bp, Mus musculus
taaagccatttccataatgacaata

SEQ ID NO: 745980 - DNA, 25 bp, Mus musculus
taaagccatttcgataatgacaata

SEQ ID NO: 745981 - DNA, 25 bp, Mus musculus
taaagccatttctagggcgaggatg

SEQ ID NO: 745982 - DNA, 25 bp, Mus musculus
taaagcccaactattattctgcaag

SEQ ID NO: 745983 - DNA, 25 bp, Mus musculus
taaagcccaacttttattctgcaag

SEQ ID NO: 745984 - DNA, 25 bp, Mus musculus
taaagcccacacaggattcggactt

SEQ ID NO: 745985 - DNA, 25 bp, Mus musculus
taaagcccacactggattcggactt

SEQ ID NO: 745986 - DNA, 25 bp, Mus musculus
taaagcccacggcaattggaaacaa

SEQ ID NO: 745987 - DNA, 25 bp, Mus musculus
taaagcccacgggaattggaaacaa

SEQ ID NO: 745988 - DNA, 25 bp, Mus musculus
taaagcccagtgatacctagcagat

SEQ ID NO: 745989 - DNA, 25 bp, Mus musculus
taaagcccagtgttacctagcagat

SEQ ID NO: 745990 - DNA, 25 bp, Mus musculus
taaagcccatccactggttttattt

SEQ ID NO: 745991 - DNA, 25 bp, Mus musculus
taaagcccatcctctggttttattt

SEQ ID NO: 745992 - DNA, 25 bp, Mus musculus
taaagcccatttatcagccctctta

SEQ ID NO: 745993 - DNA, 25 bp, Mus musculus
taaagcccatttttcagccctctta

SEQ ID NO: 745994 - DNA, 25 bp, Mus musculus
taaagccccgtgattggcagtttct

SEQ ID NO: 745995 - DNA, 25 bp, Mus musculus
taaagccccgtgtttggcagtttct

SEQ ID NO: 745996 - DNA, 25 bp, Mus musculus
taaagccctcgtctagttaccttca

SEQ ID NO: 745997 - DNA, 25 bp, Mus musculus
taaagccctcgtgtagttaccttca

SEQ ID NO: 745998 - DNA, 25 bp, Mus musculus
taaagccctggcctcataggactat

SEQ ID NO: 745999 - DNA, 25 bp, Mus musculus
taaagccctggcgtcataggactat

SEQ ID NO: 746000 - DNA, 25 bp, Mus musculus
taaagccctgttcctcagctctgag

SEQ ID NO: 746001 - DNA, 25 bp, Mus musculus
taaagccctgttgctcagctctgag

SEQ ID NO: 746002 - DNA, 25 bp, Mus musculus
taaagccctttaccgttgtgaacct

SEQ ID NO: 746003 - DNA, 25 bp, Mus musculus
taaagccctttagcgttgtgaacct

SEQ ID NO: 746004 - DNA, 25 bp, Mus musculus
taaagccctttgcttttctttatat

SEQ ID NO: 746005 - DNA, 25 bp, Mus musculus
taaagccctttggttttctttatat

SEQ ID NO: 746006 - DNA, 25 bp, Mus musculus
taaagccgagatcagtaactatgca

SEQ ID NO: 746007 - DNA, 25 bp, Mus musculus
taaagccgagatgagtaactatgca

SEQ ID NO: 746008 - DNA, 25 bp, Mus musculus
taaagccgctaacaccgaatgggat

SEQ ID NO: 746009 - DNA, 25 bp, Mus musculus
taaagccgctaagaccgaatgggat

SEQ ID NO: 746010 - DNA, 25 bp, Mus musculus
taaagccggagtcctgagcacagca

SEQ ID NO: 746011 - DNA, 25 bp, Mus musculus
taaagccggagtgctgagcacagca

SEQ ID NO: 746012 - DNA, 25 bp, Mus musculus
taaagcctctgacgatttcagtccc

SEQ ID NO: 746013 - DNA, 25 bp, Mus musculus
taaagcctctgaggatttcagtccc

SEQ ID NO: 746014 - DNA, 25 bp, Mus musculus
taaagcctgtgtcggctcatctgtc

SEQ ID NO: 746015 - DNA, 25 bp, Mus musculus
taaagcctgtgtgggctcatctgtc

SEQ ID NO: 746016 - DNA, 25 bp, Mus musculus
taaagccttaccaagagggaaaatg

SEQ ID NO: 746017 - DNA, 25 bp, Mus musculus
taaagccttacctagagggaaaatg

SEQ ID NO: 746018 - DNA, 25 bp, Mus musculus
taaagccttcaaccagcgagagcat

SEQ ID NO: 746019 - DNA, 25 bp, Mus musculus
taaagccttcaagcagcgagagcat

SEQ ID NO: 746020 - DNA, 25 bp, Mus musculus
taaagccttcagagttgtacataat

SEQ ID NO: 746021 - DNA, 25 bp, Mus musculus
taaagccttcagtgttgtacataat

SEQ ID NO: 746022 - DNA, 25 bp, Mus musculus
taaagccttcttataccaggtctca

SEQ ID NO: 746023 - DNA, 25 bp, Mus musculus
taaagccttcttttaccaggtctca

SEQ ID NO: 746024 - DNA, 25 bp, Mus musculus
taaagccttgtcaaacatttcttaa

SEQ ID NO: 746025 - DNA, 25 bp, Mus musculus
taaagccttgtctaacatttcttaa

SEQ ID NO: 746026 - DNA, 25 bp, Mus musculus
taaagcctttgcacgtaaaagatat

SEQ ID NO: 746027 - DNA, 25 bp, Mus musculus
taaagcctttgctcgtaaaagatat

SEQ ID NO: 746028 - DNA, 25 bp, Mus musculus
taaagcgacgcaacactgcctactt

SEQ ID NO: 746029 - DNA, 25 bp, Mus musculus
taaagcgacgcatcactgcctactt

SEQ ID NO: 746030 - DNA, 25 bp, Mus musculus
taaagcgagtagactacgcccgcct

SEQ ID NO: 746031 - DNA, 25 bp, Mus musculus
taaagcgagtagtctacgcccgcct

SEQ ID NO: 746032 - DNA, 25 bp, Mus musculus
taaagcgatctcactgtgtcataag

SEQ ID NO: 746033 - DNA, 25 bp, Mus musculus
taaagcgatctctctgtgtcataag

SEQ ID NO: 746034 - DNA, 25 bp, Mus musculus
taaagcgcaacacttggcatttttt

SEQ ID NO: 746035 - DNA, 25 bp, Mus musculus
taaagcgcaacagttggcatttttt

SEQ ID NO: 746036 - DNA, 25 bp, Mus musculus
taaagcgcacttcgttttcgtctct

SEQ ID NO: 746037 - DNA, 25 bp, Mus musculus
taaagcgcacttggttttcgtctct

SEQ ID NO: 746038 - DNA, 25 bp, Mus musculus
taaagcgccaagactgcaaagccag

SEQ ID NO: 746039 - DNA, 25 bp, Mus musculus
taaagcgccaagtctgcaaagccag

SEQ ID NO: 746040 - DNA, 25 bp, Mus musculus
taaagcgcccagcaggaaccacagg

SEQ ID NO: 746041 - DNA, 25 bp, Mus musculus
taaagcgcccaggaggaaccacagg

SEQ ID NO: 746042 - DNA, 25 bp, Mus musculus
taaagcgcctttcttaactttctag

SEQ ID NO: 746043 - DNA, 25 bp, Mus musculus
taaagcgcctttgttaactttctag

SEQ ID NO: 746044 - DNA, 25 bp, Mus musculus
taaagcgctcgcagtgtcagcctga

SEQ ID NO: 746045 - DNA, 25 bp, Mus musculus
taaagcgctcgctgtgtcagcctga

SEQ ID NO: 746046 - DNA, 25 bp, Mus musculus
taaagcgctgcacacacgaacacag

SEQ ID NO: 746047 - DNA, 25 bp, Mus musculus
taaagcgctgcagacacgaacacag

SEQ ID NO: 746048 - DNA, 25 bp, Mus musculus
taaagcgcttttcttacctcccaag

SEQ ID NO: 746049 - DNA, 25 bp, Mus musculus
taaagcgcttttgttacctcccaag

SEQ ID NO: 746050 - DNA, 25 bp, Mus musculus
taaagcggcactcggacttgagcac

SEQ ID NO: 746051 - DNA, 25 bp, Mus musculus
taaagcggcactgggacttgagcac

SEQ ID NO: 746052 - DNA, 25 bp, Mus musculus
taaagcggccctccaatgtgctggg

SEQ ID NO: 746053 - DNA, 25 bp, Mus musculus
taaagcggccctgcaatgtgctggg

SEQ ID NO: 746054 - DNA, 25 bp, Mus musculus
taaagcgggcttaatggtgaagaaa

SEQ ID NO: 746055 - DNA, 25 bp, Mus musculus
taaagcgggctttatggtgaagaaa

SEQ ID NO: 746056 - DNA, 25 bp, Mus musculus
taaagcgggtggctggctcctctct

SEQ ID NO: 746057 - DNA, 25 bp, Mus musculus
taaagcgggtgggtggctcctctct

SEQ ID NO: 746058 - DNA, 25 bp, Mus musculus
taaagcggtgttaaagagctgctgt

SEQ ID NO: 746059 - DNA, 25 bp, Mus musculus
taaagcggtgtttaagagctgctgt

SEQ ID NO: 746060 - DNA, 25 bp, Mus musculus
taaagcgtatctatcgttccactcc

SEQ ID NO: 746061 - DNA, 25 bp, Mus musculus
taaagcgtatctttcgttccactcc

SEQ ID NO: 746062 - DNA, 25 bp, Mus musculus
taaagcgtccaccagtcttcaggat

SEQ ID NO: 746063 - DNA, 25 bp, Mus musculus
taaagcgtccacgagtcttcaggat

SEQ ID NO: 746064 - DNA, 25 bp, Mus musculus
taaagcgtgtgtcggcagctgctcc

SEQ ID NO: 746065 - DNA, 25 bp, Mus musculus
taaagcgtgtgtgggcagctgctcc

SEQ ID NO: 746066 - DNA, 25 bp, Mus musculus
taaagcgtttgtcggagcagagctc

SEQ ID NO: 746067 - DNA, 25 bp, Mus musculus
taaagcgtttgtgggagcagagctc

SEQ ID NO: 746068 - DNA, 25 bp, Mus musculus
taaagctaagccctgctatgcagtg

SEQ ID NO: 746069 - DNA, 25 bp, Mus musculus
taaagctaagccgtgctatgcagtg

SEQ ID NO: 746070 - DNA, 25 bp, Mus musculus
taaagctagattcctgtctctcatc

SEQ ID NO: 746071 - DNA, 25 bp, Mus musculus
taaagctagattgctgtctctcatc

SEQ ID NO: 746072 - DNA, 25 bp, Mus musculus
taaagctagcctctgcttcctgcat

SEQ ID NO: 746073 - DNA, 25 bp, Mus musculus
taaagctagcctgtgcttcctgcat

SEQ ID NO: 746074 - DNA, 25 bp, Mus musculus
taaagctagtagaccattcaccagg

SEQ ID NO: 746075 - DNA, 25 bp, Mus musculus
taaagctagtagtccattcaccagg

SEQ ID NO: 746076 - DNA, 25 bp, Mus musculus
taaagctagttaattttgacccagg

SEQ ID NO: 746077 - DNA, 25 bp, Mus musculus
taaagctagttatttttgacccagg

SEQ ID NO: 746078 - DNA, 25 bp, Mus musculus
taaagctataatcggcctgcacact

SEQ ID NO: 746079 - DNA, 25 bp, Mus musculus
taaagctataatgggcctgcacact

SEQ ID NO: 746080 - DNA, 25 bp, Mus musculus
taaagctatataacaacacattcca

SEQ ID NO: 746081 - DNA, 25 bp, Mus musculus
taaagctatatatcaacacattcca

SEQ ID NO: 746082 - DNA, 25 bp, Mus musculus
taaagctatcagactgctgcccatt

SEQ ID NO: 746083 - DNA, 25 bp, Mus musculus
taaagctatcagtctgctgcccatt

SEQ ID NO: 746084 - DNA, 25 bp, Mus musculus
taaagctcaccgattggccagacag

SEQ ID NO: 746085 - DNA, 25 bp, Mus musculus
taaagctcaccgtttggccagacag

SEQ ID NO: 746086 - DNA, 25 bp, Mus musculus
taaagctcagccagacctcacagtt

SEQ ID NO: 746087 - DNA, 25 bp, Mus musculus
taaagctcagcctgacctcacagtt

SEQ ID NO: 746088 - DNA, 25 bp, Mus musculus
taaagctcagttagttatttggttt

SEQ ID NO: 746089 - DNA, 25 bp, Mus musculus
taaagctcagtttgttatttggttt

SEQ ID NO: 746090 - DNA, 25 bp, Mus musculus
taaagctccagactccagacctaac

SEQ ID NO: 746091 - DNA, 25 bp, Mus musculus
taaagctccagagtccagacctaac

SEQ ID NO: 746092 - DNA, 25 bp, Mus musculus
taaagctccaggcttctgtgagctg

SEQ ID NO: 746093 - DNA, 25 bp, Mus musculus
taaagctccagggttctgtgagctg

SEQ ID NO: 746094 - DNA, 25 bp, Mus musculus
taaagctcgctgctgggctgcattc

SEQ ID NO: 746095 - DNA, 25 bp, Mus musculus
taaagctcgctggtgggctgcattc

SEQ ID NO: 746096 - DNA, 25 bp, Mus musculus
taaagctcgggtaggtaagatgact

SEQ ID NO: 746097 - DNA, 25 bp, Mus musculus
taaagctcgggttggtaagatgact

SEQ ID NO: 746098 - DNA, 25 bp, Mus musculus
taaagctctcatccctaatacttag

SEQ ID NO: 746099 - DNA, 25 bp, Mus musculus
taaagctctcatgcctaatacttag

SEQ ID NO: 746100 - DNA, 25 bp, Mus musculus
taaagctctcctaatttcacatctc

SEQ ID NO: 746101 - DNA, 25 bp, Mus musculus
taaagctctccttatttcacatctc

SEQ ID NO: 746102 - DNA, 25 bp, Mus musculus
taaagctctcttaaaagcctttgga

SEQ ID NO: 746103 - DNA, 25 bp, Mus musculus
taaagctctctttaaagcctttgga

SEQ ID NO: 746104 - DNA, 25 bp, Mus musculus
taaagctctgttacggctgcaagac

SEQ ID NO: 746105 - DNA, 25 bp, Mus musculus
taaagctctgttattactgtctggt

SEQ ID NO: 746106 - DNA, 25 bp, Mus musculus
taaagctctgtttcggctgcaagac

SEQ ID NO: 746107 - DNA, 25 bp, Mus musculus
taaagctctgtttttactgtctggt

SEQ ID NO: 746108 - DNA, 25 bp, Mus musculus
taaagctcttctcctggtagccatt

SEQ ID NO: 746109 - DNA, 25 bp, Mus musculus
taaagctcttctgctggtagccatt

SEQ ID NO: 746110 - DNA, 25 bp, Mus musculus
taaagctgaagtcccaattaaaata

SEQ ID NO: 746111 - DNA, 25 bp, Mus musculus
taaagctgaagtgccaattaaaata

SEQ ID NO: 746112 - DNA, 25 bp, Mus musculus
taaagctgacagcatcttcaccacc

SEQ ID NO: 746113 - DNA, 25 bp, Mus musculus
taaagctgacaggatcttcaccacc

SEQ ID NO: 746114 - DNA, 25 bp, Mus musculus
taaagctgagacacctacccaaagg

SEQ ID NO: 746115 - DNA, 25 bp, Mus musculus
taaagctgagactcctacccaaagg

SEQ ID NO: 746116 - DNA, 25 bp, Mus musculus
taaagctgaggtactaccggacgtc

SEQ ID NO: 746117 - DNA, 25 bp, Mus musculus
taaagctgaggttctaccggacgtc

SEQ ID NO: 746118 - DNA, 25 bp, Mus musculus
taaagctgatcccacagtcagttcc

SEQ ID NO: 746119 - DNA, 25 bp, Mus musculus
taaagctgatccgacagtcagttcc

SEQ ID NO: 746120 - DNA, 25 bp, Mus musculus
taaagctgcaatagtctgttatgac

SEQ ID NO: 746121 - DNA, 25 bp, Mus musculus
taaagctgcaattgtctgttatgac

SEQ ID NO: 746122 - DNA, 25 bp, Mus musculus
taaagctgcactagtggtgaaaaac

SEQ ID NO: 746123 - DNA, 25 bp, Mus musculus
taaagctgcacttgtggtgaaaaac

SEQ ID NO: 746124 - DNA, 25 bp, Mus musculus
taaagctgccgacttgctctcattt

SEQ ID NO: 746125 - DNA, 25 bp, Mus musculus
taaagctgccgagttgctctcattt

SEQ ID NO: 746126 - DNA, 25 bp, Mus musculus
taaagctgctacatgctgctcaggc

SEQ ID NO: 746127 - DNA, 25 bp, Mus musculus
taaagctgctacttgctgctcaggc

SEQ ID NO: 746128 - DNA, 25 bp, Mus musculus
taaagctgctcaatgtttaccagta

SEQ ID NO: 746129 - DNA, 25 bp, Mus musculus
taaagctgctcattgtttaccagta

SEQ ID NO: 746130 - DNA, 25 bp, Mus musculus
taaagctgctgtcatggctaccctt

SEQ ID NO: 746131 - DNA, 25 bp, Mus musculus
taaagctgctgtgatggctaccctt

SEQ ID NO: 746132 - DNA, 25 bp, Mus musculus
taaagctgcttcctttccttgagtt

SEQ ID NO: 746133 - DNA, 25 bp, Mus musculus
taaagctgcttcgtttccttgagtt

SEQ ID NO: 746134 - DNA, 25 bp, Mus musculus
taaagctggaaacctctctgttcct

SEQ ID NO: 746135 - DNA, 25 bp, Mus musculus
taaagctggaaagctctctgttcct

SEQ ID NO: 746136 - DNA, 25 bp, Mus musculus
taaagctggagaccaacttcgcctc

SEQ ID NO: 746137 - DNA, 25 bp, Mus musculus
taaagctggagagcaacttcgcctc

SEQ ID NO: 746138 - DNA, 25 bp, Mus musculus
taaagctggcagacagccgccctgg

SEQ ID NO: 746139 - DNA, 25 bp, Mus musculus
taaagctggcagtcagccgccctgg

SEQ ID NO: 746140 - DNA, 25 bp, Mus musculus
taaagctggtgacctatcgacgagg

SEQ ID NO: 746141 - DNA, 25 bp, Mus musculus
taaagctggtgagctatcgacgagg

SEQ ID NO: 746142 - DNA, 25 bp, Mus musculus
taaagctgtacactgatcccctcct

SEQ ID NO: 746143 - DNA, 25 bp, Mus musculus
taaagctgtacagtgatcccctcct

SEQ ID NO: 746144 - DNA, 25 bp, Mus musculus
taaagctgtattactgtcacattgt

SEQ ID NO: 746145 - DNA, 25 bp, Mus musculus
taaagctgtatttctgtcacattgt

SEQ ID NO: 746146 - DNA, 25 bp, Mus musculus
taaagctgtccaatcaattccaaat

SEQ ID NO: 746147 - DNA, 25 bp, Mus musculus
taaagctgtccattcaattccaaat

SEQ ID NO: 746148 - DNA, 25 bp, Mus musculus
taaagctgtgacctcaggttggctt

SEQ ID NO: 746149 - DNA, 25 bp, Mus musculus
taaagctgtgacgtcaggttggctt

SEQ ID NO: 746150 - DNA, 25 bp, Mus musculus
taaagctgtgcaaggctcgtgttta

SEQ ID NO: 746151 - DNA, 25 bp, Mus musculus
taaagctgtgcatggctcgtgttta

SEQ ID NO: 746152 - DNA, 25 bp, Mus musculus
taaagctgtgtacggttgggtccct

SEQ ID NO: 746153 - DNA, 25 bp, Mus musculus
taaagctgtgtagggttgggtccct

SEQ ID NO: 746154 - DNA, 25 bp, Mus musculus
taaagctgtgtcacggagggcctgt

SEQ ID NO: 746155 - DNA, 25 bp, Mus musculus
taaagctgtgtctcggagggcctgt

SEQ ID NO: 746156 - DNA, 25 bp, Mus musculus
taaagctgttccacagctccagggc

SEQ ID NO: 746157 - DNA, 25 bp, Mus musculus
taaagctgttcctcagctccagggc

SEQ ID NO: 746158 - DNA, 25 bp, Mus musculus
taaagcttacccacattattaacct

SEQ ID NO: 746159 - DNA, 25 bp, Mus musculus
taaagcttacccacctgtagttcca

SEQ ID NO: 746160 - DNA, 25 bp, Mus musculus
taaagcttaccctcattattaacct

SEQ ID NO: 746161 - DNA, 25 bp, Mus musculus
taaagcttaccctcctgtagttcca

SEQ ID NO: 746162 - DNA, 25 bp, Mus musculus
taaagcttcacccaatggcttctca

SEQ ID NO: 746163 - DNA, 25 bp, Mus musculus
taaagcttcaccgaatggcttctca

SEQ ID NO: 746164 - DNA, 25 bp, Mus musculus
taaagcttccaaccccgagaatgta

SEQ ID NO: 746165 - DNA, 25 bp, Mus musculus
taaagcttccaagcccgagaatgta

SEQ ID NO: 746166 - DNA, 25 bp, Mus musculus
taaagcttgagactggcgagcagag

SEQ ID NO: 746167 - DNA, 25 bp, Mus musculus
taaagcttgagagtggcgagcagag

SEQ ID NO: 746168 - DNA, 25 bp, Mus musculus
taaagcttgctgaccagcaggacct

SEQ ID NO: 746169 - DNA, 25 bp, Mus musculus
taaagcttgctgtccagcaggacct

SEQ ID NO: 746170 - DNA, 25 bp, Mus musculus
taaagctttaatcccctgtgagcca

SEQ ID NO: 746171 - DNA, 25 bp, Mus musculus
taaagctttaatgccctgtgagcca

SEQ ID NO: 746172 - DNA, 25 bp, Mus musculus
taaagctttctgcattcgagacccc

SEQ ID NO: 746173 - DNA, 25 bp, Mus musculus
taaagctttctggattcgagacccc

SEQ ID NO: 746174 - DNA, 25 bp, Mus musculus
taaagcttttagattaagtgcctgg

SEQ ID NO: 746175 - DNA, 25 bp, Mus musculus
taaagcttttagtttaagtgcctgg

SEQ ID NO: 746176 - DNA, 25 bp, Mus musculus
taaaggaaactcaccatcggtgcaa

SEQ ID NO: 746177 - DNA, 25 bp, Mus musculus
taaaggaaactctccatcggtgcaa

SEQ ID NO: 746178 - DNA, 25 bp, Mus musculus
taaaggaaagttaactcttctgatt

SEQ ID NO: 746179 - DNA, 25 bp, Mus musculus
taaaggaaagtttactcttctgatt

SEQ ID NO: 746180 - DNA, 25 bp, Mus musculus
taaaggaacatgcatttgtcaatca

SEQ ID NO: 746181 - DNA, 25 bp, Mus musculus
taaaggaacatggatttgtcaatca

SEQ ID NO: 746182 - DNA, 25 bp, Mus musculus
taaaggaacgttaccggctgcgttg

SEQ ID NO: 746183 - DNA, 25 bp, Mus musculus
taaaggaacgtttccggctgcgttg

SEQ ID NO: 746184 - DNA, 25 bp, Mus musculus
taaaggaacttcagcggctcaccta

SEQ ID NO: 746185 - DNA, 25 bp, Mus musculus
taaaggaacttctgcggctcaccta

SEQ ID NO: 746186 - DNA, 25 bp, Mus musculus
taaaggaagactcactccctccaca

SEQ ID NO: 746187 - DNA, 25 bp, Mus musculus
taaaggaagactgactccctccaca

SEQ ID NO: 746188 - DNA, 25 bp, Mus musculus
taaaggaagcagctgcctgtgttaa

SEQ ID NO: 746189 - DNA, 25 bp, Mus musculus
taaaggaagcaggtgcctgtgttaa

SEQ ID NO: 746190 - DNA, 25 bp, Mus musculus
taaaggaagcctcacttgcacccta

SEQ ID NO: 746191 - DNA, 25 bp, Mus musculus
taaaggaagcctgacttgcacccta

SEQ ID NO: 746192 - DNA, 25 bp, Mus musculus
taaaggacaaagaactagccgggcg

SEQ ID NO: 746193 - DNA, 25 bp, Mus musculus
taaaggacaaagtactagccgggcg

SEQ ID NO: 746194 - DNA, 25 bp, Mus musculus
taaaggacaccaactagctaccact

SEQ ID NO: 746195 - DNA, 25 bp, Mus musculus
taaaggacaccatctagctaccact

SEQ ID NO: 746196 - DNA, 25 bp, Mus musculus
taaaggacactcaccaacggctgga

SEQ ID NO: 746197 - DNA, 25 bp, Mus musculus
taaaggacactctccaacggctgga

SEQ ID NO: 746198 - DNA, 25 bp, Mus musculus
taaaggacaggacatctcaagattt

SEQ ID NO: 746199 - DNA, 25 bp, Mus musculus
taaaggacaggagatctcaagattt

SEQ ID NO: 746200 - DNA, 25 bp, Mus musculus
taaaggacaggtatcctgagcttaa

SEQ ID NO: 746201 - DNA, 25 bp, Mus musculus
taaaggacaggtttcctgagcttaa

SEQ ID NO: 746202 - DNA, 25 bp, Mus musculus
taaaggacagtgagtggatcccaga

SEQ ID NO: 746203 - DNA, 25 bp, Mus musculus
taaaggacagtgtgtggatcccaga

SEQ ID NO: 746204 - DNA, 25 bp, Mus musculus
taaaggacataacctctccgcttgt

SEQ ID NO: 746205 - DNA, 25 bp, Mus musculus
taaaggacataagctctccgcttgt

SEQ ID NO: 746206 - DNA, 25 bp, Mus musculus
taaaggaccaacctgccttacgtat

SEQ ID NO: 746207 - DNA, 25 bp, Mus musculus
taaaggaccaacgtgccttacgtat

SEQ ID NO: 746208 - DNA, 25 bp, Mus musculus
taaaggaccaagcagccacaggctc

SEQ ID NO: 746209 - DNA, 25 bp, Mus musculus
taaaggaccaaggagccacaggctc

SEQ ID NO: 746210 - DNA, 25 bp, Mus musculus
taaaggaccagtaagccaagtgcag

SEQ ID NO: 746211 - DNA, 25 bp, Mus musculus
taaaggaccagttagccaagtgcag

SEQ ID NO: 746212 - DNA, 25 bp, Mus musculus
taaaggaccattactaccttctgta

SEQ ID NO: 746213 - DNA, 25 bp, Mus musculus
taaaggaccatttctaccttctgta

SEQ ID NO: 746214 - DNA, 25 bp, Mus musculus
taaaggacccctcaagtgagacccg

SEQ ID NO: 746215 - DNA, 25 bp, Mus musculus
taaaggacccctgaagtgagacccg

SEQ ID NO: 746216 - DNA, 25 bp, Mus musculus
taaaggaccctaaaatcacaggctt

SEQ ID NO: 746217 - DNA, 25 bp, Mus musculus
taaaggaccctataatcacaggctt

SEQ ID NO: 746218 - DNA, 25 bp, Mus musculus
taaaggaccctgattctgtagaaag

SEQ ID NO: 746219 - DNA, 25 bp, Mus musculus
taaaggaccctgtttctgtagaaag

SEQ ID NO: 746220 - DNA, 25 bp, Mus musculus
taaaggactacccatgataacatgc

SEQ ID NO: 746221 - DNA, 25 bp, Mus musculus
taaaggactaccgatgataacatgc

SEQ ID NO: 746222 - DNA, 25 bp, Mus musculus
taaaggactcagaaacagacccaga

SEQ ID NO: 746223 - DNA, 25 bp, Mus musculus
taaaggactcagtaacagacccaga

SEQ ID NO: 746224 - DNA, 25 bp, Mus musculus
taaaggactctgagacgttaggaag

SEQ ID NO: 746225 - DNA, 25 bp, Mus musculus
taaaggactctgtgacgttaggaag

SEQ ID NO: 746226 - DNA, 25 bp, Mus musculus
taaaggactgtacataccgagggaa

SEQ ID NO: 746227 - DNA, 25 bp, Mus musculus
taaaggactgtagataccgagggaa

SEQ ID NO: 746228 - DNA, 25 bp, Mus musculus
taaaggagacaccagcagtttagtg

SEQ ID NO: 746229 - DNA, 25 bp, Mus musculus
taaaggagacacgagcagtttagtg

SEQ ID NO: 746230 - DNA, 25 bp, Mus musculus
taaaggagacctatttttatactca

SEQ ID NO: 746231 - DNA, 25 bp, Mus musculus
taaaggagacctttttttatactca

SEQ ID NO: 746232 - DNA, 25 bp, Mus musculus
taaaggagatctccaccatgccctc

SEQ ID NO: 746233 - DNA, 25 bp, Mus musculus
taaaggagatctgcaccatgccctc

SEQ ID NO: 746234 - DNA, 25 bp, Mus musculus
taaaggagcaagagggacccgcacc

SEQ ID NO: 746235 - DNA, 25 bp, Mus musculus
taaaggagcaagtgggacccgcacc

SEQ ID NO: 746236 - DNA, 25 bp, Mus musculus
taaaggagccaaacactgagcgagt

SEQ ID NO: 746237 - DNA, 25 bp, Mus musculus
taaaggagccaatcactgagcgagt

SEQ ID NO: 746238 - DNA, 25 bp, Mus musculus
taaaggagccttaggtctcctctat

SEQ ID NO: 746239 - DNA, 25 bp, Mus musculus
taaaggagcctttggtctcctctat

SEQ ID NO: 746240 - DNA, 25 bp, Mus musculus
taaaggagctccatccctagccgtt

SEQ ID NO: 746241 - DNA, 25 bp, Mus musculus
taaaggagctccttccctagccgtt

SEQ ID NO: 746242 - DNA, 25 bp, Mus musculus
taaaggaggactaccggctacactt

SEQ ID NO: 746243 - DNA, 25 bp, Mus musculus
taaaggaggacttccggctacactt

SEQ ID NO: 746244 - DNA, 25 bp, Mus musculus
taaaggaggccaactcgttctcgtt

SEQ ID NO: 746245 - DNA, 25 bp, Mus musculus
taaaggaggccatctcgttctcgtt

SEQ ID NO: 746246 - DNA, 25 bp, Mus musculus
taaaggatacctctacttcctacgc

SEQ ID NO: 746247 - DNA, 25 bp, Mus musculus
taaaggatacctgtacttcctacgc

SEQ ID NO: 746248 - DNA, 25 bp, Mus musculus
taaaggatcaatatctacacctgtt

SEQ ID NO: 746249 - DNA, 25 bp, Mus musculus
taaaggatcaatttctacacctgtt

SEQ ID NO: 746250 - DNA, 25 bp, Mus musculus
taaaggatctctatttgtattcaag

SEQ ID NO: 746251 - DNA, 25 bp, Mus musculus
taaaggatctctctccatttgaaga

SEQ ID NO: 746252 - DNA, 25 bp, Mus musculus
taaaggatctctgtccatttgaaga

SEQ ID NO: 746253 - DNA, 25 bp, Mus musculus
taaaggatctctttttgtattcaag

SEQ ID NO: 746254 - DNA, 25 bp, Mus musculus
taaaggatgacccttatgcccgtgt

SEQ ID NO: 746255 - DNA, 25 bp, Mus musculus
taaaggatgaccgttatgcccgtgt

SEQ ID NO: 746256 - DNA, 25 bp, Mus musculus
taaaggatggcgacttctgtgggca

SEQ ID NO: 746257 - DNA, 25 bp, Mus musculus
taaaggatggcgtcttctgtgggca

SEQ ID NO: 746258 - DNA, 25 bp, Mus musculus
taaaggatgtgtcggctcactgccg

SEQ ID NO: 746259 - DNA, 25 bp, Mus musculus
taaaggatgtgtgggctcactgccg

SEQ ID NO: 746260 - DNA, 25 bp, Mus musculus
taaaggatgtttacaacaaacacga

SEQ ID NO: 746261 - DNA, 25 bp, Mus musculus
taaaggatgttttcaacaaacacga

SEQ ID NO: 746262 - DNA, 25 bp, Mus musculus
taaaggattatccaccacaaagatc

SEQ ID NO: 746263 - DNA, 25 bp, Mus musculus
taaaggattatcgaccacaaagatc

SEQ ID NO: 746264 - DNA, 25 bp, Mus musculus
taaaggattccacggtttcgcttca

SEQ ID NO: 746265 - DNA, 25 bp, Mus musculus
taaaggattccagggtttcgcttca

SEQ ID NO: 746266 - DNA, 25 bp, Mus musculus
taaaggattcctcggcatctacttc

SEQ ID NO: 746267 - DNA, 25 bp, Mus musculus
taaaggattcctgggcatctacttc

SEQ ID NO: 746268 - DNA, 25 bp, Mus musculus
taaaggatttcaactagccccagct

SEQ ID NO: 746269 - DNA, 25 bp, Mus musculus
taaaggatttcatctagccccagct

SEQ ID NO: 746270 - DNA, 25 bp, Mus musculus
taaaggcaattcaaccctcgctgtg

SEQ ID NO: 746271 - DNA, 25 bp, Mus musculus
taaaggcaattctaccctcgctgtg

SEQ ID NO: 746272 - DNA, 25 bp, Mus musculus
taaaggcaccataacaaagtatatc

SEQ ID NO: 746273 - DNA, 25 bp, Mus musculus
taaaggcaccattacaaagtatatc

SEQ ID NO: 746274 - DNA, 25 bp, Mus musculus
taaaggcactttatgttctgggaac

SEQ ID NO: 746275 - DNA, 25 bp, Mus musculus
taaaggcactttttgttctgggaac

SEQ ID NO: 746276 - DNA, 25 bp, Mus musculus
taaaggcagaatctctgcaggacat

SEQ ID NO: 746277 - DNA, 25 bp, Mus musculus
taaaggcagaatctgggctctgaga

SEQ ID NO: 746278 - DNA, 25 bp, Mus musculus
taaaggcagaatgtctgcaggacat

SEQ ID NO: 746279 - DNA, 25 bp, Mus musculus
taaaggcagaatgtgggctctgaga

SEQ ID NO: 746280 - DNA, 25 bp, Mus musculus
taaaggcagatcaggctttgggact

SEQ ID NO: 746281 - DNA, 25 bp, Mus musculus
taaaggcagatctggctttgggact

SEQ ID NO: 746282 - DNA, 25 bp, Mus musculus
taaaggcagatgattacagagcatt

SEQ ID NO: 746283 - DNA, 25 bp, Mus musculus
taaaggcagatgtttacagagcatt

SEQ ID NO: 746284 - DNA, 25 bp, Mus musculus
taaaggcagcgaatcccaaatctct

SEQ ID NO: 746285 - DNA, 25 bp, Mus musculus
taaaggcagcgattcccaaatctct

SEQ ID NO: 746286 - DNA, 25 bp, Mus musculus
taaaggcagctaaaccctgtccatc

SEQ ID NO: 746287 - DNA, 25 bp, Mus musculus
taaaggcagctataccctgtccatc

SEQ ID NO: 746288 - DNA, 25 bp, Mus musculus
taaaggcagcttctgctgtccatgg

SEQ ID NO: 746289 - DNA, 25 bp, Mus musculus
taaaggcagcttgtgctgtccatgg

SEQ ID NO: 746290 - DNA, 25 bp, Mus musculus
taaaggcaggcactcataacataaa

SEQ ID NO: 746291 - DNA, 25 bp, Mus musculus
taaaggcaggcagtcataacataaa

SEQ ID NO: 746292 - DNA, 25 bp, Mus musculus
taaaggcagttaatagtgctgtatc

SEQ ID NO: 746293 - DNA, 25 bp, Mus musculus
taaaggcagttattagtgctgtatc

SEQ ID NO: 746294 - DNA, 25 bp, Mus musculus
taaaggcatacaactgaaggactat

SEQ ID NO: 746295 - DNA, 25 bp, Mus musculus
taaaggcatacatctgaaggactat

SEQ ID NO: 746296 - DNA, 25 bp, Mus musculus
taaaggcatcctctgcctatcgtca

SEQ ID NO: 746297 - DNA, 25 bp, Mus musculus
taaaggcatcctgtgcctatcgtca

SEQ ID NO: 746298 - DNA, 25 bp, Mus musculus
taaaggccaattaggcaccccgtgt

SEQ ID NO: 746299 - DNA, 25 bp, Mus musculus
taaaggccaatttggcaccccgtgt

SEQ ID NO: 746300 - DNA, 25 bp, Mus musculus
taaaggccactacggtttccagatc

SEQ ID NO: 746301 - DNA, 25 bp, Mus musculus
taaaggccactagggtttccagatc

SEQ ID NO: 746302 - DNA, 25 bp, Mus musculus
taaaggccactgatgagctgggaga

SEQ ID NO: 746303 - DNA, 25 bp, Mus musculus
taaaggccactgttgagctgggaga

SEQ ID NO: 746304 - DNA, 25 bp, Mus musculus
taaaggccagtcctaactcagtgca

SEQ ID NO: 746305 - DNA, 25 bp, Mus musculus
taaaggccagtcgtaactcagtgca

SEQ ID NO: 746306 - DNA, 25 bp, Mus musculus
taaaggccattacgtcacactgaga

SEQ ID NO: 746307 - DNA, 25 bp, Mus musculus
taaaggccattaggtcacactgaga

SEQ ID NO: 746308 - DNA, 25 bp, Mus musculus
taaaggcccagcagccactggttga

SEQ ID NO: 746309 - DNA, 25 bp, Mus musculus
taaaggcccagctgccactggttga

SEQ ID NO: 746310 - DNA, 25 bp, Mus musculus
taaaggccccacatagtctgcagag

SEQ ID NO: 746311 - DNA, 25 bp, Mus musculus
taaaggccccacttagtctgcagag

SEQ ID NO: 746312 - DNA, 25 bp, Mus musculus
taaaggcccgatacccacgcaaagg

SEQ ID NO: 746313 - DNA, 25 bp, Mus musculus
taaaggcccgattcccacgcaaagg

SEQ ID NO: 746314 - DNA, 25 bp, Mus musculus
taaaggccgtcccacatttgctgag

SEQ ID NO: 746315 - DNA, 25 bp, Mus musculus
taaaggccgtccgacatttgctgag

SEQ ID NO: 746316 - DNA, 25 bp, Mus musculus
taaaggccgttgctacagtagccct

SEQ ID NO: 746317 - DNA, 25 bp, Mus musculus
taaaggccgttggtacagtagccct

SEQ ID NO: 746318 - DNA, 25 bp, Mus musculus
taaaggcctaacctaatacttggag

SEQ ID NO: 746319 - DNA, 25 bp, Mus musculus
taaaggcctaacgtaatacttggag

SEQ ID NO: 746320 - DNA, 25 bp, Mus musculus
taaaggcctcttcactggatacttc

SEQ ID NO: 746321 - DNA, 25 bp, Mus musculus
taaaggcctcttgactggatacttc

SEQ ID NO: 746322 - DNA, 25 bp, Mus musculus
taaaggcctggactttcctgccatc

SEQ ID NO: 746323 - DNA, 25 bp, Mus musculus
taaaggcctggagtttcctgccatc

SEQ ID NO: 746324 - DNA, 25 bp, Mus musculus
taaaggcctgtaaccccattctggg

SEQ ID NO: 746325 - DNA, 25 bp, Mus musculus
taaaggcctgtatccccattctggg

SEQ ID NO: 746326 - DNA, 25 bp, Mus musculus
taaaggcgatgcagacctggcccta

SEQ ID NO: 746327 - DNA, 25 bp, Mus musculus
taaaggcgatgctgacctggcccta

SEQ ID NO: 746328 - DNA, 25 bp, Mus musculus
taaaggcgcactctgatgtgaggaa

SEQ ID NO: 746329 - DNA, 25 bp, Mus musculus
taaaggcgcactgtgatgtgaggaa

SEQ ID NO: 746330 - DNA, 25 bp, Mus musculus
taaaggcgccaaagtggtggcccat

SEQ ID NO: 746331 - DNA, 25 bp, Mus musculus
taaaggcgccaatgtggtggcccat

SEQ ID NO: 746332 - DNA, 25 bp, Mus musculus
taaaggcgtagtctgctaggcaaac

SEQ ID NO: 746333 - DNA, 25 bp, Mus musculus
taaaggcgtagtgtgctaggcaaac

SEQ ID NO: 746334 - DNA, 25 bp, Mus musculus
taaaggcgtgctcttgttcccgtct

SEQ ID NO: 746335 - DNA, 25 bp, Mus musculus
taaaggcgtgctgttgttcccgtct

SEQ ID NO: 746336 - DNA, 25 bp, Mus musculus
taaaggctagtactaccacctctgg

SEQ ID NO: 746337 - DNA, 25 bp, Mus musculus
taaaggctagtagtaccacctctgg

SEQ ID NO: 746338 - DNA, 25 bp, Mus musculus
taaaggctatgcattcctgctgttc

SEQ ID NO: 746339 - DNA, 25 bp, Mus musculus
taaaggctatgctttcctgctgttc

SEQ ID NO: 746340 - DNA, 25 bp, Mus musculus
taaaggctccatccacagtggctgg

SEQ ID NO: 746341 - DNA, 25 bp, Mus musculus
taaaggctccatgcacagtggctgg

SEQ ID NO: 746342 - DNA, 25 bp, Mus musculus
taaaggctgaccaacttactaattc

SEQ ID NO: 746343 - DNA, 25 bp, Mus musculus
taaaggctgacctacttactaattc

SEQ ID NO: 746344 - DNA, 25 bp, Mus musculus
taaaggctgagcagtccgcagacaa

SEQ ID NO: 746345 - DNA, 25 bp, Mus musculus
taaaggctgagctgtccgcagacaa

SEQ ID NO: 746346 - DNA, 25 bp, Mus musculus
taaaggctgcaccactacgatcggc

SEQ ID NO: 746347 - DNA, 25 bp, Mus musculus
taaaggctgcacgactacgatcggc

SEQ ID NO: 746348 - DNA, 25 bp, Mus musculus
taaaggctgggaatcgtgtccccat

SEQ ID NO: 746349 - DNA, 25 bp, Mus musculus
taaaggctgggattcgtgtccccat

SEQ ID NO: 746350 - DNA, 25 bp, Mus musculus
taaaggctgggcaatgtggctcagt

SEQ ID NO: 746351 - DNA, 25 bp, Mus musculus
taaaggctgggctatgtggctcagt

SEQ ID NO: 746352 - DNA, 25 bp, Mus musculus
taaaggctgtcgacagtggccggca

SEQ ID NO: 746353 - DNA, 25 bp, Mus musculus
taaaggctgtcgtcagtggccggca

SEQ ID NO: 746354 - DNA, 25 bp, Mus musculus
taaaggctgttcagactggccccac

SEQ ID NO: 746355 - DNA, 25 bp, Mus musculus
taaaggctgttctgactggccccac

SEQ ID NO: 746356 - DNA, 25 bp, Mus musculus
taaaggctgttgctacccggcctgg

SEQ ID NO: 746357 - DNA, 25 bp, Mus musculus
taaaggctgttggtacccggcctgg

SEQ ID NO: 746358 - DNA, 25 bp, Mus musculus
taaaggcttccaaccagagcaggtg

SEQ ID NO: 746359 - DNA, 25 bp, Mus musculus
taaaggcttccatccagagcaggtg

SEQ ID NO: 746360 - DNA, 25 bp, Mus musculus
taaaggcttggtcgtgtgattttcc

SEQ ID NO: 746361 - DNA, 25 bp, Mus musculus
taaaggcttggtggtgtgattttcc

SEQ ID NO: 746362 - DNA, 25 bp, Mus musculus
taaaggcttgtgctaccatgtctgg

SEQ ID NO: 746363 - DNA, 25 bp, Mus musculus
taaaggcttgtgctagctatcccac

SEQ ID NO: 746364 - DNA, 25 bp, Mus musculus
taaaggcttgtggtaccatgtctgg

SEQ ID NO: 746365 - DNA, 25 bp, Mus musculus
taaaggcttgtggtagctatcccac

SEQ ID NO: 746366 - DNA, 25 bp, Mus musculus
taaagggaagctaggttctggcagc

SEQ ID NO: 746367 - DNA, 25 bp, Mus musculus
taaagggaagcttggttctggcagc

SEQ ID NO: 746368 - DNA, 25 bp, Mus musculus
taaagggaccacagagcactgtgag

SEQ ID NO: 746369 - DNA, 25 bp, Mus musculus
taaagggaccactgagcactgtgag

SEQ ID NO: 746370 - DNA, 25 bp, Mus musculus
taaagggacccaaatatctctatat

SEQ ID NO: 746371 - DNA, 25 bp, Mus musculus
taaagggacccaatactaagtgtat

SEQ ID NO: 746372 - DNA, 25 bp, Mus musculus
taaagggacccatatatctctatat

SEQ ID NO: 746373 - DNA, 25 bp, Mus musculus
taaagggacccattactaagtgtat

SEQ ID NO: 746374 - DNA, 25 bp, Mus musculus
taaagggacctccatatctcgacgc

SEQ ID NO: 746375 - DNA, 25 bp, Mus musculus
taaagggacctcgatatctcgacgc

SEQ ID NO: 746376 - DNA, 25 bp, Mus musculus
taaagggacctgcttctttgcattt

SEQ ID NO: 746377 - DNA, 25 bp, Mus musculus
taaagggacctggttctttgcattt

SEQ ID NO: 746378 - DNA, 25 bp, Mus musculus
taaagggactcgctggttttccatc

SEQ ID NO: 746379 - DNA, 25 bp, Mus musculus
taaagggactcggtggttttccatc

SEQ ID NO: 746380 - DNA, 25 bp, Mus musculus
taaagggactctatccactacagga

SEQ ID NO: 746381 - DNA, 25 bp, Mus musculus
taaagggactctttccactacagga

SEQ ID NO: 746382 - DNA, 25 bp, Mus musculus
taaagggagatcaaaacagctgtca

SEQ ID NO: 746383 - DNA, 25 bp, Mus musculus
taaagggagatctaaacagctgtca

SEQ ID NO: 746384 - DNA, 25 bp, Mus musculus
taaagggattgcatttcttaagtct

SEQ ID NO: 746385 - DNA, 25 bp, Mus musculus
taaagggattgcttttcttaagtct

SEQ ID NO: 746386 - DNA, 25 bp, Mus musculus
taaagggcccctctccagagagcat

SEQ ID NO: 746387 - DNA, 25 bp, Mus musculus
taaagggcccctgtccagagagcat

SEQ ID NO: 746388 - DNA, 25 bp, Mus musculus
taaagggccctcaagagatttcttc

SEQ ID NO: 746389 - DNA, 25 bp, Mus musculus
taaagggccctctagagatttcttc

SEQ ID NO: 746390 - DNA, 25 bp, Mus musculus
taaagggcctttactagcgctgagc

SEQ ID NO: 746391 - DNA, 25 bp, Mus musculus
taaagggccttttctagcgctgagc

SEQ ID NO: 746392 - DNA, 25 bp, Mus musculus
taaagggcgccacgctgtactgagc

SEQ ID NO: 746393 - DNA, 25 bp, Mus musculus
taaagggcgccaggctgtactgagc

SEQ ID NO: 746394 - DNA, 25 bp, Mus musculus
taaagggctcccaggaactgcatgg

SEQ ID NO: 746395 - DNA, 25 bp, Mus musculus
taaagggctccctggaactgcatgg

SEQ ID NO: 746396 - DNA, 25 bp, Mus musculus
taaagggctctgacaacacatttga

SEQ ID NO: 746397 - DNA, 25 bp, Mus musculus
taaagggctctgctttcaagtccct

SEQ ID NO: 746398 - DNA, 25 bp, Mus musculus
taaagggctctggtttcaagtccct

SEQ ID NO: 746399 - DNA, 25 bp, Mus musculus
taaagggctctgtcaacacatttga

SEQ ID NO: 746400 - DNA, 25 bp, Mus musculus
taaagggctgcaagcttattatttt

SEQ ID NO: 746401 - DNA, 25 bp, Mus musculus
taaagggctgcatgcttattatttt

SEQ ID NO: 746402 - DNA, 25 bp, Mus musculus
taaagggcttacacatcacctctgg

SEQ ID NO: 746403 - DNA, 25 bp, Mus musculus
taaagggcttactcatcacctctgg

SEQ ID NO: 746404 - DNA, 25 bp, Mus musculus
taaaggggtgagcacacagcctctg

SEQ ID NO: 746405 - DNA, 25 bp, Mus musculus
taaaggggtgaggacacagcctctg

SEQ ID NO: 746406 - DNA, 25 bp, Mus musculus
taaagggtacataaccaccaccact

SEQ ID NO: 746407 - DNA, 25 bp, Mus musculus
taaagggtacattaccaccaccact

SEQ ID NO: 746408 - DNA, 25 bp, Mus musculus
taaagggtagagctcaagtccaaat

SEQ ID NO: 746409 - DNA, 25 bp, Mus musculus
taaagggtagaggtcaagtccaaat

SEQ ID NO: 746410 - DNA, 25 bp, Mus musculus
taaagggtccaacctccttctctgt

SEQ ID NO: 746411 - DNA, 25 bp, Mus musculus
taaagggtccaagctccttctctgt

SEQ ID NO: 746412 - DNA, 25 bp, Mus musculus
taaagggtgcagaccaatgggtttt

SEQ ID NO: 746413 - DNA, 25 bp, Mus musculus
taaagggtgcagtccaatgggtttt

SEQ ID NO: 746414 - DNA, 25 bp, Mus musculus
taaagggtgggactcagttgtaact

SEQ ID NO: 746415 - DNA, 25 bp, Mus musculus
taaagggtgggagtcagttgtaact

SEQ ID NO: 746416 - DNA, 25 bp, Mus musculus
taaagggttcgtagaccaggaccat

SEQ ID NO: 746417 - DNA, 25 bp, Mus musculus
taaagggttcgttgaccaggaccat

SEQ ID NO: 746418 - DNA, 25 bp, Mus musculus
taaagggttgacaagatgggtgcaa

SEQ ID NO: 746419 - DNA, 25 bp, Mus musculus
taaagggttgactagatgggtgcaa

SEQ ID NO: 746420 - DNA, 25 bp, Mus musculus
taaagggtttgacacgcgctacgac

SEQ ID NO: 746421 - DNA, 25 bp, Mus musculus
taaagggtttgagacgcgctacgac

SEQ ID NO: 746422 - DNA, 25 bp, Mus musculus
taaaggtaaagcctatcacccctcg

SEQ ID NO: 746423 - DNA, 25 bp, Mus musculus
taaaggtaaagcgtatcacccctcg

SEQ ID NO: 746424 - DNA, 25 bp, Mus musculus
taaaggtagactctcactcagctca

SEQ ID NO: 746425 - DNA, 25 bp, Mus musculus
taaaggtagactgtcactcagctca

SEQ ID NO: 746426 - DNA, 25 bp, Mus musculus
taaaggtagattacctcctggtact

SEQ ID NO: 746427 - DNA, 25 bp, Mus musculus
taaaggtagatttcctcctggtact

SEQ ID NO: 746428 - DNA, 25 bp, Mus musculus
taaaggtagcgcaggcgctgaccct

SEQ ID NO: 746429 - DNA, 25 bp, Mus musculus
taaaggtagcgctggcgctgaccct

SEQ ID NO: 746430 - DNA, 25 bp, Mus musculus
taaaggtagcttactgtcaatcaca

SEQ ID NO: 746431 - DNA, 25 bp, Mus musculus
taaaggtagcttaggccacatgcat

SEQ ID NO: 746432 - DNA, 25 bp, Mus musculus
taaaggtagctttctgtcaatcaca

SEQ ID NO: 746433 - DNA, 25 bp, Mus musculus
taaaggtagctttggccacatgcat

SEQ ID NO: 746434 - DNA, 25 bp, Mus musculus
taaaggtatgcccactacacctggc

SEQ ID NO: 746435 - DNA, 25 bp, Mus musculus
taaaggtatgccgactacacctggc

SEQ ID NO: 746436 - DNA, 25 bp, Mus musculus
taaaggtcattgatgttgcctgtgg

SEQ ID NO: 746437 - DNA, 25 bp, Mus musculus
taaaggtcattgttgttgcctgtgg

SEQ ID NO: 746438 - DNA, 25 bp, Mus musculus
taaaggtccaagatcttcctctcca

SEQ ID NO: 746439 - DNA, 25 bp, Mus musculus
taaaggtccaagttcttcctctcca

SEQ ID NO: 746440 - DNA, 25 bp, Mus musculus
taaaggtccattattagtagtacta

SEQ ID NO: 746441 - DNA, 25 bp, Mus musculus
taaaggtccatttttagtagtacta

SEQ ID NO: 746442 - DNA, 25 bp, Mus musculus
taaaggtcccccagagaaacgaatg

SEQ ID NO: 746443 - DNA, 25 bp, Mus musculus
taaaggtccccctgagaaacgaatg

SEQ ID NO: 746444 - DNA, 25 bp, Mus musculus
taaaggtccctacagagcacgtgct

SEQ ID NO: 746445 - DNA, 25 bp, Mus musculus
taaaggtccctagagagcacgtgct

SEQ ID NO: 746446 - DNA, 25 bp, Mus musculus
taaaggtcgaagattttccccagag

SEQ ID NO: 746447 - DNA, 25 bp, Mus musculus
taaaggtcgaagtttttccccagag

SEQ ID NO: 746448 - DNA, 25 bp, Mus musculus
taaaggtcgcaacgcttcgattaaa

SEQ ID NO: 746449 - DNA, 25 bp, Mus musculus
taaaggtcgcaaggcttcgattaaa

SEQ ID NO: 746450 - DNA, 25 bp, Mus musculus
taaaggtcgccaaagcctccatttt

SEQ ID NO: 746451 - DNA, 25 bp, Mus musculus
taaaggtcgccatagcctccatttt

SEQ ID NO: 746452 - DNA, 25 bp, Mus musculus
taaaggtcgctcatctattactcac

SEQ ID NO: 746453 - DNA, 25 bp, Mus musculus
taaaggtcgctcttctattactcac

SEQ ID NO: 746454 - DNA, 25 bp, Mus musculus
taaaggtcggacacactgaagcagt

SEQ ID NO: 746455 - DNA, 25 bp, Mus musculus
taaaggtcggactcactgaagcagt

SEQ ID NO: 746456 - DNA, 25 bp, Mus musculus
taaaggtctcccattgcagttgctc

SEQ ID NO: 746457 - DNA, 25 bp, Mus musculus
taaaggtctccctttgcagttgctc

SEQ ID NO: 746458 - DNA, 25 bp, Mus musculus
taaaggtctcctagtggcacagagg

SEQ ID NO: 746459 - DNA, 25 bp, Mus musculus
taaaggtctcctccgttcatgacta

SEQ ID NO: 746460 - DNA, 25 bp, Mus musculus
taaaggtctcctgcgttcatgacta

SEQ ID NO: 746461 - DNA, 25 bp, Mus musculus
taaaggtctccttgtggcacagagg

SEQ ID NO: 746462 - DNA, 25 bp, Mus musculus
taaaggtctctcaatccctttactc

SEQ ID NO: 746463 - DNA, 25 bp, Mus musculus
taaaggtctctcctaactgctgctg

SEQ ID NO: 746464 - DNA, 25 bp, Mus musculus
taaaggtctctcgtaactgctgctg

SEQ ID NO: 746465 - DNA, 25 bp, Mus musculus
taaaggtctctctatccctttactc

SEQ ID NO: 746466 - DNA, 25 bp, Mus musculus
taaaggtctctgacatggttagatt

SEQ ID NO: 746467 - DNA, 25 bp, Mus musculus
taaaggtctctgtcatggttagatt

SEQ ID NO: 746468 - DNA, 25 bp, Mus musculus
taaaggtcttctatggtggccagga

SEQ ID NO: 746469 - DNA, 25 bp, Mus musculus
taaaggtcttctttggtggccagga

SEQ ID NO: 746470 - DNA, 25 bp, Mus musculus
taaaggtgacgcatgggccaagtac

SEQ ID NO: 746471 - DNA, 25 bp, Mus musculus
taaaggtgacgcttgggccaagtac

SEQ ID NO: 746472 - DNA, 25 bp, Mus musculus
taaaggtgagtgagccagtccctca

SEQ ID NO: 746473 - DNA, 25 bp, Mus musculus
taaaggtgagtgtgccagtccctca

SEQ ID NO: 746474 - DNA, 25 bp, Mus musculus
taaaggtgcaggcacatagttttct

SEQ ID NO: 746475 - DNA, 25 bp, Mus musculus
taaaggtgcagggacatagttttct

SEQ ID NO: 746476 - DNA, 25 bp, Mus musculus
taaaggtgctctcagacagccgaca

SEQ ID NO: 746477 - DNA, 25 bp, Mus musculus
taaaggtgctctgagacagccgaca

SEQ ID NO: 746478 - DNA, 25 bp, Mus musculus
taaaggtgctgcatatctgaagaat

SEQ ID NO: 746479 - DNA, 25 bp, Mus musculus
taaaggtgctgcttatctgaagaat

SEQ ID NO: 746480 - DNA, 25 bp, Mus musculus
taaaggtggggacgcccattcctgc

SEQ ID NO: 746481 - DNA, 25 bp, Mus musculus
taaaggtggggaggcccattcctgc

SEQ ID NO: 746482 - DNA, 25 bp, Mus musculus
taaaggtgtcccctaccactgcccg

SEQ ID NO: 746483 - DNA, 25 bp, Mus musculus
taaaggtgtcccgtaccactgcccg

SEQ ID NO: 746484 - DNA, 25 bp, Mus musculus
taaaggtgtcctaggagttggtgca

SEQ ID NO: 746485 - DNA, 25 bp, Mus musculus
taaaggtgtccttggagttggtgca

SEQ ID NO: 746486 - DNA, 25 bp, Mus musculus
taaaggtgtctaacaggttcccctg

SEQ ID NO: 746487 - DNA, 25 bp, Mus musculus
taaaggtgtctatcaggttcccctg

SEQ ID NO: 746488 - DNA, 25 bp, Mus musculus
taaaggtgtgtaccgtcatccaacc

SEQ ID NO: 746489 - DNA, 25 bp, Mus musculus
taaaggtgtgtagcgtcatccaacc

SEQ ID NO: 746490 - DNA, 25 bp, Mus musculus
taaaggtgtttgctttttcaactgt

SEQ ID NO: 746491 - DNA, 25 bp, Mus musculus
taaaggtgtttggtttttcaactgt

SEQ ID NO: 746492 - DNA, 25 bp, Mus musculus
taaaggttaactctacaagcaatta

SEQ ID NO: 746493 - DNA, 25 bp, Mus musculus
taaaggttaactgtacaagcaatta

SEQ ID NO: 746494 - DNA, 25 bp, Mus musculus
taaaggttcctcagacctggctgaa

SEQ ID NO: 746495 - DNA, 25 bp, Mus musculus
taaaggttcctctgacctggctgaa

SEQ ID NO: 746496 - DNA, 25 bp, Mus musculus
taaaggttctgcactgccagtgttc

SEQ ID NO: 746497 - DNA, 25 bp, Mus musculus
taaaggttctgctctgccagtgttc

SEQ ID NO: 746498 - DNA, 25 bp, Mus musculus
taaaggttctggcttcggccaatct

SEQ ID NO: 746499 - DNA, 25 bp, Mus musculus
taaaggttctgggttcggccaatct

SEQ ID NO: 746500 - DNA, 25 bp, Mus musculus
taaaggttgttactgctgctgggca

SEQ ID NO: 746501 - DNA, 25 bp, Mus musculus
taaaggttgttagtgctgctgggca

SEQ ID NO: 746502 - DNA, 25 bp, Mus musculus
taaaggtttactacaacttcagtgg

SEQ ID NO: 746503 - DNA, 25 bp, Mus musculus
taaaggtttacttcaacttcagtgg

SEQ ID NO: 746504 - DNA, 25 bp, Mus musculus
taaaggtttccacgacgtgtggaga

SEQ ID NO: 746505 - DNA, 25 bp, Mus musculus
taaaggtttccaggacgtgtggaga

SEQ ID NO: 746506 - DNA, 25 bp, Mus musculus
taaaggtttgctctgtgtccacccc

SEQ ID NO: 746507 - DNA, 25 bp, Mus musculus
taaaggtttgctgtgtgtccacccc

SEQ ID NO: 746508 - DNA, 25 bp, Mus musculus
taaagtaaaccaaattcagcatcac

SEQ ID NO: 746509 - DNA, 25 bp, Mus musculus
taaagtaaaccatattcagcatcac

SEQ ID NO: 746510 - DNA, 25 bp, Mus musculus
taaagtaactacactggtggatttt

SEQ ID NO: 746511 - DNA, 25 bp, Mus musculus
taaagtaactactctggtggatttt

SEQ ID NO: 746512 - DNA, 25 bp, Mus musculus
taaagtaactttcctcaaaggacat

SEQ ID NO: 746513 - DNA, 25 bp, Mus musculus
taaagtaactttgctcaaaggacat

SEQ ID NO: 746514 - DNA, 25 bp, Mus musculus
taaagtaagtataaagccccgtgat

SEQ ID NO: 746515 - DNA, 25 bp, Mus musculus
taaagtaagtattaagccccgtgat

SEQ ID NO: 746516 - DNA, 25 bp, Mus musculus
taaagtaatagcaccacctcgccag

SEQ ID NO: 746517 - DNA, 25 bp, Mus musculus
taaagtaatagctccacctcgccag

SEQ ID NO: 746518 - DNA, 25 bp, Mus musculus
taaagtacaaccaaggctcttcgat

SEQ ID NO: 746519 - DNA, 25 bp, Mus musculus
taaagtacaacctaggctcttcgat

SEQ ID NO: 746520 - DNA, 25 bp, Mus musculus
taaagtacaagcatggaagccaggg

SEQ ID NO: 746521 - DNA, 25 bp, Mus musculus
taaagtacaagcttggaagccaggg

SEQ ID NO: 746522 - DNA, 25 bp, Mus musculus
taaagtacataaactgttgcagcat

SEQ ID NO: 746523 - DNA, 25 bp, Mus musculus
taaagtacataatctgttgcagcat

SEQ ID NO: 746524 - DNA, 25 bp, Mus musculus
taaagtaccaggatcctctgcccaa

SEQ ID NO: 746525 - DNA, 25 bp, Mus musculus
taaagtaccaggttcctctgcccaa

SEQ ID NO: 746526 - DNA, 25 bp, Mus musculus
taaagtaccagtactaccccaacat

SEQ ID NO: 746527 - DNA, 25 bp, Mus musculus
taaagtaccagtcctgtggaggaat

SEQ ID NO: 746528 - DNA, 25 bp, Mus musculus
taaagtaccagtgctgtggaggaat

SEQ ID NO: 746529 - DNA, 25 bp, Mus musculus
taaagtaccagttctaccccaacat

SEQ ID NO: 746530 - DNA, 25 bp, Mus musculus
taaagtaccgtgctgcttgagagcc

SEQ ID NO: 746531 - DNA, 25 bp, Mus musculus
taaagtaccgtggtgcttgagagcc

SEQ ID NO: 746532 - DNA, 25 bp, Mus musculus
taaagtaccttgattgcacccactg

SEQ ID NO: 746533 - DNA, 25 bp, Mus musculus
taaagtaccttgtttgcacccactg

SEQ ID NO: 746534 - DNA, 25 bp, Mus musculus
taaagtacttgcagcagcctgccgt

SEQ ID NO: 746535 - DNA, 25 bp, Mus musculus
taaagtacttgctgcagcctgccgt

SEQ ID NO: 746536 - DNA, 25 bp, Mus musculus
taaagtacttgtagcataagcacaa

SEQ ID NO: 746537 - DNA, 25 bp, Mus musculus
taaagtacttgttgcataagcacaa

SEQ ID NO: 746538 - DNA, 25 bp, Mus musculus
taaagtactttgaggtggcttcagt

SEQ ID NO: 746539 - DNA, 25 bp, Mus musculus
taaagtactttgtggtggcttcagt

SEQ ID NO: 746540 - DNA, 25 bp, Mus musculus
taaagtagacagcttggctggagtc

SEQ ID NO: 746541 - DNA, 25 bp, Mus musculus
taaagtagacaggttggctggagtc

SEQ ID NO: 746542 - DNA, 25 bp, Mus musculus
taaagtagaccacctgtaccccaca

SEQ ID NO: 746543 - DNA, 25 bp, Mus musculus
taaagtagaccagctgtaccccaca

SEQ ID NO: 746544 - DNA, 25 bp, Mus musculus
taaagtagataccaggccccagctt

SEQ ID NO: 746545 - DNA, 25 bp, Mus musculus
taaagtagatacgaggccccagctt

SEQ ID NO: 746546 - DNA, 25 bp, Mus musculus
taaagtagccttagcattccatgat

SEQ ID NO: 746547 - DNA, 25 bp, Mus musculus
taaagtagcctttgcattccatgat

SEQ ID NO: 746548 - DNA, 25 bp, Mus musculus
taaagtagctttcctcctaaaccag

SEQ ID NO: 746549 - DNA, 25 bp, Mus musculus
taaagtagctttgctcctaaaccag

SEQ ID NO: 746550 - DNA, 25 bp, Mus musculus
taaagtaggcaccagttcatatttg

SEQ ID NO: 746551 - DNA, 25 bp, Mus musculus
taaagtaggcacgagttcatatttg

SEQ ID NO: 746552 - DNA, 25 bp, Mus musculus
taaagtaggtcgatcctagcccact

SEQ ID NO: 746553 - DNA, 25 bp, Mus musculus
taaagtaggtcgttcctagcccact

SEQ ID NO: 746554 - DNA, 25 bp, Mus musculus
taaagtagtggactccctctacagc

SEQ ID NO: 746555 - DNA, 25 bp, Mus musculus
taaagtagtggagtccctctacagc

SEQ ID NO: 746556 - DNA, 25 bp, Mus musculus
taaagtagtgttctaattccagtgg

SEQ ID NO: 746557 - DNA, 25 bp, Mus musculus
taaagtagtgttgtaattccagtgg

SEQ ID NO: 746558 - DNA, 25 bp, Mus musculus
taaagtatccagaatatctcaggaa

SEQ ID NO: 746559 - DNA, 25 bp, Mus musculus
taaagtatccagtatatctcaggaa

SEQ ID NO: 746560 - DNA, 25 bp, Mus musculus
taaagtatcctaacgggtaccaaat

SEQ ID NO: 746561 - DNA, 25 bp, Mus musculus
taaagtatcctatcgggtaccaaat

SEQ ID NO: 746562 - DNA, 25 bp, Mus musculus
taaagtatcgtcaagccatattggc

SEQ ID NO: 746563 - DNA, 25 bp, Mus musculus
taaagtatcgtctagccatattggc

SEQ ID NO: 746564 - DNA, 25 bp, Mus musculus
taaagtatgactacagtgcaggtga

SEQ ID NO: 746565 - DNA, 25 bp, Mus musculus
taaagtatgacttcagtgcaggtga

SEQ ID NO: 746566 - DNA, 25 bp, Mus musculus
taaagtatgcaacgtagaacaaggg

SEQ ID NO: 746567 - DNA, 25 bp, Mus musculus
taaagtatgcaaggtagaacaaggg

SEQ ID NO: 746568 - DNA, 25 bp, Mus musculus
taaagtatgctaaaccttgcctgct

SEQ ID NO: 746569 - DNA, 25 bp, Mus musculus
taaagtatgctaacccatggtccca

SEQ ID NO: 746570 - DNA, 25 bp, Mus musculus
taaagtatgctataccttgcctgct

SEQ ID NO: 746571 - DNA, 25 bp, Mus musculus
taaagtatgctatcccatggtccca

SEQ ID NO: 746572 - DNA, 25 bp, Mus musculus
taaagtatggctccgctctgtcatc

SEQ ID NO: 746573 - DNA, 25 bp, Mus musculus
taaagtatggctgcgctctgtcatc

SEQ ID NO: 746574 - DNA, 25 bp, Mus musculus
taaagtatgtgccagggctgttgca

SEQ ID NO: 746575 - DNA, 25 bp, Mus musculus
taaagtatgtgcgagggctgttgca

SEQ ID NO: 746576 - DNA, 25 bp, Mus musculus
taaagtattccgcttcgacaagtac

SEQ ID NO: 746577 - DNA, 25 bp, Mus musculus
taaagtattccggttcgacaagtac

SEQ ID NO: 746578 - DNA, 25 bp, Mus musculus
taaagtattgttaagctctgctgaa

SEQ ID NO: 746579 - DNA, 25 bp, Mus musculus
taaagtattgttccgtgtcccttgt

SEQ ID NO: 746580 - DNA, 25 bp, Mus musculus
taaagtattgttgcgtgtcccttgt

SEQ ID NO: 746581 - DNA, 25 bp, Mus musculus
taaagtattgtttagctctgctgaa

SEQ ID NO: 746582 - DNA, 25 bp, Mus musculus
taaagtatttccctttcactcttca

SEQ ID NO: 746583 - DNA, 25 bp, Mus musculus
taaagtatttccgtttcactcttca

SEQ ID NO: 746584 - DNA, 25 bp, Mus musculus
taaagtcaaagcaaagtacaagttc

SEQ ID NO: 746585 - DNA, 25 bp, Mus musculus
taaagtcaaagctaagtacaagttc

SEQ ID NO: 746586 - DNA, 25 bp, Mus musculus
taaagtcaacctccaggtcctcatc

SEQ ID NO: 746587 - DNA, 25 bp, Mus musculus
taaagtcaacctgcaggtcctcatc

SEQ ID NO: 746588 - DNA, 25 bp, Mus musculus
taaagtcaagggattcctgctgttc

SEQ ID NO: 746589 - DNA, 25 bp, Mus musculus
taaagtcaagggtttcctgctgttc

SEQ ID NO: 746590 - DNA, 25 bp, Mus musculus
taaagtcaatggcacagtccctagt

SEQ ID NO: 746591 - DNA, 25 bp, Mus musculus
taaagtcaatgggacagtccctagt

SEQ ID NO: 746592 - DNA, 25 bp, Mus musculus
taaagtcacccacattaagccaaaa

SEQ ID NO: 746593 - DNA, 25 bp, Mus musculus
taaagtcacccagattaagccaaaa

SEQ ID NO: 746594 - DNA, 25 bp, Mus musculus
taaagtcactgaactgctgctgttc

SEQ ID NO: 746595 - DNA, 25 bp, Mus musculus
taaagtcactgatctgctgctgttc

SEQ ID NO: 746596 - DNA, 25 bp, Mus musculus
taaagtcactgtacctcaaatttcc

SEQ ID NO: 746597 - DNA, 25 bp, Mus musculus
taaagtcactgttcctcaaatttcc

SEQ ID NO: 746598 - DNA, 25 bp, Mus musculus
taaagtcaggagattagcagcagac

SEQ ID NO: 746599 - DNA, 25 bp, Mus musculus
taaagtcaggagtttagcagcagac

SEQ ID NO: 746600 - DNA, 25 bp, Mus musculus
taaagtcaggcacgtgtggtcgcct

SEQ ID NO: 746601 - DNA, 25 bp, Mus musculus
taaagtcaggcaggtgtggtcgcct

SEQ ID NO: 746602 - DNA, 25 bp, Mus musculus
taaagtccaaccagctctcgggaag

SEQ ID NO: 746603 - DNA, 25 bp, Mus musculus
taaagtccaacctgctctcgggaag

SEQ ID NO: 746604 - DNA, 25 bp, Mus musculus
taaagtccaagaatcccttcgcaat

SEQ ID NO: 746605 - DNA, 25 bp, Mus musculus
taaagtccaagattcccttcgcaat

SEQ ID NO: 746606 - DNA, 25 bp, Mus musculus
taaagtccagccaattacaaacaaa

SEQ ID NO: 746607 - DNA, 25 bp, Mus musculus
taaagtccagcctattacaaacaaa

SEQ ID NO: 746608 - DNA, 25 bp, Mus musculus
taaagtccatctccaatgccactgt

SEQ ID NO: 746609 - DNA, 25 bp, Mus musculus
taaagtccatctgcaatgccactgt

SEQ ID NO: 746610 - DNA, 25 bp, Mus musculus
taaagtcccatacatcagaccgtgg

SEQ ID NO: 746611 - DNA, 25 bp, Mus musculus
taaagtcccatagatcagaccgtgg

SEQ ID NO: 746612 - DNA, 25 bp, Mus musculus
taaagtcccttaaggatagctgtga

SEQ ID NO: 746613 - DNA, 25 bp, Mus musculus
taaagtcccttatggatagctgtga

SEQ ID NO: 746614 - DNA, 25 bp, Mus musculus
taaagtccctttacgtctcctgaga

SEQ ID NO: 746615 - DNA, 25 bp, Mus musculus
taaagtcccttttcgtctcctgaga

SEQ ID NO: 746616 - DNA, 25 bp, Mus musculus
taaagtccgcctatgctttgttgca

SEQ ID NO: 746617 - DNA, 25 bp, Mus musculus
taaagtccgcctttgctttgttgca

SEQ ID NO: 746618 - DNA, 25 bp, Mus musculus
taaagtccgcgtcattaaatagttc

SEQ ID NO: 746619 - DNA, 25 bp, Mus musculus
taaagtccgcgtgattaaatagttc

SEQ ID NO: 746620 - DNA, 25 bp, Mus musculus
taaagtcctactatcctggctggat

SEQ ID NO: 746621 - DNA, 25 bp, Mus musculus
taaagtcctactttcctggctggat

SEQ ID NO: 746622 - DNA, 25 bp, Mus musculus
taaagtcctcctagagactcggaga

SEQ ID NO: 746623 - DNA, 25 bp, Mus musculus
taaagtcctccttgagactcggaga

SEQ ID NO: 746624 - DNA, 25 bp, Mus musculus
taaagtcctgccaggctttaccttt

SEQ ID NO: 746625 - DNA, 25 bp, Mus musculus
taaagtcctgcctggctttaccttt

SEQ ID NO: 746626 - DNA, 25 bp, Mus musculus
taaagtcctgtcatcttgtacctga

SEQ ID NO: 746627 - DNA, 25 bp, Mus musculus
taaagtcctgtcttcttgtacctga

SEQ ID NO: 746628 - DNA, 25 bp, Mus musculus
taaagtccttggcagcaggacctcc

SEQ ID NO: 746629 - DNA, 25 bp, Mus musculus
taaagtccttgggagcaggacctcc

SEQ ID NO: 746630 - DNA, 25 bp, Mus musculus
taaagtcgaattacaagcccttaag

SEQ ID NO: 746631 - DNA, 25 bp, Mus musculus
taaagtcgaatttcaagcccttaag

SEQ ID NO: 746632 - DNA, 25 bp, Mus musculus
taaagtcgacttcctcttacatttc

SEQ ID NO: 746633 - DNA, 25 bp, Mus musculus
taaagtcgacttgctcttacatttc

SEQ ID NO: 746634 - DNA, 25 bp, Mus musculus
taaagtcgagcaccagtccctctgg

SEQ ID NO: 746635 - DNA, 25 bp, Mus musculus
taaagtcgagcagcagtccctctgg

SEQ ID NO: 746636 - DNA, 25 bp, Mus musculus
taaagtcgatgtatggtcagtgggt

SEQ ID NO: 746637 - DNA, 25 bp, Mus musculus
taaagtcgatgtttggtcagtgggt

SEQ ID NO: 746638 - DNA, 25 bp, Mus musculus
taaagtcggctacctcgggatggat

SEQ ID NO: 746639 - DNA, 25 bp, Mus musculus
taaagtcggctagctcgggatggat

SEQ ID NO: 746640 - DNA, 25 bp, Mus musculus
taaagtctaaaacgtagctgtgtaa

SEQ ID NO: 746641 - DNA, 25 bp, Mus musculus
taaagtctaaaaggtagctgtgtaa

SEQ ID NO: 746642 - DNA, 25 bp, Mus musculus
taaagtctaactcgtcaacaaaaat

SEQ ID NO: 746643 - DNA, 25 bp, Mus musculus
taaagtctaactggtcaacaaaaat

SEQ ID NO: 746644 - DNA, 25 bp, Mus musculus
taaagtctactgacatctgttaatt

SEQ ID NO: 746645 - DNA, 25 bp, Mus musculus
taaagtctactgtcatctgttaatt

SEQ ID NO: 746646 - DNA, 25 bp, Mus musculus
taaagtctccagctctactgatatc

SEQ ID NO: 746647 - DNA, 25 bp, Mus musculus
taaagtctccaggtctactgatatc

SEQ ID NO: 746648 - DNA, 25 bp, Mus musculus
taaagtctccctaggtttatgagtg

SEQ ID NO: 746649 - DNA, 25 bp, Mus musculus
taaagtctcccttggtttatgagtg

SEQ ID NO: 746650 - DNA, 25 bp, Mus musculus
taaagtctccgaaaaggtgaactgt

SEQ ID NO: 746651 - DNA, 25 bp, Mus musculus
taaagtctccgataaggtgaactgt

SEQ ID NO: 746652 - DNA, 25 bp, Mus musculus
taaagtctccgtcccagaactgtat

SEQ ID NO: 746653 - DNA, 25 bp, Mus musculus
taaagtctccgtgccagaactgtat

SEQ ID NO: 746654 - DNA, 25 bp, Mus musculus
taaagtctctagaccttctgtccta

SEQ ID NO: 746655 - DNA, 25 bp, Mus musculus
taaagtctctagtccttctgtccta

SEQ ID NO: 746656 - DNA, 25 bp, Mus musculus
taaagtctctccaggacacttcatt

SEQ ID NO: 746657 - DNA, 25 bp, Mus musculus
taaagtctctcctggacacttcatt

SEQ ID NO: 746658 - DNA, 25 bp, Mus musculus
taaagtctgaaaaccttggtaaagt

SEQ ID NO: 746659 - DNA, 25 bp, Mus musculus
taaagtctgaaatccttggtaaagt

SEQ ID NO: 746660 - DNA, 25 bp, Mus musculus
taaagtctgactccctctgtaatta

SEQ ID NO: 746661 - DNA, 25 bp, Mus musculus
taaagtctgactgcctctgtaatta

SEQ ID NO: 746662 - DNA, 25 bp, Mus musculus
taaagtctggatcctgttctcacat

SEQ ID NO: 746663 - DNA, 25 bp, Mus musculus
taaagtctggatgctgttctcacat

SEQ ID NO: 746664 - DNA, 25 bp, Mus musculus
taaagtctgggtcagtcgtgccttg

SEQ ID NO: 746665 - DNA, 25 bp, Mus musculus
taaagtctgggtgagtcgtgccttg

SEQ ID NO: 746666 - DNA, 25 bp, Mus musculus
taaagtcttagtacacagtttcgtt

SEQ ID NO: 746667 - DNA, 25 bp, Mus musculus
taaagtcttagttcacagtttcgtt

SEQ ID NO: 746668 - DNA, 25 bp, Mus musculus
taaagtcttattctcctgtgcggtt

SEQ ID NO: 746669 - DNA, 25 bp, Mus musculus
taaagtcttattgtcctgtgcggtt

SEQ ID NO: 746670 - DNA, 25 bp, Mus musculus
taaagtcttgctctggtctcttgtt

SEQ ID NO: 746671 - DNA, 25 bp, Mus musculus
taaagtcttgctgtggtctcttgtt

SEQ ID NO: 746672 - DNA, 25 bp, Mus musculus
taaagtgaaagcctacaagagacag

SEQ ID NO: 746673 - DNA, 25 bp, Mus musculus
taaagtgaaagcgtacaagagacag

SEQ ID NO: 746674 - DNA, 25 bp, Mus musculus
taaagtgaaggaccccagcaccaag

SEQ ID NO: 746675 - DNA, 25 bp, Mus musculus
taaagtgaaggagcccagcaccaag

SEQ ID NO: 746676 - DNA, 25 bp, Mus musculus
taaagtgaatttctctccctgcagc

SEQ ID NO: 746677 - DNA, 25 bp, Mus musculus
taaagtgaatttgtctccctgcagc

SEQ ID NO: 746678 - DNA, 25 bp, Mus musculus
taaagtgacagtcgacggtccccgg

SEQ ID NO: 746679 - DNA, 25 bp, Mus musculus
taaagtgacagtggacggtccccgg

SEQ ID NO: 746680 - DNA, 25 bp, Mus musculus
taaagtgacatgaacaataggatat

SEQ ID NO: 746681 - DNA, 25 bp, Mus musculus
taaagtgacatgtacaataggatat

SEQ ID NO: 746682 - DNA, 25 bp, Mus musculus
taaagtgaccaaccttgttgcctca

SEQ ID NO: 746683 - DNA, 25 bp, Mus musculus
taaagtgaccaagcttgttgcctca

SEQ ID NO: 746684 - DNA, 25 bp, Mus musculus
taaagtgacccaccacttttctaga

SEQ ID NO: 746685 - DNA, 25 bp, Mus musculus
taaagtgacccagcacttttctaga

SEQ ID NO: 746686 - DNA, 25 bp, Mus musculus
taaagtgactggctgttgcccacac

SEQ ID NO: 746687 - DNA, 25 bp, Mus musculus
taaagtgactgggtgttgcccacac

SEQ ID NO: 746688 - DNA, 25 bp, Mus musculus
taaagtgactttccctcatgaggag

SEQ ID NO: 746689 - DNA, 25 bp, Mus musculus
taaagtgactttgcctcatgaggag

SEQ ID NO: 746690 - DNA, 25 bp, Mus musculus
taaagtgaggacatcaggccctgga

SEQ ID NO: 746691 - DNA, 25 bp, Mus musculus
taaagtgaggacttcaggccctgga

SEQ ID NO: 746692 - DNA, 25 bp, Mus musculus
taaagtgatgttcgcctgggcttat

SEQ ID NO: 746693 - DNA, 25 bp, Mus musculus
taaagtgatgttggcctgggcttat

SEQ ID NO: 746694 - DNA, 25 bp, Mus musculus
taaagtgattttccctggtgttttg

SEQ ID NO: 746695 - DNA, 25 bp, Mus musculus
taaagtgattttgcctggtgttttg

SEQ ID NO: 746696 - DNA, 25 bp, Mus musculus
taaagtgcgcaactgcaataattta

SEQ ID NO: 746697 - DNA, 25 bp, Mus musculus
taaagtgcgcaagtgcaataattta

SEQ ID NO: 746698 - DNA, 25 bp, Mus musculus
taaagtgcgcgtcggccaggagacc

SEQ ID NO: 746699 - DNA, 25 bp, Mus musculus
taaagtgcgcgtgggccaggagacc

SEQ ID NO: 746700 - DNA, 25 bp, Mus musculus
taaagtgcggatcccagttcacact

SEQ ID NO: 746701 - DNA, 25 bp, Mus musculus
taaagtgcggatgccagttcacact

SEQ ID NO: 746702 - DNA, 25 bp, Mus musculus
taaagtgcgtgcagatcgcgctaca

SEQ ID NO: 746703 - DNA, 25 bp, Mus musculus
taaagtgcgtgctgatcgcgctaca

SEQ ID NO: 746704 - DNA, 25 bp, Mus musculus
taaagtgctaccatgccaagccaga

SEQ ID NO: 746705 - DNA, 25 bp, Mus musculus
taaagtgctaccttgccaagccaga

SEQ ID NO: 746706 - DNA, 25 bp, Mus musculus
taaagtgctttcaagccgggcagtg

SEQ ID NO: 746707 - DNA, 25 bp, Mus musculus
taaagtgctttctagccgggcagtg

SEQ ID NO: 746708 - DNA, 25 bp, Mus musculus
taaagtgctttgagagccagctccc

SEQ ID NO: 746709 - DNA, 25 bp, Mus musculus
taaagtgctttgtgagccagctccc

SEQ ID NO: 746710 - DNA, 25 bp, Mus musculus
taaagtggacagcaatctctagtaa

SEQ ID NO: 746711 - DNA, 25 bp, Mus musculus
taaagtggacaggaatctctagtaa

SEQ ID NO: 746712 - DNA, 25 bp, Mus musculus
taaagtggagaaatccatggctttt

SEQ ID NO: 746713 - DNA, 25 bp, Mus musculus
taaagtggagaattccatggctttt

SEQ ID NO: 746714 - DNA, 25 bp, Mus musculus
taaagtggccccatcagctgtgctg

SEQ ID NO: 746715 - DNA, 25 bp, Mus musculus
taaagtggccccttcagctgtgctg

SEQ ID NO: 746716 - DNA, 25 bp, Mus musculus
taaagtgggtccattgcctggaact

SEQ ID NO: 746717 - DNA, 25 bp, Mus musculus
taaagtgggtcctttgcctggaact

SEQ ID NO: 746718 - DNA, 25 bp, Mus musculus
taaagtgggttcaatctctgcccaa

SEQ ID NO: 746719 - DNA, 25 bp, Mus musculus
taaagtgggttctatctctgcccaa

SEQ ID NO: 746720 - DNA, 25 bp, Mus musculus
taaagtggtaatctccctccaacta

SEQ ID NO: 746721 - DNA, 25 bp, Mus musculus
taaagtggtaatgtccctccaacta

SEQ ID NO: 746722 - DNA, 25 bp, Mus musculus
taaagtggtctgcactgcttgctcc

SEQ ID NO: 746723 - DNA, 25 bp, Mus musculus
taaagtggtctggactgcttgctcc

SEQ ID NO: 746724 - DNA, 25 bp, Mus musculus
taaagtggtggtaccttggctgacc

SEQ ID NO: 746725 - DNA, 25 bp, Mus musculus
taaagtggtggttccttggctgacc

SEQ ID NO: 746726 - DNA, 25 bp, Mus musculus
taaagtgtacggagcttcataatac

SEQ ID NO: 746727 - DNA, 25 bp, Mus musculus
taaagtgtacggtgcttcataatac

SEQ ID NO: 746728 - DNA, 25 bp, Mus musculus
taaagtgtagccaagcccttcaaga

SEQ ID NO: 746729 - DNA, 25 bp, Mus musculus
taaagtgtagcctagcccttcaaga

SEQ ID NO: 746730 - DNA, 25 bp, Mus musculus
taaagtgtatctaccttggctgtct

SEQ ID NO: 746731 - DNA, 25 bp, Mus musculus
taaagtgtatcttccttggctgtct

SEQ ID NO: 746732 - DNA, 25 bp, Mus musculus
taaagtgtcagtagcacagctccgt

SEQ ID NO: 746733 - DNA, 25 bp, Mus musculus
taaagtgtcagttgcacagctccgt

SEQ ID NO: 746734 - DNA, 25 bp, Mus musculus
taaagtgtccttagtgtatatgccc

SEQ ID NO: 746735 - DNA, 25 bp, Mus musculus
taaagtgtcctttgtgtatatgccc

SEQ ID NO: 746736 - DNA, 25 bp, Mus musculus
taaagtgtctagctttaccctgcaa

SEQ ID NO: 746737 - DNA, 25 bp, Mus musculus
taaagtgtctaggtttaccctgcaa

SEQ ID NO: 746738 - DNA, 25 bp, Mus musculus
taaagtgtctcaaaccaccagttct

SEQ ID NO: 746739 - DNA, 25 bp, Mus musculus
taaagtgtctcataccaccagttct

SEQ ID NO: 746740 - DNA, 25 bp, Mus musculus
taaagtgttagcagtgatagcctct

SEQ ID NO: 746741 - DNA, 25 bp, Mus musculus
taaagtgttagctgtgatagcctct

SEQ ID NO: 746742 - DNA, 25 bp, Mus musculus
taaagtgttatacagatccctcccc

SEQ ID NO: 746743 - DNA, 25 bp, Mus musculus
taaagtgttatagagatccctcccc

SEQ ID NO: 746744 - DNA, 25 bp, Mus musculus
taaagtgttggtcctttggtgcaaa

SEQ ID NO: 746745 - DNA, 25 bp, Mus musculus
taaagtgttggtgctttggtgcaaa

SEQ ID NO: 746746 - DNA, 25 bp, Mus musculus
taaagtgtttctcttccttgtgatt

SEQ ID NO: 746747 - DNA, 25 bp, Mus musculus
taaagtgtttctgttccttgtgatt

SEQ ID NO: 746748 - DNA, 25 bp, Mus musculus
taaagttaaaccatccaatccctca

SEQ ID NO: 746749 - DNA, 25 bp, Mus musculus
taaagttaaaccttccaatccctca

SEQ ID NO: 746750 - DNA, 25 bp, Mus musculus
taaagttaagccctttcacctgcta

SEQ ID NO: 746751 - DNA, 25 bp, Mus musculus
taaagttaagccgtttcacctgcta

SEQ ID NO: 746752 - DNA, 25 bp, Mus musculus
taaagttacaataagccttctgttt

SEQ ID NO: 746753 - DNA, 25 bp, Mus musculus
taaagttacaattagccttctgttt

SEQ ID NO: 746754 - DNA, 25 bp, Mus musculus
taaagttacagcctattcaaagaga

SEQ ID NO: 746755 - DNA, 25 bp, Mus musculus
taaagttacagcgtattcaaagaga

SEQ ID NO: 746756 - DNA, 25 bp, Mus musculus
taaagttactcaaacagaagtgtac

SEQ ID NO: 746757 - DNA, 25 bp, Mus musculus
taaagttactcatacagaagtgtac

SEQ ID NO: 746758 - DNA, 25 bp, Mus musculus
taaagttaggacctgggaccgcctg

SEQ ID NO: 746759 - DNA, 25 bp, Mus musculus
taaagttaggacgtgggaccgcctg

SEQ ID NO: 746760 - DNA, 25 bp, Mus musculus
taaagttatcttactgcccgaatgt

SEQ ID NO: 746761 - DNA, 25 bp, Mus musculus
taaagttatctttctgcccgaatgt

SEQ ID NO: 746762 - DNA, 25 bp, Mus musculus
taaagttatggtcccggaagctcct

SEQ ID NO: 746763 - DNA, 25 bp, Mus musculus
taaagttatggtgccggaagctcct

SEQ ID NO: 746764 - DNA, 25 bp, Mus musculus
taaagttatgtcattatccccattt

SEQ ID NO: 746765 - DNA, 25 bp, Mus musculus
taaagttatgtctttatccccattt

SEQ ID NO: 746766 - DNA, 25 bp, Mus musculus
taaagttattctaatggctatttgt

SEQ ID NO: 746767 - DNA, 25 bp, Mus musculus
taaagttattcttatggctatttgt

SEQ ID NO: 746768 - DNA, 25 bp, Mus musculus
taaagttcagtgaatgtttccctca

SEQ ID NO: 746769 - DNA, 25 bp, Mus musculus
taaagttcagtgtatgtttccctca

SEQ ID NO: 746770 - DNA, 25 bp, Mus musculus
taaagttcatcgcttctgcagtcag

SEQ ID NO: 746771 - DNA, 25 bp, Mus musculus
taaagttcatcggttctgcagtcag

SEQ ID NO: 746772 - DNA, 25 bp, Mus musculus
taaagttcatctcacttcccagatt

SEQ ID NO: 746773 - DNA, 25 bp, Mus musculus
taaagttcatctgacttcccagatt

SEQ ID NO: 746774 - DNA, 25 bp, Mus musculus
taaagttccaatatcccccatgaca

SEQ ID NO: 746775 - DNA, 25 bp, Mus musculus
taaagttccaatttcccccatgaca

SEQ ID NO: 746776 - DNA, 25 bp, Mus musculus
taaagttctccactagctgactcta

SEQ ID NO: 746777 - DNA, 25 bp, Mus musculus
taaagttctccagtagctgactcta

SEQ ID NO: 746778 - DNA, 25 bp, Mus musculus
taaagttctgatattttcactaatg

SEQ ID NO: 746779 - DNA, 25 bp, Mus musculus
taaagttctgattttttcactaatg

SEQ ID NO: 746780 - DNA, 25 bp, Mus musculus
taaagttcttcacctgtactcgtcc

SEQ ID NO: 746781 - DNA, 25 bp, Mus musculus
taaagttcttcagctgtactcgtcc

SEQ ID NO: 746782 - DNA, 25 bp, Mus musculus
taaagttcttgtagtgaccctgtca

SEQ ID NO: 746783 - DNA, 25 bp, Mus musculus
taaagttcttgttgtgaccctgtca

SEQ ID NO: 746784 - DNA, 25 bp, Mus musculus
taaagttctttactctcagggttgg

SEQ ID NO: 746785 - DNA, 25 bp, Mus musculus
taaagttctttagtctcagggttgg

SEQ ID NO: 746786 - DNA, 25 bp, Mus musculus
taaagttgaagcatccagggccagt

SEQ ID NO: 746787 - DNA, 25 bp, Mus musculus
taaagttgaagcttccagggccagt

SEQ ID NO: 746788 - DNA, 25 bp, Mus musculus
taaagttgagctcccttttcttatg

SEQ ID NO: 746789 - DNA, 25 bp, Mus musculus
taaagttgagctctggtttattttt

SEQ ID NO: 746790 - DNA, 25 bp, Mus musculus
taaagttgagctgccttttcttatg

SEQ ID NO: 746791 - DNA, 25 bp, Mus musculus
taaagttgagctgtggtttattttt

SEQ ID NO: 746792 - DNA, 25 bp, Mus musculus
taaagttgcattcgctggtctcttg

SEQ ID NO: 746793 - DNA, 25 bp, Mus musculus
taaagttgcattggctggtctcttg

SEQ ID NO: 746794 - DNA, 25 bp, Mus musculus
taaagttgccaccaaaaggaagtat

SEQ ID NO: 746795 - DNA, 25 bp, Mus musculus
taaagttgccacgaaaaggaagtat

SEQ ID NO: 746796 - DNA, 25 bp, Mus musculus
taaagttgctcactctccagtacac

SEQ ID NO: 746797 - DNA, 25 bp, Mus musculus
taaagttgctcagtctccagtacac

SEQ ID NO: 746798 - DNA, 25 bp, Mus musculus
taaagttggacaagctccctatctc

SEQ ID NO: 746799 - DNA, 25 bp, Mus musculus
taaagttggacatgctccctatctc

SEQ ID NO: 746800 - DNA, 25 bp, Mus musculus
taaagttggactccgcaaagcctct

SEQ ID NO: 746801 - DNA, 25 bp, Mus musculus
taaagttggactgcgcaaagcctct

SEQ ID NO: 746802 - DNA, 25 bp, Mus musculus
taaagttggcctacttttgttgagt

SEQ ID NO: 746803 - DNA, 25 bp, Mus musculus
taaagttggccttcttttgttgagt

SEQ ID NO: 746804 - DNA, 25 bp, Mus musculus
taaagttggctacaccttgtttggg

SEQ ID NO: 746805 - DNA, 25 bp, Mus musculus
taaagttggctagaccttgtttggg

SEQ ID NO: 746806 - DNA, 25 bp, Mus musculus
taaagttgggccacaggtcctgctg

SEQ ID NO: 746807 - DNA, 25 bp, Mus musculus
taaagttgggcctcaggtcctgctg

SEQ ID NO: 746808 - DNA, 25 bp, Mus musculus
taaagttgtgcactcccacacccat

SEQ ID NO: 746809 - DNA, 25 bp, Mus musculus
taaagttgtgcagtcccacacccat

SEQ ID NO: 746810 - DNA, 25 bp, Mus musculus
taaagttgttgcctactatctagaa

SEQ ID NO: 746811 - DNA, 25 bp, Mus musculus
taaagttgttgcgtactatctagaa

SEQ ID NO: 746812 - DNA, 25 bp, Mus musculus
taaagttgtttccttctacctcacg

SEQ ID NO: 746813 - DNA, 25 bp, Mus musculus
taaagttgtttcgttctacctcacg

SEQ ID NO: 746814 - DNA, 25 bp, Mus musculus
taaagtttaacacctctgaaaatga

SEQ ID NO: 746815 - DNA, 25 bp, Mus musculus
taaagtttaacagctctgaaaatga

SEQ ID NO: 746816 - DNA, 25 bp, Mus musculus
taaagtttactccagtatgttaatg

SEQ ID NO: 746817 - DNA, 25 bp, Mus musculus
taaagtttactcgagtatgttaatg

SEQ ID NO: 746818 - DNA, 25 bp, Mus musculus
taaagtttccagctaataccagtaa

SEQ ID NO: 746819 - DNA, 25 bp, Mus musculus
taaagtttccaggtaataccagtaa

SEQ ID NO: 746820 - DNA, 25 bp, Mus musculus
taaagtttctctaccattctggcgc

SEQ ID NO: 746821 - DNA, 25 bp, Mus musculus
taaagtttctcttccattctggcgc

SEQ ID NO: 746822 - DNA, 25 bp, Mus musculus
taaagtttctggagttcgactggaa

SEQ ID NO: 746823 - DNA, 25 bp, Mus musculus
taaagtttctggtgttcgactggaa

SEQ ID NO: 746824 - DNA, 25 bp, Mus musculus
taaagtttgaacatcctcatgtcag

SEQ ID NO: 746825 - DNA, 25 bp, Mus musculus
taaagtttgaacttcctcatgtcag

SEQ ID NO: 746826 - DNA, 25 bp, Mus musculus
taaagtttgcagctcaatggatgag

SEQ ID NO: 746827 - DNA, 25 bp, Mus musculus
taaagtttgcaggtcaatggatgag

SEQ ID NO: 746828 - DNA, 25 bp, Mus musculus
taaagtttgcttccggctcccaagg

SEQ ID NO: 746829 - DNA, 25 bp, Mus musculus
taaagtttgcttgcggctcccaagg

SEQ ID NO: 746830 - DNA, 25 bp, Mus musculus
taaagttttaatctctctgtaagca

SEQ ID NO: 746831 - DNA, 25 bp, Mus musculus
taaagttttaatgtctctgtaagca

SEQ ID NO: 746832 - DNA, 25 bp, Mus musculus
taaataaaaccaccgtcctccaact

SEQ ID NO: 746833 - DNA, 25 bp, Mus musculus
taaataaaaccagcgtcctccaact

SEQ ID NO: 746834 - DNA, 25 bp, Mus musculus
taaataaaacttcccctagcactgt

SEQ ID NO: 746835 - DNA, 25 bp, Mus musculus
taaataaaacttgccctagcactgt

SEQ ID NO: 746836 - DNA, 25 bp, Mus musculus
taaataaacagcacgcttccacgag

SEQ ID NO: 746837 - DNA, 25 bp, Mus musculus
taaataaacagctcgcttccacgag

SEQ ID NO: 746838 - DNA, 25 bp, Mus musculus
taaataaaccagcatcgtgccgccc

SEQ ID NO: 746839 - DNA, 25 bp, Mus musculus
taaataaaccaggatcgtgccgccc

SEQ ID NO: 746840 - DNA, 25 bp, Mus musculus
taaataaaccatcctgtaccaaggg

SEQ ID NO: 746841 - DNA, 25 bp, Mus musculus
taaataaaccatgctgtaccaaggg

SEQ ID NO: 746842 - DNA, 25 bp, Mus musculus
taaataaaccgccaatcaacttcag

SEQ ID NO: 746843 - DNA, 25 bp, Mus musculus
taaataaaccgcgaatcaacttcag

SEQ ID NO: 746844 - DNA, 25 bp, Mus musculus
taaataaacttgctggccttagata

SEQ ID NO: 746845 - DNA, 25 bp, Mus musculus
taaataaacttggtggccttagata

SEQ ID NO: 746846 - DNA, 25 bp, Mus musculus
taaataaagactctttggtgcccat

SEQ ID NO: 746847 - DNA, 25 bp, Mus musculus
taaataaagactgtttggtgcccat

SEQ ID NO: 746848 - DNA, 25 bp, Mus musculus
taaataaagcataaatcccgggagg

SEQ ID NO: 746849 - DNA, 25 bp, Mus musculus
taaataaagcattaatcccgggagg

SEQ ID NO: 746850 - DNA, 25 bp, Mus musculus
taaataaagcctccggtggcctgcc

SEQ ID NO: 746851 - DNA, 25 bp, Mus musculus
taaataaagcctgcggtggcctgcc

SEQ ID NO: 746852 - DNA, 25 bp, Mus musculus
taaataaagtacactgtggtcattt

SEQ ID NO: 746853 - DNA, 25 bp, Mus musculus
taaataaagtactctgtggtcattt

SEQ ID NO: 746854 - DNA, 25 bp, Mus musculus
taaataaccctaccagcttttctgg

SEQ ID NO: 746855 - DNA, 25 bp, Mus musculus
taaataaccctagcagcttttctgg

SEQ ID NO: 746856 - DNA, 25 bp, Mus musculus
taaataacctatatggatcctggtc

SEQ ID NO: 746857 - DNA, 25 bp, Mus musculus
taaataacctatttggatcctggtc

SEQ ID NO: 746858 - DNA, 25 bp, Mus musculus
taaataacgtgaacagcccggccga

SEQ ID NO: 746859 - DNA, 25 bp, Mus musculus
taaataacgtgatcagcccggccga

SEQ ID NO: 746860 - DNA, 25 bp, Mus musculus
taaataactccacatgcattttccc

SEQ ID NO: 746861 - DNA, 25 bp, Mus musculus
taaataactccagatgcattttccc

SEQ ID NO: 746862 - DNA, 25 bp, Mus musculus
taaataactgaaatttccaccgtgg

SEQ ID NO: 746863 - DNA, 25 bp, Mus musculus
taaataactgaattttccaccgtgg

SEQ ID NO: 746864 - DNA, 25 bp, Mus musculus
taaataagcactatcccataaacaa

SEQ ID NO: 746865 - DNA, 25 bp, Mus musculus
taaataagcactttcccataaacaa

SEQ ID NO: 746866 - DNA, 25 bp, Mus musculus
taaataagcctaagggactctacaa

SEQ ID NO: 746867 - DNA, 25 bp, Mus musculus
taaataagcctatgggactctacaa

SEQ ID NO: 746868 - DNA, 25 bp, Mus musculus
taaataaggactctgcttgccccaa

SEQ ID NO: 746869 - DNA, 25 bp, Mus musculus
taaataaggactgtgcttgccccaa

SEQ ID NO: 746870 - DNA, 25 bp, Mus musculus
taaataagggccctcccataggact

SEQ ID NO: 746871 - DNA, 25 bp, Mus musculus
taaataagggccgtcccataggact

SEQ ID NO: 746872 - DNA, 25 bp, Mus musculus
taaataatcctaactgtctttgctg

SEQ ID NO: 746873 - DNA, 25 bp, Mus musculus
taaataatcctatctgtctttgctg

SEQ ID NO: 746874 - DNA, 25 bp, Mus musculus
taaataatctggagaggtccacaaa

SEQ ID NO: 746875 - DNA, 25 bp, Mus musculus
taaataatctggtgaggtccacaaa

SEQ ID NO: 746876 - DNA, 25 bp, Mus musculus
taaataatttgcagtgtcctgtgag

SEQ ID NO: 746877 - DNA, 25 bp, Mus musculus
taaataatttgctgtgtcctgtgag

SEQ ID NO: 746878 - DNA, 25 bp, Mus musculus
taaatacaaattatcctggcttgcc

SEQ ID NO: 746879 - DNA, 25 bp, Mus musculus
taaatacaaattttcctggcttgcc

SEQ ID NO: 746880 - DNA, 25 bp, Mus musculus
taaatacaacctcttcagccttctc

SEQ ID NO: 746881 - DNA, 25 bp, Mus musculus
taaatacaacctgttcagccttctc

SEQ ID NO: 746882 - DNA, 25 bp, Mus musculus
taaatacaacgcctgccacgtggtt

SEQ ID NO: 746883 - DNA, 25 bp, Mus musculus
taaatacaacgcgtgccacgtggtt

SEQ ID NO: 746884 - DNA, 25 bp, Mus musculus
taaatacaactcattcctacactag

SEQ ID NO: 746885 - DNA, 25 bp, Mus musculus
taaatacaactctttcctacactag

SEQ ID NO: 746886 - DNA, 25 bp, Mus musculus
taaatacacacaacagccaaaccgc

SEQ ID NO: 746887 - DNA, 25 bp, Mus musculus
taaatacacacatcagccaaaccgc

SEQ ID NO: 746888 - DNA, 25 bp, Mus musculus
taaatacacatcactagccaggcag

SEQ ID NO: 746889 - DNA, 25 bp, Mus musculus
taaatacacatctctagccaggcag

SEQ ID NO: 746890 - DNA, 25 bp, Mus musculus
taaatacaggcacagcttggtccct

SEQ ID NO: 746891 - DNA, 25 bp, Mus musculus
taaatacaggcagagcttggtccct

SEQ ID NO: 746892 - DNA, 25 bp, Mus musculus
taaatacatagtcactggctcaggg

SEQ ID NO: 746893 - DNA, 25 bp, Mus musculus
taaatacatagtgactggctcaggg

SEQ ID NO: 746894 - DNA, 25 bp, Mus musculus
taaatacatggtactggcatacaat

SEQ ID NO: 746895 - DNA, 25 bp, Mus musculus
taaatacatggttctggcatacaat

SEQ ID NO: 746896 - DNA, 25 bp, Mus musculus
taaatacattgaactgggccaccgt

SEQ ID NO: 746897 - DNA, 25 bp, Mus musculus
taaatacattgatctgggccaccgt

SEQ ID NO: 746898 - DNA, 25 bp, Mus musculus
taaataccaagccttgccgtggcaa

SEQ ID NO: 746899 - DNA, 25 bp, Mus musculus
taaataccaagcgttgccgtggcaa

SEQ ID NO: 746900 - DNA, 25 bp, Mus musculus
taaataccatctatgccctcccatt

SEQ ID NO: 746901 - DNA, 25 bp, Mus musculus
taaataccatctttgccctcccatt

SEQ ID NO: 746902 - DNA, 25 bp, Mus musculus
taaatacccaccacggaaagacttg

SEQ ID NO: 746903 - DNA, 25 bp, Mus musculus
taaatacccacctcggaaagacttg

SEQ ID NO: 746904 - DNA, 25 bp, Mus musculus
taaataccttgaataaaacccagtg

SEQ ID NO: 746905 - DNA, 25 bp, Mus musculus
taaataccttgattaaaacccagtg

SEQ ID NO: 746906 - DNA, 25 bp, Mus musculus
taaatacgactcacaatccaccttt

SEQ ID NO: 746907 - DNA, 25 bp, Mus musculus
taaatacgactctcaatccaccttt

SEQ ID NO: 746908 - DNA, 25 bp, Mus musculus
taaatacgttgactgacctcatggg

SEQ ID NO: 746909 - DNA, 25 bp, Mus musculus
taaatacgttgagtgacctcatggg

SEQ ID NO: 746910 - DNA, 25 bp, Mus musculus
taaatactgaagatccaaactagag

SEQ ID NO: 746911 - DNA, 25 bp, Mus musculus
taaatactgaagttccaaactagag

SEQ ID NO: 746912 - DNA, 25 bp, Mus musculus
taaatactgggtatctcggagtttg

SEQ ID NO: 746913 - DNA, 25 bp, Mus musculus
taaatactgggtttctcggagtttg

SEQ ID NO: 746914 - DNA, 25 bp, Mus musculus
taaatactgtctacccagctgagcc

SEQ ID NO: 746915 - DNA, 25 bp, Mus musculus
taaatactgtcttcccagctgagcc

SEQ ID NO: 746916 - DNA, 25 bp, Mus musculus
taaatactgtgccaggctgtggcct

SEQ ID NO: 746917 - DNA, 25 bp, Mus musculus
taaatactgtgcgaggctgtggcct

SEQ ID NO: 746918 - DNA, 25 bp, Mus musculus
taaatactgttcaactctcctctgg

SEQ ID NO: 746919 - DNA, 25 bp, Mus musculus
taaatactgttctactctcctctgg

SEQ ID NO: 746920 - DNA, 25 bp, Mus musculus
taaatacttccccagtgctgcttat

SEQ ID NO: 746921 - DNA, 25 bp, Mus musculus
taaatacttcccgagtgctgcttat

SEQ ID NO: 746922 - DNA, 25 bp, Mus musculus
taaatacttggtaacttactctgaa

SEQ ID NO: 746923 - DNA, 25 bp, Mus musculus
taaatacttggttacttactctgaa

SEQ ID NO: 746924 - DNA, 25 bp, Mus musculus
taaatagacccaccttccctatagt

SEQ ID NO: 746925 - DNA, 25 bp, Mus musculus
taaatagacccagcttccctatagt

SEQ ID NO: 746926 - DNA, 25 bp, Mus musculus
taaatagatgctccgtctaggctgg

SEQ ID NO: 746927 - DNA, 25 bp, Mus musculus
taaatagatgctgcgtctaggctgg

SEQ ID NO: 746928 - DNA, 25 bp, Mus musculus
taaatagcatatatctggcccaaat

SEQ ID NO: 746929 - DNA, 25 bp, Mus musculus
taaatagcatatttctggcccaaat

SEQ ID NO: 746930 - DNA, 25 bp, Mus musculus
taaatagccattccattacatctag

SEQ ID NO: 746931 - DNA, 25 bp, Mus musculus
taaatagccattgcattacatctag

SEQ ID NO: 746932 - DNA, 25 bp, Mus musculus
taaatagccgaaagccgtccaggtc

SEQ ID NO: 746933 - DNA, 25 bp, Mus musculus
taaatagccgaatgccgtccaggtc

SEQ ID NO: 746934 - DNA, 25 bp, Mus musculus
taaatagccgctcgaaaacgagacg

SEQ ID NO: 746935 - DNA, 25 bp, Mus musculus
taaatagccgctggaaaacgagacg

SEQ ID NO: 746936 - DNA, 25 bp, Mus musculus
taaatagctaatcggaacttgtata

SEQ ID NO: 746937 - DNA, 25 bp, Mus musculus
taaatagctaatgggaacttgtata

SEQ ID NO: 746938 - DNA, 25 bp, Mus musculus
taaatagctgctagtctgcctggtc

SEQ ID NO: 746939 - DNA, 25 bp, Mus musculus
taaatagctgcttgtctgcctggtc

SEQ ID NO: 746940 - DNA, 25 bp, Mus musculus
taaatagctggacgtttctctctcc

SEQ ID NO: 746941 - DNA, 25 bp, Mus musculus
taaatagctggaggtttctctctcc

SEQ ID NO: 746942 - DNA, 25 bp, Mus musculus
taaatagctttccaccttggagaag

SEQ ID NO: 746943 - DNA, 25 bp, Mus musculus
taaatagctttcgaccttggagaag

SEQ ID NO: 746944 - DNA, 25 bp, Mus musculus
taaataggaccacctcttcgaacac

SEQ ID NO: 746945 - DNA, 25 bp, Mus musculus
taaataggaccagctcttcgaacac

SEQ ID NO: 746946 - DNA, 25 bp, Mus musculus
taaataggagatatcagccaccgtc

SEQ ID NO: 746947 - DNA, 25 bp, Mus musculus
taaataggagatttcagccaccgtc

SEQ ID NO: 746948 - DNA, 25 bp, Mus musculus
taaataggagccagcctgaaataat

SEQ ID NO: 746949 - DNA, 25 bp, Mus musculus
taaataggagcctgcctgaaataat

SEQ ID NO: 746950 - DNA, 25 bp, Mus musculus
taaataggctctaggtttgttttgt

SEQ ID NO: 746951 - DNA, 25 bp, Mus musculus
taaataggctcttggtttgttttgt

SEQ ID NO: 746952 - DNA, 25 bp, Mus musculus
taaatagtagctactgttcacaggg

SEQ ID NO: 746953 - DNA, 25 bp, Mus musculus
taaatagtagcttctgttcacaggg

SEQ ID NO: 746954 - DNA, 25 bp, Mus musculus
taaatagtcactctttgctcttcac

SEQ ID NO: 746955 - DNA, 25 bp, Mus musculus
taaatagtcactgtttgctcttcac

SEQ ID NO: 746956 - DNA, 25 bp, Mus musculus
taaatagtggctacaggagctcttt

SEQ ID NO: 746957 - DNA, 25 bp, Mus musculus
taaatagtggcttcaggagctcttt

SEQ ID NO: 746958 - DNA, 25 bp, Mus musculus
taaatagtttctcggtccttcctgg

SEQ ID NO: 746959 - DNA, 25 bp, Mus musculus
taaatagtttctgggtccttcctgg

SEQ ID NO: 746960 - DNA, 25 bp, Mus musculus
taaatataagctctgatgtgatcga

SEQ ID NO: 746961 - DNA, 25 bp, Mus musculus
taaatataagctgtgatgtgatcga

SEQ ID NO: 746962 - DNA, 25 bp, Mus musculus
taaatataccctataagcctcagac

SEQ ID NO: 746963 - DNA, 25 bp, Mus musculus
taaatataccctcttggctatctgt

SEQ ID NO: 746964 - DNA, 25 bp, Mus musculus
taaatataccctgttggctatctgt

SEQ ID NO: 746965 - DNA, 25 bp, Mus musculus
taaatataccctttaagcctcagac

SEQ ID NO: 746966 - DNA, 25 bp, Mus musculus
taaatatagcaaccctcacccaggt

SEQ ID NO: 746967 - DNA, 25 bp, Mus musculus
taaatatagcaagcctcacccaggt

SEQ ID NO: 746968 - DNA, 25 bp, Mus musculus
taaatatagtacacctgagacctcc

SEQ ID NO: 746969 - DNA, 25 bp, Mus musculus
taaatatagtactcctgagacctcc

SEQ ID NO: 746970 - DNA, 25 bp, Mus musculus
taaatatagttgacctaagagccag

SEQ ID NO: 746971 - DNA, 25 bp, Mus musculus
taaatatagttgtcctaagagccag

SEQ ID NO: 746972 - DNA, 25 bp, Mus musculus
taaatatatattctggatggccgcc

SEQ ID NO: 746973 - DNA, 25 bp, Mus musculus
taaatatatattgtggatggccgcc

SEQ ID NO: 746974 - DNA, 25 bp, Mus musculus
taaatatatttactcacccaccatg

SEQ ID NO: 746975 - DNA, 25 bp, Mus musculus
taaatatatttagtcacccaccatg

SEQ ID NO: 746976 - DNA, 25 bp, Mus musculus
taaatatccctacttcccctaagca

SEQ ID NO: 746977 - DNA, 25 bp, Mus musculus
taaatatccctagttcccctaagca

SEQ ID NO: 746978 - DNA, 25 bp, Mus musculus
taaatatccgcaccttttgctccag

SEQ ID NO: 746979 - DNA, 25 bp, Mus musculus
taaatatccgcagcttttgctccag

SEQ ID NO: 746980 - DNA, 25 bp, Mus musculus
taaatatcctaaaatccgtgcatgg

SEQ ID NO: 746981 - DNA, 25 bp, Mus musculus
taaatatcctaatatccgtgcatgg

SEQ ID NO: 746982 - DNA, 25 bp, Mus musculus
taaatatctcccagtatctcaggcc

SEQ ID NO: 746983 - DNA, 25 bp, Mus musculus
taaatatctccctgtatctcaggcc

SEQ ID NO: 746984 - DNA, 25 bp, Mus musculus
taaatatctgctcctttgaaagcca

SEQ ID NO: 746985 - DNA, 25 bp, Mus musculus
taaatatctgctgctttgaaagcca

SEQ ID NO: 746986 - DNA, 25 bp, Mus musculus
taaatatctgtacagcgggctgccc

SEQ ID NO: 746987 - DNA, 25 bp, Mus musculus
taaatatctgtagagcgggctgccc

SEQ ID NO: 746988 - DNA, 25 bp, Mus musculus
taaatatgagtacgagccaggccat

SEQ ID NO: 746989 - DNA, 25 bp, Mus musculus
taaatatgagtaggagccaggccat

SEQ ID NO: 746990 - DNA, 25 bp, Mus musculus
taaatatgcctaaatgcccctttct

SEQ ID NO: 746991 - DNA, 25 bp, Mus musculus
taaatatgcctatatgcccctttct

SEQ ID NO: 746992 - DNA, 25 bp, Mus musculus
taaatattagggattcttacataga

SEQ ID NO: 746993 - DNA, 25 bp, Mus musculus
taaatattagggtttcttacataga

SEQ ID NO: 746994 - DNA, 25 bp, Mus musculus
taaatattatttatccccatccgtt

SEQ ID NO: 746995 - DNA, 25 bp, Mus musculus
taaatattatttttccccatccgtt

SEQ ID NO: 746996 - DNA, 25 bp, Mus musculus
taaatattcacccacttctcccaag

SEQ ID NO: 746997 - DNA, 25 bp, Mus musculus
taaatattcaccgacttctcccaag

SEQ ID NO: 746998 - DNA, 25 bp, Mus musculus
taaatattcagactcctcccatttg

SEQ ID NO: 746999 - DNA, 25 bp, Mus musculus
taaatattcagagtcctcccatttg

SEQ ID NO: 747000 - DNA, 25 bp, Mus musculus
taaatattcttccacagtccataga

SEQ ID NO: 747001 - DNA, 25 bp, Mus musculus
taaatattcttcgacagtccataga

SEQ ID NO: 747002 - DNA, 25 bp, Mus musculus
taaatattggttacagtttggctaa

SEQ ID NO: 747003 - DNA, 25 bp, Mus musculus
taaatattggtttcagtttggctaa

SEQ ID NO: 747004 - DNA, 25 bp, Mus musculus
taaatattttagctcccaataggcg

SEQ ID NO: 747005 - DNA, 25 bp, Mus musculus
taaatattttaggtcccaataggcg

SEQ ID NO: 747006 - DNA, 25 bp, Mus musculus
taaatcaaatgcatcccgaccttca

SEQ ID NO: 747007 - DNA, 25 bp, Mus musculus
taaatcaaatgcttcccgaccttca

SEQ ID NO: 747008 - DNA, 25 bp, Mus musculus
taaatcaaattaacctaccccgcat

SEQ ID NO: 747009 - DNA, 25 bp, Mus musculus
taaatcaaattatcctaccccgcat

SEQ ID NO: 747010 - DNA, 25 bp, Mus musculus
taaatcaagattactgtgtgctttt

SEQ ID NO: 747011 - DNA, 25 bp, Mus musculus
taaatcaagatttctgtgtgctttt

SEQ ID NO: 747012 - DNA, 25 bp, Mus musculus
taaatcaagcagactcatttctatt

SEQ ID NO: 747013 - DNA, 25 bp, Mus musculus
taaatcaagcagtctcatttctatt

SEQ ID NO: 747014 - DNA, 25 bp, Mus musculus
taaatcaagtggcactacaaaacct

SEQ ID NO: 747015 - DNA, 25 bp, Mus musculus
taaatcaagtgggactacaaaacct

SEQ ID NO: 747016 - DNA, 25 bp, Mus musculus
taaatcaatatgctggtcctagtgg

SEQ ID NO: 747017 - DNA, 25 bp, Mus musculus
taaatcaatatggtggtcctagtgg

SEQ ID NO: 747018 - DNA, 25 bp, Mus musculus
taaatcacacctatgcttgggacac

SEQ ID NO: 747019 - DNA, 25 bp, Mus musculus
taaatcacacctttgcttgggacac

SEQ ID NO: 747020 - DNA, 25 bp, Mus musculus
taaatcacagtaaaccccttgagcc

SEQ ID NO: 747021 - DNA, 25 bp, Mus musculus
taaatcacagtataccccttgagcc

SEQ ID NO: 747022 - DNA, 25 bp, Mus musculus
taaatcaccaagacaacttttcctt

SEQ ID NO: 747023 - DNA, 25 bp, Mus musculus
taaatcaccaagtcaacttttcctt

SEQ ID NO: 747024 - DNA, 25 bp, Mus musculus
taaatcaccaccactcactatttct

SEQ ID NO: 747025 - DNA, 25 bp, Mus musculus
taaatcaccacctctcactatttct

SEQ ID NO: 747026 - DNA, 25 bp, Mus musculus
taaatcagagggattaagcctgcct

SEQ ID NO: 747027 - DNA, 25 bp, Mus musculus
taaatcagagggtttaagcctgcct

SEQ ID NO: 747028 - DNA, 25 bp, Mus musculus
taaatcagtgttatttgctcttgaa

SEQ ID NO: 747029 - DNA, 25 bp, Mus musculus
taaatcagtgttttttgctcttgaa

SEQ ID NO: 747030 - DNA, 25 bp, Mus musculus
taaatcatacatccacactagtaat

SEQ ID NO: 747031 - DNA, 25 bp, Mus musculus
taaatcatacatgcacactagtaat

SEQ ID NO: 747032 - DNA, 25 bp, Mus musculus
taaatcatcaacaactacatgctct

SEQ ID NO: 747033 - DNA, 25 bp, Mus musculus
taaatcatcaactactacatgctct

SEQ ID NO: 747034 - DNA, 25 bp, Mus musculus
taaatcatccttatcataccctgtt

SEQ ID NO: 747035 - DNA, 25 bp, Mus musculus
taaatcatccttttcataccctgtt

SEQ ID NO: 747036 - DNA, 25 bp, Mus musculus
taaatcatgattccagacctaactg

SEQ ID NO: 747037 - DNA, 25 bp, Mus musculus
taaatcatgattgcagacctaactg

SEQ ID NO: 747038 - DNA, 25 bp, Mus musculus
taaatcatgttgcactacccgctgc

SEQ ID NO: 747039 - DNA, 25 bp, Mus musculus
taaatcatgttggactacccgctgc

SEQ ID NO: 747040 - DNA, 25 bp, Mus musculus
taaatccaggagcaaggcaccagtg

SEQ ID NO: 747041 - DNA, 25 bp, Mus musculus
taaatccaggaggaaggcaccagtg

SEQ ID NO: 747042 - DNA, 25 bp, Mus musculus
taaatccagggtatgaagtcaactt

SEQ ID NO: 747043 - DNA, 25 bp, Mus musculus
taaatccagggtcagtttcttaaca

SEQ ID NO: 747044 - DNA, 25 bp, Mus musculus
taaatccagggtgagtttcttaaca

SEQ ID NO: 747045 - DNA, 25 bp, Mus musculus
taaatccagggtttgaagtcaactt

SEQ ID NO: 747046 - DNA, 25 bp, Mus musculus
taaatccagttactgaccctctgaa

SEQ ID NO: 747047 - DNA, 25 bp, Mus musculus
taaatccagttagtgaccctctgaa

SEQ ID NO: 747048 - DNA, 25 bp, Mus musculus
taaatcccagatcaggtaccctagc

SEQ ID NO: 747049 - DNA, 25 bp, Mus musculus
taaatcccagatgaggtaccctagc

SEQ ID NO: 747050 - DNA, 25 bp, Mus musculus
taaatcccagttatattaaagacag

SEQ ID NO: 747051 - DNA, 25 bp, Mus musculus
taaatcccagttttattaaagacag

SEQ ID NO: 747052 - DNA, 25 bp, Mus musculus
taaatcccgaggctttctgtatggc

SEQ ID NO: 747053 - DNA, 25 bp, Mus musculus
taaatcccgagggtttctgtatggc

SEQ ID NO: 747054 - DNA, 25 bp, Mus musculus
taaatcccgccaactacgagaagct

SEQ ID NO: 747055 - DNA, 25 bp, Mus musculus
taaatcccgccatctacgagaagct

SEQ ID NO: 747056 - DNA, 25 bp, Mus musculus
taaatcccgtatagaatgctgcagg

SEQ ID NO: 747057 - DNA, 25 bp, Mus musculus
taaatcccgtattgaatgctgcagg

SEQ ID NO: 747058 - DNA, 25 bp, Mus musculus
taaatccctaaaacatgccagccag

SEQ ID NO: 747059 - DNA, 25 bp, Mus musculus
taaatccctaaatcatgccagccag

SEQ ID NO: 747060 - DNA, 25 bp, Mus musculus
taaatccctaagagcctcaactgcc

SEQ ID NO: 747061 - DNA, 25 bp, Mus musculus
taaatccctaagtgcctcaactgcc

SEQ ID NO: 747062 - DNA, 25 bp, Mus musculus
taaatccctccgaaccagagaagtt

SEQ ID NO: 747063 - DNA, 25 bp, Mus musculus
taaatccctccgtaccagagaagtt

SEQ ID NO: 747064 - DNA, 25 bp, Mus musculus
taaatcccttctattctatgcactt

SEQ ID NO: 747065 - DNA, 25 bp, Mus musculus
taaatcccttcttttctatgcactt

SEQ ID NO: 747066 - DNA, 25 bp, Mus musculus
taaatccggctcaaggtgatccaat

SEQ ID NO: 747067 - DNA, 25 bp, Mus musculus
taaatccggctctaggtgatccaat

SEQ ID NO: 747068 - DNA, 25 bp, Mus musculus
taaatcctaactatcccagaagctt

SEQ ID NO: 747069 - DNA, 25 bp, Mus musculus
taaatcctaactttcccagaagctt

SEQ ID NO: 747070 - DNA, 25 bp, Mus musculus
taaatcctacctattgcaattagat

SEQ ID NO: 747071 - DNA, 25 bp, Mus musculus
taaatcctaccttttgcaattagat

SEQ ID NO: 747072 - DNA, 25 bp, Mus musculus
taaatcctactccacaaatctcttt

SEQ ID NO: 747073 - DNA, 25 bp, Mus musculus
taaatcctactcgacaaatctcttt

SEQ ID NO: 747074 - DNA, 25 bp, Mus musculus
taaatcctcaatacttattggaaaa

SEQ ID NO: 747075 - DNA, 25 bp, Mus musculus
taaatcctcaataggctgtcagtgt

SEQ ID NO: 747076 - DNA, 25 bp, Mus musculus
taaatcctcaattcttattggaaaa

SEQ ID NO: 747077 - DNA, 25 bp, Mus musculus
taaatcctcaattggctgtcagtgt

SEQ ID NO: 747078 - DNA, 25 bp, Mus musculus
taaatcctgctacgcgtgaccgagg

SEQ ID NO: 747079 - DNA, 25 bp, Mus musculus
taaatcctgctaggcgtgaccgagg

SEQ ID NO: 747080 - DNA, 25 bp, Mus musculus
taaatcctgtgcacccataacatgg

SEQ ID NO: 747081 - DNA, 25 bp, Mus musculus
taaatcctgtgcctgagaaccactg

SEQ ID NO: 747082 - DNA, 25 bp, Mus musculus
taaatcctgtgcgtgagaaccactg

SEQ ID NO: 747083 - DNA, 25 bp, Mus musculus
taaatcctgtgctcccataacatgg

SEQ ID NO: 747084 - DNA, 25 bp, Mus musculus
taaatccttaacctatctcacaaat

SEQ ID NO: 747085 - DNA, 25 bp, Mus musculus
taaatccttaacgtatctcacaaat

SEQ ID NO: 747086 - DNA, 25 bp, Mus musculus
taaatcgaaggcatcggcctgggtt

SEQ ID NO: 747087 - DNA, 25 bp, Mus musculus
taaatcgaaggcttcggcctgggtt

SEQ ID NO: 747088 - DNA, 25 bp, Mus musculus
taaatcgcccacagtattgatctat

SEQ ID NO: 747089 - DNA, 25 bp, Mus musculus
taaatcgcccactgtattgatctat

SEQ ID NO: 747090 - DNA, 25 bp, Mus musculus
taaatcggatgtatcctgtacctgc

SEQ ID NO: 747091 - DNA, 25 bp, Mus musculus
taaatcggatgtttcctgtacctgc

SEQ ID NO: 747092 - DNA, 25 bp, Mus musculus
taaatcggttcactgtatgcttaat

SEQ ID NO: 747093 - DNA, 25 bp, Mus musculus
taaatcggttcagtgtatgcttaat

SEQ ID NO: 747094 - DNA, 25 bp, Mus musculus
taaatcgtaggtccgcagagtcctt

SEQ ID NO: 747095 - DNA, 25 bp, Mus musculus
taaatcgtaggtgcgcagagtcctt

SEQ ID NO: 747096 - DNA, 25 bp, Mus musculus
taaatctaccttcatttctgtaaca

SEQ ID NO: 747097 - DNA, 25 bp, Mus musculus
taaatctaccttgatttctgtaaca

SEQ ID NO: 747098 - DNA, 25 bp, Mus musculus
taaatctacgatcgctggctgcaat

SEQ ID NO: 747099 - DNA, 25 bp, Mus musculus
taaatctacgatggctggctgcaat

SEQ ID NO: 747100 - DNA, 25 bp, Mus musculus
taaatctagcctacagcagtcttgg

SEQ ID NO: 747101 - DNA, 25 bp, Mus musculus
taaatctagccttcagcagtcttgg

SEQ ID NO: 747102 - DNA, 25 bp, Mus musculus
taaatctaggttacacagggcaggc

SEQ ID NO: 747103 - DNA, 25 bp, Mus musculus
taaatctaggtttcacagggcaggc

SEQ ID NO: 747104 - DNA, 25 bp, Mus musculus
taaatctatgtcagtagacccagct

SEQ ID NO: 747105 - DNA, 25 bp, Mus musculus
taaatctatgtctgtagacccagct

SEQ ID NO: 747106 - DNA, 25 bp, Mus musculus
taaatctcaaatctgttgccaagac

SEQ ID NO: 747107 - DNA, 25 bp, Mus musculus
taaatctcaaatgtgttgccaagac

SEQ ID NO: 747108 - DNA, 25 bp, Mus musculus
taaatctcagccacaggtgatgcct

SEQ ID NO: 747109 - DNA, 25 bp, Mus musculus
taaatctcagcctcaggtgatgcct

SEQ ID NO: 747110 - DNA, 25 bp, Mus musculus
taaatctcattcatctacccacctg

SEQ ID NO: 747111 - DNA, 25 bp, Mus musculus
taaatctcattcttctacccacctg

SEQ ID NO: 747112 - DNA, 25 bp, Mus musculus
taaatctccattcctattatttttt

SEQ ID NO: 747113 - DNA, 25 bp, Mus musculus
taaatctccattgctattatttttt

SEQ ID NO: 747114 - DNA, 25 bp, Mus musculus
taaatctccctactcttgcctggca

SEQ ID NO: 747115 - DNA, 25 bp, Mus musculus
taaatctccctagtcttgcctggca

SEQ ID NO: 747116 - DNA, 25 bp, Mus musculus
taaatctccgaaaccctcttttaca

SEQ ID NO: 747117 - DNA, 25 bp, Mus musculus
taaatctccgaatccctcttttaca

SEQ ID NO: 747118 - DNA, 25 bp, Mus musculus
taaatctcctatacctgggcaaagc

SEQ ID NO: 747119 - DNA, 25 bp, Mus musculus
taaatctcctattcctgggcaaagc

SEQ ID NO: 747120 - DNA, 25 bp, Mus musculus
taaatctctgcaactgttagccagc

SEQ ID NO: 747121 - DNA, 25 bp, Mus musculus
taaatctctgcatctgttagccagc

SEQ ID NO: 747122 - DNA, 25 bp, Mus musculus
taaatctgaatcctggtgtccctac

SEQ ID NO: 747123 - DNA, 25 bp, Mus musculus
taaatctgaatcgtggtgtccctac

SEQ ID NO: 747124 - DNA, 25 bp, Mus musculus
taaatctgccatcagcaccgtgtaa

SEQ ID NO: 747125 - DNA, 25 bp, Mus musculus
taaatctgccatcgctgaagtgagc

SEQ ID NO: 747126 - DNA, 25 bp, Mus musculus
taaatctgccatgagcaccgtgtaa

SEQ ID NO: 747127 - DNA, 25 bp, Mus musculus
taaatctgccatggctgaagtgagc

SEQ ID NO: 747128 - DNA, 25 bp, Mus musculus
taaatctgcgagacccagagtacag

SEQ ID NO: 747129 - DNA, 25 bp, Mus musculus
taaatctgcgagtcccagagtacag

SEQ ID NO: 747130 - DNA, 25 bp, Mus musculus
taaatctgcgtcacatctcctggtg

SEQ ID NO: 747131 - DNA, 25 bp, Mus musculus
taaatctgcgtctcatctcctggtg

SEQ ID NO: 747132 - DNA, 25 bp, Mus musculus
taaatctggtatccgcactttctat

SEQ ID NO: 747133 - DNA, 25 bp, Mus musculus
taaatctggtatgcgcactttctat

SEQ ID NO: 747134 - DNA, 25 bp, Mus musculus
taaatctgtaaaaagcttcaataag

SEQ ID NO: 747135 - DNA, 25 bp, Mus musculus
taaatctgtaaatagcttcaataag

SEQ ID NO: 747136 - DNA, 25 bp, Mus musculus
taaatctgtcagctcttcaggacgc

SEQ ID NO: 747137 - DNA, 25 bp, Mus musculus
taaatctgtcaggtcttcaggacgc

SEQ ID NO: 747138 - DNA, 25 bp, Mus musculus
taaatctgttgaatagtagagacct

SEQ ID NO: 747139 - DNA, 25 bp, Mus musculus
taaatctgttgattagtagagacct

SEQ ID NO: 747140 - DNA, 25 bp, Mus musculus
taaatcttaaccatctgcctaggat

SEQ ID NO: 747141 - DNA, 25 bp, Mus musculus
taaatcttaaccttctgcctaggat

SEQ ID NO: 747142 - DNA, 25 bp, Mus musculus
taaatcttaagccaaagcgggaaag

SEQ ID NO: 747143 - DNA, 25 bp, Mus musculus
taaatcttaagcgaaagcgggaaag

SEQ ID NO: 747144 - DNA, 25 bp, Mus musculus
taaatcttaattactgttgccatag

SEQ ID NO: 747145 - DNA, 25 bp, Mus musculus
taaatcttaatttctgttgccatag

SEQ ID NO: 747146 - DNA, 25 bp, Mus musculus
taaatcttatccacatacccacaga

SEQ ID NO: 747147 - DNA, 25 bp, Mus musculus
taaatcttatcctcatacccacaga

SEQ ID NO: 747148 - DNA, 25 bp, Mus musculus
taaatcttatgcatgtgtgaaactc

SEQ ID NO: 747149 - DNA, 25 bp, Mus musculus
taaatcttatgcttgtgtgaaactc

SEQ ID NO: 747150 - DNA, 25 bp, Mus musculus
taaatcttcctcatgaggtcgacag

SEQ ID NO: 747151 - DNA, 25 bp, Mus musculus
taaatcttcctcttgaggtcgacag

SEQ ID NO: 747152 - DNA, 25 bp, Mus musculus
taaatcttctttcttatcccttcta

SEQ ID NO: 747153 - DNA, 25 bp, Mus musculus
taaatcttctttgttatcccttcta

SEQ ID NO: 747154 - DNA, 25 bp, Mus musculus
taaatcttgcctcgcagtgggctct

SEQ ID NO: 747155 - DNA, 25 bp, Mus musculus
taaatcttgcctggcagtgggctct

SEQ ID NO: 747156 - DNA, 25 bp, Mus musculus
taaatcttggtaaccttctcctatg

SEQ ID NO: 747157 - DNA, 25 bp, Mus musculus
taaatcttggtatccttctcctatg

SEQ ID NO: 747158 - DNA, 25 bp, Mus musculus
taaatcttgtggcagctcagaaggg

SEQ ID NO: 747159 - DNA, 25 bp, Mus musculus
taaatcttgtgggagctcagaaggg

SEQ ID NO: 747160 - DNA, 25 bp, Mus musculus
taaatctttactcttcttctggcaa

SEQ ID NO: 747161 - DNA, 25 bp, Mus musculus
taaatctttactgttcttctggcaa

SEQ ID NO: 747162 - DNA, 25 bp, Mus musculus
taaatctttttcactattttgtcaa

SEQ ID NO: 747163 - DNA, 25 bp, Mus musculus
taaatctttttctctattttgtcaa

SEQ ID NO: 747164 - DNA, 25 bp, Mus musculus
taaatgaaccggctttggacaatat

SEQ ID NO: 747165 - DNA, 25 bp, Mus musculus
taaatgaaccgggtttggacaatat

SEQ ID NO: 747166 - DNA, 25 bp, Mus musculus
taaatgaagacaatccaccccgtcg

SEQ ID NO: 747167 - DNA, 25 bp, Mus musculus
taaatgaagacattccaccccgtcg

SEQ ID NO: 747168 - DNA, 25 bp, Mus musculus
taaatgaagactcttcccatggcct

SEQ ID NO: 747169 - DNA, 25 bp, Mus musculus
taaatgaagactgttcccatggcct

SEQ ID NO: 747170 - DNA, 25 bp, Mus musculus
taaatgaagtcactaccgtccacct

SEQ ID NO: 747171 - DNA, 25 bp, Mus musculus
taaatgaagtcagtaccgtccacct

SEQ ID NO: 747172 - DNA, 25 bp, Mus musculus
taaatgaatatccaccccaccaagc

SEQ ID NO: 747173 - DNA, 25 bp, Mus musculus
taaatgaatatcgaccccaccaagc

SEQ ID NO: 747174 - DNA, 25 bp, Mus musculus
taaatgaatgttaccgtctccactc

SEQ ID NO: 747175 - DNA, 25 bp, Mus musculus
taaatgaatgtttccgtctccactc

SEQ ID NO: 747176 - DNA, 25 bp, Mus musculus
taaatgacaggtatgctgctgttcc

SEQ ID NO: 747177 - DNA, 25 bp, Mus musculus
taaatgacaggtttgctgctgttcc

SEQ ID NO: 747178 - DNA, 25 bp, Mus musculus
taaatgaccaatcggcgaccagcca

SEQ ID NO: 747179 - DNA, 25 bp, Mus musculus
taaatgaccaatgggcgaccagcca

SEQ ID NO: 747180 - DNA, 25 bp, Mus musculus
taaatgaccctcagcgcatggacag

SEQ ID NO: 747181 - DNA, 25 bp, Mus musculus
taaatgaccctctgcgcatggacag

SEQ ID NO: 747182 - DNA, 25 bp, Mus musculus
taaatgaccgcaccagtacttatta

SEQ ID NO: 747183 - DNA, 25 bp, Mus musculus
taaatgaccgcagcagtacttatta

SEQ ID NO: 747184 - DNA, 25 bp, Mus musculus
taaatgaccgttcgtagtgggaccg

SEQ ID NO: 747185 - DNA, 25 bp, Mus musculus
taaatgaccgttggtagtgggaccg

SEQ ID NO: 747186 - DNA, 25 bp, Mus musculus
taaatgacgggcagtggcacatgaa

SEQ ID NO: 747187 - DNA, 25 bp, Mus musculus
taaatgacgggctgtggcacatgaa

SEQ ID NO: 747188 - DNA, 25 bp, Mus musculus
taaatgagaaccctggccagccttc

SEQ ID NO: 747189 - DNA, 25 bp, Mus musculus
taaatgagaaccgtggccagccttc

SEQ ID NO: 747190 - DNA, 25 bp, Mus musculus
taaatgagacatccgttcttagtgt

SEQ ID NO: 747191 - DNA, 25 bp, Mus musculus
taaatgagacatgcgttcttagtgt

SEQ ID NO: 747192 - DNA, 25 bp, Mus musculus
taaatgagccgcctcgctgagagca

SEQ ID NO: 747193 - DNA, 25 bp, Mus musculus
taaatgagccgcgtcgctgagagca

SEQ ID NO: 747194 - DNA, 25 bp, Mus musculus
taaatgagccttacactctgcatca

SEQ ID NO: 747195 - DNA, 25 bp, Mus musculus
taaatgagccttcttcctaggcctg

SEQ ID NO: 747196 - DNA, 25 bp, Mus musculus
taaatgagccttgttcctaggcctg

SEQ ID NO: 747197 - DNA, 25 bp, Mus musculus
taaatgagcctttcactctgcatca

SEQ ID NO: 747198 - DNA, 25 bp, Mus musculus
taaatgagcgacctccagcatccaa

SEQ ID NO: 747199 - DNA, 25 bp, Mus musculus
taaatgagcgacgtccagcatccaa

SEQ ID NO: 747200 - DNA, 25 bp, Mus musculus
taaatgagctcaccaggcacctctg

SEQ ID NO: 747201 - DNA, 25 bp, Mus musculus
taaatgagctcagcaggcacctctg

SEQ ID NO: 747202 - DNA, 25 bp, Mus musculus
taaatgagctgtagccacttttgac

SEQ ID NO: 747203 - DNA, 25 bp, Mus musculus
taaatgagctgttgccacttttgac

SEQ ID NO: 747204 - DNA, 25 bp, Mus musculus
taaatgagcttgcttgcccaaccgc

SEQ ID NO: 747205 - DNA, 25 bp, Mus musculus
taaatgagcttggttgcccaaccgc

SEQ ID NO: 747206 - DNA, 25 bp, Mus musculus
taaatgaggcagatctgaagtctct

SEQ ID NO: 747207 - DNA, 25 bp, Mus musculus
taaatgaggcagttctgaagtctct

SEQ ID NO: 747208 - DNA, 25 bp, Mus musculus
taaatgaggcccagtgacacactct

SEQ ID NO: 747209 - DNA, 25 bp, Mus musculus
taaatgaggccctgtgacacactct

SEQ ID NO: 747210 - DNA, 25 bp, Mus musculus
taaatgagtgataaacacttttttc

SEQ ID NO: 747211 - DNA, 25 bp, Mus musculus
taaatgagtgattaacacttttttc

SEQ ID NO: 747212 - DNA, 25 bp, Mus musculus
taaatgatacccctttcatacccta

SEQ ID NO: 747213 - DNA, 25 bp, Mus musculus
taaatgatacccgtttcatacccta

SEQ ID NO: 747214 - DNA, 25 bp, Mus musculus
taaatgatccaaataccactgaatg

SEQ ID NO: 747215 - DNA, 25 bp, Mus musculus
taaatgatccaattaccactgaatg

SEQ ID NO: 747216 - DNA, 25 bp, Mus musculus
taaatgatcctgacctcagcgccaa

SEQ ID NO: 747217 - DNA, 25 bp, Mus musculus
taaatgatcctgtcctcagcgccaa

SEQ ID NO: 747218 - DNA, 25 bp, Mus musculus
taaatgatctgtacctttaaggtag

SEQ ID NO: 747219 - DNA, 25 bp, Mus musculus
taaatgatctgttcctttaaggtag

SEQ ID NO: 747220 - DNA, 25 bp, Mus musculus
taaatgatcttgatactcactgtgg

SEQ ID NO: 747221 - DNA, 25 bp, Mus musculus
taaatgatcttgttactcactgtgg

SEQ ID NO: 747222 - DNA, 25 bp, Mus musculus
taaatgatggttattactttgccca

SEQ ID NO: 747223 - DNA, 25 bp, Mus musculus
taaatgatggtttttactttgccca

SEQ ID NO: 747224 - DNA, 25 bp, Mus musculus
taaatgattataagtacgctcctca

SEQ ID NO: 747225 - DNA, 25 bp, Mus musculus
taaatgattatatgtacgctcctca

SEQ ID NO: 747226 - DNA, 25 bp, Mus musculus
taaatgattcctccttagccctagt

SEQ ID NO: 747227 - DNA, 25 bp, Mus musculus
taaatgattcctgcttagccctagt

SEQ ID NO: 747228 - DNA, 25 bp, Mus musculus
taaatgattttcctccggtttgtat

SEQ ID NO: 747229 - DNA, 25 bp, Mus musculus
taaatgattttcgtccggtttgtat

SEQ ID NO: 747230 - DNA, 25 bp, Mus musculus
taaatgcaaaaaacacagctgggct

SEQ ID NO: 747231 - DNA, 25 bp, Mus musculus
taaatgcaaaaatcacagctgggct

SEQ ID NO: 747232 - DNA, 25 bp, Mus musculus
taaatgcaaacaagtgctccctagc

SEQ ID NO: 747233 - DNA, 25 bp, Mus musculus
taaatgcaaacatgtgctccctagc

SEQ ID NO: 747234 - DNA, 25 bp, Mus musculus
taaatgcaaacgctgactctacctc

SEQ ID NO: 747235 - DNA, 25 bp, Mus musculus
taaatgcaaacggtgactctacctc

SEQ ID NO: 747236 - DNA, 25 bp, Mus musculus
taaatgcacacactgcacacacgta

SEQ ID NO: 747237 - DNA, 25 bp, Mus musculus
taaatgcacacagtgcacacacgta

SEQ ID NO: 747238 - DNA, 25 bp, Mus musculus
taaatgcacagcatggttctttcat

SEQ ID NO: 747239 - DNA, 25 bp, Mus musculus
taaatgcacagcttggttctttcat

SEQ ID NO: 747240 - DNA, 25 bp, Mus musculus
taaatgcactaacagaccctcagcc

SEQ ID NO: 747241 - DNA, 25 bp, Mus musculus
taaatgcactaagagaccctcagcc

SEQ ID NO: 747242 - DNA, 25 bp, Mus musculus
taaatgcagatgataagggttggaa

SEQ ID NO: 747243 - DNA, 25 bp, Mus musculus
taaatgcagatgttaagggttggaa

SEQ ID NO: 747244 - DNA, 25 bp, Mus musculus
taaatgcaggtgattctgtgtgctc

SEQ ID NO: 747245 - DNA, 25 bp, Mus musculus
taaatgcaggtgtttctgtgtgctc

SEQ ID NO: 747246 - DNA, 25 bp, Mus musculus
taaatgcagtgcacctaagcctgcc

SEQ ID NO: 747247 - DNA, 25 bp, Mus musculus
taaatgcagtgctcctaagcctgcc

SEQ ID NO: 747248 - DNA, 25 bp, Mus musculus
taaatgcatacaacctttgatcccc

SEQ ID NO: 747249 - DNA, 25 bp, Mus musculus
taaatgcatacatcctttgatcccc

SEQ ID NO: 747250 - DNA, 25 bp, Mus musculus
taaatgcatatcaagtaccaggaat

SEQ ID NO: 747251 - DNA, 25 bp, Mus musculus
taaatgcatatccttagctggctat

SEQ ID NO: 747252 - DNA, 25 bp, Mus musculus
taaatgcatatcgttagctggctat

SEQ ID NO: 747253 - DNA, 25 bp, Mus musculus
taaatgcatatctagtaccaggaat

SEQ ID NO: 747254 - DNA, 25 bp, Mus musculus
taaatgcatattaaccaggtttttt

SEQ ID NO: 747255 - DNA, 25 bp, Mus musculus
taaatgcatatttaccaggtttttt

SEQ ID NO: 747256 - DNA, 25 bp, Mus musculus
taaatgcattgcctcttcagacatc

SEQ ID NO: 747257 - DNA, 25 bp, Mus musculus
taaatgcattgcgtcttcagacatc

SEQ ID NO: 747258 - DNA, 25 bp, Mus musculus
taaatgccaattacccagtggaccc

SEQ ID NO: 747259 - DNA, 25 bp, Mus musculus
taaatgccaatttcccagtggaccc

SEQ ID NO: 747260 - DNA, 25 bp, Mus musculus
taaatgccacttaattgctgaaatt

SEQ ID NO: 747261 - DNA, 25 bp, Mus musculus
taaatgccactttattgctgaaatt

SEQ ID NO: 747262 - DNA, 25 bp, Mus musculus
taaatgccagatctttccgaatgcc

SEQ ID NO: 747263 - DNA, 25 bp, Mus musculus
taaatgccagatgtttccgaatgcc

SEQ ID NO: 747264 - DNA, 25 bp, Mus musculus
taaatgcccgtgaagctgtaggtta

SEQ ID NO: 747265 - DNA, 25 bp, Mus musculus
taaatgcccgtgtagctgtaggtta

SEQ ID NO: 747266 - DNA, 25 bp, Mus musculus
taaatgccctcaaagattattgcta

SEQ ID NO: 747267 - DNA, 25 bp, Mus musculus
taaatgccctcatagattattgcta

SEQ ID NO: 747268 - DNA, 25 bp, Mus musculus
taaatgcctctacagcctgctttct

SEQ ID NO: 747269 - DNA, 25 bp, Mus musculus
taaatgcctctagagcctgctttct

SEQ ID NO: 747270 - DNA, 25 bp, Mus musculus
taaatgcgctgtcagggtgacctct

SEQ ID NO: 747271 - DNA, 25 bp, Mus musculus
taaatgcgctgtgagggtgacctct

SEQ ID NO: 747272 - DNA, 25 bp, Mus musculus
taaatgctaatcacgtccaagctcc

SEQ ID NO: 747273 - DNA, 25 bp, Mus musculus
taaatgctaatctcgtccaagctcc

SEQ ID NO: 747274 - DNA, 25 bp, Mus musculus
taaatgctagatagaaggccataga

SEQ ID NO: 747275 - DNA, 25 bp, Mus musculus
taaatgctagattgaaggccataga

SEQ ID NO: 747276 - DNA, 25 bp, Mus musculus
taaatgctaggcctcagaaatctga

SEQ ID NO: 747277 - DNA, 25 bp, Mus musculus
taaatgctaggcgtcagaaatctga

SEQ ID NO: 747278 - DNA, 25 bp, Mus musculus
taaatgctatctaagtacccaaaag

SEQ ID NO: 747279 - DNA, 25 bp, Mus musculus
taaatgctatcttagtacccaaaag

SEQ ID NO: 747280 - DNA, 25 bp, Mus musculus
taaatgctccatcttcctgtacact

SEQ ID NO: 747281 - DNA, 25 bp, Mus musculus
taaatgctccatgttcctgtacact

SEQ ID NO: 747282 - DNA, 25 bp, Mus musculus
taaatgctcccaattaagtttacct

SEQ ID NO: 747283 - DNA, 25 bp, Mus musculus
taaatgctcccatttaagtttacct

SEQ ID NO: 747284 - DNA, 25 bp, Mus musculus
taaatgctctcgctgacagtcttta

SEQ ID NO: 747285 - DNA, 25 bp, Mus musculus
taaatgctctcggtgacagtcttta

SEQ ID NO: 747286 - DNA, 25 bp, Mus musculus
taaatgctggtgcaaaacctgttta

SEQ ID NO: 747287 - DNA, 25 bp, Mus musculus
taaatgctggtggaaaacctgttta

SEQ ID NO: 747288 - DNA, 25 bp, Mus musculus
taaatgctgtaacccgtggtccatc

SEQ ID NO: 747289 - DNA, 25 bp, Mus musculus
taaatgctgtaagccgtggtccatc

SEQ ID NO: 747290 - DNA, 25 bp, Mus musculus
taaatgctgtatctcccggaaatct

SEQ ID NO: 747291 - DNA, 25 bp, Mus musculus
taaatgctgtatgtcccggaaatct

SEQ ID NO: 747292 - DNA, 25 bp, Mus musculus
taaatgctgttaacctttcctcttt

SEQ ID NO: 747293 - DNA, 25 bp, Mus musculus
taaatgctgttatcctttcctcttt

SEQ ID NO: 747294 - DNA, 25 bp, Mus musculus
taaatgcttagacggtgacactact

SEQ ID NO: 747295 - DNA, 25 bp, Mus musculus
taaatgcttagagggtgacactact

SEQ ID NO: 747296 - DNA, 25 bp, Mus musculus
taaatgcttctaaaaatccttccaa

SEQ ID NO: 747297 - DNA, 25 bp, Mus musculus
taaatgcttctataaatccttccaa

SEQ ID NO: 747298 - DNA, 25 bp, Mus musculus
taaatgcttctcatatggttccaaa

SEQ ID NO: 747299 - DNA, 25 bp, Mus musculus
taaatgcttctcttatggttccaaa

SEQ ID NO: 747300 - DNA, 25 bp, Mus musculus
taaatgcttgttatccatgtatcaa

SEQ ID NO: 747301 - DNA, 25 bp, Mus musculus
taaatgcttgttcttcaacccactc

SEQ ID NO: 747302 - DNA, 25 bp, Mus musculus
taaatgcttgttgttcaacccactc

SEQ ID NO: 747303 - DNA, 25 bp, Mus musculus
taaatgcttgttttccatgtatcaa

SEQ ID NO: 747304 - DNA, 25 bp, Mus musculus
taaatgctttatattcccctctcat

SEQ ID NO: 747305 - DNA, 25 bp, Mus musculus
taaatgctttattttcccctctcat

SEQ ID NO: 747306 - DNA, 25 bp, Mus musculus
taaatgctttttcaccccaggagga

SEQ ID NO: 747307 - DNA, 25 bp, Mus musculus
taaatgctttttgaccccaggagga

SEQ ID NO: 747308 - DNA, 25 bp, Mus musculus
taaatggacagcattccccacgatg

SEQ ID NO: 747309 - DNA, 25 bp, Mus musculus
taaatggacagctttccccacgatg

SEQ ID NO: 747310 - DNA, 25 bp, Mus musculus
taaatggacggactcccaggaaccg

SEQ ID NO: 747311 - DNA, 25 bp, Mus musculus
taaatggacggagtcccaggaaccg

SEQ ID NO: 747312 - DNA, 25 bp, Mus musculus
taaatggatgctctttcccctttaa

SEQ ID NO: 747313 - DNA, 25 bp, Mus musculus
taaatggatgctgtttcccctttaa

SEQ ID NO: 747314 - DNA, 25 bp, Mus musculus
taaatggatttgacaggcaggctct

SEQ ID NO: 747315 - DNA, 25 bp, Mus musculus
taaatggatttgtcaggcaggctct

SEQ ID NO: 747316 - DNA, 25 bp, Mus musculus
taaatggcaaccatccaaggctggg

SEQ ID NO: 747317 - DNA, 25 bp, Mus musculus
taaatggcaaccttccaaggctggg

SEQ ID NO: 747318 - DNA, 25 bp, Mus musculus
taaatggcacaaccctggaaactcc

SEQ ID NO: 747319 - DNA, 25 bp, Mus musculus
taaatggcacaagcctggaaactcc

SEQ ID NO: 747320 - DNA, 25 bp, Mus musculus
taaatggcacatcgcgtggtaccct

SEQ ID NO: 747321 - DNA, 25 bp, Mus musculus
taaatggcacatggcgtggtaccct

SEQ ID NO: 747322 - DNA, 25 bp, Mus musculus
taaatggcagatcaaacactttcaa

SEQ ID NO: 747323 - DNA, 25 bp, Mus musculus
taaatggcagatgaaacactttcaa

SEQ ID NO: 747324 - DNA, 25 bp, Mus musculus
taaatggccatcacctatcatcttg

SEQ ID NO: 747325 - DNA, 25 bp, Mus musculus
taaatggccatctcctatcatcttg

SEQ ID NO: 747326 - DNA, 25 bp, Mus musculus
taaatggcccacctacaggagacga

SEQ ID NO: 747327 - DNA, 25 bp, Mus musculus
taaatggcccacgtacaggagacga

SEQ ID NO: 747328 - DNA, 25 bp, Mus musculus
taaatggcccatcgtatgctatagg

SEQ ID NO: 747329 - DNA, 25 bp, Mus musculus
taaatggcccatggtatgctatagg

SEQ ID NO: 747330 - DNA, 25 bp, Mus musculus
taaatggcctgaacacagctccttc

SEQ ID NO: 747331 - DNA, 25 bp, Mus musculus
taaatggcctgatcacagctccttc

SEQ ID NO: 747332 - DNA, 25 bp, Mus musculus
taaatggccttcagtggtgggcgct

SEQ ID NO: 747333 - DNA, 25 bp, Mus musculus
taaatggccttctgtggtgggcgct

SEQ ID NO: 747334 - DNA, 25 bp, Mus musculus
taaatggcctttcagtttctatcac

SEQ ID NO: 747335 - DNA, 25 bp, Mus musculus
taaatggcctttgagtttctatcac

SEQ ID NO: 747336 - DNA, 25 bp, Mus musculus
taaatggcgtccattaccaggctca

SEQ ID NO: 747337 - DNA, 25 bp, Mus musculus
taaatggcgtcctttaccaggctca

SEQ ID NO: 747338 - DNA, 25 bp, Mus musculus
taaatggctcatcccagacagtgcg

SEQ ID NO: 747339 - DNA, 25 bp, Mus musculus
taaatggctcatgccagacagtgcg

SEQ ID NO: 747340 - DNA, 25 bp, Mus musculus
taaatggctgtcctatccagagacc

SEQ ID NO: 747341 - DNA, 25 bp, Mus musculus
taaatggctgtcgtatccagagacc

SEQ ID NO: 747342 - DNA, 25 bp, Mus musculus
taaatggcttaaccttggcttcctg

SEQ ID NO: 747343 - DNA, 25 bp, Mus musculus
taaatggcttaagcttggcttcctg

SEQ ID NO: 747344 - DNA, 25 bp, Mus musculus
taaatgggaaacccctcttcctatg

SEQ ID NO: 747345 - DNA, 25 bp, Mus musculus
taaatgggaaacgcctcttcctatg

SEQ ID NO: 747346 - DNA, 25 bp, Mus musculus
taaatgggacacagcacgcgttggc

SEQ ID NO: 747347 - DNA, 25 bp, Mus musculus
taaatgggacactgcacgcgttggc

SEQ ID NO: 747348 - DNA, 25 bp, Mus musculus
taaatgggatctctgctgagggcaa

SEQ ID NO: 747349 - DNA, 25 bp, Mus musculus
taaatgggatctgtgctgagggcaa

SEQ ID NO: 747350 - DNA, 25 bp, Mus musculus
taaatgggcatgctctcccagaaca

SEQ ID NO: 747351 - DNA, 25 bp, Mus musculus
taaatgggcatggtctcccagaaca

SEQ ID NO: 747352 - DNA, 25 bp, Mus musculus
taaatgggtgctattctgcgggtta

SEQ ID NO: 747353 - DNA, 25 bp, Mus musculus
taaatgggtgcttttctgcgggtta

SEQ ID NO: 747354 - DNA, 25 bp, Mus musculus
taaatgggttataccaaggcccgtg

SEQ ID NO: 747355 - DNA, 25 bp, Mus musculus
taaatgggttattccaaggcccgtg

SEQ ID NO: 747356 - DNA, 25 bp, Mus musculus
taaatggtaaccagtagctctactt

SEQ ID NO: 747357 - DNA, 25 bp, Mus musculus
taaatggtaacctgtagctctactt

SEQ ID NO: 747358 - DNA, 25 bp, Mus musculus
taaatggtcataattcactcctccc

SEQ ID NO: 747359 - DNA, 25 bp, Mus musculus
taaatggtcatatttcactcctccc

SEQ ID NO: 747360 - DNA, 25 bp, Mus musculus
taaatggtcccgagataaattgggt

SEQ ID NO: 747361 - DNA, 25 bp, Mus musculus
taaatggtcccgtgataaattgggt

SEQ ID NO: 747362 - DNA, 25 bp, Mus musculus
taaatggtccttacccaagtccttg

SEQ ID NO: 747363 - DNA, 25 bp, Mus musculus
taaatggtcctttcccaagtccttg

SEQ ID NO: 747364 - DNA, 25 bp, Mus musculus
taaatggtgcgacaactcgaagaaa

SEQ ID NO: 747365 - DNA, 25 bp, Mus musculus
taaatggtgcgagaactcgaagaaa

SEQ ID NO: 747366 - DNA, 25 bp, Mus musculus
taaatggtgtacctgccagtccaag

SEQ ID NO: 747367 - DNA, 25 bp, Mus musculus
taaatggtgtacgtgccagtccaag

SEQ ID NO: 747368 - DNA, 25 bp, Mus musculus
taaatggttacccagtctctgttta

SEQ ID NO: 747369 - DNA, 25 bp, Mus musculus
taaatggttaccgagtctctgttta

SEQ ID NO: 747370 - DNA, 25 bp, Mus musculus
taaatggttcagctgatcctccaca

SEQ ID NO: 747371 - DNA, 25 bp, Mus musculus
taaatggttcaggtgatcctccaca

SEQ ID NO: 747372 - DNA, 25 bp, Mus musculus
taaatggttcatctgcagcacatgg

SEQ ID NO: 747373 - DNA, 25 bp, Mus musculus
taaatggttcatgtgcagcacatgg

SEQ ID NO: 747374 - DNA, 25 bp, Mus musculus
taaatgtaaatgctcccttatgctt

SEQ ID NO: 747375 - DNA, 25 bp, Mus musculus
taaatgtaaatggtcccttatgctt

SEQ ID NO: 747376 - DNA, 25 bp, Mus musculus
taaatgtaagggaggcttcagtgga

SEQ ID NO: 747377 - DNA, 25 bp, Mus musculus
taaatgtaagggtggcttcagtgga

SEQ ID NO: 747378 - DNA, 25 bp, Mus musculus
taaatgtacacactcactctagatg

SEQ ID NO: 747379 - DNA, 25 bp, Mus musculus
taaatgtacacagtcactctagatg

SEQ ID NO: 747380 - DNA, 25 bp, Mus musculus
taaatgtacggtatcttgccttata

SEQ ID NO: 747381 - DNA, 25 bp, Mus musculus
taaatgtacggtttcttgccttata

SEQ ID NO: 747382 - DNA, 25 bp, Mus musculus
taaatgtagccacttcttccagcta

SEQ ID NO: 747383 - DNA, 25 bp, Mus musculus
taaatgtagccagttcttccagcta

SEQ ID NO: 747384 - DNA, 25 bp, Mus musculus
taaatgtagctacagcccctttaaa

SEQ ID NO: 747385 - DNA, 25 bp, Mus musculus
taaatgtagctagagcccctttaaa

SEQ ID NO: 747386 - DNA, 25 bp, Mus musculus
taaatgtatcccaaacgtgttcttt

SEQ ID NO: 747387 - DNA, 25 bp, Mus musculus
taaatgtatccctaacgtgttcttt

SEQ ID NO: 747388 - DNA, 25 bp, Mus musculus
taaatgtatgtgacccatgactctg

SEQ ID NO: 747389 - DNA, 25 bp, Mus musculus
taaatgtatgtgtcccatgactctg

SEQ ID NO: 747390 - DNA, 25 bp, Mus musculus
taaatgtcacatctctatcctcaag

SEQ ID NO: 747391 - DNA, 25 bp, Mus musculus
taaatgtcacatgtctatcctcaag

SEQ ID NO: 747392 - DNA, 25 bp, Mus musculus
taaatgtcaccactcttagctatag

SEQ ID NO: 747393 - DNA, 25 bp, Mus musculus
taaatgtcaccagtcttagctatag

SEQ ID NO: 747394 - DNA, 25 bp, Mus musculus
taaatgtcacggatggcagagctca

SEQ ID NO: 747395 - DNA, 25 bp, Mus musculus
taaatgtcacggttggcagagctca

SEQ ID NO: 747396 - DNA, 25 bp, Mus musculus
taaatgtcatttactctcccagttg

SEQ ID NO: 747397 - DNA, 25 bp, Mus musculus
taaatgtcattttctctcccagttg

SEQ ID NO: 747398 - DNA, 25 bp, Mus musculus
taaatgtccctcattactcaaggtg

SEQ ID NO: 747399 - DNA, 25 bp, Mus musculus
taaatgtccctccaggtaaccatac

SEQ ID NO: 747400 - DNA, 25 bp, Mus musculus
taaatgtccctcgaggtaaccatac

SEQ ID NO: 747401 - DNA, 25 bp, Mus musculus
taaatgtccctctttactcaaggtg

SEQ ID NO: 747402 - DNA, 25 bp, Mus musculus
taaatgtccttgctcccttacagag

SEQ ID NO: 747403 - DNA, 25 bp, Mus musculus
taaatgtccttggtcccttacagag

SEQ ID NO: 747404 - DNA, 25 bp, Mus musculus
taaatgtctctccatttgggctggg

SEQ ID NO: 747405 - DNA, 25 bp, Mus musculus
taaatgtctctcgatttgggctggg

SEQ ID NO: 747406 - DNA, 25 bp, Mus musculus
taaatgtctgacctctcactggaag

SEQ ID NO: 747407 - DNA, 25 bp, Mus musculus
taaatgtctgacgtctcactggaag

SEQ ID NO: 747408 - DNA, 25 bp, Mus musculus
taaatgtcttctatcacctttccag

SEQ ID NO: 747409 - DNA, 25 bp, Mus musculus
taaatgtcttctttcacctttccag

SEQ ID NO: 747410 - DNA, 25 bp, Mus musculus
taaatgtgacctatgaacagagtaa

SEQ ID NO: 747411 - DNA, 25 bp, Mus musculus
taaatgtgacctttgaacagagtaa

SEQ ID NO: 747412 - DNA, 25 bp, Mus musculus
taaatgtgattcagggcgcccagca

SEQ ID NO: 747413 - DNA, 25 bp, Mus musculus
taaatgtgattctgggcgcccagca

SEQ ID NO: 747414 - DNA, 25 bp, Mus musculus
taaatgtgccatatcccaggttgcc

SEQ ID NO: 747415 - DNA, 25 bp, Mus musculus
taaatgtgccatttcccaggttgcc

SEQ ID NO: 747416 - DNA, 25 bp, Mus musculus
taaatgtggctgctatttacagcaa

SEQ ID NO: 747417 - DNA, 25 bp, Mus musculus
taaatgtggctggtatttacagcaa

SEQ ID NO: 747418 - DNA, 25 bp, Mus musculus
taaatgtgggctcgactcaagaaac

SEQ ID NO: 747419 - DNA, 25 bp, Mus musculus
taaatgtgggctggactcaagaaac

SEQ ID NO: 747420 - DNA, 25 bp, Mus musculus
taaatgtgtcagctggtttcgttca

SEQ ID NO: 747421 - DNA, 25 bp, Mus musculus
taaatgtgtcaggtggtttcgttca

SEQ ID NO: 747422 - DNA, 25 bp, Mus musculus
taaatgtgtctaaggaccctgctct

SEQ ID NO: 747423 - DNA, 25 bp, Mus musculus
taaatgtgtctatggaccctgctct

SEQ ID NO: 747424 - DNA, 25 bp, Mus musculus
taaatgtgttaaaatatccttccct

SEQ ID NO: 747425 - DNA, 25 bp, Mus musculus
taaatgtgttaatatatccttccct

SEQ ID NO: 747426 - DNA, 25 bp, Mus musculus
taaatgtgttgtaacattatgtcac

SEQ ID NO: 747427 - DNA, 25 bp, Mus musculus
taaatgtgttgttacattatgtcac

SEQ ID NO: 747428 - DNA, 25 bp, Mus musculus
taaatgttccaacctcactttttca

SEQ ID NO: 747429 - DNA, 25 bp, Mus musculus
taaatgttccaagctcactttttca

SEQ ID NO: 747430 - DNA, 25 bp, Mus musculus
taaatgttccccaattgctgggttt

SEQ ID NO: 747431 - DNA, 25 bp, Mus musculus
taaatgttcccctattgctgggttt

SEQ ID NO: 747432 - DNA, 25 bp, Mus musculus
taaatgttcctaaaccacccatcat

SEQ ID NO: 747433 - DNA, 25 bp, Mus musculus
taaatgttcctataccacccatcat

SEQ ID NO: 747434 - DNA, 25 bp, Mus musculus
taaatgttcctgaaatgtaccctgg

SEQ ID NO: 747435 - DNA, 25 bp, Mus musculus
taaatgttcctgtaatgtaccctgg

SEQ ID NO: 747436 - DNA, 25 bp, Mus musculus
taaatgttccttcagagcctgcctt

SEQ ID NO: 747437 - DNA, 25 bp, Mus musculus
taaatgttccttgagagcctgcctt

SEQ ID NO: 747438 - DNA, 25 bp, Mus musculus
taaatgttgcttccctgaagtgatg

SEQ ID NO: 747439 - DNA, 25 bp, Mus musculus
taaatgttgcttgcctgaagtgatg

SEQ ID NO: 747440 - DNA, 25 bp, Mus musculus
taaatgttgtgtctgccgcagtgca

SEQ ID NO: 747441 - DNA, 25 bp, Mus musculus
taaatgttgtgtgtgccgcagtgca

SEQ ID NO: 747442 - DNA, 25 bp, Mus musculus
taaatgttgttcaagttcctattcc

SEQ ID NO: 747443 - DNA, 25 bp, Mus musculus
taaatgttgttctagttcctattcc

SEQ ID NO: 747444 - DNA, 25 bp, Mus musculus
taaatgtttacacttcgctgggcgt

SEQ ID NO: 747445 - DNA, 25 bp, Mus musculus
taaatgtttacagttcgctgggcgt

SEQ ID NO: 747446 - DNA, 25 bp, Mus musculus
taaatgtttagaattcttcccaact

SEQ ID NO: 747447 - DNA, 25 bp, Mus musculus
taaatgtttagatttcttcccaact

SEQ ID NO: 747448 - DNA, 25 bp, Mus musculus
taaatgtttgtcattcattcatttt

SEQ ID NO: 747449 - DNA, 25 bp, Mus musculus
taaatgtttgtctttcattcatttt

SEQ ID NO: 747450 - DNA, 25 bp, Mus musculus
taaatgtttgttaccagcaagtctc

SEQ ID NO: 747451 - DNA, 25 bp, Mus musculus
taaatgtttgtttccagcaagtctc

SEQ ID NO: 747452 - DNA, 25 bp, Mus musculus
taaatgttttagacttccagtttct

SEQ ID NO: 747453 - DNA, 25 bp, Mus musculus
taaatgttttagtcttccagtttct

SEQ ID NO: 747454 - DNA, 25 bp, Mus musculus
taaatgttttcaagatgcagccaca

SEQ ID NO: 747455 - DNA, 25 bp, Mus musculus
taaatgttttcatgatgcagccaca

SEQ ID NO: 747456 - DNA, 25 bp, Mus musculus
taaatgttttcccttcttccacaga

SEQ ID NO: 747457 - DNA, 25 bp, Mus musculus
taaatgttttccgttcttccacaga

SEQ ID NO: 747458 - DNA, 25 bp, Mus musculus
taaattaaacatctgtaccactttt

SEQ ID NO: 747459 - DNA, 25 bp, Mus musculus
taaattaaacatgtgtaccactttt

SEQ ID NO: 747460 - DNA, 25 bp, Mus musculus
taaattaaacttccccgttccagat

SEQ ID NO: 747461 - DNA, 25 bp, Mus musculus
taaattaaacttgcccgttccagat

SEQ ID NO: 747462 - DNA, 25 bp, Mus musculus
taaattaacacacgtaccaggcggg

SEQ ID NO: 747463 - DNA, 25 bp, Mus musculus
taaattaacacaggtaccaggcggg

SEQ ID NO: 747464 - DNA, 25 bp, Mus musculus
taaattaaggccactctttaaagca

SEQ ID NO: 747465 - DNA, 25 bp, Mus musculus
taaattaaggcctctctttaaagca

SEQ ID NO: 747466 - DNA, 25 bp, Mus musculus
taaattaagttccaccagtgcctcc

SEQ ID NO: 747467 - DNA, 25 bp, Mus musculus
taaattaagttcgaccagtgcctcc

SEQ ID NO: 747468 - DNA, 25 bp, Mus musculus
taaattaatcttacctgagtgtttt

SEQ ID NO: 747469 - DNA, 25 bp, Mus musculus
taaattaatctttcctgagtgtttt

SEQ ID NO: 747470 - DNA, 25 bp, Mus musculus
taaattaccaacactgtcctaaggg

SEQ ID NO: 747471 - DNA, 25 bp, Mus musculus
taaattaccaactctgtcctaaggg

SEQ ID NO: 747472 - DNA, 25 bp, Mus musculus
taaattactgctcttacacctccat

SEQ ID NO: 747473 - DNA, 25 bp, Mus musculus
taaattactgctgttacacctccat

SEQ ID NO: 747474 - DNA, 25 bp, Mus musculus
taaattactgggagggtcctgaagg

SEQ ID NO: 747475 - DNA, 25 bp, Mus musculus
taaattactgggtgggtcctgaagg

SEQ ID NO: 747476 - DNA, 25 bp, Mus musculus
taaattacttcactttgccctttag

SEQ ID NO: 747477 - DNA, 25 bp, Mus musculus
taaattacttcagtttgccctttag

SEQ ID NO: 747478 - DNA, 25 bp, Mus musculus
taaattagcaaaaggctcccggacc

SEQ ID NO: 747479 - DNA, 25 bp, Mus musculus
taaattagcaaatggctcccggacc

SEQ ID NO: 747480 - DNA, 25 bp, Mus musculus
taaattataatgcatctccccagag

SEQ ID NO: 747481 - DNA, 25 bp, Mus musculus
taaattataatggatctccccagag

SEQ ID NO: 747482 - DNA, 25 bp, Mus musculus
taaattataattacccctaccatag

SEQ ID NO: 747483 - DNA, 25 bp, Mus musculus
taaattataatttcccctaccatag

SEQ ID NO: 747484 - DNA, 25 bp, Mus musculus
taaattataccaatcactcacagtg

SEQ ID NO: 747485 - DNA, 25 bp, Mus musculus
taaattataccattcactcacagtg

SEQ ID NO: 747486 - DNA, 25 bp, Mus musculus
taaattatcggtcctgactttgaac

SEQ ID NO: 747487 - DNA, 25 bp, Mus musculus
taaattatcggtgctgactttgaac

SEQ ID NO: 747488 - DNA, 25 bp, Mus musculus
taaattatgcttatatgcctcttag

SEQ ID NO: 747489 - DNA, 25 bp, Mus musculus
taaattatgcttttatgcctcttag

SEQ ID NO: 747490 - DNA, 25 bp, Mus musculus
taaattatggatcggctggatcctg

SEQ ID NO: 747491 - DNA, 25 bp, Mus musculus
taaattatggatgggctggatcctg

SEQ ID NO: 747492 - DNA, 25 bp, Mus musculus
taaattcaaaatcaactcaggctac

SEQ ID NO: 747493 - DNA, 25 bp, Mus musculus
taaattcaaaatgaactcaggctac

SEQ ID NO: 747494 - DNA, 25 bp, Mus musculus
taaattcaaatgctgcctcttacaa

SEQ ID NO: 747495 - DNA, 25 bp, Mus musculus
taaattcaaatggtgcctcttacaa

SEQ ID NO: 747496 - DNA, 25 bp, Mus musculus
taaattcaaattacaccgggaactg

SEQ ID NO: 747497 - DNA, 25 bp, Mus musculus
taaattcaaatttcaccgggaactg

SEQ ID NO: 747498 - DNA, 25 bp, Mus musculus
taaattcaactaatcgtcacttcaa

SEQ ID NO: 747499 - DNA, 25 bp, Mus musculus
taaattcaactattcgtcacttcaa

SEQ ID NO: 747500 - DNA, 25 bp, Mus musculus
taaattcactcaaaaaggcttagga

SEQ ID NO: 747501 - DNA, 25 bp, Mus musculus
taaattcactcataaaggcttagga

SEQ ID NO: 747502 - DNA, 25 bp, Mus musculus
taaattcagaaccttgaccctgcgc

SEQ ID NO: 747503 - DNA, 25 bp, Mus musculus
taaattcagaacgttgaccctgcgc

SEQ ID NO: 747504 - DNA, 25 bp, Mus musculus
taaattcagcatacctcagggcagg

SEQ ID NO: 747505 - DNA, 25 bp, Mus musculus
taaattcagcattcctcagggcagg

SEQ ID NO: 747506 - DNA, 25 bp, Mus musculus
taaattcatacgcacatactcccta

SEQ ID NO: 747507 - DNA, 25 bp, Mus musculus
taaattcatacggacatactcccta

SEQ ID NO: 747508 - DNA, 25 bp, Mus musculus
taaattcatgccaagcttagagctc

SEQ ID NO: 747509 - DNA, 25 bp, Mus musculus
taaattcatgcctagcttagagctc

SEQ ID NO: 747510 - DNA, 25 bp, Mus musculus
taaattcatggcacgcttagctgac

SEQ ID NO: 747511 - DNA, 25 bp, Mus musculus
taaattcatggctcgcttagctgac

SEQ ID NO: 747512 - DNA, 25 bp, Mus musculus
taaattcattccactgcctttatcc

SEQ ID NO: 747513 - DNA, 25 bp, Mus musculus
taaattcattcctctgcctttatcc

SEQ ID NO: 747514 - DNA, 25 bp, Mus musculus
taaattcatttccaaaaggctcctt

SEQ ID NO: 747515 - DNA, 25 bp, Mus musculus
taaattcatttcgaaaaggctcctt

SEQ ID NO: 747516 - DNA, 25 bp, Mus musculus
taaattccaagacttcttcatcccc

SEQ ID NO: 747517 - DNA, 25 bp, Mus musculus
taaattccaagagttcttcatcccc

SEQ ID NO: 747518 - DNA, 25 bp, Mus musculus
taaattccacctcctccatgaagtt

SEQ ID NO: 747519 - DNA, 25 bp, Mus musculus
taaattccacctgctccatgaagtt

SEQ ID NO: 747520 - DNA, 25 bp, Mus musculus
taaattcccagcatgtcagtagaca

SEQ ID NO: 747521 - DNA, 25 bp, Mus musculus
taaattcccagcttgtcagtagaca

SEQ ID NO: 747522 - DNA, 25 bp, Mus musculus
taaattccctataccagggagctgt

SEQ ID NO: 747523 - DNA, 25 bp, Mus musculus
taaattccctattccagggagctgt

SEQ ID NO: 747524 - DNA, 25 bp, Mus musculus
taaattcccttgcagagacatcctc

SEQ ID NO: 747525 - DNA, 25 bp, Mus musculus
taaattcccttggagagacatcctc

SEQ ID NO: 747526 - DNA, 25 bp, Mus musculus
taaattcctcaacggactgggcaat

SEQ ID NO: 747527 - DNA, 25 bp, Mus musculus
taaattcctcaagggactgggcaat

SEQ ID NO: 747528 - DNA, 25 bp, Mus musculus
taaattccttgtcagtctcgtctat

SEQ ID NO: 747529 - DNA, 25 bp, Mus musculus
taaattccttgtgagtctcgtctat

SEQ ID NO: 747530 - DNA, 25 bp, Mus musculus
taaattcgatttccaggtactgttc

SEQ ID NO: 747531 - DNA, 25 bp, Mus musculus
taaattcgatttgcaggtactgttc

SEQ ID NO: 747532 - DNA, 25 bp, Mus musculus
taaattctaatcattgtatcaaccc

SEQ ID NO: 747533 - DNA, 25 bp, Mus musculus
taaattctaatctttgtatcaaccc

SEQ ID NO: 747534 - DNA, 25 bp, Mus musculus
taaattctacctagtaagaagacat

SEQ ID NO: 747535 - DNA, 25 bp, Mus musculus
taaattctaccttgtaagaagacat

SEQ ID NO: 747536 - DNA, 25 bp, Mus musculus
taaattctactcatcacacttcatg

SEQ ID NO: 747537 - DNA, 25 bp, Mus musculus
taaattctactcttcacacttcatg

SEQ ID NO: 747538 - DNA, 25 bp, Mus musculus
taaattctatgactgctcctctgca

SEQ ID NO: 747539 - DNA, 25 bp, Mus musculus
taaattctatgagtgctcctctgca

SEQ ID NO: 747540 - DNA, 25 bp, Mus musculus
taaattctatgcagagcatggtggt

SEQ ID NO: 747541 - DNA, 25 bp, Mus musculus
taaattctatgctgagcatggtggt

SEQ ID NO: 747542 - DNA, 25 bp, Mus musculus
taaattctcatcagctgttgtagaa

SEQ ID NO: 747543 - DNA, 25 bp, Mus musculus
taaattctcatctgctgttgtagaa

SEQ ID NO: 747544 - DNA, 25 bp, Mus musculus
taaattctccagacgcaagcagcag

SEQ ID NO: 747545 - DNA, 25 bp, Mus musculus
taaattctccagtcgcaagcagcag

SEQ ID NO: 747546 - DNA, 25 bp, Mus musculus
taaattctcctcatgtctctgggag

SEQ ID NO: 747547 - DNA, 25 bp, Mus musculus
taaattctcctcttgtctctgggag

SEQ ID NO: 747548 - DNA, 25 bp, Mus musculus
taaattctctcaagtctccaaatgc

SEQ ID NO: 747549 - DNA, 25 bp, Mus musculus
taaattctctcatgtctccaaatgc

SEQ ID NO: 747550 - DNA, 25 bp, Mus musculus
taaattctctgcagcttcaagcctt

SEQ ID NO: 747551 - DNA, 25 bp, Mus musculus
taaattctctgctgcttcaagcctt

SEQ ID NO: 747552 - DNA, 25 bp, Mus musculus
taaattctctgtccttgtaccactg

SEQ ID NO: 747553 - DNA, 25 bp, Mus musculus
taaattctctgtgcttgtaccactg

SEQ ID NO: 747554 - DNA, 25 bp, Mus musculus
taaattctgactaccttgtgggttg

SEQ ID NO: 747555 - DNA, 25 bp, Mus musculus
taaattctgacttccttgtgggttg

SEQ ID NO: 747556 - DNA, 25 bp, Mus musculus
taaattctgcctcgtgttagtgctg

SEQ ID NO: 747557 - DNA, 25 bp, Mus musculus
taaattctgcctggtgttagtgctg

SEQ ID NO: 747558 - DNA, 25 bp, Mus musculus
taaattctgcgtcccggactaagcc

SEQ ID NO: 747559 - DNA, 25 bp, Mus musculus
taaattctgcgtgccggactaagcc

SEQ ID NO: 747560 - DNA, 25 bp, Mus musculus
taaattctggttctctcttctgtta

SEQ ID NO: 747561 - DNA, 25 bp, Mus musculus
taaattctggttgtctcttctgtta

SEQ ID NO: 747562 - DNA, 25 bp, Mus musculus
taaattcttgggacctgagcacagt

SEQ ID NO: 747563 - DNA, 25 bp, Mus musculus
taaattcttgggtcctgagcacagt

SEQ ID NO: 747564 - DNA, 25 bp, Mus musculus
taaattcttgttcccagcttgtggc

SEQ ID NO: 747565 - DNA, 25 bp, Mus musculus
taaattcttgttgccagcttgtggc

SEQ ID NO: 747566 - DNA, 25 bp, Mus musculus
taaattctttatactcctacctctt

SEQ ID NO: 747567 - DNA, 25 bp, Mus musculus
taaattctttattctcctacctctt

SEQ ID NO: 747568 - DNA, 25 bp, Mus musculus
taaattcttttcatcacgtgatatt

SEQ ID NO: 747569 - DNA, 25 bp, Mus musculus
taaattcttttcttcacgtgatatt

SEQ ID NO: 747570 - DNA, 25 bp, Mus musculus
taaattgaacccacttctctgtact

SEQ ID NO: 747571 - DNA, 25 bp, Mus musculus
taaattgaaccctcttctctgtact

SEQ ID NO: 747572 - DNA, 25 bp, Mus musculus
taaattgaagtgacagctttcctta

SEQ ID NO: 747573 - DNA, 25 bp, Mus musculus
taaattgaagtgtcagctttcctta

SEQ ID NO: 747574 - DNA, 25 bp, Mus musculus
taaattgactttaggcttcttccct

SEQ ID NO: 747575 - DNA, 25 bp, Mus musculus
taaattgacttttggcttcttccct

SEQ ID NO: 747576 - DNA, 25 bp, Mus musculus
taaattgagaacactgttaacattt

SEQ ID NO: 747577 - DNA, 25 bp, Mus musculus
taaattgagaactctgttaacattt

SEQ ID NO: 747578 - DNA, 25 bp, Mus musculus
taaattgagtatcctttggtttctg

SEQ ID NO: 747579 - DNA, 25 bp, Mus musculus
taaattgagtatgctttggtttctg

SEQ ID NO: 747580 - DNA, 25 bp, Mus musculus
taaattgcagctacccttcatcaca

SEQ ID NO: 747581 - DNA, 25 bp, Mus musculus
taaattgcagcttcccttcatcaca

SEQ ID NO: 747582 - DNA, 25 bp, Mus musculus
taaattgccaaaaatgttctttctc

SEQ ID NO: 747583 - DNA, 25 bp, Mus musculus
taaattgccaaatatgttctttctc

SEQ ID NO: 747584 - DNA, 25 bp, Mus musculus
taaattgcccaaagctgggccttgc

SEQ ID NO: 747585 - DNA, 25 bp, Mus musculus
taaattgcccaatgctgggccttgc

SEQ ID NO: 747586 - DNA, 25 bp, Mus musculus
taaattgccccaaacctatgctcat

SEQ ID NO: 747587 - DNA, 25 bp, Mus musculus
taaattgccccatacctatgctcat

SEQ ID NO: 747588 - DNA, 25 bp, Mus musculus
taaattgcctatcgaagcacctagc

SEQ ID NO: 747589 - DNA, 25 bp, Mus musculus
taaattgcctatggaagcacctagc

SEQ ID NO: 747590 - DNA, 25 bp, Mus musculus
taaattgccttaagtcaccatgggt

SEQ ID NO: 747591 - DNA, 25 bp, Mus musculus
taaattgccttatgtcaccatgggt

SEQ ID NO: 747592 - DNA, 25 bp, Mus musculus
taaattgccttccttaagttttgct

SEQ ID NO: 747593 - DNA, 25 bp, Mus musculus
taaattgccttcgttaagttttgct

SEQ ID NO: 747594 - DNA, 25 bp, Mus musculus
taaattgctctcatatgcctcctat

SEQ ID NO: 747595 - DNA, 25 bp, Mus musculus
taaattgctctcttatgcctcctat

SEQ ID NO: 747596 - DNA, 25 bp, Mus musculus
taaattgctgatcggtagaaaaata

SEQ ID NO: 747597 - DNA, 25 bp, Mus musculus
taaattgctgatgggtagaaaaata

SEQ ID NO: 747598 - DNA, 25 bp, Mus musculus
taaattggatccacaccatctggca

SEQ ID NO: 747599 - DNA, 25 bp, Mus musculus
taaattggatcctcaccatctggca

SEQ ID NO: 747600 - DNA, 25 bp, Mus musculus
taaattggcaaacctgactttccct

SEQ ID NO: 747601 - DNA, 25 bp, Mus musculus
taaattggcaaagctgactttccct

SEQ ID NO: 747602 - DNA, 25 bp, Mus musculus
taaattggccaacaagttagctaaa

SEQ ID NO: 747603 - DNA, 25 bp, Mus musculus
taaattggccaagaagttagctaaa

SEQ ID NO: 747604 - DNA, 25 bp, Mus musculus
taaattggctccctttgcaacttaa

SEQ ID NO: 747605 - DNA, 25 bp, Mus musculus
taaattggctccgtttgcaacttaa

SEQ ID NO: 747606 - DNA, 25 bp, Mus musculus
taaattgggcggcagtgaaatcctt

SEQ ID NO: 747607 - DNA, 25 bp, Mus musculus
taaattgggcgggagtgaaatcctt

SEQ ID NO: 747608 - DNA, 25 bp, Mus musculus
taaattgggtctctgcagtttcaca

SEQ ID NO: 747609 - DNA, 25 bp, Mus musculus
taaattgggtctgtgcagtttcaca

SEQ ID NO: 747610 - DNA, 25 bp, Mus musculus
taaattgtacgtcccgtgtgcgtgc

SEQ ID NO: 747611 - DNA, 25 bp, Mus musculus
taaattgtacgtgccgtgtgcgtgc

SEQ ID NO: 747612 - DNA, 25 bp, Mus musculus
taaattgtagttcagagagcctcga

SEQ ID NO: 747613 - DNA, 25 bp, Mus musculus
taaattgtagttgagagagcctcga

SEQ ID NO: 747614 - DNA, 25 bp, Mus musculus
taaattgtatctcaagccagtggaa

SEQ ID NO: 747615 - DNA, 25 bp, Mus musculus
taaattgtatctgaagccagtggaa

SEQ ID NO: 747616 - DNA, 25 bp, Mus musculus
taaattgtcctcaggtttcaaaaca

SEQ ID NO: 747617 - DNA, 25 bp, Mus musculus
taaattgtcctctggtttcaaaaca

SEQ ID NO: 747618 - DNA, 25 bp, Mus musculus
taaattgtcgtacttcctcttcact

SEQ ID NO: 747619 - DNA, 25 bp, Mus musculus
taaattgtcgtagttcctcttcact

SEQ ID NO: 747620 - DNA, 25 bp, Mus musculus
taaattgtctggatttgaaaccaag

SEQ ID NO: 747621 - DNA, 25 bp, Mus musculus
taaattgtctggttttgaaaccaag

SEQ ID NO: 747622 - DNA, 25 bp, Mus musculus
taaattgtcttgagggtcctcatta

SEQ ID NO: 747623 - DNA, 25 bp, Mus musculus
taaattgtcttgtgggtcctcatta

SEQ ID NO: 747624 - DNA, 25 bp, Mus musculus
taaattgtggctaccccggtgtcac

SEQ ID NO: 747625 - DNA, 25 bp, Mus musculus
taaattgtggcttccccggtgtcac

SEQ ID NO: 747626 - DNA, 25 bp, Mus musculus
taaattgtgggtcacctggcatgct

SEQ ID NO: 747627 - DNA, 25 bp, Mus musculus
taaattgtgggtgacctggcatgct

SEQ ID NO: 747628 - DNA, 25 bp, Mus musculus
taaattgtgtacatagcattttgaa

SEQ ID NO: 747629 - DNA, 25 bp, Mus musculus
taaattgtgtacttagcattttgaa

SEQ ID NO: 747630 - DNA, 25 bp, Mus musculus
taaattgttagcatacccaactgtt

SEQ ID NO: 747631 - DNA, 25 bp, Mus musculus
taaattgttagcttacccaactgtt

SEQ ID NO: 747632 - DNA, 25 bp, Mus musculus
taaattgttcacaactgtactgatg

SEQ ID NO: 747633 - DNA, 25 bp, Mus musculus
taaattgttcactactgtactgatg

SEQ ID NO: 747634 - DNA, 25 bp, Mus musculus
taaattgttccccaaacaggcctct

SEQ ID NO: 747635 - DNA, 25 bp, Mus musculus
taaattgttcccgaaacaggcctct

SEQ ID NO: 747636 - DNA, 25 bp, Mus musculus
taaattgttgatcctctttcccctc

SEQ ID NO: 747637 - DNA, 25 bp, Mus musculus
taaattgttgatgctctttcccctc

SEQ ID NO: 747638 - DNA, 25 bp, Mus musculus
taaatttaaaatcgaacgtgtagag

SEQ ID NO: 747639 - DNA, 25 bp, Mus musculus
taaatttaaaatggaacgtgtagag

SEQ ID NO: 747640 - DNA, 25 bp, Mus musculus
taaatttaaggaacccattgctaat

SEQ ID NO: 747641 - DNA, 25 bp, Mus musculus
taaatttaaggatcccattgctaat

SEQ ID NO: 747642 - DNA, 25 bp, Mus musculus
taaatttactctctctggcacagca

SEQ ID NO: 747643 - DNA, 25 bp, Mus musculus
taaatttactctgtctggcacagca

SEQ ID NO: 747644 - DNA, 25 bp, Mus musculus
taaatttataaccaggactatccct

SEQ ID NO: 747645 - DNA, 25 bp, Mus musculus
taaatttataacgaggactatccct

SEQ ID NO: 747646 - DNA, 25 bp, Mus musculus
taaatttcaataatacgccctgctt

SEQ ID NO: 747647 - DNA, 25 bp, Mus musculus
taaatttcaatattacgccctgctt

SEQ ID NO: 747648 - DNA, 25 bp, Mus musculus
taaatttcactaacacaccttggag

SEQ ID NO: 747649 - DNA, 25 bp, Mus musculus
taaatttcactatcacaccttggag

SEQ ID NO: 747650 - DNA, 25 bp, Mus musculus
taaatttcagccatcccaaatctgc

SEQ ID NO: 747651 - DNA, 25 bp, Mus musculus
taaatttcagccttcccaaatctgc

SEQ ID NO: 747652 - DNA, 25 bp, Mus musculus
taaatttccacgacttcttggaata

SEQ ID NO: 747653 - DNA, 25 bp, Mus musculus
taaatttccacgtcttcttggaata

SEQ ID NO: 747654 - DNA, 25 bp, Mus musculus
taaatttccagaaaggttagccaga

SEQ ID NO: 747655 - DNA, 25 bp, Mus musculus
taaatttccagataggttagccaga

SEQ ID NO: 747656 - DNA, 25 bp, Mus musculus
taaatttccccactatgctcacctg

SEQ ID NO: 747657 - DNA, 25 bp, Mus musculus
taaatttccccagtatgctcacctg

SEQ ID NO: 747658 - DNA, 25 bp, Mus musculus
taaatttccctcagtcctgagaggg

SEQ ID NO: 747659 - DNA, 25 bp, Mus musculus
taaatttccctctgtcctgagaggg

SEQ ID NO: 747660 - DNA, 25 bp, Mus musculus
taaatttcctaaaactctctaatgg

SEQ ID NO: 747661 - DNA, 25 bp, Mus musculus
taaatttcctaatactctctaatgg

SEQ ID NO: 747662 - DNA, 25 bp, Mus musculus
taaatttcctgcacctctatatgtt

SEQ ID NO: 747663 - DNA, 25 bp, Mus musculus
taaatttcctgctcctctatatgtt

SEQ ID NO: 747664 - DNA, 25 bp, Mus musculus
taaatttcgttcaattcctctgagg

SEQ ID NO: 747665 - DNA, 25 bp, Mus musculus
taaatttcgttctattcctctgagg

SEQ ID NO: 747666 - DNA, 25 bp, Mus musculus
taaatttctattcacgttacaggga

SEQ ID NO: 747667 - DNA, 25 bp, Mus musculus
taaatttctattgacgttacaggga

SEQ ID NO: 747668 - DNA, 25 bp, Mus musculus
taaatttctcacatcctcattggcg

SEQ ID NO: 747669 - DNA, 25 bp, Mus musculus
taaatttctcacttcctcattggcg

SEQ ID NO: 747670 - DNA, 25 bp, Mus musculus
taaatttcttagacccttcttccag

SEQ ID NO: 747671 - DNA, 25 bp, Mus musculus
taaatttcttagtcccttcttccag

SEQ ID NO: 747672 - DNA, 25 bp, Mus musculus
taaatttgaattccatgcttacact

SEQ ID NO: 747673 - DNA, 25 bp, Mus musculus
taaatttgaattgcatgcttacact

SEQ ID NO: 747674 - DNA, 25 bp, Mus musculus
taaatttgcaatatcatttccccaa

SEQ ID NO: 747675 - DNA, 25 bp, Mus musculus
taaatttgcaatttcatttccccaa

SEQ ID NO: 747676 - DNA, 25 bp, Mus musculus
taaatttgccatcactaaagtactg

SEQ ID NO: 747677 - DNA, 25 bp, Mus musculus
taaatttgccatgactaaagtactg

SEQ ID NO: 747678 - DNA, 25 bp, Mus musculus
taaatttggtgcattggcgttgtaa

SEQ ID NO: 747679 - DNA, 25 bp, Mus musculus
taaatttggtgctttggcgttgtaa

SEQ ID NO: 747680 - DNA, 25 bp, Mus musculus
taaatttggtgtatgggatttgcaa

SEQ ID NO: 747681 - DNA, 25 bp, Mus musculus
taaatttggtgtttgggatttgcaa

SEQ ID NO: 747682 - DNA, 25 bp, Mus musculus
taaatttgtccaatgcttgcctgga

SEQ ID NO: 747683 - DNA, 25 bp, Mus musculus
taaatttgtccattgcttgcctgga

SEQ ID NO: 747684 - DNA, 25 bp, Mus musculus
taaatttgtggcagtccatctgctt

SEQ ID NO: 747685 - DNA, 25 bp, Mus musculus
taaatttgtggctgtccatctgctt

SEQ ID NO: 747686 - DNA, 25 bp, Mus musculus
taaattttatgaaccccaggcatac

SEQ ID NO: 747687 - DNA, 25 bp, Mus musculus
taaattttatgatccccaggcatac

SEQ ID NO: 747688 - DNA, 25 bp, Mus musculus
taaattttattcactgttaacagat

SEQ ID NO: 747689 - DNA, 25 bp, Mus musculus
taaattttattctctgttaacagat

SEQ ID NO: 747690 - DNA, 25 bp, Mus musculus
taaattttcattacatgcacagtga

SEQ ID NO: 747691 - DNA, 25 bp, Mus musculus
taaattttcatttcatgcacagtga

SEQ ID NO: 747692 - DNA, 25 bp, Mus musculus
taaattttcccaattatttgcccat

SEQ ID NO: 747693 - DNA, 25 bp, Mus musculus
taaattttcccatttatttgcccat

SEQ ID NO: 747694 - DNA, 25 bp, Mus musculus
taaattttctaactacctgccgtgt

SEQ ID NO: 747695 - DNA, 25 bp, Mus musculus
taaattttctaagtacctgccgtgt

SEQ ID NO: 747696 - DNA, 25 bp, Mus musculus
taaattttgattctgtccgccgacg

SEQ ID NO: 747697 - DNA, 25 bp, Mus musculus
taaattttgattgtgtccgccgacg

SEQ ID NO: 747698 - DNA, 25 bp, Mus musculus
taaattttgccccttttatgaggat

SEQ ID NO: 747699 - DNA, 25 bp, Mus musculus
taaattttgcccgttttatgaggat

SEQ ID NO: 747700 - DNA, 25 bp, Mus musculus
taaattttggtcatctgagccgggc

SEQ ID NO: 747701 - DNA, 25 bp, Mus musculus
taaattttggtcttctgagccgggc

SEQ ID NO: 747702 - DNA, 25 bp, Mus musculus
taaattttgtctatcaatcttagaa

SEQ ID NO: 747703 - DNA, 25 bp, Mus musculus
taaattttgtctttcaatcttagaa

SEQ ID NO: 747704 - DNA, 25 bp, Mus musculus
taaatttttataccagtttagcagc

SEQ ID NO: 747705 - DNA, 25 bp, Mus musculus
taaatttttatagcagtttagcagc

SEQ ID NO: 747706 - DNA, 25 bp, Mus musculus
taaatttttatgactgcatgcaggc

SEQ ID NO: 747707 - DNA, 25 bp, Mus musculus
taaatttttatgtctgcatgcaggc

SEQ ID NO: 747708 - DNA, 25 bp, Mus musculus
taaatttttctcactacccatagtg

SEQ ID NO: 747709 - DNA, 25 bp, Mus musculus
taaatttttctctctacccatagtg

SEQ ID NO: 747710 - DNA, 25 bp, Mus musculus
taaatttttgttacaactcctcctg

SEQ ID NO: 747711 - DNA, 25 bp, Mus musculus
taaatttttgtttcaactcctcctg

SEQ ID NO: 747712 - DNA, 25 bp, Mus musculus
taacaaaaaccaaccatccttcact

SEQ ID NO: 747713 - DNA, 25 bp, Mus musculus
taacaaaaaccatccatccttcact

SEQ ID NO: 747714 - DNA, 25 bp, Mus musculus
taacaaacacagctgcatgggcaat

SEQ ID NO: 747715 - DNA, 25 bp, Mus musculus
taacaaacacaggtgcatgggcaat

SEQ ID NO: 747716 - DNA, 25 bp, Mus musculus
taacaaacacataggcattgcctgg

SEQ ID NO: 747717 - DNA, 25 bp, Mus musculus
taacaaacacattggcattgcctgg

SEQ ID NO: 747718 - DNA, 25 bp, Mus musculus
taacaaacccatctctgctttcaga

SEQ ID NO: 747719 - DNA, 25 bp, Mus musculus
taacaaacccatgtctgctttcaga

SEQ ID NO: 747720 - DNA, 25 bp, Mus musculus
taacaaacctcaactaagcccacat

SEQ ID NO: 747721 - DNA, 25 bp, Mus musculus
taacaaacctcatctaagcccacat

SEQ ID NO: 747722 - DNA, 25 bp, Mus musculus
taacaaacgggaacctgtcttcttc

SEQ ID NO: 747723 - DNA, 25 bp, Mus musculus
taacaaacgggatcctgtcttcttc

SEQ ID NO: 747724 - DNA, 25 bp, Mus musculus
taacaaactgctaatttaggctttt

SEQ ID NO: 747725 - DNA, 25 bp, Mus musculus
taacaaactgcttatttaggctttt

SEQ ID NO: 747726 - DNA, 25 bp, Mus musculus
taacaaactggaaacctgtctctct

SEQ ID NO: 747727 - DNA, 25 bp, Mus musculus
taacaaactggatacctgtctctct

SEQ ID NO: 747728 - DNA, 25 bp, Mus musculus
taacaaagaaccctggaggcccata

SEQ ID NO: 747729 - DNA, 25 bp, Mus musculus
taacaaagaaccgtggaggcccata

SEQ ID NO: 747730 - DNA, 25 bp, Mus musculus
taacaaagccgcattgatttccttt

SEQ ID NO: 747731 - DNA, 25 bp, Mus musculus
taacaaagccgctttgatttccttt

SEQ ID NO: 747732 - DNA, 25 bp, Mus musculus
taacaaagcctaatatgtgcatgta

SEQ ID NO: 747733 - DNA, 25 bp, Mus musculus
taacaaagcctacttcagtccatgg

SEQ ID NO: 747734 - DNA, 25 bp, Mus musculus
taacaaagcctagttcagtccatgg

SEQ ID NO: 747735 - DNA, 25 bp, Mus musculus
taacaaagcctattatgtgcatgta

SEQ ID NO: 747736 - DNA, 25 bp, Mus musculus
taacaaagcttgagtatttatcaaa

SEQ ID NO: 747737 - DNA, 25 bp, Mus musculus
taacaaagcttgtgtatttatcaaa

SEQ ID NO: 747738 - DNA, 25 bp, Mus musculus
taacaaagtcttatatccccgtcct

SEQ ID NO: 747739 - DNA, 25 bp, Mus musculus
taacaaagtcttttatccccgtcct

SEQ ID NO: 747740 - DNA, 25 bp, Mus musculus
taacaaagtttgcagctgagacgaa

SEQ ID NO: 747741 - DNA, 25 bp, Mus musculus
taacaaagtttggagctgagacgaa

SEQ ID NO: 747742 - DNA, 25 bp, Mus musculus
taacaaatggatccggttttttcac

SEQ ID NO: 747743 - DNA, 25 bp, Mus musculus
taacaaatggatgcggttttttcac

SEQ ID NO: 747744 - DNA, 25 bp, Mus musculus
taacaacaccccagctaggagcata

SEQ ID NO: 747745 - DNA, 25 bp, Mus musculus
taacaacacccctgctaggagcata

SEQ ID NO: 747746 - DNA, 25 bp, Mus musculus
taacaacatcacatctaaggcagtt

SEQ ID NO: 747747 - DNA, 25 bp, Mus musculus
taacaacatcacttctaaggcagtt

SEQ ID NO: 747748 - DNA, 25 bp, Mus musculus
taacaacatgccagtgacggcccgt

SEQ ID NO: 747749 - DNA, 25 bp, Mus musculus
taacaacatgcctgtgacggcccgt

SEQ ID NO: 747750 - DNA, 25 bp, Mus musculus
taacaacattgccttctgggcgggt

SEQ ID NO: 747751 - DNA, 25 bp, Mus musculus
taacaacattgcgttctgggcgggt

SEQ ID NO: 747752 - DNA, 25 bp, Mus musculus
taacaaccacccaaatccatttttg

SEQ ID NO: 747753 - DNA, 25 bp, Mus musculus
taacaaccaccctaatccatttttg

SEQ ID NO: 747754 - DNA, 25 bp, Mus musculus
taacaacccaacaccagagacaggt

SEQ ID NO: 747755 - DNA, 25 bp, Mus musculus
taacaacccaactccagagacaggt

SEQ ID NO: 747756 - DNA, 25 bp, Mus musculus
taacaaccccttcgagtgcgactgc

SEQ ID NO: 747757 - DNA, 25 bp, Mus musculus
taacaaccccttctgcttttaagtg

SEQ ID NO: 747758 - DNA, 25 bp, Mus musculus
taacaaccccttggagtgcgactgc

SEQ ID NO: 747759 - DNA, 25 bp, Mus musculus
taacaaccccttgtgcttttaagtg

SEQ ID NO: 747760 - DNA, 25 bp, Mus musculus
taacaaccctagatctggacggtcc

SEQ ID NO: 747761 - DNA, 25 bp, Mus musculus
taacaaccctagttctggacggtcc

SEQ ID NO: 747762 - DNA, 25 bp, Mus musculus
taacaacctaacacgatcctggagc

SEQ ID NO: 747763 - DNA, 25 bp, Mus musculus
taacaacctaactcgatcctggagc

SEQ ID NO: 747764 - DNA, 25 bp, Mus musculus
taacaacctctccagtccatttaaa

SEQ ID NO: 747765 - DNA, 25 bp, Mus musculus
taacaacctctcgagtccatttaaa

SEQ ID NO: 747766 - DNA, 25 bp, Mus musculus
taacaacgcagacgcacgctgatcc

SEQ ID NO: 747767 - DNA, 25 bp, Mus musculus
taacaacgcagaggcacgctgatcc

SEQ ID NO: 747768 - DNA, 25 bp, Mus musculus
taacaactactgaagagctcgagat

SEQ ID NO: 747769 - DNA, 25 bp, Mus musculus
taacaactactgtagagctcgagat

SEQ ID NO: 747770 - DNA, 25 bp, Mus musculus
taacaactctcgcaaggtggccagt

SEQ ID NO: 747771 - DNA, 25 bp, Mus musculus
taacaactctcggaaggtggccagt

SEQ ID NO: 747772 - DNA, 25 bp, Mus musculus
taacaactggaacccctggtgtcat

SEQ ID NO: 747773 - DNA, 25 bp, Mus musculus
taacaactggaagccctggtgtcat

SEQ ID NO: 747774 - DNA, 25 bp, Mus musculus
taacaactgttgctgtgcaccactg

SEQ ID NO: 747775 - DNA, 25 bp, Mus musculus
taacaactgttggtgtgcaccactg

SEQ ID NO: 747776 - DNA, 25 bp, Mus musculus
taacaacttgaactcctcccactaa

SEQ ID NO: 747777 - DNA, 25 bp, Mus musculus
taacaacttgaagtcctcccactaa

SEQ ID NO: 747778 - DNA, 25 bp, Mus musculus
taacaagacaacaacctgacactga

SEQ ID NO: 747779 - DNA, 25 bp, Mus musculus
taacaagacaactacctgacactga

SEQ ID NO: 747780 - DNA, 25 bp, Mus musculus
taacaagatgtacactcctcagggc

SEQ ID NO: 747781 - DNA, 25 bp, Mus musculus
taacaagatgtagactcctcagggc

SEQ ID NO: 747782 - DNA, 25 bp, Mus musculus
taacaagcaagaatccactccaggg

SEQ ID NO: 747783 - DNA, 25 bp, Mus musculus
taacaagcaagattccactccaggg

SEQ ID NO: 747784 - DNA, 25 bp, Mus musculus
taacaagcacaacaccgtgggcaca

SEQ ID NO: 747785 - DNA, 25 bp, Mus musculus
taacaagcacaagaccgtgggcaca

SEQ ID NO: 747786 - DNA, 25 bp, Mus musculus
taacaagcagcgatggcatccagat

SEQ ID NO: 747787 - DNA, 25 bp, Mus musculus
taacaagcagcgttggcatccagat

SEQ ID NO: 747788 - DNA, 25 bp, Mus musculus
taacaagcatgtaggtggctgtagt

SEQ ID NO: 747789 - DNA, 25 bp, Mus musculus
taacaagcatgttggtggctgtagt

SEQ ID NO: 747790 - DNA, 25 bp, Mus musculus
taacaagcgcacagagtacctcact

SEQ ID NO: 747791 - DNA, 25 bp, Mus musculus
taacaagcgcactgagtacctcact

SEQ ID NO: 747792 - DNA, 25 bp, Mus musculus
taacaaggcgccctgaggatttgat

SEQ ID NO: 747793 - DNA, 25 bp, Mus musculus
taacaaggcgccgtgaggatttgat

SEQ ID NO: 747794 - DNA, 25 bp, Mus musculus
taacaaggctacatgtgctccccaa

SEQ ID NO: 747795 - DNA, 25 bp, Mus musculus
taacaaggctacttgtgctccccaa

SEQ ID NO: 747796 - DNA, 25 bp, Mus musculus
taacaaggctagcatgtcatttttt

SEQ ID NO: 747797 - DNA, 25 bp, Mus musculus
taacaaggctaggatgtcatttttt

SEQ ID NO: 747798 - DNA, 25 bp, Mus musculus
taacaaggctctcggaagtcaagaa

SEQ ID NO: 747799 - DNA, 25 bp, Mus musculus
taacaaggctctgggaagtcaagaa

SEQ ID NO: 747800 - DNA, 25 bp, Mus musculus
taacaagtgaataggctgtagcatc

SEQ ID NO: 747801 - DNA, 25 bp, Mus musculus
taacaagtgaattggctgtagcatc

SEQ ID NO: 747802 - DNA, 25 bp, Mus musculus
taacaagtgctacccttagggtggg

SEQ ID NO: 747803 - DNA, 25 bp, Mus musculus
taacaagtgctagccttagggtggg

SEQ ID NO: 747804 - DNA, 25 bp, Mus musculus
taacaagtgctgcagtttgcccacc

SEQ ID NO: 747805 - DNA, 25 bp, Mus musculus
taacaagtgctggagtttgcccacc

SEQ ID NO: 747806 - DNA, 25 bp, Mus musculus
taacaagtgtgtaccctacatccag

SEQ ID NO: 747807 - DNA, 25 bp, Mus musculus
taacaagtgtgttccctacatccag

SEQ ID NO: 747808 - DNA, 25 bp, Mus musculus
taacaagttcccagccactgagacc

SEQ ID NO: 747809 - DNA, 25 bp, Mus musculus
taacaagttccctgccactgagacc

SEQ ID NO: 747810 - DNA, 25 bp, Mus musculus
taacaagttctcagggtttccagta

SEQ ID NO: 747811 - DNA, 25 bp, Mus musculus
taacaagttctctgggtttccagta

SEQ ID NO: 747812 - DNA, 25 bp, Mus musculus
taacaagttctgctccagcctggtc

SEQ ID NO: 747813 - DNA, 25 bp, Mus musculus
taacaagttctggtccagcctggtc

SEQ ID NO: 747814 - DNA, 25 bp, Mus musculus
taacaagttggacgccagtgagatc

SEQ ID NO: 747815 - DNA, 25 bp, Mus musculus
taacaagttggaggccagtgagatc

SEQ ID NO: 747816 - DNA, 25 bp, Mus musculus
taacaagttgttactgcttctcaga

SEQ ID NO: 747817 - DNA, 25 bp, Mus musculus
taacaagttgtttctgcttctcaga

SEQ ID NO: 747818 - DNA, 25 bp, Mus musculus
taacaagtttcgcaactgttgcctt

SEQ ID NO: 747819 - DNA, 25 bp, Mus musculus
taacaagtttcggaactgttgcctt

SEQ ID NO: 747820 - DNA, 25 bp, Mus musculus
taacaatacaggactctttcgaggc

SEQ ID NO: 747821 - DNA, 25 bp, Mus musculus
taacaatacaggtctctttcgaggc

SEQ ID NO: 747822 - DNA, 25 bp, Mus musculus
taacaatactgaaaataccccacat

SEQ ID NO: 747823 - DNA, 25 bp, Mus musculus
taacaatactgataataccccacat

SEQ ID NO: 747824 - DNA, 25 bp, Mus musculus
taacaatagttcactaggttttata

SEQ ID NO: 747825 - DNA, 25 bp, Mus musculus
taacaatagttctctaggttttata

SEQ ID NO: 747826 - DNA, 25 bp, Mus musculus
taacaatcaaagcatgctccaggca

SEQ ID NO: 747827 - DNA, 25 bp, Mus musculus
taacaatcaaaggatgctccaggca

SEQ ID NO: 747828 - DNA, 25 bp, Mus musculus
taacaatcagctctgttgttccaaa

SEQ ID NO: 747829 - DNA, 25 bp, Mus musculus
taacaatcagctgtgttgttccaaa

SEQ ID NO: 747830 - DNA, 25 bp, Mus musculus
taacaatccgctaggacatgaacaa

SEQ ID NO: 747831 - DNA, 25 bp, Mus musculus
taacaatccgcttggacatgaacaa

SEQ ID NO: 747832 - DNA, 25 bp, Mus musculus
taacaatctagtacctccctctgga

SEQ ID NO: 747833 - DNA, 25 bp, Mus musculus
taacaatctagttcctccctctgga

SEQ ID NO: 747834 - DNA, 25 bp, Mus musculus
taacaatgacatcctgtgcctacgg

SEQ ID NO: 747835 - DNA, 25 bp, Mus musculus
taacaatgacatgctgtgcctacgg

SEQ ID NO: 747836 - DNA, 25 bp, Mus musculus
taacaatgaccaacacaggatctat

SEQ ID NO: 747837 - DNA, 25 bp, Mus musculus
taacaatgaccatcacaggatctat

SEQ ID NO: 747838 - DNA, 25 bp, Mus musculus
taacaatgatctacttcctgaacat

SEQ ID NO: 747839 - DNA, 25 bp, Mus musculus
taacaatgatctcggagctcggctc

SEQ ID NO: 747840 - DNA, 25 bp, Mus musculus
taacaatgatctgggagctcggctc

SEQ ID NO: 747841 - DNA, 25 bp, Mus musculus
taacaatgatcttcttcctgaacat

SEQ ID NO: 747842 - DNA, 25 bp, Mus musculus
taacaatgccacactggagccaggg

SEQ ID NO: 747843 - DNA, 25 bp, Mus musculus
taacaatgccactctggagccaggg

SEQ ID NO: 747844 - DNA, 25 bp, Mus musculus
taacaatgcttcaggaaacgaatgc

SEQ ID NO: 747845 - DNA, 25 bp, Mus musculus
taacaatgcttctggaaacgaatgc

SEQ ID NO: 747846 - DNA, 25 bp, Mus musculus
taacaatgtcatcgtccccaaggtg

SEQ ID NO: 747847 - DNA, 25 bp, Mus musculus
taacaatgtcatggtccccaaggtg

SEQ ID NO: 747848 - DNA, 25 bp, Mus musculus
taacaattacctatcccagattccg

SEQ ID NO: 747849 - DNA, 25 bp, Mus musculus
taacaattacctttcccagattccg

SEQ ID NO: 747850 - DNA, 25 bp, Mus musculus
taacaattctccaattctgcctggt

SEQ ID NO: 747851 - DNA, 25 bp, Mus musculus
taacaattctcctattctgcctggt

SEQ ID NO: 747852 - DNA, 25 bp, Mus musculus
taacaattgggtcctgcccatgtgg

SEQ ID NO: 747853 - DNA, 25 bp, Mus musculus
taacaattgggtgctgcccatgtgg

SEQ ID NO: 747854 - DNA, 25 bp, Mus musculus
taacaattggtaaagctcactgtga

SEQ ID NO: 747855 - DNA, 25 bp, Mus musculus
taacaattggtatagctcactgtga

SEQ ID NO: 747856 - DNA, 25 bp, Mus musculus
taacaattggttagtcatctgaaaa

SEQ ID NO: 747857 - DNA, 25 bp, Mus musculus
taacaattggtttgtcatctgaaaa

SEQ ID NO: 747858 - DNA, 25 bp, Mus musculus
taacaattgtggattttactgtttt

SEQ ID NO: 747859 - DNA, 25 bp, Mus musculus
taacaattgtggtttttactgtttt

SEQ ID NO: 747860 - DNA, 25 bp, Mus musculus
taacaattgtgtcgtgatcttctca

SEQ ID NO: 747861 - DNA, 25 bp, Mus musculus
taacaattgtgtggtgatcttctca

SEQ ID NO: 747862 - DNA, 25 bp, Mus musculus
taacaatttaatctgtgactgtgac

SEQ ID NO: 747863 - DNA, 25 bp, Mus musculus
taacaatttaatgtgtgactgtgac

SEQ ID NO: 747864 - DNA, 25 bp, Mus musculus
taacacaaccttagaccctctctag

SEQ ID NO: 747865 - DNA, 25 bp, Mus musculus
taacacaacctttgaccctctctag

SEQ ID NO: 747866 - DNA, 25 bp, Mus musculus
taacacaaggcacagagaatttact

SEQ ID NO: 747867 - DNA, 25 bp, Mus musculus
taacacaaggcagagagaatttact

SEQ ID NO: 747868 - DNA, 25 bp, Mus musculus
taacacaatggtattctttcatccc

SEQ ID NO: 747869 - DNA, 25 bp, Mus musculus
taacacaatggttttctttcatccc

SEQ ID NO: 747870 - DNA, 25 bp, Mus musculus
taacacacatataggacgactagta

SEQ ID NO: 747871 - DNA, 25 bp, Mus musculus
taacacacatattggacgactagta

SEQ ID NO: 747872 - DNA, 25 bp, Mus musculus
taacacacattaagagtcagactgt

SEQ ID NO: 747873 - DNA, 25 bp, Mus musculus
taacacacattatgagtcagactgt

SEQ ID NO: 747874 - DNA, 25 bp, Mus musculus
taacacaccaaaaacgttcctattg

SEQ ID NO: 747875 - DNA, 25 bp, Mus musculus
taacacaccaaatacgttcctattg

SEQ ID NO: 747876 - DNA, 25 bp, Mus musculus
taacacaccctaagctgatgaagac

SEQ ID NO: 747877 - DNA, 25 bp, Mus musculus
taacacaccctatgctgatgaagac

SEQ ID NO: 747878 - DNA, 25 bp, Mus musculus
taacacacctgcactactagacttt

SEQ ID NO: 747879 - DNA, 25 bp, Mus musculus
taacacacctgctctactagacttt

SEQ ID NO: 747880 - DNA, 25 bp, Mus musculus
taacacactaggagaaccccattcc

SEQ ID NO: 747881 - DNA, 25 bp, Mus musculus
taacacactaggtgaaccccattcc

SEQ ID NO: 747882 - DNA, 25 bp, Mus musculus
taacacactataaacttccaagaag

SEQ ID NO: 747883 - DNA, 25 bp, Mus musculus
taacacactatatacttccaagaag

SEQ ID NO: 747884 - DNA, 25 bp, Mus musculus
taacacactcccatcaaagacttgt

SEQ ID NO: 747885 - DNA, 25 bp, Mus musculus
taacacactcccttcaaagacttgt

SEQ ID NO: 747886 - DNA, 25 bp, Mus musculus
taacacactgttaccctgcagaggc

SEQ ID NO: 747887 - DNA, 25 bp, Mus musculus
taacacactgtttccctgcagaggc

SEQ ID NO: 747888 - DNA, 25 bp, Mus musculus
taacacagactaccccaagacaggt

SEQ ID NO: 747889 - DNA, 25 bp, Mus musculus
taacacagactagcccaagacaggt

SEQ ID NO: 747890 - DNA, 25 bp, Mus musculus
taacacagcctgcatagaccttctc

SEQ ID NO: 747891 - DNA, 25 bp, Mus musculus
taacacagcctggatagaccttctc

SEQ ID NO: 747892 - DNA, 25 bp, Mus musculus
taacacagctcactccatggaagga

SEQ ID NO: 747893 - DNA, 25 bp, Mus musculus
taacacagctcagtccatggaagga

SEQ ID NO: 747894 - DNA, 25 bp, Mus musculus
taacacaggaatacttcaaccccag

SEQ ID NO: 747895 - DNA, 25 bp, Mus musculus
taacacaggaattcttcaaccccag

SEQ ID NO: 747896 - DNA, 25 bp, Mus musculus
taacacaggaggatgcacggtcttc

SEQ ID NO: 747897 - DNA, 25 bp, Mus musculus
taacacaggaggttgcacggtcttc

SEQ ID NO: 747898 - DNA, 25 bp, Mus musculus
taacacaggcgaccggtttcagatg

SEQ ID NO: 747899 - DNA, 25 bp, Mus musculus
taacacaggcgagcggtttcagatg

SEQ ID NO: 747900 - DNA, 25 bp, Mus musculus
taacacaggttcaggcaggaaagaa

SEQ ID NO: 747901 - DNA, 25 bp, Mus musculus
taacacaggttctggcaggaaagaa

SEQ ID NO: 747902 - DNA, 25 bp, Mus musculus
taacacagtatccttcagattcccc

SEQ ID NO: 747903 - DNA, 25 bp, Mus musculus
taacacagtatcgttcagattcccc

SEQ ID NO: 747904 - DNA, 25 bp, Mus musculus
taacacagtgatacctcgcttctct

SEQ ID NO: 747905 - DNA, 25 bp, Mus musculus
taacacagtgatctccaactcttca

SEQ ID NO: 747906 - DNA, 25 bp, Mus musculus
taacacagtgatgtccaactcttca

SEQ ID NO: 747907 - DNA, 25 bp, Mus musculus
taacacagtgattcctcgcttctct

SEQ ID NO: 747908 - DNA, 25 bp, Mus musculus
taacacatacacacttaccctattg

SEQ ID NO: 747909 - DNA, 25 bp, Mus musculus
taacacatacactcttaccctattg

SEQ ID NO: 747910 - DNA, 25 bp, Mus musculus
taacacataccaattgtacacaatg

SEQ ID NO: 747911 - DNA, 25 bp, Mus musculus
taacacataccatttgtacacaatg

SEQ ID NO: 747912 - DNA, 25 bp, Mus musculus
taacacatagacaacgacaggaagt

SEQ ID NO: 747913 - DNA, 25 bp, Mus musculus
taacacatagactacgacaggaagt

SEQ ID NO: 747914 - DNA, 25 bp, Mus musculus
taacacatcaacaatgggtcagcaa

SEQ ID NO: 747915 - DNA, 25 bp, Mus musculus
taacacatcaactatgggtcagcaa

SEQ ID NO: 747916 - DNA, 25 bp, Mus musculus
taacacatcattacagtacctgcta

SEQ ID NO: 747917 - DNA, 25 bp, Mus musculus
taacacatcatttcagtacctgcta

SEQ ID NO: 747918 - DNA, 25 bp, Mus musculus
taacacatcttaattcaggtcccag

SEQ ID NO: 747919 - DNA, 25 bp, Mus musculus
taacacatcttatttcaggtcccag

SEQ ID NO: 747920 - DNA, 25 bp, Mus musculus
taacacatgcccctgggttcaatcc

SEQ ID NO: 747921 - DNA, 25 bp, Mus musculus
taacacatgcccgtgggttcaatcc

SEQ ID NO: 747922 - DNA, 25 bp, Mus musculus
taacacatgggaaccaccggactgt

SEQ ID NO: 747923 - DNA, 25 bp, Mus musculus
taacacatgggatccaccggactgt

SEQ ID NO: 747924 - DNA, 25 bp, Mus musculus
taacacattaagatttcagtagcat

SEQ ID NO: 747925 - DNA, 25 bp, Mus musculus
taacacattaagttttcagtagcat

SEQ ID NO: 747926 - DNA, 25 bp, Mus musculus
taacacattcatccttacgggtaat

SEQ ID NO: 747927 - DNA, 25 bp, Mus musculus
taacacattcatgcttacgggtaat

SEQ ID NO: 747928 - DNA, 25 bp, Mus musculus
taacacattttgataccagtgcatg

SEQ ID NO: 747929 - DNA, 25 bp, Mus musculus
taacacattttgttaccagtgcatg

SEQ ID NO: 747930 - DNA, 25 bp, Mus musculus
taacaccaaaagctgcctcttgata

SEQ ID NO: 747931 - DNA, 25 bp, Mus musculus
taacaccaaaaggtgcctcttgata

SEQ ID NO: 747932 - DNA, 25 bp, Mus musculus
taacaccacaaaatgatcccacctt

SEQ ID NO: 747933 - DNA, 25 bp, Mus musculus
taacaccacaaattgatcccacctt

SEQ ID NO: 747934 - DNA, 25 bp, Mus musculus
taacaccaggttagtgtcatgctgt

SEQ ID NO: 747935 - DNA, 25 bp, Mus musculus
taacaccaggtttgtgtcatgctgt

SEQ ID NO: 747936 - DNA, 25 bp, Mus musculus
taacaccatggtacagacccatctt

SEQ ID NO: 747937 - DNA, 25 bp, Mus musculus
taacaccatggttcagacccatctt

SEQ ID NO: 747938 - DNA, 25 bp, Mus musculus
taacacccaggaattgtttccactg

SEQ ID NO: 747939 - DNA, 25 bp, Mus musculus
taacacccaggatttgtttccactg

SEQ ID NO: 747940 - DNA, 25 bp, Mus musculus
taacacccatccatctgtaattaac

SEQ ID NO: 747941 - DNA, 25 bp, Mus musculus
taacacccatccttctgtaattaac

SEQ ID NO: 747942 - DNA, 25 bp, Mus musculus
taacaccccagacgttaggcagaag

SEQ ID NO: 747943 - DNA, 25 bp, Mus musculus
taacaccccagaggttaggcagaag

SEQ ID NO: 747944 - DNA, 25 bp, Mus musculus
taacacccgtgaactgcactggtac

SEQ ID NO: 747945 - DNA, 25 bp, Mus musculus
taacacccgtgatctgcactggtac

SEQ ID NO: 747946 - DNA, 25 bp, Mus musculus
taacaccctcttaggcctgggaaag

SEQ ID NO: 747947 - DNA, 25 bp, Mus musculus
taacaccctctttggcctgggaaag

SEQ ID NO: 747948 - DNA, 25 bp, Mus musculus
taacaccgggtacacttacttagat

SEQ ID NO: 747949 - DNA, 25 bp, Mus musculus
taacaccgggtagacttacttagat

SEQ ID NO: 747950 - DNA, 25 bp, Mus musculus
taacacctaattctgaccttgggaa

SEQ ID NO: 747951 - DNA, 25 bp, Mus musculus
taacacctaattgtgaccttgggaa

SEQ ID NO: 747952 - DNA, 25 bp, Mus musculus
taacacctccatctggtggctgtac

SEQ ID NO: 747953 - DNA, 25 bp, Mus musculus
taacacctccatgtggtggctgtac

SEQ ID NO: 747954 - DNA, 25 bp, Mus musculus
taacacctccgactgcagaactcag

SEQ ID NO: 747955 - DNA, 25 bp, Mus musculus
taacacctccgagtgcagaactcag

SEQ ID NO: 747956 - DNA, 25 bp, Mus musculus
taacacctgacactctactctaata

SEQ ID NO: 747957 - DNA, 25 bp, Mus musculus
taacacctgacagtctactctaata

SEQ ID NO: 747958 - DNA, 25 bp, Mus musculus
taacacctgtatagctgtttgtgtg

SEQ ID NO: 747959 - DNA, 25 bp, Mus musculus
taacacctgtattgctgtttgtgtg

SEQ ID NO: 747960 - DNA, 25 bp, Mus musculus
taacaccttatcaaacaaaatctgg

SEQ ID NO: 747961 - DNA, 25 bp, Mus musculus
taacaccttatctaacaaaatctgg

SEQ ID NO: 747962 - DNA, 25 bp, Mus musculus
taacaccttcgtaccctgagacttt

SEQ ID NO: 747963 - DNA, 25 bp, Mus musculus
taacaccttcgttccctgagacttt

SEQ ID NO: 747964 - DNA, 25 bp, Mus musculus
taacaccttctgacctcatgggtac

SEQ ID NO: 747965 - DNA, 25 bp, Mus musculus
taacaccttctgtcctcatgggtac

SEQ ID NO: 747966 - DNA, 25 bp, Mus musculus
taacacgatctcattaagggtatga

SEQ ID NO: 747967 - DNA, 25 bp, Mus musculus
taacacgatctctttaagggtatga

SEQ ID NO: 747968 - DNA, 25 bp, Mus musculus
taacacgattttcttcttatcttaa

SEQ ID NO: 747969 - DNA, 25 bp, Mus musculus
taacacgattttgttcttatcttaa

SEQ ID NO: 747970 - DNA, 25 bp, Mus musculus
taacacgcgaacaggagccccagct

SEQ ID NO: 747971 - DNA, 25 bp, Mus musculus
taacacgcgaactggagccccagct

SEQ ID NO: 747972 - DNA, 25 bp, Mus musculus
taacacgcggtgcacttcggagcct

SEQ ID NO: 747973 - DNA, 25 bp, Mus musculus
taacacgcggtggacttcggagcct

SEQ ID NO: 747974 - DNA, 25 bp, Mus musculus
taacacgggaacatgtctggagaat

SEQ ID NO: 747975 - DNA, 25 bp, Mus musculus
taacacgggaacttgtctggagaat

SEQ ID NO: 747976 - DNA, 25 bp, Mus musculus
taacacgggtaccactagttcttgt

SEQ ID NO: 747977 - DNA, 25 bp, Mus musculus
taacacgggtacgactagttcttgt

SEQ ID NO: 747978 - DNA, 25 bp, Mus musculus
taacacgtacggaaggatcaccaag

SEQ ID NO: 747979 - DNA, 25 bp, Mus musculus
taacacgtacggtaggatcaccaag

SEQ ID NO: 747980 - DNA, 25 bp, Mus musculus
taacacgtacttcttgtttgttcct

SEQ ID NO: 747981 - DNA, 25 bp, Mus musculus
taacacgtacttgttgtttgttcct

SEQ ID NO: 747982 - DNA, 25 bp, Mus musculus
taacacgtccaacctgcctttgtta

SEQ ID NO: 747983 - DNA, 25 bp, Mus musculus
taacacgtccaagctgcctttgtta

SEQ ID NO: 747984 - DNA, 25 bp, Mus musculus
taacacgtccttagtgatgctgaca

SEQ ID NO: 747985 - DNA, 25 bp, Mus musculus
taacacgtcctttgtgatgctgaca

SEQ ID NO: 747986 - DNA, 25 bp, Mus musculus
taacactaaacaaaggccagcaagt

SEQ ID NO: 747987 - DNA, 25 bp, Mus musculus
taacactaaacataggccagcaagt

SEQ ID NO: 747988 - DNA, 25 bp, Mus musculus
taacactaacagattcctttccagc

SEQ ID NO: 747989 - DNA, 25 bp, Mus musculus
taacactaacagtttcctttccagc

SEQ ID NO: 747990 - DNA, 25 bp, Mus musculus
taacactaagtgctccagctggaat

SEQ ID NO: 747991 - DNA, 25 bp, Mus musculus
taacactaagtggtccagctggaat

SEQ ID NO: 747992 - DNA, 25 bp, Mus musculus
taacactacagtaagctgcaagaaa

SEQ ID NO: 747993 - DNA, 25 bp, Mus musculus
taacactacagttagctgcaagaaa

SEQ ID NO: 747994 - DNA, 25 bp, Mus musculus
taacactagtgtactgattgcagct

SEQ ID NO: 747995 - DNA, 25 bp, Mus musculus
taacactagtgttctgattgcagct

SEQ ID NO: 747996 - DNA, 25 bp, Mus musculus
taacactatgacattaccgtatttt

SEQ ID NO: 747997 - DNA, 25 bp, Mus musculus
taacactatgactttaccgtatttt

SEQ ID NO: 747998 - DNA, 25 bp, Mus musculus
taacactattctactgtccagactc

SEQ ID NO: 747999 - DNA, 25 bp, Mus musculus
taacactattcttctgtccagactc

SEQ ID NO: 748000 - DNA, 25 bp, Mus musculus
taacactcaaagacaagttaatgga

SEQ ID NO: 748001 - DNA, 25 bp, Mus musculus
taacactcaaagtcaagttaatgga

SEQ ID NO: 748002 - DNA, 25 bp, Mus musculus
taacactcccacaaaggtttctaat

SEQ ID NO: 748003 - DNA, 25 bp, Mus musculus
taacactcccactaaggtttctaat

SEQ ID NO: 748004 - DNA, 25 bp, Mus musculus
taacactctcttagaggccattctg

SEQ ID NO: 748005 - DNA, 25 bp, Mus musculus
taacactctctttgaggccattctg

SEQ ID NO: 748006 - DNA, 25 bp, Mus musculus
taacactctgttcccactcagaaat

SEQ ID NO: 748007 - DNA, 25 bp, Mus musculus
taacactctgttgccactcagaaat

SEQ ID NO: 748008 - DNA, 25 bp, Mus musculus
taacactcttcaattccactctgtg

SEQ ID NO: 748009 - DNA, 25 bp, Mus musculus
taacactcttcatttccactctgtg

SEQ ID NO: 748010 - DNA, 25 bp, Mus musculus
taacactgacgccatttcgtgcagg

SEQ ID NO: 748011 - DNA, 25 bp, Mus musculus
taacactgacgcctcttagaactgc

SEQ ID NO: 748012 - DNA, 25 bp, Mus musculus
taacactgacgcgatttcgtgcagg

SEQ ID NO: 748013 - DNA, 25 bp, Mus musculus
taacactgacgcgtcttagaactgc

SEQ ID NO: 748014 - DNA, 25 bp, Mus musculus
taacactgaggtagggaccctgaaa

SEQ ID NO: 748015 - DNA, 25 bp, Mus musculus
taacactgaggttgggaccctgaaa

SEQ ID NO: 748016 - DNA, 25 bp, Mus musculus
taacactgcaagagtgtctttgtaa

SEQ ID NO: 748017 - DNA, 25 bp, Mus musculus
taacactgcaagtgtgtctttgtaa

SEQ ID NO: 748018 - DNA, 25 bp, Mus musculus
taacactgccgactgggttttacca

SEQ ID NO: 748019 - DNA, 25 bp, Mus musculus
taacactgccgagtgggttttacca

SEQ ID NO: 748020 - DNA, 25 bp, Mus musculus
taacactgctgcataatttaacata

SEQ ID NO: 748021 - DNA, 25 bp, Mus musculus
taacactgctgcttaatttaacata

SEQ ID NO: 748022 - DNA, 25 bp, Mus musculus
taacactggcatatctttacctccc

SEQ ID NO: 748023 - DNA, 25 bp, Mus musculus
taacactggcatttctttacctccc

SEQ ID NO: 748024 - DNA, 25 bp, Mus musculus
taacactggctactcccttgtctac

SEQ ID NO: 748025 - DNA, 25 bp, Mus musculus
taacactggctagtcccttgtctac

SEQ ID NO: 748026 - DNA, 25 bp, Mus musculus
taacactgggcgcttcaacttgaac

SEQ ID NO: 748027 - DNA, 25 bp, Mus musculus
taacactgggcggttcaacttgaac

SEQ ID NO: 748028 - DNA, 25 bp, Mus musculus
taacactgtacaactgtctctgacc

SEQ ID NO: 748029 - DNA, 25 bp, Mus musculus
taacactgtacatctgtctctgacc

SEQ ID NO: 748030 - DNA, 25 bp, Mus musculus
taacactgtcatatccttctctttt

SEQ ID NO: 748031 - DNA, 25 bp, Mus musculus
taacactgtcatttccttctctttt

SEQ ID NO: 748032 - DNA, 25 bp, Mus musculus
taacactgtctgcaccatcattatc

SEQ ID NO: 748033 - DNA, 25 bp, Mus musculus
taacactgtctggaccatcattatc

SEQ ID NO: 748034 - DNA, 25 bp, Mus musculus
taacacttaggtaggagcccctccg

SEQ ID NO: 748035 - DNA, 25 bp, Mus musculus
taacacttaggttggagcccctccg

SEQ ID NO: 748036 - DNA, 25 bp, Mus musculus
taacacttagtgctgacattaccag

SEQ ID NO: 748037 - DNA, 25 bp, Mus musculus
taacacttagtggtgacattaccag

SEQ ID NO: 748038 - DNA, 25 bp, Mus musculus
taacacttatctatgaagctataac

SEQ ID NO: 748039 - DNA, 25 bp, Mus musculus
taacacttatctttgaagctataac

SEQ ID NO: 748040 - DNA, 25 bp, Mus musculus
taacacttcctgaactaacacttgg

SEQ ID NO: 748041 - DNA, 25 bp, Mus musculus
taacacttcctgtactaacacttgg

SEQ ID NO: 748042 - DNA, 25 bp, Mus musculus
taacacttcgttatactttactcat

SEQ ID NO: 748043 - DNA, 25 bp, Mus musculus
taacacttcgttttactttactcat

SEQ ID NO: 748044 - DNA, 25 bp, Mus musculus
taacacttctcccataacgtacaat

SEQ ID NO: 748045 - DNA, 25 bp, Mus musculus
taacacttctccgataacgtacaat

SEQ ID NO: 748046 - DNA, 25 bp, Mus musculus
taacacttcttcaagctaaaatgct

SEQ ID NO: 748047 - DNA, 25 bp, Mus musculus
taacacttcttctagctaaaatgct

SEQ ID NO: 748048 - DNA, 25 bp, Mus musculus
taacacttctttatgcttggtaggt

SEQ ID NO: 748049 - DNA, 25 bp, Mus musculus
taacacttctttttgcttggtaggt

SEQ ID NO: 748050 - DNA, 25 bp, Mus musculus
taacacttgggacgtcggtcgaaga

SEQ ID NO: 748051 - DNA, 25 bp, Mus musculus
taacacttgggaggtcggtcgaaga

SEQ ID NO: 748052 - DNA, 25 bp, Mus musculus
taacactttattacagccagctggt

SEQ ID NO: 748053 - DNA, 25 bp, Mus musculus
taacactttatttcagccagctggt

SEQ ID NO: 748054 - DNA, 25 bp, Mus musculus
taacactttcatatgcactgggagc

SEQ ID NO: 748055 - DNA, 25 bp, Mus musculus
taacactttcatttgcactgggagc

SEQ ID NO: 748056 - DNA, 25 bp, Mus musculus
taacactttgtgattgtaatcacac

SEQ ID NO: 748057 - DNA, 25 bp, Mus musculus
taacactttgtgcttatgggtataa

SEQ ID NO: 748058 - DNA, 25 bp, Mus musculus
taacactttgtggttatgggtataa

SEQ ID NO: 748059 - DNA, 25 bp, Mus musculus
taacactttgtgtttgtaatcacac

SEQ ID NO: 748060 - DNA, 25 bp, Mus musculus
taacagaaaccccaatccgcatttt

SEQ ID NO: 748061 - DNA, 25 bp, Mus musculus
taacagaaacccgaatccgcatttt

SEQ ID NO: 748062 - DNA, 25 bp, Mus musculus
taacagaaaggaccccagaggacaa

SEQ ID NO: 748063 - DNA, 25 bp, Mus musculus
taacagaaaggagcccagaggacaa

SEQ ID NO: 748064 - DNA, 25 bp, Mus musculus
taacagaactgtattgtcaaccgcc

SEQ ID NO: 748065 - DNA, 25 bp, Mus musculus
taacagaactgttttgtcaaccgcc

SEQ ID NO: 748066 - DNA, 25 bp, Mus musculus
taacagaagtcaagagtgctaacat

SEQ ID NO: 748067 - DNA, 25 bp, Mus musculus
taacagaagtcatgagtgctaacat

SEQ ID NO: 748068 - DNA, 25 bp, Mus musculus
taacagaatctcatctttcgactcc

SEQ ID NO: 748069 - DNA, 25 bp, Mus musculus
taacagaatctcttctttcgactcc

SEQ ID NO: 748070 - DNA, 25 bp, Mus musculus
taacagacaaggatgacagacaaat

SEQ ID NO: 748071 - DNA, 25 bp, Mus musculus
taacagacaaggttgacagacaaat

SEQ ID NO: 748072 - DNA, 25 bp, Mus musculus
taacagacacagctgcttgtcacca

SEQ ID NO: 748073 - DNA, 25 bp, Mus musculus
taacagacacaggtgcttgtcacca

SEQ ID NO: 748074 - DNA, 25 bp, Mus musculus
taacagacagaacacttcccctgtg

SEQ ID NO: 748075 - DNA, 25 bp, Mus musculus
taacagacagaagacttcccctgtg

SEQ ID NO: 748076 - DNA, 25 bp, Mus musculus
taacagacatccctaggcatctgcc

SEQ ID NO: 748077 - DNA, 25 bp, Mus musculus
taacagacatccgtaggcatctgcc

SEQ ID NO: 748078 - DNA, 25 bp, Mus musculus
taacagaccagaaagcaccagaaat

SEQ ID NO: 748079 - DNA, 25 bp, Mus musculus
taacagaccagatagcaccagaaat

SEQ ID NO: 748080 - DNA, 25 bp, Mus musculus
taacagacctagattcttcaacttt

SEQ ID NO: 748081 - DNA, 25 bp, Mus musculus
taacagacctagtttcttcaacttt

SEQ ID NO: 748082 - DNA, 25 bp, Mus musculus
taacagacgccgcagacatcgcctt

SEQ ID NO: 748083 - DNA, 25 bp, Mus musculus
taacagacgccggagacatcgcctt

SEQ ID NO: 748084 - DNA, 25 bp, Mus musculus
taacagactgatactgggccgggca

SEQ ID NO: 748085 - DNA, 25 bp, Mus musculus
taacagactgattctgggccgggca

SEQ ID NO: 748086 - DNA, 25 bp, Mus musculus
taacagagattgatccactgacaca

SEQ ID NO: 748087 - DNA, 25 bp, Mus musculus
taacagagattgttccactgacaca

SEQ ID NO: 748088 - DNA, 25 bp, Mus musculus
taacagagccccagtacaactattg

SEQ ID NO: 748089 - DNA, 25 bp, Mus musculus
taacagagcccctgtacaactattg

SEQ ID NO: 748090 - DNA, 25 bp, Mus musculus
taacagatccttatataaacagctt

SEQ ID NO: 748091 - DNA, 25 bp, Mus musculus
taacagatccttttataaacagctt

SEQ ID NO: 748092 - DNA, 25 bp, Mus musculus
taacagatctgcacactgccttgtt

SEQ ID NO: 748093 - DNA, 25 bp, Mus musculus
taacagatctgctcactgccttgtt

SEQ ID NO: 748094 - DNA, 25 bp, Mus musculus
taacagatgaaaactccctctaacc

SEQ ID NO: 748095 - DNA, 25 bp, Mus musculus
taacagatgaaatctccctctaacc

SEQ ID NO: 748096 - DNA, 25 bp, Mus musculus
taacagatgaaccagagactccaag

SEQ ID NO: 748097 - DNA, 25 bp, Mus musculus
taacagatgaacgagagactccaag

SEQ ID NO: 748098 - DNA, 25 bp, Mus musculus
taacagatgaccagagtgctttttt

SEQ ID NO: 748099 - DNA, 25 bp, Mus musculus
taacagatgacctgagtgctttttt

SEQ ID NO: 748100 - DNA, 25 bp, Mus musculus
taacagatgcttattctgctcctca

SEQ ID NO: 748101 - DNA, 25 bp, Mus musculus
taacagatgctttttctgctcctca

SEQ ID NO: 748102 - DNA, 25 bp, Mus musculus
taacagattcctcccatgagtatct

SEQ ID NO: 748103 - DNA, 25 bp, Mus musculus
taacagattcctgccatgagtatct

SEQ ID NO: 748104 - DNA, 25 bp, Mus musculus
taacagcaaactactgtcatttatg

SEQ ID NO: 748105 - DNA, 25 bp, Mus musculus
taacagcaaacttctgtcatttatg

SEQ ID NO: 748106 - DNA, 25 bp, Mus musculus
taacagcaacagatgcttcccacca

SEQ ID NO: 748107 - DNA, 25 bp, Mus musculus
taacagcaacagttgcttcccacca

SEQ ID NO: 748108 - DNA, 25 bp, Mus musculus
taacagcaaggtcatcagaggccct

SEQ ID NO: 748109 - DNA, 25 bp, Mus musculus
taacagcaaggtgatcagaggccct

SEQ ID NO: 748110 - DNA, 25 bp, Mus musculus
taacagcaagtcacagcatcagagt

SEQ ID NO: 748111 - DNA, 25 bp, Mus musculus
taacagcaagtctcagcatcagagt

SEQ ID NO: 748112 - DNA, 25 bp, Mus musculus
taacagcaatatacaccagcagaaa

SEQ ID NO: 748113 - DNA, 25 bp, Mus musculus
taacagcaatattcaccagcagaaa

SEQ ID NO: 748114 - DNA, 25 bp, Mus musculus
taacagcacataagacaccaccaac

SEQ ID NO: 748115 - DNA, 25 bp, Mus musculus
taacagcacatatgacaccaccaac

SEQ ID NO: 748116 - DNA, 25 bp, Mus musculus
taacagcaccggaccctttcacaaa

SEQ ID NO: 748117 - DNA, 25 bp, Mus musculus
taacagcaccggtccctttcacaaa

SEQ ID NO: 748118 - DNA, 25 bp, Mus musculus
taacagcacgacagagagtcatgga

SEQ ID NO: 748119 - DNA, 25 bp, Mus musculus
taacagcacgactgagagtcatgga

SEQ ID NO: 748120 - DNA, 25 bp, Mus musculus
taacagcacttcctatgtcctgctg

SEQ ID NO: 748121 - DNA, 25 bp, Mus musculus
taacagcacttcgtatgtcctgctg

SEQ ID NO: 748122 - DNA, 25 bp, Mus musculus
taacagcagctgaaccatccagtaa

SEQ ID NO: 748123 - DNA, 25 bp, Mus musculus
taacagcagctgtaccatccagtaa

SEQ ID NO: 748124 - DNA, 25 bp, Mus musculus
taacagcatcagagtctggcctcta

SEQ ID NO: 748125 - DNA, 25 bp, Mus musculus
taacagcatcagatacatggctaca

SEQ ID NO: 748126 - DNA, 25 bp, Mus musculus
taacagcatcagtgtctggcctcta

SEQ ID NO: 748127 - DNA, 25 bp, Mus musculus
taacagcatcagttacatggctaca

SEQ ID NO: 748128 - DNA, 25 bp, Mus musculus
taacagcatgcacaggacgggtccc

SEQ ID NO: 748129 - DNA, 25 bp, Mus musculus
taacagcatgcagaggacgggtccc

SEQ ID NO: 748130 - DNA, 25 bp, Mus musculus
taacagcattgcctgtgctcctagc

SEQ ID NO: 748131 - DNA, 25 bp, Mus musculus
taacagcattgcgtgtgctcctagc

SEQ ID NO: 748132 - DNA, 25 bp, Mus musculus
taacagccacaacccagacaagctg

SEQ ID NO: 748133 - DNA, 25 bp, Mus musculus
taacagccacaagccagacaagctg

SEQ ID NO: 748134 - DNA, 25 bp, Mus musculus
taacagcccaccatggcttgaacaa

SEQ ID NO: 748135 - DNA, 25 bp, Mus musculus
taacagcccaccttggcttgaacaa

SEQ ID NO: 748136 - DNA, 25 bp, Mus musculus
taacagccctctcacggaaactaga

SEQ ID NO: 748137 - DNA, 25 bp, Mus musculus
taacagccctctgacggaaactaga

SEQ ID NO: 748138 - DNA, 25 bp, Mus musculus
taacagccgggccatcttcagaacc

SEQ ID NO: 748139 - DNA, 25 bp, Mus musculus
taacagccgggcgatcttcagaacc

SEQ ID NO: 748140 - DNA, 25 bp, Mus musculus
taacagccgtttccttttgacttct

SEQ ID NO: 748141 - DNA, 25 bp, Mus musculus
taacagccgtttgcttttgacttct

SEQ ID NO: 748142 - DNA, 25 bp, Mus musculus
taacagccttgcctcggtagccaga

SEQ ID NO: 748143 - DNA, 25 bp, Mus musculus
taacagccttgcgtcggtagccaga

SEQ ID NO: 748144 - DNA, 25 bp, Mus musculus
taacagcggctgcaattctgtgctt

SEQ ID NO: 748145 - DNA, 25 bp, Mus musculus
taacagcggctggaattctgtgctt

SEQ ID NO: 748146 - DNA, 25 bp, Mus musculus
taacagctactaagtcagcattagt

SEQ ID NO: 748147 - DNA, 25 bp, Mus musculus
taacagctactatgtcagcattagt

SEQ ID NO: 748148 - DNA, 25 bp, Mus musculus
taacagctaggcaccataccaggcc

SEQ ID NO: 748149 - DNA, 25 bp, Mus musculus
taacagctaggctccataccaggcc

SEQ ID NO: 748150 - DNA, 25 bp, Mus musculus
taacagctatctcgtgtggttgcac

SEQ ID NO: 748151 - DNA, 25 bp, Mus musculus
taacagctatctggtgtggttgcac

SEQ ID NO: 748152 - DNA, 25 bp, Mus musculus
taacagctcaagataggcatgccag

SEQ ID NO: 748153 - DNA, 25 bp, Mus musculus
taacagctcaagttaggcatgccag

SEQ ID NO: 748154 - DNA, 25 bp, Mus musculus
taacagctcactagcagtggaggat

SEQ ID NO: 748155 - DNA, 25 bp, Mus musculus
taacagctcacttgcagtggaggat

SEQ ID NO: 748156 - DNA, 25 bp, Mus musculus
taacagctgggtattgaattcttcc

SEQ ID NO: 748157 - DNA, 25 bp, Mus musculus
taacagctgggttttgaattcttcc

SEQ ID NO: 748158 - DNA, 25 bp, Mus musculus
taacagctgttcccgaaagggttag

SEQ ID NO: 748159 - DNA, 25 bp, Mus musculus
taacagctgttcgcgaaagggttag

SEQ ID NO: 748160 - DNA, 25 bp, Mus musculus
taacagcttctgcacagtgtgacca

SEQ ID NO: 748161 - DNA, 25 bp, Mus musculus
taacagcttctggacagtgtgacca

SEQ ID NO: 748162 - DNA, 25 bp, Mus musculus
taacagcttgggaggtattcataat

SEQ ID NO: 748163 - DNA, 25 bp, Mus musculus
taacagcttgggtggtattcataat

SEQ ID NO: 748164 - DNA, 25 bp, Mus musculus
taacagcttttacccaagtggagct

SEQ ID NO: 748165 - DNA, 25 bp, Mus musculus
taacagcttttagccaagtggagct

SEQ ID NO: 748166 - DNA, 25 bp, Mus musculus
taacaggaaagacataggcgcgtga

SEQ ID NO: 748167 - DNA, 25 bp, Mus musculus
taacaggaaagagataggcgcgtga

SEQ ID NO: 748168 - DNA, 25 bp, Mus musculus
taacaggaagcaactttacccgcgg

SEQ ID NO: 748169 - DNA, 25 bp, Mus musculus
taacaggaagcatctttacccgcgg

SEQ ID NO: 748170 - DNA, 25 bp, Mus musculus
taacaggaatatcacggttgtatac

SEQ ID NO: 748171 - DNA, 25 bp, Mus musculus
taacaggaatatgacggttgtatac

SEQ ID NO: 748172 - DNA, 25 bp, Mus musculus
taacaggacagtctgaccatttttt

SEQ ID NO: 748173 - DNA, 25 bp, Mus musculus
taacaggacagtgtgaccatttttt

SEQ ID NO: 748174 - DNA, 25 bp, Mus musculus
taacaggaccccaagtcatggagtc

SEQ ID NO: 748175 - DNA, 25 bp, Mus musculus
taacaggacccctagtcatggagtc

SEQ ID NO: 748176 - DNA, 25 bp, Mus musculus
taacaggactagatcccagtgagga

SEQ ID NO: 748177 - DNA, 25 bp, Mus musculus
taacaggactagttcccagtgagga

SEQ ID NO: 748178 - DNA, 25 bp, Mus musculus
taacaggagacaaggtaggaaccat

SEQ ID NO: 748179 - DNA, 25 bp, Mus musculus
taacaggagacatggtaggaaccat

SEQ ID NO: 748180 - DNA, 25 bp, Mus musculus
taacaggagtgtcctgtacagccac

SEQ ID NO: 748181 - DNA, 25 bp, Mus musculus
taacaggagtgtgctgtacagccac

SEQ ID NO: 748182 - DNA, 25 bp, Mus musculus
taacaggctcggcattggaccctga

SEQ ID NO: 748183 - DNA, 25 bp, Mus musculus
taacaggctcgggattggaccctga

SEQ ID NO: 748184 - DNA, 25 bp, Mus musculus
taacaggctgcaactgacgtccgtc

SEQ ID NO: 748185 - DNA, 25 bp, Mus musculus
taacaggctgcatctgacgtccgtc

SEQ ID NO: 748186 - DNA, 25 bp, Mus musculus
taacaggctgcccaccaaatcaatg

SEQ ID NO: 748187 - DNA, 25 bp, Mus musculus
taacaggctgccgaccaaatcaatg

SEQ ID NO: 748188 - DNA, 25 bp, Mus musculus
taacaggcttgcaggtctcagccgt

SEQ ID NO: 748189 - DNA, 25 bp, Mus musculus
taacaggcttgctggtctcagccgt

SEQ ID NO: 748190 - DNA, 25 bp, Mus musculus
taacagggaaacacggctcttttat

SEQ ID NO: 748191 - DNA, 25 bp, Mus musculus
taacagggaaactcggctcttttat

SEQ ID NO: 748192 - DNA, 25 bp, Mus musculus
taacagggacataacgcttatttct

SEQ ID NO: 748193 - DNA, 25 bp, Mus musculus
taacagggacataattggaaagcat

SEQ ID NO: 748194 - DNA, 25 bp, Mus musculus
taacagggacattacgcttatttct

SEQ ID NO: 748195 - DNA, 25 bp, Mus musculus
taacagggacattattggaaagcat

SEQ ID NO: 748196 - DNA, 25 bp, Mus musculus
taacagggagggattctttgtattg

SEQ ID NO: 748197 - DNA, 25 bp, Mus musculus
taacagggagggtttctttgtattg

SEQ ID NO: 748198 - DNA, 25 bp, Mus musculus
taacagggctgtccttgactagggt

SEQ ID NO: 748199 - DNA, 25 bp, Mus musculus
taacagggctgtgcttgactagggt

SEQ ID NO: 748200 - DNA, 25 bp, Mus musculus
taacagggtctcaagtgctgtgaaa

SEQ ID NO: 748201 - DNA, 25 bp, Mus musculus
taacagggtctctagtgctgtgaaa

SEQ ID NO: 748202 - DNA, 25 bp, Mus musculus
taacagggtgttcttctcttcttta

SEQ ID NO: 748203 - DNA, 25 bp, Mus musculus
taacagggtgttgttctcttcttta

SEQ ID NO: 748204 - DNA, 25 bp, Mus musculus
taacaggtaagtacaatgtccatag

SEQ ID NO: 748205 - DNA, 25 bp, Mus musculus
taacaggtaagttcaatgtccatag

SEQ ID NO: 748206 - DNA, 25 bp, Mus musculus
taacaggtatctcaccaggcgccgt

SEQ ID NO: 748207 - DNA, 25 bp, Mus musculus
taacaggtatctgaccaggcgccgt

SEQ ID NO: 748208 - DNA, 25 bp, Mus musculus
taacaggtcagaagtatcaacagtc

SEQ ID NO: 748209 - DNA, 25 bp, Mus musculus
taacaggtcagatgtatcaacagtc

SEQ ID NO: 748210 - DNA, 25 bp, Mus musculus
taacaggtccctctgtcaccagtgg

SEQ ID NO: 748211 - DNA, 25 bp, Mus musculus
taacaggtccctgtgtcaccagtgg

SEQ ID NO: 748212 - DNA, 25 bp, Mus musculus
taacaggtcgagcactacatccgcc

SEQ ID NO: 748213 - DNA, 25 bp, Mus musculus
taacaggtcgaggactacatccgcc

SEQ ID NO: 748214 - DNA, 25 bp, Mus musculus
taacaggtctacagcccagagagat

SEQ ID NO: 748215 - DNA, 25 bp, Mus musculus
taacaggtctactgcccagagagat

SEQ ID NO: 748216 - DNA, 25 bp, Mus musculus
taacaggtctgaacctcttctggct

SEQ ID NO: 748217 - DNA, 25 bp, Mus musculus
taacaggtctgatcctcttctggct

SEQ ID NO: 748218 - DNA, 25 bp, Mus musculus
taacaggtctgtcatgcccttagat

SEQ ID NO: 748219 - DNA, 25 bp, Mus musculus
taacaggtctgtgatgcccttagat

SEQ ID NO: 748220 - DNA, 25 bp, Mus musculus
taacaggtgccaaggatgtagccct

SEQ ID NO: 748221 - DNA, 25 bp, Mus musculus
taacaggtgccatggatgtagccct

SEQ ID NO: 748222 - DNA, 25 bp, Mus musculus
taacaggtgtggcttaatgaaccct

SEQ ID NO: 748223 - DNA, 25 bp, Mus musculus
taacaggtgtgggttaatgaaccct

SEQ ID NO: 748224 - DNA, 25 bp, Mus musculus
taacagtaactcctctttttgctct

SEQ ID NO: 748225 - DNA, 25 bp, Mus musculus
taacagtaactcgtctttttgctct

SEQ ID NO: 748226 - DNA, 25 bp, Mus musculus
taacagtaccgtacctactctatgt

SEQ ID NO: 748227 - DNA, 25 bp, Mus musculus
taacagtaccgttcctactctatgt

SEQ ID NO: 748228 - DNA, 25 bp, Mus musculus
taacagtatctcaaagtccgtcagt

SEQ ID NO: 748229 - DNA, 25 bp, Mus musculus
taacagtatctctaagtccgtcagt

SEQ ID NO: 748230 - DNA, 25 bp, Mus musculus
taacagtatgttcctctcttcacga

SEQ ID NO: 748231 - DNA, 25 bp, Mus musculus
taacagtatgttgctctcttcacga

SEQ ID NO: 748232 - DNA, 25 bp, Mus musculus
taacagtatttgaagacaggctcta

SEQ ID NO: 748233 - DNA, 25 bp, Mus musculus
taacagtatttgtagacaggctcta

SEQ ID NO: 748234 - DNA, 25 bp, Mus musculus
taacagtcacagacggagggcagaa

SEQ ID NO: 748235 - DNA, 25 bp, Mus musculus
taacagtcacagtcggagggcagaa

SEQ ID NO: 748236 - DNA, 25 bp, Mus musculus
taacagtcagcacaattcccggatg

SEQ ID NO: 748237 - DNA, 25 bp, Mus musculus
taacagtcagcagaattcccggatg

SEQ ID NO: 748238 - DNA, 25 bp, Mus musculus
taacagtccgttacactttcctcag

SEQ ID NO: 748239 - DNA, 25 bp, Mus musculus
taacagtccgtttcactttcctcag

SEQ ID NO: 748240 - DNA, 25 bp, Mus musculus
taacagtctcttcccttctgctggg

SEQ ID NO: 748241 - DNA, 25 bp, Mus musculus
taacagtctcttgccttctgctggg

SEQ ID NO: 748242 - DNA, 25 bp, Mus musculus
taacagtctgagctcaatcccagaa

SEQ ID NO: 748243 - DNA, 25 bp, Mus musculus
taacagtctgaggtcaatcccagaa

SEQ ID NO: 748244 - DNA, 25 bp, Mus musculus
taacagtctgttcatctctcagcaa

SEQ ID NO: 748245 - DNA, 25 bp, Mus musculus
taacagtctgttgatctctcagcaa

SEQ ID NO: 748246 - DNA, 25 bp, Mus musculus
taacagtctttgattgacttaacaa

SEQ ID NO: 748247 - DNA, 25 bp, Mus musculus
taacagtctttgtttgacttaacaa

SEQ ID NO: 748248 - DNA, 25 bp, Mus musculus
taacagtgactgctgtgggaccgct

SEQ ID NO: 748249 - DNA, 25 bp, Mus musculus
taacagtgactggtgtgggaccgct

SEQ ID NO: 748250 - DNA, 25 bp, Mus musculus
taacagtgaggccacgtccagatgg

SEQ ID NO: 748251 - DNA, 25 bp, Mus musculus
taacagtgaggcgacgtccagatgg

SEQ ID NO: 748252 - DNA, 25 bp, Mus musculus
taacagtgagtaaggctagcaaatg

SEQ ID NO: 748253 - DNA, 25 bp, Mus musculus
taacagtgagtatggctagcaaatg

SEQ ID NO: 748254 - DNA, 25 bp, Mus musculus
taacagtgccacatcccattggcca

SEQ ID NO: 748255 - DNA, 25 bp, Mus musculus
taacagtgccacttcccattggcca

SEQ ID NO: 748256 - DNA, 25 bp, Mus musculus
taacagtgcgggaactctgtcccag

SEQ ID NO: 748257 - DNA, 25 bp, Mus musculus
taacagtgcgggtactctgtcccag

SEQ ID NO: 748258 - DNA, 25 bp, Mus musculus
taacagtgctgccatccgtgccatt

SEQ ID NO: 748259 - DNA, 25 bp, Mus musculus
taacagtgctgcgatccgtgccatt

SEQ ID NO: 748260 - DNA, 25 bp, Mus musculus
taacagtgctggacttgcttactgc

SEQ ID NO: 748261 - DNA, 25 bp, Mus musculus
taacagtgctggtcttgcttactgc

SEQ ID NO: 748262 - DNA, 25 bp, Mus musculus
taacagtggactcgctggctcaaat

SEQ ID NO: 748263 - DNA, 25 bp, Mus musculus
taacagtggactggctggctcaaat

SEQ ID NO: 748264 - DNA, 25 bp, Mus musculus
taacagtggccccattccttgaatt

SEQ ID NO: 748265 - DNA, 25 bp, Mus musculus
taacagtggcccgattccttgaatt

SEQ ID NO: 748266 - DNA, 25 bp, Mus musculus
taacagtgtacgattctggactggg

SEQ ID NO: 748267 - DNA, 25 bp, Mus musculus
taacagtgtacgtttctggactggg

SEQ ID NO: 748268 - DNA, 25 bp, Mus musculus
taacagtgtataacaccaaccctgg

SEQ ID NO: 748269 - DNA, 25 bp, Mus musculus
taacagtgtatatcaccaaccctgg

SEQ ID NO: 748270 - DNA, 25 bp, Mus musculus
taacagtgtcagagccaggattttg

SEQ ID NO: 748271 - DNA, 25 bp, Mus musculus
taacagtgtcagtgccaggattttg

SEQ ID NO: 748272 - DNA, 25 bp, Mus musculus
taacagtgttacaatgccgcttcct

SEQ ID NO: 748273 - DNA, 25 bp, Mus musculus
taacagtgttactatgccgcttcct

SEQ ID NO: 748274 - DNA, 25 bp, Mus musculus
taacagttaattccctgcctggctt

SEQ ID NO: 748275 - DNA, 25 bp, Mus musculus
taacagttaattgcctgcctggctt

SEQ ID NO: 748276 - DNA, 25 bp, Mus musculus
taacagttcagactttttcacctaa

SEQ ID NO: 748277 - DNA, 25 bp, Mus musculus
taacagttcagagtttttcacctaa

SEQ ID NO: 748278 - DNA, 25 bp, Mus musculus
taacagttcctgagaccaaaatgaa

SEQ ID NO: 748279 - DNA, 25 bp, Mus musculus
taacagttcctgtgaccaaaatgaa

SEQ ID NO: 748280 - DNA, 25 bp, Mus musculus
taacagttctctcactcagctgggt

SEQ ID NO: 748281 - DNA, 25 bp, Mus musculus
taacagttctctgactcagctgggt

SEQ ID NO: 748282 - DNA, 25 bp, Mus musculus
taacagttgtacacctgtctctgct

SEQ ID NO: 748283 - DNA, 25 bp, Mus musculus
taacagttgtactcctgtctctgct

SEQ ID NO: 748284 - DNA, 25 bp, Mus musculus
taacagttgtccagttgcctaccag

SEQ ID NO: 748285 - DNA, 25 bp, Mus musculus
taacagttgtcctgttgcctaccag

SEQ ID NO: 748286 - DNA, 25 bp, Mus musculus
taacagttttcgatattactccaaa

SEQ ID NO: 748287 - DNA, 25 bp, Mus musculus
taacagttttcgttattactccaaa

SEQ ID NO: 748288 - DNA, 25 bp, Mus musculus
taacataaaactaccttacactgag

SEQ ID NO: 748289 - DNA, 25 bp, Mus musculus
taacataaaacttccttacactgag

SEQ ID NO: 748290 - DNA, 25 bp, Mus musculus
taacataaagaactcagaagccctg

SEQ ID NO: 748291 - DNA, 25 bp, Mus musculus
taacataaagaagtcagaagccctg

SEQ ID NO: 748292 - DNA, 25 bp, Mus musculus
taacataacctgaccatggtgctgg

SEQ ID NO: 748293 - DNA, 25 bp, Mus musculus
taacataacctgtccatggtgctgg

SEQ ID NO: 748294 - DNA, 25 bp, Mus musculus
taacatacagtgaccacccggattc

SEQ ID NO: 748295 - DNA, 25 bp, Mus musculus
taacatacagtgtccacccggattc

SEQ ID NO: 748296 - DNA, 25 bp, Mus musculus
taacataccttcctgtggaccaaaa

SEQ ID NO: 748297 - DNA, 25 bp, Mus musculus
taacataccttcgtgtggaccaaaa

SEQ ID NO: 748298 - DNA, 25 bp, Mus musculus
taacatactgcgcaacaagccctac

SEQ ID NO: 748299 - DNA, 25 bp, Mus musculus
taacatactgcggaacaagccctac

SEQ ID NO: 748300 - DNA, 25 bp, Mus musculus
taacatactggtcgcttctaaggac

SEQ ID NO: 748301 - DNA, 25 bp, Mus musculus
taacatactggtggcttctaaggac

SEQ ID NO: 748302 - DNA, 25 bp, Mus musculus
taacatactgtaagctttctacctg

SEQ ID NO: 748303 - DNA, 25 bp, Mus musculus
taacatactgtatgctttctacctg

SEQ ID NO: 748304 - DNA, 25 bp, Mus musculus
taacatagtttgacacagccctgct

SEQ ID NO: 748305 - DNA, 25 bp, Mus musculus
taacatagtttgtcacagccctgct

SEQ ID NO: 748306 - DNA, 25 bp, Mus musculus
taacatatctcaacctaagtagatt

SEQ ID NO: 748307 - DNA, 25 bp, Mus musculus
taacatatctcatcctaagtagatt

SEQ ID NO: 748308 - DNA, 25 bp, Mus musculus
taacatatgcggctgcggtagccta

SEQ ID NO: 748309 - DNA, 25 bp, Mus musculus
taacatatgcgggtgcggtagccta

SEQ ID NO: 748310 - DNA, 25 bp, Mus musculus
taacatatggtgagtgatatacggg

SEQ ID NO: 748311 - DNA, 25 bp, Mus musculus
taacatatggtgtgtgatatacggg

SEQ ID NO: 748312 - DNA, 25 bp, Mus musculus
taacatcaacagaacacagcggcat

SEQ ID NO: 748313 - DNA, 25 bp, Mus musculus
taacatcaacagtacacagcggcat

SEQ ID NO: 748314 - DNA, 25 bp, Mus musculus
taacatcacaccctttttcttctat

SEQ ID NO: 748315 - DNA, 25 bp, Mus musculus
taacatcacaccgtttttcttctat

SEQ ID NO: 748316 - DNA, 25 bp, Mus musculus
taacatcactagcaaggagccccat

SEQ ID NO: 748317 - DNA, 25 bp, Mus musculus
taacatcactaggaaggagccccat

SEQ ID NO: 748318 - DNA, 25 bp, Mus musculus
taacatcactcaacgcttgtgtaaa

SEQ ID NO: 748319 - DNA, 25 bp, Mus musculus
taacatcactcatcgcttgtgtaaa

SEQ ID NO: 748320 - DNA, 25 bp, Mus musculus
taacatcagcgcaatgtttgccacc

SEQ ID NO: 748321 - DNA, 25 bp, Mus musculus
taacatcagcgctatgtttgccacc

SEQ ID NO: 748322 - DNA, 25 bp, Mus musculus
taacatccacatcctgagtgcacag

SEQ ID NO: 748323 - DNA, 25 bp, Mus musculus
taacatccacatgctgagtgcacag

SEQ ID NO: 748324 - DNA, 25 bp, Mus musculus
taacatccatgcaagttagtgctcc

SEQ ID NO: 748325 - DNA, 25 bp, Mus musculus
taacatccatgctagttagtgctcc

SEQ ID NO: 748326 - DNA, 25 bp, Mus musculus
taacatcccattactgtagcataat

SEQ ID NO: 748327 - DNA, 25 bp, Mus musculus
taacatcccatttctgtagcataat

SEQ ID NO: 748328 - DNA, 25 bp, Mus musculus
taacatccgagcattctgaagtctt

SEQ ID NO: 748329 - DNA, 25 bp, Mus musculus
taacatccgagctttctgaagtctt

SEQ ID NO: 748330 - DNA, 25 bp, Mus musculus
taacatccggaaacaggcgcacatg

SEQ ID NO: 748331 - DNA, 25 bp, Mus musculus
taacatccggaatcaggcgcacatg

SEQ ID NO: 748332 - DNA, 25 bp, Mus musculus
taacatccggtaatgccatttgcct

SEQ ID NO: 748333 - DNA, 25 bp, Mus musculus
taacatccggtattgccatttgcct

SEQ ID NO: 748334 - DNA, 25 bp, Mus musculus
taacatcctttcattcgacataccc

SEQ ID NO: 748335 - DNA, 25 bp, Mus musculus
taacatcctttctttcgacataccc

SEQ ID NO: 748336 - DNA, 25 bp, Mus musculus
taacatcctttgatacctgcctgac

SEQ ID NO: 748337 - DNA, 25 bp, Mus musculus
taacatcctttgttacctgcctgac

SEQ ID NO: 748338 - DNA, 25 bp, Mus musculus
taacatcgcctcagaagatttttcc

SEQ ID NO: 748339 - DNA, 25 bp, Mus musculus
taacatcgcctctgaagatttttcc

SEQ ID NO: 748340 - DNA, 25 bp, Mus musculus
taacatcgtgtaagcttccatctcc

SEQ ID NO: 748341 - DNA, 25 bp, Mus musculus
taacatcgtgtatgcttccatctcc

SEQ ID NO: 748342 - DNA, 25 bp, Mus musculus
taacatctacaccaaggcatctgag

SEQ ID NO: 748343 - DNA, 25 bp, Mus musculus
taacatctacacgaaggcatctgag

SEQ ID NO: 748344 - DNA, 25 bp, Mus musculus
taacatctatttcacctgtaggaag

SEQ ID NO: 748345 - DNA, 25 bp, Mus musculus
taacatctatttgacctgtaggaag

SEQ ID NO: 748346 - DNA, 25 bp, Mus musculus
taacatctcattatagtctcttttg

SEQ ID NO: 748347 - DNA, 25 bp, Mus musculus
taacatctcattttagtctcttttg

SEQ ID NO: 748348 - DNA, 25 bp, Mus musculus
taacatctctacactcacgcttttg

SEQ ID NO: 748349 - DNA, 25 bp, Mus musculus
taacatctctaccaaaggctgccta

SEQ ID NO: 748350 - DNA, 25 bp, Mus musculus
taacatctctacgaaaggctgccta

SEQ ID NO: 748351 - DNA, 25 bp, Mus musculus
taacatctctactctcacgcttttg

SEQ ID NO: 748352 - DNA, 25 bp, Mus musculus
taacatctgagcacctaatactaag

SEQ ID NO: 748353 - DNA, 25 bp, Mus musculus
taacatctgagctcctaatactaag

SEQ ID NO: 748354 - DNA, 25 bp, Mus musculus
taacatctgcaacttagcatcctgc

SEQ ID NO: 748355 - DNA, 25 bp, Mus musculus
taacatctgcaagttagcatcctgc

SEQ ID NO: 748356 - DNA, 25 bp, Mus musculus
taacatctgcagacagagtcccttc

SEQ ID NO: 748357 - DNA, 25 bp, Mus musculus
taacatctgcagtcagagtcccttc

SEQ ID NO: 748358 - DNA, 25 bp, Mus musculus
taacatctggaacaatgtccaatgg

SEQ ID NO: 748359 - DNA, 25 bp, Mus musculus
taacatctggaagaatgtccaatgg

SEQ ID NO: 748360 - DNA, 25 bp, Mus musculus
taacatctgttccatctgcatcctt

SEQ ID NO: 748361 - DNA, 25 bp, Mus musculus
taacatctgttcgatctgcatcctt

SEQ ID NO: 748362 - DNA, 25 bp, Mus musculus
taacatcttccaacactggttggca

SEQ ID NO: 748363 - DNA, 25 bp, Mus musculus
taacatcttccatcactggttggca

SEQ ID NO: 748364 - DNA, 25 bp, Mus musculus
taacatcttctgagcagctagcgcc

SEQ ID NO: 748365 - DNA, 25 bp, Mus musculus
taacatcttctgtgcagctagcgcc

SEQ ID NO: 748366 - DNA, 25 bp, Mus musculus
taacatcttgtactgtggccacgat

SEQ ID NO: 748367 - DNA, 25 bp, Mus musculus
taacatcttgtagtgtggccacgat

SEQ ID NO: 748368 - DNA, 25 bp, Mus musculus
taacatgaagcgctcacctctgaac

SEQ ID NO: 748369 - DNA, 25 bp, Mus musculus
taacatgaagcggtcacctctgaac

SEQ ID NO: 748370 - DNA, 25 bp, Mus musculus
taacatgagaaaaacccttggtttg

SEQ ID NO: 748371 - DNA, 25 bp, Mus musculus
taacatgagaaatacccttggtttg

SEQ ID NO: 748372 - DNA, 25 bp, Mus musculus
taacatgagcttactgtaagttcaa

SEQ ID NO: 748373 - DNA, 25 bp, Mus musculus
taacatgagctttctgtaagttcaa

SEQ ID NO: 748374 - DNA, 25 bp, Mus musculus
taacatgcacatcgccctaagtggg

SEQ ID NO: 748375 - DNA, 25 bp, Mus musculus
taacatgcacatggccctaagtggg

SEQ ID NO: 748376 - DNA, 25 bp, Mus musculus
taacatgcccttcacaagctattac

SEQ ID NO: 748377 - DNA, 25 bp, Mus musculus
taacatgcccttgacaagctattac

SEQ ID NO: 748378 - DNA, 25 bp, Mus musculus
taacatgccgcacgctcagactgtt

SEQ ID NO: 748379 - DNA, 25 bp, Mus musculus
taacatgccgcaggctcagactgtt

SEQ ID NO: 748380 - DNA, 25 bp, Mus musculus
taacatgctcgcattggccattgag

SEQ ID NO: 748381 - DNA, 25 bp, Mus musculus
taacatgctcgctttggccattgag

SEQ ID NO: 748382 - DNA, 25 bp, Mus musculus
taacatgctgtaccccaaggaggac

SEQ ID NO: 748383 - DNA, 25 bp, Mus musculus
taacatgctgtagcccaaggaggac

SEQ ID NO: 748384 - DNA, 25 bp, Mus musculus
taacatgctgttaccttcctctgca

SEQ ID NO: 748385 - DNA, 25 bp, Mus musculus
taacatgctgtttccttcctctgca

SEQ ID NO: 748386 - DNA, 25 bp, Mus musculus
taacatgcttatatgactgctcagt

SEQ ID NO: 748387 - DNA, 25 bp, Mus musculus
taacatgcttatttgactgctcagt

SEQ ID NO: 748388 - DNA, 25 bp, Mus musculus
taacatggacttatgcagttccgtc

SEQ ID NO: 748389 - DNA, 25 bp, Mus musculus
taacatggacttttgcagttccgtc

SEQ ID NO: 748390 - DNA, 25 bp, Mus musculus
taacatggaggtccctgtcatgcct

SEQ ID NO: 748391 - DNA, 25 bp, Mus musculus
taacatggaggtgcctgtcatgcct

SEQ ID NO: 748392 - DNA, 25 bp, Mus musculus
taacatggatttaggaaaagccatt

SEQ ID NO: 748393 - DNA, 25 bp, Mus musculus
taacatggattttggaaaagccatt

SEQ ID NO: 748394 - DNA, 25 bp, Mus musculus
taacatggcagcatattctccacag

SEQ ID NO: 748395 - DNA, 25 bp, Mus musculus
taacatggcagcttattctccacag

SEQ ID NO: 748396 - DNA, 25 bp, Mus musculus
taacatggcggcctcctaagagtcc

SEQ ID NO: 748397 - DNA, 25 bp, Mus musculus
taacatggcggcgtcctaagagtcc

SEQ ID NO: 748398 - DNA, 25 bp, Mus musculus
taacatggctaacaccctaggttct

SEQ ID NO: 748399 - DNA, 25 bp, Mus musculus
taacatggctaagaccctaggttct

SEQ ID NO: 748400 - DNA, 25 bp, Mus musculus
taacatggctgtattgcttgctgca

SEQ ID NO: 748401 - DNA, 25 bp, Mus musculus
taacatggctgttttgcttgctgca

SEQ ID NO: 748402 - DNA, 25 bp, Mus musculus
taacatgggaacagagcctaccctc

SEQ ID NO: 748403 - DNA, 25 bp, Mus musculus
taacatgggaactgagcctaccctc

SEQ ID NO: 748404 - DNA, 25 bp, Mus musculus
taacatgggctgatgttccacactt

SEQ ID NO: 748405 - DNA, 25 bp, Mus musculus
taacatgggctgttgttccacactt

SEQ ID NO: 748406 - DNA, 25 bp, Mus musculus
taacatggttggcagtaggactcaa

SEQ ID NO: 748407 - DNA, 25 bp, Mus musculus
taacatggttgggagtaggactcaa

SEQ ID NO: 748408 - DNA, 25 bp, Mus musculus
taacatgtaaaacgccccagctcca

SEQ ID NO: 748409 - DNA, 25 bp, Mus musculus
taacatgtaaaaggccccagctcca

SEQ ID NO: 748410 - DNA, 25 bp, Mus musculus
taacatgtaaccatggttgacctta

SEQ ID NO: 748411 - DNA, 25 bp, Mus musculus
taacatgtaaccttggttgacctta

SEQ ID NO: 748412 - DNA, 25 bp, Mus musculus
taacatgtcagcctccgccatgatg

SEQ ID NO: 748413 - DNA, 25 bp, Mus musculus
taacatgtcagcgtccgccatgatg

SEQ ID NO: 748414 - DNA, 25 bp, Mus musculus
taacatgtgaccatccatcttgtga

SEQ ID NO: 748415 - DNA, 25 bp, Mus musculus
taacatgtgaccttccatcttgtga

SEQ ID NO: 748416 - DNA, 25 bp, Mus musculus
taacatgtgccaatttgttcctgta

SEQ ID NO: 748417 - DNA, 25 bp, Mus musculus
taacatgtgccattttgttcctgta

SEQ ID NO: 748418 - DNA, 25 bp, Mus musculus
taacatgtggacctcggtgtcgcca

SEQ ID NO: 748419 - DNA, 25 bp, Mus musculus
taacatgtggacgtcggtgtcgcca

SEQ ID NO: 748420 - DNA, 25 bp, Mus musculus
taacatgttcccagctcttattagt

SEQ ID NO: 748421 - DNA, 25 bp, Mus musculus
taacatgttccctgctcttattagt

SEQ ID NO: 748422 - DNA, 25 bp, Mus musculus
taacatgttcttaagcagctaggta

SEQ ID NO: 748423 - DNA, 25 bp, Mus musculus
taacatgttctttagcagctaggta

SEQ ID NO: 748424 - DNA, 25 bp, Mus musculus
taacatgtttgtattggaggagaca

SEQ ID NO: 748425 - DNA, 25 bp, Mus musculus
taacatgtttgttttggaggagaca

SEQ ID NO: 748426 - DNA, 25 bp, Mus musculus
taacatgtttttctctaagcttttt

SEQ ID NO: 748427 - DNA, 25 bp, Mus musculus
taacatgtttttgtctaagcttttt

SEQ ID NO: 748428 - DNA, 25 bp, Mus musculus
taacattaagaacacctcctaaggg

SEQ ID NO: 748429 - DNA, 25 bp, Mus musculus
taacattaagaagacctcctaaggg

SEQ ID NO: 748430 - DNA, 25 bp, Mus musculus
taacattacaagatccttctctccg

SEQ ID NO: 748431 - DNA, 25 bp, Mus musculus
taacattacaagttccttctctccg

SEQ ID NO: 748432 - DNA, 25 bp, Mus musculus
taacattactggatggttctgccaa

SEQ ID NO: 748433 - DNA, 25 bp, Mus musculus
taacattactggttggttctgccaa

SEQ ID NO: 748434 - DNA, 25 bp, Mus musculus
taacattagccaatgggcccatctc

SEQ ID NO: 748435 - DNA, 25 bp, Mus musculus
taacattagccattgggcccatctc

SEQ ID NO: 748436 - DNA, 25 bp, Mus musculus
taacattagggcagcaagttcaaca

SEQ ID NO: 748437 - DNA, 25 bp, Mus musculus
taacattagggctgcaagttcaaca

SEQ ID NO: 748438 - DNA, 25 bp, Mus musculus
taacattcaaccacaaaggactgat

SEQ ID NO: 748439 - DNA, 25 bp, Mus musculus
taacattcaacctcaaaggactgat

SEQ ID NO: 748440 - DNA, 25 bp, Mus musculus
taacattcctatcgcagggttccca

SEQ ID NO: 748441 - DNA, 25 bp, Mus musculus
taacattcctatggcagggttccca

SEQ ID NO: 748442 - DNA, 25 bp, Mus musculus
taacattccttactgggccatcaag

SEQ ID NO: 748443 - DNA, 25 bp, Mus musculus
taacattccttagtgggccatcaag

SEQ ID NO: 748444 - DNA, 25 bp, Mus musculus
taacattcgcctctacaagaaccaa

SEQ ID NO: 748445 - DNA, 25 bp, Mus musculus
taacattcgcctgtacaagaaccaa

SEQ ID NO: 748446 - DNA, 25 bp, Mus musculus
taacattctcaaagtactctctgtt

SEQ ID NO: 748447 - DNA, 25 bp, Mus musculus
taacattctcaatgtactctctgtt

SEQ ID NO: 748448 - DNA, 25 bp, Mus musculus
taacattcttgcaacagtggccgca

SEQ ID NO: 748449 - DNA, 25 bp, Mus musculus
taacattcttgctacagtggccgca

SEQ ID NO: 748450 - DNA, 25 bp, Mus musculus
taacattctttcacacattgcgcca

SEQ ID NO: 748451 - DNA, 25 bp, Mus musculus
taacattctttctcacattgcgcca

SEQ ID NO: 748452 - DNA, 25 bp, Mus musculus
taacattgagtgctttctacatcca

SEQ ID NO: 748453 - DNA, 25 bp, Mus musculus
taacattgagtggtttctacatcca

SEQ ID NO: 748454 - DNA, 25 bp, Mus musculus
taacattgatacatggctgcctatt

SEQ ID NO: 748455 - DNA, 25 bp, Mus musculus
taacattgatacttggctgcctatt

SEQ ID NO: 748456 - DNA, 25 bp, Mus musculus
taacattgctttcatcttggatatt

SEQ ID NO: 748457 - DNA, 25 bp, Mus musculus
taacattgctttgatcttggatatt

SEQ ID NO: 748458 - DNA, 25 bp, Mus musculus
taacattgggcccacagtttctatt

SEQ ID NO: 748459 - DNA, 25 bp, Mus musculus
taacattgggccgacagtttctatt

SEQ ID NO: 748460 - DNA, 25 bp, Mus musculus
taacattgtacaatcttaggagcgt

SEQ ID NO: 748461 - DNA, 25 bp, Mus musculus
taacattgtacattcttaggagcgt

SEQ ID NO: 748462 - DNA, 25 bp, Mus musculus
taacattgttgcagatgtgcatgat

SEQ ID NO: 748463 - DNA, 25 bp, Mus musculus
taacattgttgctgatgtgcatgat

SEQ ID NO: 748464 - DNA, 25 bp, Mus musculus
taacatttatacatgcctccgactg

SEQ ID NO: 748465 - DNA, 25 bp, Mus musculus
taacatttatacttgcctccgactg

SEQ ID NO: 748466 - DNA, 25 bp, Mus musculus
taacatttattgactgtcgcagtaa

SEQ ID NO: 748467 - DNA, 25 bp, Mus musculus
taacatttattgtctgtcgcagtaa

SEQ ID NO: 748468 - DNA, 25 bp, Mus musculus
taacatttccccaaaatggtgggag

SEQ ID NO: 748469 - DNA, 25 bp, Mus musculus
taacatttcccctaaatggtgggag

SEQ ID NO: 748470 - DNA, 25 bp, Mus musculus
taacatttgaagacccctttcctag

SEQ ID NO: 748471 - DNA, 25 bp, Mus musculus
taacatttgaagtcccctttcctag

SEQ ID NO: 748472 - DNA, 25 bp, Mus musculus
taacatttgacccatttctccaccc

SEQ ID NO: 748473 - DNA, 25 bp, Mus musculus
taacatttgaccgatttctccaccc

SEQ ID NO: 748474 - DNA, 25 bp, Mus musculus
taacatttgccaatgccccgtgagt

SEQ ID NO: 748475 - DNA, 25 bp, Mus musculus
taacatttgccattgccccgtgagt

SEQ ID NO: 748476 - DNA, 25 bp, Mus musculus
taacatttgttacacacctactatg

SEQ ID NO: 748477 - DNA, 25 bp, Mus musculus
taacatttgttagacacctactatg

SEQ ID NO: 748478 - DNA, 25 bp, Mus musculus
taacatttgtttacctacagccaga

SEQ ID NO: 748479 - DNA, 25 bp, Mus musculus
taacatttgttttcctacagccaga

SEQ ID NO: 748480 - DNA, 25 bp, Mus musculus
taacattttactatcctctcatttt

SEQ ID NO: 748481 - DNA, 25 bp, Mus musculus
taacattttactttcctctcatttt

SEQ ID NO: 748482 - DNA, 25 bp, Mus musculus
taacattttatactcattgggcaac

SEQ ID NO: 748483 - DNA, 25 bp, Mus musculus
taacattttatagtcattgggcaac

SEQ ID NO: 748484 - DNA, 25 bp, Mus musculus
taacattttcggctcacctgcctag

SEQ ID NO: 748485 - DNA, 25 bp, Mus musculus
taacattttcgggtcacctgcctag

SEQ ID NO: 748486 - DNA, 25 bp, Mus musculus
taacattttctacggatataggcca

SEQ ID NO: 748487 - DNA, 25 bp, Mus musculus
taacattttctagggatataggcca

SEQ ID NO: 748488 - DNA, 25 bp, Mus musculus
taacatttttacaggttcttagaat

SEQ ID NO: 748489 - DNA, 25 bp, Mus musculus
taacatttttactggttcttagaat

SEQ ID NO: 748490 - DNA, 25 bp, Mus musculus
taacatttttcccaaggctaatata

SEQ ID NO: 748491 - DNA, 25 bp, Mus musculus
taacatttttccgaaggctaatata

SEQ ID NO: 748492 - DNA, 25 bp, Mus musculus
taacatttttctaccccaaactgat

SEQ ID NO: 748493 - DNA, 25 bp, Mus musculus
taacatttttcttccccaaactgat

SEQ ID NO: 748494 - DNA, 25 bp, Mus musculus
taacattttttgcacttgctcttga

SEQ ID NO: 748495 - DNA, 25 bp, Mus musculus
taacattttttggacttgctcttga

SEQ ID NO: 748496 - DNA, 25 bp, Mus musculus
taaccaaaaggcagcattacactca

SEQ ID NO: 748497 - DNA, 25 bp, Mus musculus
taaccaaaaggctgcattacactca

SEQ ID NO: 748498 - DNA, 25 bp, Mus musculus
taaccaaaagttaaggatcctgact

SEQ ID NO: 748499 - DNA, 25 bp, Mus musculus
taaccaaaagtttaggatcctgact

SEQ ID NO: 748500 - DNA, 25 bp, Mus musculus
taaccaaacatcctacgtacctaag

SEQ ID NO: 748501 - DNA, 25 bp, Mus musculus
taaccaaacatcgtacgtacctaag

SEQ ID NO: 748502 - DNA, 25 bp, Mus musculus
taaccaaagactctagaactctggg

SEQ ID NO: 748503 - DNA, 25 bp, Mus musculus
taaccaaagactgtagaactctggg

SEQ ID NO: 748504 - DNA, 25 bp, Mus musculus
taaccaaagtttcgctattaatacg

SEQ ID NO: 748505 - DNA, 25 bp, Mus musculus
taaccaaagtttggctattaatacg

SEQ ID NO: 748506 - DNA, 25 bp, Mus musculus
taaccaaatcttcaactagtgctag

SEQ ID NO: 748507 - DNA, 25 bp, Mus musculus
taaccaaatcttgaactagtgctag

SEQ ID NO: 748508 - DNA, 25 bp, Mus musculus
taaccaaattctacatgccacaagg

SEQ ID NO: 748509 - DNA, 25 bp, Mus musculus
taaccaaattcttcatgccacaagg

SEQ ID NO: 748510 - DNA, 25 bp, Mus musculus
taaccaacacctcgagcacaggtgc

SEQ ID NO: 748511 - DNA, 25 bp, Mus musculus
taaccaacacctggagcacaggtgc

SEQ ID NO: 748512 - DNA, 25 bp, Mus musculus
taaccaacacgcactttgtagctcg

SEQ ID NO: 748513 - DNA, 25 bp, Mus musculus
taaccaacacgctctttgtagctcg

SEQ ID NO: 748514 - DNA, 25 bp, Mus musculus
taaccaacagttccaggctctgcaa

SEQ ID NO: 748515 - DNA, 25 bp, Mus musculus
taaccaacagttgcaggctctgcaa

SEQ ID NO: 748516 - DNA, 25 bp, Mus musculus
taaccaaccaatatgtaaactggag

SEQ ID NO: 748517 - DNA, 25 bp, Mus musculus
taaccaaccaatttgtaaactggag

SEQ ID NO: 748518 - DNA, 25 bp, Mus musculus
taaccaaccctgacctgagttcatg

SEQ ID NO: 748519 - DNA, 25 bp, Mus musculus
taaccaaccctgtcctgagttcatg

SEQ ID NO: 748520 - DNA, 25 bp, Mus musculus
taaccaacctccataaatgactgac

SEQ ID NO: 748521 - DNA, 25 bp, Mus musculus
taaccaacctccttaaatgactgac

SEQ ID NO: 748522 - DNA, 25 bp, Mus musculus
taaccaacctggatctgagcgcggc

SEQ ID NO: 748523 - DNA, 25 bp, Mus musculus
taaccaacctggttctgagcgcggc

SEQ ID NO: 748524 - DNA, 25 bp, Mus musculus
taaccaacttttctccagctctata

SEQ ID NO: 748525 - DNA, 25 bp, Mus musculus
taaccaacttttgtccagctctata

SEQ ID NO: 748526 - DNA, 25 bp, Mus musculus
taaccaagaaccaatttcttcacct

SEQ ID NO: 748527 - DNA, 25 bp, Mus musculus
taaccaagaacctatttcttcacct

SEQ ID NO: 748528 - DNA, 25 bp, Mus musculus
taaccaagaccaagacctcgctatg

SEQ ID NO: 748529 - DNA, 25 bp, Mus musculus
taaccaagaccatgacctcgctatg

SEQ ID NO: 748530 - DNA, 25 bp, Mus musculus
taaccaagaggaacccttacgggca

SEQ ID NO: 748531 - DNA, 25 bp, Mus musculus
taaccaagaggatcccttacgggca

SEQ ID NO: 748532 - DNA, 25 bp, Mus musculus
taaccaagccgtcgttgcacgggtc

SEQ ID NO: 748533 - DNA, 25 bp, Mus musculus
taaccaagccgtggttgcacgggtc

SEQ ID NO: 748534 - DNA, 25 bp, Mus musculus
taaccaagggttcagatatgcacag

SEQ ID NO: 748535 - DNA, 25 bp, Mus musculus
taaccaagggttgagatatgcacag

SEQ ID NO: 748536 - DNA, 25 bp, Mus musculus
taaccaagtcgaaagcagtcccagc

SEQ ID NO: 748537 - DNA, 25 bp, Mus musculus
taaccaagtcgatagcagtcccagc

SEQ ID NO: 748538 - DNA, 25 bp, Mus musculus
taaccaagtggaagccattttttct

SEQ ID NO: 748539 - DNA, 25 bp, Mus musculus
taaccaagtggatgccattttttct

SEQ ID NO: 748540 - DNA, 25 bp, Mus musculus
taaccaagtgtgatgctgacataca

SEQ ID NO: 748541 - DNA, 25 bp, Mus musculus
taaccaagtgtgttgctgacataca

SEQ ID NO: 748542 - DNA, 25 bp, Mus musculus
taaccaagtgttatttgagctgctt

SEQ ID NO: 748543 - DNA, 25 bp, Mus musculus
taaccaagtgttttttgagctgctt

SEQ ID NO: 748544 - DNA, 25 bp, Mus musculus
taaccaagttgaaattacccctgtg

SEQ ID NO: 748545 - DNA, 25 bp, Mus musculus
taaccaagttgatattacccctgtg

SEQ ID NO: 748546 - DNA, 25 bp, Mus musculus
taaccaagtttaaaatgctttgtag

SEQ ID NO: 748547 - DNA, 25 bp, Mus musculus
taaccaagtttataatgctttgtag

SEQ ID NO: 748548 - DNA, 25 bp, Mus musculus
taaccaatatgcaacatggctatga

SEQ ID NO: 748549 - DNA, 25 bp, Mus musculus
taaccaatatgctacatggctatga

SEQ ID NO: 748550 - DNA, 25 bp, Mus musculus
taaccaatccagaatgcacagaagt

SEQ ID NO: 748551 - DNA, 25 bp, Mus musculus
taaccaatccagtatgcacagaagt

SEQ ID NO: 748552 - DNA, 25 bp, Mus musculus
taaccaatctgtccgtgatcggcgg

SEQ ID NO: 748553 - DNA, 25 bp, Mus musculus
taaccaatctgtgcgtgatcggcgg

SEQ ID NO: 748554 - DNA, 25 bp, Mus musculus
taaccaatgatgatgcccttcacac

SEQ ID NO: 748555 - DNA, 25 bp, Mus musculus
taaccaatgatgttgcccttcacac

SEQ ID NO: 748556 - DNA, 25 bp, Mus musculus
taaccaatgcccagggccaaatcat

SEQ ID NO: 748557 - DNA, 25 bp, Mus musculus
taaccaatgccctgggccaaatcat

SEQ ID NO: 748558 - DNA, 25 bp, Mus musculus
taaccaatgtcaatcgctgcctcga

SEQ ID NO: 748559 - DNA, 25 bp, Mus musculus
taaccaatgtcattcgctgcctcga

SEQ ID NO: 748560 - DNA, 25 bp, Mus musculus
taaccaattaaaagcatgtgcgttc

SEQ ID NO: 748561 - DNA, 25 bp, Mus musculus
taaccaattaaatgcatgtgcgttc

SEQ ID NO: 748562 - DNA, 25 bp, Mus musculus
taaccacaactaacggacttatccc

SEQ ID NO: 748563 - DNA, 25 bp, Mus musculus
taaccacaactatcggacttatccc

SEQ ID NO: 748564 - DNA, 25 bp, Mus musculus
taaccacaagatcgcagagtgacca

SEQ ID NO: 748565 - DNA, 25 bp, Mus musculus
taaccacaagatggcagagtgacca

SEQ ID NO: 748566 - DNA, 25 bp, Mus musculus
taaccacagaggagagctgagtggc

SEQ ID NO: 748567 - DNA, 25 bp, Mus musculus
taaccacagaggtgagctgagtggc

SEQ ID NO: 748568 - DNA, 25 bp, Mus musculus
taaccacagcatacactgggaagtt

SEQ ID NO: 748569 - DNA, 25 bp, Mus musculus
taaccacagcattcactgggaagtt

SEQ ID NO: 748570 - DNA, 25 bp, Mus musculus
taaccacagcgtatgtgccttcagc

SEQ ID NO: 748571 - DNA, 25 bp, Mus musculus
taaccacagcgtttgtgccttcagc

SEQ ID NO: 748572 - DNA, 25 bp, Mus musculus
taaccacataccattttcctctgta

SEQ ID NO: 748573 - DNA, 25 bp, Mus musculus
taaccacatacctttttcctctgta

SEQ ID NO: 748574 - DNA, 25 bp, Mus musculus
taaccaccagatctagctttcacgt

SEQ ID NO: 748575 - DNA, 25 bp, Mus musculus
taaccaccagatgtagctttcacgt

SEQ ID NO: 748576 - DNA, 25 bp, Mus musculus
taaccacctttaacatcaaccacga

SEQ ID NO: 748577 - DNA, 25 bp, Mus musculus
taaccacctttatcatcaaccacga

SEQ ID NO: 748578 - DNA, 25 bp, Mus musculus
taaccacgaaaacctgaagcctcag

SEQ ID NO: 748579 - DNA, 25 bp, Mus musculus
taaccacgaaaagctgaagcctcag

SEQ ID NO: 748580 - DNA, 25 bp, Mus musculus
taaccacgatggatcgttttgtgtt

SEQ ID NO: 748581 - DNA, 25 bp, Mus musculus
taaccacgatggttcgttttgtgtt

SEQ ID NO: 748582 - DNA, 25 bp, Mus musculus
taaccacgcatcagctgatcattgc

SEQ ID NO: 748583 - DNA, 25 bp, Mus musculus
taaccacgcatctgctgatcattgc

SEQ ID NO: 748584 - DNA, 25 bp, Mus musculus
taaccacggacaattctccagagtt

SEQ ID NO: 748585 - DNA, 25 bp, Mus musculus
taaccacggacatttctccagagtt

SEQ ID NO: 748586 - DNA, 25 bp, Mus musculus
taaccacggcccatcgaggaggaaa

SEQ ID NO: 748587 - DNA, 25 bp, Mus musculus
taaccacggcccttcgaggaggaaa

SEQ ID NO: 748588 - DNA, 25 bp, Mus musculus
taaccacggtttcctcttttacaag

SEQ ID NO: 748589 - DNA, 25 bp, Mus musculus
taaccacggtttgctcttttacaag

SEQ ID NO: 748590 - DNA, 25 bp, Mus musculus
taaccacgttttaggatctcgcctg

SEQ ID NO: 748591 - DNA, 25 bp, Mus musculus
taaccacgtttttggatctcgcctg

SEQ ID NO: 748592 - DNA, 25 bp, Mus musculus
taaccactacatctaacagttcctc

SEQ ID NO: 748593 - DNA, 25 bp, Mus musculus
taaccactacatgtaacagttcctc

SEQ ID NO: 748594 - DNA, 25 bp, Mus musculus
taaccactataacgctgtagtctag

SEQ ID NO: 748595 - DNA, 25 bp, Mus musculus
taaccactataaggctgtagtctag

SEQ ID NO: 748596 - DNA, 25 bp, Mus musculus
taaccactcactctgtgcacagcaa

SEQ ID NO: 748597 - DNA, 25 bp, Mus musculus
taaccactcactgtgtgcacagcaa

SEQ ID NO: 748598 - DNA, 25 bp, Mus musculus
taaccactgagacatcgctctagct

SEQ ID NO: 748599 - DNA, 25 bp, Mus musculus
taaccactgagagatcgctctagct

SEQ ID NO: 748600 - DNA, 25 bp, Mus musculus
taaccactgcaaccgattgtccaat

SEQ ID NO: 748601 - DNA, 25 bp, Mus musculus
taaccactgcaagcgattgtccaat

SEQ ID NO: 748602 - DNA, 25 bp, Mus musculus
taaccactgcttactcttcaagttt

SEQ ID NO: 748603 - DNA, 25 bp, Mus musculus
taaccactgctttctcttcaagttt

SEQ ID NO: 748604 - DNA, 25 bp, Mus musculus
taaccacttagaccaaggcttctct

SEQ ID NO: 748605 - DNA, 25 bp, Mus musculus
taaccacttagagcaaggcttctct

SEQ ID NO: 748606 - DNA, 25 bp, Mus musculus
taaccacttagcattctatcgagcc

SEQ ID NO: 748607 - DNA, 25 bp, Mus musculus
taaccacttagctttctatcgagcc

SEQ ID NO: 748608 - DNA, 25 bp, Mus musculus
taaccacttgcaactgtctacagta

SEQ ID NO: 748609 - DNA, 25 bp, Mus musculus
taaccacttgcatctgtctacagta

SEQ ID NO: 748610 - DNA, 25 bp, Mus musculus
taaccacttggtacactggctggag

SEQ ID NO: 748611 - DNA, 25 bp, Mus musculus
taaccacttggtcggtgcatggctg

SEQ ID NO: 748612 - DNA, 25 bp, Mus musculus
taaccacttggtgggtgcatggctg

SEQ ID NO: 748613 - DNA, 25 bp, Mus musculus
taaccacttggttcactggctggag

SEQ ID NO: 748614 - DNA, 25 bp, Mus musculus
taaccagaactacaagcgaaaagca

SEQ ID NO: 748615 - DNA, 25 bp, Mus musculus
taaccagaactagaagcgaaaagca

SEQ ID NO: 748616 - DNA, 25 bp, Mus musculus
taaccagaactgacagcgaaaagca

SEQ ID NO: 748617 - DNA, 25 bp, Mus musculus
taaccagaactgtcagcgaaaagca

SEQ ID NO: 748618 - DNA, 25 bp, Mus musculus
taaccagaccaacagactctttttt

SEQ ID NO: 748619 - DNA, 25 bp, Mus musculus
taaccagaccaagagactctttttt

SEQ ID NO: 748620 - DNA, 25 bp, Mus musculus
taaccagaccccatcctcacaatga

SEQ ID NO: 748621 - DNA, 25 bp, Mus musculus
taaccagaccccttcctcacaatga

SEQ ID NO: 748622 - DNA, 25 bp, Mus musculus
taaccagacggtaatccagttgtat

SEQ ID NO: 748623 - DNA, 25 bp, Mus musculus
taaccagacggttatccagttgtat

SEQ ID NO: 748624 - DNA, 25 bp, Mus musculus
taaccagactgcattttgttctaaa

SEQ ID NO: 748625 - DNA, 25 bp, Mus musculus
taaccagactgctttttgttctaaa

SEQ ID NO: 748626 - DNA, 25 bp, Mus musculus
taaccagactttacggctcttatgg

SEQ ID NO: 748627 - DNA, 25 bp, Mus musculus
taaccagacttttcggctcttatgg

SEQ ID NO: 748628 - DNA, 25 bp, Mus musculus
taaccagagggtcactaaccattgg

SEQ ID NO: 748629 - DNA, 25 bp, Mus musculus
taaccagagggtgactaaccattgg

SEQ ID NO: 748630 - DNA, 25 bp, Mus musculus
taaccagatatgaagctgctccaag

SEQ ID NO: 748631 - DNA, 25 bp, Mus musculus
taaccagatatgtagctgctccaag

SEQ ID NO: 748632 - DNA, 25 bp, Mus musculus
taaccagatgcaagatccctaggga

SEQ ID NO: 748633 - DNA, 25 bp, Mus musculus
taaccagatgcatgatccctaggga

SEQ ID NO: 748634 - DNA, 25 bp, Mus musculus
taaccagattgtatccatcctcttc

SEQ ID NO: 748635 - DNA, 25 bp, Mus musculus
taaccagattgtttccatcctcttc

SEQ ID NO: 748636 - DNA, 25 bp, Mus musculus
taaccagatttgaagtaacatgcgt

SEQ ID NO: 748637 - DNA, 25 bp, Mus musculus
taaccagatttgaccctaagatagg

SEQ ID NO: 748638 - DNA, 25 bp, Mus musculus
taaccagatttgtagtaacatgcgt

SEQ ID NO: 748639 - DNA, 25 bp, Mus musculus
taaccagatttgtccctaagatagg

SEQ ID NO: 748640 - DNA, 25 bp, Mus musculus
taaccagcaggcaactttatctcgc

SEQ ID NO: 748641 - DNA, 25 bp, Mus musculus
taaccagcaggctactttatctcgc

SEQ ID NO: 748642 - DNA, 25 bp, Mus musculus
taaccagcagggaggagtatcagaa

SEQ ID NO: 748643 - DNA, 25 bp, Mus musculus
taaccagcagggtggagtatcagaa

SEQ ID NO: 748644 - DNA, 25 bp, Mus musculus
taaccagcatatattgtctcacccc

SEQ ID NO: 748645 - DNA, 25 bp, Mus musculus
taaccagcatattttgtctcacccc

SEQ ID NO: 748646 - DNA, 25 bp, Mus musculus
taaccagcctcaagttgtgcaacca

SEQ ID NO: 748647 - DNA, 25 bp, Mus musculus
taaccagcctcatgttgtgcaacca

SEQ ID NO: 748648 - DNA, 25 bp, Mus musculus
taaccagcctctcggttatttcagt

SEQ ID NO: 748649 - DNA, 25 bp, Mus musculus
taaccagcctctgggttatttcagt

SEQ ID NO: 748650 - DNA, 25 bp, Mus musculus
taaccagcctggaatgttcaacgat

SEQ ID NO: 748651 - DNA, 25 bp, Mus musculus
taaccagcctggtatgttcaacgat

SEQ ID NO: 748652 - DNA, 25 bp, Mus musculus
taaccagcgacgacacagtggatgc

SEQ ID NO: 748653 - DNA, 25 bp, Mus musculus
taaccagcgacgtcacagtggatgc

SEQ ID NO: 748654 - DNA, 25 bp, Mus musculus
taaccagcgcagacatcagatgtga

SEQ ID NO: 748655 - DNA, 25 bp, Mus musculus
taaccagcgcagtcatcagatgtga

SEQ ID NO: 748656 - DNA, 25 bp, Mus musculus
taaccagctataactcctaggagga

SEQ ID NO: 748657 - DNA, 25 bp, Mus musculus
taaccagctatatctcctaggagga

SEQ ID NO: 748658 - DNA, 25 bp, Mus musculus
taaccagctcagagaggcagctttg

SEQ ID NO: 748659 - DNA, 25 bp, Mus musculus
taaccagctcagtgaggcagctttg

SEQ ID NO: 748660 - DNA, 25 bp, Mus musculus
taaccaggacttacactgtgccttg

SEQ ID NO: 748661 - DNA, 25 bp, Mus musculus
taaccaggactttcactgtgccttg

SEQ ID NO: 748662 - DNA, 25 bp, Mus musculus
taaccaggagggatcccacccacag

SEQ ID NO: 748663 - DNA, 25 bp, Mus musculus
taaccaggagggttcccacccacag

SEQ ID NO: 748664 - DNA, 25 bp, Mus musculus
taaccaggctgcattctgcaggttc

SEQ ID NO: 748665 - DNA, 25 bp, Mus musculus
taaccaggctgctttctgcaggttc

SEQ ID NO: 748666 - DNA, 25 bp, Mus musculus
taaccagggcaacactatatattcc

SEQ ID NO: 748667 - DNA, 25 bp, Mus musculus
taaccagggcaagactatatattcc

SEQ ID NO: 748668 - DNA, 25 bp, Mus musculus
taaccagggcatccacgaagctcaa

SEQ ID NO: 748669 - DNA, 25 bp, Mus musculus
taaccagggcatgcacgaagctcaa

SEQ ID NO: 748670 - DNA, 25 bp, Mus musculus
taaccagggtggagagatcactaat

SEQ ID NO: 748671 - DNA, 25 bp, Mus musculus
taaccagggtggtgagatcactaat

SEQ ID NO: 748672 - DNA, 25 bp, Mus musculus
taaccaggttttcggcaaaattgag

SEQ ID NO: 748673 - DNA, 25 bp, Mus musculus
taaccaggttttgggcaaaattgag

SEQ ID NO: 748674 - DNA, 25 bp, Mus musculus
taaccagtacgtcagggaccagggc

SEQ ID NO: 748675 - DNA, 25 bp, Mus musculus
taaccagtacgtgagggaccagggc

SEQ ID NO: 748676 - DNA, 25 bp, Mus musculus
taaccagtcactctggacggtggtg

SEQ ID NO: 748677 - DNA, 25 bp, Mus musculus
taaccagtcactgtggacggtggtg

SEQ ID NO: 748678 - DNA, 25 bp, Mus musculus
taaccagtccataatctttgagaat

SEQ ID NO: 748679 - DNA, 25 bp, Mus musculus
taaccagtccattatctttgagaat

SEQ ID NO: 748680 - DNA, 25 bp, Mus musculus
taaccagtcttacgttcttcaacca

SEQ ID NO: 748681 - DNA, 25 bp, Mus musculus
taaccagtcttaggttcttcaacca

SEQ ID NO: 748682 - DNA, 25 bp, Mus musculus
taaccagttaacagtgcagaccaca

SEQ ID NO: 748683 - DNA, 25 bp, Mus musculus
taaccagttaactgtgcagaccaca

SEQ ID NO: 748684 - DNA, 25 bp, Mus musculus
taaccagttacgagctgagctggag

SEQ ID NO: 748685 - DNA, 25 bp, Mus musculus
taaccagttacgtgctgagctggag

SEQ ID NO: 748686 - DNA, 25 bp, Mus musculus
taaccataaggaccccactgggaca

SEQ ID NO: 748687 - DNA, 25 bp, Mus musculus
taaccataaggagcccactgggaca

SEQ ID NO: 748688 - DNA, 25 bp, Mus musculus
taaccatacactcgtaccggcagaa

SEQ ID NO: 748689 - DNA, 25 bp, Mus musculus
taaccatacactggtaccggcagaa

SEQ ID NO: 748690 - DNA, 25 bp, Mus musculus
taaccatacgccatgctttgggtgg

SEQ ID NO: 748691 - DNA, 25 bp, Mus musculus
taaccatacgccttgctttgggtgg

SEQ ID NO: 748692 - DNA, 25 bp, Mus musculus
taaccatacttaactccagtgactt

SEQ ID NO: 748693 - DNA, 25 bp, Mus musculus
taaccatacttatctccagtgactt

SEQ ID NO: 748694 - DNA, 25 bp, Mus musculus
taaccatagacaataaattctgcat

SEQ ID NO: 748695 - DNA, 25 bp, Mus musculus
taaccatagacattaaattctgcat

SEQ ID NO: 748696 - DNA, 25 bp, Mus musculus
taaccatagcaacacgggacgcagt

SEQ ID NO: 748697 - DNA, 25 bp, Mus musculus
taaccatagcaagacgggacgcagt

SEQ ID NO: 748698 - DNA, 25 bp, Mus musculus
taaccatagctcagggaggatttac

SEQ ID NO: 748699 - DNA, 25 bp, Mus musculus
taaccatagctctgggaggatttac

SEQ ID NO: 748700 - DNA, 25 bp, Mus musculus
taaccatagcttcatttgaccccag

SEQ ID NO: 748701 - DNA, 25 bp, Mus musculus
taaccatagcttgatttgaccccag

SEQ ID NO: 748702 - DNA, 25 bp, Mus musculus
taaccataggttcccgtctgttgcc

SEQ ID NO: 748703 - DNA, 25 bp, Mus musculus
taaccataggttgccgtctgttgcc

SEQ ID NO: 748704 - DNA, 25 bp, Mus musculus
taaccatagtggctacctactgaga

SEQ ID NO: 748705 - DNA, 25 bp, Mus musculus
taaccatagtgggtacctactgaga

SEQ ID NO: 748706 - DNA, 25 bp, Mus musculus
taaccatattgcactggaaggccag

SEQ ID NO: 748707 - DNA, 25 bp, Mus musculus
taaccatattgctctggaaggccag

SEQ ID NO: 748708 - DNA, 25 bp, Mus musculus
taaccatcaagcagtgactctccat

SEQ ID NO: 748709 - DNA, 25 bp, Mus musculus
taaccatcaagccagggcctggatc

SEQ ID NO: 748710 - DNA, 25 bp, Mus musculus
taaccatcaagcgagggcctggatc

SEQ ID NO: 748711 - DNA, 25 bp, Mus musculus
taaccatcaagctgtgactctccat

SEQ ID NO: 748712 - DNA, 25 bp, Mus musculus
taaccatcagacctacagacgaggg

SEQ ID NO: 748713 - DNA, 25 bp, Mus musculus
taaccatcagacgtacagacgaggg

SEQ ID NO: 748714 - DNA, 25 bp, Mus musculus
taaccatcctagagactttgctttt

SEQ ID NO: 748715 - DNA, 25 bp, Mus musculus
taaccatcctagtgactttgctttt

SEQ ID NO: 748716 - DNA, 25 bp, Mus musculus
taaccatcctgtacctattttgtgc

SEQ ID NO: 748717 - DNA, 25 bp, Mus musculus
taaccatcctgttcctattttgtgc

SEQ ID NO: 748718 - DNA, 25 bp, Mus musculus
taaccatcgctcctatgcgtgggac

SEQ ID NO: 748719 - DNA, 25 bp, Mus musculus
taaccatcgctcgtatgcgtgggac

SEQ ID NO: 748720 - DNA, 25 bp, Mus musculus
taaccatcttgacagagccctttcc

SEQ ID NO: 748721 - DNA, 25 bp, Mus musculus
taaccatcttgagagagccctttcc

SEQ ID NO: 748722 - DNA, 25 bp, Mus musculus
taaccatgaccccagagatagagag

SEQ ID NO: 748723 - DNA, 25 bp, Mus musculus
taaccatgacccgagagatagagag

SEQ ID NO: 748724 - DNA, 25 bp, Mus musculus
taaccatgactgaaagtgcctagca

SEQ ID NO: 748725 - DNA, 25 bp, Mus musculus
taaccatgactgtaagtgcctagca

SEQ ID NO: 748726 - DNA, 25 bp, Mus musculus
taaccatgccatataccctctgcta

SEQ ID NO: 748727 - DNA, 25 bp, Mus musculus
taaccatgccatttaccctctgcta

SEQ ID NO: 748728 - DNA, 25 bp, Mus musculus
taaccatgcctactaaccagagctg

SEQ ID NO: 748729 - DNA, 25 bp, Mus musculus
taaccatgcctagtaaccagagctg

SEQ ID NO: 748730 - DNA, 25 bp, Mus musculus
taaccatgcgacacaaaggatcttt

SEQ ID NO: 748731 - DNA, 25 bp, Mus musculus
taaccatgcgactcaaaggatcttt

SEQ ID NO: 748732 - DNA, 25 bp, Mus musculus
taaccatgctctcaaccacttaaag

SEQ ID NO: 748733 - DNA, 25 bp, Mus musculus
taaccatgctctgaaccacttaaag

SEQ ID NO: 748734 - DNA, 25 bp, Mus musculus
taaccatgctgtaggatgcttaaga

SEQ ID NO: 748735 - DNA, 25 bp, Mus musculus
taaccatgctgttggatgcttaaga

SEQ ID NO: 748736 - DNA, 25 bp, Mus musculus
taaccatggaaccttactgctgcag

SEQ ID NO: 748737 - DNA, 25 bp, Mus musculus
taaccatggaacgttactgctgcag

SEQ ID NO: 748738 - DNA, 25 bp, Mus musculus
taaccatggaggaagtggccccagt

SEQ ID NO: 748739 - DNA, 25 bp, Mus musculus
taaccatggaggtagtggccccagt

SEQ ID NO: 748740 - DNA, 25 bp, Mus musculus
taaccatgggagactgcctagagac

SEQ ID NO: 748741 - DNA, 25 bp, Mus musculus
taaccatgggagtctgcctagagac

SEQ ID NO: 748742 - DNA, 25 bp, Mus musculus
taaccatgtagaagcagcctgggaa

SEQ ID NO: 748743 - DNA, 25 bp, Mus musculus
taaccatgtagatgcagcctgggaa

SEQ ID NO: 748744 - DNA, 25 bp, Mus musculus
taaccatgtagtcatcatcctcccg

SEQ ID NO: 748745 - DNA, 25 bp, Mus musculus
taaccatgtagtgatcatcctcccg

SEQ ID NO: 748746 - DNA, 25 bp, Mus musculus
taaccatgtgcgaccggaaggcggt

SEQ ID NO: 748747 - DNA, 25 bp, Mus musculus
taaccatgtgcgtccggaaggcggt

SEQ ID NO: 748748 - DNA, 25 bp, Mus musculus
taaccatgtgctagcctatttccat

SEQ ID NO: 748749 - DNA, 25 bp, Mus musculus
taaccatgtgcttgcctatttccat

SEQ ID NO: 748750 - DNA, 25 bp, Mus musculus
taaccatgtgtcaatgggaccaatt

SEQ ID NO: 748751 - DNA, 25 bp, Mus musculus
taaccatgtgtctatgggaccaatt

SEQ ID NO: 748752 - DNA, 25 bp, Mus musculus
taaccatgtgttcctttgtttgggt

SEQ ID NO: 748753 - DNA, 25 bp, Mus musculus
taaccatgtgttgctttgtttgggt

SEQ ID NO: 748754 - DNA, 25 bp, Mus musculus
taaccatgttgacagcctacctttt

SEQ ID NO: 748755 - DNA, 25 bp, Mus musculus
taaccatgttgagagcctacctttt

SEQ ID NO: 748756 - DNA, 25 bp, Mus musculus
taaccattccaaagtctctctcaga

SEQ ID NO: 748757 - DNA, 25 bp, Mus musculus
taaccattccaatgtctctctcaga

SEQ ID NO: 748758 - DNA, 25 bp, Mus musculus
taaccattcggtcctggatcagtgt

SEQ ID NO: 748759 - DNA, 25 bp, Mus musculus
taaccattcggtgctggatcagtgt

SEQ ID NO: 748760 - DNA, 25 bp, Mus musculus
taaccattgactcagaacattcagt

SEQ ID NO: 748761 - DNA, 25 bp, Mus musculus
taaccattgactgagaacattcagt

SEQ ID NO: 748762 - DNA, 25 bp, Mus musculus
taaccattggtgaggcgtgagccct

SEQ ID NO: 748763 - DNA, 25 bp, Mus musculus
taaccattggtgtggcgtgagccct

SEQ ID NO: 748764 - DNA, 25 bp, Mus musculus
taaccattggttataatctttacat

SEQ ID NO: 748765 - DNA, 25 bp, Mus musculus
taaccattggttatcgtgcgtcatt

SEQ ID NO: 748766 - DNA, 25 bp, Mus musculus
taaccattggttttaatctttacat

SEQ ID NO: 748767 - DNA, 25 bp, Mus musculus
taaccattggttttcgtgcgtcatt

SEQ ID NO: 748768 - DNA, 25 bp, Mus musculus
taaccatttcatatcatctcatctc

SEQ ID NO: 748769 - DNA, 25 bp, Mus musculus
taaccatttcatttcatctcatctc

SEQ ID NO: 748770 - DNA, 25 bp, Mus musculus
taaccatttgggacgttacagtatc

SEQ ID NO: 748771 - DNA, 25 bp, Mus musculus
taaccatttgggtcgttacagtatc

SEQ ID NO: 748772 - DNA, 25 bp, Mus musculus
taaccattttctacagatcagggca

SEQ ID NO: 748773 - DNA, 25 bp, Mus musculus
taaccattttcttcagatcagggca

SEQ ID NO: 748774 - DNA, 25 bp, Mus musculus
taacccaaaagtccattcctcaaat

SEQ ID NO: 748775 - DNA, 25 bp, Mus musculus
taacccaaaagtgcattcctcaaat

SEQ ID NO: 748776 - DNA, 25 bp, Mus musculus
taacccaaagtgatgagagtgctct

SEQ ID NO: 748777 - DNA, 25 bp, Mus musculus
taacccaaagtgttgagagtgctct

SEQ ID NO: 748778 - DNA, 25 bp, Mus musculus
taacccaaatcactagatgctagga

SEQ ID NO: 748779 - DNA, 25 bp, Mus musculus
taacccaaatcagtagatgctagga

SEQ ID NO: 748780 - DNA, 25 bp, Mus musculus
taacccaacactcgcctcataattg

SEQ ID NO: 748781 - DNA, 25 bp, Mus musculus
taacccaacactggcctcataattg

SEQ ID NO: 748782 - DNA, 25 bp, Mus musculus
taacccaactaacgcaacactcata

SEQ ID NO: 748783 - DNA, 25 bp, Mus musculus
taacccaactaaggcaacactcata

SEQ ID NO: 748784 - DNA, 25 bp, Mus musculus
taacccaagttaagcacagtagtgt

SEQ ID NO: 748785 - DNA, 25 bp, Mus musculus
taacccaagttatgcacagtagtgt

SEQ ID NO: 748786 - DNA, 25 bp, Mus musculus
taacccaatactaagctttcagcga

SEQ ID NO: 748787 - DNA, 25 bp, Mus musculus
taacccaatacttagctttcagcga

SEQ ID NO: 748788 - DNA, 25 bp, Mus musculus
taacccaatctgctgtggtcctgac

SEQ ID NO: 748789 - DNA, 25 bp, Mus musculus
taacccaatctggtgtggtcctgac

SEQ ID NO: 748790 - DNA, 25 bp, Mus musculus
taacccacagttccacatcttcaaa

SEQ ID NO: 748791 - DNA, 25 bp, Mus musculus
taacccacagttgcacatcttcaaa

SEQ ID NO: 748792 - DNA, 25 bp, Mus musculus
taacccacatttagacaccggaagt

SEQ ID NO: 748793 - DNA, 25 bp, Mus musculus
taacccacattttgacaccggaagt

SEQ ID NO: 748794 - DNA, 25 bp, Mus musculus
taacccacccgcatataaggtttgg

SEQ ID NO: 748795 - DNA, 25 bp, Mus musculus
taacccacccgcttataaggtttgg

SEQ ID NO: 748796 - DNA, 25 bp, Mus musculus
taacccacctggatttctgtggatt

SEQ ID NO: 748797 - DNA, 25 bp, Mus musculus
taacccacctggttttctgtggatt

SEQ ID NO: 748798 - DNA, 25 bp, Mus musculus
taacccacgataacaagacccagaa

SEQ ID NO: 748799 - DNA, 25 bp, Mus musculus
taacccacgatatcaagacccagaa

SEQ ID NO: 748800 - DNA, 25 bp, Mus musculus
taacccacgggaactgcgatgaaaa

SEQ ID NO: 748801 - DNA, 25 bp, Mus musculus
taacccacgggatctgcgatgaaaa

SEQ ID NO: 748802 - DNA, 25 bp, Mus musculus
taacccactaacagaacttgttacg

SEQ ID NO: 748803 - DNA, 25 bp, Mus musculus
taacccactaactgaacttgttacg

SEQ ID NO: 748804 - DNA, 25 bp, Mus musculus
taacccagaaaaccattcactgaca

SEQ ID NO: 748805 - DNA, 25 bp, Mus musculus
taacccagaaaagcattcactgaca

SEQ ID NO: 748806 - DNA, 25 bp, Mus musculus
taacccagacagcacttgtggcaat

SEQ ID NO: 748807 - DNA, 25 bp, Mus musculus
taacccagacaggacttgtggcaat

SEQ ID NO: 748808 - DNA, 25 bp, Mus musculus
taacccagacatagacacagacatt

SEQ ID NO: 748809 - DNA, 25 bp, Mus musculus
taacccagacattgacacagacatt

SEQ ID NO: 748810 - DNA, 25 bp, Mus musculus
taacccagcataccctgtctctgaa

SEQ ID NO: 748811 - DNA, 25 bp, Mus musculus
taacccagcatagcctgtctctgaa

SEQ ID NO: 748812 - DNA, 25 bp, Mus musculus
taacccagccaactctgtgcctaga

SEQ ID NO: 748813 - DNA, 25 bp, Mus musculus
taacccagccaagtctgtgcctaga

SEQ ID NO: 748814 - DNA, 25 bp, Mus musculus
taacccagcctcactgtcaaatgat

SEQ ID NO: 748815 - DNA, 25 bp, Mus musculus
taacccagcctctctgtcaaatgat

SEQ ID NO: 748816 - DNA, 25 bp, Mus musculus
taacccagcctgctgttaagggaga

SEQ ID NO: 748817 - DNA, 25 bp, Mus musculus
taacccagcctggtgttaagggaga

SEQ ID NO: 748818 - DNA, 25 bp, Mus musculus
taacccaggctgattatttcatgct

SEQ ID NO: 748819 - DNA, 25 bp, Mus musculus
taacccaggctgtttatttcatgct

SEQ ID NO: 748820 - DNA, 25 bp, Mus musculus
taacccagggagatcactcgtgtca

SEQ ID NO: 748821 - DNA, 25 bp, Mus musculus
taacccagggagttcactcgtgtca

SEQ ID NO: 748822 - DNA, 25 bp, Mus musculus
taacccaggtgtagtgtgcagaact

SEQ ID NO: 748823 - DNA, 25 bp, Mus musculus
taacccaggtgttgtgtgcagaact

SEQ ID NO: 748824 - DNA, 25 bp, Mus musculus
taacccagtaagacatctcatcagc

SEQ ID NO: 748825 - DNA, 25 bp, Mus musculus
taacccagtaagtcatctcatcagc

SEQ ID NO: 748826 - DNA, 25 bp, Mus musculus
taacccagtaccaatttagagaaag

SEQ ID NO: 748827 - DNA, 25 bp, Mus musculus
taacccagtacctatttagagaaag

SEQ ID NO: 748828 - DNA, 25 bp, Mus musculus
taacccagtagcagttgttcaccgc

SEQ ID NO: 748829 - DNA, 25 bp, Mus musculus
taacccagtagctgttgttcaccgc

SEQ ID NO: 748830 - DNA, 25 bp, Mus musculus
taacccagtctactctggtgctgaa

SEQ ID NO: 748831 - DNA, 25 bp, Mus musculus
taacccagtctagtctggtgctgaa

SEQ ID NO: 748832 - DNA, 25 bp, Mus musculus
taacccagttgaatgtttctgcact

SEQ ID NO: 748833 - DNA, 25 bp, Mus musculus
taacccagttgattgtttctgcact

SEQ ID NO: 748834 - DNA, 25 bp, Mus musculus
taacccatagacactgtttgctcca

SEQ ID NO: 748835 - DNA, 25 bp, Mus musculus
taacccatagactctgtttgctcca

SEQ ID NO: 748836 - DNA, 25 bp, Mus musculus
taacccatatgtaccttaggtctat

SEQ ID NO: 748837 - DNA, 25 bp, Mus musculus
taacccatatgttccttaggtctat

SEQ ID NO: 748838 - DNA, 25 bp, Mus musculus
taacccatgggactgcactgtctct

SEQ ID NO: 748839 - DNA, 25 bp, Mus musculus
taacccatgggagtgcactgtctct

SEQ ID NO: 748840 - DNA, 25 bp, Mus musculus
taacccattactcccatgctttatt

SEQ ID NO: 748841 - DNA, 25 bp, Mus musculus
taacccattactgccatgctttatt

SEQ ID NO: 748842 - DNA, 25 bp, Mus musculus
taacccatttggaattattcctaat

SEQ ID NO: 748843 - DNA, 25 bp, Mus musculus
taacccatttggtattattcctaat

SEQ ID NO: 748844 - DNA, 25 bp, Mus musculus
taaccccaaatgagccattttcctc

SEQ ID NO: 748845 - DNA, 25 bp, Mus musculus
taaccccaaatgtgccattttcctc

SEQ ID NO: 748846 - DNA, 25 bp, Mus musculus
taaccccaacttctaagccatcaat

SEQ ID NO: 748847 - DNA, 25 bp, Mus musculus
taaccccaacttgtaagccatcaat

SEQ ID NO: 748848 - DNA, 25 bp, Mus musculus
taaccccaaggcaccttcaggcatg

SEQ ID NO: 748849 - DNA, 25 bp, Mus musculus
taaccccaaggctccttcaggcatg

SEQ ID NO: 748850 - DNA, 25 bp, Mus musculus
taaccccaaggtcaaagtcagtggt

SEQ ID NO: 748851 - DNA, 25 bp, Mus musculus
taaccccaaggtgaaagtcagtggt

SEQ ID NO: 748852 - DNA, 25 bp, Mus musculus
taaccccaatgcctccagtgtgtac

SEQ ID NO: 748853 - DNA, 25 bp, Mus musculus
taaccccaatgcgtccagtgtgtac

SEQ ID NO: 748854 - DNA, 25 bp, Mus musculus
taaccccaattcagctgcatgggaa

SEQ ID NO: 748855 - DNA, 25 bp, Mus musculus
taaccccaattctgctgcatgggaa

SEQ ID NO: 748856 - DNA, 25 bp, Mus musculus
taaccccacaagactgtacaataag

SEQ ID NO: 748857 - DNA, 25 bp, Mus musculus
taaccccacaagtctgtacaataag

SEQ ID NO: 748858 - DNA, 25 bp, Mus musculus
taaccccacataaattctcaatact

SEQ ID NO: 748859 - DNA, 25 bp, Mus musculus
taaccccacatatattctcaatact

SEQ ID NO: 748860 - DNA, 25 bp, Mus musculus
taaccccacctcaaagtgacctgat

SEQ ID NO: 748861 - DNA, 25 bp, Mus musculus
taaccccacctctaagtgacctgat

SEQ ID NO: 748862 - DNA, 25 bp, Mus musculus
taaccccagagtaggcaggccacgt

SEQ ID NO: 748863 - DNA, 25 bp, Mus musculus
taaccccagagtcagaagagagtgt

SEQ ID NO: 748864 - DNA, 25 bp, Mus musculus
taaccccagagtgagaagagagtgt

SEQ ID NO: 748865 - DNA, 25 bp, Mus musculus
taaccccagagttggcaggccacgt

SEQ ID NO: 748866 - DNA, 25 bp, Mus musculus
taaccccagcatatctgagttggag

SEQ ID NO: 748867 - DNA, 25 bp, Mus musculus
taaccccagcatttctgagttggag

SEQ ID NO: 748868 - DNA, 25 bp, Mus musculus
taaccccaggccaggcgtggttctg

SEQ ID NO: 748869 - DNA, 25 bp, Mus musculus
taaccccaggcctggcgtggttctg

SEQ ID NO: 748870 - DNA, 25 bp, Mus musculus
taaccccagggaattgctaccagag

SEQ ID NO: 748871 - DNA, 25 bp, Mus musculus
taaccccagggatttgctaccagag

SEQ ID NO: 748872 - DNA, 25 bp, Mus musculus
taaccccatagacttttgcctttat

SEQ ID NO: 748873 - DNA, 25 bp, Mus musculus
taaccccatagagttttgcctttat

SEQ ID NO: 748874 - DNA, 25 bp, Mus musculus
taaccccatataacttgctggaatg

SEQ ID NO: 748875 - DNA, 25 bp, Mus musculus
taaccccatatatcttgctggaatg

SEQ ID NO: 748876 - DNA, 25 bp, Mus musculus
taaccccatcagagcagcttataac

SEQ ID NO: 748877 - DNA, 25 bp, Mus musculus
taaccccatcagtgcagcttataac

SEQ ID NO: 748878 - DNA, 25 bp, Mus musculus
taaccccatcccatggaggctgaag

SEQ ID NO: 748879 - DNA, 25 bp, Mus musculus
taaccccatcccttggaggctgaag

SEQ ID NO: 748880 - DNA, 25 bp, Mus musculus
taaccccgaaggaatgtgtgctcat

SEQ ID NO: 748881 - DNA, 25 bp, Mus musculus
taaccccgaaggtatgtgtgctcat

SEQ ID NO: 748882 - DNA, 25 bp, Mus musculus
taaccccgccaccagtggctttata

SEQ ID NO: 748883 - DNA, 25 bp, Mus musculus
taaccccgccacgagtggctttata

SEQ ID NO: 748884 - DNA, 25 bp, Mus musculus
taaccccgtgatcaaatactggaga

SEQ ID NO: 748885 - DNA, 25 bp, Mus musculus
taaccccgtgatcattgacgccaaa

SEQ ID NO: 748886 - DNA, 25 bp, Mus musculus
taaccccgtgatgaaatactggaga

SEQ ID NO: 748887 - DNA, 25 bp, Mus musculus
taaccccgtgatgattgacgccaaa

SEQ ID NO: 748888 - DNA, 25 bp, Mus musculus
taacccctgaggagctttggaatcc

SEQ ID NO: 748889 - DNA, 25 bp, Mus musculus
taacccctgaggtgctttggaatcc

SEQ ID NO: 748890 - DNA, 25 bp, Mus musculus
taacccctgataccatatgaatgct

SEQ ID NO: 748891 - DNA, 25 bp, Mus musculus
taacccctgatagcatatgaatgct

SEQ ID NO: 748892 - DNA, 25 bp, Mus musculus
taacccctgatccagtctgcataat

SEQ ID NO: 748893 - DNA, 25 bp, Mus musculus
taacccctgatcgagtctgcataat

SEQ ID NO: 748894 - DNA, 25 bp, Mus musculus
taaccccttaccagagaatgaaggg

SEQ ID NO: 748895 - DNA, 25 bp, Mus musculus
taaccccttacctgagaatgaaggg

SEQ ID NO: 748896 - DNA, 25 bp, Mus musculus
taaccccttcccagtacatatgtaa

SEQ ID NO: 748897 - DNA, 25 bp, Mus musculus
taaccccttccctgtacatatgtaa

SEQ ID NO: 748898 - DNA, 25 bp, Mus musculus
taaccccttgctaggattttgtctt

SEQ ID NO: 748899 - DNA, 25 bp, Mus musculus
taaccccttgcttggattttgtctt

SEQ ID NO: 748900 - DNA, 25 bp, Mus musculus
taaccccttgtgatgtatttgtgga

SEQ ID NO: 748901 - DNA, 25 bp, Mus musculus
taaccccttgtgttgtatttgtgga

SEQ ID NO: 748902 - DNA, 25 bp, Mus musculus
taacccctttgtatcatgtagttag

SEQ ID NO: 748903 - DNA, 25 bp, Mus musculus
taacccctttgtttcatgtagttag

SEQ ID NO: 748904 - DNA, 25 bp, Mus musculus
taaccccttttaagtgctcttgaat

SEQ ID NO: 748905 - DNA, 25 bp, Mus musculus
taaccccttttatgtgctcttgaat

SEQ ID NO: 748906 - DNA, 25 bp, Mus musculus
taacccctttttccatatttagaca

SEQ ID NO: 748907 - DNA, 25 bp, Mus musculus
taacccctttttgcatatttagaca

SEQ ID NO: 748908 - DNA, 25 bp, Mus musculus
taacccgactgtactttgtttactg

SEQ ID NO: 748909 - DNA, 25 bp, Mus musculus
taacccgactgttctttgtttactg

SEQ ID NO: 748910 - DNA, 25 bp, Mus musculus
taacccgatgagctcccctatgatc

SEQ ID NO: 748911 - DNA, 25 bp, Mus musculus
taacccgatgaggtcccctatgatc

SEQ ID NO: 748912 - DNA, 25 bp, Mus musculus
taacccgctgagagggctgtgtgct

SEQ ID NO: 748913 - DNA, 25 bp, Mus musculus
taacccgctgagtgggctgtgtgct

SEQ ID NO: 748914 - DNA, 25 bp, Mus musculus
taacccggaagaactccactatgct

SEQ ID NO: 748915 - DNA, 25 bp, Mus musculus
taacccggaagatctccactatgct

SEQ ID NO: 748916 - DNA, 25 bp, Mus musculus
taacccggcttcaagttgactgatt

SEQ ID NO: 748917 - DNA, 25 bp, Mus musculus
taacccggcttctagttgactgatt

SEQ ID NO: 748918 - DNA, 25 bp, Mus musculus
taacccgggactaggagaagcactg

SEQ ID NO: 748919 - DNA, 25 bp, Mus musculus
taacccgggacttggagaagcactg

SEQ ID NO: 748920 - DNA, 25 bp, Mus musculus
taacccgggcatcaagctgttctct

SEQ ID NO: 748921 - DNA, 25 bp, Mus musculus
taacccgggcatgaagctgttctct

SEQ ID NO: 748922 - DNA, 25 bp, Mus musculus
taacccgtaagccttagttgtatat

SEQ ID NO: 748923 - DNA, 25 bp, Mus musculus
taacccgtaagcgttagttgtatat

SEQ ID NO: 748924 - DNA, 25 bp, Mus musculus
taacccgtctaacacacttgttaga

SEQ ID NO: 748925 - DNA, 25 bp, Mus musculus
taacccgtctaagacacttgttaga

SEQ ID NO: 748926 - DNA, 25 bp, Mus musculus
taacccgtgagtcacatttcctgaa

SEQ ID NO: 748927 - DNA, 25 bp, Mus musculus
taacccgtgagtgacatttcctgaa

SEQ ID NO: 748928 - DNA, 25 bp, Mus musculus
taacccgttaacagccattcagctt

SEQ ID NO: 748929 - DNA, 25 bp, Mus musculus
taacccgttaactgccattcagctt

SEQ ID NO: 748930 - DNA, 25 bp, Mus musculus
taacccgttatcatcccaactgtat

SEQ ID NO: 748931 - DNA, 25 bp, Mus musculus
taacccgttatcttcccaactgtat

SEQ ID NO: 748932 - DNA, 25 bp, Mus musculus
taaccctaaaaaacttgccttctct

SEQ ID NO: 748933 - DNA, 25 bp, Mus musculus
taaccctaaaaatcttgccttctct

SEQ ID NO: 748934 - DNA, 25 bp, Mus musculus
taaccctaaatcactttgttcctga

SEQ ID NO: 748935 - DNA, 25 bp, Mus musculus
taaccctaaatctctttgttcctga

SEQ ID NO: 748936 - DNA, 25 bp, Mus musculus
taaccctaacccactgtatgatgta

SEQ ID NO: 748937 - DNA, 25 bp, Mus musculus
taaccctaacccctctggttgtctg

SEQ ID NO: 748938 - DNA, 25 bp, Mus musculus
taaccctaacccgtctggttgtctg

SEQ ID NO: 748939 - DNA, 25 bp, Mus musculus
taaccctaaccctctgtatgatgta

SEQ ID NO: 748940 - DNA, 25 bp, Mus musculus
taaccctaacgacgacagcattatg

SEQ ID NO: 748941 - DNA, 25 bp, Mus musculus
taaccctaacgaggacagcattatg

SEQ ID NO: 748942 - DNA, 25 bp, Mus musculus
taaccctaattacccatagcatagt

SEQ ID NO: 748943 - DNA, 25 bp, Mus musculus
taaccctaattagccatagcatagt

SEQ ID NO: 748944 - DNA, 25 bp, Mus musculus
taaccctaggcaatgttctacagtg

SEQ ID NO: 748945 - DNA, 25 bp, Mus musculus
taaccctaggcattgttctacagtg

SEQ ID NO: 748946 - DNA, 25 bp, Mus musculus
taaccctatgtaaatccactgaaag

SEQ ID NO: 748947 - DNA, 25 bp, Mus musculus
taaccctatgtatatccactgaaag

SEQ ID NO: 748948 - DNA, 25 bp, Mus musculus
taaccctcaccgcaaaaaagctcta

SEQ ID NO: 748949 - DNA, 25 bp, Mus musculus
taaccctcaccggaaaaaagctcta

SEQ ID NO: 748950 - DNA, 25 bp, Mus musculus
taaccctcattccagtgacctcagt

SEQ ID NO: 748951 - DNA, 25 bp, Mus musculus
taaccctcattcgagtgacctcagt

SEQ ID NO: 748952 - DNA, 25 bp, Mus musculus
taaccctccaggagcgtggcttcag

SEQ ID NO: 748953 - DNA, 25 bp, Mus musculus
taaccctccaggtgcgtggcttcag

SEQ ID NO: 748954 - DNA, 25 bp, Mus musculus
taaccctccataacgattctcttat

SEQ ID NO: 748955 - DNA, 25 bp, Mus musculus
taaccctccatatcgattctcttat

SEQ ID NO: 748956 - DNA, 25 bp, Mus musculus
taaccctctagcacttgcctgtgga

SEQ ID NO: 748957 - DNA, 25 bp, Mus musculus
taaccctctagctcttgcctgtgga

SEQ ID NO: 748958 - DNA, 25 bp, Mus musculus
taaccctctcaccaacagagcaggt

SEQ ID NO: 748959 - DNA, 25 bp, Mus musculus
taaccctctcacgaacagagcaggt

SEQ ID NO: 748960 - DNA, 25 bp, Mus musculus
taaccctctcttctagcaaaaactc

SEQ ID NO: 748961 - DNA, 25 bp, Mus musculus
taaccctctcttctttgcttactat

SEQ ID NO: 748962 - DNA, 25 bp, Mus musculus
taaccctctcttgtagcaaaaactc

SEQ ID NO: 748963 - DNA, 25 bp, Mus musculus
taaccctctcttgtttgcttactat

SEQ ID NO: 748964 - DNA, 25 bp, Mus musculus
taaccctctgtacaagaagccatcc

SEQ ID NO: 748965 - DNA, 25 bp, Mus musculus
taaccctctgtagaagaagccatcc

SEQ ID NO: 748966 - DNA, 25 bp, Mus musculus
taaccctcttcaagctacacggaac

SEQ ID NO: 748967 - DNA, 25 bp, Mus musculus
taaccctcttcatgctacacggaac

SEQ ID NO: 748968 - DNA, 25 bp, Mus musculus
taaccctctttaaaacttctcttgt

SEQ ID NO: 748969 - DNA, 25 bp, Mus musculus
taaccctctttataacttctcttgt

SEQ ID NO: 748970 - DNA, 25 bp, Mus musculus
taaccctgaacaaaggtgccaagtt

SEQ ID NO: 748971 - DNA, 25 bp, Mus musculus
taaccctgaacataggtgccaagtt

SEQ ID NO: 748972 - DNA, 25 bp, Mus musculus
taaccctgacttaatgtttcaaggt

SEQ ID NO: 748973 - DNA, 25 bp, Mus musculus
taaccctgactttatgtttcaaggt

SEQ ID NO: 748974 - DNA, 25 bp, Mus musculus
taaccctgagttccttgtgagacaa

SEQ ID NO: 748975 - DNA, 25 bp, Mus musculus
taaccctgagttgcttgtgagacaa

SEQ ID NO: 748976 - DNA, 25 bp, Mus musculus
taaccctgattaaggaccaggctgg

SEQ ID NO: 748977 - DNA, 25 bp, Mus musculus
taaccctgattatggaccaggctgg

SEQ ID NO: 748978 - DNA, 25 bp, Mus musculus
taaccctgcctgcatctctctgctc

SEQ ID NO: 748979 - DNA, 25 bp, Mus musculus
taaccctgcctggatctctctgctc

SEQ ID NO: 748980 - DNA, 25 bp, Mus musculus
taaccctgcgacatgcgtacagtat

SEQ ID NO: 748981 - DNA, 25 bp, Mus musculus
taaccctgcgacttgcgtacagtat

SEQ ID NO: 748982 - DNA, 25 bp, Mus musculus
taaccctggaagctagccctggtgt

SEQ ID NO: 748983 - DNA, 25 bp, Mus musculus
taaccctggaaggtagccctggtgt

SEQ ID NO: 748984 - DNA, 25 bp, Mus musculus
taaccctggactagatgttccacag

SEQ ID NO: 748985 - DNA, 25 bp, Mus musculus
taaccctggacttgatgttccacag

SEQ ID NO: 748986 - DNA, 25 bp, Mus musculus
taaccctggatcataactgttaata

SEQ ID NO: 748987 - DNA, 25 bp, Mus musculus
taaccctggatcttaactgttaata

SEQ ID NO: 748988 - DNA, 25 bp, Mus musculus
taaccctggcgactactactttacg

SEQ ID NO: 748989 - DNA, 25 bp, Mus musculus
taaccctggcgagtactactttacg

SEQ ID NO: 748990 - DNA, 25 bp, Mus musculus
taaccctgtagaatgcctcacaagt

SEQ ID NO: 748991 - DNA, 25 bp, Mus musculus
taaccctgtagattgcctcacaagt

SEQ ID NO: 748992 - DNA, 25 bp, Mus musculus
taaccctgtagtatctggacgtttg

SEQ ID NO: 748993 - DNA, 25 bp, Mus musculus
taaccctgtagtttctggacgtttg

SEQ ID NO: 748994 - DNA, 25 bp, Mus musculus
taaccctgtcctctctatgaaatgg

SEQ ID NO: 748995 - DNA, 25 bp, Mus musculus
taaccctgtcctgtctatgaaatgg

SEQ ID NO: 748996 - DNA, 25 bp, Mus musculus
taaccctgtgaacttccattgtact

SEQ ID NO: 748997 - DNA, 25 bp, Mus musculus
taaccctgtgaagttccattgtact

SEQ ID NO: 748998 - DNA, 25 bp, Mus musculus
taaccctgtgacaaacaagtctggc

SEQ ID NO: 748999 - DNA, 25 bp, Mus musculus
taaccctgtgactaacaagtctggc

SEQ ID NO: 749000 - DNA, 25 bp, Mus musculus
taacccttaactcctgaggtaaatg

SEQ ID NO: 749001 - DNA, 25 bp, Mus musculus
taacccttaactgctgaggtaaatg

SEQ ID NO: 749002 - DNA, 25 bp, Mus musculus
taacccttacttattagagcaccat

SEQ ID NO: 749003 - DNA, 25 bp, Mus musculus
taacccttactttttagagcaccat

SEQ ID NO: 749004 - DNA, 25 bp, Mus musculus
taacccttatagctacattgacatg

SEQ ID NO: 749005 - DNA, 25 bp, Mus musculus
taacccttataggtacattgacatg

SEQ ID NO: 749006 - DNA, 25 bp, Mus musculus
taacccttcaacatttcttcacttt

SEQ ID NO: 749007 - DNA, 25 bp, Mus musculus
taacccttcaacttttcttcacttt

SEQ ID NO: 749008 - DNA, 25 bp, Mus musculus
taacccttccttcaatatggagcct

SEQ ID NO: 749009 - DNA, 25 bp, Mus musculus
taacccttccttgaatatggagcct

SEQ ID NO: 749010 - DNA, 25 bp, Mus musculus
taacccttctctctcagcgtctggg

SEQ ID NO: 749011 - DNA, 25 bp, Mus musculus
taacccttctctgtcagcgtctggg

SEQ ID NO: 749012 - DNA, 25 bp, Mus musculus
taacccttctgcaaatgtccattcc

SEQ ID NO: 749013 - DNA, 25 bp, Mus musculus
taacccttctgctaatgtccattcc

SEQ ID NO: 749014 - DNA, 25 bp, Mus musculus
taacccttctgtaaatgagcaccaa

SEQ ID NO: 749015 - DNA, 25 bp, Mus musculus
taacccttctgttaatgagcaccaa

SEQ ID NO: 749016 - DNA, 25 bp, Mus musculus
taacccttgaagaccaggtgcaggt

SEQ ID NO: 749017 - DNA, 25 bp, Mus musculus
taacccttgaagtccaggtgcaggt

SEQ ID NO: 749018 - DNA, 25 bp, Mus musculus
taacccttgagacgatgttcccagt

SEQ ID NO: 749019 - DNA, 25 bp, Mus musculus
taacccttgagaggatgttcccagt

SEQ ID NO: 749020 - DNA, 25 bp, Mus musculus
taacccttgatccggctgaaaggag

SEQ ID NO: 749021 - DNA, 25 bp, Mus musculus
taacccttgatcgggctgaaaggag

SEQ ID NO: 749022 - DNA, 25 bp, Mus musculus
taacccttgcctaatttgtgcctat

SEQ ID NO: 749023 - DNA, 25 bp, Mus musculus
taacccttgccttatttgtgcctat

SEQ ID NO: 749024 - DNA, 25 bp, Mus musculus
taacccttgctgacttcccagagag

SEQ ID NO: 749025 - DNA, 25 bp, Mus musculus
taacccttgctgtcttcccagagag

SEQ ID NO: 749026 - DNA, 25 bp, Mus musculus
taacccttggctcaggtctgtttct

SEQ ID NO: 749027 - DNA, 25 bp, Mus musculus
taacccttggctgaggtctgtttct

SEQ ID NO: 749028 - DNA, 25 bp, Mus musculus
taacccttgtaaatcctaagcctca

SEQ ID NO: 749029 - DNA, 25 bp, Mus musculus
taacccttgtaattcctaagcctca

SEQ ID NO: 749030 - DNA, 25 bp, Mus musculus
taaccctttagcagaccacgtctct

SEQ ID NO: 749031 - DNA, 25 bp, Mus musculus
taaccctttagctgaccacgtctct

SEQ ID NO: 749032 - DNA, 25 bp, Mus musculus
taaccctttatacaagaaactccag

SEQ ID NO: 749033 - DNA, 25 bp, Mus musculus
taaccctttatagaagaaactccag

SEQ ID NO: 749034 - DNA, 25 bp, Mus musculus
taaccctttcacattgtgtggctta

SEQ ID NO: 749035 - DNA, 25 bp, Mus musculus
taaccctttcactttgtgtggctta

SEQ ID NO: 749036 - DNA, 25 bp, Mus musculus
taaccctttcagcaccgagctgtat

SEQ ID NO: 749037 - DNA, 25 bp, Mus musculus
taaccctttcaggaccgagctgtat

SEQ ID NO: 749038 - DNA, 25 bp, Mus musculus
taaccctttcctagtgcgtaaaatg

SEQ ID NO: 749039 - DNA, 25 bp, Mus musculus
taaccctttccttgtgcgtaaaatg

SEQ ID NO: 749040 - DNA, 25 bp, Mus musculus
taaccctttctaacaacactacagt

SEQ ID NO: 749041 - DNA, 25 bp, Mus musculus
taaccctttctatcaacactacagt

SEQ ID NO: 749042 - DNA, 25 bp, Mus musculus
taaccctttgtgactagtttgaagc

SEQ ID NO: 749043 - DNA, 25 bp, Mus musculus
taaccctttgtgtctagtttgaagc

SEQ ID NO: 749044 - DNA, 25 bp, Mus musculus
taaccgaaagagacagtagaacctg

SEQ ID NO: 749045 - DNA, 25 bp, Mus musculus
taaccgaaagagtcagtagaacctg

SEQ ID NO: 749046 - DNA, 25 bp, Mus musculus
taaccgaacttccagggcagggtgt

SEQ ID NO: 749047 - DNA, 25 bp, Mus musculus
taaccgaacttcgagggcagggtgt

SEQ ID NO: 749048 - DNA, 25 bp, Mus musculus
taaccgaatttcatactggccttct

SEQ ID NO: 749049 - DNA, 25 bp, Mus musculus
taaccgaatttcttactggccttct

SEQ ID NO: 749050 - DNA, 25 bp, Mus musculus
taaccgactgtgctcagtgtctggc

SEQ ID NO: 749051 - DNA, 25 bp, Mus musculus
taaccgactgtggtcagtgtctggc

SEQ ID NO: 749052 - DNA, 25 bp, Mus musculus
taaccgagctttcacggctaatttt

SEQ ID NO: 749053 - DNA, 25 bp, Mus musculus
taaccgagctttgacggctaatttt

SEQ ID NO: 749054 - DNA, 25 bp, Mus musculus
taaccgagggcaaaggtgccaacgc

SEQ ID NO: 749055 - DNA, 25 bp, Mus musculus
taaccgagggcataggtgccaacgc

SEQ ID NO: 749056 - DNA, 25 bp, Mus musculus
taaccgagggccatagagcagcctg

SEQ ID NO: 749057 - DNA, 25 bp, Mus musculus
taaccgagggccttagagcagcctg

SEQ ID NO: 749058 - DNA, 25 bp, Mus musculus
taaccgattccccagcagtttatta

SEQ ID NO: 749059 - DNA, 25 bp, Mus musculus
taaccgattcccgagcagtttatta

SEQ ID NO: 749060 - DNA, 25 bp, Mus musculus
taaccgcaaagcaatctttccagtc

SEQ ID NO: 749061 - DNA, 25 bp, Mus musculus
taaccgcaaagctatctttccagtc

SEQ ID NO: 749062 - DNA, 25 bp, Mus musculus
taaccgcatcttagtaggaggaatt

SEQ ID NO: 749063 - DNA, 25 bp, Mus musculus
taaccgcatctttgtaggaggaatt

SEQ ID NO: 749064 - DNA, 25 bp, Mus musculus
taaccgcatgttctatgtgtgcata

SEQ ID NO: 749065 - DNA, 25 bp, Mus musculus
taaccgcatgttgtatgtgtgcata

SEQ ID NO: 749066 - DNA, 25 bp, Mus musculus
taaccgccattccttcgtcctttct

SEQ ID NO: 749067 - DNA, 25 bp, Mus musculus
taaccgccattcgttcgtcctttct

SEQ ID NO: 749068 - DNA, 25 bp, Mus musculus
taaccgcgcatgcaggaaagtcact

SEQ ID NO: 749069 - DNA, 25 bp, Mus musculus
taaccgcgcatggaggaaagtcact

SEQ ID NO: 749070 - DNA, 25 bp, Mus musculus
taaccgctcaccactagttgtttca

SEQ ID NO: 749071 - DNA, 25 bp, Mus musculus
taaccgctcacctctagttgtttca

SEQ ID NO: 749072 - DNA, 25 bp, Mus musculus
taaccgctggtaccaggacctggat

SEQ ID NO: 749073 - DNA, 25 bp, Mus musculus
taaccgctggtagcaggacctggat

SEQ ID NO: 749074 - DNA, 25 bp, Mus musculus
taaccgctgtgaccatgtcccgctg

SEQ ID NO: 749075 - DNA, 25 bp, Mus musculus
taaccgctgtgagcatgtcccgctg

SEQ ID NO: 749076 - DNA, 25 bp, Mus musculus
taaccgcttcccaaagatcctggag

SEQ ID NO: 749077 - DNA, 25 bp, Mus musculus
taaccgcttccctaagatcctggag

SEQ ID NO: 749078 - DNA, 25 bp, Mus musculus
taaccggaccatcttcgacagtgac

SEQ ID NO: 749079 - DNA, 25 bp, Mus musculus
taaccggaccatgttcgacagtgac

SEQ ID NO: 749080 - DNA, 25 bp, Mus musculus
taaccggacttcaatagcaacctct

SEQ ID NO: 749081 - DNA, 25 bp, Mus musculus
taaccggacttctatagcaacctct

SEQ ID NO: 749082 - DNA, 25 bp, Mus musculus
taaccggatggcagacaccctgcat

SEQ ID NO: 749083 - DNA, 25 bp, Mus musculus
taaccggatggctgacaccctgcat

SEQ ID NO: 749084 - DNA, 25 bp, Mus musculus
taaccggatgggattcccctggagc

SEQ ID NO: 749085 - DNA, 25 bp, Mus musculus
taaccggatgggtttcccctggagc

SEQ ID NO: 749086 - DNA, 25 bp, Mus musculus
taaccggcactacttacagttttgt

SEQ ID NO: 749087 - DNA, 25 bp, Mus musculus
taaccggcactagttacagttttgt

SEQ ID NO: 749088 - DNA, 25 bp, Mus musculus
taaccggccaaacatcagggctcgg

SEQ ID NO: 749089 - DNA, 25 bp, Mus musculus
taaccggccaaagatcagggctcgg

SEQ ID NO: 749090 - DNA, 25 bp, Mus musculus
taaccggcgccccaagttgattaag

SEQ ID NO: 749091 - DNA, 25 bp, Mus musculus
taaccggcgcccgaagttgattaag

SEQ ID NO: 749092 - DNA, 25 bp, Mus musculus
taaccggctgaaccaactggctacc

SEQ ID NO: 749093 - DNA, 25 bp, Mus musculus
taaccggctgaagcaactggctacc

SEQ ID NO: 749094 - DNA, 25 bp, Mus musculus
taaccggcttctccattatgctggt

SEQ ID NO: 749095 - DNA, 25 bp, Mus musculus
taaccggcttctgcattatgctggt

SEQ ID NO: 749096 - DNA, 25 bp, Mus musculus
taaccgggcagcattaactatttgt

SEQ ID NO: 749097 - DNA, 25 bp, Mus musculus
taaccgggcagctttaactatttgt

SEQ ID NO: 749098 - DNA, 25 bp, Mus musculus
taaccgggccatccaaattccacat

SEQ ID NO: 749099 - DNA, 25 bp, Mus musculus
taaccgggccatgcaaattccacat

SEQ ID NO: 749100 - DNA, 25 bp, Mus musculus
taaccgggctctataaattctgcat

SEQ ID NO: 749101 - DNA, 25 bp, Mus musculus
taaccgggctctttaaattctgcat

SEQ ID NO: 749102 - DNA, 25 bp, Mus musculus
taaccgggtaggctagaggcttcca

SEQ ID NO: 749103 - DNA, 25 bp, Mus musculus
taaccgggtagggtagaggcttcca

SEQ ID NO: 749104 - DNA, 25 bp, Mus musculus
taaccggtgccgaatccagattttt

SEQ ID NO: 749105 - DNA, 25 bp, Mus musculus
taaccggtgccgtatccagattttt

SEQ ID NO: 749106 - DNA, 25 bp, Mus musculus
taaccggttgagagcatgagctctg

SEQ ID NO: 749107 - DNA, 25 bp, Mus musculus
taaccggttgagtgcatgagctctg

SEQ ID NO: 749108 - DNA, 25 bp, Mus musculus
taaccgtactcaattcctatgcatt

SEQ ID NO: 749109 - DNA, 25 bp, Mus musculus
taaccgtactcatttcctatgcatt

SEQ ID NO: 749110 - DNA, 25 bp, Mus musculus
taaccgtatgtgaagccagggcaac

SEQ ID NO: 749111 - DNA, 25 bp, Mus musculus
taaccgtatgtgtagccagggcaac

SEQ ID NO: 749112 - DNA, 25 bp, Mus musculus
taaccgtcttccatggcttttaaag

SEQ ID NO: 749113 - DNA, 25 bp, Mus musculus
taaccgtcttccttggcttttaaag

SEQ ID NO: 749114 - DNA, 25 bp, Mus musculus
taaccgtgatgcaaacctgcaggcc

SEQ ID NO: 749115 - DNA, 25 bp, Mus musculus
taaccgtgatgctaacctgcaggcc

SEQ ID NO: 749116 - DNA, 25 bp, Mus musculus
taaccgtgcatgagaggagccatac

SEQ ID NO: 749117 - DNA, 25 bp, Mus musculus
taaccgtgcatgtgaggagccatac

SEQ ID NO: 749118 - DNA, 25 bp, Mus musculus
taaccgtgctccagaaagtcggcct

SEQ ID NO: 749119 - DNA, 25 bp, Mus musculus
taaccgtgctcctgaaagtcggcct

SEQ ID NO: 749120 - DNA, 25 bp, Mus musculus
taaccgtggatgctgctgcaggacc

SEQ ID NO: 749121 - DNA, 25 bp, Mus musculus
taaccgtggatggtgctgcaggacc

SEQ ID NO: 749122 - DNA, 25 bp, Mus musculus
taaccgttacctcgctagcctggta

SEQ ID NO: 749123 - DNA, 25 bp, Mus musculus
taaccgttacctggctagcctggta

SEQ ID NO: 749124 - DNA, 25 bp, Mus musculus
taaccgttctgtagaggtcctgcct

SEQ ID NO: 749125 - DNA, 25 bp, Mus musculus
taaccgttctgttgaggtcctgcct

SEQ ID NO: 749126 - DNA, 25 bp, Mus musculus
taaccgttggttaaatggacagccg

SEQ ID NO: 749127 - DNA, 25 bp, Mus musculus
taaccgttggtttaatggacagccg

SEQ ID NO: 749128 - DNA, 25 bp, Mus musculus
taacctaaacatatacttccctcat

SEQ ID NO: 749129 - DNA, 25 bp, Mus musculus
taacctaaacatttacttccctcat

SEQ ID NO: 749130 - DNA, 25 bp, Mus musculus
taacctaacccgaatggtgctgtca

SEQ ID NO: 749131 - DNA, 25 bp, Mus musculus
taacctaacccgtatggtgctgtca

SEQ ID NO: 749132 - DNA, 25 bp, Mus musculus
taacctaactttcatgtgcatgtgc

SEQ ID NO: 749133 - DNA, 25 bp, Mus musculus
taacctaactttgatgtgcatgtgc

SEQ ID NO: 749134 - DNA, 25 bp, Mus musculus
taacctaagtatagcagtttctctc

SEQ ID NO: 749135 - DNA, 25 bp, Mus musculus
taacctaagtattgcagtttctctc

SEQ ID NO: 749136 - DNA, 25 bp, Mus musculus
taacctacaggtaggaatctaattt

SEQ ID NO: 749137 - DNA, 25 bp, Mus musculus
taacctacaggttggaatctaattt

SEQ ID NO: 749138 - DNA, 25 bp, Mus musculus
taacctacagtcagtgtcgtctctg

SEQ ID NO: 749139 - DNA, 25 bp, Mus musculus
taacctacagtctgtgtcgtctctg

SEQ ID NO: 749140 - DNA, 25 bp, Mus musculus
taacctacatatcttagtgagtggg

SEQ ID NO: 749141 - DNA, 25 bp, Mus musculus
taacctacatatgttagtgagtggg

SEQ ID NO: 749142 - DNA, 25 bp, Mus musculus
taacctaccaagcatcccgattagt

SEQ ID NO: 749143 - DNA, 25 bp, Mus musculus
taacctaccaaggatcccgattagt

SEQ ID NO: 749144 - DNA, 25 bp, Mus musculus
taacctaccattcaatacggacctg

SEQ ID NO: 749145 - DNA, 25 bp, Mus musculus
taacctaccattgaatacggacctg

SEQ ID NO: 749146 - DNA, 25 bp, Mus musculus
taacctaccccaacatacatgtagc

SEQ ID NO: 749147 - DNA, 25 bp, Mus musculus
taacctaccccatcatacatgtagc

SEQ ID NO: 749148 - DNA, 25 bp, Mus musculus
taacctacccttactaagagtcagc

SEQ ID NO: 749149 - DNA, 25 bp, Mus musculus
taacctaccctttctaagagtcagc

SEQ ID NO: 749150 - DNA, 25 bp, Mus musculus
taacctaccttgatgttttctcata

SEQ ID NO: 749151 - DNA, 25 bp, Mus musculus
taacctaccttgttgttttctcata

SEQ ID NO: 749152 - DNA, 25 bp, Mus musculus
taacctagaaccagtagtgtacgtt

SEQ ID NO: 749153 - DNA, 25 bp, Mus musculus
taacctagaacctgtagtgtacgtt

SEQ ID NO: 749154 - DNA, 25 bp, Mus musculus
taacctagaactcacgtttgaatgt

SEQ ID NO: 749155 - DNA, 25 bp, Mus musculus
taacctagaactctgagacctgcct

SEQ ID NO: 749156 - DNA, 25 bp, Mus musculus
taacctagaactgacgtttgaatgt

SEQ ID NO: 749157 - DNA, 25 bp, Mus musculus
taacctagaactgtgagacctgcct

SEQ ID NO: 749158 - DNA, 25 bp, Mus musculus
taacctagagttacattccactccc

SEQ ID NO: 749159 - DNA, 25 bp, Mus musculus
taacctagagtttcattccactccc

SEQ ID NO: 749160 - DNA, 25 bp, Mus musculus
taacctaggcatcagctgcatcaac

SEQ ID NO: 749161 - DNA, 25 bp, Mus musculus
taacctaggcatgagctgcatcaac

SEQ ID NO: 749162 - DNA, 25 bp, Mus musculus
taacctagtcacctcgttcctaaag

SEQ ID NO: 749163 - DNA, 25 bp, Mus musculus
taacctagtcacgtcgttcctaaag

SEQ ID NO: 749164 - DNA, 25 bp, Mus musculus
taacctatgcagataatctcccttc

SEQ ID NO: 749165 - DNA, 25 bp, Mus musculus
taacctatgcagttaatctcccttc

SEQ ID NO: 749166 - DNA, 25 bp, Mus musculus
taacctattacgaatcactggcaag

SEQ ID NO: 749167 - DNA, 25 bp, Mus musculus
taacctattacgtatcactggcaag

SEQ ID NO: 749168 - DNA, 25 bp, Mus musculus
taacctattcctaaccacaagagcc

SEQ ID NO: 749169 - DNA, 25 bp, Mus musculus
taacctattccttaccacaagagcc

SEQ ID NO: 749170 - DNA, 25 bp, Mus musculus
taacctattgggactggtactttga

SEQ ID NO: 749171 - DNA, 25 bp, Mus musculus
taacctattgggtctggtactttga

SEQ ID NO: 749172 - DNA, 25 bp, Mus musculus
taacctcaaactcaacagcagtcct

SEQ ID NO: 749173 - DNA, 25 bp, Mus musculus
taacctcaaactgaacagcagtcct

SEQ ID NO: 749174 - DNA, 25 bp, Mus musculus
taacctcaagcaagggcagaagact

SEQ ID NO: 749175 - DNA, 25 bp, Mus musculus
taacctcaagcatgggcagaagact

SEQ ID NO: 749176 - DNA, 25 bp, Mus musculus
taacctcaattgactctgctcacaa

SEQ ID NO: 749177 - DNA, 25 bp, Mus musculus
taacctcaattgtctctgctcacaa

SEQ ID NO: 749178 - DNA, 25 bp, Mus musculus
taacctcacacacggcgaagacaag

SEQ ID NO: 749179 - DNA, 25 bp, Mus musculus
taacctcacacagggcgaagacaag

SEQ ID NO: 749180 - DNA, 25 bp, Mus musculus
taacctcaccatcttggcttttact

SEQ ID NO: 749181 - DNA, 25 bp, Mus musculus
taacctcaccatgttggcttttact

SEQ ID NO: 749182 - DNA, 25 bp, Mus musculus
taacctcactctattaaaagctatg

SEQ ID NO: 749183 - DNA, 25 bp, Mus musculus
taacctcactcttttaaaagctatg

SEQ ID NO: 749184 - DNA, 25 bp, Mus musculus
taacctcagaagctgtgggaatcag

SEQ ID NO: 749185 - DNA, 25 bp, Mus musculus
taacctcagaaggtgtgggaatcag

SEQ ID NO: 749186 - DNA, 25 bp, Mus musculus
taacctcagactcttcaactgcttt

SEQ ID NO: 749187 - DNA, 25 bp, Mus musculus
taacctcagactgttcaactgcttt

SEQ ID NO: 749188 - DNA, 25 bp, Mus musculus
taacctcagctccttgagcagctaa

SEQ ID NO: 749189 - DNA, 25 bp, Mus musculus
taacctcagctcgttgagcagctaa

SEQ ID NO: 749190 - DNA, 25 bp, Mus musculus
taacctcaggagaaactaactgcct

SEQ ID NO: 749191 - DNA, 25 bp, Mus musculus
taacctcaggagtaactaactgcct

SEQ ID NO: 749192 - DNA, 25 bp, Mus musculus
taacctcagggacacttgaagtacc

SEQ ID NO: 749193 - DNA, 25 bp, Mus musculus
taacctcagggagacttgaagtacc

SEQ ID NO: 749194 - DNA, 25 bp, Mus musculus
taacctcatctgaaatcatttcctt

SEQ ID NO: 749195 - DNA, 25 bp, Mus musculus
taacctcatctgtaatcatttcctt

SEQ ID NO: 749196 - DNA, 25 bp, Mus musculus
taacctcatcttaggagcagcctca

SEQ ID NO: 749197 - DNA, 25 bp, Mus musculus
taacctcatctttggagcagcctca

SEQ ID NO: 749198 - DNA, 25 bp, Mus musculus
taacctcatggtcaaatactaatat

SEQ ID NO: 749199 - DNA, 25 bp, Mus musculus
taacctcatggtgaaatactaatat

SEQ ID NO: 749200 - DNA, 25 bp, Mus musculus
taacctccaatgctgtgcgtagaaa

SEQ ID NO: 749201 - DNA, 25 bp, Mus musculus
taacctccaatggtgtgcgtagaaa

SEQ ID NO: 749202 - DNA, 25 bp, Mus musculus
taacctccaccgagtttagtactgg

SEQ ID NO: 749203 - DNA, 25 bp, Mus musculus
taacctccaccgtgtttagtactgg

SEQ ID NO: 749204 - DNA, 25 bp, Mus musculus
taacctccagcgactcggaatgtga

SEQ ID NO: 749205 - DNA, 25 bp, Mus musculus
taacctccagcgtctcggaatgtga

SEQ ID NO: 749206 - DNA, 25 bp, Mus musculus
taacctccaggcaagagaaacacaa

SEQ ID NO: 749207 - DNA, 25 bp, Mus musculus
taacctccaggctagagaaacacaa

SEQ ID NO: 749208 - DNA, 25 bp, Mus musculus
taacctccaggtagctcaatatgaa

SEQ ID NO: 749209 - DNA, 25 bp, Mus musculus
taacctccaggttgctcaatatgaa

SEQ ID NO: 749210 - DNA, 25 bp, Mus musculus
taacctccagttcctgagaatccaa

SEQ ID NO: 749211 - DNA, 25 bp, Mus musculus
taacctccagttgctgagaatccaa

SEQ ID NO: 749212 - DNA, 25 bp, Mus musculus
taacctcccaggactgaagactaca

SEQ ID NO: 749213 - DNA, 25 bp, Mus musculus
taacctcccaggtctgaagactaca

SEQ ID NO: 749214 - DNA, 25 bp, Mus musculus
taacctccctggaatccattttcta

SEQ ID NO: 749215 - DNA, 25 bp, Mus musculus
taacctccctggtatccattttcta

SEQ ID NO: 749216 - DNA, 25 bp, Mus musculus
taacctccgtttagaatgattctga

SEQ ID NO: 749217 - DNA, 25 bp, Mus musculus
taacctccgttttgaatgattctga

SEQ ID NO: 749218 - DNA, 25 bp, Mus musculus
taacctcctgagaggttcagctgcg

SEQ ID NO: 749219 - DNA, 25 bp, Mus musculus
taacctcctgagtggttcagctgcg

SEQ ID NO: 749220 - DNA, 25 bp, Mus musculus
taacctccttcacattcagcgtcat

SEQ ID NO: 749221 - DNA, 25 bp, Mus musculus
taacctccttcagattcagcgtcat

SEQ ID NO: 749222 - DNA, 25 bp, Mus musculus
taacctcgcctacattgttgtcctc

SEQ ID NO: 749223 - DNA, 25 bp, Mus musculus
taacctcgcctagattgttgtcctc

SEQ ID NO: 749224 - DNA, 25 bp, Mus musculus
taacctcggtgcactcaagactgga

SEQ ID NO: 749225 - DNA, 25 bp, Mus musculus
taacctcggtgctctcaagactgga

SEQ ID NO: 749226 - DNA, 25 bp, Mus musculus
taacctcgtttccttcttacctgag

SEQ ID NO: 749227 - DNA, 25 bp, Mus musculus
taacctcgtttcgttcttacctgag

SEQ ID NO: 749228 - DNA, 25 bp, Mus musculus
taacctctattactcaaaaccgcgg

SEQ ID NO: 749229 - DNA, 25 bp, Mus musculus
taacctctattagtcaaaaccgcgg

SEQ ID NO: 749230 - DNA, 25 bp, Mus musculus
taacctctcaacatatctggttccc

SEQ ID NO: 749231 - DNA, 25 bp, Mus musculus
taacctctcaacttatctggttccc

SEQ ID NO: 749232 - DNA, 25 bp, Mus musculus
taacctctcaagaattaagacacat

SEQ ID NO: 749233 - DNA, 25 bp, Mus musculus
taacctctcaagtattaagacacat

SEQ ID NO: 749234 - DNA, 25 bp, Mus musculus
taacctctccttagtccttaattca

SEQ ID NO: 749235 - DNA, 25 bp, Mus musculus
taacctctcctttgtccttaattca

SEQ ID NO: 749236 - DNA, 25 bp, Mus musculus
taacctctctcccatgctggatgaa

SEQ ID NO: 749237 - DNA, 25 bp, Mus musculus
taacctctctccgatgctggatgaa

SEQ ID NO: 749238 - DNA, 25 bp, Mus musculus
taacctctctggcttctgcttgcat

SEQ ID NO: 749239 - DNA, 25 bp, Mus musculus
taacctctctgggttctgcttgcat

SEQ ID NO: 749240 - DNA, 25 bp, Mus musculus
taacctctgagtagtatctccatcc

SEQ ID NO: 749241 - DNA, 25 bp, Mus musculus
taacctctgagttgtatctccatcc

SEQ ID NO: 749242 - DNA, 25 bp, Mus musculus
taacctctggatagagaaataaggc

SEQ ID NO: 749243 - DNA, 25 bp, Mus musculus
taacctctggattgagaaataaggc

SEQ ID NO: 749244 - DNA, 25 bp, Mus musculus
taacctctggtcattacacacatgg

SEQ ID NO: 749245 - DNA, 25 bp, Mus musculus
taacctctggtctttacacacatgg

SEQ ID NO: 749246 - DNA, 25 bp, Mus musculus
taacctctgtgtcctttgtgggttt

SEQ ID NO: 749247 - DNA, 25 bp, Mus musculus
taacctctgtgtgctttgtgggttt

SEQ ID NO: 749248 - DNA, 25 bp, Mus musculus
taacctctgttaatggccccacctc

SEQ ID NO: 749249 - DNA, 25 bp, Mus musculus
taacctctgttacttggattcatta

SEQ ID NO: 749250 - DNA, 25 bp, Mus musculus
taacctctgttagttggattcatta

SEQ ID NO: 749251 - DNA, 25 bp, Mus musculus
taacctctgttattggccccacctc

SEQ ID NO: 749252 - DNA, 25 bp, Mus musculus
taacctcttggcctagagaaccctg

SEQ ID NO: 749253 - DNA, 25 bp, Mus musculus
taacctcttggcgtagagaaccctg

SEQ ID NO: 749254 - DNA, 25 bp, Mus musculus
taacctgaaacaatgctgagcctga

SEQ ID NO: 749255 - DNA, 25 bp, Mus musculus
taacctgaaacattgctgagcctga

SEQ ID NO: 749256 - DNA, 25 bp, Mus musculus
taacctgaaaccctgactcgtgtac

SEQ ID NO: 749257 - DNA, 25 bp, Mus musculus
taacctgaaaccgtgactcgtgtac

SEQ ID NO: 749258 - DNA, 25 bp, Mus musculus
taacctgaacctacagcaaacctgt

SEQ ID NO: 749259 - DNA, 25 bp, Mus musculus
taacctgaaccttcagcaaacctgt

SEQ ID NO: 749260 - DNA, 25 bp, Mus musculus
taacctgaactgacctcaaactggg

SEQ ID NO: 749261 - DNA, 25 bp, Mus musculus
taacctgaactgtcctcaaactggg

SEQ ID NO: 749262 - DNA, 25 bp, Mus musculus
taacctgaatacctgccctgaaaga

SEQ ID NO: 749263 - DNA, 25 bp, Mus musculus
taacctgaatacgtgccctgaaaga

SEQ ID NO: 749264 - DNA, 25 bp, Mus musculus
taacctgactggaggaaaccacctt

SEQ ID NO: 749265 - DNA, 25 bp, Mus musculus
taacctgactggtggaaaccacctt

SEQ ID NO: 749266 - DNA, 25 bp, Mus musculus
taacctgatcacacacatggtagag

SEQ ID NO: 749267 - DNA, 25 bp, Mus musculus
taacctgatcactcacatggtagag

SEQ ID NO: 749268 - DNA, 25 bp, Mus musculus
taacctgatgataaaacgtgagact

SEQ ID NO: 749269 - DNA, 25 bp, Mus musculus
taacctgatgattaaacgtgagact

SEQ ID NO: 749270 - DNA, 25 bp, Mus musculus
taacctgatgccagttaacagtgca

SEQ ID NO: 749271 - DNA, 25 bp, Mus musculus
taacctgatgcctgttaacagtgca

SEQ ID NO: 749272 - DNA, 25 bp, Mus musculus
taacctgattgcctattcatccttt

SEQ ID NO: 749273 - DNA, 25 bp, Mus musculus
taacctgattgcgtattcatccttt

SEQ ID NO: 749274 - DNA, 25 bp, Mus musculus
taacctgcaactaaatagcaacagc

SEQ ID NO: 749275 - DNA, 25 bp, Mus musculus
taacctgcaacttaatagcaacagc

SEQ ID NO: 749276 - DNA, 25 bp, Mus musculus
taacctgcactcagtgaagaggcgt

SEQ ID NO: 749277 - DNA, 25 bp, Mus musculus
taacctgcactctgtgaagaggcgt

SEQ ID NO: 749278 - DNA, 25 bp, Mus musculus
taacctgcatgtaggacctggtcag

SEQ ID NO: 749279 - DNA, 25 bp, Mus musculus
taacctgcatgttggacctggtcag

SEQ ID NO: 749280 - DNA, 25 bp, Mus musculus
taacctgccacaaagagctttgcgg

SEQ ID NO: 749281 - DNA, 25 bp, Mus musculus
taacctgccacatagagctttgcgg

SEQ ID NO: 749282 - DNA, 25 bp, Mus musculus
taacctgcccaaaatgtgaaacgtg

SEQ ID NO: 749283 - DNA, 25 bp, Mus musculus
taacctgcccaatatgtgaaacgtg

SEQ ID NO: 749284 - DNA, 25 bp, Mus musculus
taacctgcccatccacaagatgatg

SEQ ID NO: 749285 - DNA, 25 bp, Mus musculus
taacctgcccatgcacaagatgatg

SEQ ID NO: 749286 - DNA, 25 bp, Mus musculus
taacctgcccttcagttacgtgaag

SEQ ID NO: 749287 - DNA, 25 bp, Mus musculus
taacctgcccttgagttacgtgaag

SEQ ID NO: 749288 - DNA, 25 bp, Mus musculus
taacctgccttactgttccttgtgt

SEQ ID NO: 749289 - DNA, 25 bp, Mus musculus
taacctgccttagtgttccttgtgt

SEQ ID NO: 749290 - DNA, 25 bp, Mus musculus
taacctgcgataatccacggcttta

SEQ ID NO: 749291 - DNA, 25 bp, Mus musculus
taacctgcgatattccacggcttta

SEQ ID NO: 749292 - DNA, 25 bp, Mus musculus
taacctgcgctaccgttgcaatgat

SEQ ID NO: 749293 - DNA, 25 bp, Mus musculus
taacctgcgctagcgttgcaatgat

SEQ ID NO: 749294 - DNA, 25 bp, Mus musculus
taacctgctaaactccagcctggaa

SEQ ID NO: 749295 - DNA, 25 bp, Mus musculus
taacctgctaaagtccagcctggaa

SEQ ID NO: 749296 - DNA, 25 bp, Mus musculus
taacctgctactaatcacggagaag

SEQ ID NO: 749297 - DNA, 25 bp, Mus musculus
taacctgctacttatcacggagaag

SEQ ID NO: 749298 - DNA, 25 bp, Mus musculus
taacctgctcctaagtctcattata

SEQ ID NO: 749299 - DNA, 25 bp, Mus musculus
taacctgctccttagtctcattata

SEQ ID NO: 749300 - DNA, 25 bp, Mus musculus
taacctgctgtcagaagcctgactc

SEQ ID NO: 749301 - DNA, 25 bp, Mus musculus
taacctgctgtctgaagcctgactc

SEQ ID NO: 749302 - DNA, 25 bp, Mus musculus
taacctgctgtgatacaatgcttca

SEQ ID NO: 749303 - DNA, 25 bp, Mus musculus
taacctgctgtgttacaatgcttca

SEQ ID NO: 749304 - DNA, 25 bp, Mus musculus
taacctgctgttactgttctgacag

SEQ ID NO: 749305 - DNA, 25 bp, Mus musculus
taacctgctgtttctgttctgacag

SEQ ID NO: 749306 - DNA, 25 bp, Mus musculus
taacctgcttgtccttaaattccct

SEQ ID NO: 749307 - DNA, 25 bp, Mus musculus
taacctgcttgtgcttaaattccct

SEQ ID NO: 749308 - DNA, 25 bp, Mus musculus
taacctgcttttcagtccactgtat

SEQ ID NO: 749309 - DNA, 25 bp, Mus musculus
taacctgcttttgagtccactgtat

SEQ ID NO: 749310 - DNA, 25 bp, Mus musculus
taacctggaaaaaggcaagcactag

SEQ ID NO: 749311 - DNA, 25 bp, Mus musculus
taacctggaaaatggcaagcactag

SEQ ID NO: 749312 - DNA, 25 bp, Mus musculus
taacctggaaagaccgcactggagt

SEQ ID NO: 749313 - DNA, 25 bp, Mus musculus
taacctggaaagtccgcactggagt

SEQ ID NO: 749314 - DNA, 25 bp, Mus musculus
taacctggaggaataccactccctg

SEQ ID NO: 749315 - DNA, 25 bp, Mus musculus
taacctggaggattaccactccctg

SEQ ID NO: 749316 - DNA, 25 bp, Mus musculus
taacctggaggtcttgggatttgct

SEQ ID NO: 749317 - DNA, 25 bp, Mus musculus
taacctggaggtgttgggatttgct

SEQ ID NO: 749318 - DNA, 25 bp, Mus musculus
taacctggcaaacggtagcattcag

SEQ ID NO: 749319 - DNA, 25 bp, Mus musculus
taacctggcaaagggtagcattcag

SEQ ID NO: 749320 - DNA, 25 bp, Mus musculus
taacctggcaatcctgacagacaat

SEQ ID NO: 749321 - DNA, 25 bp, Mus musculus
taacctggcaatgctgacagacaat

SEQ ID NO: 749322 - DNA, 25 bp, Mus musculus
taacctggcttgcaaatcatcagtt

SEQ ID NO: 749323 - DNA, 25 bp, Mus musculus
taacctggcttggaaatcatcagtt

SEQ ID NO: 749324 - DNA, 25 bp, Mus musculus
taacctgggaatcgtgtccctggca

SEQ ID NO: 749325 - DNA, 25 bp, Mus musculus
taacctgggaatggtgtccctggca

SEQ ID NO: 749326 - DNA, 25 bp, Mus musculus
taacctgggcaccaacgctcattca

SEQ ID NO: 749327 - DNA, 25 bp, Mus musculus
taacctgggcacgaacgctcattca

SEQ ID NO: 749328 - DNA, 25 bp, Mus musculus
taacctgggctcatgagggctcata

SEQ ID NO: 749329 - DNA, 25 bp, Mus musculus
taacctgggctcttgagggctcata

SEQ ID NO: 749330 - DNA, 25 bp, Mus musculus
taacctgggtctcaatatggaattg

SEQ ID NO: 749331 - DNA, 25 bp, Mus musculus
taacctgggtctgaatatggaattg

SEQ ID NO: 749332 - DNA, 25 bp, Mus musculus
taacctggtaagacagaacccttct

SEQ ID NO: 749333 - DNA, 25 bp, Mus musculus
taacctggtaagtcagaacccttct

SEQ ID NO: 749334 - DNA, 25 bp, Mus musculus
taacctggtagaccttcctgatggc

SEQ ID NO: 749335 - DNA, 25 bp, Mus musculus
taacctggtagagcttcctgatggc

SEQ ID NO: 749336 - DNA, 25 bp, Mus musculus
taacctggtgttcatccctagcatt

SEQ ID NO: 749337 - DNA, 25 bp, Mus musculus
taacctggtgttgatccctagcatt

SEQ ID NO: 749338 - DNA, 25 bp, Mus musculus
taacctgtcagtaacactgctgagg

SEQ ID NO: 749339 - DNA, 25 bp, Mus musculus
taacctgtcagttacactgctgagg

SEQ ID NO: 749340 - DNA, 25 bp, Mus musculus
taacctgtctagaggcacagtcata

SEQ ID NO: 749341 - DNA, 25 bp, Mus musculus
taacctgtctagtggcacagtcata

SEQ ID NO: 749342 - DNA, 25 bp, Mus musculus
taacctgtctgtattgccgaatctg

SEQ ID NO: 749343 - DNA, 25 bp, Mus musculus
taacctgtctgttttgccgaatctg

SEQ ID NO: 749344 - DNA, 25 bp, Mus musculus
taacctgtgaggagtcgtcaccaga

SEQ ID NO: 749345 - DNA, 25 bp, Mus musculus
taacctgtgaggtgtcgtcaccaga

SEQ ID NO: 749346 - DNA, 25 bp, Mus musculus
taacctgtgattcttcaactcttcg

SEQ ID NO: 749347 - DNA, 25 bp, Mus musculus
taacctgtgattgttcaactcttcg

SEQ ID NO: 749348 - DNA, 25 bp, Mus musculus
taacctgtggctcagagtaccttcc

SEQ ID NO: 749349 - DNA, 25 bp, Mus musculus
taacctgtggctgagagtaccttcc

SEQ ID NO: 749350 - DNA, 25 bp, Mus musculus
taacctgtgtctccgaagtcctatg

SEQ ID NO: 749351 - DNA, 25 bp, Mus musculus
taacctgtgtctgcgaagtcctatg

SEQ ID NO: 749352 - DNA, 25 bp, Mus musculus
taacctgttcatacacccattttgt

SEQ ID NO: 749353 - DNA, 25 bp, Mus musculus
taacctgttcattcacccattttgt

SEQ ID NO: 749354 - DNA, 25 bp, Mus musculus
taacctgttctgagttactggtaaa

SEQ ID NO: 749355 - DNA, 25 bp, Mus musculus
taacctgttctgatatcaacggcag

SEQ ID NO: 749356 - DNA, 25 bp, Mus musculus
taacctgttctgtgttactggtaaa

SEQ ID NO: 749357 - DNA, 25 bp, Mus musculus
taacctgttctgttatcaacggcag

SEQ ID NO: 749358 - DNA, 25 bp, Mus musculus
taacctgttgacaggctgaatgggc

SEQ ID NO: 749359 - DNA, 25 bp, Mus musculus
taacctgttgactggctgaatgggc

SEQ ID NO: 749360 - DNA, 25 bp, Mus musculus
taacctgttgagcatgctccatgct

SEQ ID NO: 749361 - DNA, 25 bp, Mus musculus
taacctgttgaggatgctccatgct

SEQ ID NO: 749362 - DNA, 25 bp, Mus musculus
taacctgtttgcctaaccaaccaag

SEQ ID NO: 749363 - DNA, 25 bp, Mus musculus
taacctgtttgcgtaaccaaccaag

SEQ ID NO: 749364 - DNA, 25 bp, Mus musculus
taacctgttttgatgcctcatatgc

SEQ ID NO: 749365 - DNA, 25 bp, Mus musculus
taacctgttttgttgcctcatatgc

SEQ ID NO: 749366 - DNA, 25 bp, Mus musculus
taaccttaacaaacggatcagctat

SEQ ID NO: 749367 - DNA, 25 bp, Mus musculus
taaccttaacaatcggatcagctat

SEQ ID NO: 749368 - DNA, 25 bp, Mus musculus
taaccttaattcactgaggacctat

SEQ ID NO: 749369 - DNA, 25 bp, Mus musculus
taaccttaattctctgaggacctat

SEQ ID NO: 749370 - DNA, 25 bp, Mus musculus
taaccttacgtcatagctttgcttt

SEQ ID NO: 749371 - DNA, 25 bp, Mus musculus
taaccttacgtcttagctttgcttt

SEQ ID NO: 749372 - DNA, 25 bp, Mus musculus
taaccttaggagctcttgggtccca

SEQ ID NO: 749373 - DNA, 25 bp, Mus musculus
taaccttaggaggtcttgggtccca

SEQ ID NO: 749374 - DNA, 25 bp, Mus musculus
taaccttatggcatcgctacttgta

SEQ ID NO: 749375 - DNA, 25 bp, Mus musculus
taaccttatggcttcgctacttgta

SEQ ID NO: 749376 - DNA, 25 bp, Mus musculus
taaccttcaggtcactcagcctaca

SEQ ID NO: 749377 - DNA, 25 bp, Mus musculus
taaccttcaggtgactcagcctaca

SEQ ID NO: 749378 - DNA, 25 bp, Mus musculus
taaccttcagttacctagagcttcc

SEQ ID NO: 749379 - DNA, 25 bp, Mus musculus
taaccttcagtttcctagagcttcc

SEQ ID NO: 749380 - DNA, 25 bp, Mus musculus
taaccttcatgaatttcctcctgtt

SEQ ID NO: 749381 - DNA, 25 bp, Mus musculus
taaccttcatgattttcctcctgtt

SEQ ID NO: 749382 - DNA, 25 bp, Mus musculus
taaccttcccaccagtgaaaatctg

SEQ ID NO: 749383 - DNA, 25 bp, Mus musculus
taaccttcccacgagtgaaaatctg

SEQ ID NO: 749384 - DNA, 25 bp, Mus musculus
taaccttctcacaaatactctctgg

SEQ ID NO: 749385 - DNA, 25 bp, Mus musculus
taaccttctcactaatactctctgg

SEQ ID NO: 749386 - DNA, 25 bp, Mus musculus
taaccttctgggagggttcttgcca

SEQ ID NO: 749387 - DNA, 25 bp, Mus musculus
taaccttctgggtgggttcttgcca

SEQ ID NO: 749388 - DNA, 25 bp, Mus musculus
taaccttctggtaacatgctgtcat

SEQ ID NO: 749389 - DNA, 25 bp, Mus musculus
taaccttctggttacatgctgtcat

SEQ ID NO: 749390 - DNA, 25 bp, Mus musculus
taaccttctgtgatgcaatccaatg

SEQ ID NO: 749391 - DNA, 25 bp, Mus musculus
taaccttctgtgttgcaatccaatg

SEQ ID NO: 749392 - DNA, 25 bp, Mus musculus
taaccttcttttccatatcattgtc

SEQ ID NO: 749393 - DNA, 25 bp, Mus musculus
taaccttcttttgcatatcattgtc

SEQ ID NO: 749394 - DNA, 25 bp, Mus musculus
taaccttgaaggctccatgaaacct

SEQ ID NO: 749395 - DNA, 25 bp, Mus musculus
taaccttgaagggtccatgaaacct

SEQ ID NO: 749396 - DNA, 25 bp, Mus musculus
taaccttgacagatcggagcaccta

SEQ ID NO: 749397 - DNA, 25 bp, Mus musculus
taaccttgacagttcggagcaccta

SEQ ID NO: 749398 - DNA, 25 bp, Mus musculus
taaccttgagatcacatagtcccag

SEQ ID NO: 749399 - DNA, 25 bp, Mus musculus
taaccttgagatgacatagtcccag

SEQ ID NO: 749400 - DNA, 25 bp, Mus musculus
taaccttgcagcatgccaacttttg

SEQ ID NO: 749401 - DNA, 25 bp, Mus musculus
taaccttgcagcttgccaacttttg

SEQ ID NO: 749402 - DNA, 25 bp, Mus musculus
taaccttgcatcaattggctgggcc

SEQ ID NO: 749403 - DNA, 25 bp, Mus musculus
taaccttgcatctattggctgggcc

SEQ ID NO: 749404 - DNA, 25 bp, Mus musculus
taaccttgctccacagaaccaggta

SEQ ID NO: 749405 - DNA, 25 bp, Mus musculus
taaccttgctcctcagaaccaggta

SEQ ID NO: 749406 - DNA, 25 bp, Mus musculus
taaccttggaacaggtcccctgtgc

SEQ ID NO: 749407 - DNA, 25 bp, Mus musculus
taaccttggaactggtcccctgtgc

SEQ ID NO: 749408 - DNA, 25 bp, Mus musculus
taaccttggagaacttcgctagacc

SEQ ID NO: 749409 - DNA, 25 bp, Mus musculus
taaccttggagatcttcgctagacc

SEQ ID NO: 749410 - DNA, 25 bp, Mus musculus
taaccttggatacaccctccaggaa

SEQ ID NO: 749411 - DNA, 25 bp, Mus musculus
taaccttggatagaccctccaggaa

SEQ ID NO: 749412 - DNA, 25 bp, Mus musculus
taaccttggatgatcctgactggaa

SEQ ID NO: 749413 - DNA, 25 bp, Mus musculus
taaccttggatgttcctgactggaa

SEQ ID NO: 749414 - DNA, 25 bp, Mus musculus
taaccttggcaactgctgttgcata

SEQ ID NO: 749415 - DNA, 25 bp, Mus musculus
taaccttggcaagtgctgttgcata

SEQ ID NO: 749416 - DNA, 25 bp, Mus musculus
taaccttggcgaattttcctcccat

SEQ ID NO: 749417 - DNA, 25 bp, Mus musculus
taaccttggcgatttttcctcccat

SEQ ID NO: 749418 - DNA, 25 bp, Mus musculus
taaccttggtccactgtaggtgctt

SEQ ID NO: 749419 - DNA, 25 bp, Mus musculus
taaccttggtcctctgtaggtgctt

SEQ ID NO: 749420 - DNA, 25 bp, Mus musculus
taaccttgtgccatacttgtacact

SEQ ID NO: 749421 - DNA, 25 bp, Mus musculus
taaccttgtgccttacttgtacact

SEQ ID NO: 749422 - DNA, 25 bp, Mus musculus
taaccttgtttcagttcgtggtcgt

SEQ ID NO: 749423 - DNA, 25 bp, Mus musculus
taaccttgtttctgttcgtggtcgt

SEQ ID NO: 749424 - DNA, 25 bp, Mus musculus
taacctttacaacctgtacttgcat

SEQ ID NO: 749425 - DNA, 25 bp, Mus musculus
taacctttacaagctgtacttgcat

SEQ ID NO: 749426 - DNA, 25 bp, Mus musculus
taacctttagctccagcggctgcgc

SEQ ID NO: 749427 - DNA, 25 bp, Mus musculus
taacctttagctgcagcggctgcgc

SEQ ID NO: 749428 - DNA, 25 bp, Mus musculus
taacctttatcccaatgatttgagt

SEQ ID NO: 749429 - DNA, 25 bp, Mus musculus
taacctttatccgaatgatttgagt

SEQ ID NO: 749430 - DNA, 25 bp, Mus musculus
taacctttcaatatagagggcacaa

SEQ ID NO: 749431 - DNA, 25 bp, Mus musculus
taacctttcaatttagagggcacaa

SEQ ID NO: 749432 - DNA, 25 bp, Mus musculus
taacctttcctaacacctatacaga

SEQ ID NO: 749433 - DNA, 25 bp, Mus musculus
taacctttcctatcacctatacaga

SEQ ID NO: 749434 - DNA, 25 bp, Mus musculus
taacctttcctcactgcggataagg

SEQ ID NO: 749435 - DNA, 25 bp, Mus musculus
taacctttcctctctgcggataagg

SEQ ID NO: 749436 - DNA, 25 bp, Mus musculus
taacctttcgccaatggcttacagt

SEQ ID NO: 749437 - DNA, 25 bp, Mus musculus
taacctttcgcctatggcttacagt

SEQ ID NO: 749438 - DNA, 25 bp, Mus musculus
taacctttctgcaatgtcttaatgc

SEQ ID NO: 749439 - DNA, 25 bp, Mus musculus
taacctttctgctatgtcttaatgc

SEQ ID NO: 749440 - DNA, 25 bp, Mus musculus
taacctttgaaaagcaagccagtcc

SEQ ID NO: 749441 - DNA, 25 bp, Mus musculus
taacctttgaaatgcaagccagtcc

SEQ ID NO: 749442 - DNA, 25 bp, Mus musculus
taacctttgacaccggaatcagaca

SEQ ID NO: 749443 - DNA, 25 bp, Mus musculus
taacctttgacagcggaatcagaca

SEQ ID NO: 749444 - DNA, 25 bp, Mus musculus
taacctttgcttcggttgagttggc

SEQ ID NO: 749445 - DNA, 25 bp, Mus musculus
taacctttgcttgggttgagttggc

SEQ ID NO: 749446 - DNA, 25 bp, Mus musculus
taacctttgggcaagactagactga

SEQ ID NO: 749447 - DNA, 25 bp, Mus musculus
taacctttgggcatttgggaacact

SEQ ID NO: 749448 - DNA, 25 bp, Mus musculus
taacctttgggctagactagactga

SEQ ID NO: 749449 - DNA, 25 bp, Mus musculus
taacctttgggcttttgggaacact

SEQ ID NO: 749450 - DNA, 25 bp, Mus musculus
taacctttgtggcatcgggcacata

SEQ ID NO: 749451 - DNA, 25 bp, Mus musculus
taacctttgtgggatcgggcacata

SEQ ID NO: 749452 - DNA, 25 bp, Mus musculus
taaccttttccaatgtcacgttcaa

SEQ ID NO: 749453 - DNA, 25 bp, Mus musculus
taaccttttccattgtcacgttcaa

SEQ ID NO: 749454 - DNA, 25 bp, Mus musculus
taaccttttcctaacacacttgaat

SEQ ID NO: 749455 - DNA, 25 bp, Mus musculus
taaccttttccttacacacttgaat

SEQ ID NO: 749456 - DNA, 25 bp, Mus musculus
taacctttttatctacctaggagct

SEQ ID NO: 749457 - DNA, 25 bp, Mus musculus
taacctttttatgtacctaggagct

SEQ ID NO: 749458 - DNA, 25 bp, Mus musculus
taacctttttgtacacactcttgtg

SEQ ID NO: 749459 - DNA, 25 bp, Mus musculus
taacctttttgttcacactcttgtg

SEQ ID NO: 749460 - DNA, 25 bp, Mus musculus
taacgaaaatctcttcccgaagtgg

SEQ ID NO: 749461 - DNA, 25 bp, Mus musculus
taacgaaaatctgttcccgaagtgg

SEQ ID NO: 749462 - DNA, 25 bp, Mus musculus
taacgaaacgttcctgtcgaagatt

SEQ ID NO: 749463 - DNA, 25 bp, Mus musculus
taacgaaacgttgctgtcgaagatt

SEQ ID NO: 749464 - DNA, 25 bp, Mus musculus
taacgaaagcaaccgctgctgccgt

SEQ ID NO: 749465 - DNA, 25 bp, Mus musculus
taacgaaagcaagcgctgctgccgt

SEQ ID NO: 749466 - DNA, 25 bp, Mus musculus
taacgaaatcaaaacaatgcgcaaa

SEQ ID NO: 749467 - DNA, 25 bp, Mus musculus
taacgaaatcaatacaatgcgcaaa

SEQ ID NO: 749468 - DNA, 25 bp, Mus musculus
taacgaaccaagactcctccctagg

SEQ ID NO: 749469 - DNA, 25 bp, Mus musculus
taacgaaccaagtctcctccctagg

SEQ ID NO: 749470 - DNA, 25 bp, Mus musculus
taacgaacgagactctggcatgcta

SEQ ID NO: 749471 - DNA, 25 bp, Mus musculus
taacgaacgagagtctggcatgcta

SEQ ID NO: 749472 - DNA, 25 bp, Mus musculus
taacgaatgctgagcctacctgtat

SEQ ID NO: 749473 - DNA, 25 bp, Mus musculus
taacgaatgctgtgcctacctgtat

SEQ ID NO: 749474 - DNA, 25 bp, Mus musculus
taacgaatggaacggtccaaatccg

SEQ ID NO: 749475 - DNA, 25 bp, Mus musculus
taacgaatggaagggtccaaatccg

SEQ ID NO: 749476 - DNA, 25 bp, Mus musculus
taacgaatggagcttcggcacctcc

SEQ ID NO: 749477 - DNA, 25 bp, Mus musculus
taacgaatggaggttcggcacctcc

SEQ ID NO: 749478 - DNA, 25 bp, Mus musculus
taacgacacattaagacgaccgcaa

SEQ ID NO: 749479 - DNA, 25 bp, Mus musculus
taacgacacatttagacgaccgcaa

SEQ ID NO: 749480 - DNA, 25 bp, Mus musculus
taacgacaccagcaacgtccaaatg

SEQ ID NO: 749481 - DNA, 25 bp, Mus musculus
taacgacaccaggaacgtccaaatg

SEQ ID NO: 749482 - DNA, 25 bp, Mus musculus
taacgaccaattatggtatttcatt

SEQ ID NO: 749483 - DNA, 25 bp, Mus musculus
taacgaccaattttggtatttcatt

SEQ ID NO: 749484 - DNA, 25 bp, Mus musculus
taacgaccggtgagcttcagtttgt

SEQ ID NO: 749485 - DNA, 25 bp, Mus musculus
taacgaccggtgtgcttcagtttgt

SEQ ID NO: 749486 - DNA, 25 bp, Mus musculus
taacgacctatcactttagttttag

SEQ ID NO: 749487 - DNA, 25 bp, Mus musculus
taacgacctatctctttagttttag

SEQ ID NO: 749488 - DNA, 25 bp, Mus musculus
taacgactctaaaaaggcccaactt

SEQ ID NO: 749489 - DNA, 25 bp, Mus musculus
taacgactctaataaggcccaactt

SEQ ID NO: 749490 - DNA, 25 bp, Mus musculus
taacgagaactcatggccaaaggtt

SEQ ID NO: 749491 - DNA, 25 bp, Mus musculus
taacgagaactcttggccaaaggtt

SEQ ID NO: 749492 - DNA, 25 bp, Mus musculus
taacgagacaaccagctgaggcaaa

SEQ ID NO: 749493 - DNA, 25 bp, Mus musculus
taacgagacaacgagctgaggcaaa

SEQ ID NO: 749494 - DNA, 25 bp, Mus musculus
taacgagacagtcgcacaagccaat

SEQ ID NO: 749495 - DNA, 25 bp, Mus musculus
taacgagacagtggcacaagccaat

SEQ ID NO: 749496 - DNA, 25 bp, Mus musculus
taacgagaccacaggagggctatct

SEQ ID NO: 749497 - DNA, 25 bp, Mus musculus
taacgagaccactggagggctatct

SEQ ID NO: 749498 - DNA, 25 bp, Mus musculus
taacgagagcaaagcccgacctggg

SEQ ID NO: 749499 - DNA, 25 bp, Mus musculus
taacgagagcaatgcccgacctggg

SEQ ID NO: 749500 - DNA, 25 bp, Mus musculus
taacgagcagccatctgtgtagatc

SEQ ID NO: 749501 - DNA, 25 bp, Mus musculus
taacgagcagccttctgtgtagatc

SEQ ID NO: 749502 - DNA, 25 bp, Mus musculus
taacgagcatgtacatcttttcttg

SEQ ID NO: 749503 - DNA, 25 bp, Mus musculus
taacgagcatgttcatcttttcttg

SEQ ID NO: 749504 - DNA, 25 bp, Mus musculus
taacgagggaatcccagctaaggga

SEQ ID NO: 749505 - DNA, 25 bp, Mus musculus
taacgagggaatgccagctaaggga

SEQ ID NO: 749506 - DNA, 25 bp, Mus musculus
taacgagggcatcgatttatatcaa

SEQ ID NO: 749507 - DNA, 25 bp, Mus musculus
taacgagggcatggatttatatcaa

SEQ ID NO: 749508 - DNA, 25 bp, Mus musculus
taacgagtatgaacgcccgagagga

SEQ ID NO: 749509 - DNA, 25 bp, Mus musculus
taacgagtatgatcgcccgagagga

SEQ ID NO: 749510 - DNA, 25 bp, Mus musculus
taacgagttcttatctgcagtgtaa

SEQ ID NO: 749511 - DNA, 25 bp, Mus musculus
taacgagttcttttctgcagtgtaa

SEQ ID NO: 749512 - DNA, 25 bp, Mus musculus
taacgatagcaaaaatcttctcatg

SEQ ID NO: 749513 - DNA, 25 bp, Mus musculus
taacgatagcaataatcttctcatg

SEQ ID NO: 749514 - DNA, 25 bp, Mus musculus
taacgatgaataaaatggtcccaaa

SEQ ID NO: 749515 - DNA, 25 bp, Mus musculus
taacgatgaatataatggtcccaaa

SEQ ID NO: 749516 - DNA, 25 bp, Mus musculus
taacgatgccgcagactctacggta

SEQ ID NO: 749517 - DNA, 25 bp, Mus musculus
taacgatgccgctgactctacggta

SEQ ID NO: 749518 - DNA, 25 bp, Mus musculus
taacgatggctccagaagcacctgt

SEQ ID NO: 749519 - DNA, 25 bp, Mus musculus
taacgatggctcgagaagcacctgt

SEQ ID NO: 749520 - DNA, 25 bp, Mus musculus
taacgcaggctgaccagatgggccc

SEQ ID NO: 749521 - DNA, 25 bp, Mus musculus
taacgcaggctgtccagatgggccc

SEQ ID NO: 749522 - DNA, 25 bp, Mus musculus
taacgcagtgtcaccttccagtggc

SEQ ID NO: 749523 - DNA, 25 bp, Mus musculus
taacgcagtgtctccttccagtggc

SEQ ID NO: 749524 - DNA, 25 bp, Mus musculus
taacgccaaaagaagggctacacca

SEQ ID NO: 749525 - DNA, 25 bp, Mus musculus
taacgccaaaagtagggctacacca

SEQ ID NO: 749526 - DNA, 25 bp, Mus musculus
taacgccagcctatcattgcaagaa

SEQ ID NO: 749527 - DNA, 25 bp, Mus musculus
taacgccagcctttcattgcaagaa

SEQ ID NO: 749528 - DNA, 25 bp, Mus musculus
taacgccatcatctctgcacctgta

SEQ ID NO: 749529 - DNA, 25 bp, Mus musculus
taacgccatcatgtctgcacctgta

SEQ ID NO: 749530 - DNA, 25 bp, Mus musculus
taacgccatttgcaagggcatgaaa

SEQ ID NO: 749531 - DNA, 25 bp, Mus musculus
taacgccatttggaagggcatgaaa

SEQ ID NO: 749532 - DNA, 25 bp, Mus musculus
taacgcctcgtgcagggtttatcca

SEQ ID NO: 749533 - DNA, 25 bp, Mus musculus
taacgcctcgtggagggtttatcca

SEQ ID NO: 749534 - DNA, 25 bp, Mus musculus
taacgcctctacaggtctcaggaga

SEQ ID NO: 749535 - DNA, 25 bp, Mus musculus
taacgcctctactggtctcaggaga

SEQ ID NO: 749536 - DNA, 25 bp, Mus musculus
taacgccttcggcatgcagttctat

SEQ ID NO: 749537 - DNA, 25 bp, Mus musculus
taacgccttcgggatgcagttctat

SEQ ID NO: 749538 - DNA, 25 bp, Mus musculus
taacgccttgcacttgattccagcc

SEQ ID NO: 749539 - DNA, 25 bp, Mus musculus
taacgccttgcagttgattccagcc

SEQ ID NO: 749540 - DNA, 25 bp, Mus musculus
taacgcggagcaagacagcaggcaa

SEQ ID NO: 749541 - DNA, 25 bp, Mus musculus
taacgcggagcacgtctgtggtcaa

SEQ ID NO: 749542 - DNA, 25 bp, Mus musculus
taacgcggagcaggtctgtggtcaa

SEQ ID NO: 749543 - DNA, 25 bp, Mus musculus
taacgcggagcatgacagcaggcaa

SEQ ID NO: 749544 - DNA, 25 bp, Mus musculus
taacgctactatcctctgggctgga

SEQ ID NO: 749545 - DNA, 25 bp, Mus musculus
taacgctactatgctctgggctgga

SEQ ID NO: 749546 - DNA, 25 bp, Mus musculus
taacgctagtgcaggttttggccag

SEQ ID NO: 749547 - DNA, 25 bp, Mus musculus
taacgctagtgctggttttggccag

SEQ ID NO: 749548 - DNA, 25 bp, Mus musculus
taacgctcagtgatagccgcgctgg

SEQ ID NO: 749549 - DNA, 25 bp, Mus musculus
taacgctcagtgttagccgcgctgg

SEQ ID NO: 749550 - DNA, 25 bp, Mus musculus
taacgctgaactatgcactaggccc

SEQ ID NO: 749551 - DNA, 25 bp, Mus musculus
taacgctgaactttgcactaggccc

SEQ ID NO: 749552 - DNA, 25 bp, Mus musculus
taacgctgatgtagactggtaccac

SEQ ID NO: 749553 - DNA, 25 bp, Mus musculus
taacgctgatgttgactggtaccac

SEQ ID NO: 749554 - DNA, 25 bp, Mus musculus
taacgctgccagcttgtacttttgg

SEQ ID NO: 749555 - DNA, 25 bp, Mus musculus
taacgctgccaggttgtacttttgg

SEQ ID NO: 749556 - DNA, 25 bp, Mus musculus
taacgctgctatattccagagccag

SEQ ID NO: 749557 - DNA, 25 bp, Mus musculus
taacgctgctattttccagagccag

SEQ ID NO: 749558 - DNA, 25 bp, Mus musculus
taacgctggacaaaggcccttggac

SEQ ID NO: 749559 - DNA, 25 bp, Mus musculus
taacgctggacataggcccttggac

SEQ ID NO: 749560 - DNA, 25 bp, Mus musculus
taacgctggcggcacaggaagccat

SEQ ID NO: 749561 - DNA, 25 bp, Mus musculus
taacgctggcgggacaggaagccat

SEQ ID NO: 749562 - DNA, 25 bp, Mus musculus
taacgcttaagcaactcgaaggcat

SEQ ID NO: 749563 - DNA, 25 bp, Mus musculus
taacgcttaagctactcgaaggcat

SEQ ID NO: 749564 - DNA, 25 bp, Mus musculus
taacgcttcctgagctgaacgcagc

SEQ ID NO: 749565 - DNA, 25 bp, Mus musculus
taacgcttcctgtgctgaacgcagc

SEQ ID NO: 749566 - DNA, 25 bp, Mus musculus
taacgcttccttactgaccactgga

SEQ ID NO: 749567 - DNA, 25 bp, Mus musculus
taacgcttcctttctgaccactgga

SEQ ID NO: 749568 - DNA, 25 bp, Mus musculus
taacgctttaatcccttggaatttt

SEQ ID NO: 749569 - DNA, 25 bp, Mus musculus
taacgctttaatgccttggaatttt

SEQ ID NO: 749570 - DNA, 25 bp, Mus musculus
taacggacgtgccagaccaggtgac

SEQ ID NO: 749571 - DNA, 25 bp, Mus musculus
taacggacgtgcgagaccaggtgac

SEQ ID NO: 749572 - DNA, 25 bp, Mus musculus
taacggacttttatacctgcttgtg

SEQ ID NO: 749573 - DNA, 25 bp, Mus musculus
taacggacttttttacctgcttgtg

SEQ ID NO: 749574 - DNA, 25 bp, Mus musculus
taacggagaatcagtttcctacctg

SEQ ID NO: 749575 - DNA, 25 bp, Mus musculus
taacggagaatctgtttcctacctg

SEQ ID NO: 749576 - DNA, 25 bp, Mus musculus
taacggatggctcggccgctttaat

SEQ ID NO: 749577 - DNA, 25 bp, Mus musculus
taacggatggctgggccgctttaat

SEQ ID NO: 749578 - DNA, 25 bp, Mus musculus
taacggatttatagttccacgccat

SEQ ID NO: 749579 - DNA, 25 bp, Mus musculus
taacggatttattgttccacgccat

SEQ ID NO: 749580 - DNA, 25 bp, Mus musculus
taacggcacgcgacgaggtgtcgaa

SEQ ID NO: 749581 - DNA, 25 bp, Mus musculus
taacggcacgcgtcgaggtgtcgaa

SEQ ID NO: 749582 - DNA, 25 bp, Mus musculus
taacggctgcacaggttctccagat

SEQ ID NO: 749583 - DNA, 25 bp, Mus musculus
taacggctgcactggttctccagat

SEQ ID NO: 749584 - DNA, 25 bp, Mus musculus
taacggcttaaacacaacccaaatg

SEQ ID NO: 749585 - DNA, 25 bp, Mus musculus
taacggcttaaagacaacccaaatg

SEQ ID NO: 749586 - DNA, 25 bp, Mus musculus
taacgggaagagacctacagggctg

SEQ ID NO: 749587 - DNA, 25 bp, Mus musculus
taacgggaagagtcctacagggctg

SEQ ID NO: 749588 - DNA, 25 bp, Mus musculus
taacgggaccggagtgcagacccaa

SEQ ID NO: 749589 - DNA, 25 bp, Mus musculus
taacgggaccggtgtgcagacccaa

SEQ ID NO: 749590 - DNA, 25 bp, Mus musculus
taacgggactctatcttcaactcaa

SEQ ID NO: 749591 - DNA, 25 bp, Mus musculus
taacgggactctttcttcaactcaa

SEQ ID NO: 749592 - DNA, 25 bp, Mus musculus
taacgggagcccagtaaatgggagt

SEQ ID NO: 749593 - DNA, 25 bp, Mus musculus
taacgggagccctgtaaatgggagt

SEQ ID NO: 749594 - DNA, 25 bp, Mus musculus
taacgggctcgcagttctatgatca

SEQ ID NO: 749595 - DNA, 25 bp, Mus musculus
taacgggctcgctgttctatgatca

SEQ ID NO: 749596 - DNA, 25 bp, Mus musculus
taacgggcttccatagatcctttga

SEQ ID NO: 749597 - DNA, 25 bp, Mus musculus
taacgggcttccttagatcctttga

SEQ ID NO: 749598 - DNA, 25 bp, Mus musculus
taacgggcttttagtgttcagttca

SEQ ID NO: 749599 - DNA, 25 bp, Mus musculus
taacgggctttttgtgttcagttca

SEQ ID NO: 749600 - DNA, 25 bp, Mus musculus
taacgggtatctattgttggtgtgt

SEQ ID NO: 749601 - DNA, 25 bp, Mus musculus
taacgggtatcttttgttggtgtgt

SEQ ID NO: 749602 - DNA, 25 bp, Mus musculus
taacgggtttgtatgctgttgttgt

SEQ ID NO: 749603 - DNA, 25 bp, Mus musculus
taacgggtttgtttgctgttgttgt

SEQ ID NO: 749604 - DNA, 25 bp, Mus musculus
taacgggttttaaattgctcagagc

SEQ ID NO: 749605 - DNA, 25 bp, Mus musculus
taacgggttttatattgctcagagc

SEQ ID NO: 749606 - DNA, 25 bp, Mus musculus
taacggtaagtaagtcgcagcagaa

SEQ ID NO: 749607 - DNA, 25 bp, Mus musculus
taacggtaagtatgtcgcagcagaa

SEQ ID NO: 749608 - DNA, 25 bp, Mus musculus
taacggtaccttactgtgccttgac

SEQ ID NO: 749609 - DNA, 25 bp, Mus musculus
taacggtacctttctgtgccttgac

SEQ ID NO: 749610 - DNA, 25 bp, Mus musculus
taacggtcgtcaccgcaagggtcat

SEQ ID NO: 749611 - DNA, 25 bp, Mus musculus
taacggtcgtcagcgcaagggtcat

SEQ ID NO: 749612 - DNA, 25 bp, Mus musculus
taacggtgactgctttctgttccaa

SEQ ID NO: 749613 - DNA, 25 bp, Mus musculus
taacggtgactggtttctgttccaa

SEQ ID NO: 749614 - DNA, 25 bp, Mus musculus
taacggtgtctcacatttgtcaagc

SEQ ID NO: 749615 - DNA, 25 bp, Mus musculus
taacggtgtctctcatttgtcaagc

SEQ ID NO: 749616 - DNA, 25 bp, Mus musculus
taacggttccacagttaaccacgcg

SEQ ID NO: 749617 - DNA, 25 bp, Mus musculus
taacggttccactgttaaccacgcg

SEQ ID NO: 749618 - DNA, 25 bp, Mus musculus
taacggttctctattctctagcaaa

SEQ ID NO: 749619 - DNA, 25 bp, Mus musculus
taacggttctcttttctctagcaaa

SEQ ID NO: 749620 - DNA, 25 bp, Mus musculus
taacggttggtcctcactgtggatc

SEQ ID NO: 749621 - DNA, 25 bp, Mus musculus
taacggttggtcgtcactgtggatc

SEQ ID NO: 749622 - DNA, 25 bp, Mus musculus
taacgtaacacaaaacactcttaaa

SEQ ID NO: 749623 - DNA, 25 bp, Mus musculus
taacgtaacacataacactcttaaa

SEQ ID NO: 749624 - DNA, 25 bp, Mus musculus
taacgtaatcgcattcagaatctct

SEQ ID NO: 749625 - DNA, 25 bp, Mus musculus
taacgtaatcgctttcagaatctct

SEQ ID NO: 749626 - DNA, 25 bp, Mus musculus
taacgtatacttatattgccctaag

SEQ ID NO: 749627 - DNA, 25 bp, Mus musculus
taacgtatacttttattgccctaag

SEQ ID NO: 749628 - DNA, 25 bp, Mus musculus
taacgtatgtgtaactacagtaaac

SEQ ID NO: 749629 - DNA, 25 bp, Mus musculus
taacgtatgtgttactacagtaaac

SEQ ID NO: 749630 - DNA, 25 bp, Mus musculus
taacgtcaggtgatccatggtctct

SEQ ID NO: 749631 - DNA, 25 bp, Mus musculus
taacgtcaggtgttccatggtctct

SEQ ID NO: 749632 - DNA, 25 bp, Mus musculus
taacgtcatcaaccaggacacgagt

SEQ ID NO: 749633 - DNA, 25 bp, Mus musculus
taacgtcatcaagcaggacacgagt

SEQ ID NO: 749634 - DNA, 25 bp, Mus musculus
taacgtcatcctcttcccctgggaa

SEQ ID NO: 749635 - DNA, 25 bp, Mus musculus
taacgtcatcctgttcccctgggaa

SEQ ID NO: 749636 - DNA, 25 bp, Mus musculus
taacgtcccattcccaatgtgactt

SEQ ID NO: 749637 - DNA, 25 bp, Mus musculus
taacgtcccattgccaatgtgactt

SEQ ID NO: 749638 - DNA, 25 bp, Mus musculus
taacgtccctttatgggcttcacag

SEQ ID NO: 749639 - DNA, 25 bp, Mus musculus
taacgtccctttttgggcttcacag

SEQ ID NO: 749640 - DNA, 25 bp, Mus musculus
taacgtccttccaggtttcaagtct

SEQ ID NO: 749641 - DNA, 25 bp, Mus musculus
taacgtccttcctggtttcaagtct

SEQ ID NO: 749642 - DNA, 25 bp, Mus musculus
taacgtcgtataagccttcttcctt

SEQ ID NO: 749643 - DNA, 25 bp, Mus musculus
taacgtcgtatatgccttcttcctt

SEQ ID NO: 749644 - DNA, 25 bp, Mus musculus
taacgtcgtggaccggtatcatcac

SEQ ID NO: 749645 - DNA, 25 bp, Mus musculus
taacgtcgtggagcggtatcatcac

SEQ ID NO: 749646 - DNA, 25 bp, Mus musculus
taacgtcgttgactgcccaaggctg

SEQ ID NO: 749647 - DNA, 25 bp, Mus musculus
taacgtcgttgagtgcccaaggctg

SEQ ID NO: 749648 - DNA, 25 bp, Mus musculus
taacgtctcctgcagcgaagctcta

SEQ ID NO: 749649 - DNA, 25 bp, Mus musculus
taacgtctcctggagcgaagctcta

SEQ ID NO: 749650 - DNA, 25 bp, Mus musculus
taacgtctctcactgtttgtcatct

SEQ ID NO: 749651 - DNA, 25 bp, Mus musculus
taacgtctctcagtgtttgtcatct

SEQ ID NO: 749652 - DNA, 25 bp, Mus musculus
taacgtctctggaagcactgttgct

SEQ ID NO: 749653 - DNA, 25 bp, Mus musculus
taacgtctctggtagcactgttgct

SEQ ID NO: 749654 - DNA, 25 bp, Mus musculus
taacgtcttgatatctacattcctt

SEQ ID NO: 749655 - DNA, 25 bp, Mus musculus
taacgtcttgatttctacattcctt

SEQ ID NO: 749656 - DNA, 25 bp, Mus musculus
taacgtcttgctatactaaacacag

SEQ ID NO: 749657 - DNA, 25 bp, Mus musculus
taacgtcttgctttactaaacacag

SEQ ID NO: 749658 - DNA, 25 bp, Mus musculus
taacgtgaacgaagtcattgagatc

SEQ ID NO: 749659 - DNA, 25 bp, Mus musculus
taacgtgaacgatgtcattgagatc

SEQ ID NO: 749660 - DNA, 25 bp, Mus musculus
taacgtgccctaacatggtggactg

SEQ ID NO: 749661 - DNA, 25 bp, Mus musculus
taacgtgccctatcatggtggactg

SEQ ID NO: 749662 - DNA, 25 bp, Mus musculus
taacgtgctaccatcttagatttcc

SEQ ID NO: 749663 - DNA, 25 bp, Mus musculus
taacgtgctaccttcttagatttcc

SEQ ID NO: 749664 - DNA, 25 bp, Mus musculus
taacgtggatccagctggcctggac

SEQ ID NO: 749665 - DNA, 25 bp, Mus musculus
taacgtggatcctgctggcctggac

SEQ ID NO: 749666 - DNA, 25 bp, Mus musculus
taacgtggattaccaccctaagcca

SEQ ID NO: 749667 - DNA, 25 bp, Mus musculus
taacgtggattagcaccctaagcca

SEQ ID NO: 749668 - DNA, 25 bp, Mus musculus
taacgtgggattacggactgatgca

SEQ ID NO: 749669 - DNA, 25 bp, Mus musculus
taacgtgggatttcggactgatgca

SEQ ID NO: 749670 - DNA, 25 bp, Mus musculus
taacgtggtcgcagttggcaagcat

SEQ ID NO: 749671 - DNA, 25 bp, Mus musculus
taacgtggtcgctgttggcaagcat

SEQ ID NO: 749672 - DNA, 25 bp, Mus musculus
taacgtggtgttcaggatgcttccc

SEQ ID NO: 749673 - DNA, 25 bp, Mus musculus
taacgtggtgttgaggatgcttccc

SEQ ID NO: 749674 - DNA, 25 bp, Mus musculus
taacgtgtgatcatgggtccctgga

SEQ ID NO: 749675 - DNA, 25 bp, Mus musculus
taacgtgtgatcttgggtccctgga

SEQ ID NO: 749676 - DNA, 25 bp, Mus musculus
taacgtgtgcggcttttgtacctct

SEQ ID NO: 749677 - DNA, 25 bp, Mus musculus
taacgtgtgcgggttttgtacctct

SEQ ID NO: 749678 - DNA, 25 bp, Mus musculus
taacgtgtggcactgagacgccttc

SEQ ID NO: 749679 - DNA, 25 bp, Mus musculus
taacgtgtggcagtgagacgccttc

SEQ ID NO: 749680 - DNA, 25 bp, Mus musculus
taacgtgtgggcacttccttgtacc

SEQ ID NO: 749681 - DNA, 25 bp, Mus musculus
taacgtgtgggctcttccttgtacc

SEQ ID NO: 749682 - DNA, 25 bp, Mus musculus
taacgttaaccacggcaggctagct

SEQ ID NO: 749683 - DNA, 25 bp, Mus musculus
taacgttaaccagggcaggctagct

SEQ ID NO: 749684 - DNA, 25 bp, Mus musculus
taacgttaccttctgcctagcataa

SEQ ID NO: 749685 - DNA, 25 bp, Mus musculus
taacgttaccttgtgcctagcataa

SEQ ID NO: 749686 - DNA, 25 bp, Mus musculus
taacgttccaacacctctaatgtaa

SEQ ID NO: 749687 - DNA, 25 bp, Mus musculus
taacgttccaactcctctaatgtaa

SEQ ID NO: 749688 - DNA, 25 bp, Mus musculus
taacgttccattccgtggatcagcg

SEQ ID NO: 749689 - DNA, 25 bp, Mus musculus
taacgttccattgcgtggatcagcg

SEQ ID NO: 749690 - DNA, 25 bp, Mus musculus
taacgttcccttactgacgctgtgg

SEQ ID NO: 749691 - DNA, 25 bp, Mus musculus
taacgttccctttctgacgctgtgg

SEQ ID NO: 749692 - DNA, 25 bp, Mus musculus
taacgttgaaacccttttatcatag

SEQ ID NO: 749693 - DNA, 25 bp, Mus musculus
taacgttgaaacgcttttatcatag

SEQ ID NO: 749694 - DNA, 25 bp, Mus musculus
taacgttgcctgagtgccggtcagc

SEQ ID NO: 749695 - DNA, 25 bp, Mus musculus
taacgttgcctgtgtgccggtcagc

SEQ ID NO: 749696 - DNA, 25 bp, Mus musculus
taacgttgggatcgaggcgcaccca

SEQ ID NO: 749697 - DNA, 25 bp, Mus musculus
taacgttgggatggaggcgcaccca

SEQ ID NO: 749698 - DNA, 25 bp, Mus musculus
taacgttgtcctaccgtgatggata

SEQ ID NO: 749699 - DNA, 25 bp, Mus musculus
taacgttgtccttccgtgatggata

SEQ ID NO: 749700 - DNA, 25 bp, Mus musculus
taacgtttactgaacccttactctg

SEQ ID NO: 749701 - DNA, 25 bp, Mus musculus
taacgtttactgtacccttactctg

SEQ ID NO: 749702 - DNA, 25 bp, Mus musculus
taacgtttccctcagctaagctaaa

SEQ ID NO: 749703 - DNA, 25 bp, Mus musculus
taacgtttccctgagctaagctaaa

SEQ ID NO: 749704 - DNA, 25 bp, Mus musculus
taacgtttcgttagtacggatgtat

SEQ ID NO: 749705 - DNA, 25 bp, Mus musculus
taacgtttcgtttgtacggatgtat

SEQ ID NO: 749706 - DNA, 25 bp, Mus musculus
taacgtttgcagaaccatgagcgat

SEQ ID NO: 749707 - DNA, 25 bp, Mus musculus
taacgtttgcagtaccatgagcgat

SEQ ID NO: 749708 - DNA, 25 bp, Mus musculus
taacgtttgccaacggacagctgac

SEQ ID NO: 749709 - DNA, 25 bp, Mus musculus
taacgtttgccacaaaagactaggt

SEQ ID NO: 749710 - DNA, 25 bp, Mus musculus
taacgtttgccagaaaagactaggt

SEQ ID NO: 749711 - DNA, 25 bp, Mus musculus
taacgtttgccatcggacagctgac

SEQ ID NO: 749712 - DNA, 25 bp, Mus musculus
taacgtttgtgtctaggtactggta

SEQ ID NO: 749713 - DNA, 25 bp, Mus musculus
taacgtttgtgtgtaggtactggta

SEQ ID NO: 749714 - DNA, 25 bp, Mus musculus
taacgtttgttccaaagtagcagaa

SEQ ID NO: 749715 - DNA, 25 bp, Mus musculus
taacgtttgttcgaaagtagcagaa

SEQ ID NO: 749716 - DNA, 25 bp, Mus musculus
taacgttttatgcagaccttaagtg

SEQ ID NO: 749717 - DNA, 25 bp, Mus musculus
taacgttttatggagaccttaagtg

SEQ ID NO: 749718 - DNA, 25 bp, Mus musculus
taacgtttttaaactatcaggacaa

SEQ ID NO: 749719 - DNA, 25 bp, Mus musculus
taacgtttttaatctatcaggacaa

SEQ ID NO: 749720 - DNA, 25 bp, Mus musculus
taactaaacctcagaccttgcggtg

SEQ ID NO: 749721 - DNA, 25 bp, Mus musculus
taactaaacctctgaccttgcggtg

SEQ ID NO: 749722 - DNA, 25 bp, Mus musculus
taactaacaacaactgcacagcacc

SEQ ID NO: 749723 - DNA, 25 bp, Mus musculus
taactaacaacatctgcacagcacc

SEQ ID NO: 749724 - DNA, 25 bp, Mus musculus
taactaacacatcggttcttttatg

SEQ ID NO: 749725 - DNA, 25 bp, Mus musculus
taactaacacatgggttcttttatg

SEQ ID NO: 749726 - DNA, 25 bp, Mus musculus
taactaacacctaactcctgtgact

SEQ ID NO: 749727 - DNA, 25 bp, Mus musculus
taactaacaccttactcctgtgact

SEQ ID NO: 749728 - DNA, 25 bp, Mus musculus
taactaacggtgagctactgcccag

SEQ ID NO: 749729 - DNA, 25 bp, Mus musculus
taactaacggtgtgctactgcccag

SEQ ID NO: 749730 - DNA, 25 bp, Mus musculus
taactaactgccatggtcccgggat

SEQ ID NO: 749731 - DNA, 25 bp, Mus musculus
taactaactgccttggtcccgggat

SEQ ID NO: 749732 - DNA, 25 bp, Mus musculus
taactaactgtgatttggttccaag

SEQ ID NO: 749733 - DNA, 25 bp, Mus musculus
taactaactgtgttttggttccaag

SEQ ID NO: 749734 - DNA, 25 bp, Mus musculus
taactaagaactagccaggcacggt

SEQ ID NO: 749735 - DNA, 25 bp, Mus musculus
taactaagaacttgccaggcacggt

SEQ ID NO: 749736 - DNA, 25 bp, Mus musculus
taactaagacccagacttcactttg

SEQ ID NO: 749737 - DNA, 25 bp, Mus musculus
taactaagaccctgacttcactttg

SEQ ID NO: 749738 - DNA, 25 bp, Mus musculus
taactaagccacatcccgttgtgtt

SEQ ID NO: 749739 - DNA, 25 bp, Mus musculus
taactaagccacttcccgttgtgtt

SEQ ID NO: 749740 - DNA, 25 bp, Mus musculus
taactaaggtcccaggtcaccctgt

SEQ ID NO: 749741 - DNA, 25 bp, Mus musculus
taactaaggtccgaggtcaccctgt

SEQ ID NO: 749742 - DNA, 25 bp, Mus musculus
taactaagtcttccgctgattattt

SEQ ID NO: 749743 - DNA, 25 bp, Mus musculus
taactaagtcttgcgctgattattt

SEQ ID NO: 749744 - DNA, 25 bp, Mus musculus
taactaatcctgcttgtcgggcaca

SEQ ID NO: 749745 - DNA, 25 bp, Mus musculus
taactaatcctggttgtcgggcaca

SEQ ID NO: 749746 - DNA, 25 bp, Mus musculus
taactaatcttgatttcccaccaca

SEQ ID NO: 749747 - DNA, 25 bp, Mus musculus
taactaatcttgttttcccaccaca

SEQ ID NO: 749748 - DNA, 25 bp, Mus musculus
taactaatttgtatcatttggcctt

SEQ ID NO: 749749 - DNA, 25 bp, Mus musculus
taactaatttgtttcatttggcctt

SEQ ID NO: 749750 - DNA, 25 bp, Mus musculus
taactacaatacataccggtcacgg

SEQ ID NO: 749751 - DNA, 25 bp, Mus musculus
taactacaatacttaccggtcacgg

SEQ ID NO: 749752 - DNA, 25 bp, Mus musculus
taactacacaaaaacatccacacat

SEQ ID NO: 749753 - DNA, 25 bp, Mus musculus
taactacacaaatacatccacacat

SEQ ID NO: 749754 - DNA, 25 bp, Mus musculus
taactacacattaactcagaacttg

SEQ ID NO: 749755 - DNA, 25 bp, Mus musculus
taactacacatttactcagaacttg

SEQ ID NO: 749756 - DNA, 25 bp, Mus musculus
taactacacggtccaagtgctggaa

SEQ ID NO: 749757 - DNA, 25 bp, Mus musculus
taactacacggtgcaagtgctggaa

SEQ ID NO: 749758 - DNA, 25 bp, Mus musculus
taactacagagtaagaccttgactg

SEQ ID NO: 749759 - DNA, 25 bp, Mus musculus
taactacagagttagaccttgactg

SEQ ID NO: 749760 - DNA, 25 bp, Mus musculus
taactacagatgatttgtctcttca

SEQ ID NO: 749761 - DNA, 25 bp, Mus musculus
taactacagatgttttgtctcttca

SEQ ID NO: 749762 - DNA, 25 bp, Mus musculus
taactacagcaaagcactcttctgc

SEQ ID NO: 749763 - DNA, 25 bp, Mus musculus
taactacagcaatgcactcttctgc

SEQ ID NO: 749764 - DNA, 25 bp, Mus musculus
taactacagttaatgttttgctctg

SEQ ID NO: 749765 - DNA, 25 bp, Mus musculus
taactacagttattgttttgctctg

SEQ ID NO: 749766 - DNA, 25 bp, Mus musculus
taactacatgtaatgcttttggcag

SEQ ID NO: 749767 - DNA, 25 bp, Mus musculus
taactacatgtattgcttttggcag

SEQ ID NO: 749768 - DNA, 25 bp, Mus musculus
taactaccaacccaatggcagtgtg

SEQ ID NO: 749769 - DNA, 25 bp, Mus musculus
taactaccaaccgaatggcagtgtg

SEQ ID NO: 749770 - DNA, 25 bp, Mus musculus
taactacctaccaacaagaagcaca

SEQ ID NO: 749771 - DNA, 25 bp, Mus musculus
taactacctacctacaagaagcaca

SEQ ID NO: 749772 - DNA, 25 bp, Mus musculus
taactacctttcctgccttaggaag

SEQ ID NO: 749773 - DNA, 25 bp, Mus musculus
taactacctttcgtgccttaggaag

SEQ ID NO: 749774 - DNA, 25 bp, Mus musculus
taactactccaaacttagcttgctc

SEQ ID NO: 749775 - DNA, 25 bp, Mus musculus
taactactccaatcttagcttgctc

SEQ ID NO: 749776 - DNA, 25 bp, Mus musculus
taactactccggctaccttgatatt

SEQ ID NO: 749777 - DNA, 25 bp, Mus musculus
taactactccgggtaccttgatatt

SEQ ID NO: 749778 - DNA, 25 bp, Mus musculus
taactactctttctaccgctgggat

SEQ ID NO: 749779 - DNA, 25 bp, Mus musculus
taactactctttgtaccgctgggat

SEQ ID NO: 749780 - DNA, 25 bp, Mus musculus
taactactgctcaacgttctgccag

SEQ ID NO: 749781 - DNA, 25 bp, Mus musculus
taactactgctctacgttctgccag

SEQ ID NO: 749782 - DNA, 25 bp, Mus musculus
taactactgtagattaagccaagct

SEQ ID NO: 749783 - DNA, 25 bp, Mus musculus
taactactgtagtttaagccaagct

SEQ ID NO: 749784 - DNA, 25 bp, Mus musculus
taactacttcgtatctgctaggttt

SEQ ID NO: 749785 - DNA, 25 bp, Mus musculus
taactacttcgtttctgctaggttt

SEQ ID NO: 749786 - DNA, 25 bp, Mus musculus
taactacttctgatttggcctcctg

SEQ ID NO: 749787 - DNA, 25 bp, Mus musculus
taactacttctgttttggcctcctg

SEQ ID NO: 749788 - DNA, 25 bp, Mus musculus
taactagaccagcttggccacaagt

SEQ ID NO: 749789 - DNA, 25 bp, Mus musculus
taactagaccaggttggccacaagt

SEQ ID NO: 749790 - DNA, 25 bp, Mus musculus
taactagagaaaagcctacccctcc

SEQ ID NO: 749791 - DNA, 25 bp, Mus musculus
taactagagaaatgcctacccctcc

SEQ ID NO: 749792 - DNA, 25 bp, Mus musculus
taactagagcttatccaagtgaaat

SEQ ID NO: 749793 - DNA, 25 bp, Mus musculus
taactagagcttttccaagtgaaat

SEQ ID NO: 749794 - DNA, 25 bp, Mus musculus
taactagatggccactccgttctgc

SEQ ID NO: 749795 - DNA, 25 bp, Mus musculus
taactagatggcgactccgttctgc

SEQ ID NO: 749796 - DNA, 25 bp, Mus musculus
taactagcagctcccatggttggta

SEQ ID NO: 749797 - DNA, 25 bp, Mus musculus
taactagcagctgccatggttggta

SEQ ID NO: 749798 - DNA, 25 bp, Mus musculus
taactagcatgcagcgcagacactg

SEQ ID NO: 749799 - DNA, 25 bp, Mus musculus
taactagcatgctgcgcagacactg

SEQ ID NO: 749800 - DNA, 25 bp, Mus musculus
taactagctgtacaaataaacccgt

SEQ ID NO: 749801 - DNA, 25 bp, Mus musculus
taactagctgtagaaataaacccgt

SEQ ID NO: 749802 - DNA, 25 bp, Mus musculus
taactaggctaactggtgctgacat

SEQ ID NO: 749803 - DNA, 25 bp, Mus musculus
taactaggctaagtggtgctgacat

SEQ ID NO: 749804 - DNA, 25 bp, Mus musculus
taactagggcccagtcaggtctgct

SEQ ID NO: 749805 - DNA, 25 bp, Mus musculus
taactagggccctgtcaggtctgct

SEQ ID NO: 749806 - DNA, 25 bp, Mus musculus
taactaggtaacctttcctcactgc

SEQ ID NO: 749807 - DNA, 25 bp, Mus musculus
taactaggtaacgtttcctcactgc

SEQ ID NO: 749808 - DNA, 25 bp, Mus musculus
taactaggtaatatatcgtggccca

SEQ ID NO: 749809 - DNA, 25 bp, Mus musculus
taactaggtaatttatcgtggccca

SEQ ID NO: 749810 - DNA, 25 bp, Mus musculus
taactaggtcttattaagaagtgat

SEQ ID NO: 749811 - DNA, 25 bp, Mus musculus
taactaggtctttttaagaagtgat

SEQ ID NO: 749812 - DNA, 25 bp, Mus musculus
taactaggttgtcagaccccgaggc

SEQ ID NO: 749813 - DNA, 25 bp, Mus musculus
taactaggttgtgagaccccgaggc

SEQ ID NO: 749814 - DNA, 25 bp, Mus musculus
taactagtacccatatgcctccatt

SEQ ID NO: 749815 - DNA, 25 bp, Mus musculus
taactagtacccttatgcctccatt

SEQ ID NO: 749816 - DNA, 25 bp, Mus musculus
taactagtgggactctggtcctgct

SEQ ID NO: 749817 - DNA, 25 bp, Mus musculus
taactagtgggagtctggtcctgct

SEQ ID NO: 749818 - DNA, 25 bp, Mus musculus
taactagttctgctggttgtcagtt

SEQ ID NO: 749819 - DNA, 25 bp, Mus musculus
taactagttctggtggttgtcagtt

SEQ ID NO: 749820 - DNA, 25 bp, Mus musculus
taactagttgcaaatttttccctgg

SEQ ID NO: 749821 - DNA, 25 bp, Mus musculus
taactagttgcatatttttccctgg

SEQ ID NO: 749822 - DNA, 25 bp, Mus musculus
taactagtttgaagtggttttccgt

SEQ ID NO: 749823 - DNA, 25 bp, Mus musculus
taactagtttgatgtggttttccgt

SEQ ID NO: 749824 - DNA, 25 bp, Mus musculus
taactataacttaccaccttactca

SEQ ID NO: 749825 - DNA, 25 bp, Mus musculus
taactataactttccaccttactca

SEQ ID NO: 749826 - DNA, 25 bp, Mus musculus
taactatagcgtagactgcctggcc

SEQ ID NO: 749827 - DNA, 25 bp, Mus musculus
taactatagcgttgactgcctggcc

SEQ ID NO: 749828 - DNA, 25 bp, Mus musculus
taactatcactacgagttgtctctc

SEQ ID NO: 749829 - DNA, 25 bp, Mus musculus
taactatcactaggagttgtctctc

SEQ ID NO: 749830 - DNA, 25 bp, Mus musculus
taactatcagggacagcgttggctc

SEQ ID NO: 749831 - DNA, 25 bp, Mus musculus
taactatcagggtcagcgttggctc

SEQ ID NO: 749832 - DNA, 25 bp, Mus musculus
taactatcagtgagtcgtcttcttg

SEQ ID NO: 749833 - DNA, 25 bp, Mus musculus
taactatcagtgtgtcgtcttcttg

SEQ ID NO: 749834 - DNA, 25 bp, Mus musculus
taactatcgcagagcaggagaacgc

SEQ ID NO: 749835 - DNA, 25 bp, Mus musculus
taactatcgcagtgcaggagaacgc

SEQ ID NO: 749836 - DNA, 25 bp, Mus musculus
taactatctgcacctatttactaat

SEQ ID NO: 749837 - DNA, 25 bp, Mus musculus
taactatctgcagctatttactaat

SEQ ID NO: 749838 - DNA, 25 bp, Mus musculus
taactatgacgaatgtggctgcccc

SEQ ID NO: 749839 - DNA, 25 bp, Mus musculus
taactatgacgattgtggctgcccc

SEQ ID NO: 749840 - DNA, 25 bp, Mus musculus
taactatgccctcagctctagagga

SEQ ID NO: 749841 - DNA, 25 bp, Mus musculus
taactatgccctgagctctagagga

SEQ ID NO: 749842 - DNA, 25 bp, Mus musculus
taactatggctaactcctgtggctt

SEQ ID NO: 749843 - DNA, 25 bp, Mus musculus
taactatggctatctcctgtggctt

SEQ ID NO: 749844 - DNA, 25 bp, Mus musculus
taactatggctgcaagcctcttcct

SEQ ID NO: 749845 - DNA, 25 bp, Mus musculus
taactatggctggaagcctcttcct

SEQ ID NO: 749846 - DNA, 25 bp, Mus musculus
taactatggtgtatctatgcatgaa

SEQ ID NO: 749847 - DNA, 25 bp, Mus musculus
taactatggtgtttctatgcatgaa

SEQ ID NO: 749848 - DNA, 25 bp, Mus musculus
taactatgtcttccccatccatttc

SEQ ID NO: 749849 - DNA, 25 bp, Mus musculus
taactatgtcttgcccatccatttc

SEQ ID NO: 749850 - DNA, 25 bp, Mus musculus
taactattaaggcagaacccactac

SEQ ID NO: 749851 - DNA, 25 bp, Mus musculus
taactattaagggagaacccactac

SEQ ID NO: 749852 - DNA, 25 bp, Mus musculus
taactattacaaacctcaccacaat

SEQ ID NO: 749853 - DNA, 25 bp, Mus musculus
taactattacaatcctcaccacaat

SEQ ID NO: 749854 - DNA, 25 bp, Mus musculus
taactattagatagtcttcctggta

SEQ ID NO: 749855 - DNA, 25 bp, Mus musculus
taactattagattgtcttcctggta

SEQ ID NO: 749856 - DNA, 25 bp, Mus musculus
taactattcactaaaccacccaaat

SEQ ID NO: 749857 - DNA, 25 bp, Mus musculus
taactattcacttaaccacccaaat

SEQ ID NO: 749858 - DNA, 25 bp, Mus musculus
taactattgagcctatttaccgaag

SEQ ID NO: 749859 - DNA, 25 bp, Mus musculus
taactattgagcgtatttaccgaag

SEQ ID NO: 749860 - DNA, 25 bp, Mus musculus
taactattgtcaatagctctgtttg

SEQ ID NO: 749861 - DNA, 25 bp, Mus musculus
taactattgtcattagctctgtttg

SEQ ID NO: 749862 - DNA, 25 bp, Mus musculus
taactattgtggacctactcttgcg

SEQ ID NO: 749863 - DNA, 25 bp, Mus musculus
taactattgtggtcctactcttgcg

SEQ ID NO: 749864 - DNA, 25 bp, Mus musculus
taactatttcttaacaggaccaatg

SEQ ID NO: 749865 - DNA, 25 bp, Mus musculus
taactatttctttacaggaccaatg

SEQ ID NO: 749866 - DNA, 25 bp, Mus musculus
taactatttttgactaaccctcctg

SEQ ID NO: 749867 - DNA, 25 bp, Mus musculus
taactatttttgtctaaccctcctg

SEQ ID NO: 749868 - DNA, 25 bp, Mus musculus
taactcaaagagactgcccaccttt

SEQ ID NO: 749869 - DNA, 25 bp, Mus musculus
taactcaaagagtctgcccaccttt

SEQ ID NO: 749870 - DNA, 25 bp, Mus musculus
taactcaacagtctctacttggcct

SEQ ID NO: 749871 - DNA, 25 bp, Mus musculus
taactcaacagtgtctacttggcct

SEQ ID NO: 749872 - DNA, 25 bp, Mus musculus
taactcaacatgattcatacacctg

SEQ ID NO: 749873 - DNA, 25 bp, Mus musculus
taactcaacatgtttcatacacctg

SEQ ID NO: 749874 - DNA, 25 bp, Mus musculus
taactcaagatacagctggaccaac

SEQ ID NO: 749875 - DNA, 25 bp, Mus musculus
taactcaagatagagctggaccaac

SEQ ID NO: 749876 - DNA, 25 bp, Mus musculus
taactcaagggaatttaggaatgcc

SEQ ID NO: 749877 - DNA, 25 bp, Mus musculus
taactcaagggattttaggaatgcc

SEQ ID NO: 749878 - DNA, 25 bp, Mus musculus
taactcaatacaactgggagaacct

SEQ ID NO: 749879 - DNA, 25 bp, Mus musculus
taactcaatacatctgggagaacct

SEQ ID NO: 749880 - DNA, 25 bp, Mus musculus
taactcaatgatcttctagaactgg

SEQ ID NO: 749881 - DNA, 25 bp, Mus musculus
taactcaatgatgttctagaactgg

SEQ ID NO: 749882 - DNA, 25 bp, Mus musculus
taactcacagccaattcagcatcag

SEQ ID NO: 749883 - DNA, 25 bp, Mus musculus
taactcacagcctattcagcatcag

SEQ ID NO: 749884 - DNA, 25 bp, Mus musculus
taactcacagtaaggcacattgcaa

SEQ ID NO: 749885 - DNA, 25 bp, Mus musculus
taactcacagtatggcacattgcaa

SEQ ID NO: 749886 - DNA, 25 bp, Mus musculus
taactcacatcacctcattcctgat

SEQ ID NO: 749887 - DNA, 25 bp, Mus musculus
taactcacatcagctcattcctgat

SEQ ID NO: 749888 - DNA, 25 bp, Mus musculus
taactcaccaccattatccttatct

SEQ ID NO: 749889 - DNA, 25 bp, Mus musculus
taactcaccacctttatccttatct

SEQ ID NO: 749890 - DNA, 25 bp, Mus musculus
taactcaccgagagatcctggtctg

SEQ ID NO: 749891 - DNA, 25 bp, Mus musculus
taactcaccgagtgatcctggtctg

SEQ ID NO: 749892 - DNA, 25 bp, Mus musculus
taactcaccgtgagacactgggctg

SEQ ID NO: 749893 - DNA, 25 bp, Mus musculus
taactcaccgtgtgacactgggctg

SEQ ID NO: 749894 - DNA, 25 bp, Mus musculus
taactcactaatattggaaaacctg

SEQ ID NO: 749895 - DNA, 25 bp, Mus musculus
taactcactaattttggaaaacctg

SEQ ID NO: 749896 - DNA, 25 bp, Mus musculus
taactcactgcacttctaaccatag

SEQ ID NO: 749897 - DNA, 25 bp, Mus musculus
taactcactgcagttctaaccatag

SEQ ID NO: 749898 - DNA, 25 bp, Mus musculus
taactcagacgacacaagtccattt

SEQ ID NO: 749899 - DNA, 25 bp, Mus musculus
taactcagacgagacaagtccattt

SEQ ID NO: 749900 - DNA, 25 bp, Mus musculus
taactcagactccatgcgggatgac

SEQ ID NO: 749901 - DNA, 25 bp, Mus musculus
taactcagactcgatgcgggatgac

SEQ ID NO: 749902 - DNA, 25 bp, Mus musculus
taactcagagccattctgtctgcac

SEQ ID NO: 749903 - DNA, 25 bp, Mus musculus
taactcagagcctttctgtctgcac

SEQ ID NO: 749904 - DNA, 25 bp, Mus musculus
taactcagagctcgtgaagccccac

SEQ ID NO: 749905 - DNA, 25 bp, Mus musculus
taactcagagctggtgaagccccac

SEQ ID NO: 749906 - DNA, 25 bp, Mus musculus
taactcagatgactgctccccgagt

SEQ ID NO: 749907 - DNA, 25 bp, Mus musculus
taactcagatgagtgctccccgagt

SEQ ID NO: 749908 - DNA, 25 bp, Mus musculus
taactcagcaagacctaggctccag

SEQ ID NO: 749909 - DNA, 25 bp, Mus musculus
taactcagcaagtcctaggctccag

SEQ ID NO: 749910 - DNA, 25 bp, Mus musculus
taactcagcagcatcgctctgtgga

SEQ ID NO: 749911 - DNA, 25 bp, Mus musculus
taactcagcagcttcgctctgtgga

SEQ ID NO: 749912 - DNA, 25 bp, Mus musculus
taactcagccctaagagtctggcaa

SEQ ID NO: 749913 - DNA, 25 bp, Mus musculus
taactcagcccttagagtctggcaa

SEQ ID NO: 749914 - DNA, 25 bp, Mus musculus
taactcagcggacagtacctttaga

SEQ ID NO: 749915 - DNA, 25 bp, Mus musculus
taactcagcggagagtacctttaga

SEQ ID NO: 749916 - DNA, 25 bp, Mus musculus
taactcaggacaccgggtctgatct

SEQ ID NO: 749917 - DNA, 25 bp, Mus musculus
taactcaggacagcgggtctgatct

SEQ ID NO: 749918 - DNA, 25 bp, Mus musculus
taactcaggcctatttaagaggaat

SEQ ID NO: 749919 - DNA, 25 bp, Mus musculus
taactcaggcctttttaagaggaat

SEQ ID NO: 749920 - DNA, 25 bp, Mus musculus
taactcagggtgattcccgtgggtg

SEQ ID NO: 749921 - DNA, 25 bp, Mus musculus
taactcagggtgtttcccgtgggtg

SEQ ID NO: 749922 - DNA, 25 bp, Mus musculus
taactcagtcttactcctagccaca

SEQ ID NO: 749923 - DNA, 25 bp, Mus musculus
taactcagtctttctcctagccaca

SEQ ID NO: 749924 - DNA, 25 bp, Mus musculus
taactcagtgttactctacctgtga

SEQ ID NO: 749925 - DNA, 25 bp, Mus musculus
taactcagtgtttctctacctgtga

SEQ ID NO: 749926 - DNA, 25 bp, Mus musculus
taactcatacgtcctggtgccagtg

SEQ ID NO: 749927 - DNA, 25 bp, Mus musculus
taactcatacgtgctggtgccagtg

SEQ ID NO: 749928 - DNA, 25 bp, Mus musculus
taactcatctgacttaatatgcatt

SEQ ID NO: 749929 - DNA, 25 bp, Mus musculus
taactcatctgagttaatatgcatt

SEQ ID NO: 749930 - DNA, 25 bp, Mus musculus
taactcattaacctagcttcctaac

SEQ ID NO: 749931 - DNA, 25 bp, Mus musculus
taactcattaacgtagcttcctaac

SEQ ID NO: 749932 - DNA, 25 bp, Mus musculus
taactcattcatagtcactacccag

SEQ ID NO: 749933 - DNA, 25 bp, Mus musculus
taactcattcattgtcactacccag

SEQ ID NO: 749934 - DNA, 25 bp, Mus musculus
taactcatttctaagacgtagctgg

SEQ ID NO: 749935 - DNA, 25 bp, Mus musculus
taactcatttcttagacgtagctgg

SEQ ID NO: 749936 - DNA, 25 bp, Mus musculus
taactcattttaaccgttcaagcgg

SEQ ID NO: 749937 - DNA, 25 bp, Mus musculus
taactcattttatccgttcaagcgg

SEQ ID NO: 749938 - DNA, 25 bp, Mus musculus
taactccaaaggaggcttcactgga

SEQ ID NO: 749939 - DNA, 25 bp, Mus musculus
taactccaaaggtggcttcactgga

SEQ ID NO: 749940 - DNA, 25 bp, Mus musculus
taactccaagatccacaatgtcatt

SEQ ID NO: 749941 - DNA, 25 bp, Mus musculus
taactccaagatgcacaatgtcatt

SEQ ID NO: 749942 - DNA, 25 bp, Mus musculus
taactccacatgagtagcgcactgc

SEQ ID NO: 749943 - DNA, 25 bp, Mus musculus
taactccacatgtgtagcgcactgc

SEQ ID NO: 749944 - DNA, 25 bp, Mus musculus
taactccagcctactattatcatct

SEQ ID NO: 749945 - DNA, 25 bp, Mus musculus
taactccagccttctattatcatct

SEQ ID NO: 749946 - DNA, 25 bp, Mus musculus
taactccaggctacaccaaatgtgc

SEQ ID NO: 749947 - DNA, 25 bp, Mus musculus
taactccaggctccctgaaacaagt

SEQ ID NO: 749948 - DNA, 25 bp, Mus musculus
taactccaggctgcctgaaacaagt

SEQ ID NO: 749949 - DNA, 25 bp, Mus musculus
taactccaggcttcaccaaatgtgc

SEQ ID NO: 749950 - DNA, 25 bp, Mus musculus
taactccatctcctaatttacactt

SEQ ID NO: 749951 - DNA, 25 bp, Mus musculus
taactccatctcgtaatttacactt

SEQ ID NO: 749952 - DNA, 25 bp, Mus musculus
taactccatggtcaccctgggatgc

SEQ ID NO: 749953 - DNA, 25 bp, Mus musculus
taactccatggtgaccctgggatgc

SEQ ID NO: 749954 - DNA, 25 bp, Mus musculus
taactccattctatggcatgcagaa

SEQ ID NO: 749955 - DNA, 25 bp, Mus musculus
taactccattctttggcatgcagaa

SEQ ID NO: 749956 - DNA, 25 bp, Mus musculus
taactcccagagctttctaattaac

SEQ ID NO: 749957 - DNA, 25 bp, Mus musculus
taactcccagaggtttctaattaac

SEQ ID NO: 749958 - DNA, 25 bp, Mus musculus
taactcccagctattatagaggtgc

SEQ ID NO: 749959 - DNA, 25 bp, Mus musculus
taactcccagcttttatagaggtgc

SEQ ID NO: 749960 - DNA, 25 bp, Mus musculus
taactcccattgctgcaccatacaa

SEQ ID NO: 749961 - DNA, 25 bp, Mus musculus
taactcccattggtgcaccatacaa

SEQ ID NO: 749962 - DNA, 25 bp, Mus musculus
taactcccatttcaacaggtctgtg

SEQ ID NO: 749963 - DNA, 25 bp, Mus musculus
taactcccatttgaacaggtctgtg

SEQ ID NO: 749964 - DNA, 25 bp, Mus musculus
taactcccctctacaaacaaacatg

SEQ ID NO: 749965 - DNA, 25 bp, Mus musculus
taactcccctcttcaaacaaacatg

SEQ ID NO: 749966 - DNA, 25 bp, Mus musculus
taactccccttaacagtacttagcg

SEQ ID NO: 749967 - DNA, 25 bp, Mus musculus
taactccccttatcagtacttagcg

SEQ ID NO: 749968 - DNA, 25 bp, Mus musculus
taactccctcccaccaataaaaatg

SEQ ID NO: 749969 - DNA, 25 bp, Mus musculus
taactccctccctccaataaaaatg

SEQ ID NO: 749970 - DNA, 25 bp, Mus musculus
taactccctgtactcaatccaagta

SEQ ID NO: 749971 - DNA, 25 bp, Mus musculus
taactccctgtagtcaatccaagta

SEQ ID NO: 749972 - DNA, 25 bp, Mus musculus
taactccctgttatccttactgtat

SEQ ID NO: 749973 - DNA, 25 bp, Mus musculus
taactccctgttttccttactgtat

SEQ ID NO: 749974 - DNA, 25 bp, Mus musculus
taactccgcattcgctgttcctcag

SEQ ID NO: 749975 - DNA, 25 bp, Mus musculus
taactccgcattggctgttcctcag

SEQ ID NO: 749976 - DNA, 25 bp, Mus musculus
taactcctaaaaattgtcctctggg

SEQ ID NO: 749977 - DNA, 25 bp, Mus musculus
taactcctaaaatttgtcctctggg

SEQ ID NO: 749978 - DNA, 25 bp, Mus musculus
taactcctaactaaccagctcgcag

SEQ ID NO: 749979 - DNA, 25 bp, Mus musculus
taactcctaacttaccagctcgcag

SEQ ID NO: 749980 - DNA, 25 bp, Mus musculus
taactcctccatacctaagtactca

SEQ ID NO: 749981 - DNA, 25 bp, Mus musculus
taactcctccattcctaagtactca

SEQ ID NO: 749982 - DNA, 25 bp, Mus musculus
taactcctcggacaatggctcctgg

SEQ ID NO: 749983 - DNA, 25 bp, Mus musculus
taactcctcggagaatggctcctgg

SEQ ID NO: 749984 - DNA, 25 bp, Mus musculus
taactcctgactcctgagacatcag

SEQ ID NO: 749985 - DNA, 25 bp, Mus musculus
taactcctgactgctgagacatcag

SEQ ID NO: 749986 - DNA, 25 bp, Mus musculus
taactcctgagcacatgtatcccta

SEQ ID NO: 749987 - DNA, 25 bp, Mus musculus
taactcctgagctcatgtatcccta

SEQ ID NO: 749988 - DNA, 25 bp, Mus musculus
taactcctgctcacctaaggatttg

SEQ ID NO: 749989 - DNA, 25 bp, Mus musculus
taactcctgctctcctaaggatttg

SEQ ID NO: 749990 - DNA, 25 bp, Mus musculus
taactcctgggcactaacctagagg

SEQ ID NO: 749991 - DNA, 25 bp, Mus musculus
taactcctgggctctaacctagagg

SEQ ID NO: 749992 - DNA, 25 bp, Mus musculus
taactcctggtgctttgtactactg

SEQ ID NO: 749993 - DNA, 25 bp, Mus musculus
taactcctggtggtttgtactactg

SEQ ID NO: 749994 - DNA, 25 bp, Mus musculus
taactcctgtatcatgtccctggac

SEQ ID NO: 749995 - DNA, 25 bp, Mus musculus
taactcctgtatgatgtccctggac

SEQ ID NO: 749996 - DNA, 25 bp, Mus musculus
taactccttgtgacaaaaccctctg

SEQ ID NO: 749997 - DNA, 25 bp, Mus musculus
taactccttgtgtcaaaaccctctg

SEQ ID NO: 749998 - DNA, 25 bp, Mus musculus
taactccttttactgtctcgggaag

SEQ ID NO: 749999 - DNA, 25 bp, Mus musculus
taactccttttagtgtctcgggaag

SEQ ID NO: 750000 - DNA, 25 bp, Mus musculus
taactcgacgaaaccaagcccaggg

SEQ ID NO: 750001 - DNA, 25 bp, Mus musculus
taactcgacgaatccaagcccaggg

SEQ ID NO: 750002 - DNA, 25 bp, Mus musculus
taactcgagaatcctttttgaacct

SEQ ID NO: 750003 - DNA, 25 bp, Mus musculus
taactcgagaatgctttttgaacct

SEQ ID NO: 750004 - DNA, 25 bp, Mus musculus
taactcgagcctcgctagcctgcgg

SEQ ID NO: 750005 - DNA, 25 bp, Mus musculus
taactcgagcctggctagcctgcgg

SEQ ID NO: 750006 - DNA, 25 bp, Mus musculus
taactcgatagactctcctttccac

SEQ ID NO: 750007 - DNA, 25 bp, Mus musculus
taactcgatagagtctcctttccac

SEQ ID NO: 750008 - DNA, 25 bp, Mus musculus
taactcgcaaggagtgggcttttgt

SEQ ID NO: 750009 - DNA, 25 bp, Mus musculus
taactcgcaaggtgtgggcttttgt

SEQ ID NO: 750010 - DNA, 25 bp, Mus musculus
taactcggatggatgccttgcttta

SEQ ID NO: 750011 - DNA, 25 bp, Mus musculus
taactcggatggttgccttgcttta

SEQ ID NO: 750012 - DNA, 25 bp, Mus musculus
taactcggcatcatgtgcatgctaa

SEQ ID NO: 750013 - DNA, 25 bp, Mus musculus
taactcggcatcttgtgcatgctaa

SEQ ID NO: 750014 - DNA, 25 bp, Mus musculus
taactcgggcccacggaaacagcgg

SEQ ID NO: 750015 - DNA, 25 bp, Mus musculus
taactcgggccctcggaaacagcgg

SEQ ID NO: 750016 - DNA, 25 bp, Mus musculus
taactcgggctcattgggattgact

SEQ ID NO: 750017 - DNA, 25 bp, Mus musculus
taactcgggctctttgggattgact

SEQ ID NO: 750018 - DNA, 25 bp, Mus musculus
taactcggtgtccatcactggctca

SEQ ID NO: 750019 - DNA, 25 bp, Mus musculus
taactcggtgtcgatcactggctca

SEQ ID NO: 750020 - DNA, 25 bp, Mus musculus
taactcggttcacttcagactacgt

SEQ ID NO: 750021 - DNA, 25 bp, Mus musculus
taactcggttcagttcagactacgt

SEQ ID NO: 750022 - DNA, 25 bp, Mus musculus
taactcgttggtccttgtttctgtc

SEQ ID NO: 750023 - DNA, 25 bp, Mus musculus
taactcgttggtgcttgtttctgtc

SEQ ID NO: 750024 - DNA, 25 bp, Mus musculus
taactctaagagcagtggaacttta

SEQ ID NO: 750025 - DNA, 25 bp, Mus musculus
taactctaagaggagtggaacttta

SEQ ID NO: 750026 - DNA, 25 bp, Mus musculus
taactctacgagagcggaagcttct

SEQ ID NO: 750027 - DNA, 25 bp, Mus musculus
taactctacgagtgcggaagcttct

SEQ ID NO: 750028 - DNA, 25 bp, Mus musculus
taactctaggctactgcttttcaac

SEQ ID NO: 750029 - DNA, 25 bp, Mus musculus
taactctaggcttctgcttttcaac

SEQ ID NO: 750030 - DNA, 25 bp, Mus musculus
taactctagtggaccttgtgggtcc

SEQ ID NO: 750031 - DNA, 25 bp, Mus musculus
taactctagtggtccttgtgggtcc

SEQ ID NO: 750032 - DNA, 25 bp, Mus musculus
taactctcagcactatgtgaacgct

SEQ ID NO: 750033 - DNA, 25 bp, Mus musculus
taactctcagcactccatcagcaaa

SEQ ID NO: 750034 - DNA, 25 bp, Mus musculus
taactctcagcagtatgtgaacgct

SEQ ID NO: 750035 - DNA, 25 bp, Mus musculus
taactctcagcagtccatcagcaaa

SEQ ID NO: 750036 - DNA, 25 bp, Mus musculus
taactctcagggatccaagggctct

SEQ ID NO: 750037 - DNA, 25 bp, Mus musculus
taactctcagggttccaagggctct

SEQ ID NO: 750038 - DNA, 25 bp, Mus musculus
taactctccaccagtggcaaagcaa

SEQ ID NO: 750039 - DNA, 25 bp, Mus musculus
taactctccacctgtggcaaagcaa

SEQ ID NO: 750040 - DNA, 25 bp, Mus musculus
taactctcccggaaggtgtcagggt

SEQ ID NO: 750041 - DNA, 25 bp, Mus musculus
taactctcccggtaggtgtcagggt

SEQ ID NO: 750042 - DNA, 25 bp, Mus musculus
taactctcccttatgggattgttga

SEQ ID NO: 750043 - DNA, 25 bp, Mus musculus
taactctcccttttgggattgttga

SEQ ID NO: 750044 - DNA, 25 bp, Mus musculus
taactctctaaaactttatggctgg

SEQ ID NO: 750045 - DNA, 25 bp, Mus musculus
taactctctaaatctttatggctgg

SEQ ID NO: 750046 - DNA, 25 bp, Mus musculus
taactctctatcactgatgtcctga

SEQ ID NO: 750047 - DNA, 25 bp, Mus musculus
taactctctatctctgatgtcctga

SEQ ID NO: 750048 - DNA, 25 bp, Mus musculus
taactctctcctcgcagagctgcag

SEQ ID NO: 750049 - DNA, 25 bp, Mus musculus
taactctctcctggcagagctgcag

SEQ ID NO: 750050 - DNA, 25 bp, Mus musculus
taactctcttctcgcctgcgagttt

SEQ ID NO: 750051 - DNA, 25 bp, Mus musculus
taactctcttctggcctgcgagttt

SEQ ID NO: 750052 - DNA, 25 bp, Mus musculus
taactctgagagctcggtgcacatc

SEQ ID NO: 750053 - DNA, 25 bp, Mus musculus
taactctgagaggtcggtgcacatc

SEQ ID NO: 750054 - DNA, 25 bp, Mus musculus
taactctgagctatctgcctataca

SEQ ID NO: 750055 - DNA, 25 bp, Mus musculus
taactctgagctttctgcctataca

SEQ ID NO: 750056 - DNA, 25 bp, Mus musculus
taactctgatccctctgatgtggca

SEQ ID NO: 750057 - DNA, 25 bp, Mus musculus
taactctgatccgtctgatgtggca

SEQ ID NO: 750058 - DNA, 25 bp, Mus musculus
taactctgcatacccttttctcttc

SEQ ID NO: 750059 - DNA, 25 bp, Mus musculus
taactctgcatagccttttctcttc

SEQ ID NO: 750060 - DNA, 25 bp, Mus musculus
taactctgccttcctttgtatggct

SEQ ID NO: 750061 - DNA, 25 bp, Mus musculus
taactctgccttgctttgtatggct

SEQ ID NO: 750062 - DNA, 25 bp, Mus musculus
taactctgcggtccccgaggcttca

SEQ ID NO: 750063 - DNA, 25 bp, Mus musculus
taactctgcggtgcccgaggcttca

SEQ ID NO: 750064 - DNA, 25 bp, Mus musculus
taactctggaggactgcttgctgtg

SEQ ID NO: 750065 - DNA, 25 bp, Mus musculus
taactctggaggtctgcttgctgtg

SEQ ID NO: 750066 - DNA, 25 bp, Mus musculus
taactctgggccaagtgcgtggact

SEQ ID NO: 750067 - DNA, 25 bp, Mus musculus
taactctgggcccacagacctgaga

SEQ ID NO: 750068 - DNA, 25 bp, Mus musculus
taactctgggccgacagacctgaga

SEQ ID NO: 750069 - DNA, 25 bp, Mus musculus
taactctgggcctagtgcgtggact

SEQ ID NO: 750070 - DNA, 25 bp, Mus musculus
taactctggttgagctctttagaaa

SEQ ID NO: 750071 - DNA, 25 bp, Mus musculus
taactctggttgtgctctttagaaa

SEQ ID NO: 750072 - DNA, 25 bp, Mus musculus
taactctgtagtactaccctgccta

SEQ ID NO: 750073 - DNA, 25 bp, Mus musculus
taactctgtagttctaccctgccta

SEQ ID NO: 750074 - DNA, 25 bp, Mus musculus
taactctgtccccattccaatgtca

SEQ ID NO: 750075 - DNA, 25 bp, Mus musculus
taactctgtcccgattccaatgtca

SEQ ID NO: 750076 - DNA, 25 bp, Mus musculus
taactctgttctactgtgttgagca

SEQ ID NO: 750077 - DNA, 25 bp, Mus musculus
taactctgttcttctgtgttgagca

SEQ ID NO: 750078 - DNA, 25 bp, Mus musculus
taactcttacaaaacactcctccaa

SEQ ID NO: 750079 - DNA, 25 bp, Mus musculus
taactcttacaatacactcctccaa

SEQ ID NO: 750080 - DNA, 25 bp, Mus musculus
taactcttatttctctaactataga

SEQ ID NO: 750081 - DNA, 25 bp, Mus musculus
taactcttatttgtctaactataga

SEQ ID NO: 750082 - DNA, 25 bp, Mus musculus
taactcttcctacaaaaaccagctt

SEQ ID NO: 750083 - DNA, 25 bp, Mus musculus
taactcttcctagaaaaaccagctt

SEQ ID NO: 750084 - DNA, 25 bp, Mus musculus
taactcttcctccattgttgatgca

SEQ ID NO: 750085 - DNA, 25 bp, Mus musculus
taactcttcctcgattgttgatgca

SEQ ID NO: 750086 - DNA, 25 bp, Mus musculus
taactcttgagtcgattgcttgatc

SEQ ID NO: 750087 - DNA, 25 bp, Mus musculus
taactcttgagtggattgcttgatc

SEQ ID NO: 750088 - DNA, 25 bp, Mus musculus
taactcttggcgcttttcctctgtt

SEQ ID NO: 750089 - DNA, 25 bp, Mus musculus
taactcttggcggttttcctctgtt

SEQ ID NO: 750090 - DNA, 25 bp, Mus musculus
taactcttgtgcacttgcaataagg

SEQ ID NO: 750091 - DNA, 25 bp, Mus musculus
taactcttgtgctcttgcaataagg

SEQ ID NO: 750092 - DNA, 25 bp, Mus musculus
taactctttaaacgtctaattcaag

SEQ ID NO: 750093 - DNA, 25 bp, Mus musculus
taactctttaaaggtctaattcaag

SEQ ID NO: 750094 - DNA, 25 bp, Mus musculus
taactctttaagaaccaacgtgaat

SEQ ID NO: 750095 - DNA, 25 bp, Mus musculus
taactctttaagtaccaacgtgaat

SEQ ID NO: 750096 - DNA, 25 bp, Mus musculus
taactctttagcatactgtctgcac

SEQ ID NO: 750097 - DNA, 25 bp, Mus musculus
taactctttagcttactgtctgcac

SEQ ID NO: 750098 - DNA, 25 bp, Mus musculus
taactctttcaactcaggatccctg

SEQ ID NO: 750099 - DNA, 25 bp, Mus musculus
taactctttcaagtcaggatccctg

SEQ ID NO: 750100 - DNA, 25 bp, Mus musculus
taactcttttatcggctttcagcta

SEQ ID NO: 750101 - DNA, 25 bp, Mus musculus
taactcttttatgggctttcagcta

SEQ ID NO: 750102 - DNA, 25 bp, Mus musculus
taactgaacagcaccagagttctgg

SEQ ID NO: 750103 - DNA, 25 bp, Mus musculus
taactgaacagctccagagttctgg

SEQ ID NO: 750104 - DNA, 25 bp, Mus musculus
taactgaacatgatggcccatacct

SEQ ID NO: 750105 - DNA, 25 bp, Mus musculus
taactgaacatgttggcccatacct

SEQ ID NO: 750106 - DNA, 25 bp, Mus musculus
taactgaagacaatactgccactgt

SEQ ID NO: 750107 - DNA, 25 bp, Mus musculus
taactgaagacattactgccactgt

SEQ ID NO: 750108 - DNA, 25 bp, Mus musculus
taactgaagcggatgagcctgtggc

SEQ ID NO: 750109 - DNA, 25 bp, Mus musculus
taactgaagcggttgagcctgtggc

SEQ ID NO: 750110 - DNA, 25 bp, Mus musculus
taactgacaagccatctgcgtggtc

SEQ ID NO: 750111 - DNA, 25 bp, Mus musculus
taactgacaagcgatctgcgtggtc

SEQ ID NO: 750112 - DNA, 25 bp, Mus musculus
taactgaccagaacgggccctggaa

SEQ ID NO: 750113 - DNA, 25 bp, Mus musculus
taactgaccagatcgggccctggaa

SEQ ID NO: 750114 - DNA, 25 bp, Mus musculus
taactgacccggaacttaactctga

SEQ ID NO: 750115 - DNA, 25 bp, Mus musculus
taactgacccggtacttaactctga

SEQ ID NO: 750116 - DNA, 25 bp, Mus musculus
taactgaccctaccttctatgtgaa

SEQ ID NO: 750117 - DNA, 25 bp, Mus musculus
taactgaccctagcttctatgtgaa

SEQ ID NO: 750118 - DNA, 25 bp, Mus musculus
taactgaccgttcgcagtgctctga

SEQ ID NO: 750119 - DNA, 25 bp, Mus musculus
taactgaccgttggcagtgctctga

SEQ ID NO: 750120 - DNA, 25 bp, Mus musculus
taactgacttcaccgttatgggtat

SEQ ID NO: 750121 - DNA, 25 bp, Mus musculus
taactgacttcagcgttatgggtat

SEQ ID NO: 750122 - DNA, 25 bp, Mus musculus
taactgagagatatataccttggct

SEQ ID NO: 750123 - DNA, 25 bp, Mus musculus
taactgagagatttataccttggct

SEQ ID NO: 750124 - DNA, 25 bp, Mus musculus
taactgagattgactttttcctctt

SEQ ID NO: 750125 - DNA, 25 bp, Mus musculus
taactgagattgtctttttcctctt

SEQ ID NO: 750126 - DNA, 25 bp, Mus musculus
taactgagcgtgactctctagctga

SEQ ID NO: 750127 - DNA, 25 bp, Mus musculus
taactgagcgtgtctctctagctga

SEQ ID NO: 750128 - DNA, 25 bp, Mus musculus
taactgagcttaacggatgggacac

SEQ ID NO: 750129 - DNA, 25 bp, Mus musculus
taactgagcttatcggatgggacac

SEQ ID NO: 750130 - DNA, 25 bp, Mus musculus
taactgagggacaggaacccctgca

SEQ ID NO: 750131 - DNA, 25 bp, Mus musculus
taactgagggactggaacccctgca

SEQ ID NO: 750132 - DNA, 25 bp, Mus musculus
taactgagggccagcttccaatttt

SEQ ID NO: 750133 - DNA, 25 bp, Mus musculus
taactgagggcctgcttccaatttt

SEQ ID NO: 750134 - DNA, 25 bp, Mus musculus
taactgagtggaactacacctcctt

SEQ ID NO: 750135 - DNA, 25 bp, Mus musculus
taactgagtggatctacacctcctt

SEQ ID NO: 750136 - DNA, 25 bp, Mus musculus
taactgatccagactttaagggttt

SEQ ID NO: 750137 - DNA, 25 bp, Mus musculus
taactgatccagtctttaagggttt

SEQ ID NO: 750138 - DNA, 25 bp, Mus musculus
taactgatctcacaggctcggtatc

SEQ ID NO: 750139 - DNA, 25 bp, Mus musculus
taactgatctcagaggctcggtatc

SEQ ID NO: 750140 - DNA, 25 bp, Mus musculus
taactgcaaccacgtagtctgcctc

SEQ ID NO: 750141 - DNA, 25 bp, Mus musculus
taactgcaaccaggtagtctgcctc

SEQ ID NO: 750142 - DNA, 25 bp, Mus musculus
taactgcaagtcaaggtatttccct

SEQ ID NO: 750143 - DNA, 25 bp, Mus musculus
taactgcaagtctaggtatttccct

SEQ ID NO: 750144 - DNA, 25 bp, Mus musculus
taactgcaccaacaggatccatcca

SEQ ID NO: 750145 - DNA, 25 bp, Mus musculus
taactgcaccaagaggatccatcca

SEQ ID NO: 750146 - DNA, 25 bp, Mus musculus
taactgcactgcctacgtgcatgtt

SEQ ID NO: 750147 - DNA, 25 bp, Mus musculus
taactgcactgcgtacgtgcatgtt

SEQ ID NO: 750148 - DNA, 25 bp, Mus musculus
taactgcagccaatcctccagagtc

SEQ ID NO: 750149 - DNA, 25 bp, Mus musculus
taactgcagccattcctccagagtc

SEQ ID NO: 750150 - DNA, 25 bp, Mus musculus
taactgcagcggagaggcacatcgt

SEQ ID NO: 750151 - DNA, 25 bp, Mus musculus
taactgcagcggtgaggcacatcgt

SEQ ID NO: 750152 - DNA, 25 bp, Mus musculus
taactgcatggtccttaaggccccg

SEQ ID NO: 750153 - DNA, 25 bp, Mus musculus
taactgcatggtgcttaaggccccg

SEQ ID NO: 750154 - DNA, 25 bp, Mus musculus
taactgccaagaaatgattactact

SEQ ID NO: 750155 - DNA, 25 bp, Mus musculus
taactgccaagatatgattactact

SEQ ID NO: 750156 - DNA, 25 bp, Mus musculus
taactgccaatgatttgtcccctga

SEQ ID NO: 750157 - DNA, 25 bp, Mus musculus
taactgccaatgttttgtcccctga

SEQ ID NO: 750158 - DNA, 25 bp, Mus musculus
taactgccagtaacgtccctttttg

SEQ ID NO: 750159 - DNA, 25 bp, Mus musculus
taactgccagtatcgtccctttttg

SEQ ID NO: 750160 - DNA, 25 bp, Mus musculus
taactgccagtgagaatttacggat

SEQ ID NO: 750161 - DNA, 25 bp, Mus musculus
taactgccagtgtgaatttacggat

SEQ ID NO: 750162 - DNA, 25 bp, Mus musculus
taactgccagttattccaccaagag

SEQ ID NO: 750163 - DNA, 25 bp, Mus musculus
taactgccagtttttccaccaagag

SEQ ID NO: 750164 - DNA, 25 bp, Mus musculus
taactgcccataagtgttgactcat

SEQ ID NO: 750165 - DNA, 25 bp, Mus musculus
taactgcccatatgtgttgactcat

SEQ ID NO: 750166 - DNA, 25 bp, Mus musculus
taactgcctcaaactctagaaccgg

SEQ ID NO: 750167 - DNA, 25 bp, Mus musculus
taactgcctcaatctctagaaccgg

SEQ ID NO: 750168 - DNA, 25 bp, Mus musculus
taactgcctgccaagtgatcacatt

SEQ ID NO: 750169 - DNA, 25 bp, Mus musculus
taactgcctgcctagtgatcacatt

SEQ ID NO: 750170 - DNA, 25 bp, Mus musculus
taactgccttctcaggtagcctgga

SEQ ID NO: 750171 - DNA, 25 bp, Mus musculus
taactgccttctgaggtagcctgga

SEQ ID NO: 750172 - DNA, 25 bp, Mus musculus
taactgccttgtcataggacccagg

SEQ ID NO: 750173 - DNA, 25 bp, Mus musculus
taactgccttgtgataggacccagg

SEQ ID NO: 750174 - DNA, 25 bp, Mus musculus
taactgcgcgcgctttgcatgggat

SEQ ID NO: 750175 - DNA, 25 bp, Mus musculus
taactgcgcgcggtttgcatgggat

SEQ ID NO: 750176 - DNA, 25 bp, Mus musculus
taactgcgggtcattcctgaatcac

SEQ ID NO: 750177 - DNA, 25 bp, Mus musculus
taactgcgggtctttcctgaatcac

SEQ ID NO: 750178 - DNA, 25 bp, Mus musculus
taactgctaaaaccattcttccacc

SEQ ID NO: 750179 - DNA, 25 bp, Mus musculus
taactgctaaaagcattcttccacc

SEQ ID NO: 750180 - DNA, 25 bp, Mus musculus
taactgctaagtcccatctctgagg

SEQ ID NO: 750181 - DNA, 25 bp, Mus musculus
taactgctaagtgccatctctgagg

SEQ ID NO: 750182 - DNA, 25 bp, Mus musculus
taactgctagtcatgtggctgtaac

SEQ ID NO: 750183 - DNA, 25 bp, Mus musculus
taactgctagtcttgtggctgtaac

SEQ ID NO: 750184 - DNA, 25 bp, Mus musculus
taactgctatccaggttttctgggc

SEQ ID NO: 750185 - DNA, 25 bp, Mus musculus
taactgctatcctggttttctgggc

SEQ ID NO: 750186 - DNA, 25 bp, Mus musculus
taactgctattgctacttgattgaa

SEQ ID NO: 750187 - DNA, 25 bp, Mus musculus
taactgctattggtacttgattgaa

SEQ ID NO: 750188 - DNA, 25 bp, Mus musculus
taactgctcaaacatggatcatgcc

SEQ ID NO: 750189 - DNA, 25 bp, Mus musculus
taactgctcaaagatggatcatgcc

SEQ ID NO: 750190 - DNA, 25 bp, Mus musculus
taactgctcttgctggcttccactg

SEQ ID NO: 750191 - DNA, 25 bp, Mus musculus
taactgctcttgcttaccctaaaag

SEQ ID NO: 750192 - DNA, 25 bp, Mus musculus
taactgctcttggtggcttccactg

SEQ ID NO: 750193 - DNA, 25 bp, Mus musculus
taactgctcttggttaccctaaaag

SEQ ID NO: 750194 - DNA, 25 bp, Mus musculus
taactgctgaagacacggacactcc

SEQ ID NO: 750195 - DNA, 25 bp, Mus musculus
taactgctgaagtcacggacactcc

SEQ ID NO: 750196 - DNA, 25 bp, Mus musculus
taactgctgactactgactttctct

SEQ ID NO: 750197 - DNA, 25 bp, Mus musculus
taactgctgacttctgactttctct

SEQ ID NO: 750198 - DNA, 25 bp, Mus musculus
taactgctgagcaaactcgactctc

SEQ ID NO: 750199 - DNA, 25 bp, Mus musculus
taactgctgagctaactcgactctc

SEQ ID NO: 750200 - DNA, 25 bp, Mus musculus
taactgctgaggcactgcttcagct

SEQ ID NO: 750201 - DNA, 25 bp, Mus musculus
taactgctgagggactgcttcagct

SEQ ID NO: 750202 - DNA, 25 bp, Mus musculus
taactgctgggtacttgcacgtaga

SEQ ID NO: 750203 - DNA, 25 bp, Mus musculus
taactgctgggttcttgcacgtaga

SEQ ID NO: 750204 - DNA, 25 bp, Mus musculus
taactgctgtttccaagagttcaga

SEQ ID NO: 750205 - DNA, 25 bp, Mus musculus
taactgctgtttgcaagagttcaga

SEQ ID NO: 750206 - DNA, 25 bp, Mus musculus
taactgcttaaccataccatccgtc

SEQ ID NO: 750207 - DNA, 25 bp, Mus musculus
taactgcttaacgataccatccgtc

SEQ ID NO: 750208 - DNA, 25 bp, Mus musculus
taactgcttgctcccagaaccagac

SEQ ID NO: 750209 - DNA, 25 bp, Mus musculus
taactgcttgctgccagaaccagac

SEQ ID NO: 750210 - DNA, 25 bp, Mus musculus
taactgctttttctacttggagaga

SEQ ID NO: 750211 - DNA, 25 bp, Mus musculus
taactgctttttgtacttggagaga

SEQ ID NO: 750212 - DNA, 25 bp, Mus musculus
taactggaattcactaagtaccctt

SEQ ID NO: 750213 - DNA, 25 bp, Mus musculus
taactggaattctctaagtaccctt

SEQ ID NO: 750214 - DNA, 25 bp, Mus musculus
taactggaccacattcgttctggga

SEQ ID NO: 750215 - DNA, 25 bp, Mus musculus
taactggaccactttcgttctggga

SEQ ID NO: 750216 - DNA, 25 bp, Mus musculus
taactggagtgtcactcacccttga

SEQ ID NO: 750217 - DNA, 25 bp, Mus musculus
taactggagtgtgactcacccttga

SEQ ID NO: 750218 - DNA, 25 bp, Mus musculus
taactggagttgaccgctctggctg

SEQ ID NO: 750219 - DNA, 25 bp, Mus musculus
taactggagttgtccgctctggctg

SEQ ID NO: 750220 - DNA, 25 bp, Mus musculus
taactggattagcaaaccaaggagg

SEQ ID NO: 750221 - DNA, 25 bp, Mus musculus
taactggattaggaaaccaaggagg

SEQ ID NO: 750222 - DNA, 25 bp, Mus musculus
taactggcatttataatcatgacac

SEQ ID NO: 750223 - DNA, 25 bp, Mus musculus
taactggcatttttaatcatgacac

SEQ ID NO: 750224 - DNA, 25 bp, Mus musculus
taactggcctggcttcttatcttca

SEQ ID NO: 750225 - DNA, 25 bp, Mus musculus
taactggcctgggttcttatcttca

SEQ ID NO: 750226 - DNA, 25 bp, Mus musculus
taactggcgtctccattattctcta

SEQ ID NO: 750227 - DNA, 25 bp, Mus musculus
taactggcgtctgcattattctcta

SEQ ID NO: 750228 - DNA, 25 bp, Mus musculus
taactggctggcatgcaccagtgtc

SEQ ID NO: 750229 - DNA, 25 bp, Mus musculus
taactggctggcttgcaccagtgtc

SEQ ID NO: 750230 - DNA, 25 bp, Mus musculus
taactggcttctaagaagacaccca

SEQ ID NO: 750231 - DNA, 25 bp, Mus musculus
taactggcttcttagaagacaccca

SEQ ID NO: 750232 - DNA, 25 bp, Mus musculus
taactgggaactaaaactctaggtg

SEQ ID NO: 750233 - DNA, 25 bp, Mus musculus
taactgggaacttaaactctaggtg

SEQ ID NO: 750234 - DNA, 25 bp, Mus musculus
taactgggacctactaattaactgg

SEQ ID NO: 750235 - DNA, 25 bp, Mus musculus
taactgggaccttctaattaactgg

SEQ ID NO: 750236 - DNA, 25 bp, Mus musculus
taactgggactaatgcaggcatcat

SEQ ID NO: 750237 - DNA, 25 bp, Mus musculus
taactgggactattgcaggcatcat

SEQ ID NO: 750238 - DNA, 25 bp, Mus musculus
taactgggccttactcgtggtgttc

SEQ ID NO: 750239 - DNA, 25 bp, Mus musculus
taactgggcctttctcgtggtgttc

SEQ ID NO: 750240 - DNA, 25 bp, Mus musculus
taactggggagacatacgggatttc

SEQ ID NO: 750241 - DNA, 25 bp, Mus musculus
taactggggagagatacgggatttc

SEQ ID NO: 750242 - DNA, 25 bp, Mus musculus
taactgggttaacgtgtagctcggt

SEQ ID NO: 750243 - DNA, 25 bp, Mus musculus
taactgggttaaggtgtagctcggt

SEQ ID NO: 750244 - DNA, 25 bp, Mus musculus
taactggtaatcagtaagacaacac

SEQ ID NO: 750245 - DNA, 25 bp, Mus musculus
taactggtaatctgtaagacaacac

SEQ ID NO: 750246 - DNA, 25 bp, Mus musculus
taactggtacggacatgggcttgga

SEQ ID NO: 750247 - DNA, 25 bp, Mus musculus
taactggtacggtcatgggcttgga

SEQ ID NO: 750248 - DNA, 25 bp, Mus musculus
taactggtcacgcttggcctactgt

SEQ ID NO: 750249 - DNA, 25 bp, Mus musculus
taactggtcacggttggcctactgt

SEQ ID NO: 750250 - DNA, 25 bp, Mus musculus
taactggtcactaaggtcttccctt

SEQ ID NO: 750251 - DNA, 25 bp, Mus musculus
taactggtcacttaggtcttccctt

SEQ ID NO: 750252 - DNA, 25 bp, Mus musculus
taactggtccacagggccacagggt

SEQ ID NO: 750253 - DNA, 25 bp, Mus musculus
taactggtccactgggccacagggt

SEQ ID NO: 750254 - DNA, 25 bp, Mus musculus
taactggtctacagtttttcaggag

SEQ ID NO: 750255 - DNA, 25 bp, Mus musculus
taactggtctactgtttttcaggag

SEQ ID NO: 750256 - DNA, 25 bp, Mus musculus
taactggtgcttcggcctcgagctg

SEQ ID NO: 750257 - DNA, 25 bp, Mus musculus
taactggtgcttgggcctcgagctg

SEQ ID NO: 750258 - DNA, 25 bp, Mus musculus
taactggtgggtacgctgccctgac

SEQ ID NO: 750259 - DNA, 25 bp, Mus musculus
taactggtgggttcgctgccctgac

SEQ ID NO: 750260 - DNA, 25 bp, Mus musculus
taactggtggttactgtgcctctca

SEQ ID NO: 750261 - DNA, 25 bp, Mus musculus
taactggtggtttctgtgcctctca

SEQ ID NO: 750262 - DNA, 25 bp, Mus musculus
taactggttcacacgaatgtttgct

SEQ ID NO: 750263 - DNA, 25 bp, Mus musculus
taactggttcactcgaatgtttgct

SEQ ID NO: 750264 - DNA, 25 bp, Mus musculus
taactggtttagacttgtttattag

SEQ ID NO: 750265 - DNA, 25 bp, Mus musculus
taactggtttagtcttgtttattag

SEQ ID NO: 750266 - DNA, 25 bp, Mus musculus
taactggtttccctcaagatgcact

SEQ ID NO: 750267 - DNA, 25 bp, Mus musculus
taactggtttccgtcaagatgcact

SEQ ID NO: 750268 - DNA, 25 bp, Mus musculus
taactgtaaccaactgccaatcgag

SEQ ID NO: 750269 - DNA, 25 bp, Mus musculus
taactgtaaccatctgccaatcgag

SEQ ID NO: 750270 - DNA, 25 bp, Mus musculus
taactgtaacctatttgggacatgt

SEQ ID NO: 750271 - DNA, 25 bp, Mus musculus
taactgtaacctttttgggacatgt

SEQ ID NO: 750272 - DNA, 25 bp, Mus musculus
taactgtaactgatgccacctgcat

SEQ ID NO: 750273 - DNA, 25 bp, Mus musculus
taactgtaactgttgccacctgcat

SEQ ID NO: 750274 - DNA, 25 bp, Mus musculus
taactgtaatttcgcctccttacct

SEQ ID NO: 750275 - DNA, 25 bp, Mus musculus
taactgtaatttggcctccttacct

SEQ ID NO: 750276 - DNA, 25 bp, Mus musculus
taactgtacagaaggccgtgggtgc

SEQ ID NO: 750277 - DNA, 25 bp, Mus musculus
taactgtacagatggccgtgggtgc

SEQ ID NO: 750278 - DNA, 25 bp, Mus musculus
taactgtacattaccttccccttat

SEQ ID NO: 750279 - DNA, 25 bp, Mus musculus
taactgtacatttccttccccttat

SEQ ID NO: 750280 - DNA, 25 bp, Mus musculus
taactgtacgggagcttaactttat

SEQ ID NO: 750281 - DNA, 25 bp, Mus musculus
taactgtacgggtgcttaactttat

SEQ ID NO: 750282 - DNA, 25 bp, Mus musculus
taactgtacgttaccggaatgcggc

SEQ ID NO: 750283 - DNA, 25 bp, Mus musculus
taactgtacgtttccggaatgcggc

SEQ ID NO: 750284 - DNA, 25 bp, Mus musculus
taactgtagcgcatcattatactat

SEQ ID NO: 750285 - DNA, 25 bp, Mus musculus
taactgtagcgcttcattatactat

SEQ ID NO: 750286 - DNA, 25 bp, Mus musculus
taactgtcacttatacttgcccaat

SEQ ID NO: 750287 - DNA, 25 bp, Mus musculus
taactgtcacttttacttgcccaat

SEQ ID NO: 750288 - DNA, 25 bp, Mus musculus
taactgtcaggaacagacctgtctc

SEQ ID NO: 750289 - DNA, 25 bp, Mus musculus
taactgtcaggatcagacctgtctc

SEQ ID NO: 750290 - DNA, 25 bp, Mus musculus
taactgtccagcaagcccttgatga

SEQ ID NO: 750291 - DNA, 25 bp, Mus musculus
taactgtccagctagcccttgatga

SEQ ID NO: 750292 - DNA, 25 bp, Mus musculus
taactgtccggcacttgaagaggct

SEQ ID NO: 750293 - DNA, 25 bp, Mus musculus
taactgtccggctcttgaagaggct

SEQ ID NO: 750294 - DNA, 25 bp, Mus musculus
taactgtcgtctatggctttttggc

SEQ ID NO: 750295 - DNA, 25 bp, Mus musculus
taactgtcgtctttggctttttggc

SEQ ID NO: 750296 - DNA, 25 bp, Mus musculus
taactgtctaatccccaatcacagg

SEQ ID NO: 750297 - DNA, 25 bp, Mus musculus
taactgtctaatgcccaatcacagg

SEQ ID NO: 750298 - DNA, 25 bp, Mus musculus
taactgtctaccagcacaccatttt

SEQ ID NO: 750299 - DNA, 25 bp, Mus musculus
taactgtctacctgcacaccatttt

SEQ ID NO: 750300 - DNA, 25 bp, Mus musculus
taactgtctgagcttgtgttgcgcc

SEQ ID NO: 750301 - DNA, 25 bp, Mus musculus
taactgtctgaggttgtgttgcgcc

SEQ ID NO: 750302 - DNA, 25 bp, Mus musculus
taactgtgagtcattcctcggtttt

SEQ ID NO: 750303 - DNA, 25 bp, Mus musculus
taactgtgagtctttcctcggtttt

SEQ ID NO: 750304 - DNA, 25 bp, Mus musculus
taactgtgatatagctaccttccca

SEQ ID NO: 750305 - DNA, 25 bp, Mus musculus
taactgtgatattgctaccttccca

SEQ ID NO: 750306 - DNA, 25 bp, Mus musculus
taactgtgccaaagagagcatgggt

SEQ ID NO: 750307 - DNA, 25 bp, Mus musculus
taactgtgccaatgagagcatgggt

SEQ ID NO: 750308 - DNA, 25 bp, Mus musculus
taactgtgcgcacggctctgagaac

SEQ ID NO: 750309 - DNA, 25 bp, Mus musculus
taactgtgcgcagggctctgagaac

SEQ ID NO: 750310 - DNA, 25 bp, Mus musculus
taactgtggccaacaggtgctgcat

SEQ ID NO: 750311 - DNA, 25 bp, Mus musculus
taactgtggccatcaggtgctgcat

SEQ ID NO: 750312 - DNA, 25 bp, Mus musculus
taactgtgggtgctacccagacgcc

SEQ ID NO: 750313 - DNA, 25 bp, Mus musculus
taactgtgggtggtacccagacgcc

SEQ ID NO: 750314 - DNA, 25 bp, Mus musculus
taactgtgtcaaaatggtagatcaa

SEQ ID NO: 750315 - DNA, 25 bp, Mus musculus
taactgtgtcaatatggtagatcaa

SEQ ID NO: 750316 - DNA, 25 bp, Mus musculus
taactgtgtctgaaggacgtggtca

SEQ ID NO: 750317 - DNA, 25 bp, Mus musculus
taactgtgtctgaagtcgtgatgaa

SEQ ID NO: 750318 - DNA, 25 bp, Mus musculus
taactgtgtctgtaggacgtggtca

SEQ ID NO: 750319 - DNA, 25 bp, Mus musculus
taactgtgtctgtagtcgtgatgaa

SEQ ID NO: 750320 - DNA, 25 bp, Mus musculus
taactgtgtgttatccctataaatt

SEQ ID NO: 750321 - DNA, 25 bp, Mus musculus
taactgtgtgttttccctataaatt

SEQ ID NO: 750322 - DNA, 25 bp, Mus musculus
taactgtgttgacggactctgctcc

SEQ ID NO: 750323 - DNA, 25 bp, Mus musculus
taactgtgttgagggactctgctcc

SEQ ID NO: 750324 - DNA, 25 bp, Mus musculus
taactgttaaacacgcttccctaag

SEQ ID NO: 750325 - DNA, 25 bp, Mus musculus
taactgttaaactcgcttccctaag

SEQ ID NO: 750326 - DNA, 25 bp, Mus musculus
taactgttaagtactgtgcttccaa

SEQ ID NO: 750327 - DNA, 25 bp, Mus musculus
taactgttaagttctgtgcttccaa

SEQ ID NO: 750328 - DNA, 25 bp, Mus musculus
taactgttatcaccgcgcttgtgac

SEQ ID NO: 750329 - DNA, 25 bp, Mus musculus
taactgttatcagcgcgcttgtgac

SEQ ID NO: 750330 - DNA, 25 bp, Mus musculus
taactgttatttctttgctcttttg

SEQ ID NO: 750331 - DNA, 25 bp, Mus musculus
taactgttatttgtttgctcttttg

SEQ ID NO: 750332 - DNA, 25 bp, Mus musculus
taactgttcctcagtggtctctgat

SEQ ID NO: 750333 - DNA, 25 bp, Mus musculus
taactgttcctctgtggtctctgat

SEQ ID NO: 750334 - DNA, 25 bp, Mus musculus
taactgttctccctcagttgcgatg

SEQ ID NO: 750335 - DNA, 25 bp, Mus musculus
taactgttctccgtcagttgcgatg

SEQ ID NO: 750336 - DNA, 20 bp, Mus musculus
taactgttgcatgcctacat

SEQ ID NO: 750337 - DNA, 20 bp, Mus musculus
taactgttgcctgcctacat

SEQ ID NO: 750338 - DNA, 20 bp, Mus musculus
taactgttgcgtgcctacat

SEQ ID NO: 750339 - DNA, 20 bp, Mus musculus
taactgttgcttgcctacat

SEQ ID NO: 750340 - DNA, 25 bp, Mus musculus
taactgttggacatgagccctcaaa

SEQ ID NO: 750341 - DNA, 25 bp, Mus musculus
taactgttggacttgagccctcaaa

SEQ ID NO: 750342 - DNA, 25 bp, Mus musculus
taactgttgtaccttaaagccgaga

SEQ ID NO: 750343 - DNA, 25 bp, Mus musculus
taactgttgtacgttaaagccgaga

SEQ ID NO: 750344 - DNA, 25 bp, Mus musculus
taactgtttcagagtcccgctggta

SEQ ID NO: 750345 - DNA, 25 bp, Mus musculus
taactgtttcagtgtcccgctggta

SEQ ID NO: 750346 - DNA, 25 bp, Mus musculus
taacttaaagtcacctccttgatcc

SEQ ID NO: 750347 - DNA, 25 bp, Mus musculus
taacttaaagtctcctccttgatcc

SEQ ID NO: 750348 - DNA, 25 bp, Mus musculus
taacttaaatccagcctcctttatt

SEQ ID NO: 750349 - DNA, 25 bp, Mus musculus
taacttaaatcctgcctcctttatt

SEQ ID NO: 750350 - DNA, 25 bp, Mus musculus
taacttaaatgtagagcccgtcctc

SEQ ID NO: 750351 - DNA, 25 bp, Mus musculus
taacttaaatgttgagcccgtcctc

SEQ ID NO: 750352 - DNA, 25 bp, Mus musculus
taacttaacacaccacatccaggtc

SEQ ID NO: 750353 - DNA, 25 bp, Mus musculus
taacttaacacagcacatccaggtc

SEQ ID NO: 750354 - DNA, 25 bp, Mus musculus
taacttaactagagcctaacatgac

SEQ ID NO: 750355 - DNA, 25 bp, Mus musculus
taacttaactagtgcctaacatgac

SEQ ID NO: 750356 - DNA, 25 bp, Mus musculus
taacttaatcggctgcataatcggg

SEQ ID NO: 750357 - DNA, 25 bp, Mus musculus
taacttaatcgggtgcataatcggg

SEQ ID NO: 750358 - DNA, 25 bp, Mus musculus
taacttacacccaaagtgcccctga

SEQ ID NO: 750359 - DNA, 25 bp, Mus musculus
taacttacaccctaagtgcccctga

SEQ ID NO: 750360 - DNA, 25 bp, Mus musculus
taacttacacctcatctgcttagag

SEQ ID NO: 750361 - DNA, 25 bp, Mus musculus
taacttacacctgatctgcttagag

SEQ ID NO: 750362 - DNA, 25 bp, Mus musculus
taacttacattgcttcaggcttccc

SEQ ID NO: 750363 - DNA, 25 bp, Mus musculus
taacttacattggttcaggcttccc

SEQ ID NO: 750364 - DNA, 25 bp, Mus musculus
taacttacccaaacacagtgctgag

SEQ ID NO: 750365 - DNA, 25 bp, Mus musculus
taacttacccaatcacagtgctgag

SEQ ID NO: 750366 - DNA, 25 bp, Mus musculus
taacttaccgggactagctccttgg

SEQ ID NO: 750367 - DNA, 25 bp, Mus musculus
taacttaccgggtctagctccttgg

SEQ ID NO: 750368 - DNA, 25 bp, Mus musculus
taacttacctaaaatggattgtctt

SEQ ID NO: 750369 - DNA, 25 bp, Mus musculus
taacttacctaatatggattgtctt

SEQ ID NO: 750370 - DNA, 25 bp, Mus musculus
taacttactgacacagagagcacag

SEQ ID NO: 750371 - DNA, 25 bp, Mus musculus
taacttactgactcagagagcacag

SEQ ID NO: 750372 - DNA, 25 bp, Mus musculus
taacttacttgaatgctggttcccc

SEQ ID NO: 750373 - DNA, 25 bp, Mus musculus
taacttacttgattgctggttcccc

SEQ ID NO: 750374 - DNA, 25 bp, Mus musculus
taacttagctctcttgtctggcctt

SEQ ID NO: 750375 - DNA, 25 bp, Mus musculus
taacttagctctgttgtctggcctt

SEQ ID NO: 750376 - DNA, 25 bp, Mus musculus
taacttagctgaaaacatgaccaca

SEQ ID NO: 750377 - DNA, 25 bp, Mus musculus
taacttagctgataacatgaccaca

SEQ ID NO: 750378 - DNA, 25 bp, Mus musculus
taacttagtctaatgggccacgtat

SEQ ID NO: 750379 - DNA, 25 bp, Mus musculus
taacttagtctattgggccacgtat

SEQ ID NO: 750380 - DNA, 25 bp, Mus musculus
taacttagttggcagctgcttgtct

SEQ ID NO: 750381 - DNA, 25 bp, Mus musculus
taacttagttgggagctgcttgtct

SEQ ID NO: 750382 - DNA, 25 bp, Mus musculus
taacttagttttccatgatgctgcc

SEQ ID NO: 750383 - DNA, 25 bp, Mus musculus
taacttagttttgcatgatgctgcc

SEQ ID NO: 750384 - DNA, 25 bp, Mus musculus
taacttatctgacccctagatcctc

SEQ ID NO: 750385 - DNA, 25 bp, Mus musculus
taacttatctgagccctagatcctc

SEQ ID NO: 750386 - DNA, 25 bp, Mus musculus
taacttatgctaatgaacttcacta

SEQ ID NO: 750387 - DNA, 25 bp, Mus musculus
taacttatgctattgaacttcacta

SEQ ID NO: 750388 - DNA, 25 bp, Mus musculus
taacttattcgtattgttcctgtct

SEQ ID NO: 750389 - DNA, 25 bp, Mus musculus
taacttattcgttttgttcctgtct

SEQ ID NO: 750390 - DNA, 25 bp, Mus musculus
taacttcaatttaatacccactagt

SEQ ID NO: 750391 - DNA, 25 bp, Mus musculus
taacttcaattttatacccactagt

SEQ ID NO: 750392 - DNA, 25 bp, Mus musculus
taacttcaccgacagtagctacaaa

SEQ ID NO: 750393 - DNA, 25 bp, Mus musculus
taacttcaccgagagtagctacaaa

SEQ ID NO: 750394 - DNA, 25 bp, Mus musculus
taacttcaccggcatatctgtgaaa

SEQ ID NO: 750395 - DNA, 25 bp, Mus musculus
taacttcaccgggatatctgtgaaa

SEQ ID NO: 750396 - DNA, 25 bp, Mus musculus
taacttcaccttcaaatgccatcga

SEQ ID NO: 750397 - DNA, 25 bp, Mus musculus
taacttcaccttgaaatgccatcga

SEQ ID NO: 750398 - DNA, 25 bp, Mus musculus
taacttcactccagggatgcacctg

SEQ ID NO: 750399 - DNA, 25 bp, Mus musculus
taacttcactcctgggatgcacctg

SEQ ID NO: 750400 - DNA, 25 bp, Mus musculus
taacttcagattagtaccctttctt

SEQ ID NO: 750401 - DNA, 25 bp, Mus musculus
taacttcagatttgtaccctttctt

SEQ ID NO: 750402 - DNA, 25 bp, Mus musculus
taacttcagcaaacattccacaggg

SEQ ID NO: 750403 - DNA, 25 bp, Mus musculus
taacttcagcaatcattccacaggg

SEQ ID NO: 750404 - DNA, 25 bp, Mus musculus
taacttcagcacaccataactctca

SEQ ID NO: 750405 - DNA, 25 bp, Mus musculus
taacttcagcactccataactctca

SEQ ID NO: 750406 - DNA, 25 bp, Mus musculus
taacttcaggccactgcaaaggagc

SEQ ID NO: 750407 - DNA, 25 bp, Mus musculus
taacttcaggcctctgcaaaggagc

SEQ ID NO: 750408 - DNA, 25 bp, Mus musculus
taacttcagtagctcccacctagga

SEQ ID NO: 750409 - DNA, 25 bp, Mus musculus
taacttcagtaggtcccacctagga

SEQ ID NO: 750410 - DNA, 25 bp, Mus musculus
taacttcagtgcactctgctagaac

SEQ ID NO: 750411 - DNA, 25 bp, Mus musculus
taacttcagtgctctctgctagaac

SEQ ID NO: 750412 - DNA, 25 bp, Mus musculus
taacttcagtgtcatgggctgggct

SEQ ID NO: 750413 - DNA, 25 bp, Mus musculus
taacttcagtgtgatgggctgggct

SEQ ID NO: 750414 - DNA, 25 bp, Mus musculus
taacttcagtttagcttccagcata

SEQ ID NO: 750415 - DNA, 25 bp, Mus musculus
taacttcagttttgcttccagcata

SEQ ID NO: 750416 - DNA, 25 bp, Mus musculus
taacttcatggcagcaaaactctga

SEQ ID NO: 750417 - DNA, 25 bp, Mus musculus
taacttcatggctgcaaaactctga

SEQ ID NO: 750418 - DNA, 25 bp, Mus musculus
taacttcattccaaatgccttgaaa

SEQ ID NO: 750419 - DNA, 25 bp, Mus musculus
taacttcattcctaatgccttgaaa

SEQ ID NO: 750420 - DNA, 25 bp, Mus musculus
taacttccaggtatccactgaaact

SEQ ID NO: 750421 - DNA, 25 bp, Mus musculus
taacttccaggtttccactgaaact

SEQ ID NO: 750422 - DNA, 25 bp, Mus musculus
taacttcccaatctttagcttggtt

SEQ ID NO: 750423 - DNA, 25 bp, Mus musculus
taacttcccaatgtttagcttggtt

SEQ ID NO: 750424 - DNA, 25 bp, Mus musculus
taacttcccataaccgcacttgata

SEQ ID NO: 750425 - DNA, 25 bp, Mus musculus
taacttcccatatccgcacttgata

SEQ ID NO: 750426 - DNA, 25 bp, Mus musculus
taacttcccatcaggttagctgttg

SEQ ID NO: 750427 - DNA, 25 bp, Mus musculus
taacttcccatctggttagctgttg

SEQ ID NO: 750428 - DNA, 25 bp, Mus musculus
taacttcccggtactttctgagcag

SEQ ID NO: 750429 - DNA, 25 bp, Mus musculus
taacttcccggttctttctgagcag

SEQ ID NO: 750430 - DNA, 25 bp, Mus musculus
taacttcccgttcgtggtccattca

SEQ ID NO: 750431 - DNA, 25 bp, Mus musculus
taacttcccgttggtggtccattca

SEQ ID NO: 750432 - DNA, 25 bp, Mus musculus
taacttccctgaaaacacacaccaa

SEQ ID NO: 750433 - DNA, 25 bp, Mus musculus
taacttccctgataacacacaccaa

SEQ ID NO: 750434 - DNA, 25 bp, Mus musculus
taacttcctactatatctcttcatg

SEQ ID NO: 750435 - DNA, 25 bp, Mus musculus
taacttcctactttatctcttcatg

SEQ ID NO: 750436 - DNA, 25 bp, Mus musculus
taacttcctcacagattatcaatgt

SEQ ID NO: 750437 - DNA, 25 bp, Mus musculus
taacttcctcactgattatcaatgt

SEQ ID NO: 750438 - DNA, 25 bp, Mus musculus
taacttcctcagccctccatggtaa

SEQ ID NO: 750439 - DNA, 25 bp, Mus musculus
taacttcctcaggcctccatggtaa

SEQ ID NO: 750440 - DNA, 25 bp, Mus musculus
taacttcctcttatgctactttagt

SEQ ID NO: 750441 - DNA, 25 bp, Mus musculus
taacttcctcttttgctactttagt

SEQ ID NO: 750442 - DNA, 25 bp, Mus musculus
taacttcctgagagcctggcttatt

SEQ ID NO: 750443 - DNA, 25 bp, Mus musculus
taacttcctgagtgcctggcttatt

SEQ ID NO: 750444 - DNA, 25 bp, Mus musculus
taacttcctgcacctatggtgaatg

SEQ ID NO: 750445 - DNA, 25 bp, Mus musculus
taacttcctgcacctgtgttcctaa

SEQ ID NO: 750446 - DNA, 25 bp, Mus musculus
taacttcctgcagctatggtgaatg

SEQ ID NO: 750447 - DNA, 25 bp, Mus musculus
taacttcctgcagctgtgttcctaa

SEQ ID NO: 750448 - DNA, 25 bp, Mus musculus
taacttccttaactctaccactgac

SEQ ID NO: 750449 - DNA, 25 bp, Mus musculus
taacttccttaagtctaccactgac

SEQ ID NO: 750450 - DNA, 25 bp, Mus musculus
taacttcgctgccttcatcgacatc

SEQ ID NO: 750451 - DNA, 25 bp, Mus musculus
taacttcgctgcgttcatcgacatc

SEQ ID NO: 750452 - DNA, 25 bp, Mus musculus
taacttcggttccagaggatctcct

SEQ ID NO: 750453 - DNA, 25 bp, Mus musculus
taacttcggttcgagaggatctcct

SEQ ID NO: 750454 - DNA, 25 bp, Mus musculus
taacttcgtgtactgttgtaacctt

SEQ ID NO: 750455 - DNA, 25 bp, Mus musculus
taacttcgtgtagtgttgtaacctt

SEQ ID NO: 750456 - DNA, 25 bp, Mus musculus
taacttctactactcaaactcttcc

SEQ ID NO: 750457 - DNA, 25 bp, Mus musculus
taacttctactagtcaaactcttcc

SEQ ID NO: 750458 - DNA, 25 bp, Mus musculus
taacttctagatctgctgctttgag

SEQ ID NO: 750459 - DNA, 25 bp, Mus musculus
taacttctagatgtgctgctttgag

SEQ ID NO: 750460 - DNA, 25 bp, Mus musculus
taacttctagccctactggtcagga

SEQ ID NO: 750461 - DNA, 25 bp, Mus musculus
taacttctagccgtactggtcagga

SEQ ID NO: 750462 - DNA, 25 bp, Mus musculus
taacttctagctcgattctttcttt

SEQ ID NO: 750463 - DNA, 25 bp, Mus musculus
taacttctagctctaacttcttgga

SEQ ID NO: 750464 - DNA, 25 bp, Mus musculus
taacttctagctggattctttcttt

SEQ ID NO: 750465 - DNA, 25 bp, Mus musculus
taacttctagctgtaacttcttgga

SEQ ID NO: 750466 - DNA, 25 bp, Mus musculus
taacttctatctcacttctcatctg

SEQ ID NO: 750467 - DNA, 25 bp, Mus musculus
taacttctatctgacttctcatctg

SEQ ID NO: 750468 - DNA, 25 bp, Mus musculus
taacttctcaagaacattgtagtag

SEQ ID NO: 750469 - DNA, 25 bp, Mus musculus
taacttctcaagtacattgtagtag

SEQ ID NO: 750470 - DNA, 25 bp, Mus musculus
taacttctctgcatctatatcagga

SEQ ID NO: 750471 - DNA, 25 bp, Mus musculus
taacttctctgcttctatatcagga

SEQ ID NO: 750472 - DNA, 25 bp, Mus musculus
taacttctgacaccagcgcgtgtgc

SEQ ID NO: 750473 - DNA, 25 bp, Mus musculus
taacttctgacagcagcgcgtgtgc

SEQ ID NO: 750474 - DNA, 25 bp, Mus musculus
taacttctgatacttcctacactgt

SEQ ID NO: 750475 - DNA, 25 bp, Mus musculus
taacttctgatagttcctacactgt

SEQ ID NO: 750476 - DNA, 25 bp, Mus musculus
taacttctgctcactggtttctttc

SEQ ID NO: 750477 - DNA, 25 bp, Mus musculus
taacttctgctctctggtttctttc

SEQ ID NO: 750478 - DNA, 25 bp, Mus musculus
taacttctgtatatactgcaccgaa

SEQ ID NO: 750479 - DNA, 25 bp, Mus musculus
taacttctgtatttactgcaccgaa

SEQ ID NO: 750480 - DNA, 25 bp, Mus musculus
taacttctgtgcaggcagacacaca

SEQ ID NO: 750481 - DNA, 25 bp, Mus musculus
taacttctgtgcctggcaacctgga

SEQ ID NO: 750482 - DNA, 25 bp, Mus musculus
taacttctgtgcgtggcaacctgga

SEQ ID NO: 750483 - DNA, 25 bp, Mus musculus
taacttctgtgctggcagacacaca

SEQ ID NO: 750484 - DNA, 25 bp, Mus musculus
taacttcttaataccaagctcaggg

SEQ ID NO: 750485 - DNA, 25 bp, Mus musculus
taacttcttaattccaagctcaggg

SEQ ID NO: 750486 - DNA, 25 bp, Mus musculus
taacttcttattcacactaccctct

SEQ ID NO: 750487 - DNA, 25 bp, Mus musculus
taacttcttattgacactaccctct

SEQ ID NO: 750488 - DNA, 25 bp, Mus musculus
taacttcttccaaatgttaacactt

SEQ ID NO: 750489 - DNA, 25 bp, Mus musculus
taacttcttccatatgttaacactt

SEQ ID NO: 750490 - DNA, 25 bp, Mus musculus
taacttcttggcctgtacatctgac

SEQ ID NO: 750491 - DNA, 25 bp, Mus musculus
taacttcttggcgtgtacatctgac

SEQ ID NO: 750492 - DNA, 25 bp, Mus musculus
taacttcttgtcattccctccatag

SEQ ID NO: 750493 - DNA, 25 bp, Mus musculus
taacttcttgtctttccctccatag

SEQ ID NO: 750494 - DNA, 25 bp, Mus musculus
taacttcttgttacgattcagggaa

SEQ ID NO: 750495 - DNA, 25 bp, Mus musculus
taacttcttgtttcgattcagggaa

SEQ ID NO: 750496 - DNA, 25 bp, Mus musculus
taacttctttggctcagtgcagtgt

SEQ ID NO: 750497 - DNA, 25 bp, Mus musculus
taacttctttgggtcagtgcagtgt

SEQ ID NO: 750498 - DNA, 25 bp, Mus musculus
taacttgaaacaacagccagtgcct

SEQ ID NO: 750499 - DNA, 25 bp, Mus musculus
taacttgaaacatcagccagtgcct

SEQ ID NO: 750500 - DNA, 25 bp, Mus musculus
taacttgaacaacctgagcagcccg

SEQ ID NO: 750501 - DNA, 25 bp, Mus musculus
taacttgaacaagctgagcagcccg

SEQ ID NO: 750502 - DNA, 25 bp, Mus musculus
taacttgacaggactaggcacccct

SEQ ID NO: 750503 - DNA, 25 bp, Mus musculus
taacttgacaggtctaggcacccct

SEQ ID NO: 750504 - DNA, 25 bp, Mus musculus
taacttgacagtatgtgtcacaaac

SEQ ID NO: 750505 - DNA, 25 bp, Mus musculus
taacttgacagtttgtgtcacaaac

SEQ ID NO: 750506 - DNA, 25 bp, Mus musculus
taacttgaccatctcccaggagtgc

SEQ ID NO: 750507 - DNA, 25 bp, Mus musculus
taacttgaccatgtcccaggagtgc

SEQ ID NO: 750508 - DNA, 25 bp, Mus musculus
taacttgacccacagcgttctcata

SEQ ID NO: 750509 - DNA, 25 bp, Mus musculus
taacttgacccagagcgttctcata

SEQ ID NO: 750510 - DNA, 25 bp, Mus musculus
taacttgagaacctcctggtggcac

SEQ ID NO: 750511 - DNA, 25 bp, Mus musculus
taacttgagaacgtcctggtggcac

SEQ ID NO: 750512 - DNA, 25 bp, Mus musculus
taacttgagcttatgatcattagaa

SEQ ID NO: 750513 - DNA, 25 bp, Mus musculus
taacttgagcttttgatcattagaa

SEQ ID NO: 750514 - DNA, 25 bp, Mus musculus
taacttgatctcagctattcacaga

SEQ ID NO: 750515 - DNA, 25 bp, Mus musculus
taacttgatctctgctattcacaga

SEQ ID NO: 750516 - DNA, 25 bp, Mus musculus
taacttgatgctaccagtgtttcct

SEQ ID NO: 750517 - DNA, 25 bp, Mus musculus
taacttgatgcttccagtgtttcct

SEQ ID NO: 750518 - DNA, 25 bp, Mus musculus
taacttgattaacttctgccatgaa

SEQ ID NO: 750519 - DNA, 25 bp, Mus musculus
taacttgattaagttctgccatgaa

SEQ ID NO: 750520 - DNA, 25 bp, Mus musculus
taacttgcaccacaaacacgatttg

SEQ ID NO: 750521 - DNA, 25 bp, Mus musculus
taacttgcaccagaaacacgatttg

SEQ ID NO: 750522 - DNA, 25 bp, Mus musculus
taacttgcagatcgttgacctgacc

SEQ ID NO: 750523 - DNA, 25 bp, Mus musculus
taacttgcagatggttgacctgacc

SEQ ID NO: 750524 - DNA, 25 bp, Mus musculus
taacttgccattatccatcccaata

SEQ ID NO: 750525 - DNA, 25 bp, Mus musculus
taacttgccattttccatcccaata

SEQ ID NO: 750526 - DNA, 25 bp, Mus musculus
taacttgcccttcgcatgggtcctg

SEQ ID NO: 750527 - DNA, 25 bp, Mus musculus
taacttgcccttggcatgggtcctg

SEQ ID NO: 750528 - DNA, 25 bp, Mus musculus
taacttgcctacaacgcacattgtc

SEQ ID NO: 750529 - DNA, 25 bp, Mus musculus
taacttgcctactacgcacattgtc

SEQ ID NO: 750530 - DNA, 25 bp, Mus musculus
taacttgcctgtagccgcaatgttt

SEQ ID NO: 750531 - DNA, 25 bp, Mus musculus
taacttgcctgttgccgcaatgttt

SEQ ID NO: 750532 - DNA, 25 bp, Mus musculus
taacttgctaaactcgatgggctta

SEQ ID NO: 750533 - DNA, 25 bp, Mus musculus
taacttgctaaagtcgatgggctta

SEQ ID NO: 750534 - DNA, 25 bp, Mus musculus
taacttgctgataacatgacttatg

SEQ ID NO: 750535 - DNA, 25 bp, Mus musculus
taacttgctgatattgtggtgctgt

SEQ ID NO: 750536 - DNA, 25 bp, Mus musculus
taacttgctgattacatgacttatg

SEQ ID NO: 750537 - DNA, 25 bp, Mus musculus
taacttgctgattttgtggtgctgt

SEQ ID NO: 750538 - DNA, 25 bp, Mus musculus
taacttgctttacgcattctctttc

SEQ ID NO: 750539 - DNA, 25 bp, Mus musculus
taacttgctttaggcattctctttc

SEQ ID NO: 750540 - DNA, 25 bp, Mus musculus
taacttggaaagagcacccctcagg

SEQ ID NO: 750541 - DNA, 25 bp, Mus musculus
taacttggaaagtgcacccctcagg

SEQ ID NO: 750542 - DNA, 25 bp, Mus musculus
taacttggataacttccccgactgg

SEQ ID NO: 750543 - DNA, 25 bp, Mus musculus
taacttggataagttccccgactgg

SEQ ID NO: 750544 - DNA, 25 bp, Mus musculus
taacttggatgcataccctcagaga

SEQ ID NO: 750545 - DNA, 25 bp, Mus musculus
taacttggatgcttaccctcagaga

SEQ ID NO: 750546 - DNA, 25 bp, Mus musculus
taacttggcattcctactgcctgtt

SEQ ID NO: 750547 - DNA, 25 bp, Mus musculus
taacttggcattgctactgcctgtt

SEQ ID NO: 750548 - DNA, 25 bp, Mus musculus
taacttggccatctaaactctttaa

SEQ ID NO: 750549 - DNA, 25 bp, Mus musculus
taacttggccatgtaaactctttaa

SEQ ID NO: 750550 - DNA, 25 bp, Mus musculus
taacttggccgacctggcagagctt

SEQ ID NO: 750551 - DNA, 25 bp, Mus musculus
taacttggccgagctggcagagctt

SEQ ID NO: 750552 - DNA, 25 bp, Mus musculus
taacttggcgcgcttgggcataacc

SEQ ID NO: 750553 - DNA, 25 bp, Mus musculus
taacttggcgcggttgggcataacc

SEQ ID NO: 750554 - DNA, 25 bp, Mus musculus
taacttgggcctacatttctccagg

SEQ ID NO: 750555 - DNA, 25 bp, Mus musculus
taacttgggccttcatttctccagg

SEQ ID NO: 750556 - DNA, 25 bp, Mus musculus
taacttggtacacctgtggaactcc

SEQ ID NO: 750557 - DNA, 25 bp, Mus musculus
taacttggtacagctgtggaactcc

SEQ ID NO: 750558 - DNA, 25 bp, Mus musculus
taacttggtccaaaagcctcctcca

SEQ ID NO: 750559 - DNA, 25 bp, Mus musculus
taacttggtccataagcctcctcca

SEQ ID NO: 750560 - DNA, 25 bp, Mus musculus
taacttggtccccagattagtaggc

SEQ ID NO: 750561 - DNA, 25 bp, Mus musculus
taacttggtcccgagattagtaggc

SEQ ID NO: 750562 - DNA, 25 bp, Mus musculus
taacttggtgtcagctaggatcctc

SEQ ID NO: 750563 - DNA, 25 bp, Mus musculus
taacttggtgtctgctaggatcctc

SEQ ID NO: 750564 - DNA, 25 bp, Mus musculus
taacttggtttgcatgtcctgttaa

SEQ ID NO: 750565 - DNA, 25 bp, Mus musculus
taacttggtttggatgtcctgttaa

SEQ ID NO: 750566 - DNA, 25 bp, Mus musculus
taacttgtccttacagcaaactgaa

SEQ ID NO: 750567 - DNA, 25 bp, Mus musculus
taacttgtcctttcagcaaactgaa

SEQ ID NO: 750568 - DNA, 25 bp, Mus musculus
taacttgtggaacagaaggcagcat

SEQ ID NO: 750569 - DNA, 25 bp, Mus musculus
taacttgtggaagagaaggcagcat

SEQ ID NO: 750570 - DNA, 25 bp, Mus musculus
taacttgtggttactttgtggttct

SEQ ID NO: 750571 - DNA, 25 bp, Mus musculus
taacttgtggtttctttgtggttct

SEQ ID NO: 750572 - DNA, 25 bp, Mus musculus
taacttgtgtcccatgtatcccagt

SEQ ID NO: 750573 - DNA, 25 bp, Mus musculus
taacttgtgtccgatgtatcccagt

SEQ ID NO: 750574 - DNA, 25 bp, Mus musculus
taacttgttctaactgttcctggcc

SEQ ID NO: 750575 - DNA, 25 bp, Mus musculus
taacttgttctatctgttcctggcc

SEQ ID NO: 750576 - DNA, 25 bp, Mus musculus
taacttgttctgaagtgttccctga

SEQ ID NO: 750577 - DNA, 25 bp, Mus musculus
taacttgttctgtagtgttccctga

SEQ ID NO: 750578 - DNA, 25 bp, Mus musculus
taactttaaggacgccagctgaaac

SEQ ID NO: 750579 - DNA, 25 bp, Mus musculus
taactttaaggaggccagctgaaac

SEQ ID NO: 750580 - DNA, 25 bp, Mus musculus
taactttacactaccttgtgactct

SEQ ID NO: 750581 - DNA, 25 bp, Mus musculus
taactttacacttccttgtgactct

SEQ ID NO: 750582 - DNA, 25 bp, Mus musculus
taactttagacgctgtagatggaca

SEQ ID NO: 750583 - DNA, 25 bp, Mus musculus
taactttagacggtgtagatggaca

SEQ ID NO: 750584 - DNA, 25 bp, Mus musculus
taactttagactatctctgggtctg

SEQ ID NO: 750585 - DNA, 25 bp, Mus musculus
taactttagactttctctgggtctg

SEQ ID NO: 750586 - DNA, 25 bp, Mus musculus
taactttagcacagttgaaacttaa

SEQ ID NO: 750587 - DNA, 25 bp, Mus musculus
taactttagcactgttgaaacttaa

SEQ ID NO: 750588 - DNA, 25 bp, Mus musculus
taactttatagacttccttctggag

SEQ ID NO: 750589 - DNA, 25 bp, Mus musculus
taactttatagagttccttctggag

SEQ ID NO: 750590 - DNA, 25 bp, Mus musculus
taactttcactaacatttgcctttt

SEQ ID NO: 750591 - DNA, 25 bp, Mus musculus
taactttcactatcatttgcctttt

SEQ ID NO: 750592 - DNA, 25 bp, Mus musculus
taactttcaggacttatctttctcc

SEQ ID NO: 750593 - DNA, 25 bp, Mus musculus
taactttcaggagttatctttctcc

SEQ ID NO: 750594 - DNA, 25 bp, Mus musculus
taactttcccataaagtctctcaaa

SEQ ID NO: 750595 - DNA, 25 bp, Mus musculus
taactttcccattaagtctctcaaa

SEQ ID NO: 750596 - DNA, 25 bp, Mus musculus
taactttcgggacattcccctgaca

SEQ ID NO: 750597 - DNA, 25 bp, Mus musculus
taactttcgggagattcccctgaca

SEQ ID NO: 750598 - DNA, 25 bp, Mus musculus
taactttcggtaatccctgtgaacg

SEQ ID NO: 750599 - DNA, 25 bp, Mus musculus
taactttcggtattccctgtgaacg

SEQ ID NO: 750600 - DNA, 25 bp, Mus musculus
taactttcgtccatttttacgtatg

SEQ ID NO: 750601 - DNA, 25 bp, Mus musculus
taactttcgtccttttttacgtatg

SEQ ID NO: 750602 - DNA, 25 bp, Mus musculus
taactttctcctctctgttctaaag

SEQ ID NO: 750603 - DNA, 25 bp, Mus musculus
taactttctcctgtctgttctaaag

SEQ ID NO: 750604 - DNA, 25 bp, Mus musculus
taactttctcttccttaaatacaag

SEQ ID NO: 750605 - DNA, 25 bp, Mus musculus
taactttctcttgcttaaatacaag

SEQ ID NO: 750606 - DNA, 25 bp, Mus musculus
taactttctgaaagtgccaacttaa

SEQ ID NO: 750607 - DNA, 25 bp, Mus musculus
taactttctgaactgtgctctgact

SEQ ID NO: 750608 - DNA, 25 bp, Mus musculus
taactttctgaagtgtgctctgact

SEQ ID NO: 750609 - DNA, 25 bp, Mus musculus
taactttctgaatgtgccaacttaa

SEQ ID NO: 750610 - DNA, 25 bp, Mus musculus
taactttctgctccttgagttgcct

SEQ ID NO: 750611 - DNA, 25 bp, Mus musculus
taactttctgctgcttgagttgcct

SEQ ID NO: 750612 - DNA, 25 bp, Mus musculus
taactttcttaactcctttcgtctg

SEQ ID NO: 750613 - DNA, 25 bp, Mus musculus
taactttcttaagtcctttcgtctg

SEQ ID NO: 750614 - DNA, 25 bp, Mus musculus
taactttcttccatgttgatctacg

SEQ ID NO: 750615 - DNA, 25 bp, Mus musculus
taactttcttccttgttgatctacg

SEQ ID NO: 750616 - DNA, 25 bp, Mus musculus
taactttgaatcattcttttagaga

SEQ ID NO: 750617 - DNA, 25 bp, Mus musculus
taactttgaatctttcttttagaga

SEQ ID NO: 750618 - DNA, 25 bp, Mus musculus
taactttgacatcacaggtcccttc

SEQ ID NO: 750619 - DNA, 25 bp, Mus musculus
taactttgacatgacaggtcccttc

SEQ ID NO: 750620 - DNA, 25 bp, Mus musculus
taactttgagatactgaccccaggt

SEQ ID NO: 750621 - DNA, 25 bp, Mus musculus
taactttgagattctgaccccaggt

SEQ ID NO: 750622 - DNA, 25 bp, Mus musculus
taactttgccacatcaagcctcaag

SEQ ID NO: 750623 - DNA, 25 bp, Mus musculus
taactttgccacttcaagcctcaag

SEQ ID NO: 750624 - DNA, 25 bp, Mus musculus
taactttgccataaatgtcaagact

SEQ ID NO: 750625 - DNA, 25 bp, Mus musculus
taactttgccattaatgtcaagact

SEQ ID NO: 750626 - DNA, 25 bp, Mus musculus
taactttgcctcaggcttacccagg

SEQ ID NO: 750627 - DNA, 25 bp, Mus musculus
taactttgcctctggcttacccagg

SEQ ID NO: 750628 - DNA, 25 bp, Mus musculus
taactttgcggtattggtgttcctg

SEQ ID NO: 750629 - DNA, 25 bp, Mus musculus
taactttgcggttttggtgttcctg

SEQ ID NO: 750630 - DNA, 25 bp, Mus musculus
taactttgctaccaactttcaaccg

SEQ ID NO: 750631 - DNA, 25 bp, Mus musculus
taactttgctacgaactttcaaccg

SEQ ID NO: 750632 - DNA, 25 bp, Mus musculus
taactttggcataggtggtgacagc

SEQ ID NO: 750633 - DNA, 25 bp, Mus musculus
taactttggcattggtggtgacagc

SEQ ID NO: 750634 - DNA, 25 bp, Mus musculus
taactttgtattcctaggtcccagc

SEQ ID NO: 750635 - DNA, 25 bp, Mus musculus
taactttgtattgctaggtcccagc

SEQ ID NO: 750636 - DNA, 25 bp, Mus musculus
taactttgtgtaccccatgtaccta

SEQ ID NO: 750637 - DNA, 25 bp, Mus musculus
taactttgtgtagcccatgtaccta

SEQ ID NO: 750638 - DNA, 25 bp, Mus musculus
taacttttacctcgaagtccgcagg

SEQ ID NO: 750639 - DNA, 25 bp, Mus musculus
taacttttacctggaagtccgcagg

SEQ ID NO: 750640 - DNA, 25 bp, Mus musculus
taacttttatatccctccagcatta

SEQ ID NO: 750641 - DNA, 25 bp, Mus musculus
taacttttatatgcctccagcatta

SEQ ID NO: 750642 - DNA, 25 bp, Mus musculus
taacttttcaaccctatcagtagta

SEQ ID NO: 750643 - DNA, 25 bp, Mus musculus
taacttttcaacgctatcagtagta

SEQ ID NO: 750644 - DNA, 25 bp, Mus musculus
taacttttccagatgggagccgcac

SEQ ID NO: 750645 - DNA, 25 bp, Mus musculus
taacttttccagttgggagccgcac

SEQ ID NO: 750646 - DNA, 25 bp, Mus musculus
taacttttcctgctcacaaggtgct

SEQ ID NO: 750647 - DNA, 25 bp, Mus musculus
taacttttcctggtcacaaggtgct

SEQ ID NO: 750648 - DNA, 25 bp, Mus musculus
taacttttctgaaatccatgccggg

SEQ ID NO: 750649 - DNA, 25 bp, Mus musculus
taacttttctgatatccatgccggg

SEQ ID NO: 750650 - DNA, 25 bp, Mus musculus
taacttttgtacaagtcagcctcct

SEQ ID NO: 750651 - DNA, 25 bp, Mus musculus
taacttttgtactagtcagcctcct

SEQ ID NO: 750652 - DNA, 25 bp, Mus musculus
taacttttgtgcagatttcttctct

SEQ ID NO: 750653 - DNA, 25 bp, Mus musculus
taacttttgtgctgatttcttctct

SEQ ID NO: 750654 - DNA, 25 bp, Mus musculus
taacttttgttaatactttcctgag

SEQ ID NO: 750655 - DNA, 25 bp, Mus musculus
taacttttgttattactttcctgag

SEQ ID NO: 750656 - DNA, 25 bp, Mus musculus
taagaaaaaactcagcccacccagt

SEQ ID NO: 750657 - DNA, 25 bp, Mus musculus
taagaaaaaactgagcccacccagt

SEQ ID NO: 750658 - DNA, 25 bp, Mus musculus
taagaaaacactccaaacctccctg

SEQ ID NO: 750659 - DNA, 25 bp, Mus musculus
taagaaaacactgcaaacctccctg

SEQ ID NO: 750660 - DNA, 25 bp, Mus musculus
taagaaaaccacagcgtgtccgggc

SEQ ID NO: 750661 - DNA, 25 bp, Mus musculus
taagaaaaccactgcgtgtccgggc

SEQ ID NO: 750662 - DNA, 25 bp, Mus musculus
taagaaaacttacagctattgccct

SEQ ID NO: 750663 - DNA, 25 bp, Mus musculus
taagaaaacttagagctattgccct

SEQ ID NO: 750664 - DNA, 25 bp, Mus musculus
taagaaaagttcacaaatcattgct

SEQ ID NO: 750665 - DNA, 25 bp, Mus musculus
taagaaaagttctcaaatcattgct

SEQ ID NO: 750666 - DNA, 25 bp, Mus musculus
taagaaaatgctacgtgccgggtgt

SEQ ID NO: 750667 - DNA, 25 bp, Mus musculus
taagaaaatgcttcgtgccgggtgt

SEQ ID NO: 750668 - DNA, 25 bp, Mus musculus
taagaaacatgcctccactttacag

SEQ ID NO: 750669 - DNA, 25 bp, Mus musculus
taagaaacatgcgtccactttacag

SEQ ID NO: 750670 - DNA, 25 bp, Mus musculus
taagaaacatggaggcccggcggat

SEQ ID NO: 750671 - DNA, 25 bp, Mus musculus
taagaaacatggtggcccggcggat

SEQ ID NO: 750672 - DNA, 25 bp, Mus musculus
taagaaacccctccgtttctctgca

SEQ ID NO: 750673 - DNA, 25 bp, Mus musculus
taagaaacccctgcgtttctctgca

SEQ ID NO: 750674 - DNA, 25 bp, Mus musculus
taagaaacccggactgccaatgtct

SEQ ID NO: 750675 - DNA, 25 bp, Mus musculus
taagaaacccggtctgccaatgtct

SEQ ID NO: 750676 - DNA, 25 bp, Mus musculus
taagaaaccgccatgcccaaggaga

SEQ ID NO: 750677 - DNA, 25 bp, Mus musculus
taagaaaccgccttgcccaaggaga

SEQ ID NO: 750678 - DNA, 25 bp, Mus musculus
taagaaacgctgcaactccatcgct

SEQ ID NO: 750679 - DNA, 25 bp, Mus musculus
taagaaacgctggaactccatcgct

SEQ ID NO: 750680 - DNA, 25 bp, Mus musculus
taagaaactgctaaaccccatccca

SEQ ID NO: 750681 - DNA, 25 bp, Mus musculus
taagaaactgcttaaccccatccca

SEQ ID NO: 750682 - DNA, 25 bp, Mus musculus
taagaaactgtgaccccagtggttt

SEQ ID NO: 750683 - DNA, 25 bp, Mus musculus
taagaaactgtgtccccagtggttt

SEQ ID NO: 750684 - DNA, 25 bp, Mus musculus
taagaaacttcgatgctccccacct

SEQ ID NO: 750685 - DNA, 25 bp, Mus musculus
taagaaacttcgttgctccccacct

SEQ ID NO: 750686 - DNA, 25 bp, Mus musculus
taagaaagaagcattgtttcctttg

SEQ ID NO: 750687 - DNA, 25 bp, Mus musculus
taagaaagaagctttgtttcctttg

SEQ ID NO: 750688 - DNA, 25 bp, Mus musculus
taagaaaggcccagccgccaagaag

SEQ ID NO: 750689 - DNA, 25 bp, Mus musculus
taagaaaggccctgccgccaagaag

SEQ ID NO: 750690 - DNA, 25 bp, Mus musculus
taagaaaggcctctggcgcttgcct

SEQ ID NO: 750691 - DNA, 25 bp, Mus musculus
taagaaaggcctgtggcgcttgcct

SEQ ID NO: 750692 - DNA, 25 bp, Mus musculus
taagaaaggcttctgtctaccccag

SEQ ID NO: 750693 - DNA, 25 bp, Mus musculus
taagaaaggcttgtgtctaccccag

SEQ ID NO: 750694 - DNA, 25 bp, Mus musculus
taagaaagtatacctgctgggaggt

SEQ ID NO: 750695 - DNA, 25 bp, Mus musculus
taagaaagtatagctgctgggaggt

SEQ ID NO: 750696 - DNA, 25 bp, Mus musculus
taagaaagtcctctgcactgagcag

SEQ ID NO: 750697 - DNA, 25 bp, Mus musculus
taagaaagtcctgtgcactgagcag

SEQ ID NO: 750698 - DNA, 25 bp, Mus musculus
taagaaatacgtcccgccacgcttg

SEQ ID NO: 750699 - DNA, 25 bp, Mus musculus
taagaaatacgtgccgccacgcttg

SEQ ID NO: 750700 - DNA, 25 bp, Mus musculus
taagaaatatacatctggaacccaa

SEQ ID NO: 750701 - DNA, 25 bp, Mus musculus
taagaaatatacttctggaacccaa

SEQ ID NO: 750702 - DNA, 25 bp, Mus musculus
taagaaatccatctgagttcgaggt

SEQ ID NO: 750703 - DNA, 25 bp, Mus musculus
taagaaatccatgtgagttcgaggt

SEQ ID NO: 750704 - DNA, 25 bp, Mus musculus
taagaaatcctcaatgtgcctgcct

SEQ ID NO: 750705 - DNA, 25 bp, Mus musculus
taagaaatcctctatgtgcctgcct

SEQ ID NO: 750706 - DNA, 25 bp, Mus musculus
taagaaatctctatgacaactgtgt

SEQ ID NO: 750707 - DNA, 25 bp, Mus musculus
taagaaatctctttgacaactgtgt

SEQ ID NO: 750708 - DNA, 25 bp, Mus musculus
taagaaatcttcagggcctgcctga

SEQ ID NO: 750709 - DNA, 25 bp, Mus musculus
taagaaatcttctgggcctgcctga

SEQ ID NO: 750710 - DNA, 25 bp, Mus musculus
taagaaatgcccacgcaggttcgcc

SEQ ID NO: 750711 - DNA, 25 bp, Mus musculus
taagaaatgccctcgcaggttcgcc

SEQ ID NO: 750712 - DNA, 25 bp, Mus musculus
taagaaatggctatccacgttgccc

SEQ ID NO: 750713 - DNA, 25 bp, Mus musculus
taagaaatggctttccacgttgccc

SEQ ID NO: 750714 - DNA, 25 bp, Mus musculus
taagaaatgttgatgaccccctctg

SEQ ID NO: 750715 - DNA, 25 bp, Mus musculus
taagaaatgttgttgaccccctctg

SEQ ID NO: 750716 - DNA, 25 bp, Mus musculus
taagaaattatcagagcctctcaac

SEQ ID NO: 750717 - DNA, 25 bp, Mus musculus
taagaaattatctgagcctctcaac

SEQ ID NO: 750718 - DNA, 25 bp, Mus musculus
taagaaattcatcctcatcacaccc

SEQ ID NO: 750719 - DNA, 25 bp, Mus musculus
taagaaattcatgctcatcacaccc

SEQ ID NO: 750720 - DNA, 25 bp, Mus musculus
taagaaatttcccaagccgggcgtg

SEQ ID NO: 750721 - DNA, 25 bp, Mus musculus
taagaaatttccgaagccgggcgtg

SEQ ID NO: 750722 - DNA, 25 bp, Mus musculus
taagaacacaaccaccagccatggt

SEQ ID NO: 750723 - DNA, 25 bp, Mus musculus
taagaacacaacgaccagccatggt

SEQ ID NO: 750724 - DNA, 25 bp, Mus musculus
taagaacacagacttcctttccttg

SEQ ID NO: 750725 - DNA, 25 bp, Mus musculus
taagaacacagagttcctttccttg

SEQ ID NO: 750726 - DNA, 25 bp, Mus musculus
taagaacaccccacctagcagagga

SEQ ID NO: 750727 - DNA, 25 bp, Mus musculus
taagaacacccctcctagcagagga

SEQ ID NO: 750728 - DNA, 25 bp, Mus musculus
taagaacaccggctattctccgaga

SEQ ID NO: 750729 - DNA, 25 bp, Mus musculus
taagaacaccgggtattctccgaga

SEQ ID NO: 750730 - DNA, 25 bp, Mus musculus
taagaacagatcactactcgccaca

SEQ ID NO: 750731 - DNA, 25 bp, Mus musculus
taagaacagatctctactcgccaca

SEQ ID NO: 750732 - DNA, 25 bp, Mus musculus
taagaacagcatctcttcctttgcc

SEQ ID NO: 750733 - DNA, 25 bp, Mus musculus
taagaacagcatgtcttcctttgcc

SEQ ID NO: 750734 - DNA, 25 bp, Mus musculus
taagaacagctcagtttctcctcat

SEQ ID NO: 750735 - DNA, 25 bp, Mus musculus
taagaacagctctgtttctcctcat

SEQ ID NO: 750736 - DNA, 25 bp, Mus musculus
taagaacatacaatttctaacctga

SEQ ID NO: 750737 - DNA, 25 bp, Mus musculus
taagaacatacattttctaacctga

SEQ ID NO: 750738 - DNA, 25 bp, Mus musculus
taagaacatagacctggctgtggtg

SEQ ID NO: 750739 - DNA, 25 bp, Mus musculus
taagaacatagagctggctgtggtg

SEQ ID NO: 750740 - DNA, 25 bp, Mus musculus
taagaacatgagagcgcacgccctg

SEQ ID NO: 750741 - DNA, 25 bp, Mus musculus
taagaacatgagtgcgcacgccctg

SEQ ID NO: 750742 - DNA, 25 bp, Mus musculus
taagaacattccaattccaaccctg

SEQ ID NO: 750743 - DNA, 25 bp, Mus musculus
taagaacattcctattccaaccctg

SEQ ID NO: 750744 - DNA, 25 bp, Mus musculus
taagaacattgcaaacccgactgcc

SEQ ID NO: 750745 - DNA, 25 bp, Mus musculus
taagaacattgctaacccgactgcc

SEQ ID NO: 750746 - DNA, 25 bp, Mus musculus
taagaaccacagaacaaccttgttg

SEQ ID NO: 750747 - DNA, 25 bp, Mus musculus
taagaaccacagtacaaccttgttg

SEQ ID NO: 750748 - DNA, 25 bp, Mus musculus
taagaaccacgtagcttctcaagct

SEQ ID NO: 750749 - DNA, 25 bp, Mus musculus
taagaaccacgttgcttctcaagct

SEQ ID NO: 750750 - DNA, 25 bp, Mus musculus
taagaaccactccatctcgctgatt

SEQ ID NO: 750751 - DNA, 25 bp, Mus musculus
taagaaccactcgatctcgctgatt

SEQ ID NO: 750752 - DNA, 25 bp, Mus musculus
taagaaccagagatgaccctaggaa

SEQ ID NO: 750753 - DNA, 25 bp, Mus musculus
taagaaccagagttgaccctaggaa

SEQ ID NO: 750754 - DNA, 25 bp, Mus musculus
taagaaccagcccatgtctacgggt

SEQ ID NO: 750755 - DNA, 25 bp, Mus musculus
taagaaccagccgatgtctacgggt

SEQ ID NO: 750756 - DNA, 25 bp, Mus musculus
taagaacccaataacaccaaaccag

SEQ ID NO: 750757 - DNA, 25 bp, Mus musculus
taagaacccaattacaccaaaccag

SEQ ID NO: 750758 - DNA, 25 bp, Mus musculus
taagaacccagcagagcgagcagat

SEQ ID NO: 750759 - DNA, 25 bp, Mus musculus
taagaacccagctgagcgagcagat

SEQ ID NO: 750760 - DNA, 25 bp, Mus musculus
taagaaccgtgaacaaagccatgcc

SEQ ID NO: 750761 - DNA, 25 bp, Mus musculus
taagaaccgtgatcaaagccatgcc

SEQ ID NO: 750762 - DNA, 25 bp, Mus musculus
taagaacctaacacttttgtttgtg

SEQ ID NO: 750763 - DNA, 25 bp, Mus musculus
taagaacctaactcttttgtttgtg

SEQ ID NO: 750764 - DNA, 25 bp, Mus musculus
taagaacctgaaagggtgtccctga

SEQ ID NO: 750765 - DNA, 25 bp, Mus musculus
taagaacctgaatgggtgtccctga

SEQ ID NO: 750766 - DNA, 25 bp, Mus musculus
taagaacgggctccatcacggatgg

SEQ ID NO: 750767 - DNA, 25 bp, Mus musculus
taagaacgggctgcatcacggatgg

SEQ ID NO: 750768 - DNA, 25 bp, Mus musculus
taagaacgtcttacacttcagctcc

SEQ ID NO: 750769 - DNA, 25 bp, Mus musculus
taagaacgtctttcacttcagctcc

SEQ ID NO: 750770 - DNA, 25 bp, Mus musculus
taagaactaagtatggctccacatg

SEQ ID NO: 750771 - DNA, 25 bp, Mus musculus
taagaactaagtttggctccacatg

SEQ ID NO: 750772 - DNA, 25 bp, Mus musculus
taagaactaattcaccaccacgcaa

SEQ ID NO: 750773 - DNA, 25 bp, Mus musculus
taagaactaattgaccaccacgcaa

SEQ ID NO: 750774 - DNA, 25 bp, Mus musculus
taagaactacttcggacgccggaat

SEQ ID NO: 750775 - DNA, 25 bp, Mus musculus
taagaactacttgggacgccggaat

SEQ ID NO: 750776 - DNA, 25 bp, Mus musculus
taagaactcctaagaaactgactga

SEQ ID NO: 750777 - DNA, 25 bp, Mus musculus
taagaactcctatgaaactgactga

SEQ ID NO: 750778 - DNA, 25 bp, Mus musculus
taagaactctctcccatgttgaaga

SEQ ID NO: 750779 - DNA, 25 bp, Mus musculus
taagaactctctgccatgttgaaga

SEQ ID NO: 750780 - DNA, 25 bp, Mus musculus
taagaactgtgcagtcttcctgggc

SEQ ID NO: 750781 - DNA, 25 bp, Mus musculus
taagaactgtgctgtcttcctgggc

SEQ ID NO: 750782 - DNA, 25 bp, Mus musculus
taagaacttctcatgcatatcaggt

SEQ ID NO: 750783 - DNA, 25 bp, Mus musculus
taagaacttctcttgcatatcaggt

SEQ ID NO: 750784 - DNA, 25 bp, Mus musculus
taagaactttctcacggtcccatgc

SEQ ID NO: 750785 - DNA, 25 bp, Mus musculus
taagaactttctgacggtcccatgc

SEQ ID NO: 750786 - DNA, 25 bp, Mus musculus
taagaagaactgctaggttgggcat

SEQ ID NO: 750787 - DNA, 25 bp, Mus musculus
taagaagaactggtaggttgggcat

SEQ ID NO: 750788 - DNA, 25 bp, Mus musculus
taagaagaatgaccacaggtcccag

SEQ ID NO: 750789 - DNA, 25 bp, Mus musculus
taagaagaatgagcacaggtcccag

SEQ ID NO: 750790 - DNA, 25 bp, Mus musculus
taagaagactgtcaccaatcccctt

SEQ ID NO: 750791 - DNA, 25 bp, Mus musculus
taagaagactgtgaccaatcccctt

SEQ ID NO: 750792 - DNA, 25 bp, Mus musculus
taagaagcaaggcatctccatccca

SEQ ID NO: 750793 - DNA, 25 bp, Mus musculus
taagaagcaagggatctccatccca

SEQ ID NO: 750794 - DNA, 25 bp, Mus musculus
taagaagcacaaagcctcccatggg

SEQ ID NO: 750795 - DNA, 25 bp, Mus musculus
taagaagcacaatgcctcccatggg

SEQ ID NO: 750796 - DNA, 25 bp, Mus musculus
taagaagcagcaaggcccttctctc

SEQ ID NO: 750797 - DNA, 25 bp, Mus musculus
taagaagcagcatggcccttctctc

SEQ ID NO: 750798 - DNA, 25 bp, Mus musculus
taagaagccaatcgggacaccagtt

SEQ ID NO: 750799 - DNA, 25 bp, Mus musculus
taagaagccaatggggacaccagtt

SEQ ID NO: 750800 - DNA, 25 bp, Mus musculus
taagaagccagactctccagacaga

SEQ ID NO: 750801 - DNA, 25 bp, Mus musculus
taagaagccagagtctccagacaga

SEQ ID NO: 750802 - DNA, 25 bp, Mus musculus
taagaagccccaaacttcccagatg

SEQ ID NO: 750803 - DNA, 25 bp, Mus musculus
taagaagccccatacttcccagatg

SEQ ID NO: 750804 - DNA, 25 bp, Mus musculus
taagaagcccttaatttagtcccag

SEQ ID NO: 750805 - DNA, 25 bp, Mus musculus
taagaagccctttatttagtcccag

SEQ ID NO: 750806 - DNA, 25 bp, Mus musculus
taagaagcctcaatttttctagggt

SEQ ID NO: 750807 - DNA, 25 bp, Mus musculus
taagaagcctcattttttctagggt

SEQ ID NO: 750808 - DNA, 25 bp, Mus musculus
taagaagcctttaacctatcagccc

SEQ ID NO: 750809 - DNA, 25 bp, Mus musculus
taagaagccttttacctatcagccc

SEQ ID NO: 750810 - DNA, 25 bp, Mus musculus
taagaagcggcgactgaaccagagc

SEQ ID NO: 750811 - DNA, 25 bp, Mus musculus
taagaagcggcgtctgaaccagagc

SEQ ID NO: 750812 - DNA, 25 bp, Mus musculus
taagaagctagaccatcctggcctc

SEQ ID NO: 750813 - DNA, 25 bp, Mus musculus
taagaagctagagcatcctggcctc

SEQ ID NO: 750814 - DNA, 25 bp, Mus musculus
taagaagctagtcccaggcagccca

SEQ ID NO: 750815 - DNA, 25 bp, Mus musculus
taagaagctagtgccaggcagccca

SEQ ID NO: 750816 - DNA, 25 bp, Mus musculus
taagaagctcatcaccaagggccgc

SEQ ID NO: 750817 - DNA, 25 bp, Mus musculus
taagaagctcatgaccaagggccgc

SEQ ID NO: 750818 - DNA, 25 bp, Mus musculus
taagaagctctacggtaccgcgtcc

SEQ ID NO: 750819 - DNA, 25 bp, Mus musculus
taagaagctctagggtaccgcgtcc

SEQ ID NO: 750820 - DNA, 25 bp, Mus musculus
taagaagcttagacccctggagaag

SEQ ID NO: 750821 - DNA, 25 bp, Mus musculus
taagaagcttagtcccctggagaag

SEQ ID NO: 750822 - DNA, 25 bp, Mus musculus
taagaaggacccaagtatctacact

SEQ ID NO: 750823 - DNA, 25 bp, Mus musculus
taagaaggaccctagtatctacact

SEQ ID NO: 750824 - DNA, 25 bp, Mus musculus
taagaaggacgtctgtagccctccc

SEQ ID NO: 750825 - DNA, 25 bp, Mus musculus
taagaaggacgtgtgtagccctccc

SEQ ID NO: 750826 - DNA, 25 bp, Mus musculus
taagaaggagcaccatcatcaccac

SEQ ID NO: 750827 - DNA, 25 bp, Mus musculus
taagaaggagcagcatcatcaccac

SEQ ID NO: 750828 - DNA, 25 bp, Mus musculus
taagaaggcattcgctgagtcctga

SEQ ID NO: 750829 - DNA, 25 bp, Mus musculus
taagaaggcattggctgagtcctga

SEQ ID NO: 750830 - DNA, 25 bp, Mus musculus
taagaaggccatcctctgagcagac

SEQ ID NO: 750831 - DNA, 25 bp, Mus musculus
taagaaggccatgctctgagcagac

SEQ ID NO: 750832 - DNA, 25 bp, Mus musculus
taagaaggcttacgctctctcgtgg

SEQ ID NO: 750833 - DNA, 25 bp, Mus musculus
taagaaggcttaggctctctcgtgg

SEQ ID NO: 750834 - DNA, 25 bp, Mus musculus
taagaagggtacagagctgtggcta

SEQ ID NO: 750835 - DNA, 25 bp, Mus musculus
taagaagggtactgagctgtggcta

SEQ ID NO: 750836 - DNA, 25 bp, Mus musculus
taagaagggttcatggcgcctcact

SEQ ID NO: 750837 - DNA, 25 bp, Mus musculus
taagaagggttcttggcgcctcact

SEQ ID NO: 750838 - DNA, 25 bp, Mus musculus
taagaaggtgctcttaccctccaga

SEQ ID NO: 750839 - DNA, 25 bp, Mus musculus
taagaaggtgctgttaccctccaga

SEQ ID NO: 750840 - DNA, 25 bp, Mus musculus
taagaagtacgcattgccctaccgc

SEQ ID NO: 750841 - DNA, 25 bp, Mus musculus
taagaagtacgctttgccctaccgc

SEQ ID NO: 750842 - DNA, 25 bp, Mus musculus
taagaagtagcaaggtagccgggca

SEQ ID NO: 750843 - DNA, 25 bp, Mus musculus
taagaagtagcatggtagccgggca

SEQ ID NO: 750844 - DNA, 25 bp, Mus musculus
taagaagtcaacacagggccttgtg

SEQ ID NO: 750845 - DNA, 25 bp, Mus musculus
taagaagtcaactcagggccttgtg

SEQ ID NO: 750846 - DNA, 25 bp, Mus musculus
taagaagtccagaagttgtccagtt

SEQ ID NO: 750847 - DNA, 25 bp, Mus musculus
taagaagtccagtagttgtccagtt

SEQ ID NO: 750848 - DNA, 25 bp, Mus musculus
taagaagtccctcctaagccatgag

SEQ ID NO: 750849 - DNA, 25 bp, Mus musculus
taagaagtccctgctaagccatgag

SEQ ID NO: 750850 - DNA, 25 bp, Mus musculus
taagaagtcggactccctgttccta

SEQ ID NO: 750851 - DNA, 25 bp, Mus musculus
taagaagtcggagtccctgttccta

SEQ ID NO: 750852 - DNA, 25 bp, Mus musculus
taagaagtctgtaggctctccaagc

SEQ ID NO: 750853 - DNA, 25 bp, Mus musculus
taagaagtctgttggctctccaagc

SEQ ID NO: 750854 - DNA, 25 bp, Mus musculus
taagaagtgacccacagtcagctct

SEQ ID NO: 750855 - DNA, 25 bp, Mus musculus
taagaagtgaccgacagtcagctct

SEQ ID NO: 750856 - DNA, 25 bp, Mus musculus
taagaagtgcaacacctccctattg

SEQ ID NO: 750857 - DNA, 25 bp, Mus musculus
taagaagtgcaagacctccctattg

SEQ ID NO: 750858 - DNA, 25 bp, Mus musculus
taagaagtggaaccgaccttgctac

SEQ ID NO: 750859 - DNA, 25 bp, Mus musculus
taagaagtggaagcgaccttgctac

SEQ ID NO: 750860 - DNA, 25 bp, Mus musculus
taagaagtgtgtcgcccctattctg

SEQ ID NO: 750861 - DNA, 25 bp, Mus musculus
taagaagtgtgtggcccctattctg

SEQ ID NO: 750862 - DNA, 25 bp, Mus musculus
taagaagttatacacagctgtttcc

SEQ ID NO: 750863 - DNA, 25 bp, Mus musculus
taagaagttatagacagctgtttcc

SEQ ID NO: 750864 - DNA, 25 bp, Mus musculus
taagaagttcccactaaaatgaaag

SEQ ID NO: 750865 - DNA, 25 bp, Mus musculus
taagaagttccctctaaaatgaaag

SEQ ID NO: 750866 - DNA, 25 bp, Mus musculus
taagaagttcctccaacccggaagt

SEQ ID NO: 750867 - DNA, 25 bp, Mus musculus
taagaagttcctgcaacccggaagt

SEQ ID NO: 750868 - DNA, 25 bp, Mus musculus
taagaagttctgctccttagccatc

SEQ ID NO: 750869 - DNA, 25 bp, Mus musculus
taagaagttctggtccttagccatc

SEQ ID NO: 750870 - DNA, 25 bp, Mus musculus
taagaagttgtcaccgtaagctcag

SEQ ID NO: 750871 - DNA, 25 bp, Mus musculus
taagaagttgtctccgtaagctcag

SEQ ID NO: 750872 - DNA, 25 bp, Mus musculus
taagaatacattattccgggctggt

SEQ ID NO: 750873 - DNA, 25 bp, Mus musculus
taagaatacatttttccgggctggt

SEQ ID NO: 750874 - DNA, 25 bp, Mus musculus
taagaatacccacgaaacttcccat

SEQ ID NO: 750875 - DNA, 25 bp, Mus musculus
taagaatacccaggaaacttcccat

SEQ ID NO: 750876 - DNA, 25 bp, Mus musculus
taagaatagcacaattatacctgat

SEQ ID NO: 750877 - DNA, 25 bp, Mus musculus
taagaatagcactattatacctgat

SEQ ID NO: 750878 - DNA, 25 bp, Mus musculus
taagaatagtcaaagccccaagatt

SEQ ID NO: 750879 - DNA, 25 bp, Mus musculus
taagaatagtcatagccccaagatt

SEQ ID NO: 750880 - DNA, 25 bp, Mus musculus
taagaatcattcctagtgctcacac

SEQ ID NO: 750881 - DNA, 25 bp, Mus musculus
taagaatcattcgtagtgctcacac

SEQ ID NO: 750882 - DNA, 25 bp, Mus musculus
taagaatcctcaacttcacccttga

SEQ ID NO: 750883 - DNA, 25 bp, Mus musculus
taagaatcctcatcttcacccttga

SEQ ID NO: 750884 - DNA, 25 bp, Mus musculus
taagaatcctgtactggctggtcca

SEQ ID NO: 750885 - DNA, 25 bp, Mus musculus
taagaatcctgttctggctggtcca

SEQ ID NO: 750886 - DNA, 25 bp, Mus musculus
taagaatcgggaatctggcagaaat

SEQ ID NO: 750887 - DNA, 25 bp, Mus musculus
taagaatcgggattctggcagaaat

SEQ ID NO: 750888 - DNA, 25 bp, Mus musculus
taagaatgaccccatgttttgtggg

SEQ ID NO: 750889 - DNA, 25 bp, Mus musculus
taagaatgacccgatgttttgtggg

SEQ ID NO: 750890 - DNA, 25 bp, Mus musculus
taagaatgcattagttgggccagga

SEQ ID NO: 750891 - DNA, 25 bp, Mus musculus
taagaatgcattctgctcggagaga

SEQ ID NO: 750892 - DNA, 25 bp, Mus musculus
taagaatgcattgtgctcggagaga

SEQ ID NO: 750893 - DNA, 25 bp, Mus musculus
taagaatgcatttgttgggccagga

SEQ ID NO: 750894 - DNA, 25 bp, Mus musculus
taagaatgctgcctcaactctgtgt

SEQ ID NO: 750895 - DNA, 25 bp, Mus musculus
taagaatgctgcgtcaactctgtgt

SEQ ID NO: 750896 - DNA, 25 bp, Mus musculus
taagaatgggcaccgccatggcgca

SEQ ID NO: 750897 - DNA, 25 bp, Mus musculus
taagaatgggcagcgccatggcgca

SEQ ID NO: 750898 - DNA, 25 bp, Mus musculus
taagaattagtcatcagggctggtg

SEQ ID NO: 750899 - DNA, 25 bp, Mus musculus
taagaattagtcttcagggctggtg

SEQ ID NO: 750900 - DNA, 25 bp, Mus musculus
taagaattatgcaggtcacctatag

SEQ ID NO: 750901 - DNA, 25 bp, Mus musculus
taagaattatgctggtcacctatag

SEQ ID NO: 750902 - DNA, 25 bp, Mus musculus
taagaattctatatccttggattac

SEQ ID NO: 750903 - DNA, 25 bp, Mus musculus
taagaattctatttccttggattac

SEQ ID NO: 750904 - DNA, 25 bp, Mus musculus
taagaattctgaacattgtgtttag

SEQ ID NO: 750905 - DNA, 25 bp, Mus musculus
taagaattctgaaccctgctgagtt

SEQ ID NO: 750906 - DNA, 25 bp, Mus musculus
taagaattctgatcattgtgtttag

SEQ ID NO: 750907 - DNA, 25 bp, Mus musculus
taagaattctgatccctgctgagtt

SEQ ID NO: 750908 - DNA, 25 bp, Mus musculus
taagaattcttacaccttggctttt

SEQ ID NO: 750909 - DNA, 25 bp, Mus musculus
taagaattcttagaccttggctttt

SEQ ID NO: 750910 - DNA, 25 bp, Mus musculus
taagaattgactctgatgggccctt

SEQ ID NO: 750911 - DNA, 25 bp, Mus musculus
taagaattgactgtgatgggccctt

SEQ ID NO: 750912 - DNA, 25 bp, Mus musculus
taagaattgcggaactttcagaatc

SEQ ID NO: 750913 - DNA, 25 bp, Mus musculus
taagaattgcggtactttcagaatc

SEQ ID NO: 750914 - DNA, 25 bp, Mus musculus
taagaattgctgctctaggaaatat

SEQ ID NO: 750915 - DNA, 25 bp, Mus musculus
taagaattgctggtctaggaaatat

SEQ ID NO: 750916 - DNA, 25 bp, Mus musculus
taagaatttaggatctctcttttga

SEQ ID NO: 750917 - DNA, 25 bp, Mus musculus
taagaatttaggttctctcttttga

SEQ ID NO: 750918 - DNA, 25 bp, Mus musculus
taagaatttattcacctcgggctgg

SEQ ID NO: 750919 - DNA, 25 bp, Mus musculus
taagaatttattgacctcgggctgg

SEQ ID NO: 750920 - DNA, 25 bp, Mus musculus
taagaatttctactatgctgccaag

SEQ ID NO: 750921 - DNA, 25 bp, Mus musculus
taagaatttctagtatgctgccaag

SEQ ID NO: 750922 - DNA, 25 bp, Mus musculus
taagacaaataccttggctcgggag

SEQ ID NO: 750923 - DNA, 25 bp, Mus musculus
taagacaaatacgttggctcgggag

SEQ ID NO: 750924 - DNA, 25 bp, Mus musculus
taagacaacagtaaatacaacaggg

SEQ ID NO: 750925 - DNA, 25 bp, Mus musculus
taagacaacagttaatacaacaggg

SEQ ID NO: 750926 - DNA, 25 bp, Mus musculus
taagacaatgcacggaagagctctg

SEQ ID NO: 750927 - DNA, 25 bp, Mus musculus
taagacaatgcagggaagagctctg

SEQ ID NO: 750928 - DNA, 25 bp, Mus musculus
taagacacaagacctgagctcacat

SEQ ID NO: 750929 - DNA, 25 bp, Mus musculus
taagacacaagagctgagctcacat

SEQ ID NO: 750930 - DNA, 25 bp, Mus musculus
taagacacaagcagcggctcgacca

SEQ ID NO: 750931 - DNA, 25 bp, Mus musculus
taagacacaagctgcggctcgacca

SEQ ID NO: 750932 - DNA, 25 bp, Mus musculus
taagacacagaaccacgtcagcagg

SEQ ID NO: 750933 - DNA, 25 bp, Mus musculus
taagacacagaagcacgtcagcagg

SEQ ID NO: 750934 - DNA, 25 bp, Mus musculus
taagacacatccctgaaagccaatc

SEQ ID NO: 750935 - DNA, 25 bp, Mus musculus
taagacacatccgtgaaagccaatc

SEQ ID NO: 750936 - DNA, 25 bp, Mus musculus
taagacacatctctggattcctaga

SEQ ID NO: 750937 - DNA, 25 bp, Mus musculus
taagacacatctgtggattcctaga

SEQ ID NO: 750938 - DNA, 25 bp, Mus musculus
taagacacctgaaagcgacatctgt

SEQ ID NO: 750939 - DNA, 25 bp, Mus musculus
taagacacctgatagcgacatctgt

SEQ ID NO: 750940 - DNA, 25 bp, Mus musculus
taagacacttcccagagtcccatca

SEQ ID NO: 750941 - DNA, 25 bp, Mus musculus
taagacacttccgagagtcccatca

SEQ ID NO: 750942 - DNA, 25 bp, Mus musculus
taagacagacaaagcgaggcgctga

SEQ ID NO: 750943 - DNA, 25 bp, Mus musculus
taagacagacaatgcgaggcgctga

SEQ ID NO: 750944 - DNA, 25 bp, Mus musculus
taagacagacatcctctctgcaaat

SEQ ID NO: 750945 - DNA, 25 bp, Mus musculus
taagacagacatgctctctgcaaat

SEQ ID NO: 750946 - DNA, 25 bp, Mus musculus
taagacagacccctctctggagaac

SEQ ID NO: 750947 - DNA, 25 bp, Mus musculus
taagacagacccgtctctggagaac

SEQ ID NO: 750948 - DNA, 25 bp, Mus musculus
taagacagacctcgctggccgacaa

SEQ ID NO: 750949 - DNA, 25 bp, Mus musculus
taagacagacctggctggccgacaa

SEQ ID NO: 750950 - DNA, 25 bp, Mus musculus
taagacagacttcaggttttcataa

SEQ ID NO: 750951 - DNA, 25 bp, Mus musculus
taagacagacttgaggttttcataa

SEQ ID NO: 750952 - DNA, 25 bp, Mus musculus
taagacagagtcaaggcagaggaag

SEQ ID NO: 750953 - DNA, 25 bp, Mus musculus
taagacagagtctaggcagaggaag

SEQ ID NO: 750954 - DNA, 25 bp, Mus musculus
taagacagcctaagaagcaaaacaa

SEQ ID NO: 750955 - DNA, 25 bp, Mus musculus
taagacagcctatgaagcaaaacaa

SEQ ID NO: 750956 - DNA, 25 bp, Mus musculus
taagacagcctcagtgatcccattt

SEQ ID NO: 750957 - DNA, 25 bp, Mus musculus
taagacagcctctgtgatcccattt

SEQ ID NO: 750958 - DNA, 25 bp, Mus musculus
taagacagcgggaaagacgatgcct

SEQ ID NO: 750959 - DNA, 25 bp, Mus musculus
taagacagcgggtaagacgatgcct

SEQ ID NO: 750960 - DNA, 25 bp, Mus musculus
taagacaggagcagtcacctccgat

SEQ ID NO: 750961 - DNA, 25 bp, Mus musculus
taagacaggagctgtcacctccgat

SEQ ID NO: 750962 - DNA, 25 bp, Mus musculus
taagacaggagtctgtaatagggat

SEQ ID NO: 750963 - DNA, 25 bp, Mus musculus
taagacaggagtgtgtaatagggat

SEQ ID NO: 750964 - DNA, 25 bp, Mus musculus
taagacaggccgctactgggtttca

SEQ ID NO: 750965 - DNA, 25 bp, Mus musculus
taagacaggccggtactgggtttca

SEQ ID NO: 750966 - DNA, 25 bp, Mus musculus
taagacagggacatgtctcttccca

SEQ ID NO: 750967 - DNA, 25 bp, Mus musculus
taagacagggacttgtctcttccca

SEQ ID NO: 750968 - DNA, 25 bp, Mus musculus
taagacagggtcacgccttggctag

SEQ ID NO: 750969 - DNA, 25 bp, Mus musculus
taagacagggtctcgccttggctag

SEQ ID NO: 750970 - DNA, 25 bp, Mus musculus
taagacaggttgcacgtcactcttc

SEQ ID NO: 750971 - DNA, 25 bp, Mus musculus
taagacaggttggacgtcactcttc

SEQ ID NO: 750972 - DNA, 25 bp, Mus musculus
taagacagtgtgaagcagccctgag

SEQ ID NO: 750973 - DNA, 25 bp, Mus musculus
taagacagtgtgtagcagccctgag

SEQ ID NO: 750974 - DNA, 25 bp, Mus musculus
taagacagttttccccggttcatca

SEQ ID NO: 750975 - DNA, 25 bp, Mus musculus
taagacagttttgcccggttcatca

SEQ ID NO: 750976 - DNA, 25 bp, Mus musculus
taagacataggtactctactgccac

SEQ ID NO: 750977 - DNA, 25 bp, Mus musculus
taagacataggttctctactgccac

SEQ ID NO: 750978 - DNA, 25 bp, Mus musculus
taagacatatccctgggcttgctgc

SEQ ID NO: 750979 - DNA, 25 bp, Mus musculus
taagacatatccgtgggcttgctgc

SEQ ID NO: 750980 - DNA, 25 bp, Mus musculus
taagacatcagtactactagactca

SEQ ID NO: 750981 - DNA, 25 bp, Mus musculus
taagacatcagttctactagactca

SEQ ID NO: 750982 - DNA, 25 bp, Mus musculus
taagacatcatgcaggagcgctacc

SEQ ID NO: 750983 - DNA, 25 bp, Mus musculus
taagacatcatggaggagcgctacc

SEQ ID NO: 750984 - DNA, 25 bp, Mus musculus
taagacatcattaccaggcatacct

SEQ ID NO: 750985 - DNA, 25 bp, Mus musculus
taagacatcatttccaggcatacct

SEQ ID NO: 750986 - DNA, 25 bp, Mus musculus
taagacatccataaaaagcccgtta

SEQ ID NO: 750987 - DNA, 25 bp, Mus musculus
taagacatccattaaaagcccgtta

SEQ ID NO: 750988 - DNA, 25 bp, Mus musculus
taagacatccctcaactttactcag

SEQ ID NO: 750989 - DNA, 25 bp, Mus musculus
taagacatccctgaactttactcag

SEQ ID NO: 750990 - DNA, 25 bp, Mus musculus
taagacatcgacagctaggttatta

SEQ ID NO: 750991 - DNA, 25 bp, Mus musculus
taagacatcgactgctaggttatta

SEQ ID NO: 750992 - DNA, 25 bp, Mus musculus
taagacatctaccacctcaatcagt

SEQ ID NO: 750993 - DNA, 25 bp, Mus musculus
taagacatctacgacctcaatcagt

SEQ ID NO: 750994 - DNA, 25 bp, Mus musculus
taagacatgaacacctctgggcagg

SEQ ID NO: 750995 - DNA, 25 bp, Mus musculus
taagacatgaactcctctgggcagg

SEQ ID NO: 750996 - DNA, 25 bp, Mus musculus
taagacatggtacttggttaagaca

SEQ ID NO: 750997 - DNA, 25 bp, Mus musculus
taagacatggtagttggttaagaca

SEQ ID NO: 750998 - DNA, 25 bp, Mus musculus
taagacattcaaattcaccaggcag

SEQ ID NO: 750999 - DNA, 25 bp, Mus musculus
taagacattcaatttcaccaggcag

SEQ ID NO: 751000 - DNA, 25 bp, Mus musculus
taagaccaacagcagacgccagatt

SEQ ID NO: 751001 - DNA, 25 bp, Mus musculus
taagaccaacaggagacgccagatt

SEQ ID NO: 751002 - DNA, 25 bp, Mus musculus
taagaccaaccccaagcataaacag

SEQ ID NO: 751003 - DNA, 25 bp, Mus musculus
taagaccaacccgaagcataaacag

SEQ ID NO: 751004 - DNA, 25 bp, Mus musculus
taagaccactctatgactgctcaca

SEQ ID NO: 751005 - DNA, 25 bp, Mus musculus
taagaccactctttgactgctcaca

SEQ ID NO: 751006 - DNA, 25 bp, Mus musculus
taagaccagcctctcttaccacaag

SEQ ID NO: 751007 - DNA, 25 bp, Mus musculus
taagaccagcctgtcttaccacaag

SEQ ID NO: 751008 - DNA, 25 bp, Mus musculus
taagaccaggagaccattatgacat

SEQ ID NO: 751009 - DNA, 25 bp, Mus musculus
taagaccaggagtccattatgacat

SEQ ID NO: 751010 - DNA, 25 bp, Mus musculus
taagaccagtctcttccttagtcac

SEQ ID NO: 751011 - DNA, 25 bp, Mus musculus
taagaccagtctgttccttagtcac

SEQ ID NO: 751012 - DNA, 25 bp, Mus musculus
taagaccagtgtacggaggaagacc

SEQ ID NO: 751013 - DNA, 25 bp, Mus musculus
taagaccagtgttcggaggaagacc

SEQ ID NO: 751014 - DNA, 25 bp, Mus musculus
taagaccagttgaaaccaccgaata

SEQ ID NO: 751015 - DNA, 25 bp, Mus musculus
taagaccagttgtaaccaccgaata

SEQ ID NO: 751016 - DNA, 25 bp, Mus musculus
taagaccattctactgccaacattt

SEQ ID NO: 751017 - DNA, 25 bp, Mus musculus
taagaccattcttctgccaacattt

SEQ ID NO: 751018 - DNA, 25 bp, Mus musculus
taagacccagatcagtgcccagcag

SEQ ID NO: 751019 - DNA, 25 bp, Mus musculus
taagacccagatgagtgcccagcag

SEQ ID NO: 751020 - DNA, 25 bp, Mus musculus
taagacccagtcacagtacctcaca

SEQ ID NO: 751021 - DNA, 25 bp, Mus musculus
taagacccagtctcagtacctcaca

SEQ ID NO: 751022 - DNA, 25 bp, Mus musculus
taagaccccaacagactctggccat

SEQ ID NO: 751023 - DNA, 25 bp, Mus musculus
taagaccccaactgactctggccat

SEQ ID NO: 751024 - DNA, 25 bp, Mus musculus
taagaccccataactccagcaacta

SEQ ID NO: 751025 - DNA, 25 bp, Mus musculus
taagaccccatatctccagcaacta

SEQ ID NO: 751026 - DNA, 25 bp, Mus musculus
taagacccctatctttatttcacca

SEQ ID NO: 751027 - DNA, 25 bp, Mus musculus
taagacccctatgtttatttcacca

SEQ ID NO: 751028 - DNA, 25 bp, Mus musculus
taagaccctagcatttccaagttgt

SEQ ID NO: 751029 - DNA, 25 bp, Mus musculus
taagaccctagcttttccaagttgt

SEQ ID NO: 751030 - DNA, 25 bp, Mus musculus
taagaccctcacaatccagatgctt

SEQ ID NO: 751031 - DNA, 25 bp, Mus musculus
taagaccctcactatccagatgctt

SEQ ID NO: 751032 - DNA, 25 bp, Mus musculus
taagaccctggcataagatgaacag

SEQ ID NO: 751033 - DNA, 25 bp, Mus musculus
taagaccctggcttaagatgaacag

SEQ ID NO: 751034 - DNA, 25 bp, Mus musculus
taagacccttctctgtgcataccaa

SEQ ID NO: 751035 - DNA, 25 bp, Mus musculus
taagacccttctgtgtgcataccaa

SEQ ID NO: 751036 - DNA, 25 bp, Mus musculus
taagaccgagagagtcttttcgtga

SEQ ID NO: 751037 - DNA, 25 bp, Mus musculus
taagaccgagagtgtcttttcgtga

SEQ ID NO: 751038 - DNA, 25 bp, Mus musculus
taagaccgtgtcagagggttacagt

SEQ ID NO: 751039 - DNA, 25 bp, Mus musculus
taagaccgtgtctgagggttacagt

SEQ ID NO: 751040 - DNA, 25 bp, Mus musculus
taagacctaaacctttaaatcagtg

SEQ ID NO: 751041 - DNA, 25 bp, Mus musculus
taagacctaaacgtttaaatcagtg

SEQ ID NO: 751042 - DNA, 25 bp, Mus musculus
taagacctaaatcttcactctggcc

SEQ ID NO: 751043 - DNA, 25 bp, Mus musculus
taagacctaaatgttcactctggcc

SEQ ID NO: 751044 - DNA, 25 bp, Mus musculus
taagacctaagccttccaagaacga

SEQ ID NO: 751045 - DNA, 25 bp, Mus musculus
taagacctaagcgttccaagaacga

SEQ ID NO: 751046 - DNA, 25 bp, Mus musculus
taagacctatgacatctcaaactat

SEQ ID NO: 751047 - DNA, 25 bp, Mus musculus
taagacctatgagatctcaaactat

SEQ ID NO: 751048 - DNA, 25 bp, Mus musculus
taagacctcagcatacttcctggtg

SEQ ID NO: 751049 - DNA, 25 bp, Mus musculus
taagacctcagcttacttcctggtg

SEQ ID NO: 751050 - DNA, 25 bp, Mus musculus
taagacctcagtatctcccagtagc

SEQ ID NO: 751051 - DNA, 25 bp, Mus musculus
taagacctcagtttctcccagtagc

SEQ ID NO: 751052 - DNA, 25 bp, Mus musculus
taagacctctagatggcatccccta

SEQ ID NO: 751053 - DNA, 25 bp, Mus musculus
taagacctctagttggcatccccta

SEQ ID NO: 751054 - DNA, 25 bp, Mus musculus
taagacctggctatcgttcactttc

SEQ ID NO: 751055 - DNA, 25 bp, Mus musculus
taagacctggctttcgttcactttc

SEQ ID NO: 751056 - DNA, 25 bp, Mus musculus
taagacctgggactgtgccctacat

SEQ ID NO: 751057 - DNA, 25 bp, Mus musculus
taagacctgggagtgtgccctacat

SEQ ID NO: 751058 - DNA, 25 bp, Mus musculus
taagacctggtcaagagccacccta

SEQ ID NO: 751059 - DNA, 25 bp, Mus musculus
taagacctggtctagagccacccta

SEQ ID NO: 751060 - DNA, 25 bp, Mus musculus
taagacctgtcccatcatgctgatg

SEQ ID NO: 751061 - DNA, 25 bp, Mus musculus
taagacctgtccgatcatgctgatg

SEQ ID NO: 751062 - DNA, 25 bp, Mus musculus
taagaccttaagagaactgtgaact

SEQ ID NO: 751063 - DNA, 25 bp, Mus musculus
taagaccttaagtgaactgtgaact

SEQ ID NO: 751064 - DNA, 25 bp, Mus musculus
taagaccttgatacctacatgtgga

SEQ ID NO: 751065 - DNA, 25 bp, Mus musculus
taagaccttgattcctacatgtgga

SEQ ID NO: 751066 - DNA, 25 bp, Mus musculus
taagaccttggaaccctagggcaga

SEQ ID NO: 751067 - DNA, 25 bp, Mus musculus
taagaccttggatccctagggcaga

SEQ ID NO: 751068 - DNA, 25 bp, Mus musculus
taagaccttgggacaatttataccg

SEQ ID NO: 751069 - DNA, 25 bp, Mus musculus
taagaccttgggtcaatttataccg

SEQ ID NO: 751070 - DNA, 25 bp, Mus musculus
taagaccttttcatcaatgtccaat

SEQ ID NO: 751071 - DNA, 25 bp, Mus musculus
taagaccttttcttcaatgtccaat

SEQ ID NO: 751072 - DNA, 25 bp, Mus musculus
taagacgatctcctgcactagtgtc

SEQ ID NO: 751073 - DNA, 25 bp, Mus musculus
taagacgatctcgtgcactagtgtc

SEQ ID NO: 751074 - DNA, 25 bp, Mus musculus
taagacgcacggcaagtcgccagag

SEQ ID NO: 751075 - DNA, 25 bp, Mus musculus
taagacgcacgggaagtcgccagag

SEQ ID NO: 751076 - DNA, 25 bp, Mus musculus
taagacgccaacagcccaggcggtt

SEQ ID NO: 751077 - DNA, 25 bp, Mus musculus
taagacgccaactgcccaggcggtt

SEQ ID NO: 751078 - DNA, 25 bp, Mus musculus
taagacgcttgcagccaaacttgat

SEQ ID NO: 751079 - DNA, 25 bp, Mus musculus
taagacgcttgctgccaaacttgat

SEQ ID NO: 751080 - DNA, 25 bp, Mus musculus
taagacgtactcctgctgtgctaag

SEQ ID NO: 751081 - DNA, 25 bp, Mus musculus
taagacgtactcgtgctgtgctaag

SEQ ID NO: 751082 - DNA, 25 bp, Mus musculus
taagacgtacttcctgctttctaat

SEQ ID NO: 751083 - DNA, 25 bp, Mus musculus
taagacgtacttgctgctttctaat

SEQ ID NO: 751084 - DNA, 25 bp, Mus musculus
taagacgtcaaaatctacatcagaa

SEQ ID NO: 751085 - DNA, 25 bp, Mus musculus
taagacgtcaaattctacatcagaa

SEQ ID NO: 751086 - DNA, 25 bp, Mus musculus
taagacgtcgagaccatgcttatca

SEQ ID NO: 751087 - DNA, 25 bp, Mus musculus
taagacgtcgagtccatgcttatca

SEQ ID NO: 751088 - DNA, 25 bp, Mus musculus
taagacgtgcttagtggcgcatcca

SEQ ID NO: 751089 - DNA, 25 bp, Mus musculus
taagacgtgctttgtggcgcatcca

SEQ ID NO: 751090 - DNA, 25 bp, Mus musculus
taagacgtgtagactcactgggaaa

SEQ ID NO: 751091 - DNA, 25 bp, Mus musculus
taagacgtgtagtctcactgggaaa

SEQ ID NO: 751092 - DNA, 25 bp, Mus musculus
taagacgttcatcccgtccttgaac

SEQ ID NO: 751093 - DNA, 25 bp, Mus musculus
taagacgttcatgccgtccttgaac

SEQ ID NO: 751094 - DNA, 25 bp, Mus musculus
taagactaaatcacagacttcctga

SEQ ID NO: 751095 - DNA, 25 bp, Mus musculus
taagactaaatctcagacttcctga

SEQ ID NO: 751096 - DNA, 25 bp, Mus musculus
taagactacctgctaccgaaatggg

SEQ ID NO: 751097 - DNA, 25 bp, Mus musculus
taagactacctggtaccgaaatggg

SEQ ID NO: 751098 - DNA, 25 bp, Mus musculus
taagactagttactttactggtaat

SEQ ID NO: 751099 - DNA, 25 bp, Mus musculus
taagactagttagtttactggtaat

SEQ ID NO: 751100 - DNA, 25 bp, Mus musculus
taagactatagaacactgtggatat

SEQ ID NO: 751101 - DNA, 25 bp, Mus musculus
taagactatagatcactgtggatat

SEQ ID NO: 751102 - DNA, 25 bp, Mus musculus
taagactatctccagggtacacaga

SEQ ID NO: 751103 - DNA, 25 bp, Mus musculus
taagactatctcgagggtacacaga

SEQ ID NO: 751104 - DNA, 25 bp, Mus musculus
taagactattatcctggttttacaa

SEQ ID NO: 751105 - DNA, 25 bp, Mus musculus
taagactattatgctggttttacaa

SEQ ID NO: 751106 - DNA, 25 bp, Mus musculus
taagactcatccatgagcttcctgc

SEQ ID NO: 751107 - DNA, 25 bp, Mus musculus
taagactcatccttgagcttcctgc

SEQ ID NO: 751108 - DNA, 25 bp, Mus musculus
taagactccagacacagggtcaatg

SEQ ID NO: 751109 - DNA, 25 bp, Mus musculus
taagactccagagacagggtcaatg

SEQ ID NO: 751110 - DNA, 25 bp, Mus musculus
taagactccctacccaccagttaaa

SEQ ID NO: 751111 - DNA, 25 bp, Mus musculus
taagactccctagccaccagttaaa

SEQ ID NO: 751112 - DNA, 25 bp, Mus musculus
taagactcctccaaggttggccttg

SEQ ID NO: 751113 - DNA, 25 bp, Mus musculus
taagactcctcctaggttggccttg

SEQ ID NO: 751114 - DNA, 25 bp, Mus musculus
taagactctattattcagggcttct

SEQ ID NO: 751115 - DNA, 25 bp, Mus musculus
taagactctatttttcagggcttct

SEQ ID NO: 751116 - DNA, 25 bp, Mus musculus
taagactgaaagactcaccctcccg

SEQ ID NO: 751117 - DNA, 25 bp, Mus musculus
taagactgaaagtctcaccctcccg

SEQ ID NO: 751118 - DNA, 25 bp, Mus musculus
taagactgaactcctcttttgaccc

SEQ ID NO: 751119 - DNA, 25 bp, Mus musculus
taagactgaactctcacccgctgta

SEQ ID NO: 751120 - DNA, 25 bp, Mus musculus
taagactgaactgctcttttgaccc

SEQ ID NO: 751121 - DNA, 25 bp, Mus musculus
taagactgaactgtcacccgctgta

SEQ ID NO: 751122 - DNA, 25 bp, Mus musculus
taagactgcctcactctttgaacag

SEQ ID NO: 751123 - DNA, 25 bp, Mus musculus
taagactgcctctctctttgaacag

SEQ ID NO: 751124 - DNA, 25 bp, Mus musculus
taagactgctacagcatctgggaca

SEQ ID NO: 751125 - DNA, 25 bp, Mus musculus
taagactgctactgcatctgggaca

SEQ ID NO: 751126 - DNA, 25 bp, Mus musculus
taagactgctctcacagtttgctgc

SEQ ID NO: 751127 - DNA, 25 bp, Mus musculus
taagactgctctgacagtttgctgc

SEQ ID NO: 751128 - DNA, 25 bp, Mus musculus
taagactgctgcagtcccatcgcaa

SEQ ID NO: 751129 - DNA, 25 bp, Mus musculus
taagactgctgctgtcccatcgcaa

SEQ ID NO: 751130 - DNA, 25 bp, Mus musculus
taagactgctttctacgtaacccct

SEQ ID NO: 751131 - DNA, 25 bp, Mus musculus
taagactgctttgtacgtaacccct

SEQ ID NO: 751132 - DNA, 25 bp, Mus musculus
taagactggaccaaatctccacggt

SEQ ID NO: 751133 - DNA, 25 bp, Mus musculus
taagactggacctaatctccacggt

SEQ ID NO: 751134 - DNA, 25 bp, Mus musculus
taagactggagtctcttgcacaagc

SEQ ID NO: 751135 - DNA, 25 bp, Mus musculus
taagactggagtgtcttgcacaagc

SEQ ID NO: 751136 - DNA, 25 bp, Mus musculus
taagactggcaacttctgtcacctt

SEQ ID NO: 751137 - DNA, 25 bp, Mus musculus
taagactggcaagttctgtcacctt

SEQ ID NO: 751138 - DNA, 25 bp, Mus musculus
taagactggtgactcctcccgggaa

SEQ ID NO: 751139 - DNA, 25 bp, Mus musculus
taagactggtgagtcctcccgggaa

SEQ ID NO: 751140 - DNA, 25 bp, Mus musculus
taagactgtattagtttcttcaggg

SEQ ID NO: 751141 - DNA, 25 bp, Mus musculus
taagactgtatttgtttcttcaggg

SEQ ID NO: 751142 - DNA, 25 bp, Mus musculus
taagactgtcacatgactgtcctca

SEQ ID NO: 751143 - DNA, 25 bp, Mus musculus
taagactgtcacttgactgtcctca

SEQ ID NO: 751144 - DNA, 25 bp, Mus musculus
taagactgtgaccttttaagcccca

SEQ ID NO: 751145 - DNA, 25 bp, Mus musculus
taagactgtgacgttttaagcccca

SEQ ID NO: 751146 - DNA, 25 bp, Mus musculus
taagactgtgcacacctccgcagga

SEQ ID NO: 751147 - DNA, 25 bp, Mus musculus
taagactgtgcagacctccgcagga

SEQ ID NO: 751148 - DNA, 25 bp, Mus musculus
taagactgtggacttcatgattgtt

SEQ ID NO: 751149 - DNA, 25 bp, Mus musculus
taagactgtggagttcatgattgtt

SEQ ID NO: 751150 - DNA, 25 bp, Mus musculus
taagactgttagagttcccatgtgt

SEQ ID NO: 751151 - DNA, 25 bp, Mus musculus
taagactgttagtgttcccatgtgt

SEQ ID NO: 751152 - DNA, 25 bp, Mus musculus
taagactgtttacctgctctggttc

SEQ ID NO: 751153 - DNA, 25 bp, Mus musculus
taagactgtttagctgctctggttc

SEQ ID NO: 751154 - DNA, 25 bp, Mus musculus
taagacttaaatattccagacttgt

SEQ ID NO: 751155 - DNA, 25 bp, Mus musculus
taagacttaaattttccagacttgt

SEQ ID NO: 751156 - DNA, 25 bp, Mus musculus
taagacttactgatgaacctccctt

SEQ ID NO: 751157 - DNA, 25 bp, Mus musculus
taagacttactgttgaacctccctt

SEQ ID NO: 751158 - DNA, 25 bp, Mus musculus
taagacttattccatggctaccaag

SEQ ID NO: 751159 - DNA, 25 bp, Mus musculus
taagacttattcgatggctaccaag

SEQ ID NO: 751160 - DNA, 25 bp, Mus musculus
taagacttgcttatattttccttca

SEQ ID NO: 751161 - DNA, 25 bp, Mus musculus
taagacttgcttttattttccttca

SEQ ID NO: 751162 - DNA, 25 bp, Mus musculus
taagacttggtcaagtgccaggcat

SEQ ID NO: 751163 - DNA, 25 bp, Mus musculus
taagacttggtctagtgccaggcat

SEQ ID NO: 751164 - DNA, 25 bp, Mus musculus
taagacttgtctccctgggttccca

SEQ ID NO: 751165 - DNA, 25 bp, Mus musculus
taagacttgtctgcctgggttccca

SEQ ID NO: 751166 - DNA, 25 bp, Mus musculus
taagacttgtttattcttgtttact

SEQ ID NO: 751167 - DNA, 25 bp, Mus musculus
taagacttgttttttcttgtttact

SEQ ID NO: 751168 - DNA, 25 bp, Mus musculus
taagactttaccatctgagcatccc

SEQ ID NO: 751169 - DNA, 25 bp, Mus musculus
taagactttaccttctgagcatccc

SEQ ID NO: 751170 - DNA, 25 bp, Mus musculus
taagactttcctcacttccgtatgc

SEQ ID NO: 751171 - DNA, 25 bp, Mus musculus
taagactttcctgacttccgtatgc

SEQ ID NO: 751172 - DNA, 25 bp, Mus musculus
taagactttctcactctacaagctg

SEQ ID NO: 751173 - DNA, 25 bp, Mus musculus
taagactttctctctctacaagctg

SEQ ID NO: 751174 - DNA, 25 bp, Mus musculus
taagactttgtaccactctgtgcac

SEQ ID NO: 751175 - DNA, 25 bp, Mus musculus
taagactttgtagcactctgtgcac

SEQ ID NO: 751176 - DNA, 25 bp, Mus musculus
taagactttgtcagagctcatgaca

SEQ ID NO: 751177 - DNA, 25 bp, Mus musculus
taagactttgtctgagctcatgaca

SEQ ID NO: 751178 - DNA, 25 bp, Mus musculus
taagagaagcagaagtccccaccaa

SEQ ID NO: 751179 - DNA, 25 bp, Mus musculus
taagagaagcagtagtccccaccaa

SEQ ID NO: 751180 - DNA, 25 bp, Mus musculus
taagagaaggccagcttttgcctga

SEQ ID NO: 751181 - DNA, 25 bp, Mus musculus
taagagaaggcctgcttttgcctga

SEQ ID NO: 751182 - DNA, 25 bp, Mus musculus
taagagacccgtctgcaggcatcgt

SEQ ID NO: 751183 - DNA, 25 bp, Mus musculus
taagagacccgtgtgcaggcatcgt

SEQ ID NO: 751184 - DNA, 25 bp, Mus musculus
taagagacctggactgcattcctct

SEQ ID NO: 751185 - DNA, 25 bp, Mus musculus
taagagacctggtctgcattcctct

SEQ ID NO: 751186 - DNA, 25 bp, Mus musculus
taagagaccttgcacaactgtacag

SEQ ID NO: 751187 - DNA, 25 bp, Mus musculus
taagagaccttggacaactgtacag

SEQ ID NO: 751188 - DNA, 25 bp, Mus musculus
taagagacgaaacactaccgggact

SEQ ID NO: 751189 - DNA, 25 bp, Mus musculus
taagagacgaaagactaccgggact

SEQ ID NO: 751190 - DNA, 25 bp, Mus musculus
taagagacgataatgagaggtctaa

SEQ ID NO: 751191 - DNA, 25 bp, Mus musculus
taagagacgatattgagaggtctaa

SEQ ID NO: 751192 - DNA, 25 bp, Mus musculus
taagagacggctccctctattgcat

SEQ ID NO: 751193 - DNA, 25 bp, Mus musculus
taagagacggctgcctctattgcat

SEQ ID NO: 751194 - DNA, 25 bp, Mus musculus
taagagactggaagttttcaaaact

SEQ ID NO: 751195 - DNA, 25 bp, Mus musculus
taagagactggatgttttcaaaact

SEQ ID NO: 751196 - DNA, 25 bp, Mus musculus
taagagactgtaatgcacggccact

SEQ ID NO: 751197 - DNA, 25 bp, Mus musculus
taagagactgtattgcacggccact

SEQ ID NO: 751198 - DNA, 25 bp, Mus musculus
taagagagagatcttccgatgcact

SEQ ID NO: 751199 - DNA, 25 bp, Mus musculus
taagagagagatgttccgatgcact

SEQ ID NO: 751200 - DNA, 25 bp, Mus musculus
taagagagctggaccttgtgccttc

SEQ ID NO: 751201 - DNA, 25 bp, Mus musculus
taagagagctggtccttgtgccttc

SEQ ID NO: 751202 - DNA, 25 bp, Mus musculus
taagagaggaaactgcaagctgact

SEQ ID NO: 751203 - DNA, 25 bp, Mus musculus
taagagaggaaagtgcaagctgact

SEQ ID NO: 751204 - DNA, 25 bp, Mus musculus
taagagagtcccaattgtctttttt

SEQ ID NO: 751205 - DNA, 25 bp, Mus musculus
taagagagtccctattgtctttttt

SEQ ID NO: 751206 - DNA, 25 bp, Mus musculus
taagagagtctgacttccgcctgac

SEQ ID NO: 751207 - DNA, 25 bp, Mus musculus
taagagagtctgtcttccgcctgac

SEQ ID NO: 751208 - DNA, 25 bp, Mus musculus
taagagagtcttccctgaatgtccc

SEQ ID NO: 751209 - DNA, 25 bp, Mus musculus
taagagagtcttgcctgaatgtccc

SEQ ID NO: 751210 - DNA, 25 bp, Mus musculus
taagagatcatcacgcagtcatagt

SEQ ID NO: 751211 - DNA, 25 bp, Mus musculus
taagagatcatctcgcagtcatagt

SEQ ID NO: 751212 - DNA, 25 bp, Mus musculus
taagagatccaccatcctctttttg

SEQ ID NO: 751213 - DNA, 25 bp, Mus musculus
taagagatccacgatcctctttttg

SEQ ID NO: 751214 - DNA, 25 bp, Mus musculus
taagagatgtatatggtgccgagaa

SEQ ID NO: 751215 - DNA, 25 bp, Mus musculus
taagagatgtatttggtgccgagaa

SEQ ID NO: 751216 - DNA, 25 bp, Mus musculus
taagagatttctaccccatcatgga

SEQ ID NO: 751217 - DNA, 25 bp, Mus musculus
taagagatttcttccccatcatgga

SEQ ID NO: 751218 - DNA, 25 bp, Mus musculus
taagagcaaagtcgcccaaggctgt

SEQ ID NO: 751219 - DNA, 25 bp, Mus musculus
taagagcaaagtggcccaaggctgt

SEQ ID NO: 751220 - DNA, 25 bp, Mus musculus
taagagcaaggcatccctttggtcc

SEQ ID NO: 751221 - DNA, 25 bp, Mus musculus
taagagcaaggcttccctttggtcc

SEQ ID NO: 751222 - DNA, 25 bp, Mus musculus
taagagcaccataccaaagccacat

SEQ ID NO: 751223 - DNA, 25 bp, Mus musculus
taagagcaccattccaaagccacat

SEQ ID NO: 751224 - DNA, 25 bp, Mus musculus
taagagcacccacatcgagcctgtg

SEQ ID NO: 751225 - DNA, 25 bp, Mus musculus
taagagcacccagatcgagcctgtg

SEQ ID NO: 751226 - DNA, 25 bp, Mus musculus
taagagcacttaatgttcctccgga

SEQ ID NO: 751227 - DNA, 25 bp, Mus musculus
taagagcacttattgttcctccgga

SEQ ID NO: 751228 - DNA, 25 bp, Mus musculus
taagagcagctgattatgggttaag

SEQ ID NO: 751229 - DNA, 25 bp, Mus musculus
taagagcagctgtttatgggttaag

SEQ ID NO: 751230 - DNA, 25 bp, Mus musculus
taagagcaggacatccctatgccag

SEQ ID NO: 751231 - DNA, 25 bp, Mus musculus
taagagcaggacttccctatgccag

SEQ ID NO: 751232 - DNA, 25 bp, Mus musculus
taagagcagttgcctaccctgtgtg

SEQ ID NO: 751233 - DNA, 25 bp, Mus musculus
taagagcagttggctaccctgtgtg

SEQ ID NO: 751234 - DNA, 25 bp, Mus musculus
taagagcatcacatcagcaggaggg

SEQ ID NO: 751235 - DNA, 25 bp, Mus musculus
taagagcatcacttcagcaggaggg

SEQ ID NO: 751236 - DNA, 25 bp, Mus musculus
taagagcatctcaagcgtttgacta

SEQ ID NO: 751237 - DNA, 25 bp, Mus musculus
taagagcatctctagcgtttgacta

SEQ ID NO: 751238 - DNA, 25 bp, Mus musculus
taagagcatgagcaagctgaaccct

SEQ ID NO: 751239 - DNA, 25 bp, Mus musculus
taagagcatgaggaagctgaaccct

SEQ ID NO: 751240 - DNA, 25 bp, Mus musculus
taagagcatgccaaactttacccct

SEQ ID NO: 751241 - DNA, 25 bp, Mus musculus
taagagcatgcctaactttacccct

SEQ ID NO: 751242 - DNA, 25 bp, Mus musculus
taagagcatttgagcctcgcagaat

SEQ ID NO: 751243 - DNA, 25 bp, Mus musculus
taagagcatttgtgcctcgcagaat

SEQ ID NO: 751244 - DNA, 25 bp, Mus musculus
taagagcattttcgcagacacaagg

SEQ ID NO: 751245 - DNA, 25 bp, Mus musculus
taagagcattttggcagacacaagg

SEQ ID NO: 751246 - DNA, 25 bp, Mus musculus
taagagccaagtactgtcctgctca

SEQ ID NO: 751247 - DNA, 25 bp, Mus musculus
taagagccaagttctgtcctgctca

SEQ ID NO: 751248 - DNA, 25 bp, Mus musculus
taagagccaccgactctggaacaag

SEQ ID NO: 751249 - DNA, 25 bp, Mus musculus
taagagccaccgtctctggaacaag

SEQ ID NO: 751250 - DNA, 25 bp, Mus musculus
taagagccactgaagatagaaggag

SEQ ID NO: 751251 - DNA, 25 bp, Mus musculus
taagagccactgtagatagaaggag

SEQ ID NO: 751252 - DNA, 25 bp, Mus musculus
taagagccagcgcaggcacacctaa

SEQ ID NO: 751253 - DNA, 25 bp, Mus musculus
taagagccagcggaggcacacctaa

SEQ ID NO: 751254 - DNA, 25 bp, Mus musculus
taagagccatccctcagtacatgag

SEQ ID NO: 751255 - DNA, 25 bp, Mus musculus
taagagccatccgtcagtacatgag

SEQ ID NO: 751256 - DNA, 25 bp, Mus musculus
taagagcccatgaggtaaacgcacc

SEQ ID NO: 751257 - DNA, 25 bp, Mus musculus
taagagcccatgtggtaaacgcacc

SEQ ID NO: 751258 - DNA, 25 bp, Mus musculus
taagagccgcagatacgtgccaaca

SEQ ID NO: 751259 - DNA, 25 bp, Mus musculus
taagagccgcagttacgtgccaaca

SEQ ID NO: 751260 - DNA, 25 bp, Mus musculus
taagagcctccaagggaagccatct

SEQ ID NO: 751261 - DNA, 25 bp, Mus musculus
taagagcctccatgggaagccatct

SEQ ID NO: 751262 - DNA, 25 bp, Mus musculus
taagagcctcgactccagaagtgtc

SEQ ID NO: 751263 - DNA, 25 bp, Mus musculus
taagagcctcgagtccagaagtgtc

SEQ ID NO: 751264 - DNA, 25 bp, Mus musculus
taagagcctcgtcttcagatactac

SEQ ID NO: 751265 - DNA, 25 bp, Mus musculus
taagagcctcgtgttcagatactac

SEQ ID NO: 751266 - DNA, 25 bp, Mus musculus
taagagcctcttagatgtgggttta

SEQ ID NO: 751267 - DNA, 25 bp, Mus musculus
taagagcctctttgatgtgggttta

SEQ ID NO: 751268 - DNA, 25 bp, Mus musculus
taagagccttatctctgatcccttc

SEQ ID NO: 751269 - DNA, 25 bp, Mus musculus
taagagccttatgtctgatcccttc

SEQ ID NO: 751270 - DNA, 25 bp, Mus musculus
taagagcgtaacaggctgtcaggaa

SEQ ID NO: 751271 - DNA, 25 bp, Mus musculus
taagagcgtaactggctgtcaggaa

SEQ ID NO: 751272 - DNA, 25 bp, Mus musculus
taagagcgtacgatttactcctgat

SEQ ID NO: 751273 - DNA, 25 bp, Mus musculus
taagagcgtacgatttattcctgat

SEQ ID NO: 751274 - DNA, 25 bp, Mus musculus
taagagcgtacgttttactcctgat

SEQ ID NO: 751275 - DNA, 25 bp, Mus musculus
taagagcgtacgttttattcctgat

SEQ ID NO: 751276 - DNA, 25 bp, Mus musculus
taagagcgtttacaacgtttcttgt

SEQ ID NO: 751277 - DNA, 25 bp, Mus musculus
taagagcgtttagaacgtttcttgt

SEQ ID NO: 751278 - DNA, 25 bp, Mus musculus
taagagctaggcctctgtttctttc

SEQ ID NO: 751279 - DNA, 25 bp, Mus musculus
taagagctaggcgtctgtttctttc

SEQ ID NO: 751280 - DNA, 25 bp, Mus musculus
taagagctcccaaaacgcctggagt

SEQ ID NO: 751281 - DNA, 25 bp, Mus musculus
taagagctcccataacgcctggagt

SEQ ID NO: 751282 - DNA, 25 bp, Mus musculus
taagagctccgacaatcttgaaaga

SEQ ID NO: 751283 - DNA, 25 bp, Mus musculus
taagagctccgagaatcttgaaaga

SEQ ID NO: 751284 - DNA, 25 bp, Mus musculus
taagagctcgtaactatctactgat

SEQ ID NO: 751285 - DNA, 25 bp, Mus musculus
taagagctcgtatctatctactgat

SEQ ID NO: 751286 - DNA, 25 bp, Mus musculus
taagagctcttccatctataacccg

SEQ ID NO: 751287 - DNA, 25 bp, Mus musculus
taagagctcttcgatctataacccg

SEQ ID NO: 751288 - DNA, 25 bp, Mus musculus
taagagctgaacctctggctttact

SEQ ID NO: 751289 - DNA, 25 bp, Mus musculus
taagagctgaacgtctggctttact

SEQ ID NO: 751290 - DNA, 25 bp, Mus musculus
taagagctgcagaaaggcagtgttt

SEQ ID NO: 751291 - DNA, 25 bp, Mus musculus
taagagctgcagctctcacagaaat

SEQ ID NO: 751292 - DNA, 25 bp, Mus musculus
taagagctgcaggtctcacagaaat

SEQ ID NO: 751293 - DNA, 25 bp, Mus musculus
taagagctgcagtaaggcagtgttt

SEQ ID NO: 751294 - DNA, 25 bp, Mus musculus
taagagctgcctccttacaccagtg

SEQ ID NO: 751295 - DNA, 25 bp, Mus musculus
taagagctgcctgcttacaccagtg

SEQ ID NO: 751296 - DNA, 25 bp, Mus musculus
taagagctgcttacttgtcctgtgc

SEQ ID NO: 751297 - DNA, 25 bp, Mus musculus
taagagctgctttcttgtcctgtgc

SEQ ID NO: 751298 - DNA, 25 bp, Mus musculus
taagagctggagaccggcacgccgt

SEQ ID NO: 751299 - DNA, 25 bp, Mus musculus
taagagctggagtccggcacgccgt

SEQ ID NO: 751300 - DNA, 25 bp, Mus musculus
taagagctggccctgtccttgacta

SEQ ID NO: 751301 - DNA, 25 bp, Mus musculus
taagagctggccgtgtccttgacta

SEQ ID NO: 751302 - DNA, 25 bp, Mus musculus
taagagcttcaacccaagtcctcca

SEQ ID NO: 751303 - DNA, 25 bp, Mus musculus
taagagcttcaagccaagtcctcca

SEQ ID NO: 751304 - DNA, 25 bp, Mus musculus
taagagctttgaccagcgagacctg

SEQ ID NO: 751305 - DNA, 25 bp, Mus musculus
taagagctttgagcagcgagacctg

SEQ ID NO: 751306 - DNA, 25 bp, Mus musculus
taagaggaatccctgaactgtcttc

SEQ ID NO: 751307 - DNA, 25 bp, Mus musculus
taagaggaatccgtgaactgtcttc

SEQ ID NO: 751308 - DNA, 25 bp, Mus musculus
taagaggacaatcctagctgggtgt

SEQ ID NO: 751309 - DNA, 25 bp, Mus musculus
taagaggacaatgctagctgggtgt

SEQ ID NO: 751310 - DNA, 25 bp, Mus musculus
taagaggaccagactctcagcttgg

SEQ ID NO: 751311 - DNA, 25 bp, Mus musculus
taagaggaccagtctctcagcttgg

SEQ ID NO: 751312 - DNA, 25 bp, Mus musculus
taagaggagttacccattagtattt

SEQ ID NO: 751313 - DNA, 25 bp, Mus musculus
taagaggagttagccattagtattt

SEQ ID NO: 751314 - DNA, 25 bp, Mus musculus
taagaggatggactggccccaaccc

SEQ ID NO: 751315 - DNA, 25 bp, Mus musculus
taagaggatggagtggccccaaccc

SEQ ID NO: 751316 - DNA, 25 bp, Mus musculus
taagaggcaagcactccaactccga

SEQ ID NO: 751317 - DNA, 25 bp, Mus musculus
taagaggcaagctctccaactccga

SEQ ID NO: 751318 - DNA, 25 bp, Mus musculus
taagaggcactgaggccctagcgta

SEQ ID NO: 751319 - DNA, 25 bp, Mus musculus
taagaggcactgtggccctagcgta

SEQ ID NO: 751320 - DNA, 25 bp, Mus musculus
taagaggcagataaccatcgaggaa

SEQ ID NO: 751321 - DNA, 25 bp, Mus musculus
taagaggcagattaccatcgaggaa

SEQ ID NO: 751322 - DNA, 25 bp, Mus musculus
taagaggcatcccagataccaccaa

SEQ ID NO: 751323 - DNA, 25 bp, Mus musculus
taagaggcatccgagataccaccaa

SEQ ID NO: 751324 - DNA, 25 bp, Mus musculus
taagaggccccaacaagttgcagat

SEQ ID NO: 751325 - DNA, 25 bp, Mus musculus
taagaggccccatcaagttgcagat

SEQ ID NO: 751326 - DNA, 25 bp, Mus musculus
taagaggcctggcatagtcccctcc

SEQ ID NO: 751327 - DNA, 25 bp, Mus musculus
taagaggcctgggatagtcccctcc

SEQ ID NO: 751328 - DNA, 25 bp, Mus musculus
taagaggctacaaaggatccacaag

SEQ ID NO: 751329 - DNA, 25 bp, Mus musculus
taagaggctacataggatccacaag

SEQ ID NO: 751330 - DNA, 25 bp, Mus musculus
taagaggctcgcagcatgctccgaa

SEQ ID NO: 751331 - DNA, 25 bp, Mus musculus
taagaggctcgctgcatgctccgaa

SEQ ID NO: 751332 - DNA, 25 bp, Mus musculus
taagaggcttgcactgctgaaggga

SEQ ID NO: 751333 - DNA, 25 bp, Mus musculus
taagaggcttgctctgctgaaggga

SEQ ID NO: 751334 - DNA, 25 bp, Mus musculus
taagagggaaccctcatttttgcct

SEQ ID NO: 751335 - DNA, 25 bp, Mus musculus
taagagggaaccgtcatttttgcct

SEQ ID NO: 751336 - DNA, 25 bp, Mus musculus
taagagggccctcgtctttcagcca

SEQ ID NO: 751337 - DNA, 25 bp, Mus musculus
taagagggccctggtctttcagcca

SEQ ID NO: 751338 - DNA, 25 bp, Mus musculus
taagagggtcctcatctgtgcacat

SEQ ID NO: 751339 - DNA, 25 bp, Mus musculus
taagagggtcctgatctgtgcacat

SEQ ID NO: 751340 - DNA, 25 bp, Mus musculus
taagagggtttcagaaccttacctg

SEQ ID NO: 751341 - DNA, 25 bp, Mus musculus
taagagggtttctgaaccttacctg

SEQ ID NO: 751342 - DNA, 25 bp, Mus musculus
taagaggtccttctacagtttctaa

SEQ ID NO: 751343 - DNA, 25 bp, Mus musculus
taagaggtccttgtacagtttctaa

SEQ ID NO: 751344 - DNA, 25 bp, Mus musculus
taagaggtgacccacttgcttcgat

SEQ ID NO: 751345 - DNA, 25 bp, Mus musculus
taagaggtgaccgacttgcttcgat

SEQ ID NO: 751346 - DNA, 25 bp, Mus musculus
taagaggtggtgcaacagtgcccta

SEQ ID NO: 751347 - DNA, 25 bp, Mus musculus
taagaggtggtggaacagtgcccta

SEQ ID NO: 751348 - DNA, 25 bp, Mus musculus
taagaggtgtcccatatgtccagag

SEQ ID NO: 751349 - DNA, 25 bp, Mus musculus
taagaggtgtccgatatgtccagag

SEQ ID NO: 751350 - DNA, 25 bp, Mus musculus
taagaggttgaacactccttttctt

SEQ ID NO: 751351 - DNA, 25 bp, Mus musculus
taagaggttgaagactccttttctt

SEQ ID NO: 751352 - DNA, 25 bp, Mus musculus
taagagtagtctcccaaccttacag

SEQ ID NO: 751353 - DNA, 25 bp, Mus musculus
taagagtagtctgccaaccttacag

SEQ ID NO: 751354 - DNA, 25 bp, Mus musculus
taagagtcaccaagtttaatagtat

SEQ ID NO: 751355 - DNA, 25 bp, Mus musculus
taagagtcaccatgtttaatagtat

SEQ ID NO: 751356 - DNA, 25 bp, Mus musculus
taagagtcactccagttgctccagg

SEQ ID NO: 751357 - DNA, 25 bp, Mus musculus
taagagtcactcgagttgctccagg

SEQ ID NO: 751358 - DNA, 25 bp, Mus musculus
taagagtcagatccctaatgctact

SEQ ID NO: 751359 - DNA, 25 bp, Mus musculus
taagagtcagatgcctaatgctact

SEQ ID NO: 751360 - DNA, 25 bp, Mus musculus
taagagtccaccacaacagaagaaa

SEQ ID NO: 751361 - DNA, 25 bp, Mus musculus
taagagtccacctcaacagaagaaa

SEQ ID NO: 751362 - DNA, 25 bp, Mus musculus
taagagtcccatccctgtgtgacac

SEQ ID NO: 751363 - DNA, 25 bp, Mus musculus
taagagtcccatgcctgtgtgacac

SEQ ID NO: 751364 - DNA, 25 bp, Mus musculus
taagagtcgcttaggtcatggcgtc

SEQ ID NO: 751365 - DNA, 25 bp, Mus musculus
taagagtcgctttggtcatggcgtc

SEQ ID NO: 751366 - DNA, 25 bp, Mus musculus
taagagtctaccaggcacacagatg

SEQ ID NO: 751367 - DNA, 25 bp, Mus musculus
taagagtctacctggcacacagatg

SEQ ID NO: 751368 - DNA, 25 bp, Mus musculus
taagagtctgtaaggcagcccactg

SEQ ID NO: 751369 - DNA, 25 bp, Mus musculus
taagagtctgtatggcagcccactg

SEQ ID NO: 751370 - DNA, 25 bp, Mus musculus
taagagtctgtgattggcatgggct

SEQ ID NO: 751371 - DNA, 25 bp, Mus musculus
taagagtctgtgtttggcatgggct

SEQ ID NO: 751372 - DNA, 25 bp, Mus musculus
taagagtcttacctcagaattttaa

SEQ ID NO: 751373 - DNA, 25 bp, Mus musculus
taagagtcttacgtcagaattttaa

SEQ ID NO: 751374 - DNA, 25 bp, Mus musculus
taagagtctttcaggccaggttcgt

SEQ ID NO: 751375 - DNA, 25 bp, Mus musculus
taagagtctttctggccaggttcgt

SEQ ID NO: 751376 - DNA, 25 bp, Mus musculus
taagagtgacctcgagtcgccatgg

SEQ ID NO: 751377 - DNA, 25 bp, Mus musculus
taagagtgacctggagtcgccatgg

SEQ ID NO: 751378 - DNA, 25 bp, Mus musculus
taagagtgacttatgcctcctttca

SEQ ID NO: 751379 - DNA, 25 bp, Mus musculus
taagagtgacttttgcctcctttca

SEQ ID NO: 751380 - DNA, 25 bp, Mus musculus
taagagtgaggaaccttccaaggga

SEQ ID NO: 751381 - DNA, 25 bp, Mus musculus
taagagtgaggatccttccaaggga

SEQ ID NO: 751382 - DNA, 25 bp, Mus musculus
taagagtgattgctgcttttccggg

SEQ ID NO: 751383 - DNA, 25 bp, Mus musculus
taagagtgattggtgcttttccggg

SEQ ID NO: 751384 - DNA, 25 bp, Mus musculus
taagagtgcagtacaattcacagct

SEQ ID NO: 751385 - DNA, 25 bp, Mus musculus
taagagtgcagttcaattcacagct

SEQ ID NO: 751386 - DNA, 25 bp, Mus musculus
taagagtgcatgcatcgtggccacc

SEQ ID NO: 751387 - DNA, 25 bp, Mus musculus
taagagtgcatggatcgtggccacc

SEQ ID NO: 751388 - DNA, 25 bp, Mus musculus
taagagtgccatcccttgtcaagat

SEQ ID NO: 751389 - DNA, 25 bp, Mus musculus
taagagtgccatgccttgtcaagat

SEQ ID NO: 751390 - DNA, 25 bp, Mus musculus
taagagtgcctgcttgtcttcgaga

SEQ ID NO: 751391 - DNA, 25 bp, Mus musculus
taagagtgcctggttgtcttcgaga

SEQ ID NO: 751392 - DNA, 25 bp, Mus musculus
taagagtgcggaagtcctcccagca

SEQ ID NO: 751393 - DNA, 25 bp, Mus musculus
taagagtgcggatgtcctcccagca

SEQ ID NO: 751394 - DNA, 25 bp, Mus musculus
taagagtgctgtacaaagacgcggt

SEQ ID NO: 751395 - DNA, 25 bp, Mus musculus
taagagtgctgttcaaagacgcggt

SEQ ID NO: 751396 - DNA, 25 bp, Mus musculus
taagagtgcttgatgctcctccaga

SEQ ID NO: 751397 - DNA, 25 bp, Mus musculus
taagagtgcttgttgctcctccaga

SEQ ID NO: 751398 - DNA, 25 bp, Mus musculus
taagagtgggccatcatgtccatga

SEQ ID NO: 751399 - DNA, 25 bp, Mus musculus
taagagtgggccttcatgtccatga

SEQ ID NO: 751400 - DNA, 25 bp, Mus musculus
taagagtgttctagagccaggcgtg

SEQ ID NO: 751401 - DNA, 25 bp, Mus musculus
taagagtgttcttgagccaggcgtg

SEQ ID NO: 751402 - DNA, 25 bp, Mus musculus
taagagtgtttgaggttgtaattgt

SEQ ID NO: 751403 - DNA, 25 bp, Mus musculus
taagagtgtttgtggttgtaattgt

SEQ ID NO: 751404 - DNA, 25 bp, Mus musculus
taagagttaatacctgtgctggcag

SEQ ID NO: 751405 - DNA, 25 bp, Mus musculus
taagagttaatagctgtgctggcag

SEQ ID NO: 751406 - DNA, 25 bp, Mus musculus
taagagttcacgatgccctgaggca

SEQ ID NO: 751407 - DNA, 25 bp, Mus musculus
taagagttcacgttgccctgaggca

SEQ ID NO: 751408 - DNA, 25 bp, Mus musculus
taagagttcaggctcttcctgcata

SEQ ID NO: 751409 - DNA, 25 bp, Mus musculus
taagagttcagggtcttcctgcata

SEQ ID NO: 751410 - DNA, 25 bp, Mus musculus
taagagttcatcatcctgtttgcct

SEQ ID NO: 751411 - DNA, 25 bp, Mus musculus
taagagttcatcttcctgtttgcct

SEQ ID NO: 751412 - DNA, 25 bp, Mus musculus
taagagttcctcagcttctcccatg

SEQ ID NO: 751413 - DNA, 25 bp, Mus musculus
taagagttcctcatcactagttacc

SEQ ID NO: 751414 - DNA, 25 bp, Mus musculus
taagagttcctctgcttctcccatg

SEQ ID NO: 751415 - DNA, 25 bp, Mus musculus
taagagttcctcttcactagttacc

SEQ ID NO: 751416 - DNA, 25 bp, Mus musculus
taagagttgcctaggagccaggtgt

SEQ ID NO: 751417 - DNA, 25 bp, Mus musculus
taagagttgccttggagccaggtgt

SEQ ID NO: 751418 - DNA, 25 bp, Mus musculus
taagagttgcttactctcgttttgc

SEQ ID NO: 751419 - DNA, 25 bp, Mus musculus
taagagttgctttctctcgttttgc

SEQ ID NO: 751420 - DNA, 25 bp, Mus musculus
taagagtttccaccagcactgtctt

SEQ ID NO: 751421 - DNA, 25 bp, Mus musculus
taagagtttccagcagcactgtctt

SEQ ID NO: 751422 - DNA, 25 bp, Mus musculus
taagagtttgctatgaaatccatgg

SEQ ID NO: 751423 - DNA, 25 bp, Mus musculus
taagagtttgctttgaaatccatgg

SEQ ID NO: 751424 - DNA, 25 bp, Mus musculus
taagataaaactcctcccttccagc

SEQ ID NO: 751425 - DNA, 25 bp, Mus musculus
taagataaaactgctcccttccagc

SEQ ID NO: 751426 - DNA, 25 bp, Mus musculus
taagataaacccagcctttttagca

SEQ ID NO: 751427 - DNA, 25 bp, Mus musculus
taagataaaccctgcctttttagca

SEQ ID NO: 751428 - DNA, 25 bp, Mus musculus
taagataacagtccgggccctggat

SEQ ID NO: 751429 - DNA, 25 bp, Mus musculus
taagataacagtgcgggccctggat

SEQ ID NO: 751430 - DNA, 25 bp, Mus musculus
taagataactacactgtgcagatag

SEQ ID NO: 751431 - DNA, 25 bp, Mus musculus
taagataactactctgtgcagatag

SEQ ID NO: 751432 - DNA, 25 bp, Mus musculus
taagataatacccagcaccaaagag

SEQ ID NO: 751433 - DNA, 25 bp, Mus musculus
taagataataccgagcaccaaagag

SEQ ID NO: 751434 - DNA, 25 bp, Mus musculus
taagataattcactgtcgcttctct

SEQ ID NO: 751435 - DNA, 25 bp, Mus musculus
taagataattcagtgtcgcttctct

SEQ ID NO: 751436 - DNA, 25 bp, Mus musculus
taagatacaacaactttttgggccc

SEQ ID NO: 751437 - DNA, 25 bp, Mus musculus
taagatacaacatctttttgggccc

SEQ ID NO: 751438 - DNA, 25 bp, Mus musculus
taagatacccagctgatccgagctc

SEQ ID NO: 751439 - DNA, 25 bp, Mus musculus
taagatacccaggtgatccgagctc

SEQ ID NO: 751440 - DNA, 25 bp, Mus musculus
taagatactataataaggcactatt

SEQ ID NO: 751441 - DNA, 25 bp, Mus musculus
taagatactatattaaggcactatt

SEQ ID NO: 751442 - DNA, 25 bp, Mus musculus
taagatacttaacctttcacctggg

SEQ ID NO: 751443 - DNA, 25 bp, Mus musculus
taagatacttaagctttcacctggg

SEQ ID NO: 751444 - DNA, 25 bp, Mus musculus
taagatagcaggcacacactctcca

SEQ ID NO: 751445 - DNA, 25 bp, Mus musculus
taagatagcagggacacactctcca

SEQ ID NO: 751446 - DNA, 25 bp, Mus musculus
taagatagcttcagcctcaggactc

SEQ ID NO: 751447 - DNA, 25 bp, Mus musculus
taagatagcttctgcctcaggactc

SEQ ID NO: 751448 - DNA, 25 bp, Mus musculus
taagatagctttctccagtcctacc

SEQ ID NO: 751449 - DNA, 25 bp, Mus musculus
taagatagctttgtccagtcctacc

SEQ ID NO: 751450 - DNA, 25 bp, Mus musculus
taagataggaacaagccagcctggg

SEQ ID NO: 751451 - DNA, 25 bp, Mus musculus
taagataggaactagccagcctggg

SEQ ID NO: 751452 - DNA, 25 bp, Mus musculus
taagataggtacaccccgattccca

SEQ ID NO: 751453 - DNA, 25 bp, Mus musculus
taagataggtactccccgattccca

SEQ ID NO: 751454 - DNA, 25 bp, Mus musculus
taagatagtgaacatggccaagcat

SEQ ID NO: 751455 - DNA, 25 bp, Mus musculus
taagatagtgaagatggccaagcat

SEQ ID NO: 751456 - DNA, 25 bp, Mus musculus
taagatatcattatcggaggcgact

SEQ ID NO: 751457 - DNA, 25 bp, Mus musculus
taagatatcattttcggaggcgact

SEQ ID NO: 751458 - DNA, 25 bp, Mus musculus
taagatattcttactacaccttgaa

SEQ ID NO: 751459 - DNA, 25 bp, Mus musculus
taagatattctttctacaccttgaa

SEQ ID NO: 751460 - DNA, 25 bp, Mus musculus
taagatcaaccgcattttccacgaa

SEQ ID NO: 751461 - DNA, 25 bp, Mus musculus
taagatcaaccggattttccacgaa

SEQ ID NO: 751462 - DNA, 25 bp, Mus musculus
taagatcacagtcgtctcctgcttt

SEQ ID NO: 751463 - DNA, 25 bp, Mus musculus
taagatcacagtggtctcctgcttt

SEQ ID NO: 751464 - DNA, 25 bp, Mus musculus
taagatcacatgactcaaccaattt

SEQ ID NO: 751465 - DNA, 25 bp, Mus musculus
taagatcacatgtctcaaccaattt

SEQ ID NO: 751466 - DNA, 25 bp, Mus musculus
taagatcacctccacgctggaagaa

SEQ ID NO: 751467 - DNA, 25 bp, Mus musculus
taagatcacctcgacgctggaagaa

SEQ ID NO: 751468 - DNA, 25 bp, Mus musculus
taagatcaccttatagctacaagtt

SEQ ID NO: 751469 - DNA, 25 bp, Mus musculus
taagatcaccttttagctacaagtt

SEQ ID NO: 751470 - DNA, 25 bp, Mus musculus
taagatcagtgacttcggctgctcc

SEQ ID NO: 751471 - DNA, 25 bp, Mus musculus
taagatcagtgagttcggctgctcc

SEQ ID NO: 751472 - DNA, 25 bp, Mus musculus
taagatcatcttcctgttgtaaaag

SEQ ID NO: 751473 - DNA, 25 bp, Mus musculus
taagatcatcttgctgttgtaaaag

SEQ ID NO: 751474 - DNA, 25 bp, Mus musculus
taagatcattctaggctctaagggt

SEQ ID NO: 751475 - DNA, 25 bp, Mus musculus
taagatcattcttggctctaagggt

SEQ ID NO: 751476 - DNA, 25 bp, Mus musculus
taagatccaacacctttttgcccct

SEQ ID NO: 751477 - DNA, 25 bp, Mus musculus
taagatccaacagctttttgcccct

SEQ ID NO: 751478 - DNA, 25 bp, Mus musculus
taagatccacaacagcagtcggcca

SEQ ID NO: 751479 - DNA, 25 bp, Mus musculus
taagatccacaagagcagtcggcca

SEQ ID NO: 751480 - DNA, 25 bp, Mus musculus
taagatccacctactttttcagctg

SEQ ID NO: 751481 - DNA, 25 bp, Mus musculus
taagatccaccttctttttcagctg

SEQ ID NO: 751482 - DNA, 25 bp, Mus musculus
taagatccataacccgtttgctaac

SEQ ID NO: 751483 - DNA, 25 bp, Mus musculus
taagatccataagccgtttgctaac

SEQ ID NO: 751484 - DNA, 25 bp, Mus musculus
taagatccatcacagctgccaagta

SEQ ID NO: 751485 - DNA, 25 bp, Mus musculus
taagatccatcagagctgccaagta

SEQ ID NO: 751486 - DNA, 25 bp, Mus musculus
taagatccatcccaacgctttatat

SEQ ID NO: 751487 - DNA, 25 bp, Mus musculus
taagatccatccgaacgctttatat

SEQ ID NO: 751488 - DNA, 25 bp, Mus musculus
taagatccatgtatattctgcccct

SEQ ID NO: 751489 - DNA, 25 bp, Mus musculus
taagatccatgtttattctgcccct

SEQ ID NO: 751490 - DNA, 25 bp, Mus musculus
taagatccctctctttgccttgaga

SEQ ID NO: 751491 - DNA, 25 bp, Mus musculus
taagatccctctgtttgccttgaga

SEQ ID NO: 751492 - DNA, 25 bp, Mus musculus
taagatccgtgactctgctagccct

SEQ ID NO: 751493 - DNA, 25 bp, Mus musculus
taagatccgtgagtctgctagccct

SEQ ID NO: 751494 - DNA, 25 bp, Mus musculus
taagatcctattctgtcacattaca

SEQ ID NO: 751495 - DNA, 25 bp, Mus musculus
taagatcctattgtgtcacattaca

SEQ ID NO: 751496 - DNA, 25 bp, Mus musculus
taagatcctccaaggcttcaaagac

SEQ ID NO: 751497 - DNA, 25 bp, Mus musculus
taagatcctccatggcttcaaagac

SEQ ID NO: 751498 - DNA, 25 bp, Mus musculus
taagatccttctcggccacaaggcc

SEQ ID NO: 751499 - DNA, 25 bp, Mus musculus
taagatccttctgggccacaaggcc

SEQ ID NO: 751500 - DNA, 25 bp, Mus musculus
taagatcgatggagaatggtggaca

SEQ ID NO: 751501 - DNA, 25 bp, Mus musculus
taagatcgatggtgaatggtggaca

SEQ ID NO: 751502 - DNA, 25 bp, Mus musculus
taagatcggccacctgaactccaag

SEQ ID NO: 751503 - DNA, 25 bp, Mus musculus
taagatcggccagctgaactccaag

SEQ ID NO: 751504 - DNA, 25 bp, Mus musculus
taagatcgttcacggccaggagcgt

SEQ ID NO: 751505 - DNA, 25 bp, Mus musculus
taagatcgttcagggccaggagcgt

SEQ ID NO: 751506 - DNA, 25 bp, Mus musculus
taagatctcatgctcatcgttttct

SEQ ID NO: 751507 - DNA, 25 bp, Mus musculus
taagatctcatggtcatcgttttct

SEQ ID NO: 751508 - DNA, 25 bp, Mus musculus
taagatctctgcaacctggacaatg

SEQ ID NO: 751509 - DNA, 25 bp, Mus musculus
taagatctctgctacctggacaatg

SEQ ID NO: 751510 - DNA, 25 bp, Mus musculus
taagatctctttaattcccctgtac

SEQ ID NO: 751511 - DNA, 25 bp, Mus musculus
taagatctcttttattcccctgtac

SEQ ID NO: 751512 - DNA, 25 bp, Mus musculus
taagatctgctgcaacgcgccctgt

SEQ ID NO: 751513 - DNA, 25 bp, Mus musculus
taagatctgctggaacgcgccctgt

SEQ ID NO: 751514 - DNA, 25 bp, Mus musculus
taagatctggttattgctccacccc

SEQ ID NO: 751515 - DNA, 25 bp, Mus musculus
taagatctggtttttgctccacccc

SEQ ID NO: 751516 - DNA, 25 bp, Mus musculus
taagatctgtcaaccttgccttttg

SEQ ID NO: 751517 - DNA, 25 bp, Mus musculus
taagatctgtcatccttgccttttg

SEQ ID NO: 751518 - DNA, 25 bp, Mus musculus
taagatcttgtcctaaaaccataaa

SEQ ID NO: 751519 - DNA, 25 bp, Mus musculus
taagatcttgtcgtaaaaccataaa

SEQ ID NO: 751520 - DNA, 25 bp, Mus musculus
taagatcttgtgaaagcacctaagt

SEQ ID NO: 751521 - DNA, 25 bp, Mus musculus
taagatcttgtgtaagcacctaagt

SEQ ID NO: 751522 - DNA, 25 bp, Mus musculus
taagatgaaccaactcaaagtgctg

SEQ ID NO: 751523 - DNA, 25 bp, Mus musculus
taagatgaaccatctcaaagtgctg

SEQ ID NO: 751524 - DNA, 25 bp, Mus musculus
taagatgaacctaacctttgcctcc

SEQ ID NO: 751525 - DNA, 25 bp, Mus musculus
taagatgaaccttacctttgcctcc

SEQ ID NO: 751526 - DNA, 25 bp, Mus musculus
taagatgaagtcaccctgctgaggc

SEQ ID NO: 751527 - DNA, 25 bp, Mus musculus
taagatgaagtctccctgctgaggc

SEQ ID NO: 751528 - DNA, 25 bp, Mus musculus
taagatgacatcacacgtggtgaac

SEQ ID NO: 751529 - DNA, 25 bp, Mus musculus
taagatgacatctcacgtggtgaac

SEQ ID NO: 751530 - DNA, 25 bp, Mus musculus
taagatgagcgcaagttgaatctgc

SEQ ID NO: 751531 - DNA, 25 bp, Mus musculus
taagatgagcgctagttgaatctgc

SEQ ID NO: 751532 - DNA, 25 bp, Mus musculus
taagatgagcttcgtgcctgttggc

SEQ ID NO: 751533 - DNA, 25 bp, Mus musculus
taagatgagcttggtgcctgttggc

SEQ ID NO: 751534 - DNA, 25 bp, Mus musculus
taagatgattcacctgtttgcccgt

SEQ ID NO: 751535 - DNA, 25 bp, Mus musculus
taagatgattcagctgtttgcccgt

SEQ ID NO: 751536 - DNA, 25 bp, Mus musculus
taagatgcaaaacaggtcagtggct

SEQ ID NO: 751537 - DNA, 25 bp, Mus musculus
taagatgcaaaagaggtcagtggct

SEQ ID NO: 751538 - DNA, 25 bp, Mus musculus
taagatgcacttctccctcaaagag

SEQ ID NO: 751539 - DNA, 25 bp, Mus musculus
taagatgcacttgtccctcaaagag

SEQ ID NO: 751540 - DNA, 25 bp, Mus musculus
taagatgcatatacagacctcagat

SEQ ID NO: 751541 - DNA, 25 bp, Mus musculus
taagatgcatattcagacctcagat

SEQ ID NO: 751542 - DNA, 25 bp, Mus musculus
taagatgccattccttgagcacata

SEQ ID NO: 751543 - DNA, 25 bp, Mus musculus
taagatgccattgcttgagcacata

SEQ ID NO: 751544 - DNA, 25 bp, Mus musculus
taagatgcccaacgcttaggctaat

SEQ ID NO: 751545 - DNA, 25 bp, Mus musculus
taagatgcccaaggcttaggctaat

SEQ ID NO: 751546 - DNA, 25 bp, Mus musculus
taagatgcccacctttctacggagt

SEQ ID NO: 751547 - DNA, 25 bp, Mus musculus
taagatgcccacgtttctacggagt

SEQ ID NO: 751548 - DNA, 25 bp, Mus musculus
taagatgccccgacgaggaggctga

SEQ ID NO: 751549 - DNA, 25 bp, Mus musculus
taagatgccccgtcgaggaggctga

SEQ ID NO: 751550 - DNA, 25 bp, Mus musculus
taagatgccggcatggagcacacag

SEQ ID NO: 751551 - DNA, 25 bp, Mus musculus
taagatgccggcttggagcacacag

SEQ ID NO: 751552 - DNA, 25 bp, Mus musculus
taagatgcggtgagcccagtcagga

SEQ ID NO: 751553 - DNA, 25 bp, Mus musculus
taagatgcggtgtgcccagtcagga

SEQ ID NO: 751554 - DNA, 25 bp, Mus musculus
taagatgcgttcagccagtgggcgt

SEQ ID NO: 751555 - DNA, 25 bp, Mus musculus
taagatgcgttctgccagtgggcgt

SEQ ID NO: 751556 - DNA, 25 bp, Mus musculus
taagatgctaacacttctcactggg

SEQ ID NO: 751557 - DNA, 25 bp, Mus musculus
taagatgctaactcttctcactggg

SEQ ID NO: 751558 - DNA, 25 bp, Mus musculus
taagatgctcatagtgttggaaggt

SEQ ID NO: 751559 - DNA, 25 bp, Mus musculus
taagatgctcattgtgttggaaggt

SEQ ID NO: 751560 - DNA, 25 bp, Mus musculus
taagatgctcttcactcagcttctc

SEQ ID NO: 751561 - DNA, 25 bp, Mus musculus
taagatgctcttgactcagcttctc

SEQ ID NO: 751562 - DNA, 25 bp, Mus musculus
taagatgctgaaccccaagcccagt

SEQ ID NO: 751563 - DNA, 25 bp, Mus musculus
taagatgctgaagcccaagcccagt

SEQ ID NO: 751564 - DNA, 25 bp, Mus musculus
taagatgctgagagaccctgacccc

SEQ ID NO: 751565 - DNA, 25 bp, Mus musculus
taagatgctgagtgaccctgacccc

SEQ ID NO: 751566 - DNA, 25 bp, Mus musculus
taagatgctgtaaagtgagtgcccc

SEQ ID NO: 751567 - DNA, 25 bp, Mus musculus
taagatgctgtatagtgagtgcccc

SEQ ID NO: 751568 - DNA, 25 bp, Mus musculus
taagatgctttcagggttggaacat

SEQ ID NO: 751569 - DNA, 25 bp, Mus musculus
taagatgctttccagcactcactct

SEQ ID NO: 751570 - DNA, 25 bp, Mus musculus
taagatgctttcgagcactcactct

SEQ ID NO: 751571 - DNA, 25 bp, Mus musculus
taagatgctttctgggttggaacat

SEQ ID NO: 751572 - DNA, 25 bp, Mus musculus
taagatgcttttcccgcacatcctt

SEQ ID NO: 751573 - DNA, 25 bp, Mus musculus
taagatgcttttgccgcacatcctt

SEQ ID NO: 751574 - DNA, 25 bp, Mus musculus
taagatggacggagcccctgatggc

SEQ ID NO: 751575 - DNA, 25 bp, Mus musculus
taagatggacggtgcccctgatggc

SEQ ID NO: 751576 - DNA, 25 bp, Mus musculus
taagatggccatcacccaaacgtcg

SEQ ID NO: 751577 - DNA, 25 bp, Mus musculus
taagatggccatgacccaaacgtcg

SEQ ID NO: 751578 - DNA, 25 bp, Mus musculus
taagatggctttcttttaccctcct

SEQ ID NO: 751579 - DNA, 25 bp, Mus musculus
taagatggctttgttttaccctcct

SEQ ID NO: 751580 - DNA, 25 bp, Mus musculus
taagatgggaccaggctgcgctgaa

SEQ ID NO: 751581 - DNA, 25 bp, Mus musculus
taagatgggacctggctgcgctgaa

SEQ ID NO: 751582 - DNA, 25 bp, Mus musculus
taagatgggagcatcccagccttca

SEQ ID NO: 751583 - DNA, 25 bp, Mus musculus
taagatgggagcttcccagccttca

SEQ ID NO: 751584 - DNA, 25 bp, Mus musculus
taagatgggatcaccctggctggag

SEQ ID NO: 751585 - DNA, 25 bp, Mus musculus
taagatgggatctccctggctggag

SEQ ID NO: 751586 - DNA, 25 bp, Mus musculus
taagatgggccaaggaaattcttga

SEQ ID NO: 751587 - DNA, 25 bp, Mus musculus
taagatgggccatggaaattcttga

SEQ ID NO: 751588 - DNA, 25 bp, Mus musculus
taagatggtgttcctgcagactgca

SEQ ID NO: 751589 - DNA, 25 bp, Mus musculus
taagatggtgttgctgcagactgca

SEQ ID NO: 751590 - DNA, 25 bp, Mus musculus
taagatgtacggcattcgcgcgtga

SEQ ID NO: 751591 - DNA, 25 bp, Mus musculus
taagatgtacgggattcgcgcgtga

SEQ ID NO: 751592 - DNA, 25 bp, Mus musculus
taagatgtatctaccaacttgactt

SEQ ID NO: 751593 - DNA, 25 bp, Mus musculus
taagatgtatcttccaacttgactt

SEQ ID NO: 751594 - DNA, 25 bp, Mus musculus
taagatgtccacacccctggagata

SEQ ID NO: 751595 - DNA, 25 bp, Mus musculus
taagatgtccactcccctggagata

SEQ ID NO: 751596 - DNA, 25 bp, Mus musculus
taagatgtctctacctataccgttc

SEQ ID NO: 751597 - DNA, 25 bp, Mus musculus
taagatgtctcttcctataccgttc

SEQ ID NO: 751598 - DNA, 25 bp, Mus musculus
taagatgtcttgaggctgcaactaa

SEQ ID NO: 751599 - DNA, 25 bp, Mus musculus
taagatgtcttgtggctgcaactaa

SEQ ID NO: 751600 - DNA, 25 bp, Mus musculus
taagatgtgcatctttcctacccta

SEQ ID NO: 751601 - DNA, 25 bp, Mus musculus
taagatgtgcatgtttcctacccta

SEQ ID NO: 751602 - DNA, 25 bp, Mus musculus
taagatgtggacagtgacctaatac

SEQ ID NO: 751603 - DNA, 25 bp, Mus musculus
taagatgtggactgtgacctaatac

SEQ ID NO: 751604 - DNA, 25 bp, Mus musculus
taagatgttaatacttttccttgtt

SEQ ID NO: 751605 - DNA, 25 bp, Mus musculus
taagatgttaattcttttccttgtt

SEQ ID NO: 751606 - DNA, 25 bp, Mus musculus
taagatgttctcatgttgcttttac

SEQ ID NO: 751607 - DNA, 25 bp, Mus musculus
taagatgttctcttgttgcttttac

SEQ ID NO: 751608 - DNA, 25 bp, Mus musculus
taagatgttcttctggttgggtttt

SEQ ID NO: 751609 - DNA, 25 bp, Mus musculus
taagatgttcttgtggttgggtttt

SEQ ID NO: 751610 - DNA, 25 bp, Mus musculus
taagatgttgcactggtggcaattc

SEQ ID NO: 751611 - DNA, 25 bp, Mus musculus
taagatgttgcagtggtggcaattc

SEQ ID NO: 751612 - DNA, 25 bp, Mus musculus
taagattacttccaatttggcccaa

SEQ ID NO: 751613 - DNA, 25 bp, Mus musculus
taagattacttcgaatttggcccaa

SEQ ID NO: 751614 - DNA, 25 bp, Mus musculus
taagattattcacacagaggcacgt

SEQ ID NO: 751615 - DNA, 25 bp, Mus musculus
taagattattcagacagaggcacgt

SEQ ID NO: 751616 - DNA, 25 bp, Mus musculus
taagattcaaagagctggacggtat

SEQ ID NO: 751617 - DNA, 25 bp, Mus musculus
taagattcaaagtgctggacggtat

SEQ ID NO: 751618 - DNA, 25 bp, Mus musculus
taagattcagttaacccactttgtt

SEQ ID NO: 751619 - DNA, 25 bp, Mus musculus
taagattcagtttacccactttgtt

SEQ ID NO: 751620 - DNA, 25 bp, Mus musculus
taagattccaccactgcccaatgct

SEQ ID NO: 751621 - DNA, 25 bp, Mus musculus
taagattccacctctgcccaatgct

SEQ ID NO: 751622 - DNA, 25 bp, Mus musculus
taagattccatcattccacgtgtgt

SEQ ID NO: 751623 - DNA, 25 bp, Mus musculus
taagattccatctttccacgtgtgt

SEQ ID NO: 751624 - DNA, 25 bp, Mus musculus
taagattcccacaattttgatattc

SEQ ID NO: 751625 - DNA, 25 bp, Mus musculus
taagattcccactattttgatattc

SEQ ID NO: 751626 - DNA, 25 bp, Mus musculus
taagattccgaacgccacgggacac

SEQ ID NO: 751627 - DNA, 25 bp, Mus musculus
taagattccgaaggccacgggacac

SEQ ID NO: 751628 - DNA, 25 bp, Mus musculus
taagattccttcctaggccaacctt

SEQ ID NO: 751629 - DNA, 25 bp, Mus musculus
taagattccttcgtaggccaacctt

SEQ ID NO: 751630 - DNA, 25 bp, Mus musculus
taagattcggccctcatttgcagag

SEQ ID NO: 751631 - DNA, 25 bp, Mus musculus
taagattcggccgtcatttgcagag

SEQ ID NO: 751632 - DNA, 25 bp, Mus musculus
taagattctcccctattaactacct

SEQ ID NO: 751633 - DNA, 25 bp, Mus musculus
taagattctcccgtattaactacct

SEQ ID NO: 751634 - DNA, 25 bp, Mus musculus
taagattgactgacgtgccccaggg

SEQ ID NO: 751635 - DNA, 25 bp, Mus musculus
taagattgactgtcgtgccccaggg

SEQ ID NO: 751636 - DNA, 25 bp, Mus musculus
taagattgctgccttcgcctgttac

SEQ ID NO: 751637 - DNA, 25 bp, Mus musculus
taagattgctgcgttcgcctgttac

SEQ ID NO: 751638 - DNA, 25 bp, Mus musculus
taagattggcttacacagggctgaa

SEQ ID NO: 751639 - DNA, 25 bp, Mus musculus
taagattggctttcacagggctgaa

SEQ ID NO: 751640 - DNA, 25 bp, Mus musculus
taagattgggtaatcgctgccacag

SEQ ID NO: 751641 - DNA, 25 bp, Mus musculus
taagattgggtattcgctgccacag

SEQ ID NO: 751642 - DNA, 25 bp, Mus musculus
taagattgtcacaggctgcttgcgc

SEQ ID NO: 751643 - DNA, 25 bp, Mus musculus
taagattgtcactggctgcttgcgc

SEQ ID NO: 751644 - DNA, 25 bp, Mus musculus
taagatttacatagtttcaggcatg

SEQ ID NO: 751645 - DNA, 25 bp, Mus musculus
taagatttacattgtttcaggcatg

SEQ ID NO: 751646 - DNA, 25 bp, Mus musculus
taagatttatacatccgtttttaat

SEQ ID NO: 751647 - DNA, 25 bp, Mus musculus
taagatttatacttccgtttttaat

SEQ ID NO: 751648 - DNA, 25 bp, Mus musculus
taagatttcagcaattcctgctgct

SEQ ID NO: 751649 - DNA, 25 bp, Mus musculus
taagatttcagctattcctgctgct

SEQ ID NO: 751650 - DNA, 25 bp, Mus musculus
taagatttcatacttctcagttctg

SEQ ID NO: 751651 - DNA, 25 bp, Mus musculus
taagatttcatagttctcagttctg

SEQ ID NO: 751652 - DNA, 25 bp, Mus musculus
taagatttcttcattgcctcacagc

SEQ ID NO: 751653 - DNA, 25 bp, Mus musculus
taagatttcttctttgcctcacagc

SEQ ID NO: 751654 - DNA, 25 bp, Mus musculus
taagcaaaattccttctctttccac

SEQ ID NO: 751655 - DNA, 25 bp, Mus musculus
taagcaaaattcgttctctttccac

SEQ ID NO: 751656 - DNA, 25 bp, Mus musculus
taagcaaagcggctctccaagcaaa

SEQ ID NO: 751657 - DNA, 25 bp, Mus musculus
taagcaaagcgggtctccaagcaaa

SEQ ID NO: 751658 - DNA, 25 bp, Mus musculus
taagcaaagcttagtcctgggacgt

SEQ ID NO: 751659 - DNA, 25 bp, Mus musculus
taagcaaagctttgtcctgggacgt

SEQ ID NO: 751660 - DNA, 25 bp, Mus musculus
taagcaaatgccagtacccacagtg

SEQ ID NO: 751661 - DNA, 25 bp, Mus musculus
taagcaaatgcctgtacccacagtg

SEQ ID NO: 751662 - DNA, 25 bp, Mus musculus
taagcaaatgcgaaaggcccggtcc

SEQ ID NO: 751663 - DNA, 25 bp, Mus musculus
taagcaaatgcgtaaggcccggtcc

SEQ ID NO: 751664 - DNA, 25 bp, Mus musculus
taagcaaattgcctgagaacataca

SEQ ID NO: 751665 - DNA, 25 bp, Mus musculus
taagcaaattgccttggaccgaggt

SEQ ID NO: 751666 - DNA, 25 bp, Mus musculus
taagcaaattgcgtgagaacataca

SEQ ID NO: 751667 - DNA, 25 bp, Mus musculus
taagcaaattgcgttggaccgaggt

SEQ ID NO: 751668 - DNA, 25 bp, Mus musculus
taagcaacagctaccatgaaagaga

SEQ ID NO: 751669 - DNA, 25 bp, Mus musculus
taagcaacagcttccatgaaagaga

SEQ ID NO: 751670 - DNA, 25 bp, Mus musculus
taagcaacagtcaaaatcatctatg

SEQ ID NO: 751671 - DNA, 25 bp, Mus musculus
taagcaacagtctaaatcatctatg

SEQ ID NO: 751672 - DNA, 25 bp, Mus musculus
taagcaaccgtgcatcctctgaaag

SEQ ID NO: 751673 - DNA, 25 bp, Mus musculus
taagcaaccgtggatcctctgaaag

SEQ ID NO: 751674 - DNA, 25 bp, Mus musculus
taagcaactccacctctgagaaagt

SEQ ID NO: 751675 - DNA, 25 bp, Mus musculus
taagcaactccagctctgagaaagt

SEQ ID NO: 751676 - DNA, 25 bp, Mus musculus
taagcaacttcacagaaaccatata

SEQ ID NO: 751677 - DNA, 25 bp, Mus musculus
taagcaacttcagagaaaccatata

SEQ ID NO: 751678 - DNA, 25 bp, Mus musculus
taagcaagatccagtctgctcccag

SEQ ID NO: 751679 - DNA, 25 bp, Mus musculus
taagcaagatcctgtctgctcccag

SEQ ID NO: 751680 - DNA, 25 bp, Mus musculus
taagcaaggacactgccaccaagga

SEQ ID NO: 751681 - DNA, 25 bp, Mus musculus
taagcaaggacagtgccaccaagga

SEQ ID NO: 751682 - DNA, 25 bp, Mus musculus
taagcaagggagctgttacttttct

SEQ ID NO: 751683 - DNA, 25 bp, Mus musculus
taagcaagggaggtgttacttttct

SEQ ID NO: 751684 - DNA, 25 bp, Mus musculus
taagcaaggtgcagccctacatgga

SEQ ID NO: 751685 - DNA, 25 bp, Mus musculus
taagcaaggtgctgccctacatgga

SEQ ID NO: 751686 - DNA, 25 bp, Mus musculus
taagcaagtaaaattgtgcccattt

SEQ ID NO: 751687 - DNA, 25 bp, Mus musculus
taagcaagtaaatttgtgcccattt

SEQ ID NO: 751688 - DNA, 25 bp, Mus musculus
taagcaatgccaccctaatgcccat

SEQ ID NO: 751689 - DNA, 25 bp, Mus musculus
taagcaatgccagcctaatgcccat

SEQ ID NO: 751690 - DNA, 25 bp, Mus musculus
taagcaatgtgtcctctgcccagca

SEQ ID NO: 751691 - DNA, 25 bp, Mus musculus
taagcaatgtgtgctctgcccagca

SEQ ID NO: 751692 - DNA, 25 bp, Mus musculus
taagcaatttctccagagctggctg

SEQ ID NO: 751693 - DNA, 25 bp, Mus musculus
taagcaatttctgcagagctggctg

SEQ ID NO: 751694 - DNA, 25 bp, Mus musculus
taagcacaagtacttgctgcctcca

SEQ ID NO: 751695 - DNA, 25 bp, Mus musculus
taagcacaagtagttgctgcctcca

SEQ ID NO: 751696 - DNA, 25 bp, Mus musculus
taagcacaatgtccacagtccatat

SEQ ID NO: 751697 - DNA, 25 bp, Mus musculus
taagcacaatgtgcacagtccatat

SEQ ID NO: 751698 - DNA, 25 bp, Mus musculus
taagcacacaacctctatctttgac

SEQ ID NO: 751699 - DNA, 25 bp, Mus musculus
taagcacacaacgtctatctttgac

SEQ ID NO: 751700 - DNA, 25 bp, Mus musculus
taagcacacacacagtacctgtggg

SEQ ID NO: 751701 - DNA, 25 bp, Mus musculus
taagcacacacagagtacctgtggg

SEQ ID NO: 751702 - DNA, 25 bp, Mus musculus
taagcacacagtaaccattcctcat

SEQ ID NO: 751703 - DNA, 25 bp, Mus musculus
taagcacacagttaccattcctcat

SEQ ID NO: 751704 - DNA, 25 bp, Mus musculus
taagcacactacacaagccctggca

SEQ ID NO: 751705 - DNA, 25 bp, Mus musculus
taagcacactactcaagccctggca

SEQ ID NO: 751706 - DNA, 25 bp, Mus musculus
taagcacactggctctcacgagagc

SEQ ID NO: 751707 - DNA, 25 bp, Mus musculus
taagcacactgggtctcacgagagc

SEQ ID NO: 751708 - DNA, 25 bp, Mus musculus
taagcacagacactgtctccaccat

SEQ ID NO: 751709 - DNA, 25 bp, Mus musculus
taagcacagacagtgtctccaccat

SEQ ID NO: 751710 - DNA, 25 bp, Mus musculus
taagcacagcccctactggagaaca

SEQ ID NO: 751711 - DNA, 25 bp, Mus musculus
taagcacagcccgtactggagaaca

SEQ ID NO: 751712 - DNA, 25 bp, Mus musculus
taagcacagtacaaggttgtcccag

SEQ ID NO: 751713 - DNA, 25 bp, Mus musculus
taagcacagtactaggttgtcccag

SEQ ID NO: 751714 - DNA, 25 bp, Mus musculus
taagcacagtgcatgcctagggtct

SEQ ID NO: 751715 - DNA, 25 bp, Mus musculus
taagcacagtgcttgcctagggtct

SEQ ID NO: 751716 - DNA, 25 bp, Mus musculus
taagcacatactcaataaacaactg

SEQ ID NO: 751717 - DNA, 25 bp, Mus musculus
taagcacatactgaataaacaactg

SEQ ID NO: 751718 - DNA, 25 bp, Mus musculus
taagcacatgaaatccatccctaca

SEQ ID NO: 751719 - DNA, 25 bp, Mus musculus
taagcacatgaattccatccctaca

SEQ ID NO: 751720 - DNA, 25 bp, Mus musculus
taagcacatgtgaaccagtcatggg

SEQ ID NO: 751721 - DNA, 25 bp, Mus musculus
taagcacatgtgtaccagtcatggg

SEQ ID NO: 751722 - DNA, 25 bp, Mus musculus
taagcacattgtcggaggctcccct

SEQ ID NO: 751723 - DNA, 25 bp, Mus musculus
taagcacattgtgggaggctcccct

SEQ ID NO: 751724 - DNA, 25 bp, Mus musculus
taagcaccagatagtctccctgtgt

SEQ ID NO: 751725 - DNA, 25 bp, Mus musculus
taagcaccagatctgtgatgatcca

SEQ ID NO: 751726 - DNA, 25 bp, Mus musculus
taagcaccagatgtgtgatgatcca

SEQ ID NO: 751727 - DNA, 25 bp, Mus musculus
taagcaccagattgtctccctgtgt

SEQ ID NO: 751728 - DNA, 25 bp, Mus musculus
taagcaccatgcagcaaccttgatt

SEQ ID NO: 751729 - DNA, 25 bp, Mus musculus
taagcaccatgctgcaaccttgatt

SEQ ID NO: 751730 - DNA, 25 bp, Mus musculus
taagcaccccgcaagcgttagaaga

SEQ ID NO: 751731 - DNA, 25 bp, Mus musculus
taagcaccccgctagcgttagaaga

SEQ ID NO: 751732 - DNA, 25 bp, Mus musculus
taagcacccctcatggatgccctga

SEQ ID NO: 751733 - DNA, 25 bp, Mus musculus
taagcacccctcttggatgccctga

SEQ ID NO: 751734 - DNA, 25 bp, Mus musculus
taagcaccctatcaagctaggcatg

SEQ ID NO: 751735 - DNA, 25 bp, Mus musculus
taagcaccctatgaagctaggcatg

SEQ ID NO: 751736 - DNA, 25 bp, Mus musculus
taagcaccctgaagcaaggcccaag

SEQ ID NO: 751737 - DNA, 25 bp, Mus musculus
taagcaccctgaaggcagctctgca

SEQ ID NO: 751738 - DNA, 25 bp, Mus musculus
taagcaccctgatgcaaggcccaag

SEQ ID NO: 751739 - DNA, 25 bp, Mus musculus
taagcaccctgatggcagctctgca

SEQ ID NO: 751740 - DNA, 25 bp, Mus musculus
taagcaccgagtcactgatctctgg

SEQ ID NO: 751741 - DNA, 25 bp, Mus musculus
taagcaccgagtgactgatctctgg

SEQ ID NO: 751742 - DNA, 25 bp, Mus musculus
taagcaccgtgtaccagattcctga

SEQ ID NO: 751743 - DNA, 25 bp, Mus musculus
taagcaccgtgttccagattcctga

SEQ ID NO: 751744 - DNA, 25 bp, Mus musculus
taagcacctatcatggaggcaagag

SEQ ID NO: 751745 - DNA, 25 bp, Mus musculus
taagcacctatcttggaggcaagag

SEQ ID NO: 751746 - DNA, 25 bp, Mus musculus
taagcacctgacatgacatctctgg

SEQ ID NO: 751747 - DNA, 25 bp, Mus musculus
taagcacctgacatgtttagcgaca

SEQ ID NO: 751748 - DNA, 25 bp, Mus musculus
taagcacctgacttgacatctctgg

SEQ ID NO: 751749 - DNA, 25 bp, Mus musculus
taagcacctgacttgtttagcgaca

SEQ ID NO: 751750 - DNA, 25 bp, Mus musculus
taagcaccttctagcccagtgttgg

SEQ ID NO: 751751 - DNA, 25 bp, Mus musculus
taagcaccttctaggtgcctgggta

SEQ ID NO: 751752 - DNA, 25 bp, Mus musculus
taagcaccttcttgcccagtgttgg

SEQ ID NO: 751753 - DNA, 25 bp, Mus musculus
taagcaccttcttggtgcctgggta

SEQ ID NO: 751754 - DNA, 25 bp, Mus musculus
taagcacgacggaatgttacatctt

SEQ ID NO: 751755 - DNA, 25 bp, Mus musculus
taagcacgacggtatgttacatctt

SEQ ID NO: 751756 - DNA, 25 bp, Mus musculus
taagcacgcgccaacttagctaaag

SEQ ID NO: 751757 - DNA, 25 bp, Mus musculus
taagcacgcgcctacttagctaaag

SEQ ID NO: 751758 - DNA, 25 bp, Mus musculus
taagcacgtctgaggttgtgcgcag

SEQ ID NO: 751759 - DNA, 25 bp, Mus musculus
taagcacgtctgtggttgtgcgcag

SEQ ID NO: 751760 - DNA, 25 bp, Mus musculus
taagcactaagcaaatgcatcctgt

SEQ ID NO: 751761 - DNA, 25 bp, Mus musculus
taagcactaagctaatgcatcctgt

SEQ ID NO: 751762 - DNA, 25 bp, Mus musculus
taagcactagctcccaagaagacca

SEQ ID NO: 751763 - DNA, 25 bp, Mus musculus
taagcactagctgccaagaagacca

SEQ ID NO: 751764 - DNA, 25 bp, Mus musculus
taagcactatggaaacaggcacagg

SEQ ID NO: 751765 - DNA, 25 bp, Mus musculus
taagcactatggtaacaggcacagg

SEQ ID NO: 751766 - DNA, 25 bp, Mus musculus
taagcactcaaacactgacctctga

SEQ ID NO: 751767 - DNA, 25 bp, Mus musculus
taagcactcaaagactgacctctga

SEQ ID NO: 751768 - DNA, 25 bp, Mus musculus
taagcactgaagagggtgtaaccca

SEQ ID NO: 751769 - DNA, 25 bp, Mus musculus
taagcactgaagtgggtgtaaccca

SEQ ID NO: 751770 - DNA, 25 bp, Mus musculus
taagcactgacaatgctcaagtggt

SEQ ID NO: 751771 - DNA, 25 bp, Mus musculus
taagcactgacattgctcaagtggt

SEQ ID NO: 751772 - DNA, 25 bp, Mus musculus
taagcactgagtcgttgcctggaag

SEQ ID NO: 751773 - DNA, 25 bp, Mus musculus
taagcactgagtggttgcctggaag

SEQ ID NO: 751774 - DNA, 25 bp, Mus musculus
taagcactgcagatgggtgccatcc

SEQ ID NO: 751775 - DNA, 25 bp, Mus musculus
taagcactgcagttgggtgccatcc

SEQ ID NO: 751776 - DNA, 25 bp, Mus musculus
taagcactgcttccaaagaacgcat

SEQ ID NO: 751777 - DNA, 25 bp, Mus musculus
taagcactgcttgcaaagaacgcat

SEQ ID NO: 751778 - DNA, 25 bp, Mus musculus
taagcactggccagtgtgcgccctg

SEQ ID NO: 751779 - DNA, 25 bp, Mus musculus
taagcactggcctgtgtgcgccctg

SEQ ID NO: 751780 - DNA, 25 bp, Mus musculus
taagcactgtacacttgctccacgt

SEQ ID NO: 751781 - DNA, 25 bp, Mus musculus
taagcactgtactcttgctccacgt

SEQ ID NO: 751782 - DNA, 25 bp, Mus musculus
taagcactgttgatcgagctgcgaa

SEQ ID NO: 751783 - DNA, 25 bp, Mus musculus
taagcactgttgttcgagctgcgaa

SEQ ID NO: 751784 - DNA, 25 bp, Mus musculus
taagcactgtttccctgctcaaatt

SEQ ID NO: 751785 - DNA, 25 bp, Mus musculus
taagcactgtttgcctgctcaaatt

SEQ ID NO: 751786 - DNA, 25 bp, Mus musculus
taagcacttattacctttaatgagg

SEQ ID NO: 751787 - DNA, 25 bp, Mus musculus
taagcacttatttcctttaatgagg

SEQ ID NO: 751788 - DNA, 25 bp, Mus musculus
taagcacttgcacgctgagtcagcc

SEQ ID NO: 751789 - DNA, 25 bp, Mus musculus
taagcacttgcaggctgagtcagcc

SEQ ID NO: 751790 - DNA, 25 bp, Mus musculus
taagcacttgctagggatggccctg

SEQ ID NO: 751791 - DNA, 25 bp, Mus musculus
taagcacttgcttgggatggccctg

SEQ ID NO: 751792 - DNA, 25 bp, Mus musculus
taagcacttggaatcacgggttgaa

SEQ ID NO: 751793 - DNA, 25 bp, Mus musculus
taagcacttggattcacgggttgaa

SEQ ID NO: 751794 - DNA, 25 bp, Mus musculus
taagcacttgggatgtacatgtagg

SEQ ID NO: 751795 - DNA, 25 bp, Mus musculus
taagcacttgggttgtacatgtagg

SEQ ID NO: 751796 - DNA, 25 bp, Mus musculus
taagcacttgtccagcaatgcacaa

SEQ ID NO: 751797 - DNA, 25 bp, Mus musculus
taagcacttgtcgagcaatgcacaa

SEQ ID NO: 751798 - DNA, 25 bp, Mus musculus
taagcactttacacaactgggttgg

SEQ ID NO: 751799 - DNA, 25 bp, Mus musculus
taagcactttactcaactgggttgg

SEQ ID NO: 751800 - DNA, 25 bp, Mus musculus
taagcactttccaaacagtcctcag

SEQ ID NO: 751801 - DNA, 25 bp, Mus musculus
taagcactttcctaacagtcctcag

SEQ ID NO: 751802 - DNA, 25 bp, Mus musculus
taagcactttggctacacttcctac

SEQ ID NO: 751803 - DNA, 25 bp, Mus musculus
taagcactttgggtacacttcctac

SEQ ID NO: 751804 - DNA, 25 bp, Mus musculus
taagcagaaccccacaggatggcac

SEQ ID NO: 751805 - DNA, 25 bp, Mus musculus
taagcagaacccgacaggatggcac

SEQ ID NO: 751806 - DNA, 25 bp, Mus musculus
taagcagaccacagccaaatggata

SEQ ID NO: 751807 - DNA, 25 bp, Mus musculus
taagcagaccactgccaaatggata

SEQ ID NO: 751808 - DNA, 25 bp, Mus musculus
taagcagacggacctgcggcttctg

SEQ ID NO: 751809 - DNA, 25 bp, Mus musculus
taagcagacggagctgcggcttctg

SEQ ID NO: 751810 - DNA, 25 bp, Mus musculus
taagcagactcaacatcactctcaa

SEQ ID NO: 751811 - DNA, 25 bp, Mus musculus
taagcagactcatcatcactctcaa

SEQ ID NO: 751812 - DNA, 25 bp, Mus musculus
taagcagagacaaccctgaccttgg

SEQ ID NO: 751813 - DNA, 25 bp, Mus musculus
taagcagagacatccctgaccttgg

SEQ ID NO: 751814 - DNA, 25 bp, Mus musculus
taagcagagcgtaccaagttcaact

SEQ ID NO: 751815 - DNA, 25 bp, Mus musculus
taagcagagcgttccaagttcaact

SEQ ID NO: 751816 - DNA, 25 bp, Mus musculus
taagcagaggctcctcccacagatg

SEQ ID NO: 751817 - DNA, 25 bp, Mus musculus
taagcagaggctgctcccacagatg

SEQ ID NO: 751818 - DNA, 25 bp, Mus musculus
taagcagatgatccgggtggcccat

SEQ ID NO: 751819 - DNA, 25 bp, Mus musculus
taagcagatgatgcgggtggcccat

SEQ ID NO: 751820 - DNA, 25 bp, Mus musculus
taagcagatggacactgggcccagt

SEQ ID NO: 751821 - DNA, 25 bp, Mus musculus
taagcagatggagactgggcccagt

SEQ ID NO: 751822 - DNA, 25 bp, Mus musculus
taagcagattacatccatcagtatt

SEQ ID NO: 751823 - DNA, 25 bp, Mus musculus
taagcagattacttccatcagtatt

SEQ ID NO: 751824 - DNA, 25 bp, Mus musculus
taagcagattcccattgacaacccg

SEQ ID NO: 751825 - DNA, 25 bp, Mus musculus
taagcagattccgattgacaacccg

SEQ ID NO: 751826 - DNA, 25 bp, Mus musculus
taagcagcacaccactatggtctct

SEQ ID NO: 751827 - DNA, 25 bp, Mus musculus
taagcagcacacgactatggtctct

SEQ ID NO: 751828 - DNA, 25 bp, Mus musculus
taagcagcacagatggacagaatcc

SEQ ID NO: 751829 - DNA, 25 bp, Mus musculus
taagcagcacagttggacagaatcc

SEQ ID NO: 751830 - DNA, 25 bp, Mus musculus
taagcagcacccagtcatggactct

SEQ ID NO: 751831 - DNA, 25 bp, Mus musculus
taagcagcaccctgtcatggactct

SEQ ID NO: 751832 - DNA, 25 bp, Mus musculus
taagcagcagcaacctggcccttag

SEQ ID NO: 751833 - DNA, 25 bp, Mus musculus
taagcagcagcatcctggcccttag

SEQ ID NO: 751834 - DNA, 25 bp, Mus musculus
taagcagcaggaccccgggtttaat

SEQ ID NO: 751835 - DNA, 25 bp, Mus musculus
taagcagcaggagcccgggtttaat

SEQ ID NO: 751836 - DNA, 25 bp, Mus musculus
taagcagcatcaactccttccggta

SEQ ID NO: 751837 - DNA, 25 bp, Mus musculus
taagcagcatcatctccttccggta

SEQ ID NO: 751838 - DNA, 25 bp, Mus musculus
taagcagcatctagccaggcagttc

SEQ ID NO: 751839 - DNA, 25 bp, Mus musculus
taagcagcatcttgccaggcagttc

SEQ ID NO: 751840 - DNA, 25 bp, Mus musculus
taagcagcatgcctaagccttcatc

SEQ ID NO: 751841 - DNA, 25 bp, Mus musculus
taagcagcatgcgtaagccttcatc

SEQ ID NO: 751842 - DNA, 25 bp, Mus musculus
taagcagcatttctatctcccttgt

SEQ ID NO: 751843 - DNA, 25 bp, Mus musculus
taagcagcatttgtatctcccttgt

SEQ ID NO: 751844 - DNA, 25 bp, Mus musculus
taagcagccggcctttaacacttta

SEQ ID NO: 751845 - DNA, 25 bp, Mus musculus
taagcagccggcgtttaacacttta

SEQ ID NO: 751846 - DNA, 25 bp, Mus musculus
taagcagcctcacgtcggccacaaa

SEQ ID NO: 751847 - DNA, 25 bp, Mus musculus
taagcagcctcaggtcggccacaaa

SEQ ID NO: 751848 - DNA, 25 bp, Mus musculus
taagcagcctctatgccgctgaaat

SEQ ID NO: 751849 - DNA, 25 bp, Mus musculus
taagcagcctctttgccgctgaaat

SEQ ID NO: 751850 - DNA, 25 bp, Mus musculus
taagcagcctttatactacatttag

SEQ ID NO: 751851 - DNA, 25 bp, Mus musculus
taagcagcctttttactacatttag

SEQ ID NO: 751852 - DNA, 25 bp, Mus musculus
taagcagcgctcaaccagtgaggta

SEQ ID NO: 751853 - DNA, 25 bp, Mus musculus
taagcagcgctctaccagtgaggta

SEQ ID NO: 751854 - DNA, 25 bp, Mus musculus
taagcagctgggaccactggcagtg

SEQ ID NO: 751855 - DNA, 25 bp, Mus musculus
taagcagctgggtccactggcagtg

SEQ ID NO: 751856 - DNA, 25 bp, Mus musculus
taagcagctgtacgacctcagaatg

SEQ ID NO: 751857 - DNA, 25 bp, Mus musculus
taagcagctgtaggacctcagaatg

SEQ ID NO: 751858 - DNA, 25 bp, Mus musculus
taagcagctgtccttccagaattgc

SEQ ID NO: 751859 - DNA, 25 bp, Mus musculus
taagcagctgtcgttccagaattgc

SEQ ID NO: 751860 - DNA, 25 bp, Mus musculus
taagcagctttaatgggttctccga

SEQ ID NO: 751861 - DNA, 25 bp, Mus musculus
taagcagctttattgggttctccga

SEQ ID NO: 751862 - DNA, 25 bp, Mus musculus
taagcaggagctactctgcaggtga

SEQ ID NO: 751863 - DNA, 25 bp, Mus musculus
taagcaggagcttctctgcaggtga

SEQ ID NO: 751864 - DNA, 25 bp, Mus musculus
taagcaggccatcttagcggctcag

SEQ ID NO: 751865 - DNA, 25 bp, Mus musculus
taagcaggccatgttagcggctcag

SEQ ID NO: 751866 - DNA, 25 bp, Mus musculus
taagcaggctagaatcccttcacat

SEQ ID NO: 751867 - DNA, 25 bp, Mus musculus
taagcaggctagtatcccttcacat

SEQ ID NO: 751868 - DNA, 25 bp, Mus musculus
taagcaggctgaatctcacgggaca

SEQ ID NO: 751869 - DNA, 25 bp, Mus musculus
taagcaggctgattctcacgggaca

SEQ ID NO: 751870 - DNA, 25 bp, Mus musculus
taagcaggtaaacgcacacccctgc

SEQ ID NO: 751871 - DNA, 25 bp, Mus musculus
taagcaggtaaaggcacacccctgc

SEQ ID NO: 751872 - DNA, 25 bp, Mus musculus
taagcaggtcaactccaaggtccac

SEQ ID NO: 751873 - DNA, 25 bp, Mus musculus
taagcaggtcaagtccaaggtccac

SEQ ID NO: 751874 - DNA, 25 bp, Mus musculus
taagcaggtgctacatctccgagct

SEQ ID NO: 751875 - DNA, 25 bp, Mus musculus
taagcaggtgcttcatctccgagct

SEQ ID NO: 751876 - DNA, 25 bp, Mus musculus
taagcagtaagccaagccaagaatg

SEQ ID NO: 751877 - DNA, 25 bp, Mus musculus
taagcagtaagcgaagccaagaatg

SEQ ID NO: 751878 - DNA, 25 bp, Mus musculus
taagcagtacagatgttgctgaaca

SEQ ID NO: 751879 - DNA, 25 bp, Mus musculus
taagcagtacagttgttgctgaaca

SEQ ID NO: 751880 - DNA, 25 bp, Mus musculus
taagcagtagcacttctttttcctc

SEQ ID NO: 751881 - DNA, 25 bp, Mus musculus
taagcagtagcagttctttttcctc

SEQ ID NO: 751882 - DNA, 25 bp, Mus musculus
taagcagtatcaaccaggaataaat

SEQ ID NO: 751883 - DNA, 25 bp, Mus musculus
taagcagtatcatccaggaataaat

SEQ ID NO: 751884 - DNA, 25 bp, Mus musculus
taagcagtcagcatgctctgcaaca

SEQ ID NO: 751885 - DNA, 25 bp, Mus musculus
taagcagtcagcttgctctgcaaca

SEQ ID NO: 751886 - DNA, 25 bp, Mus musculus
taagcagtccccactgatggagact

SEQ ID NO: 751887 - DNA, 25 bp, Mus musculus
taagcagtcccctctgatggagact

SEQ ID NO: 751888 - DNA, 25 bp, Mus musculus
taagcagtcctactggtgccacctg

SEQ ID NO: 751889 - DNA, 25 bp, Mus musculus
taagcagtcctagtggtgccacctg

SEQ ID NO: 751890 - DNA, 25 bp, Mus musculus
taagcagtgaaaccctccctgtgtt

SEQ ID NO: 751891 - DNA, 25 bp, Mus musculus
taagcagtgaaagcctccctgtgtt

SEQ ID NO: 751892 - DNA, 25 bp, Mus musculus
taagcagtgactactctcttcctgt

SEQ ID NO: 751893 - DNA, 25 bp, Mus musculus
taagcagtgacttctctcttcctgt

SEQ ID NO: 751894 - DNA, 25 bp, Mus musculus
taagcagtgcaacatgtctctgaac

SEQ ID NO: 751895 - DNA, 25 bp, Mus musculus
taagcagtgcaagatgtctctgaac

SEQ ID NO: 751896 - DNA, 25 bp, Mus musculus
taagcagttatcactgcccgagttc

SEQ ID NO: 751897 - DNA, 25 bp, Mus musculus
taagcagttatctctgcccgagttc

SEQ ID NO: 751898 - DNA, 25 bp, Mus musculus
taagcagttattcttgccaagggtt

SEQ ID NO: 751899 - DNA, 25 bp, Mus musculus
taagcagttattgttgccaagggtt

SEQ ID NO: 751900 - DNA, 25 bp, Mus musculus
taagcagttcaaacagcggcgcatc

SEQ ID NO: 751901 - DNA, 25 bp, Mus musculus
taagcagttcaatcagcggcgcatc

SEQ ID NO: 751902 - DNA, 25 bp, Mus musculus
taagcagttcatattgattattggc

SEQ ID NO: 751903 - DNA, 25 bp, Mus musculus
taagcagttcattttgattattggc

SEQ ID NO: 751904 - DNA, 25 bp, Mus musculus
taagcagtttgcaatgcaggcagag

SEQ ID NO: 751905 - DNA, 25 bp, Mus musculus
taagcagtttgctatgcaggcagag

SEQ ID NO: 751906 - DNA, 25 bp, Mus musculus
taagcataaacactcaattgaaagc

SEQ ID NO: 751907 - DNA, 25 bp, Mus musculus
taagcataaacagtcaattgaaagc

SEQ ID NO: 751908 - DNA, 25 bp, Mus musculus
taagcataatgtcgcacccgagtgc

SEQ ID NO: 751909 - DNA, 25 bp, Mus musculus
taagcataatgtggcacccgagtgc

SEQ ID NO: 751910 - DNA, 25 bp, Mus musculus
taagcatacctaaagaccatactac

SEQ ID NO: 751911 - DNA, 25 bp, Mus musculus
taagcatacctatagaccatactac

SEQ ID NO: 751912 - DNA, 25 bp, Mus musculus
taagcatacgctacctagtgatgta

SEQ ID NO: 751913 - DNA, 25 bp, Mus musculus
taagcatacgcttcctagtgatgta

SEQ ID NO: 751914 - DNA, 25 bp, Mus musculus
taagcatagcatcactgtctttttt

SEQ ID NO: 751915 - DNA, 25 bp, Mus musculus
taagcatagcatgactgtctttttt

SEQ ID NO: 751916 - DNA, 25 bp, Mus musculus
taagcataggataccctcaagtggt

SEQ ID NO: 751917 - DNA, 25 bp, Mus musculus
taagcataggattccctcaagtggt

SEQ ID NO: 751918 - DNA, 25 bp, Mus musculus
taagcatatacccaacctactattc

SEQ ID NO: 751919 - DNA, 25 bp, Mus musculus
taagcatataccgaacctactattc

SEQ ID NO: 751920 - DNA, 25 bp, Mus musculus
taagcatatataaccccattccaac

SEQ ID NO: 751921 - DNA, 25 bp, Mus musculus
taagcatatatatccccattccaac

SEQ ID NO: 751922 - DNA, 25 bp, Mus musculus
taagcatatatgcagatacacaaat

SEQ ID NO: 751923 - DNA, 25 bp, Mus musculus
taagcatatatggagatacacaaat

SEQ ID NO: 751924 - DNA, 25 bp, Mus musculus
taagcatatcttactgtcggagcag

SEQ ID NO: 751925 - DNA, 25 bp, Mus musculus
taagcatatctttctgtcggagcag

SEQ ID NO: 751926 - DNA, 25 bp, Mus musculus
taagcatattccatcttgttctcgc

SEQ ID NO: 751927 - DNA, 25 bp, Mus musculus
taagcatattccttcttgttctcgc

SEQ ID NO: 751928 - DNA, 25 bp, Mus musculus
taagcatcagaccagtgtttgtata

SEQ ID NO: 751929 - DNA, 25 bp, Mus musculus
taagcatcagacgagtgtttgtata

SEQ ID NO: 751930 - DNA, 25 bp, Mus musculus
taagcatcccatagttgtcctttct

SEQ ID NO: 751931 - DNA, 25 bp, Mus musculus
taagcatcccattgttgtcctttct

SEQ ID NO: 751932 - DNA, 25 bp, Mus musculus
taagcatccctaaggtttgtgtctg

SEQ ID NO: 751933 - DNA, 25 bp, Mus musculus
taagcatccctatggtttgtgtctg

SEQ ID NO: 751934 - DNA, 25 bp, Mus musculus
taagcatcctggcttcagagatcat

SEQ ID NO: 751935 - DNA, 25 bp, Mus musculus
taagcatcctgggttcagagatcat

SEQ ID NO: 751936 - DNA, 25 bp, Mus musculus
taagcatcttcgcaacactagttgg

SEQ ID NO: 751937 - DNA, 25 bp, Mus musculus
taagcatcttcggaacactagttgg

SEQ ID NO: 751938 - DNA, 25 bp, Mus musculus
taagcatcttctctgtccagacaag

SEQ ID NO: 751939 - DNA, 25 bp, Mus musculus
taagcatcttctgtgtccagacaag

SEQ ID NO: 751940 - DNA, 25 bp, Mus musculus
taagcatcttggagtgctacctctt

SEQ ID NO: 751941 - DNA, 25 bp, Mus musculus
taagcatcttggcagacacagtgga

SEQ ID NO: 751942 - DNA, 25 bp, Mus musculus
taagcatcttgggagacacagtgga

SEQ ID NO: 751943 - DNA, 25 bp, Mus musculus
taagcatcttggtgtgctacctctt

SEQ ID NO: 751944 - DNA, 25 bp, Mus musculus
taagcatgacgcctggttcatcgcc

SEQ ID NO: 751945 - DNA, 25 bp, Mus musculus
taagcatgacgcgtggttcatcgcc

SEQ ID NO: 751946 - DNA, 25 bp, Mus musculus
taagcatgatatctcttcacagcaa

SEQ ID NO: 751947 - DNA, 25 bp, Mus musculus
taagcatgatatgtcttcacagcaa

SEQ ID NO: 751948 - DNA, 25 bp, Mus musculus
taagcatgatctaatgggaacactg

SEQ ID NO: 751949 - DNA, 25 bp, Mus musculus
taagcatgatcttatgggaacactg

SEQ ID NO: 751950 - DNA, 25 bp, Mus musculus
taagcatgcactctacagctgagcc

SEQ ID NO: 751951 - DNA, 25 bp, Mus musculus
taagcatgcactgtacagctgagcc

SEQ ID NO: 751952 - DNA, 25 bp, Mus musculus
taagcatgctacaggatataaattt

SEQ ID NO: 751953 - DNA, 25 bp, Mus musculus
taagcatgctactggatataaattt

SEQ ID NO: 751954 - DNA, 25 bp, Mus musculus
taagcatgctatcccagtgtctatg

SEQ ID NO: 751955 - DNA, 25 bp, Mus musculus
taagcatgctatgccagtgtctatg

SEQ ID NO: 751956 - DNA, 25 bp, Mus musculus
taagcatgggacctcttgttcatct

SEQ ID NO: 751957 - DNA, 25 bp, Mus musculus
taagcatgggacgtcttgttcatct

SEQ ID NO: 751958 - DNA, 25 bp, Mus musculus
taagcatggtcccacctaaggtcag

SEQ ID NO: 751959 - DNA, 25 bp, Mus musculus
taagcatggtccgacctaaggtcag

SEQ ID NO: 751960 - DNA, 25 bp, Mus musculus
taagcatgttgtctacccttgttcc

SEQ ID NO: 751961 - DNA, 25 bp, Mus musculus
taagcatgttgtgtacccttgttcc

SEQ ID NO: 751962 - DNA, 25 bp, Mus musculus
taagcatgtttacccgttggctcgc

SEQ ID NO: 751963 - DNA, 25 bp, Mus musculus
taagcatgtttagccgttggctcgc

SEQ ID NO: 751964 - DNA, 25 bp, Mus musculus
taagcattacttaaccccctgataa

SEQ ID NO: 751965 - DNA, 25 bp, Mus musculus
taagcattactttaccccctgataa

SEQ ID NO: 751966 - DNA, 25 bp, Mus musculus
taagcattcatgctccgtggtcata

SEQ ID NO: 751967 - DNA, 25 bp, Mus musculus
taagcattcatggtccgtggtcata

SEQ ID NO: 751968 - DNA, 25 bp, Mus musculus
taagcattccaaaccattgagccat

SEQ ID NO: 751969 - DNA, 25 bp, Mus musculus
taagcattccaatccattgagccat

SEQ ID NO: 751970 - DNA, 25 bp, Mus musculus
taagcattcttccaagcaacactcg

SEQ ID NO: 751971 - DNA, 25 bp, Mus musculus
taagcattcttcgaagcaacactcg

SEQ ID NO: 751972 - DNA, 25 bp, Mus musculus
taagcattgctcaagctgtggccac

SEQ ID NO: 751973 - DNA, 25 bp, Mus musculus
taagcattgctctagctgtggccac

SEQ ID NO: 751974 - DNA, 25 bp, Mus musculus
taagcattgtgtacccttttggtaa

SEQ ID NO: 751975 - DNA, 25 bp, Mus musculus
taagcattgtgttcccttttggtaa

SEQ ID NO: 751976 - DNA, 25 bp, Mus musculus
taagcattgttcacaaccgtttaat

SEQ ID NO: 751977 - DNA, 25 bp, Mus musculus
taagcattgttctcaaccgtttaat

SEQ ID NO: 751978 - DNA, 25 bp, Mus musculus
taagcatttcttctaggtgctgagc

SEQ ID NO: 751979 - DNA, 25 bp, Mus musculus
taagcatttcttgtaggtgctgagc

SEQ ID NO: 751980 - DNA, 25 bp, Mus musculus
taagcatttggcctacattctcagc

SEQ ID NO: 751981 - DNA, 25 bp, Mus musculus
taagcatttggcgtacattctcagc

SEQ ID NO: 751982 - DNA, 25 bp, Mus musculus
taagcatttgtaaaggtctgatcct

SEQ ID NO: 751983 - DNA, 25 bp, Mus musculus
taagcatttgtataggtctgatcct

SEQ ID NO: 751984 - DNA, 25 bp, Mus musculus
taagccaaaacaccgggactcttag

SEQ ID NO: 751985 - DNA, 25 bp, Mus musculus
taagccaaaacagcgggactcttag

SEQ ID NO: 751986 - DNA, 25 bp, Mus musculus
taagccaacacactactctgggtgg

SEQ ID NO: 751987 - DNA, 25 bp, Mus musculus
taagccaacacagtactctgggtgg

SEQ ID NO: 751988 - DNA, 25 bp, Mus musculus
taagccaacctcatgtcttgcagat

SEQ ID NO: 751989 - DNA, 25 bp, Mus musculus
taagccaacctcttgtcttgcagat

SEQ ID NO: 751990 - DNA, 25 bp, Mus musculus
taagccaagaagagctctccttcct

SEQ ID NO: 751991 - DNA, 25 bp, Mus musculus
taagccaagaagtgctctccttcct

SEQ ID NO: 751992 - DNA, 25 bp, Mus musculus
taagccaagctaatcattacagact

SEQ ID NO: 751993 - DNA, 25 bp, Mus musculus
taagccaagctattcattacagact

SEQ ID NO: 751994 - DNA, 25 bp, Mus musculus
taagccaagctgaggccgccagcaa

SEQ ID NO: 751995 - DNA, 25 bp, Mus musculus
taagccaagctgtggccgccagcaa

SEQ ID NO: 751996 - DNA, 25 bp, Mus musculus
taagccaagtttcttttagagacat

SEQ ID NO: 751997 - DNA, 25 bp, Mus musculus
taagccaagtttgttttagagacat

SEQ ID NO: 751998 - DNA, 25 bp, Mus musculus
taagccaatcatattaggactgtgc

SEQ ID NO: 751999 - DNA, 25 bp, Mus musculus
taagccaatcattttaggactgtgc

SEQ ID NO: 752000 - DNA, 25 bp, Mus musculus
taagccaatttgctgtgccgtgcca

SEQ ID NO: 752001 - DNA, 25 bp, Mus musculus
taagccaatttggtgtgccgtgcca

SEQ ID NO: 752002 - DNA, 25 bp, Mus musculus
taagccaattttactgcactgagca

SEQ ID NO: 752003 - DNA, 25 bp, Mus musculus
taagccaatttttctgcactgagca

SEQ ID NO: 752004 - DNA, 25 bp, Mus musculus
taagccacaacacctgctactggat

SEQ ID NO: 752005 - DNA, 25 bp, Mus musculus
taagccacaacagctgctactggat

SEQ ID NO: 752006 - DNA, 25 bp, Mus musculus
taagccacacacattctgagccttc

SEQ ID NO: 752007 - DNA, 25 bp, Mus musculus
taagccacacactttctgagccttc

SEQ ID NO: 752008 - DNA, 25 bp, Mus musculus
taagccacagagacctgctcagaat

SEQ ID NO: 752009 - DNA, 25 bp, Mus musculus
taagccacagagtcctgctcagaat

SEQ ID NO: 752010 - DNA, 25 bp, Mus musculus
taagccacagctccttttctggcag

SEQ ID NO: 752011 - DNA, 25 bp, Mus musculus
taagccacagctgcttttctggcag

SEQ ID NO: 752012 - DNA, 25 bp, Mus musculus
taagccacagttagaatagactcat

SEQ ID NO: 752013 - DNA, 25 bp, Mus musculus
taagccacagtttgaatagactcat

SEQ ID NO: 752014 - DNA, 25 bp, Mus musculus
taagccacatggctgctcctaagct

SEQ ID NO: 752015 - DNA, 25 bp, Mus musculus
taagccacatgggtgctcctaagct

SEQ ID NO: 752016 - DNA, 25 bp, Mus musculus
taagccacattcatccctgggttag

SEQ ID NO: 752017 - DNA, 25 bp, Mus musculus
taagccacattcttccctgggttag

SEQ ID NO: 752018 - DNA, 25 bp, Mus musculus
taagccaccaacatctctggaagaa

SEQ ID NO: 752019 - DNA, 25 bp, Mus musculus
taagccaccaacttctctggaagaa

SEQ ID NO: 752020 - DNA, 25 bp, Mus musculus
taagccacctgcaaaaggacccgat

SEQ ID NO: 752021 - DNA, 25 bp, Mus musculus
taagccacctgctaaaggacccgat

SEQ ID NO: 752022 - DNA, 25 bp, Mus musculus
taagccacgctcaggccactcgaga

SEQ ID NO: 752023 - DNA, 25 bp, Mus musculus
taagccacgctctggccactcgaga

SEQ ID NO: 752024 - DNA, 25 bp, Mus musculus
taagccacggacagaaccccacatg

SEQ ID NO: 752025 - DNA, 25 bp, Mus musculus
taagccacggactgaaccccacatg

SEQ ID NO: 752026 - DNA, 25 bp, Mus musculus
taagccactagacctacccttttct

SEQ ID NO: 752027 - DNA, 25 bp, Mus musculus
taagccactagagctacccttttct

SEQ ID NO: 752028 - DNA, 25 bp, Mus musculus
taagccactatgatggtgctgggaa

SEQ ID NO: 752029 - DNA, 25 bp, Mus musculus
taagccactatgttggtgctgggaa

SEQ ID NO: 752030 - DNA, 25 bp, Mus musculus
taagccactgagaccccagatgtta

SEQ ID NO: 752031 - DNA, 25 bp, Mus musculus
taagccactgagtccccagatgtta

SEQ ID NO: 752032 - DNA, 25 bp, Mus musculus
taagccactgcccatgtgagaattg

SEQ ID NO: 752033 - DNA, 25 bp, Mus musculus
taagccactgccgatgtgagaattg

SEQ ID NO: 752034 - DNA, 25 bp, Mus musculus
taagccactgttaatcacagcagga

SEQ ID NO: 752035 - DNA, 25 bp, Mus musculus
taagccactgtttatcacagcagga

SEQ ID NO: 752036 - DNA, 25 bp, Mus musculus
taagccacttaaaacattcgccatt

SEQ ID NO: 752037 - DNA, 25 bp, Mus musculus
taagccacttaatacattcgccatt

SEQ ID NO: 752038 - DNA, 25 bp, Mus musculus
taagccacttttcacttgagatcag

SEQ ID NO: 752039 - DNA, 25 bp, Mus musculus
taagccacttttgacttgagatcag

SEQ ID NO: 752040 - DNA, 25 bp, Mus musculus
taagccagacttaatgactcattta

SEQ ID NO: 752041 - DNA, 25 bp, Mus musculus
taagccagactttatgactcattta

SEQ ID NO: 752042 - DNA, 25 bp, Mus musculus
taagccagagtaaccccacaagcgg

SEQ ID NO: 752043 - DNA, 25 bp, Mus musculus
taagccagagtatccccacaagcgg

SEQ ID NO: 752044 - DNA, 25 bp, Mus musculus
taagccagcgtgaatcacaccaagt

SEQ ID NO: 752045 - DNA, 25 bp, Mus musculus
taagccagcgtgtatcacaccaagt

SEQ ID NO: 752046 - DNA, 25 bp, Mus musculus
taagccagcgttcccatataaaaag

SEQ ID NO: 752047 - DNA, 25 bp, Mus musculus
taagccagcgttgccatataaaaag

SEQ ID NO: 752048 - DNA, 25 bp, Mus musculus
taagccagcttaatggccccaggac

SEQ ID NO: 752049 - DNA, 25 bp, Mus musculus
taagccagcttattggccccaggac

SEQ ID NO: 752050 - DNA, 25 bp, Mus musculus
taagccaggcagatccaggagacac

SEQ ID NO: 752051 - DNA, 25 bp, Mus musculus
taagccaggcagttccaggagacac

SEQ ID NO: 752052 - DNA, 25 bp, Mus musculus
taagccaggccactatacctttgtt

SEQ ID NO: 752053 - DNA, 25 bp, Mus musculus
taagccaggccagtatacctttgtt

SEQ ID NO: 752054 - DNA, 25 bp, Mus musculus
taagccagggaacgcccctaggcac

SEQ ID NO: 752055 - DNA, 25 bp, Mus musculus
taagccagggaaggcccctaggcac

SEQ ID NO: 752056 - DNA, 25 bp, Mus musculus
taagccagggacagactaccttaaa

SEQ ID NO: 752057 - DNA, 25 bp, Mus musculus
taagccagggactgactaccttaaa

SEQ ID NO: 752058 - DNA, 25 bp, Mus musculus
taagccagggctagacgaagagaat

SEQ ID NO: 752059 - DNA, 25 bp, Mus musculus
taagccagggcttgacgaagagaat

SEQ ID NO: 752060 - DNA, 25 bp, Mus musculus
taagccaggtgaacgtcttccacga

SEQ ID NO: 752061 - DNA, 25 bp, Mus musculus
taagccaggtgatcgtcttccacga

SEQ ID NO: 752062 - DNA, 25 bp, Mus musculus
taagccagtggcctaatgtaattca

SEQ ID NO: 752063 - DNA, 25 bp, Mus musculus
taagccagtggcgtaatgtaattca

SEQ ID NO: 752064 - DNA, 25 bp, Mus musculus
taagccagttaaaccctcccttgag

SEQ ID NO: 752065 - DNA, 25 bp, Mus musculus
taagccagttaatccctcccttgag

SEQ ID NO: 752066 - DNA, 25 bp, Mus musculus
taagccagttggacacttgtgttcg

SEQ ID NO: 752067 - DNA, 25 bp, Mus musculus
taagccagttggtcacttgtgttcg

SEQ ID NO: 752068 - DNA, 25 bp, Mus musculus
taagccatcccaacagcatttaact

SEQ ID NO: 752069 - DNA, 25 bp, Mus musculus
taagccatcccatcagcatttaact

SEQ ID NO: 752070 - DNA, 25 bp, Mus musculus
taagccatctgacaccttgctatgc

SEQ ID NO: 752071 - DNA, 25 bp, Mus musculus
taagccatctgagaccttgctatgc

SEQ ID NO: 752072 - DNA, 25 bp, Mus musculus
taagccatctggaaagttttcttaa

SEQ ID NO: 752073 - DNA, 25 bp, Mus musculus
taagccatctggtaagttttcttaa

SEQ ID NO: 752074 - DNA, 25 bp, Mus musculus
taagccatcttgagggccttgccta

SEQ ID NO: 752075 - DNA, 25 bp, Mus musculus
taagccatcttgtgggccttgccta

SEQ ID NO: 752076 - DNA, 25 bp, Mus musculus
taagccatgagcagggaggacagtc

SEQ ID NO: 752077 - DNA, 25 bp, Mus musculus
taagccatgagcctgaagcactgct

SEQ ID NO: 752078 - DNA, 25 bp, Mus musculus
taagccatgagcgtgaagcactgct

SEQ ID NO: 752079 - DNA, 25 bp, Mus musculus
taagccatgagctgggaggacagtc

SEQ ID NO: 752080 - DNA, 25 bp, Mus musculus
taagccatgcaccaaactctatcac

SEQ ID NO: 752081 - DNA, 25 bp, Mus musculus
taagccatgcacgaaactctatcac

SEQ ID NO: 752082 - DNA, 25 bp, Mus musculus
taagccatgctcagcagtaccgatg

SEQ ID NO: 752083 - DNA, 25 bp, Mus musculus
taagccatgctctgcagtaccgatg

SEQ ID NO: 752084 - DNA, 25 bp, Mus musculus
taagccatgtgtctggtgatgtaca

SEQ ID NO: 752085 - DNA, 25 bp, Mus musculus
taagccatgtgtgtggtgatgtaca

SEQ ID NO: 752086 - DNA, 25 bp, Mus musculus
taagccattaccatggtacactgga

SEQ ID NO: 752087 - DNA, 25 bp, Mus musculus
taagccattaccttggtacactgga

SEQ ID NO: 752088 - DNA, 25 bp, Mus musculus
taagccattatgattctataagaac

SEQ ID NO: 752089 - DNA, 25 bp, Mus musculus
taagccattatgtttctataagaac

SEQ ID NO: 752090 - DNA, 25 bp, Mus musculus
taagccattcacaagctcctatatg

SEQ ID NO: 752091 - DNA, 25 bp, Mus musculus
taagccattcactagctcctatatg

SEQ ID NO: 752092 - DNA, 25 bp, Mus musculus
taagccattcagactcatattccct

SEQ ID NO: 752093 - DNA, 25 bp, Mus musculus
taagccattcagtctcatattccct

SEQ ID NO: 752094 - DNA, 25 bp, Mus musculus
taagccattcccatgttcagctgta

SEQ ID NO: 752095 - DNA, 25 bp, Mus musculus
taagccattcccctatttatctttt

SEQ ID NO: 752096 - DNA, 25 bp, Mus musculus
taagccattcccgtatttatctttt

SEQ ID NO: 752097 - DNA, 25 bp, Mus musculus
taagccattcccttgttcagctgta

SEQ ID NO: 752098 - DNA, 25 bp, Mus musculus
taagccattctaacctccttttaat

SEQ ID NO: 752099 - DNA, 25 bp, Mus musculus
taagccattctatcctccttttaat

SEQ ID NO: 752100 - DNA, 25 bp, Mus musculus
taagccattgccaccgtgtttgaga

SEQ ID NO: 752101 - DNA, 25 bp, Mus musculus
taagccattgcctccgtgtttgaga

SEQ ID NO: 752102 - DNA, 25 bp, Mus musculus
taagccatttcgatgttctaccagt

SEQ ID NO: 752103 - DNA, 25 bp, Mus musculus
taagccatttcgttgttctaccagt

SEQ ID NO: 752104 - DNA, 25 bp, Mus musculus
taagcccaacctcggaccctagatt

SEQ ID NO: 752105 - DNA, 25 bp, Mus musculus
taagcccaacctgggaccctagatt

SEQ ID NO: 752106 - DNA, 25 bp, Mus musculus
taagcccaacgcagcccggatcgtg

SEQ ID NO: 752107 - DNA, 25 bp, Mus musculus
taagcccaacgctgcccggatcgtg

SEQ ID NO: 752108 - DNA, 25 bp, Mus musculus
taagcccacactatgccagacagaa

SEQ ID NO: 752109 - DNA, 25 bp, Mus musculus
taagcccacactttgccagacagaa

SEQ ID NO: 752110 - DNA, 25 bp, Mus musculus
taagcccacatgctataatgtacat

SEQ ID NO: 752111 - DNA, 25 bp, Mus musculus
taagcccacatggtataatgtacat

SEQ ID NO: 752112 - DNA, 25 bp, Mus musculus
taagcccacgcacgcctgtaattta

SEQ ID NO: 752113 - DNA, 25 bp, Mus musculus
taagcccacgcaggcctgtaattta

SEQ ID NO: 752114 - DNA, 25 bp, Mus musculus
taagcccagccaattcatcaggcac

SEQ ID NO: 752115 - DNA, 25 bp, Mus musculus
taagcccagccatttcatcaggcac

SEQ ID NO: 752116 - DNA, 25 bp, Mus musculus
taagcccagcgtatagagagtggag

SEQ ID NO: 752117 - DNA, 25 bp, Mus musculus
taagcccagcgtttagagagtggag

SEQ ID NO: 752118 - DNA, 25 bp, Mus musculus
taagcccagggcagtcttttgcaaa

SEQ ID NO: 752119 - DNA, 25 bp, Mus musculus
taagcccagggctgtcttttgcaaa

SEQ ID NO: 752120 - DNA, 25 bp, Mus musculus
taagcccagggtcttgcatatgctg

SEQ ID NO: 752121 - DNA, 25 bp, Mus musculus
taagcccagggtgttgcatatgctg

SEQ ID NO: 752122 - DNA, 25 bp, Mus musculus
taagcccatggtcactgtagaggtt

SEQ ID NO: 752123 - DNA, 25 bp, Mus musculus
taagcccatggtgactgtagaggtt

SEQ ID NO: 752124 - DNA, 25 bp, Mus musculus
taagcccatgtccaagcagttttct

SEQ ID NO: 752125 - DNA, 25 bp, Mus musculus
taagcccatgtcgaagcagttttct

SEQ ID NO: 752126 - DNA, 25 bp, Mus musculus
taagcccatttccaacccagacggg

SEQ ID NO: 752127 - DNA, 25 bp, Mus musculus
taagcccatttcgaacccagacggg

SEQ ID NO: 752128 - DNA, 25 bp, Mus musculus
taagccccaaagaaatgaccatcat

SEQ ID NO: 752129 - DNA, 25 bp, Mus musculus
taagccccaaagtaatgaccatcat

SEQ ID NO: 752130 - DNA, 25 bp, Mus musculus
taagccccaaggaacaaccgtgtgt

SEQ ID NO: 752131 - DNA, 25 bp, Mus musculus
taagccccaaggtacaaccgtgtgt

SEQ ID NO: 752132 - DNA, 25 bp, Mus musculus
taagccccagctcgtgacatttctg

SEQ ID NO: 752133 - DNA, 25 bp, Mus musculus
taagccccagctggtgacatttctg

SEQ ID NO: 752134 - DNA, 25 bp, Mus musculus
taagccccagttccttagagatagg

SEQ ID NO: 752135 - DNA, 25 bp, Mus musculus
taagccccagttgcttagagatagg

SEQ ID NO: 752136 - DNA, 25 bp, Mus musculus
taagccccggctcttacagaatgtt

SEQ ID NO: 752137 - DNA, 25 bp, Mus musculus
taagccccggctgttacagaatgtt

SEQ ID NO: 752138 - DNA, 25 bp, Mus musculus
taagcccctctgataactgtggtca

SEQ ID NO: 752139 - DNA, 25 bp, Mus musculus
taagcccctctgttaactgtggtca

SEQ ID NO: 752140 - DNA, 25 bp, Mus musculus
taagcccctgctcagagacaaacat

SEQ ID NO: 752141 - DNA, 25 bp, Mus musculus
taagcccctgctgagagacaaacat

SEQ ID NO: 752142 - DNA, 25 bp, Mus musculus
taagccccttttaagcaggcacaag

SEQ ID NO: 752143 - DNA, 25 bp, Mus musculus
taagccccttttctcataactgttt

SEQ ID NO: 752144 - DNA, 25 bp, Mus musculus
taagccccttttgtcataactgttt

SEQ ID NO: 752145 - DNA, 25 bp, Mus musculus
taagcccctttttagcaggcacaag

SEQ ID NO: 752146 - DNA, 25 bp, Mus musculus
taagcccgacaaataccagctgcac

SEQ ID NO: 752147 - DNA, 25 bp, Mus musculus
taagcccgacaattaccagctgcac

SEQ ID NO: 752148 - DNA, 25 bp, Mus musculus
taagcccgactgaatggaccaggct

SEQ ID NO: 752149 - DNA, 25 bp, Mus musculus
taagcccgactgtatggaccaggct

SEQ ID NO: 752150 - DNA, 25 bp, Mus musculus
taagcccggcagcttctctggaagc

SEQ ID NO: 752151 - DNA, 25 bp, Mus musculus
taagcccggcaggttctctggaagc

SEQ ID NO: 752152 - DNA, 25 bp, Mus musculus
taagcccgtggacccaactgtggat

SEQ ID NO: 752153 - DNA, 25 bp, Mus musculus
taagcccgtggagccaactgtggat

SEQ ID NO: 752154 - DNA, 25 bp, Mus musculus
taagcccgtgggaggactgactctt

SEQ ID NO: 752155 - DNA, 25 bp, Mus musculus
taagcccgtgggagtgtactgtacc

SEQ ID NO: 752156 - DNA, 25 bp, Mus musculus
taagcccgtgggtggactgactctt

SEQ ID NO: 752157 - DNA, 25 bp, Mus musculus
taagcccgtgggtgtgtactgtacc

SEQ ID NO: 752158 - DNA, 25 bp, Mus musculus
taagcccgttgcctgctatttttcc

SEQ ID NO: 752159 - DNA, 25 bp, Mus musculus
taagcccgttgcgtgctatttttcc

SEQ ID NO: 752160 - DNA, 25 bp, Mus musculus
taagccctaaacctctacagagata

SEQ ID NO: 752161 - DNA, 25 bp, Mus musculus
taagccctaaaccttttctgattct

SEQ ID NO: 752162 - DNA, 25 bp, Mus musculus
taagccctaaacgtctacagagata

SEQ ID NO: 752163 - DNA, 25 bp, Mus musculus
taagccctaaacgttttctgattct

SEQ ID NO: 752164 - DNA, 25 bp, Mus musculus
taagccctaccaatgtcagcactgt

SEQ ID NO: 752165 - DNA, 25 bp, Mus musculus
taagccctaccattgtcagcactgt

SEQ ID NO: 752166 - DNA, 25 bp, Mus musculus
taagccctagcacagtagctgccct

SEQ ID NO: 752167 - DNA, 25 bp, Mus musculus
taagccctagcagagtagctgccct

SEQ ID NO: 752168 - DNA, 25 bp, Mus musculus
taagccctatccaaagctgttcagg

SEQ ID NO: 752169 - DNA, 25 bp, Mus musculus
taagccctatcctaagctgttcagg

SEQ ID NO: 752170 - DNA, 25 bp, Mus musculus
taagccctcctgatcgggctgcttg

SEQ ID NO: 752171 - DNA, 25 bp, Mus musculus
taagccctcctgttcgggctgcttg

SEQ ID NO: 752172 - DNA, 25 bp, Mus musculus
taagccctgacaataagcagctgat

SEQ ID NO: 752173 - DNA, 25 bp, Mus musculus
taagccctgacattaagcagctgat

SEQ ID NO: 752174 - DNA, 25 bp, Mus musculus
taagccctgacgactggtgccgagg

SEQ ID NO: 752175 - DNA, 25 bp, Mus musculus
taagccctgacgtctggtgccgagg

SEQ ID NO: 752176 - DNA, 25 bp, Mus musculus
taagccctgcttaaccttcagccat

SEQ ID NO: 752177 - DNA, 25 bp, Mus musculus
taagccctgcttagtctgatttcca

SEQ ID NO: 752178 - DNA, 25 bp, Mus musculus
taagccctgctttaccttcagccat

SEQ ID NO: 752179 - DNA, 25 bp, Mus musculus
taagccctgctttgtctgatttcca

SEQ ID NO: 752180 - DNA, 25 bp, Mus musculus
taagccctggcactcgggttggtta

SEQ ID NO: 752181 - DNA, 25 bp, Mus musculus
taagccctggcagtcgggttggtta

SEQ ID NO: 752182 - DNA, 25 bp, Mus musculus
taagccctggctacatccataccaa

SEQ ID NO: 752183 - DNA, 25 bp, Mus musculus
taagccctggcttcatccataccaa

SEQ ID NO: 752184 - DNA, 25 bp, Mus musculus
taagccctggtgctcgaccttttct

SEQ ID NO: 752185 - DNA, 25 bp, Mus musculus
taagccctggtggtcgaccttttct

SEQ ID NO: 752186 - DNA, 25 bp, Mus musculus
taagccctgtagactctaggttggc

SEQ ID NO: 752187 - DNA, 25 bp, Mus musculus
taagccctgtagtctctaggttggc

SEQ ID NO: 752188 - DNA, 25 bp, Mus musculus
taagccctgtcacgactggcaccaa

SEQ ID NO: 752189 - DNA, 25 bp, Mus musculus
taagccctgtcaggactggcaccaa

SEQ ID NO: 752190 - DNA, 25 bp, Mus musculus
taagcccttgctcattctagtctgt

SEQ ID NO: 752191 - DNA, 25 bp, Mus musculus
taagcccttgctgattctagtctgt

SEQ ID NO: 752192 - DNA, 25 bp, Mus musculus
taagcccttgtgaagagcagaacca

SEQ ID NO: 752193 - DNA, 25 bp, Mus musculus
taagcccttgtgctgtgtcacgcag

SEQ ID NO: 752194 - DNA, 25 bp, Mus musculus
taagcccttgtggtgtgtcacgcag

SEQ ID NO: 752195 - DNA, 25 bp, Mus musculus
taagcccttgtgtagagcagaacca

SEQ ID NO: 752196 - DNA, 25 bp, Mus musculus
taagccctttaaacaggacacgatg

SEQ ID NO: 752197 - DNA, 25 bp, Mus musculus
taagccctttaatcaggacacgatg

SEQ ID NO: 752198 - DNA, 25 bp, Mus musculus
taagccctttgtcaacatgcctaca

SEQ ID NO: 752199 - DNA, 25 bp, Mus musculus
taagccctttgtgaacatgcctaca

SEQ ID NO: 752200 - DNA, 25 bp, Mus musculus
taagccgacattatgtgtttgatat

SEQ ID NO: 752201 - DNA, 25 bp, Mus musculus
taagccgacattttgtgtttgatat

SEQ ID NO: 752202 - DNA, 25 bp, Mus musculus
taagccgagcacacagaacatctga

SEQ ID NO: 752203 - DNA, 25 bp, Mus musculus
taagccgagcactcagaacatctga

SEQ ID NO: 752204 - DNA, 25 bp, Mus musculus
taagccgagggtacaaggatcagat

SEQ ID NO: 752205 - DNA, 25 bp, Mus musculus
taagccgagggttcaaggatcagat

SEQ ID NO: 752206 - DNA, 25 bp, Mus musculus
taagccgattttaatttccaggcac

SEQ ID NO: 752207 - DNA, 25 bp, Mus musculus
taagccgatttttatttccaggcac

SEQ ID NO: 752208 - DNA, 25 bp, Mus musculus
taagccgcgacgaaccaaacctggt

SEQ ID NO: 752209 - DNA, 25 bp, Mus musculus
taagccgcgacgtaccaaacctggt

SEQ ID NO: 752210 - DNA, 25 bp, Mus musculus
taagccgcgcagctcaaacctgaag

SEQ ID NO: 752211 - DNA, 25 bp, Mus musculus
taagccgcgcaggtcaaacctgaag

SEQ ID NO: 752212 - DNA, 25 bp, Mus musculus
taagccgctagacctatgatcttgg

SEQ ID NO: 752213 - DNA, 25 bp, Mus musculus
taagccgctagagctatgatcttgg

SEQ ID NO: 752214 - DNA, 25 bp, Mus musculus
taagccgggaccagcagggatacga

SEQ ID NO: 752215 - DNA, 25 bp, Mus musculus
taagccgggacctgcagggatacga

SEQ ID NO: 752216 - DNA, 25 bp, Mus musculus
taagccgggactattttaatgaatt

SEQ ID NO: 752217 - DNA, 25 bp, Mus musculus
taagccgggacttttttaatgaatt

SEQ ID NO: 752218 - DNA, 25 bp, Mus musculus
taagccgggagaatgctacacatct

SEQ ID NO: 752219 - DNA, 25 bp, Mus musculus
taagccgggagattgctacacatct

SEQ ID NO: 752220 - DNA, 25 bp, Mus musculus
taagccggttgcaagttcctggagg

SEQ ID NO: 752221 - DNA, 25 bp, Mus musculus
taagccggttgctagttcctggagg

SEQ ID NO: 752222 - DNA, 25 bp, Mus musculus
taagccgtacagaaagcactacccc

SEQ ID NO: 752223 - DNA, 25 bp, Mus musculus
taagccgtacagtaagcactacccc

SEQ ID NO: 752224 - DNA, 25 bp, Mus musculus
taagccgtatctcggtcttggacta

SEQ ID NO: 752225 - DNA, 25 bp, Mus musculus
taagccgtatctgggtcttggacta

SEQ ID NO: 752226 - DNA, 25 bp, Mus musculus
taagcctacaaacgtgctgtcccca

SEQ ID NO: 752227 - DNA, 25 bp, Mus musculus
taagcctacaaaggtgctgtcccca

SEQ ID NO: 752228 - DNA, 25 bp, Mus musculus
taagcctacacgagctgctgtgatg

SEQ ID NO: 752229 - DNA, 25 bp, Mus musculus
taagcctacacgtgctgctgtgatg

SEQ ID NO: 752230 - DNA, 25 bp, Mus musculus
taagcctacgataagcattcctaaa

SEQ ID NO: 752231 - DNA, 25 bp, Mus musculus
taagcctacgattagcattcctaaa

SEQ ID NO: 752232 - DNA, 25 bp, Mus musculus
taagcctacgctagttacttaaaca

SEQ ID NO: 752233 - DNA, 25 bp, Mus musculus
taagcctacgcttgttacttaaaca

SEQ ID NO: 752234 - DNA, 25 bp, Mus musculus
taagcctacgtcaggttccatatat

SEQ ID NO: 752235 - DNA, 25 bp, Mus musculus
taagcctacgtctggttccatatat

SEQ ID NO: 752236 - DNA, 25 bp, Mus musculus
taagcctaggaactctgggttttgt

SEQ ID NO: 752237 - DNA, 25 bp, Mus musculus
taagcctaggaagtctgggttttgt

SEQ ID NO: 752238 - DNA, 25 bp, Mus musculus
taagcctagtacaccttcctttatt

SEQ ID NO: 752239 - DNA, 25 bp, Mus musculus
taagcctagtactccttcctttatt

SEQ ID NO: 752240 - DNA, 25 bp, Mus musculus
taagcctagttaatccatagtgcat

SEQ ID NO: 752241 - DNA, 25 bp, Mus musculus
taagcctagttattccatagtgcat

SEQ ID NO: 752242 - DNA, 25 bp, Mus musculus
taagcctatccgacaacttagtttt

SEQ ID NO: 752243 - DNA, 25 bp, Mus musculus
taagcctatccgtcaacttagtttt

SEQ ID NO: 752244 - DNA, 25 bp, Mus musculus
taagcctatcttcggtaaaactggt

SEQ ID NO: 752245 - DNA, 25 bp, Mus musculus
taagcctatcttgggtaaaactggt

SEQ ID NO: 752246 - DNA, 25 bp, Mus musculus
taagcctatgtgatctgtacttcca

SEQ ID NO: 752247 - DNA, 25 bp, Mus musculus
taagcctatgtgctgtcatgctacc

SEQ ID NO: 752248 - DNA, 25 bp, Mus musculus
taagcctatgtggtgtcatgctacc

SEQ ID NO: 752249 - DNA, 25 bp, Mus musculus
taagcctatgtgttctgtacttcca

SEQ ID NO: 752250 - DNA, 25 bp, Mus musculus
taagcctcaggtcgtcccaaggtga

SEQ ID NO: 752251 - DNA, 25 bp, Mus musculus
taagcctcaggtggtcccaaggtga

SEQ ID NO: 752252 - DNA, 25 bp, Mus musculus
taagcctcagttagcgggaatgccc

SEQ ID NO: 752253 - DNA, 25 bp, Mus musculus
taagcctcagtttgcgggaatgccc

SEQ ID NO: 752254 - DNA, 25 bp, Mus musculus
taagcctccggaagtggctgttttc

SEQ ID NO: 752255 - DNA, 25 bp, Mus musculus
taagcctccggatgtggctgttttc

SEQ ID NO: 752256 - DNA, 25 bp, Mus musculus
taagcctcctttaattacagttcaa

SEQ ID NO: 752257 - DNA, 25 bp, Mus musculus
taagcctccttttattacagttcaa

SEQ ID NO: 752258 - DNA, 25 bp, Mus musculus
taagcctcgcccacacgaccgactt

SEQ ID NO: 752259 - DNA, 25 bp, Mus musculus
taagcctcgccctcacgaccgactt

SEQ ID NO: 752260 - DNA, 25 bp, Mus musculus
taagcctctactctgcagggagacg

SEQ ID NO: 752261 - DNA, 25 bp, Mus musculus
taagcctctactgtgcagggagacg

SEQ ID NO: 752262 - DNA, 25 bp, Mus musculus
taagcctctgtgctggtctaattct

SEQ ID NO: 752263 - DNA, 25 bp, Mus musculus
taagcctctgtggtggtctaattct

SEQ ID NO: 752264 - DNA, 25 bp, Mus musculus
taagcctcttccataaggttcttgt

SEQ ID NO: 752265 - DNA, 25 bp, Mus musculus
taagcctcttccttaaggttcttgt

SEQ ID NO: 752266 - DNA, 25 bp, Mus musculus
taagcctctttcaaacccaacagga

SEQ ID NO: 752267 - DNA, 25 bp, Mus musculus
taagcctctttctaacccaacagga

SEQ ID NO: 752268 - DNA, 25 bp, Mus musculus
taagcctgatacaaggagcctcaca

SEQ ID NO: 752269 - DNA, 25 bp, Mus musculus
taagcctgatactaggagcctcaca

SEQ ID NO: 752270 - DNA, 25 bp, Mus musculus
taagcctgccaacctgtacaggagt

SEQ ID NO: 752271 - DNA, 25 bp, Mus musculus
taagcctgccaagctgtacaggagt

SEQ ID NO: 752272 - DNA, 25 bp, Mus musculus
taagcctggagtcttgttgctgcat

SEQ ID NO: 752273 - DNA, 25 bp, Mus musculus
taagcctggagtgttgttgctgcat

SEQ ID NO: 752274 - DNA, 25 bp, Mus musculus
taagcctggcaaccggagttgactc

SEQ ID NO: 752275 - DNA, 25 bp, Mus musculus
taagcctggcaagcggagttgactc

SEQ ID NO: 752276 - DNA, 25 bp, Mus musculus
taagcctgttgaagtcaccgagtca

SEQ ID NO: 752277 - DNA, 25 bp, Mus musculus
taagcctgttgatgtcaccgagtca

SEQ ID NO: 752278 - DNA, 25 bp, Mus musculus
taagcctgttttcctgccacagtaa

SEQ ID NO: 752279 - DNA, 25 bp, Mus musculus
taagcctgttttgctgccacagtaa

SEQ ID NO: 752280 - DNA, 25 bp, Mus musculus
taagccttaaatatgcagtatctgg

SEQ ID NO: 752281 - DNA, 25 bp, Mus musculus
taagccttaaatttgcagtatctgg

SEQ ID NO: 752282 - DNA, 25 bp, Mus musculus
taagccttacgtaaggtgctcctct

SEQ ID NO: 752283 - DNA, 25 bp, Mus musculus
taagccttacgttaggtgctcctct

SEQ ID NO: 752284 - DNA, 25 bp, Mus musculus
taagccttcaggcaacatttcagat

SEQ ID NO: 752285 - DNA, 25 bp, Mus musculus
taagccttcagggaacatttcagat

SEQ ID NO: 752286 - DNA, 25 bp, Mus musculus
taagccttccagaatatacccttgt

SEQ ID NO: 752287 - DNA, 25 bp, Mus musculus
taagccttccagtatatacccttgt

SEQ ID NO: 752288 - DNA, 25 bp, Mus musculus
taagccttctttcaaaaccccatat

SEQ ID NO: 752289 - DNA, 25 bp, Mus musculus
taagccttctttgaaaaccccatat

SEQ ID NO: 752290 - DNA, 25 bp, Mus musculus
taagccttgcccctagaaatgaggg

SEQ ID NO: 752291 - DNA, 25 bp, Mus musculus
taagccttgcccgtagaaatgaggg

SEQ ID NO: 752292 - DNA, 25 bp, Mus musculus
taagccttgtaaatctaatgtggtg

SEQ ID NO: 752293 - DNA, 25 bp, Mus musculus
taagccttgtaattctaatgtggtg

SEQ ID NO: 752294 - DNA, 25 bp, Mus musculus
taagccttgtctagtggaccttcac

SEQ ID NO: 752295 - DNA, 25 bp, Mus musculus
taagccttgtcttgtggaccttcac

SEQ ID NO: 752296 - DNA, 25 bp, Mus musculus
taagccttgttgctcattctggaac

SEQ ID NO: 752297 - DNA, 25 bp, Mus musculus
taagccttgttggtcattctggaac

SEQ ID NO: 752298 - DNA, 25 bp, Mus musculus
taagccttgtttagatttatagcag

SEQ ID NO: 752299 - DNA, 25 bp, Mus musculus
taagccttgttttgatttatagcag

SEQ ID NO: 752300 - DNA, 25 bp, Mus musculus
taagcctttaacctttaatgcaaat

SEQ ID NO: 752301 - DNA, 25 bp, Mus musculus
taagcctttaacgtttaatgcaaat

SEQ ID NO: 752302 - DNA, 25 bp, Mus musculus
taagcctttaggaactactgtaaat

SEQ ID NO: 752303 - DNA, 25 bp, Mus musculus
taagcctttaggtactactgtaaat

SEQ ID NO: 752304 - DNA, 25 bp, Mus musculus
taagcctttattcccattggtatta

SEQ ID NO: 752305 - DNA, 25 bp, Mus musculus
taagcctttattgccattggtatta

SEQ ID NO: 752306 - DNA, 25 bp, Mus musculus
taagcctttctgcttgggattatcc

SEQ ID NO: 752307 - DNA, 25 bp, Mus musculus
taagcctttctggttgggattatcc

SEQ ID NO: 752308 - DNA, 25 bp, Mus musculus
taagcctttgacaagccaacaatct

SEQ ID NO: 752309 - DNA, 25 bp, Mus musculus
taagcctttgactagccaacaatct

SEQ ID NO: 752310 - DNA, 25 bp, Mus musculus
taagcctttgatcaaggctgcctct

SEQ ID NO: 752311 - DNA, 25 bp, Mus musculus
taagcctttgatgaaggctgcctct

SEQ ID NO: 752312 - DNA, 25 bp, Mus musculus
taagcctttgctctatactctcatc

SEQ ID NO: 752313 - DNA, 25 bp, Mus musculus
taagcctttgctgtatactctcatc

SEQ ID NO: 752314 - DNA, 25 bp, Mus musculus
taagcctttgttcggtcagtactag

SEQ ID NO: 752315 - DNA, 25 bp, Mus musculus
taagcctttgttgggtcagtactag

SEQ ID NO: 752316 - DNA, 25 bp, Mus musculus
taagcgaaaaccctaccacaagaag

SEQ ID NO: 752317 - DNA, 25 bp, Mus musculus
taagcgaaaaccgtaccacaagaag

SEQ ID NO: 752318 - DNA, 25 bp, Mus musculus
taagcgaacaagactccgtacagag

SEQ ID NO: 752319 - DNA, 25 bp, Mus musculus
taagcgaacaagtctccgtacagag

SEQ ID NO: 752320 - DNA, 25 bp, Mus musculus
taagcgaaggttcttattttaactg

SEQ ID NO: 752321 - DNA, 25 bp, Mus musculus
taagcgaaggttgttattttaactg

SEQ ID NO: 752322 - DNA, 25 bp, Mus musculus
taagcgaatgcacgcacacccacgt

SEQ ID NO: 752323 - DNA, 25 bp, Mus musculus
taagcgaatgcaggcacacccacgt

SEQ ID NO: 752324 - DNA, 25 bp, Mus musculus
taagcgacaacaccccatacagcag

SEQ ID NO: 752325 - DNA, 25 bp, Mus musculus
taagcgacaacagcccatacagcag

SEQ ID NO: 752326 - DNA, 25 bp, Mus musculus
taagcgaccagtcaggcatggacac

SEQ ID NO: 752327 - DNA, 25 bp, Mus musculus
taagcgaccagtgaggcatggacac

SEQ ID NO: 752328 - DNA, 25 bp, Mus musculus
taagcgacctgtcccttttacaata

SEQ ID NO: 752329 - DNA, 25 bp, Mus musculus
taagcgacctgtgccttttacaata

SEQ ID NO: 752330 - DNA, 25 bp, Mus musculus
taagcgactctaccgagacctggtg

SEQ ID NO: 752331 - DNA, 25 bp, Mus musculus
taagcgactctagcgagacctggtg

SEQ ID NO: 752332 - DNA, 25 bp, Mus musculus
taagcgactgataagttatggacta

SEQ ID NO: 752333 - DNA, 25 bp, Mus musculus
taagcgactgattagttatggacta

SEQ ID NO: 752334 - DNA, 25 bp, Mus musculus
taagcgacttcaaggcttctctgtt

SEQ ID NO: 752335 - DNA, 25 bp, Mus musculus
taagcgacttcatggcttctctgtt

SEQ ID NO: 752336 - DNA, 25 bp, Mus musculus
taagcgagacctatgctagctccac

SEQ ID NO: 752337 - DNA, 25 bp, Mus musculus
taagcgagacctttgctagctccac

SEQ ID NO: 752338 - DNA, 25 bp, Mus musculus
taagcgagcaggagttaggaggccc

SEQ ID NO: 752339 - DNA, 25 bp, Mus musculus
taagcgagcaggtgttaggaggccc

SEQ ID NO: 752340 - DNA, 25 bp, Mus musculus
taagcgaggaacactaacccaatgg

SEQ ID NO: 752341 - DNA, 25 bp, Mus musculus
taagcgaggaactctaacccaatgg

SEQ ID NO: 752342 - DNA, 25 bp, Mus musculus
taagcgataccgattgagccactga

SEQ ID NO: 752343 - DNA, 25 bp, Mus musculus
taagcgataccgtttgagccactga

SEQ ID NO: 752344 - DNA, 25 bp, Mus musculus
taagcgatttatccccaatttccca

SEQ ID NO: 752345 - DNA, 25 bp, Mus musculus
taagcgatttatgcccaatttccca

SEQ ID NO: 752346 - DNA, 25 bp, Mus musculus
taagcgcactgccttccagtactgg

SEQ ID NO: 752347 - DNA, 25 bp, Mus musculus
taagcgcactgcgttccagtactgg

SEQ ID NO: 752348 - DNA, 25 bp, Mus musculus
taagcgcagaacagccctataagaa

SEQ ID NO: 752349 - DNA, 25 bp, Mus musculus
taagcgcagaactgccctataagaa

SEQ ID NO: 752350 - DNA, 25 bp, Mus musculus
taagcgcaggataccctatctacac

SEQ ID NO: 752351 - DNA, 25 bp, Mus musculus
taagcgcaggattccctatctacac

SEQ ID NO: 752352 - DNA, 25 bp, Mus musculus
taagcgcagtgacctttggaagcct

SEQ ID NO: 752353 - DNA, 25 bp, Mus musculus
taagcgcagtgagctttggaagcct

SEQ ID NO: 752354 - DNA, 25 bp, Mus musculus
taagcgccattcacatggttgggtt

SEQ ID NO: 752355 - DNA, 25 bp, Mus musculus
taagcgccattctcatggttgggtt

SEQ ID NO: 752356 - DNA, 25 bp, Mus musculus
taagcgcccaagaacccagatcgag

SEQ ID NO: 752357 - DNA, 25 bp, Mus musculus
taagcgcccaagtacccagatcgag

SEQ ID NO: 752358 - DNA, 25 bp, Mus musculus
taagcgccgtgaacagcttcccgat

SEQ ID NO: 752359 - DNA, 25 bp, Mus musculus
taagcgccgtgatcagcttcccgat

SEQ ID NO: 752360 - DNA, 25 bp, Mus musculus
taagcgcctgctacacaagaacatc

SEQ ID NO: 752361 - DNA, 25 bp, Mus musculus
taagcgcctgcttcacaagaacatc

SEQ ID NO: 752362 - DNA, 25 bp, Mus musculus
taagcgcctggcatggtaacacaga

SEQ ID NO: 752363 - DNA, 25 bp, Mus musculus
taagcgcctggcttggtaacacaga

SEQ ID NO: 752364 - DNA, 25 bp, Mus musculus
taagcgcgacacatgctgggtccac

SEQ ID NO: 752365 - DNA, 25 bp, Mus musculus
taagcgcgacacttgctgggtccac

SEQ ID NO: 752366 - DNA, 25 bp, Mus musculus
taagcgctacagctctagtttattc

SEQ ID NO: 752367 - DNA, 25 bp, Mus musculus
taagcgctacaggtctagtttattc

SEQ ID NO: 752368 - DNA, 25 bp, Mus musculus
taagcgctacgacctcattcaggag

SEQ ID NO: 752369 - DNA, 25 bp, Mus musculus
taagcgctacgagctcattcaggag

SEQ ID NO: 752370 - DNA, 25 bp, Mus musculus
taagcgctctctcctcaaagtggtc

SEQ ID NO: 752371 - DNA, 25 bp, Mus musculus
taagcgctctctgctcaaagtggtc

SEQ ID NO: 752372 - DNA, 25 bp, Mus musculus
taagcgctgaaccacttagcagaaa

SEQ ID NO: 752373 - DNA, 25 bp, Mus musculus
taagcgctgaacgacttagcagaaa

SEQ ID NO: 752374 - DNA, 25 bp, Mus musculus
taagcgctgaggaatgatgtggcaa

SEQ ID NO: 752375 - DNA, 25 bp, Mus musculus
taagcgctgaggtatgatgtggcaa

SEQ ID NO: 752376 - DNA, 25 bp, Mus musculus
taagcgctttgtcggcttaagtcct

SEQ ID NO: 752377 - DNA, 25 bp, Mus musculus
taagcgctttgtgggcttaagtcct

SEQ ID NO: 752378 - DNA, 25 bp, Mus musculus
taagcgcttttacccaacggagtgg

SEQ ID NO: 752379 - DNA, 25 bp, Mus musculus
taagcgcttttagccaacggagtgg

SEQ ID NO: 752380 - DNA, 25 bp, Mus musculus
taagcggaccacaagtgcgccatgg

SEQ ID NO: 752381 - DNA, 25 bp, Mus musculus
taagcggaccactagtgcgccatgg

SEQ ID NO: 752382 - DNA, 25 bp, Mus musculus
taagcggagagcctttcctccttga

SEQ ID NO: 752383 - DNA, 25 bp, Mus musculus
taagcggagagcgtttcctccttga

SEQ ID NO: 752384 - DNA, 25 bp, Mus musculus
taagcggcatcaaagcaacggttgt

SEQ ID NO: 752385 - DNA, 25 bp, Mus musculus
taagcggcatcatagcaacggttgt

SEQ ID NO: 752386 - DNA, 25 bp, Mus musculus
taagcggcatccctctttgtctttg

SEQ ID NO: 752387 - DNA, 25 bp, Mus musculus
taagcggcatccgtctttgtctttg

SEQ ID NO: 752388 - DNA, 25 bp, Mus musculus
taagcggcttggctgactcctttat

SEQ ID NO: 752389 - DNA, 25 bp, Mus musculus
taagcggcttgggtgactcctttat

SEQ ID NO: 752390 - DNA, 25 bp, Mus musculus
taagcggcttgtccattctgagcat

SEQ ID NO: 752391 - DNA, 25 bp, Mus musculus
taagcggcttgtgcattctgagcat

SEQ ID NO: 752392 - DNA, 25 bp, Mus musculus
taagcgggatccctacttagggaat

SEQ ID NO: 752393 - DNA, 25 bp, Mus musculus
taagcgggatccgtacttagggaat

SEQ ID NO: 752394 - DNA, 25 bp, Mus musculus
taagcggtaccgagcaatgaaactg

SEQ ID NO: 752395 - DNA, 25 bp, Mus musculus
taagcggtaccgtgcaatgaaactg

SEQ ID NO: 752396 - DNA, 25 bp, Mus musculus
taagcggtagctagcactccatttt

SEQ ID NO: 752397 - DNA, 25 bp, Mus musculus
taagcggtagcttgcactccatttt

SEQ ID NO: 752398 - DNA, 25 bp, Mus musculus
taagcggtagttctgccttttgccc

SEQ ID NO: 752399 - DNA, 25 bp, Mus musculus
taagcggtagttgtgccttttgccc

SEQ ID NO: 752400 - DNA, 25 bp, Mus musculus
taagcggtgcttcaaaaaccgtctg

SEQ ID NO: 752401 - DNA, 25 bp, Mus musculus
taagcggtgcttgaaaaaccgtctg

SEQ ID NO: 752402 - DNA, 25 bp, Mus musculus
taagcggtgtttcgtctggatctgt

SEQ ID NO: 752403 - DNA, 25 bp, Mus musculus
taagcggtgtttggtctggatctgt

SEQ ID NO: 752404 - DNA, 25 bp, Mus musculus
taagcgtcgctgcagacttagtcgc

SEQ ID NO: 752405 - DNA, 25 bp, Mus musculus
taagcgtcgctggagacttagtcgc

SEQ ID NO: 752406 - DNA, 25 bp, Mus musculus
taagcgtcgtcgaaggagtgcctcc

SEQ ID NO: 752407 - DNA, 25 bp, Mus musculus
taagcgtcgtcgtaggagtgcctcc

SEQ ID NO: 752408 - DNA, 25 bp, Mus musculus
taagcgtgccaccacggtctcttat

SEQ ID NO: 752409 - DNA, 25 bp, Mus musculus
taagcgtgccacgacggtctcttat

SEQ ID NO: 752410 - DNA, 25 bp, Mus musculus
taagcgtgctatagtctctgtgact

SEQ ID NO: 752411 - DNA, 25 bp, Mus musculus
taagcgtgctattgtctctgtgact

SEQ ID NO: 752412 - DNA, 25 bp, Mus musculus
taagcgtgtaccatcagagctgaga

SEQ ID NO: 752413 - DNA, 25 bp, Mus musculus
taagcgtgtaccttcagagctgaga

SEQ ID NO: 752414 - DNA, 25 bp, Mus musculus
taagcgtgtcagcatggccaccctg

SEQ ID NO: 752415 - DNA, 25 bp, Mus musculus
taagcgtgtcaggatggccaccctg

SEQ ID NO: 752416 - DNA, 25 bp, Mus musculus
taagcgttcaaacgtcaccttttct

SEQ ID NO: 752417 - DNA, 25 bp, Mus musculus
taagcgttcaaaggtcaccttttct

SEQ ID NO: 752418 - DNA, 25 bp, Mus musculus
taagcgtttcccagctgagtcaaac

SEQ ID NO: 752419 - DNA, 25 bp, Mus musculus
taagcgtttccctgctgagtcaaac

SEQ ID NO: 752420 - DNA, 25 bp, Mus musculus
taagctaaaattatccacaacatat

SEQ ID NO: 752421 - DNA, 25 bp, Mus musculus
taagctaaaattttccacaacatat

SEQ ID NO: 752422 - DNA, 25 bp, Mus musculus
taagctaaacatattggagacgtct

SEQ ID NO: 752423 - DNA, 25 bp, Mus musculus
taagctaaacattttggagacgtct

SEQ ID NO: 752424 - DNA, 25 bp, Mus musculus
taagctaaataaatccaagaggtgt

SEQ ID NO: 752425 - DNA, 25 bp, Mus musculus
taagctaaataattccaagaggtgt

SEQ ID NO: 752426 - DNA, 25 bp, Mus musculus
taagctacacacaagggccactata

SEQ ID NO: 752427 - DNA, 25 bp, Mus musculus
taagctacacactagggccactata

SEQ ID NO: 752428 - DNA, 25 bp, Mus musculus
taagctacacagcaagcatcagcgt

SEQ ID NO: 752429 - DNA, 25 bp, Mus musculus
taagctacacaggaagcatcagcgt

SEQ ID NO: 752430 - DNA, 25 bp, Mus musculus
taagctacagcgaatccggcatgaa

SEQ ID NO: 752431 - DNA, 25 bp, Mus musculus
taagctacagcgtatccggcatgaa

SEQ ID NO: 752432 - DNA, 25 bp, Mus musculus
taagctacatcccagactctgtatt

SEQ ID NO: 752433 - DNA, 25 bp, Mus musculus
taagctacatccgagactctgtatt

SEQ ID NO: 752434 - DNA, 25 bp, Mus musculus
taagctacatctaccacccttggtt

SEQ ID NO: 752435 - DNA, 25 bp, Mus musculus
taagctacatcttccacccttggtt

SEQ ID NO: 752436 - DNA, 25 bp, Mus musculus
taagctaccattacgacctaactgt

SEQ ID NO: 752437 - DNA, 25 bp, Mus musculus
taagctaccatttcgacctaactgt

SEQ ID NO: 752438 - DNA, 25 bp, Mus musculus
taagctaccgcgaactctgggagaa

SEQ ID NO: 752439 - DNA, 25 bp, Mus musculus
taagctaccgcgtactctgggagaa

SEQ ID NO: 752440 - DNA, 25 bp, Mus musculus
taagctactgtaattgtcctacaat

SEQ ID NO: 752441 - DNA, 25 bp, Mus musculus
taagctactgtatttgtcctacaat

SEQ ID NO: 752442 - DNA, 25 bp, Mus musculus
taagctagaacaccgtccatgggaa

SEQ ID NO: 752443 - DNA, 25 bp, Mus musculus
taagctagaacagcgtccatgggaa

SEQ ID NO: 752444 - DNA, 25 bp, Mus musculus
taagctagaagaagcgcaggagcaa

SEQ ID NO: 752445 - DNA, 25 bp, Mus musculus
taagctagaagatgcgcaggagcaa

SEQ ID NO: 752446 - DNA, 25 bp, Mus musculus
taagctagcctcagactcactatat

SEQ ID NO: 752447 - DNA, 25 bp, Mus musculus
taagctagcctctgactcactatat

SEQ ID NO: 752448 - DNA, 25 bp, Mus musculus
taagctagcttgacctggtttgggt

SEQ ID NO: 752449 - DNA, 25 bp, Mus musculus
taagctagcttgtcctggtttgggt

SEQ ID NO: 752450 - DNA, 25 bp, Mus musculus
taagctaggccactgtctctctctt

SEQ ID NO: 752451 - DNA, 25 bp, Mus musculus
taagctaggccagtgtctctctctt

SEQ ID NO: 752452 - DNA, 25 bp, Mus musculus
taagctagtcagcactccaggatgg

SEQ ID NO: 752453 - DNA, 25 bp, Mus musculus
taagctagtcaggactccaggatgg

SEQ ID NO: 752454 - DNA, 25 bp, Mus musculus
taagctagtgcgcatctgggaagac

SEQ ID NO: 752455 - DNA, 25 bp, Mus musculus
taagctagtgcggatctgggaagac

SEQ ID NO: 752456 - DNA, 25 bp, Mus musculus
taagctagttggaccttgccttatt

SEQ ID NO: 752457 - DNA, 25 bp, Mus musculus
taagctagttggtccttgccttatt

SEQ ID NO: 752458 - DNA, 25 bp, Mus musculus
taagctagtttccaccccatatgaa

SEQ ID NO: 752459 - DNA, 25 bp, Mus musculus
taagctagtttcgaccccatatgaa

SEQ ID NO: 752460 - DNA, 25 bp, Mus musculus
taagctataggacccatctttgtgg

SEQ ID NO: 752461 - DNA, 25 bp, Mus musculus
taagctataggagccatctttgtgg

SEQ ID NO: 752462 - DNA, 25 bp, Mus musculus
taagctatatggacccagctaccgg

SEQ ID NO: 752463 - DNA, 25 bp, Mus musculus
taagctatatggtcccagctaccgg

SEQ ID NO: 752464 - DNA, 25 bp, Mus musculus
taagctatgtcccagggctccagtt

SEQ ID NO: 752465 - DNA, 25 bp, Mus musculus
taagctatgtccgagggctccagtt

SEQ ID NO: 752466 - DNA, 25 bp, Mus musculus
taagctattataattgtgtggaact

SEQ ID NO: 752467 - DNA, 25 bp, Mus musculus
taagctattatatttgtgtggaact

SEQ ID NO: 752468 - DNA, 25 bp, Mus musculus
taagctattggaatactgcaagtca

SEQ ID NO: 752469 - DNA, 25 bp, Mus musculus
taagctattggattactgcaagtca

SEQ ID NO: 752470 - DNA, 25 bp, Mus musculus
taagctatttcacctttcattttga

SEQ ID NO: 752471 - DNA, 25 bp, Mus musculus
taagctatttcagctttcattttga

SEQ ID NO: 752472 - DNA, 25 bp, Mus musculus
taagctatttttctaactacaaagg

SEQ ID NO: 752473 - DNA, 25 bp, Mus musculus
taagctatttttgtaactacaaagg

SEQ ID NO: 752474 - DNA, 25 bp, Mus musculus
taagctcaagatcgaggctgacgaa

SEQ ID NO: 752475 - DNA, 25 bp, Mus musculus
taagctcaagatggaggctgacgaa

SEQ ID NO: 752476 - DNA, 25 bp, Mus musculus
taagctcacagaagagtcggcctgt

SEQ ID NO: 752477 - DNA, 25 bp, Mus musculus
taagctcacagatgagtcggcctgt

SEQ ID NO: 752478 - DNA, 25 bp, Mus musculus
taagctcacagcatcccagtaactg

SEQ ID NO: 752479 - DNA, 25 bp, Mus musculus
taagctcacagcctagtctattttt

SEQ ID NO: 752480 - DNA, 25 bp, Mus musculus
taagctcacagcgtagtctattttt

SEQ ID NO: 752481 - DNA, 25 bp, Mus musculus
taagctcacagcttcccagtaactg

SEQ ID NO: 752482 - DNA, 25 bp, Mus musculus
taagctcacaggagtggccaccact

SEQ ID NO: 752483 - DNA, 25 bp, Mus musculus
taagctcacaggtgtggccaccact

SEQ ID NO: 752484 - DNA, 25 bp, Mus musculus
taagctcaccctatgtagttactaa

SEQ ID NO: 752485 - DNA, 25 bp, Mus musculus
taagctcaccctccgagttggaaat

SEQ ID NO: 752486 - DNA, 25 bp, Mus musculus
taagctcaccctgcgagttggaaat

SEQ ID NO: 752487 - DNA, 25 bp, Mus musculus
taagctcaccctttgtagttactaa

SEQ ID NO: 752488 - DNA, 25 bp, Mus musculus
taagctcactccctatagaccaatg

SEQ ID NO: 752489 - DNA, 25 bp, Mus musculus
taagctcactccgtatagaccaatg

SEQ ID NO: 752490 - DNA, 25 bp, Mus musculus
taagctcactttcccctaaagatag

SEQ ID NO: 752491 - DNA, 25 bp, Mus musculus
taagctcactttgccctaaagatag

SEQ ID NO: 752492 - DNA, 25 bp, Mus musculus
taagctcagattattggtttttctt

SEQ ID NO: 752493 - DNA, 25 bp, Mus musculus
taagctcagatttttggtttttctt

SEQ ID NO: 752494 - DNA, 25 bp, Mus musculus
taagctcagcacatacagtaatcat

SEQ ID NO: 752495 - DNA, 25 bp, Mus musculus
taagctcagcacttacagtaatcat

SEQ ID NO: 752496 - DNA, 25 bp, Mus musculus
taagctcagcctaagtccctagaaa

SEQ ID NO: 752497 - DNA, 25 bp, Mus musculus
taagctcagccttagtccctagaaa

SEQ ID NO: 752498 - DNA, 25 bp, Mus musculus
taagctcagctcaccagttccatat

SEQ ID NO: 752499 - DNA, 25 bp, Mus musculus
taagctcagctctccagttccatat

SEQ ID NO: 752500 - DNA, 25 bp, Mus musculus
taagctcaggacattataccctctg

SEQ ID NO: 752501 - DNA, 25 bp, Mus musculus
taagctcaggactttataccctctg

SEQ ID NO: 752502 - DNA, 25 bp, Mus musculus
taagctcagtttaatgcctgggccc

SEQ ID NO: 752503 - DNA, 25 bp, Mus musculus
taagctcagttttatgcctgggccc

SEQ ID NO: 752504 - DNA, 25 bp, Mus musculus
taagctcatagaaagaacccagaat

SEQ ID NO: 752505 - DNA, 25 bp, Mus musculus
taagctcatagatagaacccagaat

SEQ ID NO: 752506 - DNA, 25 bp, Mus musculus
taagctccacctctatgcaggatgg

SEQ ID NO: 752507 - DNA, 25 bp, Mus musculus
taagctccacctgtatgcaggatgg

SEQ ID NO: 752508 - DNA, 25 bp, Mus musculus
taagctccacggatctttcagtcac

SEQ ID NO: 752509 - DNA, 25 bp, Mus musculus
taagctccacggttctttcagtcac

SEQ ID NO: 752510 - DNA, 25 bp, Mus musculus
taagctccaggcagatcatgaacac

SEQ ID NO: 752511 - DNA, 25 bp, Mus musculus
taagctccaggccaatcaaagctat

SEQ ID NO: 752512 - DNA, 25 bp, Mus musculus
taagctccaggcgaatcaaagctat

SEQ ID NO: 752513 - DNA, 25 bp, Mus musculus
taagctccaggctgatcatgaacac

SEQ ID NO: 752514 - DNA, 25 bp, Mus musculus
taagctccagtcaaatgagagacct

SEQ ID NO: 752515 - DNA, 25 bp, Mus musculus
taagctccagtctaatgagagacct

SEQ ID NO: 752516 - DNA, 25 bp, Mus musculus
taagctcccaatcagccttgggtca

SEQ ID NO: 752517 - DNA, 25 bp, Mus musculus
taagctcccaatgagccttgggtca

SEQ ID NO: 752518 - DNA, 25 bp, Mus musculus
taagctcccacaacaggtgaggcag

SEQ ID NO: 752519 - DNA, 25 bp, Mus musculus
taagctcccacatcaggtgaggcag

SEQ ID NO: 752520 - DNA, 25 bp, Mus musculus
taagctcccactcacacacaaataa

SEQ ID NO: 752521 - DNA, 25 bp, Mus musculus
taagctcccactgacacacaaataa

SEQ ID NO: 752522 - DNA, 25 bp, Mus musculus
taagctccctacacatgtgatagat

SEQ ID NO: 752523 - DNA, 25 bp, Mus musculus
taagctccctactcatgtgatagat

SEQ ID NO: 752524 - DNA, 25 bp, Mus musculus
taagctccctgtacaaacctgcacg

SEQ ID NO: 752525 - DNA, 25 bp, Mus musculus
taagctccctgttcaaacctgcacg

SEQ ID NO: 752526 - DNA, 25 bp, Mus musculus
taagctccctttacaactctcatta

SEQ ID NO: 752527 - DNA, 25 bp, Mus musculus
taagctcccttttcaactctcatta

SEQ ID NO: 752528 - DNA, 25 bp, Mus musculus
taagctcctacaacctcatttattg

SEQ ID NO: 752529 - DNA, 25 bp, Mus musculus
taagctcctacatcctcatttattg

SEQ ID NO: 752530 - DNA, 25 bp, Mus musculus
taagctcctggaacatacatgtgta

SEQ ID NO: 752531 - DNA, 25 bp, Mus musculus
taagctcctggatcatacatgtgta

SEQ ID NO: 752532 - DNA, 25 bp, Mus musculus
taagctcctgtactattcttggcac

SEQ ID NO: 752533 - DNA, 25 bp, Mus musculus
taagctcctgtagtattcttggcac

SEQ ID NO: 752534 - DNA, 25 bp, Mus musculus
taagctcctgtgagctctgaactcc

SEQ ID NO: 752535 - DNA, 25 bp, Mus musculus
taagctcctgtgtgctctgaactcc

SEQ ID NO: 752536 - DNA, 25 bp, Mus musculus
taagctcctttcatctcacattgtg

SEQ ID NO: 752537 - DNA, 25 bp, Mus musculus
taagctcctttcttctcacattgtg

SEQ ID NO: 752538 - DNA, 25 bp, Mus musculus
taagctcctttgactggcagcaaga

SEQ ID NO: 752539 - DNA, 25 bp, Mus musculus
taagctcctttgcagcagggaccat

SEQ ID NO: 752540 - DNA, 25 bp, Mus musculus
taagctcctttggagcagggaccat

SEQ ID NO: 752541 - DNA, 25 bp, Mus musculus
taagctcctttgtctggcagcaaga

SEQ ID NO: 752542 - DNA, 25 bp, Mus musculus
taagctcgatatccagacatctaca

SEQ ID NO: 752543 - DNA, 25 bp, Mus musculus
taagctcgatatgcagacatctaca

SEQ ID NO: 752544 - DNA, 25 bp, Mus musculus
taagctcgcttgagttttcattggt

SEQ ID NO: 752545 - DNA, 25 bp, Mus musculus
taagctcgcttgtgttttcattggt

SEQ ID NO: 752546 - DNA, 25 bp, Mus musculus
taagctcgggccacatgtggtgtca

SEQ ID NO: 752547 - DNA, 25 bp, Mus musculus
taagctcgggcctcatgtggtgtca

SEQ ID NO: 752548 - DNA, 25 bp, Mus musculus
taagctcgggtcacgaggcgaagat

SEQ ID NO: 752549 - DNA, 25 bp, Mus musculus
taagctcgggtctcgaggcgaagat

SEQ ID NO: 752550 - DNA, 25 bp, Mus musculus
taagctctagtgatccttgttctga

SEQ ID NO: 752551 - DNA, 25 bp, Mus musculus
taagctctagtgttccttgttctga

SEQ ID NO: 752552 - DNA, 25 bp, Mus musculus
taagctctatccatttaaactgtat

SEQ ID NO: 752553 - DNA, 25 bp, Mus musculus
taagctctatccttttaaactgtat

SEQ ID NO: 752554 - DNA, 25 bp, Mus musculus
taagctctccatagaaatattcatg

SEQ ID NO: 752555 - DNA, 25 bp, Mus musculus
taagctctccattgaaatattcatg

SEQ ID NO: 752556 - DNA, 25 bp, Mus musculus
taagctctcccaaactgaataccga

SEQ ID NO: 752557 - DNA, 25 bp, Mus musculus
taagctctcccatactgaataccga

SEQ ID NO: 752558 - DNA, 25 bp, Mus musculus
taagctctcccgactgataacatca

SEQ ID NO: 752559 - DNA, 25 bp, Mus musculus
taagctctcccgtctgataacatca

SEQ ID NO: 752560 - DNA, 25 bp, Mus musculus
taagctctctgacctgtggatctgt

SEQ ID NO: 752561 - DNA, 25 bp, Mus musculus
taagctctctgagctgtggatctgt

SEQ ID NO: 752562 - DNA, 25 bp, Mus musculus
taagctctctgccacccaactgagg

SEQ ID NO: 752563 - DNA, 25 bp, Mus musculus
taagctctctgcgacccaactgagg

SEQ ID NO: 752564 - DNA, 25 bp, Mus musculus
taagctctgaatagtgttgccctgc

SEQ ID NO: 752565 - DNA, 25 bp, Mus musculus
taagctctgaattgtgttgccctgc

SEQ ID NO: 752566 - DNA, 25 bp, Mus musculus
taagctctgcatacagacagctgca

SEQ ID NO: 752567 - DNA, 25 bp, Mus musculus
taagctctgcattcagacagctgca

SEQ ID NO: 752568 - DNA, 25 bp, Mus musculus
taagctctgcctacatcaaagcggg

SEQ ID NO: 752569 - DNA, 25 bp, Mus musculus
taagctctgcctattgaccaggaat

SEQ ID NO: 752570 - DNA, 25 bp, Mus musculus
taagctctgccttcatcaaagcggg

SEQ ID NO: 752571 - DNA, 25 bp, Mus musculus
taagctctgccttttgaccaggaat

SEQ ID NO: 752572 - DNA, 25 bp, Mus musculus
taagctctgcttcctgacatcatac

SEQ ID NO: 752573 - DNA, 25 bp, Mus musculus
taagctctgcttgctgacatcatac

SEQ ID NO: 752574 - DNA, 25 bp, Mus musculus
taagctctggaacccatacaagtga

SEQ ID NO: 752575 - DNA, 25 bp, Mus musculus
taagctctggaagccatacaagtga

SEQ ID NO: 752576 - DNA, 25 bp, Mus musculus
taagctctgggtccggatgcagcat

SEQ ID NO: 752577 - DNA, 25 bp, Mus musculus
taagctctgggtgcggatgcagcat

SEQ ID NO: 752578 - DNA, 25 bp, Mus musculus
taagctcttcgacggcaggcatttt

SEQ ID NO: 752579 - DNA, 25 bp, Mus musculus
taagctcttcgagggcaggcatttt

SEQ ID NO: 752580 - DNA, 25 bp, Mus musculus
taagctcttgcgcagccactggcat

SEQ ID NO: 752581 - DNA, 25 bp, Mus musculus
taagctcttgcggagccactggcat

SEQ ID NO: 752582 - DNA, 25 bp, Mus musculus
taagctcttgtaaatatctgtggta

SEQ ID NO: 752583 - DNA, 25 bp, Mus musculus
taagctcttgtatatatctgtggta

SEQ ID NO: 752584 - DNA, 25 bp, Mus musculus
taagctctttagaggcctttgtttt

SEQ ID NO: 752585 - DNA, 25 bp, Mus musculus
taagctctttagtggcctttgtttt

SEQ ID NO: 752586 - DNA, 25 bp, Mus musculus
taagctctttcactgatctccattc

SEQ ID NO: 752587 - DNA, 25 bp, Mus musculus
taagctctttcagtgatctccattc

SEQ ID NO: 752588 - DNA, 25 bp, Mus musculus
taagctctttccaatgtatccatga

SEQ ID NO: 752589 - DNA, 25 bp, Mus musculus
taagctctttcctatgtatccatga

SEQ ID NO: 752590 - DNA, 25 bp, Mus musculus
taagctgaactcacgcgtggtcctg

SEQ ID NO: 752591 - DNA, 25 bp, Mus musculus
taagctgaactctcgcgtggtcctg

SEQ ID NO: 752592 - DNA, 25 bp, Mus musculus
taagctgaagcacgctgcgctgacc

SEQ ID NO: 752593 - DNA, 25 bp, Mus musculus
taagctgaagcaggctgcgctgacc

SEQ ID NO: 752594 - DNA, 25 bp, Mus musculus
taagctgaatggattccccaactaa

SEQ ID NO: 752595 - DNA, 25 bp, Mus musculus
taagctgaatggtttccccaactaa

SEQ ID NO: 752596 - DNA, 25 bp, Mus musculus
taagctgacaggcttatggcatcat

SEQ ID NO: 752597 - DNA, 25 bp, Mus musculus
taagctgacagggttatggcatcat

SEQ ID NO: 752598 - DNA, 25 bp, Mus musculus
taagctgacgctactgtaaatacag

SEQ ID NO: 752599 - DNA, 25 bp, Mus musculus
taagctgacgcttctgtaaatacag

SEQ ID NO: 752600 - DNA, 25 bp, Mus musculus
taagctgactgtcaccagaggcctg

SEQ ID NO: 752601 - DNA, 25 bp, Mus musculus
taagctgactgtgaccagaggcctg

SEQ ID NO: 752602 - DNA, 25 bp, Mus musculus
taagctgagactctagatgaaccct

SEQ ID NO: 752603 - DNA, 25 bp, Mus musculus
taagctgagactgtagatgaaccct

SEQ ID NO: 752604 - DNA, 25 bp, Mus musculus
taagctgagcggattccacttcctg

SEQ ID NO: 752605 - DNA, 25 bp, Mus musculus
taagctgagcggtttccacttcctg

SEQ ID NO: 752606 - DNA, 25 bp, Mus musculus
taagctgaggatcctatgttgcagt

SEQ ID NO: 752607 - DNA, 25 bp, Mus musculus
taagctgaggatgctatgttgcagt

SEQ ID NO: 752608 - DNA, 25 bp, Mus musculus
taagctgaggcaactaagtgtcaca

SEQ ID NO: 752609 - DNA, 25 bp, Mus musculus
taagctgaggcatctaagtgtcaca

SEQ ID NO: 752610 - DNA, 25 bp, Mus musculus
taagctgaggccacaaggagcctaa

SEQ ID NO: 752611 - DNA, 25 bp, Mus musculus
taagctgaggcctcaaggagcctaa

SEQ ID NO: 752612 - DNA, 25 bp, Mus musculus
taagctgagggaaactccaacccca

SEQ ID NO: 752613 - DNA, 25 bp, Mus musculus
taagctgagggatactccaacccca

SEQ ID NO: 752614 - DNA, 25 bp, Mus musculus
taagctgatgcgctggatccgtaaa

SEQ ID NO: 752615 - DNA, 25 bp, Mus musculus
taagctgatgcggtggatccgtaaa

SEQ ID NO: 752616 - DNA, 25 bp, Mus musculus
taagctgattagacatgtccattca

SEQ ID NO: 752617 - DNA, 25 bp, Mus musculus
taagctgattagtcatgtccattca

SEQ ID NO: 752618 - DNA, 25 bp, Mus musculus
taagctgcaagaagcctgcaatcag

SEQ ID NO: 752619 - DNA, 25 bp, Mus musculus
taagctgcaagatgcctgcaatcag

SEQ ID NO: 752620 - DNA, 25 bp, Mus musculus
taagctgcacaccacaagtacctgg

SEQ ID NO: 752621 - DNA, 25 bp, Mus musculus
taagctgcacacgacaagtacctgg

SEQ ID NO: 752622 - DNA, 25 bp, Mus musculus
taagctgcagaccttttaggcaatc

SEQ ID NO: 752623 - DNA, 25 bp, Mus musculus
taagctgcagacgttttaggcaatc

SEQ ID NO: 752624 - DNA, 25 bp, Mus musculus
taagctgcaggtcgcttcctgatgt

SEQ ID NO: 752625 - DNA, 25 bp, Mus musculus
taagctgcaggtggcttcctgatgt

SEQ ID NO: 752626 - DNA, 25 bp, Mus musculus
taagctgcagtgacgtttatggaag

SEQ ID NO: 752627 - DNA, 25 bp, Mus musculus
taagctgcagtgtcgtttatggaag

SEQ ID NO: 752628 - DNA, 25 bp, Mus musculus
taagctgcagttcaagcacccttca

SEQ ID NO: 752629 - DNA, 25 bp, Mus musculus
taagctgcagttgaagcacccttca

SEQ ID NO: 752630 - DNA, 25 bp, Mus musculus
taagctgcatccctgggtgactcct

SEQ ID NO: 752631 - DNA, 25 bp, Mus musculus
taagctgcatccgtgggtgactcct

SEQ ID NO: 752632 - DNA, 25 bp, Mus musculus
taagctgcatttcaggcctgtcacc

SEQ ID NO: 752633 - DNA, 25 bp, Mus musculus
taagctgcatttgaggcctgtcacc

SEQ ID NO: 752634 - DNA, 25 bp, Mus musculus
taagctgccaaacttcctaaaccta

SEQ ID NO: 752635 - DNA, 25 bp, Mus musculus
taagctgccaaagttcctaaaccta

SEQ ID NO: 752636 - DNA, 25 bp, Mus musculus
taagctgccattacaaagtctgatg

SEQ ID NO: 752637 - DNA, 25 bp, Mus musculus
taagctgccatttcaaagtctgatg

SEQ ID NO: 752638 - DNA, 25 bp, Mus musculus
taagctgccccacagctgggtcact

SEQ ID NO: 752639 - DNA, 25 bp, Mus musculus
taagctgccccagagctgggtcact

SEQ ID NO: 752640 - DNA, 25 bp, Mus musculus
taagctgccctcacactatataatg

SEQ ID NO: 752641 - DNA, 25 bp, Mus musculus
taagctgccctctcactatataatg

SEQ ID NO: 752642 - DNA, 25 bp, Mus musculus
taagctgcctccctttagttccatg

SEQ ID NO: 752643 - DNA, 25 bp, Mus musculus
taagctgcctccgtttagttccatg

SEQ ID NO: 752644 - DNA, 25 bp, Mus musculus
taagctgcggtgatgtcctgtttca

SEQ ID NO: 752645 - DNA, 25 bp, Mus musculus
taagctgcggtgttgtcctgtttca

SEQ ID NO: 752646 - DNA, 25 bp, Mus musculus
taagctgctgagctgggcttcagtt

SEQ ID NO: 752647 - DNA, 25 bp, Mus musculus
taagctgctgaggtgggcttcagtt

SEQ ID NO: 752648 - DNA, 25 bp, Mus musculus
taagctgctgtactgcaactggaca

SEQ ID NO: 752649 - DNA, 25 bp, Mus musculus
taagctgctgtagtgcaactggaca

SEQ ID NO: 752650 - DNA, 25 bp, Mus musculus
taagctggaaaactccaaagggcaa

SEQ ID NO: 752651 - DNA, 25 bp, Mus musculus
taagctggaaaagtccaaagggcaa

SEQ ID NO: 752652 - DNA, 25 bp, Mus musculus
taagctggacatacttgggccttct

SEQ ID NO: 752653 - DNA, 25 bp, Mus musculus
taagctggacattcttgggccttct

SEQ ID NO: 752654 - DNA, 25 bp, Mus musculus
taagctggactcacaagtcaccgac

SEQ ID NO: 752655 - DNA, 25 bp, Mus musculus
taagctggactctcaagtcaccgac

SEQ ID NO: 752656 - DNA, 25 bp, Mus musculus
taagctggagctccaagagtgtctg

SEQ ID NO: 752657 - DNA, 25 bp, Mus musculus
taagctggagctgcaagagtgtctg

SEQ ID NO: 752658 - DNA, 25 bp, Mus musculus
taagctggattcctgactgacccag

SEQ ID NO: 752659 - DNA, 25 bp, Mus musculus
taagctggattcgtgactgacccag

SEQ ID NO: 752660 - DNA, 25 bp, Mus musculus
taagctggcatcacctaactgatag

SEQ ID NO: 752661 - DNA, 25 bp, Mus musculus
taagctggcatctcctaactgatag

SEQ ID NO: 752662 - DNA, 25 bp, Mus musculus
taagctggcattcaacttccttcct

SEQ ID NO: 752663 - DNA, 25 bp, Mus musculus
taagctggcattgaacttccttcct

SEQ ID NO: 752664 - DNA, 25 bp, Mus musculus
taagctggccctctgagtagagaga

SEQ ID NO: 752665 - DNA, 25 bp, Mus musculus
taagctggccctgtgagtagagaga

SEQ ID NO: 752666 - DNA, 25 bp, Mus musculus
taagctggcgaacgaccacctgtga

SEQ ID NO: 752667 - DNA, 25 bp, Mus musculus
taagctggcgaaggaccacctgtga

SEQ ID NO: 752668 - DNA, 25 bp, Mus musculus
taagctggctggaaggtcaagaaca

SEQ ID NO: 752669 - DNA, 25 bp, Mus musculus
taagctggctggtaggtcaagaaca

SEQ ID NO: 752670 - DNA, 25 bp, Mus musculus
taagctgggccaaaggctcccggag

SEQ ID NO: 752671 - DNA, 25 bp, Mus musculus
taagctgggccaatgtgccacaatt

SEQ ID NO: 752672 - DNA, 25 bp, Mus musculus
taagctgggccataggctcccggag

SEQ ID NO: 752673 - DNA, 25 bp, Mus musculus
taagctgggccattgtgccacaatt

SEQ ID NO: 752674 - DNA, 25 bp, Mus musculus
taagctgggtggcaagctgaaacca

SEQ ID NO: 752675 - DNA, 25 bp, Mus musculus
taagctgggtgggaagctgaaacca

SEQ ID NO: 752676 - DNA, 25 bp, Mus musculus
taagctggtactacagcccagagac

SEQ ID NO: 752677 - DNA, 25 bp, Mus musculus
taagctggtacttcagcccagagac

SEQ ID NO: 752678 - DNA, 25 bp, Mus musculus
taagctggtatacacctttagtccc

SEQ ID NO: 752679 - DNA, 25 bp, Mus musculus
taagctggtatagacctttagtccc

SEQ ID NO: 752680 - DNA, 25 bp, Mus musculus
taagctggtgtaccccgatggagca

SEQ ID NO: 752681 - DNA, 25 bp, Mus musculus
taagctggtgtagcccgatggagca

SEQ ID NO: 752682 - DNA, 25 bp, Mus musculus
taagctgtaagcacctcaaagcaga

SEQ ID NO: 752683 - DNA, 25 bp, Mus musculus
taagctgtaagctcctcaaagcaga

SEQ ID NO: 752684 - DNA, 25 bp, Mus musculus
taagctgtaatcaaactcctacgac

SEQ ID NO: 752685 - DNA, 25 bp, Mus musculus
taagctgtaatctaactcctacgac

SEQ ID NO: 752686 - DNA, 25 bp, Mus musculus
taagctgtacaaactgcagttgact

SEQ ID NO: 752687 - DNA, 25 bp, Mus musculus
taagctgtacaatctgcagttgact

SEQ ID NO: 752688 - DNA, 25 bp, Mus musculus
taagctgtagaaatggttaacaacc

SEQ ID NO: 752689 - DNA, 25 bp, Mus musculus
taagctgtagaattggttaacaacc

SEQ ID NO: 752690 - DNA, 25 bp, Mus musculus
taagctgtatcccagcaaccttctc

SEQ ID NO: 752691 - DNA, 25 bp, Mus musculus
taagctgtatccgagcaaccttctc

SEQ ID NO: 752692 - DNA, 25 bp, Mus musculus
taagctgtccacaggagacatttct

SEQ ID NO: 752693 - DNA, 25 bp, Mus musculus
taagctgtccactggagacatttct

SEQ ID NO: 752694 - DNA, 25 bp, Mus musculus
taagctgtccccatctgtcaaggtc

SEQ ID NO: 752695 - DNA, 25 bp, Mus musculus
taagctgtccccttctgtcaaggtc

SEQ ID NO: 752696 - DNA, 25 bp, Mus musculus
taagctgtccgcattgcctggtgtg

SEQ ID NO: 752697 - DNA, 25 bp, Mus musculus
taagctgtccgctttgcctggtgtg

SEQ ID NO: 752698 - DNA, 25 bp, Mus musculus
taagctgtcgacagtcccacattgg

SEQ ID NO: 752699 - DNA, 25 bp, Mus musculus
taagctgtcgactgtcccacattgg

SEQ ID NO: 752700 - DNA, 25 bp, Mus musculus
taagctgtctggcatatcatggatt

SEQ ID NO: 752701 - DNA, 25 bp, Mus musculus
taagctgtctgggatatcatggatt

SEQ ID NO: 752702 - DNA, 25 bp, Mus musculus
taagctgtgactacatccaagtggt

SEQ ID NO: 752703 - DNA, 25 bp, Mus musculus
taagctgtgacttcatccaagtggt

SEQ ID NO: 752704 - DNA, 25 bp, Mus musculus
taagctgtgctccacttaacgaagt

SEQ ID NO: 752705 - DNA, 25 bp, Mus musculus
taagctgtgctcgacttaacgaagt

SEQ ID NO: 752706 - DNA, 25 bp, Mus musculus
taagctgtgcttaacttttagttaa

SEQ ID NO: 752707 - DNA, 25 bp, Mus musculus
taagctgtgctttacttttagttaa

SEQ ID NO: 752708 - DNA, 25 bp, Mus musculus
taagctgtggcgaggttttctccaa

SEQ ID NO: 752709 - DNA, 25 bp, Mus musculus
taagctgtggcgtggttttctccaa

SEQ ID NO: 752710 - DNA, 25 bp, Mus musculus
taagctgtgtggcaccgccttcact

SEQ ID NO: 752711 - DNA, 25 bp, Mus musculus
taagctgtgtgggaccgccttcact

SEQ ID NO: 752712 - DNA, 25 bp, Mus musculus
taagctgttcaacaatccctccaga

SEQ ID NO: 752713 - DNA, 25 bp, Mus musculus
taagctgttcaagaatccctccaga

SEQ ID NO: 752714 - DNA, 25 bp, Mus musculus
taagctgttctgagctagccctgag

SEQ ID NO: 752715 - DNA, 25 bp, Mus musculus
taagctgttctgtgctagccctgag

SEQ ID NO: 752716 - DNA, 25 bp, Mus musculus
taagctgttcttagctgccccagtg

SEQ ID NO: 752717 - DNA, 25 bp, Mus musculus
taagctgttctttgctgccccagtg

SEQ ID NO: 752718 - DNA, 25 bp, Mus musculus
taagctgttgataccaggccaaagc

SEQ ID NO: 752719 - DNA, 25 bp, Mus musculus
taagctgttgattccaggccaaagc

SEQ ID NO: 752720 - DNA, 25 bp, Mus musculus
taagctgttgctcctcagggcctaa

SEQ ID NO: 752721 - DNA, 25 bp, Mus musculus
taagctgttgctgctcagggcctaa

SEQ ID NO: 752722 - DNA, 25 bp, Mus musculus
taagcttaaagcctctcagctctgc

SEQ ID NO: 752723 - DNA, 25 bp, Mus musculus
taagcttaaagcgtctcagctctgc

SEQ ID NO: 752724 - DNA, 25 bp, Mus musculus
taagcttaagccaactatgtgagat

SEQ ID NO: 752725 - DNA, 25 bp, Mus musculus
taagcttaagcctactatgtgagat

SEQ ID NO: 752726 - DNA, 25 bp, Mus musculus
taagcttacacccacactattgaaa

SEQ ID NO: 752727 - DNA, 25 bp, Mus musculus
taagcttacaccgacactattgaaa

SEQ ID NO: 752728 - DNA, 25 bp, Mus musculus
taagcttaccttaatgctttttgaa

SEQ ID NO: 752729 - DNA, 25 bp, Mus musculus
taagcttacctttatgctttttgaa

SEQ ID NO: 752730 - DNA, 25 bp, Mus musculus
taagcttactgtcatcacgtgccct

SEQ ID NO: 752731 - DNA, 25 bp, Mus musculus
taagcttactgtgatcacgtgccct

SEQ ID NO: 752732 - DNA, 25 bp, Mus musculus
taagcttaggacaaacctgcatcaa

SEQ ID NO: 752733 - DNA, 25 bp, Mus musculus
taagcttaggactaacctgcatcaa

SEQ ID NO: 752734 - DNA, 25 bp, Mus musculus
taagcttatcccagaagttagttat

SEQ ID NO: 752735 - DNA, 25 bp, Mus musculus
taagcttatccctgaagttagttat

SEQ ID NO: 752736 - DNA, 25 bp, Mus musculus
taagcttcaaacctcttgctcaaga

SEQ ID NO: 752737 - DNA, 25 bp, Mus musculus
taagcttcaaacgtcttgctcaaga

SEQ ID NO: 752738 - DNA, 25 bp, Mus musculus
taagcttcaattagctctcctcttc

SEQ ID NO: 752739 - DNA, 25 bp, Mus musculus
taagcttcaatttgctctcctcttc

SEQ ID NO: 752740 - DNA, 25 bp, Mus musculus
taagcttcagctcaggtccagcctg

SEQ ID NO: 752741 - DNA, 25 bp, Mus musculus
taagcttcagctgaggtccagcctg

SEQ ID NO: 752742 - DNA, 25 bp, Mus musculus
taagcttccaggaaacctcattgta

SEQ ID NO: 752743 - DNA, 25 bp, Mus musculus
taagcttccaggaatcctctagtga

SEQ ID NO: 752744 - DNA, 25 bp, Mus musculus
taagcttccaggcttcccctggtac

SEQ ID NO: 752745 - DNA, 25 bp, Mus musculus
taagcttccagggttcccctggtac

SEQ ID NO: 752746 - DNA, 25 bp, Mus musculus
taagcttccaggtaacctcattgta

SEQ ID NO: 752747 - DNA, 25 bp, Mus musculus
taagcttccaggtatcctctagtga

SEQ ID NO: 752748 - DNA, 25 bp, Mus musculus
taagcttccatgctgagggtaggca

SEQ ID NO: 752749 - DNA, 25 bp, Mus musculus
taagcttccatggtgagggtaggca

SEQ ID NO: 752750 - DNA, 25 bp, Mus musculus
taagcttcccacattttcagtacca

SEQ ID NO: 752751 - DNA, 25 bp, Mus musculus
taagcttcccactttttcagtacca

SEQ ID NO: 752752 - DNA, 25 bp, Mus musculus
taagcttccccacaagcggtttgca

SEQ ID NO: 752753 - DNA, 25 bp, Mus musculus
taagcttccccagaagcggtttgca

SEQ ID NO: 752754 - DNA, 25 bp, Mus musculus
taagcttcccctattttctatcagt

SEQ ID NO: 752755 - DNA, 25 bp, Mus musculus
taagcttcccctctcgtttcacatg

SEQ ID NO: 752756 - DNA, 25 bp, Mus musculus
taagcttcccctgtcgtttcacatg

SEQ ID NO: 752757 - DNA, 25 bp, Mus musculus
taagcttccccttttttctatcagt

SEQ ID NO: 752758 - DNA, 25 bp, Mus musculus
taagcttcccttactgttaaatgat

SEQ ID NO: 752759 - DNA, 25 bp, Mus musculus
taagcttccctttctgttaaatgat

SEQ ID NO: 752760 - DNA, 25 bp, Mus musculus
taagcttccgaacactgcagatcaa

SEQ ID NO: 752761 - DNA, 25 bp, Mus musculus
taagcttccgaagactgcagatcaa

SEQ ID NO: 752762 - DNA, 25 bp, Mus musculus
taagcttctcatacattgtctgcag

SEQ ID NO: 752763 - DNA, 25 bp, Mus musculus
taagcttctcattcattgtctgcag

SEQ ID NO: 752764 - DNA, 25 bp, Mus musculus
taagcttctcggagtttgccagcag

SEQ ID NO: 752765 - DNA, 25 bp, Mus musculus
taagcttctcggtgtttgccagcag

SEQ ID NO: 752766 - DNA, 25 bp, Mus musculus
taagcttctgttccctctaactgaa

SEQ ID NO: 752767 - DNA, 25 bp, Mus musculus
taagcttctgttctgcatctagtct

SEQ ID NO: 752768 - DNA, 25 bp, Mus musculus
taagcttctgttgcctctaactgaa

SEQ ID NO: 752769 - DNA, 25 bp, Mus musculus
taagcttctgttgtgcatctagtct

SEQ ID NO: 752770 - DNA, 25 bp, Mus musculus
taagcttcttccaacttaccatggg

SEQ ID NO: 752771 - DNA, 25 bp, Mus musculus
taagcttcttcctacttaccatggg

SEQ ID NO: 752772 - DNA, 25 bp, Mus musculus
taagcttgatacagtgcctggtctc

SEQ ID NO: 752773 - DNA, 25 bp, Mus musculus
taagcttgatactgtgcctggtctc

SEQ ID NO: 752774 - DNA, 25 bp, Mus musculus
taagcttgcaagcaggtgacctgta

SEQ ID NO: 752775 - DNA, 25 bp, Mus musculus
taagcttgcaaggaggtgacctgta

SEQ ID NO: 752776 - DNA, 25 bp, Mus musculus
taagcttgcccacaagtgagaccac

SEQ ID NO: 752777 - DNA, 25 bp, Mus musculus
taagcttgcccagaagtgagaccac

SEQ ID NO: 752778 - DNA, 25 bp, Mus musculus
taagcttgcttaaggcctattaata

SEQ ID NO: 752779 - DNA, 25 bp, Mus musculus
taagcttgcttatggcctattaata

SEQ ID NO: 752780 - DNA, 25 bp, Mus musculus
taagcttgggccacaggagagactc

SEQ ID NO: 752781 - DNA, 25 bp, Mus musculus
taagcttgggcctcaggagagactc

SEQ ID NO: 752782 - DNA, 25 bp, Mus musculus
taagcttgggctagcaactccttca

SEQ ID NO: 752783 - DNA, 25 bp, Mus musculus
taagcttgggcttgcaactccttca

SEQ ID NO: 752784 - DNA, 25 bp, Mus musculus
taagcttggtcgagttacaggacag

SEQ ID NO: 752785 - DNA, 25 bp, Mus musculus
taagcttggtcgtgttacaggacag

SEQ ID NO: 752786 - DNA, 25 bp, Mus musculus
taagcttggtctatttctatggaag

SEQ ID NO: 752787 - DNA, 25 bp, Mus musculus
taagcttggtctttttctatggaag

SEQ ID NO: 752788 - DNA, 25 bp, Mus musculus
taagcttgttttacatatgggattc

SEQ ID NO: 752789 - DNA, 25 bp, Mus musculus
taagcttgtttttcatatgggattc

SEQ ID NO: 752790 - DNA, 25 bp, Mus musculus
taagctttaaccaactcatactgtt

SEQ ID NO: 752791 - DNA, 25 bp, Mus musculus
taagctttaacctactcatactgtt

SEQ ID NO: 752792 - DNA, 25 bp, Mus musculus
taagctttcagtcctgcgtgctcct

SEQ ID NO: 752793 - DNA, 25 bp, Mus musculus
taagctttcagtgctgcgtgctcct

SEQ ID NO: 752794 - DNA, 25 bp, Mus musculus
taagctttcccaacataatatattt

SEQ ID NO: 752795 - DNA, 25 bp, Mus musculus
taagctttcccatcataatatattt

SEQ ID NO: 752796 - DNA, 25 bp, Mus musculus
taagctttgagcatgggtttaccac

SEQ ID NO: 752797 - DNA, 25 bp, Mus musculus
taagctttgagcttgggtttaccac

SEQ ID NO: 752798 - DNA, 25 bp, Mus musculus
taagctttgatcattccccagcctc

SEQ ID NO: 752799 - DNA, 25 bp, Mus musculus
taagctttgatctttccccagcctc

SEQ ID NO: 752800 - DNA, 25 bp, Mus musculus
taagctttgcaaaacactgctgtct

SEQ ID NO: 752801 - DNA, 25 bp, Mus musculus
taagctttgcaatacactgctgtct

SEQ ID NO: 752802 - DNA, 25 bp, Mus musculus
taagctttgcagattccggtgtatt

SEQ ID NO: 752803 - DNA, 25 bp, Mus musculus
taagctttgcagtttccggtgtatt

SEQ ID NO: 752804 - DNA, 25 bp, Mus musculus
taagctttgcataattgctgggagt

SEQ ID NO: 752805 - DNA, 25 bp, Mus musculus
taagctttgcatcctagccttactc

SEQ ID NO: 752806 - DNA, 25 bp, Mus musculus
taagctttgcatgctagccttactc

SEQ ID NO: 752807 - DNA, 25 bp, Mus musculus
taagctttgcattattgctgggagt

SEQ ID NO: 752808 - DNA, 25 bp, Mus musculus
taagctttggtaatactatcatagt

SEQ ID NO: 752809 - DNA, 25 bp, Mus musculus
taagctttggtattactatcatagt

SEQ ID NO: 752810 - DNA, 25 bp, Mus musculus
taagcttttatgcagagatgtcaaa

SEQ ID NO: 752811 - DNA, 25 bp, Mus musculus
taagcttttatggagagatgtcaaa

SEQ ID NO: 752812 - DNA, 25 bp, Mus musculus
taagcttttcacaatattaactttt

SEQ ID NO: 752813 - DNA, 25 bp, Mus musculus
taagcttttcactatattaactttt

SEQ ID NO: 752814 - DNA, 25 bp, Mus musculus
taagcttttcatcagcggtccattc

SEQ ID NO: 752815 - DNA, 25 bp, Mus musculus
taagcttttcatgagcggtccattc

SEQ ID NO: 752816 - DNA, 25 bp, Mus musculus
taagcttttccaaggacagcagtca

SEQ ID NO: 752817 - DNA, 25 bp, Mus musculus
taagcttttccatggacagcagtca

SEQ ID NO: 752818 - DNA, 25 bp, Mus musculus
taagcttttctaatccaggctcttt

SEQ ID NO: 752819 - DNA, 25 bp, Mus musculus
taagcttttctattccaggctcttt

SEQ ID NO: 752820 - DNA, 25 bp, Mus musculus
taagcttttcttacgtttcaaactg

SEQ ID NO: 752821 - DNA, 25 bp, Mus musculus
taagcttttctttcgtttcaaactg

SEQ ID NO: 752822 - DNA, 25 bp, Mus musculus
taagcttttgtgagatcgtcaacga

SEQ ID NO: 752823 - DNA, 25 bp, Mus musculus
taagcttttgtgtgatcgtcaacga

SEQ ID NO: 752824 - DNA, 25 bp, Mus musculus
taagctttttctactttccactcta

SEQ ID NO: 752825 - DNA, 25 bp, Mus musculus
taagctttttcttctttccactcta

SEQ ID NO: 752826 - DNA, 25 bp, Mus musculus
taaggaaaacgcagggaagaggcta

SEQ ID NO: 752827 - DNA, 25 bp, Mus musculus
taaggaaaacgctgggaagaggcta

SEQ ID NO: 752828 - DNA, 25 bp, Mus musculus
taaggaaaccatacccctccaggag

SEQ ID NO: 752829 - DNA, 25 bp, Mus musculus
taaggaaaccattcccctccaggag

SEQ ID NO: 752830 - DNA, 25 bp, Mus musculus
taaggaaacgagctcctccatgcaa

SEQ ID NO: 752831 - DNA, 25 bp, Mus musculus
taaggaaacgaggtcctccatgcaa

SEQ ID NO: 752832 - DNA, 25 bp, Mus musculus
taaggaaacgccaaactgcactcct

SEQ ID NO: 752833 - DNA, 25 bp, Mus musculus
taaggaaacgcctaactgcactcct

SEQ ID NO: 752834 - DNA, 25 bp, Mus musculus
taaggaaacgggacgatgaatctac

SEQ ID NO: 752835 - DNA, 25 bp, Mus musculus
taaggaaacgggtcgatgaatctac

SEQ ID NO: 752836 - DNA, 25 bp, Mus musculus
taaggaaagtgcagcccctagtgga

SEQ ID NO: 752837 - DNA, 25 bp, Mus musculus
taaggaaagtgctgcccctagtgga

SEQ ID NO: 752838 - DNA, 25 bp, Mus musculus
taaggaaatctgcacctgtactgca

SEQ ID NO: 752839 - DNA, 25 bp, Mus musculus
taaggaaatctggacctgtactgca

SEQ ID NO: 752840 - DNA, 25 bp, Mus musculus
taaggaaattttacagcacaggaaa

SEQ ID NO: 752841 - DNA, 25 bp, Mus musculus
taaggaaatttttcagcacaggaaa

SEQ ID NO: 752842 - DNA, 25 bp, Mus musculus
taaggaacccatagctaattttttg

SEQ ID NO: 752843 - DNA, 25 bp, Mus musculus
taaggaacccattgctaattttttg

SEQ ID NO: 752844 - DNA, 25 bp, Mus musculus
taaggaaccctacaacattacctgt

SEQ ID NO: 752845 - DNA, 25 bp, Mus musculus
taaggaaccctagaacattacctgt

SEQ ID NO: 752846 - DNA, 25 bp, Mus musculus
taaggaaccctccaaactatcactg

SEQ ID NO: 752847 - DNA, 25 bp, Mus musculus
taaggaaccctcgaaactatcactg

SEQ ID NO: 752848 - DNA, 25 bp, Mus musculus
taaggaacctctacttcctggatcc

SEQ ID NO: 752849 - DNA, 25 bp, Mus musculus
taaggaacctcttcttcctggatcc

SEQ ID NO: 752850 - DNA, 25 bp, Mus musculus
taaggaactatgataacctcagtgt

SEQ ID NO: 752851 - DNA, 25 bp, Mus musculus
taaggaactatgttaacctcagtgt

SEQ ID NO: 752852 - DNA, 25 bp, Mus musculus
taaggaactcatacctttggcgttt

SEQ ID NO: 752853 - DNA, 25 bp, Mus musculus
taaggaactcattcctttggcgttt

SEQ ID NO: 752854 - DNA, 25 bp, Mus musculus
taaggaactccacagtcctgggaac

SEQ ID NO: 752855 - DNA, 25 bp, Mus musculus
taaggaactccagagtcctgggaac

SEQ ID NO: 752856 - DNA, 25 bp, Mus musculus
taaggaactctgagctctcaacttg

SEQ ID NO: 752857 - DNA, 25 bp, Mus musculus
taaggaactctgctcctggtgttac

SEQ ID NO: 752858 - DNA, 25 bp, Mus musculus
taaggaactctggtcctggtgttac

SEQ ID NO: 752859 - DNA, 25 bp, Mus musculus
taaggaactctgtgctctcaacttg

SEQ ID NO: 752860 - DNA, 25 bp, Mus musculus
taaggaactgccaaaggcctttctc

SEQ ID NO: 752861 - DNA, 25 bp, Mus musculus
taaggaactgcctaaggcctttctc

SEQ ID NO: 752862 - DNA, 25 bp, Mus musculus
taaggaactggccactcagcaactg

SEQ ID NO: 752863 - DNA, 25 bp, Mus musculus
taaggaactggcgactcagcaactg

SEQ ID NO: 752864 - DNA, 25 bp, Mus musculus
taaggaactgggatcatccacaaat

SEQ ID NO: 752865 - DNA, 25 bp, Mus musculus
taaggaactgggttcatccacaaat

SEQ ID NO: 752866 - DNA, 25 bp, Mus musculus
taaggaactgtaattgttacccagg

SEQ ID NO: 752867 - DNA, 25 bp, Mus musculus
taaggaactgtatttgttacccagg

SEQ ID NO: 752868 - DNA, 25 bp, Mus musculus
taaggaacttgtaggcccacctttg

SEQ ID NO: 752869 - DNA, 25 bp, Mus musculus
taaggaacttgttggcccacctttg

SEQ ID NO: 752870 - DNA, 25 bp, Mus musculus
taaggaagacaacgcaatcccgtgt

SEQ ID NO: 752871 - DNA, 25 bp, Mus musculus
taaggaagacaaggcaatcccgtgt

SEQ ID NO: 752872 - DNA, 25 bp, Mus musculus
taaggaagagctcctgctgccctat

SEQ ID NO: 752873 - DNA, 25 bp, Mus musculus
taaggaagagctgctgctgccctat

SEQ ID NO: 752874 - DNA, 25 bp, Mus musculus
taaggaagatctcgccttccctttt

SEQ ID NO: 752875 - DNA, 25 bp, Mus musculus
taaggaagatctggccttccctttt

SEQ ID NO: 752876 - DNA, 25 bp, Mus musculus
taaggaagcactctttggagaactg

SEQ ID NO: 752877 - DNA, 25 bp, Mus musculus
taaggaagcactgtttggagaactg

SEQ ID NO: 752878 - DNA, 25 bp, Mus musculus
taaggaagcatccagaaagcttgaa

SEQ ID NO: 752879 - DNA, 25 bp, Mus musculus
taaggaagcatcgagaaagcttgaa

SEQ ID NO: 752880 - DNA, 25 bp, Mus musculus
taaggaagcccgacacagaaatctc

SEQ ID NO: 752881 - DNA, 25 bp, Mus musculus
taaggaagcccgtcacagaaatctc

SEQ ID NO: 752882 - DNA, 25 bp, Mus musculus
taaggaaggctgctctgatctccag

SEQ ID NO: 752883 - DNA, 25 bp, Mus musculus
taaggaaggctggtctgatctccag

SEQ ID NO: 752884 - DNA, 25 bp, Mus musculus
taaggaaggtccagcatgcctcctg

SEQ ID NO: 752885 - DNA, 25 bp, Mus musculus
taaggaaggtcctgcatgcctcctg

SEQ ID NO: 752886 - DNA, 25 bp, Mus musculus
taaggaagtgtgaactccaggacgg

SEQ ID NO: 752887 - DNA, 25 bp, Mus musculus
taaggaagtgtgtactccaggacgg

SEQ ID NO: 752888 - DNA, 25 bp, Mus musculus
taaggaatcaagacctccaccagtc

SEQ ID NO: 752889 - DNA, 25 bp, Mus musculus
taaggaatcaagtcctccaccagtc

SEQ ID NO: 752890 - DNA, 25 bp, Mus musculus
taaggaatctccctgcgtagtgtat

SEQ ID NO: 752891 - DNA, 25 bp, Mus musculus
taaggaatctccgtgcgtagtgtat

SEQ ID NO: 752892 - DNA, 25 bp, Mus musculus
taaggaatgtcgctccaagcccctg

SEQ ID NO: 752893 - DNA, 25 bp, Mus musculus
taaggaatgtcggtccaagcccctg

SEQ ID NO: 752894 - DNA, 25 bp, Mus musculus
taaggacaacaccagtgacatcatg

SEQ ID NO: 752895 - DNA, 25 bp, Mus musculus
taaggacaacacgagtgacatcatg

SEQ ID NO: 752896 - DNA, 25 bp, Mus musculus
taaggacaatcccttctttctgcaa

SEQ ID NO: 752897 - DNA, 25 bp, Mus musculus
taaggacaatccgttctttctgcaa

SEQ ID NO: 752898 - DNA, 25 bp, Mus musculus
taaggacactccctttgtgcacagt

SEQ ID NO: 752899 - DNA, 25 bp, Mus musculus
taaggacactccgtttgtgcacagt

SEQ ID NO: 752900 - DNA, 25 bp, Mus musculus
taaggacactgcaagcacgggtttt

SEQ ID NO: 752901 - DNA, 25 bp, Mus musculus
taaggacactgctagcacgggtttt

SEQ ID NO: 752902 - DNA, 25 bp, Mus musculus
taaggacagactattgagcaaaatc

SEQ ID NO: 752903 - DNA, 25 bp, Mus musculus
taaggacagacttttgagcaaaatc

SEQ ID NO: 752904 - DNA, 25 bp, Mus musculus
taaggacagcaccaagcgcacctgc

SEQ ID NO: 752905 - DNA, 25 bp, Mus musculus
taaggacagcacgaagcgcacctgc

SEQ ID NO: 752906 - DNA, 25 bp, Mus musculus
taaggacagcgtctgtgacaccctg

SEQ ID NO: 752907 - DNA, 25 bp, Mus musculus
taaggacagcgtgtgtgacaccctg

SEQ ID NO: 752908 - DNA, 25 bp, Mus musculus
taaggacagggcagtgacaccaaat

SEQ ID NO: 752909 - DNA, 25 bp, Mus musculus
taaggacagggctgtgacaccaaat

SEQ ID NO: 752910 - DNA, 25 bp, Mus musculus
taaggacataaacccctaccctatg

SEQ ID NO: 752911 - DNA, 25 bp, Mus musculus
taaggacataaagccctaccctatg

SEQ ID NO: 752912 - DNA, 25 bp, Mus musculus
taaggacatcatagggctggactgt

SEQ ID NO: 752913 - DNA, 25 bp, Mus musculus
taaggacatcattgggctggactgt

SEQ ID NO: 752914 - DNA, 25 bp, Mus musculus
taaggacatcctagcctggacgaag

SEQ ID NO: 752915 - DNA, 25 bp, Mus musculus
taaggacatccttgcctggacgaag

SEQ ID NO: 752916 - DNA, 25 bp, Mus musculus
taaggacatcggacagcatcgcccc

SEQ ID NO: 752917 - DNA, 25 bp, Mus musculus
taaggacatcggtcagcatcgcccc

SEQ ID NO: 752918 - DNA, 25 bp, Mus musculus
taaggacatcgtcgcatccctgtaa

SEQ ID NO: 752919 - DNA, 25 bp, Mus musculus
taaggacatcgtggcatccctgtaa

SEQ ID NO: 752920 - DNA, 25 bp, Mus musculus
taaggacatttcctacctgtaccgg

SEQ ID NO: 752921 - DNA, 25 bp, Mus musculus
taaggacatttcgtacctgtaccgg

SEQ ID NO: 752922 - DNA, 25 bp, Mus musculus
taaggaccaacactgcacagagcaa

SEQ ID NO: 752923 - DNA, 25 bp, Mus musculus
taaggaccaacagtgcacagagcaa

SEQ ID NO: 752924 - DNA, 25 bp, Mus musculus
taaggaccactacatcctgcagcag

SEQ ID NO: 752925 - DNA, 25 bp, Mus musculus
taaggaccactagatcctgcagcag

SEQ ID NO: 752926 - DNA, 25 bp, Mus musculus
taaggaccaggcaccttgggacagg

SEQ ID NO: 752927 - DNA, 25 bp, Mus musculus
taaggaccaggctccttgggacagg

SEQ ID NO: 752928 - DNA, 25 bp, Mus musculus
taaggaccagtgatgccactgtccc

SEQ ID NO: 752929 - DNA, 25 bp, Mus musculus
taaggaccagtgttgccactgtccc

SEQ ID NO: 752930 - DNA, 25 bp, Mus musculus
taaggaccagttccctgctgatgag

SEQ ID NO: 752931 - DNA, 25 bp, Mus musculus
taaggaccagttgcctgctgatgag

SEQ ID NO: 752932 - DNA, 25 bp, Mus musculus
taaggaccatcgctgtccctttgat

SEQ ID NO: 752933 - DNA, 25 bp, Mus musculus
taaggaccatcggtgtccctttgat

SEQ ID NO: 752934 - DNA, 25 bp, Mus musculus
taaggaccccaaagactagtgttta

SEQ ID NO: 752935 - DNA, 25 bp, Mus musculus
taaggaccccaatgactagtgttta

SEQ ID NO: 752936 - DNA, 25 bp, Mus musculus
taaggaccgagtatcctgtgttctg

SEQ ID NO: 752937 - DNA, 25 bp, Mus musculus
taaggaccgagtttcctgtgttctg

SEQ ID NO: 752938 - DNA, 25 bp, Mus musculus
taaggacctcaacacttgaatacat

SEQ ID NO: 752939 - DNA, 25 bp, Mus musculus
taaggacctcaagacttgaatacat

SEQ ID NO: 752940 - DNA, 25 bp, Mus musculus
taaggacctcacagagcacaacgcc

SEQ ID NO: 752941 - DNA, 25 bp, Mus musculus
taaggacctcactgagcacaacgcc

SEQ ID NO: 752942 - DNA, 25 bp, Mus musculus
taaggacctcagattgatcctcggg

SEQ ID NO: 752943 - DNA, 25 bp, Mus musculus
taaggacctcagtttgatcctcggg

SEQ ID NO: 752944 - DNA, 25 bp, Mus musculus
taaggaccttatatatcactgaaaa

SEQ ID NO: 752945 - DNA, 25 bp, Mus musculus
taaggaccttatttatcactgaaaa

SEQ ID NO: 752946 - DNA, 25 bp, Mus musculus
taaggacgccatcctgaatgcagcc

SEQ ID NO: 752947 - DNA, 25 bp, Mus musculus
taaggacgccatgctgaatgcagcc

SEQ ID NO: 752948 - DNA, 25 bp, Mus musculus
taaggacggagtatgtagacttgta

SEQ ID NO: 752949 - DNA, 25 bp, Mus musculus
taaggacggagtttgtagacttgta

SEQ ID NO: 752950 - DNA, 25 bp, Mus musculus
taaggacggtcacactccgctttta

SEQ ID NO: 752951 - DNA, 25 bp, Mus musculus
taaggacggtcagactccgctttta

SEQ ID NO: 752952 - DNA, 25 bp, Mus musculus
taaggacgtagcatggaaagatttc

SEQ ID NO: 752953 - DNA, 25 bp, Mus musculus
taaggacgtagcttggaaagatttc

SEQ ID NO: 752954 - DNA, 25 bp, Mus musculus
taaggacgttacctacttccgtgat

SEQ ID NO: 752955 - DNA, 25 bp, Mus musculus
taaggacgttacgtacttccgtgat

SEQ ID NO: 752956 - DNA, 25 bp, Mus musculus
taaggactaattctggcaccccttg

SEQ ID NO: 752957 - DNA, 25 bp, Mus musculus
taaggactaattgtggcaccccttg

SEQ ID NO: 752958 - DNA, 25 bp, Mus musculus
taaggactacacatacctcttggtg

SEQ ID NO: 752959 - DNA, 25 bp, Mus musculus
taaggactacacttacctcttggtg

SEQ ID NO: 752960 - DNA, 25 bp, Mus musculus
taaggactacccacatgactctatc

SEQ ID NO: 752961 - DNA, 25 bp, Mus musculus
taaggactaccctcatgactctatc

SEQ ID NO: 752962 - DNA, 25 bp, Mus musculus
taaggactactcaccaagcctctga

SEQ ID NO: 752963 - DNA, 25 bp, Mus musculus
taaggactactctccaagcctctga

SEQ ID NO: 752964 - DNA, 25 bp, Mus musculus
taaggactactgctttgcccgagaa

SEQ ID NO: 752965 - DNA, 25 bp, Mus musculus
taaggactactggtttgcccgagaa

SEQ ID NO: 752966 - DNA, 25 bp, Mus musculus
taaggactatttcttgagcaggaac

SEQ ID NO: 752967 - DNA, 25 bp, Mus musculus
taaggactatttgttgagcaggaac

SEQ ID NO: 752968 - DNA, 25 bp, Mus musculus
taaggactccatagaccccaggtgt

SEQ ID NO: 752969 - DNA, 25 bp, Mus musculus
taaggactccattgaccccaggtgt

SEQ ID NO: 752970 - DNA, 25 bp, Mus musculus
taaggactccccctgttggtcatgt

SEQ ID NO: 752971 - DNA, 25 bp, Mus musculus
taaggactccccgtgttggtcatgt

SEQ ID NO: 752972 - DNA, 25 bp, Mus musculus
taaggactgaacactcatccctgga

SEQ ID NO: 752973 - DNA, 25 bp, Mus musculus
taaggactgaactctcatccctgga

SEQ ID NO: 752974 - DNA, 25 bp, Mus musculus
taaggactgatgactgggctgtgct

SEQ ID NO: 752975 - DNA, 25 bp, Mus musculus
taaggactgatgtctgggctgtgct

SEQ ID NO: 752976 - DNA, 25 bp, Mus musculus
taaggactgcagacagcgtcttctg

SEQ ID NO: 752977 - DNA, 25 bp, Mus musculus
taaggactgcagtcagcgtcttctg

SEQ ID NO: 752978 - DNA, 25 bp, Mus musculus
taaggactgcgtcttggcttctgac

SEQ ID NO: 752979 - DNA, 25 bp, Mus musculus
taaggactgcgtgttggcttctgac

SEQ ID NO: 752980 - DNA, 25 bp, Mus musculus
taaggactgcttactttgggatatc

SEQ ID NO: 752981 - DNA, 25 bp, Mus musculus
taaggactgctttctttgggatatc

SEQ ID NO: 752982 - DNA, 25 bp, Mus musculus
taaggactgtcgactctgggctgca

SEQ ID NO: 752983 - DNA, 25 bp, Mus musculus
taaggactgtcgtctctgggctgca

SEQ ID NO: 752984 - DNA, 25 bp, Mus musculus
taaggacttagtctacttccctgac

SEQ ID NO: 752985 - DNA, 25 bp, Mus musculus
taaggacttagtgtacttccctgac

SEQ ID NO: 752986 - DNA, 25 bp, Mus musculus
taaggacttcttagatgctgcaaga

SEQ ID NO: 752987 - DNA, 25 bp, Mus musculus
taaggacttctttgatgctgcaaga

SEQ ID NO: 752988 - DNA, 25 bp, Mus musculus
taaggactttgccttttggaccttg

SEQ ID NO: 752989 - DNA, 25 bp, Mus musculus
taaggactttgcgttttggaccttg

SEQ ID NO: 752990 - DNA, 25 bp, Mus musculus
taaggagaactacaacccaaccatc

SEQ ID NO: 752991 - DNA, 25 bp, Mus musculus
taaggagaactagaacccaaccatc

SEQ ID NO: 752992 - DNA, 25 bp, Mus musculus
taaggagaagctatattccctcggg

SEQ ID NO: 752993 - DNA, 25 bp, Mus musculus
taaggagaagctttattccctcggg

SEQ ID NO: 752994 - DNA, 25 bp, Mus musculus
taaggagacagcagtgggttctaca

SEQ ID NO: 752995 - DNA, 25 bp, Mus musculus
taaggagacagctgtgggttctaca

SEQ ID NO: 752996 - DNA, 25 bp, Mus musculus
taaggagacctaccatgggcaatat

SEQ ID NO: 752997 - DNA, 25 bp, Mus musculus
taaggagacctagcatgggcaatat

SEQ ID NO: 752998 - DNA, 25 bp, Mus musculus
taaggagactcactctacactgtac

SEQ ID NO: 752999 - DNA, 25 bp, Mus musculus
taaggagactcagtctacactgtac

SEQ ID NO: 753000 - DNA, 25 bp, Mus musculus
taaggagagccaacttcacccatga

SEQ ID NO: 753001 - DNA, 25 bp, Mus musculus
taaggagagccaccaccagatttca

SEQ ID NO: 753002 - DNA, 25 bp, Mus musculus
taaggagagccagcaccagatttca

SEQ ID NO: 753003 - DNA, 25 bp, Mus musculus
taaggagagccatcttcacccatga

SEQ ID NO: 753004 - DNA, 25 bp, Mus musculus
taaggagagcctacggctgcatcct

SEQ ID NO: 753005 - DNA, 25 bp, Mus musculus
taaggagagccttcggctgcatcct

SEQ ID NO: 753006 - DNA, 25 bp, Mus musculus
taaggagatcagctccaactatggt

SEQ ID NO: 753007 - DNA, 25 bp, Mus musculus
taaggagatcaggtccaactatggt

SEQ ID NO: 753008 - DNA, 25 bp, Mus musculus
taaggagatcccatccaccagcgag

SEQ ID NO: 753009 - DNA, 25 bp, Mus musculus
taaggagatcccttccaccagcgag

SEQ ID NO: 753010 - DNA, 25 bp, Mus musculus
taaggagatggcctgctctgtcact

SEQ ID NO: 753011 - DNA, 25 bp, Mus musculus
taaggagatggcgtgctctgtcact

SEQ ID NO: 753012 - DNA, 25 bp, Mus musculus
taaggagattgactgctccaagtcc

SEQ ID NO: 753013 - DNA, 25 bp, Mus musculus
taaggagattgagtgctccaagtcc

SEQ ID NO: 753014 - DNA, 25 bp, Mus musculus
taaggagcacacaccaggcaggtag

SEQ ID NO: 753015 - DNA, 25 bp, Mus musculus
taaggagcacactccaggcaggtag

SEQ ID NO: 753016 - DNA, 25 bp, Mus musculus
taaggagcacttaccaatagctgat

SEQ ID NO: 753017 - DNA, 25 bp, Mus musculus
taaggagcactttccaatagctgat

SEQ ID NO: 753018 - DNA, 25 bp, Mus musculus
taaggagcagcaccttctgccccag

SEQ ID NO: 753019 - DNA, 25 bp, Mus musculus
taaggagcagcagcttctgccccag

SEQ ID NO: 753020 - DNA, 25 bp, Mus musculus
taaggagcatccagattcgcagaga

SEQ ID NO: 753021 - DNA, 25 bp, Mus musculus
taaggagcatcctgattcgcagaga

SEQ ID NO: 753022 - DNA, 25 bp, Mus musculus
taaggagcattaatccccctggaaa

SEQ ID NO: 753023 - DNA, 25 bp, Mus musculus
taaggagcattattccccctggaaa

SEQ ID NO: 753024 - DNA, 25 bp, Mus musculus
taaggagccagtctcagaagcaggt

SEQ ID NO: 753025 - DNA, 25 bp, Mus musculus
taaggagccagtgtcagaagcaggt

SEQ ID NO: 753026 - DNA, 25 bp, Mus musculus
taaggagccggtagtcactcccttc

SEQ ID NO: 753027 - DNA, 25 bp, Mus musculus
taaggagccggttgtcactcccttc

SEQ ID NO: 753028 - DNA, 25 bp, Mus musculus
taaggagcctgcctgcttcactgtg

SEQ ID NO: 753029 - DNA, 25 bp, Mus musculus
taaggagcctgcgtgcttcactgtg

SEQ ID NO: 753030 - DNA, 25 bp, Mus musculus
taaggagccttgacagtcccaagtg

SEQ ID NO: 753031 - DNA, 25 bp, Mus musculus
taaggagccttgtcagtcccaagtg

SEQ ID NO: 753032 - DNA, 25 bp, Mus musculus
taaggagcgctcactgttgcacggt

SEQ ID NO: 753033 - DNA, 25 bp, Mus musculus
taaggagcgctctctgttgcacggt

SEQ ID NO: 753034 - DNA, 25 bp, Mus musculus
taaggagctccacttcttccaggat

SEQ ID NO: 753035 - DNA, 25 bp, Mus musculus
taaggagctccagttcttccaggat

SEQ ID NO: 753036 - DNA, 25 bp, Mus musculus
taaggaggacatatttgtctctaaa

SEQ ID NO: 753037 - DNA, 25 bp, Mus musculus
taaggaggacatttttgtctctaaa

SEQ ID NO: 753038 - DNA, 25 bp, Mus musculus
taaggaggatctatgttccggagat

SEQ ID NO: 753039 - DNA, 25 bp, Mus musculus
taaggaggatctttgttccggagat

SEQ ID NO: 753040 - DNA, 25 bp, Mus musculus
taaggaggcactcgtccaaaatacc

SEQ ID NO: 753041 - DNA, 25 bp, Mus musculus
taaggaggcactggtccaaaatacc

SEQ ID NO: 753042 - DNA, 25 bp, Mus musculus
taaggaggtcggatggcaccagaaa

SEQ ID NO: 753043 - DNA, 25 bp, Mus musculus
taaggaggtcggttggcaccagaaa

SEQ ID NO: 753044 - DNA, 25 bp, Mus musculus
taaggagtaaatactggcaaccatg

SEQ ID NO: 753045 - DNA, 25 bp, Mus musculus
taaggagtaaattctggcaaccatg

SEQ ID NO: 753046 - DNA, 25 bp, Mus musculus
taaggagtacgaagcagcccttcct

SEQ ID NO: 753047 - DNA, 25 bp, Mus musculus
taaggagtacgatgcagcccttcct

SEQ ID NO: 753048 - DNA, 25 bp, Mus musculus
taaggagtacgtattgtttctctct

SEQ ID NO: 753049 - DNA, 25 bp, Mus musculus
taaggagtacgttttgtttctctct

SEQ ID NO: 753050 - DNA, 25 bp, Mus musculus
taaggagtccaacggctatgtgcgt

SEQ ID NO: 753051 - DNA, 25 bp, Mus musculus
taaggagtccaagggctatgtgcgt

SEQ ID NO: 753052 - DNA, 25 bp, Mus musculus
taaggagtccatcacagcaccagaa

SEQ ID NO: 753053 - DNA, 25 bp, Mus musculus
taaggagtccatgacagcaccagaa

SEQ ID NO: 753054 - DNA, 25 bp, Mus musculus
taaggagtctttcttaccaggcttc

SEQ ID NO: 753055 - DNA, 25 bp, Mus musculus
taaggagtctttgttaccaggcttc

SEQ ID NO: 753056 - DNA, 25 bp, Mus musculus
taaggagtgccactatgtcctggag

SEQ ID NO: 753057 - DNA, 25 bp, Mus musculus
taaggagtgccagtatgtcctggag

SEQ ID NO: 753058 - DNA, 25 bp, Mus musculus
taaggagttatcagacatctggcat

SEQ ID NO: 753059 - DNA, 25 bp, Mus musculus
taaggagttatctgacatctggcat

SEQ ID NO: 753060 - DNA, 25 bp, Mus musculus
taaggagttgagaccctgcctcatg

SEQ ID NO: 753061 - DNA, 25 bp, Mus musculus
taaggagttgagtccctgcctcatg

SEQ ID NO: 753062 - DNA, 25 bp, Mus musculus
taaggatacaatctcctctcagact

SEQ ID NO: 753063 - DNA, 25 bp, Mus musculus
taaggatacaatgtcctctcagact

SEQ ID NO: 753064 - DNA, 25 bp, Mus musculus
taaggataggccatcctcctgctgg

SEQ ID NO: 753065 - DNA, 25 bp, Mus musculus
taaggataggccttcctcctgctgg

SEQ ID NO: 753066 - DNA, 25 bp, Mus musculus
taaggatatcgacctcagccctgtt

SEQ ID NO: 753067 - DNA, 25 bp, Mus musculus
taaggatatcgagctcagccctgtt

SEQ ID NO: 753068 - DNA, 25 bp, Mus musculus
taaggatcactgagggttcaagact

SEQ ID NO: 753069 - DNA, 25 bp, Mus musculus
taaggatcactgtgggttcaagact

SEQ ID NO: 753070 - DNA, 25 bp, Mus musculus
taaggatccaaactccattcgtcac

SEQ ID NO: 753071 - DNA, 25 bp, Mus musculus
taaggatccaaagtccattcgtcac

SEQ ID NO: 753072 - DNA, 25 bp, Mus musculus
taaggatcctgtaacctcatcatgt

SEQ ID NO: 753073 - DNA, 25 bp, Mus musculus
taaggatcctgttacctcatcatgt

SEQ ID NO: 753074 - DNA, 25 bp, Mus musculus
taaggatcgcttcacacagtggaat

SEQ ID NO: 753075 - DNA, 25 bp, Mus musculus
taaggatcgcttgacacagtggaat

SEQ ID NO: 753076 - DNA, 25 bp, Mus musculus
taaggatctcagcacatgggcacgg

SEQ ID NO: 753077 - DNA, 25 bp, Mus musculus
taaggatctcaggacatgggcacgg

SEQ ID NO: 753078 - DNA, 25 bp, Mus musculus
taaggatgaagcacactcaccactt

SEQ ID NO: 753079 - DNA, 25 bp, Mus musculus
taaggatgaagctcactcaccactt

SEQ ID NO: 753080 - DNA, 25 bp, Mus musculus
taaggatgaatgatccaaggacaat

SEQ ID NO: 753081 - DNA, 25 bp, Mus musculus
taaggatgaatgttccaaggacaat

SEQ ID NO: 753082 - DNA, 25 bp, Mus musculus
taaggatgactcagctttctacctc

SEQ ID NO: 753083 - DNA, 25 bp, Mus musculus
taaggatgactcaggtcagagatac

SEQ ID NO: 753084 - DNA, 25 bp, Mus musculus
taaggatgactctgctttctacctc

SEQ ID NO: 753085 - DNA, 25 bp, Mus musculus
taaggatgactctggtcagagatac

SEQ ID NO: 753086 - DNA, 25 bp, Mus musculus
taaggatgatccagctcagactcca

SEQ ID NO: 753087 - DNA, 25 bp, Mus musculus
taaggatgatcctgctcagactcca

SEQ ID NO: 753088 - DNA, 25 bp, Mus musculus
taaggatgcctgctggtttcacatg

SEQ ID NO: 753089 - DNA, 25 bp, Mus musculus
taaggatgcctggtggtttcacatg

SEQ ID NO: 753090 - DNA, 25 bp, Mus musculus
taaggatgctccagggattacacat

SEQ ID NO: 753091 - DNA, 25 bp, Mus musculus
taaggatgctcctgggattacacat

SEQ ID NO: 753092 - DNA, 25 bp, Mus musculus
taaggatgctggcttgttggctccc

SEQ ID NO: 753093 - DNA, 25 bp, Mus musculus
taaggatgctgggttgttggctccc

SEQ ID NO: 753094 - DNA, 25 bp, Mus musculus
taaggatgcttacttgtcctctgtc

SEQ ID NO: 753095 - DNA, 25 bp, Mus musculus
taaggatgcttagttgtcctctgtc

SEQ ID NO: 753096 - DNA, 25 bp, Mus musculus
taaggatggagacctttgaccctaa

SEQ ID NO: 753097 - DNA, 25 bp, Mus musculus
taaggatggagagctttgaccctaa

SEQ ID NO: 753098 - DNA, 25 bp, Mus musculus
taaggatggagtctgcccacccacc

SEQ ID NO: 753099 - DNA, 25 bp, Mus musculus
taaggatggagtgtgcccacccacc

SEQ ID NO: 753100 - DNA, 25 bp, Mus musculus
taaggatggcatcgatactgtgaga

SEQ ID NO: 753101 - DNA, 25 bp, Mus musculus
taaggatggcatggatactgtgaga

SEQ ID NO: 753102 - DNA, 25 bp, Mus musculus
taaggatgtgcaccttgccaccagc

SEQ ID NO: 753103 - DNA, 25 bp, Mus musculus
taaggatgtgcagcttgccaccagc

SEQ ID NO: 753104 - DNA, 25 bp, Mus musculus
taaggatgtgtgacactcatagcca

SEQ ID NO: 753105 - DNA, 25 bp, Mus musculus
taaggatgtgtgtcactcatagcca

SEQ ID NO: 753106 - DNA, 25 bp, Mus musculus
taaggatgttcgacagcaggcggaa

SEQ ID NO: 753107 - DNA, 25 bp, Mus musculus
taaggatgttcgtcagcaggcggaa

SEQ ID NO: 753108 - DNA, 25 bp, Mus musculus
taaggattagctccttttccaccag

SEQ ID NO: 753109 - DNA, 25 bp, Mus musculus
taaggattagctgcttttccaccag

SEQ ID NO: 753110 - DNA, 25 bp, Mus musculus
taaggattcctgaaatactgcttta

SEQ ID NO: 753111 - DNA, 25 bp, Mus musculus
taaggattcctgtaatactgcttta

SEQ ID NO: 753112 - DNA, 25 bp, Mus musculus
taaggattgcgtctacaagcatgta

SEQ ID NO: 753113 - DNA, 25 bp, Mus musculus
taaggattgcgtgtacaagcatgta

SEQ ID NO: 753114 - DNA, 25 bp, Mus musculus
taaggattttgcaccttccgcccag

SEQ ID NO: 753115 - DNA, 25 bp, Mus musculus
taaggattttgctccttccgcccag

SEQ ID NO: 753116 - DNA, 25 bp, Mus musculus
taaggcaaccagctattggcctgcg

SEQ ID NO: 753117 - DNA, 25 bp, Mus musculus
taaggcaaccaggtattggcctgcg

SEQ ID NO: 753118 - DNA, 25 bp, Mus musculus
taaggcaagcatcacatggccaggc

SEQ ID NO: 753119 - DNA, 25 bp, Mus musculus
taaggcaagcatgacatggccaggc

SEQ ID NO: 753120 - DNA, 25 bp, Mus musculus
taaggcaaggttaaactgtaacagt

SEQ ID NO: 753121 - DNA, 25 bp, Mus musculus
taaggcaaggttaccatgcccacgg

SEQ ID NO: 753122 - DNA, 25 bp, Mus musculus
taaggcaaggtttaactgtaacagt

SEQ ID NO: 753123 - DNA, 25 bp, Mus musculus
taaggcaaggtttccatgcccacgg

SEQ ID NO: 753124 - DNA, 25 bp, Mus musculus
taaggcaagttgcactttatgattc

SEQ ID NO: 753125 - DNA, 25 bp, Mus musculus
taaggcaagttggactttatgattc

SEQ ID NO: 753126 - DNA, 25 bp, Mus musculus
taaggcaatgcacaactgtctgtaa

SEQ ID NO: 753127 - DNA, 25 bp, Mus musculus
taaggcaatgcagaactgtctgtaa

SEQ ID NO: 753128 - DNA, 25 bp, Mus musculus
taaggcaatgcccaaggctaccatg

SEQ ID NO: 753129 - DNA, 25 bp, Mus musculus
taaggcaatgccgaaggctaccatg

SEQ ID NO: 753130 - DNA, 25 bp, Mus musculus
taaggcacacaaagttcatgctctg

SEQ ID NO: 753131 - DNA, 25 bp, Mus musculus
taaggcacacaatgttcatgctctg

SEQ ID NO: 753132 - DNA, 25 bp, Mus musculus
taaggcacacatcaggtgaccccaa

SEQ ID NO: 753133 - DNA, 25 bp, Mus musculus
taaggcacacatgaggtgaccccaa

SEQ ID NO: 753134 - DNA, 25 bp, Mus musculus
taaggcacacctattttgttgcttt

SEQ ID NO: 753135 - DNA, 25 bp, Mus musculus
taaggcacaccttttttgttgcttt

SEQ ID NO: 753136 - DNA, 25 bp, Mus musculus
taaggcacctaacccagatggccca

SEQ ID NO: 753137 - DNA, 25 bp, Mus musculus
taaggcacctaagccagatggccca

SEQ ID NO: 753138 - DNA, 25 bp, Mus musculus
taaggcacctacatagtcctgactg

SEQ ID NO: 753139 - DNA, 25 bp, Mus musculus
taaggcacctacttagtcctgactg

SEQ ID NO: 753140 - DNA, 25 bp, Mus musculus
taaggcactctcagcttttgacacc

SEQ ID NO: 753141 - DNA, 25 bp, Mus musculus
taaggcactctctgcttttgacacc

SEQ ID NO: 753142 - DNA, 25 bp, Mus musculus
taaggcagagttaccagcactttct

SEQ ID NO: 753143 - DNA, 25 bp, Mus musculus
taaggcagagtttccagcactttct

SEQ ID NO: 753144 - DNA, 25 bp, Mus musculus
taaggcagcaccacttggacccaag

SEQ ID NO: 753145 - DNA, 25 bp, Mus musculus
taaggcagcacctcttggacccaag

SEQ ID NO: 753146 - DNA, 25 bp, Mus musculus
taaggcagcagcatacaaacactga

SEQ ID NO: 753147 - DNA, 25 bp, Mus musculus
taaggcagcagcttacaaacactga

SEQ ID NO: 753148 - DNA, 25 bp, Mus musculus
taaggcagccttaggtcatcggcag

SEQ ID NO: 753149 - DNA, 25 bp, Mus musculus
taaggcagcctttggtcatcggcag

SEQ ID NO: 753150 - DNA, 25 bp, Mus musculus
taaggcagctagacatggtgataca

SEQ ID NO: 753151 - DNA, 25 bp, Mus musculus
taaggcagctagtcatggtgataca

SEQ ID NO: 753152 - DNA, 25 bp, Mus musculus
taaggcaggagcatcagttcaaggc

SEQ ID NO: 753153 - DNA, 25 bp, Mus musculus
taaggcaggagcttcagttcaaggc

SEQ ID NO: 753154 - DNA, 25 bp, Mus musculus
taaggcagggtgaattgtgtccaga

SEQ ID NO: 753155 - DNA, 25 bp, Mus musculus
taaggcagggtgtattgtgtccaga

SEQ ID NO: 753156 - DNA, 25 bp, Mus musculus
taaggcagggttccctcagcaaggc

SEQ ID NO: 753157 - DNA, 25 bp, Mus musculus
taaggcagggttgcctcagcaaggc

SEQ ID NO: 753158 - DNA, 25 bp, Mus musculus
taaggcagtcaccacttcagctagt

SEQ ID NO: 753159 - DNA, 25 bp, Mus musculus
taaggcagtcacgacttcagctagt

SEQ ID NO: 753160 - DNA, 25 bp, Mus musculus
taaggcagttacctctgtagagtat

SEQ ID NO: 753161 - DNA, 25 bp, Mus musculus
taaggcagttacgtctgtagagtat

SEQ ID NO: 753162 - DNA, 25 bp, Mus musculus
taaggcatatgcactcacaatcaat

SEQ ID NO: 753163 - DNA, 25 bp, Mus musculus
taaggcatatgctctcacaatcaat

SEQ ID NO: 753164 - DNA, 25 bp, Mus musculus
taaggcatcatcattttcagcatat

SEQ ID NO: 753165 - DNA, 25 bp, Mus musculus
taaggcatcatctttttcagcatat

SEQ ID NO: 753166 - DNA, 25 bp, Mus musculus
taaggcatgggcatcttcacacaga

SEQ ID NO: 753167 - DNA, 25 bp, Mus musculus
taaggcatgggcttcttcacacaga

SEQ ID NO: 753168 - DNA, 25 bp, Mus musculus
taaggcatgtagagctctggcagaa

SEQ ID NO: 753169 - DNA, 25 bp, Mus musculus
taaggcatgtagtgctctggcagaa

SEQ ID NO: 753170 - DNA, 25 bp, Mus musculus
taaggcattcgacttgtatgagcaa

SEQ ID NO: 753171 - DNA, 25 bp, Mus musculus
taaggcattcgagttgtatgagcaa

SEQ ID NO: 753172 - DNA, 25 bp, Mus musculus
taaggcattgtcaatagccccaatt

SEQ ID NO: 753173 - DNA, 25 bp, Mus musculus
taaggcattgtctatagccccaatt

SEQ ID NO: 753174 - DNA, 25 bp, Mus musculus
taaggcattttcagtcacacacgca

SEQ ID NO: 753175 - DNA, 25 bp, Mus musculus
taaggcattttctgtcacacacgca

SEQ ID NO: 753176 - DNA, 25 bp, Mus musculus
taaggcattttgacagttactgata

SEQ ID NO: 753177 - DNA, 25 bp, Mus musculus
taaggcattttgactggagcgggca

SEQ ID NO: 753178 - DNA, 25 bp, Mus musculus
taaggcattttgtcagttactgata

SEQ ID NO: 753179 - DNA, 25 bp, Mus musculus
taaggcattttgtctggagcgggca

SEQ ID NO: 753180 - DNA, 25 bp, Mus musculus
taaggccaacttacaccttgggtag

SEQ ID NO: 753181 - DNA, 25 bp, Mus musculus
taaggccaactttcaccttgggtag

SEQ ID NO: 753182 - DNA, 25 bp, Mus musculus
taaggccaagtaacatttgactccc

SEQ ID NO: 753183 - DNA, 25 bp, Mus musculus
taaggccaagtatcatttgactccc

SEQ ID NO: 753184 - DNA, 25 bp, Mus musculus
taaggccaagtgcaggtgtcatcca

SEQ ID NO: 753185 - DNA, 25 bp, Mus musculus
taaggccaagtggaggtgtcatcca

SEQ ID NO: 753186 - DNA, 25 bp, Mus musculus
taaggccacataaagtccagctgat

SEQ ID NO: 753187 - DNA, 25 bp, Mus musculus
taaggccacatatagtccagctgat

SEQ ID NO: 753188 - DNA, 25 bp, Mus musculus
taaggccaccctcgtgtatatagta

SEQ ID NO: 753189 - DNA, 25 bp, Mus musculus
taaggccaccctggtgtatatagta

SEQ ID NO: 753190 - DNA, 25 bp, Mus musculus
taaggccagcatctgtctgtgtagt

SEQ ID NO: 753191 - DNA, 25 bp, Mus musculus
taaggccagcatgtgtctgtgtagt

SEQ ID NO: 753192 - DNA, 25 bp, Mus musculus
taaggccagctcaggctacttggag

SEQ ID NO: 753193 - DNA, 25 bp, Mus musculus
taaggccagctctggctacttggag

SEQ ID NO: 753194 - DNA, 25 bp, Mus musculus
taaggccagtagctagagttctttt

SEQ ID NO: 753195 - DNA, 25 bp, Mus musculus
taaggccagtaggtagagttctttt

SEQ ID NO: 753196 - DNA, 25 bp, Mus musculus
taaggccagtggatgtaatttgtct

SEQ ID NO: 753197 - DNA, 25 bp, Mus musculus
taaggccagtggttgtaatttgtct

SEQ ID NO: 753198 - DNA, 25 bp, Mus musculus
taaggccatcctactcttacagagg

SEQ ID NO: 753199 - DNA, 25 bp, Mus musculus
taaggccatccttctcttacagagg

SEQ ID NO: 753200 - DNA, 25 bp, Mus musculus
taaggccatctacggatacacgacc

SEQ ID NO: 753201 - DNA, 25 bp, Mus musculus
taaggccatctagggatacacgacc

SEQ ID NO: 753202 - DNA, 25 bp, Mus musculus
taaggccatgctcgatcgtatccca

SEQ ID NO: 753203 - DNA, 25 bp, Mus musculus
taaggccatgctggatcgtatccca

SEQ ID NO: 753204 - DNA, 25 bp, Mus musculus
taaggccatgtgaaaagtttaacca

SEQ ID NO: 753205 - DNA, 25 bp, Mus musculus
taaggccatgtgtaaagtttaacca

SEQ ID NO: 753206 - DNA, 25 bp, Mus musculus
taaggcccagctcttagagagccaa

SEQ ID NO: 753207 - DNA, 25 bp, Mus musculus
taaggcccagctgttagagagccaa

SEQ ID NO: 753208 - DNA, 25 bp, Mus musculus
taaggccccgttccagtggtgaaca

SEQ ID NO: 753209 - DNA, 25 bp, Mus musculus
taaggccccgttgcagtggtgaaca

SEQ ID NO: 753210 - DNA, 25 bp, Mus musculus
taaggccccttcaggctttgaacta

SEQ ID NO: 753211 - DNA, 25 bp, Mus musculus
taaggccccttctggctttgaacta

SEQ ID NO: 753212 - DNA, 25 bp, Mus musculus
taaggcccggatctgtctgtttact

SEQ ID NO: 753213 - DNA, 25 bp, Mus musculus
taaggcccggatgtgtctgtttact

SEQ ID NO: 753214 - DNA, 25 bp, Mus musculus
taaggcccggttcttattcatctta

SEQ ID NO: 753215 - DNA, 25 bp, Mus musculus
taaggcccggttgttattcatctta

SEQ ID NO: 753216 - DNA, 25 bp, Mus musculus
taaggccctactactgtctctgtgg

SEQ ID NO: 753217 - DNA, 25 bp, Mus musculus
taaggccctacttctgtctctgtgg

SEQ ID NO: 753218 - DNA, 25 bp, Mus musculus
taaggccctgagatcgaaccgtgac

SEQ ID NO: 753219 - DNA, 25 bp, Mus musculus
taaggccctgagttcgaaccgtgac

SEQ ID NO: 753220 - DNA, 25 bp, Mus musculus
taaggccctggaataattcctacga

SEQ ID NO: 753221 - DNA, 25 bp, Mus musculus
taaggccctggattaattcctacga

SEQ ID NO: 753222 - DNA, 25 bp, Mus musculus
taaggcccttcacttatgtcgaaag

SEQ ID NO: 753223 - DNA, 25 bp, Mus musculus
taaggcccttcagttatgtcgaaag

SEQ ID NO: 753224 - DNA, 25 bp, Mus musculus
taaggccgactcctgaaggaacatt

SEQ ID NO: 753225 - DNA, 25 bp, Mus musculus
taaggccgactcgtgaaggaacatt

SEQ ID NO: 753226 - DNA, 25 bp, Mus musculus
taaggccgagatacttctgcaagtg

SEQ ID NO: 753227 - DNA, 25 bp, Mus musculus
taaggccgagattcttctgcaagtg

SEQ ID NO: 753228 - DNA, 25 bp, Mus musculus
taaggccggcctcgactacatagtg

SEQ ID NO: 753229 - DNA, 25 bp, Mus musculus
taaggccggcctggactacatagtg

SEQ ID NO: 753230 - DNA, 25 bp, Mus musculus
taaggccgtgacactgcctaggagt

SEQ ID NO: 753231 - DNA, 25 bp, Mus musculus
taaggccgtgactctgcctaggagt

SEQ ID NO: 753232 - DNA, 25 bp, Mus musculus
taaggccgtggacacactcttcagt

SEQ ID NO: 753233 - DNA, 25 bp, Mus musculus
taaggccgtggagacactcttcagt

SEQ ID NO: 753234 - DNA, 25 bp, Mus musculus
taaggccgttttcagatggattatc

SEQ ID NO: 753235 - DNA, 25 bp, Mus musculus
taaggccgttttgagatggattatc

SEQ ID NO: 753236 - DNA, 25 bp, Mus musculus
taaggcctaaatcctactaccaggg

SEQ ID NO: 753237 - DNA, 25 bp, Mus musculus
taaggcctaaatgctactaccaggg

SEQ ID NO: 753238 - DNA, 25 bp, Mus musculus
taaggcctaagaaaactccagctgt

SEQ ID NO: 753239 - DNA, 25 bp, Mus musculus
taaggcctaagataactccagctgt

SEQ ID NO: 753240 - DNA, 25 bp, Mus musculus
taaggcctaccactttcagaagttg

SEQ ID NO: 753241 - DNA, 25 bp, Mus musculus
taaggcctaccagtttcagaagttg

SEQ ID NO: 753242 - DNA, 25 bp, Mus musculus
taaggcctagccaaatccaacccag

SEQ ID NO: 753243 - DNA, 25 bp, Mus musculus
taaggcctagcctaatccaacccag

SEQ ID NO: 753244 - DNA, 25 bp, Mus musculus
taaggcctcaagacactaattttat

SEQ ID NO: 753245 - DNA, 25 bp, Mus musculus
taaggcctcaagtcactaattttat

SEQ ID NO: 753246 - DNA, 25 bp, Mus musculus
taaggcctcacaccatcagcatggg

SEQ ID NO: 753247 - DNA, 25 bp, Mus musculus
taaggcctcacagcatcagcatggg

SEQ ID NO: 753248 - DNA, 25 bp, Mus musculus
taaggcctcaggatctcagcattgc

SEQ ID NO: 753249 - DNA, 25 bp, Mus musculus
taaggcctcaggttctcagcattgc

SEQ ID NO: 753250 - DNA, 25 bp, Mus musculus
taaggcctccaaagtccagagccag

SEQ ID NO: 753251 - DNA, 25 bp, Mus musculus
taaggcctccaatgtccagagccag

SEQ ID NO: 753252 - DNA, 25 bp, Mus musculus
taaggcctccctaaatgtacctagg

SEQ ID NO: 753253 - DNA, 25 bp, Mus musculus
taaggcctcccttaatgtacctagg

SEQ ID NO: 753254 - DNA, 25 bp, Mus musculus
taaggcctcctgaaatcacaccatt

SEQ ID NO: 753255 - DNA, 25 bp, Mus musculus
taaggcctcctgtaatcacaccatt

SEQ ID NO: 753256 - DNA, 25 bp, Mus musculus
taaggcctgtctatacttttcgatt

SEQ ID NO: 753257 - DNA, 25 bp, Mus musculus
taaggcctgtctttacttttcgatt

SEQ ID NO: 753258 - DNA, 25 bp, Mus musculus
taaggcctgtgtaccgaggagactt

SEQ ID NO: 753259 - DNA, 25 bp, Mus musculus
taaggcctgtgttccgaggagactt

SEQ ID NO: 753260 - DNA, 25 bp, Mus musculus
taaggccttccgcaatgagcagttc

SEQ ID NO: 753261 - DNA, 25 bp, Mus musculus
taaggccttccggaatgagcagttc

SEQ ID NO: 753262 - DNA, 25 bp, Mus musculus
taaggccttggtatcatctttagag

SEQ ID NO: 753263 - DNA, 25 bp, Mus musculus
taaggccttggtttcatctttagag

SEQ ID NO: 753264 - DNA, 25 bp, Mus musculus
taaggcctttagcaagaccccagat

SEQ ID NO: 753265 - DNA, 25 bp, Mus musculus
taaggcctttaggaagaccccagat

SEQ ID NO: 753266 - DNA, 25 bp, Mus musculus
taaggcctttgacccttagctttct

SEQ ID NO: 753267 - DNA, 25 bp, Mus musculus
taaggcctttgagccttagctttct

SEQ ID NO: 753268 - DNA, 25 bp, Mus musculus
taaggcctttgcaggcttttgtttt

SEQ ID NO: 753269 - DNA, 25 bp, Mus musculus
taaggcctttgctggcttttgtttt

SEQ ID NO: 753270 - DNA, 25 bp, Mus musculus
taaggcgaacggatggtcctggttt

SEQ ID NO: 753271 - DNA, 25 bp, Mus musculus
taaggcgaacggttggtcctggttt

SEQ ID NO: 753272 - DNA, 25 bp, Mus musculus
taaggcgaccacaagccataaaatt

SEQ ID NO: 753273 - DNA, 25 bp, Mus musculus
taaggcgaccactagccataaaatt

SEQ ID NO: 753274 - DNA, 25 bp, Mus musculus
taaggcgcaatcactgtttcagact

SEQ ID NO: 753275 - DNA, 25 bp, Mus musculus
taaggcgcaatctctgtttcagact

SEQ ID NO: 753276 - DNA, 25 bp, Mus musculus
taaggcgcataaattctgccagcaa

SEQ ID NO: 753277 - DNA, 25 bp, Mus musculus
taaggcgcataatttctgccagcaa

SEQ ID NO: 753278 - DNA, 25 bp, Mus musculus
taaggcgccgagaaaagcatggaac

SEQ ID NO: 753279 - DNA, 25 bp, Mus musculus
taaggcgccgagtaaagcatggaac

SEQ ID NO: 753280 - DNA, 25 bp, Mus musculus
taaggcgctgtgacgcccaaggatc

SEQ ID NO: 753281 - DNA, 25 bp, Mus musculus
taaggcgctgtgtcgcccaaggatc

SEQ ID NO: 753282 - DNA, 25 bp, Mus musculus
taaggcggaagtccgcttcgagcca

SEQ ID NO: 753283 - DNA, 25 bp, Mus musculus
taaggcggaagtgcgcttcgagcca

SEQ ID NO: 753284 - DNA, 25 bp, Mus musculus
taaggcggagaaacacctcacatgt

SEQ ID NO: 753285 - DNA, 25 bp, Mus musculus
taaggcggagaatcacctcacatgt

SEQ ID NO: 753286 - DNA, 25 bp, Mus musculus
taaggcggataaccagattctgaaa

SEQ ID NO: 753287 - DNA, 25 bp, Mus musculus
taaggcggataagcagattctgaaa

SEQ ID NO: 753288 - DNA, 25 bp, Mus musculus
taaggcggattaccggctgcttccc

SEQ ID NO: 753289 - DNA, 25 bp, Mus musculus
taaggcggattagcggctgcttccc

SEQ ID NO: 753290 - DNA, 25 bp, Mus musculus
taaggcggtcttactgttatgcagg

SEQ ID NO: 753291 - DNA, 25 bp, Mus musculus
taaggcggtctttctgttatgcagg

SEQ ID NO: 753292 - DNA, 25 bp, Mus musculus
taaggcgtcaagcagtgtgcatcag

SEQ ID NO: 753293 - DNA, 25 bp, Mus musculus
taaggcgtcaaggagtgtgcatcag

SEQ ID NO: 753294 - DNA, 25 bp, Mus musculus
taaggctaatacattgtaactttca

SEQ ID NO: 753295 - DNA, 25 bp, Mus musculus
taaggctaatactttgtaactttca

SEQ ID NO: 753296 - DNA, 25 bp, Mus musculus
taaggctacctcagcttggctcttg

SEQ ID NO: 753297 - DNA, 25 bp, Mus musculus
taaggctacctctgcttggctcttg

SEQ ID NO: 753298 - DNA, 25 bp, Mus musculus
taaggctacgttcacttatcaaagt

SEQ ID NO: 753299 - DNA, 25 bp, Mus musculus
taaggctacgttgacttatcaaagt

SEQ ID NO: 753300 - DNA, 25 bp, Mus musculus
taaggctactggaaagggtgactct

SEQ ID NO: 753301 - DNA, 25 bp, Mus musculus
taaggctactggtaagggtgactct

SEQ ID NO: 753302 - DNA, 25 bp, Mus musculus
taaggctactttctagcaaccctgc

SEQ ID NO: 753303 - DNA, 25 bp, Mus musculus
taaggctactttgtagcaaccctgc

SEQ ID NO: 753304 - DNA, 25 bp, Mus musculus
taaggctagctgagcgtgtgcacgt

SEQ ID NO: 753305 - DNA, 25 bp, Mus musculus
taaggctagctgtgcgtgtgcacgt

SEQ ID NO: 753306 - DNA, 25 bp, Mus musculus
taaggctatgttaaaaattctcttc

SEQ ID NO: 753307 - DNA, 25 bp, Mus musculus
taaggctatgtttaaaattctcttc

SEQ ID NO: 753308 - DNA, 25 bp, Mus musculus
taaggctattgaccctagatttcta

SEQ ID NO: 753309 - DNA, 25 bp, Mus musculus
taaggctattgagcctagatttcta

SEQ ID NO: 753310 - DNA, 25 bp, Mus musculus
taaggctcaagcaatctctggtctc

SEQ ID NO: 753311 - DNA, 25 bp, Mus musculus
taaggctcaagctatctctggtctc

SEQ ID NO: 753312 - DNA, 25 bp, Mus musculus
taaggctcaggcaacctgctttggg

SEQ ID NO: 753313 - DNA, 25 bp, Mus musculus
taaggctcaggctacctgctttggg

SEQ ID NO: 753314 - DNA, 25 bp, Mus musculus
taaggctccagacatcttgcataga

SEQ ID NO: 753315 - DNA, 25 bp, Mus musculus
taaggctccagagatcttgcataga

SEQ ID NO: 753316 - DNA, 25 bp, Mus musculus
taaggctccaggatgtaggtttcct

SEQ ID NO: 753317 - DNA, 25 bp, Mus musculus
taaggctccaggttgtaggtttcct

SEQ ID NO: 753318 - DNA, 25 bp, Mus musculus
taaggctccattatatccaattcag

SEQ ID NO: 753319 - DNA, 25 bp, Mus musculus
taaggctccattttatccaattcag

SEQ ID NO: 753320 - DNA, 25 bp, Mus musculus
taaggctcccaactgaacctttgca

SEQ ID NO: 753321 - DNA, 25 bp, Mus musculus
taaggctcccaagtgaacctttgca

SEQ ID NO: 753322 - DNA, 25 bp, Mus musculus
taaggctcccttccatatatttcaa

SEQ ID NO: 753323 - DNA, 25 bp, Mus musculus
taaggctcccttgcatatatttcaa

SEQ ID NO: 753324 - DNA, 25 bp, Mus musculus
taaggctccgagatgacagttacat

SEQ ID NO: 753325 - DNA, 25 bp, Mus musculus
taaggctccgagttgacagttacat

SEQ ID NO: 753326 - DNA, 25 bp, Mus musculus
taaggctccgtcctacttcaagttt

SEQ ID NO: 753327 - DNA, 25 bp, Mus musculus
taaggctccgtcgtacttcaagttt

SEQ ID NO: 753328 - DNA, 25 bp, Mus musculus
taaggctccttcagacgagtctgtt

SEQ ID NO: 753329 - DNA, 25 bp, Mus musculus
taaggctccttctgacgagtctgtt

SEQ ID NO: 753330 - DNA, 25 bp, Mus musculus
taaggctcctttagcagctcatggc

SEQ ID NO: 753331 - DNA, 25 bp, Mus musculus
taaggctccttttgcagctcatggc

SEQ ID NO: 753332 - DNA, 25 bp, Mus musculus
taaggctcgactcacccaggtcact

SEQ ID NO: 753333 - DNA, 25 bp, Mus musculus
taaggctcgactgacccaggtcact

SEQ ID NO: 753334 - DNA, 25 bp, Mus musculus
taaggctcgcctcatttacatccgt

SEQ ID NO: 753335 - DNA, 25 bp, Mus musculus
taaggctcgcctgatttacatccgt

SEQ ID NO: 753336 - DNA, 25 bp, Mus musculus
taaggctctaccacgattagttcca

SEQ ID NO: 753337 - DNA, 25 bp, Mus musculus
taaggctctacctcgattagttcca

SEQ ID NO: 753338 - DNA, 25 bp, Mus musculus
taaggctctctaatgccaacacgag

SEQ ID NO: 753339 - DNA, 25 bp, Mus musculus
taaggctctctattgccaacacgag

SEQ ID NO: 753340 - DNA, 25 bp, Mus musculus
taaggctctgctccaggattcctta

SEQ ID NO: 753341 - DNA, 25 bp, Mus musculus
taaggctctgctgcaggattcctta

SEQ ID NO: 753342 - DNA, 25 bp, Mus musculus
taaggctctgtgacctcactagact

SEQ ID NO: 753343 - DNA, 25 bp, Mus musculus
taaggctctgtgtcctcactagact

SEQ ID NO: 753344 - DNA, 25 bp, Mus musculus
taaggctctttccaggccgggcttg

SEQ ID NO: 753345 - DNA, 25 bp, Mus musculus
taaggctctttcgaggccgggcttg

SEQ ID NO: 753346 - DNA, 25 bp, Mus musculus
taaggctgagtaagactaagggtca

SEQ ID NO: 753347 - DNA, 25 bp, Mus musculus
taaggctgagtatgactaagggtca

SEQ ID NO: 753348 - DNA, 25 bp, Mus musculus
taaggctgagttcctcatcttgtca

SEQ ID NO: 753349 - DNA, 25 bp, Mus musculus
taaggctgagttgctcatcttgtca

SEQ ID NO: 753350 - DNA, 25 bp, Mus musculus
taaggctgcaaccagagacgtgcgt

SEQ ID NO: 753351 - DNA, 25 bp, Mus musculus
taaggctgcaacgagagacgtgcgt

SEQ ID NO: 753352 - DNA, 25 bp, Mus musculus
taaggctgcagcatgaccgtcctta

SEQ ID NO: 753353 - DNA, 25 bp, Mus musculus
taaggctgcagcttgaccgtcctta

SEQ ID NO: 753354 - DNA, 25 bp, Mus musculus
taaggctgcaggacgtcccagggtc

SEQ ID NO: 753355 - DNA, 25 bp, Mus musculus
taaggctgcaggcataccctctccc

SEQ ID NO: 753356 - DNA, 25 bp, Mus musculus
taaggctgcagggataccctctccc

SEQ ID NO: 753357 - DNA, 25 bp, Mus musculus
taaggctgcaggtcgtcccagggtc

SEQ ID NO: 753358 - DNA, 25 bp, Mus musculus
taaggctgcatgagctgagctccgt

SEQ ID NO: 753359 - DNA, 25 bp, Mus musculus
taaggctgcatgtgctgagctccgt

SEQ ID NO: 753360 - DNA, 25 bp, Mus musculus
taaggctgcgccatgaagccgccaa

SEQ ID NO: 753361 - DNA, 25 bp, Mus musculus
taaggctgcgccttgaagccgccaa

SEQ ID NO: 753362 - DNA, 25 bp, Mus musculus
taaggctgctcacaaggctgtgctg

SEQ ID NO: 753363 - DNA, 25 bp, Mus musculus
taaggctgctcagaaggctgtgctg

SEQ ID NO: 753364 - DNA, 25 bp, Mus musculus
taaggctgctgtcctgtgtccagcc

SEQ ID NO: 753365 - DNA, 25 bp, Mus musculus
taaggctgctgtgctgtgtccagcc

SEQ ID NO: 753366 - DNA, 25 bp, Mus musculus
taaggctgcttgacattggtagaag

SEQ ID NO: 753367 - DNA, 25 bp, Mus musculus
taaggctgcttgtcattggtagaag

SEQ ID NO: 753368 - DNA, 25 bp, Mus musculus
taaggctggactaacattaggtgtc

SEQ ID NO: 753369 - DNA, 25 bp, Mus musculus
taaggctggacttacattaggtgtc

SEQ ID NO: 753370 - DNA, 25 bp, Mus musculus
taaggctggcatcttatctccttgc

SEQ ID NO: 753371 - DNA, 25 bp, Mus musculus
taaggctggcatgttatctccttgc

SEQ ID NO: 753372 - DNA, 25 bp, Mus musculus
taaggctgggacaggccatcctcat

SEQ ID NO: 753373 - DNA, 25 bp, Mus musculus
taaggctgggactggccatcctcat

SEQ ID NO: 753374 - DNA, 25 bp, Mus musculus
taaggctggtcaaaggctgctactt

SEQ ID NO: 753375 - DNA, 25 bp, Mus musculus
taaggctggtcataggctgctactt

SEQ ID NO: 753376 - DNA, 25 bp, Mus musculus
taaggctggtgtacctttaccacca

SEQ ID NO: 753377 - DNA, 25 bp, Mus musculus
taaggctggtgttcctttaccacca

SEQ ID NO: 753378 - DNA, 25 bp, Mus musculus
taaggctgtactacaatgtccctca

SEQ ID NO: 753379 - DNA, 25 bp, Mus musculus
taaggctgtacttcaatgtccctca

SEQ ID NO: 753380 - DNA, 25 bp, Mus musculus
taaggctgtagtcatctcactttgt

SEQ ID NO: 753381 - DNA, 25 bp, Mus musculus
taaggctgtagtgatctcactttgt

SEQ ID NO: 753382 - DNA, 25 bp, Mus musculus
taaggctgtcctaatcacacacaca

SEQ ID NO: 753383 - DNA, 25 bp, Mus musculus
taaggctgtccttatcacacacaca

SEQ ID NO: 753384 - DNA, 25 bp, Mus musculus
taaggctgtctgacctcaggagaca

SEQ ID NO: 753385 - DNA, 25 bp, Mus musculus
taaggctgtctgtcctcaggagaca

SEQ ID NO: 753386 - DNA, 25 bp, Mus musculus
taaggctgttcaactctcagaaccg

SEQ ID NO: 753387 - DNA, 25 bp, Mus musculus
taaggctgttcatctctcagaaccg

SEQ ID NO: 753388 - DNA, 25 bp, Mus musculus
taaggctgttccctttcacaggtgg

SEQ ID NO: 753389 - DNA, 25 bp, Mus musculus
taaggctgttccgtttcacaggtgg

SEQ ID NO: 753390 - DNA, 25 bp, Mus musculus
taaggctgttctaccaatcactgca

SEQ ID NO: 753391 - DNA, 25 bp, Mus musculus
taaggctgttcttccaatcactgca

SEQ ID NO: 753392 - DNA, 25 bp, Mus musculus
taaggcttaccacaccaggaactga

SEQ ID NO: 753393 - DNA, 25 bp, Mus musculus
taaggcttaccagaccaggaactga

SEQ ID NO: 753394 - DNA, 25 bp, Mus musculus
taaggcttagttcacaggtctgact

SEQ ID NO: 753395 - DNA, 25 bp, Mus musculus
taaggcttagttgacaggtctgact

SEQ ID NO: 753396 - DNA, 25 bp, Mus musculus
taaggcttcattccactatagaaag

SEQ ID NO: 753397 - DNA, 25 bp, Mus musculus
taaggcttcattgcactatagaaag

SEQ ID NO: 753398 - DNA, 25 bp, Mus musculus
taaggcttcctaagtgtagctgaac

SEQ ID NO: 753399 - DNA, 25 bp, Mus musculus
taaggcttcctatgtgtagctgaac

SEQ ID NO: 753400 - DNA, 25 bp, Mus musculus
taaggcttcttcagaccggtcaaga

SEQ ID NO: 753401 - DNA, 25 bp, Mus musculus
taaggcttcttctgaccggtcaaga

SEQ ID NO: 753402 - DNA, 25 bp, Mus musculus
taaggcttctttcatttctggaggg

SEQ ID NO: 753403 - DNA, 25 bp, Mus musculus
taaggcttctttccgatttttgtgt

SEQ ID NO: 753404 - DNA, 25 bp, Mus musculus
taaggcttctttgatttctggaggg

SEQ ID NO: 753405 - DNA, 25 bp, Mus musculus
taaggcttctttgcgatttttgtgt

SEQ ID NO: 753406 - DNA, 25 bp, Mus musculus
taaggcttgtcacctcatttctaga

SEQ ID NO: 753407 - DNA, 25 bp, Mus musculus
taaggcttgtcagctcatttctaga

SEQ ID NO: 753408 - DNA, 25 bp, Mus musculus
taaggcttgtctccaccatggaatg

SEQ ID NO: 753409 - DNA, 25 bp, Mus musculus
taaggcttgtctgcaccatggaatg

SEQ ID NO: 753410 - DNA, 25 bp, Mus musculus
taaggctttaatctggccctgaaag

SEQ ID NO: 753411 - DNA, 25 bp, Mus musculus
taaggctttaatgtggccctgaaag

SEQ ID NO: 753412 - DNA, 25 bp, Mus musculus
taaggctttagacgctatacctcaa

SEQ ID NO: 753413 - DNA, 25 bp, Mus musculus
taaggctttagaggctatacctcaa

SEQ ID NO: 753414 - DNA, 25 bp, Mus musculus
taaggctttcttactgcatggactc

SEQ ID NO: 753415 - DNA, 25 bp, Mus musculus
taaggctttcttcgagagtcaccca

SEQ ID NO: 753416 - DNA, 25 bp, Mus musculus
taaggctttcttggagagtcaccca

SEQ ID NO: 753417 - DNA, 25 bp, Mus musculus
taaggctttctttctgcatggactc

SEQ ID NO: 753418 - DNA, 25 bp, Mus musculus
taaggctttgaaccacatagttttt

SEQ ID NO: 753419 - DNA, 25 bp, Mus musculus
taaggctttgaagcacatagttttt

SEQ ID NO: 753420 - DNA, 25 bp, Mus musculus
taaggcttttgccagtctccgaatg

SEQ ID NO: 753421 - DNA, 25 bp, Mus musculus
taaggcttttgcgagtctccgaatg

SEQ ID NO: 753422 - DNA, 25 bp, Mus musculus
taagggaaaacgacagtgttcacaa

SEQ ID NO: 753423 - DNA, 25 bp, Mus musculus
taagggaaaacgtcagtgttcacaa

SEQ ID NO: 753424 - DNA, 25 bp, Mus musculus
taagggaaagatactctcaacctct

SEQ ID NO: 753425 - DNA, 25 bp, Mus musculus
taagggaaagatcccctctccagaa

SEQ ID NO: 753426 - DNA, 25 bp, Mus musculus
taagggaaagatgccctctccagaa

SEQ ID NO: 753427 - DNA, 25 bp, Mus musculus
taagggaaagattctctcaacctct

SEQ ID NO: 753428 - DNA, 25 bp, Mus musculus
taagggaacaacagagactttttct

SEQ ID NO: 753429 - DNA, 25 bp, Mus musculus
taagggaacaactgagactttttct

SEQ ID NO: 753430 - DNA, 25 bp, Mus musculus
taagggaaccatatcactgaccgga

SEQ ID NO: 753431 - DNA, 25 bp, Mus musculus
taagggaaccatttcactgaccgga

SEQ ID NO: 753432 - DNA, 25 bp, Mus musculus
taagggaaccttaatggccatctga

SEQ ID NO: 753433 - DNA, 25 bp, Mus musculus
taagggaacctttatggccatctga

SEQ ID NO: 753434 - DNA, 25 bp, Mus musculus
taagggaactgaagtttttgtatct

SEQ ID NO: 753435 - DNA, 25 bp, Mus musculus
taagggaactgatgtttttgtatct

SEQ ID NO: 753436 - DNA, 25 bp, Mus musculus
taagggaagcccaaagcaccgtgtc

SEQ ID NO: 753437 - DNA, 25 bp, Mus musculus
taagggaagccctaagcaccgtgtc

SEQ ID NO: 753438 - DNA, 25 bp, Mus musculus
taagggaagcttacgctggctgaac

SEQ ID NO: 753439 - DNA, 25 bp, Mus musculus
taagggaagctttcgctggctgaac

SEQ ID NO: 753440 - DNA, 25 bp, Mus musculus
taagggaaggctacagagcatttcc

SEQ ID NO: 753441 - DNA, 25 bp, Mus musculus
taagggaaggcttcagagcatttcc

SEQ ID NO: 753442 - DNA, 25 bp, Mus musculus
taagggaagtataggagcacaggaa

SEQ ID NO: 753443 - DNA, 25 bp, Mus musculus
taagggaagtattggagcacaggaa

SEQ ID NO: 753444 - DNA, 25 bp, Mus musculus
taagggaatcccactctcaaaggct

SEQ ID NO: 753445 - DNA, 25 bp, Mus musculus
taagggaatccctctctcaaaggct

SEQ ID NO: 753446 - DNA, 25 bp, Mus musculus
taagggacagatctgggcccctcag

SEQ ID NO: 753447 - DNA, 25 bp, Mus musculus
taagggacagatgtgggcccctcag

SEQ ID NO: 753448 - DNA, 25 bp, Mus musculus
taagggacatctcagcaacagggct

SEQ ID NO: 753449 - DNA, 25 bp, Mus musculus
taagggacatctgagcaacagggct

SEQ ID NO: 753450 - DNA, 25 bp, Mus musculus
taagggaccacacgtctcagtcctg

SEQ ID NO: 753451 - DNA, 25 bp, Mus musculus
taagggaccacaggtctcagtcctg

SEQ ID NO: 753452 - DNA, 25 bp, Mus musculus
taagggaccccaattcaagctctga

SEQ ID NO: 753453 - DNA, 25 bp, Mus musculus
taagggaccccatttcaagctctga

SEQ ID NO: 753454 - DNA, 25 bp, Mus musculus
taagggacctgtcaccattcctttc

SEQ ID NO: 753455 - DNA, 25 bp, Mus musculus
taagggacctgtgaccattcctttc

SEQ ID NO: 753456 - DNA, 25 bp, Mus musculus
taagggactactctgttaattgtaa

SEQ ID NO: 753457 - DNA, 25 bp, Mus musculus
taagggactactgtgttaattgtaa

SEQ ID NO: 753458 - DNA, 25 bp, Mus musculus
taagggacttgtctacccgagtgcc

SEQ ID NO: 753459 - DNA, 25 bp, Mus musculus
taagggacttgtgtacccgagtgcc

SEQ ID NO: 753460 - DNA, 25 bp, Mus musculus
taagggagacaaccccgactcttat

SEQ ID NO: 753461 - DNA, 25 bp, Mus musculus
taagggagacaagcccgactcttat

SEQ ID NO: 753462 - DNA, 25 bp, Mus musculus
taagggagagccctccacctgagga

SEQ ID NO: 753463 - DNA, 25 bp, Mus musculus
taagggagagccgtccacctgagga

SEQ ID NO: 753464 - DNA, 25 bp, Mus musculus
taagggagggtccagcattcctttg

SEQ ID NO: 753465 - DNA, 25 bp, Mus musculus
taagggagggtcgagcattcctttg

SEQ ID NO: 753466 - DNA, 25 bp, Mus musculus
taagggaggtctaagtcacagtgtc

SEQ ID NO: 753467 - DNA, 25 bp, Mus musculus
taagggaggtcttagtcacagtgtc

SEQ ID NO: 753468 - DNA, 25 bp, Mus musculus
taagggagtcagacttcacgttggg

SEQ ID NO: 753469 - DNA, 25 bp, Mus musculus
taagggagtcagtcttcacgttggg

SEQ ID NO: 753470 - DNA, 25 bp, Mus musculus
taagggagtggaaagcattgcctat

SEQ ID NO: 753471 - DNA, 25 bp, Mus musculus
taagggagtggatagcattgcctat

SEQ ID NO: 753472 - DNA, 25 bp, Mus musculus
taagggatcatgagctacgcttctc

SEQ ID NO: 753473 - DNA, 25 bp, Mus musculus
taagggatcatgtgctacgcttctc

SEQ ID NO: 753474 - DNA, 25 bp, Mus musculus
taagggatctgcacctgtcactcag

SEQ ID NO: 753475 - DNA, 25 bp, Mus musculus
taagggatctgctcctgtcactcag

SEQ ID NO: 753476 - DNA, 25 bp, Mus musculus
taagggatgctgacactgcccatca

SEQ ID NO: 753477 - DNA, 25 bp, Mus musculus
taagggatgctgtcactgcccatca

SEQ ID NO: 753478 - DNA, 25 bp, Mus musculus
taagggattccacaggcaatatcaa

SEQ ID NO: 753479 - DNA, 25 bp, Mus musculus
taagggattccagaggcaatatcaa

SEQ ID NO: 753480 - DNA, 25 bp, Mus musculus
taagggattgtcacctgggcctgtg

SEQ ID NO: 753481 - DNA, 25 bp, Mus musculus
taagggattgtctcctgggcctgtg

SEQ ID NO: 753482 - DNA, 25 bp, Mus musculus
taagggatttgcatggctttcggac

SEQ ID NO: 753483 - DNA, 25 bp, Mus musculus
taagggatttgcttggctttcggac

SEQ ID NO: 753484 - DNA, 25 bp, Mus musculus
taagggcaacacaggcctgcaaatc

SEQ ID NO: 753485 - DNA, 25 bp, Mus musculus
taagggcaacactggcctgcaaatc

SEQ ID NO: 753486 - DNA, 25 bp, Mus musculus
taagggcaacctacctgttgtgtct

SEQ ID NO: 753487 - DNA, 25 bp, Mus musculus
taagggcaaccttcctgttgtgtct

SEQ ID NO: 753488 - DNA, 25 bp, Mus musculus
taagggcaacgcctaccatctgatg

SEQ ID NO: 753489 - DNA, 25 bp, Mus musculus
taagggcaacgcgtaccatctgatg

SEQ ID NO: 753490 - DNA, 25 bp, Mus musculus
taagggcaagtcctgctcttggaga

SEQ ID NO: 753491 - DNA, 25 bp, Mus musculus
taagggcaagtcgtgctcttggaga

SEQ ID NO: 753492 - DNA, 25 bp, Mus musculus
taagggcaagttagggcacgagttt

SEQ ID NO: 753493 - DNA, 25 bp, Mus musculus
taagggcaagtttgggcacgagttt

SEQ ID NO: 753494 - DNA, 25 bp, Mus musculus
taagggcacattacccatcagttgg

SEQ ID NO: 753495 - DNA, 25 bp, Mus musculus
taagggcacatttcccatcagttgg

SEQ ID NO: 753496 - DNA, 25 bp, Mus musculus
taagggcacccgcagtcagttcctg

SEQ ID NO: 753497 - DNA, 25 bp, Mus musculus
taagggcacccggagtcagttcctg

SEQ ID NO: 753498 - DNA, 25 bp, Mus musculus
taagggcaccctatatagtgatgga

SEQ ID NO: 753499 - DNA, 25 bp, Mus musculus
taagggcaccctttatagtgatgga

SEQ ID NO: 753500 - DNA, 25 bp, Mus musculus
taagggcaccttcggcaagcatcat

SEQ ID NO: 753501 - DNA, 25 bp, Mus musculus
taagggcaccttgggcaagcatcat

SEQ ID NO: 753502 - DNA, 25 bp, Mus musculus
taagggcacgagacctcccagtggc

SEQ ID NO: 753503 - DNA, 25 bp, Mus musculus
taagggcacgagtcctcccagtggc

SEQ ID NO: 753504 - DNA, 25 bp, Mus musculus
taagggcactccctgggctcttctt

SEQ ID NO: 753505 - DNA, 25 bp, Mus musculus
taagggcactccgtgggctcttctt

SEQ ID NO: 753506 - DNA, 25 bp, Mus musculus
taagggcactggacagaatacagca

SEQ ID NO: 753507 - DNA, 25 bp, Mus musculus
taagggcactggatccccacccaga

SEQ ID NO: 753508 - DNA, 25 bp, Mus musculus
taagggcactggtcagaatacagca

SEQ ID NO: 753509 - DNA, 25 bp, Mus musculus
taagggcactggttccccacccaga

SEQ ID NO: 753510 - DNA, 25 bp, Mus musculus
taagggcagaaacggttcacattcc

SEQ ID NO: 753511 - DNA, 25 bp, Mus musculus
taagggcagaaagggttcacattcc

SEQ ID NO: 753512 - DNA, 25 bp, Mus musculus
taagggcaggacatgcccagctgca

SEQ ID NO: 753513 - DNA, 25 bp, Mus musculus
taagggcaggacttgcccagctgca

SEQ ID NO: 753514 - DNA, 25 bp, Mus musculus
taagggcagtaaagcttttcttggc

SEQ ID NO: 753515 - DNA, 25 bp, Mus musculus
taagggcagtaatgcttttcttggc

SEQ ID NO: 753516 - DNA, 25 bp, Mus musculus
taagggcatgctcacagtgcctttt

SEQ ID NO: 753517 - DNA, 25 bp, Mus musculus
taagggcatgctgacagtgcctttt

SEQ ID NO: 753518 - DNA, 25 bp, Mus musculus
taagggccaaagcagcctggattat

SEQ ID NO: 753519 - DNA, 25 bp, Mus musculus
taagggccaaaggagcctggattat

SEQ ID NO: 753520 - DNA, 25 bp, Mus musculus
taagggccaccgaatccataacagg

SEQ ID NO: 753521 - DNA, 25 bp, Mus musculus
taagggccaccgtatccataacagg

SEQ ID NO: 753522 - DNA, 25 bp, Mus musculus
taagggccacctccactgttgacag

SEQ ID NO: 753523 - DNA, 25 bp, Mus musculus
taagggccacctgcactgttgacag

SEQ ID NO: 753524 - DNA, 25 bp, Mus musculus
taagggccatcaaccaccttgtttt

SEQ ID NO: 753525 - DNA, 25 bp, Mus musculus
taagggccatcatccaccttgtttt

SEQ ID NO: 753526 - DNA, 25 bp, Mus musculus
taagggccatgtaaccagtgaagca

SEQ ID NO: 753527 - DNA, 25 bp, Mus musculus
taagggccatgttaccagtgaagca

SEQ ID NO: 753528 - DNA, 25 bp, Mus musculus
taagggcccatgattgccataacag

SEQ ID NO: 753529 - DNA, 25 bp, Mus musculus
taagggcccatgtttgccataacag

SEQ ID NO: 753530 - DNA, 25 bp, Mus musculus
taagggcccgaaaccatggaaatgc

SEQ ID NO: 753531 - DNA, 25 bp, Mus musculus
taagggcccgaatccatggaaatgc

SEQ ID NO: 753532 - DNA, 25 bp, Mus musculus
taagggcccttcaagtcgtgatcca

SEQ ID NO: 753533 - DNA, 25 bp, Mus musculus
taagggcccttctagtcgtgatcca

SEQ ID NO: 753534 - DNA, 25 bp, Mus musculus
taagggccggcaaacaagcgtgtaa

SEQ ID NO: 753535 - DNA, 25 bp, Mus musculus
taagggccggcatacaagcgtgtaa

SEQ ID NO: 753536 - DNA, 25 bp, Mus musculus
taagggcctccaagagttctttcta

SEQ ID NO: 753537 - DNA, 25 bp, Mus musculus
taagggcctccaagtttgctgaata

SEQ ID NO: 753538 - DNA, 25 bp, Mus musculus
taagggcctccatgagttctttcta

SEQ ID NO: 753539 - DNA, 25 bp, Mus musculus
taagggcctccatgtttgctgaata

SEQ ID NO: 753540 - DNA, 25 bp, Mus musculus
taagggcctgaaatacacgctttgg

SEQ ID NO: 753541 - DNA, 25 bp, Mus musculus
taagggcctgaattacacgctttgg

SEQ ID NO: 753542 - DNA, 25 bp, Mus musculus
taagggcctggaagccagcagctga

SEQ ID NO: 753543 - DNA, 25 bp, Mus musculus
taagggcctggacatttgggcaccc

SEQ ID NO: 753544 - DNA, 25 bp, Mus musculus
taagggcctggagatttgggcaccc

SEQ ID NO: 753545 - DNA, 25 bp, Mus musculus
taagggcctggatgccagcagctga

SEQ ID NO: 753546 - DNA, 25 bp, Mus musculus
taagggcgtcctccggatgaagcct

SEQ ID NO: 753547 - DNA, 25 bp, Mus musculus
taagggcgtcctgcggatgaagcct

SEQ ID NO: 753548 - DNA, 25 bp, Mus musculus
taagggcgtttacgccaccactcta

SEQ ID NO: 753549 - DNA, 25 bp, Mus musculus
taagggcgtttaggccaccactcta

SEQ ID NO: 753550 - DNA, 25 bp, Mus musculus
taagggctaacaccgtcatcacaca

SEQ ID NO: 753551 - DNA, 25 bp, Mus musculus
taagggctaacagcgtcatcacaca

SEQ ID NO: 753552 - DNA, 25 bp, Mus musculus
taagggctacccattgggtctctga

SEQ ID NO: 753553 - DNA, 25 bp, Mus musculus
taagggctaccctttgggtctctga

SEQ ID NO: 753554 - DNA, 25 bp, Mus musculus
taagggctagcgagatgagaagact

SEQ ID NO: 753555 - DNA, 25 bp, Mus musculus
taagggctagcgtgatgagaagact

SEQ ID NO: 753556 - DNA, 25 bp, Mus musculus
taagggctccagcaaggtcaccagc

SEQ ID NO: 753557 - DNA, 25 bp, Mus musculus
taagggctccaggaaggtcaccagc

SEQ ID NO: 753558 - DNA, 25 bp, Mus musculus
taagggctcccacatcctcatggac

SEQ ID NO: 753559 - DNA, 25 bp, Mus musculus
taagggctcccagatcctcatggac

SEQ ID NO: 753560 - DNA, 25 bp, Mus musculus
taagggctctcacctgccattgatg

SEQ ID NO: 753561 - DNA, 25 bp, Mus musculus
taagggctctcagctgccattgatg

SEQ ID NO: 753562 - DNA, 25 bp, Mus musculus
taagggctctgacttgcgtttcttc

SEQ ID NO: 753563 - DNA, 25 bp, Mus musculus
taagggctctgagttgcgtttcttc

SEQ ID NO: 753564 - DNA, 25 bp, Mus musculus
taagggctgagcacgcggattcgct

SEQ ID NO: 753565 - DNA, 25 bp, Mus musculus
taagggctgagctcgcggattcgct

SEQ ID NO: 753566 - DNA, 25 bp, Mus musculus
taagggctggcccttatttgctctc

SEQ ID NO: 753567 - DNA, 25 bp, Mus musculus
taagggctggccgttatttgctctc

SEQ ID NO: 753568 - DNA, 25 bp, Mus musculus
taaggggaagcacagtaccacggtc

SEQ ID NO: 753569 - DNA, 25 bp, Mus musculus
taaggggaagcagagtaccacggtc

SEQ ID NO: 753570 - DNA, 25 bp, Mus musculus
taagggtaatttatcacaacagcat

SEQ ID NO: 753571 - DNA, 25 bp, Mus musculus
taagggtaatttttcacaacagcat

SEQ ID NO: 753572 - DNA, 25 bp, Mus musculus
taagggtactggctgctcctgcaga

SEQ ID NO: 753573 - DNA, 25 bp, Mus musculus
taagggtactgggtgctcctgcaga

SEQ ID NO: 753574 - DNA, 25 bp, Mus musculus
taagggtaggcccaccaccaccagt

SEQ ID NO: 753575 - DNA, 25 bp, Mus musculus
taagggtaggccgaccaccaccagt

SEQ ID NO: 753576 - DNA, 25 bp, Mus musculus
taagggtcacctccaactccaaagt

SEQ ID NO: 753577 - DNA, 25 bp, Mus musculus
taagggtcacctgcaactccaaagt

SEQ ID NO: 753578 - DNA, 25 bp, Mus musculus
taagggtcatgtctctcacagcagg

SEQ ID NO: 753579 - DNA, 25 bp, Mus musculus
taagggtcatgtgtctcacagcagg

SEQ ID NO: 753580 - DNA, 25 bp, Mus musculus
taagggtcccttataccagtggcct

SEQ ID NO: 753581 - DNA, 25 bp, Mus musculus
taagggtcccttttaccagtggcct

SEQ ID NO: 753582 - DNA, 25 bp, Mus musculus
taagggtctagtcacacttctgctt

SEQ ID NO: 753583 - DNA, 25 bp, Mus musculus
taagggtctagtgacacttctgctt

SEQ ID NO: 753584 - DNA, 25 bp, Mus musculus
taagggtctgctaaggaagaattca

SEQ ID NO: 753585 - DNA, 25 bp, Mus musculus
taagggtctgcttaggaagaattca

SEQ ID NO: 753586 - DNA, 25 bp, Mus musculus
taagggtgacgcaggccacgtgtct

SEQ ID NO: 753587 - DNA, 25 bp, Mus musculus
taagggtgacgctggccacgtgtct

SEQ ID NO: 753588 - DNA, 25 bp, Mus musculus
taagggtgatacctccgtctgtctg

SEQ ID NO: 753589 - DNA, 25 bp, Mus musculus
taagggtgatacgtccgtctgtctg

SEQ ID NO: 753590 - DNA, 25 bp, Mus musculus
taagggtgccgtcgtcattttaatt

SEQ ID NO: 753591 - DNA, 25 bp, Mus musculus
taagggtgccgtggtcattttaatt

SEQ ID NO: 753592 - DNA, 25 bp, Mus musculus
taagggtgcctgctaaccatctcag

SEQ ID NO: 753593 - DNA, 25 bp, Mus musculus
taagggtgcctggtaaccatctcag

SEQ ID NO: 753594 - DNA, 25 bp, Mus musculus
taagggtgggacaccatgcactgtc

SEQ ID NO: 753595 - DNA, 25 bp, Mus musculus
taagggtgggactccatgcactgtc

SEQ ID NO: 753596 - DNA, 25 bp, Mus musculus
taagggtggtctcccaagcaacgga

SEQ ID NO: 753597 - DNA, 25 bp, Mus musculus
taagggtggtctgccaagcaacgga

SEQ ID NO: 753598 - DNA, 25 bp, Mus musculus
taagggtgtacacgatttccactct

SEQ ID NO: 753599 - DNA, 25 bp, Mus musculus
taagggtgtacaggatttccactct

SEQ ID NO: 753600 - DNA, 25 bp, Mus musculus
taagggtgttgtcatactcctccca

SEQ ID NO: 753601 - DNA, 25 bp, Mus musculus
taagggtgttgtgatactcctccca

SEQ ID NO: 753602 - DNA, 25 bp, Mus musculus
taagggtgtttgcttccttggcagt

SEQ ID NO: 753603 - DNA, 25 bp, Mus musculus
taagggtgtttggttccttggcagt

SEQ ID NO: 753604 - DNA, 25 bp, Mus musculus
taagggttattgcagctgattgcag

SEQ ID NO: 753605 - DNA, 25 bp, Mus musculus
taagggttattggagctgattgcag

SEQ ID NO: 753606 - DNA, 25 bp, Mus musculus
taagggttctatcgcttgaaagcct

SEQ ID NO: 753607 - DNA, 25 bp, Mus musculus
taagggttctatggcttgaaagcct

SEQ ID NO: 753608 - DNA, 25 bp, Mus musculus
taagggttggctctttgctgtttaa

SEQ ID NO: 753609 - DNA, 25 bp, Mus musculus
taagggttggctgtttgctgtttaa

SEQ ID NO: 753610 - DNA, 25 bp, Mus musculus
taagggtttcctcttatccttgcat

SEQ ID NO: 753611 - DNA, 25 bp, Mus musculus
taagggtttcctgttatccttgcat

SEQ ID NO: 753612 - DNA, 25 bp, Mus musculus
taagggtttgccctgatcctccagg

SEQ ID NO: 753613 - DNA, 25 bp, Mus musculus
taagggtttgccgtgatcctccagg

SEQ ID NO: 753614 - DNA, 25 bp, Mus musculus
taagggttttgtcaggcttctgaaa

SEQ ID NO: 753615 - DNA, 25 bp, Mus musculus
taagggttttgtgaggcttctgaaa

SEQ ID NO: 753616 - DNA, 25 bp, Mus musculus
taaggtaaaattcgcgcgtgtgagt

SEQ ID NO: 753617 - DNA, 25 bp, Mus musculus
taaggtaaaattggcgcgtgtgagt

SEQ ID NO: 753618 - DNA, 25 bp, Mus musculus
taaggtaaagcacgtaaaatacagg

SEQ ID NO: 753619 - DNA, 25 bp, Mus musculus
taaggtaaagcaggtaaaatacagg

SEQ ID NO: 753620 - DNA, 25 bp, Mus musculus
taaggtaaccataagcaggcatgaa

SEQ ID NO: 753621 - DNA, 25 bp, Mus musculus
taaggtaaccattagcaggcatgaa

SEQ ID NO: 753622 - DNA, 25 bp, Mus musculus
taaggtaactgcattagaatacaca

SEQ ID NO: 753623 - DNA, 25 bp, Mus musculus
taaggtaactgctttagaatacaca

SEQ ID NO: 753624 - DNA, 25 bp, Mus musculus
taaggtaagactacctctctctttc

SEQ ID NO: 753625 - DNA, 25 bp, Mus musculus
taaggtaagacttcctctctctttc

SEQ ID NO: 753626 - DNA, 25 bp, Mus musculus
taaggtaattctataggatcctggg

SEQ ID NO: 753627 - DNA, 25 bp, Mus musculus
taaggtaattctttaggatcctggg

SEQ ID NO: 753628 - DNA, 25 bp, Mus musculus
taaggtacccttctccctattgact

SEQ ID NO: 753629 - DNA, 25 bp, Mus musculus
taaggtacccttgtccctattgact

SEQ ID NO: 753630 - DNA, 25 bp, Mus musculus
taaggtactagaatccaaggagctc

SEQ ID NO: 753631 - DNA, 25 bp, Mus musculus
taaggtactagattccaaggagctc

SEQ ID NO: 753632 - DNA, 25 bp, Mus musculus
taaggtactcctagaatcagcgatg

SEQ ID NO: 753633 - DNA, 25 bp, Mus musculus
taaggtactccttgaatcagcgatg

SEQ ID NO: 753634 - DNA, 25 bp, Mus musculus
taaggtagattaaacgtaaatgcct

SEQ ID NO: 753635 - DNA, 25 bp, Mus musculus
taaggtagattatacgtaaatgcct

SEQ ID NO: 753636 - DNA, 25 bp, Mus musculus
taaggtagcacaccagtcttttctt

SEQ ID NO: 753637 - DNA, 25 bp, Mus musculus
taaggtagcacagcagtcttttctt

SEQ ID NO: 753638 - DNA, 25 bp, Mus musculus
taaggtagcagtcacccaggtggcc

SEQ ID NO: 753639 - DNA, 25 bp, Mus musculus
taaggtagcagtgacccaggtggcc

SEQ ID NO: 753640 - DNA, 25 bp, Mus musculus
taaggtagcatgatgcactcccacc

SEQ ID NO: 753641 - DNA, 25 bp, Mus musculus
taaggtagcatgttgcactcccacc

SEQ ID NO: 753642 - DNA, 25 bp, Mus musculus
taaggtagccaacccattctagcag

SEQ ID NO: 753643 - DNA, 25 bp, Mus musculus
taaggtagccaagccattctagcag

SEQ ID NO: 753644 - DNA, 25 bp, Mus musculus
taaggtatactcatggtcttcacga

SEQ ID NO: 753645 - DNA, 25 bp, Mus musculus
taaggtatactcttggtcttcacga

SEQ ID NO: 753646 - DNA, 25 bp, Mus musculus
taaggtatagtcagtctcaaaggaa

SEQ ID NO: 753647 - DNA, 25 bp, Mus musculus
taaggtatagtctgtctcaaaggaa

SEQ ID NO: 753648 - DNA, 25 bp, Mus musculus
taaggtatcctgaaactactctttg

SEQ ID NO: 753649 - DNA, 25 bp, Mus musculus
taaggtatcctgtaactactctttg

SEQ ID NO: 753650 - DNA, 25 bp, Mus musculus
taaggtatcttgctacagtagacaa

SEQ ID NO: 753651 - DNA, 25 bp, Mus musculus
taaggtatcttggtacagtagacaa

SEQ ID NO: 753652 - DNA, 25 bp, Mus musculus
taaggtatgtgcatgcctcattcct

SEQ ID NO: 753653 - DNA, 25 bp, Mus musculus
taaggtatgtgcttgcctcattcct

SEQ ID NO: 753654 - DNA, 25 bp, Mus musculus
taaggtatttatcggcatctccacc

SEQ ID NO: 753655 - DNA, 25 bp, Mus musculus
taaggtatttatgggcatctccacc

SEQ ID NO: 753656 - DNA, 25 bp, Mus musculus
taaggtatttctcagtttgtgcaaa

SEQ ID NO: 753657 - DNA, 25 bp, Mus musculus
taaggtatttctgagtttgtgcaaa

SEQ ID NO: 753658 - DNA, 25 bp, Mus musculus
taaggtcaaaacactctcgcagatg

SEQ ID NO: 753659 - DNA, 25 bp, Mus musculus
taaggtcaaaactctctcgcagatg

SEQ ID NO: 753660 - DNA, 25 bp, Mus musculus
taaggtcaaactctccattggtatc

SEQ ID NO: 753661 - DNA, 25 bp, Mus musculus
taaggtcaaactgtccattggtatc

SEQ ID NO: 753662 - DNA, 25 bp, Mus musculus
taaggtcaccggcttgcaacggaga

SEQ ID NO: 753663 - DNA, 25 bp, Mus musculus
taaggtcaccgggttgcaacggaga

SEQ ID NO: 753664 - DNA, 25 bp, Mus musculus
taaggtcactgcactgcttctgctc

SEQ ID NO: 753665 - DNA, 25 bp, Mus musculus
taaggtcactgctctgcttctgctc

SEQ ID NO: 753666 - DNA, 25 bp, Mus musculus
taaggtcagaccaagtctctttctt

SEQ ID NO: 753667 - DNA, 25 bp, Mus musculus
taaggtcagacctagtctctttctt

SEQ ID NO: 753668 - DNA, 25 bp, Mus musculus
taaggtcagacgcagcatggcccca

SEQ ID NO: 753669 - DNA, 25 bp, Mus musculus
taaggtcagacggagcatggcccca

SEQ ID NO: 753670 - DNA, 25 bp, Mus musculus
taaggtcagcaacccgtctaccaga

SEQ ID NO: 753671 - DNA, 25 bp, Mus musculus
taaggtcagcaagccgtctaccaga

SEQ ID NO: 753672 - DNA, 25 bp, Mus musculus
taaggtcatcctccgagtccaaggg

SEQ ID NO: 753673 - DNA, 25 bp, Mus musculus
taaggtcatcctgcgagtccaaggg

SEQ ID NO: 753674 - DNA, 25 bp, Mus musculus
taaggtcatcttcccttgaggacac

SEQ ID NO: 753675 - DNA, 25 bp, Mus musculus
taaggtcatcttgccttgaggacac

SEQ ID NO: 753676 - DNA, 25 bp, Mus musculus
taaggtcatttcatcactcacctcg

SEQ ID NO: 753677 - DNA, 25 bp, Mus musculus
taaggtcatttcttcactcacctcg

SEQ ID NO: 753678 - DNA, 25 bp, Mus musculus
taaggtccagacaagttcacgccca

SEQ ID NO: 753679 - DNA, 25 bp, Mus musculus
taaggtccagactagttcacgccca

SEQ ID NO: 753680 - DNA, 25 bp, Mus musculus
taaggtccagcaactacctgaggat

SEQ ID NO: 753681 - DNA, 25 bp, Mus musculus
taaggtccagcatctacctgaggat

SEQ ID NO: 753682 - DNA, 25 bp, Mus musculus
taaggtccagcgagcgaccccagag

SEQ ID NO: 753683 - DNA, 25 bp, Mus musculus
taaggtccagcgtgcgaccccagag

SEQ ID NO: 753684 - DNA, 25 bp, Mus musculus
taaggtccaggtactttccagagca

SEQ ID NO: 753685 - DNA, 25 bp, Mus musculus
taaggtccaggttctttccagagca

SEQ ID NO: 753686 - DNA, 25 bp, Mus musculus
taaggtccatcgacctagtttactg

SEQ ID NO: 753687 - DNA, 25 bp, Mus musculus
taaggtccatcgtcctagtttactg

SEQ ID NO: 753688 - DNA, 25 bp, Mus musculus
taaggtccattaaaggctgcagttt

SEQ ID NO: 753689 - DNA, 25 bp, Mus musculus
taaggtccattacggttctcactat

SEQ ID NO: 753690 - DNA, 25 bp, Mus musculus
taaggtccattagggttctcactat

SEQ ID NO: 753691 - DNA, 25 bp, Mus musculus
taaggtccattataggctgcagttt

SEQ ID NO: 753692 - DNA, 25 bp, Mus musculus
taaggtcccagaagatctgttcaat

SEQ ID NO: 753693 - DNA, 25 bp, Mus musculus
taaggtcccagatgatctgttcaat

SEQ ID NO: 753694 - DNA, 25 bp, Mus musculus
taaggtcccctgacatcagtcatct

SEQ ID NO: 753695 - DNA, 25 bp, Mus musculus
taaggtcccctgtcatcagtcatct

SEQ ID NO: 753696 - DNA, 25 bp, Mus musculus
taaggtccctgacgtttatcctcca

SEQ ID NO: 753697 - DNA, 25 bp, Mus musculus
taaggtccctgaggtttatcctcca

SEQ ID NO: 753698 - DNA, 25 bp, Mus musculus
taaggtccgttcagtatgcttgctc

SEQ ID NO: 753699 - DNA, 25 bp, Mus musculus
taaggtccgttctgtatgcttgctc

SEQ ID NO: 753700 - DNA, 25 bp, Mus musculus
taaggtcctcatagctgttgtgata

SEQ ID NO: 753701 - DNA, 25 bp, Mus musculus
taaggtcctcattgctgttgtgata

SEQ ID NO: 753702 - DNA, 25 bp, Mus musculus
taaggtctatcgcatccgaaatgtg

SEQ ID NO: 753703 - DNA, 25 bp, Mus musculus
taaggtctatcggatccgaaatgtg

SEQ ID NO: 753704 - DNA, 25 bp, Mus musculus
taaggtctctagcagcgtttgttcc

SEQ ID NO: 753705 - DNA, 25 bp, Mus musculus
taaggtctctaggagcgtttgttcc

SEQ ID NO: 753706 - DNA, 25 bp, Mus musculus
taaggtctggagctctaatctgatc

SEQ ID NO: 753707 - DNA, 25 bp, Mus musculus
taaggtctggaggtctaatctgatc

SEQ ID NO: 753708 - DNA, 25 bp, Mus musculus
taaggtctggcaaggtaccccgagg

SEQ ID NO: 753709 - DNA, 25 bp, Mus musculus
taaggtctggcatggtaccccgagg

SEQ ID NO: 753710 - DNA, 25 bp, Mus musculus
taaggtctgtgtcgccttcttgtaa

SEQ ID NO: 753711 - DNA, 25 bp, Mus musculus
taaggtctgtgtggccttcttgtaa

SEQ ID NO: 753712 - DNA, 25 bp, Mus musculus
taaggtcttctcaaatgtctggtgc

SEQ ID NO: 753713 - DNA, 25 bp, Mus musculus
taaggtcttctctaatgtctggtgc

SEQ ID NO: 753714 - DNA, 25 bp, Mus musculus
taaggtcttgagaccatgctaatcg

SEQ ID NO: 753715 - DNA, 25 bp, Mus musculus
taaggtcttgagtccatgctaatcg

SEQ ID NO: 753716 - DNA, 25 bp, Mus musculus
taaggtcttgctaagtgcacctcat

SEQ ID NO: 753717 - DNA, 25 bp, Mus musculus
taaggtcttgcttagtgcacctcat

SEQ ID NO: 753718 - DNA, 25 bp, Mus musculus
taaggtcttgttcatttccgcttga

SEQ ID NO: 753719 - DNA, 25 bp, Mus musculus
taaggtcttgttgatttccgcttga

SEQ ID NO: 753720 - DNA, 25 bp, Mus musculus
taaggtgaaccccaacttgcagcgg

SEQ ID NO: 753721 - DNA, 25 bp, Mus musculus
taaggtgaacccgaacttgcagcgg

SEQ ID NO: 753722 - DNA, 25 bp, Mus musculus
taaggtgaccatactgactgtgaac

SEQ ID NO: 753723 - DNA, 25 bp, Mus musculus
taaggtgaccattctgactgtgaac

SEQ ID NO: 753724 - DNA, 25 bp, Mus musculus
taaggtgaccctactctagttttca

SEQ ID NO: 753725 - DNA, 25 bp, Mus musculus
taaggtgacccttctctagttttca

SEQ ID NO: 753726 - DNA, 25 bp, Mus musculus
taaggtgacctcagcccacatagca

SEQ ID NO: 753727 - DNA, 25 bp, Mus musculus
taaggtgacctctgcccacatagca

SEQ ID NO: 753728 - DNA, 25 bp, Mus musculus
taaggtgacctgagccaggcatgct

SEQ ID NO: 753729 - DNA, 25 bp, Mus musculus
taaggtgacctgtgccaggcatgct

SEQ ID NO: 753730 - DNA, 25 bp, Mus musculus
taaggtgaccttcaccgcccgtaca

SEQ ID NO: 753731 - DNA, 25 bp, Mus musculus
taaggtgaccttgaccgcccgtaca

SEQ ID NO: 753732 - DNA, 25 bp, Mus musculus
taaggtgactctactggtaccactt

SEQ ID NO: 753733 - DNA, 25 bp, Mus musculus
taaggtgactcttctggtaccactt

SEQ ID NO: 753734 - DNA, 25 bp, Mus musculus
taaggtgagaaccacagctccagaa

SEQ ID NO: 753735 - DNA, 25 bp, Mus musculus
taaggtgagaacgacagctccagaa

SEQ ID NO: 753736 - DNA, 25 bp, Mus musculus
taaggtgagtgcagcagtcgcccac

SEQ ID NO: 753737 - DNA, 25 bp, Mus musculus
taaggtgagtgctgcagtcgcccac

SEQ ID NO: 753738 - DNA, 25 bp, Mus musculus
taaggtgataagagcctgtacagag

SEQ ID NO: 753739 - DNA, 25 bp, Mus musculus
taaggtgataagtgcctgtacagag

SEQ ID NO: 753740 - DNA, 25 bp, Mus musculus
taaggtgatccgagacaagcgcaca

SEQ ID NO: 753741 - DNA, 25 bp, Mus musculus
taaggtgatccgtgacaagcgcaca

SEQ ID NO: 753742 - DNA, 25 bp, Mus musculus
taaggtgatgttctgtcgctctgaa

SEQ ID NO: 753743 - DNA, 25 bp, Mus musculus
taaggtgatgttgtgtcgctctgaa

SEQ ID NO: 753744 - DNA, 25 bp, Mus musculus
taaggtgattctcgccatccggaaa

SEQ ID NO: 753745 - DNA, 25 bp, Mus musculus
taaggtgattctggccatccggaaa

SEQ ID NO: 753746 - DNA, 25 bp, Mus musculus
taaggtgattttccctgacgcagag

SEQ ID NO: 753747 - DNA, 25 bp, Mus musculus
taaggtgattttgcctgacgcagag

SEQ ID NO: 753748 - DNA, 25 bp, Mus musculus
taaggtgcaatcaagctcctgtggt

SEQ ID NO: 753749 - DNA, 25 bp, Mus musculus
taaggtgcaatctagctcctgtggt

SEQ ID NO: 753750 - DNA, 25 bp, Mus musculus
taaggtgcacatagtctctatgact

SEQ ID NO: 753751 - DNA, 25 bp, Mus musculus
taaggtgcacattgtctctatgact

SEQ ID NO: 753752 - DNA, 25 bp, Mus musculus
taaggtgcagcactcagatggcctc

SEQ ID NO: 753753 - DNA, 25 bp, Mus musculus
taaggtgcagcagtcagatggcctc

SEQ ID NO: 753754 - DNA, 25 bp, Mus musculus
taaggtgcatggaggtttccttttt

SEQ ID NO: 753755 - DNA, 25 bp, Mus musculus
taaggtgcatggtggtttccttttt

SEQ ID NO: 753756 - DNA, 25 bp, Mus musculus
taaggtgccagcagactgaccaatc

SEQ ID NO: 753757 - DNA, 25 bp, Mus musculus
taaggtgccagctgactgaccaatc

SEQ ID NO: 753758 - DNA, 25 bp, Mus musculus
taaggtgcctctcgaacttggactt

SEQ ID NO: 753759 - DNA, 25 bp, Mus musculus
taaggtgcctctggaacttggactt

SEQ ID NO: 753760 - DNA, 25 bp, Mus musculus
taaggtgcgtccaagacagcaaaat

SEQ ID NO: 753761 - DNA, 25 bp, Mus musculus
taaggtgcgtcctagacagcaaaat

SEQ ID NO: 753762 - DNA, 25 bp, Mus musculus
taaggtgctcacacagatgggctcc

SEQ ID NO: 753763 - DNA, 25 bp, Mus musculus
taaggtgctcactcagatgggctcc

SEQ ID NO: 753764 - DNA, 25 bp, Mus musculus
taaggtgctccgacagcttaactga

SEQ ID NO: 753765 - DNA, 25 bp, Mus musculus
taaggtgctccgtcagcttaactga

SEQ ID NO: 753766 - DNA, 25 bp, Mus musculus
taaggtgcttggcacttgtgcctac

SEQ ID NO: 753767 - DNA, 25 bp, Mus musculus
taaggtgcttgggacttgtgcctac

SEQ ID NO: 753768 - DNA, 25 bp, Mus musculus
taaggtgctttcagtacttctggtc

SEQ ID NO: 753769 - DNA, 25 bp, Mus musculus
taaggtgctttctgtacttctggtc

SEQ ID NO: 753770 - DNA, 25 bp, Mus musculus
taaggtggacataattacatataca

SEQ ID NO: 753771 - DNA, 25 bp, Mus musculus
taaggtggacattattacatataca

SEQ ID NO: 753772 - DNA, 25 bp, Mus musculus
taaggtggacctctcttccatatgc

SEQ ID NO: 753773 - DNA, 25 bp, Mus musculus
taaggtggacctgtcttccatatgc

SEQ ID NO: 753774 - DNA, 25 bp, Mus musculus
taaggtggagctacagccgggcaca

SEQ ID NO: 753775 - DNA, 25 bp, Mus musculus
taaggtggagcttcagccgggcaca

SEQ ID NO: 753776 - DNA, 25 bp, Mus musculus
taaggtggctccaggataaatggac

SEQ ID NO: 753777 - DNA, 25 bp, Mus musculus
taaggtggctcctggataaatggac

SEQ ID NO: 753778 - DNA, 25 bp, Mus musculus
taaggtggtaagcacatagcggtaa

SEQ ID NO: 753779 - DNA, 25 bp, Mus musculus
taaggtggtaaggacatagcggtaa

SEQ ID NO: 753780 - DNA, 25 bp, Mus musculus
taaggtggtatcacagggtcatttt

SEQ ID NO: 753781 - DNA, 25 bp, Mus musculus
taaggtggtatctcagggtcatttt

SEQ ID NO: 753782 - DNA, 25 bp, Mus musculus
taaggtggtgatatttctccctccg

SEQ ID NO: 753783 - DNA, 25 bp, Mus musculus
taaggtggtgatttttctccctccg

SEQ ID NO: 753784 - DNA, 25 bp, Mus musculus
taaggtggtgcaagtctgtaactga

SEQ ID NO: 753785 - DNA, 25 bp, Mus musculus
taaggtggtgcatgtctgtaactga

SEQ ID NO: 753786 - DNA, 25 bp, Mus musculus
taaggtggtggtccctcccaaagag

SEQ ID NO: 753787 - DNA, 25 bp, Mus musculus
taaggtggtggtgcctcccaaagag

SEQ ID NO: 753788 - DNA, 25 bp, Mus musculus
taaggtggttgtacctgggaaccat

SEQ ID NO: 753789 - DNA, 25 bp, Mus musculus
taaggtggttgttcctgggaaccat

SEQ ID NO: 753790 - DNA, 25 bp, Mus musculus
taaggtggtttaccacagaggtcat

SEQ ID NO: 753791 - DNA, 25 bp, Mus musculus
taaggtggtttagcacagaggtcat

SEQ ID NO: 753792 - DNA, 25 bp, Mus musculus
taaggtgtacccctcttggctggat

SEQ ID NO: 753793 - DNA, 25 bp, Mus musculus
taaggtgtacccgtcttggctggat

SEQ ID NO: 753794 - DNA, 25 bp, Mus musculus
taaggtgtatccaagctacatatgt

SEQ ID NO: 753795 - DNA, 25 bp, Mus musculus
taaggtgtatcctagctacatatgt

SEQ ID NO: 753796 - DNA, 25 bp, Mus musculus
taaggtgtccacctcgggccagatc

SEQ ID NO: 753797 - DNA, 25 bp, Mus musculus
taaggtgtccacgtcgggccagatc

SEQ ID NO: 753798 - DNA, 25 bp, Mus musculus
taaggtgtcccaatacctaggcacc

SEQ ID NO: 753799 - DNA, 25 bp, Mus musculus
taaggtgtcccattacctaggcacc

SEQ ID NO: 753800 - DNA, 25 bp, Mus musculus
taaggtgtcctacggttgtccaaat

SEQ ID NO: 753801 - DNA, 25 bp, Mus musculus
taaggtgtcctagggttgtccaaat

SEQ ID NO: 753802 - DNA, 25 bp, Mus musculus
taaggtgtctacaccctcagttcaa

SEQ ID NO: 753803 - DNA, 25 bp, Mus musculus
taaggtgtctactccctcagttcaa

SEQ ID NO: 753804 - DNA, 25 bp, Mus musculus
taaggtgtcttgacccatggcggag

SEQ ID NO: 753805 - DNA, 25 bp, Mus musculus
taaggtgtcttgtcccatggcggag

SEQ ID NO: 753806 - DNA, 25 bp, Mus musculus
taaggtgtgcacctcacttacttga

SEQ ID NO: 753807 - DNA, 25 bp, Mus musculus
taaggtgtgcacgtcacttacttga

SEQ ID NO: 753808 - DNA, 25 bp, Mus musculus
taaggtgtggacattggctctgaag

SEQ ID NO: 753809 - DNA, 25 bp, Mus musculus
taaggtgtggactttggctctgaag

SEQ ID NO: 753810 - DNA, 25 bp, Mus musculus
taaggtgtggttagtccctccacag

SEQ ID NO: 753811 - DNA, 25 bp, Mus musculus
taaggtgtggtttgtccctccacag

SEQ ID NO: 753812 - DNA, 25 bp, Mus musculus
taaggtgtgtgtaatttagtccagt

SEQ ID NO: 753813 - DNA, 25 bp, Mus musculus
taaggtgtgtgttatttagtccagt

SEQ ID NO: 753814 - DNA, 25 bp, Mus musculus
taaggtgttactcggcaccgttgtt

SEQ ID NO: 753815 - DNA, 25 bp, Mus musculus
taaggtgttactgggcaccgttgtt

SEQ ID NO: 753816 - DNA, 25 bp, Mus musculus
taaggtgttcagactacctcaaggg

SEQ ID NO: 753817 - DNA, 25 bp, Mus musculus
taaggtgttcagtctacctcaaggg

SEQ ID NO: 753818 - DNA, 25 bp, Mus musculus
taaggtgtttccacgttcagcctga

SEQ ID NO: 753819 - DNA, 25 bp, Mus musculus
taaggtgtttcctcgttcagcctga

SEQ ID NO: 753820 - DNA, 25 bp, Mus musculus
taaggtgtttctcccagtacttggc

SEQ ID NO: 753821 - DNA, 25 bp, Mus musculus
taaggtgtttctgccagtacttggc

SEQ ID NO: 753822 - DNA, 25 bp, Mus musculus
taaggtgttttccagagcactgatg

SEQ ID NO: 753823 - DNA, 25 bp, Mus musculus
taaggtgttttcgagagcactgatg

SEQ ID NO: 753824 - DNA, 25 bp, Mus musculus
taaggttacattctgttattccagc

SEQ ID NO: 753825 - DNA, 25 bp, Mus musculus
taaggttacattgtgttattccagc

SEQ ID NO: 753826 - DNA, 25 bp, Mus musculus
taaggttacctacagttcctgcgga

SEQ ID NO: 753827 - DNA, 25 bp, Mus musculus
taaggttacctagagttcctgcgga

SEQ ID NO: 753828 - DNA, 25 bp, Mus musculus
taaggttcacctatgcaggttttga

SEQ ID NO: 753829 - DNA, 25 bp, Mus musculus
taaggttcacctttgcaggttttga

SEQ ID NO: 753830 - DNA, 25 bp, Mus musculus
taaggttcagaaactgtaactcagc

SEQ ID NO: 753831 - DNA, 25 bp, Mus musculus
taaggttcagaatctgtaactcagc

SEQ ID NO: 753832 - DNA, 25 bp, Mus musculus
taaggttcagctccgacgcttgtct

SEQ ID NO: 753833 - DNA, 25 bp, Mus musculus
taaggttcagctgcgacgcttgtct

SEQ ID NO: 753834 - DNA, 25 bp, Mus musculus
taaggttccaatccagcctcaattg

SEQ ID NO: 753835 - DNA, 25 bp, Mus musculus
taaggttccaatgcagcctcaattg

SEQ ID NO: 753836 - DNA, 25 bp, Mus musculus
taaggttcctcaccactcagtgcta

SEQ ID NO: 753837 - DNA, 25 bp, Mus musculus
taaggttcctcagcactcagtgcta

SEQ ID NO: 753838 - DNA, 25 bp, Mus musculus
taaggttccttaactcttcttacta

SEQ ID NO: 753839 - DNA, 25 bp, Mus musculus
taaggttccttatctcttcttacta

SEQ ID NO: 753840 - DNA, 25 bp, Mus musculus
taaggttctggacccctttgttttg

SEQ ID NO: 753841 - DNA, 25 bp, Mus musculus
taaggttctggagccctttgttttg

SEQ ID NO: 753842 - DNA, 25 bp, Mus musculus
taaggttgccaaccagtgccccaaa

SEQ ID NO: 753843 - DNA, 25 bp, Mus musculus
taaggttgccaagcagtgccccaaa

SEQ ID NO: 753844 - DNA, 25 bp, Mus musculus
taaggttgccacctcggcttagaaa

SEQ ID NO: 753845 - DNA, 25 bp, Mus musculus
taaggttgccacgtcggcttagaaa

SEQ ID NO: 753846 - DNA, 25 bp, Mus musculus
taaggttgctaacggtcagctccca

SEQ ID NO: 753847 - DNA, 25 bp, Mus musculus
taaggttgctaagggtcagctccca

SEQ ID NO: 753848 - DNA, 25 bp, Mus musculus
taaggttgctacagcatgtcctccg

SEQ ID NO: 753849 - DNA, 25 bp, Mus musculus
taaggttgctactgcatgtcctccg

SEQ ID NO: 753850 - DNA, 25 bp, Mus musculus
taaggttggacacctgtaactgctc

SEQ ID NO: 753851 - DNA, 25 bp, Mus musculus
taaggttggacagctgtaactgctc

SEQ ID NO: 753852 - DNA, 25 bp, Mus musculus
taaggttggccaatattcctgtttt

SEQ ID NO: 753853 - DNA, 25 bp, Mus musculus
taaggttggccattattcctgtttt

SEQ ID NO: 753854 - DNA, 25 bp, Mus musculus
taaggttggttcagctggcaggcct

SEQ ID NO: 753855 - DNA, 25 bp, Mus musculus
taaggttggttctgctggcaggcct

SEQ ID NO: 753856 - DNA, 25 bp, Mus musculus
taaggttgtagcctgcctgtggcct

SEQ ID NO: 753857 - DNA, 25 bp, Mus musculus
taaggttgtagcgtgcctgtggcct

SEQ ID NO: 753858 - DNA, 25 bp, Mus musculus
taaggttgtatgatttcatttgact

SEQ ID NO: 753859 - DNA, 25 bp, Mus musculus
taaggttgtatgttttcatttgact

SEQ ID NO: 753860 - DNA, 25 bp, Mus musculus
taaggttgtggccacgtgtgaccat

SEQ ID NO: 753861 - DNA, 25 bp, Mus musculus
taaggttgtggcgacgtgtgaccat

SEQ ID NO: 753862 - DNA, 25 bp, Mus musculus
taaggttgttcaccatgatggcatc

SEQ ID NO: 753863 - DNA, 25 bp, Mus musculus
taaggttgttcagcatgatggcatc

SEQ ID NO: 753864 - DNA, 25 bp, Mus musculus
taaggttgtttgcttccgtgtgtgt

SEQ ID NO: 753865 - DNA, 25 bp, Mus musculus
taaggttgtttggttccgtgtgtgt

SEQ ID NO: 753866 - DNA, 25 bp, Mus musculus
taaggtttagtccatgtatctttaa

SEQ ID NO: 753867 - DNA, 25 bp, Mus musculus
taaggtttagtcgatgtatctttaa

SEQ ID NO: 753868 - DNA, 25 bp, Mus musculus
taaggtttcaataggacaaggtggc

SEQ ID NO: 753869 - DNA, 25 bp, Mus musculus
taaggtttcaattggacaaggtggc

SEQ ID NO: 753870 - DNA, 25 bp, Mus musculus
taaggtttcataatatgtccacaag

SEQ ID NO: 753871 - DNA, 25 bp, Mus musculus
taaggtttcatattatgtccacaag

SEQ ID NO: 753872 - DNA, 25 bp, Mus musculus
taaggtttcctcctcagatgactgt

SEQ ID NO: 753873 - DNA, 25 bp, Mus musculus
taaggtttcctcgtcagatgactgt

SEQ ID NO: 753874 - DNA, 25 bp, Mus musculus
taaggtttcctgatgggtaccacat

SEQ ID NO: 753875 - DNA, 25 bp, Mus musculus
taaggtttcctgttgggtaccacat

SEQ ID NO: 753876 - DNA, 25 bp, Mus musculus
taaggtttcggacgatgcccttcat

SEQ ID NO: 753877 - DNA, 25 bp, Mus musculus
taaggtttcggaggatgcccttcat

SEQ ID NO: 753878 - DNA, 25 bp, Mus musculus
taaggtttctcccacacgggctcag

SEQ ID NO: 753879 - DNA, 25 bp, Mus musculus
taaggtttctcccactcctgatgag

SEQ ID NO: 753880 - DNA, 25 bp, Mus musculus
taaggtttctccgacacgggctcag

SEQ ID NO: 753881 - DNA, 25 bp, Mus musculus
taaggtttctccgactcctgatgag

SEQ ID NO: 753882 - DNA, 25 bp, Mus musculus
taaggtttcttcatctgatctgtgc

SEQ ID NO: 753883 - DNA, 25 bp, Mus musculus
taaggtttcttcttctgatctgtgc

SEQ ID NO: 753884 - DNA, 25 bp, Mus musculus
taaggtttgcagcatggcgctcatg

SEQ ID NO: 753885 - DNA, 25 bp, Mus musculus
taaggtttgcaggatggcgctcatg

SEQ ID NO: 753886 - DNA, 25 bp, Mus musculus
taaggtttggagcttcaagtgtttg

SEQ ID NO: 753887 - DNA, 25 bp, Mus musculus
taaggtttggaggttcaagtgtttg

SEQ ID NO: 753888 - DNA, 25 bp, Mus musculus
taaggtttggctaatgcctccaggt

SEQ ID NO: 753889 - DNA, 25 bp, Mus musculus
taaggtttggcttatgcctccaggt

SEQ ID NO: 753890 - DNA, 25 bp, Mus musculus
taaggtttgttgctcatgttattaa

SEQ ID NO: 753891 - DNA, 25 bp, Mus musculus
taaggtttgttggtcatgttattaa

SEQ ID NO: 753892 - DNA, 25 bp, Mus musculus
taaggttttcgtacaccaggcagat

SEQ ID NO: 753893 - DNA, 25 bp, Mus musculus
taaggttttcgttcaccaggcagat

SEQ ID NO: 753894 - DNA, 25 bp, Mus musculus
taaggttttgaaatccctggaacag

SEQ ID NO: 753895 - DNA, 25 bp, Mus musculus
taaggttttgaattccctggaacag

SEQ ID NO: 753896 - DNA, 25 bp, Mus musculus
taaggttttgtgctataaccagtat

SEQ ID NO: 753897 - DNA, 25 bp, Mus musculus
taaggttttgtggtataaccagtat

SEQ ID NO: 753898 - DNA, 25 bp, Mus musculus
taaggtttttcaatctagttgtggg

SEQ ID NO: 753899 - DNA, 25 bp, Mus musculus
taaggtttttcattctagttgtggg

SEQ ID NO: 753900 - DNA, 25 bp, Mus musculus
taaggtttttgtactctccatctgt

SEQ ID NO: 753901 - DNA, 25 bp, Mus musculus
taaggtttttgttctctccatctgt

SEQ ID NO: 753902 - DNA, 25 bp, Mus musculus
taagtaaaacaccactgttggctcc

SEQ ID NO: 753903 - DNA, 25 bp, Mus musculus
taagtaaaacacgactgttggctcc

SEQ ID NO: 753904 - DNA, 25 bp, Mus musculus
taagtaaaagacattttctccttgt

SEQ ID NO: 753905 - DNA, 25 bp, Mus musculus
taagtaaaagactttttctccttgt

SEQ ID NO: 753906 - DNA, 25 bp, Mus musculus
taagtaaagtcgccttatgtttaca

SEQ ID NO: 753907 - DNA, 25 bp, Mus musculus
taagtaaagtcggcttatgtttaca

SEQ ID NO: 753908 - DNA, 25 bp, Mus musculus
taagtaaatagacccacctgttctg

SEQ ID NO: 753909 - DNA, 25 bp, Mus musculus
taagtaaatagagccacctgttctg

SEQ ID NO: 753910 - DNA, 25 bp, Mus musculus
taagtaaatcagcagcttccagccc

SEQ ID NO: 753911 - DNA, 25 bp, Mus musculus
taagtaaatcaggagcttccagccc

SEQ ID NO: 753912 - DNA, 25 bp, Mus musculus
taagtaaatcttaggcccggagtga

SEQ ID NO: 753913 - DNA, 25 bp, Mus musculus
taagtaaatctttggcccggagtga

SEQ ID NO: 753914 - DNA, 25 bp, Mus musculus
taagtaaatgctcctctctgctctc

SEQ ID NO: 753915 - DNA, 25 bp, Mus musculus
taagtaaatgctgctctctgctctc

SEQ ID NO: 753916 - DNA, 25 bp, Mus musculus
taagtaaatgtcagtggccttgttc

SEQ ID NO: 753917 - DNA, 25 bp, Mus musculus
taagtaaatgtctgtggccttgttc

SEQ ID NO: 753918 - DNA, 25 bp, Mus musculus
taagtaaattaaagtctgctctgat

SEQ ID NO: 753919 - DNA, 25 bp, Mus musculus
taagtaaattaatgtctgctctgat

SEQ ID NO: 753920 - DNA, 25 bp, Mus musculus
taagtaacacctctaggctcttctg

SEQ ID NO: 753921 - DNA, 25 bp, Mus musculus
taagtaacacctgtaggctcttctg

SEQ ID NO: 753922 - DNA, 25 bp, Mus musculus
taagtaaccaggccgggttcaccag

SEQ ID NO: 753923 - DNA, 25 bp, Mus musculus
taagtaaccagggcgggttcaccag

SEQ ID NO: 753924 - DNA, 25 bp, Mus musculus
taagtaaccctaagttcaaagacag

SEQ ID NO: 753925 - DNA, 25 bp, Mus musculus
taagtaaccctatgttcaaagacag

SEQ ID NO: 753926 - DNA, 25 bp, Mus musculus
taagtaacggaactaaaggcacaca

SEQ ID NO: 753927 - DNA, 25 bp, Mus musculus
taagtaacggaagtaaaggcacaca

SEQ ID NO: 753928 - DNA, 25 bp, Mus musculus
taagtaactcttatgctcctgaggc

SEQ ID NO: 753929 - DNA, 25 bp, Mus musculus
taagtaactcttttgctcctgaggc

SEQ ID NO: 753930 - DNA, 25 bp, Mus musculus
taagtaactgacaggagaccccagc

SEQ ID NO: 753931 - DNA, 25 bp, Mus musculus
taagtaactgactggagaccccagc

SEQ ID NO: 753932 - DNA, 25 bp, Mus musculus
taagtaactgctatcttagcacaga

SEQ ID NO: 753933 - DNA, 25 bp, Mus musculus
taagtaactgctttcttagcacaga

SEQ ID NO: 753934 - DNA, 25 bp, Mus musculus
taagtaacttccaccacactggttt

SEQ ID NO: 753935 - DNA, 25 bp, Mus musculus
taagtaacttcctccacactggttt

SEQ ID NO: 753936 - DNA, 25 bp, Mus musculus
taagtaagactaacacccaccacac

SEQ ID NO: 753937 - DNA, 25 bp, Mus musculus
taagtaagactatcacccaccacac

SEQ ID NO: 753938 - DNA, 25 bp, Mus musculus
taagtaagcagtaacttgacttttg

SEQ ID NO: 753939 - DNA, 25 bp, Mus musculus
taagtaagcagttacttgacttttg

SEQ ID NO: 753940 - DNA, 25 bp, Mus musculus
taagtaaggcaactggcattcccat

SEQ ID NO: 753941 - DNA, 25 bp, Mus musculus
taagtaaggcaagtggcattcccat

SEQ ID NO: 753942 - DNA, 25 bp, Mus musculus
taagtaatatttaagaaaccagcga

SEQ ID NO: 753943 - DNA, 25 bp, Mus musculus
taagtaatattttagaaaccagcga

SEQ ID NO: 753944 - DNA, 25 bp, Mus musculus
taagtaatctccagttcctctgaaa

SEQ ID NO: 753945 - DNA, 25 bp, Mus musculus
taagtaatctcctgttcctctgaaa

SEQ ID NO: 753946 - DNA, 25 bp, Mus musculus
taagtaatgattacagccctgccaa

SEQ ID NO: 753947 - DNA, 25 bp, Mus musculus
taagtaatgatttcagccctgccaa

SEQ ID NO: 753948 - DNA, 25 bp, Mus musculus
taagtaatgcaaacgattgtcgggt

SEQ ID NO: 753949 - DNA, 25 bp, Mus musculus
taagtaatgcaatcgattgtcgggt

SEQ ID NO: 753950 - DNA, 25 bp, Mus musculus
taagtacacctgacacttccaggac

SEQ ID NO: 753951 - DNA, 25 bp, Mus musculus
taagtacacctgtcacttccaggac

SEQ ID NO: 753952 - DNA, 25 bp, Mus musculus
taagtacagatcaaagctatcgtgt

SEQ ID NO: 753953 - DNA, 25 bp, Mus musculus
taagtacagatctaagctatcgtgt

SEQ ID NO: 753954 - DNA, 25 bp, Mus musculus
taagtacagcttagtttggtggttt

SEQ ID NO: 753955 - DNA, 25 bp, Mus musculus
taagtacagctttgtttggtggttt

SEQ ID NO: 753956 - DNA, 25 bp, Mus musculus
taagtacataccaccgtgtcagtgg

SEQ ID NO: 753957 - DNA, 25 bp, Mus musculus
taagtacatacctccgtgtcagtgg

SEQ ID NO: 753958 - DNA, 25 bp, Mus musculus
taagtaccatttagtcagcctccaa

SEQ ID NO: 753959 - DNA, 25 bp, Mus musculus
taagtaccattttgtcagcctccaa

SEQ ID NO: 753960 - DNA, 25 bp, Mus musculus
taagtacccaagcaccgagctcaag

SEQ ID NO: 753961 - DNA, 25 bp, Mus musculus
taagtacccaaggaccgagctcaag

SEQ ID NO: 753962 - DNA, 25 bp, Mus musculus
taagtaccgcaacgcccagcacgag

SEQ ID NO: 753963 - DNA, 25 bp, Mus musculus
taagtaccgcaaggcccagcacgag

SEQ ID NO: 753964 - DNA, 25 bp, Mus musculus
taagtaccgtgccaaggttgaccgg

SEQ ID NO: 753965 - DNA, 25 bp, Mus musculus
taagtaccgtgcgaaggttgaccgg

SEQ ID NO: 753966 - DNA, 25 bp, Mus musculus
taagtacctaggactatttatttgt

SEQ ID NO: 753967 - DNA, 25 bp, Mus musculus
taagtacctaggtctatttatttgt

SEQ ID NO: 753968 - DNA, 25 bp, Mus musculus
taagtacctcgccttgtgagagctg

SEQ ID NO: 753969 - DNA, 25 bp, Mus musculus
taagtacctcgcgttgtgagagctg

SEQ ID NO: 753970 - DNA, 25 bp, Mus musculus
taagtacctcttaacattcctcatc

SEQ ID NO: 753971 - DNA, 25 bp, Mus musculus
taagtacctctttacattcctcatc

SEQ ID NO: 753972 - DNA, 25 bp, Mus musculus
taagtacgcttgcaaaccctcttgg

SEQ ID NO: 753973 - DNA, 25 bp, Mus musculus
taagtacgcttggaaaccctcttgg

SEQ ID NO: 753974 - DNA, 25 bp, Mus musculus
taagtacggctgacggctaacgtgg

SEQ ID NO: 753975 - DNA, 25 bp, Mus musculus
taagtacggctgtcggctaacgtgg

SEQ ID NO: 753976 - DNA, 25 bp, Mus musculus
taagtacgtccccaagtatgctccc

SEQ ID NO: 753977 - DNA, 25 bp, Mus musculus
taagtacgtcccgaagtatgctccc

SEQ ID NO: 753978 - DNA, 25 bp, Mus musculus
taagtacgttctcaccctgaacaag

SEQ ID NO: 753979 - DNA, 25 bp, Mus musculus
taagtacgttctgaccctgaacaag

SEQ ID NO: 753980 - DNA, 25 bp, Mus musculus
taagtactaccgctctccatgggag

SEQ ID NO: 753981 - DNA, 25 bp, Mus musculus
taagtactaccggtctccatgggag

SEQ ID NO: 753982 - DNA, 25 bp, Mus musculus
taagtactagtcacatgtctccagc

SEQ ID NO: 753983 - DNA, 25 bp, Mus musculus
taagtactagtctcatgtctccagc

SEQ ID NO: 753984 - DNA, 25 bp, Mus musculus
taagtactcagcagcctccgtactt

SEQ ID NO: 753985 - DNA, 25 bp, Mus musculus
taagtactcagccatgtaacaccaa

SEQ ID NO: 753986 - DNA, 25 bp, Mus musculus
taagtactcagcgatgtaacaccaa

SEQ ID NO: 753987 - DNA, 25 bp, Mus musculus
taagtactcagctgcctccgtactt

SEQ ID NO: 753988 - DNA, 25 bp, Mus musculus
taagtactccatctatgtagtgctg

SEQ ID NO: 753989 - DNA, 25 bp, Mus musculus
taagtactccatgtatgtagtgctg

SEQ ID NO: 753990 - DNA, 25 bp, Mus musculus
taagtactgaagacttccccagggc

SEQ ID NO: 753991 - DNA, 25 bp, Mus musculus
taagtactgaagtcttccccagggc

SEQ ID NO: 753992 - DNA, 25 bp, Mus musculus
taagtactgcttactgttgcttcct

SEQ ID NO: 753993 - DNA, 25 bp, Mus musculus
taagtactgctttctgttgcttcct

SEQ ID NO: 753994 - DNA, 25 bp, Mus musculus
taagtactttacacatccattacaa

SEQ ID NO: 753995 - DNA, 25 bp, Mus musculus
taagtactttactcatccattacaa

SEQ ID NO: 753996 - DNA, 25 bp, Mus musculus
taagtactttgtattctggaaccgt

SEQ ID NO: 753997 - DNA, 25 bp, Mus musculus
taagtactttgtcttccagctttcc

SEQ ID NO: 753998 - DNA, 25 bp, Mus musculus
taagtactttgtgttccagctttcc

SEQ ID NO: 753999 - DNA, 25 bp, Mus musculus
taagtactttgttttctggaaccgt

SEQ ID NO: 754000 - DNA, 25 bp, Mus musculus
taagtagaagcaactggcaaaccat

SEQ ID NO: 754001 - DNA, 25 bp, Mus musculus
taagtagaagcatctggcaaaccat

SEQ ID NO: 754002 - DNA, 25 bp, Mus musculus
taagtagacctgacaacacccctgt

SEQ ID NO: 754003 - DNA, 25 bp, Mus musculus
taagtagacctgtcaacacccctgt

SEQ ID NO: 754004 - DNA, 25 bp, Mus musculus
taagtagagcatatttgtacaccca

SEQ ID NO: 754005 - DNA, 25 bp, Mus musculus
taagtagagcatttttgtacaccca

SEQ ID NO: 754006 - DNA, 25 bp, Mus musculus
taagtagatctacctcttgaagaga

SEQ ID NO: 754007 - DNA, 25 bp, Mus musculus
taagtagatctagctcttgaagaga

SEQ ID NO: 754008 - DNA, 25 bp, Mus musculus
taagtagatcttattgagttccaaa

SEQ ID NO: 754009 - DNA, 25 bp, Mus musculus
taagtagatctttttgagttccaaa

SEQ ID NO: 754010 - DNA, 25 bp, Mus musculus
taagtagcagccctttcctggatga

SEQ ID NO: 754011 - DNA, 25 bp, Mus musculus
taagtagcagccgtttcctggatga

SEQ ID NO: 754012 - DNA, 25 bp, Mus musculus
taagtagcagtcctggccgaaactc

SEQ ID NO: 754013 - DNA, 25 bp, Mus musculus
taagtagcagtcgtggccgaaactc

SEQ ID NO: 754014 - DNA, 25 bp, Mus musculus
taagtagcccgtcaagctgccggaa

SEQ ID NO: 754015 - DNA, 25 bp, Mus musculus
taagtagcccgtgaagctgccggaa

SEQ ID NO: 754016 - DNA, 25 bp, Mus musculus
taagtagccggtcacagcacagtgt

SEQ ID NO: 754017 - DNA, 25 bp, Mus musculus
taagtagccggtgacagcacagtgt

SEQ ID NO: 754018 - DNA, 25 bp, Mus musculus
taagtagcgcgcatcatgtgtttac

SEQ ID NO: 754019 - DNA, 25 bp, Mus musculus
taagtagcgcgcttcatgtgtttac

SEQ ID NO: 754020 - DNA, 25 bp, Mus musculus
taagtagcgctgacttcaaggctca

SEQ ID NO: 754021 - DNA, 25 bp, Mus musculus
taagtagcgctgtcttcaaggctca

SEQ ID NO: 754022 - DNA, 25 bp, Mus musculus
taagtagctaagaccccaggcgtat

SEQ ID NO: 754023 - DNA, 25 bp, Mus musculus
taagtagctaagtccccaggcgtat

SEQ ID NO: 754024 - DNA, 25 bp, Mus musculus
taagtagctcctagcagctctgaaa

SEQ ID NO: 754025 - DNA, 25 bp, Mus musculus
taagtagctccttgcagctctgaaa

SEQ ID NO: 754026 - DNA, 25 bp, Mus musculus
taagtagctgcaaggcccagtgtgc

SEQ ID NO: 754027 - DNA, 25 bp, Mus musculus
taagtagctgcatggcccagtgtgc

SEQ ID NO: 754028 - DNA, 25 bp, Mus musculus
taagtaggcagtcttcagcctggcc

SEQ ID NO: 754029 - DNA, 25 bp, Mus musculus
taagtaggcagtgttcagcctggcc

SEQ ID NO: 754030 - DNA, 25 bp, Mus musculus
taagtaggccccagtttacgataca

SEQ ID NO: 754031 - DNA, 25 bp, Mus musculus
taagtaggcccctgtttacgataca

SEQ ID NO: 754032 - DNA, 25 bp, Mus musculus
taagtagggatgcagacctctctgt

SEQ ID NO: 754033 - DNA, 25 bp, Mus musculus
taagtagggatggagacctctctgt

SEQ ID NO: 754034 - DNA, 25 bp, Mus musculus
taagtagggtctctaccctcttatg

SEQ ID NO: 754035 - DNA, 25 bp, Mus musculus
taagtagggtctgtaccctcttatg

SEQ ID NO: 754036 - DNA, 25 bp, Mus musculus
taagtaggtcacctcttagctgcac

SEQ ID NO: 754037 - DNA, 25 bp, Mus musculus
taagtaggtcacgtcttagctgcac

SEQ ID NO: 754038 - DNA, 25 bp, Mus musculus
taagtaggtctaaatgtcttcccaa

SEQ ID NO: 754039 - DNA, 25 bp, Mus musculus
taagtaggtctatatgtcttcccaa

SEQ ID NO: 754040 - DNA, 25 bp, Mus musculus
taagtaggtctcaagtagcctccct

SEQ ID NO: 754041 - DNA, 25 bp, Mus musculus
taagtaggtctctagtagcctccct

SEQ ID NO: 754042 - DNA, 25 bp, Mus musculus
taagtaggttggaccttcctcctct

SEQ ID NO: 754043 - DNA, 25 bp, Mus musculus
taagtaggttggtccttcctcctct

SEQ ID NO: 754044 - DNA, 25 bp, Mus musculus
taagtagtagcgagacttttggatc

SEQ ID NO: 754045 - DNA, 25 bp, Mus musculus
taagtagtagcgtgacttttggatc

SEQ ID NO: 754046 - DNA, 25 bp, Mus musculus
taagtagtccctccttctgctatct

SEQ ID NO: 754047 - DNA, 25 bp, Mus musculus
taagtagtccctgcttctgctatct

SEQ ID NO: 754048 - DNA, 25 bp, Mus musculus
taagtagtgctcctgtctgttccaa

SEQ ID NO: 754049 - DNA, 25 bp, Mus musculus
taagtagtgctcgtgtctgttccaa

SEQ ID NO: 754050 - DNA, 25 bp, Mus musculus
taagtatagcacctcttcaggcttt

SEQ ID NO: 754051 - DNA, 25 bp, Mus musculus
taagtatagcacgtcttcaggcttt

SEQ ID NO: 754052 - DNA, 25 bp, Mus musculus
taagtataggctcttcttacagaat

SEQ ID NO: 754053 - DNA, 25 bp, Mus musculus
taagtataggctgttcttacagaat

SEQ ID NO: 754054 - DNA, 25 bp, Mus musculus
taagtatatcccagactgtcccgga

SEQ ID NO: 754055 - DNA, 25 bp, Mus musculus
taagtatatccctgactgtcccgga

SEQ ID NO: 754056 - DNA, 25 bp, Mus musculus
taagtatatgacactcaatccctct

SEQ ID NO: 754057 - DNA, 25 bp, Mus musculus
taagtatatgactctcaatccctct

SEQ ID NO: 754058 - DNA, 25 bp, Mus musculus
taagtatcacccaggctttttactg

SEQ ID NO: 754059 - DNA, 25 bp, Mus musculus
taagtatcaccctggctttttactg

SEQ ID NO: 754060 - DNA, 25 bp, Mus musculus
taagtatcagccagtcatgtccgtg

SEQ ID NO: 754061 - DNA, 25 bp, Mus musculus
taagtatcagcctgtcatgtccgtg

SEQ ID NO: 754062 - DNA, 25 bp, Mus musculus
taagtatccagcagcacagactgca

SEQ ID NO: 754063 - DNA, 25 bp, Mus musculus
taagtatccagctgcacagactgca

SEQ ID NO: 754064 - DNA, 25 bp, Mus musculus
taagtatccccaagctgactcggag

SEQ ID NO: 754065 - DNA, 25 bp, Mus musculus
taagtatccccatgctgactcggag

SEQ ID NO: 754066 - DNA, 25 bp, Mus musculus
taagtatctctcattcgtctttcta

SEQ ID NO: 754067 - DNA, 25 bp, Mus musculus
taagtatctctctttcgtctttcta

SEQ ID NO: 754068 - DNA, 25 bp, Mus musculus
taagtatctttcaccatgcacacgc

SEQ ID NO: 754069 - DNA, 25 bp, Mus musculus
taagtatctttctccatgcacacgc

SEQ ID NO: 754070 - DNA, 25 bp, Mus musculus
taagtatgaaacaagcatgggctat

SEQ ID NO: 754071 - DNA, 25 bp, Mus musculus
taagtatgaaactagcatgggctat

SEQ ID NO: 754072 - DNA, 25 bp, Mus musculus
taagtatgcctcagtgggttgagaa

SEQ ID NO: 754073 - DNA, 25 bp, Mus musculus
taagtatgcctctgtgggttgagaa

SEQ ID NO: 754074 - DNA, 25 bp, Mus musculus
taagtatgcgtgagcctactgtttt

SEQ ID NO: 754075 - DNA, 25 bp, Mus musculus
taagtatgcgtgtgcctactgtttt

SEQ ID NO: 754076 - DNA, 25 bp, Mus musculus
taagtatgcttgaaacacacacaca

SEQ ID NO: 754077 - DNA, 25 bp, Mus musculus
taagtatgcttgtaacacacacaca

SEQ ID NO: 754078 - DNA, 25 bp, Mus musculus
taagtattcacaacgtgccgtttct

SEQ ID NO: 754079 - DNA, 25 bp, Mus musculus
taagtattcacatcgtgccgtttct

SEQ ID NO: 754080 - DNA, 25 bp, Mus musculus
taagtattccggaggatgcccctga

SEQ ID NO: 754081 - DNA, 25 bp, Mus musculus
taagtattccggtggatgcccctga

SEQ ID NO: 754082 - DNA, 25 bp, Mus musculus
taagtattgcttcacccacagtatg

SEQ ID NO: 754083 - DNA, 25 bp, Mus musculus
taagtattgcttgacccacagtatg

SEQ ID NO: 754084 - DNA, 25 bp, Mus musculus
taagtattggtgagtctgttccttc

SEQ ID NO: 754085 - DNA, 25 bp, Mus musculus
taagtattggtgtgtctgttccttc

SEQ ID NO: 754086 - DNA, 25 bp, Mus musculus
taagtattgttcaaccctctactgt

SEQ ID NO: 754087 - DNA, 25 bp, Mus musculus
taagtattgttctaccctctactgt

SEQ ID NO: 754088 - DNA, 25 bp, Mus musculus
taagtatttcaacaccatgcagatt

SEQ ID NO: 754089 - DNA, 25 bp, Mus musculus
taagtatttcaagaccatgcagatt

SEQ ID NO: 754090 - DNA, 25 bp, Mus musculus
taagtatttcctctttcttgggcat

SEQ ID NO: 754091 - DNA, 25 bp, Mus musculus
taagtatttcctgtttcttgggcat

SEQ ID NO: 754092 - DNA, 25 bp, Mus musculus
taagtatttcgccatcttcactcac

SEQ ID NO: 754093 - DNA, 25 bp, Mus musculus
taagtatttcgcgatcttcactcac

SEQ ID NO: 754094 - DNA, 25 bp, Mus musculus
taagtatttttcatgcatccgcctg

SEQ ID NO: 754095 - DNA, 25 bp, Mus musculus
taagtatttttcttgcatccgcctg

SEQ ID NO: 754096 - DNA, 25 bp, Mus musculus
taagtcaaggttccctctagcaagc

SEQ ID NO: 754097 - DNA, 25 bp, Mus musculus
taagtcaaggttgcctctagcaagc

SEQ ID NO: 754098 - DNA, 25 bp, Mus musculus
taagtcaattctctggctttctcta

SEQ ID NO: 754099 - DNA, 25 bp, Mus musculus
taagtcaattctgtggctttctcta

SEQ ID NO: 754100 - DNA, 25 bp, Mus musculus
taagtcacatatcggattctgggtc

SEQ ID NO: 754101 - DNA, 25 bp, Mus musculus
taagtcacatatgggattctgggtc

SEQ ID NO: 754102 - DNA, 25 bp, Mus musculus
taagtcaccgttccctttgatgcca

SEQ ID NO: 754103 - DNA, 25 bp, Mus musculus
taagtcaccgttgcctttgatgcca

SEQ ID NO: 754104 - DNA, 25 bp, Mus musculus
taagtcaccttcataccaacttgtt

SEQ ID NO: 754105 - DNA, 25 bp, Mus musculus
taagtcaccttcttaccaacttgtt

SEQ ID NO: 754106 - DNA, 25 bp, Mus musculus
taagtcacgtggcatttaggctggc

SEQ ID NO: 754107 - DNA, 25 bp, Mus musculus
taagtcacgtgggatttaggctggc

SEQ ID NO: 754108 - DNA, 25 bp, Mus musculus
taagtcactggtccccagctttgag

SEQ ID NO: 754109 - DNA, 25 bp, Mus musculus
taagtcactggtgcccagctttgag

SEQ ID NO: 754110 - DNA, 25 bp, Mus musculus
taagtcactgttagcaactcttccc

SEQ ID NO: 754111 - DNA, 25 bp, Mus musculus
taagtcactgtttgcaactcttccc

SEQ ID NO: 754112 - DNA, 25 bp, Mus musculus
taagtcagacttagtggtgcctcca

SEQ ID NO: 754113 - DNA, 25 bp, Mus musculus
taagtcagactttgtggtgcctcca

SEQ ID NO: 754114 - DNA, 25 bp, Mus musculus
taagtcagagacaccccataggtga

SEQ ID NO: 754115 - DNA, 25 bp, Mus musculus
taagtcagagactccccataggtga

SEQ ID NO: 754116 - DNA, 25 bp, Mus musculus
taagtcagagagaacgcaccccggt

SEQ ID NO: 754117 - DNA, 25 bp, Mus musculus
taagtcagagagtacgcaccccggt

SEQ ID NO: 754118 - DNA, 25 bp, Mus musculus
taagtcagcatccaattgcccgtgt

SEQ ID NO: 754119 - DNA, 25 bp, Mus musculus
taagtcagcatcgaattgcccgtgt

SEQ ID NO: 754120 - DNA, 25 bp, Mus musculus
taagtcaggatcatcctccatagac

SEQ ID NO: 754121 - DNA, 25 bp, Mus musculus
taagtcaggatcttcctccatagac

SEQ ID NO: 754122 - DNA, 25 bp, Mus musculus
taagtcagggacaggccatccaact

SEQ ID NO: 754123 - DNA, 25 bp, Mus musculus
taagtcagggactggccatccaact

SEQ ID NO: 754124 - DNA, 25 bp, Mus musculus
taagtcagggcacatggtcatccaa

SEQ ID NO: 754125 - DNA, 25 bp, Mus musculus
taagtcagggcagatggtcatccaa

SEQ ID NO: 754126 - DNA, 25 bp, Mus musculus
taagtcagggccaggagtcccaaaa

SEQ ID NO: 754127 - DNA, 25 bp, Mus musculus
taagtcagggcctggagtcccaaaa

SEQ ID NO: 754128 - DNA, 25 bp, Mus musculus
taagtcagtcagcaagccgcacctc

SEQ ID NO: 754129 - DNA, 25 bp, Mus musculus
taagtcagtcaggaagccgcacctc

SEQ ID NO: 754130 - DNA, 25 bp, Mus musculus
taagtcagtcccaatgacctctagc

SEQ ID NO: 754131 - DNA, 25 bp, Mus musculus
taagtcagtccctatgacctctagc

SEQ ID NO: 754132 - DNA, 25 bp, Mus musculus
taagtcatacctccatcttcaattg

SEQ ID NO: 754133 - DNA, 25 bp, Mus musculus
taagtcatacctgcatcttcaattg

SEQ ID NO: 754134 - DNA, 25 bp, Mus musculus
taagtcatccccatgcttggagaac

SEQ ID NO: 754135 - DNA, 25 bp, Mus musculus
taagtcatccccttgcttggagaac

SEQ ID NO: 754136 - DNA, 25 bp, Mus musculus
taagtcatcgcaataaagccaacat

SEQ ID NO: 754137 - DNA, 25 bp, Mus musculus
taagtcatcgcattaaagccaacat

SEQ ID NO: 754138 - DNA, 25 bp, Mus musculus
taagtcatcgcccatgtcctgacca

SEQ ID NO: 754139 - DNA, 25 bp, Mus musculus
taagtcatcgccgatgtcctgacca

SEQ ID NO: 754140 - DNA, 25 bp, Mus musculus
taagtcatgctgcttggccattatc

SEQ ID NO: 754141 - DNA, 25 bp, Mus musculus
taagtcatgctggttggccattatc

SEQ ID NO: 754142 - DNA, 25 bp, Mus musculus
taagtcatggccacttttgatagat

SEQ ID NO: 754143 - DNA, 25 bp, Mus musculus
taagtcatggcctcttttgatagat

SEQ ID NO: 754144 - DNA, 25 bp, Mus musculus
taagtcattaatacctaactagaat

SEQ ID NO: 754145 - DNA, 25 bp, Mus musculus
taagtcattaattcctaactagaat

SEQ ID NO: 754146 - DNA, 25 bp, Mus musculus
taagtcattcttagcacatttgcta

SEQ ID NO: 754147 - DNA, 25 bp, Mus musculus
taagtcattctttgcacatttgcta

SEQ ID NO: 754148 - DNA, 25 bp, Mus musculus
taagtcattgcgaatttcctgcctg

SEQ ID NO: 754149 - DNA, 25 bp, Mus musculus
taagtcattgcgtatttcctgcctg

SEQ ID NO: 754150 - DNA, 25 bp, Mus musculus
taagtcatttatcttcctgtgtccc

SEQ ID NO: 754151 - DNA, 25 bp, Mus musculus
taagtcatttatgttcctgtgtccc

SEQ ID NO: 754152 - DNA, 25 bp, Mus musculus
taagtcattttgctgctgcttatac

SEQ ID NO: 754153 - DNA, 25 bp, Mus musculus
taagtcattttggtgctgcttatac

SEQ ID NO: 754154 - DNA, 25 bp, Mus musculus
taagtccagaaaactgccaccttct

SEQ ID NO: 754155 - DNA, 25 bp, Mus musculus
taagtccagaaatctgccaccttct

SEQ ID NO: 754156 - DNA, 25 bp, Mus musculus
taagtccagcagagcctccctaata

SEQ ID NO: 754157 - DNA, 25 bp, Mus musculus
taagtccagcagtgcctccctaata

SEQ ID NO: 754158 - DNA, 25 bp, Mus musculus
taagtccagcatctgtgcctggagg

SEQ ID NO: 754159 - DNA, 25 bp, Mus musculus
taagtccagcatgtgtgcctggagg

SEQ ID NO: 754160 - DNA, 25 bp, Mus musculus
taagtccaggtacctcttgcaactc

SEQ ID NO: 754161 - DNA, 25 bp, Mus musculus
taagtccaggtagctcttgcaactc

SEQ ID NO: 754162 - DNA, 25 bp, Mus musculus
taagtcccacccaaagaaatctctt

SEQ ID NO: 754163 - DNA, 25 bp, Mus musculus
taagtcccaccctaagaaatctctt

SEQ ID NO: 754164 - DNA, 25 bp, Mus musculus
taagtcccagctcaacagctacttc

SEQ ID NO: 754165 - DNA, 25 bp, Mus musculus
taagtcccagctgaacagctacttc

SEQ ID NO: 754166 - DNA, 25 bp, Mus musculus
taagtcccatacagcctcgtgaatt

SEQ ID NO: 754167 - DNA, 25 bp, Mus musculus
taagtcccatactgcctcgtgaatt

SEQ ID NO: 754168 - DNA, 25 bp, Mus musculus
taagtccccacactttgaggtgcca

SEQ ID NO: 754169 - DNA, 25 bp, Mus musculus
taagtccccacagtttgaggtgcca

SEQ ID NO: 754170 - DNA, 25 bp, Mus musculus
taagtccccgagcaggctccgtgct

SEQ ID NO: 754171 - DNA, 25 bp, Mus musculus
taagtccccgaggaggctccgtgct

SEQ ID NO: 754172 - DNA, 25 bp, Mus musculus
taagtccccgccattggaaacagtg

SEQ ID NO: 754173 - DNA, 25 bp, Mus musculus
taagtccccgcctttggaaacagtg

SEQ ID NO: 754174 - DNA, 25 bp, Mus musculus
taagtccccttgctttgagcatcct

SEQ ID NO: 754175 - DNA, 25 bp, Mus musculus
taagtccccttggtttgagcatcct

SEQ ID NO: 754176 - DNA, 25 bp, Mus musculus
taagtcccgagaagaagttaatgcg

SEQ ID NO: 754177 - DNA, 25 bp, Mus musculus
taagtcccgagatgaagttaatgcg

SEQ ID NO: 754178 - DNA, 25 bp, Mus musculus
taagtcccgggacggctatggatct

SEQ ID NO: 754179 - DNA, 25 bp, Mus musculus
taagtcccgggagggctatggatct

SEQ ID NO: 754180 - DNA, 25 bp, Mus musculus
taagtcccgggtctgaagttggcca

SEQ ID NO: 754181 - DNA, 25 bp, Mus musculus
taagtcccgggtgtgaagttggcca

SEQ ID NO: 754182 - DNA, 25 bp, Mus musculus
taagtccctagactacacaggccac

SEQ ID NO: 754183 - DNA, 25 bp, Mus musculus
taagtccctagagtacacaggccac

SEQ ID NO: 754184 - DNA, 25 bp, Mus musculus
taagtccctgttctctgaagcaagg

SEQ ID NO: 754185 - DNA, 25 bp, Mus musculus
taagtccctgttgtctgaagcaagg

SEQ ID NO: 754186 - DNA, 25 bp, Mus musculus
taagtccctttgctttgatggcctc

SEQ ID NO: 754187 - DNA, 25 bp, Mus musculus
taagtccctttggtttgatggcctc

SEQ ID NO: 754188 - DNA, 25 bp, Mus musculus
taagtccggcgccggttaagccgct

SEQ ID NO: 754189 - DNA, 25 bp, Mus musculus
taagtccggcgcgggttaagccgct

SEQ ID NO: 754190 - DNA, 25 bp, Mus musculus
taagtcctacttactgttccaaact

SEQ ID NO: 754191 - DNA, 25 bp, Mus musculus
taagtcctactttctgttccaaact

SEQ ID NO: 754192 - DNA, 25 bp, Mus musculus
taagtcctagtcagtttggtggcat

SEQ ID NO: 754193 - DNA, 25 bp, Mus musculus
taagtcctagtctgtttggtggcat

SEQ ID NO: 754194 - DNA, 25 bp, Mus musculus
taagtcctatgaacctgacctcttt

SEQ ID NO: 754195 - DNA, 25 bp, Mus musculus
taagtcctatgatcctgacctcttt

SEQ ID NO: 754196 - DNA, 25 bp, Mus musculus
taagtcctgatgaggcacttgttat

SEQ ID NO: 754197 - DNA, 25 bp, Mus musculus
taagtcctgatgtggcacttgttat

SEQ ID NO: 754198 - DNA, 25 bp, Mus musculus
taagtcctggatctataagtgcccc

SEQ ID NO: 754199 - DNA, 25 bp, Mus musculus
taagtcctggatgtataagtgcccc

SEQ ID NO: 754200 - DNA, 25 bp, Mus musculus
taagtccttcccaagtggcccagat

SEQ ID NO: 754201 - DNA, 25 bp, Mus musculus
taagtccttccctagtggcccagat

SEQ ID NO: 754202 - DNA, 25 bp, Mus musculus
taagtccttcttaattcaggcccct

SEQ ID NO: 754203 - DNA, 25 bp, Mus musculus
taagtccttctttattcaggcccct

SEQ ID NO: 754204 - DNA, 25 bp, Mus musculus
taagtcgacataatcccggctaggt

SEQ ID NO: 754205 - DNA, 25 bp, Mus musculus
taagtcgacatattcccggctaggt

SEQ ID NO: 754206 - DNA, 25 bp, Mus musculus
taagtcgaggctatggcgattcctt

SEQ ID NO: 754207 - DNA, 25 bp, Mus musculus
taagtcgaggctttggcgattcctt

SEQ ID NO: 754208 - DNA, 25 bp, Mus musculus
taagtcgataggatctctgcatagc

SEQ ID NO: 754209 - DNA, 25 bp, Mus musculus
taagtcgataggttctctgcatagc

SEQ ID NO: 754210 - DNA, 25 bp, Mus musculus
taagtcgatgtgagatgtggataat

SEQ ID NO: 754211 - DNA, 25 bp, Mus musculus
taagtcgatgtgtgatgtggataat

SEQ ID NO: 754212 - DNA, 25 bp, Mus musculus
taagtcgcagagcttcaagccaccc

SEQ ID NO: 754213 - DNA, 25 bp, Mus musculus
taagtcgcagaggttcaagccaccc

SEQ ID NO: 754214 - DNA, 25 bp, Mus musculus
taagtcgctgcaactccattagagt

SEQ ID NO: 754215 - DNA, 25 bp, Mus musculus
taagtcgctgcatctccattagagt

SEQ ID NO: 754216 - DNA, 25 bp, Mus musculus
taagtcggataaatgagattctaca

SEQ ID NO: 754217 - DNA, 25 bp, Mus musculus
taagtcggataattgagattctaca

SEQ ID NO: 754218 - DNA, 25 bp, Mus musculus
taagtcggatgacccggtctgtgcc

SEQ ID NO: 754219 - DNA, 25 bp, Mus musculus
taagtcggatgagccggtctgtgcc

SEQ ID NO: 754220 - DNA, 25 bp, Mus musculus
taagtcgtaggcaccagtgatgagt

SEQ ID NO: 754221 - DNA, 25 bp, Mus musculus
taagtcgtaggctccagtgatgagt

SEQ ID NO: 754222 - DNA, 25 bp, Mus musculus
taagtcgtgccaagaaatggtcaga

SEQ ID NO: 754223 - DNA, 25 bp, Mus musculus
taagtcgtgccatgaaatggtcaga

SEQ ID NO: 754224 - DNA, 25 bp, Mus musculus
taagtctacatgaacagccatccac

SEQ ID NO: 754225 - DNA, 25 bp, Mus musculus
taagtctacatgtacagccatccac

SEQ ID NO: 754226 - DNA, 25 bp, Mus musculus
taagtctacattcatctgcaagagg

SEQ ID NO: 754227 - DNA, 25 bp, Mus musculus
taagtctacattgatctgcaagagg

SEQ ID NO: 754228 - DNA, 25 bp, Mus musculus
taagtctagaggagccagtccccag

SEQ ID NO: 754229 - DNA, 25 bp, Mus musculus
taagtctagaggtgccagtccccag

SEQ ID NO: 754230 - DNA, 25 bp, Mus musculus
taagtctaggcactcctgaagctca

SEQ ID NO: 754231 - DNA, 25 bp, Mus musculus
taagtctaggcagtcctgaagctca

SEQ ID NO: 754232 - DNA, 25 bp, Mus musculus
taagtctaggccagtcctatgcgga

SEQ ID NO: 754233 - DNA, 25 bp, Mus musculus
taagtctaggcctgtcctatgcgga

SEQ ID NO: 754234 - DNA, 25 bp, Mus musculus
taagtctaggcgcaggtgccatccc

SEQ ID NO: 754235 - DNA, 25 bp, Mus musculus
taagtctaggcggaggtgccatccc

SEQ ID NO: 754236 - DNA, 25 bp, Mus musculus
taagtctatgtccagagcctctagc

SEQ ID NO: 754237 - DNA, 25 bp, Mus musculus
taagtctatgtcgagagcctctagc

SEQ ID NO: 754238 - DNA, 25 bp, Mus musculus
taagtctcacacaacatcctgaaat

SEQ ID NO: 754239 - DNA, 25 bp, Mus musculus
taagtctcacactacatcctgaaat

SEQ ID NO: 754240 - DNA, 25 bp, Mus musculus
taagtctcagttcttgggccagatc

SEQ ID NO: 754241 - DNA, 25 bp, Mus musculus
taagtctcagttgttgggccagatc

SEQ ID NO: 754242 - DNA, 25 bp, Mus musculus
taagtctccagtagcagtccccagt

SEQ ID NO: 754243 - DNA, 25 bp, Mus musculus
taagtctccagttgcagtccccagt

SEQ ID NO: 754244 - DNA, 25 bp, Mus musculus
taagtctccggaacatttaccagat

SEQ ID NO: 754245 - DNA, 25 bp, Mus musculus
taagtctccggatcatttaccagat

SEQ ID NO: 754246 - DNA, 25 bp, Mus musculus
taagtctcctgtctactttctgtgt

SEQ ID NO: 754247 - DNA, 25 bp, Mus musculus
taagtctcctgtgtactttctgtgt

SEQ ID NO: 754248 - DNA, 25 bp, Mus musculus
taagtctctaatcattgtgcacccc

SEQ ID NO: 754249 - DNA, 25 bp, Mus musculus
taagtctctaatgattgtgcacccc

SEQ ID NO: 754250 - DNA, 25 bp, Mus musculus
taagtctctccgacagaagctgcga

SEQ ID NO: 754251 - DNA, 25 bp, Mus musculus
taagtctctccgtcagaagctgcga

SEQ ID NO: 754252 - DNA, 25 bp, Mus musculus
taagtctctgaaatccagtgtgtgt

SEQ ID NO: 754253 - DNA, 25 bp, Mus musculus
taagtctctgaattccagtgtgtgt

SEQ ID NO: 754254 - DNA, 25 bp, Mus musculus
taagtctgaagtccctagtcaaaaa

SEQ ID NO: 754255 - DNA, 25 bp, Mus musculus
taagtctgaagtgcctagtcaaaaa

SEQ ID NO: 754256 - DNA, 25 bp, Mus musculus
taagtctgagtgagccttgcctggg

SEQ ID NO: 754257 - DNA, 25 bp, Mus musculus
taagtctgagtgtgccttgcctggg

SEQ ID NO: 754258 - DNA, 25 bp, Mus musculus
taagtctgtctccaacgttctcaga

SEQ ID NO: 754259 - DNA, 25 bp, Mus musculus
taagtctgtctcgaacgttctcaga

SEQ ID NO: 754260 - DNA, 25 bp, Mus musculus
taagtctgttcaaattccctggcta

SEQ ID NO: 754261 - DNA, 25 bp, Mus musculus
taagtctgttcatattccctggcta

SEQ ID NO: 754262 - DNA, 25 bp, Mus musculus
taagtcttaagtccaaggtccaaag

SEQ ID NO: 754263 - DNA, 25 bp, Mus musculus
taagtcttaagtgcaaggtccaaag

SEQ ID NO: 754264 - DNA, 25 bp, Mus musculus
taagtcttactgactctcacgggag

SEQ ID NO: 754265 - DNA, 25 bp, Mus musculus
taagtcttactgtctctcacgggag

SEQ ID NO: 754266 - DNA, 25 bp, Mus musculus
taagtcttagccctctgagtactgg

SEQ ID NO: 754267 - DNA, 25 bp, Mus musculus
taagtcttagccgtctgagtactgg

SEQ ID NO: 754268 - DNA, 25 bp, Mus musculus
taagtcttagtgacgacacccagac

SEQ ID NO: 754269 - DNA, 25 bp, Mus musculus
taagtcttagtgtcgacacccagac

SEQ ID NO: 754270 - DNA, 25 bp, Mus musculus
taagtcttcaggctatgacaatcat

SEQ ID NO: 754271 - DNA, 25 bp, Mus musculus
taagtcttcagggtatgacaatcat

SEQ ID NO: 754272 - DNA, 25 bp, Mus musculus
taagtcttccaaaattgttatttta

SEQ ID NO: 754273 - DNA, 25 bp, Mus musculus
taagtcttccaatattgttatttta

SEQ ID NO: 754274 - DNA, 25 bp, Mus musculus
taagtcttccacattttataggact

SEQ ID NO: 754275 - DNA, 25 bp, Mus musculus
taagtcttccactttttataggact

SEQ ID NO: 754276 - DNA, 25 bp, Mus musculus
taagtcttcctgaattctcttgtca

SEQ ID NO: 754277 - DNA, 25 bp, Mus musculus
taagtcttcctgaggtttccatagc

SEQ ID NO: 754278 - DNA, 25 bp, Mus musculus
taagtcttcctgtattctcttgtca

SEQ ID NO: 754279 - DNA, 25 bp, Mus musculus
taagtcttcctgtggtttccatagc

SEQ ID NO: 754280 - DNA, 25 bp, Mus musculus
taagtcttccttaagccattgtcct

SEQ ID NO: 754281 - DNA, 25 bp, Mus musculus
taagtcttcctttagccattgtcct

SEQ ID NO: 754282 - DNA, 25 bp, Mus musculus
taagtcttcttcactgtcaggctct

SEQ ID NO: 754283 - DNA, 25 bp, Mus musculus
taagtcttcttctctgtcaggctct

SEQ ID NO: 754284 - DNA, 25 bp, Mus musculus
taagtcttgcagatagcttgctggg

SEQ ID NO: 754285 - DNA, 25 bp, Mus musculus
taagtcttgcagttagcttgctggg

SEQ ID NO: 754286 - DNA, 25 bp, Mus musculus
taagtcttgtcacttccattcccat

SEQ ID NO: 754287 - DNA, 25 bp, Mus musculus
taagtcttgtcagttccattcccat

SEQ ID NO: 754288 - DNA, 25 bp, Mus musculus
taagtcttgttccttgtccatggaa

SEQ ID NO: 754289 - DNA, 25 bp, Mus musculus
taagtcttgttcgttgtccatggaa

SEQ ID NO: 754290 - DNA, 25 bp, Mus musculus
taagtctttaccatatcacggttag

SEQ ID NO: 754291 - DNA, 25 bp, Mus musculus
taagtctttaccttatcacggttag

SEQ ID NO: 754292 - DNA, 25 bp, Mus musculus
taagtctttatcatgcaaatatgaa

SEQ ID NO: 754293 - DNA, 25 bp, Mus musculus
taagtctttatcttgcaaatatgaa

SEQ ID NO: 754294 - DNA, 25 bp, Mus musculus
taagtctttctccatggccagtggc

SEQ ID NO: 754295 - DNA, 25 bp, Mus musculus
taagtctttctcgatggccagtggc

SEQ ID NO: 754296 - DNA, 25 bp, Mus musculus
taagtcttttatagaacaattgtcc

SEQ ID NO: 754297 - DNA, 25 bp, Mus musculus
taagtcttttattgaacaattgtcc

SEQ ID NO: 754298 - DNA, 25 bp, Mus musculus
taagtcttttgcactgggtatctac

SEQ ID NO: 754299 - DNA, 25 bp, Mus musculus
taagtcttttgctctgggtatctac

SEQ ID NO: 754300 - DNA, 25 bp, Mus musculus
taagtgaaacttatgtccctgagag

SEQ ID NO: 754301 - DNA, 25 bp, Mus musculus
taagtgaaacttttgtccctgagag

SEQ ID NO: 754302 - DNA, 25 bp, Mus musculus
taagtgaaatacatgtacttccctc

SEQ ID NO: 754303 - DNA, 25 bp, Mus musculus
taagtgaaatacttgtacttccctc

SEQ ID NO: 754304 - DNA, 25 bp, Mus musculus
taagtgaaatagagcccctgataat

SEQ ID NO: 754305 - DNA, 25 bp, Mus musculus
taagtgaaatagtgcccctgataat

SEQ ID NO: 754306 - DNA, 25 bp, Mus musculus
taagtgaaattaacttcctgtgctt

SEQ ID NO: 754307 - DNA, 25 bp, Mus musculus
taagtgaaattatcttcctgtgctt

SEQ ID NO: 754308 - DNA, 25 bp, Mus musculus
taagtgaacagtaacttccatttta

SEQ ID NO: 754309 - DNA, 25 bp, Mus musculus
taagtgaacagttacttccatttta

SEQ ID NO: 754310 - DNA, 25 bp, Mus musculus
taagtgaagcccacttctgagccat

SEQ ID NO: 754311 - DNA, 25 bp, Mus musculus
taagtgaagccctcttctgagccat

SEQ ID NO: 754312 - DNA, 25 bp, Mus musculus
taagtgacagttcccttgttccttt

SEQ ID NO: 754313 - DNA, 25 bp, Mus musculus
taagtgacagttgccttgttccttt

SEQ ID NO: 754314 - DNA, 25 bp, Mus musculus
taagtgaccacaaaacccaagccag

SEQ ID NO: 754315 - DNA, 25 bp, Mus musculus
taagtgaccacataacccaagccag

SEQ ID NO: 754316 - DNA, 25 bp, Mus musculus
taagtgaccacgaacgtgttcccta

SEQ ID NO: 754317 - DNA, 25 bp, Mus musculus
taagtgaccacgtacgtgttcccta

SEQ ID NO: 754318 - DNA, 25 bp, Mus musculus
taagtgacctcccagagtggctcat

SEQ ID NO: 754319 - DNA, 25 bp, Mus musculus
taagtgacctccgagagtggctcat

SEQ ID NO: 754320 - DNA, 25 bp, Mus musculus
taagtgacgcttatgcaggtgcagg

SEQ ID NO: 754321 - DNA, 25 bp, Mus musculus
taagtgacgcttttgcaggtgcagg

SEQ ID NO: 754322 - DNA, 25 bp, Mus musculus
taagtgactcctcaaatcctactac

SEQ ID NO: 754323 - DNA, 25 bp, Mus musculus
taagtgactcctgaaatcctactac

SEQ ID NO: 754324 - DNA, 25 bp, Mus musculus
taagtgagaagaacacgccacccct

SEQ ID NO: 754325 - DNA, 25 bp, Mus musculus
taagtgagaagatcacgccacccct

SEQ ID NO: 754326 - DNA, 25 bp, Mus musculus
taagtgagagcgctcccagcagaga

SEQ ID NO: 754327 - DNA, 25 bp, Mus musculus
taagtgagagcggtcccagcagaga

SEQ ID NO: 754328 - DNA, 25 bp, Mus musculus
taagtgagctgcctatgcaagtcag

SEQ ID NO: 754329 - DNA, 25 bp, Mus musculus
taagtgagctgcgtatgcaagtcag

SEQ ID NO: 754330 - DNA, 25 bp, Mus musculus
taagtgaggctgcactcaaatgcac

SEQ ID NO: 754331 - DNA, 25 bp, Mus musculus
taagtgaggctggactcaaatgcac

SEQ ID NO: 754332 - DNA, 25 bp, Mus musculus
taagtgagggatatactccgtggaa

SEQ ID NO: 754333 - DNA, 25 bp, Mus musculus
taagtgagggatttactccgtggaa

SEQ ID NO: 754334 - DNA, 25 bp, Mus musculus
taagtgagggccatgcctgactgcg

SEQ ID NO: 754335 - DNA, 25 bp, Mus musculus
taagtgagggccttgcctgactgcg

SEQ ID NO: 754336 - DNA, 25 bp, Mus musculus
taagtgagggtcacctgctactgcg

SEQ ID NO: 754337 - DNA, 25 bp, Mus musculus
taagtgagggtctcctgctactgcg

SEQ ID NO: 754338 - DNA, 25 bp, Mus musculus
taagtgatgcgtatgcaccttttgt

SEQ ID NO: 754339 - DNA, 25 bp, Mus musculus
taagtgatgcgtttgcaccttttgt

SEQ ID NO: 754340 - DNA, 25 bp, Mus musculus
taagtgatgtcaagactcctgtcat

SEQ ID NO: 754341 - DNA, 25 bp, Mus musculus
taagtgatgtcatgactcctgtcat

SEQ ID NO: 754342 - DNA, 25 bp, Mus musculus
taagtgcaagtacgccttctgtcac

SEQ ID NO: 754343 - DNA, 25 bp, Mus musculus
taagtgcaagtaggccttctgtcac

SEQ ID NO: 754344 - DNA, 25 bp, Mus musculus
taagtgcacggcacagtagctacct

SEQ ID NO: 754345 - DNA, 25 bp, Mus musculus
taagtgcacggctcagtagctacct

SEQ ID NO: 754346 - DNA, 25 bp, Mus musculus
taagtgcaggaccttccagaacctt

SEQ ID NO: 754347 - DNA, 25 bp, Mus musculus
taagtgcaggacgttccagaacctt

SEQ ID NO: 754348 - DNA, 25 bp, Mus musculus
taagtgcagttgagcccgattccct

SEQ ID NO: 754349 - DNA, 25 bp, Mus musculus
taagtgcagttgtgcccgattccct

SEQ ID NO: 754350 - DNA, 25 bp, Mus musculus
taagtgcatgcactccatgtccatc

SEQ ID NO: 754351 - DNA, 25 bp, Mus musculus
taagtgcatgcagtccatgtccatc

SEQ ID NO: 754352 - DNA, 25 bp, Mus musculus
taagtgccacacaactgacaaggag

SEQ ID NO: 754353 - DNA, 25 bp, Mus musculus
taagtgccacactactgacaaggag

SEQ ID NO: 754354 - DNA, 25 bp, Mus musculus
taagtgccagccagagaaccttact

SEQ ID NO: 754355 - DNA, 25 bp, Mus musculus
taagtgccagcctgagaaccttact

SEQ ID NO: 754356 - DNA, 25 bp, Mus musculus
taagtgccagctccctttgaggcaa

SEQ ID NO: 754357 - DNA, 25 bp, Mus musculus
taagtgccagctgcctttgaggcaa

SEQ ID NO: 754358 - DNA, 25 bp, Mus musculus
taagtgcccagtatttatttctagt

SEQ ID NO: 754359 - DNA, 25 bp, Mus musculus
taagtgcccagtttttatttctagt

SEQ ID NO: 754360 - DNA, 25 bp, Mus musculus
taagtgcccatgactctcatagaat

SEQ ID NO: 754361 - DNA, 25 bp, Mus musculus
taagtgcccatgtctctcatagaat

SEQ ID NO: 754362 - DNA, 25 bp, Mus musculus
taagtgcctcctactggcagcaagc

SEQ ID NO: 754363 - DNA, 25 bp, Mus musculus
taagtgcctccttctggcagcaagc

SEQ ID NO: 754364 - DNA, 25 bp, Mus musculus
taagtgcctgtgctccagcatcatc

SEQ ID NO: 754365 - DNA, 25 bp, Mus musculus
taagtgcctgtggtccagcatcatc

SEQ ID NO: 754366 - DNA, 25 bp, Mus musculus
taagtgcgcgatcggcccagtgcat

SEQ ID NO: 754367 - DNA, 25 bp, Mus musculus
taagtgcgcgatgggcccagtgcat

SEQ ID NO: 754368 - DNA, 25 bp, Mus musculus
taagtgcgggtcataagcttgcgtt

SEQ ID NO: 754369 - DNA, 25 bp, Mus musculus
taagtgcgggtcttaagcttgcgtt

SEQ ID NO: 754370 - DNA, 25 bp, Mus musculus
taagtgctagttcctctcacagaag

SEQ ID NO: 754371 - DNA, 25 bp, Mus musculus
taagtgctagttgctctcacagaag

SEQ ID NO: 754372 - DNA, 25 bp, Mus musculus
taagtgctcaaacatttcctccatg

SEQ ID NO: 754373 - DNA, 25 bp, Mus musculus
taagtgctcaaagatttcctccatg

SEQ ID NO: 754374 - DNA, 25 bp, Mus musculus
taagtgctccagactcaaactacca

SEQ ID NO: 754375 - DNA, 25 bp, Mus musculus
taagtgctccagtctcaaactacca

SEQ ID NO: 754376 - DNA, 25 bp, Mus musculus
taagtgctccccatgaggcgagcca

SEQ ID NO: 754377 - DNA, 25 bp, Mus musculus
taagtgctccccttgaggcgagcca

SEQ ID NO: 754378 - DNA, 25 bp, Mus musculus
taagtgctccttcgatctgggccac

SEQ ID NO: 754379 - DNA, 25 bp, Mus musculus
taagtgctccttggatctgggccac

SEQ ID NO: 754380 - DNA, 25 bp, Mus musculus
taagtgctctgccatagacccacag

SEQ ID NO: 754381 - DNA, 25 bp, Mus musculus
taagtgctctgcgatagacccacag

SEQ ID NO: 754382 - DNA, 25 bp, Mus musculus
taagtgctgactcgaaatgctattt

SEQ ID NO: 754383 - DNA, 25 bp, Mus musculus
taagtgctgactggaaatgctattt

SEQ ID NO: 754384 - DNA, 25 bp, Mus musculus
taagtgcttcttcaccattagagat

SEQ ID NO: 754385 - DNA, 25 bp, Mus musculus
taagtgcttcttgaccattagagat

SEQ ID NO: 754386 - DNA, 25 bp, Mus musculus
taagtgcttgcaatggctccagaag

SEQ ID NO: 754387 - DNA, 25 bp, Mus musculus
taagtgcttgcattggctccagaag

SEQ ID NO: 754388 - DNA, 25 bp, Mus musculus
taagtgctttgcagggctcctcaac

SEQ ID NO: 754389 - DNA, 25 bp, Mus musculus
taagtgctttgctgggctcctcaac

SEQ ID NO: 754390 - DNA, 25 bp, Mus musculus
taagtgctttgtagtgtaatgagta

SEQ ID NO: 754391 - DNA, 25 bp, Mus musculus
taagtgctttgttgtgtaatgagta

SEQ ID NO: 754392 - DNA, 25 bp, Mus musculus
taagtggaagttcactgttgtctct

SEQ ID NO: 754393 - DNA, 25 bp, Mus musculus
taagtggaagttgactgttgtctct

SEQ ID NO: 754394 - DNA, 25 bp, Mus musculus
taagtggaccgaactttgactacaa

SEQ ID NO: 754395 - DNA, 25 bp, Mus musculus
taagtggaccgatctttgactacaa

SEQ ID NO: 754396 - DNA, 25 bp, Mus musculus
taagtggactggaagcacccgtgtc

SEQ ID NO: 754397 - DNA, 25 bp, Mus musculus
taagtggactggtagcacccgtgtc

SEQ ID NO: 754398 - DNA, 25 bp, Mus musculus
taagtggagctaaactaccagccca

SEQ ID NO: 754399 - DNA, 25 bp, Mus musculus
taagtggagctatactaccagccca

SEQ ID NO: 754400 - DNA, 25 bp, Mus musculus
taagtggagtctcatcctctctcct

SEQ ID NO: 754401 - DNA, 25 bp, Mus musculus
taagtggagtctgatcctctctcct

SEQ ID NO: 754402 - DNA, 25 bp, Mus musculus
taagtggatcaaagctactgaccct

SEQ ID NO: 754403 - DNA, 25 bp, Mus musculus
taagtggatcaatgctactgaccct

SEQ ID NO: 754404 - DNA, 25 bp, Mus musculus
taagtggatcttccaggtaaacccg

SEQ ID NO: 754405 - DNA, 25 bp, Mus musculus
taagtggatcttgcaggtaaacccg

SEQ ID NO: 754406 - DNA, 25 bp, Mus musculus
taagtggcaaggatgactcccaatg

SEQ ID NO: 754407 - DNA, 25 bp, Mus musculus
taagtggcaaggttgactcccaatg

SEQ ID NO: 754408 - DNA, 25 bp, Mus musculus
taagtggcacagaaggctgcccatg

SEQ ID NO: 754409 - DNA, 25 bp, Mus musculus
taagtggcacagtaggctgcccatg

SEQ ID NO: 754410 - DNA, 25 bp, Mus musculus
taagtggcagagacaccagaacacc

SEQ ID NO: 754411 - DNA, 25 bp, Mus musculus
taagtggcagagtcaccagaacacc

SEQ ID NO: 754412 - DNA, 25 bp, Mus musculus
taagtggcagccatgctccacggta

SEQ ID NO: 754413 - DNA, 25 bp, Mus musculus
taagtggcagccttgctccacggta

SEQ ID NO: 754414 - DNA, 25 bp, Mus musculus
taagtggcatgcacttctaagtcgt

SEQ ID NO: 754415 - DNA, 25 bp, Mus musculus
taagtggcatgctcttctaagtcgt

SEQ ID NO: 754416 - DNA, 25 bp, Mus musculus
taagtggcccagctgattaatatac

SEQ ID NO: 754417 - DNA, 25 bp, Mus musculus
taagtggcccaggtgattaatatac

SEQ ID NO: 754418 - DNA, 25 bp, Mus musculus
taagtggccctgatgcgagtgaact

SEQ ID NO: 754419 - DNA, 25 bp, Mus musculus
taagtggccctgttgcgagtgaact

SEQ ID NO: 754420 - DNA, 25 bp, Mus musculus
taagtggcgctcagttctgctaatt

SEQ ID NO: 754421 - DNA, 25 bp, Mus musculus
taagtggcgctctgttctgctaatt

SEQ ID NO: 754422 - DNA, 25 bp, Mus musculus
taagtggcgctgactgcttgggtcc

SEQ ID NO: 754423 - DNA, 25 bp, Mus musculus
taagtggcgctgtctgcttgggtcc

SEQ ID NO: 754424 - DNA, 25 bp, Mus musculus
taagtggctagaacaatcagtgcat

SEQ ID NO: 754425 - DNA, 25 bp, Mus musculus
taagtggctagatcaatcagtgcat

SEQ ID NO: 754426 - DNA, 25 bp, Mus musculus
taagtggctgtaaggctgcttggca

SEQ ID NO: 754427 - DNA, 25 bp, Mus musculus
taagtggctgtatggctgcttggca

SEQ ID NO: 754428 - DNA, 25 bp, Mus musculus
taagtggctgtgcacagcagctctc

SEQ ID NO: 754429 - DNA, 25 bp, Mus musculus
taagtggctgtggacagcagctctc

SEQ ID NO: 754430 - DNA, 25 bp, Mus musculus
taagtggcttttaatacaacccctg

SEQ ID NO: 754431 - DNA, 25 bp, Mus musculus
taagtggctttttatacaacccctg

SEQ ID NO: 754432 - DNA, 25 bp, Mus musculus
taagtgggaaatcaagccggcagtc

SEQ ID NO: 754433 - DNA, 25 bp, Mus musculus
taagtgggaaatgaagccggcagtc

SEQ ID NO: 754434 - DNA, 25 bp, Mus musculus
taagtgggaccaaagctgtctgcaa

SEQ ID NO: 754435 - DNA, 25 bp, Mus musculus
taagtgggaccatagctgtctgcaa

SEQ ID NO: 754436 - DNA, 25 bp, Mus musculus
taagtgggatcaccaccacgtaaga

SEQ ID NO: 754437 - DNA, 25 bp, Mus musculus
taagtgggatcagcaccacgtaaga

SEQ ID NO: 754438 - DNA, 25 bp, Mus musculus
taagtgggatccaatgtaaatttct

SEQ ID NO: 754439 - DNA, 25 bp, Mus musculus
taagtgggatcctatgtaaatttct

SEQ ID NO: 754440 - DNA, 25 bp, Mus musculus
taagtgggtcagagccctattctcc

SEQ ID NO: 754441 - DNA, 25 bp, Mus musculus
taagtgggtcagtgccctattctcc

SEQ ID NO: 754442 - DNA, 25 bp, Mus musculus
taagtgggtctacccagaggccgaa

SEQ ID NO: 754443 - DNA, 25 bp, Mus musculus
taagtgggtctagccagaggccgaa

SEQ ID NO: 754444 - DNA, 25 bp, Mus musculus
taagtggtcaagaagtgctcagcat

SEQ ID NO: 754445 - DNA, 25 bp, Mus musculus
taagtggtcaagtagtgctcagcat

SEQ ID NO: 754446 - DNA, 25 bp, Mus musculus
taagtggtccccagagtgccgctaa

SEQ ID NO: 754447 - DNA, 25 bp, Mus musculus
taagtggtcccctgagtgccgctaa

SEQ ID NO: 754448 - DNA, 25 bp, Mus musculus
taagtggtccttacctaaggaggat

SEQ ID NO: 754449 - DNA, 25 bp, Mus musculus
taagtggtcctttcctaaggaggat

SEQ ID NO: 754450 - DNA, 25 bp, Mus musculus
taagtggtgacaccaagcagccaac

SEQ ID NO: 754451 - DNA, 25 bp, Mus musculus
taagtggtgacagcaagcagccaac

SEQ ID NO: 754452 - DNA, 25 bp, Mus musculus
taagtggtgataaggcaccctctct

SEQ ID NO: 754453 - DNA, 25 bp, Mus musculus
taagtggtgatatggcaccctctct

SEQ ID NO: 754454 - DNA, 25 bp, Mus musculus
taagtggtgcccacagaacctgtgc

SEQ ID NO: 754455 - DNA, 25 bp, Mus musculus
taagtggtgccctcagaacctgtgc

SEQ ID NO: 754456 - DNA, 25 bp, Mus musculus
taagtggtgtctcaaatctctctct

SEQ ID NO: 754457 - DNA, 25 bp, Mus musculus
taagtggtgtctgaaatctctctct

SEQ ID NO: 754458 - DNA, 25 bp, Mus musculus
taagtggttacacgaagtccctcac

SEQ ID NO: 754459 - DNA, 25 bp, Mus musculus
taagtggttacaggaagtccctcac

SEQ ID NO: 754460 - DNA, 25 bp, Mus musculus
taagtggttattcccaacttgtcca

SEQ ID NO: 754461 - DNA, 25 bp, Mus musculus
taagtggttattgccaacttgtcca

SEQ ID NO: 754462 - DNA, 25 bp, Mus musculus
taagtggttcctaaggtctccttgg

SEQ ID NO: 754463 - DNA, 25 bp, Mus musculus
taagtggttccttaggtctccttgg

SEQ ID NO: 754464 - DNA, 25 bp, Mus musculus
taagtggttctgcttgtctttcttt

SEQ ID NO: 754465 - DNA, 25 bp, Mus musculus
taagtggttctggttgtctttcttt

SEQ ID NO: 754466 - DNA, 25 bp, Mus musculus
taagtggttcttagctctgtagtga

SEQ ID NO: 754467 - DNA, 25 bp, Mus musculus
taagtggttctttgctctgtagtga

SEQ ID NO: 754468 - DNA, 25 bp, Mus musculus
taagtggttgccagagagtgctcga

SEQ ID NO: 754469 - DNA, 25 bp, Mus musculus
taagtggttgcctgagagtgctcga

SEQ ID NO: 754470 - DNA, 25 bp, Mus musculus
taagtggtttacaatctagccggga

SEQ ID NO: 754471 - DNA, 25 bp, Mus musculus
taagtggtttactatctagccggga

SEQ ID NO: 754472 - DNA, 25 bp, Mus musculus
taagtggttttcaataagtaatagt

SEQ ID NO: 754473 - DNA, 25 bp, Mus musculus
taagtggttttctataagtaatagt

SEQ ID NO: 754474 - DNA, 25 bp, Mus musculus
taagtggttttgagcgctcctaggc

SEQ ID NO: 754475 - DNA, 25 bp, Mus musculus
taagtggttttgtgcgctcctaggc

SEQ ID NO: 754476 - DNA, 25 bp, Mus musculus
taagtgtactacatcctgcttggaa

SEQ ID NO: 754477 - DNA, 25 bp, Mus musculus
taagtgtactacttcctgcttggaa

SEQ ID NO: 754478 - DNA, 25 bp, Mus musculus
taagtgtacttcagttgcaacctcc

SEQ ID NO: 754479 - DNA, 25 bp, Mus musculus
taagtgtacttctgttgcaacctcc

SEQ ID NO: 754480 - DNA, 25 bp, Mus musculus
taagtgtagagccaccctctaactg

SEQ ID NO: 754481 - DNA, 25 bp, Mus musculus
taagtgtagagcgaccctctaactg

SEQ ID NO: 754482 - DNA, 25 bp, Mus musculus
taagtgtagctcataaccctcatca

SEQ ID NO: 754483 - DNA, 25 bp, Mus musculus
taagtgtagctcttaaccctcatca

SEQ ID NO: 754484 - DNA, 25 bp, Mus musculus
taagtgtatagtcctttcttgctgg

SEQ ID NO: 754485 - DNA, 25 bp, Mus musculus
taagtgtatagtgctttcttgctgg

SEQ ID NO: 754486 - DNA, 25 bp, Mus musculus
taagtgtattctaactgggcccttt

SEQ ID NO: 754487 - DNA, 25 bp, Mus musculus
taagtgtattcttactgggcccttt

SEQ ID NO: 754488 - DNA, 25 bp, Mus musculus
taagtgtcattgacacaggtcatcc

SEQ ID NO: 754489 - DNA, 25 bp, Mus musculus
taagtgtcattgtcacaggtcatcc

SEQ ID NO: 754490 - DNA, 25 bp, Mus musculus
taagtgtccttaacagcccaggcca

SEQ ID NO: 754491 - DNA, 25 bp, Mus musculus
taagtgtccttatcagcccaggcca

SEQ ID NO: 754492 - DNA, 25 bp, Mus musculus
taagtgtcttccctggtcctgaatt

SEQ ID NO: 754493 - DNA, 25 bp, Mus musculus
taagtgtcttccgtggtcctgaatt

SEQ ID NO: 754494 - DNA, 25 bp, Mus musculus
taagtgtgaaccctgggttcctttg

SEQ ID NO: 754495 - DNA, 25 bp, Mus musculus
taagtgtgaaccgtgggttcctttg

SEQ ID NO: 754496 - DNA, 25 bp, Mus musculus
taagtgtgagaacgccttgttgcag

SEQ ID NO: 754497 - DNA, 25 bp, Mus musculus
taagtgtgagaaggccttgttgcag

SEQ ID NO: 754498 - DNA, 25 bp, Mus musculus
taagtgtgccacattagggcggcat

SEQ ID NO: 754499 - DNA, 25 bp, Mus musculus
taagtgtgccactttagggcggcat

SEQ ID NO: 754500 - DNA, 25 bp, Mus musculus
taagtgtgcttaaatactggtatgt

SEQ ID NO: 754501 - DNA, 25 bp, Mus musculus
taagtgtgcttactcttcctccaga

SEQ ID NO: 754502 - DNA, 25 bp, Mus musculus
taagtgtgcttagtcttcctccaga

SEQ ID NO: 754503 - DNA, 25 bp, Mus musculus
taagtgtgcttatatactggtatgt

SEQ ID NO: 754504 - DNA, 25 bp, Mus musculus
taagtgtggaccaaggcgttcccgg

SEQ ID NO: 754505 - DNA, 25 bp, Mus musculus
taagtgtggacctaggcgttcccgg

SEQ ID NO: 754506 - DNA, 25 bp, Mus musculus
taagtgtggtggaccaggccttcta

SEQ ID NO: 754507 - DNA, 25 bp, Mus musculus
taagtgtggtggtccaggccttcta

SEQ ID NO: 754508 - DNA, 25 bp, Mus musculus
taagtgtggtttcgcttcatacatg

SEQ ID NO: 754509 - DNA, 25 bp, Mus musculus
taagtgtggtttggcttcatacatg

SEQ ID NO: 754510 - DNA, 25 bp, Mus musculus
taagtgtgtattatcatcatgtgcc

SEQ ID NO: 754511 - DNA, 25 bp, Mus musculus
taagtgtgtattttcatcatgtgcc

SEQ ID NO: 754512 - DNA, 25 bp, Mus musculus
taagtgtgtctgattccctgcatct

SEQ ID NO: 754513 - DNA, 25 bp, Mus musculus
taagtgtgtctgtttccctgcatct

SEQ ID NO: 754514 - DNA, 25 bp, Mus musculus
taagtgttcagccatgtctcctgtc

SEQ ID NO: 754515 - DNA, 25 bp, Mus musculus
taagtgttcagcgatgtctcctgtc

SEQ ID NO: 754516 - DNA, 25 bp, Mus musculus
taagtgttcctgcagcagagtgagt

SEQ ID NO: 754517 - DNA, 25 bp, Mus musculus
taagtgttcctggagcagagtgagt

SEQ ID NO: 754518 - DNA, 25 bp, Mus musculus
taagtgttcttgaccggagcgggca

SEQ ID NO: 754519 - DNA, 25 bp, Mus musculus
taagtgttcttgtccggagcgggca

SEQ ID NO: 754520 - DNA, 25 bp, Mus musculus
taagtgttgaatatacccttcctgg

SEQ ID NO: 754521 - DNA, 25 bp, Mus musculus
taagtgttgaatttacccttcctgg

SEQ ID NO: 754522 - DNA, 25 bp, Mus musculus
taagtgttgacaccctagacttcaa

SEQ ID NO: 754523 - DNA, 25 bp, Mus musculus
taagtgttgacagcctagacttcaa

SEQ ID NO: 754524 - DNA, 25 bp, Mus musculus
taagtgttgccaccatcttgaccta

SEQ ID NO: 754525 - DNA, 25 bp, Mus musculus
taagtgttgccagcatcttgaccta

SEQ ID NO: 754526 - DNA, 25 bp, Mus musculus
taagtgtttagaccttgttggtagg

SEQ ID NO: 754527 - DNA, 25 bp, Mus musculus
taagtgtttagagcttgttggtagg

SEQ ID NO: 754528 - DNA, 25 bp, Mus musculus
taagtgtttcctactaggtctccca

SEQ ID NO: 754529 - DNA, 25 bp, Mus musculus
taagtgtttccttctaggtctccca

SEQ ID NO: 754530 - DNA, 25 bp, Mus musculus
taagttaaatttcccctctttcact

SEQ ID NO: 754531 - DNA, 25 bp, Mus musculus
taagttaaatttgccctctttcact

SEQ ID NO: 754532 - DNA, 25 bp, Mus musculus
taagttaacagccagagacagacac

SEQ ID NO: 754533 - DNA, 25 bp, Mus musculus
taagttaacagcgagagacagacac

SEQ ID NO: 754534 - DNA, 25 bp, Mus musculus
taagttaacatgagcatcagatcat

SEQ ID NO: 754535 - DNA, 25 bp, Mus musculus
taagttaacatgtgcatcagatcat

SEQ ID NO: 754536 - DNA, 25 bp, Mus musculus
taagttaccaccaacatgggccaac

SEQ ID NO: 754537 - DNA, 25 bp, Mus musculus
taagttaccacctacatgggccaac

SEQ ID NO: 754538 - DNA, 25 bp, Mus musculus
taagttacctctatcgagagcctgc

SEQ ID NO: 754539 - DNA, 25 bp, Mus musculus
taagttacctctttcgagagcctgc

SEQ ID NO: 754540 - DNA, 25 bp, Mus musculus
taagttacttaacggagttaggcat

SEQ ID NO: 754541 - DNA, 25 bp, Mus musculus
taagttacttaagggagttaggcat

SEQ ID NO: 754542 - DNA, 25 bp, Mus musculus
taagttagaattcgttttcagggct

SEQ ID NO: 754543 - DNA, 25 bp, Mus musculus
taagttagaattggttttcagggct

SEQ ID NO: 754544 - DNA, 25 bp, Mus musculus
taagttagctttatatttgaccagt

SEQ ID NO: 754545 - DNA, 25 bp, Mus musculus
taagttagctttcgatctcaggttc

SEQ ID NO: 754546 - DNA, 25 bp, Mus musculus
taagttagctttggatctcaggttc

SEQ ID NO: 754547 - DNA, 25 bp, Mus musculus
taagttagctttttatttgaccagt

SEQ ID NO: 754548 - DNA, 25 bp, Mus musculus
taagttagttccactctactatcag

SEQ ID NO: 754549 - DNA, 25 bp, Mus musculus
taagttagttcctctctactatcag

SEQ ID NO: 754550 - DNA, 25 bp, Mus musculus
taagttataaatcttgtgattttac

SEQ ID NO: 754551 - DNA, 25 bp, Mus musculus
taagttataaatgttgtgattttac

SEQ ID NO: 754552 - DNA, 25 bp, Mus musculus
taagttatcgggagctacccctgca

SEQ ID NO: 754553 - DNA, 25 bp, Mus musculus
taagttatcgggtgctacccctgca

SEQ ID NO: 754554 - DNA, 25 bp, Mus musculus
taagttatggttcgtgctttgttct

SEQ ID NO: 754555 - DNA, 25 bp, Mus musculus
taagttatggttggtgctttgttct

SEQ ID NO: 754556 - DNA, 25 bp, Mus musculus
taagttattaagactgcccaacctg

SEQ ID NO: 754557 - DNA, 25 bp, Mus musculus
taagttattaagtctgcccaacctg

SEQ ID NO: 754558 - DNA, 25 bp, Mus musculus
taagttattgttcaggtcctaagag

SEQ ID NO: 754559 - DNA, 25 bp, Mus musculus
taagttattgttgaggtcctaagag

SEQ ID NO: 754560 - DNA, 25 bp, Mus musculus
taagttatttccaccctgtgatgac

SEQ ID NO: 754561 - DNA, 25 bp, Mus musculus
taagttatttcctccctgtgatgac

SEQ ID NO: 754562 - DNA, 25 bp, Mus musculus
taagttcaaagtcggcctggctcac

SEQ ID NO: 754563 - DNA, 25 bp, Mus musculus
taagttcaaagtgggcctggctcac

SEQ ID NO: 754564 - DNA, 25 bp, Mus musculus
taagttcaacaaccatcactttgga

SEQ ID NO: 754565 - DNA, 25 bp, Mus musculus
taagttcaacaagcatcactttgga

SEQ ID NO: 754566 - DNA, 25 bp, Mus musculus
taagttcaacacaggctactcatct

SEQ ID NO: 754567 - DNA, 25 bp, Mus musculus
taagttcaacactggctactcatct

SEQ ID NO: 754568 - DNA, 25 bp, Mus musculus
taagttcaaggaacctcctggcctc

SEQ ID NO: 754569 - DNA, 25 bp, Mus musculus
taagttcaaggatcctcctggcctc

SEQ ID NO: 754570 - DNA, 25 bp, Mus musculus
taagttcaatccctagtgcttcaca

SEQ ID NO: 754571 - DNA, 25 bp, Mus musculus
taagttcaatccgtagtgcttcaca

SEQ ID NO: 754572 - DNA, 25 bp, Mus musculus
taagttcaccatactcacttcactt

SEQ ID NO: 754573 - DNA, 25 bp, Mus musculus
taagttcaccattctcacttcactt

SEQ ID NO: 754574 - DNA, 25 bp, Mus musculus
taagttcactctccctactgtaagg

SEQ ID NO: 754575 - DNA, 25 bp, Mus musculus
taagttcactctgcctactgtaagg

SEQ ID NO: 754576 - DNA, 25 bp, Mus musculus
taagttcagcctacagtgtacatca

SEQ ID NO: 754577 - DNA, 25 bp, Mus musculus
taagttcagccttcagtgtacatca

SEQ ID NO: 754578 - DNA, 25 bp, Mus musculus
taagttcagctaattaccgggacct

SEQ ID NO: 754579 - DNA, 25 bp, Mus musculus
taagttcagctatttaccgggacct

SEQ ID NO: 754580 - DNA, 25 bp, Mus musculus
taagttcagctcctggataagagaa

SEQ ID NO: 754581 - DNA, 25 bp, Mus musculus
taagttcagctcgtggataagagaa

SEQ ID NO: 754582 - DNA, 25 bp, Mus musculus
taagttcagcttcctataagttatt

SEQ ID NO: 754583 - DNA, 25 bp, Mus musculus
taagttcagcttgctataagttatt

SEQ ID NO: 754584 - DNA, 25 bp, Mus musculus
taagttcaggttccaccatccacat

SEQ ID NO: 754585 - DNA, 25 bp, Mus musculus
taagttcaggttgcaccatccacat

SEQ ID NO: 754586 - DNA, 25 bp, Mus musculus
taagttcagtccatggagtccaaat

SEQ ID NO: 754587 - DNA, 25 bp, Mus musculus
taagttcagtccttggagtccaaat

SEQ ID NO: 754588 - DNA, 25 bp, Mus musculus
taagttcagtgccagttggaggcca

SEQ ID NO: 754589 - DNA, 25 bp, Mus musculus
taagttcagtgcgagttggaggcca

SEQ ID NO: 754590 - DNA, 25 bp, Mus musculus
taagttcagttaccagcacacatgt

SEQ ID NO: 754591 - DNA, 25 bp, Mus musculus
taagttcagttagcagcacacatgt

SEQ ID NO: 754592 - DNA, 25 bp, Mus musculus
taagttcatgcaccggcacatttgc

SEQ ID NO: 754593 - DNA, 25 bp, Mus musculus
taagttcatgcagcggcacatttgc

SEQ ID NO: 754594 - DNA, 25 bp, Mus musculus
taagttcatgcccaagtgtctgtct

SEQ ID NO: 754595 - DNA, 25 bp, Mus musculus
taagttcatgccgaagtgtctgtct

SEQ ID NO: 754596 - DNA, 25 bp, Mus musculus
taagttccaagcctttatgcccaag

SEQ ID NO: 754597 - DNA, 25 bp, Mus musculus
taagttccaagcgtttatgcccaag

SEQ ID NO: 754598 - DNA, 25 bp, Mus musculus
taagttccaccgcagttagagttcc

SEQ ID NO: 754599 - DNA, 25 bp, Mus musculus
taagttccaccggagttagagttcc

SEQ ID NO: 754600 - DNA, 25 bp, Mus musculus
taagttccccttacttttctgacag

SEQ ID NO: 754601 - DNA, 25 bp, Mus musculus
taagttcccctttcttttctgacag

SEQ ID NO: 754602 - DNA, 25 bp, Mus musculus
taagttccctgtactcacagtagca

SEQ ID NO: 754603 - DNA, 25 bp, Mus musculus
taagttccctgttctcacagtagca

SEQ ID NO: 754604 - DNA, 25 bp, Mus musculus
taagttccctttcagattcatgcgc

SEQ ID NO: 754605 - DNA, 25 bp, Mus musculus
taagttccctttgagattcatgcgc

SEQ ID NO: 754606 - DNA, 25 bp, Mus musculus
taagttccgggacattctgcttcgc

SEQ ID NO: 754607 - DNA, 25 bp, Mus musculus
taagttccgggagattctgcttcgc

SEQ ID NO: 754608 - DNA, 25 bp, Mus musculus
taagttcctctcagagatcgaaagt

SEQ ID NO: 754609 - DNA, 25 bp, Mus musculus
taagttcctctctgagatcgaaagt

SEQ ID NO: 754610 - DNA, 25 bp, Mus musculus
taagttcctcttcggttcactgtag

SEQ ID NO: 754611 - DNA, 25 bp, Mus musculus
taagttcctcttgggttcactgtag

SEQ ID NO: 754612 - DNA, 25 bp, Mus musculus
taagttcctgtacatcttgtccatg

SEQ ID NO: 754613 - DNA, 25 bp, Mus musculus
taagttcctgtagatcttgtccatg

SEQ ID NO: 754614 - DNA, 25 bp, Mus musculus
taagttctaggcaaggctctcactg

SEQ ID NO: 754615 - DNA, 25 bp, Mus musculus
taagttctaggctaggctctcactg

SEQ ID NO: 754616 - DNA, 25 bp, Mus musculus
taagttctatctcatcccacctgat

SEQ ID NO: 754617 - DNA, 25 bp, Mus musculus
taagttctatctgatcccacctgat

SEQ ID NO: 754618 - DNA, 25 bp, Mus musculus
taagttctatgtactatattcagta

SEQ ID NO: 754619 - DNA, 25 bp, Mus musculus
taagttctatgttctatattcagta

SEQ ID NO: 754620 - DNA, 25 bp, Mus musculus
taagttctattaacccattttcagc

SEQ ID NO: 754621 - DNA, 25 bp, Mus musculus
taagttctattatcccattttcagc

SEQ ID NO: 754622 - DNA, 25 bp, Mus musculus
taagttctccacacggttccagtag

SEQ ID NO: 754623 - DNA, 25 bp, Mus musculus
taagttctccacatgcagaatttgt

SEQ ID NO: 754624 - DNA, 25 bp, Mus musculus
taagttctccactcggttccagtag

SEQ ID NO: 754625 - DNA, 25 bp, Mus musculus
taagttctccacttgcagaatttgt

SEQ ID NO: 754626 - DNA, 25 bp, Mus musculus
taagttctctgtcgtgagccctgga

SEQ ID NO: 754627 - DNA, 25 bp, Mus musculus
taagttctctgtggtgagccctgga

SEQ ID NO: 754628 - DNA, 25 bp, Mus musculus
taagttctggtaactttcactggta

SEQ ID NO: 754629 - DNA, 25 bp, Mus musculus
taagttctggtatctttcactggta

SEQ ID NO: 754630 - DNA, 25 bp, Mus musculus
taagttctgtaaatctgcatttatt

SEQ ID NO: 754631 - DNA, 25 bp, Mus musculus
taagttctgtaattctgcatttatt

SEQ ID NO: 754632 - DNA, 25 bp, Mus musculus
taagttctgtgccaggttctccacc

SEQ ID NO: 754633 - DNA, 25 bp, Mus musculus
taagttctgtgcgaggttctccacc

SEQ ID NO: 754634 - DNA, 25 bp, Mus musculus
taagttcttcacagtaggcacctac

SEQ ID NO: 754635 - DNA, 25 bp, Mus musculus
taagttcttcactgtaggcacctac

SEQ ID NO: 754636 - DNA, 25 bp, Mus musculus
taagttcttgctctgatttttcccc

SEQ ID NO: 754637 - DNA, 25 bp, Mus musculus
taagttcttgctgtgatttttcccc

SEQ ID NO: 754638 - DNA, 25 bp, Mus musculus
taagttctttgtacatttacctgct

SEQ ID NO: 754639 - DNA, 25 bp, Mus musculus
taagttctttgttcatttacctgct

SEQ ID NO: 754640 - DNA, 25 bp, Mus musculus
taagttgaaaccagggcttggcttc

SEQ ID NO: 754641 - DNA, 25 bp, Mus musculus
taagttgaaacctgggcttggcttc

SEQ ID NO: 754642 - DNA, 25 bp, Mus musculus
taagttgaattgacgttaatgtgtt

SEQ ID NO: 754643 - DNA, 25 bp, Mus musculus
taagttgaattgtcgttaatgtgtt

SEQ ID NO: 754644 - DNA, 25 bp, Mus musculus
taagttgaccaccaaaaaatagcca

SEQ ID NO: 754645 - DNA, 25 bp, Mus musculus
taagttgaccacgaaaaaatagcca

SEQ ID NO: 754646 - DNA, 25 bp, Mus musculus
taagttgatacactccagggttttt

SEQ ID NO: 754647 - DNA, 25 bp, Mus musculus
taagttgatacagtccagggttttt

SEQ ID NO: 754648 - DNA, 25 bp, Mus musculus
taagttgattatcgccctcatggcc

SEQ ID NO: 754649 - DNA, 25 bp, Mus musculus
taagttgattatggccctcatggcc

SEQ ID NO: 754650 - DNA, 25 bp, Mus musculus
taagttgattgtcacctgccctcag

SEQ ID NO: 754651 - DNA, 25 bp, Mus musculus
taagttgattgtgacctgccctcag

SEQ ID NO: 754652 - DNA, 25 bp, Mus musculus
taagttgcattccaaacggaggcat

SEQ ID NO: 754653 - DNA, 25 bp, Mus musculus
taagttgcattcgaaacggaggcat

SEQ ID NO: 754654 - DNA, 25 bp, Mus musculus
taagttgccctacgagaagcctcac

SEQ ID NO: 754655 - DNA, 25 bp, Mus musculus
taagttgccctaggagaagcctcac

SEQ ID NO: 754656 - DNA, 25 bp, Mus musculus
taagttgccttacgttttggtcctg

SEQ ID NO: 754657 - DNA, 25 bp, Mus musculus
taagttgccttaggttttggtcctg

SEQ ID NO: 754658 - DNA, 25 bp, Mus musculus
taagttgctaggcttccctgttgag

SEQ ID NO: 754659 - DNA, 25 bp, Mus musculus
taagttgctagggttccctgttgag

SEQ ID NO: 754660 - DNA, 25 bp, Mus musculus
taagttggactaagcgaccttgaat

SEQ ID NO: 754661 - DNA, 25 bp, Mus musculus
taagttggactatgcgaccttgaat

SEQ ID NO: 754662 - DNA, 25 bp, Mus musculus
taagttggatgcctaggatcccagc

SEQ ID NO: 754663 - DNA, 25 bp, Mus musculus
taagttggatgcgtaggatcccagc

SEQ ID NO: 754664 - DNA, 25 bp, Mus musculus
taagttggattcctcctccagctaa

SEQ ID NO: 754665 - DNA, 25 bp, Mus musculus
taagttggattcgtcctccagctaa

SEQ ID NO: 754666 - DNA, 25 bp, Mus musculus
taagttggccatcacttgagcctca

SEQ ID NO: 754667 - DNA, 25 bp, Mus musculus
taagttggccatgacttgagcctca

SEQ ID NO: 754668 - DNA, 25 bp, Mus musculus
taagttggcctgctgcatagctagc

SEQ ID NO: 754669 - DNA, 25 bp, Mus musculus
taagttggcctggtgcatagctagc

SEQ ID NO: 754670 - DNA, 25 bp, Mus musculus
taagttggccttaaagtttctgtgg

SEQ ID NO: 754671 - DNA, 25 bp, Mus musculus
taagttggcctttaagtttctgtgg

SEQ ID NO: 754672 - DNA, 25 bp, Mus musculus
taagttggcgtgctcactagtccgg

SEQ ID NO: 754673 - DNA, 25 bp, Mus musculus
taagttggcgtggtcactagtccgg

SEQ ID NO: 754674 - DNA, 25 bp, Mus musculus
taagttgggacacctgagtctcttc

SEQ ID NO: 754675 - DNA, 25 bp, Mus musculus
taagttgggacagctgagtctcttc

SEQ ID NO: 754676 - DNA, 25 bp, Mus musculus
taagttggtattcctgctgtcctgt

SEQ ID NO: 754677 - DNA, 25 bp, Mus musculus
taagttggtattgctgctgtcctgt

SEQ ID NO: 754678 - DNA, 25 bp, Mus musculus
taagttggtgttcaggcccagcttg

SEQ ID NO: 754679 - DNA, 25 bp, Mus musculus
taagttggtgttgaggcccagcttg

SEQ ID NO: 754680 - DNA, 25 bp, Mus musculus
taagttggttctagcgcagtttttt

SEQ ID NO: 754681 - DNA, 25 bp, Mus musculus
taagttggttcttgcgcagtttttt

SEQ ID NO: 754682 - DNA, 25 bp, Mus musculus
taagttgtacttaatcagcccttaa

SEQ ID NO: 754683 - DNA, 25 bp, Mus musculus
taagttgtacttactcctaattgaa

SEQ ID NO: 754684 - DNA, 25 bp, Mus musculus
taagttgtactttatcagcccttaa

SEQ ID NO: 754685 - DNA, 25 bp, Mus musculus
taagttgtactttctcctaattgaa

SEQ ID NO: 754686 - DNA, 25 bp, Mus musculus
taagttgtagtgatccctggaggga

SEQ ID NO: 754687 - DNA, 25 bp, Mus musculus
taagttgtagtgttccctggaggga

SEQ ID NO: 754688 - DNA, 25 bp, Mus musculus
taagttgtatcaaaccaccaccttg

SEQ ID NO: 754689 - DNA, 25 bp, Mus musculus
taagttgtatcataccaccaccttg

SEQ ID NO: 754690 - DNA, 25 bp, Mus musculus
taagttgtatttatgaaagtcccat

SEQ ID NO: 754691 - DNA, 25 bp, Mus musculus
taagttgtatttttgaaagtcccat

SEQ ID NO: 754692 - DNA, 25 bp, Mus musculus
taagttgtccaaccagagcgcatcc

SEQ ID NO: 754693 - DNA, 25 bp, Mus musculus
taagttgtccaagcagagcgcatcc

SEQ ID NO: 754694 - DNA, 25 bp, Mus musculus
taagttgtgctaaatttgccacaga

SEQ ID NO: 754695 - DNA, 25 bp, Mus musculus
taagttgtgctatatttgccacaga

SEQ ID NO: 754696 - DNA, 25 bp, Mus musculus
taagttgtggccagagttgcatgtt

SEQ ID NO: 754697 - DNA, 25 bp, Mus musculus
taagttgtggcctgagttgcatgtt

SEQ ID NO: 754698 - DNA, 25 bp, Mus musculus
taagttgtggctatcatggtacaga

SEQ ID NO: 754699 - DNA, 25 bp, Mus musculus
taagttgtggctttcatggtacaga

SEQ ID NO: 754700 - DNA, 25 bp, Mus musculus
taagttgtgtctctctagtccccat

SEQ ID NO: 754701 - DNA, 25 bp, Mus musculus
taagttgtgtctgtctagtccccat

SEQ ID NO: 754702 - DNA, 25 bp, Mus musculus
taagttgtgtgactgaatctattac

SEQ ID NO: 754703 - DNA, 25 bp, Mus musculus
taagttgtgtgagtgaatctattac

SEQ ID NO: 754704 - DNA, 25 bp, Mus musculus
taagttgtgtgcagaatattggtgc

SEQ ID NO: 754705 - DNA, 25 bp, Mus musculus
taagttgtgtgctgaatattggtgc

SEQ ID NO: 754706 - DNA, 25 bp, Mus musculus
taagttgttcacatctactcaatga

SEQ ID NO: 754707 - DNA, 25 bp, Mus musculus
taagttgttcacttctactcaatga

SEQ ID NO: 754708 - DNA, 25 bp, Mus musculus
taagtttaagacatctcttcgccgg

SEQ ID NO: 754709 - DNA, 25 bp, Mus musculus
taagtttaagacttctcttcgccgg

SEQ ID NO: 754710 - DNA, 25 bp, Mus musculus
taagtttaccagagctatttcatct

SEQ ID NO: 754711 - DNA, 25 bp, Mus musculus
taagtttaccagtgctatttcatct

SEQ ID NO: 754712 - DNA, 25 bp, Mus musculus
taagtttccaatctaccatgctcac

SEQ ID NO: 754713 - DNA, 25 bp, Mus musculus
taagtttccaatgtaccatgctcac

SEQ ID NO: 754714 - DNA, 25 bp, Mus musculus
taagtttccactacatatgctcctt

SEQ ID NO: 754715 - DNA, 25 bp, Mus musculus
taagtttccacttcatatgctcctt

SEQ ID NO: 754716 - DNA, 25 bp, Mus musculus
taagtttcccttctcactgtaggac

SEQ ID NO: 754717 - DNA, 25 bp, Mus musculus
taagtttcccttgtcactgtaggac

SEQ ID NO: 754718 - DNA, 25 bp, Mus musculus
taagtttccttcctatgacccagat

SEQ ID NO: 754719 - DNA, 25 bp, Mus musculus
taagtttccttcgtatgacccagat

SEQ ID NO: 754720 - DNA, 25 bp, Mus musculus
taagtttctaagaccaattgcctct

SEQ ID NO: 754721 - DNA, 25 bp, Mus musculus
taagtttctaagtccaattgcctct

SEQ ID NO: 754722 - DNA, 25 bp, Mus musculus
taagtttctactccagtcttcatca

SEQ ID NO: 754723 - DNA, 25 bp, Mus musculus
taagtttctactgcagtcttcatca

SEQ ID NO: 754724 - DNA, 25 bp, Mus musculus
taagtttctattactgttttcctgt

SEQ ID NO: 754725 - DNA, 25 bp, Mus musculus
taagtttctatttctgttttcctgt

SEQ ID NO: 754726 - DNA, 25 bp, Mus musculus
taagtttctcttccctagtgtttac

SEQ ID NO: 754727 - DNA, 25 bp, Mus musculus
taagtttctcttgcctagtgtttac

SEQ ID NO: 754728 - DNA, 25 bp, Mus musculus
taagtttctgaaaggccgagtagcc

SEQ ID NO: 754729 - DNA, 25 bp, Mus musculus
taagtttctgaatggccgagtagcc

SEQ ID NO: 754730 - DNA, 25 bp, Mus musculus
taagtttctggcctagggtgtgttt

SEQ ID NO: 754731 - DNA, 25 bp, Mus musculus
taagtttctggcgtagggtgtgttt

SEQ ID NO: 754732 - DNA, 25 bp, Mus musculus
taagtttctgttcacggcatgtggt

SEQ ID NO: 754733 - DNA, 25 bp, Mus musculus
taagtttctgttgacggcatgtggt

SEQ ID NO: 754734 - DNA, 25 bp, Mus musculus
taagtttcttgtctccagggatttc

SEQ ID NO: 754735 - DNA, 25 bp, Mus musculus
taagtttcttgtgtccagggatttc

SEQ ID NO: 754736 - DNA, 25 bp, Mus musculus
taagtttctttcagggcttgaccgt

SEQ ID NO: 754737 - DNA, 25 bp, Mus musculus
taagtttctttcagtgggtgaacac

SEQ ID NO: 754738 - DNA, 25 bp, Mus musculus
taagtttctttctgggcttgaccgt

SEQ ID NO: 754739 - DNA, 25 bp, Mus musculus
taagtttctttctgtgggtgaacac

SEQ ID NO: 754740 - DNA, 25 bp, Mus musculus
taagtttgaaatccccacctctcca

SEQ ID NO: 754741 - DNA, 25 bp, Mus musculus
taagtttgaaatgcccacctctcca

SEQ ID NO: 754742 - DNA, 25 bp, Mus musculus
taagtttgaacaaagtactcccttc

SEQ ID NO: 754743 - DNA, 25 bp, Mus musculus
taagtttgaacatagtactcccttc

SEQ ID NO: 754744 - DNA, 25 bp, Mus musculus
taagtttgcaacaaaaagcaagcaa

SEQ ID NO: 754745 - DNA, 25 bp, Mus musculus
taagtttgcaactaaaagcaagcaa

SEQ ID NO: 754746 - DNA, 25 bp, Mus musculus
taagtttgcagcagcttaacctccc

SEQ ID NO: 754747 - DNA, 25 bp, Mus musculus
taagtttgcagctgcttaacctccc

SEQ ID NO: 754748 - DNA, 25 bp, Mus musculus
taagtttggcgtcgcccgcaagcac

SEQ ID NO: 754749 - DNA, 25 bp, Mus musculus
taagtttggcgtcgctgagccaaga

SEQ ID NO: 754750 - DNA, 25 bp, Mus musculus
taagtttggcgtggcccgcaagcac

SEQ ID NO: 754751 - DNA, 25 bp, Mus musculus
taagtttggcgtggctgagccaaga

SEQ ID NO: 754752 - DNA, 25 bp, Mus musculus
taagtttgtgatcagccgtcctgca

SEQ ID NO: 754753 - DNA, 25 bp, Mus musculus
taagtttgtgatgagccgtcctgca

SEQ ID NO: 754754 - DNA, 25 bp, Mus musculus
taagttttagggacctccacgagca

SEQ ID NO: 754755 - DNA, 25 bp, Mus musculus
taagttttagggtcctccacgagca

SEQ ID NO: 754756 - DNA, 25 bp, Mus musculus
taagttttatgaagtatccaggcaa

SEQ ID NO: 754757 - DNA, 25 bp, Mus musculus
taagttttatgatgtatccaggcaa

SEQ ID NO: 754758 - DNA, 25 bp, Mus musculus
taagttttctgcataaggacacaga

SEQ ID NO: 754759 - DNA, 25 bp, Mus musculus
taagttttctgcttaaggacacaga

SEQ ID NO: 754760 - DNA, 25 bp, Mus musculus
taagttttcttcataacccatttgg

SEQ ID NO: 754761 - DNA, 25 bp, Mus musculus
taagttttcttcttaacccatttgg

SEQ ID NO: 754762 - DNA, 25 bp, Mus musculus
taagttttgctaagagggaccctcc

SEQ ID NO: 754763 - DNA, 25 bp, Mus musculus
taagttttgctatgagggaccctcc

SEQ ID NO: 754764 - DNA, 25 bp, Mus musculus
taagttttgcttagggtcgatttga

SEQ ID NO: 754765 - DNA, 25 bp, Mus musculus
taagttttgctttgggtcgatttga

SEQ ID NO: 754766 - DNA, 25 bp, Mus musculus
taagttttggcaagggtgtcctggc

SEQ ID NO: 754767 - DNA, 25 bp, Mus musculus
taagttttggcatgggtgtcctggc

SEQ ID NO: 754768 - DNA, 25 bp, Mus musculus
taagtttttactccattatgcacag

SEQ ID NO: 754769 - DNA, 25 bp, Mus musculus
taagtttttactgcattatgcacag

SEQ ID NO: 754770 - DNA, 25 bp, Mus musculus
taagtttttctgcatttgtctctat

SEQ ID NO: 754771 - DNA, 25 bp, Mus musculus
taagtttttctggatttgtctctat

SEQ ID NO: 754772 - DNA, 25 bp, Mus musculus
taagtttttcttctggatcggctac

SEQ ID NO: 754773 - DNA, 25 bp, Mus musculus
taagtttttcttgtggatcggctac

SEQ ID NO: 754774 - DNA, 25 bp, Mus musculus
taagtttttgctaggcccgattcgg

SEQ ID NO: 754775 - DNA, 25 bp, Mus musculus
taagtttttgcttggcccgattcgg

SEQ ID NO: 754776 - DNA, 25 bp, Mus musculus
taataaaaacctcattcccagcctg

SEQ ID NO: 754777 - DNA, 25 bp, Mus musculus
taataaaaacctgattcccagcctg

SEQ ID NO: 754778 - DNA, 25 bp, Mus musculus
taataaaaccaaaacgtgctccacg

SEQ ID NO: 754779 - DNA, 25 bp, Mus musculus
taataaaaccaatacgtgctccacg

SEQ ID NO: 754780 - DNA, 25 bp, Mus musculus
taataaaactctcaggttctcaaga

SEQ ID NO: 754781 - DNA, 25 bp, Mus musculus
taataaaactctgaggttctcaaga

SEQ ID NO: 754782 - DNA, 25 bp, Mus musculus
taataaaactggaaacattctgtat

SEQ ID NO: 754783 - DNA, 25 bp, Mus musculus
taataaaactggtaacattctgtat

SEQ ID NO: 754784 - DNA, 25 bp, Mus musculus
taataaaagattcgcctacccctgc

SEQ ID NO: 754785 - DNA, 25 bp, Mus musculus
taataaaagattggcctacccctgc

SEQ ID NO: 754786 - DNA, 25 bp, Mus musculus
taataaacacaacctctcagacctg

SEQ ID NO: 754787 - DNA, 25 bp, Mus musculus
taataaacacaagctctcagacctg

SEQ ID NO: 754788 - DNA, 25 bp, Mus musculus
taataaacatttccctgccatgctt

SEQ ID NO: 754789 - DNA, 25 bp, Mus musculus
taataaacatttgcctgccatgctt

SEQ ID NO: 754790 - DNA, 25 bp, Mus musculus
taataaaccttaaaactccatctca

SEQ ID NO: 754791 - DNA, 25 bp, Mus musculus
taataaaccttataactccatctca

SEQ ID NO: 754792 - DNA, 25 bp, Mus musculus
taataaaccttcctcgtctcttttg

SEQ ID NO: 754793 - DNA, 25 bp, Mus musculus
taataaaccttcgtcgtctcttttg

SEQ ID NO: 754794 - DNA, 25 bp, Mus musculus
taataaactcgacgcctttctggct

SEQ ID NO: 754795 - DNA, 25 bp, Mus musculus
taataaactcgaggcctttctggct

SEQ ID NO: 754796 - DNA, 25 bp, Mus musculus
taataaactcttctagtgtgtagga

SEQ ID NO: 754797 - DNA, 25 bp, Mus musculus
taataaactcttgtagtgtgtagga

SEQ ID NO: 754798 - DNA, 25 bp, Mus musculus
taataaagaaccctggtgtcccaca

SEQ ID NO: 754799 - DNA, 25 bp, Mus musculus
taataaagaaccgtggtgtcccaca

SEQ ID NO: 754800 - DNA, 25 bp, Mus musculus
taataaagactaagcacctccctcg

SEQ ID NO: 754801 - DNA, 25 bp, Mus musculus
taataaagactatgcacctccctcg

SEQ ID NO: 754802 - DNA, 25 bp, Mus musculus
taataaagagccagtcgcactgcga

SEQ ID NO: 754803 - DNA, 25 bp, Mus musculus
taataaagagcctgtcgcactgcga

SEQ ID NO: 754804 - DNA, 25 bp, Mus musculus
taataaagatctcctccgggctggt

SEQ ID NO: 754805 - DNA, 25 bp, Mus musculus
taataaagatctgctccgggctggt

SEQ ID NO: 754806 - DNA, 25 bp, Mus musculus
taataaagcctgatccatcactcac

SEQ ID NO: 754807 - DNA, 25 bp, Mus musculus
taataaagcctgttccatcactcac

SEQ ID NO: 754808 - DNA, 25 bp, Mus musculus
taataaatacatccctcttagtgcg

SEQ ID NO: 754809 - DNA, 25 bp, Mus musculus
taataaatacatgcctcttagtgcg

SEQ ID NO: 754810 - DNA, 25 bp, Mus musculus
taataaatccaaaagcccttcagaa

SEQ ID NO: 754811 - DNA, 25 bp, Mus musculus
taataaatccaatagcccttcagaa

SEQ ID NO: 754812 - DNA, 25 bp, Mus musculus
taataaatctccagggttacccagg

SEQ ID NO: 754813 - DNA, 25 bp, Mus musculus
taataaatctcctgggttacccagg

SEQ ID NO: 754814 - DNA, 25 bp, Mus musculus
taataaatgaacctgcctgagccac

SEQ ID NO: 754815 - DNA, 25 bp, Mus musculus
taataaatgaacgtgcctgagccac

SEQ ID NO: 754816 - DNA, 25 bp, Mus musculus
taataaatgcaccaccatgacatgt

SEQ ID NO: 754817 - DNA, 25 bp, Mus musculus
taataaatgcacgaccatgacatgt

SEQ ID NO: 754818 - DNA, 25 bp, Mus musculus
taataaattagcagcggtttcttgc

SEQ ID NO: 754819 - DNA, 25 bp, Mus musculus
taataaattagctgcggtttcttgc

SEQ ID NO: 754820 - DNA, 25 bp, Mus musculus
taataaattcatcaggcccccactt

SEQ ID NO: 754821 - DNA, 25 bp, Mus musculus
taataaattcatgaggcccccactt

SEQ ID NO: 754822 - DNA, 25 bp, Mus musculus
taataaattcccatttgcagcaaga

SEQ ID NO: 754823 - DNA, 25 bp, Mus musculus
taataaattcccttttgcagcaaga

SEQ ID NO: 754824 - DNA, 25 bp, Mus musculus
taataacacttcactactctgcttc

SEQ ID NO: 754825 - DNA, 25 bp, Mus musculus
taataacacttctctactctgcttc

SEQ ID NO: 754826 - DNA, 25 bp, Mus musculus
taataaccacaaatagtgtcagctt

SEQ ID NO: 754827 - DNA, 25 bp, Mus musculus
taataaccacaattagtgtcagctt

SEQ ID NO: 754828 - DNA, 25 bp, Mus musculus
taataaccactcacttccctcttat

SEQ ID NO: 754829 - DNA, 25 bp, Mus musculus
taataaccactctcttccctcttat

SEQ ID NO: 754830 - DNA, 25 bp, Mus musculus
taataaccatggctctatctctgct

SEQ ID NO: 754831 - DNA, 25 bp, Mus musculus
taataaccatgggtctatctctgct

SEQ ID NO: 754832 - DNA, 25 bp, Mus musculus
taataaccgtgcaccagcatccaga

SEQ ID NO: 754833 - DNA, 25 bp, Mus musculus
taataaccgtgctccagcatccaga

SEQ ID NO: 754834 - DNA, 25 bp, Mus musculus
taataaccgttcaaacctcttccag

SEQ ID NO: 754835 - DNA, 25 bp, Mus musculus
taataaccgttctaacctcttccag

SEQ ID NO: 754836 - DNA, 25 bp, Mus musculus
taataacctattcccctaccttgat

SEQ ID NO: 754837 - DNA, 25 bp, Mus musculus
taataacctattgccctaccttgat

SEQ ID NO: 754838 - DNA, 25 bp, Mus musculus
taataacctgttccatttcctttgt

SEQ ID NO: 754839 - DNA, 25 bp, Mus musculus
taataacctgttgcatttcctttgt

SEQ ID NO: 754840 - DNA, 25 bp, Mus musculus
taataactatcactgcaagtgaact

SEQ ID NO: 754841 - DNA, 25 bp, Mus musculus
taataactatcagtgcaagtgaact

SEQ ID NO: 754842 - DNA, 25 bp, Mus musculus
taataactcaccatccagaccgaga

SEQ ID NO: 754843 - DNA, 25 bp, Mus musculus
taataactcaccttccagaccgaga

SEQ ID NO: 754844 - DNA, 25 bp, Mus musculus
taataactcagtcccaaagcaccct

SEQ ID NO: 754845 - DNA, 25 bp, Mus musculus
taataactcagtgccaaagcaccct

SEQ ID NO: 754846 - DNA, 25 bp, Mus musculus
taataactctccacgggttgataca

SEQ ID NO: 754847 - DNA, 25 bp, Mus musculus
taataactctcctcgggttgataca

SEQ ID NO: 754848 - DNA, 25 bp, Mus musculus
taataactgcccctgtgttaatgaa

SEQ ID NO: 754849 - DNA, 25 bp, Mus musculus
taataactgcccgtgtgttaatgaa

SEQ ID NO: 754850 - DNA, 25 bp, Mus musculus
taataagacagacaggccgggcagt

SEQ ID NO: 754851 - DNA, 25 bp, Mus musculus
taataagacagagaggccgggcagt

SEQ ID NO: 754852 - DNA, 25 bp, Mus musculus
taataagacccaatagtggctagag

SEQ ID NO: 754853 - DNA, 25 bp, Mus musculus
taataagacccattagtggctagag

SEQ ID NO: 754854 - DNA, 25 bp, Mus musculus
taataagactcaacccagagcctac

SEQ ID NO: 754855 - DNA, 25 bp, Mus musculus
taataagactcatcccagagcctac

SEQ ID NO: 754856 - DNA, 25 bp, Mus musculus
taataagagccactcagcctgacca

SEQ ID NO: 754857 - DNA, 25 bp, Mus musculus
taataagagccagtcagcctgacca

SEQ ID NO: 754858 - DNA, 25 bp, Mus musculus
taataagagtgcagccttctcagct

SEQ ID NO: 754859 - DNA, 25 bp, Mus musculus
taataagagtgctgccttctcagct

SEQ ID NO: 754860 - DNA, 25 bp, Mus musculus
taataagagttcaccttttctctga

SEQ ID NO: 754861 - DNA, 25 bp, Mus musculus
taataagagttctccttttctctga

SEQ ID NO: 754862 - DNA, 25 bp, Mus musculus
taataagatgctctactgtgtctca

SEQ ID NO: 754863 - DNA, 25 bp, Mus musculus
taataagatgctgtactgtgtctca

SEQ ID NO: 754864 - DNA, 25 bp, Mus musculus
taataagcaaaacattctgttctgt

SEQ ID NO: 754865 - DNA, 25 bp, Mus musculus
taataagcaaaagattctgttctgt

SEQ ID NO: 754866 - DNA, 25 bp, Mus musculus
taataagcaggaactatagctcgac

SEQ ID NO: 754867 - DNA, 25 bp, Mus musculus
taataagcaggatctatagctcgac

SEQ ID NO: 754868 - DNA, 25 bp, Mus musculus
taataagctttaacaggttggtctg

SEQ ID NO: 754869 - DNA, 25 bp, Mus musculus
taataagctttatcaggttggtctg

SEQ ID NO: 754870 - DNA, 25 bp, Mus musculus
taataaggcactcgtggcacctggc

SEQ ID NO: 754871 - DNA, 25 bp, Mus musculus
taataaggcactggtggcacctggc

SEQ ID NO: 754872 - DNA, 25 bp, Mus musculus
taataaggccctcggtagcactgac

SEQ ID NO: 754873 - DNA, 25 bp, Mus musculus
taataaggccctgggtagcactgac

SEQ ID NO: 754874 - DNA, 25 bp, Mus musculus
taataaggctgacctcgctagcaca

SEQ ID NO: 754875 - DNA, 25 bp, Mus musculus
taataaggctgagctcgctagcaca

SEQ ID NO: 754876 - DNA, 25 bp, Mus musculus
taataagtcaagagctatgcctgtc

SEQ ID NO: 754877 - DNA, 25 bp, Mus musculus
taataagtcaagtgctatgcctgtc

SEQ ID NO: 754878 - DNA, 25 bp, Mus musculus
taataagtgagaaagcgcatggcgt

SEQ ID NO: 754879 - DNA, 25 bp, Mus musculus
taataagtgagatagcgcatggcgt

SEQ ID NO: 754880 - DNA, 25 bp, Mus musculus
taataataccatagatctgtttccc

SEQ ID NO: 754881 - DNA, 25 bp, Mus musculus
taataataccattgatctgtttccc

SEQ ID NO: 754882 - DNA, 25 bp, Mus musculus
taataatagcccatccatctggcag

SEQ ID NO: 754883 - DNA, 25 bp, Mus musculus
taataatagcccttccatctggcag

SEQ ID NO: 754884 - DNA, 25 bp, Mus musculus
taataatatagtacgttccctttag

SEQ ID NO: 754885 - DNA, 25 bp, Mus musculus
taataatatagttcgttccctttag

SEQ ID NO: 754886 - DNA, 25 bp, Mus musculus
taataatcatttctaggctttcata

SEQ ID NO: 754887 - DNA, 25 bp, Mus musculus
taataatcatttgtaggctttcata

SEQ ID NO: 754888 - DNA, 25 bp, Mus musculus
taataatcggcaatggccacgcggg

SEQ ID NO: 754889 - DNA, 25 bp, Mus musculus
taataatcggcattggccacgcggg

SEQ ID NO: 754890 - DNA, 25 bp, Mus musculus
taataatcggctactccgcacgtgt

SEQ ID NO: 754891 - DNA, 25 bp, Mus musculus
taataatcggcttctccgcacgtgt

SEQ ID NO: 754892 - DNA, 25 bp, Mus musculus
taataatctcaaacaatctctagga

SEQ ID NO: 754893 - DNA, 25 bp, Mus musculus
taataatctcaatcaatctctagga

SEQ ID NO: 754894 - DNA, 25 bp, Mus musculus
taataatctctacccatatggtggg

SEQ ID NO: 754895 - DNA, 25 bp, Mus musculus
taataatctctagccatatggtggg

SEQ ID NO: 754896 - DNA, 25 bp, Mus musculus
taataatgagtcaaggaatacccct

SEQ ID NO: 754897 - DNA, 25 bp, Mus musculus
taataatgagtctaggaatacccct

SEQ ID NO: 754898 - DNA, 25 bp, Mus musculus
taataatgagttccctctggccaga

SEQ ID NO: 754899 - DNA, 25 bp, Mus musculus
taataatgagttgcctctggccaga

SEQ ID NO: 754900 - DNA, 25 bp, Mus musculus
taataatgatccatgttcaatgcac

SEQ ID NO: 754901 - DNA, 25 bp, Mus musculus
taataatgatccttgttcaatgcac

SEQ ID NO: 754902 - DNA, 25 bp, Mus musculus
taataatgccatatccacttcccac

SEQ ID NO: 754903 - DNA, 25 bp, Mus musculus
taataatgccatttccacttcccac

SEQ ID NO: 754904 - DNA, 25 bp, Mus musculus
taataatgctgaattctgaactggc

SEQ ID NO: 754905 - DNA, 25 bp, Mus musculus
taataatgctgatttctgaactggc

SEQ ID NO: 754906 - DNA, 25 bp, Mus musculus
taataatggcttctctatgtcactc

SEQ ID NO: 754907 - DNA, 25 bp, Mus musculus
taataatggcttgtctatgtcactc

SEQ ID NO: 754908 - DNA, 25 bp, Mus musculus
taataatgtcttcgcttctaagcat

SEQ ID NO: 754909 - DNA, 25 bp, Mus musculus
taataatgtcttggcttctaagcat

SEQ ID NO: 754910 - DNA, 25 bp, Mus musculus
taataattcccactactgtatttgt

SEQ ID NO: 754911 - DNA, 25 bp, Mus musculus
taataattcccagtactgtatttgt

SEQ ID NO: 754912 - DNA, 25 bp, Mus musculus
taataattctcacacagtgggtcac

SEQ ID NO: 754913 - DNA, 25 bp, Mus musculus
taataattctcagacagtgggtcac

SEQ ID NO: 754914 - DNA, 25 bp, Mus musculus
taataatttgaaagtaaccttgatt

SEQ ID NO: 754915 - DNA, 25 bp, Mus musculus
taataatttgaatgtaaccttgatt

SEQ ID NO: 754916 - DNA, 25 bp, Mus musculus
taatacaaaattctgcttgttttaa

SEQ ID NO: 754917 - DNA, 25 bp, Mus musculus
taatacaaaattgtgcttgttttaa

SEQ ID NO: 754918 - DNA, 25 bp, Mus musculus
taatacaaaccccttcgctacattc

SEQ ID NO: 754919 - DNA, 25 bp, Mus musculus
taatacaaacccgttcgctacattc

SEQ ID NO: 754920 - DNA, 25 bp, Mus musculus
taatacaatcctcaaaatatctaat

SEQ ID NO: 754921 - DNA, 25 bp, Mus musculus
taatacaatcctgaaaatatctaat

SEQ ID NO: 754922 - DNA, 25 bp, Mus musculus
taatacacaccgagcattcttcttg

SEQ ID NO: 754923 - DNA, 25 bp, Mus musculus
taatacacaccgtgcattcttcttg

SEQ ID NO: 754924 - DNA, 25 bp, Mus musculus
taatacaccgccaatgcatgtgctg

SEQ ID NO: 754925 - DNA, 25 bp, Mus musculus
taatacaccgcctatgcatgtgctg

SEQ ID NO: 754926 - DNA, 25 bp, Mus musculus
taatacacctacatcctatctttgg

SEQ ID NO: 754927 - DNA, 25 bp, Mus musculus
taatacacctacttcctatctttgg

SEQ ID NO: 754928 - DNA, 25 bp, Mus musculus
taatacacctgcaaactaacgaatg

SEQ ID NO: 754929 - DNA, 25 bp, Mus musculus
taatacacctgctaactaacgaatg

SEQ ID NO: 754930 - DNA, 25 bp, Mus musculus
taatacagacctcgtgcccgagcac

SEQ ID NO: 754931 - DNA, 25 bp, Mus musculus
taatacagacctggtgcccgagcac

SEQ ID NO: 754932 - DNA, 25 bp, Mus musculus
taatacagagtccagccattaccat

SEQ ID NO: 754933 - DNA, 25 bp, Mus musculus
taatacagagtcgagccattaccat

SEQ ID NO: 754934 - DNA, 25 bp, Mus musculus
taatacagatagatgtgggccatca

SEQ ID NO: 754935 - DNA, 25 bp, Mus musculus
taatacagatagttgtgggccatca

SEQ ID NO: 754936 - DNA, 25 bp, Mus musculus
taatacagcgggacccagaggctgc

SEQ ID NO: 754937 - DNA, 25 bp, Mus musculus
taatacagcgggtcccagaggctgc

SEQ ID NO: 754938 - DNA, 25 bp, Mus musculus
taatacatagctcggtgtggtaggc

SEQ ID NO: 754939 - DNA, 25 bp, Mus musculus
taatacatagctgggtgtggtaggc

SEQ ID NO: 754940 - DNA, 25 bp, Mus musculus
taatacatctgcagaactcctggtt

SEQ ID NO: 754941 - DNA, 25 bp, Mus musculus
taatacatctgctgaactcctggtt

SEQ ID NO: 754942 - DNA, 25 bp, Mus musculus
taataccaaatactaccctcccaga

SEQ ID NO: 754943 - DNA, 25 bp, Mus musculus
taataccaaatagtaccctcccaga

SEQ ID NO: 754944 - DNA, 25 bp, Mus musculus
taataccaccctaatttccagtgtg

SEQ ID NO: 754945 - DNA, 25 bp, Mus musculus
taataccacccttatttccagtgtg

SEQ ID NO: 754946 - DNA, 25 bp, Mus musculus
taataccagactattagatccataa

SEQ ID NO: 754947 - DNA, 25 bp, Mus musculus
taataccagacttttagatccataa

SEQ ID NO: 754948 - DNA, 25 bp, Mus musculus
taataccagcgcacctcaaactagg

SEQ ID NO: 754949 - DNA, 25 bp, Mus musculus
taataccagcgctcctcaaactagg

SEQ ID NO: 754950 - DNA, 25 bp, Mus musculus
taataccaggcgcagcatctttcca

SEQ ID NO: 754951 - DNA, 25 bp, Mus musculus
taataccaggcggagcatctttcca

SEQ ID NO: 754952 - DNA, 25 bp, Mus musculus
taataccatggaaggattcacactg

SEQ ID NO: 754953 - DNA, 25 bp, Mus musculus
taataccatggatggattcacactg

SEQ ID NO: 754954 - DNA, 25 bp, Mus musculus
taatacccactcatagtcaaccatg

SEQ ID NO: 754955 - DNA, 25 bp, Mus musculus
taatacccactcttagtcaaccatg

SEQ ID NO: 754956 - DNA, 25 bp, Mus musculus
taatacccacttagacataggaaca

SEQ ID NO: 754957 - DNA, 25 bp, Mus musculus
taatacccactttgacataggaaca

SEQ ID NO: 754958 - DNA, 25 bp, Mus musculus
taatacccaggcaaagttcctttct

SEQ ID NO: 754959 - DNA, 25 bp, Mus musculus
taatacccaggctaagttcctttct

SEQ ID NO: 754960 - DNA, 25 bp, Mus musculus
taatacccagtgagactcaggccta

SEQ ID NO: 754961 - DNA, 25 bp, Mus musculus
taatacccagtgtgactcaggccta

SEQ ID NO: 754962 - DNA, 25 bp, Mus musculus
taataccctacacatgagcgaaaat

SEQ ID NO: 754963 - DNA, 25 bp, Mus musculus
taataccctacagatgagcgaaaat

SEQ ID NO: 754964 - DNA, 25 bp, Mus musculus
taataccggcataccagagtttcaa

SEQ ID NO: 754965 - DNA, 25 bp, Mus musculus
taataccggcattccagagtttcaa

SEQ ID NO: 754966 - DNA, 25 bp, Mus musculus
taatacctatgcatccatttcacct

SEQ ID NO: 754967 - DNA, 25 bp, Mus musculus
taatacctatgcttccatttcacct

SEQ ID NO: 754968 - DNA, 25 bp, Mus musculus
taatacctcactagaacttcccttt

SEQ ID NO: 754969 - DNA, 25 bp, Mus musculus
taatacctcacttgaacttcccttt

SEQ ID NO: 754970 - DNA, 25 bp, Mus musculus
taatacctcttcattgcagcgctgt

SEQ ID NO: 754971 - DNA, 25 bp, Mus musculus
taatacctcttctttgcagcgctgt

SEQ ID NO: 754972 - DNA, 25 bp, Mus musculus
taatacctgctcacattacggccat

SEQ ID NO: 754973 - DNA, 25 bp, Mus musculus
taatacctgctctcattacggccat

SEQ ID NO: 754974 - DNA, 25 bp, Mus musculus
taatacctgtaaaccatcctgaagt

SEQ ID NO: 754975 - DNA, 25 bp, Mus musculus
taatacctgtaatccatcctgaagt

SEQ ID NO: 754976 - DNA, 25 bp, Mus musculus
taataccttatcctgagtcttcctc

SEQ ID NO: 754977 - DNA, 25 bp, Mus musculus
taataccttatcgtgagtcttcctc

SEQ ID NO: 754978 - DNA, 25 bp, Mus musculus
taatacgaactccacgttttcaggc

SEQ ID NO: 754979 - DNA, 25 bp, Mus musculus
taatacgaactcgacgttttcaggc

SEQ ID NO: 754980 - DNA, 25 bp, Mus musculus
taatactagcccattgtcctgtctt

SEQ ID NO: 754981 - DNA, 25 bp, Mus musculus
taatactagccctttgtcctgtctt

SEQ ID NO: 754982 - DNA, 25 bp, Mus musculus
taatactaggacaagggccaaacag

SEQ ID NO: 754983 - DNA, 25 bp, Mus musculus
taatactaggactagggccaaacag

SEQ ID NO: 754984 - DNA, 25 bp, Mus musculus
taatactcatccaagaccaaccgtg

SEQ ID NO: 754985 - DNA, 25 bp, Mus musculus
taatactcatcctagaccaaccgtg

SEQ ID NO: 754986 - DNA, 25 bp, Mus musculus
taatactcccttctgttgctatgta

SEQ ID NO: 754987 - DNA, 25 bp, Mus musculus
taatactcccttgtgttgctatgta

SEQ ID NO: 754988 - DNA, 25 bp, Mus musculus
taatactgaggcattagctggtcaa

SEQ ID NO: 754989 - DNA, 25 bp, Mus musculus
taatactgaggctttagctggtcaa

SEQ ID NO: 754990 - DNA, 25 bp, Mus musculus
taatactgtaggaattggtgagccc

SEQ ID NO: 754991 - DNA, 25 bp, Mus musculus
taatactgtaggtattggtgagccc

SEQ ID NO: 754992 - DNA, 25 bp, Mus musculus
taatactgtggtatctcctgttctc

SEQ ID NO: 754993 - DNA, 25 bp, Mus musculus
taatactgtggtttctcctgttctc

SEQ ID NO: 754994 - DNA, 25 bp, Mus musculus
taatacttacctccctcacagagtt

SEQ ID NO: 754995 - DNA, 25 bp, Mus musculus
taatacttacctgcctcacagagtt

SEQ ID NO: 754996 - DNA, 25 bp, Mus musculus
taatacttactgacttgtccctacc

SEQ ID NO: 754997 - DNA, 25 bp, Mus musculus
taatacttactgtcttgtccctacc

SEQ ID NO: 754998 - DNA, 25 bp, Mus musculus
taatacttcatcacagttccaatag

SEQ ID NO: 754999 - DNA, 25 bp, Mus musculus
taatacttcatctcagttccaatag

SEQ ID NO: 755000 - DNA, 25 bp, Mus musculus
taatacttggctcaactggaggatt

SEQ ID NO: 755001 - DNA, 25 bp, Mus musculus
taatacttggctgaactggaggatt

SEQ ID NO: 755002 - DNA, 25 bp, Mus musculus
taatacttgtcactccctaggaggc

SEQ ID NO: 755003 - DNA, 25 bp, Mus musculus
taatacttgtcagtccctaggaggc

SEQ ID NO: 755004 - DNA, 25 bp, Mus musculus
taatacttgtttagtcatggtgaaa

SEQ ID NO: 755005 - DNA, 25 bp, Mus musculus
taatacttgttttgtcatggtgaaa

SEQ ID NO: 755006 - DNA, 25 bp, Mus musculus
taatactttctgctgctgtgtgtgt

SEQ ID NO: 755007 - DNA, 25 bp, Mus musculus
taatactttctggtgctgtgtgtgt

SEQ ID NO: 755008 - DNA, 25 bp, Mus musculus
taatactttgggagtcttctctctg

SEQ ID NO: 755009 - DNA, 25 bp, Mus musculus
taatactttgggtgtcttctctctg

SEQ ID NO: 755010 - DNA, 25 bp, Mus musculus
taatagaaaaagcaccaacctccaa

SEQ ID NO: 755011 - DNA, 25 bp, Mus musculus
taatagaaaaaggaccaacctccaa

SEQ ID NO: 755012 - DNA, 25 bp, Mus musculus
taatagaaagatcctcccgcggctt

SEQ ID NO: 755013 - DNA, 25 bp, Mus musculus
taatagaaagatgctcccgcggctt

SEQ ID NO: 755014 - DNA, 25 bp, Mus musculus
taatagaactttcggatcttggcca

SEQ ID NO: 755015 - DNA, 25 bp, Mus musculus
taatagaactttgggatcttggcca

SEQ ID NO: 755016 - DNA, 25 bp, Mus musculus
taatagaatcctatttcggtcttcg

SEQ ID NO: 755017 - DNA, 25 bp, Mus musculus
taatagaatcctttttcggtcttcg

SEQ ID NO: 755018 - DNA, 25 bp, Mus musculus
taatagacccctacagtcacggagg

SEQ ID NO: 755019 - DNA, 25 bp, Mus musculus
taatagaccccttcagtcacggagg

SEQ ID NO: 755020 - DNA, 25 bp, Mus musculus
taatagactagaaaccacttgacag

SEQ ID NO: 755021 - DNA, 25 bp, Mus musculus
taatagactagataccacttgacag

SEQ ID NO: 755022 - DNA, 25 bp, Mus musculus
taatagagacctcatcctggatgct

SEQ ID NO: 755023 - DNA, 25 bp, Mus musculus
taatagagacctgatcctggatgct

SEQ ID NO: 755024 - DNA, 25 bp, Mus musculus
taatagagacttcagcagccgtgca

SEQ ID NO: 755025 - DNA, 25 bp, Mus musculus
taatagagacttcgcaccatttatt

SEQ ID NO: 755026 - DNA, 25 bp, Mus musculus
taatagagacttgagcagccgtgca

SEQ ID NO: 755027 - DNA, 25 bp, Mus musculus
taatagagacttggcaccatttatt

SEQ ID NO: 755028 - DNA, 25 bp, Mus musculus
taatagaggcgtaggcactttcccc

SEQ ID NO: 755029 - DNA, 25 bp, Mus musculus
taatagaggcgttggcactttcccc

SEQ ID NO: 755030 - DNA, 25 bp, Mus musculus
taatagagggttaagccacggatgc

SEQ ID NO: 755031 - DNA, 25 bp, Mus musculus
taatagagggtttagccacggatgc

SEQ ID NO: 755032 - DNA, 25 bp, Mus musculus
taatagatactgaaggccctaatga

SEQ ID NO: 755033 - DNA, 25 bp, Mus musculus
taatagatactgtaggccctaatga

SEQ ID NO: 755034 - DNA, 25 bp, Mus musculus
taatagattttgctcacatttaccc

SEQ ID NO: 755035 - DNA, 25 bp, Mus musculus
taatagattttggtcacatttaccc

SEQ ID NO: 755036 - DNA, 25 bp, Mus musculus
taatagcacaggctccttccagact

SEQ ID NO: 755037 - DNA, 25 bp, Mus musculus
taatagcacagggtccttccagact

SEQ ID NO: 755038 - DNA, 25 bp, Mus musculus
taatagcaccaaccgtgtggccctg

SEQ ID NO: 755039 - DNA, 25 bp, Mus musculus
taatagcaccaagcgtgtggccctg

SEQ ID NO: 755040 - DNA, 25 bp, Mus musculus
taatagcatactatatttccttccc

SEQ ID NO: 755041 - DNA, 25 bp, Mus musculus
taatagcatactttatttccttccc

SEQ ID NO: 755042 - DNA, 25 bp, Mus musculus
taatagcatggccacaaccccagtg

SEQ ID NO: 755043 - DNA, 25 bp, Mus musculus
taatagcatggcgacaaccccagtg

SEQ ID NO: 755044 - DNA, 25 bp, Mus musculus
taatagcattttaccccaggcttcc

SEQ ID NO: 755045 - DNA, 25 bp, Mus musculus
taatagcatttttccccaggcttcc

SEQ ID NO: 755046 - DNA, 25 bp, Mus musculus
taatagccctacaaattatgctttt

SEQ ID NO: 755047 - DNA, 25 bp, Mus musculus
taatagccctactaattatgctttt

SEQ ID NO: 755048 - DNA, 25 bp, Mus musculus
taatagccgtctactgtactgcctt

SEQ ID NO: 755049 - DNA, 25 bp, Mus musculus
taatagccgtcttctgtactgcctt

SEQ ID NO: 755050 - DNA, 25 bp, Mus musculus
taatagcctcataagccagtcctgg

SEQ ID NO: 755051 - DNA, 25 bp, Mus musculus
taatagcctcattagccagtcctgg

SEQ ID NO: 755052 - DNA, 25 bp, Mus musculus
taatagcctccaaaatgcatcagtg

SEQ ID NO: 755053 - DNA, 25 bp, Mus musculus
taatagcctccataatgcatcagtg

SEQ ID NO: 755054 - DNA, 25 bp, Mus musculus
taatagcctcggatatcaacacagt

SEQ ID NO: 755055 - DNA, 25 bp, Mus musculus
taatagcctcggttatcaacacagt

SEQ ID NO: 755056 - DNA, 25 bp, Mus musculus
taatagcctgatcctttgtgagtca

SEQ ID NO: 755057 - DNA, 25 bp, Mus musculus
taatagcctgatgctttgtgagtca

SEQ ID NO: 755058 - DNA, 25 bp, Mus musculus
taatagcgtacaatgcaggcaccaa

SEQ ID NO: 755059 - DNA, 25 bp, Mus musculus
taatagcgtacattgcaggcaccaa

SEQ ID NO: 755060 - DNA, 25 bp, Mus musculus
taatagcgttcgatatcacaataaa

SEQ ID NO: 755061 - DNA, 25 bp, Mus musculus
taatagcgttcgttatcacaataaa

SEQ ID NO: 755062 - DNA, 25 bp, Mus musculus
taatagctcagccttgttgctctgg

SEQ ID NO: 755063 - DNA, 25 bp, Mus musculus
taatagctcagcgttgttgctctgg

SEQ ID NO: 755064 - DNA, 25 bp, Mus musculus
taatagctctctatgatcatttggg

SEQ ID NO: 755065 - DNA, 25 bp, Mus musculus
taatagctctctttgatcatttggg

SEQ ID NO: 755066 - DNA, 25 bp, Mus musculus
taatagctggccattctggttccga

SEQ ID NO: 755067 - DNA, 25 bp, Mus musculus
taatagctggcctttctggttccga

SEQ ID NO: 755068 - DNA, 25 bp, Mus musculus
taatagctgtctcatattccctcgt

SEQ ID NO: 755069 - DNA, 25 bp, Mus musculus
taatagctgtctgatattccctcgt

SEQ ID NO: 755070 - DNA, 25 bp, Mus musculus
taataggacaagaggctgctggtgc

SEQ ID NO: 755071 - DNA, 25 bp, Mus musculus
taataggacaagtggctgctggtgc

SEQ ID NO: 755072 - DNA, 25 bp, Mus musculus
taataggcattgctttctgcttcct

SEQ ID NO: 755073 - DNA, 25 bp, Mus musculus
taataggcattggtttctgcttcct

SEQ ID NO: 755074 - DNA, 25 bp, Mus musculus
taataggccctcacaccttagcact

SEQ ID NO: 755075 - DNA, 25 bp, Mus musculus
taataggccctctcaccttagcact

SEQ ID NO: 755076 - DNA, 25 bp, Mus musculus
taatagggaaacaaacagctttaat

SEQ ID NO: 755077 - DNA, 25 bp, Mus musculus
taatagggaaactaacagctttaat

SEQ ID NO: 755078 - DNA, 25 bp, Mus musculus
taatagggaaccactgtcagggttt

SEQ ID NO: 755079 - DNA, 25 bp, Mus musculus
taatagggaacctctgtcagggttt

SEQ ID NO: 755080 - DNA, 25 bp, Mus musculus
taatagggcagtaatggtcattttc

SEQ ID NO: 755081 - DNA, 25 bp, Mus musculus
taatagggcagttatggtcattttc

SEQ ID NO: 755082 - DNA, 25 bp, Mus musculus
taatagggcctaattgacaaggaag

SEQ ID NO: 755083 - DNA, 25 bp, Mus musculus
taatagggcctatttgacaaggaag

SEQ ID NO: 755084 - DNA, 25 bp, Mus musculus
taatagggtcttcttctcctcatgc

SEQ ID NO: 755085 - DNA, 25 bp, Mus musculus
taatagggtcttgttctcctcatgc

SEQ ID NO: 755086 - DNA, 25 bp, Mus musculus
taatagtagcttcctttgcctcctc

SEQ ID NO: 755087 - DNA, 25 bp, Mus musculus
taatagtagcttgctttgcctcctc

SEQ ID NO: 755088 - DNA, 25 bp, Mus musculus
taatagtaggagaatgtttagggcc

SEQ ID NO: 755089 - DNA, 25 bp, Mus musculus
taatagtaggagtatgtttagggcc

SEQ ID NO: 755090 - DNA, 25 bp, Mus musculus
taatagtctccgatcagctgagctt

SEQ ID NO: 755091 - DNA, 25 bp, Mus musculus
taatagtctccgttcagctgagctt

SEQ ID NO: 755092 - DNA, 25 bp, Mus musculus
taatagtctttaatctcgggaaact

SEQ ID NO: 755093 - DNA, 25 bp, Mus musculus
taatagtctttattctcgggaaact

SEQ ID NO: 755094 - DNA, 25 bp, Mus musculus
taatagtgacctctcgttctttcaa

SEQ ID NO: 755095 - DNA, 25 bp, Mus musculus
taatagtgacctgtcgttctttcaa

SEQ ID NO: 755096 - DNA, 25 bp, Mus musculus
taatagtgactgatgaacacccagg

SEQ ID NO: 755097 - DNA, 25 bp, Mus musculus
taatagtgactgttgaacacccagg

SEQ ID NO: 755098 - DNA, 25 bp, Mus musculus
taatagtgcattctctcaaggccca

SEQ ID NO: 755099 - DNA, 25 bp, Mus musculus
taatagtgcattgtctcaaggccca

SEQ ID NO: 755100 - DNA, 25 bp, Mus musculus
taatagtgctacactctaggctaag

SEQ ID NO: 755101 - DNA, 25 bp, Mus musculus
taatagtgctactctctaggctaag

SEQ ID NO: 755102 - DNA, 25 bp, Mus musculus
taatagtgctcacagtttctttttt

SEQ ID NO: 755103 - DNA, 25 bp, Mus musculus
taatagtgctcagagtttctttttt

SEQ ID NO: 755104 - DNA, 25 bp, Mus musculus
taatagtgtataactgagccgggca

SEQ ID NO: 755105 - DNA, 25 bp, Mus musculus
taatagtgtatatctgagccgggca

SEQ ID NO: 755106 - DNA, 25 bp, Mus musculus
taatagtgttccagtgccttctaga

SEQ ID NO: 755107 - DNA, 25 bp, Mus musculus
taatagtgttcctgtgccttctaga

SEQ ID NO: 755108 - DNA, 25 bp, Mus musculus
taatagttctccaacttccacaatg

SEQ ID NO: 755109 - DNA, 25 bp, Mus musculus
taatagttctcctacttccacaatg

SEQ ID NO: 755110 - DNA, 25 bp, Mus musculus
taatagttgcttacttgccgtccca

SEQ ID NO: 755111 - DNA, 25 bp, Mus musculus
taatagttgctttcttgccgtccca

SEQ ID NO: 755112 - DNA, 25 bp, Mus musculus
taatagttgtaaattctcagccttt

SEQ ID NO: 755113 - DNA, 25 bp, Mus musculus
taatagttgtaatttctcagccttt

SEQ ID NO: 755114 - DNA, 25 bp, Mus musculus
taatagttgtgtcttgccttcagct

SEQ ID NO: 755115 - DNA, 25 bp, Mus musculus
taatagttgtgtgttgccttcagct

SEQ ID NO: 755116 - DNA, 25 bp, Mus musculus
taatagtttcctccttccagtgttc

SEQ ID NO: 755117 - DNA, 25 bp, Mus musculus
taatagtttcctgcttccagtgttc

SEQ ID NO: 755118 - DNA, 25 bp, Mus musculus
taatagtttgttatcctgctgtgga

SEQ ID NO: 755119 - DNA, 25 bp, Mus musculus
taatagtttgttttcctgctgtgga

SEQ ID NO: 755120 - DNA, 25 bp, Mus musculus
taatagttttctcctttctaaccaa

SEQ ID NO: 755121 - DNA, 25 bp, Mus musculus
taatagttttctgctttctaaccaa

SEQ ID NO: 755122 - DNA, 25 bp, Mus musculus
taatagtttttcacgcctctcatgg

SEQ ID NO: 755123 - DNA, 25 bp, Mus musculus
taatagtttttctcgcctctcatgg

SEQ ID NO: 755124 - DNA, 25 bp, Mus musculus
taatataacctcagcagttcccttg

SEQ ID NO: 755125 - DNA, 25 bp, Mus musculus
taatataacctctgcagttcccttg

SEQ ID NO: 755126 - DNA, 25 bp, Mus musculus
taatataacctgacctgctggcttg

SEQ ID NO: 755127 - DNA, 25 bp, Mus musculus
taatataacctgctgtcagaagcct

SEQ ID NO: 755128 - DNA, 25 bp, Mus musculus
taatataacctggtgtcagaagcct

SEQ ID NO: 755129 - DNA, 25 bp, Mus musculus
taatataacctgtcctgctggcttg

SEQ ID NO: 755130 - DNA, 25 bp, Mus musculus
taatataaggtcacacccatccctg

SEQ ID NO: 755131 - DNA, 25 bp, Mus musculus
taatataaggtctcacccatccctg

SEQ ID NO: 755132 - DNA, 25 bp, Mus musculus
taatataatgcaaccccaagtcccc

SEQ ID NO: 755133 - DNA, 25 bp, Mus musculus
taatataatgcatccccaagtcccc

SEQ ID NO: 755134 - DNA, 25 bp, Mus musculus
taatataattttctccaactacttg

SEQ ID NO: 755135 - DNA, 25 bp, Mus musculus
taatataattttgtccaactacttg

SEQ ID NO: 755136 - DNA, 25 bp, Mus musculus
taatatacattgaacaccgatcctg

SEQ ID NO: 755137 - DNA, 25 bp, Mus musculus
taatatacattgcataccaaccctg

SEQ ID NO: 755138 - DNA, 25 bp, Mus musculus
taatatacattggataccaaccctg

SEQ ID NO: 755139 - DNA, 25 bp, Mus musculus
taatatacattgtacaccgatcctg

SEQ ID NO: 755140 - DNA, 25 bp, Mus musculus
taatataccctcatagcttttgcct

SEQ ID NO: 755141 - DNA, 25 bp, Mus musculus
taatataccctcttagcttttgcct

SEQ ID NO: 755142 - DNA, 25 bp, Mus musculus
taatataccgaaacttagggtgtga

SEQ ID NO: 755143 - DNA, 25 bp, Mus musculus
taatataccgaatcttagggtgtga

SEQ ID NO: 755144 - DNA, 25 bp, Mus musculus
taatatactattacctacatccaga

SEQ ID NO: 755145 - DNA, 25 bp, Mus musculus
taatatactatttcctacatccaga

SEQ ID NO: 755146 - DNA, 25 bp, Mus musculus
taatatagagtcaacctctcctcca

SEQ ID NO: 755147 - DNA, 25 bp, Mus musculus
taatatagagtctacctctcctcca

SEQ ID NO: 755148 - DNA, 25 bp, Mus musculus
taatatagctgcatcctaaacccaa

SEQ ID NO: 755149 - DNA, 25 bp, Mus musculus
taatatagctgcttcctaaacccaa

SEQ ID NO: 755150 - DNA, 25 bp, Mus musculus
taatatagtctcaactcctgggtaa

SEQ ID NO: 755151 - DNA, 25 bp, Mus musculus
taatatagtctctactcctgggtaa

SEQ ID NO: 755152 - DNA, 25 bp, Mus musculus
taatatagtcttcctcatagatcta

SEQ ID NO: 755153 - DNA, 25 bp, Mus musculus
taatatagtcttgctcatagatcta

SEQ ID NO: 755154 - DNA, 25 bp, Mus musculus
taatatatacatcaagccttgccac

SEQ ID NO: 755155 - DNA, 25 bp, Mus musculus
taatatatacatgaagccttgccac

SEQ ID NO: 755156 - DNA, 25 bp, Mus musculus
taatatatacttccgggctgctcta

SEQ ID NO: 755157 - DNA, 25 bp, Mus musculus
taatatatacttgcgggctgctcta

SEQ ID NO: 755158 - DNA, 25 bp, Mus musculus
taatatattgctatttctaaatacc

SEQ ID NO: 755159 - DNA, 25 bp, Mus musculus
taatatattgctttttctaaatacc

SEQ ID NO: 755160 - DNA, 25 bp, Mus musculus
taatatcaacgaaatgcgcgatgcg

SEQ ID NO: 755161 - DNA, 25 bp, Mus musculus
taatatcaacgatatgcgcgatgcg

SEQ ID NO: 755162 - DNA, 25 bp, Mus musculus
taatatcacccgactttattctctg

SEQ ID NO: 755163 - DNA, 25 bp, Mus musculus
taatatcacccgtctttattctctg

SEQ ID NO: 755164 - DNA, 25 bp, Mus musculus
taatatcactatccatttctacaca

SEQ ID NO: 755165 - DNA, 25 bp, Mus musculus
taatatcactatgcatttctacaca

SEQ ID NO: 755166 - DNA, 25 bp, Mus musculus
taatatcacttgcagacttagctaa

SEQ ID NO: 755167 - DNA, 25 bp, Mus musculus
taatatcacttggagacttagctaa

SEQ ID NO: 755168 - DNA, 25 bp, Mus musculus
taatatcagggcatctgctgtcttt

SEQ ID NO: 755169 - DNA, 25 bp, Mus musculus
taatatcagggcttctgctgtcttt

SEQ ID NO: 755170 - DNA, 25 bp, Mus musculus
taatatcattatctttcccctaaaa

SEQ ID NO: 755171 - DNA, 25 bp, Mus musculus
taatatcattatgtttcccctaaaa

SEQ ID NO: 755172 - DNA, 25 bp, Mus musculus
taatatccatatacctcagggctat

SEQ ID NO: 755173 - DNA, 25 bp, Mus musculus
taatatccatattcctcagggctat

SEQ ID NO: 755174 - DNA, 25 bp, Mus musculus
taatatccattcaacctgactgctt

SEQ ID NO: 755175 - DNA, 25 bp, Mus musculus
taatatccattctacctgactgctt

SEQ ID NO: 755176 - DNA, 25 bp, Mus musculus
taatatcccagcagtgagcacctat

SEQ ID NO: 755177 - DNA, 25 bp, Mus musculus
taatatcccagctgtgagcacctat

SEQ ID NO: 755178 - DNA, 25 bp, Mus musculus
taatatcccgttctgttgtcccata

SEQ ID NO: 755179 - DNA, 25 bp, Mus musculus
taatatcccgttgtgttgtcccata

SEQ ID NO: 755180 - DNA, 25 bp, Mus musculus
taatatcctagtccatgaagcagct

SEQ ID NO: 755181 - DNA, 25 bp, Mus musculus
taatatcctagtgcatgaagcagct

SEQ ID NO: 755182 - DNA, 25 bp, Mus musculus
taatatcctgccatttatcctcttt

SEQ ID NO: 755183 - DNA, 25 bp, Mus musculus
taatatcctgccttttatcctcttt

SEQ ID NO: 755184 - DNA, 25 bp, Mus musculus
taatatcctgtgagaacgacctgca

SEQ ID NO: 755185 - DNA, 25 bp, Mus musculus
taatatcctgtgtgaacgacctgca

SEQ ID NO: 755186 - DNA, 25 bp, Mus musculus
taatatccttttctcctggttgtta

SEQ ID NO: 755187 - DNA, 25 bp, Mus musculus
taatatccttttgtcctggttgtta

SEQ ID NO: 755188 - DNA, 25 bp, Mus musculus
taatatcgatacagtgagcattttg

SEQ ID NO: 755189 - DNA, 25 bp, Mus musculus
taatatcgatactgtgagcattttg

SEQ ID NO: 755190 - DNA, 25 bp, Mus musculus
taatatctacgtccaggccatcaat

SEQ ID NO: 755191 - DNA, 25 bp, Mus musculus
taatatctacgtgcaggccatcaat

SEQ ID NO: 755192 - DNA, 25 bp, Mus musculus
taatatctccctattcatcttttgc

SEQ ID NO: 755193 - DNA, 25 bp, Mus musculus
taatatctcccttttcatcttttgc

SEQ ID NO: 755194 - DNA, 25 bp, Mus musculus
taatatctggaaactaaacctttgg

SEQ ID NO: 755195 - DNA, 25 bp, Mus musculus
taatatctggaatctaaacctttgg

SEQ ID NO: 755196 - DNA, 25 bp, Mus musculus
taatatctgtgtcgaggtacgcaac

SEQ ID NO: 755197 - DNA, 25 bp, Mus musculus
taatatctgtgtggaggtacgcaac

SEQ ID NO: 755198 - DNA, 25 bp, Mus musculus
taatatgacaacaatctccaaactg

SEQ ID NO: 755199 - DNA, 25 bp, Mus musculus
taatatgacaactatctccaaactg

SEQ ID NO: 755200 - DNA, 25 bp, Mus musculus
taatatgaccgcatttctgctgttc

SEQ ID NO: 755201 - DNA, 25 bp, Mus musculus
taatatgaccgcttttctgctgttc

SEQ ID NO: 755202 - DNA, 25 bp, Mus musculus
taatatgactgtccagggagcccca

SEQ ID NO: 755203 - DNA, 25 bp, Mus musculus
taatatgactgtgcagggagcccca

SEQ ID NO: 755204 - DNA, 25 bp, Mus musculus
taatatgcacaccacccattgagag

SEQ ID NO: 755205 - DNA, 25 bp, Mus musculus
taatatgcacacgacccattgagag

SEQ ID NO: 755206 - DNA, 25 bp, Mus musculus
taatatgcacttaatccttttcaga

SEQ ID NO: 755207 - DNA, 25 bp, Mus musculus
taatatgcactttatccttttcaga

SEQ ID NO: 755208 - DNA, 25 bp, Mus musculus
taatatgcagatccgggctgtgaat

SEQ ID NO: 755209 - DNA, 25 bp, Mus musculus
taatatgcagatgcgggctgtgaat

SEQ ID NO: 755210 - DNA, 25 bp, Mus musculus
taatatgcgtgccatatctatctat

SEQ ID NO: 755211 - DNA, 25 bp, Mus musculus
taatatgcgtgcgatatctatctat

SEQ ID NO: 755212 - DNA, 25 bp, Mus musculus
taatatgctaatcactctgtgctca

SEQ ID NO: 755213 - DNA, 25 bp, Mus musculus
taatatgctaatgactctgtgctca

SEQ ID NO: 755214 - DNA, 25 bp, Mus musculus
taatatgctcatacgccacgtaact

SEQ ID NO: 755215 - DNA, 25 bp, Mus musculus
taatatgctcattcgccacgtaact

SEQ ID NO: 755216 - DNA, 25 bp, Mus musculus
taatatgctcctaaacacgtatgtt

SEQ ID NO: 755217 - DNA, 25 bp, Mus musculus
taatatgctccttaacacgtatgtt

SEQ ID NO: 755218 - DNA, 25 bp, Mus musculus
taatatgctgcgaaggtcaaaccca

SEQ ID NO: 755219 - DNA, 25 bp, Mus musculus
taatatgctgcgtaggtcaaaccca

SEQ ID NO: 755220 - DNA, 25 bp, Mus musculus
taatatgctttaattgatacacagt

SEQ ID NO: 755221 - DNA, 25 bp, Mus musculus
taatatgctttatttgatacacagt

SEQ ID NO: 755222 - DNA, 25 bp, Mus musculus
taatatggctttattgtactactaa

SEQ ID NO: 755223 - DNA, 25 bp, Mus musculus
taatatggcttttttgtactactaa

SEQ ID NO: 755224 - DNA, 25 bp, Mus musculus
taatatggtcttaatcctgttgata

SEQ ID NO: 755225 - DNA, 25 bp, Mus musculus
taatatggtctttatcctgttgata

SEQ ID NO: 755226 - DNA, 25 bp, Mus musculus
taatatggtttgagagactccttcc

SEQ ID NO: 755227 - DNA, 25 bp, Mus musculus
taatatggtttgtgagactccttcc

SEQ ID NO: 755228 - DNA, 25 bp, Mus musculus
taatatgtaatgatggaaccctggt

SEQ ID NO: 755229 - DNA, 25 bp, Mus musculus
taatatgtaatgttggaaccctggt

SEQ ID NO: 755230 - DNA, 25 bp, Mus musculus
taatatgtctccactgtacagaccc

SEQ ID NO: 755231 - DNA, 25 bp, Mus musculus
taatatgtctcctctgtacagaccc

SEQ ID NO: 755232 - DNA, 25 bp, Mus musculus
taatatgtgcaccatccaggatgat

SEQ ID NO: 755233 - DNA, 25 bp, Mus musculus
taatatgtgcacgatccaggatgat

SEQ ID NO: 755234 - DNA, 25 bp, Mus musculus
taatatgtttataccaccagcattt

SEQ ID NO: 755235 - DNA, 25 bp, Mus musculus
taatatgtttattccaccagcattt

SEQ ID NO: 755236 - DNA, 25 bp, Mus musculus
taatattacccccatgtttacatcc

SEQ ID NO: 755237 - DNA, 25 bp, Mus musculus
taatattaccccgatgtttacatcc

SEQ ID NO: 755238 - DNA, 25 bp, Mus musculus
taatattagctcataggcacgcacc

SEQ ID NO: 755239 - DNA, 25 bp, Mus musculus
taatattagctcttaggcacgcacc

SEQ ID NO: 755240 - DNA, 25 bp, Mus musculus
taatattatctgatttgcctgtact

SEQ ID NO: 755241 - DNA, 25 bp, Mus musculus
taatattatctgttttgcctgtact

SEQ ID NO: 755242 - DNA, 25 bp, Mus musculus
taatattcagaaaccatccccagac

SEQ ID NO: 755243 - DNA, 25 bp, Mus musculus
taatattcagaatccatccccagac

SEQ ID NO: 755244 - DNA, 25 bp, Mus musculus
taatattcatctactgcacagagag

SEQ ID NO: 755245 - DNA, 25 bp, Mus musculus
taatattcatcttctgcacagagag

SEQ ID NO: 755246 - DNA, 25 bp, Mus musculus
taatattccaggcttatccccgagg

SEQ ID NO: 755247 - DNA, 25 bp, Mus musculus
taatattccagggttatccccgagg

SEQ ID NO: 755248 - DNA, 25 bp, Mus musculus
taatattccatcaacctctttggga

SEQ ID NO: 755249 - DNA, 25 bp, Mus musculus
taatattccatctacctctttggga

SEQ ID NO: 755250 - DNA, 25 bp, Mus musculus
taatattcctgtacaccatctactg

SEQ ID NO: 755251 - DNA, 25 bp, Mus musculus
taatattcctgttcaccatctactg

SEQ ID NO: 755252 - DNA, 25 bp, Mus musculus
taatattccttgattaaatgcaaac

SEQ ID NO: 755253 - DNA, 25 bp, Mus musculus
taatattccttgtttaaatgcaaac

SEQ ID NO: 755254 - DNA, 25 bp, Mus musculus
taatattcttagattgaggaccctc

SEQ ID NO: 755255 - DNA, 25 bp, Mus musculus
taatattcttagtttgaggaccctc

SEQ ID NO: 755256 - DNA, 25 bp, Mus musculus
taatattctttcagaccaggtctca

SEQ ID NO: 755257 - DNA, 25 bp, Mus musculus
taatattctttctgaccaggtctca

SEQ ID NO: 755258 - DNA, 25 bp, Mus musculus
taatattgtgagacccctgccactg

SEQ ID NO: 755259 - DNA, 25 bp, Mus musculus
taatattgtgagtcccctgccactg

SEQ ID NO: 755260 - DNA, 25 bp, Mus musculus
taatatttcaaacttcaactgcatg

SEQ ID NO: 755261 - DNA, 25 bp, Mus musculus
taatatttcaaagttcaactgcatg

SEQ ID NO: 755262 - DNA, 25 bp, Mus musculus
taatatttccataagttaccagcaa

SEQ ID NO: 755263 - DNA, 25 bp, Mus musculus
taatatttccattagttaccagcaa

SEQ ID NO: 755264 - DNA, 25 bp, Mus musculus
taatatttccccacctttattggat

SEQ ID NO: 755265 - DNA, 25 bp, Mus musculus
taatatttcccctcctttattggat

SEQ ID NO: 755266 - DNA, 25 bp, Mus musculus
taatatttccgcatcagcttctgga

SEQ ID NO: 755267 - DNA, 25 bp, Mus musculus
taatatttccgcttcagcttctgga

SEQ ID NO: 755268 - DNA, 25 bp, Mus musculus
taatatttctacctcatacccagtt

SEQ ID NO: 755269 - DNA, 25 bp, Mus musculus
taatatttctacgtcatacccagtt

SEQ ID NO: 755270 - DNA, 25 bp, Mus musculus
taatatttctgcatgaacggccttg

SEQ ID NO: 755271 - DNA, 25 bp, Mus musculus
taatatttctgcttgaacggccttg

SEQ ID NO: 755272 - DNA, 25 bp, Mus musculus
taatatttggcactcttccaggaat

SEQ ID NO: 755273 - DNA, 25 bp, Mus musculus
taatatttggcagtcttccaggaat

SEQ ID NO: 755274 - DNA, 25 bp, Mus musculus
taatatttgtgacgtgttgggaacc

SEQ ID NO: 755275 - DNA, 25 bp, Mus musculus
taatatttgtgaggtgttgggaacc

SEQ ID NO: 755276 - DNA, 25 bp, Mus musculus
taatattttcttactaggcaaccac

SEQ ID NO: 755277 - DNA, 25 bp, Mus musculus
taatattttctttctaggcaaccac

SEQ ID NO: 755278 - DNA, 25 bp, Mus musculus
taatattttgccctcttaactagaa

SEQ ID NO: 755279 - DNA, 25 bp, Mus musculus
taatattttgccgtcttaactagaa

SEQ ID NO: 755280 - DNA, 25 bp, Mus musculus
taatcaaaccaccatactgggcaaa

SEQ ID NO: 755281 - DNA, 25 bp, Mus musculus
taatcaaaccacgatactgggcaaa

SEQ ID NO: 755282 - DNA, 25 bp, Mus musculus
taatcaaccattccggagatcctcc

SEQ ID NO: 755283 - DNA, 25 bp, Mus musculus
taatcaaccattgcggagatcctcc

SEQ ID NO: 755284 - DNA, 25 bp, Mus musculus
taatcaacccgaaagccaacttgca

SEQ ID NO: 755285 - DNA, 25 bp, Mus musculus
taatcaacccgatagccaacttgca

SEQ ID NO: 755286 - DNA, 25 bp, Mus musculus
taatcaactcaccatgaccagcaag

SEQ ID NO: 755287 - DNA, 25 bp, Mus musculus
taatcaactcacgatgaccagcaag

SEQ ID NO: 755288 - DNA, 25 bp, Mus musculus
taatcaactgcaagtgtttccttca

SEQ ID NO: 755289 - DNA, 25 bp, Mus musculus
taatcaactgcatgtgtttccttca

SEQ ID NO: 755290 - DNA, 25 bp, Mus musculus
taatcaagaagcctgtgggtctgca

SEQ ID NO: 755291 - DNA, 25 bp, Mus musculus
taatcaagaagcgtgtgggtctgca

SEQ ID NO: 755292 - DNA, 25 bp, Mus musculus
taatcaagagatccactcccttcct

SEQ ID NO: 755293 - DNA, 25 bp, Mus musculus
taatcaagagatgcactcccttcct

SEQ ID NO: 755294 - DNA, 25 bp, Mus musculus
taatcaagatgtactccgaccctgg

SEQ ID NO: 755295 - DNA, 25 bp, Mus musculus
taatcaagatgttctccgaccctgg

SEQ ID NO: 755296 - DNA, 25 bp, Mus musculus
taatcaagcctccttgtgctcttag

SEQ ID NO: 755297 - DNA, 25 bp, Mus musculus
taatcaagcctcgttgtgctcttag

SEQ ID NO: 755298 - DNA, 25 bp, Mus musculus
taatcaaggaggatacgggtctgtt

SEQ ID NO: 755299 - DNA, 25 bp, Mus musculus
taatcaaggaggttacgggtctgtt

SEQ ID NO: 755300 - DNA, 25 bp, Mus musculus
taatcaaggctgacagtgacactaa

SEQ ID NO: 755301 - DNA, 25 bp, Mus musculus
taatcaaggctgtcagtgacactaa

SEQ ID NO: 755302 - DNA, 25 bp, Mus musculus
taatcaagtcctacagcaagtagag

SEQ ID NO: 755303 - DNA, 25 bp, Mus musculus
taatcaagtccttcagcaagtagag

SEQ ID NO: 755304 - DNA, 25 bp, Mus musculus
taatcaagtcttaaccacgtagggt

SEQ ID NO: 755305 - DNA, 25 bp, Mus musculus
taatcaagtctttaccacgtagggt

SEQ ID NO: 755306 - DNA, 25 bp, Mus musculus
taatcaatctcacagctattattat

SEQ ID NO: 755307 - DNA, 25 bp, Mus musculus
taatcaatctcagagctattattat

SEQ ID NO: 755308 - DNA, 25 bp, Mus musculus
taatcaatggtaagtttctttgacc

SEQ ID NO: 755309 - DNA, 25 bp, Mus musculus
taatcaatggtatgtttctttgacc

SEQ ID NO: 755310 - DNA, 25 bp, Mus musculus
taatcaatgtggaaccctgcttact

SEQ ID NO: 755311 - DNA, 25 bp, Mus musculus
taatcaatgtggtaccctgcttact

SEQ ID NO: 755312 - DNA, 25 bp, Mus musculus
taatcaatgtgtaccattgcccggc

SEQ ID NO: 755313 - DNA, 25 bp, Mus musculus
taatcaatgtgttccattgcccggc

SEQ ID NO: 755314 - DNA, 25 bp, Mus musculus
taatcaattgtcataaccttggtgg

SEQ ID NO: 755315 - DNA, 25 bp, Mus musculus
taatcaattgtcttaaccttggtgg

SEQ ID NO: 755316 - DNA, 25 bp, Mus musculus
taatcacaatgcactaaccttctca

SEQ ID NO: 755317 - DNA, 25 bp, Mus musculus
taatcacaatgctctaaccttctca

SEQ ID NO: 755318 - DNA, 25 bp, Mus musculus
taatcacacatgatcttgctataca

SEQ ID NO: 755319 - DNA, 25 bp, Mus musculus
taatcacacatgttcttgctataca

SEQ ID NO: 755320 - DNA, 25 bp, Mus musculus
taatcacacttcatgggttacctcc

SEQ ID NO: 755321 - DNA, 25 bp, Mus musculus
taatcacacttcttgggttacctcc

SEQ ID NO: 755322 - DNA, 25 bp, Mus musculus
taatcacagcaaatgggagctagag

SEQ ID NO: 755323 - DNA, 25 bp, Mus musculus
taatcacagcaattgggagctagag

SEQ ID NO: 755324 - DNA, 25 bp, Mus musculus
taatcacagcatctaagagggccat

SEQ ID NO: 755325 - DNA, 25 bp, Mus musculus
taatcacagcatgtaagagggccat

SEQ ID NO: 755326 - DNA, 25 bp, Mus musculus
taatcacagcctatttttttcaagc

SEQ ID NO: 755327 - DNA, 25 bp, Mus musculus
taatcacagcctttttttttcaagc

SEQ ID NO: 755328 - DNA, 25 bp, Mus musculus
taatcacatcagctgtgtcatcaag

SEQ ID NO: 755329 - DNA, 25 bp, Mus musculus
taatcacatcaggtgtgtcatcaag

SEQ ID NO: 755330 - DNA, 25 bp, Mus musculus
taatcacatggcacagccgtcgcag

SEQ ID NO: 755331 - DNA, 25 bp, Mus musculus
taatcacatggctcagccgtcgcag

SEQ ID NO: 755332 - DNA, 25 bp, Mus musculus
taatcaccaacgagtgcatgctttc

SEQ ID NO: 755333 - DNA, 25 bp, Mus musculus
taatcaccaacgtgtgcatgctttc

SEQ ID NO: 755334 - DNA, 25 bp, Mus musculus
taatcaccacatatctgagtcccag

SEQ ID NO: 755335 - DNA, 25 bp, Mus musculus
taatcaccacatttctgagtcccag

SEQ ID NO: 755336 - DNA, 25 bp, Mus musculus
taatcaccactgagtaccgtccaaa

SEQ ID NO: 755337 - DNA, 25 bp, Mus musculus
taatcaccactgtgtaccgtccaaa

SEQ ID NO: 755338 - DNA, 25 bp, Mus musculus
taatcaccacttccctgtctggaga

SEQ ID NO: 755339 - DNA, 25 bp, Mus musculus
taatcaccacttgcctgtctggaga

SEQ ID NO: 755340 - DNA, 25 bp, Mus musculus
taatcaccagacacctagtgcaaat

SEQ ID NO: 755341 - DNA, 25 bp, Mus musculus
taatcaccagactcctagtgcaaat

SEQ ID NO: 755342 - DNA, 25 bp, Mus musculus
taatcaccagttatcatgttcctca

SEQ ID NO: 755343 - DNA, 25 bp, Mus musculus
taatcaccagttttcatgttcctca

SEQ ID NO: 755344 - DNA, 25 bp, Mus musculus
taatcacccctgaaattgttctaga

SEQ ID NO: 755345 - DNA, 25 bp, Mus musculus
taatcacccctgtaattgttctaga

SEQ ID NO: 755346 - DNA, 25 bp, Mus musculus
taatcaccggtgacgtctaaggctc

SEQ ID NO: 755347 - DNA, 25 bp, Mus musculus
taatcaccggtgtcgtctaaggctc

SEQ ID NO: 755348 - DNA, 25 bp, Mus musculus
taatcaccgtgcctggcccagtgga

SEQ ID NO: 755349 - DNA, 25 bp, Mus musculus
taatcaccgtgcgtggcccagtgga

SEQ ID NO: 755350 - DNA, 25 bp, Mus musculus
taatcacctatcattcttcatctag

SEQ ID NO: 755351 - DNA, 25 bp, Mus musculus
taatcacctatctttcttcatctag

SEQ ID NO: 755352 - DNA, 25 bp, Mus musculus
taatcacctattctgaagttttttg

SEQ ID NO: 755353 - DNA, 25 bp, Mus musculus
taatcacctattgtgaagttttttg

SEQ ID NO: 755354 - DNA, 25 bp, Mus musculus
taatcacctgccctgcacaggacag

SEQ ID NO: 755355 - DNA, 25 bp, Mus musculus
taatcacctgccgtgcacaggacag

SEQ ID NO: 755356 - DNA, 25 bp, Mus musculus
taatcacgctgcacgagaggctgag

SEQ ID NO: 755357 - DNA, 25 bp, Mus musculus
taatcacgctgctcgagaggctgag

SEQ ID NO: 755358 - DNA, 25 bp, Mus musculus
taatcacgtaaccacagcgacagaa

SEQ ID NO: 755359 - DNA, 25 bp, Mus musculus
taatcacgtaacgacagcgacagaa

SEQ ID NO: 755360 - DNA, 25 bp, Mus musculus
taatcactcagacgttgtatcaatt

SEQ ID NO: 755361 - DNA, 25 bp, Mus musculus
taatcactcagaggttgtatcaatt

SEQ ID NO: 755362 - DNA, 25 bp, Mus musculus
taatcactccgcaacatgcaaatgc

SEQ ID NO: 755363 - DNA, 25 bp, Mus musculus
taatcactccgctacatgcaaatgc

SEQ ID NO: 755364 - DNA, 25 bp, Mus musculus
taatcactcttaatatcaactttta

SEQ ID NO: 755365 - DNA, 25 bp, Mus musculus
taatcactcttattatcaactttta

SEQ ID NO: 755366 - DNA, 25 bp, Mus musculus
taatcactctttaaatcactatcag

SEQ ID NO: 755367 - DNA, 25 bp, Mus musculus
taatcactcttttaatcactatcag

SEQ ID NO: 755368 - DNA, 25 bp, Mus musculus
taatcactgagcaagctttccagcc

SEQ ID NO: 755369 - DNA, 25 bp, Mus musculus
taatcactgagctagctttccagcc

SEQ ID NO: 755370 - DNA, 25 bp, Mus musculus
taatcactgaggcaccaatgcagct

SEQ ID NO: 755371 - DNA, 25 bp, Mus musculus
taatcactgagggaccaatgcagct

SEQ ID NO: 755372 - DNA, 25 bp, Mus musculus
taatcactgattagtgtgtccacat

SEQ ID NO: 755373 - DNA, 25 bp, Mus musculus
taatcactgatttgtgtgtccacat

SEQ ID NO: 755374 - DNA, 25 bp, Mus musculus
taatcactgcctcttgcattctggg

SEQ ID NO: 755375 - DNA, 25 bp, Mus musculus
taatcactgcctgttgcattctggg

SEQ ID NO: 755376 - DNA, 25 bp, Mus musculus
taatcactgctaaacttcagttaag

SEQ ID NO: 755377 - DNA, 25 bp, Mus musculus
taatcactgctatacttcagttaag

SEQ ID NO: 755378 - DNA, 25 bp, Mus musculus
taatcactggctattcttactcttc

SEQ ID NO: 755379 - DNA, 25 bp, Mus musculus
taatcactggcttttcttactcttc

SEQ ID NO: 755380 - DNA, 25 bp, Mus musculus
taatcactgggcactgcggcctgat

SEQ ID NO: 755381 - DNA, 25 bp, Mus musculus
taatcactgggctctgcggcctgat

SEQ ID NO: 755382 - DNA, 25 bp, Mus musculus
taatcactgtacatcactgcactct

SEQ ID NO: 755383 - DNA, 25 bp, Mus musculus
taatcactgtacttcactgcactct

SEQ ID NO: 755384 - DNA, 25 bp, Mus musculus
taatcactgttcaagtcctgtgaag

SEQ ID NO: 755385 - DNA, 25 bp, Mus musculus
taatcactgttctagtcctgtgaag

SEQ ID NO: 755386 - DNA, 25 bp, Mus musculus
taatcacttgagcttatgactctaa

SEQ ID NO: 755387 - DNA, 25 bp, Mus musculus
taatcacttgaggttatgactctaa

SEQ ID NO: 755388 - DNA, 25 bp, Mus musculus
taatcagactctctcacatcatatc

SEQ ID NO: 755389 - DNA, 25 bp, Mus musculus
taatcagactctgtcacatcatatc

SEQ ID NO: 755390 - DNA, 25 bp, Mus musculus
taatcagactggcagatgcagatct

SEQ ID NO: 755391 - DNA, 25 bp, Mus musculus
taatcagactgggagatgcagatct

SEQ ID NO: 755392 - DNA, 25 bp, Mus musculus
taatcagagacaccccttgcttcac

SEQ ID NO: 755393 - DNA, 25 bp, Mus musculus
taatcagagacagcccttgcttcac

SEQ ID NO: 755394 - DNA, 25 bp, Mus musculus
taatcagcactaatcataacatcag

SEQ ID NO: 755395 - DNA, 25 bp, Mus musculus
taatcagcactattcataacatcag

SEQ ID NO: 755396 - DNA, 25 bp, Mus musculus
taatcagccaccaagcgcagacact

SEQ ID NO: 755397 - DNA, 25 bp, Mus musculus
taatcagccacctagcgcagacact

SEQ ID NO: 755398 - DNA, 25 bp, Mus musculus
taatcagcccttaagaattttgttt

SEQ ID NO: 755399 - DNA, 25 bp, Mus musculus
taatcagccctttagaattttgttt

SEQ ID NO: 755400 - DNA, 25 bp, Mus musculus
taatcagcctagcaaagccatcaga

SEQ ID NO: 755401 - DNA, 25 bp, Mus musculus
taatcagcctaggaaagccatcaga

SEQ ID NO: 755402 - DNA, 25 bp, Mus musculus
taatcagcgtggctgtccagacttc

SEQ ID NO: 755403 - DNA, 25 bp, Mus musculus
taatcagcgtgggtgtccagacttc

SEQ ID NO: 755404 - DNA, 25 bp, Mus musculus
taatcagctcagaaaacaacagtgt

SEQ ID NO: 755405 - DNA, 25 bp, Mus musculus
taatcagctcagtaaacaacagtgt

SEQ ID NO: 755406 - DNA, 25 bp, Mus musculus
taatcagctcccaacttatacacag

SEQ ID NO: 755407 - DNA, 25 bp, Mus musculus
taatcagctccctacttatacacag

SEQ ID NO: 755408 - DNA, 25 bp, Mus musculus
taatcagctctaatactggatgtat

SEQ ID NO: 755409 - DNA, 25 bp, Mus musculus
taatcagctctattactggatgtat

SEQ ID NO: 755410 - DNA, 25 bp, Mus musculus
taatcagctgctagggcagacgctc

SEQ ID NO: 755411 - DNA, 25 bp, Mus musculus
taatcagctgctctgtgcttagccc

SEQ ID NO: 755412 - DNA, 25 bp, Mus musculus
taatcagctgctgtgtgcttagccc

SEQ ID NO: 755413 - DNA, 25 bp, Mus musculus
taatcagctgcttgggcagacgctc

SEQ ID NO: 755414 - DNA, 25 bp, Mus musculus
taatcagcttgtcactgccccaaga

SEQ ID NO: 755415 - DNA, 25 bp, Mus musculus
taatcagcttgtgactgccccaaga

SEQ ID NO: 755416 - DNA, 25 bp, Mus musculus
taatcaggataaatgctaaggtaaa

SEQ ID NO: 755417 - DNA, 25 bp, Mus musculus
taatcaggataattgctaaggtaaa

SEQ ID NO: 755418 - DNA, 25 bp, Mus musculus
taatcaggatatagctttgtgtttg

SEQ ID NO: 755419 - DNA, 25 bp, Mus musculus
taatcaggatattgctttgtgtttg

SEQ ID NO: 755420 - DNA, 25 bp, Mus musculus
taatcagggtttccttcctagagcg

SEQ ID NO: 755421 - DNA, 25 bp, Mus musculus
taatcagggtttgcttcctagagcg

SEQ ID NO: 755422 - DNA, 25 bp, Mus musculus
taatcaggtgaacagcagcgtggct

SEQ ID NO: 755423 - DNA, 25 bp, Mus musculus
taatcaggtgaagagcagcgtggct

SEQ ID NO: 755424 - DNA, 25 bp, Mus musculus
taatcagtccctattgccactagca

SEQ ID NO: 755425 - DNA, 25 bp, Mus musculus
taatcagtcccttttgccactagca

SEQ ID NO: 755426 - DNA, 25 bp, Mus musculus
taatcagtcttcaaatgccttgcct

SEQ ID NO: 755427 - DNA, 25 bp, Mus musculus
taatcagtcttctaatgccttgcct

SEQ ID NO: 755428 - DNA, 25 bp, Mus musculus
taatcagtgataccaaccctaccag

SEQ ID NO: 755429 - DNA, 25 bp, Mus musculus
taatcagtgatagcaaccctaccag

SEQ ID NO: 755430 - DNA, 25 bp, Mus musculus
taatcagtgattagggccctttaac

SEQ ID NO: 755431 - DNA, 25 bp, Mus musculus
taatcagtgatttgggccctttaac

SEQ ID NO: 755432 - DNA, 25 bp, Mus musculus
taatcagtgcccatggctgtctgat

SEQ ID NO: 755433 - DNA, 25 bp, Mus musculus
taatcagtgcccttggctgtctgat

SEQ ID NO: 755434 - DNA, 25 bp, Mus musculus
taatcagtgtaaccaatgcagtgtg

SEQ ID NO: 755435 - DNA, 25 bp, Mus musculus
taatcagtgtaagcaatgcagtgtg

SEQ ID NO: 755436 - DNA, 25 bp, Mus musculus
taatcagtgtatcaatgagtgtgtg

SEQ ID NO: 755437 - DNA, 25 bp, Mus musculus
taatcagtgtatgaatgagtgtgtg

SEQ ID NO: 755438 - DNA, 25 bp, Mus musculus
taatcagtgtgtcgcttctgcacaa

SEQ ID NO: 755439 - DNA, 25 bp, Mus musculus
taatcagtgtgtggcttctgcacaa

SEQ ID NO: 755440 - DNA, 25 bp, Mus musculus
taatcagttcctacaacccacagga

SEQ ID NO: 755441 - DNA, 25 bp, Mus musculus
taatcagttccttcaacccacagga

SEQ ID NO: 755442 - DNA, 25 bp, Mus musculus
taatcagttgacaggctgcagtaag

SEQ ID NO: 755443 - DNA, 25 bp, Mus musculus
taatcagttgactggctgcagtaag

SEQ ID NO: 755444 - DNA, 25 bp, Mus musculus
taatcagtttgtccgcgctgcaagg

SEQ ID NO: 755445 - DNA, 25 bp, Mus musculus
taatcagtttgtgcgcgctgcaagg

SEQ ID NO: 755446 - DNA, 25 bp, Mus musculus
taatcataattgcttccctgagatg

SEQ ID NO: 755447 - DNA, 25 bp, Mus musculus
taatcataattggttccctgagatg

SEQ ID NO: 755448 - DNA, 25 bp, Mus musculus
taatcatagaggcaaatacattcat

SEQ ID NO: 755449 - DNA, 25 bp, Mus musculus
taatcatagagggaaatacattcat

SEQ ID NO: 755450 - DNA, 25 bp, Mus musculus
taatcatattcaccctccatgagcc

SEQ ID NO: 755451 - DNA, 25 bp, Mus musculus
taatcatattcagcctccatgagcc

SEQ ID NO: 755452 - DNA, 25 bp, Mus musculus
taatcatcacagatttgttccttaa

SEQ ID NO: 755453 - DNA, 25 bp, Mus musculus
taatcatcacagttttgttccttaa

SEQ ID NO: 755454 - DNA, 25 bp, Mus musculus
taatcatccttaagttgaaaaacca

SEQ ID NO: 755455 - DNA, 25 bp, Mus musculus
taatcatccttatgttgaaaaacca

SEQ ID NO: 755456 - DNA, 25 bp, Mus musculus
taatcatctgtcagagctcctcgag

SEQ ID NO: 755457 - DNA, 25 bp, Mus musculus
taatcatctgtctgagctcctcgag

SEQ ID NO: 755458 - DNA, 25 bp, Mus musculus
taatcatcttacagctatccctgca

SEQ ID NO: 755459 - DNA, 25 bp, Mus musculus
taatcatcttactgctatccctgca

SEQ ID NO: 755460 - DNA, 25 bp, Mus musculus
taatcatgaaggacacagttgtggt

SEQ ID NO: 755461 - DNA, 25 bp, Mus musculus
taatcatgaaggtcacagttgtggt

SEQ ID NO: 755462 - DNA, 25 bp, Mus musculus
taatcatgatgaccacggtggtggc

SEQ ID NO: 755463 - DNA, 25 bp, Mus musculus
taatcatgatgagcacggtggtggc

SEQ ID NO: 755464 - DNA, 25 bp, Mus musculus
taatcatgcataaactcccaaggag

SEQ ID NO: 755465 - DNA, 25 bp, Mus musculus
taatcatgcatatactcccaaggag

SEQ ID NO: 755466 - DNA, 25 bp, Mus musculus
taatcatgctaaaaaacgtttttgg

SEQ ID NO: 755467 - DNA, 25 bp, Mus musculus
taatcatgctaataaacgtttttgg

SEQ ID NO: 755468 - DNA, 25 bp, Mus musculus
taatcatgggtgaactcaactcggt

SEQ ID NO: 755469 - DNA, 25 bp, Mus musculus
taatcatgggtgtactcaactcggt

SEQ ID NO: 755470 - DNA, 25 bp, Mus musculus
taatcatgtgatactcttagtggaa

SEQ ID NO: 755471 - DNA, 25 bp, Mus musculus
taatcatgtgattctcttagtggaa

SEQ ID NO: 755472 - DNA, 25 bp, Mus musculus
taatcattagtacactgttgccttg

SEQ ID NO: 755473 - DNA, 25 bp, Mus musculus
taatcattagtagactgttgccttg

SEQ ID NO: 755474 - DNA, 25 bp, Mus musculus
taatcattagttcaatggtgctggg

SEQ ID NO: 755475 - DNA, 25 bp, Mus musculus
taatcattagttgaatggtgctggg

SEQ ID NO: 755476 - DNA, 25 bp, Mus musculus
taatcattccatactagaacaggtg

SEQ ID NO: 755477 - DNA, 25 bp, Mus musculus
taatcattccattctagaacaggtg

SEQ ID NO: 755478 - DNA, 25 bp, Mus musculus
taatcattccttctgatgtacatat

SEQ ID NO: 755479 - DNA, 25 bp, Mus musculus
taatcattccttgtgatgtacatat

SEQ ID NO: 755480 - DNA, 25 bp, Mus musculus
taatcattgttcattcttgctctcc

SEQ ID NO: 755481 - DNA, 25 bp, Mus musculus
taatcattgttctttcttgctctcc

SEQ ID NO: 755482 - DNA, 25 bp, Mus musculus
taatcattgtttactcatccgttat

SEQ ID NO: 755483 - DNA, 25 bp, Mus musculus
taatcattgttttctcatccgttat

SEQ ID NO: 755484 - DNA, 25 bp, Mus musculus
taatcatttggacagaactagaaca

SEQ ID NO: 755485 - DNA, 25 bp, Mus musculus
taatcatttggagagaactagaaca

SEQ ID NO: 755486 - DNA, 25 bp, Mus musculus
taatcattttatcgcacttatttct

SEQ ID NO: 755487 - DNA, 25 bp, Mus musculus
taatcattttatggcacttatttct

SEQ ID NO: 755488 - DNA, 25 bp, Mus musculus
taatcattttcaaggttggcctgcc

SEQ ID NO: 755489 - DNA, 25 bp, Mus musculus
taatcattttcatggttggcctgcc

SEQ ID NO: 755490 - DNA, 25 bp, Mus musculus
taatccaacatgcaaccatctcagg

SEQ ID NO: 755491 - DNA, 25 bp, Mus musculus
taatccaacatggaaccatctcagg

SEQ ID NO: 755492 - DNA, 25 bp, Mus musculus
taatccaacgcaaggccatctcagg

SEQ ID NO: 755493 - DNA, 25 bp, Mus musculus
taatccaacgcatggccatctcagg

SEQ ID NO: 755494 - DNA, 25 bp, Mus musculus
taatccaatgggatctgtacagtag

SEQ ID NO: 755495 - DNA, 25 bp, Mus musculus
taatccaatgggttctgtacagtag

SEQ ID NO: 755496 - DNA, 25 bp, Mus musculus
taatccacaacccagaacctgagga

SEQ ID NO: 755497 - DNA, 25 bp, Mus musculus
taatccacaaccgagaacctgagga

SEQ ID NO: 755498 - DNA, 25 bp, Mus musculus
taatccacatggcaggtttcaggct

SEQ ID NO: 755499 - DNA, 25 bp, Mus musculus
taatccacatgggaggtttcaggct

SEQ ID NO: 755500 - DNA, 25 bp, Mus musculus
taatccaccattattatgaaacaga

SEQ ID NO: 755501 - DNA, 25 bp, Mus musculus
taatccaccatttttatgaaacaga

SEQ ID NO: 755502 - DNA, 25 bp, Mus musculus
taatccaccgtgagtgcctttcttt

SEQ ID NO: 755503 - DNA, 25 bp, Mus musculus
taatccaccgtgtgtgcctttcttt

SEQ ID NO: 755504 - DNA, 25 bp, Mus musculus
taatccacctagacgcaggtctgtt

SEQ ID NO: 755505 - DNA, 25 bp, Mus musculus
taatccacctagtcgcaggtctgtt

SEQ ID NO: 755506 - DNA, 25 bp, Mus musculus
taatccacctctaaacagtactcag

SEQ ID NO: 755507 - DNA, 25 bp, Mus musculus
taatccacctcttaacagtactcag

SEQ ID NO: 755508 - DNA, 25 bp, Mus musculus
taatccacctgtccaatctatcaat

SEQ ID NO: 755509 - DNA, 25 bp, Mus musculus
taatccacctgtgcaatctatcaat

SEQ ID NO: 755510 - DNA, 25 bp, Mus musculus
taatccacgtagacattattgcagg

SEQ ID NO: 755511 - DNA, 25 bp, Mus musculus
taatccacgtagtcattattgcagg

SEQ ID NO: 755512 - DNA, 25 bp, Mus musculus
taatccactcgtatccaagacgtat

SEQ ID NO: 755513 - DNA, 25 bp, Mus musculus
taatccactcgtttccaagacgtat

SEQ ID NO: 755514 - DNA, 25 bp, Mus musculus
taatccactcttacatttccatgac

SEQ ID NO: 755515 - DNA, 25 bp, Mus musculus
taatccactctttcatttccatgac

SEQ ID NO: 755516 - DNA, 25 bp, Mus musculus
taatccactggcacatgactatcac

SEQ ID NO: 755517 - DNA, 25 bp, Mus musculus
taatccactggctcatgactatcac

SEQ ID NO: 755518 - DNA, 25 bp, Mus musculus
taatccacttccagttcctttttat

SEQ ID NO: 755519 - DNA, 25 bp, Mus musculus
taatccacttcctgttcctttttat

SEQ ID NO: 755520 - DNA, 25 bp, Mus musculus
taatccagaactctgcttctctcct

SEQ ID NO: 755521 - DNA, 25 bp, Mus musculus
taatccagaactgtgcttctctcct

SEQ ID NO: 755522 - DNA, 25 bp, Mus musculus
taatccagagcgactcagctggact

SEQ ID NO: 755523 - DNA, 25 bp, Mus musculus
taatccagagcgtctcagctggact

SEQ ID NO: 755524 - DNA, 25 bp, Mus musculus
taatccagcacactgtgggatcgca

SEQ ID NO: 755525 - DNA, 25 bp, Mus musculus
taatccagcacagtgtgggatcgca

SEQ ID NO: 755526 - DNA, 25 bp, Mus musculus
taatccagcactctttttaaaccct

SEQ ID NO: 755527 - DNA, 25 bp, Mus musculus
taatccagcactgtttttaaaccct

SEQ ID NO: 755528 - DNA, 25 bp, Mus musculus
taatccagcctgaatctcttagttc

SEQ ID NO: 755529 - DNA, 25 bp, Mus musculus
taatccagcctgtatctcttagttc

SEQ ID NO: 755530 - DNA, 25 bp, Mus musculus
taatccagcggcagacagtgcagga

SEQ ID NO: 755531 - DNA, 25 bp, Mus musculus
taatccagcggctgacagtgcagga

SEQ ID NO: 755532 - DNA, 25 bp, Mus musculus
taatccaggaaactcgtacttggga

SEQ ID NO: 755533 - DNA, 25 bp, Mus musculus
taatccaggaaagtcgtacttggga

SEQ ID NO: 755534 - DNA, 25 bp, Mus musculus
taatccatacttagtttgcccactg

SEQ ID NO: 755535 - DNA, 25 bp, Mus musculus
taatccatactttgtttgcccactg

SEQ ID NO: 755536 - DNA, 25 bp, Mus musculus
taatccatagacatactgcctgcac

SEQ ID NO: 755537 - DNA, 25 bp, Mus musculus
taatccatagacttactgcctgcac

SEQ ID NO: 755538 - DNA, 25 bp, Mus musculus
taatccataggaatgctattctaag

SEQ ID NO: 755539 - DNA, 25 bp, Mus musculus
taatccataggattgctattctaag

SEQ ID NO: 755540 - DNA, 25 bp, Mus musculus
taatccatctccaatgcggaaaaga

SEQ ID NO: 755541 - DNA, 25 bp, Mus musculus
taatccatctcctatgcggaaaaga

SEQ ID NO: 755542 - DNA, 25 bp, Mus musculus
taatccatgggtacccaggctggtt

SEQ ID NO: 755543 - DNA, 25 bp, Mus musculus
taatccatgggttcccaggctggtt

SEQ ID NO: 755544 - DNA, 25 bp, Mus musculus
taatccattataagcttgttacatt

SEQ ID NO: 755545 - DNA, 25 bp, Mus musculus
taatccattatatgcttgttacatt

SEQ ID NO: 755546 - DNA, 25 bp, Mus musculus
taatcccaacccacgaaaggaagag

SEQ ID NO: 755547 - DNA, 25 bp, Mus musculus
taatcccaaccctcgaaaggaagag

SEQ ID NO: 755548 - DNA, 25 bp, Mus musculus
taatcccacaacatgatcttctctg

SEQ ID NO: 755549 - DNA, 25 bp, Mus musculus
taatcccacaacttgatcttctctg

SEQ ID NO: 755550 - DNA, 25 bp, Mus musculus
taatcccacagcattgacggaaccg

SEQ ID NO: 755551 - DNA, 25 bp, Mus musculus
taatcccacagctttgacggaaccg

SEQ ID NO: 755552 - DNA, 25 bp, Mus musculus
taatcccacttcactattcctttac

SEQ ID NO: 755553 - DNA, 25 bp, Mus musculus
taatcccacttctctattcctttac

SEQ ID NO: 755554 - DNA, 25 bp, Mus musculus
taatcccagaagctcatgctgaaga

SEQ ID NO: 755555 - DNA, 25 bp, Mus musculus
taatcccagaaggtcatgctgaaga

SEQ ID NO: 755556 - DNA, 25 bp, Mus musculus
taatcccagagcaataatcccagag

SEQ ID NO: 755557 - DNA, 25 bp, Mus musculus
taatcccagagctataatcccagag

SEQ ID NO: 755558 - DNA, 25 bp, Mus musculus
taatcccagagtaagccctaacaag

SEQ ID NO: 755559 - DNA, 25 bp, Mus musculus
taatcccagagttagccctaacaag

SEQ ID NO: 755560 - DNA, 25 bp, Mus musculus
taatcccagatgcttgcacctgaga

SEQ ID NO: 755561 - DNA, 25 bp, Mus musculus
taatcccagatggttgcacctgaga

SEQ ID NO: 755562 - DNA, 25 bp, Mus musculus
taatcccagcaaacaacaggaggat

SEQ ID NO: 755563 - DNA, 25 bp, Mus musculus
taatcccagcaatcaacaggaggat

SEQ ID NO: 755564 - DNA, 25 bp, Mus musculus
taatcccagcacaaatgaatcgcaa

SEQ ID NO: 755565 - DNA, 25 bp, Mus musculus
taatcccagcactaatgaatcgcaa

SEQ ID NO: 755566 - DNA, 25 bp, Mus musculus
taatcccagcatcaacagtcggagg

SEQ ID NO: 755567 - DNA, 25 bp, Mus musculus
taatcccagcatcttcagtgtagaa

SEQ ID NO: 755568 - DNA, 25 bp, Mus musculus
taatcccagcatgaacagtcggagg

SEQ ID NO: 755569 - DNA, 25 bp, Mus musculus
taatcccagcatgttcagtgtagaa

SEQ ID NO: 755570 - DNA, 25 bp, Mus musculus
taatcccagcctatgtcctgtcaca

SEQ ID NO: 755571 - DNA, 25 bp, Mus musculus
taatcccagcctttgtcctgtcaca

SEQ ID NO: 755572 - DNA, 25 bp, Mus musculus
taatcccagcgtcgtaactctgtgt

SEQ ID NO: 755573 - DNA, 25 bp, Mus musculus
taatcccagcgtggtaactctgtgt

SEQ ID NO: 755574 - DNA, 25 bp, Mus musculus
taatcccaggaaccactagcagtag

SEQ ID NO: 755575 - DNA, 25 bp, Mus musculus
taatcccaggaagcactagcagtag

SEQ ID NO: 755576 - DNA, 25 bp, Mus musculus
taatcccaggagcacttgctgtgag

SEQ ID NO: 755577 - DNA, 25 bp, Mus musculus
taatcccaggaggacttgctgtgag

SEQ ID NO: 755578 - DNA, 25 bp, Mus musculus
taatcccagtatacaaggcccaata

SEQ ID NO: 755579 - DNA, 25 bp, Mus musculus
taatcccagtatacccatttaatct

SEQ ID NO: 755580 - DNA, 25 bp, Mus musculus
taatcccagtattcaaggcccaata

SEQ ID NO: 755581 - DNA, 25 bp, Mus musculus
taatcccagtattcccatttaatct

SEQ ID NO: 755582 - DNA, 25 bp, Mus musculus
taatcccatatgcacttgttcataa

SEQ ID NO: 755583 - DNA, 25 bp, Mus musculus
taatcccatatggacttgttcataa

SEQ ID NO: 755584 - DNA, 25 bp, Mus musculus
taatcccatcgtatcatggctaacc

SEQ ID NO: 755585 - DNA, 25 bp, Mus musculus
taatcccatcgtttcatggctaacc

SEQ ID NO: 755586 - DNA, 25 bp, Mus musculus
taatcccatggaagtgaggctctcg

SEQ ID NO: 755587 - DNA, 25 bp, Mus musculus
taatcccatggatgtgaggctctcg

SEQ ID NO: 755588 - DNA, 25 bp, Mus musculus
taatcccctcctaattcttaactca

SEQ ID NO: 755589 - DNA, 25 bp, Mus musculus
taatcccctccttattcttaactca

SEQ ID NO: 755590 - DNA, 25 bp, Mus musculus
taatcccctcttattgacctcgtgg

SEQ ID NO: 755591 - DNA, 25 bp, Mus musculus
taatcccctctttttgacctcgtgg

SEQ ID NO: 755592 - DNA, 25 bp, Mus musculus
taatcccctgagcaaataaagtgtc

SEQ ID NO: 755593 - DNA, 25 bp, Mus musculus
taatcccctgaggaaataaagtgtc

SEQ ID NO: 755594 - DNA, 25 bp, Mus musculus
taatcccctgtgctttattttttgt

SEQ ID NO: 755595 - DNA, 25 bp, Mus musculus
taatcccctgtggtttattttttgt

SEQ ID NO: 755596 - DNA, 25 bp, Mus musculus
taatcccgaaacactgacttacgct

SEQ ID NO: 755597 - DNA, 25 bp, Mus musculus
taatcccgaaactctgacttacgct

SEQ ID NO: 755598 - DNA, 25 bp, Mus musculus
taatcccggaagcaaataaactaag

SEQ ID NO: 755599 - DNA, 25 bp, Mus musculus
taatcccggaaggaaataaactaag

SEQ ID NO: 755600 - DNA, 25 bp, Mus musculus
taatcccggcatatcagaggcagag

SEQ ID NO: 755601 - DNA, 25 bp, Mus musculus
taatcccggcatttcagaggcagag

SEQ ID NO: 755602 - DNA, 25 bp, Mus musculus
taatccctaaccagcaaatcactta

SEQ ID NO: 755603 - DNA, 25 bp, Mus musculus
taatccctaacctgcaaatcactta

SEQ ID NO: 755604 - DNA, 25 bp, Mus musculus
taatccctagatcgtgtgttacgtg

SEQ ID NO: 755605 - DNA, 25 bp, Mus musculus
taatccctagatggtgtgttacgtg

SEQ ID NO: 755606 - DNA, 25 bp, Mus musculus
taatccctcgttaacacatgaatga

SEQ ID NO: 755607 - DNA, 25 bp, Mus musculus
taatccctcgtttacacatgaatga

SEQ ID NO: 755608 - DNA, 25 bp, Mus musculus
taatccctgactagctcatgctgta

SEQ ID NO: 755609 - DNA, 25 bp, Mus musculus
taatccctgactattccacttgatg

SEQ ID NO: 755610 - DNA, 25 bp, Mus musculus
taatccctgacttgctcatgctgta

SEQ ID NO: 755611 - DNA, 25 bp, Mus musculus
taatccctgacttttccacttgatg

SEQ ID NO: 755612 - DNA, 25 bp, Mus musculus
taatccctgcaacacaaatactgta

SEQ ID NO: 755613 - DNA, 25 bp, Mus musculus
taatccctgcaagacaaatactgta

SEQ ID NO: 755614 - DNA, 25 bp, Mus musculus
taatccctgggacagactgttactt

SEQ ID NO: 755615 - DNA, 25 bp, Mus musculus
taatccctgggagagactgttactt

SEQ ID NO: 755616 - DNA, 25 bp, Mus musculus
taatccctgtggctaagggacaagt

SEQ ID NO: 755617 - DNA, 25 bp, Mus musculus
taatccctgtgggtaagggacaagt

SEQ ID NO: 755618 - DNA, 25 bp, Mus musculus
taatccgaggaacgagcttccgagg

SEQ ID NO: 755619 - DNA, 25 bp, Mus musculus
taatccgaggaaggagcttccgagg

SEQ ID NO: 755620 - DNA, 25 bp, Mus musculus
taatccgattcacttcactcaatgt

SEQ ID NO: 755621 - DNA, 25 bp, Mus musculus
taatccgattcagttcactcaatgt

SEQ ID NO: 755622 - DNA, 25 bp, Mus musculus
taatccgccatgcaggtggctcgta

SEQ ID NO: 755623 - DNA, 25 bp, Mus musculus
taatccgccatggaggtggctcgta

SEQ ID NO: 755624 - DNA, 25 bp, Mus musculus
taatccggaaggagtctgctgtact

SEQ ID NO: 755625 - DNA, 25 bp, Mus musculus
taatccggaaggtgtctgctgtact

SEQ ID NO: 755626 - DNA, 25 bp, Mus musculus
taatccgggaaaatctcactttggt

SEQ ID NO: 755627 - DNA, 25 bp, Mus musculus
taatccgggaaattctcactttggt

SEQ ID NO: 755628 - DNA, 25 bp, Mus musculus
taatccgggagaaagacgaagagct

SEQ ID NO: 755629 - DNA, 25 bp, Mus musculus
taatccgggagatagacgaagagct

SEQ ID NO: 755630 - DNA, 25 bp, Mus musculus
taatccgggagtcacactgcggact

SEQ ID NO: 755631 - DNA, 25 bp, Mus musculus
taatccgggagtgacactgcggact

SEQ ID NO: 755632 - DNA, 25 bp, Mus musculus
taatccggtatacatttgactcccc

SEQ ID NO: 755633 - DNA, 25 bp, Mus musculus
taatccggtatagatttgactcccc

SEQ ID NO: 755634 - DNA, 25 bp, Mus musculus
taatccgtactccagctgctcttag

SEQ ID NO: 755635 - DNA, 25 bp, Mus musculus
taatccgtactcgagctgctcttag

SEQ ID NO: 755636 - DNA, 25 bp, Mus musculus
taatccgtccatcaggacaggaccc

SEQ ID NO: 755637 - DNA, 25 bp, Mus musculus
taatccgtccatgaggacaggaccc

SEQ ID NO: 755638 - DNA, 25 bp, Mus musculus
taatcctaaagtcttcacctctctc

SEQ ID NO: 755639 - DNA, 25 bp, Mus musculus
taatcctaaagtgttcacctctctc

SEQ ID NO: 755640 - DNA, 25 bp, Mus musculus
taatcctaagggaacacgtcgtgtt

SEQ ID NO: 755641 - DNA, 25 bp, Mus musculus
taatcctaagggtacacgtcgtgtt

SEQ ID NO: 755642 - DNA, 25 bp, Mus musculus
taatcctacagtccccttagacagc

SEQ ID NO: 755643 - DNA, 25 bp, Mus musculus
taatcctacagtgcccttagacagc

SEQ ID NO: 755644 - DNA, 25 bp, Mus musculus
taatcctacattcacatctttccaa

SEQ ID NO: 755645 - DNA, 25 bp, Mus musculus
taatcctacattgacatctttccaa

SEQ ID NO: 755646 - DNA, 25 bp, Mus musculus
taatcctagaacaccaaaggcagag

SEQ ID NO: 755647 - DNA, 25 bp, Mus musculus
taatcctagaactccaaaggcagag

SEQ ID NO: 755648 - DNA, 25 bp, Mus musculus
taatcctagtatccctagttggtgg

SEQ ID NO: 755649 - DNA, 25 bp, Mus musculus
taatcctagtatgcctagttggtgg

SEQ ID NO: 755650 - DNA, 25 bp, Mus musculus
taatcctattctacctgcttggtga

SEQ ID NO: 755651 - DNA, 25 bp, Mus musculus
taatcctattcttcctgcttggtga

SEQ ID NO: 755652 - DNA, 25 bp, Mus musculus
taatcctcacggaatgcgagcgcat

SEQ ID NO: 755653 - DNA, 25 bp, Mus musculus
taatcctcacggtatgcgagcgcat

SEQ ID NO: 755654 - DNA, 25 bp, Mus musculus
taatcctcagctccaggctaaatct

SEQ ID NO: 755655 - DNA, 25 bp, Mus musculus
taatcctcagctgcaggctaaatct

SEQ ID NO: 755656 - DNA, 25 bp, Mus musculus
taatcctcaggccaggcttacatag

SEQ ID NO: 755657 - DNA, 25 bp, Mus musculus
taatcctcaggcgaggcttacatag

SEQ ID NO: 755658 - DNA, 25 bp, Mus musculus
taatcctcctggcagtgccgagcaa

SEQ ID NO: 755659 - DNA, 25 bp, Mus musculus
taatcctcctgggagtgccgagcaa

SEQ ID NO: 755660 - DNA, 25 bp, Mus musculus
taatcctcctgtattcaccttctag

SEQ ID NO: 755661 - DNA, 25 bp, Mus musculus
taatcctcctgttttcaccttctag

SEQ ID NO: 755662 - DNA, 25 bp, Mus musculus
taatcctcctttcaacaatgtccta

SEQ ID NO: 755663 - DNA, 25 bp, Mus musculus
taatcctcctttgaacaatgtccta

SEQ ID NO: 755664 - DNA, 25 bp, Mus musculus
taatcctcgcacatggactgcagag

SEQ ID NO: 755665 - DNA, 25 bp, Mus musculus
taatcctcgcacttggactgcagag

SEQ ID NO: 755666 - DNA, 25 bp, Mus musculus
taatcctcgctgaaccttcaaggaa

SEQ ID NO: 755667 - DNA, 25 bp, Mus musculus
taatcctcgctgtaccttcaaggaa

SEQ ID NO: 755668 - DNA, 25 bp, Mus musculus
taatcctcgttgagtttcagtacaa

SEQ ID NO: 755669 - DNA, 25 bp, Mus musculus
taatcctcgttgtgtttcagtacaa

SEQ ID NO: 755670 - DNA, 25 bp, Mus musculus
taatcctctcagaccgcagaaattt

SEQ ID NO: 755671 - DNA, 25 bp, Mus musculus
taatcctctcagtccgcagaaattt

SEQ ID NO: 755672 - DNA, 25 bp, Mus musculus
taatcctctcctagttaatccttct

SEQ ID NO: 755673 - DNA, 25 bp, Mus musculus
taatcctctccttgttaatccttct

SEQ ID NO: 755674 - DNA, 25 bp, Mus musculus
taatcctctggccaaccttaggagg

SEQ ID NO: 755675 - DNA, 25 bp, Mus musculus
taatcctctggcgaaccttaggagg

SEQ ID NO: 755676 - DNA, 25 bp, Mus musculus
taatcctctggtcctctacatggaa

SEQ ID NO: 755677 - DNA, 25 bp, Mus musculus
taatcctctggtgctctacatggaa

SEQ ID NO: 755678 - DNA, 25 bp, Mus musculus
taatcctcttctcggccctgtaaaa

SEQ ID NO: 755679 - DNA, 25 bp, Mus musculus
taatcctcttctgggccctgtaaaa

SEQ ID NO: 755680 - DNA, 25 bp, Mus musculus
taatcctcttgtctcacagatccat

SEQ ID NO: 755681 - DNA, 25 bp, Mus musculus
taatcctcttgtgtcacagatccat

SEQ ID NO: 755682 - DNA, 25 bp, Mus musculus
taatcctctttaaatcatgtgcaga

SEQ ID NO: 755683 - DNA, 25 bp, Mus musculus
taatcctctttatatcatgtgcaga

SEQ ID NO: 755684 - DNA, 25 bp, Mus musculus
taatcctgacacataaggagacaga

SEQ ID NO: 755685 - DNA, 25 bp, Mus musculus
taatcctgacacttaaggagacaga

SEQ ID NO: 755686 - DNA, 25 bp, Mus musculus
taatcctgatgaccgttctaatgac

SEQ ID NO: 755687 - DNA, 25 bp, Mus musculus
taatcctgatgagcgttctaatgac

SEQ ID NO: 755688 - DNA, 25 bp, Mus musculus
taatcctgcccaatggtcaagaagt

SEQ ID NO: 755689 - DNA, 25 bp, Mus musculus
taatcctgcccattggtcaagaagt

SEQ ID NO: 755690 - DNA, 25 bp, Mus musculus
taatcctgctctaggtaagtttttt

SEQ ID NO: 755691 - DNA, 25 bp, Mus musculus
taatcctgctcttggtaagtttttt

SEQ ID NO: 755692 - DNA, 25 bp, Mus musculus
taatcctgcttgacgggcacagagc

SEQ ID NO: 755693 - DNA, 25 bp, Mus musculus
taatcctgcttgtcgggcacagagc

SEQ ID NO: 755694 - DNA, 25 bp, Mus musculus
taatcctggagtaagtgacactgag

SEQ ID NO: 755695 - DNA, 25 bp, Mus musculus
taatcctggagttagtgacactgag

SEQ ID NO: 755696 - DNA, 25 bp, Mus musculus
taatcctggcacaccacagccagat

SEQ ID NO: 755697 - DNA, 25 bp, Mus musculus
taatcctggcactccacagccagat

SEQ ID NO: 755698 - DNA, 25 bp, Mus musculus
taatcctggcttatggttcttctac

SEQ ID NO: 755699 - DNA, 25 bp, Mus musculus
taatcctggcttttggttcttctac

SEQ ID NO: 755700 - DNA, 25 bp, Mus musculus
taatcctgggctaactcctatagac

SEQ ID NO: 755701 - DNA, 25 bp, Mus musculus
taatcctgggcttactcctatagac

SEQ ID NO: 755702 - DNA, 25 bp, Mus musculus
taatcctgtactaccctgaattcct

SEQ ID NO: 755703 - DNA, 25 bp, Mus musculus
taatcctgtacttccctgaattcct

SEQ ID NO: 755704 - DNA, 25 bp, Mus musculus
taatcctgtcccagtccttcattca

SEQ ID NO: 755705 - DNA, 25 bp, Mus musculus
taatcctgtccctgtccttcattca

SEQ ID NO: 755706 - DNA, 25 bp, Mus musculus
taatcctgtgaacggctgtatttta

SEQ ID NO: 755707 - DNA, 25 bp, Mus musculus
taatcctgtgaagggctgtatttta

SEQ ID NO: 755708 - DNA, 25 bp, Mus musculus
taatcctgtgagctggaagagccca

SEQ ID NO: 755709 - DNA, 25 bp, Mus musculus
taatcctgtgaggtggaagagccca

SEQ ID NO: 755710 - DNA, 25 bp, Mus musculus
taatcctgtgccatttttcaaaagt

SEQ ID NO: 755711 - DNA, 25 bp, Mus musculus
taatcctgtgccttttttcaaaagt

SEQ ID NO: 755712 - DNA, 25 bp, Mus musculus
taatcctgtgtgaatctctgacctg

SEQ ID NO: 755713 - DNA, 25 bp, Mus musculus
taatcctgtgtgtatctctgacctg

SEQ ID NO: 755714 - DNA, 25 bp, Mus musculus
taatcctgttatcgcattgtcctct

SEQ ID NO: 755715 - DNA, 25 bp, Mus musculus
taatcctgttatggcattgtcctct

SEQ ID NO: 755716 - DNA, 25 bp, Mus musculus
taatccttacaacttgatcctcctg

SEQ ID NO: 755717 - DNA, 25 bp, Mus musculus
taatccttacaagttgatcctcctg

SEQ ID NO: 755718 - DNA, 25 bp, Mus musculus
taatccttcctgattatgcagcaag

SEQ ID NO: 755719 - DNA, 25 bp, Mus musculus
taatccttcctgtttatgcagcaag

SEQ ID NO: 755720 - DNA, 25 bp, Mus musculus
taatccttgcagcagctctgtgtgg

SEQ ID NO: 755721 - DNA, 25 bp, Mus musculus
taatccttgcaggagctctgtgtgg

SEQ ID NO: 755722 - DNA, 25 bp, Mus musculus
taatcctttcaaatactgtcgctcc

SEQ ID NO: 755723 - DNA, 25 bp, Mus musculus
taatcctttcaattactgtcgctcc

SEQ ID NO: 755724 - DNA, 25 bp, Mus musculus
taatcctttcacctagtgctactcc

SEQ ID NO: 755725 - DNA, 25 bp, Mus musculus
taatcctttcacgtagtgctactcc

SEQ ID NO: 755726 - DNA, 25 bp, Mus musculus
taatcctttctcactacataagcca

SEQ ID NO: 755727 - DNA, 25 bp, Mus musculus
taatcctttctctctacataagcca

SEQ ID NO: 755728 - DNA, 25 bp, Mus musculus
taatcctttgcaccacagtcagggt

SEQ ID NO: 755729 - DNA, 25 bp, Mus musculus
taatcctttgcagcacagtcagggt

SEQ ID NO: 755730 - DNA, 25 bp, Mus musculus
taatcgaaacctcagctgggtgttt

SEQ ID NO: 755731 - DNA, 25 bp, Mus musculus
taatcgaaacctgagctgggtgttt

SEQ ID NO: 755732 - DNA, 25 bp, Mus musculus
taatcgaccaggatagtccacttgc

SEQ ID NO: 755733 - DNA, 25 bp, Mus musculus
taatcgaccaggttagtccacttgc

SEQ ID NO: 755734 - DNA, 25 bp, Mus musculus
taatcgacctctcccagatacaggg

SEQ ID NO: 755735 - DNA, 25 bp, Mus musculus
taatcgacctctgccagatacaggg

SEQ ID NO: 755736 - DNA, 25 bp, Mus musculus
taatcgagagtaaaccagccagctg

SEQ ID NO: 755737 - DNA, 25 bp, Mus musculus
taatcgagagtataccagccagctg

SEQ ID NO: 755738 - DNA, 25 bp, Mus musculus
taatcgatacctcagcatccgtgga

SEQ ID NO: 755739 - DNA, 25 bp, Mus musculus
taatcgatacctgagcatccgtgga

SEQ ID NO: 755740 - DNA, 25 bp, Mus musculus
taatcgcaaatgaattccttcaaac

SEQ ID NO: 755741 - DNA, 25 bp, Mus musculus
taatcgcaaatgtattccttcaaac

SEQ ID NO: 755742 - DNA, 25 bp, Mus musculus
taatcgcacactatttcactttggg

SEQ ID NO: 755743 - DNA, 25 bp, Mus musculus
taatcgcacactttttcactttggg

SEQ ID NO: 755744 - DNA, 25 bp, Mus musculus
taatcgcagcggattgtcgtccaaa

SEQ ID NO: 755745 - DNA, 25 bp, Mus musculus
taatcgcagcggtttgtcgtccaaa

SEQ ID NO: 755746 - DNA, 25 bp, Mus musculus
taatcgcccaagctgggtcctgaat

SEQ ID NO: 755747 - DNA, 25 bp, Mus musculus
taatcgcccaaggtgggtcctgaat

SEQ ID NO: 755748 - DNA, 25 bp, Mus musculus
taatcgccccatccggtgtggagaa

SEQ ID NO: 755749 - DNA, 25 bp, Mus musculus
taatcgccccatgcggtgtggagaa

SEQ ID NO: 755750 - DNA, 25 bp, Mus musculus
taatcgcccgacaaatttctatcag

SEQ ID NO: 755751 - DNA, 25 bp, Mus musculus
taatcgcccgactaatttctatcag

SEQ ID NO: 755752 - DNA, 25 bp, Mus musculus
taatcgcctccacctgagaagtgca

SEQ ID NO: 755753 - DNA, 25 bp, Mus musculus
taatcgcctccagctgagaagtgca

SEQ ID NO: 755754 - DNA, 25 bp, Mus musculus
taatcgctcactaacccagggagac

SEQ ID NO: 755755 - DNA, 25 bp, Mus musculus
taatcgctcacttacccagggagac

SEQ ID NO: 755756 - DNA, 25 bp, Mus musculus
taatcgctcagcaactgagatgact

SEQ ID NO: 755757 - DNA, 25 bp, Mus musculus
taatcgctcagctactgagatgact

SEQ ID NO: 755758 - DNA, 25 bp, Mus musculus
taatcgcttggaactaccaccatat

SEQ ID NO: 755759 - DNA, 25 bp, Mus musculus
taatcgcttggatctaccaccatat

SEQ ID NO: 755760 - DNA, 25 bp, Mus musculus
taatcggactgccaaatttcaccgg

SEQ ID NO: 755761 - DNA, 25 bp, Mus musculus
taatcggactgcgaaatttcaccgg

SEQ ID NO: 755762 - DNA, 25 bp, Mus musculus
taatcggagcagatgtggtcacagg

SEQ ID NO: 755763 - DNA, 25 bp, Mus musculus
taatcggagcagttgtggtcacagg

SEQ ID NO: 755764 - DNA, 25 bp, Mus musculus
taatcggattgaaagcgcgccggcc

SEQ ID NO: 755765 - DNA, 25 bp, Mus musculus
taatcggattgatagcgcgccggcc

SEQ ID NO: 755766 - DNA, 25 bp, Mus musculus
taatcggcctgaagcacaggtcctt

SEQ ID NO: 755767 - DNA, 25 bp, Mus musculus
taatcggcctgatgcacaggtcctt

SEQ ID NO: 755768 - DNA, 25 bp, Mus musculus
taatcgggaatgacaggtaccagtt

SEQ ID NO: 755769 - DNA, 25 bp, Mus musculus
taatcgggaatgtcaggtaccagtt

SEQ ID NO: 755770 - DNA, 25 bp, Mus musculus
taatcggtaggtagcaaagctgcct

SEQ ID NO: 755771 - DNA, 25 bp, Mus musculus
taatcggtaggttgcaaagctgcct

SEQ ID NO: 755772 - DNA, 25 bp, Mus musculus
taatcgtagcatcccttatcttagg

SEQ ID NO: 755773 - DNA, 25 bp, Mus musculus
taatcgtagcatgccttatcttagg

SEQ ID NO: 755774 - DNA, 25 bp, Mus musculus
taatcgtccacgaaatccaagagag

SEQ ID NO: 755775 - DNA, 25 bp, Mus musculus
taatcgtccacgtaatccaagagag

SEQ ID NO: 755776 - DNA, 25 bp, Mus musculus
taatcgtcttgcctgaccctcattc

SEQ ID NO: 755777 - DNA, 25 bp, Mus musculus
taatcgtcttgcgtgaccctcattc

SEQ ID NO: 755778 - DNA, 25 bp, Mus musculus
taatcgtctttcacccctgcatggt

SEQ ID NO: 755779 - DNA, 25 bp, Mus musculus
taatcgtctttctcccctgcatggt

SEQ ID NO: 755780 - DNA, 25 bp, Mus musculus
taatcgtgtgaactgtctgtctccc

SEQ ID NO: 755781 - DNA, 25 bp, Mus musculus
taatcgtgtgaagtgtctgtctccc

SEQ ID NO: 755782 - DNA, 25 bp, Mus musculus
taatcgttaagccatatcatctgag

SEQ ID NO: 755783 - DNA, 25 bp, Mus musculus
taatcgttaagcgatatcatctgag

SEQ ID NO: 755784 - DNA, 25 bp, Mus musculus
taatcgttatacacttttactgggt

SEQ ID NO: 755785 - DNA, 25 bp, Mus musculus
taatcgttatactcttttactgggt

SEQ ID NO: 755786 - DNA, 25 bp, Mus musculus
taatctaactggactgtatttcaag

SEQ ID NO: 755787 - DNA, 25 bp, Mus musculus
taatctaactggtctgtatttcaag

SEQ ID NO: 755788 - DNA, 25 bp, Mus musculus
taatctaacttgcatgtcttccatg

SEQ ID NO: 755789 - DNA, 25 bp, Mus musculus
taatctaacttggatgtcttccatg

SEQ ID NO: 755790 - DNA, 25 bp, Mus musculus
taatctaagaagctgtcacacattt

SEQ ID NO: 755791 - DNA, 25 bp, Mus musculus
taatctaagaaggtgtcacacattt

SEQ ID NO: 755792 - DNA, 25 bp, Mus musculus
taatctacacataccatcagtgccc

SEQ ID NO: 755793 - DNA, 25 bp, Mus musculus
taatctacacattccatcagtgccc

SEQ ID NO: 755794 - DNA, 25 bp, Mus musculus
taatctacagagataccgcaatttg

SEQ ID NO: 755795 - DNA, 25 bp, Mus musculus
taatctacagagttaccgcaatttg

SEQ ID NO: 755796 - DNA, 25 bp, Mus musculus
taatctacagcgcttagcctgcaac

SEQ ID NO: 755797 - DNA, 25 bp, Mus musculus
taatctacagcggttagcctgcaac

SEQ ID NO: 755798 - DNA, 25 bp, Mus musculus
taatctacatatcaagccaggactt

SEQ ID NO: 755799 - DNA, 25 bp, Mus musculus
taatctacatatgaagccaggactt

SEQ ID NO: 755800 - DNA, 25 bp, Mus musculus
taatctacatctacagtgggactgg

SEQ ID NO: 755801 - DNA, 25 bp, Mus musculus
taatctacatcttcagtgggactgg

SEQ ID NO: 755802 - DNA, 25 bp, Mus musculus
taatctacattcagccatgtggctg

SEQ ID NO: 755803 - DNA, 25 bp, Mus musculus
taatctacattctgccatgtggctg

SEQ ID NO: 755804 - DNA, 25 bp, Mus musculus
taatctacctgtccttcaatgtcca

SEQ ID NO: 755805 - DNA, 25 bp, Mus musculus
taatctacctgtgcttcaatgtcca

SEQ ID NO: 755806 - DNA, 25 bp, Mus musculus
taatctacggctactagcgtcaacg

SEQ ID NO: 755807 - DNA, 25 bp, Mus musculus
taatctacggcttctagcgtcaacg

SEQ ID NO: 755808 - DNA, 25 bp, Mus musculus
taatctactccgaggttgtttttat

SEQ ID NO: 755809 - DNA, 25 bp, Mus musculus
taatctactccgtggttgtttttat

SEQ ID NO: 755810 - DNA, 25 bp, Mus musculus
taatctacttagcaggatgcccatt

SEQ ID NO: 755811 - DNA, 25 bp, Mus musculus
taatctacttaggaggatgcccatt

SEQ ID NO: 755812 - DNA, 25 bp, Mus musculus
taatctagggacattggtgggacaa

SEQ ID NO: 755813 - DNA, 25 bp, Mus musculus
taatctagggactttggtgggacaa

SEQ ID NO: 755814 - DNA, 25 bp, Mus musculus
taatctaggtctaatactctaaggg

SEQ ID NO: 755815 - DNA, 25 bp, Mus musculus
taatctaggtcttatactctaaggg

SEQ ID NO: 755816 - DNA, 25 bp, Mus musculus
taatctagtcacagtctcaagcctt

SEQ ID NO: 755817 - DNA, 25 bp, Mus musculus
taatctagtcactgtctcaagcctt

SEQ ID NO: 755818 - DNA, 25 bp, Mus musculus
taatctagtctcactgtgagatcac

SEQ ID NO: 755819 - DNA, 25 bp, Mus musculus
taatctagtctctctgtgagatcac

SEQ ID NO: 755820 - DNA, 25 bp, Mus musculus
taatctagttagagcagcttttcat

SEQ ID NO: 755821 - DNA, 25 bp, Mus musculus
taatctagttagtgcagcttttcat

SEQ ID NO: 755822 - DNA, 25 bp, Mus musculus
taatctagttataccctatggtggg

SEQ ID NO: 755823 - DNA, 25 bp, Mus musculus
taatctagttattccctatggtggg

SEQ ID NO: 755824 - DNA, 25 bp, Mus musculus
taatctagtttgatgccttccctca

SEQ ID NO: 755825 - DNA, 25 bp, Mus musculus
taatctagtttgttgccttccctca

SEQ ID NO: 755826 - DNA, 25 bp, Mus musculus
taatctataaataaggagaagtccc

SEQ ID NO: 755827 - DNA, 25 bp, Mus musculus
taatctataaattaggagaagtccc

SEQ ID NO: 755828 - DNA, 25 bp, Mus musculus
taatctatacacactactctttttt

SEQ ID NO: 755829 - DNA, 25 bp, Mus musculus
taatctatacactctactctttttt

SEQ ID NO: 755830 - DNA, 25 bp, Mus musculus
taatctatcaccagcaaaccccttg

SEQ ID NO: 755831 - DNA, 25 bp, Mus musculus
taatctatcacctgcaaaccccttg

SEQ ID NO: 755832 - DNA, 25 bp, Mus musculus
taatctatccgtcaagtggtacctt

SEQ ID NO: 755833 - DNA, 25 bp, Mus musculus
taatctatccgtgaagtggtacctt

SEQ ID NO: 755834 - DNA, 25 bp, Mus musculus
taatctattcttatctctcgctttt

SEQ ID NO: 755835 - DNA, 25 bp, Mus musculus
taatctattcttttctctcgctttt

SEQ ID NO: 755836 - DNA, 25 bp, Mus musculus
taatctcaagagacagcatttttgt

SEQ ID NO: 755837 - DNA, 25 bp, Mus musculus
taatctcaagagtcagcatttttgt

SEQ ID NO: 755838 - DNA, 25 bp, Mus musculus
taatctcacatgaacatggcgcacc

SEQ ID NO: 755839 - DNA, 25 bp, Mus musculus
taatctcacatgtacatggcgcacc

SEQ ID NO: 755840 - DNA, 25 bp, Mus musculus
taatctcacgctcaattgccaactg

SEQ ID NO: 755841 - DNA, 25 bp, Mus musculus
taatctcacgctctatcttgtcatc

SEQ ID NO: 755842 - DNA, 25 bp, Mus musculus
taatctcacgctgaattgccaactg

SEQ ID NO: 755843 - DNA, 25 bp, Mus musculus
taatctcacgctgtatcttgtcatc

SEQ ID NO: 755844 - DNA, 25 bp, Mus musculus
taatctcagagaacctttgttcaag

SEQ ID NO: 755845 - DNA, 25 bp, Mus musculus
taatctcagagatcctttgttcaag

SEQ ID NO: 755846 - DNA, 25 bp, Mus musculus
taatctcagctgaaacccaagttgt

SEQ ID NO: 755847 - DNA, 25 bp, Mus musculus
taatctcagctgtaacccaagttgt

SEQ ID NO: 755848 - DNA, 25 bp, Mus musculus
taatctcaggatcgctgggtaccgt

SEQ ID NO: 755849 - DNA, 25 bp, Mus musculus
taatctcaggatggctgggtaccgt

SEQ ID NO: 755850 - DNA, 25 bp, Mus musculus
taatctcatcacagtgtattctgat

SEQ ID NO: 755851 - DNA, 25 bp, Mus musculus
taatctcatcactgtgtattctgat

SEQ ID NO: 755852 - DNA, 25 bp, Mus musculus
taatctcattctcggccagagctga

SEQ ID NO: 755853 - DNA, 25 bp, Mus musculus
taatctcattctgggccagagctga

SEQ ID NO: 755854 - DNA, 25 bp, Mus musculus
taatctcattggaagctcactcgga

SEQ ID NO: 755855 - DNA, 25 bp, Mus musculus
taatctcattggtagctcactcgga

SEQ ID NO: 755856 - DNA, 25 bp, Mus musculus
taatctccacccactttgaatagtg

SEQ ID NO: 755857 - DNA, 25 bp, Mus musculus
taatctccaccctctttgaatagtg

SEQ ID NO: 755858 - DNA, 25 bp, Mus musculus
taatctcccatcacaggatgttctt

SEQ ID NO: 755859 - DNA, 25 bp, Mus musculus
taatctcccatctcaggatgttctt

SEQ ID NO: 755860 - DNA, 25 bp, Mus musculus
taatctcccggaacggtgatggcat

SEQ ID NO: 755861 - DNA, 25 bp, Mus musculus
taatctcccggatcggtgatggcat

SEQ ID NO: 755862 - DNA, 25 bp, Mus musculus
taatctcccttcactgcattgagca

SEQ ID NO: 755863 - DNA, 25 bp, Mus musculus
taatctcccttctctgcattgagca

SEQ ID NO: 755864 - DNA, 25 bp, Mus musculus
taatctccgtggaacaggctcagat

SEQ ID NO: 755865 - DNA, 25 bp, Mus musculus
taatctccgtggtacaggctcagat

SEQ ID NO: 755866 - DNA, 25 bp, Mus musculus
taatctcctctcaattcttcctaaa

SEQ ID NO: 755867 - DNA, 25 bp, Mus musculus
taatctcctctctattcttcctaaa

SEQ ID NO: 755868 - DNA, 25 bp, Mus musculus
taatctccttagctgtgccttcctt

SEQ ID NO: 755869 - DNA, 25 bp, Mus musculus
taatctccttaggtgtgccttcctt

SEQ ID NO: 755870 - DNA, 25 bp, Mus musculus
taatctccttcaagtccttctttca

SEQ ID NO: 755871 - DNA, 25 bp, Mus musculus
taatctccttcatgtccttctttca

SEQ ID NO: 755872 - DNA, 25 bp, Mus musculus
taatctccttcccttttacaaatgc

SEQ ID NO: 755873 - DNA, 25 bp, Mus musculus
taatctccttccgttttacaaatgc

SEQ ID NO: 755874 - DNA, 25 bp, Mus musculus
taatctcggtagctcgggtgtccaa

SEQ ID NO: 755875 - DNA, 25 bp, Mus musculus
taatctcggtaggtcgggtgtccaa

SEQ ID NO: 755876 - DNA, 25 bp, Mus musculus
taatctcgtaggcttttcttagaaa

SEQ ID NO: 755877 - DNA, 25 bp, Mus musculus
taatctcgtagggttttcttagaaa

SEQ ID NO: 755878 - DNA, 25 bp, Mus musculus
taatctctaaacatgctcctatctg

SEQ ID NO: 755879 - DNA, 25 bp, Mus musculus
taatctctaaacttgctcctatctg

SEQ ID NO: 755880 - DNA, 25 bp, Mus musculus
taatctctaatgaatacctcttgga

SEQ ID NO: 755881 - DNA, 25 bp, Mus musculus
taatctctaatgtatacctcttgga

SEQ ID NO: 755882 - DNA, 25 bp, Mus musculus
taatctctaattatctaggaatcaa

SEQ ID NO: 755883 - DNA, 25 bp, Mus musculus
taatctctaattttctaggaatcaa

SEQ ID NO: 755884 - DNA, 25 bp, Mus musculus
taatctctacagactcagatccgcg

SEQ ID NO: 755885 - DNA, 25 bp, Mus musculus
taatctctacagtctcagatccgcg

SEQ ID NO: 755886 - DNA, 25 bp, Mus musculus
taatctctagctaaatacattaggg

SEQ ID NO: 755887 - DNA, 25 bp, Mus musculus
taatctctagcttaatacattaggg

SEQ ID NO: 755888 - DNA, 25 bp, Mus musculus
taatctctaggcagaatgtgcttac

SEQ ID NO: 755889 - DNA, 25 bp, Mus musculus
taatctctaggctgaatgtgcttac

SEQ ID NO: 755890 - DNA, 25 bp, Mus musculus
taatctctattccatcttcttttcc

SEQ ID NO: 755891 - DNA, 25 bp, Mus musculus
taatctctattcgatcttcttttcc

SEQ ID NO: 755892 - DNA, 25 bp, Mus musculus
taatctctcactcttgcatcatttc

SEQ ID NO: 755893 - DNA, 25 bp, Mus musculus
taatctctcactgttgcatcatttc

SEQ ID NO: 755894 - DNA, 25 bp, Mus musculus
taatctctcagaaggatgtgttcca

SEQ ID NO: 755895 - DNA, 25 bp, Mus musculus
taatctctcagatggatgtgttcca

SEQ ID NO: 755896 - DNA, 25 bp, Mus musculus
taatctctgagaatgctcccagttt

SEQ ID NO: 755897 - DNA, 25 bp, Mus musculus
taatctctgagattgctcccagttt

SEQ ID NO: 755898 - DNA, 25 bp, Mus musculus
taatctctgccacgtgtcccgtgtg

SEQ ID NO: 755899 - DNA, 25 bp, Mus musculus
taatctctgccaggtgtcccgtgtg

SEQ ID NO: 755900 - DNA, 25 bp, Mus musculus
taatctctgcttaatgcaatcctca

SEQ ID NO: 755901 - DNA, 25 bp, Mus musculus
taatctctgctttatgcaatcctca

SEQ ID NO: 755902 - DNA, 25 bp, Mus musculus
taatctctggcgagacgtaccagtt

SEQ ID NO: 755903 - DNA, 25 bp, Mus musculus
taatctctggcgtgacgtaccagtt

SEQ ID NO: 755904 - DNA, 25 bp, Mus musculus
taatctctgggaaatgtctcatgta

SEQ ID NO: 755905 - DNA, 25 bp, Mus musculus
taatctctgggatatgtctcatgta

SEQ ID NO: 755906 - DNA, 25 bp, Mus musculus
taatctctggttagggtctgacctg

SEQ ID NO: 755907 - DNA, 25 bp, Mus musculus
taatctctggtttgggtctgacctg

SEQ ID NO: 755908 - DNA, 25 bp, Mus musculus
taatctctgtggctggccagcactg

SEQ ID NO: 755909 - DNA, 25 bp, Mus musculus
taatctctgtgggtggccagcactg

SEQ ID NO: 755910 - DNA, 25 bp, Mus musculus
taatctcttcaccaagtcagagaag

SEQ ID NO: 755911 - DNA, 25 bp, Mus musculus
taatctcttcacgaagtcagagaag

SEQ ID NO: 755912 - DNA, 25 bp, Mus musculus
taatctgaacctattgcctggcatg

SEQ ID NO: 755913 - DNA, 25 bp, Mus musculus
taatctgaaccttttgcctggcatg

SEQ ID NO: 755914 - DNA, 25 bp, Mus musculus
taatctgaacttatactttggaatg

SEQ ID NO: 755915 - DNA, 25 bp, Mus musculus
taatctgaacttttactttggaatg

SEQ ID NO: 755916 - DNA, 25 bp, Mus musculus
taatctgaagataaaccattttttg

SEQ ID NO: 755917 - DNA, 25 bp, Mus musculus
taatctgaagattaaccattttttg

SEQ ID NO: 755918 - DNA, 25 bp, Mus musculus
taatctgaccccagtgttcctggct

SEQ ID NO: 755919 - DNA, 25 bp, Mus musculus
taatctgacccctgtgttcctggct

SEQ ID NO: 755920 - DNA, 25 bp, Mus musculus
taatctgacttcaaacctcagttag

SEQ ID NO: 755921 - DNA, 25 bp, Mus musculus
taatctgacttctaacctcagttag

SEQ ID NO: 755922 - DNA, 25 bp, Mus musculus
taatctgatgatcttccctcttgca

SEQ ID NO: 755923 - DNA, 25 bp, Mus musculus
taatctgatgatgttccctcttgca

SEQ ID NO: 755924 - DNA, 25 bp, Mus musculus
taatctgatgtaaggcatagctgtt

SEQ ID NO: 755925 - DNA, 25 bp, Mus musculus
taatctgatgtatggcatagctgtt

SEQ ID NO: 755926 - DNA, 25 bp, Mus musculus
taatctgcaactaacctgttttgag

SEQ ID NO: 755927 - DNA, 25 bp, Mus musculus
taatctgcaacttacctgttttgag

SEQ ID NO: 755928 - DNA, 25 bp, Mus musculus
taatctgcagaaatcgggacaccct

SEQ ID NO: 755929 - DNA, 25 bp, Mus musculus
taatctgcagaattcgggacaccct

SEQ ID NO: 755930 - DNA, 25 bp, Mus musculus
taatctgcattgatacatctcggat

SEQ ID NO: 755931 - DNA, 25 bp, Mus musculus
taatctgcattgttacatctcggat

SEQ ID NO: 755932 - DNA, 25 bp, Mus musculus
taatctgccaaactctctatgttaa

SEQ ID NO: 755933 - DNA, 25 bp, Mus musculus
taatctgccaaagtctctatgttaa

SEQ ID NO: 755934 - DNA, 25 bp, Mus musculus
taatctgccctactatcttatagta

SEQ ID NO: 755935 - DNA, 25 bp, Mus musculus
taatctgccctagtatcttatagta

SEQ ID NO: 755936 - DNA, 25 bp, Mus musculus
taatctgccttcagatcagtccggg

SEQ ID NO: 755937 - DNA, 25 bp, Mus musculus
taatctgccttctgatcagtccggg

SEQ ID NO: 755938 - DNA, 25 bp, Mus musculus
taatctgcggacagaaatggcctca

SEQ ID NO: 755939 - DNA, 25 bp, Mus musculus
taatctgcggactgaaatggcctca

SEQ ID NO: 755940 - DNA, 25 bp, Mus musculus
taatctgctgctcaattgtatatga

SEQ ID NO: 755941 - DNA, 25 bp, Mus musculus
taatctgctgctgaattgtatatga

SEQ ID NO: 755942 - DNA, 25 bp, Mus musculus
taatctgctgttacgggtactttct

SEQ ID NO: 755943 - DNA, 25 bp, Mus musculus
taatctgctgtttcgggtactttct

SEQ ID NO: 755944 - DNA, 25 bp, Mus musculus
taatctgctttgaccatagatgcaa

SEQ ID NO: 755945 - DNA, 25 bp, Mus musculus
taatctgctttgtccatagatgcaa

SEQ ID NO: 755946 - DNA, 25 bp, Mus musculus
taatctggactcaaagctccgggcc

SEQ ID NO: 755947 - DNA, 25 bp, Mus musculus
taatctggactctaagctccgggcc

SEQ ID NO: 755948 - DNA, 25 bp, Mus musculus
taatctggatggattccttgctgtt

SEQ ID NO: 755949 - DNA, 25 bp, Mus musculus
taatctggatggtttccttgctgtt

SEQ ID NO: 755950 - DNA, 25 bp, Mus musculus
taatctggcattcagcctgaggcgg

SEQ ID NO: 755951 - DNA, 25 bp, Mus musculus
taatctggcattgagcctgaggcgg

SEQ ID NO: 755952 - DNA, 25 bp, Mus musculus
taatctgtaaggctgctggatcaag

SEQ ID NO: 755953 - DNA, 25 bp, Mus musculus
taatctgtaagggtgctggatcaag

SEQ ID NO: 755954 - DNA, 25 bp, Mus musculus
taatctgtacatacctgatccctcg

SEQ ID NO: 755955 - DNA, 25 bp, Mus musculus
taatctgtacattcctgatccctcg

SEQ ID NO: 755956 - DNA, 25 bp, Mus musculus
taatctgtactgaaccatgggctga

SEQ ID NO: 755957 - DNA, 25 bp, Mus musculus
taatctgtactgtaccatgggctga

SEQ ID NO: 755958 - DNA, 25 bp, Mus musculus
taatctgtagcaaatcttctttcaa

SEQ ID NO: 755959 - DNA, 25 bp, Mus musculus
taatctgtagcatatcttctttcaa

SEQ ID NO: 755960 - DNA, 25 bp, Mus musculus
taatctgtatgacggcggcagagat

SEQ ID NO: 755961 - DNA, 25 bp, Mus musculus
taatctgtatgagggcggcagagat

SEQ ID NO: 755962 - DNA, 25 bp, Mus musculus
taatctgtattccaggccaaccttg

SEQ ID NO: 755963 - DNA, 25 bp, Mus musculus
taatctgtattcgaggccaaccttg

SEQ ID NO: 755964 - DNA, 25 bp, Mus musculus
taatctgtccatacttcagctttaa

SEQ ID NO: 755965 - DNA, 25 bp, Mus musculus
taatctgtccattcttcagctttaa

SEQ ID NO: 755966 - DNA, 25 bp, Mus musculus
taatctgtccctcgctacgactcaa

SEQ ID NO: 755967 - DNA, 25 bp, Mus musculus
taatctgtccctggctacgactcaa

SEQ ID NO: 755968 - DNA, 25 bp, Mus musculus
taatctgttaataattcccgaaaag

SEQ ID NO: 755969 - DNA, 25 bp, Mus musculus
taatctgttaattattcccgaaaag

SEQ ID NO: 755970 - DNA, 25 bp, Mus musculus
taatctgttattatcctggctcggg

SEQ ID NO: 755971 - DNA, 25 bp, Mus musculus
taatctgttattttcctggctcggg

SEQ ID NO: 755972 - DNA, 25 bp, Mus musculus
taatctgttccacctattgctttct

SEQ ID NO: 755973 - DNA, 25 bp, Mus musculus
taatctgttccagctattgctttct

SEQ ID NO: 755974 - DNA, 25 bp, Mus musculus
taatcttaagttcaccatccccaca

SEQ ID NO: 755975 - DNA, 25 bp, Mus musculus
taatcttaagttgaccatccccaca

SEQ ID NO: 755976 - DNA, 25 bp, Mus musculus
taatcttacgccataatcttaggtg

SEQ ID NO: 755977 - DNA, 25 bp, Mus musculus
taatcttacgccttaatcttaggtg

SEQ ID NO: 755978 - DNA, 25 bp, Mus musculus
taatcttagcacatgtaaaacggag

SEQ ID NO: 755979 - DNA, 25 bp, Mus musculus
taatcttagcacttgtaaaacggag

SEQ ID NO: 755980 - DNA, 25 bp, Mus musculus
taatcttcaactctgctgttccact

SEQ ID NO: 755981 - DNA, 25 bp, Mus musculus
taatcttcaactgtgctgttccact

SEQ ID NO: 755982 - DNA, 25 bp, Mus musculus
taatcttcagtccttatctttctca

SEQ ID NO: 755983 - DNA, 25 bp, Mus musculus
taatcttcagtcgttatctttctca

SEQ ID NO: 755984 - DNA, 25 bp, Mus musculus
taatcttcagttcagttgtaggcat

SEQ ID NO: 755985 - DNA, 25 bp, Mus musculus
taatcttcagttgagttgtaggcat

SEQ ID NO: 755986 - DNA, 25 bp, Mus musculus
taatcttcatacatggtggatgggt

SEQ ID NO: 755987 - DNA, 25 bp, Mus musculus
taatcttcatacttggtggatgggt

SEQ ID NO: 755988 - DNA, 25 bp, Mus musculus
taatcttcccatcgaatttatggct

SEQ ID NO: 755989 - DNA, 25 bp, Mus musculus
taatcttcccatggaatttatggct

SEQ ID NO: 755990 - DNA, 25 bp, Mus musculus
taatcttcctccctgctctaaagaa

SEQ ID NO: 755991 - DNA, 25 bp, Mus musculus
taatcttcctccgtgctctaaagaa

SEQ ID NO: 755992 - DNA, 25 bp, Mus musculus
taatcttctggcctggagacccctt

SEQ ID NO: 755993 - DNA, 25 bp, Mus musculus
taatcttctggcgtggagacccctt

SEQ ID NO: 755994 - DNA, 25 bp, Mus musculus
taatcttcttgcatagcctacagag

SEQ ID NO: 755995 - DNA, 25 bp, Mus musculus
taatcttcttgcttagcctacagag

SEQ ID NO: 755996 - DNA, 25 bp, Mus musculus
taatcttgagcccactatgaaaact

SEQ ID NO: 755997 - DNA, 25 bp, Mus musculus
taatcttgagccgactatgaaaact

SEQ ID NO: 755998 - DNA, 25 bp, Mus musculus
taatcttgccagagcagtgaccaaa

SEQ ID NO: 755999 - DNA, 25 bp, Mus musculus
taatcttgccagtgcagtgaccaaa

SEQ ID NO: 756000 - DNA, 25 bp, Mus musculus
taatcttgcttcaccatgcactata

SEQ ID NO: 756001 - DNA, 25 bp, Mus musculus
taatcttgcttctccatgcactata

SEQ ID NO: 756002 - DNA, 25 bp, Mus musculus
taatcttggaaacacacaggcaaag

SEQ ID NO: 756003 - DNA, 25 bp, Mus musculus
taatcttggaaagacacaggcaaag

SEQ ID NO: 756004 - DNA, 25 bp, Mus musculus
taatcttggactcgcaacaaaagtg

SEQ ID NO: 756005 - DNA, 25 bp, Mus musculus
taatcttggactggcaacaaaagtg

SEQ ID NO: 756006 - DNA, 25 bp, Mus musculus
taatcttggctcattggcaccaggc

SEQ ID NO: 756007 - DNA, 25 bp, Mus musculus
taatcttggctctttggcaccaggc

SEQ ID NO: 756008 - DNA, 25 bp, Mus musculus
taatcttggtgacaggagagcccct

SEQ ID NO: 756009 - DNA, 25 bp, Mus musculus
taatcttggtgagaggagagcccct

SEQ ID NO: 756010 - DNA, 25 bp, Mus musculus
taatcttgtaataggtatgaaccta

SEQ ID NO: 756011 - DNA, 25 bp, Mus musculus
taatcttgtaattggtatgaaccta

SEQ ID NO: 756012 - DNA, 25 bp, Mus musculus
taatcttgtctgaccttcccaaagg

SEQ ID NO: 756013 - DNA, 25 bp, Mus musculus
taatcttgtctgtccttcccaaagg

SEQ ID NO: 756014 - DNA, 25 bp, Mus musculus
taatcttgtgttcgcttcgcgaaac

SEQ ID NO: 756015 - DNA, 25 bp, Mus musculus
taatcttgtgttggcttcgcgaaac

SEQ ID NO: 756016 - DNA, 25 bp, Mus musculus
taatcttgttccaccaatgggtgtt

SEQ ID NO: 756017 - DNA, 25 bp, Mus musculus
taatcttgttcctccaatgggtgtt

SEQ ID NO: 756018 - DNA, 25 bp, Mus musculus
taatctttacctaaccaagcggcag

SEQ ID NO: 756019 - DNA, 25 bp, Mus musculus
taatctttaccttaccaagcggcag

SEQ ID NO: 756020 - DNA, 25 bp, Mus musculus
taatctttagacatgctcagaaatc

SEQ ID NO: 756021 - DNA, 25 bp, Mus musculus
taatctttagacttgctcagaaatc

SEQ ID NO: 756022 - DNA, 25 bp, Mus musculus
taatctttagcaacctccatacgac

SEQ ID NO: 756023 - DNA, 25 bp, Mus musculus
taatctttagcatcctccatacgac

SEQ ID NO: 756024 - DNA, 25 bp, Mus musculus
taatctttatgcaccagcattggcg

SEQ ID NO: 756025 - DNA, 25 bp, Mus musculus
taatctttatgctccagcattggcg

SEQ ID NO: 756026 - DNA, 25 bp, Mus musculus
taatctttcacgatgtctccattca

SEQ ID NO: 756027 - DNA, 25 bp, Mus musculus
taatctttcacgttgtctccattca

SEQ ID NO: 756028 - DNA, 25 bp, Mus musculus
taatctttcccacatagttccacca

SEQ ID NO: 756029 - DNA, 25 bp, Mus musculus
taatctttcccagatagttccacca

SEQ ID NO: 756030 - DNA, 25 bp, Mus musculus
taatctttgaaccactttcgtacct

SEQ ID NO: 756031 - DNA, 25 bp, Mus musculus
taatctttgaacgactttcgtacct

SEQ ID NO: 756032 - DNA, 25 bp, Mus musculus
taatctttgactactcgctgactgc

SEQ ID NO: 756033 - DNA, 25 bp, Mus musculus
taatctttgacttctcgctgactgc

SEQ ID NO: 756034 - DNA, 25 bp, Mus musculus
taatctttggcaatctgcagctgat

SEQ ID NO: 756035 - DNA, 25 bp, Mus musculus
taatctttggcattctgcagctgat

SEQ ID NO: 756036 - DNA, 25 bp, Mus musculus
taatctttgtttccctcacacttag

SEQ ID NO: 756037 - DNA, 25 bp, Mus musculus
taatctttgtttgcctcacacttag

SEQ ID NO: 756038 - DNA, 25 bp, Mus musculus
taatcttttcccagtttgtgtagag

SEQ ID NO: 756039 - DNA, 25 bp, Mus musculus
taatcttttccctgtttgtgtagag

SEQ ID NO: 756040 - DNA, 25 bp, Mus musculus
taatcttttgtcactgcctttcaga

SEQ ID NO: 756041 - DNA, 25 bp, Mus musculus
taatcttttgtctctgcctttcaga

SEQ ID NO: 756042 - DNA, 25 bp, Mus musculus
taatctttttacacttatggtctat

SEQ ID NO: 756043 - DNA, 25 bp, Mus musculus
taatctttttactcttatggtctat

SEQ ID NO: 756044 - DNA, 25 bp, Mus musculus
taatgaaaaagaaggcctgaggagc

SEQ ID NO: 756045 - DNA, 25 bp, Mus musculus
taatgaaaaagatggcctgaggagc

SEQ ID NO: 756046 - DNA, 25 bp, Mus musculus
taatgaaaagttcttgtgtggacag

SEQ ID NO: 756047 - DNA, 25 bp, Mus musculus
taatgaaaagttgttgtgtggacag

SEQ ID NO: 756048 - DNA, 25 bp, Mus musculus
taatgaaaattcaaggcaagtaagt

SEQ ID NO: 756049 - DNA, 25 bp, Mus musculus
taatgaaaattctaggcaagtaagt

SEQ ID NO: 756050 - DNA, 25 bp, Mus musculus
taatgaaaccctacaggaccgcaat

SEQ ID NO: 756051 - DNA, 25 bp, Mus musculus
taatgaaacccttcaggaccgcaat

SEQ ID NO: 756052 - DNA, 25 bp, Mus musculus
taatgaacactacatgtttgggatc

SEQ ID NO: 756053 - DNA, 25 bp, Mus musculus
taatgaacactagatgtttgggatc

SEQ ID NO: 756054 - DNA, 25 bp, Mus musculus
taatgaacagagctctttcctcggg

SEQ ID NO: 756055 - DNA, 25 bp, Mus musculus
taatgaacagaggtctttcctcggg

SEQ ID NO: 756056 - DNA, 25 bp, Mus musculus
taatgaaccttgcttggtctcaacc

SEQ ID NO: 756057 - DNA, 25 bp, Mus musculus
taatgaaccttggttggtctcaacc

SEQ ID NO: 756058 - DNA, 25 bp, Mus musculus
taatgaactgcaaactcagtttttt

SEQ ID NO: 756059 - DNA, 25 bp, Mus musculus
taatgaactgcatactcagtttttt

SEQ ID NO: 756060 - DNA, 25 bp, Mus musculus
taatgaactgtgatggtctctgtgt

SEQ ID NO: 756061 - DNA, 25 bp, Mus musculus
taatgaactgtgttggtctctgtgt

SEQ ID NO: 756062 - DNA, 25 bp, Mus musculus
taatgaagaacacggaggcagcaag

SEQ ID NO: 756063 - DNA, 25 bp, Mus musculus
taatgaagaacagggaggcagcaag

SEQ ID NO: 756064 - DNA, 25 bp, Mus musculus
taatgaagacccagttagaacagta

SEQ ID NO: 756065 - DNA, 25 bp, Mus musculus
taatgaagaccctgttagaacagta

SEQ ID NO: 756066 - DNA, 25 bp, Mus musculus
taatgaagcaatctgtgtgcggcag

SEQ ID NO: 756067 - DNA, 25 bp, Mus musculus
taatgaagcaatgtgtgtgcggcag

SEQ ID NO: 756068 - DNA, 25 bp, Mus musculus
taatgaagcccaccagcttacccat

SEQ ID NO: 756069 - DNA, 25 bp, Mus musculus
taatgaagcccagcagcttacccat

SEQ ID NO: 756070 - DNA, 25 bp, Mus musculus
taatgaagccctaagctcagccatc

SEQ ID NO: 756071 - DNA, 25 bp, Mus musculus
taatgaagcccttagctcagccatc

SEQ ID NO: 756072 - DNA, 25 bp, Mus musculus
taatgaaggaacaggtagtgcagat

SEQ ID NO: 756073 - DNA, 25 bp, Mus musculus
taatgaaggaactggtagtgcagat

SEQ ID NO: 756074 - DNA, 25 bp, Mus musculus
taatgaaggttcctagctcctgctc

SEQ ID NO: 756075 - DNA, 25 bp, Mus musculus
taatgaaggttcgtagctcctgctc

SEQ ID NO: 756076 - DNA, 25 bp, Mus musculus
taatgaagtctgagattgtccaatc

SEQ ID NO: 756077 - DNA, 25 bp, Mus musculus
taatgaagtctgtgattgtccaatc

SEQ ID NO: 756078 - DNA, 25 bp, Mus musculus
taatgaagttttaccacgtaattgc

SEQ ID NO: 756079 - DNA, 25 bp, Mus musculus
taatgaagtttttccacgtaattgc

SEQ ID NO: 756080 - DNA, 25 bp, Mus musculus
taatgaataagtctctccaagctga

SEQ ID NO: 756081 - DNA, 25 bp, Mus musculus
taatgaataagtgtctccaagctga

SEQ ID NO: 756082 - DNA, 25 bp, Mus musculus
taatgaatcctaaaaatcctgccag

SEQ ID NO: 756083 - DNA, 25 bp, Mus musculus
taatgaatcctataaatcctgccag

SEQ ID NO: 756084 - DNA, 25 bp, Mus musculus
taatgaattcacatgtggctcccac

SEQ ID NO: 756085 - DNA, 25 bp, Mus musculus
taatgaattcacttgtggctcccac

SEQ ID NO: 756086 - DNA, 25 bp, Mus musculus
taatgacaacacagtccgtggctcc

SEQ ID NO: 756087 - DNA, 25 bp, Mus musculus
taatgacaacactgtccgtggctcc

SEQ ID NO: 756088 - DNA, 25 bp, Mus musculus
taatgacaactgatccttaggactt

SEQ ID NO: 756089 - DNA, 25 bp, Mus musculus
taatgacaactgttccttaggactt

SEQ ID NO: 756090 - DNA, 25 bp, Mus musculus
taatgacaagttctgggtctgtttc

SEQ ID NO: 756091 - DNA, 25 bp, Mus musculus
taatgacaagttgtgggtctgtttc

SEQ ID NO: 756092 - DNA, 25 bp, Mus musculus
taatgacacaaccagagcccttaat

SEQ ID NO: 756093 - DNA, 25 bp, Mus musculus
taatgacacaacgagagcccttaat

SEQ ID NO: 756094 - DNA, 25 bp, Mus musculus
taatgacacaccatttagcctcaac

SEQ ID NO: 756095 - DNA, 25 bp, Mus musculus
taatgacacaccttttagcctcaac

SEQ ID NO: 756096 - DNA, 25 bp, Mus musculus
taatgacagacacctgcactaccag

SEQ ID NO: 756097 - DNA, 25 bp, Mus musculus
taatgacagacagctgcactaccag

SEQ ID NO: 756098 - DNA, 25 bp, Mus musculus
taatgacagcataggtccctcactc

SEQ ID NO: 756099 - DNA, 25 bp, Mus musculus
taatgacagcattggtccctcactc

SEQ ID NO: 756100 - DNA, 25 bp, Mus musculus
taatgacaggctagagggcagcagc

SEQ ID NO: 756101 - DNA, 25 bp, Mus musculus
taatgacaggcttgagggcagcagc

SEQ ID NO: 756102 - DNA, 25 bp, Mus musculus
taatgacaggtcacactcagctcag

SEQ ID NO: 756103 - DNA, 25 bp, Mus musculus
taatgacaggtctcactcagctcag

SEQ ID NO: 756104 - DNA, 25 bp, Mus musculus
taatgacatccgccaacacacagaa

SEQ ID NO: 756105 - DNA, 25 bp, Mus musculus
taatgacatccggcaacacacagaa

SEQ ID NO: 756106 - DNA, 25 bp, Mus musculus
taatgacatgtaccaaagattttaa

SEQ ID NO: 756107 - DNA, 25 bp, Mus musculus
taatgacatgtagcaaagattttaa

SEQ ID NO: 756108 - DNA, 25 bp, Mus musculus
taatgacatgttccatgtgactggc

SEQ ID NO: 756109 - DNA, 25 bp, Mus musculus
taatgacatgttgcatgtgactggc

SEQ ID NO: 756110 - DNA, 25 bp, Mus musculus
taatgacatttacgccacactgagg

SEQ ID NO: 756111 - DNA, 25 bp, Mus musculus
taatgacatttaggccacactgagg

SEQ ID NO: 756112 - DNA, 25 bp, Mus musculus
taatgaccagcccattgtcttccga

SEQ ID NO: 756113 - DNA, 25 bp, Mus musculus
taatgaccagccgattgtcttccga

SEQ ID NO: 756114 - DNA, 25 bp, Mus musculus
taatgacccatactgagacctatag

SEQ ID NO: 756115 - DNA, 25 bp, Mus musculus
taatgacccatagtgagacctatag

SEQ ID NO: 756116 - DNA, 25 bp, Mus musculus
taatgacccattcagtccaatttgt

SEQ ID NO: 756117 - DNA, 25 bp, Mus musculus
taatgacccattgagtccaatttgt

SEQ ID NO: 756118 - DNA, 25 bp, Mus musculus
taatgacccgagagtttctttgaaa

SEQ ID NO: 756119 - DNA, 25 bp, Mus musculus
taatgacccgagtgtttctttgaaa

SEQ ID NO: 756120 - DNA, 25 bp, Mus musculus
taatgaccctttatgagctggctcg

SEQ ID NO: 756121 - DNA, 25 bp, Mus musculus
taatgaccctttttgagctggctcg

SEQ ID NO: 756122 - DNA, 25 bp, Mus musculus
taatgaccgacacttcaggcgcaaa

SEQ ID NO: 756123 - DNA, 25 bp, Mus musculus
taatgaccgacagttcaggcgcaaa

SEQ ID NO: 756124 - DNA, 25 bp, Mus musculus
taatgacctgcccaacaatctcact

SEQ ID NO: 756125 - DNA, 25 bp, Mus musculus
taatgacctgccgaacaatctcact

SEQ ID NO: 756126 - DNA, 25 bp, Mus musculus
taatgacctgtccttgtgtgtcaca

SEQ ID NO: 756127 - DNA, 25 bp, Mus musculus
taatgacctgtcgttgtgtgtcaca

SEQ ID NO: 756128 - DNA, 25 bp, Mus musculus
taatgaccttagatgagattagaca

SEQ ID NO: 756129 - DNA, 25 bp, Mus musculus
taatgaccttagttgagattagaca

SEQ ID NO: 756130 - DNA, 25 bp, Mus musculus
taatgaccttgcaattgacctgtag

SEQ ID NO: 756131 - DNA, 25 bp, Mus musculus
taatgaccttgctattgacctgtag

SEQ ID NO: 756132 - DNA, 25 bp, Mus musculus
taatgaccttttctgttcttacagt

SEQ ID NO: 756133 - DNA, 25 bp, Mus musculus
taatgaccttttgtgttcttacagt

SEQ ID NO: 756134 - DNA, 25 bp, Mus musculus
taatgacgctgccattccccttaat

SEQ ID NO: 756135 - DNA, 25 bp, Mus musculus
taatgacgctgcgattccccttaat

SEQ ID NO: 756136 - DNA, 25 bp, Mus musculus
taatgacggtgtctttgcctagcat

SEQ ID NO: 756137 - DNA, 25 bp, Mus musculus
taatgacggtgtgtttgcctagcat

SEQ ID NO: 756138 - DNA, 25 bp, Mus musculus
taatgactaagcattcacatacatg

SEQ ID NO: 756139 - DNA, 25 bp, Mus musculus
taatgactaagctttcacatacatg

SEQ ID NO: 756140 - DNA, 25 bp, Mus musculus
taatgactacctacagcatccgtgt

SEQ ID NO: 756141 - DNA, 25 bp, Mus musculus
taatgactaccttcagcatccgtgt

SEQ ID NO: 756142 - DNA, 25 bp, Mus musculus
taatgactatctccacttgaaccct

SEQ ID NO: 756143 - DNA, 25 bp, Mus musculus
taatgactatctgcacttgaaccct

SEQ ID NO: 756144 - DNA, 25 bp, Mus musculus
taatgactattaagcttcctgaggt

SEQ ID NO: 756145 - DNA, 25 bp, Mus musculus
taatgactattatgcttcctgaggt

SEQ ID NO: 756146 - DNA, 25 bp, Mus musculus
taatgactcaataccagccgtccta

SEQ ID NO: 756147 - DNA, 25 bp, Mus musculus
taatgactcaattccagccgtccta

SEQ ID NO: 756148 - DNA, 25 bp, Mus musculus
taatgactccaaccctgagttacca

SEQ ID NO: 756149 - DNA, 25 bp, Mus musculus
taatgactccaagcctgagttacca

SEQ ID NO: 756150 - DNA, 25 bp, Mus musculus
taatgactggagatagcaggctttt

SEQ ID NO: 756151 - DNA, 25 bp, Mus musculus
taatgactggagttagcaggctttt

SEQ ID NO: 756152 - DNA, 25 bp, Mus musculus
taatgactggcacacctggacagct

SEQ ID NO: 756153 - DNA, 25 bp, Mus musculus
taatgactggcagacctggacagct

SEQ ID NO: 756154 - DNA, 25 bp, Mus musculus
taatgacttgtcaacccagggccca

SEQ ID NO: 756155 - DNA, 25 bp, Mus musculus
taatgacttgtctacccagggccca

SEQ ID NO: 756156 - DNA, 25 bp, Mus musculus
taatgacttgtgaagttggatgaac

SEQ ID NO: 756157 - DNA, 25 bp, Mus musculus
taatgacttgtgtagttggatgaac

SEQ ID NO: 756158 - DNA, 25 bp, Mus musculus
taatgactttacaagggctccttta

SEQ ID NO: 756159 - DNA, 25 bp, Mus musculus
taatgactttactagggctccttta

SEQ ID NO: 756160 - DNA, 25 bp, Mus musculus
taatgagaaatacctcccttcgtct

SEQ ID NO: 756161 - DNA, 25 bp, Mus musculus
taatgagaaatagctcccttcgtct

SEQ ID NO: 756162 - DNA, 25 bp, Mus musculus
taatgagaagatcctctcccttgtg

SEQ ID NO: 756163 - DNA, 25 bp, Mus musculus
taatgagaagatgctctcccttgtg

SEQ ID NO: 756164 - DNA, 25 bp, Mus musculus
taatgagagccaaggtgggtacctg

SEQ ID NO: 756165 - DNA, 25 bp, Mus musculus
taatgagagccatggtgggtacctg

SEQ ID NO: 756166 - DNA, 25 bp, Mus musculus
taatgagagcctatctcagtgcaac

SEQ ID NO: 756167 - DNA, 25 bp, Mus musculus
taatgagagcctttctcagtgcaac

SEQ ID NO: 756168 - DNA, 25 bp, Mus musculus
taatgagaggctacctttcgaccat

SEQ ID NO: 756169 - DNA, 25 bp, Mus musculus
taatgagaggcttcctttcgaccat

SEQ ID NO: 756170 - DNA, 25 bp, Mus musculus
taatgagagttccttccggactctt

SEQ ID NO: 756171 - DNA, 25 bp, Mus musculus
taatgagagttcgttccggactctt

SEQ ID NO: 756172 - DNA, 25 bp, Mus musculus
taatgagatatccagccagagccag

SEQ ID NO: 756173 - DNA, 25 bp, Mus musculus
taatgagatatcgagccagagccag

SEQ ID NO: 756174 - DNA, 25 bp, Mus musculus
taatgagatcctccacatgtccttc

SEQ ID NO: 756175 - DNA, 25 bp, Mus musculus
taatgagatcctgcacatgtccttc

SEQ ID NO: 756176 - DNA, 25 bp, Mus musculus
taatgagcacacctggcaccaaggt

SEQ ID NO: 756177 - DNA, 25 bp, Mus musculus
taatgagcacacgtggcaccaaggt

SEQ ID NO: 756178 - DNA, 25 bp, Mus musculus
taatgagcacagagattaacctcta

SEQ ID NO: 756179 - DNA, 25 bp, Mus musculus
taatgagcacagtgattaacctcta

SEQ ID NO: 756180 - DNA, 25 bp, Mus musculus
taatgagcacgcactgtttgacagc

SEQ ID NO: 756181 - DNA, 25 bp, Mus musculus
taatgagcacgctctgtttgacagc

SEQ ID NO: 756182 - DNA, 25 bp, Mus musculus
taatgagcaggaaacaaacatacaa

SEQ ID NO: 756183 - DNA, 25 bp, Mus musculus
taatgagcaggatacaaacatacaa

SEQ ID NO: 756184 - DNA, 25 bp, Mus musculus
taatgagcccatatactgtgaaatt

SEQ ID NO: 756185 - DNA, 25 bp, Mus musculus
taatgagcccatttactgtgaaatt

SEQ ID NO: 756186 - DNA, 25 bp, Mus musculus
taatgagcctcaagcttgctttgct

SEQ ID NO: 756187 - DNA, 25 bp, Mus musculus
taatgagcctcatgcttgctttgct

SEQ ID NO: 756188 - DNA, 25 bp, Mus musculus
taatgagcctcgataagccttccta

SEQ ID NO: 756189 - DNA, 25 bp, Mus musculus
taatgagcctcgttaagccttccta

SEQ ID NO: 756190 - DNA, 25 bp, Mus musculus
taatgagcgcccagtacaccagctg

SEQ ID NO: 756191 - DNA, 25 bp, Mus musculus
taatgagcgccctgtacaccagctg

SEQ ID NO: 756192 - DNA, 25 bp, Mus musculus
taatgagcggccaggagtatcagct

SEQ ID NO: 756193 - DNA, 25 bp, Mus musculus
taatgagcggcctggagtatcagct

SEQ ID NO: 756194 - DNA, 25 bp, Mus musculus
taatgagctactccaatctccaagg

SEQ ID NO: 756195 - DNA, 25 bp, Mus musculus
taatgagctactgcaatctccaagg

SEQ ID NO: 756196 - DNA, 25 bp, Mus musculus
taatgagctcgtaattttgccaaag

SEQ ID NO: 756197 - DNA, 25 bp, Mus musculus
taatgagctcgttattttgccaaag

SEQ ID NO: 756198 - DNA, 25 bp, Mus musculus
taatgagctctgacagtcttgctgc

SEQ ID NO: 756199 - DNA, 25 bp, Mus musculus
taatgagctctgtcagtcttgctgc

SEQ ID NO: 756200 - DNA, 25 bp, Mus musculus
taatgagcttccaaactggtgtgaa

SEQ ID NO: 756201 - DNA, 25 bp, Mus musculus
taatgagcttcctaactggtgtgaa

SEQ ID NO: 756202 - DNA, 25 bp, Mus musculus
taatgaggaagtaggtcattatact

SEQ ID NO: 756203 - DNA, 25 bp, Mus musculus
taatgaggaagttggtcattatact

SEQ ID NO: 756204 - DNA, 25 bp, Mus musculus
taatgaggcattcagagctaacact

SEQ ID NO: 756205 - DNA, 25 bp, Mus musculus
taatgaggcattgagagctaacact

SEQ ID NO: 756206 - DNA, 25 bp, Mus musculus
taatgaggcgttaccgttatcactc

SEQ ID NO: 756207 - DNA, 25 bp, Mus musculus
taatgaggcgtttccgttatcactc

SEQ ID NO: 756208 - DNA, 25 bp, Mus musculus
taatgaggctcgatcaagctgtggt

SEQ ID NO: 756209 - DNA, 25 bp, Mus musculus
taatgaggctcgttcaagctgtggt

SEQ ID NO: 756210 - DNA, 25 bp, Mus musculus
taatgaggctgtagtgcctgctgcg

SEQ ID NO: 756211 - DNA, 25 bp, Mus musculus
taatgaggctgttgtgcctgctgcg

SEQ ID NO: 756212 - DNA, 25 bp, Mus musculus
taatgaggctttactgcggcctgtt

SEQ ID NO: 756213 - DNA, 25 bp, Mus musculus
taatgaggcttttctgcggcctgtt

SEQ ID NO: 756214 - DNA, 25 bp, Mus musculus
taatgagtaattccactgccttatt

SEQ ID NO: 756215 - DNA, 25 bp, Mus musculus
taatgagtaattgcactgccttatt

SEQ ID NO: 756216 - DNA, 25 bp, Mus musculus
taatgagtcagtcagcccaggcctg

SEQ ID NO: 756217 - DNA, 25 bp, Mus musculus
taatgagtcagtgagcccaggcctg

SEQ ID NO: 756218 - DNA, 25 bp, Mus musculus
taatgagtccacactgagcccttaa

SEQ ID NO: 756219 - DNA, 25 bp, Mus musculus
taatgagtccaccaacacccgggtc

SEQ ID NO: 756220 - DNA, 25 bp, Mus musculus
taatgagtccacgaacacccgggtc

SEQ ID NO: 756221 - DNA, 25 bp, Mus musculus
taatgagtccactctgagcccttaa

SEQ ID NO: 756222 - DNA, 25 bp, Mus musculus
taatgagtctctatattctcatagg

SEQ ID NO: 756223 - DNA, 25 bp, Mus musculus
taatgagtctctcgctatacttgtg

SEQ ID NO: 756224 - DNA, 25 bp, Mus musculus
taatgagtctctggctatacttgtg

SEQ ID NO: 756225 - DNA, 25 bp, Mus musculus
taatgagtctctttattctcatagg

SEQ ID NO: 756226 - DNA, 25 bp, Mus musculus
taatgagtgacccagccatgagact

SEQ ID NO: 756227 - DNA, 25 bp, Mus musculus
taatgagtgaccgagccatgagact

SEQ ID NO: 756228 - DNA, 25 bp, Mus musculus
taatgagtgactctccgtgtcagga

SEQ ID NO: 756229 - DNA, 25 bp, Mus musculus
taatgagtgactgtccgtgtcagga

SEQ ID NO: 756230 - DNA, 25 bp, Mus musculus
taatgagtgcccagacgatcacgtc

SEQ ID NO: 756231 - DNA, 25 bp, Mus musculus
taatgagtgccctgacgatcacgtc

SEQ ID NO: 756232 - DNA, 25 bp, Mus musculus
taatgagtgtaacagtcttccaagc

SEQ ID NO: 756233 - DNA, 25 bp, Mus musculus
taatgagtgtaagagtcttccaagc

SEQ ID NO: 756234 - DNA, 25 bp, Mus musculus
taatgagtgtggacgggcttaccgc

SEQ ID NO: 756235 - DNA, 25 bp, Mus musculus
taatgagtgtggtcgggcttaccgc

SEQ ID NO: 756236 - DNA, 25 bp, Mus musculus
taatgagtttttcacccatgcagct

SEQ ID NO: 756237 - DNA, 25 bp, Mus musculus
taatgagtttttgacccatgcagct

SEQ ID NO: 756238 - DNA, 25 bp, Mus musculus
taatgatataatccccttagccaac

SEQ ID NO: 756239 - DNA, 25 bp, Mus musculus
taatgatataatgcccttagccaac

SEQ ID NO: 756240 - DNA, 25 bp, Mus musculus
taatgatcaactagaccacccagtc

SEQ ID NO: 756241 - DNA, 25 bp, Mus musculus
taatgatcaacttgaccacccagtc

SEQ ID NO: 756242 - DNA, 25 bp, Mus musculus
taatgatcagctattctgtttattg

SEQ ID NO: 756243 - DNA, 25 bp, Mus musculus
taatgatcagcttttctgtttattg

SEQ ID NO: 756244 - DNA, 25 bp, Mus musculus
taatgatcctatctggtaattacca

SEQ ID NO: 756245 - DNA, 25 bp, Mus musculus
taatgatcctatgtggtaattacca

SEQ ID NO: 756246 - DNA, 25 bp, Mus musculus
taatgatctatcatttgtacaaaac

SEQ ID NO: 756247 - DNA, 25 bp, Mus musculus
taatgatctatcttttgtacaaaac

SEQ ID NO: 756248 - DNA, 25 bp, Mus musculus
taatgatctcctcaggtggctgtgc

SEQ ID NO: 756249 - DNA, 25 bp, Mus musculus
taatgatctcctgaggtggctgtgc

SEQ ID NO: 756250 - DNA, 25 bp, Mus musculus
taatgatctgcaagtcccggagagc

SEQ ID NO: 756251 - DNA, 25 bp, Mus musculus
taatgatctgcatgtcccggagagc

SEQ ID NO: 756252 - DNA, 25 bp, Mus musculus
taatgatgaatgcactcagctggat

SEQ ID NO: 756253 - DNA, 25 bp, Mus musculus
taatgatgaatggactcagctggat

SEQ ID NO: 756254 - DNA, 25 bp, Mus musculus
taatgattacctctccagcagctgc

SEQ ID NO: 756255 - DNA, 25 bp, Mus musculus
taatgattacctgtccagcagctgc

SEQ ID NO: 756256 - DNA, 25 bp, Mus musculus
taatgattgtctatctacaccctgg

SEQ ID NO: 756257 - DNA, 25 bp, Mus musculus
taatgattgtctttctacaccctgg

SEQ ID NO: 756258 - DNA, 25 bp, Mus musculus
taatgatttcaaaacgccctttccc

SEQ ID NO: 756259 - DNA, 25 bp, Mus musculus
taatgatttcaatacgccctttccc

SEQ ID NO: 756260 - DNA, 25 bp, Mus musculus
taatgatttccaagccctgctcttc

SEQ ID NO: 756261 - DNA, 25 bp, Mus musculus
taatgatttccatgccctgctcttc

SEQ ID NO: 756262 - DNA, 25 bp, Mus musculus
taatgatttctcctatagacccaac

SEQ ID NO: 756263 - DNA, 25 bp, Mus musculus
taatgatttctcgtatagacccaac

SEQ ID NO: 756264 - DNA, 25 bp, Mus musculus
taatgatttgttattactggcttta

SEQ ID NO: 756265 - DNA, 25 bp, Mus musculus
taatgatttgtttttactggcttta

SEQ ID NO: 756266 - DNA, 25 bp, Mus musculus
taatgatttttaaagcacctggact

SEQ ID NO: 756267 - DNA, 25 bp, Mus musculus
taatgatttttatagcacctggact

SEQ ID NO: 756268 - DNA, 25 bp, Mus musculus
taatgcaaaaagcacccctgaccac

SEQ ID NO: 756269 - DNA, 25 bp, Mus musculus
taatgcaaaaaggacccctgaccac

SEQ ID NO: 756270 - DNA, 25 bp, Mus musculus
taatgcaacactaacccaaggtctg

SEQ ID NO: 756271 - DNA, 25 bp, Mus musculus
taatgcaacacttacccaaggtctg

SEQ ID NO: 756272 - DNA, 25 bp, Mus musculus
taatgcaactaaaggttgtgccagc

SEQ ID NO: 756273 - DNA, 25 bp, Mus musculus
taatgcaactaatggttgtgccagc

SEQ ID NO: 756274 - DNA, 25 bp, Mus musculus
taatgcactggacacgaccgcagtt

SEQ ID NO: 756275 - DNA, 25 bp, Mus musculus
taatgcactggagacgaccgcagtt

SEQ ID NO: 756276 - DNA, 25 bp, Mus musculus
taatgcactggtcggtcctttgaca

SEQ ID NO: 756277 - DNA, 25 bp, Mus musculus
taatgcactggtgggtcctttgaca

SEQ ID NO: 756278 - DNA, 25 bp, Mus musculus
taatgcacttagatttcctttaggt

SEQ ID NO: 756279 - DNA, 25 bp, Mus musculus
taatgcacttagttttcctttaggt

SEQ ID NO: 756280 - DNA, 25 bp, Mus musculus
taatgcagaggcacacacctggtca

SEQ ID NO: 756281 - DNA, 25 bp, Mus musculus
taatgcagaggctcacacctggtca

SEQ ID NO: 756282 - DNA, 25 bp, Mus musculus
taatgcagcacaaccagtctcctac

SEQ ID NO: 756283 - DNA, 25 bp, Mus musculus
taatgcagcacatccagtctcctac

SEQ ID NO: 756284 - DNA, 25 bp, Mus musculus
taatgcagcttcaaggactctcctg

SEQ ID NO: 756285 - DNA, 25 bp, Mus musculus
taatgcagcttctaggactctcctg

SEQ ID NO: 756286 - DNA, 25 bp, Mus musculus
taatgcagctttagccttggttctt

SEQ ID NO: 756287 - DNA, 25 bp, Mus musculus
taatgcagcttttgccttggttctt

SEQ ID NO: 756288 - DNA, 25 bp, Mus musculus
taatgcaggagaccttgaggcccca

SEQ ID NO: 756289 - DNA, 25 bp, Mus musculus
taatgcaggagagcttgaggcccca

SEQ ID NO: 756290 - DNA, 25 bp, Mus musculus
taatgcaggcgacctaaccagactt

SEQ ID NO: 756291 - DNA, 25 bp, Mus musculus
taatgcaggcgagctaaccagactt

SEQ ID NO: 756292 - DNA, 25 bp, Mus musculus
taatgcagtcttacttcaaagtggt

SEQ ID NO: 756293 - DNA, 25 bp, Mus musculus
taatgcagtctttcttcaaagtggt

SEQ ID NO: 756294 - DNA, 25 bp, Mus musculus
taatgcataggacaacccttttccc

SEQ ID NO: 756295 - DNA, 25 bp, Mus musculus
taatgcataggagaacccttttccc

SEQ ID NO: 756296 - DNA, 25 bp, Mus musculus
taatgcatatatccttctcctactt

SEQ ID NO: 756297 - DNA, 25 bp, Mus musculus
taatgcatatatgcttctcctactt

SEQ ID NO: 756298 - DNA, 25 bp, Mus musculus
taatgcatctgtcattgaggctgtg

SEQ ID NO: 756299 - DNA, 25 bp, Mus musculus
taatgcatctgtgattgaggctgtg

SEQ ID NO: 756300 - DNA, 25 bp, Mus musculus
taatgcatggcccacatcttggtct

SEQ ID NO: 756301 - DNA, 25 bp, Mus musculus
taatgcatggccgacatcttggtct

SEQ ID NO: 756302 - DNA, 25 bp, Mus musculus
taatgcattaggcttgtgtgcacat

SEQ ID NO: 756303 - DNA, 25 bp, Mus musculus
taatgcattagggttgtgtgcacat

SEQ ID NO: 756304 - DNA, 25 bp, Mus musculus
taatgcattcgtctttcttccatag

SEQ ID NO: 756305 - DNA, 25 bp, Mus musculus
taatgcattcgtgtttcttccatag

SEQ ID NO: 756306 - DNA, 25 bp, Mus musculus
taatgcattgcaactgtggtttcaa

SEQ ID NO: 756307 - DNA, 25 bp, Mus musculus
taatgcattgcatctgtggtttcaa

SEQ ID NO: 756308 - DNA, 25 bp, Mus musculus
taatgcattgttccactgagggaca

SEQ ID NO: 756309 - DNA, 25 bp, Mus musculus
taatgcattgttgcactgagggaca

SEQ ID NO: 756310 - DNA, 25 bp, Mus musculus
taatgcatttccctaacctagtcac

SEQ ID NO: 756311 - DNA, 25 bp, Mus musculus
taatgcatttccgtaacctagtcac

SEQ ID NO: 756312 - DNA, 25 bp, Mus musculus
taatgcatttctcctttaatcaagt

SEQ ID NO: 756313 - DNA, 25 bp, Mus musculus
taatgcatttctgctttaatcaagt

SEQ ID NO: 756314 - DNA, 25 bp, Mus musculus
taatgcatttgtatacactgtacat

SEQ ID NO: 756315 - DNA, 25 bp, Mus musculus
taatgcatttgtttacactgtacat

SEQ ID NO: 756316 - DNA, 25 bp, Mus musculus
taatgccaacacatagggaggagac

SEQ ID NO: 756317 - DNA, 25 bp, Mus musculus
taatgccaacacttagggaggagac

SEQ ID NO: 756318 - DNA, 25 bp, Mus musculus
taatgccaagctaagaaccccacct

SEQ ID NO: 756319 - DNA, 25 bp, Mus musculus
taatgccaagcttagaaccccacct

SEQ ID NO: 756320 - DNA, 25 bp, Mus musculus
taatgccaagttcccaaacacagtg

SEQ ID NO: 756321 - DNA, 25 bp, Mus musculus
taatgccaagttgccaaacacagtg

SEQ ID NO: 756322 - DNA, 25 bp, Mus musculus
taatgccacacccattgacagaatg

SEQ ID NO: 756323 - DNA, 25 bp, Mus musculus
taatgccacaccgattgacagaatg

SEQ ID NO: 756324 - DNA, 25 bp, Mus musculus
taatgccacactagagaggtcccag

SEQ ID NO: 756325 - DNA, 25 bp, Mus musculus
taatgccacacttgagaggtcccag

SEQ ID NO: 756326 - DNA, 25 bp, Mus musculus
taatgccaccacactttagcacagt

SEQ ID NO: 756327 - DNA, 25 bp, Mus musculus
taatgccaccactctttagcacagt

SEQ ID NO: 756328 - DNA, 25 bp, Mus musculus
taatgccaccgtacccacagtttag

SEQ ID NO: 756329 - DNA, 25 bp, Mus musculus
taatgccaccgttcccacagtttag

SEQ ID NO: 756330 - DNA, 25 bp, Mus musculus
taatgccagaagcagtgtcagcctt

SEQ ID NO: 756331 - DNA, 25 bp, Mus musculus
taatgccagaaggagtgtcagcctt

SEQ ID NO: 756332 - DNA, 25 bp, Mus musculus
taatgccagacgcatggatgcaccc

SEQ ID NO: 756333 - DNA, 25 bp, Mus musculus
taatgccagacggatggatgcaccc

SEQ ID NO: 756334 - DNA, 25 bp, Mus musculus
taatgccatcagatttttttagaac

SEQ ID NO: 756335 - DNA, 25 bp, Mus musculus
taatgccatcagttttttttagaac

SEQ ID NO: 756336 - DNA, 25 bp, Mus musculus
taatgccatcatctgggagaccgag

SEQ ID NO: 756337 - DNA, 25 bp, Mus musculus
taatgccatcatgtgggagaccgag

SEQ ID NO: 756338 - DNA, 25 bp, Mus musculus
taatgccccgttactgccggctgac

SEQ ID NO: 756339 - DNA, 25 bp, Mus musculus
taatgccccgtttctgccggctgac

SEQ ID NO: 756340 - DNA, 25 bp, Mus musculus
taatgcccctagctgcaactttagg

SEQ ID NO: 756341 - DNA, 25 bp, Mus musculus
taatgcccctaggtgcaactttagg

SEQ ID NO: 756342 - DNA, 25 bp, Mus musculus
taatgcccgtgtccgactttggcag

SEQ ID NO: 756343 - DNA, 25 bp, Mus musculus
taatgcccgtgtgcgactttggcag

SEQ ID NO: 756344 - DNA, 25 bp, Mus musculus
taatgcccttaaatatttactaatg

SEQ ID NO: 756345 - DNA, 25 bp, Mus musculus
taatgcccttaattatttactaatg

SEQ ID NO: 756346 - DNA, 25 bp, Mus musculus
taatgcccttgtcactaacctgcag

SEQ ID NO: 756347 - DNA, 25 bp, Mus musculus
taatgcccttgtgactaacctgcag

SEQ ID NO: 756348 - DNA, 25 bp, Mus musculus
taatgcctacgacaagacagccttg

SEQ ID NO: 756349 - DNA, 25 bp, Mus musculus
taatgcctacgagaagacagccttg

SEQ ID NO: 756350 - DNA, 25 bp, Mus musculus
taatgcctatcacccgacattgatt

SEQ ID NO: 756351 - DNA, 25 bp, Mus musculus
taatgcctatcagccgacattgatt

SEQ ID NO: 756352 - DNA, 25 bp, Mus musculus
taatgcctatttactgctgtactat

SEQ ID NO: 756353 - DNA, 25 bp, Mus musculus
taatgcctattttctgctgtactat

SEQ ID NO: 756354 - DNA, 25 bp, Mus musculus
taatgcctcaagcaaatctgctagt

SEQ ID NO: 756355 - DNA, 25 bp, Mus musculus
taatgcctcaaggaaatctgctagt

SEQ ID NO: 756356 - DNA, 25 bp, Mus musculus
taatgcctcaggatgtgggaagact

SEQ ID NO: 756357 - DNA, 25 bp, Mus musculus
taatgcctcaggttgtgggaagact

SEQ ID NO: 756358 - DNA, 25 bp, Mus musculus
taatgcctcttcatttacggcgacg

SEQ ID NO: 756359 - DNA, 25 bp, Mus musculus
taatgcctcttcttttacggcgacg

SEQ ID NO: 756360 - DNA, 25 bp, Mus musculus
taatgcctgcagacaaagttaaaat

SEQ ID NO: 756361 - DNA, 25 bp, Mus musculus
taatgcctgcagtcaaagttaaaat

SEQ ID NO: 756362 - DNA, 25 bp, Mus musculus
taatgcctggcgacctcaggtgaat

SEQ ID NO: 756363 - DNA, 25 bp, Mus musculus
taatgcctggcgtcctcaggtgaat

SEQ ID NO: 756364 - DNA, 25 bp, Mus musculus
taatgccttcggactagcttgcgca

SEQ ID NO: 756365 - DNA, 25 bp, Mus musculus
taatgccttcggtctagcttgcgca

SEQ ID NO: 756366 - DNA, 25 bp, Mus musculus
taatgccttgccaaccatagcagga

SEQ ID NO: 756367 - DNA, 25 bp, Mus musculus
taatgccttgcctaccatagcagga

SEQ ID NO: 756368 - DNA, 25 bp, Mus musculus
taatgcctttatctcttagaatgga

SEQ ID NO: 756369 - DNA, 25 bp, Mus musculus
taatgcctttatgtcttagaatgga

SEQ ID NO: 756370 - DNA, 25 bp, Mus musculus
taatgcgagcttcttgcctttagat

SEQ ID NO: 756371 - DNA, 25 bp, Mus musculus
taatgcgagcttgttgcctttagat

SEQ ID NO: 756372 - DNA, 25 bp, Mus musculus
taatgcgagttaatctccctccatt

SEQ ID NO: 756373 - DNA, 25 bp, Mus musculus
taatgcgagttattctccctccatt

SEQ ID NO: 756374 - DNA, 25 bp, Mus musculus
taatgcgcggagagcccaccttaag

SEQ ID NO: 756375 - DNA, 25 bp, Mus musculus
taatgcgcggagtgcccaccttaag

SEQ ID NO: 756376 - DNA, 25 bp, Mus musculus
taatgcgcgttcatttcactggttt

SEQ ID NO: 756377 - DNA, 25 bp, Mus musculus
taatgcgcgttcttttcactggttt

SEQ ID NO: 756378 - DNA, 25 bp, Mus musculus
taatgcgcttgtatcaaccctacat

SEQ ID NO: 756379 - DNA, 25 bp, Mus musculus
taatgcgcttgtttcaaccctacat

SEQ ID NO: 756380 - DNA, 25 bp, Mus musculus
taatgcgggcatactgaacagtcca

SEQ ID NO: 756381 - DNA, 25 bp, Mus musculus
taatgcgggcattctgaacagtcca

SEQ ID NO: 756382 - DNA, 25 bp, Mus musculus
taatgcggtataatcccctgtaaat

SEQ ID NO: 756383 - DNA, 25 bp, Mus musculus
taatgcggtatattcccctgtaaat

SEQ ID NO: 756384 - DNA, 25 bp, Mus musculus
taatgcgttcagaggtttggagttt

SEQ ID NO: 756385 - DNA, 25 bp, Mus musculus
taatgcgttcagtggtttggagttt

SEQ ID NO: 756386 - DNA, 25 bp, Mus musculus
taatgctaacttccccttggcatgg

SEQ ID NO: 756387 - DNA, 25 bp, Mus musculus
taatgctaacttgcccttggcatgg

SEQ ID NO: 756388 - DNA, 25 bp, Mus musculus
taatgctaccaacaacggtcaaagt

SEQ ID NO: 756389 - DNA, 25 bp, Mus musculus
taatgctaccaagaacggtcaaagt

SEQ ID NO: 756390 - DNA, 25 bp, Mus musculus
taatgctacctgacttctcttgtga

SEQ ID NO: 756391 - DNA, 25 bp, Mus musculus
taatgctacctgtcttctcttgtga

SEQ ID NO: 756392 - DNA, 25 bp, Mus musculus
taatgctactatcttctacagtgac

SEQ ID NO: 756393 - DNA, 25 bp, Mus musculus
taatgctactatgttctacagtgac

SEQ ID NO: 756394 - DNA, 25 bp, Mus musculus
taatgctatcatctttcacacgaag

SEQ ID NO: 756395 - DNA, 25 bp, Mus musculus
taatgctatcatgtttcacacgaag

SEQ ID NO: 756396 - DNA, 25 bp, Mus musculus
taatgctatggcctgctcatgggct

SEQ ID NO: 756397 - DNA, 25 bp, Mus musculus
taatgctatggcgtgctcatgggct

SEQ ID NO: 756398 - DNA, 25 bp, Mus musculus
taatgctattttctggcttctggtg

SEQ ID NO: 756399 - DNA, 25 bp, Mus musculus
taatgctattttgtggcttctggtg

SEQ ID NO: 756400 - DNA, 25 bp, Mus musculus
taatgctcagagctggtcaaggctg

SEQ ID NO: 756401 - DNA, 25 bp, Mus musculus
taatgctcagaggtggtcaaggctg

SEQ ID NO: 756402 - DNA, 25 bp, Mus musculus
taatgctcagcacagactgactcct

SEQ ID NO: 756403 - DNA, 25 bp, Mus musculus
taatgctcagcagagactgactcct

SEQ ID NO: 756404 - DNA, 25 bp, Mus musculus
taatgctcatgtcggtcaaacttgg

SEQ ID NO: 756405 - DNA, 25 bp, Mus musculus
taatgctcatgtgggtcaaacttgg

SEQ ID NO: 756406 - DNA, 25 bp, Mus musculus
taatgctcctacagctctgtttctg

SEQ ID NO: 756407 - DNA, 25 bp, Mus musculus
taatgctcctactgctctgtttctg

SEQ ID NO: 756408 - DNA, 25 bp, Mus musculus
taatgctccttgagtttcacctgaa

SEQ ID NO: 756409 - DNA, 25 bp, Mus musculus
taatgctccttgtgtttcacctgaa

SEQ ID NO: 756410 - DNA, 25 bp, Mus musculus
taatgctcctttagctgtcaagcac

SEQ ID NO: 756411 - DNA, 25 bp, Mus musculus
taatgctccttttgctgtcaagcac

SEQ ID NO: 756412 - DNA, 25 bp, Mus musculus
taatgctgacatcgtaaccctgcta

SEQ ID NO: 756413 - DNA, 25 bp, Mus musculus
taatgctgacatggtaaccctgcta

SEQ ID NO: 756414 - DNA, 25 bp, Mus musculus
taatgctgacctcataatgctccca

SEQ ID NO: 756415 - DNA, 25 bp, Mus musculus
taatgctgacctgataatgctccca

SEQ ID NO: 756416 - DNA, 25 bp, Mus musculus
taatgctgatgtagtcttgccttat

SEQ ID NO: 756417 - DNA, 25 bp, Mus musculus
taatgctgatgttgtcttgccttat

SEQ ID NO: 756418 - DNA, 25 bp, Mus musculus
taatgctgccgtacctcagtttgaa

SEQ ID NO: 756419 - DNA, 25 bp, Mus musculus
taatgctgccgttcctcagtttgaa

SEQ ID NO: 756420 - DNA, 25 bp, Mus musculus
taatgctgcttcatcactcctgtcc

SEQ ID NO: 756421 - DNA, 25 bp, Mus musculus
taatgctgcttcttcactcctgtcc

SEQ ID NO: 756422 - DNA, 25 bp, Mus musculus
taatgctgctttctgcttttgttgg

SEQ ID NO: 756423 - DNA, 25 bp, Mus musculus
taatgctgctttgtgcttttgttgg

SEQ ID NO: 756424 - DNA, 25 bp, Mus musculus
taatgctggaatatactagtctgaa

SEQ ID NO: 756425 - DNA, 25 bp, Mus musculus
taatgctggaatttactagtctgaa

SEQ ID NO: 756426 - DNA, 25 bp, Mus musculus
taatgctggagtccgaactgccgac

SEQ ID NO: 756427 - DNA, 25 bp, Mus musculus
taatgctggagtgcgaactgccgac

SEQ ID NO: 756428 - DNA, 25 bp, Mus musculus
taatgctggcgccttaacctctgaa

SEQ ID NO: 756429 - DNA, 25 bp, Mus musculus
taatgctggcgcgttaacctctgaa

SEQ ID NO: 756430 - DNA, 25 bp, Mus musculus
taatgctgtaccaatacatttaagg

SEQ ID NO: 756431 - DNA, 25 bp, Mus musculus
taatgctgtacctatacatttaagg

SEQ ID NO: 756432 - DNA, 25 bp, Mus musculus
taatgctgtcatcatcgcagtctcc

SEQ ID NO: 756433 - DNA, 25 bp, Mus musculus
taatgctgtcatgatcgcagtctcc

SEQ ID NO: 756434 - DNA, 25 bp, Mus musculus
taatgctgtgacctcatgctgtgct

SEQ ID NO: 756435 - DNA, 25 bp, Mus musculus
taatgctgtgacctctccttaacca

SEQ ID NO: 756436 - DNA, 25 bp, Mus musculus
taatgctgtgacgtcatgctgtgct

SEQ ID NO: 756437 - DNA, 25 bp, Mus musculus
taatgctgtgacgtctccttaacca

SEQ ID NO: 756438 - DNA, 25 bp, Mus musculus
taatgctgtggcattacgttatgat

SEQ ID NO: 756439 - DNA, 25 bp, Mus musculus
taatgctgtggctttacgttatgat

SEQ ID NO: 756440 - DNA, 25 bp, Mus musculus
taatgctgtgtcagccttcaaagta

SEQ ID NO: 756441 - DNA, 25 bp, Mus musculus
taatgctgtgtctgccttcaaagta

SEQ ID NO: 756442 - DNA, 25 bp, Mus musculus
taatgctgttctactgtggtttcaa

SEQ ID NO: 756443 - DNA, 25 bp, Mus musculus
taatgctgttcttctgtggtttcaa

SEQ ID NO: 756444 - DNA, 25 bp, Mus musculus
taatgctgttggaggtcctggttgc

SEQ ID NO: 756445 - DNA, 25 bp, Mus musculus
taatgctgttggtggtcctggttgc

SEQ ID NO: 756446 - DNA, 25 bp, Mus musculus
taatgcttccaaccctcagaggtgg

SEQ ID NO: 756447 - DNA, 25 bp, Mus musculus
taatgcttccaagcctcagaggtgg

SEQ ID NO: 756448 - DNA, 25 bp, Mus musculus
taatgcttgcacatcattgtttgtt

SEQ ID NO: 756449 - DNA, 25 bp, Mus musculus
taatgcttgcacttcattgtttgtt

SEQ ID NO: 756450 - DNA, 25 bp, Mus musculus
taatgcttgcctcgcccttttcctt

SEQ ID NO: 756451 - DNA, 25 bp, Mus musculus
taatgcttgcctggcccttttcctt

SEQ ID NO: 756452 - DNA, 25 bp, Mus musculus
taatgcttgcttagtcaaagagaga

SEQ ID NO: 756453 - DNA, 25 bp, Mus musculus
taatgcttgctttgtcaaagagaga

SEQ ID NO: 756454 - DNA, 25 bp, Mus musculus
taatgcttggatcgatgtgtcacag

SEQ ID NO: 756455 - DNA, 25 bp, Mus musculus
taatgcttggatggatgtgtcacag

SEQ ID NO: 756456 - DNA, 25 bp, Mus musculus
taatgcttgtaactcttaccctaca

SEQ ID NO: 756457 - DNA, 25 bp, Mus musculus
taatgcttgtaagtcttaccctaca

SEQ ID NO: 756458 - DNA, 25 bp, Mus musculus
taatgcttgtgtcggcacatgcgcc

SEQ ID NO: 756459 - DNA, 25 bp, Mus musculus
taatgcttgtgtgggcacatgcgcc

SEQ ID NO: 756460 - DNA, 25 bp, Mus musculus
taatgcttgtttcttaacctgtgta

SEQ ID NO: 756461 - DNA, 25 bp, Mus musculus
taatgcttgtttgttaacctgtgta

SEQ ID NO: 756462 - DNA, 25 bp, Mus musculus
taatgctttcttcttaacatcacat

SEQ ID NO: 756463 - DNA, 25 bp, Mus musculus
taatgctttcttgttaacatcacat

SEQ ID NO: 756464 - DNA, 25 bp, Mus musculus
taatgctttgcaatggtgcaggctg

SEQ ID NO: 756465 - DNA, 25 bp, Mus musculus
taatgctttgcattggtgcaggctg

SEQ ID NO: 756466 - DNA, 25 bp, Mus musculus
taatgcttttctatctgttgaccac

SEQ ID NO: 756467 - DNA, 25 bp, Mus musculus
taatgcttttctttctgttgaccac

SEQ ID NO: 756468 - DNA, 25 bp, Mus musculus
taatgctttttgaggcgaatctaat

SEQ ID NO: 756469 - DNA, 25 bp, Mus musculus
taatgctttttgtggcgaatctaat

SEQ ID NO: 756470 - DNA, 25 bp, Mus musculus
taatggaaaataaggacccaagtaa

SEQ ID NO: 756471 - DNA, 25 bp, Mus musculus
taatggaaaatatggacccaagtaa

SEQ ID NO: 756472 - DNA, 25 bp, Mus musculus
taatggaacaatctttggctgcaag

SEQ ID NO: 756473 - DNA, 25 bp, Mus musculus
taatggaacaatgtttggctgcaag

SEQ ID NO: 756474 - DNA, 25 bp, Mus musculus
taatggaacgttagcagacccgcca

SEQ ID NO: 756475 - DNA, 25 bp, Mus musculus
taatggaacgtttgcagacccgcca

SEQ ID NO: 756476 - DNA, 25 bp, Mus musculus
taatggaactctccaacacccaaag

SEQ ID NO: 756477 - DNA, 25 bp, Mus musculus
taatggaactctgcaacacccaaag

SEQ ID NO: 756478 - DNA, 25 bp, Mus musculus
taatggaaggcaacttggtgactat

SEQ ID NO: 756479 - DNA, 25 bp, Mus musculus
taatggaaggcatcttggtgactat

SEQ ID NO: 756480 - DNA, 25 bp, Mus musculus
taatggaaggtacctgccctcactt

SEQ ID NO: 756481 - DNA, 25 bp, Mus musculus
taatggaaggtagctgccctcactt

SEQ ID NO: 756482 - DNA, 25 bp, Mus musculus
taatggacaggacccagacctgcac

SEQ ID NO: 756483 - DNA, 25 bp, Mus musculus
taatggacaggagccagacctgcac

SEQ ID NO: 756484 - DNA, 25 bp, Mus musculus
taatggacagttccgaggctgcacc

SEQ ID NO: 756485 - DNA, 25 bp, Mus musculus
taatggacagttgcgaggctgcacc

SEQ ID NO: 756486 - DNA, 25 bp, Mus musculus
taatggacctgtacttcacgctgac

SEQ ID NO: 756487 - DNA, 25 bp, Mus musculus
taatggacctgttcttcacgctgac

SEQ ID NO: 756488 - DNA, 25 bp, Mus musculus
taatggactgcacaagtgactcaat

SEQ ID NO: 756489 - DNA, 25 bp, Mus musculus
taatggactgcagaagtgactcaat

SEQ ID NO: 756490 - DNA, 25 bp, Mus musculus
taatggactggacttttcccatggc

SEQ ID NO: 756491 - DNA, 25 bp, Mus musculus
taatggactggagttttcccatggc

SEQ ID NO: 756492 - DNA, 25 bp, Mus musculus
taatggacttcgatgcactggtgca

SEQ ID NO: 756493 - DNA, 25 bp, Mus musculus
taatggacttcgttgcactggtgca

SEQ ID NO: 756494 - DNA, 25 bp, Mus musculus
taatggagcacaacgtgtcctaccc

SEQ ID NO: 756495 - DNA, 25 bp, Mus musculus
taatggagcacatcgtgtcctaccc

SEQ ID NO: 756496 - DNA, 25 bp, Mus musculus
taatggagcgttaatttatttatcg

SEQ ID NO: 756497 - DNA, 25 bp, Mus musculus
taatggagcgtttatttatttatcg

SEQ ID NO: 756498 - DNA, 25 bp, Mus musculus
taatggaggattatgtgggcaaccc

SEQ ID NO: 756499 - DNA, 25 bp, Mus musculus
taatggaggattttgtgggcaaccc

SEQ ID NO: 756500 - DNA, 25 bp, Mus musculus
taatggagggatcgctgacttcctt

SEQ ID NO: 756501 - DNA, 25 bp, Mus musculus
taatggagggatggctgacttcctt

SEQ ID NO: 756502 - DNA, 25 bp, Mus musculus
taatggagtgatatcctgccgcaca

SEQ ID NO: 756503 - DNA, 25 bp, Mus musculus
taatggagtgatttcctgccgcaca

SEQ ID NO: 756504 - DNA, 25 bp, Mus musculus
taatggatctctcccaaacggtgat

SEQ ID NO: 756505 - DNA, 25 bp, Mus musculus
taatggatctctgccaaacggtgat

SEQ ID NO: 756506 - DNA, 25 bp, Mus musculus
taatggatctgtaccaggcagtggt

SEQ ID NO: 756507 - DNA, 25 bp, Mus musculus
taatggatctgttccaggcagtggt

SEQ ID NO: 756508 - DNA, 25 bp, Mus musculus
taatggatgcaacctgagacctggg

SEQ ID NO: 756509 - DNA, 25 bp, Mus musculus
taatggatgcaagctgagacctggg

SEQ ID NO: 756510 - DNA, 25 bp, Mus musculus
taatggatgttcagccttttgtccg

SEQ ID NO: 756511 - DNA, 25 bp, Mus musculus
taatggatgttctgccttttgtccg

SEQ ID NO: 756512 - DNA, 25 bp, Mus musculus
taatggattcacatacagcaacgag

SEQ ID NO: 756513 - DNA, 25 bp, Mus musculus
taatggattcacttacagcaacgag

SEQ ID NO: 756514 - DNA, 25 bp, Mus musculus
taatggattcagctttacagcacag

SEQ ID NO: 756515 - DNA, 25 bp, Mus musculus
taatggattcaggtttacagcacag

SEQ ID NO: 756516 - DNA, 25 bp, Mus musculus
taatggattcatcggccgtagttta

SEQ ID NO: 756517 - DNA, 25 bp, Mus musculus
taatggattcatgggccgtagttta

SEQ ID NO: 756518 - DNA, 25 bp, Mus musculus
taatggatttccatgcggaccgagg

SEQ ID NO: 756519 - DNA, 25 bp, Mus musculus
taatggatttccttgcggaccgagg

SEQ ID NO: 756520 - DNA, 25 bp, Mus musculus
taatggcacacacctatcttctcag

SEQ ID NO: 756521 - DNA, 25 bp, Mus musculus
taatggcacacagctatcttctcag

SEQ ID NO: 756522 - DNA, 25 bp, Mus musculus
taatggcacgtaaaaatggcaactc

SEQ ID NO: 756523 - DNA, 25 bp, Mus musculus
taatggcacgtataaatggcaactc

SEQ ID NO: 756524 - DNA, 25 bp, Mus musculus
taatggcagcaacatgcccctagct

SEQ ID NO: 756525 - DNA, 25 bp, Mus musculus
taatggcagcaagatgcccctagct

SEQ ID NO: 756526 - DNA, 25 bp, Mus musculus
taatggcagtgccttcgtcttgtac

SEQ ID NO: 756527 - DNA, 25 bp, Mus musculus
taatggcagtgcgttcgtcttgtac

SEQ ID NO: 756528 - DNA, 25 bp, Mus musculus
taatggcatcacacatgaccggtct

SEQ ID NO: 756529 - DNA, 25 bp, Mus musculus
taatggcatcactcatgaccggtct

SEQ ID NO: 756530 - DNA, 25 bp, Mus musculus
taatggcatccgcatctactggcga

SEQ ID NO: 756531 - DNA, 25 bp, Mus musculus
taatggcatccggatctactggcga

SEQ ID NO: 756532 - DNA, 25 bp, Mus musculus
taatggcatctgagagactgctgct

SEQ ID NO: 756533 - DNA, 25 bp, Mus musculus
taatggcatctgtgagactgctgct

SEQ ID NO: 756534 - DNA, 25 bp, Mus musculus
taatggcatgtcagacttctgtcct

SEQ ID NO: 756535 - DNA, 25 bp, Mus musculus
taatggcatgtctgacttctgtcct

SEQ ID NO: 756536 - DNA, 25 bp, Mus musculus
taatggccagatcactggagccagt

SEQ ID NO: 756537 - DNA, 25 bp, Mus musculus
taatggccagatgactggagccagt

SEQ ID NO: 756538 - DNA, 25 bp, Mus musculus
taatggccattgaatctgacagaaa

SEQ ID NO: 756539 - DNA, 25 bp, Mus musculus
taatggccattgtatctgacagaaa

SEQ ID NO: 756540 - DNA, 25 bp, Mus musculus
taatggcccacaccagtaatcctgg

SEQ ID NO: 756541 - DNA, 25 bp, Mus musculus
taatggcccacagcagtaatcctgg

SEQ ID NO: 756542 - DNA, 25 bp, Mus musculus
taatggccccaacgtcctgaattat

SEQ ID NO: 756543 - DNA, 25 bp, Mus musculus
taatggccccaaggtcctgaattat

SEQ ID NO: 756544 - DNA, 25 bp, Mus musculus
taatggcccttgacaaaccccaggc

SEQ ID NO: 756545 - DNA, 25 bp, Mus musculus
taatggcccttgtcaaaccccaggc

SEQ ID NO: 756546 - DNA, 25 bp, Mus musculus
taatggcctcacatttcccttttgg

SEQ ID NO: 756547 - DNA, 25 bp, Mus musculus
taatggcctcacttttcccttttgg

SEQ ID NO: 756548 - DNA, 25 bp, Mus musculus
taatggcctctcatacagcctggag

SEQ ID NO: 756549 - DNA, 25 bp, Mus musculus
taatggcctctcttacagcctggag

SEQ ID NO: 756550 - DNA, 25 bp, Mus musculus
taatggccttttcaaattactgtag

SEQ ID NO: 756551 - DNA, 25 bp, Mus musculus
taatggccttttgaaattactgtag

SEQ ID NO: 756552 - DNA, 25 bp, Mus musculus
taatggcgagaacatgtcctgggtc

SEQ ID NO: 756553 - DNA, 25 bp, Mus musculus
taatggcgagaagatgtcctgggtc

SEQ ID NO: 756554 - DNA, 25 bp, Mus musculus
taatggctagtaacctgtattgact

SEQ ID NO: 756555 - DNA, 25 bp, Mus musculus
taatggctagtatcctgtattgact

SEQ ID NO: 756556 - DNA, 25 bp, Mus musculus
taatggctagttagaccaggtagaa

SEQ ID NO: 756557 - DNA, 25 bp, Mus musculus
taatggctagtttgaccaggtagaa

SEQ ID NO: 756558 - DNA, 25 bp, Mus musculus
taatggctcatgcagtataaaacta

SEQ ID NO: 756559 - DNA, 25 bp, Mus musculus
taatggctcatggagtataaaacta

SEQ ID NO: 756560 - DNA, 25 bp, Mus musculus
taatggctccgtagggctgcatttg

SEQ ID NO: 756561 - DNA, 25 bp, Mus musculus
taatggctccgttgggctgcatttg

SEQ ID NO: 756562 - DNA, 25 bp, Mus musculus
taatggctctcactttcctcggtct

SEQ ID NO: 756563 - DNA, 25 bp, Mus musculus
taatggctctcagtttcctcggtct

SEQ ID NO: 756564 - DNA, 25 bp, Mus musculus
taatggctctgactcagcacacatc

SEQ ID NO: 756565 - DNA, 25 bp, Mus musculus
taatggctctgagtcagcacacatc

SEQ ID NO: 756566 - DNA, 25 bp, Mus musculus
taatggctgccaaagatttgcccgt

SEQ ID NO: 756567 - DNA, 25 bp, Mus musculus
taatggctgccatagatttgcccgt

SEQ ID NO: 756568 - DNA, 25 bp, Mus musculus
taatggctgcctaccaatctcggga

SEQ ID NO: 756569 - DNA, 25 bp, Mus musculus
taatggctgccttccaatctcggga

SEQ ID NO: 756570 - DNA, 25 bp, Mus musculus
taatggctgtctcctcgatgtcaga

SEQ ID NO: 756571 - DNA, 25 bp, Mus musculus
taatggctgtctgctcgatgtcaga

SEQ ID NO: 756572 - DNA, 25 bp, Mus musculus
taatggctgttgacagtgtctcttc

SEQ ID NO: 756573 - DNA, 25 bp, Mus musculus
taatggctgttgtcagtgtctcttc

SEQ ID NO: 756574 - DNA, 25 bp, Mus musculus
taatggcttaggacagtggtcatat

SEQ ID NO: 756575 - DNA, 25 bp, Mus musculus
taatggcttaggtcagtggtcatat

SEQ ID NO: 756576 - DNA, 25 bp, Mus musculus
taatggcttctgagctctttccccg

SEQ ID NO: 756577 - DNA, 25 bp, Mus musculus
taatggcttctgtgctctttccccg

SEQ ID NO: 756578 - DNA, 25 bp, Mus musculus
taatggcttgttatgtctcctggat

SEQ ID NO: 756579 - DNA, 25 bp, Mus musculus
taatggcttgttttgtctcctggat

SEQ ID NO: 756580 - DNA, 25 bp, Mus musculus
taatgggaccacaagggccctgacc

SEQ ID NO: 756581 - DNA, 25 bp, Mus musculus
taatgggaccactagggccctgacc

SEQ ID NO: 756582 - DNA, 25 bp, Mus musculus
taatgggacttcagaccaaccacgg

SEQ ID NO: 756583 - DNA, 25 bp, Mus musculus
taatgggacttctgaccaaccacgg

SEQ ID NO: 756584 - DNA, 25 bp, Mus musculus
taatgggagcagcttcaccctatta

SEQ ID NO: 756585 - DNA, 25 bp, Mus musculus
taatgggagcaggttcaccctatta

SEQ ID NO: 756586 - DNA, 25 bp, Mus musculus
taatgggatcgtccagcccttctct

SEQ ID NO: 756587 - DNA, 25 bp, Mus musculus
taatgggatcgtgcagcccttctct

SEQ ID NO: 756588 - DNA, 25 bp, Mus musculus
taatgggatttgaactttcagcctc

SEQ ID NO: 756589 - DNA, 25 bp, Mus musculus
taatgggatttgtactttcagcctc

SEQ ID NO: 756590 - DNA, 25 bp, Mus musculus
taatgggcacgcaggctagcaggac

SEQ ID NO: 756591 - DNA, 25 bp, Mus musculus
taatgggcacgctggctagcaggac

SEQ ID NO: 756592 - DNA, 25 bp, Mus musculus
taatgggcatcaatattcaggctta

SEQ ID NO: 756593 - DNA, 25 bp, Mus musculus
taatgggcatcattattcaggctta

SEQ ID NO: 756594 - DNA, 25 bp, Mus musculus
taatgggccttgcaagccaatctgg

SEQ ID NO: 756595 - DNA, 25 bp, Mus musculus
taatgggccttggaagccaatctgg

SEQ ID NO: 756596 - DNA, 25 bp, Mus musculus
taatgggcggcaatgggaaaaccat

SEQ ID NO: 756597 - DNA, 25 bp, Mus musculus
taatgggcggcattgggaaaaccat

SEQ ID NO: 756598 - DNA, 25 bp, Mus musculus
taatgggctagaacacaagaacact

SEQ ID NO: 756599 - DNA, 25 bp, Mus musculus
taatgggctagatcacaagaacact

SEQ ID NO: 756600 - DNA, 25 bp, Mus musculus
taatgggctatgcatgttcttcccc

SEQ ID NO: 756601 - DNA, 25 bp, Mus musculus
taatgggctatggatgttcttcccc

SEQ ID NO: 756602 - DNA, 25 bp, Mus musculus
taatgggctcagcagtgcaggcaat

SEQ ID NO: 756603 - DNA, 25 bp, Mus musculus
taatgggctcaggagtgcaggcaat

SEQ ID NO: 756604 - DNA, 25 bp, Mus musculus
taatgggctcatcgccctaggaggc

SEQ ID NO: 756605 - DNA, 25 bp, Mus musculus
taatgggctcatggccctaggaggc

SEQ ID NO: 756606 - DNA, 25 bp, Mus musculus
taatgggctctgataaactttaaat

SEQ ID NO: 756607 - DNA, 25 bp, Mus musculus
taatgggctctgttaaactttaaat

SEQ ID NO: 756608 - DNA, 25 bp, Mus musculus
taatgggctgcgacctgaaatctca

SEQ ID NO: 756609 - DNA, 25 bp, Mus musculus
taatgggctgcgtcctgaaatctca

SEQ ID NO: 756610 - DNA, 25 bp, Mus musculus
taatgggtaaagcacttggctgatt

SEQ ID NO: 756611 - DNA, 25 bp, Mus musculus
taatgggtaaaggacttggctgatt

SEQ ID NO: 756612 - DNA, 25 bp, Mus musculus
taatgggtaaccacgatctggtcca

SEQ ID NO: 756613 - DNA, 25 bp, Mus musculus
taatgggtaacctcgatctggtcca

SEQ ID NO: 756614 - DNA, 25 bp, Mus musculus
taatgggtcataaagcctggtaaca

SEQ ID NO: 756615 - DNA, 25 bp, Mus musculus
taatgggtcatatagcctggtaaca

SEQ ID NO: 756616 - DNA, 25 bp, Mus musculus
taatgggtgccaccttgccatcatc

SEQ ID NO: 756617 - DNA, 25 bp, Mus musculus
taatgggtgccagcttgccatcatc

SEQ ID NO: 756618 - DNA, 25 bp, Mus musculus
taatggtaaccaagaattgaaggca

SEQ ID NO: 756619 - DNA, 25 bp, Mus musculus
taatggtaaccatgaattgaaggca

SEQ ID NO: 756620 - DNA, 25 bp, Mus musculus
taatggtacccgagctggttcacga

SEQ ID NO: 756621 - DNA, 25 bp, Mus musculus
taatggtacccgtgctggttcacga

SEQ ID NO: 756622 - DNA, 25 bp, Mus musculus
taatggtatcctactgagcatttgc

SEQ ID NO: 756623 - DNA, 25 bp, Mus musculus
taatggtatccttctgagcatttgc

SEQ ID NO: 756624 - DNA, 25 bp, Mus musculus
taatggtcaagtaatcacagtatct

SEQ ID NO: 756625 - DNA, 25 bp, Mus musculus
taatggtcaagttatcacagtatct

SEQ ID NO: 756626 - DNA, 25 bp, Mus musculus
taatggtcccataagggtggccctt

SEQ ID NO: 756627 - DNA, 25 bp, Mus musculus
taatggtcccattagggtggccctt

SEQ ID NO: 756628 - DNA, 25 bp, Mus musculus
taatggtcctttacttcaaagtaca

SEQ ID NO: 756629 - DNA, 25 bp, Mus musculus
taatggtccttttcttcaaagtaca

SEQ ID NO: 756630 - DNA, 25 bp, Mus musculus
taatggtctcacatacatgcaagga

SEQ ID NO: 756631 - DNA, 25 bp, Mus musculus
taatggtctcacttacatgcaagga

SEQ ID NO: 756632 - DNA, 25 bp, Mus musculus
taatggtctccacattctcagcaca

SEQ ID NO: 756633 - DNA, 25 bp, Mus musculus
taatggtctccagattctcagcaca

SEQ ID NO: 756634 - DNA, 25 bp, Mus musculus
taatggtctgctacctgacaaggca

SEQ ID NO: 756635 - DNA, 25 bp, Mus musculus
taatggtctgcttcctgacaaggca

SEQ ID NO: 756636 - DNA, 25 bp, Mus musculus
taatggtgaacactggtcaataaat

SEQ ID NO: 756637 - DNA, 25 bp, Mus musculus
taatggtgaacagtggtcaataaat

SEQ ID NO: 756638 - DNA, 25 bp, Mus musculus
taatggtgcatgaatctcaaggcct

SEQ ID NO: 756639 - DNA, 25 bp, Mus musculus
taatggtgcatgtatctcaaggcct

SEQ ID NO: 756640 - DNA, 25 bp, Mus musculus
taatggtgcccacagtttgtttgct

SEQ ID NO: 756641 - DNA, 25 bp, Mus musculus
taatggtgcccagagtttgtttgct

SEQ ID NO: 756642 - DNA, 25 bp, Mus musculus
taatggtgccccatggctgtaaggc

SEQ ID NO: 756643 - DNA, 25 bp, Mus musculus
taatggtgccccttggctgtaaggc

SEQ ID NO: 756644 - DNA, 25 bp, Mus musculus
taatggtgctctctgactgttgcgg

SEQ ID NO: 756645 - DNA, 25 bp, Mus musculus
taatggtgctctgtgactgttgcgg

SEQ ID NO: 756646 - DNA, 25 bp, Mus musculus
taatggtggcaaatcttcagctaag

SEQ ID NO: 756647 - DNA, 25 bp, Mus musculus
taatggtggcaattcttcagctaag

SEQ ID NO: 756648 - DNA, 25 bp, Mus musculus
taatggtggcccaccagatctaatg

SEQ ID NO: 756649 - DNA, 25 bp, Mus musculus
taatggtggccctccagatctaatg

SEQ ID NO: 756650 - DNA, 25 bp, Mus musculus
taatggtggtatctctgcagcctca

SEQ ID NO: 756651 - DNA, 25 bp, Mus musculus
taatggtggtatgtctgcagcctca

SEQ ID NO: 756652 - DNA, 25 bp, Mus musculus
taatggtgtataataagtgctcact

SEQ ID NO: 756653 - DNA, 25 bp, Mus musculus
taatggtgtatattaagtgctcact

SEQ ID NO: 756654 - DNA, 25 bp, Mus musculus
taatggtgtcagagtggtcttgctc

SEQ ID NO: 756655 - DNA, 25 bp, Mus musculus
taatggtgtcagtgtggtcttgctc

SEQ ID NO: 756656 - DNA, 25 bp, Mus musculus
taatggtgtggaacccatctttctg

SEQ ID NO: 756657 - DNA, 25 bp, Mus musculus
taatggtgtggatcccatctttctg

SEQ ID NO: 756658 - DNA, 25 bp, Mus musculus
taatggtgtgggacactgcactgcc

SEQ ID NO: 756659 - DNA, 25 bp, Mus musculus
taatggtgtgggtcactgcactgcc

SEQ ID NO: 756660 - DNA, 25 bp, Mus musculus
taatggttcattaacttgcatgtat

SEQ ID NO: 756661 - DNA, 25 bp, Mus musculus
taatggttcatttacttgcatgtat

SEQ ID NO: 756662 - DNA, 25 bp, Mus musculus
taatggttctgcatgacctagccac

SEQ ID NO: 756663 - DNA, 25 bp, Mus musculus
taatggttctgcttgacctagccac

SEQ ID NO: 756664 - DNA, 25 bp, Mus musculus
taatggttgcagatgcctcgttttt

SEQ ID NO: 756665 - DNA, 25 bp, Mus musculus
taatggttgcagttgcctcgttttt

SEQ ID NO: 756666 - DNA, 25 bp, Mus musculus
taatggttgtacatctgtgcttgct

SEQ ID NO: 756667 - DNA, 25 bp, Mus musculus
taatggttgtacttctgtgcttgct

SEQ ID NO: 756668 - DNA, 25 bp, Mus musculus
taatggttgtatccccagccaaaac

SEQ ID NO: 756669 - DNA, 25 bp, Mus musculus
taatggttgtatgcccagccaaaac

SEQ ID NO: 756670 - DNA, 25 bp, Mus musculus
taatggtttaagcactggctgattt

SEQ ID NO: 756671 - DNA, 25 bp, Mus musculus
taatggtttaaggactggctgattt

SEQ ID NO: 756672 - DNA, 25 bp, Mus musculus
taatggtttagtattcacccagtga

SEQ ID NO: 756673 - DNA, 25 bp, Mus musculus
taatggtttagttttcacccagtga

SEQ ID NO: 756674 - DNA, 25 bp, Mus musculus
taatggtttcgacttctcctttcat

SEQ ID NO: 756675 - DNA, 25 bp, Mus musculus
taatggtttcgagttctcctttcat

SEQ ID NO: 756676 - DNA, 25 bp, Mus musculus
taatgtaaaaccatgtcctgcagat

SEQ ID NO: 756677 - DNA, 25 bp, Mus musculus
taatgtaaaaccttgtcctgcagat

SEQ ID NO: 756678 - DNA, 25 bp, Mus musculus
taatgtaaacctcatcgatcgatcg

SEQ ID NO: 756679 - DNA, 25 bp, Mus musculus
taatgtaaacctgatcgatcgatcg

SEQ ID NO: 756680 - DNA, 25 bp, Mus musculus
taatgtaaataaacgccttttgcta

SEQ ID NO: 756681 - DNA, 25 bp, Mus musculus
taatgtaaataatcgccttttgcta

SEQ ID NO: 756682 - DNA, 25 bp, Mus musculus
taatgtaaatcccacggcggcccca

SEQ ID NO: 756683 - DNA, 25 bp, Mus musculus
taatgtaaatccgacggcggcccca

SEQ ID NO: 756684 - DNA, 25 bp, Mus musculus
taatgtaaccctattccacaccttt

SEQ ID NO: 756685 - DNA, 25 bp, Mus musculus
taatgtaacccttttccacaccttt

SEQ ID NO: 756686 - DNA, 25 bp, Mus musculus
taatgtaagccacttggagctacac

SEQ ID NO: 756687 - DNA, 25 bp, Mus musculus
taatgtaagccagttggagctacac

SEQ ID NO: 756688 - DNA, 25 bp, Mus musculus
taatgtaagggcaggaccatagaaa

SEQ ID NO: 756689 - DNA, 25 bp, Mus musculus
taatgtaagggctggaccatagaaa

SEQ ID NO: 756690 - DNA, 25 bp, Mus musculus
taatgtaattttaggccacctactt

SEQ ID NO: 756691 - DNA, 25 bp, Mus musculus
taatgtaatttttggccacctactt

SEQ ID NO: 756692 - DNA, 25 bp, Mus musculus
taatgtacaaccaagtccatccctt

SEQ ID NO: 756693 - DNA, 25 bp, Mus musculus
taatgtacaacctagtccatccctt

SEQ ID NO: 756694 - DNA, 25 bp, Mus musculus
taatgtacaactcaccacttcatgc

SEQ ID NO: 756695 - DNA, 25 bp, Mus musculus
taatgtacaactgaccacttcatgc

SEQ ID NO: 756696 - DNA, 25 bp, Mus musculus
taatgtacactaattcactctgtat

SEQ ID NO: 756697 - DNA, 25 bp, Mus musculus
taatgtacactaattgccaatatgt

SEQ ID NO: 756698 - DNA, 25 bp, Mus musculus
taatgtacactatttcactctgtat

SEQ ID NO: 756699 - DNA, 25 bp, Mus musculus
taatgtacactatttgccaatatgt

SEQ ID NO: 756700 - DNA, 25 bp, Mus musculus
taatgtaccaaaacctgtttatagc

SEQ ID NO: 756701 - DNA, 25 bp, Mus musculus
taatgtaccaaatcctgtttatagc

SEQ ID NO: 756702 - DNA, 25 bp, Mus musculus
taatgtacctttactctttcaccac

SEQ ID NO: 756703 - DNA, 25 bp, Mus musculus
taatgtaccttttctctttcaccac

SEQ ID NO: 756704 - DNA, 25 bp, Mus musculus
taatgtactcagattcactccctac

SEQ ID NO: 756705 - DNA, 25 bp, Mus musculus
taatgtactcagtttcactccctac

SEQ ID NO: 756706 - DNA, 25 bp, Mus musculus
taatgtactgctaggaatttccctt

SEQ ID NO: 756707 - DNA, 25 bp, Mus musculus
taatgtactgcttggaatttccctt

SEQ ID NO: 756708 - DNA, 25 bp, Mus musculus
taatgtactgtcctcaatgttgccc

SEQ ID NO: 756709 - DNA, 25 bp, Mus musculus
taatgtactgtcgtcaatgttgccc

SEQ ID NO: 756710 - DNA, 25 bp, Mus musculus
taatgtagacatacacagacgggat

SEQ ID NO: 756711 - DNA, 25 bp, Mus musculus
taatgtagacattcacagacgggat

SEQ ID NO: 756712 - DNA, 25 bp, Mus musculus
taatgtagatttcggtcttgtctcc

SEQ ID NO: 756713 - DNA, 25 bp, Mus musculus
taatgtagatttgggtcttgtctcc

SEQ ID NO: 756714 - DNA, 25 bp, Mus musculus
taatgtagctgtagccgagaacaca

SEQ ID NO: 756715 - DNA, 25 bp, Mus musculus
taatgtagctgttgccgagaacaca

SEQ ID NO: 756716 - DNA, 25 bp, Mus musculus
taatgtaggcctatcatagcaccag

SEQ ID NO: 756717 - DNA, 25 bp, Mus musculus
taatgtaggcctttcatagcaccag

SEQ ID NO: 756718 - DNA, 25 bp, Mus musculus
taatgtagtcccaccaaaattactt

SEQ ID NO: 756719 - DNA, 25 bp, Mus musculus
taatgtagtccctccaaaattactt

SEQ ID NO: 756720 - DNA, 25 bp, Mus musculus
taatgtagtgctctcctaggaaccc

SEQ ID NO: 756721 - DNA, 25 bp, Mus musculus
taatgtagtgctgtcctaggaaccc

SEQ ID NO: 756722 - DNA, 25 bp, Mus musculus
taatgtagtgggattgaggacagct

SEQ ID NO: 756723 - DNA, 25 bp, Mus musculus
taatgtagtgggtttgaggacagct

SEQ ID NO: 756724 - DNA, 25 bp, Mus musculus
taatgtagtgtgctcgtcactgcca

SEQ ID NO: 756725 - DNA, 25 bp, Mus musculus
taatgtagtgtggtcgtcactgcca

SEQ ID NO: 756726 - DNA, 25 bp, Mus musculus
taatgtatacctcaccgctgaattc

SEQ ID NO: 756727 - DNA, 25 bp, Mus musculus
taatgtatacctgaccgctgaattc

SEQ ID NO: 756728 - DNA, 25 bp, Mus musculus
taatgtatactcatattttcttcct

SEQ ID NO: 756729 - DNA, 25 bp, Mus musculus
taatgtatactcttattttcttcct

SEQ ID NO: 756730 - DNA, 25 bp, Mus musculus
taatgtatattcagtgccgttgtaa

SEQ ID NO: 756731 - DNA, 25 bp, Mus musculus
taatgtatattctgtgccgttgtaa

SEQ ID NO: 756732 - DNA, 25 bp, Mus musculus
taatgtatcgccacaataacgtgag

SEQ ID NO: 756733 - DNA, 25 bp, Mus musculus
taatgtatcgcctcaataacgtgag

SEQ ID NO: 756734 - DNA, 25 bp, Mus musculus
taatgtatgcccatatctgtcctta

SEQ ID NO: 756735 - DNA, 25 bp, Mus musculus
taatgtatgcccttatctgtcctta

SEQ ID NO: 756736 - DNA, 25 bp, Mus musculus
taatgtatgtgcatatgtatgctac

SEQ ID NO: 756737 - DNA, 25 bp, Mus musculus
taatgtatgtgcttatgtatgctac

SEQ ID NO: 756738 - DNA, 25 bp, Mus musculus
taatgtatgtttagagacatgaaat

SEQ ID NO: 756739 - DNA, 25 bp, Mus musculus
taatgtatgttttgagacatgaaat

SEQ ID NO: 756740 - DNA, 25 bp, Mus musculus
taatgtcacaaacccaccagctcat

SEQ ID NO: 756741 - DNA, 25 bp, Mus musculus
taatgtcacaaagccaccagctcat

SEQ ID NO: 756742 - DNA, 25 bp, Mus musculus
taatgtcacaatcccagtacctgtt

SEQ ID NO: 756743 - DNA, 25 bp, Mus musculus
taatgtcacaatgccagtacctgtt

SEQ ID NO: 756744 - DNA, 25 bp, Mus musculus
taatgtcacactctgtcactaggca

SEQ ID NO: 756745 - DNA, 25 bp, Mus musculus
taatgtcacactgtgtcactaggca

SEQ ID NO: 756746 - DNA, 25 bp, Mus musculus
taatgtcaccatcggaggccagaaa

SEQ ID NO: 756747 - DNA, 25 bp, Mus musculus
taatgtcaccatgggaggccagaaa

SEQ ID NO: 756748 - DNA, 25 bp, Mus musculus
taatgtcacctcaatgacttcttcc

SEQ ID NO: 756749 - DNA, 25 bp, Mus musculus
taatgtcacctctatgacttcttcc

SEQ ID NO: 756750 - DNA, 25 bp, Mus musculus
taatgtcacctgctgttgtgatgta

SEQ ID NO: 756751 - DNA, 25 bp, Mus musculus
taatgtcacctggtgttgtgatgta

SEQ ID NO: 756752 - DNA, 25 bp, Mus musculus
taatgtcaccttacgcagagttccc

SEQ ID NO: 756753 - DNA, 25 bp, Mus musculus
taatgtcacctttcgcagagttccc

SEQ ID NO: 756754 - DNA, 25 bp, Mus musculus
taatgtcactcaacagagctgcccc

SEQ ID NO: 756755 - DNA, 25 bp, Mus musculus
taatgtcactcatcagagctgcccc

SEQ ID NO: 756756 - DNA, 25 bp, Mus musculus
taatgtcactgactagcccttctgc

SEQ ID NO: 756757 - DNA, 25 bp, Mus musculus
taatgtcactgagtagcccttctgc

SEQ ID NO: 756758 - DNA, 25 bp, Mus musculus
taatgtcacttcaaaacgtgctggg

SEQ ID NO: 756759 - DNA, 25 bp, Mus musculus
taatgtcacttctaaacgtgctggg

SEQ ID NO: 756760 - DNA, 25 bp, Mus musculus
taatgtcaggtactcctaacgttaa

SEQ ID NO: 756761 - DNA, 25 bp, Mus musculus
taatgtcaggtagtcctaacgttaa

SEQ ID NO: 756762 - DNA, 25 bp, Mus musculus
taatgtcagtgtcctttccgtatca

SEQ ID NO: 756763 - DNA, 25 bp, Mus musculus
taatgtcagtgtgctttccgtatca

SEQ ID NO: 756764 - DNA, 25 bp, Mus musculus
taatgtcatcctctggtaaattctg

SEQ ID NO: 756765 - DNA, 25 bp, Mus musculus
taatgtcatcctgtggtaaattctg

SEQ ID NO: 756766 - DNA, 25 bp, Mus musculus
taatgtcatctaaccccggacacag

SEQ ID NO: 756767 - DNA, 25 bp, Mus musculus
taatgtcatctatccccggacacag

SEQ ID NO: 756768 - DNA, 25 bp, Mus musculus
taatgtcatgaaagctcaggctaaa

SEQ ID NO: 756769 - DNA, 25 bp, Mus musculus
taatgtcatgaatgctcaggctaaa

SEQ ID NO: 756770 - DNA, 25 bp, Mus musculus
taatgtccacagaccgtactgggta

SEQ ID NO: 756771 - DNA, 25 bp, Mus musculus
taatgtccacagtccgtactgggta

SEQ ID NO: 756772 - DNA, 25 bp, Mus musculus
taatgtccaggcctgactttttgtc

SEQ ID NO: 756773 - DNA, 25 bp, Mus musculus
taatgtccaggcgtgactttttgtc

SEQ ID NO: 756774 - DNA, 25 bp, Mus musculus
taatgtccatgacttagtcctcctc

SEQ ID NO: 756775 - DNA, 25 bp, Mus musculus
taatgtccatgagttagtcctcctc

SEQ ID NO: 756776 - DNA, 25 bp, Mus musculus
taatgtccatttatccttttgtagg

SEQ ID NO: 756777 - DNA, 25 bp, Mus musculus
taatgtccatttttccttttgtagg

SEQ ID NO: 756778 - DNA, 25 bp, Mus musculus
taatgtcccatacttaactttttct

SEQ ID NO: 756779 - DNA, 25 bp, Mus musculus
taatgtcccatagttaactttttct

SEQ ID NO: 756780 - DNA, 25 bp, Mus musculus
taatgtccccagatgcagactgtcc

SEQ ID NO: 756781 - DNA, 25 bp, Mus musculus
taatgtccccagttgcagactgtcc

SEQ ID NO: 756782 - DNA, 25 bp, Mus musculus
taatgtccctagatactccacttct

SEQ ID NO: 756783 - DNA, 25 bp, Mus musculus
taatgtccctagttactccacttct

SEQ ID NO: 756784 - DNA, 25 bp, Mus musculus
taatgtccctggcactttatttcct

SEQ ID NO: 756785 - DNA, 25 bp, Mus musculus
taatgtccctgggactttatttcct

SEQ ID NO: 756786 - DNA, 25 bp, Mus musculus
taatgtccctgtccttagttcggag

SEQ ID NO: 756787 - DNA, 25 bp, Mus musculus
taatgtccctgtgcttagttcggag

SEQ ID NO: 756788 - DNA, 25 bp, Mus musculus
taatgtcccttcagtaataccccta

SEQ ID NO: 756789 - DNA, 25 bp, Mus musculus
taatgtcccttctgtaataccccta

SEQ ID NO: 756790 - DNA, 25 bp, Mus musculus
taatgtcctcaacctgcttcctgca

SEQ ID NO: 756791 - DNA, 25 bp, Mus musculus
taatgtcctcaagctgcttcctgca

SEQ ID NO: 756792 - DNA, 25 bp, Mus musculus
taatgtcctccaagaatgcctttgt

SEQ ID NO: 756793 - DNA, 25 bp, Mus musculus
taatgtcctccatgaatgcctttgt

SEQ ID NO: 756794 - DNA, 25 bp, Mus musculus
taatgtcctcccatcactgcatgtg

SEQ ID NO: 756795 - DNA, 25 bp, Mus musculus
taatgtcctcccttcactgcatgtg

SEQ ID NO: 756796 - DNA, 25 bp, Mus musculus
taatgtcctggtacagcctttccca

SEQ ID NO: 756797 - DNA, 25 bp, Mus musculus
taatgtcctggtacccggctggctt

SEQ ID NO: 756798 - DNA, 25 bp, Mus musculus
taatgtcctggtccccgggaagagt

SEQ ID NO: 756799 - DNA, 25 bp, Mus musculus
taatgtcctggtgcccgggaagagt

SEQ ID NO: 756800 - DNA, 25 bp, Mus musculus
taatgtcctggttcagcctttccca

SEQ ID NO: 756801 - DNA, 25 bp, Mus musculus
taatgtcctggttcccggctggctt

SEQ ID NO: 756802 - DNA, 25 bp, Mus musculus
taatgtcctgtcctttctttatcac

SEQ ID NO: 756803 - DNA, 25 bp, Mus musculus
taatgtcctgtcgtttctttatcac

SEQ ID NO: 756804 - DNA, 25 bp, Mus musculus
taatgtccttgtacttattcttccc

SEQ ID NO: 756805 - DNA, 25 bp, Mus musculus
taatgtccttgttcttattcttccc

SEQ ID NO: 756806 - DNA, 25 bp, Mus musculus
taatgtcgacagattggagattcac

SEQ ID NO: 756807 - DNA, 25 bp, Mus musculus
taatgtcgacagtttggagattcac

SEQ ID NO: 756808 - DNA, 25 bp, Mus musculus
taatgtcgcaagctggccgttactg

SEQ ID NO: 756809 - DNA, 25 bp, Mus musculus
taatgtcgcaaggtggccgttactg

SEQ ID NO: 756810 - DNA, 25 bp, Mus musculus
taatgtctacctctgatctctacat

SEQ ID NO: 756811 - DNA, 25 bp, Mus musculus
taatgtctacctctggccttcatgt

SEQ ID NO: 756812 - DNA, 25 bp, Mus musculus
taatgtctacctgtgatctctacat

SEQ ID NO: 756813 - DNA, 25 bp, Mus musculus
taatgtctacctgtggccttcatgt

SEQ ID NO: 756814 - DNA, 25 bp, Mus musculus
taatgtctcacaattgtctgctaga

SEQ ID NO: 756815 - DNA, 25 bp, Mus musculus
taatgtctcacatttgtctgctaga

SEQ ID NO: 756816 - DNA, 25 bp, Mus musculus
taatgtctcataacctggactccca

SEQ ID NO: 756817 - DNA, 25 bp, Mus musculus
taatgtctcatacttccggttccaa

SEQ ID NO: 756818 - DNA, 25 bp, Mus musculus
taatgtctcatagttccggttccaa

SEQ ID NO: 756819 - DNA, 25 bp, Mus musculus
taatgtctcatatcctggactccca

SEQ ID NO: 756820 - DNA, 25 bp, Mus musculus
taatgtctcccactcttgctgagcc

SEQ ID NO: 756821 - DNA, 25 bp, Mus musculus
taatgtctcccagtcttgctgagcc

SEQ ID NO: 756822 - DNA, 25 bp, Mus musculus
taatgtctctctagacacttcacac

SEQ ID NO: 756823 - DNA, 25 bp, Mus musculus
taatgtctctcttgacacttcacac

SEQ ID NO: 756824 - DNA, 25 bp, Mus musculus
taatgtctcttaaccctgttacaag

SEQ ID NO: 756825 - DNA, 25 bp, Mus musculus
taatgtctcttatccctgttacaag

SEQ ID NO: 756826 - DNA, 25 bp, Mus musculus
taatgtctgatcctccttctgtgaa

SEQ ID NO: 756827 - DNA, 25 bp, Mus musculus
taatgtctgatcgtccttctgtgaa

SEQ ID NO: 756828 - DNA, 25 bp, Mus musculus
taatgtctgcagctatctgcctctt

SEQ ID NO: 756829 - DNA, 25 bp, Mus musculus
taatgtctgcaggtatctgcctctt

SEQ ID NO: 756830 - DNA, 25 bp, Mus musculus
taatgtctgcatcccttagtttccc

SEQ ID NO: 756831 - DNA, 25 bp, Mus musculus
taatgtctgcatgccttagtttccc

SEQ ID NO: 756832 - DNA, 25 bp, Mus musculus
taatgtctgctaatctagatgtaga

SEQ ID NO: 756833 - DNA, 25 bp, Mus musculus
taatgtctgctattctagatgtaga

SEQ ID NO: 756834 - DNA, 25 bp, Mus musculus
taatgtctgggaattttcttggctc

SEQ ID NO: 756835 - DNA, 25 bp, Mus musculus
taatgtctgggatttttcttggctc

SEQ ID NO: 756836 - DNA, 25 bp, Mus musculus
taatgtctggtcacgctcctgtatg

SEQ ID NO: 756837 - DNA, 25 bp, Mus musculus
taatgtctggtctcgctcctgtatg

SEQ ID NO: 756838 - DNA, 25 bp, Mus musculus
taatgtctgtttccctagctacaac

SEQ ID NO: 756839 - DNA, 25 bp, Mus musculus
taatgtctgtttgcctagctacaac

SEQ ID NO: 756840 - DNA, 25 bp, Mus musculus
taatgtcttactaaagtgccacaat

SEQ ID NO: 756841 - DNA, 25 bp, Mus musculus
taatgtcttacttaagtgccacaat

SEQ ID NO: 756842 - DNA, 25 bp, Mus musculus
taatgtcttagtcccctgggttcct

SEQ ID NO: 756843 - DNA, 25 bp, Mus musculus
taatgtcttagtgccctgggttcct

SEQ ID NO: 756844 - DNA, 25 bp, Mus musculus
taatgtcttctcatttctcctgaac

SEQ ID NO: 756845 - DNA, 25 bp, Mus musculus
taatgtcttctcttttctcctgaac

SEQ ID NO: 756846 - DNA, 25 bp, Mus musculus
taatgtcttgttctctctcatagat

SEQ ID NO: 756847 - DNA, 25 bp, Mus musculus
taatgtcttgttgtctctcatagat

SEQ ID NO: 756848 - DNA, 25 bp, Mus musculus
taatgtctttgtaagacatctcccc

SEQ ID NO: 756849 - DNA, 25 bp, Mus musculus
taatgtctttgttagacatctcccc

SEQ ID NO: 756850 - DNA, 25 bp, Mus musculus
taatgtgaaaacacgactcttcctg

SEQ ID NO: 756851 - DNA, 25 bp, Mus musculus
taatgtgaaaactcgactcttcctg

SEQ ID NO: 756852 - DNA, 25 bp, Mus musculus
taatgtgactgcatcccagggaaga

SEQ ID NO: 756853 - DNA, 25 bp, Mus musculus
taatgtgactgcttcccagggaaga

SEQ ID NO: 756854 - DNA, 25 bp, Mus musculus
taatgtgatgggacttctggctgaa

SEQ ID NO: 756855 - DNA, 25 bp, Mus musculus
taatgtgatgggtcttctggctgaa

SEQ ID NO: 756856 - DNA, 25 bp, Mus musculus
taatgtgcactgaacaattttaggt

SEQ ID NO: 756857 - DNA, 25 bp, Mus musculus
taatgtgcactgtacaattttaggt

SEQ ID NO: 756858 - DNA, 25 bp, Mus musculus
taatgtgccccgcaggtatttaaag

SEQ ID NO: 756859 - DNA, 25 bp, Mus musculus
taatgtgccccggaggtatttaaag

SEQ ID NO: 756860 - DNA, 25 bp, Mus musculus
taatgtgcctaacccacttgagtgg

SEQ ID NO: 756861 - DNA, 25 bp, Mus musculus
taatgtgcctaagccacttgagtgg

SEQ ID NO: 756862 - DNA, 25 bp, Mus musculus
taatgtgcctacctaaccaggagga

SEQ ID NO: 756863 - DNA, 25 bp, Mus musculus
taatgtgcctacgtaaccaggagga

SEQ ID NO: 756864 - DNA, 25 bp, Mus musculus
taatgtgcctctctcagcaggagat

SEQ ID NO: 756865 - DNA, 25 bp, Mus musculus
taatgtgcctctgtcagcaggagat

SEQ ID NO: 756866 - DNA, 25 bp, Mus musculus
taatgtgccttaagtcagtgtccct

SEQ ID NO: 756867 - DNA, 25 bp, Mus musculus
taatgtgccttatgtcagtgtccct

SEQ ID NO: 756868 - DNA, 25 bp, Mus musculus
taatgtgcgcatagtgtgtacccta

SEQ ID NO: 756869 - DNA, 25 bp, Mus musculus
taatgtgcgcattgtgtgtacccta

SEQ ID NO: 756870 - DNA, 25 bp, Mus musculus
taatgtgcgtctacagttgttttaa

SEQ ID NO: 756871 - DNA, 25 bp, Mus musculus
taatgtgcgtcttcagttgttttaa

SEQ ID NO: 756872 - DNA, 25 bp, Mus musculus
taatgtgctagtatacgtggtccct

SEQ ID NO: 756873 - DNA, 25 bp, Mus musculus
taatgtgctagtttacgtggtccct

SEQ ID NO: 756874 - DNA, 25 bp, Mus musculus
taatgtgctctactggctgatttgc

SEQ ID NO: 756875 - DNA, 25 bp, Mus musculus
taatgtgctctagtggctgatttgc

SEQ ID NO: 756876 - DNA, 25 bp, Mus musculus
taatgtgctttgagttctcaggcgc

SEQ ID NO: 756877 - DNA, 25 bp, Mus musculus
taatgtgctttgtgttctcaggcgc

SEQ ID NO: 756878 - DNA, 25 bp, Mus musculus
taatgtgcttttcaggctttggtct

SEQ ID NO: 756879 - DNA, 25 bp, Mus musculus
taatgtgcttttgaggctttggtct

SEQ ID NO: 756880 - DNA, 25 bp, Mus musculus
taatgtggacatacccctaagctat

SEQ ID NO: 756881 - DNA, 25 bp, Mus musculus
taatgtggacattcccctaagctat

SEQ ID NO: 756882 - DNA, 25 bp, Mus musculus
taatgtggacgaatgtggcttttct

SEQ ID NO: 756883 - DNA, 25 bp, Mus musculus
taatgtggacgattgtggcttttct

SEQ ID NO: 756884 - DNA, 25 bp, Mus musculus
taatgtggatttatcctgagaaaca

SEQ ID NO: 756885 - DNA, 25 bp, Mus musculus
taatgtggatttttcctgagaaaca

SEQ ID NO: 756886 - DNA, 25 bp, Mus musculus
taatgtggcagtcaccttcagcacc

SEQ ID NO: 756887 - DNA, 25 bp, Mus musculus
taatgtggcagtgaccttcagcacc

SEQ ID NO: 756888 - DNA, 25 bp, Mus musculus
taatgtggcataaagtgacttctta

SEQ ID NO: 756889 - DNA, 25 bp, Mus musculus
taatgtggcataccatttgtcttat

SEQ ID NO: 756890 - DNA, 25 bp, Mus musculus
taatgtggcatagcatttgtcttat

SEQ ID NO: 756891 - DNA, 25 bp, Mus musculus
taatgtggcatatagtgacttctta

SEQ ID NO: 756892 - DNA, 25 bp, Mus musculus
taatgtggcgttaatgtgacatcaa

SEQ ID NO: 756893 - DNA, 25 bp, Mus musculus
taatgtggcgtttatgtgacatcaa

SEQ ID NO: 756894 - DNA, 25 bp, Mus musculus
taatgtggctttatatggagggtgt

SEQ ID NO: 756895 - DNA, 25 bp, Mus musculus
taatgtggctttttatggagggtgt

SEQ ID NO: 756896 - DNA, 25 bp, Mus musculus
taatgtggtcatcttcttagcacca

SEQ ID NO: 756897 - DNA, 25 bp, Mus musculus
taatgtggtcatgttcttagcacca

SEQ ID NO: 756898 - DNA, 25 bp, Mus musculus
taatgtggtgacctccccagaagta

SEQ ID NO: 756899 - DNA, 25 bp, Mus musculus
taatgtggtgacgtccccagaagta

SEQ ID NO: 756900 - DNA, 25 bp, Mus musculus
taatgtggttacagtcatattacac

SEQ ID NO: 756901 - DNA, 25 bp, Mus musculus
taatgtggttactgtcatattacac

SEQ ID NO: 756902 - DNA, 25 bp, Mus musculus
taatgtggttttctggcttttaata

SEQ ID NO: 756903 - DNA, 25 bp, Mus musculus
taatgtggttttgtggcttttaata

SEQ ID NO: 756904 - DNA, 25 bp, Mus musculus
taatgtgtaatcaaagctctttcca

SEQ ID NO: 756905 - DNA, 25 bp, Mus musculus
taatgtgtaatctaagctctttcca

SEQ ID NO: 756906 - DNA, 25 bp, Mus musculus
taatgtgtacatcctcctttcttcg

SEQ ID NO: 756907 - DNA, 25 bp, Mus musculus
taatgtgtacatgctcctttcttcg

SEQ ID NO: 756908 - DNA, 25 bp, Mus musculus
taatgtgtcacacctgctagctctg

SEQ ID NO: 756909 - DNA, 25 bp, Mus musculus
taatgtgtcacagctgctagctctg

SEQ ID NO: 756910 - DNA, 25 bp, Mus musculus
taatgtgtcctaaatttccccagat

SEQ ID NO: 756911 - DNA, 25 bp, Mus musculus
taatgtgtcctatatttccccagat

SEQ ID NO: 756912 - DNA, 25 bp, Mus musculus
taatgtgtcgtgcatgcagacggaa

SEQ ID NO: 756913 - DNA, 25 bp, Mus musculus
taatgtgtcgtggatgcagacggaa

SEQ ID NO: 756914 - DNA, 25 bp, Mus musculus
taatgtgtctgcaggctgaggcagc

SEQ ID NO: 756915 - DNA, 25 bp, Mus musculus
taatgtgtctgctggctgaggcagc

SEQ ID NO: 756916 - DNA, 25 bp, Mus musculus
taatgtgtcttcaatcagtcctgga

SEQ ID NO: 756917 - DNA, 25 bp, Mus musculus
taatgtgtcttctatcagtcctgga

SEQ ID NO: 756918 - DNA, 25 bp, Mus musculus
taatgtgtgactatgcaggctgtgt

SEQ ID NO: 756919 - DNA, 25 bp, Mus musculus
taatgtgtgactttgcaggctgtgt

SEQ ID NO: 756920 - DNA, 25 bp, Mus musculus
taatgtgtgattacctccatataca

SEQ ID NO: 756921 - DNA, 25 bp, Mus musculus
taatgtgtgatttcctccatataca

SEQ ID NO: 756922 - DNA, 25 bp, Mus musculus
taatgtgtgcatccccacgtacaat

SEQ ID NO: 756923 - DNA, 25 bp, Mus musculus
taatgtgtgcatgcccacgtacaat

SEQ ID NO: 756924 - DNA, 25 bp, Mus musculus
taatgtgtggccagcacagtacagg

SEQ ID NO: 756925 - DNA, 25 bp, Mus musculus
taatgtgtggcctgcacagtacagg

SEQ ID NO: 756926 - DNA, 25 bp, Mus musculus
taatgtgtggttattatgcttccag

SEQ ID NO: 756927 - DNA, 25 bp, Mus musculus
taatgtgtggtttttatgcttccag

SEQ ID NO: 756928 - DNA, 25 bp, Mus musculus
taatgtgttcacagagggtaatcct

SEQ ID NO: 756929 - DNA, 25 bp, Mus musculus
taatgtgttcactgagggtaatcct

SEQ ID NO: 756930 - DNA, 25 bp, Mus musculus
taatgtgttcccaactctgacagag

SEQ ID NO: 756931 - DNA, 25 bp, Mus musculus
taatgtgttccctactctgacagag

SEQ ID NO: 756932 - DNA, 25 bp, Mus musculus
taatgttaacttactttgcatgaaa

SEQ ID NO: 756933 - DNA, 25 bp, Mus musculus
taatgttaactttctttgcatgaaa

SEQ ID NO: 756934 - DNA, 25 bp, Mus musculus
taatgttaatttcttccccatcacc

SEQ ID NO: 756935 - DNA, 25 bp, Mus musculus
taatgttaatttgttccccatcacc

SEQ ID NO: 756936 - DNA, 25 bp, Mus musculus
taatgttactacagcttccttctcc

SEQ ID NO: 756937 - DNA, 25 bp, Mus musculus
taatgttactactgcttccttctcc

SEQ ID NO: 756938 - DNA, 25 bp, Mus musculus
taatgttagaaaacctgtataaaag

SEQ ID NO: 756939 - DNA, 25 bp, Mus musculus
taatgttagaaatcctgtataaaag

SEQ ID NO: 756940 - DNA, 25 bp, Mus musculus
taatgttatcctaacctccaaagat

SEQ ID NO: 756941 - DNA, 25 bp, Mus musculus
taatgttatccttacctccaaagat

SEQ ID NO: 756942 - DNA, 25 bp, Mus musculus
taatgttcaactactcagtgccaaa

SEQ ID NO: 756943 - DNA, 25 bp, Mus musculus
taatgttcaacttctcagtgccaaa

SEQ ID NO: 756944 - DNA, 25 bp, Mus musculus
taatgttcaagcaacatttccccgc

SEQ ID NO: 756945 - DNA, 25 bp, Mus musculus
taatgttcaagctacatttccccgc

SEQ ID NO: 756946 - DNA, 25 bp, Mus musculus
taatgttcaattaaaaagacctctt

SEQ ID NO: 756947 - DNA, 25 bp, Mus musculus
taatgttcaatttaaaagacctctt

SEQ ID NO: 756948 - DNA, 25 bp, Mus musculus
taatgttcacaaccactggcctttg

SEQ ID NO: 756949 - DNA, 25 bp, Mus musculus
taatgttcacaagcactggcctttg

SEQ ID NO: 756950 - DNA, 25 bp, Mus musculus
taatgttcacacactggagctctgt

SEQ ID NO: 756951 - DNA, 25 bp, Mus musculus
taatgttcacactctggagctctgt

SEQ ID NO: 756952 - DNA, 25 bp, Mus musculus
taatgttcagctcagttggttcaaa

SEQ ID NO: 756953 - DNA, 25 bp, Mus musculus
taatgttcagctgagttggttcaaa

SEQ ID NO: 756954 - DNA, 25 bp, Mus musculus
taatgttcatggacttaatgcctga

SEQ ID NO: 756955 - DNA, 25 bp, Mus musculus
taatgttcatggtcttaatgcctga

SEQ ID NO: 756956 - DNA, 25 bp, Mus musculus
taatgttcatttcctctgtcccaga

SEQ ID NO: 756957 - DNA, 25 bp, Mus musculus
taatgttcatttgctctgtcccaga

SEQ ID NO: 756958 - DNA, 25 bp, Mus musculus
taatgttccaggctgcttcttgttc

SEQ ID NO: 756959 - DNA, 25 bp, Mus musculus
taatgttccagggtgcttcttgttc

SEQ ID NO: 756960 - DNA, 25 bp, Mus musculus
taatgttccattctcacacgcacag

SEQ ID NO: 756961 - DNA, 25 bp, Mus musculus
taatgttccattgtcacacgcacag

SEQ ID NO: 756962 - DNA, 25 bp, Mus musculus
taatgttcgtgtctgttcctagatt

SEQ ID NO: 756963 - DNA, 25 bp, Mus musculus
taatgttcgtgtgtgttcctagatt

SEQ ID NO: 756964 - DNA, 25 bp, Mus musculus
taatgttcgttcatcctttaatagg

SEQ ID NO: 756965 - DNA, 25 bp, Mus musculus
taatgttcgttcttcctttaatagg

SEQ ID NO: 756966 - DNA, 25 bp, Mus musculus
taatgttctcatattggccccagat

SEQ ID NO: 756967 - DNA, 25 bp, Mus musculus
taatgttctcattttggccccagat

SEQ ID NO: 756968 - DNA, 25 bp, Mus musculus
taatgttctcggcttttgttttctg

SEQ ID NO: 756969 - DNA, 25 bp, Mus musculus
taatgttctcgggttttgttttctg

SEQ ID NO: 756970 - DNA, 25 bp, Mus musculus
taatgttcttcaagactgtctgttg

SEQ ID NO: 756971 - DNA, 25 bp, Mus musculus
taatgttcttcatgactgtctgttg

SEQ ID NO: 756972 - DNA, 25 bp, Mus musculus
taatgttcttggattcctcagtgca

SEQ ID NO: 756973 - DNA, 25 bp, Mus musculus
taatgttcttggtttcctcagtgca

SEQ ID NO: 756974 - DNA, 25 bp, Mus musculus
taatgttctttgagtcctagtgact

SEQ ID NO: 756975 - DNA, 25 bp, Mus musculus
taatgttctttgtgtcctagtgact

SEQ ID NO: 756976 - DNA, 25 bp, Mus musculus
taatgttgacttctctctagtcctc

SEQ ID NO: 756977 - DNA, 25 bp, Mus musculus
taatgttgacttgtctctagtcctc

SEQ ID NO: 756978 - DNA, 25 bp, Mus musculus
taatgttgcctgcagcccacataaa

SEQ ID NO: 756979 - DNA, 25 bp, Mus musculus
taatgttgcctggagcccacataaa

SEQ ID NO: 756980 - DNA, 25 bp, Mus musculus
taatgttgggacattgatttcactt

SEQ ID NO: 756981 - DNA, 25 bp, Mus musculus
taatgttgggactttgatttcactt

SEQ ID NO: 756982 - DNA, 25 bp, Mus musculus
taatgttgtatgagcgtgtatgtat

SEQ ID NO: 756983 - DNA, 25 bp, Mus musculus
taatgttgtatgtgcgtgtatgtat

SEQ ID NO: 756984 - DNA, 25 bp, Mus musculus
taatgttgtgacacaatggaaccat

SEQ ID NO: 756985 - DNA, 25 bp, Mus musculus
taatgttgtgactcaatggaaccat

SEQ ID NO: 756986 - DNA, 25 bp, Mus musculus
taatgttgtgagaaacccttggaca

SEQ ID NO: 756987 - DNA, 25 bp, Mus musculus
taatgttgtgagtaacccttggaca

SEQ ID NO: 756988 - DNA, 25 bp, Mus musculus
taatgttgtgcacccaaattacatt

SEQ ID NO: 756989 - DNA, 25 bp, Mus musculus
taatgttgtgcagccaaattacatt

SEQ ID NO: 756990 - DNA, 25 bp, Mus musculus
taatgtttacatctgctgcttagct

SEQ ID NO: 756991 - DNA, 25 bp, Mus musculus
taatgtttacatgtgctgcttagct

SEQ ID NO: 756992 - DNA, 25 bp, Mus musculus
taatgtttacctctacttcctaact

SEQ ID NO: 756993 - DNA, 25 bp, Mus musculus
taatgtttacctgtacttcctaact

SEQ ID NO: 756994 - DNA, 25 bp, Mus musculus
taatgtttactgataccctgctgtc

SEQ ID NO: 756995 - DNA, 25 bp, Mus musculus
taatgtttactgttaccctgctgtc

SEQ ID NO: 756996 - DNA, 25 bp, Mus musculus
taatgtttacttcagcttgttgagc

SEQ ID NO: 756997 - DNA, 25 bp, Mus musculus
taatgtttacttgagcttgttgagc

SEQ ID NO: 756998 - DNA, 25 bp, Mus musculus
taatgtttaggccttccagtgttta

SEQ ID NO: 756999 - DNA, 25 bp, Mus musculus
taatgtttaggcgttccagtgttta

SEQ ID NO: 757000 - DNA, 25 bp, Mus musculus
taatgtttccaaacctctggcacaa

SEQ ID NO: 757001 - DNA, 25 bp, Mus musculus
taatgtttccaatcctctggcacaa

SEQ ID NO: 757002 - DNA, 25 bp, Mus musculus
taatgtttccaccaatgtatttcaa

SEQ ID NO: 757003 - DNA, 25 bp, Mus musculus
taatgtttccacgaatgtatttcaa

SEQ ID NO: 757004 - DNA, 25 bp, Mus musculus
taatgtttcgctctggtactctgca

SEQ ID NO: 757005 - DNA, 25 bp, Mus musculus
taatgtttcgctgtggtactctgca

SEQ ID NO: 757006 - DNA, 25 bp, Mus musculus
taatgtttcttacccatcatggcac

SEQ ID NO: 757007 - DNA, 25 bp, Mus musculus
taatgtttcttagccatcatggcac

SEQ ID NO: 757008 - DNA, 25 bp, Mus musculus
taatgtttgaggaactagttgccaa

SEQ ID NO: 757009 - DNA, 25 bp, Mus musculus
taatgtttgaggtactagttgccaa

SEQ ID NO: 757010 - DNA, 25 bp, Mus musculus
taatgtttgcaacgccctatgtcta

SEQ ID NO: 757011 - DNA, 25 bp, Mus musculus
taatgtttgcaaggccctatgtcta

SEQ ID NO: 757012 - DNA, 25 bp, Mus musculus
taatgtttgcccacatatcagaaga

SEQ ID NO: 757013 - DNA, 25 bp, Mus musculus
taatgtttgccctcatatcagaaga

SEQ ID NO: 757014 - DNA, 25 bp, Mus musculus
taatgtttgcttctgtggtggttct

SEQ ID NO: 757015 - DNA, 25 bp, Mus musculus
taatgtttgcttgtgtggtggttct

SEQ ID NO: 757016 - DNA, 25 bp, Mus musculus
taatgtttgtatatccctgtcagct

SEQ ID NO: 757017 - DNA, 25 bp, Mus musculus
taatgtttgtatttccctgtcagct

SEQ ID NO: 757018 - DNA, 25 bp, Mus musculus
taatgtttgtctccatccctagagc

SEQ ID NO: 757019 - DNA, 25 bp, Mus musculus
taatgtttgtctgcatccctagagc

SEQ ID NO: 757020 - DNA, 25 bp, Mus musculus
taatgtttgtggctgtcttctactg

SEQ ID NO: 757021 - DNA, 25 bp, Mus musculus
taatgtttgtgggtgtcttctactg

SEQ ID NO: 757022 - DNA, 25 bp, Mus musculus
taatgtttgttcaaaatgccataat

SEQ ID NO: 757023 - DNA, 25 bp, Mus musculus
taatgtttgttctaaatgccataat

SEQ ID NO: 757024 - DNA, 25 bp, Mus musculus
taatgtttgtttctactcagctctg

SEQ ID NO: 757025 - DNA, 25 bp, Mus musculus
taatgtttgtttgtactcagctctg

SEQ ID NO: 757026 - DNA, 25 bp, Mus musculus
taatgttttaaacggccagtgagat

SEQ ID NO: 757027 - DNA, 25 bp, Mus musculus
taatgttttaaagggccagtgagat

SEQ ID NO: 757028 - DNA, 25 bp, Mus musculus
taatgttttcccatgtaaaccggag

SEQ ID NO: 757029 - DNA, 25 bp, Mus musculus
taatgttttcccttgtaaaccggag

SEQ ID NO: 757030 - DNA, 25 bp, Mus musculus
taatgttttcctccttgtgacattg

SEQ ID NO: 757031 - DNA, 25 bp, Mus musculus
taatgttttcctgcttgtgacattg

SEQ ID NO: 757032 - DNA, 25 bp, Mus musculus
taatgttttgtaatcaacaaaccta

SEQ ID NO: 757033 - DNA, 25 bp, Mus musculus
taatgttttgtattcaacaaaccta

SEQ ID NO: 757034 - DNA, 25 bp, Mus musculus
taattaaaatcccagcagcagccct

SEQ ID NO: 757035 - DNA, 25 bp, Mus musculus
taattaaaatccgagcagcagccct

SEQ ID NO: 757036 - DNA, 25 bp, Mus musculus
taattaaagatgacgcagaggagcc

SEQ ID NO: 757037 - DNA, 25 bp, Mus musculus
taattaaagatgtcgcagaggagcc

SEQ ID NO: 757038 - DNA, 25 bp, Mus musculus
taattaacagaacgccggcactatt

SEQ ID NO: 757039 - DNA, 25 bp, Mus musculus
taattaacagaaggccggcactatt

SEQ ID NO: 757040 - DNA, 25 bp, Mus musculus
taattaacagcaacgtcacaaagat

SEQ ID NO: 757041 - DNA, 25 bp, Mus musculus
taattaacagcatcgtcacaaagat

SEQ ID NO: 757042 - DNA, 25 bp, Mus musculus
taattaacatccagggtaagtgcaa

SEQ ID NO: 757043 - DNA, 25 bp, Mus musculus
taattaacatcctgggtaagtgcaa

SEQ ID NO: 757044 - DNA, 25 bp, Mus musculus
taattaactgcccattagagagact

SEQ ID NO: 757045 - DNA, 25 bp, Mus musculus
taattaactgccgattagagagact

SEQ ID NO: 757046 - DNA, 25 bp, Mus musculus
taattaagctcccagacctgcttta

SEQ ID NO: 757047 - DNA, 25 bp, Mus musculus
taattaagctccgagacctgcttta

SEQ ID NO: 757048 - DNA, 25 bp, Mus musculus
taattaaggtctaggattcaattcc

SEQ ID NO: 757049 - DNA, 25 bp, Mus musculus
taattaaggtcttggattcaattcc

SEQ ID NO: 757050 - DNA, 25 bp, Mus musculus
taattaataatgctcagactgatgg

SEQ ID NO: 757051 - DNA, 25 bp, Mus musculus
taattaataatggtcagactgatgg

SEQ ID NO: 757052 - DNA, 25 bp, Mus musculus
taattaatacctcccatgttctgga

SEQ ID NO: 757053 - DNA, 25 bp, Mus musculus
taattaatacctgccatgttctgga

SEQ ID NO: 757054 - DNA, 25 bp, Mus musculus
taattaatacttcgctgaactggag

SEQ ID NO: 757055 - DNA, 25 bp, Mus musculus
taattaatacttggctgaactggag

SEQ ID NO: 757056 - DNA, 25 bp, Mus musculus
taattaatcctaccacccaaattgt

SEQ ID NO: 757057 - DNA, 25 bp, Mus musculus
taattaatcctagcacccaaattgt

SEQ ID NO: 757058 - DNA, 25 bp, Mus musculus
taattaatctttcatgtggtgtctt

SEQ ID NO: 757059 - DNA, 25 bp, Mus musculus
taattaatctttgatgtggtgtctt

SEQ ID NO: 757060 - DNA, 25 bp, Mus musculus
taattaatggctcctgccacattcc

SEQ ID NO: 757061 - DNA, 25 bp, Mus musculus
taattaatggctgctgccacattcc

SEQ ID NO: 757062 - DNA, 25 bp, Mus musculus
taattaatgtctctttttaactgag

SEQ ID NO: 757063 - DNA, 25 bp, Mus musculus
taattaatgtctgtttttaactgag

SEQ ID NO: 757064 - DNA, 25 bp, Mus musculus
taattaatttccctgtctgtatctg

SEQ ID NO: 757065 - DNA, 25 bp, Mus musculus
taattaatttccgtgtctgtatctg

SEQ ID NO: 757066 - DNA, 25 bp, Mus musculus
taattacaccgtcgctcatcttgag

SEQ ID NO: 757067 - DNA, 25 bp, Mus musculus
taattacaccgtggctcatcttgag

SEQ ID NO: 757068 - DNA, 25 bp, Mus musculus
taattacactacaaggcagacgctc

SEQ ID NO: 757069 - DNA, 25 bp, Mus musculus
taattacactactaggcagacgctc

SEQ ID NO: 757070 - DNA, 25 bp, Mus musculus
taattacagcagctttcagccctac

SEQ ID NO: 757071 - DNA, 25 bp, Mus musculus
taattacagcaggtttcagccctac

SEQ ID NO: 757072 - DNA, 25 bp, Mus musculus
taattacagcccacaagccagttga

SEQ ID NO: 757073 - DNA, 25 bp, Mus musculus
taattacagccctcaagccagttga

SEQ ID NO: 757074 - DNA, 25 bp, Mus musculus
taattaccactgacctgttggccag

SEQ ID NO: 757075 - DNA, 25 bp, Mus musculus
taattaccactgtcctgttggccag

SEQ ID NO: 757076 - DNA, 25 bp, Mus musculus
taattacccctgctgtgggcactaa

SEQ ID NO: 757077 - DNA, 25 bp, Mus musculus
taattacccctggtgtgggcactaa

SEQ ID NO: 757078 - DNA, 25 bp, Mus musculus
taattaccccttactgacagcttcg

SEQ ID NO: 757079 - DNA, 25 bp, Mus musculus
taattacccctttctgacagcttcg

SEQ ID NO: 757080 - DNA, 25 bp, Mus musculus
taattacccttcaggtacaaggaga

SEQ ID NO: 757081 - DNA, 25 bp, Mus musculus
taattacccttctggtacaaggaga

SEQ ID NO: 757082 - DNA, 25 bp, Mus musculus
taattaccgagcacctgcaggcata

SEQ ID NO: 757083 - DNA, 25 bp, Mus musculus
taattaccgagctcctgcaggcata

SEQ ID NO: 757084 - DNA, 25 bp, Mus musculus
taattaccttttcgatactgtggtt

SEQ ID NO: 757085 - DNA, 25 bp, Mus musculus
taattaccttttggatactgtggtt

SEQ ID NO: 757086 - DNA, 25 bp, Mus musculus
taattacgtgtgcacattacctgtg

SEQ ID NO: 757087 - DNA, 25 bp, Mus musculus
taattacgtgtggacattacctgtg

SEQ ID NO: 757088 - DNA, 25 bp, Mus musculus
taattacgttctcatgttctggcat

SEQ ID NO: 757089 - DNA, 25 bp, Mus musculus
taattacgttctgatgttctggcat

SEQ ID NO: 757090 - DNA, 25 bp, Mus musculus
taattactacagcaaccctcagtct

SEQ ID NO: 757091 - DNA, 25 bp, Mus musculus
taattactacaggaaccctcagtct

SEQ ID NO: 757092 - DNA, 25 bp, Mus musculus
taattactaccactacaggccatct

SEQ ID NO: 757093 - DNA, 25 bp, Mus musculus
taattactaccagtacaggccatct

SEQ ID NO: 757094 - DNA, 25 bp, Mus musculus
taattactcattccctttgtccctt

SEQ ID NO: 757095 - DNA, 25 bp, Mus musculus
taattactcattgcctttgtccctt

SEQ ID NO: 757096 - DNA, 25 bp, Mus musculus
taattactcgttcttgatctttgga

SEQ ID NO: 757097 - DNA, 25 bp, Mus musculus
taattactcgttgttgatctttgga

SEQ ID NO: 757098 - DNA, 25 bp, Mus musculus
taattactcttcagtccgcgttgct

SEQ ID NO: 757099 - DNA, 25 bp, Mus musculus
taattactcttctgtccgcgttgct

SEQ ID NO: 757100 - DNA, 25 bp, Mus musculus
taattactgaacaacccctttatat

SEQ ID NO: 757101 - DNA, 25 bp, Mus musculus
taattactgaactacccctttatat

SEQ ID NO: 757102 - DNA, 25 bp, Mus musculus
taattactgattcttttttagaggt

SEQ ID NO: 757103 - DNA, 25 bp, Mus musculus
taattactgattgttttttagaggt

SEQ ID NO: 757104 - DNA, 25 bp, Mus musculus
taattactgctaccgctgtggcaat

SEQ ID NO: 757105 - DNA, 25 bp, Mus musculus
taattactgctagcgctgtggcaat

SEQ ID NO: 757106 - DNA, 25 bp, Mus musculus
taattactggaaagctcctccgagc

SEQ ID NO: 757107 - DNA, 25 bp, Mus musculus
taattactggaatgctcctccgagc

SEQ ID NO: 757108 - DNA, 25 bp, Mus musculus
taattacttcagcagacactgggct

SEQ ID NO: 757109 - DNA, 25 bp, Mus musculus
taattacttcaggagacactgggct

SEQ ID NO: 757110 - DNA, 25 bp, Mus musculus
taattagaaagtatcccaagtggct

SEQ ID NO: 757111 - DNA, 25 bp, Mus musculus
taattagaaagtttcccaagtggct

SEQ ID NO: 757112 - DNA, 25 bp, Mus musculus
taattagagcacaccttcccatgaa

SEQ ID NO: 757113 - DNA, 25 bp, Mus musculus
taattagagcactccttcccatgaa

SEQ ID NO: 757114 - DNA, 25 bp, Mus musculus
taattagatagtaaggagcccttcc

SEQ ID NO: 757115 - DNA, 25 bp, Mus musculus
taattagatagttaggagcccttcc

SEQ ID NO: 757116 - DNA, 25 bp, Mus musculus
taattagcatgcatcttacccttga

SEQ ID NO: 757117 - DNA, 25 bp, Mus musculus
taattagcatgcttcttacccttga

SEQ ID NO: 757118 - DNA, 25 bp, Mus musculus
taattagccctgctttgaccctaat

SEQ ID NO: 757119 - DNA, 25 bp, Mus musculus
taattagccctggtttgaccctaat

SEQ ID NO: 757120 - DNA, 25 bp, Mus musculus
taattagcctaaaatgtcaggcttc

SEQ ID NO: 757121 - DNA, 25 bp, Mus musculus
taattagcctaatatgtcaggcttc

SEQ ID NO: 757122 - DNA, 25 bp, Mus musculus
taattagcctccatccgactttaat

SEQ ID NO: 757123 - DNA, 25 bp, Mus musculus
taattagcctccttccgactttaat

SEQ ID NO: 757124 - DNA, 25 bp, Mus musculus
taattagctcctaactttgttgcct

SEQ ID NO: 757125 - DNA, 25 bp, Mus musculus
taattagctccttactttgttgcct

SEQ ID NO: 757126 - DNA, 25 bp, Mus musculus
taattagcttccaaattgctttagg

SEQ ID NO: 757127 - DNA, 25 bp, Mus musculus
taattagcttcctaattgctttagg

SEQ ID NO: 757128 - DNA, 25 bp, Mus musculus
taattaggctacactctgaaacaat

SEQ ID NO: 757129 - DNA, 25 bp, Mus musculus
taattaggctactctctgaaacaat

SEQ ID NO: 757130 - DNA, 25 bp, Mus musculus
taattaggttccagttttggctgcc

SEQ ID NO: 757131 - DNA, 25 bp, Mus musculus
taattaggttcctgttttggctgcc

SEQ ID NO: 757132 - DNA, 25 bp, Mus musculus
taattaggttggcaaatccccgccg

SEQ ID NO: 757133 - DNA, 25 bp, Mus musculus
taattaggttgggaaatccccgccg

SEQ ID NO: 757134 - DNA, 25 bp, Mus musculus
taattagtagttacaccctggtctt

SEQ ID NO: 757135 - DNA, 25 bp, Mus musculus
taattagtagtttcaccctggtctt

SEQ ID NO: 757136 - DNA, 25 bp, Mus musculus
taattagtctggaccccatgcatca

SEQ ID NO: 757137 - DNA, 25 bp, Mus musculus
taattagtctggtccccatgcatca

SEQ ID NO: 757138 - DNA, 25 bp, Mus musculus
taattagtgcccagcattctgtctg

SEQ ID NO: 757139 - DNA, 25 bp, Mus musculus
taattagtgccctgcattctgtctg

SEQ ID NO: 757140 - DNA, 25 bp, Mus musculus
taattagttaagatttgactttcct

SEQ ID NO: 757141 - DNA, 25 bp, Mus musculus
taattagttaagttttgactttcct

SEQ ID NO: 757142 - DNA, 25 bp, Mus musculus
taattagttactactgttgacaatt

SEQ ID NO: 757143 - DNA, 25 bp, Mus musculus
taattagttactccaggttatccac

SEQ ID NO: 757144 - DNA, 25 bp, Mus musculus
taattagttactgcaggttatccac

SEQ ID NO: 757145 - DNA, 25 bp, Mus musculus
taattagttacttctgttgacaatt

SEQ ID NO: 757146 - DNA, 25 bp, Mus musculus
taattatacagtcatttctttcccc

SEQ ID NO: 757147 - DNA, 25 bp, Mus musculus
taattatacagtgatttctttcccc

SEQ ID NO: 757148 - DNA, 25 bp, Mus musculus
taattatacattagatagaaccatg

SEQ ID NO: 757149 - DNA, 25 bp, Mus musculus
taattatacatttgatagaaccatg

SEQ ID NO: 757150 - DNA, 25 bp, Mus musculus
taattataccctctgcaaagcccaa

SEQ ID NO: 757151 - DNA, 25 bp, Mus musculus
taattataccctgtgcaaagcccaa

SEQ ID NO: 757152 - DNA, 25 bp, Mus musculus
taattatattgtactcgcccctctg

SEQ ID NO: 757153 - DNA, 25 bp, Mus musculus
taattatattgttctcgcccctctg

SEQ ID NO: 757154 - DNA, 25 bp, Mus musculus
taattatcccttcgcatgagccgga

SEQ ID NO: 757155 - DNA, 25 bp, Mus musculus
taattatcccttggcatgagccgga

SEQ ID NO: 757156 - DNA, 25 bp, Mus musculus
taattatcctcgcttcagtgttcct

SEQ ID NO: 757157 - DNA, 25 bp, Mus musculus
taattatcctcggttcagtgttcct

SEQ ID NO: 757158 - DNA, 25 bp, Mus musculus
taattatcctctaccgacactgtgg

SEQ ID NO: 757159 - DNA, 25 bp, Mus musculus
taattatcctcttccgacactgtgg

SEQ ID NO: 757160 - DNA, 25 bp, Mus musculus
taattatcctttcgcactttgccca

SEQ ID NO: 757161 - DNA, 25 bp, Mus musculus
taattatcctttggcactttgccca

SEQ ID NO: 757162 - DNA, 25 bp, Mus musculus
taattatctaacctactgtctgaag

SEQ ID NO: 757163 - DNA, 25 bp, Mus musculus
taattatctaacgtactgtctgaag

SEQ ID NO: 757164 - DNA, 25 bp, Mus musculus
taattatctccgagacactgctgtt

SEQ ID NO: 757165 - DNA, 25 bp, Mus musculus
taattatctccgtgacactgctgtt

SEQ ID NO: 757166 - DNA, 25 bp, Mus musculus
taattatgacacctgttctaactgt

SEQ ID NO: 757167 - DNA, 25 bp, Mus musculus
taattatgacacgtgttctaactgt

SEQ ID NO: 757168 - DNA, 25 bp, Mus musculus
taattatgcccaagattagccccta

SEQ ID NO: 757169 - DNA, 25 bp, Mus musculus
taattatgcccatgattagccccta

SEQ ID NO: 757170 - DNA, 25 bp, Mus musculus
taattatgcctcatatacccgggat

SEQ ID NO: 757171 - DNA, 25 bp, Mus musculus
taattatgcctcttatacccgggat

SEQ ID NO: 757172 - DNA, 25 bp, Mus musculus
taattatgctatcgctatgtatggc

SEQ ID NO: 757173 - DNA, 25 bp, Mus musculus
taattatgctatggctatgtatggc

SEQ ID NO: 757174 - DNA, 25 bp, Mus musculus
taattatgtatccacctcctaactg

SEQ ID NO: 757175 - DNA, 25 bp, Mus musculus
taattatgtatcgacctcctaactg

SEQ ID NO: 757176 - DNA, 25 bp, Mus musculus
taattatgtcctaggtgttctcccc

SEQ ID NO: 757177 - DNA, 25 bp, Mus musculus
taattatgtccttggtgttctcccc

SEQ ID NO: 757178 - DNA, 25 bp, Mus musculus
taattatgtctccttagccacttga

SEQ ID NO: 757179 - DNA, 25 bp, Mus musculus
taattatgtctcgttagccacttga

SEQ ID NO: 757180 - DNA, 25 bp, Mus musculus
taattatgtgtacacccctgagctg

SEQ ID NO: 757181 - DNA, 25 bp, Mus musculus
taattatgtgtagacccctgagctg

SEQ ID NO: 757182 - DNA, 25 bp, Mus musculus
taattatgttgacacctcagcctcc

SEQ ID NO: 757183 - DNA, 25 bp, Mus musculus
taattatgttgagacctcagcctcc

SEQ ID NO: 757184 - DNA, 25 bp, Mus musculus
taattatgttgtactggctgcctgc

SEQ ID NO: 757185 - DNA, 25 bp, Mus musculus
taattatgttgttctggctgcctgc

SEQ ID NO: 757186 - DNA, 25 bp, Mus musculus
taattattcaatatttcccggtata

SEQ ID NO: 757187 - DNA, 25 bp, Mus musculus
taattattcaatttttcccggtata

SEQ ID NO: 757188 - DNA, 25 bp, Mus musculus
taattattccggatggtccagctga

SEQ ID NO: 757189 - DNA, 25 bp, Mus musculus
taattattccggttggtccagctga

SEQ ID NO: 757190 - DNA, 25 bp, Mus musculus
taattattctcccaagatcccacac

SEQ ID NO: 757191 - DNA, 25 bp, Mus musculus
taattattctccgaagatcccacac

SEQ ID NO: 757192 - DNA, 25 bp, Mus musculus
taattattggtcacagttcaggtca

SEQ ID NO: 757193 - DNA, 25 bp, Mus musculus
taattattggtctcagttcaggtca

SEQ ID NO: 757194 - DNA, 25 bp, Mus musculus
taattattgttcactgacaaaaacc

SEQ ID NO: 757195 - DNA, 25 bp, Mus musculus
taattattgttctctgacaaaaacc

SEQ ID NO: 757196 - DNA, 25 bp, Mus musculus
taattatttcctcttgtgtcctact

SEQ ID NO: 757197 - DNA, 25 bp, Mus musculus
taattatttcctgttgtgtcctact

SEQ ID NO: 757198 - DNA, 25 bp, Mus musculus
taattcaaactcatatctcccaact

SEQ ID NO: 757199 - DNA, 25 bp, Mus musculus
taattcaaactcttatctcccaact

SEQ ID NO: 757200 - DNA, 25 bp, Mus musculus
taattcaactctaaaggcttaaggg

SEQ ID NO: 757201 - DNA, 25 bp, Mus musculus
taattcaactcttaaggcttaaggg

SEQ ID NO: 757202 - DNA, 25 bp, Mus musculus
taattcacacacctggaagcagcaa

SEQ ID NO: 757203 - DNA, 25 bp, Mus musculus
taattcacacacgtggaagcagcaa

SEQ ID NO: 757204 - DNA, 25 bp, Mus musculus
taattcacacctcactcaacatcag

SEQ ID NO: 757205 - DNA, 25 bp, Mus musculus
taattcacacctgactcaacatcag

SEQ ID NO: 757206 - DNA, 25 bp, Mus musculus
taattcaccgcaagaccgtcggagt

SEQ ID NO: 757207 - DNA, 25 bp, Mus musculus
taattcaccgcatgaccgtcggagt

SEQ ID NO: 757208 - DNA, 25 bp, Mus musculus
taattcactaagctgcctagccaca

SEQ ID NO: 757209 - DNA, 25 bp, Mus musculus
taattcactaaggtgcctagccaca

SEQ ID NO: 757210 - DNA, 25 bp, Mus musculus
taattcagcaggaaggagtctcaaa

SEQ ID NO: 757211 - DNA, 25 bp, Mus musculus
taattcagcaggtaggagtctcaaa

SEQ ID NO: 757212 - DNA, 25 bp, Mus musculus
taattcagcctgatatagtaaatgt

SEQ ID NO: 757213 - DNA, 25 bp, Mus musculus
taattcagcctgttatagtaaatgt

SEQ ID NO: 757214 - DNA, 25 bp, Mus musculus
taattcagctgcatgactcgtgcct

SEQ ID NO: 757215 - DNA, 25 bp, Mus musculus
taattcagctgcttgactcgtgcct

SEQ ID NO: 757216 - DNA, 25 bp, Mus musculus
taattcaggaatagttcaccatcac

SEQ ID NO: 757217 - DNA, 25 bp, Mus musculus
taattcaggaattgttcaccatcac

SEQ ID NO: 757218 - DNA, 25 bp, Mus musculus
taattcaggcgcaagagaaaccaat

SEQ ID NO: 757219 - DNA, 25 bp, Mus musculus
taattcaggcgctagagaaaccaat

SEQ ID NO: 757220 - DNA, 25 bp, Mus musculus
taattcaggtatctctctctgtatc

SEQ ID NO: 757221 - DNA, 25 bp, Mus musculus
taattcaggtatgtctctctgtatc

SEQ ID NO: 757222 - DNA, 25 bp, Mus musculus
taattcaggtggctgttccttgcca

SEQ ID NO: 757223 - DNA, 25 bp, Mus musculus
taattcaggtgggtgttccttgcca

SEQ ID NO: 757224 - DNA, 25 bp, Mus musculus
taattcagtaaccagcgcttccaag

SEQ ID NO: 757225 - DNA, 25 bp, Mus musculus
taattcagtaacgagcgcttccaag

SEQ ID NO: 757226 - DNA, 25 bp, Mus musculus
taattcagtcaacggaaccatcact

SEQ ID NO: 757227 - DNA, 25 bp, Mus musculus
taattcagtcaagggaaccatcact

SEQ ID NO: 757228 - DNA, 25 bp, Mus musculus
taattcagttctcattttgactgga

SEQ ID NO: 757229 - DNA, 25 bp, Mus musculus
taattcagttctgattttgactgga

SEQ ID NO: 757230 - DNA, 25 bp, Mus musculus
taattcatagatctcagtgctcccc

SEQ ID NO: 757231 - DNA, 25 bp, Mus musculus
taattcatagatgtcagtgctcccc

SEQ ID NO: 757232 - DNA, 25 bp, Mus musculus
taattcatcatcaatcttccgaaat

SEQ ID NO: 757233 - DNA, 25 bp, Mus musculus
taattcatcatctatcttccgaaat

SEQ ID NO: 757234 - DNA, 25 bp, Mus musculus
taattcatccccatttcaactgagc

SEQ ID NO: 757235 - DNA, 25 bp, Mus musculus
taattcatccccttttcaactgagc

SEQ ID NO: 757236 - DNA, 25 bp, Mus musculus
taattcatcgttacccttgaaagac

SEQ ID NO: 757237 - DNA, 25 bp, Mus musculus
taattcatcgtttcccttgaaagac

SEQ ID NO: 757238 - DNA, 25 bp, Mus musculus
taattcatgaataggtgcacctggt

SEQ ID NO: 757239 - DNA, 25 bp, Mus musculus
taattcatgaattggtgcacctggt

SEQ ID NO: 757240 - DNA, 25 bp, Mus musculus
taattcatgacccagaacaacgact

SEQ ID NO: 757241 - DNA, 25 bp, Mus musculus
taattcatgaccgagaacaacgact

SEQ ID NO: 757242 - DNA, 25 bp, Mus musculus
taattcatgattcccctgcgcctag

SEQ ID NO: 757243 - DNA, 25 bp, Mus musculus
taattcatgattgccctgcgcctag

SEQ ID NO: 757244 - DNA, 25 bp, Mus musculus
taattcatgggcctctaactccaga

SEQ ID NO: 757245 - DNA, 25 bp, Mus musculus
taattcatgggcgtctaactccaga

SEQ ID NO: 757246 - DNA, 25 bp, Mus musculus
taattcatttcaaatacccactccc

SEQ ID NO: 757247 - DNA, 25 bp, Mus musculus
taattcatttcacatattctttccc

SEQ ID NO: 757248 - DNA, 25 bp, Mus musculus
taattcatttcagatattctttccc

SEQ ID NO: 757249 - DNA, 25 bp, Mus musculus
taattcatttcatatacccactccc

SEQ ID NO: 757250 - DNA, 25 bp, Mus musculus
taattccaaatcacacacactcaaa

SEQ ID NO: 757251 - DNA, 25 bp, Mus musculus
taattccaaatctcacacactcaaa

SEQ ID NO: 757252 - DNA, 25 bp, Mus musculus
taattccaacatataggaggtagag

SEQ ID NO: 757253 - DNA, 25 bp, Mus musculus
taattccaacatttaggaggtagag

SEQ ID NO: 757254 - DNA, 25 bp, Mus musculus
taattccactggcatctgtgccctg

SEQ ID NO: 757255 - DNA, 25 bp, Mus musculus
taattccactgggatctgtgccctg

SEQ ID NO: 757256 - DNA, 25 bp, Mus musculus
taattccactgtaccaggccactag

SEQ ID NO: 757257 - DNA, 25 bp, Mus musculus
taattccactgttccaggccactag

SEQ ID NO: 757258 - DNA, 25 bp, Mus musculus
taattccagaacattgtgctagtaa

SEQ ID NO: 757259 - DNA, 25 bp, Mus musculus
taattccagaactttgtgctagtaa

SEQ ID NO: 757260 - DNA, 25 bp, Mus musculus
taattccagcacaggtgagtcaggg

SEQ ID NO: 757261 - DNA, 25 bp, Mus musculus
taattccagcactggtgagtcaggg

SEQ ID NO: 757262 - DNA, 25 bp, Mus musculus
taattccagcagatcttatgccctc

SEQ ID NO: 757263 - DNA, 25 bp, Mus musculus
taattccagcagttcttatgccctc

SEQ ID NO: 757264 - DNA, 25 bp, Mus musculus
taattccaggaaacagtgcaggcaa

SEQ ID NO: 757265 - DNA, 25 bp, Mus musculus
taattccaggaatcagtgcaggcaa

SEQ ID NO: 757266 - DNA, 25 bp, Mus musculus
taattccaggacatagaaggccaag

SEQ ID NO: 757267 - DNA, 25 bp, Mus musculus
taattccaggacttagaaggccaag

SEQ ID NO: 757268 - DNA, 25 bp, Mus musculus
taattccaggtgacttacaacatct

SEQ ID NO: 757269 - DNA, 25 bp, Mus musculus
taattccaggtgtcttacaacatct

SEQ ID NO: 757270 - DNA, 25 bp, Mus musculus
taattccagtcaaggtaggcagggc

SEQ ID NO: 757271 - DNA, 25 bp, Mus musculus
taattccagtcatggtaggcagggc

SEQ ID NO: 757272 - DNA, 25 bp, Mus musculus
taattccagtgcacgggatgggctc

SEQ ID NO: 757273 - DNA, 25 bp, Mus musculus
taattccagtgctcgggatgggctc

SEQ ID NO: 757274 - DNA, 25 bp, Mus musculus
taattccatacacgctctgcaggga

SEQ ID NO: 757275 - DNA, 25 bp, Mus musculus
taattccatacaggctctgcaggga

SEQ ID NO: 757276 - DNA, 25 bp, Mus musculus
taattccatgggagctggcaatatg

SEQ ID NO: 757277 - DNA, 25 bp, Mus musculus
taattccatgggtgctggcaatatg

SEQ ID NO: 757278 - DNA, 25 bp, Mus musculus
taattccatgttcccttcttcagat

SEQ ID NO: 757279 - DNA, 25 bp, Mus musculus
taattccatgttgccttcttcagat

SEQ ID NO: 757280 - DNA, 25 bp, Mus musculus
taattccattccagctttagtgtgc

SEQ ID NO: 757281 - DNA, 25 bp, Mus musculus
taattccattccctccgtgtgtttc

SEQ ID NO: 757282 - DNA, 25 bp, Mus musculus
taattccattccgtccgtgtgtttc

SEQ ID NO: 757283 - DNA, 25 bp, Mus musculus
taattccattcctgctttagtgtgc

SEQ ID NO: 757284 - DNA, 25 bp, Mus musculus
taattcccagggacctcattctttt

SEQ ID NO: 757285 - DNA, 25 bp, Mus musculus
taattcccagggtcctcattctttt

SEQ ID NO: 757286 - DNA, 25 bp, Mus musculus
taattcccatggatgttctgctcat

SEQ ID NO: 757287 - DNA, 25 bp, Mus musculus
taattcccatggttgttctgctcat

SEQ ID NO: 757288 - DNA, 25 bp, Mus musculus
taattccccaccattgtaatacatt

SEQ ID NO: 757289 - DNA, 25 bp, Mus musculus
taattccccacctttgtaatacatt

SEQ ID NO: 757290 - DNA, 25 bp, Mus musculus
taattccccagtcggtttcacaggt

SEQ ID NO: 757291 - DNA, 25 bp, Mus musculus
taattccccagtgggtttcacaggt

SEQ ID NO: 757292 - DNA, 25 bp, Mus musculus
taattccctattaagtatttcagct

SEQ ID NO: 757293 - DNA, 25 bp, Mus musculus
taattccctatttagtatttcagct

SEQ ID NO: 757294 - DNA, 25 bp, Mus musculus
taattccctgggatagtgattcatt

SEQ ID NO: 757295 - DNA, 25 bp, Mus musculus
taattccctgggttagtgattcatt

SEQ ID NO: 757296 - DNA, 25 bp, Mus musculus
taattcccttggatagataccaaca

SEQ ID NO: 757297 - DNA, 25 bp, Mus musculus
taattcccttggctgtgctctgcaa

SEQ ID NO: 757298 - DNA, 25 bp, Mus musculus
taattcccttgggtgtgctctgcaa

SEQ ID NO: 757299 - DNA, 25 bp, Mus musculus
taattcccttggttagataccaaca

SEQ ID NO: 757300 - DNA, 25 bp, Mus musculus
taattccgaagcacaggcccaatga

SEQ ID NO: 757301 - DNA, 25 bp, Mus musculus
taattccgaagctcaggcccaatga

SEQ ID NO: 757302 - DNA, 25 bp, Mus musculus
taattccgtggaccagctctctcca

SEQ ID NO: 757303 - DNA, 25 bp, Mus musculus
taattccgtggagcagctctctcca

SEQ ID NO: 757304 - DNA, 25 bp, Mus musculus
taattcctacctaaaagggtcgctg

SEQ ID NO: 757305 - DNA, 25 bp, Mus musculus
taattcctaccttaaagggtcgctg

SEQ ID NO: 757306 - DNA, 25 bp, Mus musculus
taattcctatgtcctgacttctacc

SEQ ID NO: 757307 - DNA, 25 bp, Mus musculus
taattcctatgtgctgacttctacc

SEQ ID NO: 757308 - DNA, 25 bp, Mus musculus
taattcctccagattttccctaaca

SEQ ID NO: 757309 - DNA, 25 bp, Mus musculus
taattcctccagtttttccctaaca

SEQ ID NO: 757310 - DNA, 25 bp, Mus musculus
taattcctccttcccacctgagaag

SEQ ID NO: 757311 - DNA, 25 bp, Mus musculus
taattcctccttgccacctgagaag

SEQ ID NO: 757312 - DNA, 25 bp, Mus musculus
taattcctcgttccattctgatcaa

SEQ ID NO: 757313 - DNA, 25 bp, Mus musculus
taattcctcgttgcattctgatcaa

SEQ ID NO: 757314 - DNA, 25 bp, Mus musculus
taattcctctaacttccaactctca

SEQ ID NO: 757315 - DNA, 25 bp, Mus musculus
taattcctctaagttccaactctca

SEQ ID NO: 757316 - DNA, 25 bp, Mus musculus
taattcctctctatgccaagcaggg

SEQ ID NO: 757317 - DNA, 25 bp, Mus musculus
taattcctctctttgccaagcaggg

SEQ ID NO: 757318 - DNA, 25 bp, Mus musculus
taattcctcttcatggagtcgggac

SEQ ID NO: 757319 - DNA, 25 bp, Mus musculus
taattcctcttcttggagtcgggac

SEQ ID NO: 757320 - DNA, 25 bp, Mus musculus
taattcctgacacagtcccaagtac

SEQ ID NO: 757321 - DNA, 25 bp, Mus musculus
taattcctgacagagtcccaagtac

SEQ ID NO: 757322 - DNA, 25 bp, Mus musculus
taattcctgaccaaaagtatagttt

SEQ ID NO: 757323 - DNA, 25 bp, Mus musculus
taattcctgacctaaagtatagttt

SEQ ID NO: 757324 - DNA, 25 bp, Mus musculus
taattcctgccactatgctgacttc

SEQ ID NO: 757325 - DNA, 25 bp, Mus musculus
taattcctgccagtatgctgacttc

SEQ ID NO: 757326 - DNA, 25 bp, Mus musculus
taattcctgggcatggttggtgtta

SEQ ID NO: 757327 - DNA, 25 bp, Mus musculus
taattcctgggcttggttggtgtta

SEQ ID NO: 757328 - DNA, 25 bp, Mus musculus
taattcctgtttcactgctggcctt

SEQ ID NO: 757329 - DNA, 25 bp, Mus musculus
taattcctgtttgactgctggcctt

SEQ ID NO: 757330 - DNA, 25 bp, Mus musculus
taattccttaatatcaactgcccac

SEQ ID NO: 757331 - DNA, 25 bp, Mus musculus
taattccttaatttcaactgcccac

SEQ ID NO: 757332 - DNA, 25 bp, Mus musculus
taattccttggacggctgtagctct

SEQ ID NO: 757333 - DNA, 25 bp, Mus musculus
taattccttggagggctgtagctct

SEQ ID NO: 757334 - DNA, 25 bp, Mus musculus
taattcctttcaagcctctcaggga

SEQ ID NO: 757335 - DNA, 25 bp, Mus musculus
taattcctttcatgcctctcaggga

SEQ ID NO: 757336 - DNA, 25 bp, Mus musculus
taattccttttgcactgtttgccca

SEQ ID NO: 757337 - DNA, 25 bp, Mus musculus
taattccttttggactgtttgccca

SEQ ID NO: 757338 - DNA, 25 bp, Mus musculus
taattcgcagcaactgtgtagcttt

SEQ ID NO: 757339 - DNA, 25 bp, Mus musculus
taattcgcagcatctgtgtagcttt

SEQ ID NO: 757340 - DNA, 25 bp, Mus musculus
taattcgcgcgactttcctgcttat

SEQ ID NO: 757341 - DNA, 25 bp, Mus musculus
taattcgcgcgagtttcctgcttat

SEQ ID NO: 757342 - DNA, 25 bp, Mus musculus
taattcgtaaacagaagagtgcacc

SEQ ID NO: 757343 - DNA, 25 bp, Mus musculus
taattcgtaaactgaagagtgcacc

SEQ ID NO: 757344 - DNA, 25 bp, Mus musculus
taattcgttccactcaggatttttt

SEQ ID NO: 757345 - DNA, 25 bp, Mus musculus
taattcgttccagtcaggatttttt

SEQ ID NO: 757346 - DNA, 25 bp, Mus musculus
taattcgttcggatttccaggccag

SEQ ID NO: 757347 - DNA, 25 bp, Mus musculus
taattcgttcggttttccaggccag

SEQ ID NO: 757348 - DNA, 25 bp, Mus musculus
taattctaaccacagcaagcttttt

SEQ ID NO: 757349 - DNA, 25 bp, Mus musculus
taattctaaccagagcaagcttttt

SEQ ID NO: 757350 - DNA, 25 bp, Mus musculus
taattctagcacatttttggaaact

SEQ ID NO: 757351 - DNA, 25 bp, Mus musculus
taattctagcacttttttggaaact

SEQ ID NO: 757352 - DNA, 25 bp, Mus musculus
taattctaggaaatggtgttttctt

SEQ ID NO: 757353 - DNA, 25 bp, Mus musculus
taattctaggaattggtgttttctt

SEQ ID NO: 757354 - DNA, 25 bp, Mus musculus
taattctcacataatcagacctctg

SEQ ID NO: 757355 - DNA, 25 bp, Mus musculus
taattctcacattatcagacctctg

SEQ ID NO: 757356 - DNA, 25 bp, Mus musculus
taattctcactaaaaaccacctcat

SEQ ID NO: 757357 - DNA, 25 bp, Mus musculus
taattctcactataaaccacctcat

SEQ ID NO: 757358 - DNA, 25 bp, Mus musculus
taattctcacttactgaactcagag

SEQ ID NO: 757359 - DNA, 25 bp, Mus musculus
taattctcactttctgaactcagag

SEQ ID NO: 757360 - DNA, 25 bp, Mus musculus
taattctcagtgagcttctgcctcg

SEQ ID NO: 757361 - DNA, 25 bp, Mus musculus
taattctcagtgtgcttctgcctcg

SEQ ID NO: 757362 - DNA, 25 bp, Mus musculus
taattctccgatatagatcctgtgg

SEQ ID NO: 757363 - DNA, 25 bp, Mus musculus
taattctccgatttagatcctgtgg

SEQ ID NO: 757364 - DNA, 25 bp, Mus musculus
taattctcttacaatctgtgctgat

SEQ ID NO: 757365 - DNA, 25 bp, Mus musculus
taattctcttactatctgtgctgat

SEQ ID NO: 757366 - DNA, 25 bp, Mus musculus
taattctcttccaccagttagttgc

SEQ ID NO: 757367 - DNA, 25 bp, Mus musculus
taattctcttcctccagttagttgc

SEQ ID NO: 757368 - DNA, 25 bp, Mus musculus
taattctcttctccccttgactcaa

SEQ ID NO: 757369 - DNA, 25 bp, Mus musculus
taattctcttctgcccttgactcaa

SEQ ID NO: 757370 - DNA, 25 bp, Mus musculus
taattctcttgaagattgcctggca

SEQ ID NO: 757371 - DNA, 25 bp, Mus musculus
taattctcttgatgattgcctggca

SEQ ID NO: 757372 - DNA, 25 bp, Mus musculus
taattctgaacacgacccaaccttc

SEQ ID NO: 757373 - DNA, 25 bp, Mus musculus
taattctgaacaggacccaaccttc

SEQ ID NO: 757374 - DNA, 25 bp, Mus musculus
taattctgactgaccaggagctatc

SEQ ID NO: 757375 - DNA, 25 bp, Mus musculus
taattctgactgtccaggagctatc

SEQ ID NO: 757376 - DNA, 25 bp, Mus musculus
taattctgagctcttgcttcaccag

SEQ ID NO: 757377 - DNA, 25 bp, Mus musculus
taattctgagctgttgcttcaccag

SEQ ID NO: 757378 - DNA, 25 bp, Mus musculus
taattctgaggcactttgtttaggc

SEQ ID NO: 757379 - DNA, 25 bp, Mus musculus
taattctgaggctctttgtttaggc

SEQ ID NO: 757380 - DNA, 25 bp, Mus musculus
taattctgcagaagtcctagggttt

SEQ ID NO: 757381 - DNA, 25 bp, Mus musculus
taattctgcagatgtcctagggttt

SEQ ID NO: 757382 - DNA, 25 bp, Mus musculus
taattctgcatgaggactttatcca

SEQ ID NO: 757383 - DNA, 25 bp, Mus musculus
taattctgcatgtggactttatcca

SEQ ID NO: 757384 - DNA, 25 bp, Mus musculus
taattctgtactcttatgtttatag

SEQ ID NO: 757385 - DNA, 25 bp, Mus musculus
taattctgtactgttatgtttatag

SEQ ID NO: 757386 - DNA, 25 bp, Mus musculus
taattctgtagtacacctgtcgtgt

SEQ ID NO: 757387 - DNA, 25 bp, Mus musculus
taattctgtagttcacctgtcgtgt

SEQ ID NO: 757388 - DNA, 25 bp, Mus musculus
taattctgtcacacaccagctaggc

SEQ ID NO: 757389 - DNA, 25 bp, Mus musculus
taattctgtcactcaccagctaggc

SEQ ID NO: 757390 - DNA, 25 bp, Mus musculus
taattctgtgccaaaggtttttaag

SEQ ID NO: 757391 - DNA, 25 bp, Mus musculus
taattctgtgcctaaggtttttaag

SEQ ID NO: 757392 - DNA, 25 bp, Mus musculus
taattcttaaaaactgtccccgtcg

SEQ ID NO: 757393 - DNA, 25 bp, Mus musculus
taattcttaaaatctgtccccgtcg

SEQ ID NO: 757394 - DNA, 25 bp, Mus musculus
taattcttaccacttctgcttctgt

SEQ ID NO: 757395 - DNA, 25 bp, Mus musculus
taattcttaccagttctgcttctgt

SEQ ID NO: 757396 - DNA, 25 bp, Mus musculus
taattcttctccctcacatagatga

SEQ ID NO: 757397 - DNA, 25 bp, Mus musculus
taattcttctccgtcacatagatga

SEQ ID NO: 757398 - DNA, 25 bp, Mus musculus
taattcttctctaagtcttggactg

SEQ ID NO: 757399 - DNA, 25 bp, Mus musculus
taattcttctcttagtcttggactg

SEQ ID NO: 757400 - DNA, 25 bp, Mus musculus
taattcttgattctcaaccctcatc

SEQ ID NO: 757401 - DNA, 25 bp, Mus musculus
taattcttgattgtcaaccctcatc

SEQ ID NO: 757402 - DNA, 25 bp, Mus musculus
taattctttaatactcccaacacca

SEQ ID NO: 757403 - DNA, 25 bp, Mus musculus
taattctttaattctcccaacacca

SEQ ID NO: 757404 - DNA, 25 bp, Mus musculus
taattctttagtaccttcctgctca

SEQ ID NO: 757405 - DNA, 25 bp, Mus musculus
taattctttagttccttcctgctca

SEQ ID NO: 757406 - DNA, 25 bp, Mus musculus
taattctttccaaaactactgttct

SEQ ID NO: 757407 - DNA, 25 bp, Mus musculus
taattctttccataactactgttct

SEQ ID NO: 757408 - DNA, 25 bp, Mus musculus
taattctttctgctagttctagggt

SEQ ID NO: 757409 - DNA, 25 bp, Mus musculus
taattctttctggtagttctagggt

SEQ ID NO: 757410 - DNA, 25 bp, Mus musculus
taattctttgcaatcccatgtatag

SEQ ID NO: 757411 - DNA, 25 bp, Mus musculus
taattctttgcattcccatgtatag

SEQ ID NO: 757412 - DNA, 25 bp, Mus musculus
taattcttttggaccggtttctctg

SEQ ID NO: 757413 - DNA, 25 bp, Mus musculus
taattcttttggtccggtttctctg

SEQ ID NO: 757414 - DNA, 25 bp, Mus musculus
taattcttttgtatacccttttgct

SEQ ID NO: 757415 - DNA, 25 bp, Mus musculus
taattcttttgtttacccttttgct

SEQ ID NO: 757416 - DNA, 25 bp, Mus musculus
taattgaagcttcctctccctagat

SEQ ID NO: 757417 - DNA, 25 bp, Mus musculus
taattgaagcttgctctccctagat

SEQ ID NO: 757418 - DNA, 25 bp, Mus musculus
taattgaatgacagagggacctcct

SEQ ID NO: 757419 - DNA, 25 bp, Mus musculus
taattgaatgactgagggacctcct

SEQ ID NO: 757420 - DNA, 25 bp, Mus musculus
taattgacaaacatttcctggacac

SEQ ID NO: 757421 - DNA, 25 bp, Mus musculus
taattgacaaacttttcctggacac

SEQ ID NO: 757422 - DNA, 25 bp, Mus musculus
taattgacattcctaagccacagtg

SEQ ID NO: 757423 - DNA, 25 bp, Mus musculus
taattgacattcgtaagccacagtg

SEQ ID NO: 757424 - DNA, 25 bp, Mus musculus
taattgacctttatcttgggcgcta

SEQ ID NO: 757425 - DNA, 25 bp, Mus musculus
taattgacctttttcttgggcgcta

SEQ ID NO: 757426 - DNA, 25 bp, Mus musculus
taattgacgtcaatccactcctttc

SEQ ID NO: 757427 - DNA, 25 bp, Mus musculus
taattgacgtcattccactcctttc

SEQ ID NO: 757428 - DNA, 25 bp, Mus musculus
taattgagccacagtgcaactcctc

SEQ ID NO: 757429 - DNA, 25 bp, Mus musculus
taattgagccactgtgcaactcctc

SEQ ID NO: 757430 - DNA, 25 bp, Mus musculus
taattgagctatatgttgatggcca

SEQ ID NO: 757431 - DNA, 25 bp, Mus musculus
taattgagctatttgttgatggcca

SEQ ID NO: 757432 - DNA, 25 bp, Mus musculus
taattgataaaaccacatgtgttcc

SEQ ID NO: 757433 - DNA, 25 bp, Mus musculus
taattgataaaagcacatgtgttcc

SEQ ID NO: 757434 - DNA, 25 bp, Mus musculus
taattgatccttctagtgactctag

SEQ ID NO: 757435 - DNA, 25 bp, Mus musculus
taattgatccttgtagtgactctag

SEQ ID NO: 757436 - DNA, 25 bp, Mus musculus
taattgatcttcctgggtaccaagc

SEQ ID NO: 757437 - DNA, 25 bp, Mus musculus
taattgatcttcgtgggtaccaagc

SEQ ID NO: 757438 - DNA, 25 bp, Mus musculus
taattgatgaggaggccgggcccct

SEQ ID NO: 757439 - DNA, 25 bp, Mus musculus
taattgatgaggtggccgggcccct

SEQ ID NO: 757440 - DNA, 25 bp, Mus musculus
taattgattcatcccacccatatgc

SEQ ID NO: 757441 - DNA, 25 bp, Mus musculus
taattgattcatgccacccatatgc

SEQ ID NO: 757442 - DNA, 25 bp, Mus musculus
taattgcacagcacacaactttgct

SEQ ID NO: 757443 - DNA, 25 bp, Mus musculus
taattgcacagctcacaactttgct

SEQ ID NO: 757444 - DNA, 25 bp, Mus musculus
taattgcacaggcttaaatttactt

SEQ ID NO: 757445 - DNA, 25 bp, Mus musculus
taattgcacagggttaaatttactt

SEQ ID NO: 757446 - DNA, 25 bp, Mus musculus
taattgcacatgatctcttagagga

SEQ ID NO: 757447 - DNA, 25 bp, Mus musculus
taattgcacatgttctcttagagga

SEQ ID NO: 757448 - DNA, 25 bp, Mus musculus
taattgcactttcgtctggaggccc

SEQ ID NO: 757449 - DNA, 25 bp, Mus musculus
taattgcactttggtctggaggccc

SEQ ID NO: 757450 - DNA, 25 bp, Mus musculus
taattgcagagaagcgcgggatccg

SEQ ID NO: 757451 - DNA, 25 bp, Mus musculus
taattgcagagatgcgcgggatccg

SEQ ID NO: 757452 - DNA, 25 bp, Mus musculus
taattgcagcatcggtacacgtggg

SEQ ID NO: 757453 - DNA, 25 bp, Mus musculus
taattgcagcatgggtacacgtggg

SEQ ID NO: 757454 - DNA, 25 bp, Mus musculus
taattgcaggatcgccccaatgcgc

SEQ ID NO: 757455 - DNA, 25 bp, Mus musculus
taattgcaggatggccccaatgcgc

SEQ ID NO: 757456 - DNA, 25 bp, Mus musculus
taattgcaggcacgtttcattgaga

SEQ ID NO: 757457 - DNA, 25 bp, Mus musculus
taattgcaggcaggtttcattgaga

SEQ ID NO: 757458 - DNA, 25 bp, Mus musculus
taattgcagggtcccagtggcttct

SEQ ID NO: 757459 - DNA, 25 bp, Mus musculus
taattgcagggtgccagtggcttct

SEQ ID NO: 757460 - DNA, 25 bp, Mus musculus
taattgcatctcctataccatcagt

SEQ ID NO: 757461 - DNA, 25 bp, Mus musculus
taattgcatctcgtataccatcagt

SEQ ID NO: 757462 - DNA, 25 bp, Mus musculus
taattgcatgcactactccttcagt

SEQ ID NO: 757463 - DNA, 25 bp, Mus musculus
taattgcatgcagtactccttcagt

SEQ ID NO: 757464 - DNA, 25 bp, Mus musculus
taattgcattacctgattcataaga

SEQ ID NO: 757465 - DNA, 25 bp, Mus musculus
taattgcattacgtgattcataaga

SEQ ID NO: 757466 - DNA, 25 bp, Mus musculus
taattgcctagcatttacctttaga

SEQ ID NO: 757467 - DNA, 25 bp, Mus musculus
taattgcctagcttttacctttaga

SEQ ID NO: 757468 - DNA, 25 bp, Mus musculus
taattgccttatacctctaagactt

SEQ ID NO: 757469 - DNA, 25 bp, Mus musculus
taattgccttattcctctaagactt

SEQ ID NO: 757470 - DNA, 25 bp, Mus musculus
taattgcgccaaaattgattttggg

SEQ ID NO: 757471 - DNA, 25 bp, Mus musculus
taattgcgccaatattgattttggg

SEQ ID NO: 757472 - DNA, 25 bp, Mus musculus
taattgcggatgagtacagccccac

SEQ ID NO: 757473 - DNA, 25 bp, Mus musculus
taattgcggatgtgtacagccccac

SEQ ID NO: 757474 - DNA, 25 bp, Mus musculus
taattgcgggtcctacagggtccac

SEQ ID NO: 757475 - DNA, 25 bp, Mus musculus
taattgcgggtcgtacagggtccac

SEQ ID NO: 757476 - DNA, 25 bp, Mus musculus
taattgcgtcacacaggaaactctg

SEQ ID NO: 757477 - DNA, 25 bp, Mus musculus
taattgcgtcactcaggaaactctg

SEQ ID NO: 757478 - DNA, 25 bp, Mus musculus
taattgcgtctaactctttatgtgt

SEQ ID NO: 757479 - DNA, 25 bp, Mus musculus
taattgcgtctatctctttatgtgt

SEQ ID NO: 757480 - DNA, 25 bp, Mus musculus
taattgctaaacacctagggctccc

SEQ ID NO: 757481 - DNA, 25 bp, Mus musculus
taattgctaaactcctagggctccc

SEQ ID NO: 757482 - DNA, 25 bp, Mus musculus
taattgctacagctgatcttttata

SEQ ID NO: 757483 - DNA, 25 bp, Mus musculus
taattgctacaggtgatcttttata

SEQ ID NO: 757484 - DNA, 25 bp, Mus musculus
taattgctactcatttcatacttag

SEQ ID NO: 757485 - DNA, 25 bp, Mus musculus
taattgctactcttttcatacttag

SEQ ID NO: 757486 - DNA, 25 bp, Mus musculus
taattgctacttcctatgaactaaa

SEQ ID NO: 757487 - DNA, 25 bp, Mus musculus
taattgctacttgctatgaactaaa

SEQ ID NO: 757488 - DNA, 25 bp, Mus musculus
taattgctatccatgttacccattc

SEQ ID NO: 757489 - DNA, 25 bp, Mus musculus
taattgctatccttgttacccattc

SEQ ID NO: 757490 - DNA, 25 bp, Mus musculus
taattgctgctcactgtcacgtgaa

SEQ ID NO: 757491 - DNA, 25 bp, Mus musculus
taattgctgctctctgtcacgtgaa

SEQ ID NO: 757492 - DNA, 25 bp, Mus musculus
taattgctgtgtctctcccaccttg

SEQ ID NO: 757493 - DNA, 25 bp, Mus musculus
taattgctgtgtgtctcccaccttg

SEQ ID NO: 757494 - DNA, 25 bp, Mus musculus
taattgctgttaaggtttcgagtca

SEQ ID NO: 757495 - DNA, 25 bp, Mus musculus
taattgctgttatggtttcgagtca

SEQ ID NO: 757496 - DNA, 25 bp, Mus musculus
taattgcttgtacagttaaccttta

SEQ ID NO: 757497 - DNA, 25 bp, Mus musculus
taattgcttgtagagttaaccttta

SEQ ID NO: 757498 - DNA, 25 bp, Mus musculus
taattggaactcctgctgtcagtct

SEQ ID NO: 757499 - DNA, 25 bp, Mus musculus
taattggaactcgtgctgtcagtct

SEQ ID NO: 757500 - DNA, 25 bp, Mus musculus
taattggaccgtaatgacagcattt

SEQ ID NO: 757501 - DNA, 25 bp, Mus musculus
taattggaccgttatgacagcattt

SEQ ID NO: 757502 - DNA, 25 bp, Mus musculus
taattggaccttctgaaactgaaaa

SEQ ID NO: 757503 - DNA, 25 bp, Mus musculus
taattggaccttgtgaaactgaaaa

SEQ ID NO: 757504 - DNA, 25 bp, Mus musculus
taattggagctcagcgcaaagcgcc

SEQ ID NO: 757505 - DNA, 25 bp, Mus musculus
taattggagctctgcgcaaagcgcc

SEQ ID NO: 757506 - DNA, 25 bp, Mus musculus
taattggagtttcctcctgcctttc

SEQ ID NO: 757507 - DNA, 25 bp, Mus musculus
taattggagtttgctcctgcctttc

SEQ ID NO: 757508 - DNA, 25 bp, Mus musculus
taattggatgtgctgtttctgatgt

SEQ ID NO: 757509 - DNA, 25 bp, Mus musculus
taattggatgtggtgtttctgatgt

SEQ ID NO: 757510 - DNA, 25 bp, Mus musculus
taattggcactgcttagcttgccgt

SEQ ID NO: 757511 - DNA, 25 bp, Mus musculus
taattggcactggttagcttgccgt

SEQ ID NO: 757512 - DNA, 25 bp, Mus musculus
taattggcatggaaagactgacttt

SEQ ID NO: 757513 - DNA, 25 bp, Mus musculus
taattggcatggtaagactgacttt

SEQ ID NO: 757514 - DNA, 25 bp, Mus musculus
taattggccaccacagcgcgtgaag

SEQ ID NO: 757515 - DNA, 25 bp, Mus musculus
taattggccacctcagcgcgtgaag

SEQ ID NO: 757516 - DNA, 25 bp, Mus musculus
taattggcccttccttattttccag

SEQ ID NO: 757517 - DNA, 25 bp, Mus musculus
taattggcccttgcttattttccag

SEQ ID NO: 757518 - DNA, 25 bp, Mus musculus
taattggcggatcggccattcctgg

SEQ ID NO: 757519 - DNA, 25 bp, Mus musculus
taattggcggatgggccattcctgg

SEQ ID NO: 757520 - DNA, 25 bp, Mus musculus
taattggcggtcaaacgagcctgcc

SEQ ID NO: 757521 - DNA, 25 bp, Mus musculus
taattggcggtctaacgagcctgcc

SEQ ID NO: 757522 - DNA, 25 bp, Mus musculus
taattggctaccctgttaccattat

SEQ ID NO: 757523 - DNA, 25 bp, Mus musculus
taattggctaccgtgttaccattat

SEQ ID NO: 757524 - DNA, 25 bp, Mus musculus
taattgggaggcagtgcttgcctgt

SEQ ID NO: 757525 - DNA, 25 bp, Mus musculus
taattgggaggctgtgcttgcctgt

SEQ ID NO: 757526 - DNA, 25 bp, Mus musculus
taattgggcaggatgcttgggcatc

SEQ ID NO: 757527 - DNA, 25 bp, Mus musculus
taattgggcaggcacgcagaccaca

SEQ ID NO: 757528 - DNA, 25 bp, Mus musculus
taattgggcagggacgcagaccaca

SEQ ID NO: 757529 - DNA, 25 bp, Mus musculus
taattgggcaggttgcttgggcatc

SEQ ID NO: 757530 - DNA, 25 bp, Mus musculus
taattggtaattactcccagctttt

SEQ ID NO: 757531 - DNA, 25 bp, Mus musculus
taattggtaatttctcccagctttt

SEQ ID NO: 757532 - DNA, 25 bp, Mus musculus
taattggtgctcctgatgtggtgat

SEQ ID NO: 757533 - DNA, 25 bp, Mus musculus
taattggtgctcgtgatgtggtgat

SEQ ID NO: 757534 - DNA, 25 bp, Mus musculus
taattggtggaacctaactgtccaa

SEQ ID NO: 757535 - DNA, 25 bp, Mus musculus
taattggtggaagctaactgtccaa

SEQ ID NO: 757536 - DNA, 25 bp, Mus musculus
taattggtggtcagtgtctcttggg

SEQ ID NO: 757537 - DNA, 25 bp, Mus musculus
taattggtggtctgtgtctcttggg

SEQ ID NO: 757538 - DNA, 25 bp, Mus musculus
taattggttcagaagagaaactcaa

SEQ ID NO: 757539 - DNA, 25 bp, Mus musculus
taattggttcagtagagaaactcaa

SEQ ID NO: 757540 - DNA, 25 bp, Mus musculus
taattggttccacttccttacctag

SEQ ID NO: 757541 - DNA, 25 bp, Mus musculus
taattggttccagttccttacctag

SEQ ID NO: 757542 - DNA, 25 bp, Mus musculus
taattgtaccatcaagaagagcaca

SEQ ID NO: 757543 - DNA, 25 bp, Mus musculus
taattgtaccatgaagaagagcaca

SEQ ID NO: 757544 - DNA, 25 bp, Mus musculus
taattgtagcatactcaggtgttct

SEQ ID NO: 757545 - DNA, 25 bp, Mus musculus
taattgtagcattctcaggtgttct

SEQ ID NO: 757546 - DNA, 25 bp, Mus musculus
taattgtatataacttttcccacta

SEQ ID NO: 757547 - DNA, 25 bp, Mus musculus
taattgtatatatcttttcccacta

SEQ ID NO: 757548 - DNA, 25 bp, Mus musculus
taattgtattacaaactgcaaagca

SEQ ID NO: 757549 - DNA, 25 bp, Mus musculus
taattgtattactaactgcaaagca

SEQ ID NO: 757550 - DNA, 25 bp, Mus musculus
taattgtcatctctggtctgtcttt

SEQ ID NO: 757551 - DNA, 25 bp, Mus musculus
taattgtcatctgtggtctgtcttt

SEQ ID NO: 757552 - DNA, 25 bp, Mus musculus
taattgtcgcaccatctctaactca

SEQ ID NO: 757553 - DNA, 25 bp, Mus musculus
taattgtcgcacgatctctaactca

SEQ ID NO: 757554 - DNA, 25 bp, Mus musculus
taattgtcgtctcggaagcttactc

SEQ ID NO: 757555 - DNA, 25 bp, Mus musculus
taattgtcgtctgggaagcttactc

SEQ ID NO: 757556 - DNA, 25 bp, Mus musculus
taattgtctagaagaggcttggctc

SEQ ID NO: 757557 - DNA, 25 bp, Mus musculus
taattgtctagatgaggcttggctc

SEQ ID NO: 757558 - DNA, 25 bp, Mus musculus
taattgtctgttagctgtccaggct

SEQ ID NO: 757559 - DNA, 25 bp, Mus musculus
taattgtctgtttgctgtccaggct

SEQ ID NO: 757560 - DNA, 25 bp, Mus musculus
taattgtgacacatactcttggaat

SEQ ID NO: 757561 - DNA, 25 bp, Mus musculus
taattgtgacacttactcttggaat

SEQ ID NO: 757562 - DNA, 25 bp, Mus musculus
taattgtgagcaccacaggtcccaa

SEQ ID NO: 757563 - DNA, 25 bp, Mus musculus
taattgtgagcagcacaggtcccaa

SEQ ID NO: 757564 - DNA, 25 bp, Mus musculus
taattgtgaggccatgcagtgaatc

SEQ ID NO: 757565 - DNA, 25 bp, Mus musculus
taattgtgaggcgatgcagtgaatc

SEQ ID NO: 757566 - DNA, 25 bp, Mus musculus
taattgtgcaagacttttttccact

SEQ ID NO: 757567 - DNA, 25 bp, Mus musculus
taattgtgcaagtcttttttccact

SEQ ID NO: 757568 - DNA, 25 bp, Mus musculus
taattgtgcataaatcttgcctgct

SEQ ID NO: 757569 - DNA, 25 bp, Mus musculus
taattgtgcatatatcttgcctgct

SEQ ID NO: 757570 - DNA, 25 bp, Mus musculus
taattgtggtttaggagcagctcat

SEQ ID NO: 757571 - DNA, 25 bp, Mus musculus
taattgtggttttggagcagctcat

SEQ ID NO: 757572 - DNA, 25 bp, Mus musculus
taattgttacaacccattttcctaa

SEQ ID NO: 757573 - DNA, 25 bp, Mus musculus
taattgttacaagccattttcctaa

SEQ ID NO: 757574 - DNA, 25 bp, Mus musculus
taattgttagtgctgcttatatcca

SEQ ID NO: 757575 - DNA, 25 bp, Mus musculus
taattgttagtggtgcttatatcca

SEQ ID NO: 757576 - DNA, 25 bp, Mus musculus
taattgttatcaaccttcgtgctgc

SEQ ID NO: 757577 - DNA, 25 bp, Mus musculus
taattgttatcatccttcgtgctgc

SEQ ID NO: 757578 - DNA, 25 bp, Mus musculus
taattgttcaccacacatccttcaa

SEQ ID NO: 757579 - DNA, 25 bp, Mus musculus
taattgttcacctcacatccttcaa

SEQ ID NO: 757580 - DNA, 25 bp, Mus musculus
taattgttcatgcacattcatttta

SEQ ID NO: 757581 - DNA, 25 bp, Mus musculus
taattgttcatggacattcatttta

SEQ ID NO: 757582 - DNA, 25 bp, Mus musculus
taattgttccacaacctcttggcaa

SEQ ID NO: 757583 - DNA, 25 bp, Mus musculus
taattgttccactacctcttggcaa

SEQ ID NO: 757584 - DNA, 25 bp, Mus musculus
taattgttccccactactgtcaaaa

SEQ ID NO: 757585 - DNA, 25 bp, Mus musculus
taattgttcccctctactgtcaaaa

SEQ ID NO: 757586 - DNA, 25 bp, Mus musculus
taattgttcctaaccttttccattg

SEQ ID NO: 757587 - DNA, 25 bp, Mus musculus
taattgttcctatccttttccattg

SEQ ID NO: 757588 - DNA, 25 bp, Mus musculus
taattgttcgttcacctttcaggac

SEQ ID NO: 757589 - DNA, 25 bp, Mus musculus
taattgttcgttgacctttcaggac

SEQ ID NO: 757590 - DNA, 25 bp, Mus musculus
taatttaaaaacagcattccctcct

SEQ ID NO: 757591 - DNA, 25 bp, Mus musculus
taatttaaaaactgcattccctcct

SEQ ID NO: 757592 - DNA, 25 bp, Mus musculus
taatttaaaattctcttggcacact

SEQ ID NO: 757593 - DNA, 25 bp, Mus musculus
taatttaaaattgtcttggcacact

SEQ ID NO: 757594 - DNA, 25 bp, Mus musculus
taatttaaactacaccagatcggta

SEQ ID NO: 757595 - DNA, 25 bp, Mus musculus
taatttaaactagaccagatcggta

SEQ ID NO: 757596 - DNA, 25 bp, Mus musculus
taatttaacaggagcatttcaggga

SEQ ID NO: 757597 - DNA, 25 bp, Mus musculus
taatttaacaggtgcatttcaggga

SEQ ID NO: 757598 - DNA, 25 bp, Mus musculus
taatttaactatattccaatgtaat

SEQ ID NO: 757599 - DNA, 25 bp, Mus musculus
taatttaactattttccaatgtaat

SEQ ID NO: 757600 - DNA, 25 bp, Mus musculus
taatttaagcccaatccttgtgaat

SEQ ID NO: 757601 - DNA, 25 bp, Mus musculus
taatttaagccctatccttgtgaat

SEQ ID NO: 757602 - DNA, 25 bp, Mus musculus
taatttaatccccacgatggcacag

SEQ ID NO: 757603 - DNA, 25 bp, Mus musculus
taatttaatcccgacgatggcacag

SEQ ID NO: 757604 - DNA, 25 bp, Mus musculus
taatttacatagagcctgagggaca

SEQ ID NO: 757605 - DNA, 25 bp, Mus musculus
taatttacatagtgcctgagggaca

SEQ ID NO: 757606 - DNA, 25 bp, Mus musculus
taatttaccattagttgtcattaaa

SEQ ID NO: 757607 - DNA, 25 bp, Mus musculus
taatttaccatttgttgtcattaaa

SEQ ID NO: 757608 - DNA, 25 bp, Mus musculus
taatttacccaacaacttctactct

SEQ ID NO: 757609 - DNA, 25 bp, Mus musculus
taatttacccaagaacttctactct

SEQ ID NO: 757610 - DNA, 25 bp, Mus musculus
taatttacccagattttcagtttgt

SEQ ID NO: 757611 - DNA, 25 bp, Mus musculus
taatttacccagtttttcagtttgt

SEQ ID NO: 757612 - DNA, 25 bp, Mus musculus
taatttaccctgatctcccaaatag

SEQ ID NO: 757613 - DNA, 25 bp, Mus musculus
taatttaccctgttctcccaaatag

SEQ ID NO: 757614 - DNA, 25 bp, Mus musculus
taatttactaccacgaatttccacg

SEQ ID NO: 757615 - DNA, 25 bp, Mus musculus
taatttactacctcgaatttccacg

SEQ ID NO: 757616 - DNA, 25 bp, Mus musculus
taatttaggagcaaggaaatcatcc

SEQ ID NO: 757617 - DNA, 25 bp, Mus musculus
taatttaggagctaggaaatcatcc

SEQ ID NO: 757618 - DNA, 25 bp, Mus musculus
taatttagtaaaactctgtggctgc

SEQ ID NO: 757619 - DNA, 25 bp, Mus musculus
taatttagtaaatctctgtggctgc

SEQ ID NO: 757620 - DNA, 25 bp, Mus musculus
taatttatactcaagtggtaccact

SEQ ID NO: 757621 - DNA, 25 bp, Mus musculus
taatttatactctagtggtaccact

SEQ ID NO: 757622 - DNA, 25 bp, Mus musculus
taatttatagacagccacggcctta

SEQ ID NO: 757623 - DNA, 25 bp, Mus musculus
taatttatagactgccacggcctta

SEQ ID NO: 757624 - DNA, 25 bp, Mus musculus
taatttatcctcacctggagttgaa

SEQ ID NO: 757625 - DNA, 25 bp, Mus musculus
taatttatcctctcctggagttgaa

SEQ ID NO: 757626 - DNA, 25 bp, Mus musculus
taatttatggagcacttggtaccac

SEQ ID NO: 757627 - DNA, 25 bp, Mus musculus
taatttatggaggacttggtaccac

SEQ ID NO: 757628 - DNA, 25 bp, Mus musculus
taatttatgtttctctttccggtgg

SEQ ID NO: 757629 - DNA, 25 bp, Mus musculus
taatttatgtttgtctttccggtgg

SEQ ID NO: 757630 - DNA, 25 bp, Mus musculus
taatttattcttacaagcactcccc

SEQ ID NO: 757631 - DNA, 25 bp, Mus musculus
taatttattcttcagatctgatctc

SEQ ID NO: 757632 - DNA, 25 bp, Mus musculus
taatttattcttgagatctgatctc

SEQ ID NO: 757633 - DNA, 25 bp, Mus musculus
taatttattctttcaagcactcccc

SEQ ID NO: 757634 - DNA, 25 bp, Mus musculus
taatttattgacaccagtgcccagg

SEQ ID NO: 757635 - DNA, 25 bp, Mus musculus
taatttattgactccagtgcccagg

SEQ ID NO: 757636 - DNA, 25 bp, Mus musculus
taatttattggcaatattgataccc

SEQ ID NO: 757637 - DNA, 25 bp, Mus musculus
taatttattggctatattgataccc

SEQ ID NO: 757638 - DNA, 25 bp, Mus musculus
taatttatttgaagaccctgcgtct

SEQ ID NO: 757639 - DNA, 25 bp, Mus musculus
taatttatttgatgaccctgcgtct

SEQ ID NO: 757640 - DNA, 25 bp, Mus musculus
taatttatttgcagaggttcctcca

SEQ ID NO: 757641 - DNA, 25 bp, Mus musculus
taatttatttgctgaggttcctcca

SEQ ID NO: 757642 - DNA, 25 bp, Mus musculus
taatttcaagagagtctgggacctt

SEQ ID NO: 757643 - DNA, 25 bp, Mus musculus
taatttcaagagtgtctgggacctt

SEQ ID NO: 757644 - DNA, 25 bp, Mus musculus
taatttcaccaaattcggtcttcat

SEQ ID NO: 757645 - DNA, 25 bp, Mus musculus
taatttcaccaatttcggtcttcat

SEQ ID NO: 757646 - DNA, 25 bp, Mus musculus
taatttcactatacgccatacaagg

SEQ ID NO: 757647 - DNA, 25 bp, Mus musculus
taatttcactattcgccatacaagg

SEQ ID NO: 757648 - DNA, 25 bp, Mus musculus
taatttcagaccatttacacggacc

SEQ ID NO: 757649 - DNA, 25 bp, Mus musculus
taatttcagaccttttacacggacc

SEQ ID NO: 757650 - DNA, 25 bp, Mus musculus
taatttcagatcaatgtttcaagag

SEQ ID NO: 757651 - DNA, 25 bp, Mus musculus
taatttcagatctatgtttcaagag

SEQ ID NO: 757652 - DNA, 25 bp, Mus musculus
taatttcagcatccccatgagtaga

SEQ ID NO: 757653 - DNA, 25 bp, Mus musculus
taatttcagcatgcccatgagtaga

SEQ ID NO: 757654 - DNA, 25 bp, Mus musculus
taatttcagcccagtttcgttttcg

SEQ ID NO: 757655 - DNA, 25 bp, Mus musculus
taatttcagccctgtttcgttttcg

SEQ ID NO: 757656 - DNA, 25 bp, Mus musculus
taatttcaggtcaggcgacattagt

SEQ ID NO: 757657 - DNA, 25 bp, Mus musculus
taatttcaggtctggcgacattagt

SEQ ID NO: 757658 - DNA, 25 bp, Mus musculus
taatttcagtacctgggaactctgt

SEQ ID NO: 757659 - DNA, 25 bp, Mus musculus
taatttcagtacgtgggaactctgt

SEQ ID NO: 757660 - DNA, 25 bp, Mus musculus
taatttcatgagacattggctaaag

SEQ ID NO: 757661 - DNA, 25 bp, Mus musculus
taatttcatgagtcattggctaaag

SEQ ID NO: 757662 - DNA, 25 bp, Mus musculus
taatttccacgtatcacttttccac

SEQ ID NO: 757663 - DNA, 25 bp, Mus musculus
taatttccacgtttcacttttccac

SEQ ID NO: 757664 - DNA, 25 bp, Mus musculus
taatttccacttctttttggcccag

SEQ ID NO: 757665 - DNA, 25 bp, Mus musculus
taatttccacttgtttttggcccag

SEQ ID NO: 757666 - DNA, 25 bp, Mus musculus
taatttccaggaccatttgggctga

SEQ ID NO: 757667 - DNA, 25 bp, Mus musculus
taatttccaggagcatttgggctga

SEQ ID NO: 757668 - DNA, 25 bp, Mus musculus
taatttccatacaggtatcctgaat

SEQ ID NO: 757669 - DNA, 25 bp, Mus musculus
taatttccatactggtatcctgaat

SEQ ID NO: 757670 - DNA, 25 bp, Mus musculus
taatttccccacagaggtctacctg

SEQ ID NO: 757671 - DNA, 25 bp, Mus musculus
taatttccccactgaggtctacctg

SEQ ID NO: 757672 - DNA, 25 bp, Mus musculus
taatttcccggtagagtgacttctt

SEQ ID NO: 757673 - DNA, 25 bp, Mus musculus
taatttcccggttgagtgacttctt

SEQ ID NO: 757674 - DNA, 25 bp, Mus musculus
taatttccgaccagaatcatgcacc

SEQ ID NO: 757675 - DNA, 25 bp, Mus musculus
taatttccgacctgaatcatgcacc

SEQ ID NO: 757676 - DNA, 25 bp, Mus musculus
taatttcctgaaatggtctcatgtg

SEQ ID NO: 757677 - DNA, 25 bp, Mus musculus
taatttcctgaattggtctcatgtg

SEQ ID NO: 757678 - DNA, 25 bp, Mus musculus
taatttccttggcacaataaaacca

SEQ ID NO: 757679 - DNA, 25 bp, Mus musculus
taatttccttgggacaataaaacca

SEQ ID NO: 757680 - DNA, 25 bp, Mus musculus
taatttcgaggcctgggttttatgt

SEQ ID NO: 757681 - DNA, 25 bp, Mus musculus
taatttcgaggcgtgggttttatgt

SEQ ID NO: 757682 - DNA, 25 bp, Mus musculus
taatttcgcctcacatttattggat

SEQ ID NO: 757683 - DNA, 25 bp, Mus musculus
taatttcgcctctcatttattggat

SEQ ID NO: 757684 - DNA, 25 bp, Mus musculus
taatttcgggtgatgttggccagag

SEQ ID NO: 757685 - DNA, 25 bp, Mus musculus
taatttcgggtgttgttggccagag

SEQ ID NO: 757686 - DNA, 20 bp, Mus musculus
taatttctatctcctcaact

SEQ ID NO: 757687 - DNA, 25 bp, Mus musculus
taatttctattacagtctccttaaa

SEQ ID NO: 757688 - DNA, 25 bp, Mus musculus
taatttctattagagtctccttaaa

SEQ ID NO: 757689 - DNA, 25 bp, Mus musculus
taatttctctatctgcctgttcttc

SEQ ID NO: 757690 - DNA, 25 bp, Mus musculus
taatttctctatgtgcctgttcttc

SEQ ID NO: 757691 - DNA, 25 bp, Mus musculus
taatttctctcaaaaccagccagat

SEQ ID NO: 757692 - DNA, 25 bp, Mus musculus
taatttctctcacgtctttggctca

SEQ ID NO: 757693 - DNA, 25 bp, Mus musculus
taatttctctcaggtctttggctca

SEQ ID NO: 757694 - DNA, 25 bp, Mus musculus
taatttctctcataaccagccagat

SEQ ID NO: 757695 - DNA, 20 bp, Mus musculus
taatttctctctcctcaact

SEQ ID NO: 757696 - DNA, 25 bp, Mus musculus
taatttctcttgctatcgatttgta

SEQ ID NO: 757697 - DNA, 25 bp, Mus musculus
taatttctcttggtatcgatttgta

SEQ ID NO: 757698 - DNA, 25 bp, Mus musculus
taatttctgcatcaagtttacagaa

SEQ ID NO: 757699 - DNA, 25 bp, Mus musculus
taatttctgcatgaagtttacagaa

SEQ ID NO: 757700 - DNA, 25 bp, Mus musculus
taatttctgcgacgtgttctgctgc

SEQ ID NO: 757701 - DNA, 25 bp, Mus musculus
taatttctgcgaggtgttctgctgc

SEQ ID NO: 757702 - DNA, 20 bp, Mus musculus
taatttctgtctcctcaact

SEQ ID NO: 757703 - DNA, 25 bp, Mus musculus
taatttcttaggcaccatttgggag

SEQ ID NO: 757704 - DNA, 25 bp, Mus musculus
taatttcttagggaccatttgggag

SEQ ID NO: 757705 - DNA, 25 bp, Mus musculus
taatttcttcctccgaatgccacaa

SEQ ID NO: 757706 - DNA, 25 bp, Mus musculus
taatttcttcctgcgaatgccacaa

SEQ ID NO: 757707 - DNA, 25 bp, Mus musculus
taatttcttcggagtgtttaaacat

SEQ ID NO: 757708 - DNA, 25 bp, Mus musculus
taatttcttcggtgtgtttaaacat

SEQ ID NO: 757709 - DNA, 25 bp, Mus musculus
taatttcttgccagtgagatgtcta

SEQ ID NO: 757710 - DNA, 25 bp, Mus musculus
taatttcttgcctgtgagatgtcta

SEQ ID NO: 757711 - DNA, 25 bp, Mus musculus
taatttcttggccaatagtcacatg

SEQ ID NO: 757712 - DNA, 25 bp, Mus musculus
taatttcttggcgaatagtcacatg

SEQ ID NO: 757713 - DNA, 20 bp, Mus musculus
taatttctttctcctcaact

SEQ ID NO: 757714 - DNA, 25 bp, Mus musculus
taatttcttttaatgttttcaacag

SEQ ID NO: 757715 - DNA, 25 bp, Mus musculus
taatttcttttattgttttcaacag

SEQ ID NO: 757716 - DNA, 25 bp, Mus musculus
taatttctttttctgagtcccacgg

SEQ ID NO: 757717 - DNA, 25 bp, Mus musculus
taatttctttttgtgagtcccacgg

SEQ ID NO: 757718 - DNA, 25 bp, Mus musculus
taatttgaccccatttcaggtgtgg

SEQ ID NO: 757719 - DNA, 25 bp, Mus musculus
taatttgaccccttttcaggtgtgg

SEQ ID NO: 757720 - DNA, 25 bp, Mus musculus
taatttgactaaccctttgcctccg

SEQ ID NO: 757721 - DNA, 25 bp, Mus musculus
taatttgactaagcctttgcctccg

SEQ ID NO: 757722 - DNA, 25 bp, Mus musculus
taatttgactgtcctctttggaggt

SEQ ID NO: 757723 - DNA, 25 bp, Mus musculus
taatttgactgtgctctttggaggt

SEQ ID NO: 757724 - DNA, 25 bp, Mus musculus
taatttgatgttactacagttgttc

SEQ ID NO: 757725 - DNA, 25 bp, Mus musculus
taatttgatgtttctacagttgttc

SEQ ID NO: 757726 - DNA, 25 bp, Mus musculus
taatttgcacacatcacagctacta

SEQ ID NO: 757727 - DNA, 25 bp, Mus musculus
taatttgcacacttcacagctacta

SEQ ID NO: 757728 - DNA, 25 bp, Mus musculus
taatttgcacgtcgattcaccttca

SEQ ID NO: 757729 - DNA, 25 bp, Mus musculus
taatttgcacgtggattcaccttca

SEQ ID NO: 757730 - DNA, 25 bp, Mus musculus
taatttgcacttaaatcgcccgaca

SEQ ID NO: 757731 - DNA, 25 bp, Mus musculus
taatttgcactttaatcgcccgaca

SEQ ID NO: 757732 - DNA, 25 bp, Mus musculus
taatttgcagtgaccgcccacaaaa

SEQ ID NO: 757733 - DNA, 25 bp, Mus musculus
taatttgcagtgtccgcccacaaaa

SEQ ID NO: 757734 - DNA, 25 bp, Mus musculus
taatttgccactctgtgctgcacgg

SEQ ID NO: 757735 - DNA, 25 bp, Mus musculus
taatttgccactgtgtgctgcacgg

SEQ ID NO: 757736 - DNA, 25 bp, Mus musculus
taatttgccagtcgcggacatggtt

SEQ ID NO: 757737 - DNA, 25 bp, Mus musculus
taatttgccagtggcggacatggtt

SEQ ID NO: 757738 - DNA, 25 bp, Mus musculus
taatttgcccatccttctcatctta

SEQ ID NO: 757739 - DNA, 25 bp, Mus musculus
taatttgcccatgcttctcatctta

SEQ ID NO: 757740 - DNA, 25 bp, Mus musculus
taatttgccctgacaatcagatgtt

SEQ ID NO: 757741 - DNA, 25 bp, Mus musculus
taatttgccctgtcaatcagatgtt

SEQ ID NO: 757742 - DNA, 25 bp, Mus musculus
taatttgcctggctgtttgcttggg

SEQ ID NO: 757743 - DNA, 25 bp, Mus musculus
taatttgcctgggtgtttgcttggg

SEQ ID NO: 757744 - DNA, 25 bp, Mus musculus
taatttgccttgcttaagaatgaag

SEQ ID NO: 757745 - DNA, 25 bp, Mus musculus
taatttgccttggttaagaatgaag

SEQ ID NO: 757746 - DNA, 25 bp, Mus musculus
taatttgctgctcatagagactcaa

SEQ ID NO: 757747 - DNA, 25 bp, Mus musculus
taatttgctgctgatagagactcaa

SEQ ID NO: 757748 - DNA, 25 bp, Mus musculus
taatttgcttcaataccctgctatt

SEQ ID NO: 757749 - DNA, 25 bp, Mus musculus
taatttgcttcattaccctgctatt

SEQ ID NO: 757750 - DNA, 25 bp, Mus musculus
taatttggaactaactggttaccag

SEQ ID NO: 757751 - DNA, 25 bp, Mus musculus
taatttggaacttactggttaccag

SEQ ID NO: 757752 - DNA, 25 bp, Mus musculus
taatttggagataacctctgggagc

SEQ ID NO: 757753 - DNA, 25 bp, Mus musculus
taatttggagattacctctgggagc

SEQ ID NO: 757754 - DNA, 25 bp, Mus musculus
taatttgggaggctcacctggtgtc

SEQ ID NO: 757755 - DNA, 25 bp, Mus musculus
taatttgggagggtcacctggtgtc

SEQ ID NO: 757756 - DNA, 25 bp, Mus musculus
taatttgggcctagagttccctgct

SEQ ID NO: 757757 - DNA, 25 bp, Mus musculus
taatttgggccttgagttccctgct

SEQ ID NO: 757758 - DNA, 25 bp, Mus musculus
taatttgggtctccatgctttctgt

SEQ ID NO: 757759 - DNA, 25 bp, Mus musculus
taatttgggtctgcatgctttctgt

SEQ ID NO: 757760 - DNA, 25 bp, Mus musculus
taatttggtattaatattcgaggca

SEQ ID NO: 757761 - DNA, 25 bp, Mus musculus
taatttggtatttatattcgaggca

SEQ ID NO: 757762 - DNA, 25 bp, Mus musculus
taatttggtttcagaattttcgtat

SEQ ID NO: 757763 - DNA, 25 bp, Mus musculus
taatttggtttctgaattttcgtat

SEQ ID NO: 757764 - DNA, 25 bp, Mus musculus
taatttggttttcctggtcttcctc

SEQ ID NO: 757765 - DNA, 25 bp, Mus musculus
taatttggttttgctggtcttcctc

SEQ ID NO: 757766 - DNA, 25 bp, Mus musculus
taatttgtaacgactgtgtcactgt

SEQ ID NO: 757767 - DNA, 25 bp, Mus musculus
taatttgtaacgtctgtgtcactgt

SEQ ID NO: 757768 - DNA, 25 bp, Mus musculus
taatttgtaagcagcaaccagcatg

SEQ ID NO: 757769 - DNA, 25 bp, Mus musculus
taatttgtaagctgcaaccagcatg

SEQ ID NO: 757770 - DNA, 25 bp, Mus musculus
taatttgtcataacacctaccctcc

SEQ ID NO: 757771 - DNA, 25 bp, Mus musculus
taatttgtcatatcacctaccctcc

SEQ ID NO: 757772 - DNA, 25 bp, Mus musculus
taatttgtccaaaacccggatccat

SEQ ID NO: 757773 - DNA, 25 bp, Mus musculus
taatttgtccaatacccggatccat

SEQ ID NO: 757774 - DNA, 25 bp, Mus musculus
taatttgtgaataccctgagaccgt

SEQ ID NO: 757775 - DNA, 25 bp, Mus musculus
taatttgtgaattccctgagaccgt

SEQ ID NO: 757776 - DNA, 25 bp, Mus musculus
taatttgtggccacctgacttaata

SEQ ID NO: 757777 - DNA, 25 bp, Mus musculus
taatttgtggcctcctgacttaata

SEQ ID NO: 757778 - DNA, 25 bp, Mus musculus
taatttgtggttacttttctttgag

SEQ ID NO: 757779 - DNA, 25 bp, Mus musculus
taatttgtggtttcttttctttgag

SEQ ID NO: 757780 - DNA, 25 bp, Mus musculus
taatttgttttcagtccttatctaa

SEQ ID NO: 757781 - DNA, 25 bp, Mus musculus
taatttgttttctgtccttatctaa

SEQ ID NO: 757782 - DNA, 25 bp, Mus musculus
taattttaatatcacgccctgcttc

SEQ ID NO: 757783 - DNA, 25 bp, Mus musculus
taattttaatatgacgccctgcttc

SEQ ID NO: 757784 - DNA, 25 bp, Mus musculus
taattttacacgagtttttatgagt

SEQ ID NO: 757785 - DNA, 25 bp, Mus musculus
taattttacacgtgtttttatgagt

SEQ ID NO: 757786 - DNA, 25 bp, Mus musculus
taattttacaggaaccatatggaat

SEQ ID NO: 757787 - DNA, 25 bp, Mus musculus
taattttacaggtaccatatggaat

SEQ ID NO: 757788 - DNA, 25 bp, Mus musculus
taattttactatcttgtgactacag

SEQ ID NO: 757789 - DNA, 25 bp, Mus musculus
taattttactatgttgtgactacag

SEQ ID NO: 757790 - DNA, 25 bp, Mus musculus
taattttacttaatcaacatgtttg

SEQ ID NO: 757791 - DNA, 25 bp, Mus musculus
taattttacttacaggtccatgagg

SEQ ID NO: 757792 - DNA, 25 bp, Mus musculus
taattttacttagaggtccatgagg

SEQ ID NO: 757793 - DNA, 25 bp, Mus musculus
taattttacttattcaacatgtttg

SEQ ID NO: 757794 - DNA, 25 bp, Mus musculus
taattttagacactctactccctgg

SEQ ID NO: 757795 - DNA, 25 bp, Mus musculus
taattttagacagtctactccctgg

SEQ ID NO: 757796 - DNA, 25 bp, Mus musculus
taattttagttgcgctggaactcac

SEQ ID NO: 757797 - DNA, 25 bp, Mus musculus
taattttagttgggctggaactcac

SEQ ID NO: 757798 - DNA, 25 bp, Mus musculus
taattttatcacagcccttttccat

SEQ ID NO: 757799 - DNA, 25 bp, Mus musculus
taattttatcactgcccttttccat

SEQ ID NO: 757800 - DNA, 25 bp, Mus musculus
taattttcacctctatttctgccag

SEQ ID NO: 757801 - DNA, 25 bp, Mus musculus
taattttcacctgtatttctgccag

SEQ ID NO: 757802 - DNA, 25 bp, Mus musculus
taattttcagcacttaagcctcccc

SEQ ID NO: 757803 - DNA, 25 bp, Mus musculus
taattttcagcagttaagcctcccc

SEQ ID NO: 757804 - DNA, 25 bp, Mus musculus
taattttcatgtcgaagctggtaca

SEQ ID NO: 757805 - DNA, 25 bp, Mus musculus
taattttcatgtggaagctggtaca

SEQ ID NO: 757806 - DNA, 25 bp, Mus musculus
taattttccaccattgtgtgagtgt

SEQ ID NO: 757807 - DNA, 25 bp, Mus musculus
taattttccacctttgtgtgagtgt

SEQ ID NO: 757808 - DNA, 25 bp, Mus musculus
taattttcccatcacttctttcttc

SEQ ID NO: 757809 - DNA, 25 bp, Mus musculus
taattttcccatgacttctttcttc

SEQ ID NO: 757810 - DNA, 25 bp, Mus musculus
taattttcccctcacttcttagaat

SEQ ID NO: 757811 - DNA, 25 bp, Mus musculus
taattttcccctgacttcttagaat

SEQ ID NO: 757812 - DNA, 25 bp, Mus musculus
taattttcctcccagctttgacctc

SEQ ID NO: 757813 - DNA, 25 bp, Mus musculus
taattttcctccgagctttgacctc

SEQ ID NO: 757814 - DNA, 25 bp, Mus musculus
taattttcctgccaccattctgatc

SEQ ID NO: 757815 - DNA, 25 bp, Mus musculus
taattttcctgcgaccattctgatc

SEQ ID NO: 757816 - DNA, 25 bp, Mus musculus
taattttctgtgattcatcatgaga

SEQ ID NO: 757817 - DNA, 25 bp, Mus musculus
taattttctgtgtttcatcatgaga

SEQ ID NO: 757818 - DNA, 25 bp, Mus musculus
taattttcttcaaaggtgtctcgtg

SEQ ID NO: 757819 - DNA, 25 bp, Mus musculus
taattttcttcataggtgtctcgtg

SEQ ID NO: 757820 - DNA, 25 bp, Mus musculus
taattttgacatattttgtagcaga

SEQ ID NO: 757821 - DNA, 25 bp, Mus musculus
taattttgacattttttgtagcaga

SEQ ID NO: 757822 - DNA, 25 bp, Mus musculus
taattttgctttcttcccatctgcc

SEQ ID NO: 757823 - DNA, 25 bp, Mus musculus
taattttgctttgttcccatctgcc

SEQ ID NO: 757824 - DNA, 25 bp, Mus musculus
taattttggcatcaaccccttgttc

SEQ ID NO: 757825 - DNA, 25 bp, Mus musculus
taattttggcatgaaccccttgttc

SEQ ID NO: 757826 - DNA, 25 bp, Mus musculus
taattttgggacagccctgcacatt

SEQ ID NO: 757827 - DNA, 25 bp, Mus musculus
taattttgggactgccctgcacatt

SEQ ID NO: 757828 - DNA, 25 bp, Mus musculus
taattttgggtaagccagggctact

SEQ ID NO: 757829 - DNA, 25 bp, Mus musculus
taattttgggtatgccagggctact

SEQ ID NO: 757830 - DNA, 25 bp, Mus musculus
taattttggtaccacctgaggcttt

SEQ ID NO: 757831 - DNA, 25 bp, Mus musculus
taattttggtacgacctgaggcttt

SEQ ID NO: 757832 - DNA, 25 bp, Mus musculus
taattttgtactccccatggttatc

SEQ ID NO: 757833 - DNA, 25 bp, Mus musculus
taattttgtactgcccatggttatc

SEQ ID NO: 757834 - DNA, 25 bp, Mus musculus
taattttgtcctcagctcttccaat

SEQ ID NO: 757835 - DNA, 25 bp, Mus musculus
taattttgtcctgagctcttccaat

SEQ ID NO: 757836 - DNA, 25 bp, Mus musculus
taattttgttccaagctgggttatg

SEQ ID NO: 757837 - DNA, 25 bp, Mus musculus
taattttgttcctagctgggttatg

SEQ ID NO: 757838 - DNA, 25 bp, Mus musculus
taatttttaacccactcagccggtg

SEQ ID NO: 757839 - DNA, 25 bp, Mus musculus
taatttttaaccgactcagccggtg

SEQ ID NO: 757840 - DNA, 25 bp, Mus musculus
taatttttatatccacccatacata

SEQ ID NO: 757841 - DNA, 25 bp, Mus musculus
taatttttatatgcacccatacata

SEQ ID NO: 757842 - DNA, 25 bp, Mus musculus
taatttttctcaatctttcagggtt

SEQ ID NO: 757843 - DNA, 25 bp, Mus musculus
taatttttctcattctttcagggtt

SEQ ID NO: 757844 - DNA, 25 bp, Mus musculus
taatttttctccaacttccacctag

SEQ ID NO: 757845 - DNA, 25 bp, Mus musculus
taatttttctcctacttccacctag

SEQ ID NO: 757846 - DNA, 25 bp, Mus musculus
taatttttctgtaggtcatccttat

SEQ ID NO: 757847 - DNA, 25 bp, Mus musculus
taatttttctgtccttgcccgtgtg

SEQ ID NO: 757848 - DNA, 25 bp, Mus musculus
taatttttctgtgcttgcccgtgtg

SEQ ID NO: 757849 - DNA, 25 bp, Mus musculus
taatttttctgttggtcatccttat

SEQ ID NO: 757850 - DNA, 25 bp, Mus musculus
taatttttgcttctgtgactagtga

SEQ ID NO: 757851 - DNA, 25 bp, Mus musculus
taatttttgcttcttcctgttaacg

SEQ ID NO: 757852 - DNA, 25 bp, Mus musculus
taatttttgcttgtgtgactagtga

SEQ ID NO: 757853 - DNA, 25 bp, Mus musculus
taatttttgcttgttcctgttaacg

SEQ ID NO: 757854 - DNA, 25 bp, Mus musculus
taatttttgtcaccaaacgaggact

SEQ ID NO: 757855 - DNA, 25 bp, Mus musculus
taatttttgtcagcaaacgaggact

SEQ ID NO: 757856 - DNA, 25 bp, Mus musculus
taattttttctgctgctcgtgatag

SEQ ID NO: 757857 - DNA, 25 bp, Mus musculus
taattttttctggtgctcgtgatag

SEQ ID NO: 757858 - DNA, 25 bp, Mus musculus
tacaaaaactttagcccggcatcag

SEQ ID NO: 757859 - DNA, 25 bp, Mus musculus
tacaaaaacttttgcccggcatcag

SEQ ID NO: 757860 - DNA, 25 bp, Mus musculus
tacaaaaagccacacttccgcacga

SEQ ID NO: 757861 - DNA, 25 bp, Mus musculus
tacaaaaagccagacttccgcacga

SEQ ID NO: 757862 - DNA, 25 bp, Mus musculus
tacaaaacatagcaataaatcctgg

SEQ ID NO: 757863 - DNA, 25 bp, Mus musculus
tacaaaacataggaataaatcctgg

SEQ ID NO: 757864 - DNA, 25 bp, Mus musculus
tacaaaaccggacgactggacctgc

SEQ ID NO: 757865 - DNA, 25 bp, Mus musculus
tacaaaaccggaggactggacctgc

SEQ ID NO: 757866 - DNA, 25 bp, Mus musculus
tacaaaacgacaactgttcaccaag

SEQ ID NO: 757867 - DNA, 25 bp, Mus musculus
tacaaaacgacatctgttcaccaag

SEQ ID NO: 757868 - DNA, 25 bp, Mus musculus
tacaaaactctgagtgatctctggt

SEQ ID NO: 757869 - DNA, 25 bp, Mus musculus
tacaaaactctgtgtgatctctggt

SEQ ID NO: 757870 - DNA, 25 bp, Mus musculus
tacaaaagcaagacacgtgagcccc

SEQ ID NO: 757871 - DNA, 25 bp, Mus musculus
tacaaaagcaagtcacgtgagcccc

SEQ ID NO: 757872 - DNA, 25 bp, Mus musculus
tacaaaagtctaccccactgtacct

SEQ ID NO: 757873 - DNA, 25 bp, Mus musculus
tacaaaagtctagcccactgtacct

SEQ ID NO: 757874 - DNA, 25 bp, Mus musculus
tacaaaataattaccaggcgtctgg

SEQ ID NO: 757875 - DNA, 25 bp, Mus musculus
tacaaaataatttccaggcgtctgg

SEQ ID NO: 757876 - DNA, 25 bp, Mus musculus
tacaaaataggtaggagctggctac

SEQ ID NO: 757877 - DNA, 25 bp, Mus musculus
tacaaaataggttggagctggctac

SEQ ID NO: 757878 - DNA, 25 bp, Mus musculus
tacaaaatcaaacctgcatgccatg

SEQ ID NO: 757879 - DNA, 25 bp, Mus musculus
tacaaaatcaaagctgcatgccatg

SEQ ID NO: 757880 - DNA, 25 bp, Mus musculus
tacaaaatgagccatttgctcccaa

SEQ ID NO: 757881 - DNA, 25 bp, Mus musculus
tacaaaatgagcgatttgctcccaa

SEQ ID NO: 757882 - DNA, 25 bp, Mus musculus
tacaaaatgcacagttttagggttt

SEQ ID NO: 757883 - DNA, 25 bp, Mus musculus
tacaaaatgcactgttttagggttt

SEQ ID NO: 757884 - DNA, 25 bp, Mus musculus
tacaaaatgcctcatcgttgccagt

SEQ ID NO: 757885 - DNA, 25 bp, Mus musculus
tacaaaatgcctgatcgttgccagt

SEQ ID NO: 757886 - DNA, 25 bp, Mus musculus
tacaaaattatacccacaccagcac

SEQ ID NO: 757887 - DNA, 25 bp, Mus musculus
tacaaaattatagccacaccagcac

SEQ ID NO: 757888 - DNA, 25 bp, Mus musculus
tacaaacaagccatgggacccattc

SEQ ID NO: 757889 - DNA, 25 bp, Mus musculus
tacaaacaagccttgggacccattc

SEQ ID NO: 757890 - DNA, 25 bp, Mus musculus
tacaaacaagtcaacattccctcag

SEQ ID NO: 757891 - DNA, 25 bp, Mus musculus
tacaaacaagtctacattccctcag

SEQ ID NO: 757892 - DNA, 25 bp, Mus musculus
tacaaacacgcgctttccctgaggc

SEQ ID NO: 757893 - DNA, 25 bp, Mus musculus
tacaaacacgcggtttccctgaggc

SEQ ID NO: 757894 - DNA, 25 bp, Mus musculus
tacaaacacgtacgatgccctgcgc

SEQ ID NO: 757895 - DNA, 25 bp, Mus musculus
tacaaacacgtaggatgccctgcgc

SEQ ID NO: 757896 - DNA, 25 bp, Mus musculus
tacaaacactcaatgccatcacagg

SEQ ID NO: 757897 - DNA, 25 bp, Mus musculus
tacaaacactcattgccatcacagg

SEQ ID NO: 757898 - DNA, 25 bp, Mus musculus
tacaaacactttaaccgacatggga

SEQ ID NO: 757899 - DNA, 25 bp, Mus musculus
tacaaacacttttaccgacatggga

SEQ ID NO: 757900 - DNA, 25 bp, Mus musculus
tacaaacagtaaatggccatgcaaa

SEQ ID NO: 757901 - DNA, 25 bp, Mus musculus
tacaaacagtaattggccatgcaaa

SEQ ID NO: 757902 - DNA, 25 bp, Mus musculus
tacaaaccaaccagtgtctaaaaag

SEQ ID NO: 757903 - DNA, 25 bp, Mus musculus
tacaaaccaacctgtgtctaaaaag

SEQ ID NO: 757904 - DNA, 25 bp, Mus musculus
tacaaaccatcacaagcatagaggt

SEQ ID NO: 757905 - DNA, 25 bp, Mus musculus
tacaaaccatcagaagcatagaggt

SEQ ID NO: 757906 - DNA, 25 bp, Mus musculus
tacaaacccagcaaccttgagaggc

SEQ ID NO: 757907 - DNA, 25 bp, Mus musculus
tacaaacccagctaccttgagaggc

SEQ ID NO: 757908 - DNA, 25 bp, Mus musculus
tacaaacccgtcattcttaatagtg

SEQ ID NO: 757909 - DNA, 25 bp, Mus musculus
tacaaacccgtctttcttaatagtg

SEQ ID NO: 757910 - DNA, 25 bp, Mus musculus
tacaaaccctgaagatcctaacaag

SEQ ID NO: 757911 - DNA, 25 bp, Mus musculus
tacaaaccctgatgatcctaacaag

SEQ ID NO: 757912 - DNA, 25 bp, Mus musculus
tacaaacccttcactttgcggaaca

SEQ ID NO: 757913 - DNA, 25 bp, Mus musculus
tacaaacccttctctttgcggaaca

SEQ ID NO: 757914 - DNA, 25 bp, Mus musculus
tacaaacctctactagtcacctcag

SEQ ID NO: 757915 - DNA, 25 bp, Mus musculus
tacaaacctctagtagtcacctcag

SEQ ID NO: 757916 - DNA, 25 bp, Mus musculus
tacaaacctttaatataccagtgtt

SEQ ID NO: 757917 - DNA, 25 bp, Mus musculus
tacaaacctttattataccagtgtt

SEQ ID NO: 757918 - DNA, 25 bp, Mus musculus
tacaaaccttttagaaatgtgcttt

SEQ ID NO: 757919 - DNA, 25 bp, Mus musculus
tacaaacctttttgaaatgtgcttt

SEQ ID NO: 757920 - DNA, 25 bp, Mus musculus
tacaaacgcaaacacccagagcttg

SEQ ID NO: 757921 - DNA, 25 bp, Mus musculus
tacaaacgcaaagacccagagcttg

SEQ ID NO: 757922 - DNA, 25 bp, Mus musculus
tacaaactaaaaacagcttctacct

SEQ ID NO: 757923 - DNA, 25 bp, Mus musculus
tacaaactaaaatcagcttctacct

SEQ ID NO: 757924 - DNA, 25 bp, Mus musculus
tacaaactgtagactagctaatcca

SEQ ID NO: 757925 - DNA, 25 bp, Mus musculus
tacaaactgtagtctagctaatcca

SEQ ID NO: 757926 - DNA, 25 bp, Mus musculus
tacaaactgtcacttctgttcacct

SEQ ID NO: 757927 - DNA, 25 bp, Mus musculus
tacaaactgtcagttctgttcacct

SEQ ID NO: 757928 - DNA, 25 bp, Mus musculus
tacaaacttagaagcggttctggct

SEQ ID NO: 757929 - DNA, 25 bp, Mus musculus
tacaaacttagatgcggttctggct

SEQ ID NO: 757930 - DNA, 25 bp, Mus musculus
tacaaacttatacacctgcatccag

SEQ ID NO: 757931 - DNA, 25 bp, Mus musculus
tacaaacttatagacctgcatccag

SEQ ID NO: 757932 - DNA, 25 bp, Mus musculus
tacaaacttcctctgtaacttgggt

SEQ ID NO: 757933 - DNA, 25 bp, Mus musculus
tacaaacttcctgtgtaacttgggt

SEQ ID NO: 757934 - DNA, 25 bp, Mus musculus
tacaaagaaaagcaccgccacggag

SEQ ID NO: 757935 - DNA, 25 bp, Mus musculus
tacaaagaaaaggaccgccacggag

SEQ ID NO: 757936 - DNA, 25 bp, Mus musculus
tacaaagaactcaacccacaaagat

SEQ ID NO: 757937 - DNA, 25 bp, Mus musculus
tacaaagaactctacccacaaagat

SEQ ID NO: 757938 - DNA, 25 bp, Mus musculus
tacaaagactggaaatgctgggagc

SEQ ID NO: 757939 - DNA, 25 bp, Mus musculus
tacaaagactggtaatgctgggagc

SEQ ID NO: 757940 - DNA, 25 bp, Mus musculus
tacaaagagcctactgcttaccagt

SEQ ID NO: 757941 - DNA, 25 bp, Mus musculus
tacaaagagccttctgcttaccagt

SEQ ID NO: 757942 - DNA, 25 bp, Mus musculus
tacaaagatgacatccccgagaaac

SEQ ID NO: 757943 - DNA, 25 bp, Mus musculus
tacaaagatgacttccccgagaaac

SEQ ID NO: 757944 - DNA, 25 bp, Mus musculus
tacaaagatgttactgctcctggct

SEQ ID NO: 757945 - DNA, 25 bp, Mus musculus
tacaaagatgtttctgctcctggct

SEQ ID NO: 757946 - DNA, 25 bp, Mus musculus
tacaaagcaaacagagggccaggcg

SEQ ID NO: 757947 - DNA, 25 bp, Mus musculus
tacaaagcaaactgagggccaggcg

SEQ ID NO: 757948 - DNA, 25 bp, Mus musculus
tacaaagcaaagactcacaaggatc

SEQ ID NO: 757949 - DNA, 25 bp, Mus musculus
tacaaagcaaagtctcacaaggatc

SEQ ID NO: 757950 - DNA, 25 bp, Mus musculus
tacaaagcaacaatggccaactatc

SEQ ID NO: 757951 - DNA, 25 bp, Mus musculus
tacaaagcaacattggccaactatc

SEQ ID NO: 757952 - DNA, 25 bp, Mus musculus
tacaaagcaacgcagaacgacattt

SEQ ID NO: 757953 - DNA, 25 bp, Mus musculus
tacaaagcaacggagaacgacattt

SEQ ID NO: 757954 - DNA, 25 bp, Mus musculus
tacaaagcactacccatacatctct

SEQ ID NO: 757955 - DNA, 25 bp, Mus musculus
tacaaagcactagccatacatctct

SEQ ID NO: 757956 - DNA, 25 bp, Mus musculus
tacaaagcagctcctaccttatttt

SEQ ID NO: 757957 - DNA, 25 bp, Mus musculus
tacaaagcagctgctaccttatttt

SEQ ID NO: 757958 - DNA, 25 bp, Mus musculus
tacaaagccagcatacaccaagtct

SEQ ID NO: 757959 - DNA, 25 bp, Mus musculus
tacaaagccagcattctttccattc

SEQ ID NO: 757960 - DNA, 25 bp, Mus musculus
tacaaagccagccattgtccgtctt

SEQ ID NO: 757961 - DNA, 25 bp, Mus musculus
tacaaagccagcgattgtccgtctt

SEQ ID NO: 757962 - DNA, 25 bp, Mus musculus
tacaaagccagcttacaccaagtct

SEQ ID NO: 757963 - DNA, 25 bp, Mus musculus
tacaaagccagctttctttccattc

SEQ ID NO: 757964 - DNA, 25 bp, Mus musculus
tacaaagcgatcagagcctgctgcc

SEQ ID NO: 757965 - DNA, 25 bp, Mus musculus
tacaaagcgatctgagcctgctgcc

SEQ ID NO: 757966 - DNA, 25 bp, Mus musculus
tacaaagctatgactcgaaaccaga

SEQ ID NO: 757967 - DNA, 25 bp, Mus musculus
tacaaagctatgtctcgaaaccaga

SEQ ID NO: 757968 - DNA, 25 bp, Mus musculus
tacaaagctattcttttccggccct

SEQ ID NO: 757969 - DNA, 25 bp, Mus musculus
tacaaagctattgttttccggccct

SEQ ID NO: 757970 - DNA, 25 bp, Mus musculus
tacaaagctcgtaactgcatttcag

SEQ ID NO: 757971 - DNA, 25 bp, Mus musculus
tacaaagctcgttactgcatttcag

SEQ ID NO: 757972 - DNA, 25 bp, Mus musculus
tacaaagctgtgaatcgcctgtgct

SEQ ID NO: 757973 - DNA, 25 bp, Mus musculus
tacaaagctgtgtatcgcctgtgct

SEQ ID NO: 757974 - DNA, 25 bp, Mus musculus
tacaaaggacctaccatttaggtgt

SEQ ID NO: 757975 - DNA, 25 bp, Mus musculus
tacaaaggaccttccatttaggtgt

SEQ ID NO: 757976 - DNA, 25 bp, Mus musculus
tacaaaggagttagaaatcagggat

SEQ ID NO: 757977 - DNA, 25 bp, Mus musculus
tacaaaggagtttgaaatcagggat

SEQ ID NO: 757978 - DNA, 25 bp, Mus musculus
tacaaaggatctatgctacgctgga

SEQ ID NO: 757979 - DNA, 25 bp, Mus musculus
tacaaaggatctttgctacgctgga

SEQ ID NO: 757980 - DNA, 25 bp, Mus musculus
tacaaaggctggatgatagttttca

SEQ ID NO: 757981 - DNA, 25 bp, Mus musculus
tacaaaggctggttgatagttttca

SEQ ID NO: 757982 - DNA, 25 bp, Mus musculus
tacaaagggacaccaggcgtgcagc

SEQ ID NO: 757983 - DNA, 25 bp, Mus musculus
tacaaagggacagcaggcgtgcagc

SEQ ID NO: 757984 - DNA, 25 bp, Mus musculus
tacaaagggagtctgacgccagcct

SEQ ID NO: 757985 - DNA, 25 bp, Mus musculus
tacaaagggagtgtgacgccagcct

SEQ ID NO: 757986 - DNA, 25 bp, Mus musculus
tacaaagggcctctcttccacagtt

SEQ ID NO: 757987 - DNA, 25 bp, Mus musculus
tacaaagggcctgtcttccacagtt

SEQ ID NO: 757988 - DNA, 25 bp, Mus musculus
tacaaagggtcaaggcttcccaagc

SEQ ID NO: 757989 - DNA, 25 bp, Mus musculus
tacaaagggtcatggcttcccaagc

SEQ ID NO: 757990 - DNA, 25 bp, Mus musculus
tacaaagtaagtcaggttcatgtcc

SEQ ID NO: 757991 - DNA, 25 bp, Mus musculus
tacaaagtaagtgaggttcatgtcc

SEQ ID NO: 757992 - DNA, 25 bp, Mus musculus
tacaaagtcagtcatttctcccatc

SEQ ID NO: 757993 - DNA, 25 bp, Mus musculus
tacaaagtcagtgatttctcccatc

SEQ ID NO: 757994 - DNA, 25 bp, Mus musculus
tacaaagtggccaacgtgcagctgg

SEQ ID NO: 757995 - DNA, 25 bp, Mus musculus
tacaaagtggcctacgtgcagctgg

SEQ ID NO: 757996 - DNA, 25 bp, Mus musculus
tacaaagttgtaccaaacccctctg

SEQ ID NO: 757997 - DNA, 25 bp, Mus musculus
tacaaagttgtagcaaacccctctg

SEQ ID NO: 757998 - DNA, 25 bp, Mus musculus
tacaaatacgctcggccttctgatt

SEQ ID NO: 757999 - DNA, 25 bp, Mus musculus
tacaaatacgctgggccttctgatt

SEQ ID NO: 758000 - DNA, 25 bp, Mus musculus
tacaaatatattctcccaccctgag

SEQ ID NO: 758001 - DNA, 25 bp, Mus musculus
tacaaatatattgtcccaccctgag

SEQ ID NO: 758002 - DNA, 25 bp, Mus musculus
tacaaatatgggaagaaccgggtag

SEQ ID NO: 758003 - DNA, 25 bp, Mus musculus
tacaaatatgggtagaaccgggtag

SEQ ID NO: 758004 - DNA, 25 bp, Mus musculus
tacaaatcaaatcactgggctccag

SEQ ID NO: 758005 - DNA, 25 bp, Mus musculus
tacaaatcaaatgactgggctccag

SEQ ID NO: 758006 - DNA, 25 bp, Mus musculus
tacaaatcagtgaccttgccagtgc

SEQ ID NO: 758007 - DNA, 25 bp, Mus musculus
tacaaatcagtgtccttgccagtgc

SEQ ID NO: 758008 - DNA, 25 bp, Mus musculus
tacaaatccctgaactacctcttga

SEQ ID NO: 758009 - DNA, 25 bp, Mus musculus
tacaaatccctgtactacctcttga

SEQ ID NO: 758010 - DNA, 25 bp, Mus musculus
tacaaatcctaaagagcgtcctcca

SEQ ID NO: 758011 - DNA, 25 bp, Mus musculus
tacaaatcctaatgagcgtcctcca

SEQ ID NO: 758012 - DNA, 25 bp, Mus musculus
tacaaatctttgaatcttctgaggt

SEQ ID NO: 758013 - DNA, 25 bp, Mus musculus
tacaaatctttgtatcttctgaggt

SEQ ID NO: 758014 - DNA, 25 bp, Mus musculus
tacaaatgaactagaaaccaccttt

SEQ ID NO: 758015 - DNA, 25 bp, Mus musculus
tacaaatgaactctgcttcgatccc

SEQ ID NO: 758016 - DNA, 25 bp, Mus musculus
tacaaatgaactgtgcttcgatccc

SEQ ID NO: 758017 - DNA, 25 bp, Mus musculus
tacaaatgaacttgaaaccaccttt

SEQ ID NO: 758018 - DNA, 25 bp, Mus musculus
tacaaatgccatataaaccttgatt

SEQ ID NO: 758019 - DNA, 25 bp, Mus musculus
tacaaatgccatttaaaccttgatt

SEQ ID NO: 758020 - DNA, 25 bp, Mus musculus
tacaaatggtctacacagtgttact

SEQ ID NO: 758021 - DNA, 25 bp, Mus musculus
tacaaatggtcttcacagtgttact

SEQ ID NO: 758022 - DNA, 25 bp, Mus musculus
tacaaatgtaccatagctgcaatgg

SEQ ID NO: 758023 - DNA, 25 bp, Mus musculus
tacaaatgtaccttagctgcaatgg

SEQ ID NO: 758024 - DNA, 25 bp, Mus musculus
tacaaatgtgtgatcctcctttttt

SEQ ID NO: 758025 - DNA, 25 bp, Mus musculus
tacaaatgtgtgttcctcctttttt

SEQ ID NO: 758026 - DNA, 25 bp, Mus musculus
tacaaatgttcccttagaccattaa

SEQ ID NO: 758027 - DNA, 25 bp, Mus musculus
tacaaatgttccgttagaccattaa

SEQ ID NO: 758028 - DNA, 25 bp, Mus musculus
tacaaatgttttcgtcagggttctt

SEQ ID NO: 758029 - DNA, 25 bp, Mus musculus
tacaaatgttttggtcagggttctt

SEQ ID NO: 758030 - DNA, 25 bp, Mus musculus
tacaaattcaggacatgggcatgct

SEQ ID NO: 758031 - DNA, 25 bp, Mus musculus
tacaaattcaggtcatgggcatgct

SEQ ID NO: 758032 - DNA, 25 bp, Mus musculus
tacaaattcttaatgcagtccttca

SEQ ID NO: 758033 - DNA, 25 bp, Mus musculus
tacaaattcttattgcagtccttca

SEQ ID NO: 758034 - DNA, 25 bp, Mus musculus
tacaaattgtcaacaagtcccaccc

SEQ ID NO: 758035 - DNA, 25 bp, Mus musculus
tacaaattgtcatcaagtcccaccc

SEQ ID NO: 758036 - DNA, 25 bp, Mus musculus
tacaacaaactacggacttcagcta

SEQ ID NO: 758037 - DNA, 25 bp, Mus musculus
tacaacaaactagggacttcagcta

SEQ ID NO: 758038 - DNA, 25 bp, Mus musculus
tacaacaaagctatctccaaagtgc

SEQ ID NO: 758039 - DNA, 25 bp, Mus musculus
tacaacaaagctttctccaaagtgc

SEQ ID NO: 758040 - DNA, 25 bp, Mus musculus
tacaacaacactataacatcctcca

SEQ ID NO: 758041 - DNA, 25 bp, Mus musculus
tacaacaacactttaacatcctcca

SEQ ID NO: 758042 - DNA, 25 bp, Mus musculus
tacaacaacataacaatgaaagcgt

SEQ ID NO: 758043 - DNA, 25 bp, Mus musculus
tacaacaacatatcaatgaaagcgt

SEQ ID NO: 758044 - DNA, 25 bp, Mus musculus
tacaacaagacccatgtggccgcac

SEQ ID NO: 758045 - DNA, 25 bp, Mus musculus
tacaacaagaccgatgtggccgcac

SEQ ID NO: 758046 - DNA, 25 bp, Mus musculus
tacaacaagatcctgtatcacaaac

SEQ ID NO: 758047 - DNA, 25 bp, Mus musculus
tacaacaagatcgtgtatcacaaac

SEQ ID NO: 758048 - DNA, 25 bp, Mus musculus
tacaacaaggtacttatcacctctg

SEQ ID NO: 758049 - DNA, 25 bp, Mus musculus
tacaacaaggtagttatcacctctg

SEQ ID NO: 758050 - DNA, 25 bp, Mus musculus
tacaacaataacacacacagtgaaa

SEQ ID NO: 758051 - DNA, 25 bp, Mus musculus
tacaacaataactcacacagtgaaa

SEQ ID NO: 758052 - DNA, 25 bp, Mus musculus
tacaacacaaacaaaaccgtctctt

SEQ ID NO: 758053 - DNA, 25 bp, Mus musculus
tacaacacaaactaaaccgtctctt

SEQ ID NO: 758054 - DNA, 25 bp, Mus musculus
tacaacacaagcctgctcacagaag

SEQ ID NO: 758055 - DNA, 25 bp, Mus musculus
tacaacacaagcgtgctcacagaag

SEQ ID NO: 758056 - DNA, 25 bp, Mus musculus
tacaacacacctcaagcctaagcgt

SEQ ID NO: 758057 - DNA, 25 bp, Mus musculus
tacaacacacctgaagcctaagcgt

SEQ ID NO: 758058 - DNA, 25 bp, Mus musculus
tacaacacagaaccacctgtgctca

SEQ ID NO: 758059 - DNA, 25 bp, Mus musculus
tacaacacagaagcacctgtgctca

SEQ ID NO: 758060 - DNA, 25 bp, Mus musculus
tacaacactaccaaaccaccaagca

SEQ ID NO: 758061 - DNA, 25 bp, Mus musculus
tacaacactacctaaccaccaagca

SEQ ID NO: 758062 - DNA, 25 bp, Mus musculus
tacaacactcagaaccaaacagaaa

SEQ ID NO: 758063 - DNA, 25 bp, Mus musculus
tacaacactcagtaccaaacagaaa

SEQ ID NO: 758064 - DNA, 25 bp, Mus musculus
tacaacactggtacctttgtggacc

SEQ ID NO: 758065 - DNA, 25 bp, Mus musculus
tacaacactggttcctttgtggacc

SEQ ID NO: 758066 - DNA, 25 bp, Mus musculus
tacaacactgtcagctttctagcta

SEQ ID NO: 758067 - DNA, 25 bp, Mus musculus
tacaacactgtctgctttctagcta

SEQ ID NO: 758068 - DNA, 25 bp, Mus musculus
tacaacagcatgcttgtcggcagct

SEQ ID NO: 758069 - DNA, 25 bp, Mus musculus
tacaacagcatggttgtcggcagct

SEQ ID NO: 758070 - DNA, 25 bp, Mus musculus
tacaacagcctcagggtctagggaa

SEQ ID NO: 758071 - DNA, 25 bp, Mus musculus
tacaacagcctctgggtctagggaa

SEQ ID NO: 758072 - DNA, 25 bp, Mus musculus
tacaacagctgtcctcagacactgc

SEQ ID NO: 758073 - DNA, 25 bp, Mus musculus
tacaacagctgtgctcagacactgc

SEQ ID NO: 758074 - DNA, 25 bp, Mus musculus
tacaacaggaacctttttgtgtgtt

SEQ ID NO: 758075 - DNA, 25 bp, Mus musculus
tacaacaggaacgtttttgtgtgtt

SEQ ID NO: 758076 - DNA, 25 bp, Mus musculus
tacaacaggactactaaaagctcat

SEQ ID NO: 758077 - DNA, 25 bp, Mus musculus
tacaacaggacttctaaaagctcat

SEQ ID NO: 758078 - DNA, 25 bp, Mus musculus
tacaacaggatgctcactaagttag

SEQ ID NO: 758079 - DNA, 25 bp, Mus musculus
tacaacaggatggtcactaagttag

SEQ ID NO: 758080 - DNA, 25 bp, Mus musculus
tacaacaggtgtactttcaaacatg

SEQ ID NO: 758081 - DNA, 25 bp, Mus musculus
tacaacaggtgttctttcaaacatg

SEQ ID NO: 758082 - DNA, 25 bp, Mus musculus
tacaacaggtttctctccacacttt

SEQ ID NO: 758083 - DNA, 25 bp, Mus musculus
tacaacaggtttgtctccacacttt

SEQ ID NO: 758084 - DNA, 25 bp, Mus musculus
tacaacagtgtccttaaccctaaca

SEQ ID NO: 758085 - DNA, 25 bp, Mus musculus
tacaacagtgtcgttaaccctaaca

SEQ ID NO: 758086 - DNA, 25 bp, Mus musculus
tacaacagttccagtacctaggctg

SEQ ID NO: 758087 - DNA, 25 bp, Mus musculus
tacaacagttcctgtacctaggctg

SEQ ID NO: 758088 - DNA, 25 bp, Mus musculus
tacaacatactcacatttggactgt

SEQ ID NO: 758089 - DNA, 25 bp, Mus musculus
tacaacatactctcatttggactgt

SEQ ID NO: 758090 - DNA, 25 bp, Mus musculus
tacaacatcacaactaccctggcag

SEQ ID NO: 758091 - DNA, 25 bp, Mus musculus
tacaacatcacatctaccctggcag

SEQ ID NO: 758092 - DNA, 25 bp, Mus musculus
tacaacatcatgagccacgtcgcag

SEQ ID NO: 758093 - DNA, 25 bp, Mus musculus
tacaacatcatgtgccacgtcgcag

SEQ ID NO: 758094 - DNA, 25 bp, Mus musculus
tacaacatccttaacgcagccgaga

SEQ ID NO: 758095 - DNA, 25 bp, Mus musculus
tacaacatcctttacgcagccgaga

SEQ ID NO: 758096 - DNA, 25 bp, Mus musculus
tacaacatgggtacacttagttcct

SEQ ID NO: 758097 - DNA, 25 bp, Mus musculus
tacaacatgggttcacttagttcct

SEQ ID NO: 758098 - DNA, 25 bp, Mus musculus
tacaacatttaaaaacagggaccat

SEQ ID NO: 758099 - DNA, 25 bp, Mus musculus
tacaacatttaataacagggaccat

SEQ ID NO: 758100 - DNA, 25 bp, Mus musculus
tacaacatttacatccagcagactg

SEQ ID NO: 758101 - DNA, 25 bp, Mus musculus
tacaacatttacttccagcagactg

SEQ ID NO: 758102 - DNA, 25 bp, Mus musculus
tacaacattttactgggactttcaa

SEQ ID NO: 758103 - DNA, 25 bp, Mus musculus
tacaacattttagtgggactttcaa

SEQ ID NO: 758104 - DNA, 25 bp, Mus musculus
tacaaccaagcacccaatttacaat

SEQ ID NO: 758105 - DNA, 25 bp, Mus musculus
tacaaccaagcagccaatttacaat

SEQ ID NO: 758106 - DNA, 25 bp, Mus musculus
tacaaccacggcatttgatcctttc

SEQ ID NO: 758107 - DNA, 25 bp, Mus musculus
tacaaccacggcttttgatcctttc

SEQ ID NO: 758108 - DNA, 25 bp, Mus musculus
tacaaccagaagatccgagagctgt

SEQ ID NO: 758109 - DNA, 25 bp, Mus musculus
tacaaccagaagttccgagagctgt

SEQ ID NO: 758110 - DNA, 25 bp, Mus musculus
tacaaccagcatatgagtggcaagt

SEQ ID NO: 758111 - DNA, 25 bp, Mus musculus
tacaaccagcatttgagtggcaagt

SEQ ID NO: 758112 - DNA, 25 bp, Mus musculus
tacaaccagcgtcattatgatgaag

SEQ ID NO: 758113 - DNA, 25 bp, Mus musculus
tacaaccagcgtgattatgatgaag

SEQ ID NO: 758114 - DNA, 25 bp, Mus musculus
tacaaccatcacatacatgctacac

SEQ ID NO: 758115 - DNA, 25 bp, Mus musculus
tacaaccatcacttacatgctacac

SEQ ID NO: 758116 - DNA, 25 bp, Mus musculus
tacaaccccaatatccttagtttct

SEQ ID NO: 758117 - DNA, 25 bp, Mus musculus
tacaaccccaatttccttagtttct

SEQ ID NO: 758118 - DNA, 25 bp, Mus musculus
tacaacccctgtatttacgtggctg

SEQ ID NO: 758119 - DNA, 25 bp, Mus musculus
tacaacccctgtttttacgtggctg

SEQ ID NO: 758120 - DNA, 25 bp, Mus musculus
tacaacccgtctattcagttgacgt

SEQ ID NO: 758121 - DNA, 25 bp, Mus musculus
tacaacccgtcttttcagttgacgt

SEQ ID NO: 758122 - DNA, 25 bp, Mus musculus
tacaaccctaaccaggctacaacta

SEQ ID NO: 758123 - DNA, 25 bp, Mus musculus
tacaaccctaacgaggctacaacta

SEQ ID NO: 758124 - DNA, 25 bp, Mus musculus
tacaaccctataacccagtacttgg

SEQ ID NO: 758125 - DNA, 25 bp, Mus musculus
tacaaccctatatcccagtacttgg

SEQ ID NO: 758126 - DNA, 25 bp, Mus musculus
tacaaccctcacagacttgactagc

SEQ ID NO: 758127 - DNA, 25 bp, Mus musculus
tacaaccctcactgacttgactagc

SEQ ID NO: 758128 - DNA, 25 bp, Mus musculus
tacaaccctgcgactgatagactta

SEQ ID NO: 758129 - DNA, 25 bp, Mus musculus
tacaaccctgcgtctgatagactta

SEQ ID NO: 758130 - DNA, 25 bp, Mus musculus
tacaaccgattcatgaacccagatg

SEQ ID NO: 758131 - DNA, 25 bp, Mus musculus
tacaaccgattcttgaacccagatg

SEQ ID NO: 758132 - DNA, 25 bp, Mus musculus
tacaaccgtcagctcggccagggag

SEQ ID NO: 758133 - DNA, 25 bp, Mus musculus
tacaaccgtcaggtcggccagggag

SEQ ID NO: 758134 - DNA, 25 bp, Mus musculus
tacaacctcaaacgtctgggaccct

SEQ ID NO: 758135 - DNA, 25 bp, Mus musculus
tacaacctcaaaggtctgggaccct

SEQ ID NO: 758136 - DNA, 25 bp, Mus musculus
tacaacctcaggaactactacttta

SEQ ID NO: 758137 - DNA, 25 bp, Mus musculus
tacaacctcaggtactactacttta

SEQ ID NO: 758138 - DNA, 25 bp, Mus musculus
tacaacctcttgcaatgtacttcaa

SEQ ID NO: 758139 - DNA, 25 bp, Mus musculus
tacaacctcttggaatgtacttcaa

SEQ ID NO: 758140 - DNA, 25 bp, Mus musculus
tacaacctgctgctgctagaaaatg

SEQ ID NO: 758141 - DNA, 25 bp, Mus musculus
tacaacctgctggtgctagaaaatg

SEQ ID NO: 758142 - DNA, 25 bp, Mus musculus
tacaacctgcttagaatttctaagt

SEQ ID NO: 758143 - DNA, 25 bp, Mus musculus
tacaacctgctttgaatttctaagt

SEQ ID NO: 758144 - DNA, 25 bp, Mus musculus
tacaacctgtacacagctacagtgt

SEQ ID NO: 758145 - DNA, 25 bp, Mus musculus
tacaacctgtactcagctacagtgt

SEQ ID NO: 758146 - DNA, 25 bp, Mus musculus
tacaaccttgccatcgagagtgcct

SEQ ID NO: 758147 - DNA, 25 bp, Mus musculus
tacaaccttgccttcgagagtgcct

SEQ ID NO: 758148 - DNA, 25 bp, Mus musculus
tacaacctttccagcgctgagcagc

SEQ ID NO: 758149 - DNA, 25 bp, Mus musculus
tacaacctttcctgcgctgagcagc

SEQ ID NO: 758150 - DNA, 25 bp, Mus musculus
tacaacgagatcagtagagacgtgt

SEQ ID NO: 758151 - DNA, 25 bp, Mus musculus
tacaacgagatctgtagagacgtgt

SEQ ID NO: 758152 - DNA, 25 bp, Mus musculus
tacaacgccattatttctgaatgtg

SEQ ID NO: 758153 - DNA, 25 bp, Mus musculus
tacaacgccattttttctgaatgtg

SEQ ID NO: 758154 - DNA, 25 bp, Mus musculus
tacaacgccctgattagtagtgaca

SEQ ID NO: 758155 - DNA, 25 bp, Mus musculus
tacaacgccctgtttagtagtgaca

SEQ ID NO: 758156 - DNA, 25 bp, Mus musculus
tacaacgtccacaataacggtctgg

SEQ ID NO: 758157 - DNA, 25 bp, Mus musculus
tacaacgtccactataacggtctgg

SEQ ID NO: 758158 - DNA, 25 bp, Mus musculus
tacaacgtggtgcttttcctggaga

SEQ ID NO: 758159 - DNA, 25 bp, Mus musculus
tacaacgtggtggttttcctggaga

SEQ ID NO: 758160 - DNA, 25 bp, Mus musculus
tacaacgtgtagacggttccctgtt

SEQ ID NO: 758161 - DNA, 25 bp, Mus musculus
tacaacgtgtagtcggttccctgtt

SEQ ID NO: 758162 - DNA, 25 bp, Mus musculus
tacaacgtgtgtcgagcagatggct

SEQ ID NO: 758163 - DNA, 25 bp, Mus musculus
tacaacgtgtgtggagcagatggct

SEQ ID NO: 758164 - DNA, 25 bp, Mus musculus
tacaacgtttgcatgggagggacca

SEQ ID NO: 758165 - DNA, 25 bp, Mus musculus
tacaacgtttgcttgggagggacca

SEQ ID NO: 758166 - DNA, 25 bp, Mus musculus
tacaacgttttcatttttattcaag

SEQ ID NO: 758167 - DNA, 25 bp, Mus musculus
tacaacgttttcttttttattcaag

SEQ ID NO: 758168 - DNA, 25 bp, Mus musculus
tacaactaaaccaaacagacctact

SEQ ID NO: 758169 - DNA, 25 bp, Mus musculus
tacaactaaacctaacagacctact

SEQ ID NO: 758170 - DNA, 25 bp, Mus musculus
tacaactaccttcctgatgggcaag

SEQ ID NO: 758171 - DNA, 25 bp, Mus musculus
tacaactaccttgctgatgggcaag

SEQ ID NO: 758172 - DNA, 25 bp, Mus musculus
tacaactacgttcaagggacagcac

SEQ ID NO: 758173 - DNA, 25 bp, Mus musculus
tacaactacgttgaagggacagcac

SEQ ID NO: 758174 - DNA, 25 bp, Mus musculus
tacaactagggcagcgggtcccttc

SEQ ID NO: 758175 - DNA, 25 bp, Mus musculus
tacaactagggctgcgggtcccttc

SEQ ID NO: 758176 - DNA, 25 bp, Mus musculus
tacaactatactcgaggctgatgca

SEQ ID NO: 758177 - DNA, 25 bp, Mus musculus
tacaactatactggaggctgatgca

SEQ ID NO: 758178 - DNA, 25 bp, Mus musculus
tacaactcaggcatgcctcaaattc

SEQ ID NO: 758179 - DNA, 25 bp, Mus musculus
tacaactcaggcttgcctcaaattc

SEQ ID NO: 758180 - DNA, 25 bp, Mus musculus
tacaactcggacagggataacagct

SEQ ID NO: 758181 - DNA, 25 bp, Mus musculus
tacaactcggactgggataacagct

SEQ ID NO: 758182 - DNA, 25 bp, Mus musculus
tacaactcggagatggagcgttacc

SEQ ID NO: 758183 - DNA, 25 bp, Mus musculus
tacaactcggagttggagcgttacc

SEQ ID NO: 758184 - DNA, 25 bp, Mus musculus
tacaactctagtccctacaaaaagc

SEQ ID NO: 758185 - DNA, 25 bp, Mus musculus
tacaactctagtgcctacaaaaagc

SEQ ID NO: 758186 - DNA, 25 bp, Mus musculus
tacaactgaaatcccctgtaagggt

SEQ ID NO: 758187 - DNA, 25 bp, Mus musculus
tacaactgaaatgccctgtaagggt

SEQ ID NO: 758188 - DNA, 25 bp, Mus musculus
tacaactgaagccacccgggaaaga

SEQ ID NO: 758189 - DNA, 25 bp, Mus musculus
tacaactgaagcgacccgggaaaga

SEQ ID NO: 758190 - DNA, 25 bp, Mus musculus
tacaactgagccaaaaaagccaaga

SEQ ID NO: 758191 - DNA, 25 bp, Mus musculus
tacaactgagcctaaaaagccaaga

SEQ ID NO: 758192 - DNA, 25 bp, Mus musculus
tacaactgcatacagcacttgggat

SEQ ID NO: 758193 - DNA, 25 bp, Mus musculus
tacaactgcatagagcacttgggat

SEQ ID NO: 758194 - DNA, 25 bp, Mus musculus
tacaactgctctaggaatctgggcc

SEQ ID NO: 758195 - DNA, 25 bp, Mus musculus
tacaactgctcttggaatctgggcc

SEQ ID NO: 758196 - DNA, 25 bp, Mus musculus
tacaactgcttaactattcctgacc

SEQ ID NO: 758197 - DNA, 25 bp, Mus musculus
tacaactgcttatctattcctgacc

SEQ ID NO: 758198 - DNA, 25 bp, Mus musculus
tacaactgctttctggactgtacga

SEQ ID NO: 758199 - DNA, 25 bp, Mus musculus
tacaactgctttgtggactgtacga

SEQ ID NO: 758200 - DNA, 25 bp, Mus musculus
tacaactggatgacccttttcaggg

SEQ ID NO: 758201 - DNA, 25 bp, Mus musculus
tacaactggatgtcccttttcaggg

SEQ ID NO: 758202 - DNA, 25 bp, Mus musculus
tacaactggttgactcactttcctg

SEQ ID NO: 758203 - DNA, 25 bp, Mus musculus
tacaactggttgtctcactttcctg

SEQ ID NO: 758204 - DNA, 25 bp, Mus musculus
tacaactgtattacatcccagggct

SEQ ID NO: 758205 - DNA, 25 bp, Mus musculus
tacaactgtatttcatcccagggct

SEQ ID NO: 758206 - DNA, 25 bp, Mus musculus
tacaactgtcaaaaaggctctttct

SEQ ID NO: 758207 - DNA, 25 bp, Mus musculus
tacaactgtcaataaggctctttct

SEQ ID NO: 758208 - DNA, 25 bp, Mus musculus
tacaactgtcatagccctgtgtctg

SEQ ID NO: 758209 - DNA, 25 bp, Mus musculus
tacaactgtcattgccctgtgtctg

SEQ ID NO: 758210 - DNA, 25 bp, Mus musculus
tacaactgttaaacttcttgcctca

SEQ ID NO: 758211 - DNA, 25 bp, Mus musculus
tacaactgttaatcttcttgcctca

SEQ ID NO: 758212 - DNA, 25 bp, Mus musculus
tacaactgtttgacccttagagggc

SEQ ID NO: 758213 - DNA, 25 bp, Mus musculus
tacaactgtttgtcccttagagggc

SEQ ID NO: 758214 - DNA, 25 bp, Mus musculus
tacaacttactgctcatgctagtga

SEQ ID NO: 758215 - DNA, 25 bp, Mus musculus
tacaacttactggtcatgctagtga

SEQ ID NO: 758216 - DNA, 25 bp, Mus musculus
tacaacttcagaacggtttccgtgt

SEQ ID NO: 758217 - DNA, 25 bp, Mus musculus
tacaacttcagatcggtttccgtgt

SEQ ID NO: 758218 - DNA, 25 bp, Mus musculus
tacaacttcgccagagacgtgttgc

SEQ ID NO: 758219 - DNA, 25 bp, Mus musculus
tacaacttcgcctgagacgtgttgc

SEQ ID NO: 758220 - DNA, 25 bp, Mus musculus
tacaacttgatcaaagctccagcaa

SEQ ID NO: 758221 - DNA, 25 bp, Mus musculus
tacaacttgatctaagctccagcaa

SEQ ID NO: 758222 - DNA, 25 bp, Mus musculus
tacaactttgatcactgtaccttgt

SEQ ID NO: 758223 - DNA, 25 bp, Mus musculus
tacaactttgatgactgtaccttgt

SEQ ID NO: 758224 - DNA, 25 bp, Mus musculus
tacaactttttcactatcagcgatg

SEQ ID NO: 758225 - DNA, 25 bp, Mus musculus
tacaactttttctctatcagcgatg

SEQ ID NO: 758226 - DNA, 25 bp, Mus musculus
tacaagaaacatacctcagcaacaa

SEQ ID NO: 758227 - DNA, 25 bp, Mus musculus
tacaagaaacattcctcagcaacaa

SEQ ID NO: 758228 - DNA, 25 bp, Mus musculus
tacaagaaatctccaacccatccat

SEQ ID NO: 758229 - DNA, 25 bp, Mus musculus
tacaagaaatctgcaacccatccat

SEQ ID NO: 758230 - DNA, 25 bp, Mus musculus
tacaagaaggatccggtcctctacg

SEQ ID NO: 758231 - DNA, 25 bp, Mus musculus
tacaagaaggatgcggtcctctacg

SEQ ID NO: 758232 - DNA, 25 bp, Mus musculus
tacaagaaggtgaccccttaacctg

SEQ ID NO: 758233 - DNA, 25 bp, Mus musculus
tacaagaaggtgtccccttaacctg

SEQ ID NO: 758234 - DNA, 25 bp, Mus musculus
tacaagaattaaccaacctgatcag

SEQ ID NO: 758235 - DNA, 25 bp, Mus musculus
tacaagaattaagcaacctgatcag

SEQ ID NO: 758236 - DNA, 25 bp, Mus musculus
tacaagacagtccagttccaccagg

SEQ ID NO: 758237 - DNA, 25 bp, Mus musculus
tacaagacagtcgagttccaccagg

SEQ ID NO: 758238 - DNA, 25 bp, Mus musculus
tacaagacattaaagagcaccggaa

SEQ ID NO: 758239 - DNA, 25 bp, Mus musculus
tacaagacattatagagcaccggaa

SEQ ID NO: 758240 - DNA, 25 bp, Mus musculus
tacaagaccttccatcctagaagct

SEQ ID NO: 758241 - DNA, 25 bp, Mus musculus
tacaagaccttcgatcctagaagct

SEQ ID NO: 758242 - DNA, 25 bp, Mus musculus
tacaagacgagacggccaaggccaa

SEQ ID NO: 758243 - DNA, 25 bp, Mus musculus
tacaagacgagagggccaaggccaa

SEQ ID NO: 758244 - DNA, 25 bp, Mus musculus
tacaagactgtactctgtccatcgg

SEQ ID NO: 758245 - DNA, 25 bp, Mus musculus
tacaagactgtagtctgtccatcgg

SEQ ID NO: 758246 - DNA, 25 bp, Mus musculus
tacaagagactcaggtcgggcaagg

SEQ ID NO: 758247 - DNA, 25 bp, Mus musculus
tacaagagactctggtcgggcaagg

SEQ ID NO: 758248 - DNA, 25 bp, Mus musculus
tacaagagagctccagtcgcctgac

SEQ ID NO: 758249 - DNA, 25 bp, Mus musculus
tacaagagagctgcagtcgcctgac

SEQ ID NO: 758250 - DNA, 25 bp, Mus musculus
tacaagagagtcagcaagagaattt

SEQ ID NO: 758251 - DNA, 25 bp, Mus musculus
tacaagagagtctgcaagagaattt

SEQ ID NO: 758252 - DNA, 25 bp, Mus musculus
tacaagagatctcggcgcgtgacac

SEQ ID NO: 758253 - DNA, 25 bp, Mus musculus
tacaagagatctgggcgcgtgacac

SEQ ID NO: 758254 - DNA, 25 bp, Mus musculus
tacaagagcctcaccgaataactgc

SEQ ID NO: 758255 - DNA, 25 bp, Mus musculus
tacaagagcctctccgaataactgc

SEQ ID NO: 758256 - DNA, 25 bp, Mus musculus
tacaagaggctaatccagactcatt

SEQ ID NO: 758257 - DNA, 25 bp, Mus musculus
tacaagaggctattccagactcatt

SEQ ID NO: 758258 - DNA, 25 bp, Mus musculus
tacaagagtgttcgcgccaagtcag

SEQ ID NO: 758259 - DNA, 25 bp, Mus musculus
tacaagagtgttggcgccaagtcag

SEQ ID NO: 758260 - DNA, 25 bp, Mus musculus
tacaagatgcggactgtgtacgctc

SEQ ID NO: 758261 - DNA, 25 bp, Mus musculus
tacaagatgcggtctgtgtacgctc

SEQ ID NO: 758262 - DNA, 25 bp, Mus musculus
tacaagatggcactggtttcaacaa

SEQ ID NO: 758263 - DNA, 25 bp, Mus musculus
tacaagatggcagtggtttcaacaa

SEQ ID NO: 758264 - DNA, 25 bp, Mus musculus
tacaagatgtgtacctccattctca

SEQ ID NO: 758265 - DNA, 25 bp, Mus musculus
tacaagatgtgttcctccattctca

SEQ ID NO: 758266 - DNA, 25 bp, Mus musculus
tacaagatgtttcatggctgcctgg

SEQ ID NO: 758267 - DNA, 25 bp, Mus musculus
tacaagatgtttgatggctgcctgg

SEQ ID NO: 758268 - DNA, 25 bp, Mus musculus
tacaagattagcacaggatggcaat

SEQ ID NO: 758269 - DNA, 25 bp, Mus musculus
tacaagattagctcaggatggcaat

SEQ ID NO: 758270 - DNA, 25 bp, Mus musculus
tacaagattctacgtggttccgtcc

SEQ ID NO: 758271 - DNA, 25 bp, Mus musculus
tacaagattctaggtggttccgtcc

SEQ ID NO: 758272 - DNA, 25 bp, Mus musculus
tacaagcaactgatgcgctcgcgaa

SEQ ID NO: 758273 - DNA, 25 bp, Mus musculus
tacaagcaactgttgcgctcgcgaa

SEQ ID NO: 758274 - DNA, 25 bp, Mus musculus
tacaagcaacttccatggcctctcg

SEQ ID NO: 758275 - DNA, 25 bp, Mus musculus
tacaagcaacttgcatggcctctcg

SEQ ID NO: 758276 - DNA, 25 bp, Mus musculus
tacaagcaattgatccacaccagat

SEQ ID NO: 758277 - DNA, 25 bp, Mus musculus
tacaagcaattgttccacaccagat

SEQ ID NO: 758278 - DNA, 25 bp, Mus musculus
tacaagcaccttcaggatgctcagt

SEQ ID NO: 758279 - DNA, 25 bp, Mus musculus
tacaagcaccttgaggatgctcagt

SEQ ID NO: 758280 - DNA, 25 bp, Mus musculus
tacaagcactgtcccataattaaga

SEQ ID NO: 758281 - DNA, 25 bp, Mus musculus
tacaagcactgtgccataattaaga

SEQ ID NO: 758282 - DNA, 25 bp, Mus musculus
tacaagcagctgcacaccggcatta

SEQ ID NO: 758283 - DNA, 25 bp, Mus musculus
tacaagcagctggacaccggcatta

SEQ ID NO: 758284 - DNA, 25 bp, Mus musculus
tacaagcatgcaagggtctactagc

SEQ ID NO: 758285 - DNA, 25 bp, Mus musculus
tacaagcatgcatgggtctactagc

SEQ ID NO: 758286 - DNA, 25 bp, Mus musculus
tacaagcatgcgagccaggcgtggt

SEQ ID NO: 758287 - DNA, 25 bp, Mus musculus
tacaagcatgcgtgccaggcgtggt

SEQ ID NO: 758288 - DNA, 25 bp, Mus musculus
tacaagcatggacaccacacagtct

SEQ ID NO: 758289 - DNA, 25 bp, Mus musculus
tacaagcatggagaccacacagtct

SEQ ID NO: 758290 - DNA, 25 bp, Mus musculus
tacaagccacatcacttgagcttgg

SEQ ID NO: 758291 - DNA, 25 bp, Mus musculus
tacaagccacatgacttgagcttgg

SEQ ID NO: 758292 - DNA, 25 bp, Mus musculus
tacaagccacggactctgattacgt

SEQ ID NO: 758293 - DNA, 25 bp, Mus musculus
tacaagccacggtctctgattacgt

SEQ ID NO: 758294 - DNA, 25 bp, Mus musculus
tacaagccaggtccgctgacattcc

SEQ ID NO: 758295 - DNA, 25 bp, Mus musculus
tacaagccaggtgcgctgacattcc

SEQ ID NO: 758296 - DNA, 25 bp, Mus musculus
tacaagccatgcctacccacggaga

SEQ ID NO: 758297 - DNA, 25 bp, Mus musculus
tacaagccatgcgtacccacggaga

SEQ ID NO: 758298 - DNA, 25 bp, Mus musculus
tacaagcccagtcgctgtcttacag

SEQ ID NO: 758299 - DNA, 25 bp, Mus musculus
tacaagcccagtggctgtcttacag

SEQ ID NO: 758300 - DNA, 25 bp, Mus musculus
tacaagccgctaacatccacaggat

SEQ ID NO: 758301 - DNA, 25 bp, Mus musculus
tacaagccgctatcatccacaggat

SEQ ID NO: 758302 - DNA, 25 bp, Mus musculus
tacaagccggtgcacctgagcaaag

SEQ ID NO: 758303 - DNA, 25 bp, Mus musculus
tacaagccggtggacctgagcaaag

SEQ ID NO: 758304 - DNA, 25 bp, Mus musculus
tacaagcctatcatgcagaccacag

SEQ ID NO: 758305 - DNA, 25 bp, Mus musculus
tacaagcctatcttgcagaccacag

SEQ ID NO: 758306 - DNA, 25 bp, Mus musculus
tacaagcctcaacacccaaattcgg

SEQ ID NO: 758307 - DNA, 25 bp, Mus musculus
tacaagcctcaagacccaaattcgg

SEQ ID NO: 758308 - DNA, 25 bp, Mus musculus
tacaagcctgccaggtaccctgtga

SEQ ID NO: 758309 - DNA, 25 bp, Mus musculus
tacaagcctgcctggtaccctgtga

SEQ ID NO: 758310 - DNA, 25 bp, Mus musculus
tacaagcctgggaagagcctctgaa

SEQ ID NO: 758311 - DNA, 25 bp, Mus musculus
tacaagcctgggtagagcctctgaa

SEQ ID NO: 758312 - DNA, 25 bp, Mus musculus
tacaagccttctaacttatttgaat

SEQ ID NO: 758313 - DNA, 25 bp, Mus musculus
tacaagccttcttacttatttgaat

SEQ ID NO: 758314 - DNA, 25 bp, Mus musculus
tacaagcgagaaatcactgtgactt

SEQ ID NO: 758315 - DNA, 25 bp, Mus musculus
tacaagcgagaattcactgtgactt

SEQ ID NO: 758316 - DNA, 25 bp, Mus musculus
tacaagcgaggtctccggaaccaaa

SEQ ID NO: 758317 - DNA, 25 bp, Mus musculus
tacaagcgaggtgtccggaaccaaa

SEQ ID NO: 758318 - DNA, 25 bp, Mus musculus
tacaagcgtcttccccggaactagc

SEQ ID NO: 758319 - DNA, 25 bp, Mus musculus
tacaagcgtcttgcccggaactagc

SEQ ID NO: 758320 - DNA, 25 bp, Mus musculus
tacaagcgtgagcagtgccacccta

SEQ ID NO: 758321 - DNA, 25 bp, Mus musculus
tacaagcgtgaggagtgccacccta

SEQ ID NO: 758322 - DNA, 25 bp, Mus musculus
tacaagctcccactcagcaaagtca

SEQ ID NO: 758323 - DNA, 25 bp, Mus musculus
tacaagctcccagtcagcaaagtca

SEQ ID NO: 758324 - DNA, 25 bp, Mus musculus
tacaagctctaacgtgcatgaaccc

SEQ ID NO: 758325 - DNA, 25 bp, Mus musculus
tacaagctctaaggtgcatgaaccc

SEQ ID NO: 758326 - DNA, 25 bp, Mus musculus
tacaagctctgtccaacaggataaa

SEQ ID NO: 758327 - DNA, 25 bp, Mus musculus
tacaagctctgtgcaacaggataaa

SEQ ID NO: 758328 - DNA, 25 bp, Mus musculus
tacaagctggccactgtcctatact

SEQ ID NO: 758329 - DNA, 25 bp, Mus musculus
tacaagctggcctctgtcctatact

SEQ ID NO: 758330 - DNA, 25 bp, Mus musculus
tacaagctggtgccccaccaaatgg

SEQ ID NO: 758331 - DNA, 25 bp, Mus musculus
tacaagctggtggcccaccaaatgg

SEQ ID NO: 758332 - DNA, 25 bp, Mus musculus
tacaagcttcagatcccaacatcaa

SEQ ID NO: 758333 - DNA, 25 bp, Mus musculus
tacaagcttcagttcccaacatcaa

SEQ ID NO: 758334 - DNA, 25 bp, Mus musculus
tacaagcttccaagattctcctatc

SEQ ID NO: 758335 - DNA, 25 bp, Mus musculus
tacaagcttccatgattctcctatc

SEQ ID NO: 758336 - DNA, 25 bp, Mus musculus
tacaagcttcttctgatcgttgtgg

SEQ ID NO: 758337 - DNA, 25 bp, Mus musculus
tacaagcttcttgtgatcgttgtgg

SEQ ID NO: 758338 - DNA, 25 bp, Mus musculus
tacaaggaagaaaccaggctggcca

SEQ ID NO: 758339 - DNA, 25 bp, Mus musculus
tacaaggaagaatccaggctggcca

SEQ ID NO: 758340 - DNA, 25 bp, Mus musculus
tacaaggactaccaagtagcaactt

SEQ ID NO: 758341 - DNA, 25 bp, Mus musculus
tacaaggactacgaagtagcaactt

SEQ ID NO: 758342 - DNA, 25 bp, Mus musculus
tacaaggagatgacccagctgaagt

SEQ ID NO: 758343 - DNA, 25 bp, Mus musculus
tacaaggagatgtcccagctgaagt

SEQ ID NO: 758344 - DNA, 25 bp, Mus musculus
tacaaggagctacgcttccagggct

SEQ ID NO: 758345 - DNA, 25 bp, Mus musculus
tacaaggagctaggcttccagggct

SEQ ID NO: 758346 - DNA, 25 bp, Mus musculus
tacaaggatagcctccagatctgtg

SEQ ID NO: 758347 - DNA, 25 bp, Mus musculus
tacaaggatagcgtccagatctgtg

SEQ ID NO: 758348 - DNA, 25 bp, Mus musculus
tacaaggatagtcctgtgcgcagcc

SEQ ID NO: 758349 - DNA, 25 bp, Mus musculus
tacaaggatagtgctgtgcgcagcc

SEQ ID NO: 758350 - DNA, 25 bp, Mus musculus
tacaaggatgaacattgaccctgac

SEQ ID NO: 758351 - DNA, 25 bp, Mus musculus
tacaaggatgaagattgaccctgac

SEQ ID NO: 758352 - DNA, 25 bp, Mus musculus
tacaaggattttaacccgctgctct

SEQ ID NO: 758353 - DNA, 25 bp, Mus musculus
tacaaggatttttacccgctgctct

SEQ ID NO: 758354 - DNA, 25 bp, Mus musculus
tacaaggcagctcgtcaggcagaga

SEQ ID NO: 758355 - DNA, 25 bp, Mus musculus
tacaaggcagctggtcaggcagaga

SEQ ID NO: 758356 - DNA, 25 bp, Mus musculus
tacaaggcatacagcaccatcactt

SEQ ID NO: 758357 - DNA, 25 bp, Mus musculus
tacaaggcatactgcaccatcactt

SEQ ID NO: 758358 - DNA, 25 bp, Mus musculus
tacaaggccagtccagttacacagt

SEQ ID NO: 758359 - DNA, 25 bp, Mus musculus
tacaaggccagtgcagttacacagt

SEQ ID NO: 758360 - DNA, 25 bp, Mus musculus
tacaaggccatcatgcggaaccgga

SEQ ID NO: 758361 - DNA, 25 bp, Mus musculus
tacaaggccatcttgcggaaccgga

SEQ ID NO: 758362 - DNA, 25 bp, Mus musculus
tacaaggcccaaagctctgcttgcc

SEQ ID NO: 758363 - DNA, 25 bp, Mus musculus
tacaaggcccaatgctctgcttgcc

SEQ ID NO: 758364 - DNA, 25 bp, Mus musculus
tacaaggcccctcacatcagttgat

SEQ ID NO: 758365 - DNA, 25 bp, Mus musculus
tacaaggcccctgacatcagttgat

SEQ ID NO: 758366 - DNA, 25 bp, Mus musculus
tacaaggccgttcagaataatctct

SEQ ID NO: 758367 - DNA, 25 bp, Mus musculus
tacaaggccgttgagaataatctct

SEQ ID NO: 758368 - DNA, 25 bp, Mus musculus
tacaaggcctacctgaaggcctctc

SEQ ID NO: 758369 - DNA, 25 bp, Mus musculus
tacaaggcctacgtgaaggcctctc

SEQ ID NO: 758370 - DNA, 25 bp, Mus musculus
tacaaggcctttcggcgtctcatgg

SEQ ID NO: 758371 - DNA, 25 bp, Mus musculus
tacaaggcctttgggcgtctcatgg

SEQ ID NO: 758372 - DNA, 25 bp, Mus musculus
tacaaggctatcatcattagactga

SEQ ID NO: 758373 - DNA, 25 bp, Mus musculus
tacaaggctatcttcattagactga

SEQ ID NO: 758374 - DNA, 25 bp, Mus musculus
tacaagggaccactacaactctact

SEQ ID NO: 758375 - DNA, 25 bp, Mus musculus
tacaagggaccagtacaactctact

SEQ ID NO: 758376 - DNA, 25 bp, Mus musculus
tacaagggcaacatctcagagacaa

SEQ ID NO: 758377 - DNA, 25 bp, Mus musculus
tacaagggcaacttctcagagacaa

SEQ ID NO: 758378 - DNA, 25 bp, Mus musculus
tacaagggcaagaaatacaagcccc

SEQ ID NO: 758379 - DNA, 25 bp, Mus musculus
tacaagggcaagtaatacaagcccc

SEQ ID NO: 758380 - DNA, 25 bp, Mus musculus
tacaagggctcgagtctatgggaca

SEQ ID NO: 758381 - DNA, 25 bp, Mus musculus
tacaagggctcgtgtctatgggaca

SEQ ID NO: 758382 - DNA, 25 bp, Mus musculus
tacaagggctgtaccgagctcacat

SEQ ID NO: 758383 - DNA, 25 bp, Mus musculus
tacaagggctgttccgagctcacat

SEQ ID NO: 758384 - DNA, 25 bp, Mus musculus
tacaagggtaacagacgtcctggtt

SEQ ID NO: 758385 - DNA, 25 bp, Mus musculus
tacaagggtaactgacgtcctggtt

SEQ ID NO: 758386 - DNA, 25 bp, Mus musculus
tacaaggtaagcaaggttgcccact

SEQ ID NO: 758387 - DNA, 25 bp, Mus musculus
tacaaggtaagctaggttgcccact

SEQ ID NO: 758388 - DNA, 25 bp, Mus musculus
tacaaggtacatcctatttcacccc

SEQ ID NO: 758389 - DNA, 25 bp, Mus musculus
tacaaggtacatgctatttcacccc

SEQ ID NO: 758390 - DNA, 25 bp, Mus musculus
tacaaggtcagcaactacagcagag

SEQ ID NO: 758391 - DNA, 25 bp, Mus musculus
tacaaggtcagctactacagcagag

SEQ ID NO: 758392 - DNA, 25 bp, Mus musculus
tacaaggtcatgacgggctcaccat

SEQ ID NO: 758393 - DNA, 25 bp, Mus musculus
tacaaggtcatgtcgggctcaccat

SEQ ID NO: 758394 - DNA, 25 bp, Mus musculus
tacaaggtctgcaatctgtgccaca

SEQ ID NO: 758395 - DNA, 25 bp, Mus musculus
tacaaggtctgctatctgtgccaca

SEQ ID NO: 758396 - DNA, 25 bp, Mus musculus
tacaaggtgcgcagtcgttggttag

SEQ ID NO: 758397 - DNA, 25 bp, Mus musculus
tacaaggtgcgcctcagctctgggc

SEQ ID NO: 758398 - DNA, 25 bp, Mus musculus
tacaaggtgcgcgtcagctctgggc

SEQ ID NO: 758399 - DNA, 25 bp, Mus musculus
tacaaggtgcgctgtcgttggttag

SEQ ID NO: 758400 - DNA, 25 bp, Mus musculus
tacaaggtggacagtgcatgcctca

SEQ ID NO: 758401 - DNA, 25 bp, Mus musculus
tacaaggtggactgtgcatgcctca

SEQ ID NO: 758402 - DNA, 25 bp, Mus musculus
tacaaggtggtgattgcttaaatta

SEQ ID NO: 758403 - DNA, 25 bp, Mus musculus
tacaaggtggtgtttgcttaaatta

SEQ ID NO: 758404 - DNA, 25 bp, Mus musculus
tacaaggttcaaaacaagacttcaa

SEQ ID NO: 758405 - DNA, 25 bp, Mus musculus
tacaaggttcaatacaagacttcaa

SEQ ID NO: 758406 - DNA, 25 bp, Mus musculus
tacaaggttggcatcaaatacagag

SEQ ID NO: 758407 - DNA, 25 bp, Mus musculus
tacaaggttggcttcaaatacagag

SEQ ID NO: 758408 - DNA, 25 bp, Mus musculus
tacaaggtttcactaaccacctggg

SEQ ID NO: 758409 - DNA, 25 bp, Mus musculus
tacaaggtttcagtaaccacctggg

SEQ ID NO: 758410 - DNA, 25 bp, Mus musculus
tacaaggttttgctgaccggccatc

SEQ ID NO: 758411 - DNA, 25 bp, Mus musculus
tacaaggttttggtgaccggccatc

SEQ ID NO: 758412 - DNA, 25 bp, Mus musculus
tacaagtaagaacctgcacaccaag

SEQ ID NO: 758413 - DNA, 25 bp, Mus musculus
tacaagtaagaagctgcacaccaag

SEQ ID NO: 758414 - DNA, 25 bp, Mus musculus
tacaagtagtacagatggcctcaag

SEQ ID NO: 758415 - DNA, 25 bp, Mus musculus
tacaagtagtactgatggcctcaag

SEQ ID NO: 758416 - DNA, 25 bp, Mus musculus
tacaagtatagtcactgatcctggg

SEQ ID NO: 758417 - DNA, 25 bp, Mus musculus
tacaagtatagtgactgatcctggg

SEQ ID NO: 758418 - DNA, 25 bp, Mus musculus
tacaagtatgtgatgaagcccacct

SEQ ID NO: 758419 - DNA, 25 bp, Mus musculus
tacaagtatgtgttgaagcccacct

SEQ ID NO: 758420 - DNA, 25 bp, Mus musculus
tacaagtcaactacccaagatcaat

SEQ ID NO: 758421 - DNA, 25 bp, Mus musculus
tacaagtcaacttcccaagatcaat

SEQ ID NO: 758422 - DNA, 25 bp, Mus musculus
tacaagtcacccaatacaaaccaac

SEQ ID NO: 758423 - DNA, 25 bp, Mus musculus
tacaagtcaccctatacaaaccaac

SEQ ID NO: 758424 - DNA, 25 bp, Mus musculus
tacaagtcactgagcaacactaccc

SEQ ID NO: 758425 - DNA, 25 bp, Mus musculus
tacaagtcactgtgcaacactaccc

SEQ ID NO: 758426 - DNA, 25 bp, Mus musculus
tacaagtcatagacctttgtctgca

SEQ ID NO: 758427 - DNA, 25 bp, Mus musculus
tacaagtcatagtcctttgtctgca

SEQ ID NO: 758428 - DNA, 25 bp, Mus musculus
tacaagtcatttctgccaggaggca

SEQ ID NO: 758429 - DNA, 25 bp, Mus musculus
tacaagtcatttgtgccaggaggca

SEQ ID NO: 758430 - DNA, 25 bp, Mus musculus
tacaagtcccaactatacacccacc

SEQ ID NO: 758431 - DNA, 25 bp, Mus musculus
tacaagtcccaagtatacacccacc

SEQ ID NO: 758432 - DNA, 25 bp, Mus musculus
tacaagtcccatcatcaagagcaac

SEQ ID NO: 758433 - DNA, 25 bp, Mus musculus
tacaagtcccatgatcaagagcaac

SEQ ID NO: 758434 - DNA, 25 bp, Mus musculus
tacaagtcttgtccccatgactggg

SEQ ID NO: 758435 - DNA, 25 bp, Mus musculus
tacaagtcttgtgcccatgactggg

SEQ ID NO: 758436 - DNA, 25 bp, Mus musculus
tacaagtgagatacagattgctaat

SEQ ID NO: 758437 - DNA, 25 bp, Mus musculus
tacaagtgagattcagattgctaat

SEQ ID NO: 758438 - DNA, 25 bp, Mus musculus
tacaagtgcataaacccacacctgg

SEQ ID NO: 758439 - DNA, 25 bp, Mus musculus
tacaagtgcatatacccacacctgg

SEQ ID NO: 758440 - DNA, 25 bp, Mus musculus
tacaagtgcctgatccctacaccac

SEQ ID NO: 758441 - DNA, 25 bp, Mus musculus
tacaagtgcctgttccctacaccac

SEQ ID NO: 758442 - DNA, 25 bp, Mus musculus
tacaagtgctggctacccggcattc

SEQ ID NO: 758443 - DNA, 25 bp, Mus musculus
tacaagtgctgggtacccggcattc

SEQ ID NO: 758444 - DNA, 25 bp, Mus musculus
tacaagtgggcacgcttgtgcaagc

SEQ ID NO: 758445 - DNA, 25 bp, Mus musculus
tacaagtgggcaggcttgtgcaagc

SEQ ID NO: 758446 - DNA, 25 bp, Mus musculus
tacaagtgtgtaatctaggagaaaa

SEQ ID NO: 758447 - DNA, 25 bp, Mus musculus
tacaagtgtgtattctaggagaaaa

SEQ ID NO: 758448 - DNA, 25 bp, Mus musculus
tacaagtgtgtgcccctacaccgag

SEQ ID NO: 758449 - DNA, 25 bp, Mus musculus
tacaagtgtgtggccctacaccgag

SEQ ID NO: 758450 - DNA, 25 bp, Mus musculus
tacaagttactgcagcctgttttgc

SEQ ID NO: 758451 - DNA, 25 bp, Mus musculus
tacaagttactggagcctgttttgc

SEQ ID NO: 758452 - DNA, 25 bp, Mus musculus
tacaagttcaaaagggcaggctgct

SEQ ID NO: 758453 - DNA, 25 bp, Mus musculus
tacaagttcaaatgggcaggctgct

SEQ ID NO: 758454 - DNA, 25 bp, Mus musculus
tacaagttccctctcccaactgtag

SEQ ID NO: 758455 - DNA, 25 bp, Mus musculus
tacaagttccctgtcccaactgtag

SEQ ID NO: 758456 - DNA, 25 bp, Mus musculus
tacaagttctcccaatgctgctttt

SEQ ID NO: 758457 - DNA, 25 bp, Mus musculus
tacaagttctccgaatgctgctttt

SEQ ID NO: 758458 - DNA, 25 bp, Mus musculus
tacaagttggcacggtggacctgct

SEQ ID NO: 758459 - DNA, 25 bp, Mus musculus
tacaagttggcagggtggacctgct

SEQ ID NO: 758460 - DNA, 25 bp, Mus musculus
tacaagttgtcccaacaaataattt

SEQ ID NO: 758461 - DNA, 25 bp, Mus musculus
tacaagttgtccgaacaaataattt

SEQ ID NO: 758462 - DNA, 25 bp, Mus musculus
tacaagtttccgacagagcagcatg

SEQ ID NO: 758463 - DNA, 25 bp, Mus musculus
tacaagtttccgtcagagcagcatg

SEQ ID NO: 758464 - DNA, 25 bp, Mus musculus
tacaagtttggcactgtccctgacc

SEQ ID NO: 758465 - DNA, 25 bp, Mus musculus
tacaagtttggctctgtccctgacc

SEQ ID NO: 758466 - DNA, 25 bp, Mus musculus
tacaagttttgcaaatgctgttggt

SEQ ID NO: 758467 - DNA, 25 bp, Mus musculus
tacaagttttgctaatgctgttggt

SEQ ID NO: 758468 - DNA, 25 bp, Mus musculus
tacaataacatgaggttccatatac

SEQ ID NO: 758469 - DNA, 25 bp, Mus musculus
tacaataacatgtggttccatatac

SEQ ID NO: 758470 - DNA, 25 bp, Mus musculus
tacaataaggttaggcacctcccct

SEQ ID NO: 758471 - DNA, 25 bp, Mus musculus
tacaataaggtttggcacctcccct

SEQ ID NO: 758472 - DNA, 25 bp, Mus musculus
tacaataatctgaacctggagcggg

SEQ ID NO: 758473 - DNA, 25 bp, Mus musculus
tacaataatctgtacctggagcggg

SEQ ID NO: 758474 - DNA, 25 bp, Mus musculus
tacaataattccatggtacgtagtt

SEQ ID NO: 758475 - DNA, 25 bp, Mus musculus
tacaataattccttggtacgtagtt

SEQ ID NO: 758476 - DNA, 25 bp, Mus musculus
tacaatacagccattgtctacgtaa

SEQ ID NO: 758477 - DNA, 25 bp, Mus musculus
tacaatacagcctttgtctacgtaa

SEQ ID NO: 758478 - DNA, 25 bp, Mus musculus
tacaataccaacagtatccacggaa

SEQ ID NO: 758479 - DNA, 25 bp, Mus musculus
tacaataccaactgtatccacggaa

SEQ ID NO: 758480 - DNA, 25 bp, Mus musculus
tacaatatcatgatccgctgctgga

SEQ ID NO: 758481 - DNA, 25 bp, Mus musculus
tacaatatcatgttccgctgctgga

SEQ ID NO: 758482 - DNA, 25 bp, Mus musculus
tacaatatgtacatcttccctgtcc

SEQ ID NO: 758483 - DNA, 25 bp, Mus musculus
tacaatatgtacttcttccctgtcc

SEQ ID NO: 758484 - DNA, 25 bp, Mus musculus
tacaatatttcacccaatgtcaaaa

SEQ ID NO: 758485 - DNA, 25 bp, Mus musculus
tacaatatttcagccaatgtcaaaa

SEQ ID NO: 758486 - DNA, 25 bp, Mus musculus
tacaatcacagcctcctgttggaaa

SEQ ID NO: 758487 - DNA, 25 bp, Mus musculus
tacaatcacagcgtcctgttggaaa

SEQ ID NO: 758488 - DNA, 25 bp, Mus musculus
tacaatcagagcacctacacacaat

SEQ ID NO: 758489 - DNA, 25 bp, Mus musculus
tacaatcagagctcctacacacaat

SEQ ID NO: 758490 - DNA, 25 bp, Mus musculus
tacaatcagctcatgatttcttata

SEQ ID NO: 758491 - DNA, 25 bp, Mus musculus
tacaatcagctcttgatttcttata

SEQ ID NO: 758492 - DNA, 25 bp, Mus musculus
tacaatcagtggcagcagggtcaat

SEQ ID NO: 758493 - DNA, 25 bp, Mus musculus
tacaatcagtgggagcagggtcaat

SEQ ID NO: 758494 - DNA, 25 bp, Mus musculus
tacaatcatgctagacctttttata

SEQ ID NO: 758495 - DNA, 25 bp, Mus musculus
tacaatcatgcttgacctttttata

SEQ ID NO: 758496 - DNA, 25 bp, Mus musculus
tacaatccccttactttgggtatag

SEQ ID NO: 758497 - DNA, 25 bp, Mus musculus
tacaatcccctttctttgggtatag

SEQ ID NO: 758498 - DNA, 25 bp, Mus musculus
tacaatcccgagatcttcctaagaa

SEQ ID NO: 758499 - DNA, 25 bp, Mus musculus
tacaatcccgagttcttcctaagaa

SEQ ID NO: 758500 - DNA, 25 bp, Mus musculus
tacaatcctacacttacagtcccag

SEQ ID NO: 758501 - DNA, 25 bp, Mus musculus
tacaatcctacagttacagtcccag

SEQ ID NO: 758502 - DNA, 25 bp, Mus musculus
tacaatcctcatctcctaaagtcat

SEQ ID NO: 758503 - DNA, 25 bp, Mus musculus
tacaatcctcatgtcctaaagtcat

SEQ ID NO: 758504 - DNA, 25 bp, Mus musculus
tacaatcctcccactgaggaggcaa

SEQ ID NO: 758505 - DNA, 25 bp, Mus musculus
tacaatcctccctctgaggaggcaa

SEQ ID NO: 758506 - DNA, 25 bp, Mus musculus
tacaatcgtttcatcattcggcgtg

SEQ ID NO: 758507 - DNA, 25 bp, Mus musculus
tacaatcgtttcttcattcggcgtg

SEQ ID NO: 758508 - DNA, 25 bp, Mus musculus
tacaatctagacacacgacacacct

SEQ ID NO: 758509 - DNA, 25 bp, Mus musculus
tacaatctagactcacgacacacct

SEQ ID NO: 758510 - DNA, 25 bp, Mus musculus
tacaatctggccaacctcatctact

SEQ ID NO: 758511 - DNA, 25 bp, Mus musculus
tacaatctggcctacctcatctact

SEQ ID NO: 758512 - DNA, 25 bp, Mus musculus
tacaatctgtttcaacaactcccac

SEQ ID NO: 758513 - DNA, 25 bp, Mus musculus
tacaatctgtttgaacaactcccac

SEQ ID NO: 758514 - DNA, 25 bp, Mus musculus
tacaatcttacaatgtgtgtacatt

SEQ ID NO: 758515 - DNA, 25 bp, Mus musculus
tacaatcttacattgtgtgtacatt

SEQ ID NO: 758516 - DNA, 25 bp, Mus musculus
tacaatgacaatctgtgtgcatcag

SEQ ID NO: 758517 - DNA, 25 bp, Mus musculus
tacaatgacaatgtgtgtgcatcag

SEQ ID NO: 758518 - DNA, 25 bp, Mus musculus
tacaatgacagaatccctgggactt

SEQ ID NO: 758519 - DNA, 25 bp, Mus musculus
tacaatgacagattccctgggactt

SEQ ID NO: 758520 - DNA, 25 bp, Mus musculus
tacaatgagccgatgggagaactgg

SEQ ID NO: 758521 - DNA, 25 bp, Mus musculus
tacaatgagccgttgggagaactgg

SEQ ID NO: 758522 - DNA, 25 bp, Mus musculus
tacaatgagctcaatctagggcgaa

SEQ ID NO: 758523 - DNA, 25 bp, Mus musculus
tacaatgagctcagttggttccgaa

SEQ ID NO: 758524 - DNA, 25 bp, Mus musculus
tacaatgagctctatctagggcgaa

SEQ ID NO: 758525 - DNA, 25 bp, Mus musculus
tacaatgagctctgttggttccgaa

SEQ ID NO: 758526 - DNA, 25 bp, Mus musculus
tacaatgagtgtaacttctgcatag

SEQ ID NO: 758527 - DNA, 25 bp, Mus musculus
tacaatgagtgttacttctgcatag

SEQ ID NO: 758528 - DNA, 25 bp, Mus musculus
tacaatgatacgaaacccctggaga

SEQ ID NO: 758529 - DNA, 25 bp, Mus musculus
tacaatgatacgtaacccctggaga

SEQ ID NO: 758530 - DNA, 25 bp, Mus musculus
tacaatgatgcaatgcccgctgaca

SEQ ID NO: 758531 - DNA, 25 bp, Mus musculus
tacaatgatgcattgcccgctgaca

SEQ ID NO: 758532 - DNA, 25 bp, Mus musculus
tacaatgcacacacagcctatcagg

SEQ ID NO: 758533 - DNA, 25 bp, Mus musculus
tacaatgcacactcagcctatcagg

SEQ ID NO: 758534 - DNA, 25 bp, Mus musculus
tacaatgccacacccagggatgcct

SEQ ID NO: 758535 - DNA, 25 bp, Mus musculus
tacaatgccacagccagggatgcct

SEQ ID NO: 758536 - DNA, 25 bp, Mus musculus
tacaatgcctatcaagaatgttctg

SEQ ID NO: 758537 - DNA, 25 bp, Mus musculus
tacaatgcctatgaagaatgttctg

SEQ ID NO: 758538 - DNA, 25 bp, Mus musculus
tacaatgcctggacccatcgcatct

SEQ ID NO: 758539 - DNA, 25 bp, Mus musculus
tacaatgcctggtcccatcgcatct

SEQ ID NO: 758540 - DNA, 25 bp, Mus musculus
tacaatgctctgacattccaatttc

SEQ ID NO: 758541 - DNA, 25 bp, Mus musculus
tacaatgctctgactagatctgcaa

SEQ ID NO: 758542 - DNA, 25 bp, Mus musculus
tacaatgctctgtcattccaatttc

SEQ ID NO: 758543 - DNA, 25 bp, Mus musculus
tacaatgctctgtctagatctgcaa

SEQ ID NO: 758544 - DNA, 25 bp, Mus musculus
tacaatgctcttctggccgtgcaga

SEQ ID NO: 758545 - DNA, 25 bp, Mus musculus
tacaatgctcttgtggccgtgcaga

SEQ ID NO: 758546 - DNA, 25 bp, Mus musculus
tacaatgctgcaacacatcggcttg

SEQ ID NO: 758547 - DNA, 25 bp, Mus musculus
tacaatgctgcatcacatcggcttg

SEQ ID NO: 758548 - DNA, 25 bp, Mus musculus
tacaatggattgacaccgaagacat

SEQ ID NO: 758549 - DNA, 25 bp, Mus musculus
tacaatggattgtcaccgaagacat

SEQ ID NO: 758550 - DNA, 25 bp, Mus musculus
tacaatggcattctcatccttccca

SEQ ID NO: 758551 - DNA, 25 bp, Mus musculus
tacaatggcattgtcatccttccca

SEQ ID NO: 758552 - DNA, 25 bp, Mus musculus
tacaatgggacaccttttctaaatg

SEQ ID NO: 758553 - DNA, 25 bp, Mus musculus
tacaatgggacagcttttctaaatg

SEQ ID NO: 758554 - DNA, 25 bp, Mus musculus
tacaatgggctgatgcactgttaat

SEQ ID NO: 758555 - DNA, 25 bp, Mus musculus
tacaatgggctgctccctcctgcat

SEQ ID NO: 758556 - DNA, 25 bp, Mus musculus
tacaatgggctggtccctcctgcat

SEQ ID NO: 758557 - DNA, 25 bp, Mus musculus
tacaatgggctgttgcactgttaat

SEQ ID NO: 758558 - DNA, 25 bp, Mus musculus
tacaatggtggtccatgagaaacaa

SEQ ID NO: 758559 - DNA, 25 bp, Mus musculus
tacaatggtggtgcatgagaaacaa

SEQ ID NO: 758560 - DNA, 25 bp, Mus musculus
tacaatggttatctctggtttataa

SEQ ID NO: 758561 - DNA, 25 bp, Mus musculus
tacaatggttatgtctggtttataa

SEQ ID NO: 758562 - DNA, 25 bp, Mus musculus
tacaatggttctaattcctgggctt

SEQ ID NO: 758563 - DNA, 25 bp, Mus musculus
tacaatggttcttattcctgggctt

SEQ ID NO: 758564 - DNA, 25 bp, Mus musculus
tacaatggttggatacttcgcctcc

SEQ ID NO: 758565 - DNA, 25 bp, Mus musculus
tacaatggttggttacttcgcctcc

SEQ ID NO: 758566 - DNA, 25 bp, Mus musculus
tacaatgtaactcttctgtatgttc

SEQ ID NO: 758567 - DNA, 25 bp, Mus musculus
tacaatgtaactgttctgtatgttc

SEQ ID NO: 758568 - DNA, 25 bp, Mus musculus
tacaatgtacatcagagaccttcaa

SEQ ID NO: 758569 - DNA, 25 bp, Mus musculus
tacaatgtacatgagagaccttcaa

SEQ ID NO: 758570 - DNA, 25 bp, Mus musculus
tacaatgtcacccagcatgccgtgg

SEQ ID NO: 758571 - DNA, 25 bp, Mus musculus
tacaatgtcaccgagcatgccgtgg

SEQ ID NO: 758572 - DNA, 25 bp, Mus musculus
tacaatgtcatacactacaatctgt

SEQ ID NO: 758573 - DNA, 25 bp, Mus musculus
tacaatgtcatagactacaatctgt

SEQ ID NO: 758574 - DNA, 25 bp, Mus musculus
tacaatgtccataggcaagccatgg

SEQ ID NO: 758575 - DNA, 25 bp, Mus musculus
tacaatgtccattggcaagccatgg

SEQ ID NO: 758576 - DNA, 25 bp, Mus musculus
tacaatgtgtgtaccatgggcctgt

SEQ ID NO: 758577 - DNA, 25 bp, Mus musculus
tacaatgtgtgttccatgggcctgt

SEQ ID NO: 758578 - DNA, 25 bp, Mus musculus
tacaatgttacccagcatgctgttg

SEQ ID NO: 758579 - DNA, 25 bp, Mus musculus
tacaatgttaccgagcatgctgttg

SEQ ID NO: 758580 - DNA, 25 bp, Mus musculus
tacaatgttcccataagcaagattt

SEQ ID NO: 758581 - DNA, 25 bp, Mus musculus
tacaatgttcccttaagcaagattt

SEQ ID NO: 758582 - DNA, 25 bp, Mus musculus
tacaatgttccgagtcctgtggcta

SEQ ID NO: 758583 - DNA, 25 bp, Mus musculus
tacaatgttccgctgtgtgtcacag

SEQ ID NO: 758584 - DNA, 25 bp, Mus musculus
tacaatgttccggtgtgtgtcacag

SEQ ID NO: 758585 - DNA, 25 bp, Mus musculus
tacaatgttccgtgtcctgtggcta

SEQ ID NO: 758586 - DNA, 25 bp, Mus musculus
tacaattacgtgagatctgcctcta

SEQ ID NO: 758587 - DNA, 25 bp, Mus musculus
tacaattacgtgtgatctgcctcta

SEQ ID NO: 758588 - DNA, 25 bp, Mus musculus
tacaattaggaacccagatgccacc

SEQ ID NO: 758589 - DNA, 25 bp, Mus musculus
tacaattaggaagccagatgccacc

SEQ ID NO: 758590 - DNA, 25 bp, Mus musculus
tacaattaggtgacaagttggcatt

SEQ ID NO: 758591 - DNA, 25 bp, Mus musculus
tacaattaggtgtcaagttggcatt

SEQ ID NO: 758592 - DNA, 25 bp, Mus musculus
tacaattcattcacttgacctccac

SEQ ID NO: 758593 - DNA, 25 bp, Mus musculus
tacaattcattctcttgacctccac

SEQ ID NO: 758594 - DNA, 25 bp, Mus musculus
tacaattccaacagccgagactcca

SEQ ID NO: 758595 - DNA, 25 bp, Mus musculus
tacaattccaactgccgagactcca

SEQ ID NO: 758596 - DNA, 25 bp, Mus musculus
tacaattccacccagagaactgcac

SEQ ID NO: 758597 - DNA, 25 bp, Mus musculus
tacaattccaccgagagaactgcac

SEQ ID NO: 758598 - DNA, 25 bp, Mus musculus
tacaattccatgagtcctcctcata

SEQ ID NO: 758599 - DNA, 25 bp, Mus musculus
tacaattccatgtgtcctcctcata

SEQ ID NO: 758600 - DNA, 25 bp, Mus musculus
tacaattccctacaactttgccaga

SEQ ID NO: 758601 - DNA, 25 bp, Mus musculus
tacaattccctagaactttgccaga

SEQ ID NO: 758602 - DNA, 25 bp, Mus musculus
tacaattcctcacacggttgcaaac

SEQ ID NO: 758603 - DNA, 25 bp, Mus musculus
tacaattcctcagacggttgcaaac

SEQ ID NO: 758604 - DNA, 25 bp, Mus musculus
tacaattcgttcctccttttgtgag

SEQ ID NO: 758605 - DNA, 25 bp, Mus musculus
tacaattcgttcgtccttttgtgag

SEQ ID NO: 758606 - DNA, 25 bp, Mus musculus
tacaattctgccctctattacaact

SEQ ID NO: 758607 - DNA, 25 bp, Mus musculus
tacaattctgccgtctattacaact

SEQ ID NO: 758608 - DNA, 25 bp, Mus musculus
tacaattgacagagaggcggtccct

SEQ ID NO: 758609 - DNA, 25 bp, Mus musculus
tacaattgacagtgaggcggtccct

SEQ ID NO: 758610 - DNA, 25 bp, Mus musculus
tacaattgtcacaccagctctgaac

SEQ ID NO: 758611 - DNA, 25 bp, Mus musculus
tacaattgtcactccagctctgaac

SEQ ID NO: 758612 - DNA, 25 bp, Mus musculus
tacaatttattcctgtatgtatgga

SEQ ID NO: 758613 - DNA, 25 bp, Mus musculus
tacaatttattcgtgtatgtatgga

SEQ ID NO: 758614 - DNA, 25 bp, Mus musculus
tacaatttcaataatcagtgcagtc

SEQ ID NO: 758615 - DNA, 25 bp, Mus musculus
tacaatttcaattatcagtgcagtc

SEQ ID NO: 758616 - DNA, 25 bp, Mus musculus
tacaatttctgtcacttgccataat

SEQ ID NO: 758617 - DNA, 25 bp, Mus musculus
tacaatttctgtgacttgccataat

SEQ ID NO: 758618 - DNA, 25 bp, Mus musculus
tacaatttgcacactttctttttag

SEQ ID NO: 758619 - DNA, 25 bp, Mus musculus
tacaatttgcactctttctttttag

SEQ ID NO: 758620 - DNA, 25 bp, Mus musculus
tacaattttgtgatttcaggaatgg

SEQ ID NO: 758621 - DNA, 25 bp, Mus musculus
tacaattttgtgttttcaggaatgg

SEQ ID NO: 758622 - DNA, 25 bp, Mus musculus
tacaatttttcaccattcctttctg

SEQ ID NO: 758623 - DNA, 25 bp, Mus musculus
tacaatttttcagcattcctttctg

SEQ ID NO: 758624 - DNA, 25 bp, Mus musculus
tacacaaaatcaaggaatctctggt

SEQ ID NO: 758625 - DNA, 25 bp, Mus musculus
tacacaaaatcatggaatctctggt

SEQ ID NO: 758626 - DNA, 25 bp, Mus musculus
tacacaaacagaaatgcttccattt

SEQ ID NO: 758627 - DNA, 25 bp, Mus musculus
tacacaaacagatatgcttccattt

SEQ ID NO: 758628 - DNA, 25 bp, Mus musculus
tacacaaacccacttgatgcgcagg

SEQ ID NO: 758629 - DNA, 25 bp, Mus musculus
tacacaaacccagttgatgcgcagg

SEQ ID NO: 758630 - DNA, 25 bp, Mus musculus
tacacaaacgcgctcattcatgagg

SEQ ID NO: 758631 - DNA, 25 bp, Mus musculus
tacacaaacgcggtcattcatgagg

SEQ ID NO: 758632 - DNA, 25 bp, Mus musculus
tacacaaacggaacagaaactcagt

SEQ ID NO: 758633 - DNA, 25 bp, Mus musculus
tacacaaacggatcagaaactcagt

SEQ ID NO: 758634 - DNA, 25 bp, Mus musculus
tacacaaactggatgaaagactcaa

SEQ ID NO: 758635 - DNA, 25 bp, Mus musculus
tacacaaactggttgaaagactcaa

SEQ ID NO: 758636 - DNA, 25 bp, Mus musculus
tacacaaagccacttgctgttcctg

SEQ ID NO: 758637 - DNA, 25 bp, Mus musculus
tacacaaagccagttgctgttcctg

SEQ ID NO: 758638 - DNA, 25 bp, Mus musculus
tacacaaaggacaggaggtgactaa

SEQ ID NO: 758639 - DNA, 25 bp, Mus musculus
tacacaaaggactggaggtgactaa

SEQ ID NO: 758640 - DNA, 25 bp, Mus musculus
tacacaacaaggaatgcccatgccc

SEQ ID NO: 758641 - DNA, 25 bp, Mus musculus
tacacaacaaggtatgcccatgccc

SEQ ID NO: 758642 - DNA, 25 bp, Mus musculus
tacacaacaagtctaaggcttccct

SEQ ID NO: 758643 - DNA, 25 bp, Mus musculus
tacacaacaagtgtaaggcttccct

SEQ ID NO: 758644 - DNA, 25 bp, Mus musculus
tacacaacagaaaagcagacttgtc

SEQ ID NO: 758645 - DNA, 25 bp, Mus musculus
tacacaacagaatagcagacttgtc

SEQ ID NO: 758646 - DNA, 25 bp, Mus musculus
tacacaacagagcacagtcacctga

SEQ ID NO: 758647 - DNA, 25 bp, Mus musculus
tacacaacagaggacagtcacctga

SEQ ID NO: 758648 - DNA, 25 bp, Mus musculus
tacacaacattgactgatgttccct

SEQ ID NO: 758649 - DNA, 25 bp, Mus musculus
tacacaacattgtctgatgttccct

SEQ ID NO: 758650 - DNA, 25 bp, Mus musculus
tacacaaccatcaggccgtggcctt

SEQ ID NO: 758651 - DNA, 25 bp, Mus musculus
tacacaaccatctggccgtggcctt

SEQ ID NO: 758652 - DNA, 25 bp, Mus musculus
tacacaacctcaagctaaaactagt

SEQ ID NO: 758653 - DNA, 25 bp, Mus musculus
tacacaacctcatgctaaaactagt

SEQ ID NO: 758654 - DNA, 25 bp, Mus musculus
tacacaacgtaccttccatttcctg

SEQ ID NO: 758655 - DNA, 25 bp, Mus musculus
tacacaacgtacgttccatttcctg

SEQ ID NO: 758656 - DNA, 25 bp, Mus musculus
tacacaacgttgactgatgttccct

SEQ ID NO: 758657 - DNA, 25 bp, Mus musculus
tacacaacgttgtctgatgttccct

SEQ ID NO: 758658 - DNA, 25 bp, Mus musculus
tacacaactggacttcctaagaagg

SEQ ID NO: 758659 - DNA, 25 bp, Mus musculus
tacacaactggagttcctaagaagg

SEQ ID NO: 758660 - DNA, 25 bp, Mus musculus
tacacaacttagacctgttctgaga

SEQ ID NO: 758661 - DNA, 25 bp, Mus musculus
tacacaacttagtcctgttctgaga

SEQ ID NO: 758662 - DNA, 25 bp, Mus musculus
tacacaactttgaggccacacactg

SEQ ID NO: 758663 - DNA, 25 bp, Mus musculus
tacacaactttgtggccacacactg

SEQ ID NO: 758664 - DNA, 25 bp, Mus musculus
tacacaagaattatggtttttaact

SEQ ID NO: 758665 - DNA, 25 bp, Mus musculus
tacacaagaattttggtttttaact

SEQ ID NO: 758666 - DNA, 25 bp, Mus musculus
tacacaagagctcttctggttgcct

SEQ ID NO: 758667 - DNA, 25 bp, Mus musculus
tacacaagagctgttctggttgcct

SEQ ID NO: 758668 - DNA, 25 bp, Mus musculus
tacacaagcttgaggcagatttctt

SEQ ID NO: 758669 - DNA, 25 bp, Mus musculus
tacacaagcttgtggcagatttctt

SEQ ID NO: 758670 - DNA, 25 bp, Mus musculus
tacacaaggagaagcgcgtcgcccc

SEQ ID NO: 758671 - DNA, 25 bp, Mus musculus
tacacaaggagatgcgcgtcgcccc

SEQ ID NO: 758672 - DNA, 25 bp, Mus musculus
tacacaagtttcacaaataccccgc

SEQ ID NO: 758673 - DNA, 25 bp, Mus musculus
tacacaagtttctcaaataccccgc

SEQ ID NO: 758674 - DNA, 25 bp, Mus musculus
tacacaatccctctcataaaggtag

SEQ ID NO: 758675 - DNA, 25 bp, Mus musculus
tacacaatccctgtcataaaggtag

SEQ ID NO: 758676 - DNA, 25 bp, Mus musculus
tacacaatgcaaaaaaccgggcaat

SEQ ID NO: 758677 - DNA, 25 bp, Mus musculus
tacacaatgcaataaaccgggcaat

SEQ ID NO: 758678 - DNA, 25 bp, Mus musculus
tacacaattgctattacctttataa

SEQ ID NO: 758679 - DNA, 25 bp, Mus musculus
tacacaattgcttttacctttataa

SEQ ID NO: 758680 - DNA, 25 bp, Mus musculus
tacacacaaacactagttccggaga

SEQ ID NO: 758681 - DNA, 25 bp, Mus musculus
tacacacaaacagtagttccggaga

SEQ ID NO: 758682 - DNA, 25 bp, Mus musculus
tacacacaaagaattcatgcacata

SEQ ID NO: 758683 - DNA, 25 bp, Mus musculus
tacacacaaagatttcatgcacata

SEQ ID NO: 758684 - DNA, 25 bp, Mus musculus
tacacacaagcaatatacttactag

SEQ ID NO: 758685 - DNA, 25 bp, Mus musculus
tacacacaagcattatacttactag

SEQ ID NO: 758686 - DNA, 25 bp, Mus musculus
tacacacaagtgactagatgcttca

SEQ ID NO: 758687 - DNA, 25 bp, Mus musculus
tacacacaagtgtctagatgcttca

SEQ ID NO: 758688 - DNA, 25 bp, Mus musculus
tacacacaatgtatctctcgcacag

SEQ ID NO: 758689 - DNA, 25 bp, Mus musculus
tacacacaatgtttctctcgcacag

SEQ ID NO: 758690 - DNA, 25 bp, Mus musculus
tacacacacagcagaggaggtttaa

SEQ ID NO: 758691 - DNA, 25 bp, Mus musculus
tacacacacagctgaggaggtttaa

SEQ ID NO: 758692 - DNA, 25 bp, Mus musculus
tacacacacctgcatagcagacttg

SEQ ID NO: 758693 - DNA, 25 bp, Mus musculus
tacacacacctggatagcagacttg

SEQ ID NO: 758694 - DNA, 25 bp, Mus musculus
tacacacacgcactcataatttatt

SEQ ID NO: 758695 - DNA, 25 bp, Mus musculus
tacacacacgcagtcataatttatt

SEQ ID NO: 758696 - DNA, 25 bp, Mus musculus
tacacacacgtacccacatttgatt

SEQ ID NO: 758697 - DNA, 25 bp, Mus musculus
tacacacacgtagccacatttgatt

SEQ ID NO: 758698 - DNA, 25 bp, Mus musculus
tacacacactgactggatgtccagc

SEQ ID NO: 758699 - DNA, 25 bp, Mus musculus
tacacacactgagtggatgtccagc

SEQ ID NO: 758700 - DNA, 25 bp, Mus musculus
tacacacagagaatatggccgtttt

SEQ ID NO: 758701 - DNA, 25 bp, Mus musculus
tacacacagagattatggccgtttt

SEQ ID NO: 758702 - DNA, 25 bp, Mus musculus
tacacacagcacaagctaagggctt

SEQ ID NO: 758703 - DNA, 25 bp, Mus musculus
tacacacagcactagctaagggctt

SEQ ID NO: 758704 - DNA, 25 bp, Mus musculus
tacacacagtggagactaggcagca

SEQ ID NO: 758705 - DNA, 25 bp, Mus musculus
tacacacagtggtgactaggcagca

SEQ ID NO: 758706 - DNA, 25 bp, Mus musculus
tacacacagtgtcctccttgtgcca

SEQ ID NO: 758707 - DNA, 25 bp, Mus musculus
tacacacagtgtgctccttgtgcca

SEQ ID NO: 758708 - DNA, 25 bp, Mus musculus
tacacacatagcctagagctcagtt

SEQ ID NO: 758709 - DNA, 25 bp, Mus musculus
tacacacatagcgtagagctcagtt

SEQ ID NO: 758710 - DNA, 25 bp, Mus musculus
tacacacatgcgaaacagctgacag

SEQ ID NO: 758711 - DNA, 25 bp, Mus musculus
tacacacatgcgcatgcgagtgcac

SEQ ID NO: 758712 - DNA, 25 bp, Mus musculus
tacacacatgcggatgcgagtgcac

SEQ ID NO: 758713 - DNA, 25 bp, Mus musculus
tacacacatgcgtaacagctgacag

SEQ ID NO: 758714 - DNA, 25 bp, Mus musculus
tacacacattctattacacacactc

SEQ ID NO: 758715 - DNA, 25 bp, Mus musculus
tacacacattcttttacacacactc

SEQ ID NO: 758716 - DNA, 25 bp, Mus musculus
tacacaccaaccatggctttagcag

SEQ ID NO: 758717 - DNA, 25 bp, Mus musculus
tacacaccaaccttggctttagcag

SEQ ID NO: 758718 - DNA, 25 bp, Mus musculus
tacacaccaggtccccaagagaggc

SEQ ID NO: 758719 - DNA, 25 bp, Mus musculus
tacacaccaggtgcccaagagaggc

SEQ ID NO: 758720 - DNA, 25 bp, Mus musculus
tacacacccacaagtacgcataggt

SEQ ID NO: 758721 - DNA, 25 bp, Mus musculus
tacacacccacatgtacgcataggt

SEQ ID NO: 758722 - DNA, 25 bp, Mus musculus
tacacacccatgcacacggctatgg

SEQ ID NO: 758723 - DNA, 25 bp, Mus musculus
tacacacccatggacacggctatgg

SEQ ID NO: 758724 - DNA, 25 bp, Mus musculus
tacacaccctcgcttatttgaatgg

SEQ ID NO: 758725 - DNA, 25 bp, Mus musculus
tacacaccctcggttatttgaatgg

SEQ ID NO: 758726 - DNA, 25 bp, Mus musculus
tacacaccgaaaatctgactgagaa

SEQ ID NO: 758727 - DNA, 25 bp, Mus musculus
tacacaccgaaattctgactgagaa

SEQ ID NO: 758728 - DNA, 25 bp, Mus musculus
tacacaccgattccctgagtactat

SEQ ID NO: 758729 - DNA, 25 bp, Mus musculus
tacacaccgattgcctgagtactat

SEQ ID NO: 758730 - DNA, 25 bp, Mus musculus
tacacacctccgatcaaattcctga

SEQ ID NO: 758731 - DNA, 25 bp, Mus musculus
tacacacctccgttcaaattcctga

SEQ ID NO: 758732 - DNA, 25 bp, Mus musculus
tacacacgcaccaaagacctgataa

SEQ ID NO: 758733 - DNA, 25 bp, Mus musculus
tacacacgcacctaagacctgataa

SEQ ID NO: 758734 - DNA, 25 bp, Mus musculus
tacacacggatcaggagcctccacg

SEQ ID NO: 758735 - DNA, 25 bp, Mus musculus
tacacacggatctggagcctccacg

SEQ ID NO: 758736 - DNA, 25 bp, Mus musculus
tacacacgtgcacttcaggtttggg

SEQ ID NO: 758737 - DNA, 25 bp, Mus musculus
tacacacgtgcagttcaggtttggg

SEQ ID NO: 758738 - DNA, 25 bp, Mus musculus
tacacacgtgtgcatagtcaggaat

SEQ ID NO: 758739 - DNA, 25 bp, Mus musculus
tacacacgtgtggatagtcaggaat

SEQ ID NO: 758740 - DNA, 25 bp, Mus musculus
tacacactacacacacgtacaatca

SEQ ID NO: 758741 - DNA, 25 bp, Mus musculus
tacacactacactcacgtacaatca

SEQ ID NO: 758742 - DNA, 25 bp, Mus musculus
tacacactacagagccttccaacga

SEQ ID NO: 758743 - DNA, 25 bp, Mus musculus
tacacactacagtgccttccaacga

SEQ ID NO: 758744 - DNA, 25 bp, Mus musculus
tacacactcagaccacacatattca

SEQ ID NO: 758745 - DNA, 25 bp, Mus musculus
tacacactcagagcacacatattca

SEQ ID NO: 758746 - DNA, 25 bp, Mus musculus
tacacactcatgcaacagaactagg

SEQ ID NO: 758747 - DNA, 25 bp, Mus musculus
tacacactcatggaacagaactagg

SEQ ID NO: 758748 - DNA, 25 bp, Mus musculus
tacacactcggcagactttggccat

SEQ ID NO: 758749 - DNA, 25 bp, Mus musculus
tacacactcggctgactttggccat

SEQ ID NO: 758750 - DNA, 25 bp, Mus musculus
tacacactgactactaaggcagctg

SEQ ID NO: 758751 - DNA, 25 bp, Mus musculus
tacacactgacttctaaggcagctg

SEQ ID NO: 758752 - DNA, 25 bp, Mus musculus
tacacactgctgctggcctcaaagg

SEQ ID NO: 758753 - DNA, 25 bp, Mus musculus
tacacactgctggtggcctcaaagg

SEQ ID NO: 758754 - DNA, 25 bp, Mus musculus
tacacactggccaggatctctggca

SEQ ID NO: 758755 - DNA, 25 bp, Mus musculus
tacacactggcctggatctctggca

SEQ ID NO: 758756 - DNA, 25 bp, Mus musculus
tacacactgggtactctgcgtctaa

SEQ ID NO: 758757 - DNA, 25 bp, Mus musculus
tacacactgggttctctgcgtctaa

SEQ ID NO: 758758 - DNA, 25 bp, Mus musculus
tacacactggtaaacttgtacaaca

SEQ ID NO: 758759 - DNA, 25 bp, Mus musculus
tacacactggtatacttgtacaaca

SEQ ID NO: 758760 - DNA, 25 bp, Mus musculus
tacacactggttaggtctacacgag

SEQ ID NO: 758761 - DNA, 25 bp, Mus musculus
tacacactggtttggtctacacgag

SEQ ID NO: 758762 - DNA, 25 bp, Mus musculus
tacacacttaccctattgtacactc

SEQ ID NO: 758763 - DNA, 25 bp, Mus musculus
tacacacttaccgtattgtacactc

SEQ ID NO: 758764 - DNA, 25 bp, Mus musculus
tacacactttagactgaagcccgtg

SEQ ID NO: 758765 - DNA, 25 bp, Mus musculus
tacacactttagtctgaagcccgtg

SEQ ID NO: 758766 - DNA, 25 bp, Mus musculus
tacacagaacagatcaccaacgaga

SEQ ID NO: 758767 - DNA, 25 bp, Mus musculus
tacacagaacagttcaccaacgaga

SEQ ID NO: 758768 - DNA, 25 bp, Mus musculus
tacacagacaccagggaaattctac

SEQ ID NO: 758769 - DNA, 25 bp, Mus musculus
tacacagacacctgggaaattctac

SEQ ID NO: 758770 - DNA, 25 bp, Mus musculus
tacacagactaaaaccacccttggt

SEQ ID NO: 758771 - DNA, 25 bp, Mus musculus
tacacagactaataccacccttggt

SEQ ID NO: 758772 - DNA, 25 bp, Mus musculus
tacacagactccaggatcctcgttc

SEQ ID NO: 758773 - DNA, 25 bp, Mus musculus
tacacagactcctggatcctcgttc

SEQ ID NO: 758774 - DNA, 25 bp, Mus musculus
tacacagactggatcttgagactct

SEQ ID NO: 758775 - DNA, 25 bp, Mus musculus
tacacagactggttcttgagactct

SEQ ID NO: 758776 - DNA, 25 bp, Mus musculus
tacacagagaaaccaggaagttaac

SEQ ID NO: 758777 - DNA, 25 bp, Mus musculus
tacacagagaaagcaggaagttaac

SEQ ID NO: 758778 - DNA, 25 bp, Mus musculus
tacacagagagtcgcgatgggtttt

SEQ ID NO: 758779 - DNA, 25 bp, Mus musculus
tacacagagagtggcgatgggtttt

SEQ ID NO: 758780 - DNA, 25 bp, Mus musculus
tacacagagcttctatactgcaaga

SEQ ID NO: 758781 - DNA, 25 bp, Mus musculus
tacacagagcttgtatactgcaaga

SEQ ID NO: 758782 - DNA, 25 bp, Mus musculus
tacacagaggctatgctgcagggct

SEQ ID NO: 758783 - DNA, 25 bp, Mus musculus
tacacagaggctttgctgcagggct

SEQ ID NO: 758784 - DNA, 25 bp, Mus musculus
tacacagatatccatgcctgtttta

SEQ ID NO: 758785 - DNA, 25 bp, Mus musculus
tacacagatatcgatgcctgtttta

SEQ ID NO: 758786 - DNA, 25 bp, Mus musculus
tacacagatctaaacatgcagtcaa

SEQ ID NO: 758787 - DNA, 25 bp, Mus musculus
tacacagatctatacatgcagtcaa

SEQ ID NO: 758788 - DNA, 25 bp, Mus musculus
tacacagatgcacagctcacacctg

SEQ ID NO: 758789 - DNA, 25 bp, Mus musculus
tacacagatgcagagctcacacctg

SEQ ID NO: 758790 - DNA, 25 bp, Mus musculus
tacacagcaactactggccttggag

SEQ ID NO: 758791 - DNA, 25 bp, Mus musculus
tacacagcaacttctggccttggag

SEQ ID NO: 758792 - DNA, 25 bp, Mus musculus
tacacagccaggctccaggcggcag

SEQ ID NO: 758793 - DNA, 25 bp, Mus musculus
tacacagccagggtccaggcggcag

SEQ ID NO: 758794 - DNA, 25 bp, Mus musculus
tacacagccctacaactatagcaaa

SEQ ID NO: 758795 - DNA, 25 bp, Mus musculus
tacacagccctagaactatagcaaa

SEQ ID NO: 758796 - DNA, 25 bp, Mus musculus
tacacagccgcacctgtgctgggaa

SEQ ID NO: 758797 - DNA, 25 bp, Mus musculus
tacacagccgcactttggtgcagga

SEQ ID NO: 758798 - DNA, 25 bp, Mus musculus
tacacagccgcagctgtgctgggaa

SEQ ID NO: 758799 - DNA, 25 bp, Mus musculus
tacacagccgcagtttggtgcagga

SEQ ID NO: 758800 - DNA, 25 bp, Mus musculus
tacacagctcaaatctttgccaggt

SEQ ID NO: 758801 - DNA, 25 bp, Mus musculus
tacacagctcaattctttgccaggt

SEQ ID NO: 758802 - DNA, 25 bp, Mus musculus
tacacagctcagaaagaccgtggtt

SEQ ID NO: 758803 - DNA, 25 bp, Mus musculus
tacacagctcagtaagaccgtggtt

SEQ ID NO: 758804 - DNA, 25 bp, Mus musculus
tacacagctgctcgctaccgagttg

SEQ ID NO: 758805 - DNA, 25 bp, Mus musculus
tacacagctgctggctaccgagttg

SEQ ID NO: 758806 - DNA, 25 bp, Mus musculus
tacacagctgtcaataacagtaagt

SEQ ID NO: 758807 - DNA, 25 bp, Mus musculus
tacacagctgtctataacagtaagt

SEQ ID NO: 758808 - DNA, 25 bp, Mus musculus
tacacaggacagcaacgtgggatgc

SEQ ID NO: 758809 - DNA, 25 bp, Mus musculus
tacacaggacaggaacgtgggatgc

SEQ ID NO: 758810 - DNA, 25 bp, Mus musculus
tacacaggagtaagctgcacaccat

SEQ ID NO: 758811 - DNA, 25 bp, Mus musculus
tacacaggagtatgctgcacaccat

SEQ ID NO: 758812 - DNA, 25 bp, Mus musculus
tacacaggcacgcttgactgctggc

SEQ ID NO: 758813 - DNA, 25 bp, Mus musculus
tacacaggcacggttgactgctggc

SEQ ID NO: 758814 - DNA, 25 bp, Mus musculus
tacacaggcagtatcaggtcagcaa

SEQ ID NO: 758815 - DNA, 25 bp, Mus musculus
tacacaggcagtttcaggtcagcaa

SEQ ID NO: 758816 - DNA, 25 bp, Mus musculus
tacacaggccacagctctgagctga

SEQ ID NO: 758817 - DNA, 25 bp, Mus musculus
tacacaggccactgctctgagctga

SEQ ID NO: 758818 - DNA, 25 bp, Mus musculus
tacacaggcctgatacctaggaata

SEQ ID NO: 758819 - DNA, 25 bp, Mus musculus
tacacaggcctgttacctaggaata

SEQ ID NO: 758820 - DNA, 25 bp, Mus musculus
tacacaggcttcagttcatcccaga

SEQ ID NO: 758821 - DNA, 25 bp, Mus musculus
tacacaggcttctgttcatcccaga

SEQ ID NO: 758822 - DNA, 25 bp, Mus musculus
tacacagggaatatttgcatctcat

SEQ ID NO: 758823 - DNA, 25 bp, Mus musculus
tacacagggaatttttgcatctcat

SEQ ID NO: 758824 - DNA, 25 bp, Mus musculus
tacacagggacaccaaacttgacag

SEQ ID NO: 758825 - DNA, 25 bp, Mus musculus
tacacagggacagcaaacttgacag

SEQ ID NO: 758826 - DNA, 25 bp, Mus musculus
tacacagggaggattggctttggtt

SEQ ID NO: 758827 - DNA, 25 bp, Mus musculus
tacacagggaggtttggctttggtt

SEQ ID NO: 758828 - DNA, 25 bp, Mus musculus
tacacagggttgatcatgacattcc

SEQ ID NO: 758829 - DNA, 25 bp, Mus musculus
tacacagggttgttcatgacattcc

SEQ ID NO: 758830 - DNA, 25 bp, Mus musculus
tacacaggtctgacccataagcata

SEQ ID NO: 758831 - DNA, 25 bp, Mus musculus
tacacaggtctgtcccataagcata

SEQ ID NO: 758832 - DNA, 25 bp, Mus musculus
tacacaggtggccatgggacccttt

SEQ ID NO: 758833 - DNA, 25 bp, Mus musculus
tacacaggtggcgatgggacccttt

SEQ ID NO: 758834 - DNA, 25 bp, Mus musculus
tacacagtaaacacagagacacatt

SEQ ID NO: 758835 - DNA, 25 bp, Mus musculus
tacacagtaaactcagagacacatt

SEQ ID NO: 758836 - DNA, 25 bp, Mus musculus
tacacagtacgtaacctatagtgag

SEQ ID NO: 758837 - DNA, 25 bp, Mus musculus
tacacagtacgttacctatagtgag

SEQ ID NO: 758838 - DNA, 25 bp, Mus musculus
tacacagtactgctgggtaccatct

SEQ ID NO: 758839 - DNA, 25 bp, Mus musculus
tacacagtactggtgggtaccatct

SEQ ID NO: 758840 - DNA, 25 bp, Mus musculus
tacacagtaggacgaggcacgtccc

SEQ ID NO: 758841 - DNA, 25 bp, Mus musculus
tacacagtaggaggaggcacgtccc

SEQ ID NO: 758842 - DNA, 25 bp, Mus musculus
tacacagtcaggagggaagccgtca

SEQ ID NO: 758843 - DNA, 25 bp, Mus musculus
tacacagtcaggtgggaagccgtca

SEQ ID NO: 758844 - DNA, 25 bp, Mus musculus
tacacagtccacagacttgggcctt

SEQ ID NO: 758845 - DNA, 25 bp, Mus musculus
tacacagtccactgacttgggcctt

SEQ ID NO: 758846 - DNA, 25 bp, Mus musculus
tacacagtcctgagctattggtgat

SEQ ID NO: 758847 - DNA, 25 bp, Mus musculus
tacacagtcctgattggagtgtctc

SEQ ID NO: 758848 - DNA, 25 bp, Mus musculus
tacacagtcctgtgctattggtgat

SEQ ID NO: 758849 - DNA, 25 bp, Mus musculus
tacacagtcctgtttggagtgtctc

SEQ ID NO: 758850 - DNA, 25 bp, Mus musculus
tacacagtcgccactgagtctgctg

SEQ ID NO: 758851 - DNA, 25 bp, Mus musculus
tacacagtcgcctctgagtctgctg

SEQ ID NO: 758852 - DNA, 25 bp, Mus musculus
tacacagtctatccatagatgcata

SEQ ID NO: 758853 - DNA, 25 bp, Mus musculus
tacacagtctatgcatagatgcata

SEQ ID NO: 758854 - DNA, 25 bp, Mus musculus
tacacagtgcttcccttacttcaaa

SEQ ID NO: 758855 - DNA, 25 bp, Mus musculus
tacacagtgcttgccttacttcaaa

SEQ ID NO: 758856 - DNA, 25 bp, Mus musculus
tacacagtggagatcactcagcagc

SEQ ID NO: 758857 - DNA, 25 bp, Mus musculus
tacacagtggagttcactcagcagc

SEQ ID NO: 758858 - DNA, 25 bp, Mus musculus
tacacagtgggcactgtttgctaca

SEQ ID NO: 758859 - DNA, 25 bp, Mus musculus
tacacagtgggctctgtttgctaca

SEQ ID NO: 758860 - DNA, 25 bp, Mus musculus
tacacagtgtagcagttcccagggc

SEQ ID NO: 758861 - DNA, 25 bp, Mus musculus
tacacagtgtaggagttcccagggc

SEQ ID NO: 758862 - DNA, 25 bp, Mus musculus
tacacagttcagacattgttagtaa

SEQ ID NO: 758863 - DNA, 25 bp, Mus musculus
tacacagttcagtcattgttagtaa

SEQ ID NO: 758864 - DNA, 25 bp, Mus musculus
tacacagttccaccaagtagccatg

SEQ ID NO: 758865 - DNA, 25 bp, Mus musculus
tacacagttccagcaagtagccatg

SEQ ID NO: 758866 - DNA, 25 bp, Mus musculus
tacacagttttacccagccgaatca

SEQ ID NO: 758867 - DNA, 25 bp, Mus musculus
tacacagttttagccagccgaatca

SEQ ID NO: 758868 - DNA, 25 bp, Mus musculus
tacacagttttgccccacttggggg

SEQ ID NO: 758869 - DNA, 25 bp, Mus musculus
tacacagttttggcccacttggggg

SEQ ID NO: 758870 - DNA, 25 bp, Mus musculus
tacacataaggaagctcacttgggt

SEQ ID NO: 758871 - DNA, 25 bp, Mus musculus
tacacataaggatgctcacttgggt

SEQ ID NO: 758872 - DNA, 25 bp, Mus musculus
tacacatacacactgcctaacactg

SEQ ID NO: 758873 - DNA, 25 bp, Mus musculus
tacacatacacagtgcctaacactg

SEQ ID NO: 758874 - DNA, 25 bp, Mus musculus
tacacatacatactttcgacccaat

SEQ ID NO: 758875 - DNA, 25 bp, Mus musculus
tacacatacatagtttcgacccaat

SEQ ID NO: 758876 - DNA, 25 bp, Mus musculus
tacacataccatcagtgcccaagtg

SEQ ID NO: 758877 - DNA, 25 bp, Mus musculus
tacacataccatgagtgcccaagtg

SEQ ID NO: 758878 - DNA, 25 bp, Mus musculus
tacacataggcacggtgtgcccatg

SEQ ID NO: 758879 - DNA, 25 bp, Mus musculus
tacacataggcagggtgtgcccatg

SEQ ID NO: 758880 - DNA, 25 bp, Mus musculus
tacacataggtcatcgtcttgcttg

SEQ ID NO: 758881 - DNA, 25 bp, Mus musculus
tacacataggtcttcgtcttgcttg

SEQ ID NO: 758882 - DNA, 25 bp, Mus musculus
tacacatagttccagctgcatatgt

SEQ ID NO: 758883 - DNA, 25 bp, Mus musculus
tacacatagttcgagctgcatatgt

SEQ ID NO: 758884 - DNA, 25 bp, Mus musculus
tacacatataagaggtaggcacata

SEQ ID NO: 758885 - DNA, 25 bp, Mus musculus
tacacatataagtggtaggcacata

SEQ ID NO: 758886 - DNA, 25 bp, Mus musculus
tacacatatgcaaacgtgcacgaat

SEQ ID NO: 758887 - DNA, 25 bp, Mus musculus
tacacatatgcatacgtgcacgaat

SEQ ID NO: 758888 - DNA, 25 bp, Mus musculus
tacacatcaaaccacgcctgtgagg

SEQ ID NO: 758889 - DNA, 25 bp, Mus musculus
tacacatcaaacgacgcctgtgagg

SEQ ID NO: 758890 - DNA, 25 bp, Mus musculus
tacacatccagaacaagaattgact

SEQ ID NO: 758891 - DNA, 25 bp, Mus musculus
tacacatccagatcaagaattgact

SEQ ID NO: 758892 - DNA, 25 bp, Mus musculus
tacacatccatgaagacgggtagaa

SEQ ID NO: 758893 - DNA, 25 bp, Mus musculus
tacacatccatgtagacgggtagaa

SEQ ID NO: 758894 - DNA, 25 bp, Mus musculus
tacacatcccatagtaagctctgat

SEQ ID NO: 758895 - DNA, 25 bp, Mus musculus
tacacatcccattgtaagctctgat

SEQ ID NO: 758896 - DNA, 25 bp, Mus musculus
tacacatcccctatttgatttccaa

SEQ ID NO: 758897 - DNA, 25 bp, Mus musculus
tacacatcccctttttgatttccaa

SEQ ID NO: 758898 - DNA, 25 bp, Mus musculus
tacacatctaacaccgtggtgccta

SEQ ID NO: 758899 - DNA, 25 bp, Mus musculus
tacacatctaactccgtggtgccta

SEQ ID NO: 758900 - DNA, 25 bp, Mus musculus
tacacatctagcagtcagttcttgt

SEQ ID NO: 758901 - DNA, 25 bp, Mus musculus
tacacatctagctgtcagttcttgt

SEQ ID NO: 758902 - DNA, 25 bp, Mus musculus
tacacatctgccaccaacaatgttg

SEQ ID NO: 758903 - DNA, 25 bp, Mus musculus
tacacatctgcctccaacaatgttg

SEQ ID NO: 758904 - DNA, 25 bp, Mus musculus
tacacatcttgaaagttggagctgt

SEQ ID NO: 758905 - DNA, 25 bp, Mus musculus
tacacatcttgatagttggagctgt

SEQ ID NO: 758906 - DNA, 25 bp, Mus musculus
tacacatggaggaggccagcacagg

SEQ ID NO: 758907 - DNA, 25 bp, Mus musculus
tacacatggaggtggccagcacagg

SEQ ID NO: 758908 - DNA, 25 bp, Mus musculus
tacacatggagtacagctttcaaat

SEQ ID NO: 758909 - DNA, 25 bp, Mus musculus
tacacatggagttcagctttcaaat

SEQ ID NO: 758910 - DNA, 25 bp, Mus musculus
tacacatggcaccagcatgaaccgt

SEQ ID NO: 758911 - DNA, 25 bp, Mus musculus
tacacatggcacgagcatgaaccgt

SEQ ID NO: 758912 - DNA, 25 bp, Mus musculus
tacacatggtagatctagcccagta

SEQ ID NO: 758913 - DNA, 25 bp, Mus musculus
tacacatggtagttctagcccagta

SEQ ID NO: 758914 - DNA, 25 bp, Mus musculus
tacacatgtactataggattctagg

SEQ ID NO: 758915 - DNA, 25 bp, Mus musculus
tacacatgtactttaggattctagg

SEQ ID NO: 758916 - DNA, 25 bp, Mus musculus
tacacatgtgtgagccaagaccaga

SEQ ID NO: 758917 - DNA, 25 bp, Mus musculus
tacacatgtgtgtgccaagaccaga

SEQ ID NO: 758918 - DNA, 25 bp, Mus musculus
tacacatgttgtcagccatcttgct

SEQ ID NO: 758919 - DNA, 25 bp, Mus musculus
tacacatgttgtgagccatcttgct

SEQ ID NO: 758920 - DNA, 25 bp, Mus musculus
tacacattacacagggttgaacaag

SEQ ID NO: 758921 - DNA, 25 bp, Mus musculus
tacacattacactgggttgaacaag

SEQ ID NO: 758922 - DNA, 25 bp, Mus musculus
tacacattcatacctttgcgttcaa

SEQ ID NO: 758923 - DNA, 25 bp, Mus musculus
tacacattcatagctttgcgttcaa

SEQ ID NO: 758924 - DNA, 25 bp, Mus musculus
tacacattccctaccactcttaaag

SEQ ID NO: 758925 - DNA, 25 bp, Mus musculus
tacacattcccttccactcttaaag

SEQ ID NO: 758926 - DNA, 25 bp, Mus musculus
tacacattcttcacttttagctacc

SEQ ID NO: 758927 - DNA, 25 bp, Mus musculus
tacacattcttctcttttagctacc

SEQ ID NO: 758928 - DNA, 25 bp, Mus musculus
tacacattgcctacagttttctacc

SEQ ID NO: 758929 - DNA, 25 bp, Mus musculus
tacacattgccttcagttttctacc

SEQ ID NO: 758930 - DNA, 25 bp, Mus musculus
tacacattgtccaacgactcagtca

SEQ ID NO: 758931 - DNA, 25 bp, Mus musculus
tacacattgtcctacgactcagtca

SEQ ID NO: 758932 - DNA, 25 bp, Mus musculus
tacacattgtgtaccttcagccagt

SEQ ID NO: 758933 - DNA, 25 bp, Mus musculus
tacacattgtgttccttcagccagt

SEQ ID NO: 758934 - DNA, 25 bp, Mus musculus
tacacatttaccagttacaatatgc

SEQ ID NO: 758935 - DNA, 25 bp, Mus musculus
tacacatttacctgttacaatatgc

SEQ ID NO: 758936 - DNA, 25 bp, Mus musculus
tacacatttaggacgtactttgttt

SEQ ID NO: 758937 - DNA, 25 bp, Mus musculus
tacacatttaggtcgtactttgttt

SEQ ID NO: 758938 - DNA, 25 bp, Mus musculus
tacacatttagtcataccttccttg

SEQ ID NO: 758939 - DNA, 25 bp, Mus musculus
tacacatttagtgataccttccttg

SEQ ID NO: 758940 - DNA, 25 bp, Mus musculus
tacacatttatcagcacttcttcct

SEQ ID NO: 758941 - DNA, 25 bp, Mus musculus
tacacatttatctgcacttcttcct

SEQ ID NO: 758942 - DNA, 25 bp, Mus musculus
tacacatttcctaccactaaacatt

SEQ ID NO: 758943 - DNA, 25 bp, Mus musculus
tacacatttccttccactaaacatt

SEQ ID NO: 758944 - DNA, 25 bp, Mus musculus
tacacatttgcgactggttctccag

SEQ ID NO: 758945 - DNA, 25 bp, Mus musculus
tacacatttgcgtctggttctccag

SEQ ID NO: 758946 - DNA, 25 bp, Mus musculus
tacacattttaaaacagtgctggtg

SEQ ID NO: 758947 - DNA, 25 bp, Mus musculus
tacacattttaatacagtgctggtg

SEQ ID NO: 758948 - DNA, 25 bp, Mus musculus
tacaccaaccggatgagcctcaacg

SEQ ID NO: 758949 - DNA, 25 bp, Mus musculus
tacaccaaccggttgagcctcaacg

SEQ ID NO: 758950 - DNA, 25 bp, Mus musculus
tacaccaacgtgcccttcctggtgg

SEQ ID NO: 758951 - DNA, 25 bp, Mus musculus
tacaccaacgtggccttcctggtgg

SEQ ID NO: 758952 - DNA, 25 bp, Mus musculus
tacaccaactgcagttagcttcggg

SEQ ID NO: 758953 - DNA, 25 bp, Mus musculus
tacaccaactgctgttagcttcggg

SEQ ID NO: 758954 - DNA, 25 bp, Mus musculus
tacaccaagaatcctggccctcgag

SEQ ID NO: 758955 - DNA, 25 bp, Mus musculus
tacaccaagaatgctggccctcgag

SEQ ID NO: 758956 - DNA, 25 bp, Mus musculus
tacaccaagccacttaggagctctc

SEQ ID NO: 758957 - DNA, 25 bp, Mus musculus
tacaccaagccagttaggagctctc

SEQ ID NO: 758958 - DNA, 25 bp, Mus musculus
tacaccaagtatcctagcatgatca

SEQ ID NO: 758959 - DNA, 25 bp, Mus musculus
tacaccaagtatgctagcatgatca

SEQ ID NO: 758960 - DNA, 25 bp, Mus musculus
tacaccaatggtatatttctaatag

SEQ ID NO: 758961 - DNA, 25 bp, Mus musculus
tacaccaatggtttatttctaatag

SEQ ID NO: 758962 - DNA, 25 bp, Mus musculus
tacaccacaagccattaccatactg

SEQ ID NO: 758963 - DNA, 25 bp, Mus musculus
tacaccacaagcgattaccatactg

SEQ ID NO: 758964 - DNA, 25 bp, Mus musculus
tacaccacagacctgatctgctttt

SEQ ID NO: 758965 - DNA, 25 bp, Mus musculus
tacaccacagacgtgatctgctttt

SEQ ID NO: 758966 - DNA, 25 bp, Mus musculus
tacaccacagagctggagctgtcgc

SEQ ID NO: 758967 - DNA, 25 bp, Mus musculus
tacaccacagaggtggagctgtcgc

SEQ ID NO: 758968 - DNA, 25 bp, Mus musculus
tacaccacaggccagcatagcaatc

SEQ ID NO: 758969 - DNA, 25 bp, Mus musculus
tacaccacaggcgagcatagcaatc

SEQ ID NO: 758970 - DNA, 25 bp, Mus musculus
tacaccaccagcatctagaggaatt

SEQ ID NO: 758971 - DNA, 25 bp, Mus musculus
tacaccaccagcttctagaggaatt

SEQ ID NO: 758972 - DNA, 25 bp, Mus musculus
tacaccaccattcggagtttctatg

SEQ ID NO: 758973 - DNA, 25 bp, Mus musculus
tacaccaccattgggagtttctatg

SEQ ID NO: 758974 - DNA, 25 bp, Mus musculus
tacaccacccagaactggtccagtc

SEQ ID NO: 758975 - DNA, 25 bp, Mus musculus
tacaccacccagtactggtccagtc

SEQ ID NO: 758976 - DNA, 25 bp, Mus musculus
tacaccacgagaacacatgctctgg

SEQ ID NO: 758977 - DNA, 25 bp, Mus musculus
tacaccacgagatcacatgctctgg

SEQ ID NO: 758978 - DNA, 25 bp, Mus musculus
tacaccacttacaaccagacgggat

SEQ ID NO: 758979 - DNA, 25 bp, Mus musculus
tacaccacttactaccagacgggat

SEQ ID NO: 758980 - DNA, 25 bp, Mus musculus
tacaccagaaaacgctgtcctgtgg

SEQ ID NO: 758981 - DNA, 25 bp, Mus musculus
tacaccagaaaaggctgtcctgtgg

SEQ ID NO: 758982 - DNA, 25 bp, Mus musculus
tacaccagaactcatccttttgttt

SEQ ID NO: 758983 - DNA, 25 bp, Mus musculus
tacaccagaactgatccttttgttt

SEQ ID NO: 758984 - DNA, 25 bp, Mus musculus
tacaccagcaacagtgggacctcgg

SEQ ID NO: 758985 - DNA, 25 bp, Mus musculus
tacaccagcaactgtgggacctcgg

SEQ ID NO: 758986 - DNA, 25 bp, Mus musculus
tacaccagcacgctctgagttggat

SEQ ID NO: 758987 - DNA, 25 bp, Mus musculus
tacaccagcacggtctgagttggat

SEQ ID NO: 758988 - DNA, 25 bp, Mus musculus
tacaccagcgtcagtagacacggct

SEQ ID NO: 758989 - DNA, 25 bp, Mus musculus
tacaccagcgtctgtagacacggct

SEQ ID NO: 758990 - DNA, 25 bp, Mus musculus
tacaccaggaaaaactccggttgat

SEQ ID NO: 758991 - DNA, 25 bp, Mus musculus
tacaccaggaaatactccggttgat

SEQ ID NO: 758992 - DNA, 25 bp, Mus musculus
tacaccaggaggcaaggctctttgg

SEQ ID NO: 758993 - DNA, 25 bp, Mus musculus
tacaccaggagggaaggctctttgg

SEQ ID NO: 758994 - DNA, 25 bp, Mus musculus
tacaccaggcctattctttacaact

SEQ ID NO: 758995 - DNA, 25 bp, Mus musculus
tacaccaggccttttctttacaact

SEQ ID NO: 758996 - DNA, 25 bp, Mus musculus
tacaccaggtcacatctttgctcta

SEQ ID NO: 758997 - DNA, 25 bp, Mus musculus
tacaccaggtcagatctttgctcta

SEQ ID NO: 758998 - DNA, 25 bp, Mus musculus
tacaccagtaggatcaggctgaaca

SEQ ID NO: 758999 - DNA, 25 bp, Mus musculus
tacaccagtaggttcaggctgaaca

SEQ ID NO: 759000 - DNA, 25 bp, Mus musculus
tacaccagtgacctgaactatgact

SEQ ID NO: 759001 - DNA, 25 bp, Mus musculus
tacaccagtgacgtgaactatgact

SEQ ID NO: 759002 - DNA, 25 bp, Mus musculus
tacaccataagtagtcttcgctgct

SEQ ID NO: 759003 - DNA, 25 bp, Mus musculus
tacaccataagttgtcttcgctgct

SEQ ID NO: 759004 - DNA, 25 bp, Mus musculus
tacaccatatgaattctgctcatgt

SEQ ID NO: 759005 - DNA, 25 bp, Mus musculus
tacaccatatgatttctgctcatgt

SEQ ID NO: 759006 - DNA, 25 bp, Mus musculus
tacaccatatgcctcattttatcat

SEQ ID NO: 759007 - DNA, 25 bp, Mus musculus
tacaccatatgcgtcattttatcat

SEQ ID NO: 759008 - DNA, 25 bp, Mus musculus
tacaccatcatgcatctcgaatctt

SEQ ID NO: 759009 - DNA, 25 bp, Mus musculus
tacaccatcatggatctcgaatctt

SEQ ID NO: 759010 - DNA, 25 bp, Mus musculus
tacaccatgcccaagatctggattt

SEQ ID NO: 759011 - DNA, 25 bp, Mus musculus
tacaccatgccctagatctggattt

SEQ ID NO: 759012 - DNA, 25 bp, Mus musculus
tacaccatgggacaaccctgccgtg

SEQ ID NO: 759013 - DNA, 25 bp, Mus musculus
tacaccatgggagaaccctgccgtg

SEQ ID NO: 759014 - DNA, 25 bp, Mus musculus
tacacccaacatagctctgctaaag

SEQ ID NO: 759015 - DNA, 25 bp, Mus musculus
tacacccaacattgctctgctaaag

SEQ ID NO: 759016 - DNA, 25 bp, Mus musculus
tacacccaactacttttgctggtaa

SEQ ID NO: 759017 - DNA, 25 bp, Mus musculus
tacacccaactagttttgctggtaa

SEQ ID NO: 759018 - DNA, 25 bp, Mus musculus
tacacccaactcagacatcatggat

SEQ ID NO: 759019 - DNA, 25 bp, Mus musculus
tacacccaactctgacatcatggat

SEQ ID NO: 759020 - DNA, 25 bp, Mus musculus
tacacccaagagcaatagacagcag

SEQ ID NO: 759021 - DNA, 25 bp, Mus musculus
tacacccaagaggaatagacagcag

SEQ ID NO: 759022 - DNA, 25 bp, Mus musculus
tacacccaagttcttaacgcagctt

SEQ ID NO: 759023 - DNA, 25 bp, Mus musculus
tacacccaagttgttaacgcagctt

SEQ ID NO: 759024 - DNA, 25 bp, Mus musculus
tacacccaatgtaatatccccttgg

SEQ ID NO: 759025 - DNA, 25 bp, Mus musculus
tacacccaatgttatatccccttgg

SEQ ID NO: 759026 - DNA, 25 bp, Mus musculus
tacacccacaaaataccaaatccca

SEQ ID NO: 759027 - DNA, 25 bp, Mus musculus
tacacccacaaattaccaaatccca

SEQ ID NO: 759028 - DNA, 25 bp, Mus musculus
tacacccacccacagtcaggaggat

SEQ ID NO: 759029 - DNA, 25 bp, Mus musculus
tacacccacccagagtcaggaggat

SEQ ID NO: 759030 - DNA, 25 bp, Mus musculus
tacacccacctacagatccctattt

SEQ ID NO: 759031 - DNA, 25 bp, Mus musculus
tacacccacctagagatccctattt

SEQ ID NO: 759032 - DNA, 25 bp, Mus musculus
tacacccaggtgattcgagtcatct

SEQ ID NO: 759033 - DNA, 25 bp, Mus musculus
tacacccaggtgtttcgagtcatct

SEQ ID NO: 759034 - DNA, 25 bp, Mus musculus
tacacccagtggaatcacctatgac

SEQ ID NO: 759035 - DNA, 25 bp, Mus musculus
tacacccagtggtatcacctatgac

SEQ ID NO: 759036 - DNA, 25 bp, Mus musculus
tacacccagtgtcctactcatgaat

SEQ ID NO: 759037 - DNA, 25 bp, Mus musculus
tacacccagtgtgctactcatgaat

SEQ ID NO: 759038 - DNA, 25 bp, Mus musculus
tacacccataaaatctctcaaccta

SEQ ID NO: 759039 - DNA, 25 bp, Mus musculus
tacacccataaattctctcaaccta

SEQ ID NO: 759040 - DNA, 25 bp, Mus musculus
tacacccatctaaagcccagagctg

SEQ ID NO: 759041 - DNA, 25 bp, Mus musculus
tacacccatctatagcccagagctg

SEQ ID NO: 759042 - DNA, 25 bp, Mus musculus
tacaccccaatgcatctcgcagtgg

SEQ ID NO: 759043 - DNA, 25 bp, Mus musculus
tacaccccaatggatctcgcagtgg

SEQ ID NO: 759044 - DNA, 25 bp, Mus musculus
tacaccccactcatcctgatttatt

SEQ ID NO: 759045 - DNA, 25 bp, Mus musculus
tacaccccactcttcctgatttatt

SEQ ID NO: 759046 - DNA, 25 bp, Mus musculus
tacaccccatccaggaagcatgttg

SEQ ID NO: 759047 - DNA, 25 bp, Mus musculus
tacaccccatcctggaagcatgttg

SEQ ID NO: 759048 - DNA, 25 bp, Mus musculus
tacacccctgtactgtgtacacttg

SEQ ID NO: 759049 - DNA, 25 bp, Mus musculus
tacacccctgtagtgtgtacacttg

SEQ ID NO: 759050 - DNA, 25 bp, Mus musculus
tacacccgggtcctggacagtgacg

SEQ ID NO: 759051 - DNA, 25 bp, Mus musculus
tacacccgggtcgtggacagtgacg

SEQ ID NO: 759052 - DNA, 25 bp, Mus musculus
tacacccgggtgaggactcacataa

SEQ ID NO: 759053 - DNA, 25 bp, Mus musculus
tacacccgggtgtggactcacataa

SEQ ID NO: 759054 - DNA, 25 bp, Mus musculus
tacacccggtttaagctgtgctaca

SEQ ID NO: 759055 - DNA, 25 bp, Mus musculus
tacacccggttttagctgtgctaca

SEQ ID NO: 759056 - DNA, 25 bp, Mus musculus
tacacccgtgggactctcttacaaa

SEQ ID NO: 759057 - DNA, 25 bp, Mus musculus
tacacccgtgggtctctcttacaaa

SEQ ID NO: 759058 - DNA, 25 bp, Mus musculus
tacaccctaaggagttttgcgttgt

SEQ ID NO: 759059 - DNA, 25 bp, Mus musculus
tacaccctaaggtgttttgcgttgt

SEQ ID NO: 759060 - DNA, 25 bp, Mus musculus
tacaccctaatacaattattgattt

SEQ ID NO: 759061 - DNA, 25 bp, Mus musculus
tacaccctaatagaattattgattt

SEQ ID NO: 759062 - DNA, 25 bp, Mus musculus
tacaccctagttccgttctttaaca

SEQ ID NO: 759063 - DNA, 25 bp, Mus musculus
tacaccctagttgcgttctttaaca

SEQ ID NO: 759064 - DNA, 25 bp, Mus musculus
tacaccctcatgacctgtgagatgc

SEQ ID NO: 759065 - DNA, 25 bp, Mus musculus
tacaccctcatgtcctgtgagatgc

SEQ ID NO: 759066 - DNA, 25 bp, Mus musculus
tacaccctgaacatcagctttgaag

SEQ ID NO: 759067 - DNA, 25 bp, Mus musculus
tacaccctgaacttcagctttgaag

SEQ ID NO: 759068 - DNA, 25 bp, Mus musculus
tacaccctgatgcagagattgccag

SEQ ID NO: 759069 - DNA, 25 bp, Mus musculus
tacaccctgatggagagattgccag

SEQ ID NO: 759070 - DNA, 25 bp, Mus musculus
tacaccctgcctctgggacaaagcg

SEQ ID NO: 759071 - DNA, 25 bp, Mus musculus
tacaccctgcctgtgggacaaagcg

SEQ ID NO: 759072 - DNA, 25 bp, Mus musculus
tacaccctgcttcttcatgattcat

SEQ ID NO: 759073 - DNA, 25 bp, Mus musculus
tacaccctgcttgttcatgattcat

SEQ ID NO: 759074 - DNA, 25 bp, Mus musculus
tacaccctgtgaacctaacactcag

SEQ ID NO: 759075 - DNA, 25 bp, Mus musculus
tacaccctgtgatcctaacactcag

SEQ ID NO: 759076 - DNA, 25 bp, Mus musculus
tacaccctttacaattgggattgtt

SEQ ID NO: 759077 - DNA, 25 bp, Mus musculus
tacaccctttacacaattatacaac

SEQ ID NO: 759078 - DNA, 25 bp, Mus musculus
tacaccctttactattgggattgtt

SEQ ID NO: 759079 - DNA, 25 bp, Mus musculus
tacaccctttactcaattatacaac

SEQ ID NO: 759080 - DNA, 25 bp, Mus musculus
tacaccctttgaactaactagttgc

SEQ ID NO: 759081 - DNA, 25 bp, Mus musculus
tacaccctttgatctaactagttgc

SEQ ID NO: 759082 - DNA, 25 bp, Mus musculus
tacaccgaagctcctggtacacaga

SEQ ID NO: 759083 - DNA, 25 bp, Mus musculus
tacaccgaagctgctggtacacaga

SEQ ID NO: 759084 - DNA, 25 bp, Mus musculus
tacaccgaccgcatcctgggagtgc

SEQ ID NO: 759085 - DNA, 25 bp, Mus musculus
tacaccgaccgcttcctgggagtgc

SEQ ID NO: 759086 - DNA, 25 bp, Mus musculus
tacaccgactgtcatcagcccttgt

SEQ ID NO: 759087 - DNA, 25 bp, Mus musculus
tacaccgactgtgatcagcccttgt

SEQ ID NO: 759088 - DNA, 25 bp, Mus musculus
tacaccgatggtcacagggctgtct

SEQ ID NO: 759089 - DNA, 25 bp, Mus musculus
tacaccgatggtgacagggctgtct

SEQ ID NO: 759090 - DNA, 25 bp, Mus musculus
tacaccgcagacatcatccaaggtc

SEQ ID NO: 759091 - DNA, 25 bp, Mus musculus
tacaccgcagacttcatccaaggtc

SEQ ID NO: 759092 - DNA, 25 bp, Mus musculus
tacaccgctaccagttctttgtcta

SEQ ID NO: 759093 - DNA, 25 bp, Mus musculus
tacaccgctacctgttctttgtcta

SEQ ID NO: 759094 - DNA, 25 bp, Mus musculus
tacaccgctgtgagcagatccatgc

SEQ ID NO: 759095 - DNA, 25 bp, Mus musculus
tacaccgctgtgtgcagatccatgc

SEQ ID NO: 759096 - DNA, 25 bp, Mus musculus
tacaccgctttgacctggagcatga

SEQ ID NO: 759097 - DNA, 25 bp, Mus musculus
tacaccgctttgtcctggagcatga

SEQ ID NO: 759098 - DNA, 25 bp, Mus musculus
tacaccggcatcctctgtgagaagc

SEQ ID NO: 759099 - DNA, 25 bp, Mus musculus
tacaccggcatcgtctgtgagaagc

SEQ ID NO: 759100 - DNA, 25 bp, Mus musculus
tacaccggcattcgctgtgagcagc

SEQ ID NO: 759101 - DNA, 25 bp, Mus musculus
tacaccggcattggctgtgagcagc

SEQ ID NO: 759102 - DNA, 25 bp, Mus musculus
tacaccgggctgaagaaaactctac

SEQ ID NO: 759103 - DNA, 25 bp, Mus musculus
tacaccgggctgtagaaaactctac

SEQ ID NO: 759104 - DNA, 25 bp, Mus musculus
tacaccggtcatagttcccggaagt

SEQ ID NO: 759105 - DNA, 25 bp, Mus musculus
tacaccggtcattgttcccggaagt

SEQ ID NO: 759106 - DNA, 25 bp, Mus musculus
tacaccgtccaacactttgagcgtt

SEQ ID NO: 759107 - DNA, 25 bp, Mus musculus
tacaccgtccaagactttgagcgtt

SEQ ID NO: 759108 - DNA, 25 bp, Mus musculus
tacaccgtccggctggaggatcaaa

SEQ ID NO: 759109 - DNA, 25 bp, Mus musculus
tacaccgtccgggtggaggatcaaa

SEQ ID NO: 759110 - DNA, 25 bp, Mus musculus
tacaccgtcctacggcacttgagaa

SEQ ID NO: 759111 - DNA, 25 bp, Mus musculus
tacaccgtcctagggcacttgagaa

SEQ ID NO: 759112 - DNA, 25 bp, Mus musculus
tacaccgtgcctacgctcttgggct

SEQ ID NO: 759113 - DNA, 25 bp, Mus musculus
tacaccgtgccttcgctcttgggct

SEQ ID NO: 759114 - DNA, 25 bp, Mus musculus
tacacctacatcatccctaaaataa

SEQ ID NO: 759115 - DNA, 25 bp, Mus musculus
tacacctacatcttccctaaaataa

SEQ ID NO: 759116 - DNA, 25 bp, Mus musculus
tacacctataaaacccaatgcctgg

SEQ ID NO: 759117 - DNA, 25 bp, Mus musculus
tacacctataaatcccaatgcctgg

SEQ ID NO: 759118 - DNA, 25 bp, Mus musculus
tacacctccattcgctattcctttg

SEQ ID NO: 759119 - DNA, 25 bp, Mus musculus
tacacctccattggctattcctttg

SEQ ID NO: 759120 - DNA, 25 bp, Mus musculus
tacacctcgcatctgagatctggct

SEQ ID NO: 759121 - DNA, 25 bp, Mus musculus
tacacctcgcatgtgagatctggct

SEQ ID NO: 759122 - DNA, 25 bp, Mus musculus
tacacctctagaccctgttcaatag

SEQ ID NO: 759123 - DNA, 25 bp, Mus musculus
tacacctctagagcctgttcaatag

SEQ ID NO: 759124 - DNA, 25 bp, Mus musculus
tacacctctaggcagcagctcacaa

SEQ ID NO: 759125 - DNA, 25 bp, Mus musculus
tacacctctagggagcagctcacaa

SEQ ID NO: 759126 - DNA, 25 bp, Mus musculus
tacacctctagtagggtcttggaga

SEQ ID NO: 759127 - DNA, 25 bp, Mus musculus
tacacctctagttgggtcttggaga

SEQ ID NO: 759128 - DNA, 25 bp, Mus musculus
tacacctctttacgtatatgatgtg

SEQ ID NO: 759129 - DNA, 25 bp, Mus musculus
tacacctctttaggtatatgatgtg

SEQ ID NO: 759130 - DNA, 25 bp, Mus musculus
tacacctgcttgattccatacaaac

SEQ ID NO: 759131 - DNA, 25 bp, Mus musculus
tacacctgcttgtttccatacaaac

SEQ ID NO: 759132 - DNA, 25 bp, Mus musculus
tacacctggcggaacgtggcagaga

SEQ ID NO: 759133 - DNA, 25 bp, Mus musculus
tacacctggcggtacgtggcagaga

SEQ ID NO: 759134 - DNA, 25 bp, Mus musculus
tacacctggcttaatctggtgctgg

SEQ ID NO: 759135 - DNA, 25 bp, Mus musculus
tacacctggctttatctggtgctgg

SEQ ID NO: 759136 - DNA, 25 bp, Mus musculus
tacacctgtgtgcttttctagaaaa

SEQ ID NO: 759137 - DNA, 25 bp, Mus musculus
tacacctgtgtggttttctagaaaa

SEQ ID NO: 759138 - DNA, 25 bp, Mus musculus
tacaccttagccaagctcctagtta

SEQ ID NO: 759139 - DNA, 25 bp, Mus musculus
tacaccttagcctagctcctagtta

SEQ ID NO: 759140 - DNA, 25 bp, Mus musculus
tacaccttaggtatctcaggccttt

SEQ ID NO: 759141 - DNA, 25 bp, Mus musculus
tacaccttaggtttctcaggccttt

SEQ ID NO: 759142 - DNA, 25 bp, Mus musculus
tacaccttcatcacagaggatcaag

SEQ ID NO: 759143 - DNA, 25 bp, Mus musculus
tacaccttcatctcagaggatcaag

SEQ ID NO: 759144 - DNA, 25 bp, Mus musculus
tacaccttccaacgtgtcttctggg

SEQ ID NO: 759145 - DNA, 25 bp, Mus musculus
tacaccttccaaggtgtcttctggg

SEQ ID NO: 759146 - DNA, 25 bp, Mus musculus
tacaccttcctacgatgggccagga

SEQ ID NO: 759147 - DNA, 25 bp, Mus musculus
tacaccttcctaggatgggccagga

SEQ ID NO: 759148 - DNA, 25 bp, Mus musculus
tacaccttggtaaaacacatggcac

SEQ ID NO: 759149 - DNA, 25 bp, Mus musculus
tacaccttggtataacacatggcac

SEQ ID NO: 759150 - DNA, 25 bp, Mus musculus
tacaccttggtgctatccttttgaa

SEQ ID NO: 759151 - DNA, 25 bp, Mus musculus
tacaccttggtggtatccttttgaa

SEQ ID NO: 759152 - DNA, 25 bp, Mus musculus
tacacctttaaaaggagtcaacttt

SEQ ID NO: 759153 - DNA, 25 bp, Mus musculus
tacacctttaaatggagtcaacttt

SEQ ID NO: 759154 - DNA, 25 bp, Mus musculus
tacaccttttcaagtgttccctgac

SEQ ID NO: 759155 - DNA, 25 bp, Mus musculus
tacaccttttcatgtgttccctgac

SEQ ID NO: 759156 - DNA, 25 bp, Mus musculus
tacacgaacccgatggagtagcacc

SEQ ID NO: 759157 - DNA, 25 bp, Mus musculus
tacacgaacccgttggagtagcacc

SEQ ID NO: 759158 - DNA, 25 bp, Mus musculus
tacacgaccagaactgcgcttctgt

SEQ ID NO: 759159 - DNA, 25 bp, Mus musculus
tacacgaccagatctgcgcttctgt

SEQ ID NO: 759160 - DNA, 25 bp, Mus musculus
tacacgacgcacatacgcctttaag

SEQ ID NO: 759161 - DNA, 25 bp, Mus musculus
tacacgacgcacttacgcctttaag

SEQ ID NO: 759162 - DNA, 25 bp, Mus musculus
tacacgagagaactaaacagctttc

SEQ ID NO: 759163 - DNA, 25 bp, Mus musculus
tacacgagagaagtaaacagctttc

SEQ ID NO: 759164 - DNA, 25 bp, Mus musculus
tacacgaggatcaagcgcccacagg

SEQ ID NO: 759165 - DNA, 25 bp, Mus musculus
tacacgaggatctagcgcccacagg

SEQ ID NO: 759166 - DNA, 25 bp, Mus musculus
tacacgcactgaaacgtccacatag

SEQ ID NO: 759167 - DNA, 25 bp, Mus musculus
tacacgcactgatacgtccacatag

SEQ ID NO: 759168 - DNA, 25 bp, Mus musculus
tacacgcagaaacacagtccacagg

SEQ ID NO: 759169 - DNA, 25 bp, Mus musculus
tacacgcagaaagacagtccacagg

SEQ ID NO: 759170 - DNA, 25 bp, Mus musculus
tacacgcatgtgatccgtctgaaaa

SEQ ID NO: 759171 - DNA, 25 bp, Mus musculus
tacacgcatgtgttccgtctgaaaa

SEQ ID NO: 759172 - DNA, 25 bp, Mus musculus
tacacgccccaaaaagatgggtaca

SEQ ID NO: 759173 - DNA, 25 bp, Mus musculus
tacacgccccaataagatgggtaca

SEQ ID NO: 759174 - DNA, 25 bp, Mus musculus
tacacgcccttcctagtaataaaat

SEQ ID NO: 759175 - DNA, 25 bp, Mus musculus
tacacgcccttcgtagtaataaaat

SEQ ID NO: 759176 - DNA, 25 bp, Mus musculus
tacacgcctaccagaatacttttgg

SEQ ID NO: 759177 - DNA, 25 bp, Mus musculus
tacacgcctacctgaatacttttgg

SEQ ID NO: 759178 - DNA, 25 bp, Mus musculus
tacacgcctagaagaccagtactat

SEQ ID NO: 759179 - DNA, 25 bp, Mus musculus
tacacgcctagatgaccagtactat

SEQ ID NO: 759180 - DNA, 25 bp, Mus musculus
tacacgcctggaacctatgtttagt

SEQ ID NO: 759181 - DNA, 25 bp, Mus musculus
tacacgcctggatcctatgtttagt

SEQ ID NO: 759182 - DNA, 25 bp, Mus musculus
tacacgcgtgtaactctcttggtac

SEQ ID NO: 759183 - DNA, 25 bp, Mus musculus
tacacgcgtgtacccatgtacacat

SEQ ID NO: 759184 - DNA, 25 bp, Mus musculus
tacacgcgtgtagccatgtacacat

SEQ ID NO: 759185 - DNA, 25 bp, Mus musculus
tacacgcgtgtatctctcttggtac

SEQ ID NO: 759186 - DNA, 25 bp, Mus musculus
tacacgctgctgaaggagagcaccg

SEQ ID NO: 759187 - DNA, 25 bp, Mus musculus
tacacgctgctgtaggagagcaccg

SEQ ID NO: 759188 - DNA, 25 bp, Mus musculus
tacacgctggtaacttacgtgcctg

SEQ ID NO: 759189 - DNA, 25 bp, Mus musculus
tacacgctggtatcttacgtgcctg

SEQ ID NO: 759190 - DNA, 25 bp, Mus musculus
tacacgcttgcgcatatccggtgcc

SEQ ID NO: 759191 - DNA, 25 bp, Mus musculus
tacacgcttgcggatatccggtgcc

SEQ ID NO: 759192 - DNA, 25 bp, Mus musculus
tacacgctttcaagaaggtcctctc

SEQ ID NO: 759193 - DNA, 25 bp, Mus musculus
tacacgctttcatgaaggtcctctc

SEQ ID NO: 759194 - DNA, 25 bp, Mus musculus
tacacggaagcaaaccacgcggcat

SEQ ID NO: 759195 - DNA, 25 bp, Mus musculus
tacacggaagcataccacgcggcat

SEQ ID NO: 759196 - DNA, 25 bp, Mus musculus
tacacggacgtgaccaacatgggcc

SEQ ID NO: 759197 - DNA, 25 bp, Mus musculus
tacacggacgtgtccaacatgggcc

SEQ ID NO: 759198 - DNA, 25 bp, Mus musculus
tacacggaggtgcacatcggagaac

SEQ ID NO: 759199 - DNA, 25 bp, Mus musculus
tacacggaggtggacatcggagaac

SEQ ID NO: 759200 - DNA, 25 bp, Mus musculus
tacacggagtctactattctgagcc

SEQ ID NO: 759201 - DNA, 25 bp, Mus musculus
tacacggagtcttctattctgagcc

SEQ ID NO: 759202 - DNA, 25 bp, Mus musculus
tacacggattgacttaaacccaggg

SEQ ID NO: 759203 - DNA, 25 bp, Mus musculus
tacacggattgagttaaacccaggg

SEQ ID NO: 759204 - DNA, 25 bp, Mus musculus
tacacggcctgtatactttagtatg

SEQ ID NO: 759205 - DNA, 25 bp, Mus musculus
tacacggcctgtttactttagtatg

SEQ ID NO: 759206 - DNA, 25 bp, Mus musculus
tacacggcgctgcagaacgccaagt

SEQ ID NO: 759207 - DNA, 25 bp, Mus musculus
tacacggcgctggagaacgccaagt

SEQ ID NO: 759208 - DNA, 25 bp, Mus musculus
tacacgggagatcatcaacaacaag

SEQ ID NO: 759209 - DNA, 25 bp, Mus musculus
tacacgggagatgatcaacaacaag

SEQ ID NO: 759210 - DNA, 25 bp, Mus musculus
tacacgggcactcactaggaggacc

SEQ ID NO: 759211 - DNA, 25 bp, Mus musculus
tacacgggcactgactaggaggacc

SEQ ID NO: 759212 - DNA, 25 bp, Mus musculus
tacacggtccagcatgagagtcatt

SEQ ID NO: 759213 - DNA, 25 bp, Mus musculus
tacacggtccaggatgagagtcatt

SEQ ID NO: 759214 - DNA, 25 bp, Mus musculus
tacacggtccatcgatccaggttac

SEQ ID NO: 759215 - DNA, 25 bp, Mus musculus
tacacggtccatggatccaggttac

SEQ ID NO: 759216 - DNA, 25 bp, Mus musculus
tacacggtgctacctgagagcaaga

SEQ ID NO: 759217 - DNA, 25 bp, Mus musculus
tacacggtgctagctgagagcaaga

SEQ ID NO: 759218 - DNA, 25 bp, Mus musculus
tacacggtgctcaggatcttcttgg

SEQ ID NO: 759219 - DNA, 25 bp, Mus musculus
tacacggtgctctggatcttcttgg

SEQ ID NO: 759220 - DNA, 25 bp, Mus musculus
tacacggtttttcgcttctcttact

SEQ ID NO: 759221 - DNA, 25 bp, Mus musculus
tacacggtttttggcttctcttact

SEQ ID NO: 759222 - DNA, 25 bp, Mus musculus
tacacgtccctacagcgtcgagaga

SEQ ID NO: 759223 - DNA, 25 bp, Mus musculus
tacacgtccctagagcgtcgagaga

SEQ ID NO: 759224 - DNA, 25 bp, Mus musculus
tacacgtcttggctgaacactgggc

SEQ ID NO: 759225 - DNA, 25 bp, Mus musculus
tacacgtcttgggtgaacactgggc

SEQ ID NO: 759226 - DNA, 25 bp, Mus musculus
tacacgtgcataattcctgagaaag

SEQ ID NO: 759227 - DNA, 25 bp, Mus musculus
tacacgtgcatatttcctgagaaag

SEQ ID NO: 759228 - DNA, 25 bp, Mus musculus
tacacgtgcattaatataccctgaa

SEQ ID NO: 759229 - DNA, 25 bp, Mus musculus
tacacgtgcatttatataccctgaa

SEQ ID NO: 759230 - DNA, 25 bp, Mus musculus
tacacgtgcgttcaaggaaatctgg

SEQ ID NO: 759231 - DNA, 25 bp, Mus musculus
tacacgtgcgttgaaggaaatctgg

SEQ ID NO: 759232 - DNA, 25 bp, Mus musculus
tacacgtggctcaagggcctggaga

SEQ ID NO: 759233 - DNA, 25 bp, Mus musculus
tacacgtggctctagggcctggaga

SEQ ID NO: 759234 - DNA, 25 bp, Mus musculus
tacacgtgtggactcatagctaggt

SEQ ID NO: 759235 - DNA, 25 bp, Mus musculus
tacacgtgtggagtcatagctaggt

SEQ ID NO: 759236 - DNA, 25 bp, Mus musculus
tacacgttactccagcgctactctt

SEQ ID NO: 759237 - DNA, 25 bp, Mus musculus
tacacgttactcgagcgctactctt

SEQ ID NO: 759238 - DNA, 25 bp, Mus musculus
tacacgttcttcctaccttcgaatt

SEQ ID NO: 759239 - DNA, 25 bp, Mus musculus
tacacgttcttcgtaccttcgaatt

SEQ ID NO: 759240 - DNA, 25 bp, Mus musculus
tacactaaaagcatcctgcttacta

SEQ ID NO: 759241 - DNA, 25 bp, Mus musculus
tacactaaaagcttcctgcttacta

SEQ ID NO: 759242 - DNA, 25 bp, Mus musculus
tacactaactttccatactttattc

SEQ ID NO: 759243 - DNA, 25 bp, Mus musculus
tacactaactttgcatactttattc

SEQ ID NO: 759244 - DNA, 25 bp, Mus musculus
tacactaatataaggacctagctta

SEQ ID NO: 759245 - DNA, 25 bp, Mus musculus
tacactaatatatggacctagctta

SEQ ID NO: 759246 - DNA, 25 bp, Mus musculus
tacactaatgccacatacactcgtc

SEQ ID NO: 759247 - DNA, 25 bp, Mus musculus
tacactaatgcctcatacactcgtc

SEQ ID NO: 759248 - DNA, 25 bp, Mus musculus
tacactacaaggctggccagcctga

SEQ ID NO: 759249 - DNA, 25 bp, Mus musculus
tacactacaagggtggccagcctga

SEQ ID NO: 759250 - DNA, 25 bp, Mus musculus
tacactacagtgaagggaagttcct

SEQ ID NO: 759251 - DNA, 25 bp, Mus musculus
tacactacagtgtagggaagttcct

SEQ ID NO: 759252 - DNA, 25 bp, Mus musculus
tacactacggacaaggagccccgag

SEQ ID NO: 759253 - DNA, 25 bp, Mus musculus
tacactacggactaggagccccgag

SEQ ID NO: 759254 - DNA, 25 bp, Mus musculus
tacactacttgaacaatcaaattgg

SEQ ID NO: 759255 - DNA, 25 bp, Mus musculus
tacactacttgatcaatcaaattgg

SEQ ID NO: 759256 - DNA, 25 bp, Mus musculus
tacactagcccacatgttgacgttg

SEQ ID NO: 759257 - DNA, 25 bp, Mus musculus
tacactagcccagatgttgacgttg

SEQ ID NO: 759258 - DNA, 25 bp, Mus musculus
tacactagtagaatctcctgagact

SEQ ID NO: 759259 - DNA, 25 bp, Mus musculus
tacactagtagattctcctgagact

SEQ ID NO: 759260 - DNA, 25 bp, Mus musculus
tacactattactcagcgctgatggc

SEQ ID NO: 759261 - DNA, 25 bp, Mus musculus
tacactattactgagcgctgatggc

SEQ ID NO: 759262 - DNA, 25 bp, Mus musculus
tacactattttacccagaactttct

SEQ ID NO: 759263 - DNA, 25 bp, Mus musculus
tacactattttagccagaactttct

SEQ ID NO: 759264 - DNA, 25 bp, Mus musculus
tacactcaaacaatctgaggttgaa

SEQ ID NO: 759265 - DNA, 25 bp, Mus musculus
tacactcaaacattctgaggttgaa

SEQ ID NO: 759266 - DNA, 25 bp, Mus musculus
tacactcaaatacacttcagttttt

SEQ ID NO: 759267 - DNA, 25 bp, Mus musculus
tacactcaaatagacttcagttttt

SEQ ID NO: 759268 - DNA, 25 bp, Mus musculus
tacactcaattgatacccactcatg

SEQ ID NO: 759269 - DNA, 25 bp, Mus musculus
tacactcaattgttacccactcatg

SEQ ID NO: 759270 - DNA, 25 bp, Mus musculus
tacactcaccaaaaccaccacatat

SEQ ID NO: 759271 - DNA, 25 bp, Mus musculus
tacactcaccaataccaccacatat

SEQ ID NO: 759272 - DNA, 25 bp, Mus musculus
tacactcaccttcatgtctacaaaa

SEQ ID NO: 759273 - DNA, 25 bp, Mus musculus
tacactcaccttgatgtctacaaaa

SEQ ID NO: 759274 - DNA, 25 bp, Mus musculus
tacactcactctctttgaaccagat

SEQ ID NO: 759275 - DNA, 25 bp, Mus musculus
tacactcactctgtttgaaccagat

SEQ ID NO: 759276 - DNA, 25 bp, Mus musculus
tacactcacttccagggtgggtcta

SEQ ID NO: 759277 - DNA, 25 bp, Mus musculus
tacactcacttcgagggtgggtcta

SEQ ID NO: 759278 - DNA, 25 bp, Mus musculus
tacactcagaggagaccctccctga

SEQ ID NO: 759279 - DNA, 25 bp, Mus musculus
tacactcagaggagctctcggtaca

SEQ ID NO: 759280 - DNA, 25 bp, Mus musculus
tacactcagaggtgaccctccctga

SEQ ID NO: 759281 - DNA, 25 bp, Mus musculus
tacactcagaggtgctctcggtaca

SEQ ID NO: 759282 - DNA, 25 bp, Mus musculus
tacactcaggtaagcatgcacacat

SEQ ID NO: 759283 - DNA, 25 bp, Mus musculus
tacactcaggtaattgccatcaggt

SEQ ID NO: 759284 - DNA, 25 bp, Mus musculus
tacactcaggtatgcatgcacacat

SEQ ID NO: 759285 - DNA, 25 bp, Mus musculus
tacactcaggtatttgccatcaggt

SEQ ID NO: 759286 - DNA, 25 bp, Mus musculus
tacactcatctactgatgctgcgga

SEQ ID NO: 759287 - DNA, 25 bp, Mus musculus
tacactcatctagtgatgctgcgga

SEQ ID NO: 759288 - DNA, 25 bp, Mus musculus
tacactcatcttcttgtgtcagaaa

SEQ ID NO: 759289 - DNA, 25 bp, Mus musculus
tacactcatcttgttgtgtcagaaa

SEQ ID NO: 759290 - DNA, 25 bp, Mus musculus
tacactccacgcctttatttgatac

SEQ ID NO: 759291 - DNA, 25 bp, Mus musculus
tacactccacgcgtttatttgatac

SEQ ID NO: 759292 - DNA, 25 bp, Mus musculus
tacactccatggctcatgtgcaagt

SEQ ID NO: 759293 - DNA, 25 bp, Mus musculus
tacactccatgggtcatgtgcaagt

SEQ ID NO: 759294 - DNA, 25 bp, Mus musculus
tacactcccaggatggagcctaggg

SEQ ID NO: 759295 - DNA, 25 bp, Mus musculus
tacactcccaggttggagcctaggg

SEQ ID NO: 759296 - DNA, 25 bp, Mus musculus
tacactccccttcaaggatgctatt

SEQ ID NO: 759297 - DNA, 25 bp, Mus musculus
tacactccccttgaaggatgctatt

SEQ ID NO: 759298 - DNA, 25 bp, Mus musculus
tacactccctgcagttaccgaggaa

SEQ ID NO: 759299 - DNA, 25 bp, Mus musculus
tacactccctgctgttaccgaggaa

SEQ ID NO: 759300 - DNA, 25 bp, Mus musculus
tacactccggatattcgtgctcata

SEQ ID NO: 759301 - DNA, 25 bp, Mus musculus
tacactccggattttcgtgctcata

SEQ ID NO: 759302 - DNA, 25 bp, Mus musculus
tacactcctaataaaactgttgcat

SEQ ID NO: 759303 - DNA, 25 bp, Mus musculus
tacactcctaattaaactgttgcat

SEQ ID NO: 759304 - DNA, 25 bp, Mus musculus
tacactcctacactatgactgcatt

SEQ ID NO: 759305 - DNA, 25 bp, Mus musculus
tacactcctacagtatgactgcatt

SEQ ID NO: 759306 - DNA, 25 bp, Mus musculus
tacactcctagtatacaaagtcttt

SEQ ID NO: 759307 - DNA, 25 bp, Mus musculus
tacactcctagtttacaaagtcttt

SEQ ID NO: 759308 - DNA, 25 bp, Mus musculus
tacactcctcataattctcttctaa

SEQ ID NO: 759309 - DNA, 25 bp, Mus musculus
tacactcctcattattctcttctaa

SEQ ID NO: 759310 - DNA, 25 bp, Mus musculus
tacactcctggcattgtgaggcacc

SEQ ID NO: 759311 - DNA, 25 bp, Mus musculus
tacactcctggctttgtgaggcacc

SEQ ID NO: 759312 - DNA, 25 bp, Mus musculus
tacactcctgttacgacctgagaga

SEQ ID NO: 759313 - DNA, 25 bp, Mus musculus
tacactcctgtttcgacctgagaga

SEQ ID NO: 759314 - DNA, 25 bp, Mus musculus
tacactccttaacaccatgtttggc

SEQ ID NO: 759315 - DNA, 25 bp, Mus musculus
tacactccttaagaccatgtttggc

SEQ ID NO: 759316 - DNA, 25 bp, Mus musculus
tacactcgggtcagcaagttcagta

SEQ ID NO: 759317 - DNA, 25 bp, Mus musculus
tacactcgggtctgcaagttcagta

SEQ ID NO: 759318 - DNA, 25 bp, Mus musculus
tacactctacggatacttgatgcaa

SEQ ID NO: 759319 - DNA, 25 bp, Mus musculus
tacactctacggttacttgatgcaa

SEQ ID NO: 759320 - DNA, 25 bp, Mus musculus
tacactctacttcaggctagcccta

SEQ ID NO: 759321 - DNA, 25 bp, Mus musculus
tacactctacttgaggctagcccta

SEQ ID NO: 759322 - DNA, 25 bp, Mus musculus
tacactctaggtaaaagaatgcccc

SEQ ID NO: 759323 - DNA, 25 bp, Mus musculus
tacactctaggttaaagaatgcccc

SEQ ID NO: 759324 - DNA, 25 bp, Mus musculus
tacactctagtgcttgcacggctgc

SEQ ID NO: 759325 - DNA, 25 bp, Mus musculus
tacactctagtggttgcacggctgc

SEQ ID NO: 759326 - DNA, 25 bp, Mus musculus
tacactctatttctcttcgggtttg

SEQ ID NO: 759327 - DNA, 25 bp, Mus musculus
tacactctatttgtcttcgggtttg

SEQ ID NO: 759328 - DNA, 25 bp, Mus musculus
tacactctcaaaccttcagtcccat

SEQ ID NO: 759329 - DNA, 25 bp, Mus musculus
tacactctcaaagcttcagtcccat

SEQ ID NO: 759330 - DNA, 25 bp, Mus musculus
tacactctcgtcagagctggaagag

SEQ ID NO: 759331 - DNA, 25 bp, Mus musculus
tacactctcgtctgagctggaagag

SEQ ID NO: 759332 - DNA, 25 bp, Mus musculus
tacactctctcccagcaaagcaaat

SEQ ID NO: 759333 - DNA, 25 bp, Mus musculus
tacactctctccgagcaaagcaaat

SEQ ID NO: 759334 - DNA, 25 bp, Mus musculus
tacactctctttcaagattattgtg

SEQ ID NO: 759335 - DNA, 25 bp, Mus musculus
tacactctctttgaagattattgtg

SEQ ID NO: 759336 - DNA, 25 bp, Mus musculus
tacactctgtacactgaagcttttg

SEQ ID NO: 759337 - DNA, 25 bp, Mus musculus
tacactctgtactctgaagcttttg

SEQ ID NO: 759338 - DNA, 25 bp, Mus musculus
tacactctgtagctgtatccaggga

SEQ ID NO: 759339 - DNA, 25 bp, Mus musculus
tacactctgtaggtgtatccaggga

SEQ ID NO: 759340 - DNA, 25 bp, Mus musculus
tacactctgtgtcattaggaaaaac

SEQ ID NO: 759341 - DNA, 25 bp, Mus musculus
tacactctgtgtgattaggaaaaac

SEQ ID NO: 759342 - DNA, 25 bp, Mus musculus
tacactcttttcacgtacttctagt

SEQ ID NO: 759343 - DNA, 25 bp, Mus musculus
tacactcttttctcgtacttctagt

SEQ ID NO: 759344 - DNA, 25 bp, Mus musculus
tacactgaacatagggtcacccatg

SEQ ID NO: 759345 - DNA, 25 bp, Mus musculus
tacactgaacattgggtcacccatg

SEQ ID NO: 759346 - DNA, 25 bp, Mus musculus
tacactgacagtcactttcatccca

SEQ ID NO: 759347 - DNA, 25 bp, Mus musculus
tacactgacagtgactttcatccca

SEQ ID NO: 759348 - DNA, 25 bp, Mus musculus
tacactgacattctgatttcctgag

SEQ ID NO: 759349 - DNA, 25 bp, Mus musculus
tacactgacattgtgatttcctgag

SEQ ID NO: 759350 - DNA, 25 bp, Mus musculus
tacactgaccctcagggtattatgt

SEQ ID NO: 759351 - DNA, 25 bp, Mus musculus
tacactgaccctgagggtattatgt

SEQ ID NO: 759352 - DNA, 25 bp, Mus musculus
tacactgacctaaagacttcccttt

SEQ ID NO: 759353 - DNA, 25 bp, Mus musculus
tacactgacctatagacttcccttt

SEQ ID NO: 759354 - DNA, 25 bp, Mus musculus
tacactgaccttcccttatgtggaa

SEQ ID NO: 759355 - DNA, 25 bp, Mus musculus
tacactgaccttgccttatgtggaa

SEQ ID NO: 759356 - DNA, 25 bp, Mus musculus
tacactgacgccaaaccacaggtaa

SEQ ID NO: 759357 - DNA, 25 bp, Mus musculus
tacactgacgcctaaccacaggtaa

SEQ ID NO: 759358 - DNA, 25 bp, Mus musculus
tacactgactctaccaatacatttg

SEQ ID NO: 759359 - DNA, 25 bp, Mus musculus
tacactgactcttccaatacatttg

SEQ ID NO: 759360 - DNA, 25 bp, Mus musculus
tacactgactgtaattttaactgtt

SEQ ID NO: 759361 - DNA, 25 bp, Mus musculus
tacactgactgttattttaactgtt

SEQ ID NO: 759362 - DNA, 25 bp, Mus musculus
tacactgagctaagacccactgacc

SEQ ID NO: 759363 - DNA, 25 bp, Mus musculus
tacactgagctatgacccactgacc

SEQ ID NO: 759364 - DNA, 25 bp, Mus musculus
tacactgaggaacgatcgaggcgaa

SEQ ID NO: 759365 - DNA, 25 bp, Mus musculus
tacactgaggaaggatcgaggcgaa

SEQ ID NO: 759366 - DNA, 25 bp, Mus musculus
tacactgagttaaccaaatatcatg

SEQ ID NO: 759367 - DNA, 25 bp, Mus musculus
tacactgagttatccaaatatcatg

SEQ ID NO: 759368 - DNA, 25 bp, Mus musculus
tacactgattgtagggaaggtcctt

SEQ ID NO: 759369 - DNA, 25 bp, Mus musculus
tacactgattgttgggaaggtcctt

SEQ ID NO: 759370 - DNA, 25 bp, Mus musculus
tacactgcaattattctctaacatt

SEQ ID NO: 759371 - DNA, 25 bp, Mus musculus
tacactgcaatttttctctaacatt

SEQ ID NO: 759372 - DNA, 25 bp, Mus musculus
tacactgcacagactcggaagaggg

SEQ ID NO: 759373 - DNA, 25 bp, Mus musculus
tacactgcacagtctcggaagaggg

SEQ ID NO: 759374 - DNA, 25 bp, Mus musculus
tacactgcacctacggctgcgatga

SEQ ID NO: 759375 - DNA, 25 bp, Mus musculus
tacactgcaccttcggctgcgatga

SEQ ID NO: 759376 - DNA, 25 bp, Mus musculus
tacactgcagcacattcctaagaca

SEQ ID NO: 759377 - DNA, 25 bp, Mus musculus
tacactgcagcagattcctaagaca

SEQ ID NO: 759378 - DNA, 25 bp, Mus musculus
tacactgcagctaggaaaacccagg

SEQ ID NO: 759379 - DNA, 25 bp, Mus musculus
tacactgcagcttggaaaacccagg

SEQ ID NO: 759380 - DNA, 25 bp, Mus musculus
tacactgcagtaacccacatgcttt

SEQ ID NO: 759381 - DNA, 25 bp, Mus musculus
tacactgcagtatcccacatgcttt

SEQ ID NO: 759382 - DNA, 25 bp, Mus musculus
tacactgcatgtaggctgaccacag

SEQ ID NO: 759383 - DNA, 25 bp, Mus musculus
tacactgcatgttggctgaccacag

SEQ ID NO: 759384 - DNA, 25 bp, Mus musculus
tacactgccagtcctattaccaatc

SEQ ID NO: 759385 - DNA, 25 bp, Mus musculus
tacactgccagtgctattaccaatc

SEQ ID NO: 759386 - DNA, 25 bp, Mus musculus
tacactgccatccactatgactgat

SEQ ID NO: 759387 - DNA, 25 bp, Mus musculus
tacactgccatcgactatgactgat

SEQ ID NO: 759388 - DNA, 25 bp, Mus musculus
tacactgcctggctgatccagaacc

SEQ ID NO: 759389 - DNA, 25 bp, Mus musculus
tacactgcctgggtgatccagaacc

SEQ ID NO: 759390 - DNA, 25 bp, Mus musculus
tacactgccttaatccacaagggcc

SEQ ID NO: 759391 - DNA, 25 bp, Mus musculus
tacactgccttattccacaagggcc

SEQ ID NO: 759392 - DNA, 25 bp, Mus musculus
tacactgctcagatacatcctattg

SEQ ID NO: 759393 - DNA, 25 bp, Mus musculus
tacactgctcagttacatcctattg

SEQ ID NO: 759394 - DNA, 25 bp, Mus musculus
tacactgctgatcacaggatccaga

SEQ ID NO: 759395 - DNA, 25 bp, Mus musculus
tacactgctgatgacaggatccaga

SEQ ID NO: 759396 - DNA, 25 bp, Mus musculus
tacactgctgccatggtgcaaattc

SEQ ID NO: 759397 - DNA, 25 bp, Mus musculus
tacactgctgccttggtgcaaattc

SEQ ID NO: 759398 - DNA, 25 bp, Mus musculus
tacactgctgggagcaatattaata

SEQ ID NO: 759399 - DNA, 25 bp, Mus musculus
tacactgctgggtgcaatattaata

SEQ ID NO: 759400 - DNA, 25 bp, Mus musculus
tacactgctgtaactaatgcgtagg

SEQ ID NO: 759401 - DNA, 25 bp, Mus musculus
tacactgctgtatctaatgcgtagg

SEQ ID NO: 759402 - DNA, 25 bp, Mus musculus
tacactgcttttatcagtgcatttc

SEQ ID NO: 759403 - DNA, 25 bp, Mus musculus
tacactgcttttttcagtgcatttc

SEQ ID NO: 759404 - DNA, 25 bp, Mus musculus
tacactggaccaaagctctcaatga

SEQ ID NO: 759405 - DNA, 25 bp, Mus musculus
tacactggaccatagctctcaatga

SEQ ID NO: 759406 - DNA, 25 bp, Mus musculus
tacactggacggcagagcaccaagt

SEQ ID NO: 759407 - DNA, 25 bp, Mus musculus
tacactggacgggagagcaccaagt

SEQ ID NO: 759408 - DNA, 25 bp, Mus musculus
tacactggatccagcattagaggtt

SEQ ID NO: 759409 - DNA, 25 bp, Mus musculus
tacactggatcctgcattagaggtt

SEQ ID NO: 759410 - DNA, 25 bp, Mus musculus
tacactggcactctgaatctctaag

SEQ ID NO: 759411 - DNA, 25 bp, Mus musculus
tacactggcactgtgaatctctaag

SEQ ID NO: 759412 - DNA, 25 bp, Mus musculus
tacactggcaggaccgagggtttct

SEQ ID NO: 759413 - DNA, 25 bp, Mus musculus
tacactggcaggctggcgaagctcc

SEQ ID NO: 759414 - DNA, 25 bp, Mus musculus
tacactggcagggtggcgaagctcc

SEQ ID NO: 759415 - DNA, 25 bp, Mus musculus
tacactggcaggtccgagggtttct

SEQ ID NO: 759416 - DNA, 25 bp, Mus musculus
tacactggcccacatatatccttgt

SEQ ID NO: 759417 - DNA, 25 bp, Mus musculus
tacactggcccagatatatccttgt

SEQ ID NO: 759418 - DNA, 25 bp, Mus musculus
tacactggccggcaggctgcagaac

SEQ ID NO: 759419 - DNA, 25 bp, Mus musculus
tacactggccgggaggctgcagaac

SEQ ID NO: 759420 - DNA, 25 bp, Mus musculus
tacactggctgtaacctagggatcg

SEQ ID NO: 759421 - DNA, 25 bp, Mus musculus
tacactggctgttacctagggatcg

SEQ ID NO: 759422 - DNA, 25 bp, Mus musculus
tacactgggccaatgaacacactaa

SEQ ID NO: 759423 - DNA, 25 bp, Mus musculus
tacactgggccattgaacacactaa

SEQ ID NO: 759424 - DNA, 25 bp, Mus musculus
tacactgggctcattggaagctctt

SEQ ID NO: 759425 - DNA, 25 bp, Mus musculus
tacactgggctctttggaagctctt

SEQ ID NO: 759426 - DNA, 25 bp, Mus musculus
tacactggtacaaagactgcgtctt

SEQ ID NO: 759427 - DNA, 25 bp, Mus musculus
tacactggtacatagactgcgtctt

SEQ ID NO: 759428 - DNA, 25 bp, Mus musculus
tacactggtcctatattccatcatc

SEQ ID NO: 759429 - DNA, 25 bp, Mus musculus
tacactggtcctttattccatcatc

SEQ ID NO: 759430 - DNA, 25 bp, Mus musculus
tacactggtggcattaaccctgtat

SEQ ID NO: 759431 - DNA, 25 bp, Mus musculus
tacactggtggctttaaccctgtat

SEQ ID NO: 759432 - DNA, 25 bp, Mus musculus
tacactggtgtgctatccctgcagc

SEQ ID NO: 759433 - DNA, 25 bp, Mus musculus
tacactggtgtggtatccctgcagc

SEQ ID NO: 759434 - DNA, 25 bp, Mus musculus
tacactggtttcctgtgggtaacga

SEQ ID NO: 759435 - DNA, 25 bp, Mus musculus
tacactggtttcgtgtgggtaacga

SEQ ID NO: 759436 - DNA, 25 bp, Mus musculus
tacactgtaaacatgtctatgaatg

SEQ ID NO: 759437 - DNA, 25 bp, Mus musculus
tacactgtaaacttgtctatgaatg

SEQ ID NO: 759438 - DNA, 25 bp, Mus musculus
tacactgtacttactgtacactgaa

SEQ ID NO: 759439 - DNA, 25 bp, Mus musculus
tacactgtactttctgtacactgaa

SEQ ID NO: 759440 - DNA, 25 bp, Mus musculus
tacactgtagagcagaatttagttc

SEQ ID NO: 759441 - DNA, 25 bp, Mus musculus
tacactgtagaggagaatttagttc

SEQ ID NO: 759442 - DNA, 25 bp, Mus musculus
tacactgtagccctgttcggatgca

SEQ ID NO: 759443 - DNA, 25 bp, Mus musculus
tacactgtagccgtgttcggatgca

SEQ ID NO: 759444 - DNA, 25 bp, Mus musculus
tacactgtagttctgtggcccaggg

SEQ ID NO: 759445 - DNA, 25 bp, Mus musculus
tacactgtagttgtgtggcccaggg

SEQ ID NO: 759446 - DNA, 25 bp, Mus musculus
tacactgtatgaacgcacttggttc

SEQ ID NO: 759447 - DNA, 25 bp, Mus musculus
tacactgtatgatcgcacttggttc

SEQ ID NO: 759448 - DNA, 25 bp, Mus musculus
tacactgtatttccctttgctgata

SEQ ID NO: 759449 - DNA, 25 bp, Mus musculus
tacactgtatttgcctttgctgata

SEQ ID NO: 759450 - DNA, 25 bp, Mus musculus
tacactgtcataaattcctggcaaa

SEQ ID NO: 759451 - DNA, 25 bp, Mus musculus
tacactgtcatatattcctggcaaa

SEQ ID NO: 759452 - DNA, 25 bp, Mus musculus
tacactgtccagctagagatttcgt

SEQ ID NO: 759453 - DNA, 25 bp, Mus musculus
tacactgtccaggtagagatttcgt

SEQ ID NO: 759454 - DNA, 25 bp, Mus musculus
tacactgtccctccattcagaggta

SEQ ID NO: 759455 - DNA, 25 bp, Mus musculus
tacactgtccctgcattcagaggta

SEQ ID NO: 759456 - DNA, 25 bp, Mus musculus
tacactgtgagcaagcattctgtta

SEQ ID NO: 759457 - DNA, 25 bp, Mus musculus
tacactgtgagctagcattctgtta

SEQ ID NO: 759458 - DNA, 25 bp, Mus musculus
tacactgtgcaaataggtacaccag

SEQ ID NO: 759459 - DNA, 25 bp, Mus musculus
tacactgtgcaattaggtacaccag

SEQ ID NO: 759460 - DNA, 25 bp, Mus musculus
tacactgtgcacaagcgctactact

SEQ ID NO: 759461 - DNA, 25 bp, Mus musculus
tacactgtgcactagcgctactact

SEQ ID NO: 759462 - DNA, 25 bp, Mus musculus
tacactgtgccgacctgttgggaat

SEQ ID NO: 759463 - DNA, 25 bp, Mus musculus
tacactgtgccgtcctgttgggaat

SEQ ID NO: 759464 - DNA, 25 bp, Mus musculus
tacactgtggtaactgaccagtttt

SEQ ID NO: 759465 - DNA, 25 bp, Mus musculus
tacactgtggtaagcatactctccc

SEQ ID NO: 759466 - DNA, 25 bp, Mus musculus
tacactgtggtatctgaccagtttt

SEQ ID NO: 759467 - DNA, 25 bp, Mus musculus
tacactgtggtatgcatactctccc

SEQ ID NO: 759468 - DNA, 25 bp, Mus musculus
tacactgtggtgcacttaacttgtg

SEQ ID NO: 759469 - DNA, 25 bp, Mus musculus
tacactgtggtggacttaacttgtg

SEQ ID NO: 759470 - DNA, 25 bp, Mus musculus
tacactgtgtctctatgtgaataca

SEQ ID NO: 759471 - DNA, 25 bp, Mus musculus
tacactgtgtctgtatgtgaataca

SEQ ID NO: 759472 - DNA, 25 bp, Mus musculus
tacactgtgtggcttggcttcgatc

SEQ ID NO: 759473 - DNA, 25 bp, Mus musculus
tacactgtgtgggttggcttcgatc

SEQ ID NO: 759474 - DNA, 25 bp, Mus musculus
tacactgttaatctttagtcccaaa

SEQ ID NO: 759475 - DNA, 25 bp, Mus musculus
tacactgttaatgtttagtcccaaa

SEQ ID NO: 759476 - DNA, 25 bp, Mus musculus
tacactgttcttcaaaaggcttttt

SEQ ID NO: 759477 - DNA, 25 bp, Mus musculus
tacactgttcttgaaaaggcttttt

SEQ ID NO: 759478 - DNA, 25 bp, Mus musculus
tacactgttttaccagtagaacaag

SEQ ID NO: 759479 - DNA, 25 bp, Mus musculus
tacactgttttagcagtagaacaag

SEQ ID NO: 759480 - DNA, 25 bp, Mus musculus
tacacttaaagacttccgcagcact

SEQ ID NO: 759481 - DNA, 25 bp, Mus musculus
tacacttaaagagttccgcagcact

SEQ ID NO: 759482 - DNA, 25 bp, Mus musculus
tacacttacaggacatgggttttct

SEQ ID NO: 759483 - DNA, 25 bp, Mus musculus
tacacttacaggtcatgggttttct

SEQ ID NO: 759484 - DNA, 25 bp, Mus musculus
tacacttactacctactttcaactg

SEQ ID NO: 759485 - DNA, 25 bp, Mus musculus
tacacttactacgtactttcaactg

SEQ ID NO: 759486 - DNA, 25 bp, Mus musculus
tacacttagattcttttgacccaca

SEQ ID NO: 759487 - DNA, 25 bp, Mus musculus
tacacttagattgttttgacccaca

SEQ ID NO: 759488 - DNA, 25 bp, Mus musculus
tacacttagggcctgagccaacgca

SEQ ID NO: 759489 - DNA, 25 bp, Mus musculus
tacacttagggcgtgagccaacgca

SEQ ID NO: 759490 - DNA, 25 bp, Mus musculus
tacacttagtaccttatcttggaag

SEQ ID NO: 759491 - DNA, 25 bp, Mus musculus
tacacttagtacgttatcttggaag

SEQ ID NO: 759492 - DNA, 25 bp, Mus musculus
tacacttatacaccctcttgacgaa

SEQ ID NO: 759493 - DNA, 25 bp, Mus musculus
tacacttatacagcctcttgacgaa

SEQ ID NO: 759494 - DNA, 25 bp, Mus musculus
tacacttcaatcctcgcttcaatgc

SEQ ID NO: 759495 - DNA, 25 bp, Mus musculus
tacacttcaatcgtcgcttcaatgc

SEQ ID NO: 759496 - DNA, 25 bp, Mus musculus
tacacttcagcgacgtgagcagcga

SEQ ID NO: 759497 - DNA, 25 bp, Mus musculus
tacacttcagcgtcgtgagcagcga

SEQ ID NO: 759498 - DNA, 25 bp, Mus musculus
tacacttcttggctgagggtatcct

SEQ ID NO: 759499 - DNA, 25 bp, Mus musculus
tacacttcttgggtgagggtatcct

SEQ ID NO: 759500 - DNA, 25 bp, Mus musculus
tacacttgaactacgtatcccgagc

SEQ ID NO: 759501 - DNA, 25 bp, Mus musculus
tacacttgaacttcgtatcccgagc

SEQ ID NO: 759502 - DNA, 25 bp, Mus musculus
tacacttgagatatgtactcgtttg

SEQ ID NO: 759503 - DNA, 25 bp, Mus musculus
tacacttgagatttgtactcgtttg

SEQ ID NO: 759504 - DNA, 25 bp, Mus musculus
tacacttgatttatatcctcgagat

SEQ ID NO: 759505 - DNA, 25 bp, Mus musculus
tacacttgatttttatcctcgagat

SEQ ID NO: 759506 - DNA, 25 bp, Mus musculus
tacacttgcacaattgctgctgagt

SEQ ID NO: 759507 - DNA, 25 bp, Mus musculus
tacacttgcacatttgctgctgagt

SEQ ID NO: 759508 - DNA, 25 bp, Mus musculus
tacacttgcgcacactgtgggctga

SEQ ID NO: 759509 - DNA, 25 bp, Mus musculus
tacacttgcgcagactgtgggctga

SEQ ID NO: 759510 - DNA, 25 bp, Mus musculus
tacacttggcatcatacttgctttg

SEQ ID NO: 759511 - DNA, 25 bp, Mus musculus
tacacttggcatgatacttgctttg

SEQ ID NO: 759512 - DNA, 25 bp, Mus musculus
tacacttgggctagatacacatcag

SEQ ID NO: 759513 - DNA, 25 bp, Mus musculus
tacacttgggcttgatacacatcag

SEQ ID NO: 759514 - DNA, 25 bp, Mus musculus
tacacttggtatagtttggccctta

SEQ ID NO: 759515 - DNA, 25 bp, Mus musculus
tacacttggtattgtttggccctta

SEQ ID NO: 759516 - DNA, 25 bp, Mus musculus
tacacttgtgaactgttacttcaaa

SEQ ID NO: 759517 - DNA, 25 bp, Mus musculus
tacacttgtgaagtgttacttcaaa

SEQ ID NO: 759518 - DNA, 25 bp, Mus musculus
tacacttgtgagcatgactcaggag

SEQ ID NO: 759519 - DNA, 25 bp, Mus musculus
tacacttgtgaggatgactcaggag

SEQ ID NO: 759520 - DNA, 25 bp, Mus musculus
tacacttgttggatgaaccaatcat

SEQ ID NO: 759521 - DNA, 25 bp, Mus musculus
tacacttgttggttgaaccaatcat

SEQ ID NO: 759522 - DNA, 25 bp, Mus musculus
tacactttaccccttgctgtaggga

SEQ ID NO: 759523 - DNA, 25 bp, Mus musculus
tacactttacccgttgctgtaggga

SEQ ID NO: 759524 - DNA, 25 bp, Mus musculus
tacactttactaacttctgcttttc

SEQ ID NO: 759525 - DNA, 25 bp, Mus musculus
tacactttactatcttctgcttttc

SEQ ID NO: 759526 - DNA, 25 bp, Mus musculus
tacactttcacgctcttctaaacac

SEQ ID NO: 759527 - DNA, 25 bp, Mus musculus
tacactttcacggtcttctaaacac

SEQ ID NO: 759528 - DNA, 25 bp, Mus musculus
tacactttccttctggagcctggga

SEQ ID NO: 759529 - DNA, 25 bp, Mus musculus
tacactttccttgtggagcctggga

SEQ ID NO: 759530 - DNA, 25 bp, Mus musculus
tacactttctacaaattatgggcta

SEQ ID NO: 759531 - DNA, 25 bp, Mus musculus
tacactttctactaattatgggcta

SEQ ID NO: 759532 - DNA, 25 bp, Mus musculus
tacactttctggacttacatgatga

SEQ ID NO: 759533 - DNA, 25 bp, Mus musculus
tacactttctggtcttacatgatga

SEQ ID NO: 759534 - DNA, 25 bp, Mus musculus
tacactttgctgattgcgtacttca

SEQ ID NO: 759535 - DNA, 25 bp, Mus musculus
tacactttgctgtttgcgtacttca

SEQ ID NO: 759536 - DNA, 25 bp, Mus musculus
tacacttttaacaggtattccacag

SEQ ID NO: 759537 - DNA, 25 bp, Mus musculus
tacacttttaactggtattccacag

SEQ ID NO: 759538 - DNA, 25 bp, Mus musculus
tacacttttgctacttggttgtcca

SEQ ID NO: 759539 - DNA, 25 bp, Mus musculus
tacacttttgcttcttggttgtcca

SEQ ID NO: 759540 - DNA, 25 bp, Mus musculus
tacacttttgtgcatcttgttgcaa

SEQ ID NO: 759541 - DNA, 25 bp, Mus musculus
tacacttttgtggatcttgttgcaa

SEQ ID NO: 759542 - DNA, 25 bp, Mus musculus
tacagaaaaccgactatggacacag

SEQ ID NO: 759543 - DNA, 25 bp, Mus musculus
tacagaaaaccgtctatggacacag

SEQ ID NO: 759544 - DNA, 25 bp, Mus musculus
tacagaaaattcacccataaaggga

SEQ ID NO: 759545 - DNA, 25 bp, Mus musculus
tacagaaaattctcccataaaggga

SEQ ID NO: 759546 - DNA, 25 bp, Mus musculus
tacagaaacactcgcccttggattt

SEQ ID NO: 759547 - DNA, 25 bp, Mus musculus
tacagaaacactggcccttggattt

SEQ ID NO: 759548 - DNA, 25 bp, Mus musculus
tacagaaacatgctggtccgggcct

SEQ ID NO: 759549 - DNA, 25 bp, Mus musculus
tacagaaacatggtggtccgggcct

SEQ ID NO: 759550 - DNA, 25 bp, Mus musculus
tacagaaaccagagacccaggtgat

SEQ ID NO: 759551 - DNA, 25 bp, Mus musculus
tacagaaaccagtgacccaggtgat

SEQ ID NO: 759552 - DNA, 25 bp, Mus musculus
tacagaaagctcactaccacagggc

SEQ ID NO: 759553 - DNA, 25 bp, Mus musculus
tacagaaagctctctaccacagggc

SEQ ID NO: 759554 - DNA, 25 bp, Mus musculus
tacagaaagtttaaggtgcgaagct

SEQ ID NO: 759555 - DNA, 25 bp, Mus musculus
tacagaaagttttaggtgcgaagct

SEQ ID NO: 759556 - DNA, 25 bp, Mus musculus
tacagaaatacacagcacaacctag

SEQ ID NO: 759557 - DNA, 25 bp, Mus musculus
tacagaaatacagagcacaacctag

SEQ ID NO: 759558 - DNA, 25 bp, Mus musculus
tacagaaatcatactccccacaatg

SEQ ID NO: 759559 - DNA, 25 bp, Mus musculus
tacagaaatcattctccccacaatg

SEQ ID NO: 759560 - DNA, 25 bp, Mus musculus
tacagaacaccgactccaagtggac

SEQ ID NO: 759561 - DNA, 25 bp, Mus musculus
tacagaacaccgtctccaagtggac

SEQ ID NO: 759562 - DNA, 25 bp, Mus musculus
tacagaaccacacagccatatcagt

SEQ ID NO: 759563 - DNA, 25 bp, Mus musculus
tacagaaccacagagccatatcagt

SEQ ID NO: 759564 - DNA, 25 bp, Mus musculus
tacagaacccagattggtccattgt

SEQ ID NO: 759565 - DNA, 25 bp, Mus musculus
tacagaacccagtttggtccattgt

SEQ ID NO: 759566 - DNA, 25 bp, Mus musculus
tacagaacctggcactctgtgggtg

SEQ ID NO: 759567 - DNA, 25 bp, Mus musculus
tacagaacctgggactctgtgggtg

SEQ ID NO: 759568 - DNA, 25 bp, Mus musculus
tacagaaccttcaggaaggaggaca

SEQ ID NO: 759569 - DNA, 25 bp, Mus musculus
tacagaaccttctggaaggaggaca

SEQ ID NO: 759570 - DNA, 25 bp, Mus musculus
tacagaaccttgcagtagtgctccc

SEQ ID NO: 759571 - DNA, 25 bp, Mus musculus
tacagaaccttggagtagtgctccc

SEQ ID NO: 759572 - DNA, 25 bp, Mus musculus
tacagaacgaatcggtcaataaact

SEQ ID NO: 759573 - DNA, 25 bp, Mus musculus
tacagaacgaatgggtcaataaact

SEQ ID NO: 759574 - DNA, 25 bp, Mus musculus
tacagaacgaggacaggaacacagg

SEQ ID NO: 759575 - DNA, 25 bp, Mus musculus
tacagaacgaggtcaggaacacagg

SEQ ID NO: 759576 - DNA, 25 bp, Mus musculus
tacagaacggtacgtgttgctcaca

SEQ ID NO: 759577 - DNA, 25 bp, Mus musculus
tacagaacggtaggtgttgctcaca

SEQ ID NO: 759578 - DNA, 25 bp, Mus musculus
tacagaactagccttagcgctctca

SEQ ID NO: 759579 - DNA, 25 bp, Mus musculus
tacagaactagcgttagcgctctca

SEQ ID NO: 759580 - DNA, 25 bp, Mus musculus
tacagaactcggaccttgattccgt

SEQ ID NO: 759581 - DNA, 25 bp, Mus musculus
tacagaactcggtccttgattccgt

SEQ ID NO: 759582 - DNA, 25 bp, Mus musculus
tacagaagcacaattgtctcctacc

SEQ ID NO: 759583 - DNA, 25 bp, Mus musculus
tacagaagcacatttgtctcctacc

SEQ ID NO: 759584 - DNA, 25 bp, Mus musculus
tacagaagcagcatgatgacctgtt

SEQ ID NO: 759585 - DNA, 25 bp, Mus musculus
tacagaagcagcttgatgacctgtt

SEQ ID NO: 759586 - DNA, 25 bp, Mus musculus
tacagaagccatatttgctttcaag

SEQ ID NO: 759587 - DNA, 25 bp, Mus musculus
tacagaagccatttttgctttcaag

SEQ ID NO: 759588 - DNA, 25 bp, Mus musculus
tacagaagccttcagtcacccgaag

SEQ ID NO: 759589 - DNA, 25 bp, Mus musculus
tacagaagccttgagtcacccgaag

SEQ ID NO: 759590 - DNA, 25 bp, Mus musculus
tacagaagcgccaccctaaggctta

SEQ ID NO: 759591 - DNA, 25 bp, Mus musculus
tacagaagcgcctccctaaggctta

SEQ ID NO: 759592 - DNA, 25 bp, Mus musculus
tacagaaggacacccgactctattt

SEQ ID NO: 759593 - DNA, 25 bp, Mus musculus
tacagaaggacagccgactctattt

SEQ ID NO: 759594 - DNA, 25 bp, Mus musculus
tacagaaggccgagggtgccagcca

SEQ ID NO: 759595 - DNA, 25 bp, Mus musculus
tacagaaggccgtgggtgccagcca

SEQ ID NO: 759596 - DNA, 25 bp, Mus musculus
tacagaatacttcgctgttagccca

SEQ ID NO: 759597 - DNA, 25 bp, Mus musculus
tacagaatacttggctgttagccca

SEQ ID NO: 759598 - DNA, 25 bp, Mus musculus
tacagaatagccctttgcgatcctt

SEQ ID NO: 759599 - DNA, 25 bp, Mus musculus
tacagaatagccgtttgcgatcctt

SEQ ID NO: 759600 - DNA, 25 bp, Mus musculus
tacagaatcttcagggtgcagcaca

SEQ ID NO: 759601 - DNA, 25 bp, Mus musculus
tacagaatcttctgggtgcagcaca

SEQ ID NO: 759602 - DNA, 25 bp, Mus musculus
tacagaatgctcagactgcaagaaa

SEQ ID NO: 759603 - DNA, 25 bp, Mus musculus
tacagaatgctctgactgcaagaaa

SEQ ID NO: 759604 - DNA, 25 bp, Mus musculus
tacagaattcacaagttccctaccc

SEQ ID NO: 759605 - DNA, 25 bp, Mus musculus
tacagaattcactagttccctaccc

SEQ ID NO: 759606 - DNA, 25 bp, Mus musculus
tacagaattccaattgagaccagga

SEQ ID NO: 759607 - DNA, 25 bp, Mus musculus
tacagaattccatttgagaccagga

SEQ ID NO: 759608 - DNA, 25 bp, Mus musculus
tacagaattcttcccctgagggatc

SEQ ID NO: 759609 - DNA, 25 bp, Mus musculus
tacagaattcttgccctgagggatc

SEQ ID NO: 759610 - DNA, 25 bp, Mus musculus
tacagacacacccatcgtcatacag

SEQ ID NO: 759611 - DNA, 25 bp, Mus musculus
tacagacacaccgatcgtcatacag

SEQ ID NO: 759612 - DNA, 25 bp, Mus musculus
tacagacacagtcccactcttctaa

SEQ ID NO: 759613 - DNA, 25 bp, Mus musculus
tacagacacagtcctgcgtttcctc

SEQ ID NO: 759614 - DNA, 25 bp, Mus musculus
tacagacacagtgccactcttctaa

SEQ ID NO: 759615 - DNA, 25 bp, Mus musculus
tacagacacagtgctgcgtttcctc

SEQ ID NO: 759616 - DNA, 25 bp, Mus musculus
tacagacactcgaacacacacttga

SEQ ID NO: 759617 - DNA, 25 bp, Mus musculus
tacagacactcgtacacacacttga

SEQ ID NO: 759618 - DNA, 25 bp, Mus musculus
tacagacaggcccttcggaacgtat

SEQ ID NO: 759619 - DNA, 25 bp, Mus musculus
tacagacaggccgttcggaacgtat

SEQ ID NO: 759620 - DNA, 25 bp, Mus musculus
tacagacagtacatgttcttccctc

SEQ ID NO: 759621 - DNA, 25 bp, Mus musculus
tacagacagtacttgttcttccctc

SEQ ID NO: 759622 - DNA, 25 bp, Mus musculus
tacagaccaagcagtggcactggat

SEQ ID NO: 759623 - DNA, 25 bp, Mus musculus
tacagaccaagctgtggcactggat

SEQ ID NO: 759624 - DNA, 25 bp, Mus musculus
tacagaccacatccctggcgtgggt

SEQ ID NO: 759625 - DNA, 25 bp, Mus musculus
tacagaccacatgcctggcgtgggt

SEQ ID NO: 759626 - DNA, 25 bp, Mus musculus
tacagaccagatagcaactccagag

SEQ ID NO: 759627 - DNA, 25 bp, Mus musculus
tacagaccagattgcaactccagag

SEQ ID NO: 759628 - DNA, 25 bp, Mus musculus
tacagacccaccagttaagacaaaa

SEQ ID NO: 759629 - DNA, 25 bp, Mus musculus
tacagacccacctgttaagacaaaa

SEQ ID NO: 759630 - DNA, 25 bp, Mus musculus
tacagaccgcgcagagacgcttttg

SEQ ID NO: 759631 - DNA, 25 bp, Mus musculus
tacagaccgcgctgagacgcttttg

SEQ ID NO: 759632 - DNA, 25 bp, Mus musculus
tacagacgagataccataagccatt

SEQ ID NO: 759633 - DNA, 25 bp, Mus musculus
tacagacgagattccataagccatt

SEQ ID NO: 759634 - DNA, 25 bp, Mus musculus
tacagacgcttacgtacgggcactt

SEQ ID NO: 759635 - DNA, 25 bp, Mus musculus
tacagacgcttaggtacgggcactt

SEQ ID NO: 759636 - DNA, 25 bp, Mus musculus
tacagacgtgaactgcagccgattc

SEQ ID NO: 759637 - DNA, 25 bp, Mus musculus
tacagacgtgaagtgcagccgattc

SEQ ID NO: 759638 - DNA, 25 bp, Mus musculus
tacagacgttacatggaagcttttc

SEQ ID NO: 759639 - DNA, 25 bp, Mus musculus
tacagacgttacttggaagcttttc

SEQ ID NO: 759640 - DNA, 25 bp, Mus musculus
tacagactacctatccactatttat

SEQ ID NO: 759641 - DNA, 25 bp, Mus musculus
tacagactacctttccactatttat

SEQ ID NO: 759642 - DNA, 25 bp, Mus musculus
tacagactatctcctcatggttcag

SEQ ID NO: 759643 - DNA, 25 bp, Mus musculus
tacagactatctgctcatggttcag

SEQ ID NO: 759644 - DNA, 25 bp, Mus musculus
tacagactcactagaatgcccaggt

SEQ ID NO: 759645 - DNA, 25 bp, Mus musculus
tacagactcacttgaatgcccaggt

SEQ ID NO: 759646 - DNA, 25 bp, Mus musculus
tacagactcgccatagctcttttcg

SEQ ID NO: 759647 - DNA, 25 bp, Mus musculus
tacagactcgccttagctcttttcg

SEQ ID NO: 759648 - DNA, 25 bp, Mus musculus
tacagactctgtacccgtctacagt

SEQ ID NO: 759649 - DNA, 25 bp, Mus musculus
tacagactctgttcccgtctacagt

SEQ ID NO: 759650 - DNA, 25 bp, Mus musculus
tacagactgctcctagttcatggca

SEQ ID NO: 759651 - DNA, 25 bp, Mus musculus
tacagactgctcgtagttcatggca

SEQ ID NO: 759652 - DNA, 25 bp, Mus musculus
tacagactggacattcacggccatt

SEQ ID NO: 759653 - DNA, 25 bp, Mus musculus
tacagactggactttcacggccatt

SEQ ID NO: 759654 - DNA, 25 bp, Mus musculus
tacagactggtgacagcctcgtaag

SEQ ID NO: 759655 - DNA, 25 bp, Mus musculus
tacagactggtgtcagcctcgtaag

SEQ ID NO: 759656 - DNA, 25 bp, Mus musculus
tacagactgtccagtggccaggcca

SEQ ID NO: 759657 - DNA, 25 bp, Mus musculus
tacagactgtcctgtggccaggcca

SEQ ID NO: 759658 - DNA, 25 bp, Mus musculus
tacagacttattctagcttttgttt

SEQ ID NO: 759659 - DNA, 25 bp, Mus musculus
tacagacttattgtagcttttgttt

SEQ ID NO: 759660 - DNA, 25 bp, Mus musculus
tacagacttccaaagccttacttcc

SEQ ID NO: 759661 - DNA, 25 bp, Mus musculus
tacagacttccatagccttacttcc

SEQ ID NO: 759662 - DNA, 25 bp, Mus musculus
tacagacttcttatcttcatggcca

SEQ ID NO: 759663 - DNA, 25 bp, Mus musculus
tacagacttcttttcttcatggcca

SEQ ID NO: 759664 - DNA, 25 bp, Mus musculus
tacagacttgcaatgtagctcaggc

SEQ ID NO: 759665 - DNA, 25 bp, Mus musculus
tacagacttgcattgtagctcaggc

SEQ ID NO: 759666 - DNA, 25 bp, Mus musculus
tacagacttgtgctttgtgcagtag

SEQ ID NO: 759667 - DNA, 25 bp, Mus musculus
tacagacttgtggtttgtgcagtag

SEQ ID NO: 759668 - DNA, 25 bp, Mus musculus
tacagactttctaggcccgcaggca

SEQ ID NO: 759669 - DNA, 25 bp, Mus musculus
tacagactttctcccgcatttgaca

SEQ ID NO: 759670 - DNA, 25 bp, Mus musculus
tacagactttctgccgcatttgaca

SEQ ID NO: 759671 - DNA, 25 bp, Mus musculus
tacagactttcttggcccgcaggca

SEQ ID NO: 759672 - DNA, 25 bp, Mus musculus
tacagagaagctacccctgaaaatg

SEQ ID NO: 759673 - DNA, 25 bp, Mus musculus
tacagagaagcttcccctgaaaatg

SEQ ID NO: 759674 - DNA, 25 bp, Mus musculus
tacagagacctgagacagacacatt

SEQ ID NO: 759675 - DNA, 25 bp, Mus musculus
tacagagacctgtgacagacacatt

SEQ ID NO: 759676 - DNA, 25 bp, Mus musculus
tacagagacgcgagcctcactgagg

SEQ ID NO: 759677 - DNA, 25 bp, Mus musculus
tacagagacgcgtgcctcactgagg

SEQ ID NO: 759678 - DNA, 25 bp, Mus musculus
tacagagactggcaagcggtgcatt

SEQ ID NO: 759679 - DNA, 25 bp, Mus musculus
tacagagactgggaagcggtgcatt

SEQ ID NO: 759680 - DNA, 25 bp, Mus musculus
tacagagacttccaaaaactcctta

SEQ ID NO: 759681 - DNA, 25 bp, Mus musculus
tacagagacttcgaaaaactcctta

SEQ ID NO: 759682 - DNA, 25 bp, Mus musculus
tacagagagactatatttacaggct

SEQ ID NO: 759683 - DNA, 25 bp, Mus musculus
tacagagagactttatttacaggct

SEQ ID NO: 759684 - DNA, 25 bp, Mus musculus
tacagagagagcaggcaagaaacgc

SEQ ID NO: 759685 - DNA, 25 bp, Mus musculus
tacagagagagctggcaagaaacgc

SEQ ID NO: 759686 - DNA, 25 bp, Mus musculus
tacagagagcaaaagggtccccaga

SEQ ID NO: 759687 - DNA, 25 bp, Mus musculus
tacagagagcaatagggtccccaga

SEQ ID NO: 759688 - DNA, 25 bp, Mus musculus
tacagagagctgaagggtcccttct

SEQ ID NO: 759689 - DNA, 25 bp, Mus musculus
tacagagagctgtagggtcccttct

SEQ ID NO: 759690 - DNA, 25 bp, Mus musculus
tacagagagggcagaaagggacttt

SEQ ID NO: 759691 - DNA, 25 bp, Mus musculus
tacagagagggctgaaagggacttt

SEQ ID NO: 759692 - DNA, 25 bp, Mus musculus
tacagagcaacacagcaaggcctcc

SEQ ID NO: 759693 - DNA, 25 bp, Mus musculus
tacagagcaacagagcaaggcctcc

SEQ ID NO: 759694 - DNA, 25 bp, Mus musculus
tacagagcacctccaggacaagtta

SEQ ID NO: 759695 - DNA, 25 bp, Mus musculus
tacagagcacctgcaggacaagtta

SEQ ID NO: 759696 - DNA, 25 bp, Mus musculus
tacagagcacgtacgtttagcccat

SEQ ID NO: 759697 - DNA, 25 bp, Mus musculus
tacagagcacgttcgtttagcccat

SEQ ID NO: 759698 - DNA, 25 bp, Mus musculus
tacagagccacgcagcaccacagaa

SEQ ID NO: 759699 - DNA, 25 bp, Mus musculus
tacagagccacggagcaccacagaa

SEQ ID NO: 759700 - DNA, 25 bp, Mus musculus
tacagagccccaagttgacagtcag

SEQ ID NO: 759701 - DNA, 25 bp, Mus musculus
tacagagccccatgttgacagtcag

SEQ ID NO: 759702 - DNA, 25 bp, Mus musculus
tacagagcccctagtatagtctctc

SEQ ID NO: 759703 - DNA, 25 bp, Mus musculus
tacagagccccttgtatagtctctc

SEQ ID NO: 759704 - DNA, 25 bp, Mus musculus
tacagagccggaactgcctcgtggt

SEQ ID NO: 759705 - DNA, 25 bp, Mus musculus
tacagagccggatctgcctcgtggt

SEQ ID NO: 759706 - DNA, 25 bp, Mus musculus
tacagagcctgactcgtagcccctt

SEQ ID NO: 759707 - DNA, 25 bp, Mus musculus
tacagagcctgagtcgtagcccctt

SEQ ID NO: 759708 - DNA, 25 bp, Mus musculus
tacagagcgagtccttgtgttcccc

SEQ ID NO: 759709 - DNA, 25 bp, Mus musculus
tacagagcgagtgcttgtgttcccc

SEQ ID NO: 759710 - DNA, 25 bp, Mus musculus
tacagagcgcttatatctataccac

SEQ ID NO: 759711 - DNA, 25 bp, Mus musculus
tacagagcgcttttatctataccac

SEQ ID NO: 759712 - DNA, 25 bp, Mus musculus
tacagagctagcagctgggtccata

SEQ ID NO: 759713 - DNA, 25 bp, Mus musculus
tacagagctagctgctgggtccata

SEQ ID NO: 759714 - DNA, 25 bp, Mus musculus
tacagagctatcactttagtataaa

SEQ ID NO: 759715 - DNA, 25 bp, Mus musculus
tacagagctatctctttagtataaa

SEQ ID NO: 759716 - DNA, 25 bp, Mus musculus
tacagagctgcaacacgcctataag

SEQ ID NO: 759717 - DNA, 25 bp, Mus musculus
tacagagctgcaccctttgcacggg

SEQ ID NO: 759718 - DNA, 25 bp, Mus musculus
tacagagctgcagcctttgcacggg

SEQ ID NO: 759719 - DNA, 25 bp, Mus musculus
tacagagctgcatcacgcctataag

SEQ ID NO: 759720 - DNA, 25 bp, Mus musculus
tacagagctgctccggcacctagcg

SEQ ID NO: 759721 - DNA, 25 bp, Mus musculus
tacagagctgctgcggcacctagcg

SEQ ID NO: 759722 - DNA, 25 bp, Mus musculus
tacagaggactcattttgttctttg

SEQ ID NO: 759723 - DNA, 25 bp, Mus musculus
tacagaggactctttttgttctttg

SEQ ID NO: 759724 - DNA, 25 bp, Mus musculus
tacagaggatttctttagtaaacgt

SEQ ID NO: 759725 - DNA, 25 bp, Mus musculus
tacagaggatttgtttagtaaacgt

SEQ ID NO: 759726 - DNA, 25 bp, Mus musculus
tacagaggcattccttttacttccc

SEQ ID NO: 759727 - DNA, 25 bp, Mus musculus
tacagaggcattgcttttacttccc

SEQ ID NO: 759728 - DNA, 25 bp, Mus musculus
tacagaggccatctttaaggagcta

SEQ ID NO: 759729 - DNA, 25 bp, Mus musculus
tacagaggccatgtttaaggagcta

SEQ ID NO: 759730 - DNA, 25 bp, Mus musculus
tacagaggcttgcaaaacgttggga

SEQ ID NO: 759731 - DNA, 25 bp, Mus musculus
tacagaggcttggaaaacgttggga

SEQ ID NO: 759732 - DNA, 25 bp, Mus musculus
tacagagggacccaggttaccccag

SEQ ID NO: 759733 - DNA, 25 bp, Mus musculus
tacagagggaccgaggttaccccag

SEQ ID NO: 759734 - DNA, 25 bp, Mus musculus
tacagagggtccagtggagactacc

SEQ ID NO: 759735 - DNA, 25 bp, Mus musculus
tacagagggtcctgtggagactacc

SEQ ID NO: 759736 - DNA, 25 bp, Mus musculus
tacagagggtgaagtagatgctgct

SEQ ID NO: 759737 - DNA, 25 bp, Mus musculus
tacagagggtgatgtagatgctgct

SEQ ID NO: 759738 - DNA, 25 bp, Mus musculus
tacagaggttatcggaactaaggtc

SEQ ID NO: 759739 - DNA, 25 bp, Mus musculus
tacagaggttatgggaactaaggtc

SEQ ID NO: 759740 - DNA, 25 bp, Mus musculus
tacagagtactgatgccctcgtccc

SEQ ID NO: 759741 - DNA, 25 bp, Mus musculus
tacagagtactgttgccctcgtccc

SEQ ID NO: 759742 - DNA, 25 bp, Mus musculus
tacagagtcaatacccttagtcaag

SEQ ID NO: 759743 - DNA, 25 bp, Mus musculus
tacagagtcaattcccttagtcaag

SEQ ID NO: 759744 - DNA, 25 bp, Mus musculus
tacagagtcaccattccgatagaaa

SEQ ID NO: 759745 - DNA, 25 bp, Mus musculus
tacagagtcacctttccgatagaaa

SEQ ID NO: 759746 - DNA, 25 bp, Mus musculus
tacagagtccctacaaccacgttgg

SEQ ID NO: 759747 - DNA, 25 bp, Mus musculus
tacagagtccctaccttttggtggg

SEQ ID NO: 759748 - DNA, 25 bp, Mus musculus
tacagagtcccttcaaccacgttgg

SEQ ID NO: 759749 - DNA, 25 bp, Mus musculus
tacagagtcccttccttttggtggg

SEQ ID NO: 759750 - DNA, 25 bp, Mus musculus
tacagagtccttatcgggttcaatg

SEQ ID NO: 759751 - DNA, 25 bp, Mus musculus
tacagagtccttttcgggttcaatg

SEQ ID NO: 759752 - DNA, 25 bp, Mus musculus
tacagagtcgctctgtgttcaggca

SEQ ID NO: 759753 - DNA, 25 bp, Mus musculus
tacagagtcgctgtgtgttcaggca

SEQ ID NO: 759754 - DNA, 25 bp, Mus musculus
tacagagtctctaccaatgaaactg

SEQ ID NO: 759755 - DNA, 25 bp, Mus musculus
tacagagtctcttccaatgaaactg

SEQ ID NO: 759756 - DNA, 25 bp, Mus musculus
tacagagtgagcagcatcccgggct

SEQ ID NO: 759757 - DNA, 25 bp, Mus musculus
tacagagtgagctgcatcccgggct

SEQ ID NO: 759758 - DNA, 25 bp, Mus musculus
tacagagtgcttacccgcaagtgag

SEQ ID NO: 759759 - DNA, 25 bp, Mus musculus
tacagagtgctttcccgcaagtgag

SEQ ID NO: 759760 - DNA, 25 bp, Mus musculus
tacagagtgttcaccgggtttccat

SEQ ID NO: 759761 - DNA, 25 bp, Mus musculus
tacagagtgttctccgggtttccat

SEQ ID NO: 759762 - DNA, 25 bp, Mus musculus
tacagagtgttgaacatgtcccctt

SEQ ID NO: 759763 - DNA, 25 bp, Mus musculus
tacagagtgttgtacatgtcccctt

SEQ ID NO: 759764 - DNA, 25 bp, Mus musculus
tacagagttatacccaccacagaaa

SEQ ID NO: 759765 - DNA, 25 bp, Mus musculus
tacagagttatagccaccacagaaa

SEQ ID NO: 759766 - DNA, 25 bp, Mus musculus
tacagagttcacaggccaacttcct

SEQ ID NO: 759767 - DNA, 25 bp, Mus musculus
tacagagttcactggccaacttcct

SEQ ID NO: 759768 - DNA, 25 bp, Mus musculus
tacagagttcctctggtgtgggaaa

SEQ ID NO: 759769 - DNA, 25 bp, Mus musculus
tacagagttcctgtggtgtgggaaa

SEQ ID NO: 759770 - DNA, 25 bp, Mus musculus
tacagagttgtaatgttttcttggt

SEQ ID NO: 759771 - DNA, 25 bp, Mus musculus
tacagagttgtaattccagctagca

SEQ ID NO: 759772 - DNA, 25 bp, Mus musculus
tacagagttgtattgttttcttggt

SEQ ID NO: 759773 - DNA, 25 bp, Mus musculus
tacagagttgtatttccagctagca

SEQ ID NO: 759774 - DNA, 25 bp, Mus musculus
tacagataacccatcactgggatgg

SEQ ID NO: 759775 - DNA, 25 bp, Mus musculus
tacagataacccttcactgggatgg

SEQ ID NO: 759776 - DNA, 25 bp, Mus musculus
tacagataacttccgtctactcctt

SEQ ID NO: 759777 - DNA, 25 bp, Mus musculus
tacagataacttgcgtctactcctt

SEQ ID NO: 759778 - DNA, 25 bp, Mus musculus
tacagatacagtatcactcgcaaag

SEQ ID NO: 759779 - DNA, 25 bp, Mus musculus
tacagatacagtttcactcgcaaag

SEQ ID NO: 759780 - DNA, 25 bp, Mus musculus
tacagataccaccattaaagcaatt

SEQ ID NO: 759781 - DNA, 25 bp, Mus musculus
tacagataccacgattaaagcaatt

SEQ ID NO: 759782 - DNA, 25 bp, Mus musculus
tacagatactttctcaagctcttcc

SEQ ID NO: 759783 - DNA, 25 bp, Mus musculus
tacagatactttgtcaagctcttcc

SEQ ID NO: 759784 - DNA, 25 bp, Mus musculus
tacagatagcttctgtaatcacaga

SEQ ID NO: 759785 - DNA, 25 bp, Mus musculus
tacagatagcttgtgtaatcacaga

SEQ ID NO: 759786 - DNA, 25 bp, Mus musculus
tacagatatgcacagcctgctactg

SEQ ID NO: 759787 - DNA, 25 bp, Mus musculus
tacagatatgcagagcctgctactg

SEQ ID NO: 759788 - DNA, 25 bp, Mus musculus
tacagatatgtcactgtttcctgtc

SEQ ID NO: 759789 - DNA, 25 bp, Mus musculus
tacagatatgtctctgtttcctgtc

SEQ ID NO: 759790 - DNA, 25 bp, Mus musculus
tacagatattatcatgacggctttg

SEQ ID NO: 759791 - DNA, 25 bp, Mus musculus
tacagatattatgatgacggctttg

SEQ ID NO: 759792 - DNA, 25 bp, Mus musculus
tacagatatttcagctcgagccctg

SEQ ID NO: 759793 - DNA, 25 bp, Mus musculus
tacagatatttctgctcgagccctg

SEQ ID NO: 759794 - DNA, 25 bp, Mus musculus
tacagatcagatctacccaggagaa

SEQ ID NO: 759795 - DNA, 25 bp, Mus musculus
tacagatcagatgtacccaggagaa

SEQ ID NO: 759796 - DNA, 25 bp, Mus musculus
tacagatcccacaaagttcttgaaa

SEQ ID NO: 759797 - DNA, 25 bp, Mus musculus
tacagatcccactaagttcttgaaa

SEQ ID NO: 759798 - DNA, 25 bp, Mus musculus
tacagatccttgctcatagtacgca

SEQ ID NO: 759799 - DNA, 25 bp, Mus musculus
tacagatccttggtcatagtacgca

SEQ ID NO: 759800 - DNA, 25 bp, Mus musculus
tacagatcctttcctacccatgagt

SEQ ID NO: 759801 - DNA, 25 bp, Mus musculus
tacagatcctttgctacccatgagt

SEQ ID NO: 759802 - DNA, 25 bp, Mus musculus
tacagatcgaccacaacagtgggat

SEQ ID NO: 759803 - DNA, 25 bp, Mus musculus
tacagatcgacctcaacagtgggat

SEQ ID NO: 759804 - DNA, 25 bp, Mus musculus
tacagatcggagaaggccgtctctc

SEQ ID NO: 759805 - DNA, 25 bp, Mus musculus
tacagatcggagtaggccgtctctc

SEQ ID NO: 759806 - DNA, 25 bp, Mus musculus
tacagatctcagctggcttttactc

SEQ ID NO: 759807 - DNA, 25 bp, Mus musculus
tacagatctcaggtggcttttactc

SEQ ID NO: 759808 - DNA, 25 bp, Mus musculus
tacagatgacacacaagcccgtatg

SEQ ID NO: 759809 - DNA, 25 bp, Mus musculus
tacagatgacactcaagcccgtatg

SEQ ID NO: 759810 - DNA, 25 bp, Mus musculus
tacagatgatttctggctctcctgg

SEQ ID NO: 759811 - DNA, 25 bp, Mus musculus
tacagatgatttgtggctctcctgg

SEQ ID NO: 759812 - DNA, 25 bp, Mus musculus
tacagatgccaaatcttgggaaact

SEQ ID NO: 759813 - DNA, 25 bp, Mus musculus
tacagatgccaattcttgggaaact

SEQ ID NO: 759814 - DNA, 25 bp, Mus musculus
tacagatgcccgcagtgcggcaaag

SEQ ID NO: 759815 - DNA, 25 bp, Mus musculus
tacagatgcccggagtgcggcaaag

SEQ ID NO: 759816 - DNA, 25 bp, Mus musculus
tacagatgcctacaaacaccccatg

SEQ ID NO: 759817 - DNA, 25 bp, Mus musculus
tacagatgcctagaaacaccccatg

SEQ ID NO: 759818 - DNA, 25 bp, Mus musculus
tacagatgcgtacacatgcggagat

SEQ ID NO: 759819 - DNA, 25 bp, Mus musculus
tacagatgcgtagacatgcggagat

SEQ ID NO: 759820 - DNA, 25 bp, Mus musculus
tacagatggaatcaacttggcaacc

SEQ ID NO: 759821 - DNA, 25 bp, Mus musculus
tacagatggaatgaacttggcaacc

SEQ ID NO: 759822 - DNA, 25 bp, Mus musculus
tacagatggcccattacgtggagcc

SEQ ID NO: 759823 - DNA, 25 bp, Mus musculus
tacagatggccctttacgtggagcc

SEQ ID NO: 759824 - DNA, 25 bp, Mus musculus
tacagatggctcaagttcaagtccc

SEQ ID NO: 759825 - DNA, 25 bp, Mus musculus
tacagatggctctagttcaagtccc

SEQ ID NO: 759826 - DNA, 25 bp, Mus musculus
tacagatgggagcatctcaccttca

SEQ ID NO: 759827 - DNA, 25 bp, Mus musculus
tacagatgggaggatctcaccttca

SEQ ID NO: 759828 - DNA, 25 bp, Mus musculus
tacagatgtatgatgccacgcccac

SEQ ID NO: 759829 - DNA, 25 bp, Mus musculus
tacagatgtatgttgccacgcccac

SEQ ID NO: 759830 - DNA, 25 bp, Mus musculus
tacagatgtggcctggtgttgtctt

SEQ ID NO: 759831 - DNA, 25 bp, Mus musculus
tacagatgtggcgtggtgttgtctt

SEQ ID NO: 759832 - DNA, 25 bp, Mus musculus
tacagatgtgttccgaccctgattc

SEQ ID NO: 759833 - DNA, 25 bp, Mus musculus
tacagatgtgttgcgaccctgattc

SEQ ID NO: 759834 - DNA, 25 bp, Mus musculus
tacagattcaagctttgcgccctag

SEQ ID NO: 759835 - DNA, 25 bp, Mus musculus
tacagattcaaggtttgcgccctag

SEQ ID NO: 759836 - DNA, 25 bp, Mus musculus
tacagattctagctgtgcatcacac

SEQ ID NO: 759837 - DNA, 25 bp, Mus musculus
tacagattctaggtgtgcatcacac

SEQ ID NO: 759838 - DNA, 25 bp, Mus musculus
tacagattgaacagctgaacagaac

SEQ ID NO: 759839 - DNA, 25 bp, Mus musculus
tacagattgaactgctgaacagaac

SEQ ID NO: 759840 - DNA, 25 bp, Mus musculus
tacagattgtctcagggaagccttg

SEQ ID NO: 759841 - DNA, 25 bp, Mus musculus
tacagattgtctgagggaagccttg

SEQ ID NO: 759842 - DNA, 25 bp, Mus musculus
tacagatttctcagattccccaaga

SEQ ID NO: 759843 - DNA, 25 bp, Mus musculus
tacagatttctctgattccccaaga

SEQ ID NO: 759844 - DNA, 25 bp, Mus musculus
tacagatttgctcatctgctttttt

SEQ ID NO: 759845 - DNA, 25 bp, Mus musculus
tacagatttgctgatctgctttttt

SEQ ID NO: 759846 - DNA, 25 bp, Mus musculus
tacagatttgttagttgtggcttct

SEQ ID NO: 759847 - DNA, 25 bp, Mus musculus
tacagatttgtttgttgtggcttct

SEQ ID NO: 759848 - DNA, 25 bp, Mus musculus
tacagatttttgacaaatccaataa

SEQ ID NO: 759849 - DNA, 25 bp, Mus musculus
tacagatttttgtcaaatccaataa

SEQ ID NO: 759850 - DNA, 25 bp, Mus musculus
tacagattttttcactttatagcac

SEQ ID NO: 759851 - DNA, 25 bp, Mus musculus
tacagattttttgactttatagcac

SEQ ID NO: 759852 - DNA, 25 bp, Mus musculus
tacagcaaaaagcaacccatccaag

SEQ ID NO: 759853 - DNA, 25 bp, Mus musculus
tacagcaaaaaggaacccatccaag

SEQ ID NO: 759854 - DNA, 25 bp, Mus musculus
tacagcaaaatgctgccaaagcgct

SEQ ID NO: 759855 - DNA, 25 bp, Mus musculus
tacagcaaaatggtgccaaagcgct

SEQ ID NO: 759856 - DNA, 25 bp, Mus musculus
tacagcaaacacaaaggaacccttc

SEQ ID NO: 759857 - DNA, 25 bp, Mus musculus
tacagcaaacactaaggaacccttc

SEQ ID NO: 759858 - DNA, 25 bp, Mus musculus
tacagcaacatgcaggaggtcgatt

SEQ ID NO: 759859 - DNA, 25 bp, Mus musculus
tacagcaacatggaggaggtcgatt

SEQ ID NO: 759860 - DNA, 25 bp, Mus musculus
tacagcaagactacatcgttcactt

SEQ ID NO: 759861 - DNA, 25 bp, Mus musculus
tacagcaagacttcatcgttcactt

SEQ ID NO: 759862 - DNA, 25 bp, Mus musculus
tacagcaagcacatcgtatggcgcc

SEQ ID NO: 759863 - DNA, 25 bp, Mus musculus
tacagcaagcacttcgtatggcgcc

SEQ ID NO: 759864 - DNA, 25 bp, Mus musculus
tacagcaatcgtcgatggctccctg

SEQ ID NO: 759865 - DNA, 25 bp, Mus musculus
tacagcaatcgtggatggctccctg

SEQ ID NO: 759866 - DNA, 25 bp, Mus musculus
tacagcaatgctcttgcctctgtct

SEQ ID NO: 759867 - DNA, 25 bp, Mus musculus
tacagcaatgctgttgcctctgtct

SEQ ID NO: 759868 - DNA, 25 bp, Mus musculus
tacagcaatggcctgggacctaaag

SEQ ID NO: 759869 - DNA, 25 bp, Mus musculus
tacagcaatggcgtgggacctaaag

SEQ ID NO: 759870 - DNA, 25 bp, Mus musculus
tacagcacaaagacctcaccagata

SEQ ID NO: 759871 - DNA, 25 bp, Mus musculus
tacagcacaaagtcctcaccagata

SEQ ID NO: 759872 - DNA, 25 bp, Mus musculus
tacagcacagccattctattccagg

SEQ ID NO: 759873 - DNA, 25 bp, Mus musculus
tacagcacagcccagctgttggaat

SEQ ID NO: 759874 - DNA, 25 bp, Mus musculus
tacagcacagccgagctgttggaat

SEQ ID NO: 759875 - DNA, 25 bp, Mus musculus
tacagcacagcctttctattccagg

SEQ ID NO: 759876 - DNA, 25 bp, Mus musculus
tacagcaccggccagttattagagt

SEQ ID NO: 759877 - DNA, 25 bp, Mus musculus
tacagcaccggcgagttattagagt

SEQ ID NO: 759878 - DNA, 25 bp, Mus musculus
tacagcaccgtgaggcgatcagttc

SEQ ID NO: 759879 - DNA, 25 bp, Mus musculus
tacagcaccgtgtggcgatcagttc

SEQ ID NO: 759880 - DNA, 25 bp, Mus musculus
tacagcacctccagccatgattaga

SEQ ID NO: 759881 - DNA, 25 bp, Mus musculus
tacagcacctcctgccatgattaga

SEQ ID NO: 759882 - DNA, 25 bp, Mus musculus
tacagcacctggatatgttggatct

SEQ ID NO: 759883 - DNA, 25 bp, Mus musculus
tacagcacctggttatgttggatct

SEQ ID NO: 759884 - DNA, 25 bp, Mus musculus
tacagcactaggctcacaggactca

SEQ ID NO: 759885 - DNA, 25 bp, Mus musculus
tacagcactagggtcacaggactca

SEQ ID NO: 759886 - DNA, 25 bp, Mus musculus
tacagcagaaccctttagtacagcg

SEQ ID NO: 759887 - DNA, 25 bp, Mus musculus
tacagcagaaccgtttagtacagcg

SEQ ID NO: 759888 - DNA, 25 bp, Mus musculus
tacagcagaacgctctcaagtcgtc

SEQ ID NO: 759889 - DNA, 25 bp, Mus musculus
tacagcagaacggtctcaagtcgtc

SEQ ID NO: 759890 - DNA, 25 bp, Mus musculus
tacagcagagctcgtgcttgttaat

SEQ ID NO: 759891 - DNA, 25 bp, Mus musculus
tacagcagagctggtgcttgttaat

SEQ ID NO: 759892 - DNA, 25 bp, Mus musculus
tacagcagattgaagacaaaaccat

SEQ ID NO: 759893 - DNA, 25 bp, Mus musculus
tacagcagattgtagacaaaaccat

SEQ ID NO: 759894 - DNA, 25 bp, Mus musculus
tacagcagcagccttcggctaacaa

SEQ ID NO: 759895 - DNA, 25 bp, Mus musculus
tacagcagcagcgttcggctaacaa

SEQ ID NO: 759896 - DNA, 25 bp, Mus musculus
tacagcagcagtctgtatccatcac

SEQ ID NO: 759897 - DNA, 25 bp, Mus musculus
tacagcagcagtgtgtatccatcac

SEQ ID NO: 759898 - DNA, 25 bp, Mus musculus
tacagcagccctagtcgcaggactt

SEQ ID NO: 759899 - DNA, 25 bp, Mus musculus
tacagcagcccttgtcgcaggactt

SEQ ID NO: 759900 - DNA, 25 bp, Mus musculus
tacagcagcggtcgcgaagatggtt

SEQ ID NO: 759901 - DNA, 25 bp, Mus musculus
tacagcagcggtggcgaagatggtt

SEQ ID NO: 759902 - DNA, 25 bp, Mus musculus
tacagcagctggagcgaagcatcgc

SEQ ID NO: 759903 - DNA, 25 bp, Mus musculus
tacagcagctggtgcgaagcatcgc

SEQ ID NO: 759904 - DNA, 25 bp, Mus musculus
tacagcaggaagcaaccggttccct

SEQ ID NO: 759905 - DNA, 25 bp, Mus musculus
tacagcaggaaggaaccggttccct

SEQ ID NO: 759906 - DNA, 25 bp, Mus musculus
tacagcagtaaaatacgccctcctt

SEQ ID NO: 759907 - DNA, 25 bp, Mus musculus
tacagcagtaaattacgccctcctt

SEQ ID NO: 759908 - DNA, 25 bp, Mus musculus
tacagcagtatcctcccaagtcttg

SEQ ID NO: 759909 - DNA, 25 bp, Mus musculus
tacagcagtatcgtcccaagtcttg

SEQ ID NO: 759910 - DNA, 25 bp, Mus musculus
tacagcagtcagaagggtgatcaga

SEQ ID NO: 759911 - DNA, 25 bp, Mus musculus
tacagcagtcagtagggtgatcaga

SEQ ID NO: 759912 - DNA, 25 bp, Mus musculus
tacagcagtcctatccaattacttg

SEQ ID NO: 759913 - DNA, 25 bp, Mus musculus
tacagcagtcctttccaattacttg

SEQ ID NO: 759914 - DNA, 25 bp, Mus musculus
tacagcagtgctatcaaggtcttct

SEQ ID NO: 759915 - DNA, 25 bp, Mus musculus
tacagcagtgctttcaaggtcttct

SEQ ID NO: 759916 - DNA, 25 bp, Mus musculus
tacagcagtggactcacaagggagc

SEQ ID NO: 759917 - DNA, 25 bp, Mus musculus
tacagcagtggacttagaggatttt

SEQ ID NO: 759918 - DNA, 25 bp, Mus musculus
tacagcagtggagtcacaagggagc

SEQ ID NO: 759919 - DNA, 25 bp, Mus musculus
tacagcagtggagttagaggatttt

SEQ ID NO: 759920 - DNA, 25 bp, Mus musculus
tacagcagtggtaccagcagttcct

SEQ ID NO: 759921 - DNA, 25 bp, Mus musculus
tacagcagtggttccagcagttcct

SEQ ID NO: 759922 - DNA, 25 bp, Mus musculus
tacagcagttgtcgcaggcttactg

SEQ ID NO: 759923 - DNA, 25 bp, Mus musculus
tacagcagttgtggcaggcttactg

SEQ ID NO: 759924 - DNA, 25 bp, Mus musculus
tacagcatactcaggaggtcctttc

SEQ ID NO: 759925 - DNA, 25 bp, Mus musculus
tacagcatactctggaggtcctttc

SEQ ID NO: 759926 - DNA, 25 bp, Mus musculus
tacagcatatgcatgccaggccggg

SEQ ID NO: 759927 - DNA, 25 bp, Mus musculus
tacagcatatgcttgccaggccggg

SEQ ID NO: 759928 - DNA, 25 bp, Mus musculus
tacagcatcactacttgaaatacag

SEQ ID NO: 759929 - DNA, 25 bp, Mus musculus
tacagcatcacttcttgaaatacag

SEQ ID NO: 759930 - DNA, 25 bp, Mus musculus
tacagcatcagtctgcttagcccat

SEQ ID NO: 759931 - DNA, 25 bp, Mus musculus
tacagcatcagtgtgcttagcccat

SEQ ID NO: 759932 - DNA, 25 bp, Mus musculus
tacagcatccaaatggctagccagg

SEQ ID NO: 759933 - DNA, 25 bp, Mus musculus
tacagcatccaattggctagccagg

SEQ ID NO: 759934 - DNA, 25 bp, Mus musculus
tacagcatcctacccacagtggtta

SEQ ID NO: 759935 - DNA, 25 bp, Mus musculus
tacagcatcctagccacagtggtta

SEQ ID NO: 759936 - DNA, 25 bp, Mus musculus
tacagcatcgaaagcaggtgtcctg

SEQ ID NO: 759937 - DNA, 25 bp, Mus musculus
tacagcatcgaatgcaggtgtcctg

SEQ ID NO: 759938 - DNA, 25 bp, Mus musculus
tacagcatctagcagctcgtgggaa

SEQ ID NO: 759939 - DNA, 25 bp, Mus musculus
tacagcatctaggagctcgtgggaa

SEQ ID NO: 759940 - DNA, 25 bp, Mus musculus
tacagcatctgcctctgaagaaatg

SEQ ID NO: 759941 - DNA, 25 bp, Mus musculus
tacagcatctgcgtctgaagaaatg

SEQ ID NO: 759942 - DNA, 25 bp, Mus musculus
tacagcatcttcacctacaacacaa

SEQ ID NO: 759943 - DNA, 25 bp, Mus musculus
tacagcatcttctcctacaacacaa

SEQ ID NO: 759944 - DNA, 25 bp, Mus musculus
tacagcatgaacagtgcctactttt

SEQ ID NO: 759945 - DNA, 25 bp, Mus musculus
tacagcatgaactgtgcctactttt

SEQ ID NO: 759946 - DNA, 25 bp, Mus musculus
tacagcatgatgcaaatgattttct

SEQ ID NO: 759947 - DNA, 25 bp, Mus musculus
tacagcatgatggaaatgattttct

SEQ ID NO: 759948 - DNA, 25 bp, Mus musculus
tacagcatgcagagtgcccgcttat

SEQ ID NO: 759949 - DNA, 25 bp, Mus musculus
tacagcatgcagtgtgcccgcttat

SEQ ID NO: 759950 - DNA, 25 bp, Mus musculus
tacagcatgctgacctgtggcagat

SEQ ID NO: 759951 - DNA, 25 bp, Mus musculus
tacagcatgctgctggcctttacaa

SEQ ID NO: 759952 - DNA, 25 bp, Mus musculus
tacagcatgctggtggcctttacaa

SEQ ID NO: 759953 - DNA, 25 bp, Mus musculus
tacagcatgctgtcctgtggcagat

SEQ ID NO: 759954 - DNA, 25 bp, Mus musculus
tacagcatggccaaccaggaggctt

SEQ ID NO: 759955 - DNA, 25 bp, Mus musculus
tacagcatggcctaccaggaggctt

SEQ ID NO: 759956 - DNA, 25 bp, Mus musculus
tacagcatggctaccgtctccgagc

SEQ ID NO: 759957 - DNA, 25 bp, Mus musculus
tacagcatggctacttctctcaata

SEQ ID NO: 759958 - DNA, 25 bp, Mus musculus
tacagcatggcttccgtctccgagc

SEQ ID NO: 759959 - DNA, 25 bp, Mus musculus
tacagcatggcttcttctctcaata

SEQ ID NO: 759960 - DNA, 25 bp, Mus musculus
tacagcatgtccattatcactccga

SEQ ID NO: 759961 - DNA, 25 bp, Mus musculus
tacagcatgtcctttatcactccga

SEQ ID NO: 759962 - DNA, 25 bp, Mus musculus
tacagcatgtctctctgttgtccgt

SEQ ID NO: 759963 - DNA, 25 bp, Mus musculus
tacagcatgtctgtctgttgtccgt

SEQ ID NO: 759964 - DNA, 25 bp, Mus musculus
tacagcatgtgccatgtgcggccat

SEQ ID NO: 759965 - DNA, 25 bp, Mus musculus
tacagcatgtgcgatgtgcggccat

SEQ ID NO: 759966 - DNA, 25 bp, Mus musculus
tacagcattccacctatgatcatgt

SEQ ID NO: 759967 - DNA, 25 bp, Mus musculus
tacagcattccagctatgatcatgt

SEQ ID NO: 759968 - DNA, 25 bp, Mus musculus
tacagcattctgatctccatgcaaa

SEQ ID NO: 759969 - DNA, 25 bp, Mus musculus
tacagcattctgttctccatgcaaa

SEQ ID NO: 759970 - DNA, 25 bp, Mus musculus
tacagcattcttccattaatccatt

SEQ ID NO: 759971 - DNA, 25 bp, Mus musculus
tacagcattcttgcattaatccatt

SEQ ID NO: 759972 - DNA, 25 bp, Mus musculus
tacagcattgcacaggttgagaaac

SEQ ID NO: 759973 - DNA, 25 bp, Mus musculus
tacagcattgcagaggttgagaaac

SEQ ID NO: 759974 - DNA, 25 bp, Mus musculus
tacagccacacaaacctatgcacag

SEQ ID NO: 759975 - DNA, 25 bp, Mus musculus
tacagccacacatacctatgcacag

SEQ ID NO: 759976 - DNA, 25 bp, Mus musculus
tacagccacagcactggaagtggtg

SEQ ID NO: 759977 - DNA, 25 bp, Mus musculus
tacagccacagctctggaagtggtg

SEQ ID NO: 759978 - DNA, 25 bp, Mus musculus
tacagccaccctcagaagttaaagt

SEQ ID NO: 759979 - DNA, 25 bp, Mus musculus
tacagccaccctgagaagttaaagt

SEQ ID NO: 759980 - DNA, 25 bp, Mus musculus
tacagccactgcactgcaaaaggga

SEQ ID NO: 759981 - DNA, 25 bp, Mus musculus
tacagccactgctctgcaaaaggga

SEQ ID NO: 759982 - DNA, 25 bp, Mus musculus
tacagccactggacaggtctctagt

SEQ ID NO: 759983 - DNA, 25 bp, Mus musculus
tacagccactggtcaggtctctagt

SEQ ID NO: 759984 - DNA, 25 bp, Mus musculus
tacagccaggaaacaaagcttagca

SEQ ID NO: 759985 - DNA, 25 bp, Mus musculus
tacagccaggaatcaaagcttagca

SEQ ID NO: 759986 - DNA, 25 bp, Mus musculus
tacagccagttgcacagtcaaacat

SEQ ID NO: 759987 - DNA, 25 bp, Mus musculus
tacagccagttggacagtcaaacat

SEQ ID NO: 759988 - DNA, 25 bp, Mus musculus
tacagccatactaagctcagggcag

SEQ ID NO: 759989 - DNA, 25 bp, Mus musculus
tacagccatacttagctcagggcag

SEQ ID NO: 759990 - DNA, 25 bp, Mus musculus
tacagccatgcactcagactgacag

SEQ ID NO: 759991 - DNA, 25 bp, Mus musculus
tacagccatgcagtcagactgacag

SEQ ID NO: 759992 - DNA, 25 bp, Mus musculus
tacagccatgccacatagcagtgaa

SEQ ID NO: 759993 - DNA, 25 bp, Mus musculus
tacagccatgccctggtggctggaa

SEQ ID NO: 759994 - DNA, 25 bp, Mus musculus
tacagccatgccgtggtggctggaa

SEQ ID NO: 759995 - DNA, 25 bp, Mus musculus
tacagccatgcctcatagcagtgaa

SEQ ID NO: 759996 - DNA, 25 bp, Mus musculus
tacagccatgctaccaacaagtatg

SEQ ID NO: 759997 - DNA, 25 bp, Mus musculus
tacagccatgcttccaacaagtatg

SEQ ID NO: 759998 - DNA, 25 bp, Mus musculus
tacagccatggcacttgtgttgaaa

SEQ ID NO: 759999 - DNA, 25 bp, Mus musculus
tacagccatggctcttgtgttgaaa

SEQ ID NO: 760000 - DNA, 25 bp, Mus musculus
tacagccatgggactagtgccagat

SEQ ID NO: 760001 - DNA, 25 bp, Mus musculus
tacagccatgggtctagtgccagat

SEQ ID NO: 760002 - DNA, 25 bp, Mus musculus
tacagccatgtcagagccctcagaa

SEQ ID NO: 760003 - DNA, 25 bp, Mus musculus
tacagccatgtctgagccctcagaa

SEQ ID NO: 760004 - DNA, 25 bp, Mus musculus
tacagcccaccgaaagatccaggtt

SEQ ID NO: 760005 - DNA, 25 bp, Mus musculus
tacagcccaccgtaagatccaggtt

SEQ ID NO: 760006 - DNA, 25 bp, Mus musculus
tacagcccagcacggcattaacctg

SEQ ID NO: 760007 - DNA, 25 bp, Mus musculus
tacagcccagcagggcattaacctg

SEQ ID NO: 760008 - DNA, 25 bp, Mus musculus
tacagcccagggaacgtccgagtgg

SEQ ID NO: 760009 - DNA, 25 bp, Mus musculus
tacagcccagggaggactgtgtagt

SEQ ID NO: 760010 - DNA, 25 bp, Mus musculus
tacagcccagggtacgtccgagtgg

SEQ ID NO: 760011 - DNA, 25 bp, Mus musculus
tacagcccagggtggactgtgtagt

SEQ ID NO: 760012 - DNA, 25 bp, Mus musculus
tacagccccagcaaacatctcttta

SEQ ID NO: 760013 - DNA, 25 bp, Mus musculus
tacagccccagctaacatctcttta

SEQ ID NO: 760014 - DNA, 25 bp, Mus musculus
tacagccccgagaacgccagcggtg

SEQ ID NO: 760015 - DNA, 25 bp, Mus musculus
tacagccccgagtacgccagcggtg

SEQ ID NO: 760016 - DNA, 25 bp, Mus musculus
tacagccccgggagctttaccagag

SEQ ID NO: 760017 - DNA, 25 bp, Mus musculus
tacagccccgggtgctttaccagag

SEQ ID NO: 760018 - DNA, 25 bp, Mus musculus
tacagcccctaaccttttcttctaa

SEQ ID NO: 760019 - DNA, 25 bp, Mus musculus
tacagcccctaagcttttcttctaa

SEQ ID NO: 760020 - DNA, 25 bp, Mus musculus
tacagccctggcaagacaagagcgg

SEQ ID NO: 760021 - DNA, 25 bp, Mus musculus
tacagccctggctagacaagagcgg

SEQ ID NO: 760022 - DNA, 25 bp, Mus musculus
tacagccgacagagcgcccaacttg

SEQ ID NO: 760023 - DNA, 25 bp, Mus musculus
tacagccgacagtgcgcccaacttg

SEQ ID NO: 760024 - DNA, 25 bp, Mus musculus
tacagccgacccagtactgaacaaa

SEQ ID NO: 760025 - DNA, 25 bp, Mus musculus
tacagccgaccctgtactgaacaaa

SEQ ID NO: 760026 - DNA, 25 bp, Mus musculus
tacagccgaggcactcccatatgca

SEQ ID NO: 760027 - DNA, 25 bp, Mus musculus
tacagccgaggctctcccatatgca

SEQ ID NO: 760028 - DNA, 25 bp, Mus musculus
tacagccgccggagcctgaagaggc

SEQ ID NO: 760029 - DNA, 25 bp, Mus musculus
tacagccgccggtgcctgaagaggc

SEQ ID NO: 760030 - DNA, 25 bp, Mus musculus
tacagccgcttcatgaagtctgact

SEQ ID NO: 760031 - DNA, 25 bp, Mus musculus
tacagccgcttcttgaagtctgact

SEQ ID NO: 760032 - DNA, 25 bp, Mus musculus
tacagccgtataatttcttatgatg

SEQ ID NO: 760033 - DNA, 25 bp, Mus musculus
tacagccgtatattttcttatgatg

SEQ ID NO: 760034 - DNA, 25 bp, Mus musculus
tacagcctaaagctgtcagcagaat

SEQ ID NO: 760035 - DNA, 25 bp, Mus musculus
tacagcctaaaggtgtcagcagaat

SEQ ID NO: 760036 - DNA, 25 bp, Mus musculus
tacagcctcatgacgcagaaattcc

SEQ ID NO: 760037 - DNA, 25 bp, Mus musculus
tacagcctcatgtcgcagaaattcc

SEQ ID NO: 760038 - DNA, 25 bp, Mus musculus
tacagcctcccaatggaagcctctg

SEQ ID NO: 760039 - DNA, 25 bp, Mus musculus
tacagcctcccattggaagcctctg

SEQ ID NO: 760040 - DNA, 25 bp, Mus musculus
tacagcctcctcagatagacaacca

SEQ ID NO: 760041 - DNA, 25 bp, Mus musculus
tacagcctcctctgatagacaacca

SEQ ID NO: 760042 - DNA, 25 bp, Mus musculus
tacagcctctatccgtctgagctgc

SEQ ID NO: 760043 - DNA, 25 bp, Mus musculus
tacagcctctatgcgtctgagctgc

SEQ ID NO: 760044 - DNA, 25 bp, Mus musculus
tacagcctctcacttgccttctgtg

SEQ ID NO: 760045 - DNA, 25 bp, Mus musculus
tacagcctctcagttgccttctgtg

SEQ ID NO: 760046 - DNA, 25 bp, Mus musculus
tacagcctctgtacctgaaggaaag

SEQ ID NO: 760047 - DNA, 25 bp, Mus musculus
tacagcctctgttcctgaaggaaag

SEQ ID NO: 760048 - DNA, 25 bp, Mus musculus
tacagcctgacaaggacgagccaga

SEQ ID NO: 760049 - DNA, 25 bp, Mus musculus
tacagcctgacatggacgagccaga

SEQ ID NO: 760050 - DNA, 25 bp, Mus musculus
tacagcctggatccgtgtaccaaca

SEQ ID NO: 760051 - DNA, 25 bp, Mus musculus
tacagcctggatgcgtgtaccaaca

SEQ ID NO: 760052 - DNA, 25 bp, Mus musculus
tacagcctggccatatcccaggtaa

SEQ ID NO: 760053 - DNA, 25 bp, Mus musculus
tacagcctggccttatcccaggtaa

SEQ ID NO: 760054 - DNA, 25 bp, Mus musculus
tacagcctggttctctacacacaca

SEQ ID NO: 760055 - DNA, 25 bp, Mus musculus
tacagcctggttgtctacacacaca

SEQ ID NO: 760056 - DNA, 25 bp, Mus musculus
tacagcctgtccacctgaaatcttg

SEQ ID NO: 760057 - DNA, 25 bp, Mus musculus
tacagcctgtcctcctgaaatcttg

SEQ ID NO: 760058 - DNA, 25 bp, Mus musculus
tacagccttgtgacaggagcctcat

SEQ ID NO: 760059 - DNA, 25 bp, Mus musculus
tacagccttgtgtcaggagcctcat

SEQ ID NO: 760060 - DNA, 25 bp, Mus musculus
tacagcctttgtctacgtaaaggag

SEQ ID NO: 760061 - DNA, 25 bp, Mus musculus
tacagcctttgtgtacgtaaaggag

SEQ ID NO: 760062 - DNA, 25 bp, Mus musculus
tacagcgaacagagaggcacctggg

SEQ ID NO: 760063 - DNA, 25 bp, Mus musculus
tacagcgaacagtgaggcacctggg

SEQ ID NO: 760064 - DNA, 25 bp, Mus musculus
tacagcgaaccaaccctatctcaaa

SEQ ID NO: 760065 - DNA, 25 bp, Mus musculus
tacagcgaaccatccctatctcaaa

SEQ ID NO: 760066 - DNA, 25 bp, Mus musculus
tacagcgaagcccacgagatcagca

SEQ ID NO: 760067 - DNA, 25 bp, Mus musculus
tacagcgaagccgacgagatcagca

SEQ ID NO: 760068 - DNA, 25 bp, Mus musculus
tacagcgaatcacttggacaccaat

SEQ ID NO: 760069 - DNA, 25 bp, Mus musculus
tacagcgaatcagttggacaccaat

SEQ ID NO: 760070 - DNA, 25 bp, Mus musculus
tacagcgacctgctagatgccgagg

SEQ ID NO: 760071 - DNA, 25 bp, Mus musculus
tacagcgacctggtagatgccgagg

SEQ ID NO: 760072 - DNA, 25 bp, Mus musculus
tacagcgacgatcattcctctgatc

SEQ ID NO: 760073 - DNA, 25 bp, Mus musculus
tacagcgacgatgattcctctgatc

SEQ ID NO: 760074 - DNA, 25 bp, Mus musculus
tacagcgacgccaagaggatgagct

SEQ ID NO: 760075 - DNA, 25 bp, Mus musculus
tacagcgacgcctagaggatgagct

SEQ ID NO: 760076 - DNA, 25 bp, Mus musculus
tacagcgactccagttcactcgatt

SEQ ID NO: 760077 - DNA, 25 bp, Mus musculus
tacagcgactcctgttcactcgatt

SEQ ID NO: 760078 - DNA, 25 bp, Mus musculus
tacagcgagtacatttattccaaca

SEQ ID NO: 760079 - DNA, 25 bp, Mus musculus
tacagcgagtacttttattccaaca

SEQ ID NO: 760080 - DNA, 25 bp, Mus musculus
tacagcgcagtccaggagggaattc

SEQ ID NO: 760081 - DNA, 25 bp, Mus musculus
tacagcgcagtcgaggagggaattc

SEQ ID NO: 760082 - DNA, 25 bp, Mus musculus
tacagcgccagactgctgacgcctt

SEQ ID NO: 760083 - DNA, 25 bp, Mus musculus
tacagcgccagagtgctgacgcctt

SEQ ID NO: 760084 - DNA, 25 bp, Mus musculus
tacagcgccgcaacatgaacctgat

SEQ ID NO: 760085 - DNA, 25 bp, Mus musculus
tacagcgccgcatcatgaacctgat

SEQ ID NO: 760086 - DNA, 25 bp, Mus musculus
tacagcgcctcgaaagcaggacagc

SEQ ID NO: 760087 - DNA, 25 bp, Mus musculus
tacagcgcctcgtaagcaggacagc

SEQ ID NO: 760088 - DNA, 25 bp, Mus musculus
tacagcgcctggcacaagcagtttt

SEQ ID NO: 760089 - DNA, 25 bp, Mus musculus
tacagcgcctgggacaagcagtttt

SEQ ID NO: 760090 - DNA, 25 bp, Mus musculus
tacagcgctccactgtatgactgtc

SEQ ID NO: 760091 - DNA, 25 bp, Mus musculus
tacagcgctccagtgtatgactgtc

SEQ ID NO: 760092 - DNA, 25 bp, Mus musculus
tacagcggaaaaagggtacatacat

SEQ ID NO: 760093 - DNA, 25 bp, Mus musculus
tacagcggaaaatgggtacatacat

SEQ ID NO: 760094 - DNA, 25 bp, Mus musculus
tacagcggtcagaacagcatgggcg

SEQ ID NO: 760095 - DNA, 25 bp, Mus musculus
tacagcggtcagtacagcatgggcg

SEQ ID NO: 760096 - DNA, 25 bp, Mus musculus
tacagcggtgtgctgtgcccctgaa

SEQ ID NO: 760097 - DNA, 25 bp, Mus musculus
tacagcggtgtggtgtgcccctgaa

SEQ ID NO: 760098 - DNA, 25 bp, Mus musculus
tacagcgtccccagctttcctgaat

SEQ ID NO: 760099 - DNA, 25 bp, Mus musculus
tacagcgtcccctgctttcctgaat

SEQ ID NO: 760100 - DNA, 25 bp, Mus musculus
tacagcgtgaaccatgggtcccact

SEQ ID NO: 760101 - DNA, 25 bp, Mus musculus
tacagcgtgaacgatgggtcccact

SEQ ID NO: 760102 - DNA, 25 bp, Mus musculus
tacagcgtgagaccctgggcagtca

SEQ ID NO: 760103 - DNA, 25 bp, Mus musculus
tacagcgtgagagcctgggcagtca

SEQ ID NO: 760104 - DNA, 25 bp, Mus musculus
tacagcgttaacaccagtcttagaa

SEQ ID NO: 760105 - DNA, 25 bp, Mus musculus
tacagcgttaactccagtcttagaa

SEQ ID NO: 760106 - DNA, 25 bp, Mus musculus
tacagcgttaagatacaccagggtt

SEQ ID NO: 760107 - DNA, 25 bp, Mus musculus
tacagcgttaagttacaccagggtt

SEQ ID NO: 760108 - DNA, 25 bp, Mus musculus
tacagcgttcctatgtaacccaggc

SEQ ID NO: 760109 - DNA, 25 bp, Mus musculus
tacagcgttcctttgtaacccaggc

SEQ ID NO: 760110 - DNA, 25 bp, Mus musculus
tacagctacaaaagtgtaccctttg

SEQ ID NO: 760111 - DNA, 25 bp, Mus musculus
tacagctacaaatgtgtaccctttg

SEQ ID NO: 760112 - DNA, 25 bp, Mus musculus
tacagctacagcagcgcggccacga

SEQ ID NO: 760113 - DNA, 25 bp, Mus musculus
tacagctacagctgcgcggccacga

SEQ ID NO: 760114 - DNA, 25 bp, Mus musculus
tacagctacggcaatcgcagaacat

SEQ ID NO: 760115 - DNA, 25 bp, Mus musculus
tacagctacggctatcgcagaacat

SEQ ID NO: 760116 - DNA, 25 bp, Mus musculus
tacagctacttcacagagccgtggt

SEQ ID NO: 760117 - DNA, 25 bp, Mus musculus
tacagctacttcctatgcacagaca

SEQ ID NO: 760118 - DNA, 25 bp, Mus musculus
tacagctacttcgtatgcacagaca

SEQ ID NO: 760119 - DNA, 25 bp, Mus musculus
tacagctacttctcagagccgtggt

SEQ ID NO: 760120 - DNA, 25 bp, Mus musculus
tacagctagcacagccacggaaggt

SEQ ID NO: 760121 - DNA, 25 bp, Mus musculus
tacagctagcactgccacggaaggt

SEQ ID NO: 760122 - DNA, 25 bp, Mus musculus
tacagctataacaataccaccacca

SEQ ID NO: 760123 - DNA, 25 bp, Mus musculus
tacagctataactataccaccacca

SEQ ID NO: 760124 - DNA, 25 bp, Mus musculus
tacagctatatacctgagtcccttc

SEQ ID NO: 760125 - DNA, 25 bp, Mus musculus
tacagctatatagctgagtcccttc

SEQ ID NO: 760126 - DNA, 25 bp, Mus musculus
tacagctcagtaaagaacggccaag

SEQ ID NO: 760127 - DNA, 25 bp, Mus musculus
tacagctcagtactgttctgccctg

SEQ ID NO: 760128 - DNA, 25 bp, Mus musculus
tacagctcagtagtgttctgccctg

SEQ ID NO: 760129 - DNA, 25 bp, Mus musculus
tacagctcagtatagaacggccaag

SEQ ID NO: 760130 - DNA, 25 bp, Mus musculus
tacagctcagtgcttatcttgcatt

SEQ ID NO: 760131 - DNA, 25 bp, Mus musculus
tacagctcagtggttatcttgcatt

SEQ ID NO: 760132 - DNA, 25 bp, Mus musculus
tacagctcattacctcaggagcctt

SEQ ID NO: 760133 - DNA, 25 bp, Mus musculus
tacagctcattagctcaggagcctt

SEQ ID NO: 760134 - DNA, 25 bp, Mus musculus
tacagctccagcatcagagcctggc

SEQ ID NO: 760135 - DNA, 25 bp, Mus musculus
tacagctccagcttcagagcctggc

SEQ ID NO: 760136 - DNA, 25 bp, Mus musculus
tacagctcccacagaagccggaatg

SEQ ID NO: 760137 - DNA, 25 bp, Mus musculus
tacagctcccactgaagccggaatg

SEQ ID NO: 760138 - DNA, 25 bp, Mus musculus
tacagctccttacaactcagcgtgt

SEQ ID NO: 760139 - DNA, 25 bp, Mus musculus
tacagctccttagaactcagcgtgt

SEQ ID NO: 760140 - DNA, 25 bp, Mus musculus
tacagctccttccaagccatgaaag

SEQ ID NO: 760141 - DNA, 25 bp, Mus musculus
tacagctccttcgaagccatgaaag

SEQ ID NO: 760142 - DNA, 25 bp, Mus musculus
tacagctcggagcaccctagcatgt

SEQ ID NO: 760143 - DNA, 25 bp, Mus musculus
tacagctcggaggaccctagcatgt

SEQ ID NO: 760144 - DNA, 25 bp, Mus musculus
tacagctctattatcaaagtctcct

SEQ ID NO: 760145 - DNA, 25 bp, Mus musculus
tacagctctattttcaaagtctcct

SEQ ID NO: 760146 - DNA, 25 bp, Mus musculus
tacagctctcagcacactcttggtg

SEQ ID NO: 760147 - DNA, 25 bp, Mus musculus
tacagctctcaggacactcttggtg

SEQ ID NO: 760148 - DNA, 25 bp, Mus musculus
tacagctctctgatatctttaagag

SEQ ID NO: 760149 - DNA, 25 bp, Mus musculus
tacagctctctgattgactcacatg

SEQ ID NO: 760150 - DNA, 25 bp, Mus musculus
tacagctctctgttatctttaagag

SEQ ID NO: 760151 - DNA, 25 bp, Mus musculus
tacagctctctgtttgactcacatg

SEQ ID NO: 760152 - DNA, 25 bp, Mus musculus
tacagctctgttactgttcagcttt

SEQ ID NO: 760153 - DNA, 25 bp, Mus musculus
tacagctctgtttctgttcagcttt

SEQ ID NO: 760154 - DNA, 25 bp, Mus musculus
tacagctgaaggaccagcggatctg

SEQ ID NO: 760155 - DNA, 25 bp, Mus musculus
tacagctgaaggtccagcggatctg

SEQ ID NO: 760156 - DNA, 25 bp, Mus musculus
tacagctgacataccattccttcat

SEQ ID NO: 760157 - DNA, 25 bp, Mus musculus
tacagctgacattccattccttcat

SEQ ID NO: 760158 - DNA, 25 bp, Mus musculus
tacagctgcaatctacacacataca

SEQ ID NO: 760159 - DNA, 25 bp, Mus musculus
tacagctgcaatgtacacacataca

SEQ ID NO: 760160 - DNA, 25 bp, Mus musculus
tacagctgcagccaggtgacatgct

SEQ ID NO: 760161 - DNA, 25 bp, Mus musculus
tacagctgcagcgaggtgacatgct

SEQ ID NO: 760162 - DNA, 25 bp, Mus musculus
tacagctgcatgattctccctgtga

SEQ ID NO: 760163 - DNA, 25 bp, Mus musculus
tacagctgcatgtttctccctgtga

SEQ ID NO: 760164 - DNA, 25 bp, Mus musculus
tacagctgccgtctttcagcctgga

SEQ ID NO: 760165 - DNA, 25 bp, Mus musculus
tacagctgccgtgtttcagcctgga

SEQ ID NO: 760166 - DNA, 25 bp, Mus musculus
tacagctgcgctaccaggagatcgc

SEQ ID NO: 760167 - DNA, 25 bp, Mus musculus
tacagctgcgcttccaggagatcgc

SEQ ID NO: 760168 - DNA, 25 bp, Mus musculus
tacagctgctggcatgagcttccag

SEQ ID NO: 760169 - DNA, 25 bp, Mus musculus
tacagctgctgggatgagcttccag

SEQ ID NO: 760170 - DNA, 25 bp, Mus musculus
tacagctggactcgactccacttag

SEQ ID NO: 760171 - DNA, 25 bp, Mus musculus
tacagctggactggactccacttag

SEQ ID NO: 760172 - DNA, 25 bp, Mus musculus
tacagctggatcattctttcatgcg

SEQ ID NO: 760173 - DNA, 25 bp, Mus musculus
tacagctggatctttctttcatgcg

SEQ ID NO: 760174 - DNA, 25 bp, Mus musculus
tacagctggctaagagttcccgtat

SEQ ID NO: 760175 - DNA, 25 bp, Mus musculus
tacagctggctatgagttcccgtat

SEQ ID NO: 760176 - DNA, 25 bp, Mus musculus
tacagctgggaaaagttaaactcaa

SEQ ID NO: 760177 - DNA, 25 bp, Mus musculus
tacagctgggaatagttaaactcaa

SEQ ID NO: 760178 - DNA, 25 bp, Mus musculus
tacagctggtcaacgtgttcgccga

SEQ ID NO: 760179 - DNA, 25 bp, Mus musculus
tacagctggtcatcgtgttcgccga

SEQ ID NO: 760180 - DNA, 25 bp, Mus musculus
tacagctggtgtctctagctgcgta

SEQ ID NO: 760181 - DNA, 25 bp, Mus musculus
tacagctggtgtgtctagctgcgta

SEQ ID NO: 760182 - DNA, 25 bp, Mus musculus
tacagctgtcagagttggcatcaag

SEQ ID NO: 760183 - DNA, 25 bp, Mus musculus
tacagctgtcagtgttggcatcaag

SEQ ID NO: 760184 - DNA, 25 bp, Mus musculus
tacagctgtctacccgctgcaagaa

SEQ ID NO: 760185 - DNA, 25 bp, Mus musculus
tacagctgtctagccgctgcaagaa

SEQ ID NO: 760186 - DNA, 25 bp, Mus musculus
tacagctgtgaaatggtgcttgcag

SEQ ID NO: 760187 - DNA, 25 bp, Mus musculus
tacagctgtgaattggtgcttgcag

SEQ ID NO: 760188 - DNA, 25 bp, Mus musculus
tacagctgtgttacccttaaaggtt

SEQ ID NO: 760189 - DNA, 25 bp, Mus musculus
tacagctgtgtttcccttaaaggtt

SEQ ID NO: 760190 - DNA, 25 bp, Mus musculus
tacagctgttgcaccaggcagggac

SEQ ID NO: 760191 - DNA, 25 bp, Mus musculus
tacagctgttgctccaggcagggac

SEQ ID NO: 760192 - DNA, 25 bp, Mus musculus
tacagcttacatcaacctcagggaa

SEQ ID NO: 760193 - DNA, 25 bp, Mus musculus
tacagcttacatgaacctcagggaa

SEQ ID NO: 760194 - DNA, 25 bp, Mus musculus
tacagcttacctactgagagcgtct

SEQ ID NO: 760195 - DNA, 25 bp, Mus musculus
tacagcttaccttctgagagcgtct

SEQ ID NO: 760196 - DNA, 25 bp, Mus musculus
tacagcttatacaggtaaccacaat

SEQ ID NO: 760197 - DNA, 25 bp, Mus musculus
tacagcttatactggtaaccacaat

SEQ ID NO: 760198 - DNA, 25 bp, Mus musculus
tacagcttatctattctgacgtaga

SEQ ID NO: 760199 - DNA, 25 bp, Mus musculus
tacagcttatcttttctgacgtaga

SEQ ID NO: 760200 - DNA, 25 bp, Mus musculus
tacagcttatgcacaacctgggcaa

SEQ ID NO: 760201 - DNA, 25 bp, Mus musculus
tacagcttatgctcaacctgggcaa

SEQ ID NO: 760202 - DNA, 25 bp, Mus musculus
tacagcttcaaacccataccttgaa

SEQ ID NO: 760203 - DNA, 25 bp, Mus musculus
tacagcttcaaagccataccttgaa

SEQ ID NO: 760204 - DNA, 25 bp, Mus musculus
tacagcttccatcaaagcagcgaag

SEQ ID NO: 760205 - DNA, 25 bp, Mus musculus
tacagcttccatgaaagcagcgaag

SEQ ID NO: 760206 - DNA, 25 bp, Mus musculus
tacagcttgagtctacactctgcct

SEQ ID NO: 760207 - DNA, 25 bp, Mus musculus
tacagcttgagtgtacactctgcct

SEQ ID NO: 760208 - DNA, 25 bp, Mus musculus
tacagcttgcccctcagagcgagaa

SEQ ID NO: 760209 - DNA, 25 bp, Mus musculus
tacagcttgcccgtcagagcgagaa

SEQ ID NO: 760210 - DNA, 25 bp, Mus musculus
tacagcttgctacaacactctagtg

SEQ ID NO: 760211 - DNA, 25 bp, Mus musculus
tacagcttgctagaacactctagtg

SEQ ID NO: 760212 - DNA, 25 bp, Mus musculus
tacagcttgctcatagtggatggaa

SEQ ID NO: 760213 - DNA, 25 bp, Mus musculus
tacagcttgctcttagtggatggaa

SEQ ID NO: 760214 - DNA, 25 bp, Mus musculus
tacagcttgtcgccctttgagcagc

SEQ ID NO: 760215 - DNA, 25 bp, Mus musculus
tacagcttgtcggcctttgagcagc

SEQ ID NO: 760216 - DNA, 25 bp, Mus musculus
tacagcttgtctccaaaggtgtgtg

SEQ ID NO: 760217 - DNA, 25 bp, Mus musculus
tacagcttgtctgcaaaggtgtgtg

SEQ ID NO: 760218 - DNA, 25 bp, Mus musculus
tacagctttcgtacttattttttat

SEQ ID NO: 760219 - DNA, 25 bp, Mus musculus
tacagctttcgttcttattttttat

SEQ ID NO: 760220 - DNA, 25 bp, Mus musculus
tacagcttttatcccctgggaggca

SEQ ID NO: 760221 - DNA, 25 bp, Mus musculus
tacagcttttatgccctgggaggca

SEQ ID NO: 760222 - DNA, 25 bp, Mus musculus
tacagcttttctccccatgtaaatg

SEQ ID NO: 760223 - DNA, 25 bp, Mus musculus
tacagcttttctgcccatgtaaatg

SEQ ID NO: 760224 - DNA, 25 bp, Mus musculus
tacaggaaagccctccattttcggt

SEQ ID NO: 760225 - DNA, 25 bp, Mus musculus
tacaggaaagccgtccattttcggt

SEQ ID NO: 760226 - DNA, 25 bp, Mus musculus
tacaggaaccgaatgcagctgcctc

SEQ ID NO: 760227 - DNA, 25 bp, Mus musculus
tacaggaaccgattgcagctgcctc

SEQ ID NO: 760228 - DNA, 25 bp, Mus musculus
tacaggaaccggcatgaagggtcgt

SEQ ID NO: 760229 - DNA, 25 bp, Mus musculus
tacaggaaccgggatgaagggtcgt

SEQ ID NO: 760230 - DNA, 25 bp, Mus musculus
tacaggaaggaactccccaagggca

SEQ ID NO: 760231 - DNA, 25 bp, Mus musculus
tacaggaaggaagtccccaagggca

SEQ ID NO: 760232 - DNA, 25 bp, Mus musculus
tacaggaagggaaccaggcctccct

SEQ ID NO: 760233 - DNA, 25 bp, Mus musculus
tacaggaagggatccaggcctccct

SEQ ID NO: 760234 - DNA, 25 bp, Mus musculus
tacaggaagtggcagctcaatatat

SEQ ID NO: 760235 - DNA, 25 bp, Mus musculus
tacaggaagtgggagctcaatatat

SEQ ID NO: 760236 - DNA, 25 bp, Mus musculus
tacaggaagttgaaagccaccttac

SEQ ID NO: 760237 - DNA, 25 bp, Mus musculus
tacaggaagttgtaagccaccttac

SEQ ID NO: 760238 - DNA, 25 bp, Mus musculus
tacaggaataaacatggccagtact

SEQ ID NO: 760239 - DNA, 25 bp, Mus musculus
tacaggaataaagatggccagtact

SEQ ID NO: 760240 - DNA, 25 bp, Mus musculus
tacaggaatcagaggtgccaggatc

SEQ ID NO: 760241 - DNA, 25 bp, Mus musculus
tacaggaatcagtggtgccaggatc

SEQ ID NO: 760242 - DNA, 25 bp, Mus musculus
tacaggaatctaactgcttccgtct

SEQ ID NO: 760243 - DNA, 25 bp, Mus musculus
tacaggaatctatctgcttccgtct

SEQ ID NO: 760244 - DNA, 25 bp, Mus musculus
tacaggaattacaacggttaccaag

SEQ ID NO: 760245 - DNA, 25 bp, Mus musculus
tacaggaattactacggttaccaag

SEQ ID NO: 760246 - DNA, 25 bp, Mus musculus
tacaggaatttaataacacacccca

SEQ ID NO: 760247 - DNA, 25 bp, Mus musculus
tacaggaatttattaacacacccca

SEQ ID NO: 760248 - DNA, 25 bp, Mus musculus
tacaggacaattctgccagcgagca

SEQ ID NO: 760249 - DNA, 25 bp, Mus musculus
tacaggacaattgtgccagcgagca

SEQ ID NO: 760250 - DNA, 25 bp, Mus musculus
tacaggacaccacaattcatcccag

SEQ ID NO: 760251 - DNA, 25 bp, Mus musculus
tacaggacaccagaattcatcccag

SEQ ID NO: 760252 - DNA, 25 bp, Mus musculus
tacaggacacttctcggtagagctg

SEQ ID NO: 760253 - DNA, 25 bp, Mus musculus
tacaggacacttgtcggtagagctg

SEQ ID NO: 760254 - DNA, 25 bp, Mus musculus
tacaggacagttaagcatgcccaca

SEQ ID NO: 760255 - DNA, 25 bp, Mus musculus
tacaggacagtttagcatgcccaca

SEQ ID NO: 760256 - DNA, 25 bp, Mus musculus
tacaggaccaaacgccagcttgcta

SEQ ID NO: 760257 - DNA, 25 bp, Mus musculus
tacaggaccaaaggccagcttgcta

SEQ ID NO: 760258 - DNA, 25 bp, Mus musculus
tacaggaccaagacttctatttaag

SEQ ID NO: 760259 - DNA, 25 bp, Mus musculus
tacaggaccaagctagtggcaccat

SEQ ID NO: 760260 - DNA, 25 bp, Mus musculus
tacaggaccaaggtagtggcaccat

SEQ ID NO: 760261 - DNA, 25 bp, Mus musculus
tacaggaccaagtcttctatttaag

SEQ ID NO: 760262 - DNA, 25 bp, Mus musculus
tacaggaccagaaccttctgctaga

SEQ ID NO: 760263 - DNA, 25 bp, Mus musculus
tacaggaccagatccttctgctaga

SEQ ID NO: 760264 - DNA, 25 bp, Mus musculus
tacaggactctgacacctacctcca

SEQ ID NO: 760265 - DNA, 25 bp, Mus musculus
tacaggactctgtcacctacctcca

SEQ ID NO: 760266 - DNA, 25 bp, Mus musculus
tacaggactgtgactgttccagagc

SEQ ID NO: 760267 - DNA, 25 bp, Mus musculus
tacaggactgtgtctgttccagagc

SEQ ID NO: 760268 - DNA, 25 bp, Mus musculus
tacaggactttcaagcagtgccggc

SEQ ID NO: 760269 - DNA, 25 bp, Mus musculus
tacaggactttctagcagtgccggc

SEQ ID NO: 760270 - DNA, 25 bp, Mus musculus
tacaggagaattcgtgtacactgct

SEQ ID NO: 760271 - DNA, 25 bp, Mus musculus
tacaggagaattggtgtacactgct

SEQ ID NO: 760272 - DNA, 25 bp, Mus musculus
tacaggagacatagggaggctccag

SEQ ID NO: 760273 - DNA, 25 bp, Mus musculus
tacaggagacattgggaggctccag

SEQ ID NO: 760274 - DNA, 25 bp, Mus musculus
tacaggagacccaagacctaaaatt

SEQ ID NO: 760275 - DNA, 25 bp, Mus musculus
tacaggagaccctagacctaaaatt

SEQ ID NO: 760276 - DNA, 25 bp, Mus musculus
tacaggagatccactgcctactttg

SEQ ID NO: 760277 - DNA, 25 bp, Mus musculus
tacaggagatcctctgcctactttg

SEQ ID NO: 760278 - DNA, 25 bp, Mus musculus
tacaggagcaggctacccaaccggc

SEQ ID NO: 760279 - DNA, 25 bp, Mus musculus
tacaggagcagggtacccaaccggc

SEQ ID NO: 760280 - DNA, 25 bp, Mus musculus
tacaggaggaaaacattcccttgta

SEQ ID NO: 760281 - DNA, 25 bp, Mus musculus
tacaggaggaaatcattcccttgta

SEQ ID NO: 760282 - DNA, 25 bp, Mus musculus
tacaggagtagaagggtcgcctctc

SEQ ID NO: 760283 - DNA, 25 bp, Mus musculus
tacaggagtagatgggtcgcctctc

SEQ ID NO: 760284 - DNA, 25 bp, Mus musculus
tacaggatacatacgtgggcccaaa

SEQ ID NO: 760285 - DNA, 25 bp, Mus musculus
tacaggatacattcgtgggcccaaa

SEQ ID NO: 760286 - DNA, 25 bp, Mus musculus
tacaggatatttctgcagtctcatc

SEQ ID NO: 760287 - DNA, 25 bp, Mus musculus
tacaggatatttgtgcagtctcatc

SEQ ID NO: 760288 - DNA, 25 bp, Mus musculus
tacaggatccacctgcttcatcatg

SEQ ID NO: 760289 - DNA, 25 bp, Mus musculus
tacaggatccacgtgcttcatcatg

SEQ ID NO: 760290 - DNA, 25 bp, Mus musculus
tacaggatcgccaagtctgctgcag

SEQ ID NO: 760291 - DNA, 25 bp, Mus musculus
tacaggatcgcctagtctgctgcag

SEQ ID NO: 760292 - DNA, 25 bp, Mus musculus
tacaggatctcgagtcacagccagc

SEQ ID NO: 760293 - DNA, 25 bp, Mus musculus
tacaggatctcgtgtcacagccagc

SEQ ID NO: 760294 - DNA, 25 bp, Mus musculus
tacaggatctggattgacccttcta

SEQ ID NO: 760295 - DNA, 25 bp, Mus musculus
tacaggatctggcagctgagcctcc

SEQ ID NO: 760296 - DNA, 25 bp, Mus musculus
tacaggatctgggagctgagcctcc

SEQ ID NO: 760297 - DNA, 25 bp, Mus musculus
tacaggatctggtttgacccttcta

SEQ ID NO: 760298 - DNA, 25 bp, Mus musculus
tacaggatctgtcaccctatgagcc

SEQ ID NO: 760299 - DNA, 25 bp, Mus musculus
tacaggatctgtgaccctatgagcc

SEQ ID NO: 760300 - DNA, 25 bp, Mus musculus
tacaggatgaggatttctttcacag

SEQ ID NO: 760301 - DNA, 25 bp, Mus musculus
tacaggatgaggttttctttcacag

SEQ ID NO: 760302 - DNA, 25 bp, Mus musculus
tacaggatgatcatctcacacctgc

SEQ ID NO: 760303 - DNA, 25 bp, Mus musculus
tacaggatgatcttctcacacctgc

SEQ ID NO: 760304 - DNA, 25 bp, Mus musculus
tacaggatgcaacagtgggcccgcc

SEQ ID NO: 760305 - DNA, 25 bp, Mus musculus
tacaggatgcaagagtgggcccgcc

SEQ ID NO: 760306 - DNA, 25 bp, Mus musculus
tacaggatgcctaactatgggaaca

SEQ ID NO: 760307 - DNA, 25 bp, Mus musculus
tacaggatgccttactatgggaaca

SEQ ID NO: 760308 - DNA, 25 bp, Mus musculus
tacaggatgcgtacagtgggctctt

SEQ ID NO: 760309 - DNA, 25 bp, Mus musculus
tacaggatgcgttcagtgggctctt

SEQ ID NO: 760310 - DNA, 25 bp, Mus musculus
tacaggatgctcagtagctctgcac

SEQ ID NO: 760311 - DNA, 25 bp, Mus musculus
tacaggatgctctgtagctctgcac

SEQ ID NO: 760312 - DNA, 25 bp, Mus musculus
tacaggatggtgcaactagaagcca

SEQ ID NO: 760313 - DNA, 25 bp, Mus musculus
tacaggatggtggaactagaagcca

SEQ ID NO: 760314 - DNA, 25 bp, Mus musculus
tacaggattcatcttggagcagaga

SEQ ID NO: 760315 - DNA, 25 bp, Mus musculus
tacaggattcatgttggagcagaga

SEQ ID NO: 760316 - DNA, 25 bp, Mus musculus
tacaggattgacaattgcagcccca

SEQ ID NO: 760317 - DNA, 25 bp, Mus musculus
tacaggattgactattgcagcccca

SEQ ID NO: 760318 - DNA, 25 bp, Mus musculus
tacaggcaactgacaacttgtgaga

SEQ ID NO: 760319 - DNA, 25 bp, Mus musculus
tacaggcaactgtcaacttgtgaga

SEQ ID NO: 760320 - DNA, 25 bp, Mus musculus
tacaggcaagcacaacccaccaggg

SEQ ID NO: 760321 - DNA, 25 bp, Mus musculus
tacaggcaagcagaacccaccaggg

SEQ ID NO: 760322 - DNA, 25 bp, Mus musculus
tacaggcacgaaatttctagctcag

SEQ ID NO: 760323 - DNA, 25 bp, Mus musculus
tacaggcacgaattttctagctcag

SEQ ID NO: 760324 - DNA, 25 bp, Mus musculus
tacaggcacgacacctcctttaaga

SEQ ID NO: 760325 - DNA, 25 bp, Mus musculus
tacaggcacgactcctcctttaaga

SEQ ID NO: 760326 - DNA, 25 bp, Mus musculus
tacaggcagcagaggccaagtctgg

SEQ ID NO: 760327 - DNA, 25 bp, Mus musculus
tacaggcagcagtggccaagtctgg

SEQ ID NO: 760328 - DNA, 25 bp, Mus musculus
tacaggcaggaaccaatctaccact

SEQ ID NO: 760329 - DNA, 25 bp, Mus musculus
tacaggcaggaagcaatctaccact

SEQ ID NO: 760330 - DNA, 25 bp, Mus musculus
tacaggcaggtgctggcattgttgc

SEQ ID NO: 760331 - DNA, 25 bp, Mus musculus
tacaggcaggtggtggcattgttgc

SEQ ID NO: 760332 - DNA, 25 bp, Mus musculus
tacaggcagtgaattctgtcaccaa

SEQ ID NO: 760333 - DNA, 25 bp, Mus musculus
tacaggcagtgatttctgtcaccaa

SEQ ID NO: 760334 - DNA, 25 bp, Mus musculus
tacaggcagttaagggccatctgac

SEQ ID NO: 760335 - DNA, 25 bp, Mus musculus
tacaggcagttatgggccatctgac

SEQ ID NO: 760336 - DNA, 25 bp, Mus musculus
tacaggcatcctagcatgaaaatgt

SEQ ID NO: 760337 - DNA, 25 bp, Mus musculus
tacaggcatccttgcatgaaaatgt

SEQ ID NO: 760338 - DNA, 25 bp, Mus musculus
tacaggcatctgatgacaagagact

SEQ ID NO: 760339 - DNA, 25 bp, Mus musculus
tacaggcatctgttgacaagagact

SEQ ID NO: 760340 - DNA, 25 bp, Mus musculus
tacaggcatcttatgccactcctgg

SEQ ID NO: 760341 - DNA, 25 bp, Mus musculus
tacaggcatcttttgccactcctgg

SEQ ID NO: 760342 - DNA, 25 bp, Mus musculus
tacaggcatggaagctcaggcagca

SEQ ID NO: 760343 - DNA, 25 bp, Mus musculus
tacaggcatggatgctcaggcagca

SEQ ID NO: 760344 - DNA, 25 bp, Mus musculus
tacaggcattctatcttagtacaga

SEQ ID NO: 760345 - DNA, 25 bp, Mus musculus
tacaggcattctttcttagtacaga

SEQ ID NO: 760346 - DNA, 25 bp, Mus musculus
tacaggccaacgagcaccagctcct

SEQ ID NO: 760347 - DNA, 25 bp, Mus musculus
tacaggccaacgtgcaccagctcct

SEQ ID NO: 760348 - DNA, 25 bp, Mus musculus
tacaggccacacagagcttgaggct

SEQ ID NO: 760349 - DNA, 25 bp, Mus musculus
tacaggccacactgagcttgaggct

SEQ ID NO: 760350 - DNA, 25 bp, Mus musculus
tacaggccacctatctatgacatgg

SEQ ID NO: 760351 - DNA, 25 bp, Mus musculus
tacaggccacctttctatgacatgg

SEQ ID NO: 760352 - DNA, 25 bp, Mus musculus
tacaggccacgaagacagttatata

SEQ ID NO: 760353 - DNA, 25 bp, Mus musculus
tacaggccacgatgacagttatata

SEQ ID NO: 760354 - DNA, 25 bp, Mus musculus
tacaggccagccatgaacgcacaat

SEQ ID NO: 760355 - DNA, 25 bp, Mus musculus
tacaggccagccttgaacgcacaat

SEQ ID NO: 760356 - DNA, 25 bp, Mus musculus
tacaggccctataacctagggcaat

SEQ ID NO: 760357 - DNA, 25 bp, Mus musculus
tacaggccctattacctagggcaat

SEQ ID NO: 760358 - DNA, 25 bp, Mus musculus
tacaggccctccatgggttgaaatc

SEQ ID NO: 760359 - DNA, 25 bp, Mus musculus
tacaggccctccttgggttgaaatc

SEQ ID NO: 760360 - DNA, 25 bp, Mus musculus
tacaggccgacaagcgtgtggccga

SEQ ID NO: 760361 - DNA, 25 bp, Mus musculus
tacaggccgacatgcgtgtggccga

SEQ ID NO: 760362 - DNA, 25 bp, Mus musculus
tacaggccggccacgaagacgaaat

SEQ ID NO: 760363 - DNA, 25 bp, Mus musculus
tacaggccggcctcgaagacgaaat

SEQ ID NO: 760364 - DNA, 25 bp, Mus musculus
tacaggcctgggagtggcatttcgt

SEQ ID NO: 760365 - DNA, 25 bp, Mus musculus
tacaggcctgggtgtggcatttcgt

SEQ ID NO: 760366 - DNA, 25 bp, Mus musculus
tacaggcctgtcattagcagaggat

SEQ ID NO: 760367 - DNA, 25 bp, Mus musculus
tacaggcctgtccactgggaagctg

SEQ ID NO: 760368 - DNA, 25 bp, Mus musculus
tacaggcctgtcgactgggaagctg

SEQ ID NO: 760369 - DNA, 25 bp, Mus musculus
tacaggcctgtctttagcagaggat

SEQ ID NO: 760370 - DNA, 25 bp, Mus musculus
tacaggcgaagcatttggtcaacga

SEQ ID NO: 760371 - DNA, 25 bp, Mus musculus
tacaggcgaagcttttggtcaacga

SEQ ID NO: 760372 - DNA, 25 bp, Mus musculus
tacaggcgaaggagaaatcctacaa

SEQ ID NO: 760373 - DNA, 25 bp, Mus musculus
tacaggcgaaggtgaaatcctacaa

SEQ ID NO: 760374 - DNA, 25 bp, Mus musculus
tacaggcgcagtcattagatcccat

SEQ ID NO: 760375 - DNA, 25 bp, Mus musculus
tacaggcgcagtgattagatcccat

SEQ ID NO: 760376 - DNA, 25 bp, Mus musculus
tacaggcgcttactgcttgtgcaga

SEQ ID NO: 760377 - DNA, 25 bp, Mus musculus
tacaggcgcttagtgcttgtgcaga

SEQ ID NO: 760378 - DNA, 25 bp, Mus musculus
tacaggcgtaccacttggtaattaa

SEQ ID NO: 760379 - DNA, 25 bp, Mus musculus
tacaggcgtacctcttggtaattaa

SEQ ID NO: 760380 - DNA, 25 bp, Mus musculus
tacaggctacctagatcatctatga

SEQ ID NO: 760381 - DNA, 25 bp, Mus musculus
tacaggctaccttgatcatctatga

SEQ ID NO: 760382 - DNA, 25 bp, Mus musculus
tacaggctccttacgagggtgaatc

SEQ ID NO: 760383 - DNA, 25 bp, Mus musculus
tacaggctcctttcgagggtgaatc

SEQ ID NO: 760384 - DNA, 25 bp, Mus musculus
tacaggctctagagtacccggaggc

SEQ ID NO: 760385 - DNA, 25 bp, Mus musculus
tacaggctctagtgtacccggaggc

SEQ ID NO: 760386 - DNA, 25 bp, Mus musculus
tacaggctgaaaatgaccgagtgat

SEQ ID NO: 760387 - DNA, 25 bp, Mus musculus
tacaggctgaaattgaccgagtgat

SEQ ID NO: 760388 - DNA, 25 bp, Mus musculus
tacaggctgagtacttcatcccagg

SEQ ID NO: 760389 - DNA, 25 bp, Mus musculus
tacaggctgagttcttcatcccagg

SEQ ID NO: 760390 - DNA, 25 bp, Mus musculus
tacaggctgataacgcgtgcaagac

SEQ ID NO: 760391 - DNA, 25 bp, Mus musculus
tacaggctgatatcgcgtgcaagac

SEQ ID NO: 760392 - DNA, 25 bp, Mus musculus
tacaggctggcgacaagcaaccaag

SEQ ID NO: 760393 - DNA, 25 bp, Mus musculus
tacaggctggcgtcaagcaaccaag

SEQ ID NO: 760394 - DNA, 25 bp, Mus musculus
tacaggctgtcccaaggtacgttag

SEQ ID NO: 760395 - DNA, 25 bp, Mus musculus
tacaggctgtccgaaggtacgttag

SEQ ID NO: 760396 - DNA, 25 bp, Mus musculus
tacaggctgtgtcttttagccacac

SEQ ID NO: 760397 - DNA, 25 bp, Mus musculus
tacaggctgtgtgttttagccacac

SEQ ID NO: 760398 - DNA, 25 bp, Mus musculus
tacaggcttcccatacatcatgcta

SEQ ID NO: 760399 - DNA, 25 bp, Mus musculus
tacaggcttcccttacatcatgcta

SEQ ID NO: 760400 - DNA, 25 bp, Mus musculus
tacaggcttctgatgcacactgcta

SEQ ID NO: 760401 - DNA, 25 bp, Mus musculus
tacaggcttctgttgcacactgcta

SEQ ID NO: 760402 - DNA, 25 bp, Mus musculus
tacaggcttcttaacataaaccagg

SEQ ID NO: 760403 - DNA, 25 bp, Mus musculus
tacaggcttctttacataaaccagg

SEQ ID NO: 760404 - DNA, 25 bp, Mus musculus
tacaggcttttaccaactagaacat

SEQ ID NO: 760405 - DNA, 25 bp, Mus musculus
tacaggcttttagcaactagaacat

SEQ ID NO: 760406 - DNA, 25 bp, Mus musculus
tacagggaagagaacttaaatattt

SEQ ID NO: 760407 - DNA, 25 bp, Mus musculus
tacagggaagagtacttaaatattt

SEQ ID NO: 760408 - DNA, 25 bp, Mus musculus
tacagggaagctcgccagcagctct

SEQ ID NO: 760409 - DNA, 25 bp, Mus musculus
tacagggaagctggccagcagctct

SEQ ID NO: 760410 - DNA, 25 bp, Mus musculus
tacagggaagttacaggaagaagcc

SEQ ID NO: 760411 - DNA, 25 bp, Mus musculus
tacagggaagtttcaggaagaagcc

SEQ ID NO: 760412 - DNA, 25 bp, Mus musculus
tacagggaatctacgcttttaattt

SEQ ID NO: 760413 - DNA, 25 bp, Mus musculus
tacagggaatcttcgcttttaattt

SEQ ID NO: 760414 - DNA, 25 bp, Mus musculus
tacagggacattcacgcccagctat

SEQ ID NO: 760415 - DNA, 25 bp, Mus musculus
tacagggacattgacgcccagctat

SEQ ID NO: 760416 - DNA, 25 bp, Mus musculus
tacagggaccagaagtagagggctt

SEQ ID NO: 760417 - DNA, 25 bp, Mus musculus
tacagggaccagtagtagagggctt

SEQ ID NO: 760418 - DNA, 25 bp, Mus musculus
tacagggacgaccagataaacaagc

SEQ ID NO: 760419 - DNA, 25 bp, Mus musculus
tacagggacgacgagataaacaagc

SEQ ID NO: 760420 - DNA, 25 bp, Mus musculus
tacagggactgaaacaatggctttt

SEQ ID NO: 760421 - DNA, 25 bp, Mus musculus
tacagggactgatacaatggctttt

SEQ ID NO: 760422 - DNA, 25 bp, Mus musculus
tacagggacttacacatggcagaca

SEQ ID NO: 760423 - DNA, 25 bp, Mus musculus
tacagggacttagacatggcagaca

SEQ ID NO: 760424 - DNA, 25 bp, Mus musculus
tacagggacttgctgtgcttgccaa

SEQ ID NO: 760425 - DNA, 25 bp, Mus musculus
tacagggacttggtgtgcttgccaa

SEQ ID NO: 760426 - DNA, 25 bp, Mus musculus
tacagggatcaactgccccgagacc

SEQ ID NO: 760427 - DNA, 25 bp, Mus musculus
tacagggatcaagtgccccgagacc

SEQ ID NO: 760428 - DNA, 25 bp, Mus musculus
tacagggatgctctttttccattct

SEQ ID NO: 760429 - DNA, 25 bp, Mus musculus
tacagggatgctgtttttccattct

SEQ ID NO: 760430 - DNA, 25 bp, Mus musculus
tacagggatgggatgctccaccagc

SEQ ID NO: 760431 - DNA, 25 bp, Mus musculus
tacagggatgggttgctccaccagc

SEQ ID NO: 760432 - DNA, 25 bp, Mus musculus
tacagggatgtccttatgaccccga

SEQ ID NO: 760433 - DNA, 25 bp, Mus musculus
tacagggatgtcgttatgaccccga

SEQ ID NO: 760434 - DNA, 25 bp, Mus musculus
tacagggattgtcgccattcactct

SEQ ID NO: 760435 - DNA, 25 bp, Mus musculus
tacagggattgtggccattcactct

SEQ ID NO: 760436 - DNA, 25 bp, Mus musculus
tacagggcactgcactgctgggcca

SEQ ID NO: 760437 - DNA, 25 bp, Mus musculus
tacagggcactggactgctgggcca

SEQ ID NO: 760438 - DNA, 25 bp, Mus musculus
tacagggcacttcatcatgcacaat

SEQ ID NO: 760439 - DNA, 25 bp, Mus musculus
tacagggcacttgatcatgcacaat

SEQ ID NO: 760440 - DNA, 25 bp, Mus musculus
tacagggcatcccaattgactcaga

SEQ ID NO: 760441 - DNA, 25 bp, Mus musculus
tacagggcatccgaattgactcaga

SEQ ID NO: 760442 - DNA, 25 bp, Mus musculus
tacagggccacacttgtccgaggaa

SEQ ID NO: 760443 - DNA, 25 bp, Mus musculus
tacagggccacagttgtccgaggaa

SEQ ID NO: 760444 - DNA, 25 bp, Mus musculus
tacagggcctacagaggatgacttc

SEQ ID NO: 760445 - DNA, 25 bp, Mus musculus
tacagggcctactgaggatgacttc

SEQ ID NO: 760446 - DNA, 25 bp, Mus musculus
tacagggcgactatatcacgggagt

SEQ ID NO: 760447 - DNA, 25 bp, Mus musculus
tacagggcgactttatcacgggagt

SEQ ID NO: 760448 - DNA, 25 bp, Mus musculus
tacagggctgcgacccagggaatgc

SEQ ID NO: 760449 - DNA, 25 bp, Mus musculus
tacagggctgcgtcccagggaatgc

SEQ ID NO: 760450 - DNA, 25 bp, Mus musculus
tacagggcttttctccagagtccaa

SEQ ID NO: 760451 - DNA, 25 bp, Mus musculus
tacagggcttttgtccagagtccaa

SEQ ID NO: 760452 - DNA, 25 bp, Mus musculus
tacagggtccagatccaaagttcca

SEQ ID NO: 760453 - DNA, 25 bp, Mus musculus
tacagggtccagttccaaagttcca

SEQ ID NO: 760454 - DNA, 25 bp, Mus musculus
tacagggtcctactgaagagccgat

SEQ ID NO: 760455 - DNA, 25 bp, Mus musculus
tacagggtcctagtgaagagccgat

SEQ ID NO: 760456 - DNA, 25 bp, Mus musculus
tacagggtctggcagccacctgtgt

SEQ ID NO: 760457 - DNA, 25 bp, Mus musculus
tacagggtctgggagccacctgtgt

SEQ ID NO: 760458 - DNA, 25 bp, Mus musculus
tacagggtctgtcattaataataat

SEQ ID NO: 760459 - DNA, 25 bp, Mus musculus
tacagggtctgtgattaataataat

SEQ ID NO: 760460 - DNA, 25 bp, Mus musculus
tacagggtgaccagcgcaagaacat

SEQ ID NO: 760461 - DNA, 25 bp, Mus musculus
tacagggtgacctgcgcaagaacat

SEQ ID NO: 760462 - DNA, 25 bp, Mus musculus
tacagggtgcagagtgttgacagtt

SEQ ID NO: 760463 - DNA, 25 bp, Mus musculus
tacagggtgcagtgtgttgacagtt

SEQ ID NO: 760464 - DNA, 25 bp, Mus musculus
tacagggtgctgctcaccaatccac

SEQ ID NO: 760465 - DNA, 25 bp, Mus musculus
tacagggtgctggtcaccaatccac

SEQ ID NO: 760466 - DNA, 25 bp, Mus musculus
tacagggtggcccaggctttgcata

SEQ ID NO: 760467 - DNA, 25 bp, Mus musculus
tacagggtggccgaggctttgcata

SEQ ID NO: 760468 - DNA, 25 bp, Mus musculus
tacagggtggctcgcgaaaccccac

SEQ ID NO: 760469 - DNA, 25 bp, Mus musculus
tacagggtggctggcgaaaccccac

SEQ ID NO: 760470 - DNA, 25 bp, Mus musculus
tacagggtggtccttttgtagacag

SEQ ID NO: 760471 - DNA, 25 bp, Mus musculus
tacagggtggtcgttttgtagacag

SEQ ID NO: 760472 - DNA, 25 bp, Mus musculus
tacagggttcttcttggcctggccc

SEQ ID NO: 760473 - DNA, 25 bp, Mus musculus
tacagggttcttgttggcctggccc

SEQ ID NO: 760474 - DNA, 25 bp, Mus musculus
tacagggttgccataacgggaattg

SEQ ID NO: 760475 - DNA, 25 bp, Mus musculus
tacagggttgccttaacgggaattg

SEQ ID NO: 760476 - DNA, 25 bp, Mus musculus
tacaggtacacccttcttgaagaga

SEQ ID NO: 760477 - DNA, 25 bp, Mus musculus
tacaggtacaccgttcttgaagaga

SEQ ID NO: 760478 - DNA, 25 bp, Mus musculus
tacaggtacactcgcaagttccaat

SEQ ID NO: 760479 - DNA, 25 bp, Mus musculus
tacaggtacactggcaagttccaat

SEQ ID NO: 760480 - DNA, 25 bp, Mus musculus
tacaggtagcgaaggaggtagatac

SEQ ID NO: 760481 - DNA, 25 bp, Mus musculus
tacaggtagcgatggaggtagatac

SEQ ID NO: 760482 - DNA, 25 bp, Mus musculus
tacaggtagctaattgggttcttta

SEQ ID NO: 760483 - DNA, 25 bp, Mus musculus
tacaggtagctatttgggttcttta

SEQ ID NO: 760484 - DNA, 25 bp, Mus musculus
tacaggtagctcaggattctgtccc

SEQ ID NO: 760485 - DNA, 25 bp, Mus musculus
tacaggtagctctggattctgtccc

SEQ ID NO: 760486 - DNA, 25 bp, Mus musculus
tacaggtaggtaccagctgcctgct

SEQ ID NO: 760487 - DNA, 25 bp, Mus musculus
tacaggtaggtagcagctgcctgct

SEQ ID NO: 760488 - DNA, 25 bp, Mus musculus
tacaggtagttgagtttccctcccg

SEQ ID NO: 760489 - DNA, 25 bp, Mus musculus
tacaggtagttgtgtttccctcccg

SEQ ID NO: 760490 - DNA, 25 bp, Mus musculus
tacaggtatacacattttcaacttc

SEQ ID NO: 760491 - DNA, 25 bp, Mus musculus
tacaggtatacagattttcaacttc

SEQ ID NO: 760492 - DNA, 25 bp, Mus musculus
tacaggtatatcataagtgcattcc

SEQ ID NO: 760493 - DNA, 25 bp, Mus musculus
tacaggtatatcttaagtgcattcc

SEQ ID NO: 760494 - DNA, 25 bp, Mus musculus
tacaggtattgcaacagaagtcact

SEQ ID NO: 760495 - DNA, 25 bp, Mus musculus
tacaggtattgctacagaagtcact

SEQ ID NO: 760496 - DNA, 25 bp, Mus musculus
tacaggtcacacacctccactaatt

SEQ ID NO: 760497 - DNA, 25 bp, Mus musculus
tacaggtcacactcctccactaatt

SEQ ID NO: 760498 - DNA, 25 bp, Mus musculus
tacaggtcacctaagactgcatagt

SEQ ID NO: 760499 - DNA, 25 bp, Mus musculus
tacaggtcaccttagactgcatagt

SEQ ID NO: 760500 - DNA, 25 bp, Mus musculus
tacaggtcactaacattccaatgag

SEQ ID NO: 760501 - DNA, 25 bp, Mus musculus
tacaggtcactatcattccaatgag

SEQ ID NO: 760502 - DNA, 25 bp, Mus musculus
tacaggtcactgattgtcacttttg

SEQ ID NO: 760503 - DNA, 25 bp, Mus musculus
tacaggtcactgtttgtcacttttg

SEQ ID NO: 760504 - DNA, 25 bp, Mus musculus
tacaggtccccgacagaccgtgact

SEQ ID NO: 760505 - DNA, 25 bp, Mus musculus
tacaggtccccgtcagaccgtgact

SEQ ID NO: 760506 - DNA, 25 bp, Mus musculus
tacaggtccgagaaagtcgcgtcct

SEQ ID NO: 760507 - DNA, 25 bp, Mus musculus
tacaggtccgagtaagtcgcgtcct

SEQ ID NO: 760508 - DNA, 25 bp, Mus musculus
tacaggtcctaaattgtaaggtgtt

SEQ ID NO: 760509 - DNA, 25 bp, Mus musculus
tacaggtcctaatttgtaaggtgtt

SEQ ID NO: 760510 - DNA, 25 bp, Mus musculus
tacaggtcgatgctagagcacttcc

SEQ ID NO: 760511 - DNA, 25 bp, Mus musculus
tacaggtcgatggtagagcacttcc

SEQ ID NO: 760512 - DNA, 25 bp, Mus musculus
tacaggtgagaaacactataacagt

SEQ ID NO: 760513 - DNA, 25 bp, Mus musculus
tacaggtgagaatcactataacagt

SEQ ID NO: 760514 - DNA, 25 bp, Mus musculus
tacaggtgagggactctgaccggaa

SEQ ID NO: 760515 - DNA, 25 bp, Mus musculus
tacaggtgagggtctctgaccggaa

SEQ ID NO: 760516 - DNA, 25 bp, Mus musculus
tacaggtgcagactgttttgtgctg

SEQ ID NO: 760517 - DNA, 25 bp, Mus musculus
tacaggtgcagagtgttttgtgctg

SEQ ID NO: 760518 - DNA, 25 bp, Mus musculus
tacaggtgccaacctcatagtggaa

SEQ ID NO: 760519 - DNA, 25 bp, Mus musculus
tacaggtgccaagctcatagtggaa

SEQ ID NO: 760520 - DNA, 25 bp, Mus musculus
tacaggtgcgcaccaccattcccag

SEQ ID NO: 760521 - DNA, 25 bp, Mus musculus
tacaggtgcgcagcaccattcccag

SEQ ID NO: 760522 - DNA, 25 bp, Mus musculus
tacaggtggactagtttcgtctcca

SEQ ID NO: 760523 - DNA, 25 bp, Mus musculus
tacaggtggacttgtttcgtctcca

SEQ ID NO: 760524 - DNA, 25 bp, Mus musculus
tacaggtggattccccagtggaaaa

SEQ ID NO: 760525 - DNA, 25 bp, Mus musculus
tacaggtggattgcccagtggaaaa

SEQ ID NO: 760526 - DNA, 25 bp, Mus musculus
tacaggtgtcgtatcaaatgagctc

SEQ ID NO: 760527 - DNA, 25 bp, Mus musculus
tacaggtgtcgtttcaaatgagctc

SEQ ID NO: 760528 - DNA, 25 bp, Mus musculus
tacaggtgtgtgaagcacgctaggc

SEQ ID NO: 760529 - DNA, 25 bp, Mus musculus
tacaggtgtgtgtagcacgctaggc

SEQ ID NO: 760530 - DNA, 25 bp, Mus musculus
tacaggttaagcaatttggacaatg

SEQ ID NO: 760531 - DNA, 25 bp, Mus musculus
tacaggttaagctatttggacaatg

SEQ ID NO: 760532 - DNA, 25 bp, Mus musculus
tacaggttaccaaagtgacccaggt

SEQ ID NO: 760533 - DNA, 25 bp, Mus musculus
tacaggttaccatagtgacccaggt

SEQ ID NO: 760534 - DNA, 25 bp, Mus musculus
tacaggttagatctgacacacacac

SEQ ID NO: 760535 - DNA, 25 bp, Mus musculus
tacaggttagatgtgacacacacac

SEQ ID NO: 760536 - DNA, 25 bp, Mus musculus
tacaggttcaagaggccctcctggt

SEQ ID NO: 760537 - DNA, 25 bp, Mus musculus
tacaggttcaagtggccctcctggt

SEQ ID NO: 760538 - DNA, 25 bp, Mus musculus
tacaggttcagtccagacagggtcc

SEQ ID NO: 760539 - DNA, 25 bp, Mus musculus
tacaggttcagtgcagacagggtcc

SEQ ID NO: 760540 - DNA, 25 bp, Mus musculus
tacaggttcatgatctctggctgca

SEQ ID NO: 760541 - DNA, 25 bp, Mus musculus
tacaggttcatgttctctggctgca

SEQ ID NO: 760542 - DNA, 25 bp, Mus musculus
tacaggttcctcacaagcagaggta

SEQ ID NO: 760543 - DNA, 25 bp, Mus musculus
tacaggttcctctcaagcagaggta

SEQ ID NO: 760544 - DNA, 25 bp, Mus musculus
tacaggttctgacctccggcaatga

SEQ ID NO: 760545 - DNA, 25 bp, Mus musculus
tacaggttctgagctccggcaatga

SEQ ID NO: 760546 - DNA, 25 bp, Mus musculus
tacaggttctttcttcgtgcgatca

SEQ ID NO: 760547 - DNA, 25 bp, Mus musculus
tacaggttctttgttcgtgcgatca

SEQ ID NO: 760548 - DNA, 25 bp, Mus musculus
tacaggttgaccaagccgcactaga

SEQ ID NO: 760549 - DNA, 25 bp, Mus musculus
tacaggttgacctagccgcactaga

SEQ ID NO: 760550 - DNA, 25 bp, Mus musculus
tacaggttgcccaaaatggcttaga

SEQ ID NO: 760551 - DNA, 25 bp, Mus musculus
tacaggttgccctaaatggcttaga

SEQ ID NO: 760552 - DNA, 25 bp, Mus musculus
tacaggttgcgccatggttcaggaa

SEQ ID NO: 760553 - DNA, 25 bp, Mus musculus
tacaggttgcgcgatggttcaggaa

SEQ ID NO: 760554 - DNA, 25 bp, Mus musculus
tacaggtttaatagcctgcctttta

SEQ ID NO: 760555 - DNA, 25 bp, Mus musculus
tacaggtttaattgcctgcctttta

SEQ ID NO: 760556 - DNA, 25 bp, Mus musculus
tacaggtttcagagcagccttgccg

SEQ ID NO: 760557 - DNA, 25 bp, Mus musculus
tacaggtttcagtgcagccttgccg

SEQ ID NO: 760558 - DNA, 25 bp, Mus musculus
tacaggtttcatcttacctggaagc

SEQ ID NO: 760559 - DNA, 25 bp, Mus musculus
tacaggtttcatgttacctggaagc

SEQ ID NO: 760560 - DNA, 25 bp, Mus musculus
tacaggtttgcaagcacttgctggg

SEQ ID NO: 760561 - DNA, 25 bp, Mus musculus
tacaggtttgcatgcacttgctggg

SEQ ID NO: 760562 - DNA, 25 bp, Mus musculus
tacagtaaccgactggtcgacctcc

SEQ ID NO: 760563 - DNA, 25 bp, Mus musculus
tacagtaaccgagtggtcgacctcc

SEQ ID NO: 760564 - DNA, 25 bp, Mus musculus
tacagtaaggcccaggttcattccc

SEQ ID NO: 760565 - DNA, 25 bp, Mus musculus
tacagtaaggccgaggttcattccc

SEQ ID NO: 760566 - DNA, 25 bp, Mus musculus
tacagtaattgcaggttcataggaa

SEQ ID NO: 760567 - DNA, 25 bp, Mus musculus
tacagtaattgctggttcataggaa

SEQ ID NO: 760568 - DNA, 25 bp, Mus musculus
tacagtacacatattgtggatcaat

SEQ ID NO: 760569 - DNA, 25 bp, Mus musculus
tacagtacacattttgtggatcaat

SEQ ID NO: 760570 - DNA, 25 bp, Mus musculus
tacagtacagtgagctcgcgtccta

SEQ ID NO: 760571 - DNA, 25 bp, Mus musculus
tacagtacagtgtgctcgcgtccta

SEQ ID NO: 760572 - DNA, 25 bp, Mus musculus
tacagtaccggcaccgcatgaggga

SEQ ID NO: 760573 - DNA, 25 bp, Mus musculus
tacagtaccggctccgcatgaggga

SEQ ID NO: 760574 - DNA, 25 bp, Mus musculus
tacagtacggatcgagatgcaccac

SEQ ID NO: 760575 - DNA, 25 bp, Mus musculus
tacagtacggatggagatgcaccac

SEQ ID NO: 760576 - DNA, 25 bp, Mus musculus
tacagtactgagacctgtgccactg

SEQ ID NO: 760577 - DNA, 25 bp, Mus musculus
tacagtactgagtcctgtgccactg

SEQ ID NO: 760578 - DNA, 25 bp, Mus musculus
tacagtactgcaagggccaggtctg

SEQ ID NO: 760579 - DNA, 25 bp, Mus musculus
tacagtactgcatgggccaggtctg

SEQ ID NO: 760580 - DNA, 25 bp, Mus musculus
tacagtactgctccctttactgctg

SEQ ID NO: 760581 - DNA, 25 bp, Mus musculus
tacagtactgctgcctttactgctg

SEQ ID NO: 760582 - DNA, 25 bp, Mus musculus
tacagtactggtagggtcctatgcc

SEQ ID NO: 760583 - DNA, 25 bp, Mus musculus
tacagtactggttgggtcctatgcc

SEQ ID NO: 760584 - DNA, 25 bp, Mus musculus
tacagtacttctaaccccgacttga

SEQ ID NO: 760585 - DNA, 25 bp, Mus musculus
tacagtacttcttaccccgacttga

SEQ ID NO: 760586 - DNA, 25 bp, Mus musculus
tacagtagaccactacgtcagtagt

SEQ ID NO: 760587 - DNA, 25 bp, Mus musculus
tacagtagaccagtacgtcagtagt

SEQ ID NO: 760588 - DNA, 25 bp, Mus musculus
tacagtagcaataagcgttctctct

SEQ ID NO: 760589 - DNA, 25 bp, Mus musculus
tacagtagcaattagcgttctctct

SEQ ID NO: 760590 - DNA, 25 bp, Mus musculus
tacagtagcacaaggtgcgacccca

SEQ ID NO: 760591 - DNA, 25 bp, Mus musculus
tacagtagcacatggtgcgacccca

SEQ ID NO: 760592 - DNA, 25 bp, Mus musculus
tacagtagcctgatgttttcacagc

SEQ ID NO: 760593 - DNA, 25 bp, Mus musculus
tacagtagcctgttgttttcacagc

SEQ ID NO: 760594 - DNA, 25 bp, Mus musculus
tacagtagggtccatctgccgagct

SEQ ID NO: 760595 - DNA, 25 bp, Mus musculus
tacagtagggtcgatctgccgagct

SEQ ID NO: 760596 - DNA, 25 bp, Mus musculus
tacagtagttctcataccttgctgg

SEQ ID NO: 760597 - DNA, 25 bp, Mus musculus
tacagtagttctgataccttgctgg

SEQ ID NO: 760598 - DNA, 25 bp, Mus musculus
tacagtataactatccttctcacct

SEQ ID NO: 760599 - DNA, 25 bp, Mus musculus
tacagtataactttccttctcacct

SEQ ID NO: 760600 - DNA, 25 bp, Mus musculus
tacagtatacttcgccatccaaatt

SEQ ID NO: 760601 - DNA, 25 bp, Mus musculus
tacagtatacttggccatccaaatt

SEQ ID NO: 760602 - DNA, 25 bp, Mus musculus
tacagtatagccagcgtttatcctc

SEQ ID NO: 760603 - DNA, 25 bp, Mus musculus
tacagtatagcctgcgtttatcctc

SEQ ID NO: 760604 - DNA, 25 bp, Mus musculus
tacagtatatgaccttctgcatctt

SEQ ID NO: 760605 - DNA, 25 bp, Mus musculus
tacagtatatgagcttctgcatctt

SEQ ID NO: 760606 - DNA, 25 bp, Mus musculus
tacagtatcgcccacagcaggatgc

SEQ ID NO: 760607 - DNA, 25 bp, Mus musculus
tacagtatcgccgacagcaggatgc

SEQ ID NO: 760608 - DNA, 25 bp, Mus musculus
tacagtatctgacgatcccctgcta

SEQ ID NO: 760609 - DNA, 25 bp, Mus musculus
tacagtatctgaggatcccctgcta

SEQ ID NO: 760610 - DNA, 25 bp, Mus musculus
tacagtatcttactgtaccctcctg

SEQ ID NO: 760611 - DNA, 25 bp, Mus musculus
tacagtatcttagtgtaccctcctg

SEQ ID NO: 760612 - DNA, 25 bp, Mus musculus
tacagtatggtgcttagcttgatgc

SEQ ID NO: 760613 - DNA, 25 bp, Mus musculus
tacagtatggtggttagcttgatgc

SEQ ID NO: 760614 - DNA, 25 bp, Mus musculus
tacagtattactagatgcctcctta

SEQ ID NO: 760615 - DNA, 25 bp, Mus musculus
tacagtattacttgatgcctcctta

SEQ ID NO: 760616 - DNA, 25 bp, Mus musculus
tacagtattcaacagtccagtcttg

SEQ ID NO: 760617 - DNA, 25 bp, Mus musculus
tacagtattcaagagtccagtcttg

SEQ ID NO: 760618 - DNA, 25 bp, Mus musculus
tacagtatttcacgtgcctaccaca

SEQ ID NO: 760619 - DNA, 25 bp, Mus musculus
tacagtatttcaggtgcctaccaca

SEQ ID NO: 760620 - DNA, 25 bp, Mus musculus
tacagtattttaatgccccaaaaca

SEQ ID NO: 760621 - DNA, 25 bp, Mus musculus
tacagtattttattgccccaaaaca

SEQ ID NO: 760622 - DNA, 25 bp, Mus musculus
tacagtcaagacctctagccggaga

SEQ ID NO: 760623 - DNA, 25 bp, Mus musculus
tacagtcaagacgtctagccggaga

SEQ ID NO: 760624 - DNA, 25 bp, Mus musculus
tacagtcacaagcacatggtcgctg

SEQ ID NO: 760625 - DNA, 25 bp, Mus musculus
tacagtcacaaggacatggtcgctg

SEQ ID NO: 760626 - DNA, 25 bp, Mus musculus
tacagtcacctgattcaaagagcta

SEQ ID NO: 760627 - DNA, 25 bp, Mus musculus
tacagtcacctgtttcaaagagcta

SEQ ID NO: 760628 - DNA, 25 bp, Mus musculus
tacagtcacgaacctggtgctgctt

SEQ ID NO: 760629 - DNA, 25 bp, Mus musculus
tacagtcacgaagctggtgctgctt

SEQ ID NO: 760630 - DNA, 25 bp, Mus musculus
tacagtcactaaatcccttaaggtt

SEQ ID NO: 760631 - DNA, 25 bp, Mus musculus
tacagtcactaattcccttaaggtt

SEQ ID NO: 760632 - DNA, 25 bp, Mus musculus
tacagtcactctacagtcagacggt

SEQ ID NO: 760633 - DNA, 25 bp, Mus musculus
tacagtcactcttcagtcagacggt

SEQ ID NO: 760634 - DNA, 25 bp, Mus musculus
tacagtcagacgctggatgctcagg

SEQ ID NO: 760635 - DNA, 25 bp, Mus musculus
tacagtcagacggtggatgctcagg

SEQ ID NO: 760636 - DNA, 25 bp, Mus musculus
tacagtcagactatggttgtgaaaa

SEQ ID NO: 760637 - DNA, 25 bp, Mus musculus
tacagtcagactttggttgtgaaaa

SEQ ID NO: 760638 - DNA, 25 bp, Mus musculus
tacagtcatcgtagtcttctatgaa

SEQ ID NO: 760639 - DNA, 25 bp, Mus musculus
tacagtcatcgttgtcttctatgaa

SEQ ID NO: 760640 - DNA, 25 bp, Mus musculus
tacagtcatggcagggtggcctgat

SEQ ID NO: 760641 - DNA, 25 bp, Mus musculus
tacagtcatggctgggtggcctgat

SEQ ID NO: 760642 - DNA, 25 bp, Mus musculus
tacagtcatttcaatgccctcacaa

SEQ ID NO: 760643 - DNA, 25 bp, Mus musculus
tacagtcatttctatgccctcacaa

SEQ ID NO: 760644 - DNA, 25 bp, Mus musculus
tacagtccaatcattatcctccttt

SEQ ID NO: 760645 - DNA, 25 bp, Mus musculus
tacagtccaatctttatcctccttt

SEQ ID NO: 760646 - DNA, 25 bp, Mus musculus
tacagtccagaacaaccaaaaatac

SEQ ID NO: 760647 - DNA, 25 bp, Mus musculus
tacagtccagaagaaccaaaaatac

SEQ ID NO: 760648 - DNA, 25 bp, Mus musculus
tacagtccataccaaatcctttctt

SEQ ID NO: 760649 - DNA, 25 bp, Mus musculus
tacagtccatacgaaatcctttctt

SEQ ID NO: 760650 - DNA, 25 bp, Mus musculus
tacagtcccattacttttgtgtgga

SEQ ID NO: 760651 - DNA, 25 bp, Mus musculus
tacagtcccatttcttttgtgtgga

SEQ ID NO: 760652 - DNA, 25 bp, Mus musculus
tacagtccccatatgatcttggttc

SEQ ID NO: 760653 - DNA, 25 bp, Mus musculus
tacagtccccatttgatcttggttc

SEQ ID NO: 760654 - DNA, 25 bp, Mus musculus
tacagtccccttatgagaagctcaa

SEQ ID NO: 760655 - DNA, 25 bp, Mus musculus
tacagtccccttttgagaagctcaa

SEQ ID NO: 760656 - DNA, 25 bp, Mus musculus
tacagtcccttcattcaacagatgc

SEQ ID NO: 760657 - DNA, 25 bp, Mus musculus
tacagtcccttctttcaacagatgc

SEQ ID NO: 760658 - DNA, 25 bp, Mus musculus
tacagtccgagacatgacttcctga

SEQ ID NO: 760659 - DNA, 25 bp, Mus musculus
tacagtccgagagatgacttcctga

SEQ ID NO: 760660 - DNA, 25 bp, Mus musculus
tacagtccgcatctctaagaatgtt

SEQ ID NO: 760661 - DNA, 25 bp, Mus musculus
tacagtccgcatgtctaagaatgtt

SEQ ID NO: 760662 - DNA, 25 bp, Mus musculus
tacagtccgttacctagtgctattc

SEQ ID NO: 760663 - DNA, 25 bp, Mus musculus
tacagtccgttagctagtgctattc

SEQ ID NO: 760664 - DNA, 25 bp, Mus musculus
tacagtcctagcacatgttcgtaag

SEQ ID NO: 760665 - DNA, 25 bp, Mus musculus
tacagtcctagctcatgttcgtaag

SEQ ID NO: 760666 - DNA, 25 bp, Mus musculus
tacagtcctgtcaaggtctcagatg

SEQ ID NO: 760667 - DNA, 25 bp, Mus musculus
tacagtcctgtctaggtctcagatg

SEQ ID NO: 760668 - DNA, 25 bp, Mus musculus
tacagtccttcccaggtgtacacat

SEQ ID NO: 760669 - DNA, 25 bp, Mus musculus
tacagtccttccgaggtgtacacat

SEQ ID NO: 760670 - DNA, 25 bp, Mus musculus
tacagtccttcgagttgtactgacc

SEQ ID NO: 760671 - DNA, 25 bp, Mus musculus
tacagtccttcgtgttgtactgacc

SEQ ID NO: 760672 - DNA, 25 bp, Mus musculus
tacagtcgacttccaggaacccagc

SEQ ID NO: 760673 - DNA, 25 bp, Mus musculus
tacagtcgacttgcaggaacccagc

SEQ ID NO: 760674 - DNA, 25 bp, Mus musculus
tacagtcgctctccagggagcccgg

SEQ ID NO: 760675 - DNA, 25 bp, Mus musculus
tacagtcgctctgcagggagcccgg

SEQ ID NO: 760676 - DNA, 25 bp, Mus musculus
tacagtcgggaaacgcttcaaggaa

SEQ ID NO: 760677 - DNA, 25 bp, Mus musculus
tacagtcgggaatcgcttcaaggaa

SEQ ID NO: 760678 - DNA, 25 bp, Mus musculus
tacagtcgggcgacaggtcagagat

SEQ ID NO: 760679 - DNA, 25 bp, Mus musculus
tacagtcgggcgtcaggtcagagat

SEQ ID NO: 760680 - DNA, 25 bp, Mus musculus
tacagtcgtgacactcagaggacta

SEQ ID NO: 760681 - DNA, 25 bp, Mus musculus
tacagtcgtgactctcagaggacta

SEQ ID NO: 760682 - DNA, 25 bp, Mus musculus
tacagtcgtggtacagaatgcacag

SEQ ID NO: 760683 - DNA, 25 bp, Mus musculus
tacagtcgtggttcagaatgcacag

SEQ ID NO: 760684 - DNA, 25 bp, Mus musculus
tacagtcgttctcttcatgctagaa

SEQ ID NO: 760685 - DNA, 25 bp, Mus musculus
tacagtcgttctgttcatgctagaa

SEQ ID NO: 760686 - DNA, 25 bp, Mus musculus
tacagtctcatcaaagcaggaccag

SEQ ID NO: 760687 - DNA, 25 bp, Mus musculus
tacagtctcatctaagcaggaccag

SEQ ID NO: 760688 - DNA, 25 bp, Mus musculus
tacagtctctgtctctgctaggagc

SEQ ID NO: 760689 - DNA, 25 bp, Mus musculus
tacagtctctgtgtctgctaggagc

SEQ ID NO: 760690 - DNA, 25 bp, Mus musculus
tacagtctgcaaataaaaccttcca

SEQ ID NO: 760691 - DNA, 25 bp, Mus musculus
tacagtctgcaattaaaaccttcca

SEQ ID NO: 760692 - DNA, 25 bp, Mus musculus
tacagtctgggcatttacatgtatt

SEQ ID NO: 760693 - DNA, 25 bp, Mus musculus
tacagtctgggcttttacatgtatt

SEQ ID NO: 760694 - DNA, 25 bp, Mus musculus
tacagtctgtacagtagggatatga

SEQ ID NO: 760695 - DNA, 25 bp, Mus musculus
tacagtctgtactgtagggatatga

SEQ ID NO: 760696 - DNA, 25 bp, Mus musculus
tacagtcttacaaatggttcctatg

SEQ ID NO: 760697 - DNA, 25 bp, Mus musculus
tacagtcttacatatggttcctatg

SEQ ID NO: 760698 - DNA, 25 bp, Mus musculus
tacagtcttactagccgttccttat

SEQ ID NO: 760699 - DNA, 25 bp, Mus musculus
tacagtcttacttgccgttccttat

SEQ ID NO: 760700 - DNA, 25 bp, Mus musculus
tacagtcttctgatgagtcaaccat

SEQ ID NO: 760701 - DNA, 25 bp, Mus musculus
tacagtcttctgctagggtagccaa

SEQ ID NO: 760702 - DNA, 25 bp, Mus musculus
tacagtcttctggtagggtagccaa

SEQ ID NO: 760703 - DNA, 25 bp, Mus musculus
tacagtcttctgttgagtcaaccat

SEQ ID NO: 760704 - DNA, 25 bp, Mus musculus
tacagtctttgaagccgttcctatg

SEQ ID NO: 760705 - DNA, 25 bp, Mus musculus
tacagtctttgaccccttgatgaat

SEQ ID NO: 760706 - DNA, 25 bp, Mus musculus
tacagtctttgagcccttgatgaat

SEQ ID NO: 760707 - DNA, 25 bp, Mus musculus
tacagtctttgatgccgttcctatg

SEQ ID NO: 760708 - DNA, 25 bp, Mus musculus
tacagtgaaagcagccattggcccc

SEQ ID NO: 760709 - DNA, 25 bp, Mus musculus
tacagtgaaagctgccattggcccc

SEQ ID NO: 760710 - DNA, 25 bp, Mus musculus
tacagtgaaatgacaggcatcccat

SEQ ID NO: 760711 - DNA, 25 bp, Mus musculus
tacagtgaaatgtcaggcatcccat

SEQ ID NO: 760712 - DNA, 25 bp, Mus musculus
tacagtgaacagagtttccttgtta

SEQ ID NO: 760713 - DNA, 25 bp, Mus musculus
tacagtgaacagtgtttccttgtta

SEQ ID NO: 760714 - DNA, 25 bp, Mus musculus
tacagtgacagaatgacctcgcgct

SEQ ID NO: 760715 - DNA, 25 bp, Mus musculus
tacagtgacagattgacctcgcgct

SEQ ID NO: 760716 - DNA, 25 bp, Mus musculus
tacagtgacaggatctttcgctaag

SEQ ID NO: 760717 - DNA, 25 bp, Mus musculus
tacagtgacaggttctttcgctaag

SEQ ID NO: 760718 - DNA, 25 bp, Mus musculus
tacagtgactacacgtgacaacaca

SEQ ID NO: 760719 - DNA, 25 bp, Mus musculus
tacagtgactactcgtgacaacaca

SEQ ID NO: 760720 - DNA, 25 bp, Mus musculus
tacagtgagatcatacctattaaat

SEQ ID NO: 760721 - DNA, 25 bp, Mus musculus
tacagtgagatcttacctattaaat

SEQ ID NO: 760722 - DNA, 25 bp, Mus musculus
tacagtgagcatcaaggaccttagt

SEQ ID NO: 760723 - DNA, 25 bp, Mus musculus
tacagtgagcatgaaggaccttagt

SEQ ID NO: 760724 - DNA, 25 bp, Mus musculus
tacagtgagttcatcaccggcagca

SEQ ID NO: 760725 - DNA, 25 bp, Mus musculus
tacagtgagttcttcaccggcagca

SEQ ID NO: 760726 - DNA, 25 bp, Mus musculus
tacagtgatccaaaccatagaaacg

SEQ ID NO: 760727 - DNA, 25 bp, Mus musculus
tacagtgatccataccatagaaacg

SEQ ID NO: 760728 - DNA, 25 bp, Mus musculus
tacagtgcagatacttgtgggtttt

SEQ ID NO: 760729 - DNA, 25 bp, Mus musculus
tacagtgcagattcttgtgggtttt

SEQ ID NO: 760730 - DNA, 25 bp, Mus musculus
tacagtgcaggtacttagcttcttg

SEQ ID NO: 760731 - DNA, 25 bp, Mus musculus
tacagtgcaggttcttagcttcttg

SEQ ID NO: 760732 - DNA, 25 bp, Mus musculus
tacagtgcatatcaggagccatacg

SEQ ID NO: 760733 - DNA, 25 bp, Mus musculus
tacagtgcatatgaggagccatacg

SEQ ID NO: 760734 - DNA, 25 bp, Mus musculus
tacagtgccaacatagacagaagcg

SEQ ID NO: 760735 - DNA, 25 bp, Mus musculus
tacagtgccaacttagacagaagcg

SEQ ID NO: 760736 - DNA, 25 bp, Mus musculus
tacagtgcccgaatgcacctttttt

SEQ ID NO: 760737 - DNA, 25 bp, Mus musculus
tacagtgcccgattgcacctttttt

SEQ ID NO: 760738 - DNA, 25 bp, Mus musculus
tacagtgccctaaaacggtattcct

SEQ ID NO: 760739 - DNA, 25 bp, Mus musculus
tacagtgccctataacggtattcct

SEQ ID NO: 760740 - DNA, 25 bp, Mus musculus
tacagtgccctgaaacctttattaa

SEQ ID NO: 760741 - DNA, 25 bp, Mus musculus
tacagtgccctgtaacctttattaa

SEQ ID NO: 760742 - DNA, 25 bp, Mus musculus
tacagtgcctggaagacaagtgcta

SEQ ID NO: 760743 - DNA, 25 bp, Mus musculus
tacagtgcctggtagacaagtgcta

SEQ ID NO: 760744 - DNA, 25 bp, Mus musculus
tacagtgcctgtatagcccggaacc

SEQ ID NO: 760745 - DNA, 25 bp, Mus musculus
tacagtgcctgtttagcccggaacc

SEQ ID NO: 760746 - DNA, 25 bp, Mus musculus
tacagtgccttacatactcccttag

SEQ ID NO: 760747 - DNA, 25 bp, Mus musculus
tacagtgccttagatactcccttag

SEQ ID NO: 760748 - DNA, 25 bp, Mus musculus
tacagtgcctttcctgctatggatc

SEQ ID NO: 760749 - DNA, 25 bp, Mus musculus
tacagtgcctttgctgctatggatc

SEQ ID NO: 760750 - DNA, 25 bp, Mus musculus
tacagtgcggtccacaacgaccagt

SEQ ID NO: 760751 - DNA, 25 bp, Mus musculus
tacagtgcggtcgacaacgaccagt

SEQ ID NO: 760752 - DNA, 25 bp, Mus musculus
tacagtgctacacatatctgcagag

SEQ ID NO: 760753 - DNA, 25 bp, Mus musculus
tacagtgctacagatatctgcagag

SEQ ID NO: 760754 - DNA, 25 bp, Mus musculus
tacagtgctaggactctcttaaaag

SEQ ID NO: 760755 - DNA, 25 bp, Mus musculus
tacagtgctaggtctctcttaaaag

SEQ ID NO: 760756 - DNA, 25 bp, Mus musculus
tacagtgctccacaggaatcttgcc

SEQ ID NO: 760757 - DNA, 25 bp, Mus musculus
tacagtgctccagaggaatcttgcc

SEQ ID NO: 760758 - DNA, 25 bp, Mus musculus
tacagtgctgctacattactcgtag

SEQ ID NO: 760759 - DNA, 25 bp, Mus musculus
tacagtgctgcttcattactcgtag

SEQ ID NO: 760760 - DNA, 25 bp, Mus musculus
tacagtgctgggatcttcttgatgg

SEQ ID NO: 760761 - DNA, 25 bp, Mus musculus
tacagtgctgggttcttcttgatgg

SEQ ID NO: 760762 - DNA, 25 bp, Mus musculus
tacagtggaacaaggcggcccgtaa

SEQ ID NO: 760763 - DNA, 25 bp, Mus musculus
tacagtggaacatggcggcccgtaa

SEQ ID NO: 760764 - DNA, 25 bp, Mus musculus
tacagtggagcaagggcccctctca

SEQ ID NO: 760765 - DNA, 25 bp, Mus musculus
tacagtggagcatgggcccctctca

SEQ ID NO: 760766 - DNA, 25 bp, Mus musculus
tacagtggagcgatagtttcagaga

SEQ ID NO: 760767 - DNA, 25 bp, Mus musculus
tacagtggagcgttagtttcagaga

SEQ ID NO: 760768 - DNA, 25 bp, Mus musculus
tacagtggagttctacagaggacat

SEQ ID NO: 760769 - DNA, 25 bp, Mus musculus
tacagtggagttgtacagaggacat

SEQ ID NO: 760770 - DNA, 25 bp, Mus musculus
tacagtggattactggctgctccgg

SEQ ID NO: 760771 - DNA, 25 bp, Mus musculus
tacagtggattagtggctgctccgg

SEQ ID NO: 760772 - DNA, 25 bp, Mus musculus
tacagtggcaccaggacaagtggcc

SEQ ID NO: 760773 - DNA, 25 bp, Mus musculus
tacagtggcacctggacaagtggcc

SEQ ID NO: 760774 - DNA, 25 bp, Mus musculus
tacagtggcagcatgctcaagagca

SEQ ID NO: 760775 - DNA, 25 bp, Mus musculus
tacagtggcagcttgctcaagagca

SEQ ID NO: 760776 - DNA, 25 bp, Mus musculus
tacagtgggactaccattgccaaat

SEQ ID NO: 760777 - DNA, 25 bp, Mus musculus
tacagtgggactctattcaaacaac

SEQ ID NO: 760778 - DNA, 25 bp, Mus musculus
tacagtgggactgtattcaaacaac

SEQ ID NO: 760779 - DNA, 25 bp, Mus musculus
tacagtgggacttccattgccaaat

SEQ ID NO: 760780 - DNA, 25 bp, Mus musculus
tacagtgggccactaattcagtgtg

SEQ ID NO: 760781 - DNA, 25 bp, Mus musculus
tacagtgggccagtaattcagtgtg

SEQ ID NO: 760782 - DNA, 25 bp, Mus musculus
tacagtgggtatatagatggcagat

SEQ ID NO: 760783 - DNA, 25 bp, Mus musculus
tacagtgggtatttagatggcagat

SEQ ID NO: 760784 - DNA, 25 bp, Mus musculus
tacagtggtaagagcctgctatccc

SEQ ID NO: 760785 - DNA, 25 bp, Mus musculus
tacagtggtaagtgcctgctatccc

SEQ ID NO: 760786 - DNA, 25 bp, Mus musculus
tacagtggtgtgcaccccataacaa

SEQ ID NO: 760787 - DNA, 25 bp, Mus musculus
tacagtggtgtggaccccataacaa

SEQ ID NO: 760788 - DNA, 25 bp, Mus musculus
tacagtggttcaccagttgaaggtg

SEQ ID NO: 760789 - DNA, 25 bp, Mus musculus
tacagtggttcagcagttgaaggtg

SEQ ID NO: 760790 - DNA, 25 bp, Mus musculus
tacagtgtacaccaccattcatact

SEQ ID NO: 760791 - DNA, 25 bp, Mus musculus
tacagtgtacacgaccattcatact

SEQ ID NO: 760792 - DNA, 25 bp, Mus musculus
tacagtgtataaacttcatttgctt

SEQ ID NO: 760793 - DNA, 25 bp, Mus musculus
tacagtgtataatcttcatttgctt

SEQ ID NO: 760794 - DNA, 25 bp, Mus musculus
tacagtgtatgtctgacccgaattc

SEQ ID NO: 760795 - DNA, 25 bp, Mus musculus
tacagtgtatgtgtgacccgaattc

SEQ ID NO: 760796 - DNA, 25 bp, Mus musculus
tacagtgtcaccaagaaacatctat

SEQ ID NO: 760797 - DNA, 25 bp, Mus musculus
tacagtgtcacctagaaacatctat

SEQ ID NO: 760798 - DNA, 25 bp, Mus musculus
tacagtgtcatcatccacacgctgc

SEQ ID NO: 760799 - DNA, 25 bp, Mus musculus
tacagtgtcatcttccacacgctgc

SEQ ID NO: 760800 - DNA, 25 bp, Mus musculus
tacagtgtcatgaagctcagggtta

SEQ ID NO: 760801 - DNA, 25 bp, Mus musculus
tacagtgtcatgtagctcagggtta

SEQ ID NO: 760802 - DNA, 25 bp, Mus musculus
tacagtgtcccaattaaaaggctct

SEQ ID NO: 760803 - DNA, 25 bp, Mus musculus
tacagtgtcccatttaaaaggctct

SEQ ID NO: 760804 - DNA, 25 bp, Mus musculus
tacagtgtcctgaaagagctctgct

SEQ ID NO: 760805 - DNA, 25 bp, Mus musculus
tacagtgtcctgtaagagctctgct

SEQ ID NO: 760806 - DNA, 25 bp, Mus musculus
tacagtgtcttcaaagttccttctc

SEQ ID NO: 760807 - DNA, 25 bp, Mus musculus
tacagtgtcttcctattacctgaaa

SEQ ID NO: 760808 - DNA, 25 bp, Mus musculus
tacagtgtcttcgtattacctgaaa

SEQ ID NO: 760809 - DNA, 25 bp, Mus musculus
tacagtgtcttctaagttccttctc

SEQ ID NO: 760810 - DNA, 25 bp, Mus musculus
tacagtgtgaccagttaccagccaa

SEQ ID NO: 760811 - DNA, 25 bp, Mus musculus
tacagtgtgacctgttaccagccaa

SEQ ID NO: 760812 - DNA, 25 bp, Mus musculus
tacagtgtgcagacgtccgaccacc

SEQ ID NO: 760813 - DNA, 25 bp, Mus musculus
tacagtgtgcagcaaccccgggaag

SEQ ID NO: 760814 - DNA, 25 bp, Mus musculus
tacagtgtgcaggaaccccgggaag

SEQ ID NO: 760815 - DNA, 25 bp, Mus musculus
tacagtgtgcagtcgtccgaccacc

SEQ ID NO: 760816 - DNA, 25 bp, Mus musculus
tacagtgtggacaaaggccaggcag

SEQ ID NO: 760817 - DNA, 25 bp, Mus musculus
tacagtgtggactaaggccaggcag

SEQ ID NO: 760818 - DNA, 25 bp, Mus musculus
tacagtgtggcactgtttgggtccc

SEQ ID NO: 760819 - DNA, 25 bp, Mus musculus
tacagtgtggcagtgtttgggtccc

SEQ ID NO: 760820 - DNA, 25 bp, Mus musculus
tacagtgtgtccagcgtcctgcctg

SEQ ID NO: 760821 - DNA, 25 bp, Mus musculus
tacagtgtgtcctgcgtcctgcctg

SEQ ID NO: 760822 - DNA, 25 bp, Mus musculus
tacagtgttagtcgtcccggtgcca

SEQ ID NO: 760823 - DNA, 25 bp, Mus musculus
tacagtgttagtggtcccggtgcca

SEQ ID NO: 760824 - DNA, 25 bp, Mus musculus
tacagtgttataaaaggttcctccc

SEQ ID NO: 760825 - DNA, 25 bp, Mus musculus
tacagtgttatataaggttcctccc

SEQ ID NO: 760826 - DNA, 25 bp, Mus musculus
tacagtgttatgagatccagttgga

SEQ ID NO: 760827 - DNA, 25 bp, Mus musculus
tacagtgttatgtgatccagttgga

SEQ ID NO: 760828 - DNA, 25 bp, Mus musculus
tacagtgttcacatggtgcagcctc

SEQ ID NO: 760829 - DNA, 25 bp, Mus musculus
tacagtgttcacttggtgcagcctc

SEQ ID NO: 760830 - DNA, 25 bp, Mus musculus
tacagtgtttacatgcaagtgcatt

SEQ ID NO: 760831 - DNA, 25 bp, Mus musculus
tacagtgtttacttgcaagtgcatt

SEQ ID NO: 760832 - DNA, 25 bp, Mus musculus
tacagtgtttcactccataggccca

SEQ ID NO: 760833 - DNA, 25 bp, Mus musculus
tacagtgtttcagtccataggccca

SEQ ID NO: 760834 - DNA, 25 bp, Mus musculus
tacagtgtttgcatgttagagggtt

SEQ ID NO: 760835 - DNA, 25 bp, Mus musculus
tacagtgtttgcttgttagagggtt

SEQ ID NO: 760836 - DNA, 25 bp, Mus musculus
tacagtgttttgaagcggccattac

SEQ ID NO: 760837 - DNA, 25 bp, Mus musculus
tacagtgttttgtagcggccattac

SEQ ID NO: 760838 - DNA, 25 bp, Mus musculus
tacagtgtttttccaaagagcaagg

SEQ ID NO: 760839 - DNA, 25 bp, Mus musculus
tacagtgtttttgcaaagagcaagg

SEQ ID NO: 760840 - DNA, 25 bp, Mus musculus
tacagttaagcaaacactttggcaa

SEQ ID NO: 760841 - DNA, 25 bp, Mus musculus
tacagttaagcatacactttggcaa

SEQ ID NO: 760842 - DNA, 25 bp, Mus musculus
tacagttacactatgcacaccacat

SEQ ID NO: 760843 - DNA, 25 bp, Mus musculus
tacagttacactttgcacaccacat

SEQ ID NO: 760844 - DNA, 25 bp, Mus musculus
tacagttactacatggatatgtgtc

SEQ ID NO: 760845 - DNA, 25 bp, Mus musculus
tacagttactacttggatatgtgtc

SEQ ID NO: 760846 - DNA, 25 bp, Mus musculus
tacagttatcatactttcaatttag

SEQ ID NO: 760847 - DNA, 25 bp, Mus musculus
tacagttatcattctttcaatttag

SEQ ID NO: 760848 - DNA, 25 bp, Mus musculus
tacagttatcttaacctttatggca

SEQ ID NO: 760849 - DNA, 25 bp, Mus musculus
tacagttatcttatccatggcatac

SEQ ID NO: 760850 - DNA, 25 bp, Mus musculus
tacagttatctttacctttatggca

SEQ ID NO: 760851 - DNA, 25 bp, Mus musculus
tacagttatcttttccatggcatac

SEQ ID NO: 760852 - DNA, 25 bp, Mus musculus
tacagttatgccatctgtgtgtggt

SEQ ID NO: 760853 - DNA, 25 bp, Mus musculus
tacagttatgccttctgtgtgtggt

SEQ ID NO: 760854 - DNA, 25 bp, Mus musculus
tacagttatttcagctgggctatac

SEQ ID NO: 760855 - DNA, 25 bp, Mus musculus
tacagttatttctgctgggctatac

SEQ ID NO: 760856 - DNA, 25 bp, Mus musculus
tacagttcacagaccctcgctaata

SEQ ID NO: 760857 - DNA, 25 bp, Mus musculus
tacagttcacagcattaacaaatgg

SEQ ID NO: 760858 - DNA, 25 bp, Mus musculus
tacagttcacaggattaacaaatgg

SEQ ID NO: 760859 - DNA, 25 bp, Mus musculus
tacagttcacagtccctcgctaata

SEQ ID NO: 760860 - DNA, 25 bp, Mus musculus
tacagttcacatactttggaaacaa

SEQ ID NO: 760861 - DNA, 25 bp, Mus musculus
tacagttcacattctttggaaacaa

SEQ ID NO: 760862 - DNA, 25 bp, Mus musculus
tacagttccagccttcctatataac

SEQ ID NO: 760863 - DNA, 25 bp, Mus musculus
tacagttccagcgttcctatataac

SEQ ID NO: 760864 - DNA, 25 bp, Mus musculus
tacagttccataagataatccatca

SEQ ID NO: 760865 - DNA, 25 bp, Mus musculus
tacagttccatatgataatccatca

SEQ ID NO: 760866 - DNA, 25 bp, Mus musculus
tacagttcccagctgcatcaattaa

SEQ ID NO: 760867 - DNA, 25 bp, Mus musculus
tacagttcccaggtgcatcaattaa

SEQ ID NO: 760868 - DNA, 25 bp, Mus musculus
tacagttcccttcaaaatcctatgt

SEQ ID NO: 760869 - DNA, 25 bp, Mus musculus
tacagttcccttcggtagctcactg

SEQ ID NO: 760870 - DNA, 25 bp, Mus musculus
tacagttcccttgaaaatcctatgt

SEQ ID NO: 760871 - DNA, 25 bp, Mus musculus
tacagttcccttgggtagctcactg

SEQ ID NO: 760872 - DNA, 25 bp, Mus musculus
tacagttccgacaagcattggctac

SEQ ID NO: 760873 - DNA, 25 bp, Mus musculus
tacagttccgactagcattggctac

SEQ ID NO: 760874 - DNA, 25 bp, Mus musculus
tacagttccggacaaactcctgcaa

SEQ ID NO: 760875 - DNA, 25 bp, Mus musculus
tacagttccggagaaactcctgcaa

SEQ ID NO: 760876 - DNA, 25 bp, Mus musculus
tacagttccgtgcatgaagcacctg

SEQ ID NO: 760877 - DNA, 25 bp, Mus musculus
tacagttccgtggatgaagcacctg

SEQ ID NO: 760878 - DNA, 25 bp, Mus musculus
tacagttcctaactcgtggttaaag

SEQ ID NO: 760879 - DNA, 25 bp, Mus musculus
tacagttcctaagtcgtggttaaag

SEQ ID NO: 760880 - DNA, 25 bp, Mus musculus
tacagttccttaattagaatttcta

SEQ ID NO: 760881 - DNA, 25 bp, Mus musculus
tacagttccttatttagaatttcta

SEQ ID NO: 760882 - DNA, 25 bp, Mus musculus
tacagttctaagcaaaatttctcag

SEQ ID NO: 760883 - DNA, 25 bp, Mus musculus
tacagttctaaggaaaatttctcag

SEQ ID NO: 760884 - DNA, 25 bp, Mus musculus
tacagttctataaagccgggaccta

SEQ ID NO: 760885 - DNA, 25 bp, Mus musculus
tacagttctatatagccgggaccta

SEQ ID NO: 760886 - DNA, 25 bp, Mus musculus
tacagttctcaaaggacatcaggtt

SEQ ID NO: 760887 - DNA, 25 bp, Mus musculus
tacagttctcaatggacatcaggtt

SEQ ID NO: 760888 - DNA, 25 bp, Mus musculus
tacagttctcctcaagttttgctct

SEQ ID NO: 760889 - DNA, 25 bp, Mus musculus
tacagttctcctgaagttttgctct

SEQ ID NO: 760890 - DNA, 25 bp, Mus musculus
tacagttctgccagcccaatattcc

SEQ ID NO: 760891 - DNA, 25 bp, Mus musculus
tacagttctgcctgcccaatattcc

SEQ ID NO: 760892 - DNA, 25 bp, Mus musculus
tacagttgaaccatgcaccgaggag

SEQ ID NO: 760893 - DNA, 25 bp, Mus musculus
tacagttgaaccttgcaccgaggag

SEQ ID NO: 760894 - DNA, 25 bp, Mus musculus
tacagttgaattacatctctatgga

SEQ ID NO: 760895 - DNA, 25 bp, Mus musculus
tacagttgaatttcatctctatgga

SEQ ID NO: 760896 - DNA, 25 bp, Mus musculus
tacagttgagcaaggactccctagt

SEQ ID NO: 760897 - DNA, 25 bp, Mus musculus
tacagttgagcatggactccctagt

SEQ ID NO: 760898 - DNA, 25 bp, Mus musculus
tacagttgattgcttactctctccg

SEQ ID NO: 760899 - DNA, 25 bp, Mus musculus
tacagttgattggttactctctccg

SEQ ID NO: 760900 - DNA, 25 bp, Mus musculus
tacagttgcaacacccaaggtggtt

SEQ ID NO: 760901 - DNA, 25 bp, Mus musculus
tacagttgcaactcccaaggtggtt

SEQ ID NO: 760902 - DNA, 25 bp, Mus musculus
tacagttgcctgcacaaacctgact

SEQ ID NO: 760903 - DNA, 25 bp, Mus musculus
tacagttgcctggacaaacctgact

SEQ ID NO: 760904 - DNA, 25 bp, Mus musculus
tacagttgggtgctataacagggct

SEQ ID NO: 760905 - DNA, 25 bp, Mus musculus
tacagttgggtggtataacagggct

SEQ ID NO: 760906 - DNA, 25 bp, Mus musculus
tacagttggttgacatgtgttcaca

SEQ ID NO: 760907 - DNA, 25 bp, Mus musculus
tacagttggttgtcatgtgttcaca

SEQ ID NO: 760908 - DNA, 25 bp, Mus musculus
tacagttggtttcgaggccctggac

SEQ ID NO: 760909 - DNA, 25 bp, Mus musculus
tacagttggtttggaggccctggac

SEQ ID NO: 760910 - DNA, 25 bp, Mus musculus
tacagttgtacgcagccattaccac

SEQ ID NO: 760911 - DNA, 25 bp, Mus musculus
tacagttgtacggagccattaccac

SEQ ID NO: 760912 - DNA, 25 bp, Mus musculus
tacagttgtgtgaagctgtttatat

SEQ ID NO: 760913 - DNA, 25 bp, Mus musculus
tacagttgtgtgtagctgtttatat

SEQ ID NO: 760914 - DNA, 25 bp, Mus musculus
tacagtttacacacgtttgagtttt

SEQ ID NO: 760915 - DNA, 25 bp, Mus musculus
tacagtttacactcgtttgagtttt

SEQ ID NO: 760916 - DNA, 25 bp, Mus musculus
tacagtttacctcctcgcgaaagtt

SEQ ID NO: 760917 - DNA, 25 bp, Mus musculus
tacagtttacctgctcgcgaaagtt

SEQ ID NO: 760918 - DNA, 25 bp, Mus musculus
tacagtttcagacactcatgctaaa

SEQ ID NO: 760919 - DNA, 25 bp, Mus musculus
tacagtttcagagactcatgctaaa

SEQ ID NO: 760920 - DNA, 25 bp, Mus musculus
tacagtttcatcagcttccattgtt

SEQ ID NO: 760921 - DNA, 25 bp, Mus musculus
tacagtttcatctgcttccattgtt

SEQ ID NO: 760922 - DNA, 25 bp, Mus musculus
tacagtttccagattcagtgcagtg

SEQ ID NO: 760923 - DNA, 25 bp, Mus musculus
tacagtttccagtttcagtgcagtg

SEQ ID NO: 760924 - DNA, 25 bp, Mus musculus
tacagtttcctgaacaagaccagac

SEQ ID NO: 760925 - DNA, 25 bp, Mus musculus
tacagtttcctgatgtttccttgca

SEQ ID NO: 760926 - DNA, 25 bp, Mus musculus
tacagtttcctgtacaagaccagac

SEQ ID NO: 760927 - DNA, 25 bp, Mus musculus
tacagtttcctgttgtttccttgca

SEQ ID NO: 760928 - DNA, 25 bp, Mus musculus
tacagtttccttcctgatgtgaatg

SEQ ID NO: 760929 - DNA, 25 bp, Mus musculus
tacagtttccttgctgatgtgaatg

SEQ ID NO: 760930 - DNA, 25 bp, Mus musculus
tacagtttcgtgctaggctccgacg

SEQ ID NO: 760931 - DNA, 25 bp, Mus musculus
tacagtttcgtggtaggctccgacg

SEQ ID NO: 760932 - DNA, 25 bp, Mus musculus
tacagtttctaaccccacatcaatc

SEQ ID NO: 760933 - DNA, 25 bp, Mus musculus
tacagtttctaagcccacatcaatc

SEQ ID NO: 760934 - DNA, 25 bp, Mus musculus
tacagtttctgcacattttacacat

SEQ ID NO: 760935 - DNA, 25 bp, Mus musculus
tacagtttctgctcattttacacat

SEQ ID NO: 760936 - DNA, 25 bp, Mus musculus
tacagtttgcaaactcttcctcctt

SEQ ID NO: 760937 - DNA, 25 bp, Mus musculus
tacagtttgcaatctcttcctcctt

SEQ ID NO: 760938 - DNA, 25 bp, Mus musculus
tacagtttgcacatggctttgaaat

SEQ ID NO: 760939 - DNA, 25 bp, Mus musculus
tacagtttgcacttggctttgaaat

SEQ ID NO: 760940 - DNA, 25 bp, Mus musculus
tacagtttgcccatggtaaagtctg

SEQ ID NO: 760941 - DNA, 25 bp, Mus musculus
tacagtttgcccttggtaaagtctg

SEQ ID NO: 760942 - DNA, 25 bp, Mus musculus
tacagtttgcttctgctgagaggct

SEQ ID NO: 760943 - DNA, 25 bp, Mus musculus
tacagtttgcttgtgctgagaggct

SEQ ID NO: 760944 - DNA, 25 bp, Mus musculus
tacagtttgtagaatcgccaccctc

SEQ ID NO: 760945 - DNA, 25 bp, Mus musculus
tacagtttgtagtatcgccaccctc

SEQ ID NO: 760946 - DNA, 25 bp, Mus musculus
tacagtttgttcacgtacgcacaca

SEQ ID NO: 760947 - DNA, 25 bp, Mus musculus
tacagtttgttctcgtacgcacaca

SEQ ID NO: 760948 - DNA, 25 bp, Mus musculus
tacagttttagtacgtatctggctt

SEQ ID NO: 760949 - DNA, 25 bp, Mus musculus
tacagttttagttcgtatctggctt

SEQ ID NO: 760950 - DNA, 25 bp, Mus musculus
tacagttttatcaacacccagtggt

SEQ ID NO: 760951 - DNA, 25 bp, Mus musculus
tacagttttatctacacccagtggt

SEQ ID NO: 760952 - DNA, 25 bp, Mus musculus
tacagttttcatcaggaggttttaa

SEQ ID NO: 760953 - DNA, 25 bp, Mus musculus
tacagttttcatgaggaggttttaa

SEQ ID NO: 760954 - DNA, 25 bp, Mus musculus
tacagttttcccagacagagctatg

SEQ ID NO: 760955 - DNA, 25 bp, Mus musculus
tacagttttccctgacagagctatg

SEQ ID NO: 760956 - DNA, 25 bp, Mus musculus
tacagttttcctatactcagtacaa

SEQ ID NO: 760957 - DNA, 25 bp, Mus musculus
tacagttttcctttactcagtacaa

SEQ ID NO: 760958 - DNA, 25 bp, Mus musculus
tacagttttcgaaggtgtagtgcat

SEQ ID NO: 760959 - DNA, 25 bp, Mus musculus
tacagttttcgatggtgtagtgcat

SEQ ID NO: 760960 - DNA, 25 bp, Mus musculus
tacagttttgtaaaagctaatggat

SEQ ID NO: 760961 - DNA, 25 bp, Mus musculus
tacagttttgtataagctaatggat

SEQ ID NO: 760962 - DNA, 25 bp, Mus musculus
tacagttttgtcacgtaccatttta

SEQ ID NO: 760963 - DNA, 25 bp, Mus musculus
tacagttttgtctcgtaccatttta

SEQ ID NO: 760964 - DNA, 25 bp, Mus musculus
tacagttttgttcccatgtgcacta

SEQ ID NO: 760965 - DNA, 25 bp, Mus musculus
tacagttttgttgccatgtgcacta

SEQ ID NO: 760966 - DNA, 25 bp, Mus musculus
tacagtttttagaagtcttccctga

SEQ ID NO: 760967 - DNA, 25 bp, Mus musculus
tacagtttttagtagtcttccctga

SEQ ID NO: 760968 - DNA, 25 bp, Mus musculus
tacagtttttggctggccatgacat

SEQ ID NO: 760969 - DNA, 25 bp, Mus musculus
tacagtttttgggtggccatgacat

SEQ ID NO: 760970 - DNA, 25 bp, Mus musculus
tacagttttttaaaggtcgcttata

SEQ ID NO: 760971 - DNA, 25 bp, Mus musculus
tacagttttttataggtcgcttata

SEQ ID NO: 760972 - DNA, 25 bp, Mus musculus
tacataaaacccacggctggccagg

SEQ ID NO: 760973 - DNA, 25 bp, Mus musculus
tacataaaacccagttgcactccca

SEQ ID NO: 760974 - DNA, 25 bp, Mus musculus
tacataaaaccctcggctggccagg

SEQ ID NO: 760975 - DNA, 25 bp, Mus musculus
tacataaaaccctgttgcactccca

SEQ ID NO: 760976 - DNA, 25 bp, Mus musculus
tacataaacagaaactcctgtaggt

SEQ ID NO: 760977 - DNA, 25 bp, Mus musculus
tacataaacagatactcctgtaggt

SEQ ID NO: 760978 - DNA, 25 bp, Mus musculus
tacataaagttccttaaccctgtct

SEQ ID NO: 760979 - DNA, 25 bp, Mus musculus
tacataaagttcgttaaccctgtct

SEQ ID NO: 760980 - DNA, 25 bp, Mus musculus
tacataaatcaccacttagtgcagt

SEQ ID NO: 760981 - DNA, 25 bp, Mus musculus
tacataaatcacgacttagtgcagt

SEQ ID NO: 760982 - DNA, 25 bp, Mus musculus
tacataaattgtactggccagcatc

SEQ ID NO: 760983 - DNA, 25 bp, Mus musculus
tacataaattgttctggccagcatc

SEQ ID NO: 760984 - DNA, 25 bp, Mus musculus
tacataacccttacatatttcccac

SEQ ID NO: 760985 - DNA, 25 bp, Mus musculus
tacataaccctttcatatttcccac

SEQ ID NO: 760986 - DNA, 25 bp, Mus musculus
tacataaccgttatgtacctggtga

SEQ ID NO: 760987 - DNA, 25 bp, Mus musculus
tacataaccgttttgtacctggtga

SEQ ID NO: 760988 - DNA, 25 bp, Mus musculus
tacataactgttaagtgcttgacat

SEQ ID NO: 760989 - DNA, 25 bp, Mus musculus
tacataactgtttagtgcttgacat

SEQ ID NO: 760990 - DNA, 25 bp, Mus musculus
tacataactttaatgtcccctccac

SEQ ID NO: 760991 - DNA, 25 bp, Mus musculus
tacataactttattgtcccctccac

SEQ ID NO: 760992 - DNA, 25 bp, Mus musculus
tacataagaaccacatggatcccca

SEQ ID NO: 760993 - DNA, 25 bp, Mus musculus
tacataagaacctcatggatcccca

SEQ ID NO: 760994 - DNA, 25 bp, Mus musculus
tacataagcgagcatgtgcgactca

SEQ ID NO: 760995 - DNA, 25 bp, Mus musculus
tacataagcgaggatgtgcgactca

SEQ ID NO: 760996 - DNA, 25 bp, Mus musculus
tacataaggcctatcttctttacat

SEQ ID NO: 760997 - DNA, 25 bp, Mus musculus
tacataaggcctttcttctttacat

SEQ ID NO: 760998 - DNA, 25 bp, Mus musculus
tacataagtacgagggcgagccaga

SEQ ID NO: 760999 - DNA, 25 bp, Mus musculus
tacataagtacgtgggcgagccaga

SEQ ID NO: 761000 - DNA, 25 bp, Mus musculus
tacataatcatcatgcttttcataa

SEQ ID NO: 761001 - DNA, 25 bp, Mus musculus
tacataatcatcttgcttttcataa

SEQ ID NO: 761002 - DNA, 25 bp, Mus musculus
tacataatgaccacccctactgcag

SEQ ID NO: 761003 - DNA, 25 bp, Mus musculus
tacataatgacctcccctactgcag

SEQ ID NO: 761004 - DNA, 25 bp, Mus musculus
tacataattgttctctgtcttcctt

SEQ ID NO: 761005 - DNA, 25 bp, Mus musculus
tacataattgttgtctgtcttcctt

SEQ ID NO: 761006 - DNA, 25 bp, Mus musculus
tacatacaacatccagctcttagtt

SEQ ID NO: 761007 - DNA, 25 bp, Mus musculus
tacatacaacatgcagctcttagtt

SEQ ID NO: 761008 - DNA, 25 bp, Mus musculus
tacatacaatgacatgtgtgtgccc

SEQ ID NO: 761009 - DNA, 25 bp, Mus musculus
tacatacaatgagatgtgtgtgccc

SEQ ID NO: 761010 - DNA, 25 bp, Mus musculus
tacatacacctaatccctacagaag

SEQ ID NO: 761011 - DNA, 25 bp, Mus musculus
tacatacacctattccctacagaag

SEQ ID NO: 761012 - DNA, 25 bp, Mus musculus
tacatacaggctcggtcaccttgtc

SEQ ID NO: 761013 - DNA, 25 bp, Mus musculus
tacatacaggctgggtcaccttgtc

SEQ ID NO: 761014 - DNA, 25 bp, Mus musculus
tacatacagtatataaagccagatc

SEQ ID NO: 761015 - DNA, 25 bp, Mus musculus
tacatacagtatttaaagccagatc

SEQ ID NO: 761016 - DNA, 25 bp, Mus musculus
tacatacagtgtccatccttttggc

SEQ ID NO: 761017 - DNA, 25 bp, Mus musculus
tacatacagtgtgcatccttttggc

SEQ ID NO: 761018 - DNA, 25 bp, Mus musculus
tacatacataacacaacccgcaagg

SEQ ID NO: 761019 - DNA, 25 bp, Mus musculus
tacatacataacctgctttctctcc

SEQ ID NO: 761020 - DNA, 25 bp, Mus musculus
tacatacataacgtgctttctctcc

SEQ ID NO: 761021 - DNA, 25 bp, Mus musculus
tacatacataactcaacccgcaagg

SEQ ID NO: 761022 - DNA, 25 bp, Mus musculus
tacatacatcccaaggctgatgttt

SEQ ID NO: 761023 - DNA, 25 bp, Mus musculus
tacatacatccctaggctgatgttt

SEQ ID NO: 761024 - DNA, 25 bp, Mus musculus
tacatacattttaatacgcagatag

SEQ ID NO: 761025 - DNA, 25 bp, Mus musculus
tacatacatttttatacgcagatag

SEQ ID NO: 761026 - DNA, 25 bp, Mus musculus
tacatacccaataccagtaactctc

SEQ ID NO: 761027 - DNA, 25 bp, Mus musculus
tacatacccaattccagtaactctc

SEQ ID NO: 761028 - DNA, 25 bp, Mus musculus
tacataccccgactttttctttcag

SEQ ID NO: 761029 - DNA, 25 bp, Mus musculus
tacataccccgagtttttctttcag

SEQ ID NO: 761030 - DNA, 25 bp, Mus musculus
tacatacctatgctgaatggcccca

SEQ ID NO: 761031 - DNA, 25 bp, Mus musculus
tacatacctatggtgaatggcccca

SEQ ID NO: 761032 - DNA, 25 bp, Mus musculus
tacatacgcacaagacctctgaatg

SEQ ID NO: 761033 - DNA, 25 bp, Mus musculus
tacatacgcacatgacctctgaatg

SEQ ID NO: 761034 - DNA, 25 bp, Mus musculus
tacatacgggtcattatcactcaca

SEQ ID NO: 761035 - DNA, 25 bp, Mus musculus
tacatacgggtctttatcactcaca

SEQ ID NO: 761036 - DNA, 25 bp, Mus musculus
tacatactcatgcacgtgcgtgtgt

SEQ ID NO: 761037 - DNA, 25 bp, Mus musculus
tacatactcatggacgtgcgtgtgt

SEQ ID NO: 761038 - DNA, 25 bp, Mus musculus
tacatactgcttacctattccacag

SEQ ID NO: 761039 - DNA, 25 bp, Mus musculus
tacatactgctttcctattccacag

SEQ ID NO: 761040 - DNA, 25 bp, Mus musculus
tacatacttacaaaccggtactgtc

SEQ ID NO: 761041 - DNA, 25 bp, Mus musculus
tacatacttacataccggtactgtc

SEQ ID NO: 761042 - DNA, 25 bp, Mus musculus
tacatactttggctgtgcactgaat

SEQ ID NO: 761043 - DNA, 25 bp, Mus musculus
tacatactttgggtgtgcactgaat

SEQ ID NO: 761044 - DNA, 25 bp, Mus musculus
tacatactttgtctgctgcttggca

SEQ ID NO: 761045 - DNA, 25 bp, Mus musculus
tacatactttgtgtgctgcttggca

SEQ ID NO: 761046 - DNA, 25 bp, Mus musculus
tacatagaatgtcctgttcagtaaa

SEQ ID NO: 761047 - DNA, 25 bp, Mus musculus
tacatagaatgtgctgttcagtaaa

SEQ ID NO: 761048 - DNA, 25 bp, Mus musculus
tacatagagacacctctgacaggct

SEQ ID NO: 761049 - DNA, 25 bp, Mus musculus
tacatagagacagctctgacaggct

SEQ ID NO: 761050 - DNA, 25 bp, Mus musculus
tacatagagcacatgcgggtgtact

SEQ ID NO: 761051 - DNA, 25 bp, Mus musculus
tacatagagcacttgcgggtgtact

SEQ ID NO: 761052 - DNA, 25 bp, Mus musculus
tacatagatgaaccgcctttccagg

SEQ ID NO: 761053 - DNA, 25 bp, Mus musculus
tacatagatgaagcgcctttccagg

SEQ ID NO: 761054 - DNA, 25 bp, Mus musculus
tacatagcaatccagtcatttactc

SEQ ID NO: 761055 - DNA, 25 bp, Mus musculus
tacatagcaatcgagtcatttactc

SEQ ID NO: 761056 - DNA, 25 bp, Mus musculus
tacatagcacctcacagccaagtag

SEQ ID NO: 761057 - DNA, 25 bp, Mus musculus
tacatagcacctgacagccaagtag

SEQ ID NO: 761058 - DNA, 25 bp, Mus musculus
tacatagcatacacgattccctgcg

SEQ ID NO: 761059 - DNA, 25 bp, Mus musculus
tacatagcatactcgattccctgcg

SEQ ID NO: 761060 - DNA, 25 bp, Mus musculus
tacatagcatgcatacctccagtgc

SEQ ID NO: 761061 - DNA, 25 bp, Mus musculus
tacatagcatgcttacctccagtgc

SEQ ID NO: 761062 - DNA, 25 bp, Mus musculus
tacatagcccagattgctctttcac

SEQ ID NO: 761063 - DNA, 25 bp, Mus musculus
tacatagcccagtttgctctttcac

SEQ ID NO: 761064 - DNA, 25 bp, Mus musculus
tacatagctccacagatcctacagg

SEQ ID NO: 761065 - DNA, 25 bp, Mus musculus
tacatagctccagagatcctacagg

SEQ ID NO: 761066 - DNA, 25 bp, Mus musculus
tacatagctgaacgacatgtccctg

SEQ ID NO: 761067 - DNA, 25 bp, Mus musculus
tacatagctgaaggacatgtccctg

SEQ ID NO: 761068 - DNA, 25 bp, Mus musculus
tacatagctgccatttttatatatt

SEQ ID NO: 761069 - DNA, 25 bp, Mus musculus
tacatagctgccttttttatatatt

SEQ ID NO: 761070 - DNA, 25 bp, Mus musculus
tacataggcccaagtcaagagtcag

SEQ ID NO: 761071 - DNA, 25 bp, Mus musculus
tacataggcccatgtcaagagtcag

SEQ ID NO: 761072 - DNA, 25 bp, Mus musculus
tacataggccctaacagtttaaaag

SEQ ID NO: 761073 - DNA, 25 bp, Mus musculus
tacataggcccttacagtttaaaag

SEQ ID NO: 761074 - DNA, 25 bp, Mus musculus
tacatagggctacactcattactgt

SEQ ID NO: 761075 - DNA, 25 bp, Mus musculus
tacatagggctagactcattactgt

SEQ ID NO: 761076 - DNA, 25 bp, Mus musculus
tacatagtacatagattcgggcttt

SEQ ID NO: 761077 - DNA, 25 bp, Mus musculus
tacatagtacattgattcgggcttt

SEQ ID NO: 761078 - DNA, 25 bp, Mus musculus
tacatagtccagacctctgaggata

SEQ ID NO: 761079 - DNA, 25 bp, Mus musculus
tacatagtccagtcctctgaggata

SEQ ID NO: 761080 - DNA, 25 bp, Mus musculus
tacatagtctgtagcgcctggttcc

SEQ ID NO: 761081 - DNA, 25 bp, Mus musculus
tacatagtctgttgcgcctggttcc

SEQ ID NO: 761082 - DNA, 25 bp, Mus musculus
tacatagtgaacacctggttatcct

SEQ ID NO: 761083 - DNA, 25 bp, Mus musculus
tacatagtgaactcctggttatcct

SEQ ID NO: 761084 - DNA, 25 bp, Mus musculus
tacatagtgacaaaccaggcgtaca

SEQ ID NO: 761085 - DNA, 25 bp, Mus musculus
tacatagtgacacccagaacagcca

SEQ ID NO: 761086 - DNA, 25 bp, Mus musculus
tacatagtgacagccagaacagcca

SEQ ID NO: 761087 - DNA, 25 bp, Mus musculus
tacatagtgacataccaggcgtaca

SEQ ID NO: 761088 - DNA, 25 bp, Mus musculus
tacatagtgcagactgctccaggag

SEQ ID NO: 761089 - DNA, 25 bp, Mus musculus
tacatagtgcagtctgctccaggag

SEQ ID NO: 761090 - DNA, 25 bp, Mus musculus
tacatagtgctcaatcttgtcagaa

SEQ ID NO: 761091 - DNA, 25 bp, Mus musculus
tacatagtgctctatcttgtcagaa

SEQ ID NO: 761092 - DNA, 25 bp, Mus musculus
tacatagtgggcaggaggctagcct

SEQ ID NO: 761093 - DNA, 25 bp, Mus musculus
tacatagtgggctggaggctagcct

SEQ ID NO: 761094 - DNA, 25 bp, Mus musculus
tacatagtgtgcaggctagcctaca

SEQ ID NO: 761095 - DNA, 25 bp, Mus musculus
tacatagtgtgctggctagcctaca

SEQ ID NO: 761096 - DNA, 25 bp, Mus musculus
tacatagttcagcaccttcctagac

SEQ ID NO: 761097 - DNA, 25 bp, Mus musculus
tacatagttcaggaccttcctagac

SEQ ID NO: 761098 - DNA, 25 bp, Mus musculus
tacatagttccacgccagcgtgagc

SEQ ID NO: 761099 - DNA, 25 bp, Mus musculus
tacatagttccaggccagcgtgagc

SEQ ID NO: 761100 - DNA, 25 bp, Mus musculus
tacatataaacactggaggaggccc

SEQ ID NO: 761101 - DNA, 25 bp, Mus musculus
tacatataaacagtggaggaggccc

SEQ ID NO: 761102 - DNA, 25 bp, Mus musculus
tacatataagtacgcatccactgtt

SEQ ID NO: 761103 - DNA, 25 bp, Mus musculus
tacatataagtaggcatccactgtt

SEQ ID NO: 761104 - DNA, 25 bp, Mus musculus
tacatatataccatggattcccata

SEQ ID NO: 761105 - DNA, 25 bp, Mus musculus
tacatatataccttggattcccata

SEQ ID NO: 761106 - DNA, 25 bp, Mus musculus
tacatatatatacacctgaacacag

SEQ ID NO: 761107 - DNA, 25 bp, Mus musculus
tacatatatatagacctgaacacag

SEQ ID NO: 761108 - DNA, 25 bp, Mus musculus
tacatatccgatagtcttcacacca

SEQ ID NO: 761109 - DNA, 25 bp, Mus musculus
tacatatccgattgtcttcacacca

SEQ ID NO: 761110 - DNA, 25 bp, Mus musculus
tacatatctaaactcccatgccata

SEQ ID NO: 761111 - DNA, 25 bp, Mus musculus
tacatatctaaagtcccatgccata

SEQ ID NO: 761112 - DNA, 25 bp, Mus musculus
tacatatgagtgcagtgtagctgag

SEQ ID NO: 761113 - DNA, 25 bp, Mus musculus
tacatatgagtggagtgtagctgag

SEQ ID NO: 761114 - DNA, 25 bp, Mus musculus
tacatatgccctcctcgaaacagag

SEQ ID NO: 761115 - DNA, 25 bp, Mus musculus
tacatatgccctgctcgaaacagag

SEQ ID NO: 761116 - DNA, 25 bp, Mus musculus
tacatatggcccaatcctggcagga

SEQ ID NO: 761117 - DNA, 25 bp, Mus musculus
tacatatggccctatcctggcagga

SEQ ID NO: 761118 - DNA, 25 bp, Mus musculus
tacatatgtcagaatatttcacaca

SEQ ID NO: 761119 - DNA, 25 bp, Mus musculus
tacatatgtcagtatatttcacaca

SEQ ID NO: 761120 - DNA, 25 bp, Mus musculus
tacatatgtcttagtccttctttcc

SEQ ID NO: 761121 - DNA, 25 bp, Mus musculus
tacatatgtctttgtccttctttcc

SEQ ID NO: 761122 - DNA, 25 bp, Mus musculus
tacatattaaaccttggccctccaa

SEQ ID NO: 761123 - DNA, 25 bp, Mus musculus
tacatattaaacgttggccctccaa

SEQ ID NO: 761124 - DNA, 25 bp, Mus musculus
tacatattccagctgtgtcttgacg

SEQ ID NO: 761125 - DNA, 25 bp, Mus musculus
tacatattccaggtgtgtcttgacg

SEQ ID NO: 761126 - DNA, 25 bp, Mus musculus
tacatatttctcacaactcgtgcga

SEQ ID NO: 761127 - DNA, 25 bp, Mus musculus
tacatatttctctcaactcgtgcga

SEQ ID NO: 761128 - DNA, 25 bp, Mus musculus
tacatattttgcatactgtctgatt

SEQ ID NO: 761129 - DNA, 25 bp, Mus musculus
tacatattttgcttactgtctgatt

SEQ ID NO: 761130 - DNA, 25 bp, Mus musculus
tacatatttttcatgcacgttacaa

SEQ ID NO: 761131 - DNA, 25 bp, Mus musculus
tacatatttttcttgcacgttacaa

SEQ ID NO: 761132 - DNA, 25 bp, Mus musculus
tacatcaaaatgacactttccagtg

SEQ ID NO: 761133 - DNA, 25 bp, Mus musculus
tacatcaaaatgtcactttccagtg

SEQ ID NO: 761134 - DNA, 25 bp, Mus musculus
tacatcaaccatcccctggacgttg

SEQ ID NO: 761135 - DNA, 25 bp, Mus musculus
tacatcaaccatgccctggacgttg

SEQ ID NO: 761136 - DNA, 25 bp, Mus musculus
tacatcaaccttaccatggagcact

SEQ ID NO: 761137 - DNA, 25 bp, Mus musculus
tacatcaacctttccatggagcact

SEQ ID NO: 761138 - DNA, 25 bp, Mus musculus
tacatcaacgttcggaaaggcagca

SEQ ID NO: 761139 - DNA, 25 bp, Mus musculus
tacatcaacgttgggaaaggcagca

SEQ ID NO: 761140 - DNA, 25 bp, Mus musculus
tacatcaacttgatcatgcgccatc

SEQ ID NO: 761141 - DNA, 25 bp, Mus musculus
tacatcaacttgttcatgcgccatc

SEQ ID NO: 761142 - DNA, 25 bp, Mus musculus
tacatcaagaccctggtgttcgccc

SEQ ID NO: 761143 - DNA, 25 bp, Mus musculus
tacatcaagaccgtggtgttcgccc

SEQ ID NO: 761144 - DNA, 25 bp, Mus musculus
tacatcacaagacacagcttagaag

SEQ ID NO: 761145 - DNA, 25 bp, Mus musculus
tacatcacaagagacagcttagaag

SEQ ID NO: 761146 - DNA, 25 bp, Mus musculus
tacatcacagacatacatagcgcat

SEQ ID NO: 761147 - DNA, 25 bp, Mus musculus
tacatcacagacttacatagcgcat

SEQ ID NO: 761148 - DNA, 25 bp, Mus musculus
tacatcaccagtcagatcttgtggg

SEQ ID NO: 761149 - DNA, 25 bp, Mus musculus
tacatcaccagtgagatcttgtggg

SEQ ID NO: 761150 - DNA, 25 bp, Mus musculus
tacatcaccgatatgcagctctaat

SEQ ID NO: 761151 - DNA, 25 bp, Mus musculus
tacatcaccgatttgcagctctaat

SEQ ID NO: 761152 - DNA, 25 bp, Mus musculus
tacatcaccgcaccatatgtggaga

SEQ ID NO: 761153 - DNA, 25 bp, Mus musculus
tacatcaccgcagcatatgtggaga

SEQ ID NO: 761154 - DNA, 25 bp, Mus musculus
tacatcagaacaatcacctatccca

SEQ ID NO: 761155 - DNA, 25 bp, Mus musculus
tacatcagaacattcacctatccca

SEQ ID NO: 761156 - DNA, 25 bp, Mus musculus
tacatcagaagtatgcatccagctt

SEQ ID NO: 761157 - DNA, 25 bp, Mus musculus
tacatcagaagtttgcatccagctt

SEQ ID NO: 761158 - DNA, 25 bp, Mus musculus
tacatcagactgaccatacttggaa

SEQ ID NO: 761159 - DNA, 25 bp, Mus musculus
tacatcagactgtccatacttggaa

SEQ ID NO: 761160 - DNA, 25 bp, Mus musculus
tacatcagatgcaagccgagtatga

SEQ ID NO: 761161 - DNA, 25 bp, Mus musculus
tacatcagatgctagccgagtatga

SEQ ID NO: 761162 - DNA, 25 bp, Mus musculus
tacatcagcggcagattgacttaga

SEQ ID NO: 761163 - DNA, 25 bp, Mus musculus
tacatcagcggctgattgacttaga

SEQ ID NO: 761164 - DNA, 25 bp, Mus musculus
tacatcagctctcgtctttcttcct

SEQ ID NO: 761165 - DNA, 25 bp, Mus musculus
tacatcagctctggtctttcttcct

SEQ ID NO: 761166 - DNA, 25 bp, Mus musculus
tacatcagggacagctgaggccagc

SEQ ID NO: 761167 - DNA, 25 bp, Mus musculus
tacatcagggactgctgaggccagc

SEQ ID NO: 761168 - DNA, 25 bp, Mus musculus
tacatcagtcctcccacgggacaga

SEQ ID NO: 761169 - DNA, 25 bp, Mus musculus
tacatcagtcctgccacgggacaga

SEQ ID NO: 761170 - DNA, 25 bp, Mus musculus
tacatcagtgcacggcttggtgcca

SEQ ID NO: 761171 - DNA, 25 bp, Mus musculus
tacatcagtgcagggcttggtgcca

SEQ ID NO: 761172 - DNA, 25 bp, Mus musculus
tacatcataagcacctttgaagttt

SEQ ID NO: 761173 - DNA, 25 bp, Mus musculus
tacatcataagctcctttgaagttt

SEQ ID NO: 761174 - DNA, 25 bp, Mus musculus
tacatcatacggaactgtgaccagt

SEQ ID NO: 761175 - DNA, 25 bp, Mus musculus
tacatcatacggtactgtgaccagt

SEQ ID NO: 761176 - DNA, 25 bp, Mus musculus
tacatcatactaaactacacagagc

SEQ ID NO: 761177 - DNA, 25 bp, Mus musculus
tacatcatactatactacacagagc

SEQ ID NO: 761178 - DNA, 25 bp, Mus musculus
tacatcatcagcaatgtttctaaga

SEQ ID NO: 761179 - DNA, 25 bp, Mus musculus
tacatcatcagctatgtttctaaga

SEQ ID NO: 761180 - DNA, 25 bp, Mus musculus
tacatcatctttacttgcttagcat

SEQ ID NO: 761181 - DNA, 25 bp, Mus musculus
tacatcatcttttcttgcttagcat

SEQ ID NO: 761182 - DNA, 25 bp, Mus musculus
tacatcatggagacgtttgggatga

SEQ ID NO: 761183 - DNA, 25 bp, Mus musculus
tacatcatggagtcgtttgggatga

SEQ ID NO: 761184 - DNA, 25 bp, Mus musculus
tacatcatggcgactgagctgcggt

SEQ ID NO: 761185 - DNA, 25 bp, Mus musculus
tacatcatggcgtctgagctgcggt

SEQ ID NO: 761186 - DNA, 25 bp, Mus musculus
tacatcattcttcctagtaaatttt

SEQ ID NO: 761187 - DNA, 25 bp, Mus musculus
tacatcattcttgctagtaaatttt

SEQ ID NO: 761188 - DNA, 25 bp, Mus musculus
tacatcatttagactgtgttccttt

SEQ ID NO: 761189 - DNA, 25 bp, Mus musculus
tacatcatttagtctgtgttccttt

SEQ ID NO: 761190 - DNA, 25 bp, Mus musculus
tacatcatttatcatggactagccc

SEQ ID NO: 761191 - DNA, 25 bp, Mus musculus
tacatcatttatgatggactagccc

SEQ ID NO: 761192 - DNA, 25 bp, Mus musculus
tacatcatttttcaggagtttccta

SEQ ID NO: 761193 - DNA, 25 bp, Mus musculus
tacatcatttttgaggagtttccta

SEQ ID NO: 761194 - DNA, 25 bp, Mus musculus
tacatccaagatatctattcctgtg

SEQ ID NO: 761195 - DNA, 25 bp, Mus musculus
tacatccaagatttctattcctgtg

SEQ ID NO: 761196 - DNA, 25 bp, Mus musculus
tacatccaagtcatgttcagtccct

SEQ ID NO: 761197 - DNA, 25 bp, Mus musculus
tacatccaagtcttgttcagtccct

SEQ ID NO: 761198 - DNA, 25 bp, Mus musculus
tacatccacatcagagacccgagga

SEQ ID NO: 761199 - DNA, 25 bp, Mus musculus
tacatccacatctgagacccgagga

SEQ ID NO: 761200 - DNA, 25 bp, Mus musculus
tacatccacatgaacaagccccagg

SEQ ID NO: 761201 - DNA, 25 bp, Mus musculus
tacatccacatgtacaagccccagg

SEQ ID NO: 761202 - DNA, 25 bp, Mus musculus
tacatccagaaaagggtggtccaga

SEQ ID NO: 761203 - DNA, 25 bp, Mus musculus
tacatccagaaatgggtggtccaga

SEQ ID NO: 761204 - DNA, 25 bp, Mus musculus
tacatccagaacaacctgcccaagg

SEQ ID NO: 761205 - DNA, 25 bp, Mus musculus
tacatccagaactacctgcccaagg

SEQ ID NO: 761206 - DNA, 25 bp, Mus musculus
tacatccagagaagatgttgtgttc

SEQ ID NO: 761207 - DNA, 25 bp, Mus musculus
tacatccagagatgatgttgtgttc

SEQ ID NO: 761208 - DNA, 25 bp, Mus musculus
tacatccagcaacacaccaagggtg

SEQ ID NO: 761209 - DNA, 25 bp, Mus musculus
tacatccagcaagacaccaagggtg

SEQ ID NO: 761210 - DNA, 25 bp, Mus musculus
tacatccatggcctttgaattttaa

SEQ ID NO: 761211 - DNA, 25 bp, Mus musculus
tacatccatggcgtttgaattttaa

SEQ ID NO: 761212 - DNA, 25 bp, Mus musculus
tacatcccactcctgtatgagactt

SEQ ID NO: 761213 - DNA, 25 bp, Mus musculus
tacatcccactcgtgtatgagactt

SEQ ID NO: 761214 - DNA, 25 bp, Mus musculus
tacatcccacttccagattagcaaa

SEQ ID NO: 761215 - DNA, 25 bp, Mus musculus
tacatcccacttgcagattagcaaa

SEQ ID NO: 761216 - DNA, 25 bp, Mus musculus
tacatcccatagcagagacgagcag

SEQ ID NO: 761217 - DNA, 25 bp, Mus musculus
tacatcccataggagagacgagcag

SEQ ID NO: 761218 - DNA, 25 bp, Mus musculus
tacatcccattcacagacgtctggg

SEQ ID NO: 761219 - DNA, 25 bp, Mus musculus
tacatcccattctcagacgtctggg

SEQ ID NO: 761220 - DNA, 25 bp, Mus musculus
tacatcccctctaagacggacttgg

SEQ ID NO: 761221 - DNA, 25 bp, Mus musculus
tacatcccctcttagacggacttgg

SEQ ID NO: 761222 - DNA, 25 bp, Mus musculus
tacatccctgacaactcagtacgag

SEQ ID NO: 761223 - DNA, 25 bp, Mus musculus
tacatccctgactactcagtacgag

SEQ ID NO: 761224 - DNA, 25 bp, Mus musculus
tacatccctttcaacggcatcttgg

SEQ ID NO: 761225 - DNA, 25 bp, Mus musculus
tacatccctttctacggcatcttgg

SEQ ID NO: 761226 - DNA, 25 bp, Mus musculus
tacatccgaaagaacaatcgctttg

SEQ ID NO: 761227 - DNA, 25 bp, Mus musculus
tacatccgaaagtacaatcgctttg

SEQ ID NO: 761228 - DNA, 25 bp, Mus musculus
tacatccgagggacgtatttggcaa

SEQ ID NO: 761229 - DNA, 25 bp, Mus musculus
tacatccgagggtcgtatttggcaa

SEQ ID NO: 761230 - DNA, 25 bp, Mus musculus
tacatccggagactgccccaaagga

SEQ ID NO: 761231 - DNA, 25 bp, Mus musculus
tacatccggagagtgccccaaagga

SEQ ID NO: 761232 - DNA, 25 bp, Mus musculus
tacatcctaaaacatatacctcaat

SEQ ID NO: 761233 - DNA, 25 bp, Mus musculus
tacatcctaaaagatatacctcaat

SEQ ID NO: 761234 - DNA, 25 bp, Mus musculus
tacatcctactaacagtagattttt

SEQ ID NO: 761235 - DNA, 25 bp, Mus musculus
tacatcctactatcagtagattttt

SEQ ID NO: 761236 - DNA, 25 bp, Mus musculus
tacatcctctctattcccgttctat

SEQ ID NO: 761237 - DNA, 25 bp, Mus musculus
tacatcctctcttttcccgttctat

SEQ ID NO: 761238 - DNA, 25 bp, Mus musculus
tacatccttaatatagccgtgagtt

SEQ ID NO: 761239 - DNA, 25 bp, Mus musculus
tacatccttaatttagccgtgagtt

SEQ ID NO: 761240 - DNA, 25 bp, Mus musculus
tacatccttgaaatcagtagcagtt

SEQ ID NO: 761241 - DNA, 25 bp, Mus musculus
tacatccttgaattcagtagcagtt

SEQ ID NO: 761242 - DNA, 25 bp, Mus musculus
tacatccttggcaagttagaggcca

SEQ ID NO: 761243 - DNA, 25 bp, Mus musculus
tacatccttggctagttagaggcca

SEQ ID NO: 761244 - DNA, 25 bp, Mus musculus
tacatccttgtgacaatcctgaaga

SEQ ID NO: 761245 - DNA, 25 bp, Mus musculus
tacatccttgtgtcaatcctgaaga

SEQ ID NO: 761246 - DNA, 25 bp, Mus musculus
tacatcctttggagagtagacgtca

SEQ ID NO: 761247 - DNA, 25 bp, Mus musculus
tacatcctttggtgagtagacgtca

SEQ ID NO: 761248 - DNA, 25 bp, Mus musculus
tacatcgaagggatcttgaagtgca

SEQ ID NO: 761249 - DNA, 25 bp, Mus musculus
tacatcgaagggttcttgaagtgca

SEQ ID NO: 761250 - DNA, 25 bp, Mus musculus
tacatcgaatttagttttgtgaagg

SEQ ID NO: 761251 - DNA, 25 bp, Mus musculus
tacatcgaattttgttttgtgaagg

SEQ ID NO: 761252 - DNA, 25 bp, Mus musculus
tacatcgacctgaaagaccgtcctt

SEQ ID NO: 761253 - DNA, 25 bp, Mus musculus
tacatcgacctgtaagaccgtcctt

SEQ ID NO: 761254 - DNA, 25 bp, Mus musculus
tacatcgagttcagtgagcttttct

SEQ ID NO: 761255 - DNA, 25 bp, Mus musculus
tacatcgagttctgtgagcttttct

SEQ ID NO: 761256 - DNA, 25 bp, Mus musculus
tacatcgccattattcagcaggaac

SEQ ID NO: 761257 - DNA, 25 bp, Mus musculus
tacatcgccatttttcagcaggaac

SEQ ID NO: 761258 - DNA, 25 bp, Mus musculus
tacatcgctcctctctttggaggtg

SEQ ID NO: 761259 - DNA, 25 bp, Mus musculus
tacatcgctcctgtctttggaggtg

SEQ ID NO: 761260 - DNA, 25 bp, Mus musculus
tacatcggagttaccgggacctggt

SEQ ID NO: 761261 - DNA, 25 bp, Mus musculus
tacatcggagtttccgggacctggt

SEQ ID NO: 761262 - DNA, 25 bp, Mus musculus
tacatcgtatgtcgattctttgaag

SEQ ID NO: 761263 - DNA, 25 bp, Mus musculus
tacatcgtatgtggattctttgaag

SEQ ID NO: 761264 - DNA, 25 bp, Mus musculus
tacatcgtcccaagagtgctgaaca

SEQ ID NO: 761265 - DNA, 25 bp, Mus musculus
tacatcgtcccatgagtgctgaaca

SEQ ID NO: 761266 - DNA, 25 bp, Mus musculus
tacatcgtgtccctgaacgggcagc

SEQ ID NO: 761267 - DNA, 25 bp, Mus musculus
tacatcgtgtccgtgaacgggcagc

SEQ ID NO: 761268 - DNA, 25 bp, Mus musculus
tacatcgttgggagaacagcacaca

SEQ ID NO: 761269 - DNA, 25 bp, Mus musculus
tacatcgttgggtgaacagcacaca

SEQ ID NO: 761270 - DNA, 25 bp, Mus musculus
tacatctaaggcatcgaagactccc

SEQ ID NO: 761271 - DNA, 25 bp, Mus musculus
tacatctaaggcttcgaagactccc

SEQ ID NO: 761272 - DNA, 25 bp, Mus musculus
tacatctaagttcccctgactggcc

SEQ ID NO: 761273 - DNA, 25 bp, Mus musculus
tacatctaagttgccctgactggcc

SEQ ID NO: 761274 - DNA, 25 bp, Mus musculus
tacatctacaagatcctgaccctgt

SEQ ID NO: 761275 - DNA, 25 bp, Mus musculus
tacatctacaagttcctgaccctgt

SEQ ID NO: 761276 - DNA, 25 bp, Mus musculus
tacatctatatacctccacttctta

SEQ ID NO: 761277 - DNA, 25 bp, Mus musculus
tacatctatatagctccacttctta

SEQ ID NO: 761278 - DNA, 25 bp, Mus musculus
tacatctatggacactcacctctgt

SEQ ID NO: 761279 - DNA, 25 bp, Mus musculus
tacatctatggagactcacctctgt

SEQ ID NO: 761280 - DNA, 25 bp, Mus musculus
tacatctcacaaaacatcaccaaag

SEQ ID NO: 761281 - DNA, 25 bp, Mus musculus
tacatctcacaatacatcaccaaag

SEQ ID NO: 761282 - DNA, 25 bp, Mus musculus
tacatctcacgaaaccatttccctt

SEQ ID NO: 761283 - DNA, 25 bp, Mus musculus
tacatctcacgataccatttccctt

SEQ ID NO: 761284 - DNA, 25 bp, Mus musculus
tacatctcagagacggaagcctcct

SEQ ID NO: 761285 - DNA, 25 bp, Mus musculus
tacatctcagagtcggaagcctcct

SEQ ID NO: 761286 - DNA, 25 bp, Mus musculus
tacatctcagcactcagcagtggca

SEQ ID NO: 761287 - DNA, 25 bp, Mus musculus
tacatctcagcagtcagcagtggca

SEQ ID NO: 761288 - DNA, 25 bp, Mus musculus
tacatctcagttatcaacttcatgt

SEQ ID NO: 761289 - DNA, 25 bp, Mus musculus
tacatctcagttttcaacttcatgt

SEQ ID NO: 761290 - DNA, 25 bp, Mus musculus
tacatctccacacttactgaaactg

SEQ ID NO: 761291 - DNA, 25 bp, Mus musculus
tacatctccacagttactgaaactg

SEQ ID NO: 761292 - DNA, 25 bp, Mus musculus
tacatctccagcatgtcacaggctg

SEQ ID NO: 761293 - DNA, 25 bp, Mus musculus
tacatctccagcttgtcacaggctg

SEQ ID NO: 761294 - DNA, 25 bp, Mus musculus
tacatctcccggctcggtgtagtgg

SEQ ID NO: 761295 - DNA, 25 bp, Mus musculus
tacatctcccgggtcggtgtagtgg

SEQ ID NO: 761296 - DNA, 25 bp, Mus musculus
tacatctctactcattggcatcaac

SEQ ID NO: 761297 - DNA, 25 bp, Mus musculus
tacatctctactgattggcatcaac

SEQ ID NO: 761298 - DNA, 25 bp, Mus musculus
tacatctgacagaggccgttctttt

SEQ ID NO: 761299 - DNA, 25 bp, Mus musculus
tacatctgacagtggccgttctttt

SEQ ID NO: 761300 - DNA, 25 bp, Mus musculus
tacatctgaccaagtccacagagca

SEQ ID NO: 761301 - DNA, 25 bp, Mus musculus
tacatctgaccatgtccacagagca

SEQ ID NO: 761302 - DNA, 25 bp, Mus musculus
tacatctgagtgcatggctcctctc

SEQ ID NO: 761303 - DNA, 25 bp, Mus musculus
tacatctgagtggatggctcctctc

SEQ ID NO: 761304 - DNA, 25 bp, Mus musculus
tacatctgcacccttacatcatcag

SEQ ID NO: 761305 - DNA, 25 bp, Mus musculus
tacatctgcaccgttacatcatcag

SEQ ID NO: 761306 - DNA, 25 bp, Mus musculus
tacatctgcagtcctactgttgtta

SEQ ID NO: 761307 - DNA, 25 bp, Mus musculus
tacatctgcagtgctactgttgtta

SEQ ID NO: 761308 - DNA, 25 bp, Mus musculus
tacatctgccctacagccagaggag

SEQ ID NO: 761309 - DNA, 25 bp, Mus musculus
tacatctgcccttcagccagaggag

SEQ ID NO: 761310 - DNA, 25 bp, Mus musculus
tacatctgcctgctcatccagggag

SEQ ID NO: 761311 - DNA, 25 bp, Mus musculus
tacatctgcctggtcatccagggag

SEQ ID NO: 761312 - DNA, 25 bp, Mus musculus
tacatctgcgaaagactctgcgctg

SEQ ID NO: 761313 - DNA, 25 bp, Mus musculus
tacatctgcgaatgactctgcgctg

SEQ ID NO: 761314 - DNA, 25 bp, Mus musculus
tacatctgcgttcgtgctagttaga

SEQ ID NO: 761315 - DNA, 25 bp, Mus musculus
tacatctgcgttggtgctagttaga

SEQ ID NO: 761316 - DNA, 25 bp, Mus musculus
tacatctgggcactgactcagacgc

SEQ ID NO: 761317 - DNA, 25 bp, Mus musculus
tacatctgggcagtgactcagacgc

SEQ ID NO: 761318 - DNA, 25 bp, Mus musculus
tacatctgtatgatcaagcacacat

SEQ ID NO: 761319 - DNA, 25 bp, Mus musculus
tacatctgtatgttcaagcacacat

SEQ ID NO: 761320 - DNA, 25 bp, Mus musculus
tacatctgtgccacgagcagcagtg

SEQ ID NO: 761321 - DNA, 25 bp, Mus musculus
tacatctgtgcctcgagcagcagtg

SEQ ID NO: 761322 - DNA, 25 bp, Mus musculus
tacatcttaaacaactaattaccaa

SEQ ID NO: 761323 - DNA, 25 bp, Mus musculus
tacatcttaaactactaattaccaa

SEQ ID NO: 761324 - DNA, 25 bp, Mus musculus
tacatcttaatgatgtcttcttggt

SEQ ID NO: 761325 - DNA, 25 bp, Mus musculus
tacatcttaatgttgtcttcttggt

SEQ ID NO: 761326 - DNA, 25 bp, Mus musculus
tacatcttatgtctctaactgaagg

SEQ ID NO: 761327 - DNA, 25 bp, Mus musculus
tacatcttatgtgtctaactgaagg

SEQ ID NO: 761328 - DNA, 25 bp, Mus musculus
tacatcttccaacgagcctatcaat

SEQ ID NO: 761329 - DNA, 25 bp, Mus musculus
tacatcttccaaggagcctatcaat

SEQ ID NO: 761330 - DNA, 25 bp, Mus musculus
tacatcttccttatactaccttaag

SEQ ID NO: 761331 - DNA, 25 bp, Mus musculus
tacatcttccttttactaccttaag

SEQ ID NO: 761332 - DNA, 25 bp, Mus musculus
tacatcttgaagcagtgaacacatt

SEQ ID NO: 761333 - DNA, 25 bp, Mus musculus
tacatcttgaaggagtgaacacatt

SEQ ID NO: 761334 - DNA, 25 bp, Mus musculus
tacatcttgcctaccattgcatgaa

SEQ ID NO: 761335 - DNA, 25 bp, Mus musculus
tacatcttgccttccattgcatgaa

SEQ ID NO: 761336 - DNA, 25 bp, Mus musculus
tacatctttgcgcttacattgtacc

SEQ ID NO: 761337 - DNA, 25 bp, Mus musculus
tacatctttgcggttacattgtacc

SEQ ID NO: 761338 - DNA, 25 bp, Mus musculus
tacatctttgctctcaaggaagcct

SEQ ID NO: 761339 - DNA, 25 bp, Mus musculus
tacatctttgctgtcaaggaagcct

SEQ ID NO: 761340 - DNA, 25 bp, Mus musculus
tacatctttggcatgacccatcgga

SEQ ID NO: 761341 - DNA, 25 bp, Mus musculus
tacatctttggcttgacccatcgga

SEQ ID NO: 761342 - DNA, 25 bp, Mus musculus
tacatgaaaggaaccccgtctgaga

SEQ ID NO: 761343 - DNA, 25 bp, Mus musculus
tacatgaaaggatccccgtctgaga

SEQ ID NO: 761344 - DNA, 25 bp, Mus musculus
tacatgaacttgacatcaagacact

SEQ ID NO: 761345 - DNA, 25 bp, Mus musculus
tacatgaacttgtcatcaagacact

SEQ ID NO: 761346 - DNA, 25 bp, Mus musculus
tacatgaagatgctctttcccctca

SEQ ID NO: 761347 - DNA, 25 bp, Mus musculus
tacatgaagatggtctttcccctca

SEQ ID NO: 761348 - DNA, 25 bp, Mus musculus
tacatgaagtttagtggcccaggca

SEQ ID NO: 761349 - DNA, 25 bp, Mus musculus
tacatgaagttttgtggcccaggca

SEQ ID NO: 761350 - DNA, 25 bp, Mus musculus
tacatgaatattccagcgtgtctga

SEQ ID NO: 761351 - DNA, 25 bp, Mus musculus
tacatgaatattgcagcgtgtctga

SEQ ID NO: 761352 - DNA, 25 bp, Mus musculus
tacatgaatcaaccaagagacattt

SEQ ID NO: 761353 - DNA, 25 bp, Mus musculus
tacatgaatcaagcaagagacattt

SEQ ID NO: 761354 - DNA, 25 bp, Mus musculus
tacatgacagataccctaactcagg

SEQ ID NO: 761355 - DNA, 25 bp, Mus musculus
tacatgacagattccctaactcagg

SEQ ID NO: 761356 - DNA, 25 bp, Mus musculus
tacatgacagggaccatcttctctt

SEQ ID NO: 761357 - DNA, 25 bp, Mus musculus
tacatgacagggtccatcttctctt

SEQ ID NO: 761358 - DNA, 25 bp, Mus musculus
tacatgacatacaattgagccccag

SEQ ID NO: 761359 - DNA, 25 bp, Mus musculus
tacatgacatactattgagccccag

SEQ ID NO: 761360 - DNA, 25 bp, Mus musculus
tacatgacatcactttcctagccat

SEQ ID NO: 761361 - DNA, 25 bp, Mus musculus
tacatgacatcagtttcctagccat

SEQ ID NO: 761362 - DNA, 25 bp, Mus musculus
tacatgacgtggactgcactctgac

SEQ ID NO: 761363 - DNA, 25 bp, Mus musculus
tacatgacgtggtctgcactctgac

SEQ ID NO: 761364 - DNA, 25 bp, Mus musculus
tacatgagaccaacatctactctgt

SEQ ID NO: 761365 - DNA, 25 bp, Mus musculus
tacatgagaccatcatctactctgt

SEQ ID NO: 761366 - DNA, 25 bp, Mus musculus
tacatgagccccatggaggcccaag

SEQ ID NO: 761367 - DNA, 25 bp, Mus musculus
tacatgagccccttggaggcccaag

SEQ ID NO: 761368 - DNA, 25 bp, Mus musculus
tacatgagctccaatctgcagcact

SEQ ID NO: 761369 - DNA, 25 bp, Mus musculus
tacatgagctcctatctgcagcact

SEQ ID NO: 761370 - DNA, 25 bp, Mus musculus
tacatgagggccagcacaaccacca

SEQ ID NO: 761371 - DNA, 25 bp, Mus musculus
tacatgagggcccagctctttacct

SEQ ID NO: 761372 - DNA, 25 bp, Mus musculus
tacatgagggccgagctctttacct

SEQ ID NO: 761373 - DNA, 25 bp, Mus musculus
tacatgagggcctgcacaaccacca

SEQ ID NO: 761374 - DNA, 25 bp, Mus musculus
tacatgaggtgtcggacgcactgcc

SEQ ID NO: 761375 - DNA, 25 bp, Mus musculus
tacatgaggtgtgggacgcactgcc

SEQ ID NO: 761376 - DNA, 25 bp, Mus musculus
tacatgatacccaacagttcctttt

SEQ ID NO: 761377 - DNA, 25 bp, Mus musculus
tacatgataccctacagttcctttt

SEQ ID NO: 761378 - DNA, 25 bp, Mus musculus
tacatgatatttatgcttgtggtcc

SEQ ID NO: 761379 - DNA, 25 bp, Mus musculus
tacatgatatttttgcttgtggtcc

SEQ ID NO: 761380 - DNA, 25 bp, Mus musculus
tacatgatcaaaccgtctgcaggtt

SEQ ID NO: 761381 - DNA, 25 bp, Mus musculus
tacatgatcaaagcgtctgcaggtt

SEQ ID NO: 761382 - DNA, 25 bp, Mus musculus
tacatgatgaaccttgccagcctgt

SEQ ID NO: 761383 - DNA, 25 bp, Mus musculus
tacatgatgaacgttgccagcctgt

SEQ ID NO: 761384 - DNA, 25 bp, Mus musculus
tacatgatgtgtcatttagggctta

SEQ ID NO: 761385 - DNA, 25 bp, Mus musculus
tacatgatgtgtgatttagggctta

SEQ ID NO: 761386 - DNA, 25 bp, Mus musculus
tacatgcaacggactgtacgcgtat

SEQ ID NO: 761387 - DNA, 25 bp, Mus musculus
tacatgcaacggtctgtacgcgtat

SEQ ID NO: 761388 - DNA, 25 bp, Mus musculus
tacatgcaactcagacgcttggcct

SEQ ID NO: 761389 - DNA, 25 bp, Mus musculus
tacatgcaactctgacgcttggcct

SEQ ID NO: 761390 - DNA, 25 bp, Mus musculus
tacatgcacgtaagtgtgcgcctgt

SEQ ID NO: 761391 - DNA, 25 bp, Mus musculus
tacatgcacgtatgtgtgcgcctgt

SEQ ID NO: 761392 - DNA, 25 bp, Mus musculus
tacatgcagatgaacttgtatacct

SEQ ID NO: 761393 - DNA, 25 bp, Mus musculus
tacatgcagatgtacttgtatacct

SEQ ID NO: 761394 - DNA, 25 bp, Mus musculus
tacatgcataacattctgactgata

SEQ ID NO: 761395 - DNA, 25 bp, Mus musculus
tacatgcataactttctgactgata

SEQ ID NO: 761396 - DNA, 25 bp, Mus musculus
tacatgcatatgaatgatcagacat

SEQ ID NO: 761397 - DNA, 25 bp, Mus musculus
tacatgcatatgtatgatcagacat

SEQ ID NO: 761398 - DNA, 25 bp, Mus musculus
tacatgcatttgaacagtgggccct

SEQ ID NO: 761399 - DNA, 25 bp, Mus musculus
tacatgcatttgtacagtgggccct

SEQ ID NO: 761400 - DNA, 25 bp, Mus musculus
tacatgccaatccattgggagccat

SEQ ID NO: 761401 - DNA, 25 bp, Mus musculus
tacatgccaatcgattgggagccat

SEQ ID NO: 761402 - DNA, 25 bp, Mus musculus
tacatgccacacctaccaacaaggt

SEQ ID NO: 761403 - DNA, 25 bp, Mus musculus
tacatgccacacgtaccaacaaggt

SEQ ID NO: 761404 - DNA, 25 bp, Mus musculus
tacatgccatgtctcttgaaatagg

SEQ ID NO: 761405 - DNA, 25 bp, Mus musculus
tacatgccatgtgtcttgaaatagg

SEQ ID NO: 761406 - DNA, 25 bp, Mus musculus
tacatgcccccactccggtttaaag

SEQ ID NO: 761407 - DNA, 25 bp, Mus musculus
tacatgcccccagtccggtttaaag

SEQ ID NO: 761408 - DNA, 25 bp, Mus musculus
tacatgccctgacttgactgcttta

SEQ ID NO: 761409 - DNA, 25 bp, Mus musculus
tacatgccctgagttgactgcttta

SEQ ID NO: 761410 - DNA, 25 bp, Mus musculus
tacatgcccttcactgttggtcatt

SEQ ID NO: 761411 - DNA, 25 bp, Mus musculus
tacatgcccttctctgttggtcatt

SEQ ID NO: 761412 - DNA, 25 bp, Mus musculus
tacatgccggccacaggaagatgga

SEQ ID NO: 761413 - DNA, 25 bp, Mus musculus
tacatgccggcctcaggaagatgga

SEQ ID NO: 761414 - DNA, 25 bp, Mus musculus
tacatgcctcctctaacattttcac

SEQ ID NO: 761415 - DNA, 25 bp, Mus musculus
tacatgcctcctgtaacattttcac

SEQ ID NO: 761416 - DNA, 25 bp, Mus musculus
tacatgcctgcaaagctgcagatgc

SEQ ID NO: 761417 - DNA, 25 bp, Mus musculus
tacatgcctgcatagctgcagatgc

SEQ ID NO: 761418 - DNA, 25 bp, Mus musculus
tacatgcctggaaatgtgacttcag

SEQ ID NO: 761419 - DNA, 25 bp, Mus musculus
tacatgcctggatatgtgacttcag

SEQ ID NO: 761420 - DNA, 25 bp, Mus musculus
tacatgcgcctgcacaagcttcttt

SEQ ID NO: 761421 - DNA, 25 bp, Mus musculus
tacatgcgcctggacaagcttcttt

SEQ ID NO: 761422 - DNA, 25 bp, Mus musculus
tacatgcggccactgagcatctggg

SEQ ID NO: 761423 - DNA, 25 bp, Mus musculus
tacatgcggccagtgagcatctggg

SEQ ID NO: 761424 - DNA, 25 bp, Mus musculus
tacatgcgtgagactggatagattc

SEQ ID NO: 761425 - DNA, 25 bp, Mus musculus
tacatgcgtgagtctggatagattc

SEQ ID NO: 761426 - DNA, 25 bp, Mus musculus
tacatgctagctagtcagacggccg

SEQ ID NO: 761427 - DNA, 25 bp, Mus musculus
tacatgctagcttgtcagacggccg

SEQ ID NO: 761428 - DNA, 25 bp, Mus musculus
tacatgctaggtagtcttcttttcc

SEQ ID NO: 761429 - DNA, 25 bp, Mus musculus
tacatgctaggttgtcttcttttcc

SEQ ID NO: 761430 - DNA, 25 bp, Mus musculus
tacatgctatctcggatctttgaaa

SEQ ID NO: 761431 - DNA, 25 bp, Mus musculus
tacatgctatctgggatctttgaaa

SEQ ID NO: 761432 - DNA, 25 bp, Mus musculus
tacatgctccgaaacccgtaggtaa

SEQ ID NO: 761433 - DNA, 25 bp, Mus musculus
tacatgctccgatacccgtaggtaa

SEQ ID NO: 761434 - DNA, 25 bp, Mus musculus
tacatgctctagctgctgcagtcaa

SEQ ID NO: 761435 - DNA, 25 bp, Mus musculus
tacatgctctaggtgctgcagtcaa

SEQ ID NO: 761436 - DNA, 25 bp, Mus musculus
tacatgctgggtagtctctagtcag

SEQ ID NO: 761437 - DNA, 25 bp, Mus musculus
tacatgctgggttgtctctagtcag

SEQ ID NO: 761438 - DNA, 25 bp, Mus musculus
tacatgctggtcatagtgctggctc

SEQ ID NO: 761439 - DNA, 25 bp, Mus musculus
tacatgctggtcttagtgctggctc

SEQ ID NO: 761440 - DNA, 25 bp, Mus musculus
tacatgctgttcacgccacacataa

SEQ ID NO: 761441 - DNA, 25 bp, Mus musculus
tacatgctgttctcgccacacataa

SEQ ID NO: 761442 - DNA, 25 bp, Mus musculus
tacatgcttaaaactggatatcaga

SEQ ID NO: 761443 - DNA, 25 bp, Mus musculus
tacatgcttaaatctggatatcaga

SEQ ID NO: 761444 - DNA, 25 bp, Mus musculus
tacatgctttttctggagtgcccca

SEQ ID NO: 761445 - DNA, 25 bp, Mus musculus
tacatgctttttgtggagtgcccca

SEQ ID NO: 761446 - DNA, 25 bp, Mus musculus
tacatggaaagaacgcacactggag

SEQ ID NO: 761447 - DNA, 25 bp, Mus musculus
tacatggaaagatcgcacactggag

SEQ ID NO: 761448 - DNA, 25 bp, Mus musculus
tacatggaatctccttccggtgccc

SEQ ID NO: 761449 - DNA, 25 bp, Mus musculus
tacatggaatctgcttccggtgccc

SEQ ID NO: 761450 - DNA, 25 bp, Mus musculus
tacatggacctaatgaccacactcc

SEQ ID NO: 761451 - DNA, 25 bp, Mus musculus
tacatggacctattgaccacactcc

SEQ ID NO: 761452 - DNA, 25 bp, Mus musculus
tacatggaccttcatgtcaaacttg

SEQ ID NO: 761453 - DNA, 25 bp, Mus musculus
tacatggaccttgatgtcaaacttg

SEQ ID NO: 761454 - DNA, 25 bp, Mus musculus
tacatggacgtacaggccaccactc

SEQ ID NO: 761455 - DNA, 25 bp, Mus musculus
tacatggacgtagaggccaccactc

SEQ ID NO: 761456 - DNA, 25 bp, Mus musculus
tacatggactacctggcagccttgg

SEQ ID NO: 761457 - DNA, 25 bp, Mus musculus
tacatggactacgtggcagccttgg

SEQ ID NO: 761458 - DNA, 25 bp, Mus musculus
tacatggactgcatttcctcgctga

SEQ ID NO: 761459 - DNA, 25 bp, Mus musculus
tacatggactgcttttcctcgctga

SEQ ID NO: 761460 - DNA, 25 bp, Mus musculus
tacatggagagacttgccctgggcc

SEQ ID NO: 761461 - DNA, 25 bp, Mus musculus
tacatggagagagttgccctgggcc

SEQ ID NO: 761462 - DNA, 25 bp, Mus musculus
tacatggagcacctgtgggcaagcc

SEQ ID NO: 761463 - DNA, 25 bp, Mus musculus
tacatggagcacgtgtgggcaagcc

SEQ ID NO: 761464 - DNA, 25 bp, Mus musculus
tacatggaggccctggtgaagctct

SEQ ID NO: 761465 - DNA, 25 bp, Mus musculus
tacatggaggccgtggtgaagctct

SEQ ID NO: 761466 - DNA, 25 bp, Mus musculus
tacatggatgcccatgtctactggg

SEQ ID NO: 761467 - DNA, 25 bp, Mus musculus
tacatggatgccgatgtctactggg

SEQ ID NO: 761468 - DNA, 25 bp, Mus musculus
tacatggatgctcagacccgagctc

SEQ ID NO: 761469 - DNA, 25 bp, Mus musculus
tacatggatgctgagacccgagctc

SEQ ID NO: 761470 - DNA, 25 bp, Mus musculus
tacatggatttgcaccactggcctg

SEQ ID NO: 761471 - DNA, 25 bp, Mus musculus
tacatggatttggaccactggcctg

SEQ ID NO: 761472 - DNA, 25 bp, Mus musculus
tacatggattttaattcacttttca

SEQ ID NO: 761473 - DNA, 25 bp, Mus musculus
tacatggatttttattcacttttca

SEQ ID NO: 761474 - DNA, 25 bp, Mus musculus
tacatggcatctatccttacctcta

SEQ ID NO: 761475 - DNA, 25 bp, Mus musculus
tacatggcatctttccttacctcta

SEQ ID NO: 761476 - DNA, 25 bp, Mus musculus
tacatggccccgcaagttctagaat

SEQ ID NO: 761477 - DNA, 25 bp, Mus musculus
tacatggccccggaagttctagaat

SEQ ID NO: 761478 - DNA, 25 bp, Mus musculus
tacatggccctgaatttcaaagttt

SEQ ID NO: 761479 - DNA, 25 bp, Mus musculus
tacatggccctgtatttcaaagttt

SEQ ID NO: 761480 - DNA, 25 bp, Mus musculus
tacatggcgagaccctacctactgg

SEQ ID NO: 761481 - DNA, 25 bp, Mus musculus
tacatggcgagagcctacctactgg

SEQ ID NO: 761482 - DNA, 25 bp, Mus musculus
tacatggctaggactgatgacctgg

SEQ ID NO: 761483 - DNA, 25 bp, Mus musculus
tacatggctaggtctgatgacctgg

SEQ ID NO: 761484 - DNA, 25 bp, Mus musculus
tacatggctgcaccgttgctagagt

SEQ ID NO: 761485 - DNA, 25 bp, Mus musculus
tacatggctgcagcgttgctagagt

SEQ ID NO: 761486 - DNA, 25 bp, Mus musculus
tacatggctgtccagcactacatag

SEQ ID NO: 761487 - DNA, 25 bp, Mus musculus
tacatggctgtcgagcactacatag

SEQ ID NO: 761488 - DNA, 25 bp, Mus musculus
tacatggcttttcccttgacttcct

SEQ ID NO: 761489 - DNA, 25 bp, Mus musculus
tacatggcttttgccttgacttcct

SEQ ID NO: 761490 - DNA, 25 bp, Mus musculus
tacatgggacaccaggttgtgcaca

SEQ ID NO: 761491 - DNA, 25 bp, Mus musculus
tacatgggacacgaggttgtgcaca

SEQ ID NO: 761492 - DNA, 25 bp, Mus musculus
tacatgggacccagaatttggttcc

SEQ ID NO: 761493 - DNA, 25 bp, Mus musculus
tacatgggaccctgaatttggttcc

SEQ ID NO: 761494 - DNA, 25 bp, Mus musculus
tacatgggattaaaaggacttggaa

SEQ ID NO: 761495 - DNA, 25 bp, Mus musculus
tacatgggattataaggacttggaa

SEQ ID NO: 761496 - DNA, 25 bp, Mus musculus
tacatgggcaacataaaacagaatt

SEQ ID NO: 761497 - DNA, 25 bp, Mus musculus
tacatgggcaacttaaaacagaatt

SEQ ID NO: 761498 - DNA, 25 bp, Mus musculus
tacatgggcattatatgcgggtgct

SEQ ID NO: 761499 - DNA, 25 bp, Mus musculus
tacatgggcattttatgcgggtgct

SEQ ID NO: 761500 - DNA, 25 bp, Mus musculus
tacatgggtcacaggctcaccagga

SEQ ID NO: 761501 - DNA, 25 bp, Mus musculus
tacatgggtcactggctcaccagga

SEQ ID NO: 761502 - DNA, 25 bp, Mus musculus
tacatgggtgtgagtacctactcac

SEQ ID NO: 761503 - DNA, 25 bp, Mus musculus
tacatgggtgtgtgtacctactcac

SEQ ID NO: 761504 - DNA, 25 bp, Mus musculus
tacatggtcatccactttaaggaaa

SEQ ID NO: 761505 - DNA, 25 bp, Mus musculus
tacatggtcatcgactttaaggaaa

SEQ ID NO: 761506 - DNA, 25 bp, Mus musculus
tacatggtgcacacgtctctggatg

SEQ ID NO: 761507 - DNA, 25 bp, Mus musculus
tacatggtgcactcgtctctggatg

SEQ ID NO: 761508 - DNA, 25 bp, Mus musculus
tacatggtgggcacactgagacaaa

SEQ ID NO: 761509 - DNA, 25 bp, Mus musculus
tacatggtgggctcactgagacaaa

SEQ ID NO: 761510 - DNA, 25 bp, Mus musculus
tacatggtggtgaacaggtcctcag

SEQ ID NO: 761511 - DNA, 25 bp, Mus musculus
tacatggtggtgtacaggtcctcag

SEQ ID NO: 761512 - DNA, 25 bp, Mus musculus
tacatggttttgctaggctctcatc

SEQ ID NO: 761513 - DNA, 25 bp, Mus musculus
tacatggttttggtaggctctcatc

SEQ ID NO: 761514 - DNA, 25 bp, Mus musculus
tacatgtaccagctcctcgatgact

SEQ ID NO: 761515 - DNA, 25 bp, Mus musculus
tacatgtaccaggtcctcgatgact

SEQ ID NO: 761516 - DNA, 25 bp, Mus musculus
tacatgtagaccagctgccttaacg

SEQ ID NO: 761517 - DNA, 25 bp, Mus musculus
tacatgtagacctgctgccttaacg

SEQ ID NO: 761518 - DNA, 25 bp, Mus musculus
tacatgtataatcactcccaccagg

SEQ ID NO: 761519 - DNA, 25 bp, Mus musculus
tacatgtataatgactcccaccagg

SEQ ID NO: 761520 - DNA, 25 bp, Mus musculus
tacatgtatatgaggctgccagttt

SEQ ID NO: 761521 - DNA, 25 bp, Mus musculus
tacatgtatatgtggctgccagttt

SEQ ID NO: 761522 - DNA, 25 bp, Mus musculus
tacatgtatctaactgagtccccac

SEQ ID NO: 761523 - DNA, 25 bp, Mus musculus
tacatgtatctatctgagtccccac

SEQ ID NO: 761524 - DNA, 25 bp, Mus musculus
tacatgtatgccaggcgcacgtata

SEQ ID NO: 761525 - DNA, 25 bp, Mus musculus
tacatgtatgcctggcgcacgtata

SEQ ID NO: 761526 - DNA, 25 bp, Mus musculus
tacatgtatggcatctttactaagt

SEQ ID NO: 761527 - DNA, 25 bp, Mus musculus
tacatgtatggcttctttactaagt

SEQ ID NO: 761528 - DNA, 25 bp, Mus musculus
tacatgtattccctgcttcttagaa

SEQ ID NO: 761529 - DNA, 25 bp, Mus musculus
tacatgtattccgtgcttcttagaa

SEQ ID NO: 761530 - DNA, 25 bp, Mus musculus
tacatgtgacctattctcaaaaaca

SEQ ID NO: 761531 - DNA, 25 bp, Mus musculus
tacatgtgaccttttctcaaaaaca

SEQ ID NO: 761532 - DNA, 25 bp, Mus musculus
tacatgtgctgcagtgcatcccatg

SEQ ID NO: 761533 - DNA, 25 bp, Mus musculus
tacatgtgctgctgtgcatcccatg

SEQ ID NO: 761534 - DNA, 25 bp, Mus musculus
tacatgtggatgagcgtctgcctgc

SEQ ID NO: 761535 - DNA, 25 bp, Mus musculus
tacatgtggatgtgcgtctgcctgc

SEQ ID NO: 761536 - DNA, 25 bp, Mus musculus
tacatgtggtgccaatgccaagcag

SEQ ID NO: 761537 - DNA, 25 bp, Mus musculus
tacatgtggtgcgaatgccaagcag

SEQ ID NO: 761538 - DNA, 25 bp, Mus musculus
tacatgtgtgctagaccccgaggtc

SEQ ID NO: 761539 - DNA, 25 bp, Mus musculus
tacatgtgtgcttgaccccgaggtc

SEQ ID NO: 761540 - DNA, 25 bp, Mus musculus
tacatgtgtggcacaggtggctcat

SEQ ID NO: 761541 - DNA, 25 bp, Mus musculus
tacatgtgtggctcaggtggctcat

SEQ ID NO: 761542 - DNA, 25 bp, Mus musculus
tacatgttacctccctggtgtagtt

SEQ ID NO: 761543 - DNA, 25 bp, Mus musculus
tacatgttacctgcctggtgtagtt

SEQ ID NO: 761544 - DNA, 25 bp, Mus musculus
tacatgttatttcggtctgaccgct

SEQ ID NO: 761545 - DNA, 25 bp, Mus musculus
tacatgttatttgggtctgaccgct

SEQ ID NO: 761546 - DNA, 25 bp, Mus musculus
tacatgttcaaacgtgtccctagat

SEQ ID NO: 761547 - DNA, 25 bp, Mus musculus
tacatgttcaaaggtgtccctagat

SEQ ID NO: 761548 - DNA, 25 bp, Mus musculus
tacatgttgattatgtaccttacaa

SEQ ID NO: 761549 - DNA, 25 bp, Mus musculus
tacatgttgattttgtaccttacaa

SEQ ID NO: 761550 - DNA, 25 bp, Mus musculus
tacatgtttagactacttggtctta

SEQ ID NO: 761551 - DNA, 25 bp, Mus musculus
tacatgtttagagtacttggtctta

SEQ ID NO: 761552 - DNA, 25 bp, Mus musculus
tacatgttttacattttgagcacag

SEQ ID NO: 761553 - DNA, 25 bp, Mus musculus
tacatgttttactttttgagcacag

SEQ ID NO: 761554 - DNA, 25 bp, Mus musculus
tacattaacccacgttctgccactg

SEQ ID NO: 761555 - DNA, 25 bp, Mus musculus
tacattaacccaggttctgccactg

SEQ ID NO: 761556 - DNA, 25 bp, Mus musculus
tacattaagcctagtccatggacca

SEQ ID NO: 761557 - DNA, 25 bp, Mus musculus
tacattaagccttgtccatggacca

SEQ ID NO: 761558 - DNA, 25 bp, Mus musculus
tacattaatttccttctgatagcat

SEQ ID NO: 761559 - DNA, 25 bp, Mus musculus
tacattaatttcgttctgatagcat

SEQ ID NO: 761560 - DNA, 25 bp, Mus musculus
tacattacacatctggcttttccgt

SEQ ID NO: 761561 - DNA, 25 bp, Mus musculus
tacattacacatgtggcttttccgt

SEQ ID NO: 761562 - DNA, 25 bp, Mus musculus
tacattacagtgctgcccagagatt

SEQ ID NO: 761563 - DNA, 25 bp, Mus musculus
tacattacagtggtgcccagagatt

SEQ ID NO: 761564 - DNA, 25 bp, Mus musculus
tacattacggagctcatctggcatc

SEQ ID NO: 761565 - DNA, 25 bp, Mus musculus
tacattacggaggtcatctggcatc

SEQ ID NO: 761566 - DNA, 25 bp, Mus musculus
tacattagccgtcatcccttgtaca

SEQ ID NO: 761567 - DNA, 25 bp, Mus musculus
tacattagccgtgatcccttgtaca

SEQ ID NO: 761568 - DNA, 25 bp, Mus musculus
tacattagtgccattcttccagtga

SEQ ID NO: 761569 - DNA, 25 bp, Mus musculus
tacattagtgcctttcttccagtga

SEQ ID NO: 761570 - DNA, 25 bp, Mus musculus
tacattagttacagtggtggcactt

SEQ ID NO: 761571 - DNA, 25 bp, Mus musculus
tacattagttactgtggtggcactt

SEQ ID NO: 761572 - DNA, 25 bp, Mus musculus
tacattatacatacagcacatttaa

SEQ ID NO: 761573 - DNA, 25 bp, Mus musculus
tacattatacattcagcacatttaa

SEQ ID NO: 761574 - DNA, 25 bp, Mus musculus
tacattatcttgatgagaccagaca

SEQ ID NO: 761575 - DNA, 25 bp, Mus musculus
tacattatcttgttgagaccagaca

SEQ ID NO: 761576 - DNA, 25 bp, Mus musculus
tacattatgactactaacaggagca

SEQ ID NO: 761577 - DNA, 25 bp, Mus musculus
tacattatgacttctaacaggagca

SEQ ID NO: 761578 - DNA, 25 bp, Mus musculus
tacattatggtgacagcatccttca

SEQ ID NO: 761579 - DNA, 25 bp, Mus musculus
tacattatggtgtcagcatccttca

SEQ ID NO: 761580 - DNA, 25 bp, Mus musculus
tacattatgtccactctgaggtctt

SEQ ID NO: 761581 - DNA, 25 bp, Mus musculus
tacattatgtcctctctgaggtctt

SEQ ID NO: 761582 - DNA, 25 bp, Mus musculus
tacattattagtaacctctgggtca

SEQ ID NO: 761583 - DNA, 25 bp, Mus musculus
tacattattagttacctctgggtca

SEQ ID NO: 761584 - DNA, 25 bp, Mus musculus
tacattattgttccagcactgccat

SEQ ID NO: 761585 - DNA, 25 bp, Mus musculus
tacattattgttgcagcactgccat

SEQ ID NO: 761586 - DNA, 25 bp, Mus musculus
tacattcaagagatgcactgtgcag

SEQ ID NO: 761587 - DNA, 25 bp, Mus musculus
tacattcaagagttgcactgtgcag

SEQ ID NO: 761588 - DNA, 25 bp, Mus musculus
tacattcaatgcacagtgctgcctg

SEQ ID NO: 761589 - DNA, 25 bp, Mus musculus
tacattcaatgctcagtgctgcctg

SEQ ID NO: 761590 - DNA, 25 bp, Mus musculus
tacattcacaccagtttactttgag

SEQ ID NO: 761591 - DNA, 25 bp, Mus musculus
tacattcacacctgtttactttgag

SEQ ID NO: 761592 - DNA, 25 bp, Mus musculus
tacattcactggcacttccttaggg

SEQ ID NO: 761593 - DNA, 25 bp, Mus musculus
tacattcactgggacttccttaggg

SEQ ID NO: 761594 - DNA, 25 bp, Mus musculus
tacattcactttagtttttcagcaa

SEQ ID NO: 761595 - DNA, 25 bp, Mus musculus
tacattcacttttgtttttcagcaa

SEQ ID NO: 761596 - DNA, 25 bp, Mus musculus
tacattcagagtcttcccatagctc

SEQ ID NO: 761597 - DNA, 25 bp, Mus musculus
tacattcagagtgttcccatagctc

SEQ ID NO: 761598 - DNA, 25 bp, Mus musculus
tacattcagctcctgcagtagaaag

SEQ ID NO: 761599 - DNA, 25 bp, Mus musculus
tacattcagctcgtgcagtagaaag

SEQ ID NO: 761600 - DNA, 25 bp, Mus musculus
tacattcaggccaaccactgtccaa

SEQ ID NO: 761601 - DNA, 25 bp, Mus musculus
tacattcaggcctaccactgtccaa

SEQ ID NO: 761602 - DNA, 25 bp, Mus musculus
tacattcagtcaaacaaacactcag

SEQ ID NO: 761603 - DNA, 25 bp, Mus musculus
tacattcagtcatacaaacactcag

SEQ ID NO: 761604 - DNA, 25 bp, Mus musculus
tacattccaagaatttccttcagcc

SEQ ID NO: 761605 - DNA, 25 bp, Mus musculus
tacattccaagattttccttcagcc

SEQ ID NO: 761606 - DNA, 25 bp, Mus musculus
tacattccaggaaggcggccggtag

SEQ ID NO: 761607 - DNA, 25 bp, Mus musculus
tacattccaggatggcggccggtag

SEQ ID NO: 761608 - DNA, 25 bp, Mus musculus
tacattccatatatttctgtcaaat

SEQ ID NO: 761609 - DNA, 25 bp, Mus musculus
tacattccatatttttctgtcaaat

SEQ ID NO: 761610 - DNA, 25 bp, Mus musculus
tacattccatcaactgaagcccggt

SEQ ID NO: 761611 - DNA, 25 bp, Mus musculus
tacattccatcatctgaagcccggt

SEQ ID NO: 761612 - DNA, 25 bp, Mus musculus
tacattccatggagtcccacaaggg

SEQ ID NO: 761613 - DNA, 25 bp, Mus musculus
tacattccatggtgtcccacaaggg

SEQ ID NO: 761614 - DNA, 25 bp, Mus musculus
tacattcccaatagcgcatttttct

SEQ ID NO: 761615 - DNA, 25 bp, Mus musculus
tacattcccaattgcgcatttttct

SEQ ID NO: 761616 - DNA, 25 bp, Mus musculus
tacattccccttaataactacctgg

SEQ ID NO: 761617 - DNA, 25 bp, Mus musculus
tacattcccctttataactacctgg

SEQ ID NO: 761618 - DNA, 25 bp, Mus musculus
tacattccctcaccatatcattggc

SEQ ID NO: 761619 - DNA, 25 bp, Mus musculus
tacattccctcagcatatcattggc

SEQ ID NO: 761620 - DNA, 25 bp, Mus musculus
tacattcctgaaacaatttttaggt

SEQ ID NO: 761621 - DNA, 25 bp, Mus musculus
tacattcctgaatcaatttttaggt

SEQ ID NO: 761622 - DNA, 25 bp, Mus musculus
tacattcctggtcggctttctgcat

SEQ ID NO: 761623 - DNA, 25 bp, Mus musculus
tacattcctggtgggctttctgcat

SEQ ID NO: 761624 - DNA, 25 bp, Mus musculus
tacattcgagcccacccagagagag

SEQ ID NO: 761625 - DNA, 25 bp, Mus musculus
tacattcgagccgacccagagagag

SEQ ID NO: 761626 - DNA, 25 bp, Mus musculus
tacattcgctgtattaggtaatcgt

SEQ ID NO: 761627 - DNA, 25 bp, Mus musculus
tacattcgctgttttaggtaatcgt

SEQ ID NO: 761628 - DNA, 25 bp, Mus musculus
tacattcggcgacacactaataggt

SEQ ID NO: 761629 - DNA, 25 bp, Mus musculus
tacattcggcgagacactaataggt

SEQ ID NO: 761630 - DNA, 25 bp, Mus musculus
tacattcgtataaaagctgtcttag

SEQ ID NO: 761631 - DNA, 25 bp, Mus musculus
tacattcgtatataagctgtcttag

SEQ ID NO: 761632 - DNA, 25 bp, Mus musculus
tacattctagcgatgctcatacaca

SEQ ID NO: 761633 - DNA, 25 bp, Mus musculus
tacattctagcgttgctcatacaca

SEQ ID NO: 761634 - DNA, 25 bp, Mus musculus
tacattctcagcacccgaatgaaca

SEQ ID NO: 761635 - DNA, 25 bp, Mus musculus
tacattctcagcctcagcacagtga

SEQ ID NO: 761636 - DNA, 25 bp, Mus musculus
tacattctcagcgtcagcacagtga

SEQ ID NO: 761637 - DNA, 25 bp, Mus musculus
tacattctcagctcccgaatgaaca

SEQ ID NO: 761638 - DNA, 25 bp, Mus musculus
tacattctcagtctagctgctgtct

SEQ ID NO: 761639 - DNA, 25 bp, Mus musculus
tacattctcagtgtagctgctgtct

SEQ ID NO: 761640 - DNA, 25 bp, Mus musculus
tacattctccttctgaactctagtt

SEQ ID NO: 761641 - DNA, 25 bp, Mus musculus
tacattctccttgtgaactctagtt

SEQ ID NO: 761642 - DNA, 25 bp, Mus musculus
tacattctgaccagatctgactttg

SEQ ID NO: 761643 - DNA, 25 bp, Mus musculus
tacattctgacctgatctgactttg

SEQ ID NO: 761644 - DNA, 25 bp, Mus musculus
tacattctgattcggcttttcctct

SEQ ID NO: 761645 - DNA, 25 bp, Mus musculus
tacattctgattgggcttttcctct

SEQ ID NO: 761646 - DNA, 25 bp, Mus musculus
tacattctgctgctatccttgggct

SEQ ID NO: 761647 - DNA, 25 bp, Mus musculus
tacattctgctggtatccttgggct

SEQ ID NO: 761648 - DNA, 25 bp, Mus musculus
tacattctggaaatcttagcatgag

SEQ ID NO: 761649 - DNA, 25 bp, Mus musculus
tacattctggaattcttagcatgag

SEQ ID NO: 761650 - DNA, 25 bp, Mus musculus
tacattctggagctcagtgtttcga

SEQ ID NO: 761651 - DNA, 25 bp, Mus musculus
tacattctggaggtcagtgtttcga

SEQ ID NO: 761652 - DNA, 25 bp, Mus musculus
tacattcttcgtcgatgctcaccat

SEQ ID NO: 761653 - DNA, 25 bp, Mus musculus
tacattcttcgtggatgctcaccat

SEQ ID NO: 761654 - DNA, 25 bp, Mus musculus
tacattcttgtaataacttccctaa

SEQ ID NO: 761655 - DNA, 25 bp, Mus musculus
tacattcttgtattaacttccctaa

SEQ ID NO: 761656 - DNA, 25 bp, Mus musculus
tacattctttaaccctgtttctcct

SEQ ID NO: 761657 - DNA, 25 bp, Mus musculus
tacattctttaagcctgtttctcct

SEQ ID NO: 761658 - DNA, 25 bp, Mus musculus
tacattgaaattcagcacgtgagat

SEQ ID NO: 761659 - DNA, 25 bp, Mus musculus
tacattgaaattgagcacgtgagat

SEQ ID NO: 761660 - DNA, 25 bp, Mus musculus
tacattgacagcataccagcgtgct

SEQ ID NO: 761661 - DNA, 25 bp, Mus musculus
tacattgacagcttaccagcgtgct

SEQ ID NO: 761662 - DNA, 25 bp, Mus musculus
tacattgatatcagtttttggagat

SEQ ID NO: 761663 - DNA, 25 bp, Mus musculus
tacattgatatctgtttttggagat

SEQ ID NO: 761664 - DNA, 25 bp, Mus musculus
tacattgcagaccacctcaaggcag

SEQ ID NO: 761665 - DNA, 25 bp, Mus musculus
tacattgcagacgacctcaaggcag

SEQ ID NO: 761666 - DNA, 25 bp, Mus musculus
tacattgcctatcagtttttgcggg

SEQ ID NO: 761667 - DNA, 25 bp, Mus musculus
tacattgcctatgagtttttgcggg

SEQ ID NO: 761668 - DNA, 25 bp, Mus musculus
tacattgctagtattggttgagaca

SEQ ID NO: 761669 - DNA, 25 bp, Mus musculus
tacattgctagttttggttgagaca

SEQ ID NO: 761670 - DNA, 25 bp, Mus musculus
tacattgctgacagttctttgtgat

SEQ ID NO: 761671 - DNA, 25 bp, Mus musculus
tacattgctgactgttctttgtgat

SEQ ID NO: 761672 - DNA, 25 bp, Mus musculus
tacattgcttccaagtttacagcat

SEQ ID NO: 761673 - DNA, 25 bp, Mus musculus
tacattgcttcctagtttacagcat

SEQ ID NO: 761674 - DNA, 25 bp, Mus musculus
tacattggagtgacccctatctgtt

SEQ ID NO: 761675 - DNA, 25 bp, Mus musculus
tacattggagtgtcccctatctgtt

SEQ ID NO: 761676 - DNA, 25 bp, Mus musculus
tacattggctccctggttaacagct

SEQ ID NO: 761677 - DNA, 25 bp, Mus musculus
tacattggctccgtggttaacagct

SEQ ID NO: 761678 - DNA, 25 bp, Mus musculus
tacattggcttgctatatcaagtct

SEQ ID NO: 761679 - DNA, 25 bp, Mus musculus
tacattggcttggtatatcaagtct

SEQ ID NO: 761680 - DNA, 25 bp, Mus musculus
tacattggtaataagctcctggccc

SEQ ID NO: 761681 - DNA, 25 bp, Mus musculus
tacattggtaattagctcctggccc

SEQ ID NO: 761682 - DNA, 25 bp, Mus musculus
tacattggtcagcaactcgcacaga

SEQ ID NO: 761683 - DNA, 25 bp, Mus musculus
tacattggtcaggaactcgcacaga

SEQ ID NO: 761684 - DNA, 25 bp, Mus musculus
tacattgtaaggcttcaagcagact

SEQ ID NO: 761685 - DNA, 25 bp, Mus musculus
tacattgtaagggttcaagcagact

SEQ ID NO: 761686 - DNA, 25 bp, Mus musculus
tacattgtacacaggcaagacccct

SEQ ID NO: 761687 - DNA, 25 bp, Mus musculus
tacattgtacactggcaagacccct

SEQ ID NO: 761688 - DNA, 25 bp, Mus musculus
tacattgtacctatactgtggctaa

SEQ ID NO: 761689 - DNA, 25 bp, Mus musculus
tacattgtacctttactgtggctaa

SEQ ID NO: 761690 - DNA, 25 bp, Mus musculus
tacattgtagctccttcatctctgg

SEQ ID NO: 761691 - DNA, 25 bp, Mus musculus
tacattgtagctgcttcatctctgg

SEQ ID NO: 761692 - DNA, 25 bp, Mus musculus
tacattgtagtaccttatcacatat

SEQ ID NO: 761693 - DNA, 25 bp, Mus musculus
tacattgtagtagcttatcacatat

SEQ ID NO: 761694 - DNA, 25 bp, Mus musculus
tacattgtatgtagggacactccaa

SEQ ID NO: 761695 - DNA, 25 bp, Mus musculus
tacattgtatgttgggacactccaa

SEQ ID NO: 761696 - DNA, 25 bp, Mus musculus
tacattgtatttacccatgaacatg

SEQ ID NO: 761697 - DNA, 25 bp, Mus musculus
tacattgtattttcccatgaacatg

SEQ ID NO: 761698 - DNA, 25 bp, Mus musculus
tacattgtcatcctgcgcactttga

SEQ ID NO: 761699 - DNA, 25 bp, Mus musculus
tacattgtcatcgtgcgcactttga

SEQ ID NO: 761700 - DNA, 25 bp, Mus musculus
tacattgtcctcaaccacaggccgg

SEQ ID NO: 761701 - DNA, 25 bp, Mus musculus
tacattgtcctccttctatattcag

SEQ ID NO: 761702 - DNA, 25 bp, Mus musculus
tacattgtcctcgttctatattcag

SEQ ID NO: 761703 - DNA, 25 bp, Mus musculus
tacattgtcctctaccacaggccgg

SEQ ID NO: 761704 - DNA, 25 bp, Mus musculus
tacattgtctcacgcctagtgaagc

SEQ ID NO: 761705 - DNA, 25 bp, Mus musculus
tacattgtctcaggcctagtgaagc

SEQ ID NO: 761706 - DNA, 25 bp, Mus musculus
tacattgtgtgaatcatgggccacc

SEQ ID NO: 761707 - DNA, 25 bp, Mus musculus
tacattgtgtgattcatgggccacc

SEQ ID NO: 761708 - DNA, 25 bp, Mus musculus
tacattgtgtgtcaggcaacatcag

SEQ ID NO: 761709 - DNA, 25 bp, Mus musculus
tacattgtgtgtgaggcaacatcag

SEQ ID NO: 761710 - DNA, 25 bp, Mus musculus
tacattgtgttcagctctgcacctt

SEQ ID NO: 761711 - DNA, 25 bp, Mus musculus
tacattgtgttctgctctgcacctt

SEQ ID NO: 761712 - DNA, 25 bp, Mus musculus
tacattgttacgcaggacttggaag

SEQ ID NO: 761713 - DNA, 25 bp, Mus musculus
tacattgttacggaggacttggaag

SEQ ID NO: 761714 - DNA, 25 bp, Mus musculus
tacattgttctgcagtctgacttca

SEQ ID NO: 761715 - DNA, 25 bp, Mus musculus
tacattgttctggagtctgacttca

SEQ ID NO: 761716 - DNA, 25 bp, Mus musculus
tacattgttgcacagctcagggctc

SEQ ID NO: 761717 - DNA, 25 bp, Mus musculus
tacattgttgcagagctcagggctc

SEQ ID NO: 761718 - DNA, 25 bp, Mus musculus
tacattgttttcctaagacagctca

SEQ ID NO: 761719 - DNA, 25 bp, Mus musculus
tacattgttttcgtaagacagctca

SEQ ID NO: 761720 - DNA, 25 bp, Mus musculus
tacatttaatccagagagcttgctg

SEQ ID NO: 761721 - DNA, 25 bp, Mus musculus
tacatttaatcctgagagcttgctg

SEQ ID NO: 761722 - DNA, 25 bp, Mus musculus
tacatttacaaaccaggagacttaa

SEQ ID NO: 761723 - DNA, 25 bp, Mus musculus
tacatttacaaagcaggagacttaa

SEQ ID NO: 761724 - DNA, 25 bp, Mus musculus
tacatttacacaactagcagtcagt

SEQ ID NO: 761725 - DNA, 25 bp, Mus musculus
tacatttacacatctagcagtcagt

SEQ ID NO: 761726 - DNA, 25 bp, Mus musculus
tacatttactgcactgtagctcggg

SEQ ID NO: 761727 - DNA, 25 bp, Mus musculus
tacatttactgcagactttctcaga

SEQ ID NO: 761728 - DNA, 25 bp, Mus musculus
tacatttactgctctgtagctcggg

SEQ ID NO: 761729 - DNA, 25 bp, Mus musculus
tacatttactgctgactttctcaga

SEQ ID NO: 761730 - DNA, 25 bp, Mus musculus
tacatttagtttcatcggctgcttc

SEQ ID NO: 761731 - DNA, 25 bp, Mus musculus
tacatttagtttgatcggctgcttc

SEQ ID NO: 761732 - DNA, 25 bp, Mus musculus
tacatttatatcagttgctttttaa

SEQ ID NO: 761733 - DNA, 25 bp, Mus musculus
tacatttatatctgttgctttttaa

SEQ ID NO: 761734 - DNA, 25 bp, Mus musculus
tacatttatgatcggcatacccaat

SEQ ID NO: 761735 - DNA, 25 bp, Mus musculus
tacatttatgatgggcatacccaat

SEQ ID NO: 761736 - DNA, 25 bp, Mus musculus
tacatttcaaatcctgtctggtgtg

SEQ ID NO: 761737 - DNA, 25 bp, Mus musculus
tacatttcaaatgctgtctggtgtg

SEQ ID NO: 761738 - DNA, 25 bp, Mus musculus
tacatttcacccatgggcaataatg

SEQ ID NO: 761739 - DNA, 25 bp, Mus musculus
tacatttcacccttgggcaataatg

SEQ ID NO: 761740 - DNA, 25 bp, Mus musculus
tacatttcaggacatgacgcattca

SEQ ID NO: 761741 - DNA, 25 bp, Mus musculus
tacatttcaggagatgacgcattca

SEQ ID NO: 761742 - DNA, 25 bp, Mus musculus
tacatttccaggctctgctttactc

SEQ ID NO: 761743 - DNA, 25 bp, Mus musculus
tacatttccagggtctgctttactc

SEQ ID NO: 761744 - DNA, 25 bp, Mus musculus
tacatttccattctggcttcagggc

SEQ ID NO: 761745 - DNA, 25 bp, Mus musculus
tacatttccattgtggcttcagggc

SEQ ID NO: 761746 - DNA, 25 bp, Mus musculus
tacatttcccagcacgccaagcggt

SEQ ID NO: 761747 - DNA, 25 bp, Mus musculus
tacatttcccagcagtctcagcagc

SEQ ID NO: 761748 - DNA, 25 bp, Mus musculus
tacatttcccaggacgccaagcggt

SEQ ID NO: 761749 - DNA, 25 bp, Mus musculus
tacatttcccaggagtctcagcagc

SEQ ID NO: 761750 - DNA, 25 bp, Mus musculus
tacatttcccctcgatggttgttgg

SEQ ID NO: 761751 - DNA, 25 bp, Mus musculus
tacatttcccctggatggttgttgg

SEQ ID NO: 761752 - DNA, 25 bp, Mus musculus
tacatttcccttctcagatctagaa

SEQ ID NO: 761753 - DNA, 25 bp, Mus musculus
tacatttcccttgtcagatctagaa

SEQ ID NO: 761754 - DNA, 25 bp, Mus musculus
tacatttcctaaattcatgaacagg

SEQ ID NO: 761755 - DNA, 25 bp, Mus musculus
tacatttcctaatttcatgaacagg

SEQ ID NO: 761756 - DNA, 25 bp, Mus musculus
tacatttcctggctgatgggcaagt

SEQ ID NO: 761757 - DNA, 25 bp, Mus musculus
tacatttcctgggtgatgggcaagt

SEQ ID NO: 761758 - DNA, 25 bp, Mus musculus
tacatttctagtatcctcctcacaa

SEQ ID NO: 761759 - DNA, 25 bp, Mus musculus
tacatttctagtttcctcctcacaa

SEQ ID NO: 761760 - DNA, 25 bp, Mus musculus
tacatttctcccagcagagttgcta

SEQ ID NO: 761761 - DNA, 25 bp, Mus musculus
tacatttctccctgcagagttgcta

SEQ ID NO: 761762 - DNA, 25 bp, Mus musculus
tacatttcttcaacagtccatccac

SEQ ID NO: 761763 - DNA, 25 bp, Mus musculus
tacatttcttcatcagtccatccac

SEQ ID NO: 761764 - DNA, 25 bp, Mus musculus
tacatttgacacatggaccatcttg

SEQ ID NO: 761765 - DNA, 25 bp, Mus musculus
tacatttgacacttggaccatcttg

SEQ ID NO: 761766 - DNA, 25 bp, Mus musculus
tacatttgacatcggaccagtggag

SEQ ID NO: 761767 - DNA, 25 bp, Mus musculus
tacatttgacatgggaccagtggag

SEQ ID NO: 761768 - DNA, 25 bp, Mus musculus
tacatttgcaaaataactttcccat

SEQ ID NO: 761769 - DNA, 25 bp, Mus musculus
tacatttgcaaattaactttcccat

SEQ ID NO: 761770 - DNA, 25 bp, Mus musculus
tacatttgcatccattcctgtcctt

SEQ ID NO: 761771 - DNA, 25 bp, Mus musculus
tacatttgcatcgattcctgtcctt

SEQ ID NO: 761772 - DNA, 25 bp, Mus musculus
tacatttgcctaaatctctcaaagg

SEQ ID NO: 761773 - DNA, 25 bp, Mus musculus
tacatttgcctatatctctcaaagg

SEQ ID NO: 761774 - DNA, 25 bp, Mus musculus
tacatttgcgttatgccctgttatc

SEQ ID NO: 761775 - DNA, 25 bp, Mus musculus
tacatttgcgttttgccctgttatc

SEQ ID NO: 761776 - DNA, 25 bp, Mus musculus
tacatttgctacatctgcttcacag

SEQ ID NO: 761777 - DNA, 25 bp, Mus musculus
tacatttgctacttctgcttcacag

SEQ ID NO: 761778 - DNA, 25 bp, Mus musculus
tacatttgctgtcccaggggatcaa

SEQ ID NO: 761779 - DNA, 25 bp, Mus musculus
tacatttgctgtgccaggggatcaa

SEQ ID NO: 761780 - DNA, 25 bp, Mus musculus
tacatttggcttagggttcacttta

SEQ ID NO: 761781 - DNA, 25 bp, Mus musculus
tacatttggctttgggttcacttta

SEQ ID NO: 761782 - DNA, 25 bp, Mus musculus
tacatttgtcacatggacccatttt

SEQ ID NO: 761783 - DNA, 25 bp, Mus musculus
tacatttgtcacttggacccatttt

SEQ ID NO: 761784 - DNA, 25 bp, Mus musculus
tacatttgtgcaattctctgaagaa

SEQ ID NO: 761785 - DNA, 25 bp, Mus musculus
tacatttgtgcatttctctgaagaa

SEQ ID NO: 761786 - DNA, 25 bp, Mus musculus
tacattttatctagccaccatgaga

SEQ ID NO: 761787 - DNA, 25 bp, Mus musculus
tacattttatcttgccaccatgaga

SEQ ID NO: 761788 - DNA, 25 bp, Mus musculus
tacattttccacctttactgacagg

SEQ ID NO: 761789 - DNA, 25 bp, Mus musculus
tacattttccacgtttactgacagg

SEQ ID NO: 761790 - DNA, 25 bp, Mus musculus
tacattttctacagcgaaggccggc

SEQ ID NO: 761791 - DNA, 25 bp, Mus musculus
tacattttctactgcgaaggccggc

SEQ ID NO: 761792 - DNA, 25 bp, Mus musculus
tacattttctgtctacccacttttc

SEQ ID NO: 761793 - DNA, 25 bp, Mus musculus
tacattttctgtgtacccacttttc

SEQ ID NO: 761794 - DNA, 25 bp, Mus musculus
tacattttgactattcccctgggtg

SEQ ID NO: 761795 - DNA, 25 bp, Mus musculus
tacattttgacttttcccctgggtg

SEQ ID NO: 761796 - DNA, 25 bp, Mus musculus
tacattttgatcaacagacagcagg

SEQ ID NO: 761797 - DNA, 25 bp, Mus musculus
tacattttgatctacagacagcagg

SEQ ID NO: 761798 - DNA, 25 bp, Mus musculus
tacattttgttacctccctgtcctt

SEQ ID NO: 761799 - DNA, 25 bp, Mus musculus
tacattttgttagctccctgtcctt

SEQ ID NO: 761800 - DNA, 25 bp, Mus musculus
tacatttttaagctccatgtgcata

SEQ ID NO: 761801 - DNA, 25 bp, Mus musculus
tacatttttaaggtccatgtgcata

SEQ ID NO: 761802 - DNA, 25 bp, Mus musculus
tacatttttatgcaccagtacctgg

SEQ ID NO: 761803 - DNA, 25 bp, Mus musculus
tacatttttatggaccagtacctgg

SEQ ID NO: 761804 - DNA, 25 bp, Mus musculus
tacatttttattcattctccagaaa

SEQ ID NO: 761805 - DNA, 25 bp, Mus musculus
tacatttttattgattctccagaaa

SEQ ID NO: 761806 - DNA, 25 bp, Mus musculus
tacatttttctgagtcatcaagaac

SEQ ID NO: 761807 - DNA, 25 bp, Mus musculus
tacatttttctgtgtcatcaagaac

SEQ ID NO: 761808 - DNA, 25 bp, Mus musculus
tacatttttgtaatgtcattccaac

SEQ ID NO: 761809 - DNA, 25 bp, Mus musculus
tacatttttgtacttaacagaacac

SEQ ID NO: 761810 - DNA, 25 bp, Mus musculus
tacatttttgtagttaacagaacac

SEQ ID NO: 761811 - DNA, 25 bp, Mus musculus
tacatttttgtattgtcattccaac

SEQ ID NO: 761812 - DNA, 25 bp, Mus musculus
tacatttttgtgattatgtgccaat

SEQ ID NO: 761813 - DNA, 25 bp, Mus musculus
tacatttttgtgtttatgtgccaat

SEQ ID NO: 761814 - DNA, 25 bp, Mus musculus
tacattttttggagtccgtttgtat

SEQ ID NO: 761815 - DNA, 25 bp, Mus musculus
tacattttttggtgtccgtttgtat

SEQ ID NO: 761816 - DNA, 25 bp, Mus musculus
taccaaaaattcattctcattgcta

SEQ ID NO: 761817 - DNA, 25 bp, Mus musculus
taccaaaaattctttctcattgcta

SEQ ID NO: 761818 - DNA, 25 bp, Mus musculus
taccaaaaatttaccagcttacagt

SEQ ID NO: 761819 - DNA, 25 bp, Mus musculus
taccaaaaattttccagcttacagt

SEQ ID NO: 761820 - DNA, 25 bp, Mus musculus
taccaaaatgtcacgtttgctcagg

SEQ ID NO: 761821 - DNA, 25 bp, Mus musculus
taccaaaatgtctcgtttgctcagg

SEQ ID NO: 761822 - DNA, 25 bp, Mus musculus
taccaaaccaccaagcagaaccttt

SEQ ID NO: 761823 - DNA, 25 bp, Mus musculus
taccaaaccacctagcagaaccttt

SEQ ID NO: 761824 - DNA, 25 bp, Mus musculus
taccaaacctttcgtgggcttggag

SEQ ID NO: 761825 - DNA, 25 bp, Mus musculus
taccaaacctttggtgggcttggag

SEQ ID NO: 761826 - DNA, 25 bp, Mus musculus
taccaaactagcagtgggcagtaca

SEQ ID NO: 761827 - DNA, 25 bp, Mus musculus
taccaaactagctgtgggcagtaca

SEQ ID NO: 761828 - DNA, 25 bp, Mus musculus
taccaaacttgacgcctagagctaa

SEQ ID NO: 761829 - DNA, 25 bp, Mus musculus
taccaaacttgaggcctagagctaa

SEQ ID NO: 761830 - DNA, 25 bp, Mus musculus
taccaaagaaggatctgatggctct

SEQ ID NO: 761831 - DNA, 25 bp, Mus musculus
taccaaagaaggttctgatggctct

SEQ ID NO: 761832 - DNA, 25 bp, Mus musculus
taccaaagactacccaccgtcagga

SEQ ID NO: 761833 - DNA, 25 bp, Mus musculus
taccaaagactagccaccgtcagga

SEQ ID NO: 761834 - DNA, 25 bp, Mus musculus
taccaaagatggcagacaccaccct

SEQ ID NO: 761835 - DNA, 25 bp, Mus musculus
taccaaagatgggagacaccaccct

SEQ ID NO: 761836 - DNA, 25 bp, Mus musculus
taccaaagcacgctagctgccgggt

SEQ ID NO: 761837 - DNA, 25 bp, Mus musculus
taccaaagcacggtagctgccgggt

SEQ ID NO: 761838 - DNA, 25 bp, Mus musculus
taccaaaggcagactatagattcag

SEQ ID NO: 761839 - DNA, 25 bp, Mus musculus
taccaaaggcagtctatagattcag

SEQ ID NO: 761840 - DNA, 25 bp, Mus musculus
taccaaaggctcatgtgcagaaggt

SEQ ID NO: 761841 - DNA, 25 bp, Mus musculus
taccaaaggctcttgtgcagaaggt

SEQ ID NO: 761842 - DNA, 25 bp, Mus musculus
taccaaagggcgaagagagccgtgt

SEQ ID NO: 761843 - DNA, 25 bp, Mus musculus
taccaaagggcgtagagagccgtgt

SEQ ID NO: 761844 - DNA, 25 bp, Mus musculus
taccaaaggtgcaggccatggcata

SEQ ID NO: 761845 - DNA, 25 bp, Mus musculus
taccaaaggtgctggccatggcata

SEQ ID NO: 761846 - DNA, 25 bp, Mus musculus
taccaaagtgttaacttagttcaca

SEQ ID NO: 761847 - DNA, 25 bp, Mus musculus
taccaaagtgtttacttagttcaca

SEQ ID NO: 761848 - DNA, 25 bp, Mus musculus
taccaaagtttacggacacatgtta

SEQ ID NO: 761849 - DNA, 25 bp, Mus musculus
taccaaagtttagggacacatgtta

SEQ ID NO: 761850 - DNA, 25 bp, Mus musculus
taccaaatcctgaaggcctgtacag

SEQ ID NO: 761851 - DNA, 25 bp, Mus musculus
taccaaatcctgtaggcctgtacag

SEQ ID NO: 761852 - DNA, 25 bp, Mus musculus
taccaaatctccagggtttgccaag

SEQ ID NO: 761853 - DNA, 25 bp, Mus musculus
taccaaatctcctgggtttgccaag

SEQ ID NO: 761854 - DNA, 25 bp, Mus musculus
taccaaatgaataaggtcactgcaa

SEQ ID NO: 761855 - DNA, 25 bp, Mus musculus
taccaaatgaattaggtcactgcaa

SEQ ID NO: 761856 - DNA, 25 bp, Mus musculus
taccaaatggcccttcaagcagatg

SEQ ID NO: 761857 - DNA, 25 bp, Mus musculus
taccaaatggccgttcaagcagatg

SEQ ID NO: 761858 - DNA, 25 bp, Mus musculus
taccaaatgggtccagcgtctcctg

SEQ ID NO: 761859 - DNA, 25 bp, Mus musculus
taccaaatgggtgcagcgtctcctg

SEQ ID NO: 761860 - DNA, 25 bp, Mus musculus
taccaacaacaaagtgtgctctgag

SEQ ID NO: 761861 - DNA, 25 bp, Mus musculus
taccaacaacaatgtgtgctctgag

SEQ ID NO: 761862 - DNA, 25 bp, Mus musculus
taccaacaaggtctaaacacttaga

SEQ ID NO: 761863 - DNA, 25 bp, Mus musculus
taccaacaaggtgtaaacacttaga

SEQ ID NO: 761864 - DNA, 25 bp, Mus musculus
taccaacagcgacgcggcgagagct

SEQ ID NO: 761865 - DNA, 25 bp, Mus musculus
taccaacagcgaggcggcgagagct

SEQ ID NO: 761866 - DNA, 25 bp, Mus musculus
taccaacaggtactcggcaaagatt

SEQ ID NO: 761867 - DNA, 25 bp, Mus musculus
taccaacaggtagtcggcaaagatt

SEQ ID NO: 761868 - DNA, 25 bp, Mus musculus
taccaacaggttacgtactcagtcc

SEQ ID NO: 761869 - DNA, 25 bp, Mus musculus
taccaacaggtttcgtactcagtcc

SEQ ID NO: 761870 - DNA, 25 bp, Mus musculus
taccaacatagtaccctactttcct

SEQ ID NO: 761871 - DNA, 25 bp, Mus musculus
taccaacatagttccctactttcct

SEQ ID NO: 761872 - DNA, 25 bp, Mus musculus
taccaaccagctccacaagtgcatt

SEQ ID NO: 761873 - DNA, 25 bp, Mus musculus
taccaaccagctgcacaagtgcatt

SEQ ID NO: 761874 - DNA, 25 bp, Mus musculus
taccaacccagtatggaccatgaga

SEQ ID NO: 761875 - DNA, 25 bp, Mus musculus
taccaacccagtttggaccatgaga

SEQ ID NO: 761876 - DNA, 25 bp, Mus musculus
taccaaccgaataacatcaacagtc

SEQ ID NO: 761877 - DNA, 25 bp, Mus musculus
taccaaccgaattacatcaacagtc

SEQ ID NO: 761878 - DNA, 25 bp, Mus musculus
taccaacctctcagtaaatgctgtc

SEQ ID NO: 761879 - DNA, 25 bp, Mus musculus
taccaacctctctgtaaatgctgtc

SEQ ID NO: 761880 - DNA, 25 bp, Mus musculus
taccaacctggcaaagtaccgcaag

SEQ ID NO: 761881 - DNA, 25 bp, Mus musculus
taccaacctggctaagtaccgcaag

SEQ ID NO: 761882 - DNA, 25 bp, Mus musculus
taccaacctgttaggccgaggcatg

SEQ ID NO: 761883 - DNA, 25 bp, Mus musculus
taccaacctgtttggccgaggcatg

SEQ ID NO: 761884 - DNA, 25 bp, Mus musculus
taccaacgaaacaattctcgcaagg

SEQ ID NO: 761885 - DNA, 25 bp, Mus musculus
taccaacgaaactattctcgcaagg

SEQ ID NO: 761886 - DNA, 25 bp, Mus musculus
taccaacgcttgacagagatcacag

SEQ ID NO: 761887 - DNA, 25 bp, Mus musculus
taccaacgcttgtcagagatcacag

SEQ ID NO: 761888 - DNA, 25 bp, Mus musculus
taccaactagccctacaagcaagaa

SEQ ID NO: 761889 - DNA, 25 bp, Mus musculus
taccaactagccgtacaagcaagaa

SEQ ID NO: 761890 - DNA, 25 bp, Mus musculus
taccaactcagcaggtcagtggaca

SEQ ID NO: 761891 - DNA, 25 bp, Mus musculus
taccaactcagctggtcagtggaca

SEQ ID NO: 761892 - DNA, 25 bp, Mus musculus
taccaactcaggccttcttattaaa

SEQ ID NO: 761893 - DNA, 25 bp, Mus musculus
taccaactcagggcttcttattaaa

SEQ ID NO: 761894 - DNA, 25 bp, Mus musculus
taccaactgtatccacggaaaacca

SEQ ID NO: 761895 - DNA, 25 bp, Mus musculus
taccaactgtatgcacggaaaacca

SEQ ID NO: 761896 - DNA, 25 bp, Mus musculus
taccaacttaagagaaaccaaccag

SEQ ID NO: 761897 - DNA, 25 bp, Mus musculus
taccaacttaagtgaaaccaaccag

SEQ ID NO: 761898 - DNA, 25 bp, Mus musculus
taccaacttcagaccagagagttct

SEQ ID NO: 761899 - DNA, 25 bp, Mus musculus
taccaacttcagtccagagagttct

SEQ ID NO: 761900 - DNA, 25 bp, Mus musculus
taccaacttgtaagcactttagaat

SEQ ID NO: 761901 - DNA, 25 bp, Mus musculus
taccaacttgtatgcactttagaat

SEQ ID NO: 761902 - DNA, 25 bp, Mus musculus
taccaacttgttctgaattatgtta

SEQ ID NO: 761903 - DNA, 25 bp, Mus musculus
taccaacttgttgtgaattatgtta

SEQ ID NO: 761904 - DNA, 25 bp, Mus musculus
taccaagaacggacaaagtgccaac

SEQ ID NO: 761905 - DNA, 25 bp, Mus musculus
taccaagaacggtcaaagtgccaac

SEQ ID NO: 761906 - DNA, 25 bp, Mus musculus
taccaagacctcacagatgttttct

SEQ ID NO: 761907 - DNA, 25 bp, Mus musculus
taccaagacctctcagatgttttct

SEQ ID NO: 761908 - DNA, 25 bp, Mus musculus
taccaagacctgactaactacagat

SEQ ID NO: 761909 - DNA, 25 bp, Mus musculus
taccaagacctgtctaactacagat

SEQ ID NO: 761910 - DNA, 25 bp, Mus musculus
taccaagacgggagcagcacgctac

SEQ ID NO: 761911 - DNA, 25 bp, Mus musculus
taccaagacgggtgcagcacgctac

SEQ ID NO: 761912 - DNA, 25 bp, Mus musculus
taccaagactatcagcctgaagcct

SEQ ID NO: 761913 - DNA, 25 bp, Mus musculus
taccaagactatgagcctgaagcct

SEQ ID NO: 761914 - DNA, 25 bp, Mus musculus
taccaagactgtcagaccttcggaa

SEQ ID NO: 761915 - DNA, 25 bp, Mus musculus
taccaagactgtgagaccttcggaa

SEQ ID NO: 761916 - DNA, 25 bp, Mus musculus
taccaagactttactattttgttga

SEQ ID NO: 761917 - DNA, 25 bp, Mus musculus
taccaagacttttctattttgttga

SEQ ID NO: 761918 - DNA, 25 bp, Mus musculus
taccaagagactcatacttaggccc

SEQ ID NO: 761919 - DNA, 25 bp, Mus musculus
taccaagagactgatacttaggccc

SEQ ID NO: 761920 - DNA, 25 bp, Mus musculus
taccaagatgccatcactgattaag

SEQ ID NO: 761921 - DNA, 25 bp, Mus musculus
taccaagatgccttcactgattaag

SEQ ID NO: 761922 - DNA, 25 bp, Mus musculus
taccaagattaccttccccaaagag

SEQ ID NO: 761923 - DNA, 25 bp, Mus musculus
taccaagattacgttccccaaagag

SEQ ID NO: 761924 - DNA, 25 bp, Mus musculus
taccaagcacacacactttcctgat

SEQ ID NO: 761925 - DNA, 25 bp, Mus musculus
taccaagcacactcactttcctgat

SEQ ID NO: 761926 - DNA, 25 bp, Mus musculus
taccaagcagtcctgtgttctcaga

SEQ ID NO: 761927 - DNA, 25 bp, Mus musculus
taccaagcagtcgtgtgttctcaga

SEQ ID NO: 761928 - DNA, 25 bp, Mus musculus
taccaagccaccaacagagatgcct

SEQ ID NO: 761929 - DNA, 25 bp, Mus musculus
taccaagccacctacagagatgcct

SEQ ID NO: 761930 - DNA, 25 bp, Mus musculus
taccaagccacgagctgcccttggt

SEQ ID NO: 761931 - DNA, 25 bp, Mus musculus
taccaagccacgtgctgcccttggt

SEQ ID NO: 761932 - DNA, 25 bp, Mus musculus
taccaagcgtggagggctgatttct

SEQ ID NO: 761933 - DNA, 25 bp, Mus musculus
taccaagcgtggtgggctgatttct

SEQ ID NO: 761934 - DNA, 25 bp, Mus musculus
taccaagctggcaacctatcagttt

SEQ ID NO: 761935 - DNA, 25 bp, Mus musculus
taccaagctggctacctatcagttt

SEQ ID NO: 761936 - DNA, 25 bp, Mus musculus
taccaaggaatcactccaacaactg

SEQ ID NO: 761937 - DNA, 25 bp, Mus musculus
taccaaggaatctctccaacaactg

SEQ ID NO: 761938 - DNA, 25 bp, Mus musculus
taccaaggatgaaggctgctaccgg

SEQ ID NO: 761939 - DNA, 25 bp, Mus musculus
taccaaggatgatggctgctaccgg

SEQ ID NO: 761940 - DNA, 25 bp, Mus musculus
taccaaggctcaaccaatagtccct

SEQ ID NO: 761941 - DNA, 25 bp, Mus musculus
taccaaggctcatccaatagtccct

SEQ ID NO: 761942 - DNA, 25 bp, Mus musculus
taccaagggacccatctgtcagcat

SEQ ID NO: 761943 - DNA, 25 bp, Mus musculus
taccaagggaccgatctgtcagcat

SEQ ID NO: 761944 - DNA, 25 bp, Mus musculus
taccaagggcctcaaggtgtacctg

SEQ ID NO: 761945 - DNA, 25 bp, Mus musculus
taccaagggcctgaaggtgtacctg

SEQ ID NO: 761946 - DNA, 25 bp, Mus musculus
taccaaggtcttactgtctctattc

SEQ ID NO: 761947 - DNA, 25 bp, Mus musculus
taccaaggtctttctgtctctattc

SEQ ID NO: 761948 - DNA, 25 bp, Mus musculus
taccaagtaccgcaaaggtgcatgt

SEQ ID NO: 761949 - DNA, 25 bp, Mus musculus
taccaagtaccggaaaggtgcatgt

SEQ ID NO: 761950 - DNA, 25 bp, Mus musculus
taccaagtagttcacctttctaatt

SEQ ID NO: 761951 - DNA, 25 bp, Mus musculus
taccaagtagttgacctttctaatt

SEQ ID NO: 761952 - DNA, 25 bp, Mus musculus
taccaagtattaaaactgtcatcct

SEQ ID NO: 761953 - DNA, 25 bp, Mus musculus
taccaagtattataactgtcatcct

SEQ ID NO: 761954 - DNA, 25 bp, Mus musculus
taccaagtccatctgtgaatgattt

SEQ ID NO: 761955 - DNA, 25 bp, Mus musculus
taccaagtccatgtgtgaatgattt

SEQ ID NO: 761956 - DNA, 25 bp, Mus musculus
taccaagtctatattaaagcgacgc

SEQ ID NO: 761957 - DNA, 25 bp, Mus musculus
taccaagtctattttaaagcgacgc

SEQ ID NO: 761958 - DNA, 25 bp, Mus musculus
taccaagtgataaatcaagccagaa

SEQ ID NO: 761959 - DNA, 25 bp, Mus musculus
taccaagtgatatatcaagccagaa

SEQ ID NO: 761960 - DNA, 25 bp, Mus musculus
taccaagtgcagcagtgcaggaccc

SEQ ID NO: 761961 - DNA, 25 bp, Mus musculus
taccaagtgcaggagtgcaggaccc

SEQ ID NO: 761962 - DNA, 25 bp, Mus musculus
taccaagtgctgagttctgacctaa

SEQ ID NO: 761963 - DNA, 25 bp, Mus musculus
taccaagtgctgtgttctgacctaa

SEQ ID NO: 761964 - DNA, 25 bp, Mus musculus
taccaagtggtgatatagttgttaa

SEQ ID NO: 761965 - DNA, 25 bp, Mus musculus
taccaagtggtgttatagttgttaa

SEQ ID NO: 761966 - DNA, 25 bp, Mus musculus
taccaagtgtgcatcgctgagtcct

SEQ ID NO: 761967 - DNA, 25 bp, Mus musculus
taccaagtgtgcttcgctgagtcct

SEQ ID NO: 761968 - DNA, 25 bp, Mus musculus
taccaagtttccagacatgatccat

SEQ ID NO: 761969 - DNA, 25 bp, Mus musculus
taccaagtttcctgacatgatccat

SEQ ID NO: 761970 - DNA, 25 bp, Mus musculus
taccaataacaaaaggctgatgctg

SEQ ID NO: 761971 - DNA, 25 bp, Mus musculus
taccaataacaataggctgatgctg

SEQ ID NO: 761972 - DNA, 25 bp, Mus musculus
taccaataatttcggcctagagttc

SEQ ID NO: 761973 - DNA, 25 bp, Mus musculus
taccaataatttgggcctagagttc

SEQ ID NO: 761974 - DNA, 25 bp, Mus musculus
taccaatacagtagggcacacggct

SEQ ID NO: 761975 - DNA, 25 bp, Mus musculus
taccaatacagttgggcacacggct

SEQ ID NO: 761976 - DNA, 25 bp, Mus musculus
taccaataccaaaacgttcttgcaa

SEQ ID NO: 761977 - DNA, 25 bp, Mus musculus
taccaataccaatacgttcttgcaa

SEQ ID NO: 761978 - DNA, 25 bp, Mus musculus
taccaatatgcaattctcggaagcg

SEQ ID NO: 761979 - DNA, 25 bp, Mus musculus
taccaatatgcatttctcggaagcg

SEQ ID NO: 761980 - DNA, 25 bp, Mus musculus
taccaatcaggtcagtttcacgcgt

SEQ ID NO: 761981 - DNA, 25 bp, Mus musculus
taccaatcaggtgagtttcacgcgt

SEQ ID NO: 761982 - DNA, 25 bp, Mus musculus
taccaatcatccactcttatcatta

SEQ ID NO: 761983 - DNA, 25 bp, Mus musculus
taccaatcatcctctcttatcatta

SEQ ID NO: 761984 - DNA, 25 bp, Mus musculus
taccaatgaccacctatccactttt

SEQ ID NO: 761985 - DNA, 25 bp, Mus musculus
taccaatgaccagctatccactttt

SEQ ID NO: 761986 - DNA, 25 bp, Mus musculus
taccaatgattgcacgactcctgac

SEQ ID NO: 761987 - DNA, 25 bp, Mus musculus
taccaatgattggacgactcctgac

SEQ ID NO: 761988 - DNA, 25 bp, Mus musculus
taccaatgcagcaactttcaacttc

SEQ ID NO: 761989 - DNA, 25 bp, Mus musculus
taccaatgcagctactttcaacttc

SEQ ID NO: 761990 - DNA, 25 bp, Mus musculus
taccaatgcctgcactgtggcaagc

SEQ ID NO: 761991 - DNA, 25 bp, Mus musculus
taccaatgcctggactgtggcaagc

SEQ ID NO: 761992 - DNA, 25 bp, Mus musculus
taccaatggctactgttgtgggatt

SEQ ID NO: 761993 - DNA, 25 bp, Mus musculus
taccaatggctagtgttgtgggatt

SEQ ID NO: 761994 - DNA, 25 bp, Mus musculus
taccaatggctcagggtcttaattt

SEQ ID NO: 761995 - DNA, 25 bp, Mus musculus
taccaatggctctgggtcttaattt

SEQ ID NO: 761996 - DNA, 25 bp, Mus musculus
taccaatggcttcctaaaaagaaaa

SEQ ID NO: 761997 - DNA, 25 bp, Mus musculus
taccaatggcttgctaaaaagaaaa

SEQ ID NO: 761998 - DNA, 25 bp, Mus musculus
taccaattatgtcctgcccaacaac

SEQ ID NO: 761999 - DNA, 25 bp, Mus musculus
taccaattatgtgctgcccaacaac

SEQ ID NO: 762000 - DNA, 25 bp, Mus musculus
taccaattggcaagccggcctcaga

SEQ ID NO: 762001 - DNA, 25 bp, Mus musculus
taccaattggcatgccggcctcaga

SEQ ID NO: 762002 - DNA, 25 bp, Mus musculus
taccaatttaacaactgcaccagcc

SEQ ID NO: 762003 - DNA, 25 bp, Mus musculus
taccaatttaacaatggcatggaaa

SEQ ID NO: 762004 - DNA, 25 bp, Mus musculus
taccaatttaactactgcaccagcc

SEQ ID NO: 762005 - DNA, 25 bp, Mus musculus
taccaatttaactatggcatggaaa

SEQ ID NO: 762006 - DNA, 25 bp, Mus musculus
taccaatttcacatcggagctgcgt

SEQ ID NO: 762007 - DNA, 25 bp, Mus musculus
taccaatttcacttcggagctgcgt

SEQ ID NO: 762008 - DNA, 25 bp, Mus musculus
taccaatttctgacccattttgtat

SEQ ID NO: 762009 - DNA, 25 bp, Mus musculus
taccaatttctgtcccattttgtat

SEQ ID NO: 762010 - DNA, 25 bp, Mus musculus
taccacaagggtactgtgctctccg

SEQ ID NO: 762011 - DNA, 25 bp, Mus musculus
taccacaagggttctgtgctctccg

SEQ ID NO: 762012 - DNA, 25 bp, Mus musculus
taccacaatccgagttgcagtgcag

SEQ ID NO: 762013 - DNA, 25 bp, Mus musculus
taccacaatccgtgttgcagtgcag

SEQ ID NO: 762014 - DNA, 25 bp, Mus musculus
taccacaatgctatgtttgtctgtg

SEQ ID NO: 762015 - DNA, 25 bp, Mus musculus
taccacaatgctttgtttgtctgtg

SEQ ID NO: 762016 - DNA, 25 bp, Mus musculus
taccacacagcaacaagtggccttg

SEQ ID NO: 762017 - DNA, 25 bp, Mus musculus
taccacacagcatcaagtggccttg

SEQ ID NO: 762018 - DNA, 25 bp, Mus musculus
taccacaccaagacacgggcagtga

SEQ ID NO: 762019 - DNA, 25 bp, Mus musculus
taccacaccaagctgggtttctttg

SEQ ID NO: 762020 - DNA, 25 bp, Mus musculus
taccacaccaaggtgggtttctttg

SEQ ID NO: 762021 - DNA, 25 bp, Mus musculus
taccacaccaagtcacgggcagtga

SEQ ID NO: 762022 - DNA, 25 bp, Mus musculus
taccacaccagtatttcgacttaag

SEQ ID NO: 762023 - DNA, 25 bp, Mus musculus
taccacaccagtttttcgacttaag

SEQ ID NO: 762024 - DNA, 25 bp, Mus musculus
taccacacccggacaggtggaacat

SEQ ID NO: 762025 - DNA, 25 bp, Mus musculus
taccacacccggtcaggtggaacat

SEQ ID NO: 762026 - DNA, 25 bp, Mus musculus
taccacaccgtgctacagggaggga

SEQ ID NO: 762027 - DNA, 25 bp, Mus musculus
taccacaccgtggtacagggaggga

SEQ ID NO: 762028 - DNA, 25 bp, Mus musculus
taccacaccgttaatcagatctctg

SEQ ID NO: 762029 - DNA, 25 bp, Mus musculus
taccacaccgtttatcagatctctg

SEQ ID NO: 762030 - DNA, 25 bp, Mus musculus
taccacacgcatagtcaaactccta

SEQ ID NO: 762031 - DNA, 25 bp, Mus musculus
taccacacgcattgtcaaactccta

SEQ ID NO: 762032 - DNA, 25 bp, Mus musculus
taccacacgtggagtctaactgagg

SEQ ID NO: 762033 - DNA, 25 bp, Mus musculus
taccacacgtggtgtctaactgagg

SEQ ID NO: 762034 - DNA, 25 bp, Mus musculus
taccacagcagtagtttcagccagt

SEQ ID NO: 762035 - DNA, 25 bp, Mus musculus
taccacagcagttgtttcagccagt

SEQ ID NO: 762036 - DNA, 25 bp, Mus musculus
taccacagcgtgatttggaacaaca

SEQ ID NO: 762037 - DNA, 25 bp, Mus musculus
taccacagcgtgttttggaacaaca

SEQ ID NO: 762038 - DNA, 25 bp, Mus musculus
taccacagggttctcatgccaaggc

SEQ ID NO: 762039 - DNA, 25 bp, Mus musculus
taccacagggttgtcatgccaaggc

SEQ ID NO: 762040 - DNA, 25 bp, Mus musculus
taccacaggtggcatctggacactt

SEQ ID NO: 762041 - DNA, 25 bp, Mus musculus
taccacaggtgggatctggacactt

SEQ ID NO: 762042 - DNA, 25 bp, Mus musculus
taccacagtcttctaaaaacctaca

SEQ ID NO: 762043 - DNA, 25 bp, Mus musculus
taccacagtcttgtaaaaacctaca

SEQ ID NO: 762044 - DNA, 25 bp, Mus musculus
taccacagtggacagcccggcagag

SEQ ID NO: 762045 - DNA, 25 bp, Mus musculus
taccacagtggagagcccggcagag

SEQ ID NO: 762046 - DNA, 25 bp, Mus musculus
taccacagtggcagtgtcttttctg

SEQ ID NO: 762047 - DNA, 25 bp, Mus musculus
taccacagtggctgtgtcttttctg

SEQ ID NO: 762048 - DNA, 25 bp, Mus musculus
taccacagttatctttgcccactgt

SEQ ID NO: 762049 - DNA, 25 bp, Mus musculus
taccacagttatgtttgcccactgt

SEQ ID NO: 762050 - DNA, 25 bp, Mus musculus
taccacataacaatttttcccctcg

SEQ ID NO: 762051 - DNA, 25 bp, Mus musculus
taccacataacattttttcccctcg

SEQ ID NO: 762052 - DNA, 25 bp, Mus musculus
taccacatatatcccttgcctctta

SEQ ID NO: 762053 - DNA, 25 bp, Mus musculus
taccacatatatgccttgcctctta

SEQ ID NO: 762054 - DNA, 25 bp, Mus musculus
taccacatcatcacagagccaactt

SEQ ID NO: 762055 - DNA, 25 bp, Mus musculus
taccacatcatctcagagccaactt

SEQ ID NO: 762056 - DNA, 25 bp, Mus musculus
taccacatctggctatttttaggtt

SEQ ID NO: 762057 - DNA, 25 bp, Mus musculus
taccacatctgggtatttttaggtt

SEQ ID NO: 762058 - DNA, 25 bp, Mus musculus
taccacatcttcagtctgctggagg

SEQ ID NO: 762059 - DNA, 25 bp, Mus musculus
taccacatcttctgtctgctggagg

SEQ ID NO: 762060 - DNA, 25 bp, Mus musculus
taccacatgggtcttcgggatcaaa

SEQ ID NO: 762061 - DNA, 25 bp, Mus musculus
taccacatgggtgttcgggatcaaa

SEQ ID NO: 762062 - DNA, 25 bp, Mus musculus
taccacatggtcaatgtagccctag

SEQ ID NO: 762063 - DNA, 25 bp, Mus musculus
taccacatggtctatgtagccctag

SEQ ID NO: 762064 - DNA, 25 bp, Mus musculus
taccacatgtcgctacttattctgt

SEQ ID NO: 762065 - DNA, 25 bp, Mus musculus
taccacatgtcggtacttattctgt

SEQ ID NO: 762066 - DNA, 25 bp, Mus musculus
taccacattgtgataggattctgaa

SEQ ID NO: 762067 - DNA, 25 bp, Mus musculus
taccacattgtgttaggattctgaa

SEQ ID NO: 762068 - DNA, 25 bp, Mus musculus
taccaccaaatactgtacttttcag

SEQ ID NO: 762069 - DNA, 25 bp, Mus musculus
taccaccaaatagtgtacttttcag

SEQ ID NO: 762070 - DNA, 25 bp, Mus musculus
taccaccaacatcggccaacagttt

SEQ ID NO: 762071 - DNA, 25 bp, Mus musculus
taccaccaacatgggccaacagttt

SEQ ID NO: 762072 - DNA, 25 bp, Mus musculus
taccaccaacctaaacaacctgagt

SEQ ID NO: 762073 - DNA, 25 bp, Mus musculus
taccaccaaccttaacaacctgagt

SEQ ID NO: 762074 - DNA, 25 bp, Mus musculus
taccaccaacttcataaacgacaca

SEQ ID NO: 762075 - DNA, 25 bp, Mus musculus
taccaccaacttgataaacgacaca

SEQ ID NO: 762076 - DNA, 25 bp, Mus musculus
taccaccaagcccaggttggtattt

SEQ ID NO: 762077 - DNA, 25 bp, Mus musculus
taccaccaagccgaggttggtattt

SEQ ID NO: 762078 - DNA, 25 bp, Mus musculus
taccaccaaggacacatcactgatg

SEQ ID NO: 762079 - DNA, 25 bp, Mus musculus
taccaccaaggagacatcactgatg

SEQ ID NO: 762080 - DNA, 25 bp, Mus musculus
taccaccaagtgaagcttttacaag

SEQ ID NO: 762081 - DNA, 25 bp, Mus musculus
taccaccaagtgtagcttttacaag

SEQ ID NO: 762082 - DNA, 25 bp, Mus musculus
taccaccacagaaaatcatactggg

SEQ ID NO: 762083 - DNA, 25 bp, Mus musculus
taccaccacagacccaataagtttt

SEQ ID NO: 762084 - DNA, 25 bp, Mus musculus
taccaccacagagccaataagtttt

SEQ ID NO: 762085 - DNA, 25 bp, Mus musculus
taccaccacagataatcatactggg

SEQ ID NO: 762086 - DNA, 25 bp, Mus musculus
taccaccacatgagtaattacagat

SEQ ID NO: 762087 - DNA, 25 bp, Mus musculus
taccaccacatgtgtaattacagat

SEQ ID NO: 762088 - DNA, 25 bp, Mus musculus
taccaccaccagcaataattgacaa

SEQ ID NO: 762089 - DNA, 25 bp, Mus musculus
taccaccaccaggaataattgacaa

SEQ ID NO: 762090 - DNA, 25 bp, Mus musculus
taccaccaccctaattagcagacga

SEQ ID NO: 762091 - DNA, 25 bp, Mus musculus
taccaccacccttattagcagacga

SEQ ID NO: 762092 - DNA, 25 bp, Mus musculus
taccaccagccaaatgacttttcct

SEQ ID NO: 762093 - DNA, 25 bp, Mus musculus
taccaccagccatatgacttttcct

SEQ ID NO: 762094 - DNA, 25 bp, Mus musculus
taccaccaggcacctgaatgggttt

SEQ ID NO: 762095 - DNA, 25 bp, Mus musculus
taccaccaggcagctgaatgggttt

SEQ ID NO: 762096 - DNA, 25 bp, Mus musculus
taccaccataccagtccttgattta

SEQ ID NO: 762097 - DNA, 25 bp, Mus musculus
taccaccatacctgtccttgattta

SEQ ID NO: 762098 - DNA, 25 bp, Mus musculus
taccaccatactctgcagaagtctg

SEQ ID NO: 762099 - DNA, 25 bp, Mus musculus
taccaccatactgtgcagaagtctg

SEQ ID NO: 762100 - DNA, 25 bp, Mus musculus
taccaccatcaccatatcactataa

SEQ ID NO: 762101 - DNA, 25 bp, Mus musculus
taccaccatcacgatatcactataa

SEQ ID NO: 762102 - DNA, 25 bp, Mus musculus
taccaccatgcaaaacttcctgttt

SEQ ID NO: 762103 - DNA, 25 bp, Mus musculus
taccaccatgcataacttcctgttt

SEQ ID NO: 762104 - DNA, 25 bp, Mus musculus
taccacccactgctgtggatttgaa

SEQ ID NO: 762105 - DNA, 25 bp, Mus musculus
taccacccactggtgtggatttgaa

SEQ ID NO: 762106 - DNA, 25 bp, Mus musculus
taccaccccacacagcctatattta

SEQ ID NO: 762107 - DNA, 25 bp, Mus musculus
taccaccccacagagcctatattta

SEQ ID NO: 762108 - DNA, 25 bp, Mus musculus
taccaccccggcagaagagctagtg

SEQ ID NO: 762109 - DNA, 25 bp, Mus musculus
taccaccccggctgaagagctagtg

SEQ ID NO: 762110 - DNA, 25 bp, Mus musculus
taccaccctatacacactgacagag

SEQ ID NO: 762111 - DNA, 25 bp, Mus musculus
taccaccctatagacactgacagag

SEQ ID NO: 762112 - DNA, 25 bp, Mus musculus
taccaccgcagcagtgaatgactgt

SEQ ID NO: 762113 - DNA, 25 bp, Mus musculus
taccaccgcagctgtgaatgactgt

SEQ ID NO: 762114 - DNA, 25 bp, Mus musculus
taccaccggtgtctgaagaccatga

SEQ ID NO: 762115 - DNA, 25 bp, Mus musculus
taccaccggtgtgtgaagaccatga

SEQ ID NO: 762116 - DNA, 25 bp, Mus musculus
taccaccgtgagcacatgaccagga

SEQ ID NO: 762117 - DNA, 25 bp, Mus musculus
taccaccgtgaggacatgaccagga

SEQ ID NO: 762118 - DNA, 25 bp, Mus musculus
taccaccgttgccttttcaagaacg

SEQ ID NO: 762119 - DNA, 25 bp, Mus musculus
taccaccgttgcgttttcaagaacg

SEQ ID NO: 762120 - DNA, 25 bp, Mus musculus
taccacctaagtctattttggaact

SEQ ID NO: 762121 - DNA, 25 bp, Mus musculus
taccacctaagtgtattttggaact

SEQ ID NO: 762122 - DNA, 25 bp, Mus musculus
taccacctacaaagtgtgggcctgg

SEQ ID NO: 762123 - DNA, 25 bp, Mus musculus
taccacctacaatgtgtgggcctgg

SEQ ID NO: 762124 - DNA, 25 bp, Mus musculus
taccacctacggcttcagtcagaaa

SEQ ID NO: 762125 - DNA, 25 bp, Mus musculus
taccacctacgggttcagtcagaaa

SEQ ID NO: 762126 - DNA, 25 bp, Mus musculus
taccacctagaaactgagctgtccc

SEQ ID NO: 762127 - DNA, 25 bp, Mus musculus
taccacctagaatctgagctgtccc

SEQ ID NO: 762128 - DNA, 25 bp, Mus musculus
taccacctagctatgctttctcaac

SEQ ID NO: 762129 - DNA, 25 bp, Mus musculus
taccacctagctttgctttctcaac

SEQ ID NO: 762130 - DNA, 25 bp, Mus musculus
taccacctcaacaggactttgtcca

SEQ ID NO: 762131 - DNA, 25 bp, Mus musculus
taccacctcaactggactttgtcca

SEQ ID NO: 762132 - DNA, 25 bp, Mus musculus
taccacctgaagctgaattccactt

SEQ ID NO: 762133 - DNA, 25 bp, Mus musculus
taccacctgaaggtgaattccactt

SEQ ID NO: 762134 - DNA, 25 bp, Mus musculus
taccacctgccgaagctttcagtaa

SEQ ID NO: 762135 - DNA, 25 bp, Mus musculus
taccacctgccgtagctttcagtaa

SEQ ID NO: 762136 - DNA, 25 bp, Mus musculus
taccacctgcttatacacacatgag

SEQ ID NO: 762137 - DNA, 25 bp, Mus musculus
taccacctgcttttacacacatgag

SEQ ID NO: 762138 - DNA, 25 bp, Mus musculus
taccacctggcaacattcagtttgg

SEQ ID NO: 762139 - DNA, 25 bp, Mus musculus
taccacctggcatcattcagtttgg

SEQ ID NO: 762140 - DNA, 25 bp, Mus musculus
taccacctgtataccccaaagaaat

SEQ ID NO: 762141 - DNA, 25 bp, Mus musculus
taccacctgtattccccaaagaaat

SEQ ID NO: 762142 - DNA, 25 bp, Mus musculus
taccaccttacccaaagattcagat

SEQ ID NO: 762143 - DNA, 25 bp, Mus musculus
taccaccttaccgaaagattcagat

SEQ ID NO: 762144 - DNA, 25 bp, Mus musculus
taccaccttatcacaataccacatt

SEQ ID NO: 762145 - DNA, 25 bp, Mus musculus
taccaccttatctcaataccacatt

SEQ ID NO: 762146 - DNA, 25 bp, Mus musculus
taccacgacaggcaggaggagcatt

SEQ ID NO: 762147 - DNA, 25 bp, Mus musculus
taccacgacagggaggaggagcatt

SEQ ID NO: 762148 - DNA, 25 bp, Mus musculus
taccacgagaacactgcggccgagg

SEQ ID NO: 762149 - DNA, 25 bp, Mus musculus
taccacgagaactctgcggccgagg

SEQ ID NO: 762150 - DNA, 25 bp, Mus musculus
taccacgcctgacttgttttggttt

SEQ ID NO: 762151 - DNA, 25 bp, Mus musculus
taccacgcctgagttgttttggttt

SEQ ID NO: 762152 - DNA, 25 bp, Mus musculus
taccacgcggccatttttggaggaa

SEQ ID NO: 762153 - DNA, 25 bp, Mus musculus
taccacgcggccttttttggaggaa

SEQ ID NO: 762154 - DNA, 25 bp, Mus musculus
taccacggagcacaaaggatgacaa

SEQ ID NO: 762155 - DNA, 25 bp, Mus musculus
taccacggagcagaaaggatgacaa

SEQ ID NO: 762156 - DNA, 25 bp, Mus musculus
taccacggagtgagcctgttgattc

SEQ ID NO: 762157 - DNA, 25 bp, Mus musculus
taccacggagtgtgcctgttgattc

SEQ ID NO: 762158 - DNA, 25 bp, Mus musculus
taccacggcataaggaagactctcc

SEQ ID NO: 762159 - DNA, 25 bp, Mus musculus
taccacggcatatggaagactctcc

SEQ ID NO: 762160 - DNA, 25 bp, Mus musculus
taccacggcttcatatttacagttg

SEQ ID NO: 762161 - DNA, 25 bp, Mus musculus
taccacggcttcttatttacagttg

SEQ ID NO: 762162 - DNA, 25 bp, Mus musculus
taccacggtctgaacgtaacaggct

SEQ ID NO: 762163 - DNA, 25 bp, Mus musculus
taccacggtctgtacgtaacaggct

SEQ ID NO: 762164 - DNA, 25 bp, Mus musculus
taccacgtaagtatcttgcgttcag

SEQ ID NO: 762165 - DNA, 25 bp, Mus musculus
taccacgtaagtttcttgcgttcag

SEQ ID NO: 762166 - DNA, 25 bp, Mus musculus
taccacgtggtcattggcatccagt

SEQ ID NO: 762167 - DNA, 25 bp, Mus musculus
taccacgtggtctttggcatccagt

SEQ ID NO: 762168 - DNA, 25 bp, Mus musculus
taccacgttggacgaggatagctca

SEQ ID NO: 762169 - DNA, 25 bp, Mus musculus
taccacgttggaggaggatagctca

SEQ ID NO: 762170 - DNA, 25 bp, Mus musculus
taccactaagcccaaccaatatttt

SEQ ID NO: 762171 - DNA, 25 bp, Mus musculus
taccactaagccgaaccaatatttt

SEQ ID NO: 762172 - DNA, 25 bp, Mus musculus
taccactagggcatccagaacaagc

SEQ ID NO: 762173 - DNA, 25 bp, Mus musculus
taccactagggcttccagaacaagc

SEQ ID NO: 762174 - DNA, 25 bp, Mus musculus
taccactcactgctggcattaaggg

SEQ ID NO: 762175 - DNA, 25 bp, Mus musculus
taccactcactggtggcattaaggg

SEQ ID NO: 762176 - DNA, 25 bp, Mus musculus
taccactctaagaactactggccca

SEQ ID NO: 762177 - DNA, 25 bp, Mus musculus
taccactctaagtactactggccca

SEQ ID NO: 762178 - DNA, 25 bp, Mus musculus
taccactctcagcacatagttcata

SEQ ID NO: 762179 - DNA, 25 bp, Mus musculus
taccactctcaggacatagttcata

SEQ ID NO: 762180 - DNA, 25 bp, Mus musculus
taccactctcatctagaacttctag

SEQ ID NO: 762181 - DNA, 25 bp, Mus musculus
taccactctcatgtagaacttctag

SEQ ID NO: 762182 - DNA, 25 bp, Mus musculus
taccactgacatcagcttacacgct

SEQ ID NO: 762183 - DNA, 25 bp, Mus musculus
taccactgacatgagcttacacgct

SEQ ID NO: 762184 - DNA, 25 bp, Mus musculus
taccactgccagatcattttaaagc

SEQ ID NO: 762185 - DNA, 25 bp, Mus musculus
taccactgccagttcattttaaagc

SEQ ID NO: 762186 - DNA, 25 bp, Mus musculus
taccactgttcccttgaggattaac

SEQ ID NO: 762187 - DNA, 25 bp, Mus musculus
taccactgttccgttgaggattaac

SEQ ID NO: 762188 - DNA, 25 bp, Mus musculus
taccactgttttctgaggccaccga

SEQ ID NO: 762189 - DNA, 25 bp, Mus musculus
taccactgttttgtgaggccaccga

SEQ ID NO: 762190 - DNA, 25 bp, Mus musculus
taccacttactaagtattcccaggc

SEQ ID NO: 762191 - DNA, 25 bp, Mus musculus
taccacttactatgtattcccaggc

SEQ ID NO: 762192 - DNA, 25 bp, Mus musculus
taccacttagctctgtgctgggcag

SEQ ID NO: 762193 - DNA, 25 bp, Mus musculus
taccacttagctgtgtgctgggcag

SEQ ID NO: 762194 - DNA, 25 bp, Mus musculus
taccacttatttaatgtcttctcaa

SEQ ID NO: 762195 - DNA, 25 bp, Mus musculus
taccacttattttatgtcttctcaa

SEQ ID NO: 762196 - DNA, 25 bp, Mus musculus
taccacttccagctgtatcagtctt

SEQ ID NO: 762197 - DNA, 25 bp, Mus musculus
taccacttccaggtgtatcagtctt

SEQ ID NO: 762198 - DNA, 25 bp, Mus musculus
taccacttcccaaaacaaaacctag

SEQ ID NO: 762199 - DNA, 25 bp, Mus musculus
taccacttcccataacaaaacctag

SEQ ID NO: 762200 - DNA, 25 bp, Mus musculus
taccacttgggtatcactctgtatt

SEQ ID NO: 762201 - DNA, 25 bp, Mus musculus
taccacttgggtttcactctgtatt

SEQ ID NO: 762202 - DNA, 25 bp, Mus musculus
taccacttggtacctgtgtggcctt

SEQ ID NO: 762203 - DNA, 25 bp, Mus musculus
taccacttggtagctgtgtggcctt

SEQ ID NO: 762204 - DNA, 25 bp, Mus musculus
taccactttatgcacaatgcccagc

SEQ ID NO: 762205 - DNA, 25 bp, Mus musculus
taccactttatggacaatgcccagc

SEQ ID NO: 762206 - DNA, 25 bp, Mus musculus
taccagaaacccaccaagcaggagg

SEQ ID NO: 762207 - DNA, 25 bp, Mus musculus
taccagaaaccctccaagcaggagg

SEQ ID NO: 762208 - DNA, 25 bp, Mus musculus
taccagaagcctctgtgcatgtagg

SEQ ID NO: 762209 - DNA, 25 bp, Mus musculus
taccagaagcctgtgtgcatgtagg

SEQ ID NO: 762210 - DNA, 25 bp, Mus musculus
taccagaattagccgctttttttct

SEQ ID NO: 762211 - DNA, 25 bp, Mus musculus
taccagaattaggcgctttttttct

SEQ ID NO: 762212 - DNA, 25 bp, Mus musculus
taccagaattctcccgcccatcccg

SEQ ID NO: 762213 - DNA, 25 bp, Mus musculus
taccagaattctgccgcccatcccg

SEQ ID NO: 762214 - DNA, 25 bp, Mus musculus
taccagacactgctgtacccaagag

SEQ ID NO: 762215 - DNA, 25 bp, Mus musculus
taccagacactggtgtacccaagag

SEQ ID NO: 762216 - DNA, 25 bp, Mus musculus
taccagacagctcttagcgtgccta

SEQ ID NO: 762217 - DNA, 25 bp, Mus musculus
taccagacagctgttagcgtgccta

SEQ ID NO: 762218 - DNA, 25 bp, Mus musculus
taccagacgctgacatcacctctaa

SEQ ID NO: 762219 - DNA, 25 bp, Mus musculus
taccagacgctgtcatcacctctaa

SEQ ID NO: 762220 - DNA, 25 bp, Mus musculus
taccagactcagctactggccactg

SEQ ID NO: 762221 - DNA, 25 bp, Mus musculus
taccagactcaggtactggccactg

SEQ ID NO: 762222 - DNA, 25 bp, Mus musculus
taccagacttctcacgcgcttcagt

SEQ ID NO: 762223 - DNA, 25 bp, Mus musculus
taccagacttctgacgcgcttcagt

SEQ ID NO: 762224 - DNA, 25 bp, Mus musculus
taccagaggactaacttatttttgt

SEQ ID NO: 762225 - DNA, 25 bp, Mus musculus
taccagaggacttacttatttttgt

SEQ ID NO: 762226 - DNA, 25 bp, Mus musculus
taccagagtgacagtggccctcgct

SEQ ID NO: 762227 - DNA, 25 bp, Mus musculus
taccagagtgactgtggccctcgct

SEQ ID NO: 762228 - DNA, 25 bp, Mus musculus
taccagagtgcacgtggcatgcctg

SEQ ID NO: 762229 - DNA, 25 bp, Mus musculus
taccagagtgcaggtggcatgcctg

SEQ ID NO: 762230 - DNA, 25 bp, Mus musculus
taccagagtggaaagcctgtgttct

SEQ ID NO: 762231 - DNA, 25 bp, Mus musculus
taccagagtggatagcctgtgttct

SEQ ID NO: 762232 - DNA, 25 bp, Mus musculus
taccagatactgacccttgcgtcac

SEQ ID NO: 762233 - DNA, 25 bp, Mus musculus
taccagatactgtcccttgcgtcac

SEQ ID NO: 762234 - DNA, 25 bp, Mus musculus
taccagataggtcgcactgaccctg

SEQ ID NO: 762235 - DNA, 25 bp, Mus musculus
taccagataggtggcactgaccctg

SEQ ID NO: 762236 - DNA, 25 bp, Mus musculus
taccagatatgcacacacgttcaca

SEQ ID NO: 762237 - DNA, 25 bp, Mus musculus
taccagatatgctcacacgttcaca

SEQ ID NO: 762238 - DNA, 25 bp, Mus musculus
taccagatccgccaactggaacgcg

SEQ ID NO: 762239 - DNA, 25 bp, Mus musculus
taccagatccgcgaactggaacgcg

SEQ ID NO: 762240 - DNA, 25 bp, Mus musculus
taccagatcctgcagttgggaagtt

SEQ ID NO: 762241 - DNA, 25 bp, Mus musculus
taccagatcctggagttgggaagtt

SEQ ID NO: 762242 - DNA, 25 bp, Mus musculus
taccagatgtggatcattccttcct

SEQ ID NO: 762243 - DNA, 25 bp, Mus musculus
taccagatgtggttcattccttcct

SEQ ID NO: 762244 - DNA, 25 bp, Mus musculus
taccagattatcatgagtctcactt

SEQ ID NO: 762245 - DNA, 25 bp, Mus musculus
taccagattatcttgagtctcactt

SEQ ID NO: 762246 - DNA, 25 bp, Mus musculus
taccagattttccactgatgtacca

SEQ ID NO: 762247 - DNA, 25 bp, Mus musculus
taccagattttcgactgatgtacca

SEQ ID NO: 762248 - DNA, 25 bp, Mus musculus
taccagcaacaacggccaggttttt

SEQ ID NO: 762249 - DNA, 25 bp, Mus musculus
taccagcaacaagggccaggttttt

SEQ ID NO: 762250 - DNA, 25 bp, Mus musculus
taccagcaacctaggcttgtgatca

SEQ ID NO: 762251 - DNA, 25 bp, Mus musculus
taccagcaaccttggcttgtgatca

SEQ ID NO: 762252 - DNA, 25 bp, Mus musculus
taccagcaattaccagccctggcag

SEQ ID NO: 762253 - DNA, 25 bp, Mus musculus
taccagcaattagcagccctggcag

SEQ ID NO: 762254 - DNA, 25 bp, Mus musculus
taccagcaccaacgatctcatgaag

SEQ ID NO: 762255 - DNA, 25 bp, Mus musculus
taccagcaccaaggatctcatgaag

SEQ ID NO: 762256 - DNA, 25 bp, Mus musculus
taccagcacttaacaagttccaagt

SEQ ID NO: 762257 - DNA, 25 bp, Mus musculus
taccagcacttatcaagttccaagt

SEQ ID NO: 762258 - DNA, 25 bp, Mus musculus
taccagcagtggcagccctgatgga

SEQ ID NO: 762259 - DNA, 25 bp, Mus musculus
taccagcagtgggagccctgatgga

SEQ ID NO: 762260 - DNA, 25 bp, Mus musculus
taccagcatctcatgacagaggccc

SEQ ID NO: 762261 - DNA, 25 bp, Mus musculus
taccagcatctcttgacagaggccc

SEQ ID NO: 762262 - DNA, 25 bp, Mus musculus
taccagcatgaaatgggtctgttca

SEQ ID NO: 762263 - DNA, 25 bp, Mus musculus
taccagcatgaattgggtctgttca

SEQ ID NO: 762264 - DNA, 25 bp, Mus musculus
taccagcatgcaagggccatctttc

SEQ ID NO: 762265 - DNA, 25 bp, Mus musculus
taccagcatgcatgggccatctttc

SEQ ID NO: 762266 - DNA, 25 bp, Mus musculus
taccagcatggaaatttaacccatt

SEQ ID NO: 762267 - DNA, 25 bp, Mus musculus
taccagcatggatatttaacccatt

SEQ ID NO: 762268 - DNA, 25 bp, Mus musculus
taccagcattcactctacaccagag

SEQ ID NO: 762269 - DNA, 25 bp, Mus musculus
taccagcattcagtctacaccagag

SEQ ID NO: 762270 - DNA, 25 bp, Mus musculus
taccagccaataaccacaggagcaa

SEQ ID NO: 762271 - DNA, 25 bp, Mus musculus
taccagccaatatccacaggagcaa

SEQ ID NO: 762272 - DNA, 25 bp, Mus musculus
taccagccaattcctcttagtcaca

SEQ ID NO: 762273 - DNA, 25 bp, Mus musculus
taccagccaattgctcttagtcaca

SEQ ID NO: 762274 - DNA, 25 bp, Mus musculus
taccagccccttcgttgtagggaag

SEQ ID NO: 762275 - DNA, 25 bp, Mus musculus
taccagccccttggttgtagggaag

SEQ ID NO: 762276 - DNA, 25 bp, Mus musculus
taccagccctctccatgactgaggt

SEQ ID NO: 762277 - DNA, 25 bp, Mus musculus
taccagccctctgcatgactgaggt

SEQ ID NO: 762278 - DNA, 25 bp, Mus musculus
taccagcgacccagacaatgacatg

SEQ ID NO: 762279 - DNA, 25 bp, Mus musculus
taccagcgaccctgacaatgacatg

SEQ ID NO: 762280 - DNA, 25 bp, Mus musculus
taccagcgacgaatcttagttacta

SEQ ID NO: 762281 - DNA, 25 bp, Mus musculus
taccagcgacgattcttagttacta

SEQ ID NO: 762282 - DNA, 25 bp, Mus musculus
taccagcgacggcaagctttcaagc

SEQ ID NO: 762283 - DNA, 25 bp, Mus musculus
taccagcgacgggaagctttcaagc

SEQ ID NO: 762284 - DNA, 25 bp, Mus musculus
taccagcgagctctaggccatgtca

SEQ ID NO: 762285 - DNA, 25 bp, Mus musculus
taccagcgagctgtaggccatgtca

SEQ ID NO: 762286 - DNA, 25 bp, Mus musculus
taccagcgtttgcaccaggaagcta

SEQ ID NO: 762287 - DNA, 25 bp, Mus musculus
taccagcgtttggaccaggaagcta

SEQ ID NO: 762288 - DNA, 25 bp, Mus musculus
taccagctagtgatagttcaccagt

SEQ ID NO: 762289 - DNA, 25 bp, Mus musculus
taccagctagtgttagttcaccagt

SEQ ID NO: 762290 - DNA, 25 bp, Mus musculus
taccagctcagactccagggatgtt

SEQ ID NO: 762291 - DNA, 25 bp, Mus musculus
taccagctcagagtccagggatgtt

SEQ ID NO: 762292 - DNA, 25 bp, Mus musculus
taccagctcggaagagatcactctt

SEQ ID NO: 762293 - DNA, 25 bp, Mus musculus
taccagctcggatgagatcactctt

SEQ ID NO: 762294 - DNA, 25 bp, Mus musculus
taccagctgattcccttgttgtaca

SEQ ID NO: 762295 - DNA, 25 bp, Mus musculus
taccagctgattgccttgttgtaca

SEQ ID NO: 762296 - DNA, 25 bp, Mus musculus
taccagcttcctacacaataggatt

SEQ ID NO: 762297 - DNA, 25 bp, Mus musculus
taccagcttcctagatttcatctat

SEQ ID NO: 762298 - DNA, 25 bp, Mus musculus
taccagcttccttcacaataggatt

SEQ ID NO: 762299 - DNA, 25 bp, Mus musculus
taccagcttccttgatttcatctat

SEQ ID NO: 762300 - DNA, 25 bp, Mus musculus
taccagcttctgattatatttagtg

SEQ ID NO: 762301 - DNA, 25 bp, Mus musculus
taccagcttctgtttatatttagtg

SEQ ID NO: 762302 - DNA, 25 bp, Mus musculus
taccagcttgagatgcatgcttagt

SEQ ID NO: 762303 - DNA, 25 bp, Mus musculus
taccagcttgagttgcatgcttagt

SEQ ID NO: 762304 - DNA, 25 bp, Mus musculus
taccagcttgtcctaaagtgtagat

SEQ ID NO: 762305 - DNA, 25 bp, Mus musculus
taccagcttgtcgtaaagtgtagat

SEQ ID NO: 762306 - DNA, 25 bp, Mus musculus
taccagctttccatctcaacaatag

SEQ ID NO: 762307 - DNA, 25 bp, Mus musculus
taccagctttccttctcaacaatag

SEQ ID NO: 762308 - DNA, 25 bp, Mus musculus
taccagctttgccaggactgcttct

SEQ ID NO: 762309 - DNA, 25 bp, Mus musculus
taccagctttgcgaggactgcttct

SEQ ID NO: 762310 - DNA, 25 bp, Mus musculus
taccaggaacggcagctgcagcaaa

SEQ ID NO: 762311 - DNA, 25 bp, Mus musculus
taccaggaacgggagctgcagcaaa

SEQ ID NO: 762312 - DNA, 25 bp, Mus musculus
taccaggacctcaacagtgctagga

SEQ ID NO: 762313 - DNA, 25 bp, Mus musculus
taccaggacctctacagtgctagga

SEQ ID NO: 762314 - DNA, 25 bp, Mus musculus
taccaggacgccacggtcaatgatg

SEQ ID NO: 762315 - DNA, 25 bp, Mus musculus
taccaggacgcctcggtcaatgatg

SEQ ID NO: 762316 - DNA, 25 bp, Mus musculus
taccaggactagaaagacaggcaga

SEQ ID NO: 762317 - DNA, 25 bp, Mus musculus
taccaggactagtaagacaggcaga

SEQ ID NO: 762318 - DNA, 25 bp, Mus musculus
taccaggagcacctggccttacatg

SEQ ID NO: 762319 - DNA, 25 bp, Mus musculus
taccaggagcacgtggccttacatg

SEQ ID NO: 762320 - DNA, 25 bp, Mus musculus
taccaggagcagacctctaggtgag

SEQ ID NO: 762321 - DNA, 25 bp, Mus musculus
taccaggagcagtcctctaggtgag

SEQ ID NO: 762322 - DNA, 25 bp, Mus musculus
taccaggagctcagattcagtgaca

SEQ ID NO: 762323 - DNA, 25 bp, Mus musculus
taccaggagctctgattcagtgaca

SEQ ID NO: 762324 - DNA, 25 bp, Mus musculus
taccaggaggccattgtgtgcctga

SEQ ID NO: 762325 - DNA, 25 bp, Mus musculus
taccaggaggcctttgtgtgcctga

SEQ ID NO: 762326 - DNA, 25 bp, Mus musculus
taccaggaggtcaacatttattaat

SEQ ID NO: 762327 - DNA, 25 bp, Mus musculus
taccaggaggtctacatttattaat

SEQ ID NO: 762328 - DNA, 25 bp, Mus musculus
taccaggaggtgaagaggagtaatt

SEQ ID NO: 762329 - DNA, 25 bp, Mus musculus
taccaggaggtgtagaggagtaatt

SEQ ID NO: 762330 - DNA, 25 bp, Mus musculus
taccaggagtcaacagctttctaaa

SEQ ID NO: 762331 - DNA, 25 bp, Mus musculus
taccaggagtcatcagctttctaaa

SEQ ID NO: 762332 - DNA, 25 bp, Mus musculus
taccaggatacacctgccatcatgt

SEQ ID NO: 762333 - DNA, 25 bp, Mus musculus
taccaggatacagctgccatcatgt

SEQ ID NO: 762334 - DNA, 25 bp, Mus musculus
taccaggatggtataccttgttgaa

SEQ ID NO: 762335 - DNA, 25 bp, Mus musculus
taccaggatggtttaccttgttgaa

SEQ ID NO: 762336 - DNA, 25 bp, Mus musculus
taccaggatgtgcatggcagagacc

SEQ ID NO: 762337 - DNA, 25 bp, Mus musculus
taccaggatgtggatggcagagacc

SEQ ID NO: 762338 - DNA, 25 bp, Mus musculus
taccaggcacccctaagttagtgtg

SEQ ID NO: 762339 - DNA, 25 bp, Mus musculus
taccaggcacccgtaagttagtgtg

SEQ ID NO: 762340 - DNA, 25 bp, Mus musculus
taccaggccatgatgtaccagcaga

SEQ ID NO: 762341 - DNA, 25 bp, Mus musculus
taccaggccatgttgtaccagcaga

SEQ ID NO: 762342 - DNA, 25 bp, Mus musculus
taccaggccgagatgacgtggaagc

SEQ ID NO: 762343 - DNA, 25 bp, Mus musculus
taccaggccgagttgacgtggaagc

SEQ ID NO: 762344 - DNA, 25 bp, Mus musculus
taccaggcctcaatcaggacgttca

SEQ ID NO: 762345 - DNA, 25 bp, Mus musculus
taccaggcctcattcaggacgttca

SEQ ID NO: 762346 - DNA, 25 bp, Mus musculus
taccaggcgcaaacccggagctgag

SEQ ID NO: 762347 - DNA, 25 bp, Mus musculus
taccaggcgcaatcccggagctgag

SEQ ID NO: 762348 - DNA, 25 bp, Mus musculus
taccaggctacaagtgcataccaat

SEQ ID NO: 762349 - DNA, 25 bp, Mus musculus
taccaggctacatgtgcataccaat

SEQ ID NO: 762350 - DNA, 25 bp, Mus musculus
taccaggctcacagagatcctgttg

SEQ ID NO: 762351 - DNA, 25 bp, Mus musculus
taccaggctcactgagatcctgttg

SEQ ID NO: 762352 - DNA, 25 bp, Mus musculus
taccaggctgggaaggcacttgcat

SEQ ID NO: 762353 - DNA, 25 bp, Mus musculus
taccaggctgggtaggcacttgcat

SEQ ID NO: 762354 - DNA, 25 bp, Mus musculus
taccaggcttaaaacttttagtctc

SEQ ID NO: 762355 - DNA, 25 bp, Mus musculus
taccaggcttaatacttttagtctc

SEQ ID NO: 762356 - DNA, 25 bp, Mus musculus
taccagggaaaacccatacagatgt

SEQ ID NO: 762357 - DNA, 25 bp, Mus musculus
taccagggaaaagccatacagatgt

SEQ ID NO: 762358 - DNA, 25 bp, Mus musculus
taccagggaatcagcagccagggac

SEQ ID NO: 762359 - DNA, 25 bp, Mus musculus
taccagggaatctgcagccagggac

SEQ ID NO: 762360 - DNA, 25 bp, Mus musculus
taccagggacagcactctagcacag

SEQ ID NO: 762361 - DNA, 25 bp, Mus musculus
taccagggacaggactctagcacag

SEQ ID NO: 762362 - DNA, 25 bp, Mus musculus
taccagggacctctgaatggtggct

SEQ ID NO: 762363 - DNA, 25 bp, Mus musculus
taccagggacctgtgaatggtggct

SEQ ID NO: 762364 - DNA, 25 bp, Mus musculus
taccagggactgagacagacatcat

SEQ ID NO: 762365 - DNA, 25 bp, Mus musculus
taccagggactgtgacagacatcat

SEQ ID NO: 762366 - DNA, 25 bp, Mus musculus
taccagggacttacataacttcgag

SEQ ID NO: 762367 - DNA, 25 bp, Mus musculus
taccagggactttcataacttcgag

SEQ ID NO: 762368 - DNA, 25 bp, Mus musculus
taccagggatcgaaggagccccgca

SEQ ID NO: 762369 - DNA, 25 bp, Mus musculus
taccagggatcgtaggagccccgca

SEQ ID NO: 762370 - DNA, 25 bp, Mus musculus
taccagggtccaaaggtgaacgagg

SEQ ID NO: 762371 - DNA, 25 bp, Mus musculus
taccagggtccataggtgaacgagg

SEQ ID NO: 762372 - DNA, 25 bp, Mus musculus
taccaggtaccaactgggcctaagt

SEQ ID NO: 762373 - DNA, 25 bp, Mus musculus
taccaggtaccaagatttttcaatc

SEQ ID NO: 762374 - DNA, 25 bp, Mus musculus
taccaggtaccatctgggcctaagt

SEQ ID NO: 762375 - DNA, 25 bp, Mus musculus
taccaggtaccatgatttttcaatc

SEQ ID NO: 762376 - DNA, 25 bp, Mus musculus
taccaggtacccaagtccttgatga

SEQ ID NO: 762377 - DNA, 25 bp, Mus musculus
taccaggtaccctagtccttgatga

SEQ ID NO: 762378 - DNA, 25 bp, Mus musculus
taccaggtagcccaatagaaataca

SEQ ID NO: 762379 - DNA, 25 bp, Mus musculus
taccaggtagccgaatagaaataca

SEQ ID NO: 762380 - DNA, 25 bp, Mus musculus
taccaggtcctgcttgccaagacag

SEQ ID NO: 762381 - DNA, 25 bp, Mus musculus
taccaggtcctggttgccaagacag

SEQ ID NO: 762382 - DNA, 25 bp, Mus musculus
taccaggtgcctccctattagtagg

SEQ ID NO: 762383 - DNA, 25 bp, Mus musculus
taccaggtgcctgcctattagtagg

SEQ ID NO: 762384 - DNA, 25 bp, Mus musculus
taccaggtggtaccggtttcatgcc

SEQ ID NO: 762385 - DNA, 25 bp, Mus musculus
taccaggtggtagcggtttcatgcc

SEQ ID NO: 762386 - DNA, 25 bp, Mus musculus
taccaggttaggacagtttttaatg

SEQ ID NO: 762387 - DNA, 25 bp, Mus musculus
taccaggttaggtcagtttttaatg

SEQ ID NO: 762388 - DNA, 25 bp, Mus musculus
taccaggttgtgacagtttgttgtt

SEQ ID NO: 762389 - DNA, 25 bp, Mus musculus
taccaggttgtgtcagtttgttgtt

SEQ ID NO: 762390 - DNA, 25 bp, Mus musculus
taccagtaaagtcatccccgaggcc

SEQ ID NO: 762391 - DNA, 25 bp, Mus musculus
taccagtaaagtgatccccgaggcc

SEQ ID NO: 762392 - DNA, 25 bp, Mus musculus
taccagtaaggcctccacttgcaat

SEQ ID NO: 762393 - DNA, 25 bp, Mus musculus
taccagtaaggcgtccacttgcaat

SEQ ID NO: 762394 - DNA, 25 bp, Mus musculus
taccagtacatactaactgtgacat

SEQ ID NO: 762395 - DNA, 25 bp, Mus musculus
taccagtacatagtaactgtgacat

SEQ ID NO: 762396 - DNA, 25 bp, Mus musculus
taccagtacctcatctaagtcacaa

SEQ ID NO: 762397 - DNA, 25 bp, Mus musculus
taccagtacctcctgcaagatgtgg

SEQ ID NO: 762398 - DNA, 25 bp, Mus musculus
taccagtacctcgtgcaagatgtgg

SEQ ID NO: 762399 - DNA, 25 bp, Mus musculus
taccagtacctcttctaagtcacaa

SEQ ID NO: 762400 - DNA, 25 bp, Mus musculus
taccagtagggaatagcagggacat

SEQ ID NO: 762401 - DNA, 25 bp, Mus musculus
taccagtagggattagcagggacat

SEQ ID NO: 762402 - DNA, 25 bp, Mus musculus
taccagtagtctactagttccattg

SEQ ID NO: 762403 - DNA, 25 bp, Mus musculus
taccagtagtcttctagttccattg

SEQ ID NO: 762404 - DNA, 25 bp, Mus musculus
taccagtatgtgcaccatggtgcgt

SEQ ID NO: 762405 - DNA, 25 bp, Mus musculus
taccagtatgtggaccatggtgcgt

SEQ ID NO: 762406 - DNA, 25 bp, Mus musculus
taccagtattgaatgtgagcctaag

SEQ ID NO: 762407 - DNA, 25 bp, Mus musculus
taccagtattgattgtgagcctaag

SEQ ID NO: 762408 - DNA, 25 bp, Mus musculus
taccagtcaccgcattgaggcagga

SEQ ID NO: 762409 - DNA, 25 bp, Mus musculus
taccagtcaccggattgaggcagga

SEQ ID NO: 762410 - DNA, 25 bp, Mus musculus
taccagtcaggtagcacagctgctg

SEQ ID NO: 762411 - DNA, 25 bp, Mus musculus
taccagtcaggttgcacagctgctg

SEQ ID NO: 762412 - DNA, 25 bp, Mus musculus
taccagtcattacatagtcttttaa

SEQ ID NO: 762413 - DNA, 25 bp, Mus musculus
taccagtcattagatagtcttttaa

SEQ ID NO: 762414 - DNA, 25 bp, Mus musculus
taccagtccctgacatagtgtctaa

SEQ ID NO: 762415 - DNA, 25 bp, Mus musculus
taccagtccctgtcatagtgtctaa

SEQ ID NO: 762416 - DNA, 25 bp, Mus musculus
taccagtcgccgctgcaaaagaagt

SEQ ID NO: 762417 - DNA, 25 bp, Mus musculus
taccagtcgccggtgcaaaagaagt

SEQ ID NO: 762418 - DNA, 25 bp, Mus musculus
taccagtctcaaatacgttaaaagt

SEQ ID NO: 762419 - DNA, 25 bp, Mus musculus
taccagtctcaattacgttaaaagt

SEQ ID NO: 762420 - DNA, 25 bp, Mus musculus
taccagtctctgcagaaccttgaaa

SEQ ID NO: 762421 - DNA, 25 bp, Mus musculus
taccagtctctggagaaccttgaaa

SEQ ID NO: 762422 - DNA, 25 bp, Mus musculus
taccagtctgagaatcagctcctca

SEQ ID NO: 762423 - DNA, 25 bp, Mus musculus
taccagtctgagtatcagctcctca

SEQ ID NO: 762424 - DNA, 25 bp, Mus musculus
taccagtctgtgcacatgacctgtt

SEQ ID NO: 762425 - DNA, 25 bp, Mus musculus
taccagtctgtggacatgacctgtt

SEQ ID NO: 762426 - DNA, 25 bp, Mus musculus
taccagtcttcgaaagctgcgtgat

SEQ ID NO: 762427 - DNA, 25 bp, Mus musculus
taccagtcttcgtaagctgcgtgat

SEQ ID NO: 762428 - DNA, 25 bp, Mus musculus
taccagtgacttcagcatagcgagt

SEQ ID NO: 762429 - DNA, 25 bp, Mus musculus
taccagtgacttgagcatagcgagt

SEQ ID NO: 762430 - DNA, 25 bp, Mus musculus
taccagtgcaggaaagccttgcgcc

SEQ ID NO: 762431 - DNA, 25 bp, Mus musculus
taccagtgcaggtaagccttgcgcc

SEQ ID NO: 762432 - DNA, 25 bp, Mus musculus
taccagtggacaactctaacatcaa

SEQ ID NO: 762433 - DNA, 25 bp, Mus musculus
taccagtggacatctctaacatcaa

SEQ ID NO: 762434 - DNA, 25 bp, Mus musculus
taccagtggcttagagtaggatctt

SEQ ID NO: 762435 - DNA, 25 bp, Mus musculus
taccagtggctttgagtaggatctt

SEQ ID NO: 762436 - DNA, 25 bp, Mus musculus
taccagtgtcagaactagctctaga

SEQ ID NO: 762437 - DNA, 25 bp, Mus musculus
taccagtgtcagtactagctctaga

SEQ ID NO: 762438 - DNA, 25 bp, Mus musculus
taccagtgtgcacagactactactc

SEQ ID NO: 762439 - DNA, 25 bp, Mus musculus
taccagtgtgcagagactactactc

SEQ ID NO: 762440 - DNA, 25 bp, Mus musculus
taccagtgtgttaatacaggtattt

SEQ ID NO: 762441 - DNA, 25 bp, Mus musculus
taccagtgtgtttatacaggtattt

SEQ ID NO: 762442 - DNA, 25 bp, Mus musculus
taccagttacatcgtaatgccaccc

SEQ ID NO: 762443 - DNA, 25 bp, Mus musculus
taccagttacatggtaatgccaccc

SEQ ID NO: 762444 - DNA, 25 bp, Mus musculus
taccagttacctcactgtgtgtgtg

SEQ ID NO: 762445 - DNA, 25 bp, Mus musculus
taccagttacctgactgtgtgtgtg

SEQ ID NO: 762446 - DNA, 25 bp, Mus musculus
taccagttactaactcctaaatatg

SEQ ID NO: 762447 - DNA, 25 bp, Mus musculus
taccagttactatctcctaaatatg

SEQ ID NO: 762448 - DNA, 25 bp, Mus musculus
taccagttcagccaggctgttctcc

SEQ ID NO: 762449 - DNA, 25 bp, Mus musculus
taccagttcagcgaggctgttctcc

SEQ ID NO: 762450 - DNA, 25 bp, Mus musculus
taccagttccctatgtatgggacaa

SEQ ID NO: 762451 - DNA, 25 bp, Mus musculus
taccagttccctttgtatgggacaa

SEQ ID NO: 762452 - DNA, 25 bp, Mus musculus
taccagttcctgctcctttctagaa

SEQ ID NO: 762453 - DNA, 25 bp, Mus musculus
taccagttcctggtcctttctagaa

SEQ ID NO: 762454 - DNA, 25 bp, Mus musculus
taccagttctttcagtgccaattac

SEQ ID NO: 762455 - DNA, 25 bp, Mus musculus
taccagttctttctctaccttcagg

SEQ ID NO: 762456 - DNA, 25 bp, Mus musculus
taccagttctttgagtgccaattac

SEQ ID NO: 762457 - DNA, 25 bp, Mus musculus
taccagttctttgtctaccttcagg

SEQ ID NO: 762458 - DNA, 25 bp, Mus musculus
taccagttgactcactagttttggg

SEQ ID NO: 762459 - DNA, 25 bp, Mus musculus
taccagttgactgactagttttggg

SEQ ID NO: 762460 - DNA, 25 bp, Mus musculus
taccagttgcttcgatgtggctcag

SEQ ID NO: 762461 - DNA, 25 bp, Mus musculus
taccagttgcttggatgtggctcag

SEQ ID NO: 762462 - DNA, 25 bp, Mus musculus
taccagtttcttcaagtgacttaaa

SEQ ID NO: 762463 - DNA, 25 bp, Mus musculus
taccagtttcttgaagtgacttaaa

SEQ ID NO: 762464 - DNA, 25 bp, Mus musculus
taccagttttcactccatcatttta

SEQ ID NO: 762465 - DNA, 25 bp, Mus musculus
taccagttttcagtccatcatttta

SEQ ID NO: 762466 - DNA, 25 bp, Mus musculus
taccataatgtaattaactcgaact

SEQ ID NO: 762467 - DNA, 25 bp, Mus musculus
taccataatgtatttaactcgaact

SEQ ID NO: 762468 - DNA, 25 bp, Mus musculus
taccatacccaaacctttttaatct

SEQ ID NO: 762469 - DNA, 25 bp, Mus musculus
taccatacccaatcctttttaatct

SEQ ID NO: 762470 - DNA, 25 bp, Mus musculus
taccatacctcacatagaaacacag

SEQ ID NO: 762471 - DNA, 25 bp, Mus musculus
taccatacctcagatagaaacacag

SEQ ID NO: 762472 - DNA, 25 bp, Mus musculus
taccatacgggtccttttcctttgc

SEQ ID NO: 762473 - DNA, 25 bp, Mus musculus
taccatacgggtgcttttcctttgc

SEQ ID NO: 762474 - DNA, 25 bp, Mus musculus
taccatactaacacagtgattgctg

SEQ ID NO: 762475 - DNA, 25 bp, Mus musculus
taccatactaactcagtgattgctg

SEQ ID NO: 762476 - DNA, 25 bp, Mus musculus
taccatactaggcttgagctccagt

SEQ ID NO: 762477 - DNA, 25 bp, Mus musculus
taccatactagggttgagctccagt

SEQ ID NO: 762478 - DNA, 25 bp, Mus musculus
taccatactgttaacctattcaagg

SEQ ID NO: 762479 - DNA, 25 bp, Mus musculus
taccatactgtttacctattcaagg

SEQ ID NO: 762480 - DNA, 25 bp, Mus musculus
taccatacttatagtgagccaagct

SEQ ID NO: 762481 - DNA, 25 bp, Mus musculus
taccatacttattgtgagccaagct

SEQ ID NO: 762482 - DNA, 25 bp, Mus musculus
taccatactttcataattcctctca

SEQ ID NO: 762483 - DNA, 25 bp, Mus musculus
taccatactttcttaattcctctca

SEQ ID NO: 762484 - DNA, 25 bp, Mus musculus
taccatagacctcacagtgggttaa

SEQ ID NO: 762485 - DNA, 25 bp, Mus musculus
taccatagacctgacagtgggttaa

SEQ ID NO: 762486 - DNA, 25 bp, Mus musculus
taccatagaggacacgtaccggcag

SEQ ID NO: 762487 - DNA, 25 bp, Mus musculus
taccatagaggagacgtaccggcag

SEQ ID NO: 762488 - DNA, 25 bp, Mus musculus
taccatagattactgcgtccctcaa

SEQ ID NO: 762489 - DNA, 25 bp, Mus musculus
taccatagattagtgcgtccctcaa

SEQ ID NO: 762490 - DNA, 25 bp, Mus musculus
taccatagcacaacatcagtgagct

SEQ ID NO: 762491 - DNA, 25 bp, Mus musculus
taccatagcacatcatcagtgagct

SEQ ID NO: 762492 - DNA, 25 bp, Mus musculus
taccatagcccgattgtgaagggat

SEQ ID NO: 762493 - DNA, 25 bp, Mus musculus
taccatagcccgtttgtgaagggat

SEQ ID NO: 762494 - DNA, 25 bp, Mus musculus
taccataggcaaaaacctgggacct

SEQ ID NO: 762495 - DNA, 25 bp, Mus musculus
taccataggcaataacctgggacct

SEQ ID NO: 762496 - DNA, 25 bp, Mus musculus
taccatagtagcaagactctaagta

SEQ ID NO: 762497 - DNA, 25 bp, Mus musculus
taccatagtagctagactctaagta

SEQ ID NO: 762498 - DNA, 25 bp, Mus musculus
taccatagtcttcagtggcggctag

SEQ ID NO: 762499 - DNA, 25 bp, Mus musculus
taccatagtcttgagtggcggctag

SEQ ID NO: 762500 - DNA, 25 bp, Mus musculus
taccatatattaaggcacacggtgt

SEQ ID NO: 762501 - DNA, 25 bp, Mus musculus
taccatatattatggcacacggtgt

SEQ ID NO: 762502 - DNA, 25 bp, Mus musculus
taccatattgtcaagacccttcagg

SEQ ID NO: 762503 - DNA, 25 bp, Mus musculus
taccatattgtctagacccttcagg

SEQ ID NO: 762504 - DNA, 25 bp, Mus musculus
taccatcaccatccttaggaaccaa

SEQ ID NO: 762505 - DNA, 25 bp, Mus musculus
taccatcaccatgcttaggaaccaa

SEQ ID NO: 762506 - DNA, 25 bp, Mus musculus
taccatcacctacatagcctttgag

SEQ ID NO: 762507 - DNA, 25 bp, Mus musculus
taccatcacctagatagcctttgag

SEQ ID NO: 762508 - DNA, 25 bp, Mus musculus
taccatcagagcagtgcagtgccct

SEQ ID NO: 762509 - DNA, 25 bp, Mus musculus
taccatcagagctgtgcagtgccct

SEQ ID NO: 762510 - DNA, 25 bp, Mus musculus
taccatcagcacattgtccatatag

SEQ ID NO: 762511 - DNA, 25 bp, Mus musculus
taccatcagcactttgtccatatag

SEQ ID NO: 762512 - DNA, 25 bp, Mus musculus
taccatcagcagacttactcaaggc

SEQ ID NO: 762513 - DNA, 25 bp, Mus musculus
taccatcagcagtcttactcaaggc

SEQ ID NO: 762514 - DNA, 25 bp, Mus musculus
taccatcaggacaggtcgcatgcag

SEQ ID NO: 762515 - DNA, 25 bp, Mus musculus
taccatcaggactggtcgcatgcag

SEQ ID NO: 762516 - DNA, 25 bp, Mus musculus
taccatcagggaaactgtggaatgc

SEQ ID NO: 762517 - DNA, 25 bp, Mus musculus
taccatcagggatactgtggaatgc

SEQ ID NO: 762518 - DNA, 25 bp, Mus musculus
taccatcagtggctagtttttgtct

SEQ ID NO: 762519 - DNA, 25 bp, Mus musculus
taccatcagtgggtagtttttgtct

SEQ ID NO: 762520 - DNA, 25 bp, Mus musculus
taccatccaccacgcttgaagcagg

SEQ ID NO: 762521 - DNA, 25 bp, Mus musculus
taccatccaccaggcttgaagcagg

SEQ ID NO: 762522 - DNA, 25 bp, Mus musculus
taccatcccaccctgttgtatgtat

SEQ ID NO: 762523 - DNA, 25 bp, Mus musculus
taccatcccaccgtgttgtatgtat

SEQ ID NO: 762524 - DNA, 25 bp, Mus musculus
taccatccccaacttaaagccagta

SEQ ID NO: 762525 - DNA, 25 bp, Mus musculus
taccatccccaagttaaagccagta

SEQ ID NO: 762526 - DNA, 25 bp, Mus musculus
taccatcccttgcttggactgctta

SEQ ID NO: 762527 - DNA, 25 bp, Mus musculus
taccatcccttggttggactgctta

SEQ ID NO: 762528 - DNA, 25 bp, Mus musculus
taccatccggagcttgaggcgagat

SEQ ID NO: 762529 - DNA, 25 bp, Mus musculus
taccatccggaggttgaggcgagat

SEQ ID NO: 762530 - DNA, 25 bp, Mus musculus
taccatccgtccagttctgttttta

SEQ ID NO: 762531 - DNA, 25 bp, Mus musculus
taccatccgtcctgttctgttttta

SEQ ID NO: 762532 - DNA, 25 bp, Mus musculus
taccatccttcaatttagcttaatg

SEQ ID NO: 762533 - DNA, 25 bp, Mus musculus
taccatccttcattttagcttaatg

SEQ ID NO: 762534 - DNA, 25 bp, Mus musculus
taccatcgtcgtaatgttctgttgc

SEQ ID NO: 762535 - DNA, 25 bp, Mus musculus
taccatcgtcgttatgttctgttgc

SEQ ID NO: 762536 - DNA, 25 bp, Mus musculus
taccatctacttcttcatgtgctag

SEQ ID NO: 762537 - DNA, 25 bp, Mus musculus
taccatctacttgttcatgtgctag

SEQ ID NO: 762538 - DNA, 25 bp, Mus musculus
taccatctataaatcacctttccta

SEQ ID NO: 762539 - DNA, 25 bp, Mus musculus
taccatctataattcacctttccta

SEQ ID NO: 762540 - DNA, 25 bp, Mus musculus
taccatctatacaacggcgcctcgg

SEQ ID NO: 762541 - DNA, 25 bp, Mus musculus
taccatctatactacggcgcctcgg

SEQ ID NO: 762542 - DNA, 25 bp, Mus musculus
taccatctattcactggacatgaag

SEQ ID NO: 762543 - DNA, 25 bp, Mus musculus
taccatctattctctggacatgaag

SEQ ID NO: 762544 - DNA, 25 bp, Mus musculus
taccatctcaccatgacttgggttt

SEQ ID NO: 762545 - DNA, 25 bp, Mus musculus
taccatctcaccttgacttgggttt

SEQ ID NO: 762546 - DNA, 25 bp, Mus musculus
taccatctcagcatcttatatccag

SEQ ID NO: 762547 - DNA, 25 bp, Mus musculus
taccatctcagcttcttatatccag

SEQ ID NO: 762548 - DNA, 25 bp, Mus musculus
taccatctctccagttaccacattt

SEQ ID NO: 762549 - DNA, 25 bp, Mus musculus
taccatctctcctgttaccacattt

SEQ ID NO: 762550 - DNA, 25 bp, Mus musculus
taccatctctgcacagcggtaatga

SEQ ID NO: 762551 - DNA, 25 bp, Mus musculus
taccatctctgctcagcggtaatga

SEQ ID NO: 762552 - DNA, 25 bp, Mus musculus
taccatctgaagacaagtgctttgc

SEQ ID NO: 762553 - DNA, 25 bp, Mus musculus
taccatctgaagtcaagtgctttgc

SEQ ID NO: 762554 - DNA, 25 bp, Mus musculus
taccatctgcatccttgacttttca

SEQ ID NO: 762555 - DNA, 25 bp, Mus musculus
taccatctgcatgcttgacttttca

SEQ ID NO: 762556 - DNA, 25 bp, Mus musculus
taccatctgttaagtttcaaagctg

SEQ ID NO: 762557 - DNA, 25 bp, Mus musculus
taccatctgttatgtttcaaagctg

SEQ ID NO: 762558 - DNA, 25 bp, Mus musculus
taccatcttattctccatcacagaa

SEQ ID NO: 762559 - DNA, 25 bp, Mus musculus
taccatcttattgtccatcacagaa

SEQ ID NO: 762560 - DNA, 25 bp, Mus musculus
taccatcttttcaactcggcacaga

SEQ ID NO: 762561 - DNA, 25 bp, Mus musculus
taccatcttttctactcggcacaga

SEQ ID NO: 762562 - DNA, 25 bp, Mus musculus
taccatgaaagcaataggcagccac

SEQ ID NO: 762563 - DNA, 25 bp, Mus musculus
taccatgaaagctataggcagccac

SEQ ID NO: 762564 - DNA, 25 bp, Mus musculus
taccatgaacatcaactcagacttt

SEQ ID NO: 762565 - DNA, 25 bp, Mus musculus
taccatgaacatgaactcagacttt

SEQ ID NO: 762566 - DNA, 25 bp, Mus musculus
taccatgaagatcgaacagcccatc

SEQ ID NO: 762567 - DNA, 25 bp, Mus musculus
taccatgaagatggaacagcccatc

SEQ ID NO: 762568 - DNA, 25 bp, Mus musculus
taccatgaaggtaacccacttcctt

SEQ ID NO: 762569 - DNA, 25 bp, Mus musculus
taccatgaaggtagtgatttgtatc

SEQ ID NO: 762570 - DNA, 25 bp, Mus musculus
taccatgaaggttacccacttcctt

SEQ ID NO: 762571 - DNA, 25 bp, Mus musculus
taccatgaaggttgtgatttgtatc

SEQ ID NO: 762572 - DNA, 25 bp, Mus musculus
taccatgaatccatcagttgtgcaa

SEQ ID NO: 762573 - DNA, 25 bp, Mus musculus
taccatgaatccttcagttgtgcaa

SEQ ID NO: 762574 - DNA, 25 bp, Mus musculus
taccatgacaaaacctagcttttta

SEQ ID NO: 762575 - DNA, 25 bp, Mus musculus
taccatgacaaatcctagcttttta

SEQ ID NO: 762576 - DNA, 25 bp, Mus musculus
taccatgacataatgagcatttttt

SEQ ID NO: 762577 - DNA, 25 bp, Mus musculus
taccatgacatattgagcatttttt

SEQ ID NO: 762578 - DNA, 25 bp, Mus musculus
taccatgactggagagcgtgaggtc

SEQ ID NO: 762579 - DNA, 25 bp, Mus musculus
taccatgactggtgagcgtgaggtc

SEQ ID NO: 762580 - DNA, 25 bp, Mus musculus
taccatgagcacactttccatgtaa

SEQ ID NO: 762581 - DNA, 25 bp, Mus musculus
taccatgagcactctttccatgtaa

SEQ ID NO: 762582 - DNA, 25 bp, Mus musculus
taccatgaggcccatgagtcgccga

SEQ ID NO: 762583 - DNA, 25 bp, Mus musculus
taccatgaggccgatgagtcgccga

SEQ ID NO: 762584 - DNA, 25 bp, Mus musculus
taccatgatctacagggaacccacc

SEQ ID NO: 762585 - DNA, 25 bp, Mus musculus
taccatgatctagagggaacccacc

SEQ ID NO: 762586 - DNA, 25 bp, Mus musculus
taccatgattttagtgtttctgata

SEQ ID NO: 762587 - DNA, 25 bp, Mus musculus
taccatgatttttgtgtttctgata

SEQ ID NO: 762588 - DNA, 25 bp, Mus musculus
taccatgcatgccattttggaacct

SEQ ID NO: 762589 - DNA, 25 bp, Mus musculus
taccatgcatgcgattttggaacct

SEQ ID NO: 762590 - DNA, 25 bp, Mus musculus
taccatgcattgctgcgctgcgaga

SEQ ID NO: 762591 - DNA, 25 bp, Mus musculus
taccatgcattggtgcgctgcgaga

SEQ ID NO: 762592 - DNA, 25 bp, Mus musculus
taccatgccaacatctgtctgggac

SEQ ID NO: 762593 - DNA, 25 bp, Mus musculus
taccatgccaacttctgtctgggac

SEQ ID NO: 762594 - DNA, 25 bp, Mus musculus
taccatgccctaaagaatcaaatat

SEQ ID NO: 762595 - DNA, 25 bp, Mus musculus
taccatgccctatagaatcaaatat

SEQ ID NO: 762596 - DNA, 25 bp, Mus musculus
taccatgcctctctgtagctggtga

SEQ ID NO: 762597 - DNA, 25 bp, Mus musculus
taccatgcctctgtgtagctggtga

SEQ ID NO: 762598 - DNA, 25 bp, Mus musculus
taccatgcctgcattatgtttatat

SEQ ID NO: 762599 - DNA, 25 bp, Mus musculus
taccatgcctgctttatgtttatat

SEQ ID NO: 762600 - DNA, 25 bp, Mus musculus
taccatgcctggatcccaagttttt

SEQ ID NO: 762601 - DNA, 25 bp, Mus musculus
taccatgcctggttcccaagttttt

SEQ ID NO: 762602 - DNA, 25 bp, Mus musculus
taccatgctatgagttgagcgaaca

SEQ ID NO: 762603 - DNA, 25 bp, Mus musculus
taccatgctatgtgttgagcgaaca

SEQ ID NO: 762604 - DNA, 25 bp, Mus musculus
taccatgctccgcaaggagggaccc

SEQ ID NO: 762605 - DNA, 25 bp, Mus musculus
taccatgctccggaaggagggaccc

SEQ ID NO: 762606 - DNA, 25 bp, Mus musculus
taccatgctctgattactttaggat

SEQ ID NO: 762607 - DNA, 25 bp, Mus musculus
taccatgctctgtttactttaggat

SEQ ID NO: 762608 - DNA, 25 bp, Mus musculus
taccatgctgagatgatactgcgct

SEQ ID NO: 762609 - DNA, 25 bp, Mus musculus
taccatgctgagttgatactgcgct

SEQ ID NO: 762610 - DNA, 25 bp, Mus musculus
taccatgcttgcctagaataaagga

SEQ ID NO: 762611 - DNA, 25 bp, Mus musculus
taccatgcttgcgtagaataaagga

SEQ ID NO: 762612 - DNA, 25 bp, Mus musculus
taccatggaaggaccgtgtgcctat

SEQ ID NO: 762613 - DNA, 25 bp, Mus musculus
taccatggaaggtccgtgtgcctat

SEQ ID NO: 762614 - DNA, 25 bp, Mus musculus
taccatggagcaaccctaggtactg

SEQ ID NO: 762615 - DNA, 25 bp, Mus musculus
taccatggagcatccctaggtactg

SEQ ID NO: 762616 - DNA, 25 bp, Mus musculus
taccatggattgatcttttgggcat

SEQ ID NO: 762617 - DNA, 25 bp, Mus musculus
taccatggattgttcttttgggcat

SEQ ID NO: 762618 - DNA, 25 bp, Mus musculus
taccatggcaacagggcttcttttt

SEQ ID NO: 762619 - DNA, 25 bp, Mus musculus
taccatggcaactgggcttcttttt

SEQ ID NO: 762620 - DNA, 25 bp, Mus musculus
taccatggctgcctgaccaagcgag

SEQ ID NO: 762621 - DNA, 25 bp, Mus musculus
taccatggctgcgtgaccaagcgag

SEQ ID NO: 762622 - DNA, 25 bp, Mus musculus
taccatgggattcccaagaagcctt

SEQ ID NO: 762623 - DNA, 25 bp, Mus musculus
taccatgggattgccaagaagcctt

SEQ ID NO: 762624 - DNA, 25 bp, Mus musculus
taccatgggcggagagatgtggagc

SEQ ID NO: 762625 - DNA, 25 bp, Mus musculus
taccatgggcggtgagatgtggagc

SEQ ID NO: 762626 - DNA, 25 bp, Mus musculus
taccatggtattacatacccgtggt

SEQ ID NO: 762627 - DNA, 25 bp, Mus musculus
taccatggtatttcatacccgtggt

SEQ ID NO: 762628 - DNA, 25 bp, Mus musculus
taccatgtacggaaatgtgaaagac

SEQ ID NO: 762629 - DNA, 25 bp, Mus musculus
taccatgtacggtaatgtgaaagac

SEQ ID NO: 762630 - DNA, 25 bp, Mus musculus
taccatgtagaaacctatgacttaa

SEQ ID NO: 762631 - DNA, 25 bp, Mus musculus
taccatgtagaatcctatgacttaa

SEQ ID NO: 762632 - DNA, 25 bp, Mus musculus
taccatgtatgtccaggagcctgca

SEQ ID NO: 762633 - DNA, 25 bp, Mus musculus
taccatgtatgtgcaggagcctgca

SEQ ID NO: 762634 - DNA, 25 bp, Mus musculus
taccatgtcagtcctctggagttaa

SEQ ID NO: 762635 - DNA, 25 bp, Mus musculus
taccatgtcagtgctctggagttaa

SEQ ID NO: 762636 - DNA, 25 bp, Mus musculus
taccatgtccatatgcagacttctg

SEQ ID NO: 762637 - DNA, 25 bp, Mus musculus
taccatgtccatttgcagacttctg

SEQ ID NO: 762638 - DNA, 25 bp, Mus musculus
taccatgtcctgagccctcttttca

SEQ ID NO: 762639 - DNA, 25 bp, Mus musculus
taccatgtcctgtgccctcttttca

SEQ ID NO: 762640 - DNA, 25 bp, Mus musculus
taccatgtctggacgcggcaagcag

SEQ ID NO: 762641 - DNA, 25 bp, Mus musculus
taccatgtctggtcgcggcaagcag

SEQ ID NO: 762642 - DNA, 25 bp, Mus musculus
taccatgtgatactgcagctgcaag

SEQ ID NO: 762643 - DNA, 25 bp, Mus musculus
taccatgtgatagtgcagctgcaag

SEQ ID NO: 762644 - DNA, 25 bp, Mus musculus
taccatgtgcaccacctcattggag

SEQ ID NO: 762645 - DNA, 25 bp, Mus musculus
taccatgtgcacgacctcattggag

SEQ ID NO: 762646 - DNA, 25 bp, Mus musculus
taccatgtgccccagtttacaaagt

SEQ ID NO: 762647 - DNA, 25 bp, Mus musculus
taccatgtgcccgagtttacaaagt

SEQ ID NO: 762648 - DNA, 25 bp, Mus musculus
taccatgtgtcaactagtccgaggg

SEQ ID NO: 762649 - DNA, 25 bp, Mus musculus
taccatgtgtcatctagtccgaggg

SEQ ID NO: 762650 - DNA, 25 bp, Mus musculus
taccatgttttcattctccagtcat

SEQ ID NO: 762651 - DNA, 25 bp, Mus musculus
taccatgttttctttctccagtcat

SEQ ID NO: 762652 - DNA, 25 bp, Mus musculus
taccattacgtaaaccttgtctgag

SEQ ID NO: 762653 - DNA, 25 bp, Mus musculus
taccattacgtataccttgtctgag

SEQ ID NO: 762654 - DNA, 25 bp, Mus musculus
taccattactaccaagatccctgag

SEQ ID NO: 762655 - DNA, 25 bp, Mus musculus
taccattactacgaagatccctgag

SEQ ID NO: 762656 - DNA, 25 bp, Mus musculus
taccattacttgaatacctgacatt

SEQ ID NO: 762657 - DNA, 25 bp, Mus musculus
taccattacttgtatacctgacatt

SEQ ID NO: 762658 - DNA, 25 bp, Mus musculus
taccattaggttattgtagcttcat

SEQ ID NO: 762659 - DNA, 25 bp, Mus musculus
taccattaggtttttgtagcttcat

SEQ ID NO: 762660 - DNA, 25 bp, Mus musculus
taccattattagaccagtcaccaca

SEQ ID NO: 762661 - DNA, 25 bp, Mus musculus
taccattattagtccagtcaccaca

SEQ ID NO: 762662 - DNA, 25 bp, Mus musculus
taccattattttaatcagagcgctg

SEQ ID NO: 762663 - DNA, 25 bp, Mus musculus
taccattatttttatcagagcgctg

SEQ ID NO: 762664 - DNA, 25 bp, Mus musculus
taccattcaagtccctcttgttgaa

SEQ ID NO: 762665 - DNA, 25 bp, Mus musculus
taccattcaagtgcctcttgttgaa

SEQ ID NO: 762666 - DNA, 25 bp, Mus musculus
taccattcagacacaatcttggaag

SEQ ID NO: 762667 - DNA, 25 bp, Mus musculus
taccattcagactcaatcttggaag

SEQ ID NO: 762668 - DNA, 25 bp, Mus musculus
taccattcatgactgctctactctc

SEQ ID NO: 762669 - DNA, 25 bp, Mus musculus
taccattcatgagtgctctactctc

SEQ ID NO: 762670 - DNA, 25 bp, Mus musculus
taccattccggtaaagatttgctag

SEQ ID NO: 762671 - DNA, 25 bp, Mus musculus
taccattccggttaagatttgctag

SEQ ID NO: 762672 - DNA, 25 bp, Mus musculus
taccattccttaattgtttttgtgt

SEQ ID NO: 762673 - DNA, 25 bp, Mus musculus
taccattccttatttgtttttgtgt

SEQ ID NO: 762674 - DNA, 25 bp, Mus musculus
taccattctgccacaaggagactgg

SEQ ID NO: 762675 - DNA, 25 bp, Mus musculus
taccattctgcctcaaggagactgg

SEQ ID NO: 762676 - DNA, 25 bp, Mus musculus
taccattctggaaataagcctggaa

SEQ ID NO: 762677 - DNA, 25 bp, Mus musculus
taccattctggatataagcctggaa

SEQ ID NO: 762678 - DNA, 25 bp, Mus musculus
taccattcttcactttgcttacctt

SEQ ID NO: 762679 - DNA, 25 bp, Mus musculus
taccattcttcagtttgcttacctt

SEQ ID NO: 762680 - DNA, 25 bp, Mus musculus
taccattggtcaacgccgaaatttt

SEQ ID NO: 762681 - DNA, 25 bp, Mus musculus
taccattggtcatcgccgaaatttt

SEQ ID NO: 762682 - DNA, 25 bp, Mus musculus
taccattgtactattcataggagga

SEQ ID NO: 762683 - DNA, 25 bp, Mus musculus
taccattgtacttttcataggagga

SEQ ID NO: 762684 - DNA, 25 bp, Mus musculus
taccattgttataggcactcccagt

SEQ ID NO: 762685 - DNA, 25 bp, Mus musculus
taccattgttattggcactcccagt

SEQ ID NO: 762686 - DNA, 25 bp, Mus musculus
taccatttaggtcattacattaaga

SEQ ID NO: 762687 - DNA, 25 bp, Mus musculus
taccatttaggtgattacattaaga

SEQ ID NO: 762688 - DNA, 25 bp, Mus musculus
taccatttctataaaccttaccctg

SEQ ID NO: 762689 - DNA, 25 bp, Mus musculus
taccatttctattaaccttaccctg

SEQ ID NO: 762690 - DNA, 25 bp, Mus musculus
taccatttctctctgacatttgtca

SEQ ID NO: 762691 - DNA, 25 bp, Mus musculus
taccatttctctgtgacatttgtca

SEQ ID NO: 762692 - DNA, 25 bp, Mus musculus
taccatttgcacaacacagggctct

SEQ ID NO: 762693 - DNA, 25 bp, Mus musculus
taccatttgcactacacagggctct

SEQ ID NO: 762694 - DNA, 25 bp, Mus musculus
taccatttgggtagcttctactaag

SEQ ID NO: 762695 - DNA, 25 bp, Mus musculus
taccatttgggttgcttctactaag

SEQ ID NO: 762696 - DNA, 25 bp, Mus musculus
taccatttggtgactaccgttctta

SEQ ID NO: 762697 - DNA, 25 bp, Mus musculus
taccatttggtgtctaccgttctta

SEQ ID NO: 762698 - DNA, 25 bp, Mus musculus
taccatttgtgacctgccatcctaa

SEQ ID NO: 762699 - DNA, 25 bp, Mus musculus
taccatttgtgagctgccatcctaa

SEQ ID NO: 762700 - DNA, 25 bp, Mus musculus
taccattttggcattcttgatacat

SEQ ID NO: 762701 - DNA, 25 bp, Mus musculus
taccattttggctttcttgatacat

SEQ ID NO: 762702 - DNA, 25 bp, Mus musculus
taccattttgtacatcagccacggg

SEQ ID NO: 762703 - DNA, 25 bp, Mus musculus
taccattttgtagatcagccacggg

SEQ ID NO: 762704 - DNA, 25 bp, Mus musculus
taccattttgttcgccagggacctt

SEQ ID NO: 762705 - DNA, 25 bp, Mus musculus
taccattttgttggccagggacctt

SEQ ID NO: 762706 - DNA, 25 bp, Mus musculus
taccatttttgcacatagcctagtg

SEQ ID NO: 762707 - DNA, 25 bp, Mus musculus
taccatttttgctcatagcctagtg

SEQ ID NO: 762708 - DNA, 25 bp, Mus musculus
taccattttttgcttgcactgaaaa

SEQ ID NO: 762709 - DNA, 25 bp, Mus musculus
taccattttttggttgcactgaaaa

SEQ ID NO: 762710 - DNA, 25 bp, Mus musculus
tacccaaaatgtccttctctgtctg

SEQ ID NO: 762711 - DNA, 25 bp, Mus musculus
tacccaaaatgtgcttctctgtctg

SEQ ID NO: 762712 - DNA, 25 bp, Mus musculus
tacccaaaccataacttctttatag

SEQ ID NO: 762713 - DNA, 25 bp, Mus musculus
tacccaaaccattacttctttatag

SEQ ID NO: 762714 - DNA, 25 bp, Mus musculus
tacccaaacttcctgccatgtaaag

SEQ ID NO: 762715 - DNA, 25 bp, Mus musculus
tacccaaacttcgtgccatgtaaag

SEQ ID NO: 762716 - DNA, 25 bp, Mus musculus
tacccaaagaacatgtttatctgtg

SEQ ID NO: 762717 - DNA, 25 bp, Mus musculus
tacccaaagaacttgtttatctgtg

SEQ ID NO: 762718 - DNA, 25 bp, Mus musculus
tacccaaagcataggaaagcgttcc

SEQ ID NO: 762719 - DNA, 25 bp, Mus musculus
tacccaaagcattggaaagcgttcc

SEQ ID NO: 762720 - DNA, 25 bp, Mus musculus
tacccaaatcccaccataagagaac

SEQ ID NO: 762721 - DNA, 25 bp, Mus musculus
tacccaaatccctccataagagaac

SEQ ID NO: 762722 - DNA, 25 bp, Mus musculus
tacccaaatggcagagaaacggttt

SEQ ID NO: 762723 - DNA, 25 bp, Mus musculus
tacccaaatggctgagaaacggttt

SEQ ID NO: 762724 - DNA, 25 bp, Mus musculus
tacccaaattttaatatacaccgtg

SEQ ID NO: 762725 - DNA, 25 bp, Mus musculus
tacccaaatttttatatacaccgtg

SEQ ID NO: 762726 - DNA, 25 bp, Mus musculus
tacccaacatggcactagcctttga

SEQ ID NO: 762727 - DNA, 25 bp, Mus musculus
tacccaacatgggactagcctttga

SEQ ID NO: 762728 - DNA, 25 bp, Mus musculus
tacccaacccaaccctgtatttatt

SEQ ID NO: 762729 - DNA, 25 bp, Mus musculus
tacccaacccaagcctgtatttatt

SEQ ID NO: 762730 - DNA, 25 bp, Mus musculus
tacccaaccctgaagaagttagaag

SEQ ID NO: 762731 - DNA, 25 bp, Mus musculus
tacccaaccctgtagaagttagaag

SEQ ID NO: 762732 - DNA, 25 bp, Mus musculus
tacccaactctgaagtctctgcagg

SEQ ID NO: 762733 - DNA, 25 bp, Mus musculus
tacccaactctgacatctgtaacaa

SEQ ID NO: 762734 - DNA, 25 bp, Mus musculus
tacccaactctgtagtctctgcagg

SEQ ID NO: 762735 - DNA, 25 bp, Mus musculus
tacccaactctgtcatctgtaacaa

SEQ ID NO: 762736 - DNA, 25 bp, Mus musculus
tacccaactggaatacgtactactt

SEQ ID NO: 762737 - DNA, 25 bp, Mus musculus
tacccaactggattacgtactactt

SEQ ID NO: 762738 - DNA, 25 bp, Mus musculus
tacccaagaactactactctttctc

SEQ ID NO: 762739 - DNA, 25 bp, Mus musculus
tacccaagaacttctactctttctc

SEQ ID NO: 762740 - DNA, 25 bp, Mus musculus
tacccaagagctatcccaggatggc

SEQ ID NO: 762741 - DNA, 25 bp, Mus musculus
tacccaagagctcccaaggtttact

SEQ ID NO: 762742 - DNA, 25 bp, Mus musculus
tacccaagagctgccaaggtttact

SEQ ID NO: 762743 - DNA, 25 bp, Mus musculus
tacccaagagctttcccaggatggc

SEQ ID NO: 762744 - DNA, 25 bp, Mus musculus
tacccaagctttatcaaactgttag

SEQ ID NO: 762745 - DNA, 25 bp, Mus musculus
tacccaagctttttcaaactgttag

SEQ ID NO: 762746 - DNA, 25 bp, Mus musculus
tacccaaggacgagaatgtcgccat

SEQ ID NO: 762747 - DNA, 25 bp, Mus musculus
tacccaaggacgtgaatgtcgccat

SEQ ID NO: 762748 - DNA, 25 bp, Mus musculus
tacccaaggactcgaatcgccctta

SEQ ID NO: 762749 - DNA, 25 bp, Mus musculus
tacccaaggactggaatcgccctta

SEQ ID NO: 762750 - DNA, 25 bp, Mus musculus
tacccaaggctcattctagctggaa

SEQ ID NO: 762751 - DNA, 25 bp, Mus musculus
tacccaaggctctttctagctggaa

SEQ ID NO: 762752 - DNA, 25 bp, Mus musculus
tacccaaggtctctctttcattgtc

SEQ ID NO: 762753 - DNA, 25 bp, Mus musculus
tacccaaggtctgtctttcattgtc

SEQ ID NO: 762754 - DNA, 25 bp, Mus musculus
tacccaagtaccatcagaaccaaaa

SEQ ID NO: 762755 - DNA, 25 bp, Mus musculus
tacccaagtaccttcagaaccaaaa

SEQ ID NO: 762756 - DNA, 25 bp, Mus musculus
tacccaagtgaaatgcagacctcag

SEQ ID NO: 762757 - DNA, 25 bp, Mus musculus
tacccaagtgaattgcagacctcag

SEQ ID NO: 762758 - DNA, 25 bp, Mus musculus
tacccaagtgctcggctctagcgaa

SEQ ID NO: 762759 - DNA, 25 bp, Mus musculus
tacccaagtgctgggctctagcgaa

SEQ ID NO: 762760 - DNA, 25 bp, Mus musculus
tacccaagtggccattcaccaaatt

SEQ ID NO: 762761 - DNA, 25 bp, Mus musculus
tacccaagtggcgattcaccaaatt

SEQ ID NO: 762762 - DNA, 25 bp, Mus musculus
tacccaataatgatagatttctagt

SEQ ID NO: 762763 - DNA, 25 bp, Mus musculus
tacccaataatgttagatttctagt

SEQ ID NO: 762764 - DNA, 25 bp, Mus musculus
tacccaatatagaagtcacccagat

SEQ ID NO: 762765 - DNA, 25 bp, Mus musculus
tacccaatatagtagtcacccagat

SEQ ID NO: 762766 - DNA, 25 bp, Mus musculus
tacccaatcatcagggcagcgggca

SEQ ID NO: 762767 - DNA, 25 bp, Mus musculus
tacccaatcatctgggcagcgggca

SEQ ID NO: 762768 - DNA, 25 bp, Mus musculus
tacccaatgaggagatcctacagat

SEQ ID NO: 762769 - DNA, 25 bp, Mus musculus
tacccaatgaggtgatcctacagat

SEQ ID NO: 762770 - DNA, 25 bp, Mus musculus
tacccaattcctatggcctggacta

SEQ ID NO: 762771 - DNA, 25 bp, Mus musculus
tacccaattcctttggcctggacta

SEQ ID NO: 762772 - DNA, 25 bp, Mus musculus
tacccacaagagctctagctggtct

SEQ ID NO: 762773 - DNA, 25 bp, Mus musculus
tacccacaagaggtctagctggtct

SEQ ID NO: 762774 - DNA, 25 bp, Mus musculus
tacccacaatccatttcacaggaca

SEQ ID NO: 762775 - DNA, 25 bp, Mus musculus
tacccacaatccttttcacaggaca

SEQ ID NO: 762776 - DNA, 25 bp, Mus musculus
tacccacaatggactaggttctccc

SEQ ID NO: 762777 - DNA, 25 bp, Mus musculus
tacccacaatggtctaggttctccc

SEQ ID NO: 762778 - DNA, 25 bp, Mus musculus
tacccacactgcagaggatggcata

SEQ ID NO: 762779 - DNA, 25 bp, Mus musculus
tacccacactgctgaggatggcata

SEQ ID NO: 762780 - DNA, 25 bp, Mus musculus
tacccacactggatatgcctttgag

SEQ ID NO: 762781 - DNA, 25 bp, Mus musculus
tacccacactggttatgcctttgag

SEQ ID NO: 762782 - DNA, 25 bp, Mus musculus
tacccacagggcaaagctcaggctc

SEQ ID NO: 762783 - DNA, 25 bp, Mus musculus
tacccacagggctaagctcaggctc

SEQ ID NO: 762784 - DNA, 25 bp, Mus musculus
tacccacagggtagacttctaagga

SEQ ID NO: 762785 - DNA, 25 bp, Mus musculus
tacccacagggttgacttctaagga

SEQ ID NO: 762786 - DNA, 25 bp, Mus musculus
tacccacaggtactagccataggca

SEQ ID NO: 762787 - DNA, 25 bp, Mus musculus
tacccacaggtagtagccataggca

SEQ ID NO: 762788 - DNA, 25 bp, Mus musculus
tacccacatacaacactcatggtga

SEQ ID NO: 762789 - DNA, 25 bp, Mus musculus
tacccacatacatcactcatggtga

SEQ ID NO: 762790 - DNA, 25 bp, Mus musculus
tacccacatattcttggtcaccttg

SEQ ID NO: 762791 - DNA, 25 bp, Mus musculus
tacccacatattgttggtcaccttg

SEQ ID NO: 762792 - DNA, 25 bp, Mus musculus
tacccacatgggactatgattgaag

SEQ ID NO: 762793 - DNA, 25 bp, Mus musculus
tacccacatgggtctatgattgaag

SEQ ID NO: 762794 - DNA, 25 bp, Mus musculus
tacccaccaagactcaccattaaag

SEQ ID NO: 762795 - DNA, 25 bp, Mus musculus
tacccaccaagagtcaccattaaag

SEQ ID NO: 762796 - DNA, 25 bp, Mus musculus
tacccaccacatagagctatgctga

SEQ ID NO: 762797 - DNA, 25 bp, Mus musculus
tacccaccacattgagctatgctga

SEQ ID NO: 762798 - DNA, 25 bp, Mus musculus
tacccaccactgcacataaatcatt

SEQ ID NO: 762799 - DNA, 25 bp, Mus musculus
tacccaccactggacataaatcatt

SEQ ID NO: 762800 - DNA, 25 bp, Mus musculus
tacccaccaggtagtacttaacgca

SEQ ID NO: 762801 - DNA, 25 bp, Mus musculus
tacccaccaggttgtacttaacgca

SEQ ID NO: 762802 - DNA, 25 bp, Mus musculus
tacccacccatgaagagcatgaagg

SEQ ID NO: 762803 - DNA, 25 bp, Mus musculus
tacccacccatgtagagcatgaagg

SEQ ID NO: 762804 - DNA, 25 bp, Mus musculus
tacccacccgtaaaagcccagtgct

SEQ ID NO: 762805 - DNA, 25 bp, Mus musculus
tacccacccgtataagcccagtgct

SEQ ID NO: 762806 - DNA, 25 bp, Mus musculus
tacccaccgatgaactttaaccttg

SEQ ID NO: 762807 - DNA, 25 bp, Mus musculus
tacccaccgatgtactttaaccttg

SEQ ID NO: 762808 - DNA, 25 bp, Mus musculus
tacccacctctcacaggaaaggaaa

SEQ ID NO: 762809 - DNA, 25 bp, Mus musculus
tacccacctctctcaggaaaggaaa

SEQ ID NO: 762810 - DNA, 25 bp, Mus musculus
tacccacctggacgactttaacaca

SEQ ID NO: 762811 - DNA, 25 bp, Mus musculus
tacccacctggaggactttaacaca

SEQ ID NO: 762812 - DNA, 25 bp, Mus musculus
tacccacgaacaccatctactgatg

SEQ ID NO: 762813 - DNA, 25 bp, Mus musculus
tacccacgaacagcatctactgatg

SEQ ID NO: 762814 - DNA, 25 bp, Mus musculus
tacccacgaatacacacgcatttgt

SEQ ID NO: 762815 - DNA, 25 bp, Mus musculus
tacccacgaatagacacgcatttgt

SEQ ID NO: 762816 - DNA, 25 bp, Mus musculus
tacccacgcagccagtcaagggagt

SEQ ID NO: 762817 - DNA, 25 bp, Mus musculus
tacccacgcagcgagtcaagggagt

SEQ ID NO: 762818 - DNA, 25 bp, Mus musculus
tacccacgctaccagtctgattata

SEQ ID NO: 762819 - DNA, 25 bp, Mus musculus
tacccacgctacgagtctgattata

SEQ ID NO: 762820 - DNA, 25 bp, Mus musculus
tacccacgtgacaggaaacccattg

SEQ ID NO: 762821 - DNA, 25 bp, Mus musculus
tacccacgtgactggaaacccattg

SEQ ID NO: 762822 - DNA, 25 bp, Mus musculus
tacccacgtgccatagtgcacacat

SEQ ID NO: 762823 - DNA, 25 bp, Mus musculus
tacccacgtgccttagtgcacacat

SEQ ID NO: 762824 - DNA, 25 bp, Mus musculus
tacccacgtgggagaatgagaacaa

SEQ ID NO: 762825 - DNA, 25 bp, Mus musculus
tacccacgtgggtgaatgagaacaa

SEQ ID NO: 762826 - DNA, 25 bp, Mus musculus
tacccactaggtctcacagtaggtt

SEQ ID NO: 762827 - DNA, 25 bp, Mus musculus
tacccactaggtgtcacagtaggtt

SEQ ID NO: 762828 - DNA, 25 bp, Mus musculus
tacccactagtcctgttcttgtaac

SEQ ID NO: 762829 - DNA, 25 bp, Mus musculus
tacccactagtcgtgttcttgtaac

SEQ ID NO: 762830 - DNA, 25 bp, Mus musculus
tacccactcacaagtactttctgat

SEQ ID NO: 762831 - DNA, 25 bp, Mus musculus
tacccactcacatgtactttctgat

SEQ ID NO: 762832 - DNA, 25 bp, Mus musculus
tacccactcacgatcggtggtggga

SEQ ID NO: 762833 - DNA, 25 bp, Mus musculus
tacccactcacgttcggtggtggga

SEQ ID NO: 762834 - DNA, 25 bp, Mus musculus
tacccactctatccagtagctactg

SEQ ID NO: 762835 - DNA, 25 bp, Mus musculus
tacccactctatgcagtagctactg

SEQ ID NO: 762836 - DNA, 25 bp, Mus musculus
tacccactgatcagtattgaagaat

SEQ ID NO: 762837 - DNA, 25 bp, Mus musculus
tacccactgatctgtattgaagaat

SEQ ID NO: 762838 - DNA, 25 bp, Mus musculus
tacccactgtctcaacgttgtcatt

SEQ ID NO: 762839 - DNA, 25 bp, Mus musculus
tacccactgtctgaacgttgtcatt

SEQ ID NO: 762840 - DNA, 25 bp, Mus musculus
tacccacttccaatttgtaaaacag

SEQ ID NO: 762841 - DNA, 25 bp, Mus musculus
tacccacttccattttgtaaaacag

SEQ ID NO: 762842 - DNA, 25 bp, Mus musculus
tacccacttctcaacatgacttagt

SEQ ID NO: 762843 - DNA, 25 bp, Mus musculus
tacccacttctctacatgacttagt

SEQ ID NO: 762844 - DNA, 25 bp, Mus musculus
tacccacttctgagcttgtgactgg

SEQ ID NO: 762845 - DNA, 25 bp, Mus musculus
tacccacttctgcttattttaacca

SEQ ID NO: 762846 - DNA, 25 bp, Mus musculus
tacccacttctggttattttaacca

SEQ ID NO: 762847 - DNA, 25 bp, Mus musculus
tacccacttctgtgcttgtgactgg

SEQ ID NO: 762848 - DNA, 25 bp, Mus musculus
tacccacttgccatgcagaggcctg

SEQ ID NO: 762849 - DNA, 25 bp, Mus musculus
tacccacttgccttgcagaggcctg

SEQ ID NO: 762850 - DNA, 25 bp, Mus musculus
tacccacttggaaaccttgccgctg

SEQ ID NO: 762851 - DNA, 25 bp, Mus musculus
tacccacttggataccttgccgctg

SEQ ID NO: 762852 - DNA, 25 bp, Mus musculus
tacccagaacatacctgctggcaag

SEQ ID NO: 762853 - DNA, 25 bp, Mus musculus
tacccagaacattcctgctggcaag

SEQ ID NO: 762854 - DNA, 25 bp, Mus musculus
tacccagaagcaatctcggccatac

SEQ ID NO: 762855 - DNA, 25 bp, Mus musculus
tacccagaagcattctcggccatac

SEQ ID NO: 762856 - DNA, 25 bp, Mus musculus
tacccagaaggcatcccatgcctga

SEQ ID NO: 762857 - DNA, 25 bp, Mus musculus
tacccagaaggcttcccatgcctga

SEQ ID NO: 762858 - DNA, 25 bp, Mus musculus
tacccagaagtgatccatactacaa

SEQ ID NO: 762859 - DNA, 25 bp, Mus musculus
tacccagaagtgttccatactacaa

SEQ ID NO: 762860 - DNA, 25 bp, Mus musculus
tacccagaccgcaagtagaggcagg

SEQ ID NO: 762861 - DNA, 25 bp, Mus musculus
tacccagaccgctagtagaggcagg

SEQ ID NO: 762862 - DNA, 25 bp, Mus musculus
tacccagacgcccaagggtgtcgcg

SEQ ID NO: 762863 - DNA, 25 bp, Mus musculus
tacccagacgccgaagggtgtcgcg

SEQ ID NO: 762864 - DNA, 25 bp, Mus musculus
tacccagactgcagagcttcaggat

SEQ ID NO: 762865 - DNA, 25 bp, Mus musculus
tacccagactgctgagcttcaggat

SEQ ID NO: 762866 - DNA, 25 bp, Mus musculus
tacccagactggctcacagcaggtg

SEQ ID NO: 762867 - DNA, 25 bp, Mus musculus
tacccagactgggtcacagcaggtg

SEQ ID NO: 762868 - DNA, 25 bp, Mus musculus
tacccagagattaaacaggaattcc

SEQ ID NO: 762869 - DNA, 25 bp, Mus musculus
tacccagagattaattttagttgca

SEQ ID NO: 762870 - DNA, 25 bp, Mus musculus
tacccagagatttaacaggaattcc

SEQ ID NO: 762871 - DNA, 25 bp, Mus musculus
tacccagagatttattttagttgca

SEQ ID NO: 762872 - DNA, 25 bp, Mus musculus
tacccagagcagctagtaccaggct

SEQ ID NO: 762873 - DNA, 25 bp, Mus musculus
tacccagagcaggtagtaccaggct

SEQ ID NO: 762874 - DNA, 25 bp, Mus musculus
tacccagagctaagtttccatgatg

SEQ ID NO: 762875 - DNA, 25 bp, Mus musculus
tacccagagctatgtttccatgatg

SEQ ID NO: 762876 - DNA, 25 bp, Mus musculus
tacccagagcttccacattttctag

SEQ ID NO: 762877 - DNA, 25 bp, Mus musculus
tacccagagcttcccattaaagact

SEQ ID NO: 762878 - DNA, 25 bp, Mus musculus
tacccagagcttgcacattttctag

SEQ ID NO: 762879 - DNA, 25 bp, Mus musculus
tacccagagcttgccattaaagact

SEQ ID NO: 762880 - DNA, 25 bp, Mus musculus
tacccagaggcgctactgaatgtat

SEQ ID NO: 762881 - DNA, 25 bp, Mus musculus
tacccagaggcggtactgaatgtat

SEQ ID NO: 762882 - DNA, 25 bp, Mus musculus
tacccagatggaccttacaggcaag

SEQ ID NO: 762883 - DNA, 25 bp, Mus musculus
tacccagatggagcttacaggcaag

SEQ ID NO: 762884 - DNA, 25 bp, Mus musculus
tacccagattttcagtttgtactgc

SEQ ID NO: 762885 - DNA, 25 bp, Mus musculus
tacccagattttgagtttgtactgc

SEQ ID NO: 762886 - DNA, 25 bp, Mus musculus
tacccagcagatcacgcgatgagtt

SEQ ID NO: 762887 - DNA, 25 bp, Mus musculus
tacccagcagatgacgcgatgagtt

SEQ ID NO: 762888 - DNA, 25 bp, Mus musculus
tacccagcaggcatcagcaggcttc

SEQ ID NO: 762889 - DNA, 25 bp, Mus musculus
tacccagcaggcttcagcaggcttc

SEQ ID NO: 762890 - DNA, 25 bp, Mus musculus
tacccagcagtaagccaagtctctg

SEQ ID NO: 762891 - DNA, 25 bp, Mus musculus
tacccagcagtatgccaagtctctg

SEQ ID NO: 762892 - DNA, 25 bp, Mus musculus
tacccagcatgccacaatctgattg

SEQ ID NO: 762893 - DNA, 25 bp, Mus musculus
tacccagcatgcgacaatctgattg

SEQ ID NO: 762894 - DNA, 25 bp, Mus musculus
tacccagccaaccagaagagtccta

SEQ ID NO: 762895 - DNA, 25 bp, Mus musculus
tacccagccaacgagaagagtccta

SEQ ID NO: 762896 - DNA, 25 bp, Mus musculus
tacccagccaagatcaaagtgcgct

SEQ ID NO: 762897 - DNA, 25 bp, Mus musculus
tacccagccaagttcaaagtgcgct

SEQ ID NO: 762898 - DNA, 25 bp, Mus musculus
tacccagccctgaggtgactgacca

SEQ ID NO: 762899 - DNA, 25 bp, Mus musculus
tacccagccctgtggtgactgacca

SEQ ID NO: 762900 - DNA, 25 bp, Mus musculus
tacccagcctacatctcaatgaaag

SEQ ID NO: 762901 - DNA, 25 bp, Mus musculus
tacccagcctacttctcaatgaaag

SEQ ID NO: 762902 - DNA, 25 bp, Mus musculus
tacccagcctccagtgttatttata

SEQ ID NO: 762903 - DNA, 25 bp, Mus musculus
tacccagcctcctgtgttatttata

SEQ ID NO: 762904 - DNA, 25 bp, Mus musculus
tacccagcctctaatgtgcctgtag

SEQ ID NO: 762905 - DNA, 25 bp, Mus musculus
tacccagcctcttatgtgcctgtag

SEQ ID NO: 762906 - DNA, 25 bp, Mus musculus
tacccagcgccaactttagggaatg

SEQ ID NO: 762907 - DNA, 25 bp, Mus musculus
tacccagcgccatctttagggaatg

SEQ ID NO: 762908 - DNA, 25 bp, Mus musculus
tacccagcgtgtcctttatagacat

SEQ ID NO: 762909 - DNA, 25 bp, Mus musculus
tacccagcgtgtgctttatagacat

SEQ ID NO: 762910 - DNA, 25 bp, Mus musculus
tacccagctacaacatccttggtga

SEQ ID NO: 762911 - DNA, 25 bp, Mus musculus
tacccagctacatcatccttggtga

SEQ ID NO: 762912 - DNA, 25 bp, Mus musculus
tacccagctattaccctttcacatt

SEQ ID NO: 762913 - DNA, 25 bp, Mus musculus
tacccagctatttccctttcacatt

SEQ ID NO: 762914 - DNA, 25 bp, Mus musculus
tacccagctccaagggtgcccgtga

SEQ ID NO: 762915 - DNA, 25 bp, Mus musculus
tacccagctccatgggtgcccgtga

SEQ ID NO: 762916 - DNA, 25 bp, Mus musculus
tacccagctggtactttccatacaa

SEQ ID NO: 762917 - DNA, 25 bp, Mus musculus
tacccagctggttctttccatacaa

SEQ ID NO: 762918 - DNA, 25 bp, Mus musculus
tacccagcttccctggtgctaagga

SEQ ID NO: 762919 - DNA, 25 bp, Mus musculus
tacccagcttccgtggtgctaagga

SEQ ID NO: 762920 - DNA, 25 bp, Mus musculus
tacccaggaaatcaacttttgcaaa

SEQ ID NO: 762921 - DNA, 25 bp, Mus musculus
tacccaggaaatgaacttttgcaaa

SEQ ID NO: 762922 - DNA, 25 bp, Mus musculus
tacccaggataaattcagtttttct

SEQ ID NO: 762923 - DNA, 25 bp, Mus musculus
tacccaggataatttcagtttttct

SEQ ID NO: 762924 - DNA, 25 bp, Mus musculus
tacccaggatcacaaacccgtcaga

SEQ ID NO: 762925 - DNA, 25 bp, Mus musculus
tacccaggatcagaaacccgtcaga

SEQ ID NO: 762926 - DNA, 25 bp, Mus musculus
tacccaggattgctttagtcaataa

SEQ ID NO: 762927 - DNA, 25 bp, Mus musculus
tacccaggattggtttagtcaataa

SEQ ID NO: 762928 - DNA, 25 bp, Mus musculus
tacccaggcagacgtgctccgtgtc

SEQ ID NO: 762929 - DNA, 25 bp, Mus musculus
tacccaggcagaggtgctccgtgtc

SEQ ID NO: 762930 - DNA, 25 bp, Mus musculus
tacccaggccagattaccagcaata

SEQ ID NO: 762931 - DNA, 25 bp, Mus musculus
tacccaggccagtttaccagcaata

SEQ ID NO: 762932 - DNA, 25 bp, Mus musculus
tacccaggcccacagtcagtttgat

SEQ ID NO: 762933 - DNA, 25 bp, Mus musculus
tacccaggcccagagtcagtttgat

SEQ ID NO: 762934 - DNA, 25 bp, Mus musculus
tacccaggctttacccgagggcttg

SEQ ID NO: 762935 - DNA, 25 bp, Mus musculus
tacccaggcttttcccgagggcttg

SEQ ID NO: 762936 - DNA, 25 bp, Mus musculus
tacccagggtgcaaatacctattgg

SEQ ID NO: 762937 - DNA, 25 bp, Mus musculus
tacccagggtgctaatacctattgg

SEQ ID NO: 762938 - DNA, 25 bp, Mus musculus
tacccaggtacgcataggctagcat

SEQ ID NO: 762939 - DNA, 25 bp, Mus musculus
tacccaggtacggataggctagcat

SEQ ID NO: 762940 - DNA, 25 bp, Mus musculus
tacccaggttcaagcagtccgagca

SEQ ID NO: 762941 - DNA, 25 bp, Mus musculus
tacccaggttcatgcagtccgagca

SEQ ID NO: 762942 - DNA, 25 bp, Mus musculus
tacccaggttggactctcagagagc

SEQ ID NO: 762943 - DNA, 25 bp, Mus musculus
tacccaggttggtctctcagagagc

SEQ ID NO: 762944 - DNA, 25 bp, Mus musculus
tacccagtaaatactcctgaacgat

SEQ ID NO: 762945 - DNA, 25 bp, Mus musculus
tacccagtaaattctcctgaacgat

SEQ ID NO: 762946 - DNA, 25 bp, Mus musculus
tacccagtagatatagaataatgag

SEQ ID NO: 762947 - DNA, 25 bp, Mus musculus
tacccagtagatttagaataatgag

SEQ ID NO: 762948 - DNA, 25 bp, Mus musculus
tacccagtagctagggattttattt

SEQ ID NO: 762949 - DNA, 25 bp, Mus musculus
tacccagtagcttgggattttattt

SEQ ID NO: 762950 - DNA, 25 bp, Mus musculus
tacccagtcccaagaaaccaaagtc

SEQ ID NO: 762951 - DNA, 25 bp, Mus musculus
tacccagtcccatgaaaccaaagtc

SEQ ID NO: 762952 - DNA, 25 bp, Mus musculus
tacccagtcctgaatcgttcagtaa

SEQ ID NO: 762953 - DNA, 25 bp, Mus musculus
tacccagtcctgtatcgttcagtaa

SEQ ID NO: 762954 - DNA, 25 bp, Mus musculus
tacccagtcttacgtttccctagag

SEQ ID NO: 762955 - DNA, 25 bp, Mus musculus
tacccagtcttaggtttccctagag

SEQ ID NO: 762956 - DNA, 25 bp, Mus musculus
tacccagtggccagttcctagtatc

SEQ ID NO: 762957 - DNA, 25 bp, Mus musculus
tacccagtggcctgttcctagtatc

SEQ ID NO: 762958 - DNA, 25 bp, Mus musculus
tacccagtgggcagtggatccagtg

SEQ ID NO: 762959 - DNA, 25 bp, Mus musculus
tacccagtgggctgtggatccagtg

SEQ ID NO: 762960 - DNA, 25 bp, Mus musculus
tacccagtgtatctggcttctacag

SEQ ID NO: 762961 - DNA, 25 bp, Mus musculus
tacccagtgtatgtggcttctacag

SEQ ID NO: 762962 - DNA, 25 bp, Mus musculus
tacccagtgtggctatgacatccga

SEQ ID NO: 762963 - DNA, 25 bp, Mus musculus
tacccagtgtgggtatgacatccga

SEQ ID NO: 762964 - DNA, 25 bp, Mus musculus
tacccagtgttaacctctctacaat

SEQ ID NO: 762965 - DNA, 25 bp, Mus musculus
tacccagtgttatcctctctacaat

SEQ ID NO: 762966 - DNA, 25 bp, Mus musculus
tacccagtgttccatcgctttagct

SEQ ID NO: 762967 - DNA, 25 bp, Mus musculus
tacccagtgttcgatcgctttagct

SEQ ID NO: 762968 - DNA, 25 bp, Mus musculus
tacccagtgtttaccttgacagaac

SEQ ID NO: 762969 - DNA, 25 bp, Mus musculus
tacccagtgttttccttgacagaac

SEQ ID NO: 762970 - DNA, 25 bp, Mus musculus
tacccagttactatagaaccaacca

SEQ ID NO: 762971 - DNA, 25 bp, Mus musculus
tacccagttactttagaaccaacca

SEQ ID NO: 762972 - DNA, 25 bp, Mus musculus
tacccagttcacaaggcatctgctt

SEQ ID NO: 762973 - DNA, 25 bp, Mus musculus
tacccagttcactaggcatctgctt

SEQ ID NO: 762974 - DNA, 25 bp, Mus musculus
tacccagttcatactttgtaagaaa

SEQ ID NO: 762975 - DNA, 25 bp, Mus musculus
tacccagttcattctttgtaagaaa

SEQ ID NO: 762976 - DNA, 25 bp, Mus musculus
tacccagtttcccattcaatctcgt

SEQ ID NO: 762977 - DNA, 25 bp, Mus musculus
tacccagtttccgattcaatctcgt

SEQ ID NO: 762978 - DNA, 25 bp, Mus musculus
tacccagtttgacagtttttgtact

SEQ ID NO: 762979 - DNA, 25 bp, Mus musculus
tacccagtttgagagtttttgtact

SEQ ID NO: 762980 - DNA, 25 bp, Mus musculus
tacccatacatacctgtccttatgc

SEQ ID NO: 762981 - DNA, 25 bp, Mus musculus
tacccatacatagctgtccttatgc

SEQ ID NO: 762982 - DNA, 25 bp, Mus musculus
tacccatagtgtaatatttctccaa

SEQ ID NO: 762983 - DNA, 25 bp, Mus musculus
tacccatagtgttatatttctccaa

SEQ ID NO: 762984 - DNA, 25 bp, Mus musculus
tacccatatcatactgcattccaga

SEQ ID NO: 762985 - DNA, 25 bp, Mus musculus
tacccatatcattctgcattccaga

SEQ ID NO: 762986 - DNA, 25 bp, Mus musculus
tacccatccaaacaaatgtgccttg

SEQ ID NO: 762987 - DNA, 25 bp, Mus musculus
tacccatccaaagaaatgtgccttg

SEQ ID NO: 762988 - DNA, 25 bp, Mus musculus
tacccatcctggaaatattttcttt

SEQ ID NO: 762989 - DNA, 25 bp, Mus musculus
tacccatcctggtaatattttcttt

SEQ ID NO: 762990 - DNA, 25 bp, Mus musculus
tacccatctattcatgttcccatga

SEQ ID NO: 762991 - DNA, 25 bp, Mus musculus
tacccatctattgatgttcccatga

SEQ ID NO: 762992 - DNA, 25 bp, Mus musculus
tacccatgaagcctttaattctagc

SEQ ID NO: 762993 - DNA, 25 bp, Mus musculus
tacccatgaagcgtttaattctagc

SEQ ID NO: 762994 - DNA, 25 bp, Mus musculus
tacccatgactaacagaaaggagat

SEQ ID NO: 762995 - DNA, 25 bp, Mus musculus
tacccatgactatcagaaaggagat

SEQ ID NO: 762996 - DNA, 25 bp, Mus musculus
tacccatgagtcaggggtgaagcca

SEQ ID NO: 762997 - DNA, 25 bp, Mus musculus
tacccatgagtctggggtgaagcca

SEQ ID NO: 762998 - DNA, 25 bp, Mus musculus
tacccatgatcacatccagcgagga

SEQ ID NO: 762999 - DNA, 25 bp, Mus musculus
tacccatgatcagatccagcgagga

SEQ ID NO: 763000 - DNA, 25 bp, Mus musculus
tacccatggaccctgagacttgggg

SEQ ID NO: 763001 - DNA, 25 bp, Mus musculus
tacccatggaccgtgagacttgggg

SEQ ID NO: 763002 - DNA, 25 bp, Mus musculus
tacccatggcttacagtagacattt

SEQ ID NO: 763003 - DNA, 25 bp, Mus musculus
tacccatggctttcagtagacattt

SEQ ID NO: 763004 - DNA, 25 bp, Mus musculus
tacccatgggtacttaagcttgaga

SEQ ID NO: 763005 - DNA, 25 bp, Mus musculus
tacccatgggtagttaagcttgaga

SEQ ID NO: 763006 - DNA, 25 bp, Mus musculus
tacccatgtagtagtatcacttttg

SEQ ID NO: 763007 - DNA, 25 bp, Mus musculus
tacccatgtagttgtatcacttttg

SEQ ID NO: 763008 - DNA, 25 bp, Mus musculus
tacccatgtgttattctaactcaac

SEQ ID NO: 763009 - DNA, 25 bp, Mus musculus
tacccatgtgtttttctaactcaac

SEQ ID NO: 763010 - DNA, 25 bp, Mus musculus
tacccattcttcaggcttttcccta

SEQ ID NO: 763011 - DNA, 25 bp, Mus musculus
tacccattcttctggcttttcccta

SEQ ID NO: 763012 - DNA, 25 bp, Mus musculus
tacccattgccaaaccacgagagct

SEQ ID NO: 763013 - DNA, 25 bp, Mus musculus
tacccattgccataccacgagagct

SEQ ID NO: 763014 - DNA, 25 bp, Mus musculus
tacccattgtccctgtcctggttgg

SEQ ID NO: 763015 - DNA, 25 bp, Mus musculus
tacccattgtccgtgtcctggttgg

SEQ ID NO: 763016 - DNA, 25 bp, Mus musculus
tacccatttccaaagcattccagat

SEQ ID NO: 763017 - DNA, 25 bp, Mus musculus
tacccatttccatagcattccagat

SEQ ID NO: 763018 - DNA, 25 bp, Mus musculus
tacccattttctcatcatcggttgc

SEQ ID NO: 763019 - DNA, 25 bp, Mus musculus
tacccattttctgatcatcggttgc

SEQ ID NO: 763020 - DNA, 25 bp, Mus musculus
taccccaaactcagaggactacctt

SEQ ID NO: 763021 - DNA, 25 bp, Mus musculus
taccccaaactctgaggactacctt

SEQ ID NO: 763022 - DNA, 25 bp, Mus musculus
taccccaaagagcacttcagcactt

SEQ ID NO: 763023 - DNA, 25 bp, Mus musculus
taccccaaagaggacttcagcactt

SEQ ID NO: 763024 - DNA, 25 bp, Mus musculus
taccccaaagcacaatggcaactgt

SEQ ID NO: 763025 - DNA, 25 bp, Mus musculus
taccccaaagcagaatggcaactgt

SEQ ID NO: 763026 - DNA, 25 bp, Mus musculus
taccccaaataaccgccaatgaact

SEQ ID NO: 763027 - DNA, 25 bp, Mus musculus
taccccaaataagcgccaatgaact

SEQ ID NO: 763028 - DNA, 25 bp, Mus musculus
taccccaaattccagttcttacttg

SEQ ID NO: 763029 - DNA, 25 bp, Mus musculus
taccccaaattcgagttcttacttg

SEQ ID NO: 763030 - DNA, 25 bp, Mus musculus
taccccaaccagacgacgaaacaga

SEQ ID NO: 763031 - DNA, 25 bp, Mus musculus
taccccaaccagtcgacgaaacaga

SEQ ID NO: 763032 - DNA, 25 bp, Mus musculus
taccccaacctgaagtcagtaaacg

SEQ ID NO: 763033 - DNA, 25 bp, Mus musculus
taccccaacctgtagtcagtaaacg

SEQ ID NO: 763034 - DNA, 25 bp, Mus musculus
taccccaactataccatcacttttt

SEQ ID NO: 763035 - DNA, 25 bp, Mus musculus
taccccaactattccatcacttttt

SEQ ID NO: 763036 - DNA, 25 bp, Mus musculus
taccccaactggctagagatttatt

SEQ ID NO: 763037 - DNA, 25 bp, Mus musculus
taccccaactgggtagagatttatt

SEQ ID NO: 763038 - DNA, 25 bp, Mus musculus
taccccaagaccaacgtgccgaggt

SEQ ID NO: 763039 - DNA, 25 bp, Mus musculus
taccccaagacctacgtgccgaggt

SEQ ID NO: 763040 - DNA, 25 bp, Mus musculus
taccccaagttcattgagtctgcca

SEQ ID NO: 763041 - DNA, 25 bp, Mus musculus
taccccaagttctttgagtctgcca

SEQ ID NO: 763042 - DNA, 25 bp, Mus musculus
taccccaattatattatccctatat

SEQ ID NO: 763043 - DNA, 25 bp, Mus musculus
taccccaattattttatccctatat

SEQ ID NO: 763044 - DNA, 25 bp, Mus musculus
taccccaattttactatagagccaa

SEQ ID NO: 763045 - DNA, 25 bp, Mus musculus
taccccaatttttctatagagccaa

SEQ ID NO: 763046 - DNA, 25 bp, Mus musculus
taccccacaaacatggagtccctga

SEQ ID NO: 763047 - DNA, 25 bp, Mus musculus
taccccacaaacttggagtccctga

SEQ ID NO: 763048 - DNA, 25 bp, Mus musculus
taccccacacggctagagaaggaca

SEQ ID NO: 763049 - DNA, 25 bp, Mus musculus
taccccacacgggtagagaaggaca

SEQ ID NO: 763050 - DNA, 25 bp, Mus musculus
taccccacagagaagtccaagtaaa

SEQ ID NO: 763051 - DNA, 25 bp, Mus musculus
taccccacagagtagtccaagtaaa

SEQ ID NO: 763052 - DNA, 25 bp, Mus musculus
taccccacagctcaggagaaacatt

SEQ ID NO: 763053 - DNA, 25 bp, Mus musculus
taccccacagctgaggagaaacatt

SEQ ID NO: 763054 - DNA, 25 bp, Mus musculus
taccccacatgaacggtgtatttgt

SEQ ID NO: 763055 - DNA, 25 bp, Mus musculus
taccccacatgatcggtgtatttgt

SEQ ID NO: 763056 - DNA, 25 bp, Mus musculus
taccccacatggctgttccaggtga

SEQ ID NO: 763057 - DNA, 25 bp, Mus musculus
taccccacatgggtgttccaggtga

SEQ ID NO: 763058 - DNA, 25 bp, Mus musculus
taccccacattcatgagtccttgaa

SEQ ID NO: 763059 - DNA, 25 bp, Mus musculus
taccccacattcttgagtccttgaa

SEQ ID NO: 763060 - DNA, 25 bp, Mus musculus
taccccaccagacatcatgcatgaa

SEQ ID NO: 763061 - DNA, 25 bp, Mus musculus
taccccaccagagatcatgcatgaa

SEQ ID NO: 763062 - DNA, 25 bp, Mus musculus
taccccactatcattaaggagcagg

SEQ ID NO: 763063 - DNA, 25 bp, Mus musculus
taccccactatctttaaggagcagg

SEQ ID NO: 763064 - DNA, 25 bp, Mus musculus
taccccactgataagtaccgatagc

SEQ ID NO: 763065 - DNA, 25 bp, Mus musculus
taccccactgattagtaccgatagc

SEQ ID NO: 763066 - DNA, 25 bp, Mus musculus
taccccactggtctgtggtaggtca

SEQ ID NO: 763067 - DNA, 25 bp, Mus musculus
taccccactggtgtgtggtaggtca

SEQ ID NO: 763068 - DNA, 25 bp, Mus musculus
taccccagacctagaaagaggagag

SEQ ID NO: 763069 - DNA, 25 bp, Mus musculus
taccccagaccttgaaagaggagag

SEQ ID NO: 763070 - DNA, 25 bp, Mus musculus
taccccagagagctcatggcaggga

SEQ ID NO: 763071 - DNA, 25 bp, Mus musculus
taccccagagaggtcatggcaggga

SEQ ID NO: 763072 - DNA, 25 bp, Mus musculus
taccccagatataggaggccagggc

SEQ ID NO: 763073 - DNA, 25 bp, Mus musculus
taccccagatattggaggccagggc

SEQ ID NO: 763074 - DNA, 25 bp, Mus musculus
taccccagcaggatctgagcctagg

SEQ ID NO: 763075 - DNA, 25 bp, Mus musculus
taccccagcaggcaagcactgcaga

SEQ ID NO: 763076 - DNA, 25 bp, Mus musculus
taccccagcagggaagcactgcaga

SEQ ID NO: 763077 - DNA, 25 bp, Mus musculus
taccccagcaggttctgagcctagg

SEQ ID NO: 763078 - DNA, 25 bp, Mus musculus
taccccagcatcattcaggaccaaa

SEQ ID NO: 763079 - DNA, 25 bp, Mus musculus
taccccagcatctttcaggaccaaa

SEQ ID NO: 763080 - DNA, 25 bp, Mus musculus
taccccagcatgcttgtaatttttt

SEQ ID NO: 763081 - DNA, 25 bp, Mus musculus
taccccagcatggttgtaatttttt

SEQ ID NO: 763082 - DNA, 25 bp, Mus musculus
taccccagctgcaactgtgattaat

SEQ ID NO: 763083 - DNA, 25 bp, Mus musculus
taccccagctgctactgtgattaat

SEQ ID NO: 763084 - DNA, 25 bp, Mus musculus
taccccagcttcatacctaaatatt

SEQ ID NO: 763085 - DNA, 25 bp, Mus musculus
taccccagcttcttacctaaatatt

SEQ ID NO: 763086 - DNA, 25 bp, Mus musculus
taccccaggtaacacttttgcctct

SEQ ID NO: 763087 - DNA, 25 bp, Mus musculus
taccccaggtaagacttttgcctct

SEQ ID NO: 763088 - DNA, 25 bp, Mus musculus
taccccaggtctactttagttcaga

SEQ ID NO: 763089 - DNA, 25 bp, Mus musculus
taccccaggtcttctttagttcaga

SEQ ID NO: 763090 - DNA, 25 bp, Mus musculus
taccccaggttaccacttagctgtg

SEQ ID NO: 763091 - DNA, 25 bp, Mus musculus
taccccaggttagcacttagctgtg

SEQ ID NO: 763092 - DNA, 25 bp, Mus musculus
taccccagtagacaaagtgagccat

SEQ ID NO: 763093 - DNA, 25 bp, Mus musculus
taccccagtagagaaagtgagccat

SEQ ID NO: 763094 - DNA, 25 bp, Mus musculus
taccccagtctgaggatttataact

SEQ ID NO: 763095 - DNA, 25 bp, Mus musculus
taccccagtctgtggatttataact

SEQ ID NO: 763096 - DNA, 25 bp, Mus musculus
taccccagtcttacttaagtctatg

SEQ ID NO: 763097 - DNA, 25 bp, Mus musculus
taccccagtctttcttaagtctatg

SEQ ID NO: 763098 - DNA, 25 bp, Mus musculus
taccccagtgtaccagctatgttaa

SEQ ID NO: 763099 - DNA, 25 bp, Mus musculus
taccccagtgtagcagctatgttaa

SEQ ID NO: 763100 - DNA, 25 bp, Mus musculus
taccccagttcacagtcctcatgag

SEQ ID NO: 763101 - DNA, 25 bp, Mus musculus
taccccagttcagagtcctcatgag

SEQ ID NO: 763102 - DNA, 25 bp, Mus musculus
taccccataagtctcactcagtaaa

SEQ ID NO: 763103 - DNA, 25 bp, Mus musculus
taccccataagtgtcactcagtaaa

SEQ ID NO: 763104 - DNA, 25 bp, Mus musculus
taccccatagtccttcctgtaatgg

SEQ ID NO: 763105 - DNA, 25 bp, Mus musculus
taccccatagtcgttcctgtaatgg

SEQ ID NO: 763106 - DNA, 25 bp, Mus musculus
taccccatatctattaccaaatcct

SEQ ID NO: 763107 - DNA, 25 bp, Mus musculus
taccccatatcttttaccaaatcct

SEQ ID NO: 763108 - DNA, 25 bp, Mus musculus
taccccatcttaaagggattcagga

SEQ ID NO: 763109 - DNA, 25 bp, Mus musculus
taccccatcttatagggattcagga

SEQ ID NO: 763110 - DNA, 25 bp, Mus musculus
taccccatctttagccttataaaat

SEQ ID NO: 763111 - DNA, 25 bp, Mus musculus
taccccatcttttgccttataaaat

SEQ ID NO: 763112 - DNA, 25 bp, Mus musculus
taccccatgatgagataatacacca

SEQ ID NO: 763113 - DNA, 25 bp, Mus musculus
taccccatgatgtgataatacacca

SEQ ID NO: 763114 - DNA, 25 bp, Mus musculus
taccccattagtcaataaagacctg

SEQ ID NO: 763115 - DNA, 25 bp, Mus musculus
taccccattagtgaataaagacctg

SEQ ID NO: 763116 - DNA, 25 bp, Mus musculus
taccccatttatactattctattag

SEQ ID NO: 763117 - DNA, 25 bp, Mus musculus
taccccatttattctattctattag

SEQ ID NO: 763118 - DNA, 25 bp, Mus musculus
taccccgaaactagtacagagccct

SEQ ID NO: 763119 - DNA, 25 bp, Mus musculus
taccccgaaacttgtacagagccct

SEQ ID NO: 763120 - DNA, 25 bp, Mus musculus
taccccgatgggaccagagtcagat

SEQ ID NO: 763121 - DNA, 25 bp, Mus musculus
taccccgatgggtccagagtcagat

SEQ ID NO: 763122 - DNA, 25 bp, Mus musculus
taccccgattggacacatatcttag

SEQ ID NO: 763123 - DNA, 25 bp, Mus musculus
taccccgattggtcacatatcttag

SEQ ID NO: 763124 - DNA, 25 bp, Mus musculus
taccccgcagcaatcagcaactatg

SEQ ID NO: 763125 - DNA, 25 bp, Mus musculus
taccccgcagcattcagcaactatg

SEQ ID NO: 763126 - DNA, 25 bp, Mus musculus
taccccgcgtgtccttgagaaggga

SEQ ID NO: 763127 - DNA, 25 bp, Mus musculus
taccccgcgtgtgcttgagaaggga

SEQ ID NO: 763128 - DNA, 25 bp, Mus musculus
taccccggagtacttggcgcctgag

SEQ ID NO: 763129 - DNA, 25 bp, Mus musculus
taccccggagtagttggcgcctgag

SEQ ID NO: 763130 - DNA, 25 bp, Mus musculus
taccccgggcagctggtccagttga

SEQ ID NO: 763131 - DNA, 25 bp, Mus musculus
taccccgggcaggtggtccagttga

SEQ ID NO: 763132 - DNA, 25 bp, Mus musculus
taccccgggtggatggtctcatttc

SEQ ID NO: 763133 - DNA, 25 bp, Mus musculus
taccccgggtggttggtctcatttc

SEQ ID NO: 763134 - DNA, 25 bp, Mus musculus
taccccgtggttctttattgcactg

SEQ ID NO: 763135 - DNA, 25 bp, Mus musculus
taccccgtggttgtttattgcactg

SEQ ID NO: 763136 - DNA, 25 bp, Mus musculus
tacccctaacttcacctcagataat

SEQ ID NO: 763137 - DNA, 25 bp, Mus musculus
tacccctaacttgacctcagataat

SEQ ID NO: 763138 - DNA, 25 bp, Mus musculus
tacccctaagtcctatgataacgtc

SEQ ID NO: 763139 - DNA, 25 bp, Mus musculus
tacccctaagtcgtatgataacgtc

SEQ ID NO: 763140 - DNA, 25 bp, Mus musculus
tacccctaccatagtggccctaaag

SEQ ID NO: 763141 - DNA, 25 bp, Mus musculus
tacccctaccattgtggccctaaag

SEQ ID NO: 763142 - DNA, 25 bp, Mus musculus
tacccctactgtatgcatgccttta

SEQ ID NO: 763143 - DNA, 25 bp, Mus musculus
tacccctactgtttgcatgccttta

SEQ ID NO: 763144 - DNA, 25 bp, Mus musculus
tacccctagaagagcacagaatccc

SEQ ID NO: 763145 - DNA, 25 bp, Mus musculus
tacccctagaagtgcacagaatccc

SEQ ID NO: 763146 - DNA, 25 bp, Mus musculus
tacccctatggtcagtggaactgac

SEQ ID NO: 763147 - DNA, 25 bp, Mus musculus
tacccctatggtgagtggaactgac

SEQ ID NO: 763148 - DNA, 25 bp, Mus musculus
tacccctatgtacaggtggttttca

SEQ ID NO: 763149 - DNA, 25 bp, Mus musculus
tacccctatgtagaggtggttttca

SEQ ID NO: 763150 - DNA, 25 bp, Mus musculus
tacccctcacatacatggagtacac

SEQ ID NO: 763151 - DNA, 25 bp, Mus musculus
tacccctcacattcatggagtacac

SEQ ID NO: 763152 - DNA, 25 bp, Mus musculus
tacccctcatggactttggtgaagt

SEQ ID NO: 763153 - DNA, 25 bp, Mus musculus
tacccctcatggtctttggtgaagt

SEQ ID NO: 763154 - DNA, 25 bp, Mus musculus
tacccctccaccataaacatatatt

SEQ ID NO: 763155 - DNA, 25 bp, Mus musculus
tacccctccaccttaaacatatatt

SEQ ID NO: 763156 - DNA, 25 bp, Mus musculus
tacccctctcctctgaggtgaggaa

SEQ ID NO: 763157 - DNA, 25 bp, Mus musculus
tacccctctcctgtgaggtgaggaa

SEQ ID NO: 763158 - DNA, 25 bp, Mus musculus
tacccctcttggctggattatgtcc

SEQ ID NO: 763159 - DNA, 25 bp, Mus musculus
tacccctcttgggtggattatgtcc

SEQ ID NO: 763160 - DNA, 25 bp, Mus musculus
tacccctgacatatgattattactg

SEQ ID NO: 763161 - DNA, 25 bp, Mus musculus
tacccctgacatttgattattactg

SEQ ID NO: 763162 - DNA, 25 bp, Mus musculus
tacccctgagggatgcggccaagtt

SEQ ID NO: 763163 - DNA, 25 bp, Mus musculus
tacccctgagggttgcggccaagtt

SEQ ID NO: 763164 - DNA, 25 bp, Mus musculus
tacccctgagtcacaccaaatatag

SEQ ID NO: 763165 - DNA, 25 bp, Mus musculus
tacccctgagtctcaccaaatatag

SEQ ID NO: 763166 - DNA, 25 bp, Mus musculus
tacccctgccatatatggtaagatt

SEQ ID NO: 763167 - DNA, 25 bp, Mus musculus
tacccctgccatttatggtaagatt

SEQ ID NO: 763168 - DNA, 25 bp, Mus musculus
tacccctgccgcaaagagcttttgg

SEQ ID NO: 763169 - DNA, 25 bp, Mus musculus
tacccctgccgctaagagcttttgg

SEQ ID NO: 763170 - DNA, 25 bp, Mus musculus
tacccctggcgaaggaatgggcctc

SEQ ID NO: 763171 - DNA, 25 bp, Mus musculus
tacccctggcgatggaatgggcctc

SEQ ID NO: 763172 - DNA, 25 bp, Mus musculus
tacccctgggtgagcaagaagtcca

SEQ ID NO: 763173 - DNA, 25 bp, Mus musculus
tacccctgggtgtgcaagaagtcca

SEQ ID NO: 763174 - DNA, 25 bp, Mus musculus
tacccctgtacccttgtggtgtgaa

SEQ ID NO: 763175 - DNA, 25 bp, Mus musculus
tacccctgtaccgttgtggtgtgaa

SEQ ID NO: 763176 - DNA, 25 bp, Mus musculus
tacccctgtctgagttaacttattt

SEQ ID NO: 763177 - DNA, 25 bp, Mus musculus
tacccctgtctgtgttaacttattt

SEQ ID NO: 763178 - DNA, 25 bp, Mus musculus
tacccctgttggcagtgccagttga

SEQ ID NO: 763179 - DNA, 25 bp, Mus musculus
tacccctgttgggagtgccagttga

SEQ ID NO: 763180 - DNA, 25 bp, Mus musculus
taccccttaatacatacaatctcct

SEQ ID NO: 763181 - DNA, 25 bp, Mus musculus
taccccttaatagatacaatctcct

SEQ ID NO: 763182 - DNA, 25 bp, Mus musculus
taccccttacttcatcttgctctag

SEQ ID NO: 763183 - DNA, 25 bp, Mus musculus
taccccttacttgatcttgctctag

SEQ ID NO: 763184 - DNA, 25 bp, Mus musculus
taccccttccctatttgacgaagag

SEQ ID NO: 763185 - DNA, 25 bp, Mus musculus
taccccttccctttttgacgaagag

SEQ ID NO: 763186 - DNA, 25 bp, Mus musculus
taccccttgatcctctgaagactgt

SEQ ID NO: 763187 - DNA, 25 bp, Mus musculus
taccccttgatcgtctgaagactgt

SEQ ID NO: 763188 - DNA, 25 bp, Mus musculus
tacccctttacgagaacagaagcaa

SEQ ID NO: 763189 - DNA, 25 bp, Mus musculus
tacccctttacgtgaacagaagcaa

SEQ ID NO: 763190 - DNA, 25 bp, Mus musculus
tacccctttcctaactgctcaaaga

SEQ ID NO: 763191 - DNA, 25 bp, Mus musculus
tacccctttccttactgctcaaaga

SEQ ID NO: 763192 - DNA, 25 bp, Mus musculus
tacccctttctaagggaaataggag

SEQ ID NO: 763193 - DNA, 25 bp, Mus musculus
tacccctttctatgggaaataggag

SEQ ID NO: 763194 - DNA, 25 bp, Mus musculus
tacccctttctcacgggcgtgggtg

SEQ ID NO: 763195 - DNA, 25 bp, Mus musculus
tacccctttctctcgggcgtgggtg

SEQ ID NO: 763196 - DNA, 25 bp, Mus musculus
taccccttttctagatttgtttgag

SEQ ID NO: 763197 - DNA, 25 bp, Mus musculus
taccccttttcttgatttgtttgag

SEQ ID NO: 763198 - DNA, 25 bp, Mus musculus
tacccgaacgtcatcaggcgtggca

SEQ ID NO: 763199 - DNA, 25 bp, Mus musculus
tacccgaacgtcttcaggcgtggca

SEQ ID NO: 763200 - DNA, 25 bp, Mus musculus
tacccgaagccgatcccaggacagg

SEQ ID NO: 763201 - DNA, 25 bp, Mus musculus
tacccgaagccgttcccaggacagg

SEQ ID NO: 763202 - DNA, 25 bp, Mus musculus
tacccgacaacacccttctagaaat

SEQ ID NO: 763203 - DNA, 25 bp, Mus musculus
tacccgacaacagccttctagaaat

SEQ ID NO: 763204 - DNA, 25 bp, Mus musculus
tacccgacactgatctgagagtcgc

SEQ ID NO: 763205 - DNA, 25 bp, Mus musculus
tacccgacactgttctgagagtcgc

SEQ ID NO: 763206 - DNA, 25 bp, Mus musculus
tacccgacagtccaaccatctaaat

SEQ ID NO: 763207 - DNA, 25 bp, Mus musculus
tacccgacagtcgaaccatctaaat

SEQ ID NO: 763208 - DNA, 25 bp, Mus musculus
tacccgaccaagcacattatctttt

SEQ ID NO: 763209 - DNA, 25 bp, Mus musculus
tacccgaccaaggacattatctttt

SEQ ID NO: 763210 - DNA, 25 bp, Mus musculus
tacccgacgtggctgaagtgctctg

SEQ ID NO: 763211 - DNA, 25 bp, Mus musculus
tacccgacgtgggtgaagtgctctg

SEQ ID NO: 763212 - DNA, 25 bp, Mus musculus
tacccgactcttagggccgttatct

SEQ ID NO: 763213 - DNA, 25 bp, Mus musculus
tacccgactctttgggccgttatct

SEQ ID NO: 763214 - DNA, 25 bp, Mus musculus
tacccgagaggcaagctatttaagg

SEQ ID NO: 763215 - DNA, 25 bp, Mus musculus
tacccgagaggctagctatttaagg

SEQ ID NO: 763216 - DNA, 25 bp, Mus musculus
tacccgaggctcaaccatctgatgg

SEQ ID NO: 763217 - DNA, 25 bp, Mus musculus
tacccgaggctctaccatctgatgg

SEQ ID NO: 763218 - DNA, 25 bp, Mus musculus
tacccgagggctcagtttagagtct

SEQ ID NO: 763219 - DNA, 25 bp, Mus musculus
tacccgagggctgagtttagagtct

SEQ ID NO: 763220 - DNA, 25 bp, Mus musculus
tacccgatcttgaacttctctggag

SEQ ID NO: 763221 - DNA, 25 bp, Mus musculus
tacccgatcttgtacttctctggag

SEQ ID NO: 763222 - DNA, 25 bp, Mus musculus
tacccgcacaagacgtcatttggag

SEQ ID NO: 763223 - DNA, 25 bp, Mus musculus
tacccgcacaagtcgtcatttggag

SEQ ID NO: 763224 - DNA, 25 bp, Mus musculus
tacccgcagacacacgtgttcttaa

SEQ ID NO: 763225 - DNA, 25 bp, Mus musculus
tacccgcagacagacgtgttcttaa

SEQ ID NO: 763226 - DNA, 25 bp, Mus musculus
tacccgcatttacccggagattatt

SEQ ID NO: 763227 - DNA, 25 bp, Mus musculus
tacccgcatttagccggagattatt

SEQ ID NO: 763228 - DNA, 25 bp, Mus musculus
tacccgctatgcacggtatgatgta

SEQ ID NO: 763229 - DNA, 25 bp, Mus musculus
tacccgctatgctcggtatgatgta

SEQ ID NO: 763230 - DNA, 25 bp, Mus musculus
tacccgctgcaaagtcagttggtca

SEQ ID NO: 763231 - DNA, 25 bp, Mus musculus
tacccgctgcaatgtcagttggtca

SEQ ID NO: 763232 - DNA, 25 bp, Mus musculus
tacccgctgtgcaacgagaacttca

SEQ ID NO: 763233 - DNA, 25 bp, Mus musculus
tacccgctgtgctacgagaacttca

SEQ ID NO: 763234 - DNA, 25 bp, Mus musculus
tacccggaccttctgaaacctagct

SEQ ID NO: 763235 - DNA, 25 bp, Mus musculus
tacccggaccttgtgaaacctagct

SEQ ID NO: 763236 - DNA, 25 bp, Mus musculus
tacccggagataagtacgcaagttt

SEQ ID NO: 763237 - DNA, 25 bp, Mus musculus
tacccggagatatgtacgcaagttt

SEQ ID NO: 763238 - DNA, 25 bp, Mus musculus
tacccggagctgcagaatagagcca

SEQ ID NO: 763239 - DNA, 25 bp, Mus musculus
tacccggagctggagaatagagcca

SEQ ID NO: 763240 - DNA, 25 bp, Mus musculus
tacccggatacaagaagattgcctt

SEQ ID NO: 763241 - DNA, 25 bp, Mus musculus
tacccggatacatgaagattgcctt

SEQ ID NO: 763242 - DNA, 25 bp, Mus musculus
tacccggctggccatacagaagcta

SEQ ID NO: 763243 - DNA, 25 bp, Mus musculus
tacccggctggcgatacagaagcta

SEQ ID NO: 763244 - DNA, 25 bp, Mus musculus
tacccgggctccatgtcaaagcaaa

SEQ ID NO: 763245 - DNA, 25 bp, Mus musculus
tacccgggctccttgtcaaagcaaa

SEQ ID NO: 763246 - DNA, 25 bp, Mus musculus
tacccggtctgtagagggctctgac

SEQ ID NO: 763247 - DNA, 25 bp, Mus musculus
tacccggtctgttgagggctctgac

SEQ ID NO: 763248 - DNA, 25 bp, Mus musculus
tacccggtgcccagactactgatgg

SEQ ID NO: 763249 - DNA, 25 bp, Mus musculus
tacccggtgccctgactactgatgg

SEQ ID NO: 763250 - DNA, 25 bp, Mus musculus
tacccggtttgaagcctggaatgtc

SEQ ID NO: 763251 - DNA, 25 bp, Mus musculus
tacccggtttgatgcctggaatgtc

SEQ ID NO: 763252 - DNA, 25 bp, Mus musculus
tacccgtacttgctcatggattgtg

SEQ ID NO: 763253 - DNA, 25 bp, Mus musculus
tacccgtacttggtcatggattgtg

SEQ ID NO: 763254 - DNA, 25 bp, Mus musculus
tacccgtctgcacgtgtctttacat

SEQ ID NO: 763255 - DNA, 25 bp, Mus musculus
tacccgtctgcaggtgtctttacat

SEQ ID NO: 763256 - DNA, 25 bp, Mus musculus
tacccgtgggtacagtataacatga

SEQ ID NO: 763257 - DNA, 25 bp, Mus musculus
tacccgtgggtagagtataacatga

SEQ ID NO: 763258 - DNA, 25 bp, Mus musculus
tacccgtgtggaagagctggacgcc

SEQ ID NO: 763259 - DNA, 25 bp, Mus musculus
tacccgtgtggatgagctggacgcc

SEQ ID NO: 763260 - DNA, 25 bp, Mus musculus
taccctaaaggacgctgctgtgaag

SEQ ID NO: 763261 - DNA, 25 bp, Mus musculus
taccctaaaggaggctgctgtgaag

SEQ ID NO: 763262 - DNA, 25 bp, Mus musculus
taccctaacgtgctaccatcttaga

SEQ ID NO: 763263 - DNA, 25 bp, Mus musculus
taccctaacgtggtaccatcttaga

SEQ ID NO: 763264 - DNA, 25 bp, Mus musculus
taccctaactccacgggcaggaact

SEQ ID NO: 763265 - DNA, 25 bp, Mus musculus
taccctaactcctcgggcaggaact

SEQ ID NO: 763266 - DNA, 25 bp, Mus musculus
taccctaagcgcatccaataacaaa

SEQ ID NO: 763267 - DNA, 25 bp, Mus musculus
taccctaagcgcttccaataacaaa

SEQ ID NO: 763268 - DNA, 25 bp, Mus musculus
taccctaaggttatgttgagactcc

SEQ ID NO: 763269 - DNA, 25 bp, Mus musculus
taccctaaggttttgttgagactcc

SEQ ID NO: 763270 - DNA, 25 bp, Mus musculus
taccctaatagtatctcatctccat

SEQ ID NO: 763271 - DNA, 25 bp, Mus musculus
taccctaatagtttctcatctccat

SEQ ID NO: 763272 - DNA, 25 bp, Mus musculus
taccctaatgttccttgtttaaaat

SEQ ID NO: 763273 - DNA, 25 bp, Mus musculus
taccctaatgttgcttgtttaaaat

SEQ ID NO: 763274 - DNA, 25 bp, Mus musculus
taccctacagcgctaaggagccaat

SEQ ID NO: 763275 - DNA, 25 bp, Mus musculus
taccctacagcggtaaggagccaat

SEQ ID NO: 763276 - DNA, 25 bp, Mus musculus
taccctacatccaatttaccagcat

SEQ ID NO: 763277 - DNA, 25 bp, Mus musculus
taccctacatcctatttaccagcat

SEQ ID NO: 763278 - DNA, 25 bp, Mus musculus
taccctacctgcagtgctcaagaat

SEQ ID NO: 763279 - DNA, 25 bp, Mus musculus
taccctacctgctgtgctcaagaat

SEQ ID NO: 763280 - DNA, 25 bp, Mus musculus
taccctagagtacttctgagtcact

SEQ ID NO: 763281 - DNA, 25 bp, Mus musculus
taccctagagtagttctgagtcact

SEQ ID NO: 763282 - DNA, 25 bp, Mus musculus
taccctagagttatgtgccacctta

SEQ ID NO: 763283 - DNA, 25 bp, Mus musculus
taccctagagttttgtgccacctta

SEQ ID NO: 763284 - DNA, 25 bp, Mus musculus
taccctaggagcatcggttgcaagt

SEQ ID NO: 763285 - DNA, 25 bp, Mus musculus
taccctaggagcttcggttgcaagt

SEQ ID NO: 763286 - DNA, 25 bp, Mus musculus
taccctaggcctcagaggtctctgt

SEQ ID NO: 763287 - DNA, 25 bp, Mus musculus
taccctaggcctgagaggtctctgt

SEQ ID NO: 763288 - DNA, 25 bp, Mus musculus
taccctagggtcacttctcagaaaa

SEQ ID NO: 763289 - DNA, 25 bp, Mus musculus
taccctagggtctcttctcagaaaa

SEQ ID NO: 763290 - DNA, 25 bp, Mus musculus
taccctagtggtatgtcacctggac

SEQ ID NO: 763291 - DNA, 25 bp, Mus musculus
taccctagtggtttgtcacctggac

SEQ ID NO: 763292 - DNA, 25 bp, Mus musculus
taccctagttggcaatgggactccg

SEQ ID NO: 763293 - DNA, 25 bp, Mus musculus
taccctagttgggaatgggactccg

SEQ ID NO: 763294 - DNA, 25 bp, Mus musculus
taccctatcagtagcatggtcattc

SEQ ID NO: 763295 - DNA, 25 bp, Mus musculus
taccctatcagttgcatggtcattc

SEQ ID NO: 763296 - DNA, 25 bp, Mus musculus
taccctatccatcttctgttcatta

SEQ ID NO: 763297 - DNA, 25 bp, Mus musculus
taccctatccatgttctgttcatta

SEQ ID NO: 763298 - DNA, 25 bp, Mus musculus
taccctattaaactcaaccccagag

SEQ ID NO: 763299 - DNA, 25 bp, Mus musculus
taccctattaaagtcaaccccagag

SEQ ID NO: 763300 - DNA, 25 bp, Mus musculus
taccctattgtcacaggccgagact

SEQ ID NO: 763301 - DNA, 25 bp, Mus musculus
taccctattgtctcaggccgagact

SEQ ID NO: 763302 - DNA, 25 bp, Mus musculus
taccctcaacccaaccttttatatg

SEQ ID NO: 763303 - DNA, 25 bp, Mus musculus
taccctcaacccatttagaagttct

SEQ ID NO: 763304 - DNA, 25 bp, Mus musculus
taccctcaaccctaccttttatatg

SEQ ID NO: 763305 - DNA, 25 bp, Mus musculus
taccctcaacccttttagaagttct

SEQ ID NO: 763306 - DNA, 25 bp, Mus musculus
taccctcaattcctagtcgataaaa

SEQ ID NO: 763307 - DNA, 25 bp, Mus musculus
taccctcaattcgtagtcgataaaa

SEQ ID NO: 763308 - DNA, 25 bp, Mus musculus
taccctcacaaaagtggccacgttg

SEQ ID NO: 763309 - DNA, 25 bp, Mus musculus
taccctcacaaatgtggccacgttg

SEQ ID NO: 763310 - DNA, 25 bp, Mus musculus
taccctcacaatccgaatcatcagt

SEQ ID NO: 763311 - DNA, 25 bp, Mus musculus
taccctcacaatgcgaatcatcagt

SEQ ID NO: 763312 - DNA, 25 bp, Mus musculus
taccctcactcactctctgaaggat

SEQ ID NO: 763313 - DNA, 25 bp, Mus musculus
taccctcactcagtctctgaaggat

SEQ ID NO: 763314 - DNA, 25 bp, Mus musculus
taccctcagagtagccaaaaattgt

SEQ ID NO: 763315 - DNA, 25 bp, Mus musculus
taccctcagagttgccaaaaattgt

SEQ ID NO: 763316 - DNA, 25 bp, Mus musculus
taccctcagcaaacatccgctttta

SEQ ID NO: 763317 - DNA, 25 bp, Mus musculus
taccctcagcaatcatccgctttta

SEQ ID NO: 763318 - DNA, 25 bp, Mus musculus
taccctcagggcaccatcttggaaa

SEQ ID NO: 763319 - DNA, 25 bp, Mus musculus
taccctcagggctccatcttggaaa

SEQ ID NO: 763320 - DNA, 25 bp, Mus musculus
taccctcagtaacggagctgacgtt

SEQ ID NO: 763321 - DNA, 25 bp, Mus musculus
taccctcagtaagggagctgacgtt

SEQ ID NO: 763322 - DNA, 25 bp, Mus musculus
taccctcatacaaagaggcccaggc

SEQ ID NO: 763323 - DNA, 25 bp, Mus musculus
taccctcatacatagaggcccaggc

SEQ ID NO: 763324 - DNA, 25 bp, Mus musculus
taccctcatctcatctagagcatga

SEQ ID NO: 763325 - DNA, 25 bp, Mus musculus
taccctcatctcttctagagcatga

SEQ ID NO: 763326 - DNA, 25 bp, Mus musculus
taccctcatggaaagttttggaaga

SEQ ID NO: 763327 - DNA, 25 bp, Mus musculus
taccctcatggatagttttggaaga

SEQ ID NO: 763328 - DNA, 25 bp, Mus musculus
taccctcatggccaaggcgctgcag

SEQ ID NO: 763329 - DNA, 25 bp, Mus musculus
taccctcatggcgaaggcgctgcag

SEQ ID NO: 763330 - DNA, 25 bp, Mus musculus
taccctccatgtacaggctggatga

SEQ ID NO: 763331 - DNA, 25 bp, Mus musculus
taccctccatgttcaggctggatga

SEQ ID NO: 763332 - DNA, 25 bp, Mus musculus
taccctcccacaccttggaagagtg

SEQ ID NO: 763333 - DNA, 25 bp, Mus musculus
taccctcccacagcttggaagagtg

SEQ ID NO: 763334 - DNA, 25 bp, Mus musculus
taccctcccatgagcacagttttac

SEQ ID NO: 763335 - DNA, 25 bp, Mus musculus
taccctcccatgtgcacagttttac

SEQ ID NO: 763336 - DNA, 25 bp, Mus musculus
taccctcccattagtagctttatct

SEQ ID NO: 763337 - DNA, 25 bp, Mus musculus
taccctcccatttgtagctttatct

SEQ ID NO: 763338 - DNA, 25 bp, Mus musculus
taccctccctatatcttcgtgatga

SEQ ID NO: 763339 - DNA, 25 bp, Mus musculus
taccctccctatttcttcgtgatga

SEQ ID NO: 763340 - DNA, 25 bp, Mus musculus
taccctcctactctgtgaggttcat

SEQ ID NO: 763341 - DNA, 25 bp, Mus musculus
taccctcctactgtgtgaggttcat

SEQ ID NO: 763342 - DNA, 25 bp, Mus musculus
taccctcctccaagcgaaaacgatg

SEQ ID NO: 763343 - DNA, 25 bp, Mus musculus
taccctcctccatgcgaaaacgatg

SEQ ID NO: 763344 - DNA, 25 bp, Mus musculus
taccctcctctcattgtaaaagtga

SEQ ID NO: 763345 - DNA, 25 bp, Mus musculus
taccctcctctctttgtaaaagtga

SEQ ID NO: 763346 - DNA, 25 bp, Mus musculus
taccctcctgatcttttaagtctca

SEQ ID NO: 763347 - DNA, 25 bp, Mus musculus
taccctcctgatgttttaagtctca

SEQ ID NO: 763348 - DNA, 25 bp, Mus musculus
taccctcctggcacaaatgggactt

SEQ ID NO: 763349 - DNA, 25 bp, Mus musculus
taccctcctggctcaaatgggactt

SEQ ID NO: 763350 - DNA, 25 bp, Mus musculus
taccctcctgtaaatgtttatcctc

SEQ ID NO: 763351 - DNA, 25 bp, Mus musculus
taccctcctgtaagcaacactttaa

SEQ ID NO: 763352 - DNA, 25 bp, Mus musculus
taccctcctgtatatgtttatcctc

SEQ ID NO: 763353 - DNA, 25 bp, Mus musculus
taccctcctgtatgcaacactttaa

SEQ ID NO: 763354 - DNA, 25 bp, Mus musculus
taccctcgcagaagtggacctagga

SEQ ID NO: 763355 - DNA, 25 bp, Mus musculus
taccctcgcagatgtggacctagga

SEQ ID NO: 763356 - DNA, 25 bp, Mus musculus
taccctcggacaatccacatgtgag

SEQ ID NO: 763357 - DNA, 25 bp, Mus musculus
taccctcggacattccacatgtgag

SEQ ID NO: 763358 - DNA, 25 bp, Mus musculus
taccctcggtacattgtgcaatttc

SEQ ID NO: 763359 - DNA, 25 bp, Mus musculus
taccctcggtactttgtgcaatttc

SEQ ID NO: 763360 - DNA, 25 bp, Mus musculus
taccctctacatcaaatgcggctga

SEQ ID NO: 763361 - DNA, 25 bp, Mus musculus
taccctctacatgaaatgcggctga

SEQ ID NO: 763362 - DNA, 25 bp, Mus musculus
taccctctccagctgtggactgcat

SEQ ID NO: 763363 - DNA, 25 bp, Mus musculus
taccctctccaggtgtggactgcat

SEQ ID NO: 763364 - DNA, 25 bp, Mus musculus
taccctctgacactgtctctcaaaa

SEQ ID NO: 763365 - DNA, 25 bp, Mus musculus
taccctctgacagtgtctctcaaaa

SEQ ID NO: 763366 - DNA, 25 bp, Mus musculus
taccctctgattctagcactttcaa

SEQ ID NO: 763367 - DNA, 25 bp, Mus musculus
taccctctgattgtagcactttcaa

SEQ ID NO: 763368 - DNA, 25 bp, Mus musculus
taccctctgcggagtaattgcatta

SEQ ID NO: 763369 - DNA, 25 bp, Mus musculus
taccctctgcggtgtaattgcatta

SEQ ID NO: 763370 - DNA, 25 bp, Mus musculus
taccctctggtaactctgaaaactc

SEQ ID NO: 763371 - DNA, 25 bp, Mus musculus
taccctctggtatctctgaaaactc

SEQ ID NO: 763372 - DNA, 25 bp, Mus musculus
taccctctggttaagaaagcagcaa

SEQ ID NO: 763373 - DNA, 25 bp, Mus musculus
taccctctggttagcttcgtcactc

SEQ ID NO: 763374 - DNA, 25 bp, Mus musculus
taccctctggtttagaaagcagcaa

SEQ ID NO: 763375 - DNA, 25 bp, Mus musculus
taccctctggtttgcttcgtcactc

SEQ ID NO: 763376 - DNA, 25 bp, Mus musculus
taccctcttcaacttttaggacgag

SEQ ID NO: 763377 - DNA, 25 bp, Mus musculus
taccctcttcaagttttaggacgag

SEQ ID NO: 763378 - DNA, 25 bp, Mus musculus
taccctcttgtcacgccaaatgaag

SEQ ID NO: 763379 - DNA, 25 bp, Mus musculus
taccctcttgtcctgtgactgattt

SEQ ID NO: 763380 - DNA, 25 bp, Mus musculus
taccctcttgtcgtgtgactgattt

SEQ ID NO: 763381 - DNA, 25 bp, Mus musculus
taccctcttgtctcgccaaatgaag

SEQ ID NO: 763382 - DNA, 25 bp, Mus musculus
taccctgaacagagctgaagtgagc

SEQ ID NO: 763383 - DNA, 25 bp, Mus musculus
taccctgaacagtgctgaagtgagc

SEQ ID NO: 763384 - DNA, 25 bp, Mus musculus
taccctgacaaaaacagtctggcca

SEQ ID NO: 763385 - DNA, 25 bp, Mus musculus
taccctgacaaatacagtctggcca

SEQ ID NO: 763386 - DNA, 25 bp, Mus musculus
taccctgacgctactttgataagga

SEQ ID NO: 763387 - DNA, 25 bp, Mus musculus
taccctgacgcttctttgataagga

SEQ ID NO: 763388 - DNA, 25 bp, Mus musculus
taccctgactcaatccttactggta

SEQ ID NO: 763389 - DNA, 25 bp, Mus musculus
taccctgactcattccttactggta

SEQ ID NO: 763390 - DNA, 25 bp, Mus musculus
taccctgactgtattggaaatgttc

SEQ ID NO: 763391 - DNA, 25 bp, Mus musculus
taccctgactgttttggaaatgttc

SEQ ID NO: 763392 - DNA, 25 bp, Mus musculus
taccctgacttaccgagaggacttc

SEQ ID NO: 763393 - DNA, 25 bp, Mus musculus
taccctgacttagcgagaggacttc

SEQ ID NO: 763394 - DNA, 25 bp, Mus musculus
taccctgagaacattctcctactgt

SEQ ID NO: 763395 - DNA, 25 bp, Mus musculus
taccctgagaactttctcctactgt

SEQ ID NO: 763396 - DNA, 25 bp, Mus musculus
taccctgagagacacactcgggatc

SEQ ID NO: 763397 - DNA, 25 bp, Mus musculus
taccctgagagagacactcgggatc

SEQ ID NO: 763398 - DNA, 25 bp, Mus musculus
taccctgagaggaagatgtccttgg

SEQ ID NO: 763399 - DNA, 25 bp, Mus musculus
taccctgagaggtagatgtccttgg

SEQ ID NO: 763400 - DNA, 25 bp, Mus musculus
taccctgagctaatcttatattttt

SEQ ID NO: 763401 - DNA, 25 bp, Mus musculus
taccctgagctattcttatattttt

SEQ ID NO: 763402 - DNA, 25 bp, Mus musculus
taccctgagctgagaatgtgaccct

SEQ ID NO: 763403 - DNA, 25 bp, Mus musculus
taccctgagctgtgaatgtgaccct

SEQ ID NO: 763404 - DNA, 25 bp, Mus musculus
taccctgaggaacaggctgctcttg

SEQ ID NO: 763405 - DNA, 25 bp, Mus musculus
taccctgaggaactacgggcctgag

SEQ ID NO: 763406 - DNA, 25 bp, Mus musculus
taccctgaggaagaggctgctcttg

SEQ ID NO: 763407 - DNA, 25 bp, Mus musculus
taccctgaggaagtacgggcctgag

SEQ ID NO: 763408 - DNA, 25 bp, Mus musculus
taccctgagtgccaagccagcaagg

SEQ ID NO: 763409 - DNA, 25 bp, Mus musculus
taccctgagtgcgaagccagcaagg

SEQ ID NO: 763410 - DNA, 25 bp, Mus musculus
taccctgagtggcaaacgttacaaa

SEQ ID NO: 763411 - DNA, 25 bp, Mus musculus
taccctgagtgggaaacgttacaaa

SEQ ID NO: 763412 - DNA, 25 bp, Mus musculus
taccctgatatcaggtcagagccca

SEQ ID NO: 763413 - DNA, 25 bp, Mus musculus
taccctgatatctggtcagagccca

SEQ ID NO: 763414 - DNA, 25 bp, Mus musculus
taccctgatgatcccagctttgtgc

SEQ ID NO: 763415 - DNA, 25 bp, Mus musculus
taccctgatgatgccagctttgtgc

SEQ ID NO: 763416 - DNA, 25 bp, Mus musculus
taccctgcacccatgaaactagaaa

SEQ ID NO: 763417 - DNA, 25 bp, Mus musculus
taccctgcacccttgaaactagaaa

SEQ ID NO: 763418 - DNA, 25 bp, Mus musculus
taccctgcacctcatgaagtctatg

SEQ ID NO: 763419 - DNA, 25 bp, Mus musculus
taccctgcacctgatgaagtctatg

SEQ ID NO: 763420 - DNA, 25 bp, Mus musculus
taccctgcacgtcgtggacatggag

SEQ ID NO: 763421 - DNA, 25 bp, Mus musculus
taccctgcacgtggtggacatggag

SEQ ID NO: 763422 - DNA, 25 bp, Mus musculus
taccctgcatgccattttgggactg

SEQ ID NO: 763423 - DNA, 25 bp, Mus musculus
taccctgcatgcgattttgggactg

SEQ ID NO: 763424 - DNA, 25 bp, Mus musculus
taccctgcattaatgttatccattc

SEQ ID NO: 763425 - DNA, 25 bp, Mus musculus
taccctgcattattgttatccattc

SEQ ID NO: 763426 - DNA, 25 bp, Mus musculus
taccctgccatcaaagtgctcagaa

SEQ ID NO: 763427 - DNA, 25 bp, Mus musculus
taccctgccatctaagtgctcagaa

SEQ ID NO: 763428 - DNA, 25 bp, Mus musculus
taccctgcccttctgttaaactcat

SEQ ID NO: 763429 - DNA, 25 bp, Mus musculus
taccctgcccttgtgttaaactcat

SEQ ID NO: 763430 - DNA, 25 bp, Mus musculus
taccctgccgagccatgattttcac

SEQ ID NO: 763431 - DNA, 25 bp, Mus musculus
taccctgccgaggcatgattttcac

SEQ ID NO: 763432 - DNA, 25 bp, Mus musculus
taccctgcctgacggtcactttgat

SEQ ID NO: 763433 - DNA, 25 bp, Mus musculus
taccctgcctgagggtcactttgat

SEQ ID NO: 763434 - DNA, 25 bp, Mus musculus
taccctgccttcaaacgtgtttgga

SEQ ID NO: 763435 - DNA, 25 bp, Mus musculus
taccctgccttctaacgtgtttgga

SEQ ID NO: 763436 - DNA, 25 bp, Mus musculus
taccctgctactctgattgttcaag

SEQ ID NO: 763437 - DNA, 25 bp, Mus musculus
taccctgctactgtgattgttcaag

SEQ ID NO: 763438 - DNA, 25 bp, Mus musculus
taccctgctagaccccaaggtggaa

SEQ ID NO: 763439 - DNA, 25 bp, Mus musculus
taccctgctagagcccaaggtggaa

SEQ ID NO: 763440 - DNA, 25 bp, Mus musculus
taccctgctcttagtcagccggtta

SEQ ID NO: 763441 - DNA, 25 bp, Mus musculus
taccctgctctttgtcagccggtta

SEQ ID NO: 763442 - DNA, 25 bp, Mus musculus
taccctgcttcactggatgacatgc

SEQ ID NO: 763443 - DNA, 25 bp, Mus musculus
taccctgcttcagtggatgacatgc

SEQ ID NO: 763444 - DNA, 25 bp, Mus musculus
taccctgcttgcaagtcactctctt

SEQ ID NO: 763445 - DNA, 25 bp, Mus musculus
taccctgcttgctagtcactctctt

SEQ ID NO: 763446 - DNA, 25 bp, Mus musculus
taccctgctttcctttgtaattact

SEQ ID NO: 763447 - DNA, 25 bp, Mus musculus
taccctgctttcgtttgtaattact

SEQ ID NO: 763448 - DNA, 25 bp, Mus musculus
taccctgctttgctttctacaaaag

SEQ ID NO: 763449 - DNA, 25 bp, Mus musculus
taccctgctttggtttctacaaaag

SEQ ID NO: 763450 - DNA, 25 bp, Mus musculus
taccctggaattcgaaccacccatt

SEQ ID NO: 763451 - DNA, 25 bp, Mus musculus
taccctggaattggaaccacccatt

SEQ ID NO: 763452 - DNA, 25 bp, Mus musculus
taccctggagatcgcgtgcagcagc

SEQ ID NO: 763453 - DNA, 25 bp, Mus musculus
taccctggagatggcgtgcagcagc

SEQ ID NO: 763454 - DNA, 25 bp, Mus musculus
taccctggagttccgaagcgtgagt

SEQ ID NO: 763455 - DNA, 25 bp, Mus musculus
taccctggagttgcgaagcgtgagt

SEQ ID NO: 763456 - DNA, 25 bp, Mus musculus
taccctggcctcctaaagtcattta

SEQ ID NO: 763457 - DNA, 25 bp, Mus musculus
taccctggcctcgtaaagtcattta

SEQ ID NO: 763458 - DNA, 25 bp, Mus musculus
taccctggccttcagataacagaga

SEQ ID NO: 763459 - DNA, 25 bp, Mus musculus
taccctggccttgagataacagaga

SEQ ID NO: 763460 - DNA, 25 bp, Mus musculus
taccctggctgacaggcaaaggaaa

SEQ ID NO: 763461 - DNA, 25 bp, Mus musculus
taccctggctgagaggcaaaggaaa

SEQ ID NO: 763462 - DNA, 25 bp, Mus musculus
taccctgggatcacattctgttgct

SEQ ID NO: 763463 - DNA, 25 bp, Mus musculus
taccctgggatctcattctgttgct

SEQ ID NO: 763464 - DNA, 25 bp, Mus musculus
taccctgggcagactcccaagtctg

SEQ ID NO: 763465 - DNA, 25 bp, Mus musculus
taccctgggcagtctcccaagtctg

SEQ ID NO: 763466 - DNA, 25 bp, Mus musculus
taccctgggcatctggcctggctga

SEQ ID NO: 763467 - DNA, 25 bp, Mus musculus
taccctgggcatgtggcctggctga

SEQ ID NO: 763468 - DNA, 25 bp, Mus musculus
taccctgggcctcagggaaatttca

SEQ ID NO: 763469 - DNA, 25 bp, Mus musculus
taccctgggcctgagggaaatttca

SEQ ID NO: 763470 - DNA, 25 bp, Mus musculus
taccctggggacatcaccaacaaca

SEQ ID NO: 763471 - DNA, 25 bp, Mus musculus
taccctggggacttcaccaacaaca

SEQ ID NO: 763472 - DNA, 25 bp, Mus musculus
taccctgggtctaatgtgctttctg

SEQ ID NO: 763473 - DNA, 25 bp, Mus musculus
taccctgggtcttatgtgctttctg

SEQ ID NO: 763474 - DNA, 25 bp, Mus musculus
taccctgggttcacttacttgggag

SEQ ID NO: 763475 - DNA, 25 bp, Mus musculus
taccctgggttctcttacttgggag

SEQ ID NO: 763476 - DNA, 25 bp, Mus musculus
taccctggtgtacgacaggcccact

SEQ ID NO: 763477 - DNA, 25 bp, Mus musculus
taccctggtgtaggacaggcccact

SEQ ID NO: 763478 - DNA, 25 bp, Mus musculus
taccctggtgttaaccaagttaatg

SEQ ID NO: 763479 - DNA, 25 bp, Mus musculus
taccctggtgtttaccaagttaatg

SEQ ID NO: 763480 - DNA, 25 bp, Mus musculus
taccctggttgcattaaaacctctg

SEQ ID NO: 763481 - DNA, 25 bp, Mus musculus
taccctggttgctttaaaacctctg

SEQ ID NO: 763482 - DNA, 25 bp, Mus musculus
taccctgtacacattgacttggtca

SEQ ID NO: 763483 - DNA, 25 bp, Mus musculus
taccctgtacactttgacttggtca

SEQ ID NO: 763484 - DNA, 25 bp, Mus musculus
taccctgtagggactggaagtggca

SEQ ID NO: 763485 - DNA, 25 bp, Mus musculus
taccctgtagggtctggaagtggca

SEQ ID NO: 763486 - DNA, 25 bp, Mus musculus
taccctgtagttcccactgactgga

SEQ ID NO: 763487 - DNA, 25 bp, Mus musculus
taccctgtagttgccactgactgga

SEQ ID NO: 763488 - DNA, 25 bp, Mus musculus
taccctgtatcaatagctgttctcc

SEQ ID NO: 763489 - DNA, 25 bp, Mus musculus
taccctgtatcattagctgttctcc

SEQ ID NO: 763490 - DNA, 25 bp, Mus musculus
taccctgtcccactttcatgggttt

SEQ ID NO: 763491 - DNA, 25 bp, Mus musculus
taccctgtcccagtttcatgggttt

SEQ ID NO: 763492 - DNA, 25 bp, Mus musculus
taccctgtctagagatcgcaaaagc

SEQ ID NO: 763493 - DNA, 25 bp, Mus musculus
taccctgtctagtgatcgcaaaagc

SEQ ID NO: 763494 - DNA, 25 bp, Mus musculus
taccctgtctgcctctacataagca

SEQ ID NO: 763495 - DNA, 25 bp, Mus musculus
taccctgtctgcgtctacataagca

SEQ ID NO: 763496 - DNA, 25 bp, Mus musculus
taccctgtgcagagccagttatgat

SEQ ID NO: 763497 - DNA, 25 bp, Mus musculus
taccctgtgcagtgccagttatgat

SEQ ID NO: 763498 - DNA, 25 bp, Mus musculus
taccctgtggatccctgcccagtta

SEQ ID NO: 763499 - DNA, 25 bp, Mus musculus
taccctgtggatgcctgcccagtta

SEQ ID NO: 763500 - DNA, 25 bp, Mus musculus
taccctgtgtgaagagcgccatctg

SEQ ID NO: 763501 - DNA, 25 bp, Mus musculus
taccctgtgtgaatttgcactgcta

SEQ ID NO: 763502 - DNA, 25 bp, Mus musculus
taccctgtgtgatgagcgccatctg

SEQ ID NO: 763503 - DNA, 25 bp, Mus musculus
taccctgtgtgattttgcactgcta

SEQ ID NO: 763504 - DNA, 25 bp, Mus musculus
taccctgtgtttactcttgggaggc

SEQ ID NO: 763505 - DNA, 25 bp, Mus musculus
taccctgtgttttctcttgggaggc

SEQ ID NO: 763506 - DNA, 25 bp, Mus musculus
taccctgttaaccatagcctctgga

SEQ ID NO: 763507 - DNA, 25 bp, Mus musculus
taccctgttaacgatagcctctgga

SEQ ID NO: 763508 - DNA, 25 bp, Mus musculus
taccctgttgtgacttcctattaga

SEQ ID NO: 763509 - DNA, 25 bp, Mus musculus
taccctgttgtgtcttcctattaga

SEQ ID NO: 763510 - DNA, 25 bp, Mus musculus
tacccttaaatcactgtggctatct

SEQ ID NO: 763511 - DNA, 25 bp, Mus musculus
tacccttaaatctctgtggctatct

SEQ ID NO: 763512 - DNA, 25 bp, Mus musculus
tacccttaccctaaaagaagatgct

SEQ ID NO: 763513 - DNA, 25 bp, Mus musculus
tacccttacccttaaagaagatgct

SEQ ID NO: 763514 - DNA, 25 bp, Mus musculus
tacccttagctaaatactttgcctt

SEQ ID NO: 763515 - DNA, 25 bp, Mus musculus
tacccttagctatatactttgcctt

SEQ ID NO: 763516 - DNA, 25 bp, Mus musculus
tacccttaggtcctgaatacctgag

SEQ ID NO: 763517 - DNA, 25 bp, Mus musculus
tacccttaggtcgtgaatacctgag

SEQ ID NO: 763518 - DNA, 25 bp, Mus musculus
tacccttaggttactgctgctgggt

SEQ ID NO: 763519 - DNA, 25 bp, Mus musculus
tacccttaggtttctgctgctgggt

SEQ ID NO: 763520 - DNA, 25 bp, Mus musculus
tacccttcccatatgtgattacact

SEQ ID NO: 763521 - DNA, 25 bp, Mus musculus
tacccttcccatttgtgattacact

SEQ ID NO: 763522 - DNA, 25 bp, Mus musculus
tacccttccctgcatgccagtattg

SEQ ID NO: 763523 - DNA, 25 bp, Mus musculus
tacccttccctggatgccagtattg

SEQ ID NO: 763524 - DNA, 25 bp, Mus musculus
tacccttcgatgaggtgaagacaca

SEQ ID NO: 763525 - DNA, 25 bp, Mus musculus
tacccttcgatgtggtgaagacaca

SEQ ID NO: 763526 - DNA, 25 bp, Mus musculus
tacccttcggtcaggactcaagttg

SEQ ID NO: 763527 - DNA, 25 bp, Mus musculus
tacccttcggtctggactcaagttg

SEQ ID NO: 763528 - DNA, 25 bp, Mus musculus
tacccttctaccatggttctgctaa

SEQ ID NO: 763529 - DNA, 25 bp, Mus musculus
tacccttctaccttggttctgctaa

SEQ ID NO: 763530 - DNA, 25 bp, Mus musculus
tacccttctcccaattgactgatat

SEQ ID NO: 763531 - DNA, 25 bp, Mus musculus
tacccttctccctattgactgatat

SEQ ID NO: 763532 - DNA, 25 bp, Mus musculus
tacccttctctcagtgatctttgaa

SEQ ID NO: 763533 - DNA, 25 bp, Mus musculus
tacccttctctctgtgatctttgaa

SEQ ID NO: 763534 - DNA, 25 bp, Mus musculus
tacccttctgccaacatgcatagaa

SEQ ID NO: 763535 - DNA, 25 bp, Mus musculus
tacccttctgcctacatgcatagaa

SEQ ID NO: 763536 - DNA, 25 bp, Mus musculus
tacccttcttggctttgggctgtat

SEQ ID NO: 763537 - DNA, 25 bp, Mus musculus
tacccttcttgggtttgggctgtat

SEQ ID NO: 763538 - DNA, 25 bp, Mus musculus
tacccttgcctacaatattgtgatt

SEQ ID NO: 763539 - DNA, 25 bp, Mus musculus
tacccttgcctagaatattgtgatt

SEQ ID NO: 763540 - DNA, 25 bp, Mus musculus
tacccttgcctgctggaagtctgtt

SEQ ID NO: 763541 - DNA, 25 bp, Mus musculus
tacccttgcctggtggaagtctgtt

SEQ ID NO: 763542 - DNA, 25 bp, Mus musculus
tacccttgctttacctgagttcggt

SEQ ID NO: 763543 - DNA, 25 bp, Mus musculus
tacccttgcttttcctgagttcggt

SEQ ID NO: 763544 - DNA, 25 bp, Mus musculus
tacccttggctacgcatttagttca

SEQ ID NO: 763545 - DNA, 25 bp, Mus musculus
tacccttggctaggcatttagttca

SEQ ID NO: 763546 - DNA, 25 bp, Mus musculus
tacccttggctgcacagcagtccag

SEQ ID NO: 763547 - DNA, 25 bp, Mus musculus
tacccttggctggacagcagtccag

SEQ ID NO: 763548 - DNA, 25 bp, Mus musculus
tacccttgtaataaccagactgagc

SEQ ID NO: 763549 - DNA, 25 bp, Mus musculus
tacccttgtaattaccagactgagc

SEQ ID NO: 763550 - DNA, 25 bp, Mus musculus
tacccttgttaaaggtgtgcccgtg

SEQ ID NO: 763551 - DNA, 25 bp, Mus musculus
tacccttgttaatggtgtgcccgtg

SEQ ID NO: 763552 - DNA, 25 bp, Mus musculus
taccctttctccctaagaaacagag

SEQ ID NO: 763553 - DNA, 25 bp, Mus musculus
taccctttctccgtaagaaacagag

SEQ ID NO: 763554 - DNA, 25 bp, Mus musculus
taccctttggcaagcctccaagtgc

SEQ ID NO: 763555 - DNA, 25 bp, Mus musculus
taccctttggcatgcctccaagtgc

SEQ ID NO: 763556 - DNA, 25 bp, Mus musculus
taccctttggcgcaccttttgatgt

SEQ ID NO: 763557 - DNA, 25 bp, Mus musculus
taccctttggcggaccttttgatgt

SEQ ID NO: 763558 - DNA, 25 bp, Mus musculus
tacccttttaaaactagaattgcct

SEQ ID NO: 763559 - DNA, 25 bp, Mus musculus
tacccttttaaatctagaattgcct

SEQ ID NO: 763560 - DNA, 25 bp, Mus musculus
tacccttttctcatgggatcagagg

SEQ ID NO: 763561 - DNA, 25 bp, Mus musculus
tacccttttctcttgggatcagagg

SEQ ID NO: 763562 - DNA, 25 bp, Mus musculus
tacccttttctgaggaattcttaat

SEQ ID NO: 763563 - DNA, 25 bp, Mus musculus
tacccttttctgtggaattcttaat

SEQ ID NO: 763564 - DNA, 25 bp, Mus musculus
taccgaaaacgcacagcatctcgag

SEQ ID NO: 763565 - DNA, 25 bp, Mus musculus
taccgaaaacgctcagcatctcgag

SEQ ID NO: 763566 - DNA, 25 bp, Mus musculus
taccgaaaagtccacttccttcaga

SEQ ID NO: 763567 - DNA, 25 bp, Mus musculus
taccgaaaagtcgacttccttcaga

SEQ ID NO: 763568 - DNA, 25 bp, Mus musculus
taccgaatgaggagccccagtgagg

SEQ ID NO: 763569 - DNA, 25 bp, Mus musculus
taccgaatgaggtgccccagtgagg

SEQ ID NO: 763570 - DNA, 25 bp, Mus musculus
taccgaatgtgtctttagatagccc

SEQ ID NO: 763571 - DNA, 25 bp, Mus musculus
taccgaatgtgtgtttagatagccc

SEQ ID NO: 763572 - DNA, 25 bp, Mus musculus
taccgaattctgcaccctgaaggcc
